United States Patent 7,314,750 (ADDRESSABLE OLIGONUCLEOTIDE ARRAY OF THE RAT GENOME) - sequence listing, part 13

SEQ ID NO: 453579 - DNA, 25 bp, Rattus norvegicus
gggcaatacagagcagtcacatctt

SEQ ID NO: 453580 - DNA, 25 bp, Rattus norvegicus
gggcaatacctaccccgagtggcaa

SEQ ID NO: 453581 - DNA, 25 bp, Rattus norvegicus
gggcaatacctagcccgagtggcaa

SEQ ID NO: 453582 - DNA, 25 bp, Rattus norvegicus
gggcaatagaccatttcatccaaaa

SEQ ID NO: 453583 - DNA, 25 bp, Rattus norvegicus
gggcaatagaccttttcatccaaaa

SEQ ID NO: 453584 - DNA, 25 bp, Rattus norvegicus
gggcaatatgcaataacaggacaca

SEQ ID NO: 453585 - DNA, 25 bp, Rattus norvegicus
gggcaatatgcaatcttccagctgt

SEQ ID NO: 453586 - DNA, 25 bp, Rattus norvegicus
gggcaatatgcattaacaggacaca

SEQ ID NO: 453587 - DNA, 25 bp, Rattus norvegicus
gggcaatatgcattcttccagctgt

SEQ ID NO: 453588 - DNA, 25 bp, Rattus norvegicus
gggcaatattggcacctttgtttta

SEQ ID NO: 453589 - DNA, 25 bp, Rattus norvegicus
gggcaatattgggacctttgtttta

SEQ ID NO: 453590 - DNA, 25 bp, Rattus norvegicus
gggcaatattgtaataccctgtctc

SEQ ID NO: 453591 - DNA, 25 bp, Rattus norvegicus
gggcaatattgttataccctgtctc

SEQ ID NO: 453592 - DNA, 25 bp, Rattus norvegicus
gggcaatcataaagtttccgattca

SEQ ID NO: 453593 - DNA, 25 bp, Rattus norvegicus
gggcaatcataatgtttccgattca

SEQ ID NO: 453594 - DNA, 25 bp, Rattus norvegicus
gggcaatcatttaaccagcttttgt

SEQ ID NO: 453595 - DNA, 25 bp, Rattus norvegicus
gggcaatcattttaccagcttttgt

SEQ ID NO: 453596 - DNA, 25 bp, Rattus norvegicus
gggcaatcccagatctcactgcaga

SEQ ID NO: 453597 - DNA, 25 bp, Rattus norvegicus
gggcaatcccagttctcactgcaga

SEQ ID NO: 453598 - DNA, 25 bp, Rattus norvegicus
gggcaatctgctatttgactggtac

SEQ ID NO: 453599 - DNA, 25 bp, Rattus norvegicus
gggcaatctgctttttgactggtac

SEQ ID NO: 453600 - DNA, 25 bp, Rattus norvegicus
gggcaatcttgcattattcatcctc

SEQ ID NO: 453601 - DNA, 25 bp, Rattus norvegicus
gggcaatcttgctttattcatcctc

SEQ ID NO: 453602 - DNA, 25 bp, Rattus norvegicus
gggcaatgacttcccagagcgctga

SEQ ID NO: 453603 - DNA, 25 bp, Rattus norvegicus
gggcaatgacttgccagagcgctga

SEQ ID NO: 453604 - DNA, 25 bp, Rattus norvegicus
gggcaatgcctaaaataacctgcat

SEQ ID NO: 453605 - DNA, 25 bp, Rattus norvegicus
gggcaatgcctataataacctgcat

SEQ ID NO: 453606 - DNA, 25 bp, Rattus norvegicus
gggcaatgcctgaagtccttcccca

SEQ ID NO: 453607 - DNA, 25 bp, Rattus norvegicus
gggcaatgcctgtagtccttcccca

SEQ ID NO: 453608 - DNA, 25 bp, Rattus norvegicus
gggcaatgctccatcctggactgac

SEQ ID NO: 453609 - DNA, 25 bp, Rattus norvegicus
gggcaatgctccttcctggactgac

SEQ ID NO: 453610 - DNA, 25 bp, Rattus norvegicus
gggcaatggctccttcattgagcac

SEQ ID NO: 453611 - DNA, 25 bp, Rattus norvegicus
gggcaatggctcgttcattgagcac

SEQ ID NO: 453612 - DNA, 25 bp, Rattus norvegicus
gggcaatgggcaacaaaagcctcaa

SEQ ID NO: 453613 - DNA, 25 bp, Rattus norvegicus
gggcaatgggcatcaaaagcctcaa

SEQ ID NO: 453614 - DNA, 25 bp, Rattus norvegicus
gggcaatgtggcatccttgacctgc

SEQ ID NO: 453615 - DNA, 25 bp, Rattus norvegicus
gggcaatgtggcttccttgacctgc

SEQ ID NO: 453616 - DNA, 25 bp, Rattus norvegicus
gggcaatgtttgaaccaaatctgga

SEQ ID NO: 453617 - DNA, 25 bp, Rattus norvegicus
gggcaatgtttgtaccaaatctgga

SEQ ID NO: 453618 - DNA, 25 bp, Rattus norvegicus
gggcaattacttcgctttcctatgt

SEQ ID NO: 453619 - DNA, 25 bp, Rattus norvegicus
gggcaattacttggctttcctatgt

SEQ ID NO: 453620 - DNA, 25 bp, Rattus norvegicus
gggcaattcagaccattaccccgaa

SEQ ID NO: 453621 - DNA, 25 bp, Rattus norvegicus
gggcaattcagagcattaccccgaa

SEQ ID NO: 453622 - DNA, 25 bp, Rattus norvegicus
gggcaattccacagtatttttcatc

SEQ ID NO: 453623 - DNA, 25 bp, Rattus norvegicus
gggcaattccactgtatttttcatc

SEQ ID NO: 453624 - DNA, 25 bp, Rattus norvegicus
gggcaattcccgacatagtgttcat

SEQ ID NO: 453625 - DNA, 25 bp, Rattus norvegicus
gggcaattcccgtcatagtgttcat

SEQ ID NO: 453626 - DNA, 25 bp, Rattus norvegicus
gggcaattctcaccatacagcaaca

SEQ ID NO: 453627 - DNA, 25 bp, Rattus norvegicus
gggcaattctcagcatacagcaaca

SEQ ID NO: 453628 - DNA, 25 bp, Rattus norvegicus
gggcaattctgacatccaaagagat

SEQ ID NO: 453629 - DNA, 25 bp, Rattus norvegicus
gggcaattctgagatccaaagagat

SEQ ID NO: 453630 - DNA, 25 bp, Rattus norvegicus
gggcaattgcttcctgtaccactgc

SEQ ID NO: 453631 - DNA, 25 bp, Rattus norvegicus
gggcaattgcttgctgtaccactgc

SEQ ID NO: 453632 - DNA, 25 bp, Rattus norvegicus
gggcaatttactatttgtacttcag

SEQ ID NO: 453633 - DNA, 25 bp, Rattus norvegicus
gggcaatttactttttgtacttcag

SEQ ID NO: 453634 - DNA, 25 bp, Rattus norvegicus
gggcacaaatcacggaccggacatt

SEQ ID NO: 453635 - DNA, 25 bp, Rattus norvegicus
gggcacaaatcagggaccggacatt

SEQ ID NO: 453636 - DNA, 25 bp, Rattus norvegicus
gggcacaaatgaaacttgaactagg

SEQ ID NO: 453637 - DNA, 25 bp, Rattus norvegicus
gggcacaaatgatacttgaactagg

SEQ ID NO: 453638 - DNA, 25 bp, Rattus norvegicus
gggcacaagagtcggaccctactga

SEQ ID NO: 453639 - DNA, 25 bp, Rattus norvegicus
gggcacaagagtgggaccctactga

SEQ ID NO: 453640 - DNA, 25 bp, Rattus norvegicus
gggcacaaggttcactgaaatactt

SEQ ID NO: 453641 - DNA, 25 bp, Rattus norvegicus
gggcacaaggttgactgaaatactt

SEQ ID NO: 453642 - DNA, 25 bp, Rattus norvegicus
gggcacaagtcaacgaacttttcat

SEQ ID NO: 453643 - DNA, 25 bp, Rattus norvegicus
gggcacaagtcatcgaacttttcat

SEQ ID NO: 453644 - DNA, 25 bp, Rattus norvegicus
gggcacaagtcgaatacgccgtggt

SEQ ID NO: 453645 - DNA, 25 bp, Rattus norvegicus
gggcacaagtcgtatacgccgtggt

SEQ ID NO: 453646 - DNA, 25 bp, Rattus norvegicus
gggcacaatattatctctcatcaac

SEQ ID NO: 453647 - DNA, 25 bp, Rattus norvegicus
gggcacaatattttctctcatcaac

SEQ ID NO: 453648 - DNA, 25 bp, Rattus norvegicus
gggcacaatcttaatcttccaaatc

SEQ ID NO: 453649 - DNA, 25 bp, Rattus norvegicus
gggcacaatctttatcttccaaatc

SEQ ID NO: 453650 - DNA, 25 bp, Rattus norvegicus
gggcacaatgcccttttatattctt

SEQ ID NO: 453651 - DNA, 25 bp, Rattus norvegicus
gggcacaatgccgttttatattctt

SEQ ID NO: 453652 - DNA, 25 bp, Rattus norvegicus
gggcacacacgtaggtggtcaccag

SEQ ID NO: 453653 - DNA, 25 bp, Rattus norvegicus
gggcacacacgttggtggtcaccag

SEQ ID NO: 453654 - DNA, 25 bp, Rattus norvegicus
gggcacacagatcccttggctctga

SEQ ID NO: 453655 - DNA, 25 bp, Rattus norvegicus
gggcacacagatgccttggctctga

SEQ ID NO: 453656 - DNA, 25 bp, Rattus norvegicus
gggcacacagccaaggttaccagtc

SEQ ID NO: 453657 - DNA, 25 bp, Rattus norvegicus
gggcacacagcctaggttaccagtc

SEQ ID NO: 453658 - DNA, 25 bp, Rattus norvegicus
gggcacacagtacgtaatcacacac

SEQ ID NO: 453659 - DNA, 25 bp, Rattus norvegicus
gggcacacagtaggtaatcacacac

SEQ ID NO: 453660 - DNA, 25 bp, Rattus norvegicus
gggcacacagttacaacgcggcttt

SEQ ID NO: 453661 - DNA, 25 bp, Rattus norvegicus
gggcacacagtttcaacgcggcttt

SEQ ID NO: 453662 - DNA, 25 bp, Rattus norvegicus
gggcacacatgtattccctaaagcc

SEQ ID NO: 453663 - DNA, 25 bp, Rattus norvegicus
gggcacacatgttttccctaaagcc

SEQ ID NO: 453664 - DNA, 25 bp, Rattus norvegicus
gggcacaccattcagaattttgtct

SEQ ID NO: 453665 - DNA, 25 bp, Rattus norvegicus
gggcacaccattgagaattttgtct

SEQ ID NO: 453666 - DNA, 25 bp, Rattus norvegicus
gggcacacgcataactcatatttag

SEQ ID NO: 453667 - DNA, 25 bp, Rattus norvegicus
gggcacacgcattactcatatttag

SEQ ID NO: 453668 - DNA, 25 bp, Rattus norvegicus
gggcacacgctgaggtttttgttac

SEQ ID NO: 453669 - DNA, 25 bp, Rattus norvegicus
gggcacacgctgtggtttttgttac

SEQ ID NO: 453670 - DNA, 25 bp, Rattus norvegicus
gggcacacgggcaggactcaccctt

SEQ ID NO: 453671 - DNA, 25 bp, Rattus norvegicus
gggcacacgggctggactcaccctt

SEQ ID NO: 453672 - DNA, 25 bp, Rattus norvegicus
gggcacactcatcgcctacttaaac

SEQ ID NO: 453673 - DNA, 25 bp, Rattus norvegicus
gggcacactcatggcctacttaaac

SEQ ID NO: 453674 - DNA, 25 bp, Rattus norvegicus
gggcacactcggaggcgggagaggc

SEQ ID NO: 453675 - DNA, 25 bp, Rattus norvegicus
gggcacactcggtggcgggagaggc

SEQ ID NO: 453676 - DNA, 25 bp, Rattus norvegicus
gggcacactgccacagaatatgcaa

SEQ ID NO: 453677 - DNA, 25 bp, Rattus norvegicus
gggcacactgcctcagaatatgcaa

SEQ ID NO: 453678 - DNA, 25 bp, Rattus norvegicus
gggcacacttgtatgttcgtagata

SEQ ID NO: 453679 - DNA, 25 bp, Rattus norvegicus
gggcacacttgtttgttcgtagata

SEQ ID NO: 453680 - DNA, 25 bp, Rattus norvegicus
gggcacagaaaaccctgatgatgag

SEQ ID NO: 453681 - DNA, 25 bp, Rattus norvegicus
gggcacagaaaagcctgatgatgag

SEQ ID NO: 453682 - DNA, 25 bp, Rattus norvegicus
gggcacagacccagaagctgtttta

SEQ ID NO: 453683 - DNA, 25 bp, Rattus norvegicus
gggcacagaccctgaagctgtttta

SEQ ID NO: 453684 - DNA, 25 bp, Rattus norvegicus
gggcacagagatactggcttccctc

SEQ ID NO: 453685 - DNA, 25 bp, Rattus norvegicus
gggcacagagattctggcttccctc

SEQ ID NO: 453686 - DNA, 25 bp, Rattus norvegicus
gggcacagagccaactgaatagaat

SEQ ID NO: 453687 - DNA, 25 bp, Rattus norvegicus
gggcacagagccaccaagtagtgct

SEQ ID NO: 453688 - DNA, 25 bp, Rattus norvegicus
gggcacagagcctactgaatagaat

SEQ ID NO: 453689 - DNA, 25 bp, Rattus norvegicus
gggcacagagcctccaagtagtgct

SEQ ID NO: 453690 - DNA, 25 bp, Rattus norvegicus
gggcacagagggatctgctctcctg

SEQ ID NO: 453691 - DNA, 25 bp, Rattus norvegicus
gggcacagagggttctgctctcctg

SEQ ID NO: 453692 - DNA, 25 bp, Rattus norvegicus
gggcacagattcaagaaccagtctt

SEQ ID NO: 453693 - DNA, 25 bp, Rattus norvegicus
gggcacagattctagaaccagtctt

SEQ ID NO: 453694 - DNA, 25 bp, Rattus norvegicus
gggcacagccaaagaccggagcttt

SEQ ID NO: 453695 - DNA, 25 bp, Rattus norvegicus
gggcacagccaatgaccggagcttt

SEQ ID NO: 453696 - DNA, 25 bp, Rattus norvegicus
gggcacagccagaacagaacatttt

SEQ ID NO: 453697 - DNA, 25 bp, Rattus norvegicus
gggcacagccagtacagaacatttt

SEQ ID NO: 453698 - DNA, 25 bp, Rattus norvegicus
gggcacagcctaaggacaacgggat

SEQ ID NO: 453699 - DNA, 25 bp, Rattus norvegicus
gggcacagcctactttggtatgaga

SEQ ID NO: 453700 - DNA, 25 bp, Rattus norvegicus
gggcacagcctagtttggtatgaga

SEQ ID NO: 453701 - DNA, 25 bp, Rattus norvegicus
gggcacagcctatggacaacgggat

SEQ ID NO: 453702 - DNA, 25 bp, Rattus norvegicus
gggcacaggctcaatgcattattct

SEQ ID NO: 453703 - DNA, 25 bp, Rattus norvegicus
gggcacaggctctatgcattattct

SEQ ID NO: 453704 - DNA, 25 bp, Rattus norvegicus
gggcacatacatagtgcacaggcat

SEQ ID NO: 453705 - DNA, 25 bp, Rattus norvegicus
gggcacatacatcaccctgggtaaa

SEQ ID NO: 453706 - DNA, 25 bp, Rattus norvegicus
gggcacatacatgaccctgggtaaa

SEQ ID NO: 453707 - DNA, 25 bp, Rattus norvegicus
gggcacatacattgtgcacaggcat

SEQ ID NO: 453708 - DNA, 25 bp, Rattus norvegicus
gggcacatatgtctcccacagacat

SEQ ID NO: 453709 - DNA, 25 bp, Rattus norvegicus
gggcacatatgtgtcccacagacat

SEQ ID NO: 453710 - DNA, 25 bp, Rattus norvegicus
gggcacatcaacattctcctgaact

SEQ ID NO: 453711 - DNA, 25 bp, Rattus norvegicus
gggcacatcaactttctcctgaact

SEQ ID NO: 453712 - DNA, 25 bp, Rattus norvegicus
gggcacatcattagcatgagccaaa

SEQ ID NO: 453713 - DNA, 25 bp, Rattus norvegicus
gggcacatcatttgcatgagccaaa

SEQ ID NO: 453714 - DNA, 25 bp, Rattus norvegicus
gggcacatccaacgcaaatttcttt

SEQ ID NO: 453715 - DNA, 25 bp, Rattus norvegicus
gggcacatccaaggcaaatttcttt

SEQ ID NO: 453716 - DNA, 25 bp, Rattus norvegicus
gggcacatctctatccttaagaatt

SEQ ID NO: 453717 - DNA, 25 bp, Rattus norvegicus
gggcacatctctttccttaagaatt

SEQ ID NO: 453718 - DNA, 25 bp, Rattus norvegicus
gggcacatctgtaaacatattatac

SEQ ID NO: 453719 - DNA, 25 bp, Rattus norvegicus
gggcacatctgttaacatattatac

SEQ ID NO: 453720 - DNA, 25 bp, Rattus norvegicus
gggcacatgagactctgacctgaga

SEQ ID NO: 453721 - DNA, 25 bp, Rattus norvegicus
gggcacatgagagtctgacctgaga

SEQ ID NO: 453722 - DNA, 25 bp, Rattus norvegicus
gggcacatgggcaccagtccacagg

SEQ ID NO: 453723 - DNA, 25 bp, Rattus norvegicus
gggcacatgggcagggtatttccta

SEQ ID NO: 453724 - DNA, 25 bp, Rattus norvegicus
gggcacatgggctccagtccacagg

SEQ ID NO: 453725 - DNA, 25 bp, Rattus norvegicus
gggcacatgggctgggtatttccta

SEQ ID NO: 453726 - DNA, 25 bp, Rattus norvegicus
gggcacatgtccaggggcaactttc

SEQ ID NO: 453727 - DNA, 25 bp, Rattus norvegicus
gggcacatgtcctggggcaactttc

SEQ ID NO: 453728 - DNA, 25 bp, Rattus norvegicus
gggcacatgttaagctggctctaga

SEQ ID NO: 453729 - DNA, 25 bp, Rattus norvegicus
gggcacatgttatgctggctctaga

SEQ ID NO: 453730 - DNA, 25 bp, Rattus norvegicus
gggcacatgttcacactgtactagg

SEQ ID NO: 453731 - DNA, 25 bp, Rattus norvegicus
gggcacatgttctcactgtactagg

SEQ ID NO: 453732 - DNA, 25 bp, Rattus norvegicus
gggcacattcacatcagaaccatag

SEQ ID NO: 453733 - DNA, 25 bp, Rattus norvegicus
gggcacattcaccagtgactacagc

SEQ ID NO: 453734 - DNA, 25 bp, Rattus norvegicus
gggcacattcacgagtgactacagc

SEQ ID NO: 453735 - DNA, 25 bp, Rattus norvegicus
gggcacattcacttcagaaccatag

SEQ ID NO: 453736 - DNA, 25 bp, Rattus norvegicus
gggcacattcatagcctactgaaca

SEQ ID NO: 453737 - DNA, 25 bp, Rattus norvegicus
gggcacattcattgcctactgaaca

SEQ ID NO: 453738 - DNA, 25 bp, Rattus norvegicus
gggcacattgctaacctatattatt

SEQ ID NO: 453739 - DNA, 25 bp, Rattus norvegicus
gggcacattgcttacctatattatt

SEQ ID NO: 453740 - DNA, 25 bp, Rattus norvegicus
gggcacattgttacttaactgctcc

SEQ ID NO: 453741 - DNA, 25 bp, Rattus norvegicus
gggcacattgtttcttaactgctcc

SEQ ID NO: 453742 - DNA, 25 bp, Rattus norvegicus
gggcaccaaattactgacatcacct

SEQ ID NO: 453743 - DNA, 25 bp, Rattus norvegicus
gggcaccaaatttctgacatcacct

SEQ ID NO: 453744 - DNA, 25 bp, Rattus norvegicus
gggcaccaagtcagacatcttaaat

SEQ ID NO: 453745 - DNA, 25 bp, Rattus norvegicus
gggcaccaagtctgacatcttaaat

SEQ ID NO: 453746 - DNA, 25 bp, Rattus norvegicus
gggcaccacaaacaggcagagacga

SEQ ID NO: 453747 - DNA, 25 bp, Rattus norvegicus
gggcaccacaaagaggcagagacga

SEQ ID NO: 453748 - DNA, 25 bp, Rattus norvegicus
gggcaccacagaacaggtcccacgg

SEQ ID NO: 453749 - DNA, 25 bp, Rattus norvegicus
gggcaccacagatcaggtcccacgg

SEQ ID NO: 453750 - DNA, 25 bp, Rattus norvegicus
gggcaccacagtagcagtcagtttg

SEQ ID NO: 453751 - DNA, 25 bp, Rattus norvegicus
gggcaccacagttgcagtcagtttg

SEQ ID NO: 453752 - DNA, 25 bp, Rattus norvegicus
gggcaccacccaagtattactacag

SEQ ID NO: 453753 - DNA, 25 bp, Rattus norvegicus
gggcaccacccatgtattactacag

SEQ ID NO: 453754 - DNA, 25 bp, Rattus norvegicus
gggcaccactccaagcagttgatga

SEQ ID NO: 453755 - DNA, 25 bp, Rattus norvegicus
gggcaccactcctagcagttgatga

SEQ ID NO: 453756 - DNA, 25 bp, Rattus norvegicus
gggcaccagctccaacagattattg

SEQ ID NO: 453757 - DNA, 25 bp, Rattus norvegicus
gggcaccagctcgaacagattattg

SEQ ID NO: 453758 - DNA, 25 bp, Rattus norvegicus
gggcaccagggacacagcacaaaag

SEQ ID NO: 453759 - DNA, 25 bp, Rattus norvegicus
gggcaccagggagacagcacaaaag

SEQ ID NO: 453760 - DNA, 25 bp, Rattus norvegicus
gggcaccagtaccttgtagaaacat

SEQ ID NO: 453761 - DNA, 25 bp, Rattus norvegicus
gggcaccagtacgttgtagaaacat

SEQ ID NO: 453762 - DNA, 25 bp, Rattus norvegicus
gggcaccatatcaactggcttgtgt

SEQ ID NO: 453763 - DNA, 25 bp, Rattus norvegicus
gggcaccatatctactggcttgtgt

SEQ ID NO: 453764 - DNA, 25 bp, Rattus norvegicus
gggcaccatgccagagggtacgatc

SEQ ID NO: 453765 - DNA, 25 bp, Rattus norvegicus
gggcaccatgcctgagggtacgatc

SEQ ID NO: 453766 - DNA, 25 bp, Rattus norvegicus
gggcaccatttcattggatgtaact

SEQ ID NO: 453767 - DNA, 25 bp, Rattus norvegicus
gggcaccatttctttggatgtaact

SEQ ID NO: 453768 - DNA, 25 bp, Rattus norvegicus
gggcacccagaaccatagctgcttt

SEQ ID NO: 453769 - DNA, 25 bp, Rattus norvegicus
gggcacccagaagcatagctgcttt

SEQ ID NO: 453770 - DNA, 25 bp, Rattus norvegicus
gggcacccagccaagtgtaaccttt

SEQ ID NO: 453771 - DNA, 25 bp, Rattus norvegicus
gggcacccagcctagtgtaaccttt

SEQ ID NO: 453772 - DNA, 25 bp, Rattus norvegicus
gggcacccagtgctagtccagtagt

SEQ ID NO: 453773 - DNA, 25 bp, Rattus norvegicus
gggcacccagtggtagtccagtagt

SEQ ID NO: 453774 - DNA, 25 bp, Rattus norvegicus
gggcacccgattagtgaacgtcctt

SEQ ID NO: 453775 - DNA, 25 bp, Rattus norvegicus
gggcacccgatttgtgaacgtcctt

SEQ ID NO: 453776 - DNA, 25 bp, Rattus norvegicus
gggcacccggagacagtattgacat

SEQ ID NO: 453777 - DNA, 25 bp, Rattus norvegicus
gggcacccggagtcagtattgacat

SEQ ID NO: 453778 - DNA, 25 bp, Rattus norvegicus
gggcacccggtgacacctagctcaa

SEQ ID NO: 453779 - DNA, 25 bp, Rattus norvegicus
gggcacccggtgtcacctagctcaa

SEQ ID NO: 453780 - DNA, 25 bp, Rattus norvegicus
gggcaccctcagatcacgaagcaac

SEQ ID NO: 453781 - DNA, 25 bp, Rattus norvegicus
gggcaccctcagttcacgaagcaac

SEQ ID NO: 453782 - DNA, 25 bp, Rattus norvegicus
gggcaccctgcgaactggaattgag

SEQ ID NO: 453783 - DNA, 25 bp, Rattus norvegicus
gggcaccctgcgtactggaattgag

SEQ ID NO: 453784 - DNA, 25 bp, Rattus norvegicus
gggcacccttctcattcacaaagtg

SEQ ID NO: 453785 - DNA, 25 bp, Rattus norvegicus
gggcacccttctgattcacaaagtg

SEQ ID NO: 453786 - DNA, 25 bp, Rattus norvegicus
gggcaccgagaaatttatccaacac

SEQ ID NO: 453787 - DNA, 25 bp, Rattus norvegicus
gggcaccgagaattttatccaacac

SEQ ID NO: 453788 - DNA, 25 bp, Rattus norvegicus
gggcaccgcatactccgagacctga

SEQ ID NO: 453789 - DNA, 25 bp, Rattus norvegicus
gggcaccgcatagtccgagacctga

SEQ ID NO: 453790 - DNA, 25 bp, Rattus norvegicus
gggcaccgctcaacttgatgaggac

SEQ ID NO: 453791 - DNA, 25 bp, Rattus norvegicus
gggcaccgctcatcttgatgaggac

SEQ ID NO: 453792 - DNA, 25 bp, Rattus norvegicus
gggcaccggctacctcgcagtttgt

SEQ ID NO: 453793 - DNA, 25 bp, Rattus norvegicus
gggcaccggctagctcgcagtttgt

SEQ ID NO: 453794 - DNA, 25 bp, Rattus norvegicus
gggcaccggtttcagttgccaaaca

SEQ ID NO: 453795 - DNA, 25 bp, Rattus norvegicus
gggcaccggtttgagttgccaaaca

SEQ ID NO: 453796 - DNA, 25 bp, Rattus norvegicus
gggcaccgttcccaaagggcaagat

SEQ ID NO: 453797 - DNA, 25 bp, Rattus norvegicus
gggcaccgttccgaaagggcaagat

SEQ ID NO: 453798 - DNA, 25 bp, Rattus norvegicus
gggcacctaccactgtacggagtgc

SEQ ID NO: 453799 - DNA, 25 bp, Rattus norvegicus
gggcacctaccagtgtacggagtgc

SEQ ID NO: 453800 - DNA, 25 bp, Rattus norvegicus
gggcacctactactagagaccagat

SEQ ID NO: 453801 - DNA, 25 bp, Rattus norvegicus
gggcacctactagtagagaccagat

SEQ ID NO: 453802 - DNA, 25 bp, Rattus norvegicus
gggcacctagccaaagaccatttga

SEQ ID NO: 453803 - DNA, 25 bp, Rattus norvegicus
gggcacctagcctaagaccatttga

SEQ ID NO: 453804 - DNA, 25 bp, Rattus norvegicus
gggcacctaggcctgactctgacac

SEQ ID NO: 453805 - DNA, 25 bp, Rattus norvegicus
gggcacctaggcgtgactctgacac

SEQ ID NO: 453806 - DNA, 25 bp, Rattus norvegicus
gggcacctcacaactgagtagggat

SEQ ID NO: 453807 - DNA, 25 bp, Rattus norvegicus
gggcacctcacatctgagtagggat

SEQ ID NO: 453808 - DNA, 25 bp, Rattus norvegicus
gggcacctcgatattcatgtggatt

SEQ ID NO: 453809 - DNA, 25 bp, Rattus norvegicus
gggcacctcgattttcatgtggatt

SEQ ID NO: 453810 - DNA, 25 bp, Rattus norvegicus
gggcacctctgacccacagtggtag

SEQ ID NO: 453811 - DNA, 25 bp, Rattus norvegicus
gggcacctctgagccacagtggtag

SEQ ID NO: 453812 - DNA, 25 bp, Rattus norvegicus
gggcacctgaacactcgtgtacata

SEQ ID NO: 453813 - DNA, 25 bp, Rattus norvegicus
gggcacctgaactctcgtgtacata

SEQ ID NO: 453814 - DNA, 25 bp, Rattus norvegicus
gggcacctgagaagacctgctctga

SEQ ID NO: 453815 - DNA, 25 bp, Rattus norvegicus
gggcacctgagatgacctgctctga

SEQ ID NO: 453816 - DNA, 25 bp, Rattus norvegicus
gggcacctgaggaactacccccatt

SEQ ID NO: 453817 - DNA, 25 bp, Rattus norvegicus
gggcacctgaggtactacccccatt

SEQ ID NO: 453818 - DNA, 25 bp, Rattus norvegicus
gggcaccttcttcgctatggaacag

SEQ ID NO: 453819 - DNA, 25 bp, Rattus norvegicus
gggcaccttcttggctatggaacag

SEQ ID NO: 453820 - DNA, 25 bp, Rattus norvegicus
gggcaccttggcaggtcatttcctg

SEQ ID NO: 453821 - DNA, 25 bp, Rattus norvegicus
gggcaccttggctggtcatttcctg

SEQ ID NO: 453822 - DNA, 25 bp, Rattus norvegicus
gggcacgaaattcaccatctttgat

SEQ ID NO: 453823 - DNA, 25 bp, Rattus norvegicus
gggcacgaaattgaccatctttgat

SEQ ID NO: 453824 - DNA, 25 bp, Rattus norvegicus
gggcacgaccgtctgtaactatggt

SEQ ID NO: 453825 - DNA, 25 bp, Rattus norvegicus
gggcacgaccgtgtgtaactatggt

SEQ ID NO: 453826 - DNA, 25 bp, Rattus norvegicus
gggcacgcacgaagtggtcctcttc

SEQ ID NO: 453827 - DNA, 25 bp, Rattus norvegicus
gggcacgcacgatgtggtcctcttc

SEQ ID NO: 453828 - DNA, 25 bp, Rattus norvegicus
gggcacgcccacatgctgggagcaa

SEQ ID NO: 453829 - DNA, 25 bp, Rattus norvegicus
gggcacgcccacttgctgggagcaa

SEQ ID NO: 453830 - DNA, 25 bp, Rattus norvegicus
gggcacgctattagttctcagagat

SEQ ID NO: 453831 - DNA, 25 bp, Rattus norvegicus
gggcacgctatttgttctcagagat

SEQ ID NO: 453832 - DNA, 25 bp, Rattus norvegicus
gggcacgctgagacgccatgacgac

SEQ ID NO: 453833 - DNA, 25 bp, Rattus norvegicus
gggcacgctgagtcgccatgacgac

SEQ ID NO: 453834 - DNA, 25 bp, Rattus norvegicus
gggcacgcttaaaggccgagctctt

SEQ ID NO: 453835 - DNA, 25 bp, Rattus norvegicus
gggcacgcttaatggccgagctctt

SEQ ID NO: 453836 - DNA, 25 bp, Rattus norvegicus
gggcacggattcaaactgtctttgt

SEQ ID NO: 453837 - DNA, 25 bp, Rattus norvegicus
gggcacggattctaactgtctttgt

SEQ ID NO: 453838 - DNA, 25 bp, Rattus norvegicus
gggcacggcagtacaacaacagcag

SEQ ID NO: 453839 - DNA, 25 bp, Rattus norvegicus
gggcacggcagttcaacaacagcag

SEQ ID NO: 453840 - DNA, 25 bp, Rattus norvegicus
gggcacggccagacaaaggcgcggc

SEQ ID NO: 453841 - DNA, 25 bp, Rattus norvegicus
gggcacggccagtcaaaggcgcggc

SEQ ID NO: 453842 - DNA, 25 bp, Rattus norvegicus
gggcacgtttccaggcatcgggttc

SEQ ID NO: 453843 - DNA, 25 bp, Rattus norvegicus
gggcacgtttcctggcatcgggttc

SEQ ID NO: 453844 - DNA, 25 bp, Rattus norvegicus
gggcactaaacccttagcagcacaa

SEQ ID NO: 453845 - DNA, 25 bp, Rattus norvegicus
gggcactaaaccgttagcagcacaa

SEQ ID NO: 453846 - DNA, 25 bp, Rattus norvegicus
gggcactaaagaccagctcttcatg

SEQ ID NO: 453847 - DNA, 25 bp, Rattus norvegicus
gggcactaaagagcagctcttcatg

SEQ ID NO: 453848 - DNA, 25 bp, Rattus norvegicus
gggcactaataaatctctacctctt

SEQ ID NO: 453849 - DNA, 25 bp, Rattus norvegicus
gggcactaataattctctacctctt

SEQ ID NO: 453850 - DNA, 25 bp, Rattus norvegicus
gggcactacaccactatgggcgtgt

SEQ ID NO: 453851 - DNA, 25 bp, Rattus norvegicus
gggcactacacctctatgggcgtgt

SEQ ID NO: 453852 - DNA, 25 bp, Rattus norvegicus
gggcactactgcctcagtttgatgg

SEQ ID NO: 453853 - DNA, 25 bp, Rattus norvegicus
gggcactactgcgtcagtttgatgg

SEQ ID NO: 453854 - DNA, 25 bp, Rattus norvegicus
gggcactaggaacgccagtcccgaa

SEQ ID NO: 453855 - DNA, 25 bp, Rattus norvegicus
gggcactaggaaggccagtcccgaa

SEQ ID NO: 453856 - DNA, 25 bp, Rattus norvegicus
gggcactaggacagccgagcttcct

SEQ ID NO: 453857 - DNA, 25 bp, Rattus norvegicus
gggcactaggactgccgagcttcct

SEQ ID NO: 453858 - DNA, 25 bp, Rattus norvegicus
gggcactaggtcaactatgatctca

SEQ ID NO: 453859 - DNA, 25 bp, Rattus norvegicus
gggcactaggtctactatgatctca

SEQ ID NO: 453860 - DNA, 25 bp, Rattus norvegicus
gggcactagtagaaacgctctaaat

SEQ ID NO: 453861 - DNA, 25 bp, Rattus norvegicus
gggcactagtagtaacgctctaaat

SEQ ID NO: 453862 - DNA, 25 bp, Rattus norvegicus
gggcactagtcacggcatcacggat

SEQ ID NO: 453863 - DNA, 25 bp, Rattus norvegicus
gggcactagtcagggcatcacggat

SEQ ID NO: 453864 - DNA, 25 bp, Rattus norvegicus
gggcactagtgaccaccagggttat

SEQ ID NO: 453865 - DNA, 25 bp, Rattus norvegicus
gggcactagtgagcaccagggttat

SEQ ID NO: 453866 - DNA, 25 bp, Rattus norvegicus
gggcactatgtaacccactaataaa

SEQ ID NO: 453867 - DNA, 25 bp, Rattus norvegicus
gggcactatgtatcccactaataaa

SEQ ID NO: 453868 - DNA, 25 bp, Rattus norvegicus
gggcactcaagcatcccatgggtga

SEQ ID NO: 453869 - DNA, 25 bp, Rattus norvegicus
gggcactcaagcttcccatgggtga

SEQ ID NO: 453870 - DNA, 25 bp, Rattus norvegicus
gggcactcaccaccatatgtgtgat

SEQ ID NO: 453871 - DNA, 25 bp, Rattus norvegicus
gggcactcaccagcatatgtgtgat

SEQ ID NO: 453872 - DNA, 25 bp, Rattus norvegicus
gggcactcagcaacctttctaataa

SEQ ID NO: 453873 - DNA, 25 bp, Rattus norvegicus
gggcactcagcatcctttctaataa

SEQ ID NO: 453874 - DNA, 25 bp, Rattus norvegicus
gggcactcagccacagggatgaact

SEQ ID NO: 453875 - DNA, 25 bp, Rattus norvegicus
gggcactcagcctcagggatgaact

SEQ ID NO: 453876 - DNA, 25 bp, Rattus norvegicus
gggcactcagctaagccaggtggaa

SEQ ID NO: 453877 - DNA, 25 bp, Rattus norvegicus
gggcactcagcttagccaggtggaa

SEQ ID NO: 453878 - DNA, 25 bp, Rattus norvegicus
gggcactcagtgattcattcacttt

SEQ ID NO: 453879 - DNA, 25 bp, Rattus norvegicus
gggcactcagtgtttcattcacttt

SEQ ID NO: 453880 - DNA, 25 bp, Rattus norvegicus
gggcactccaaaacagggcttattt

SEQ ID NO: 453881 - DNA, 25 bp, Rattus norvegicus
gggcactccaaatcagggcttattt

SEQ ID NO: 453882 - DNA, 25 bp, Rattus norvegicus
gggcactcccgaacagatttctcct

SEQ ID NO: 453883 - DNA, 25 bp, Rattus norvegicus
gggcactcccgatcagatttctcct

SEQ ID NO: 453884 - DNA, 25 bp, Rattus norvegicus
gggcactcggtgacattgagcgcca

SEQ ID NO: 453885 - DNA, 25 bp, Rattus norvegicus
gggcactcggtgtcattgagcgcca

SEQ ID NO: 453886 - DNA, 25 bp, Rattus norvegicus
gggcactctcaacggagcagcaaca

SEQ ID NO: 453887 - DNA, 25 bp, Rattus norvegicus
gggcactctcaagggagcagcaaca

SEQ ID NO: 453888 - DNA, 25 bp, Rattus norvegicus
gggcactctcacagagacctggcag

SEQ ID NO: 453889 - DNA, 25 bp, Rattus norvegicus
gggcactctcactgagacctggcag

SEQ ID NO: 453890 - DNA, 25 bp, Rattus norvegicus
gggcactgaaagatgaccctggagt

SEQ ID NO: 453891 - DNA, 25 bp, Rattus norvegicus
gggcactgaaagttgaccctggagt

SEQ ID NO: 453892 - DNA, 25 bp, Rattus norvegicus
gggcactgaacacagctctgggaat

SEQ ID NO: 453893 - DNA, 25 bp, Rattus norvegicus
gggcactgaacagagctctgggaat

SEQ ID NO: 453894 - DNA, 25 bp, Rattus norvegicus
gggcactgaacgaactccgtacaga

SEQ ID NO: 453895 - DNA, 25 bp, Rattus norvegicus
gggcactgaacgtactccgtacaga

SEQ ID NO: 453896 - DNA, 25 bp, Rattus norvegicus
gggcactgaactcactgacatgagc

SEQ ID NO: 453897 - DNA, 25 bp, Rattus norvegicus
gggcactgaactgactgacatgagc

SEQ ID NO: 453898 - DNA, 25 bp, Rattus norvegicus
gggcactgacccaatggcgaagagc

SEQ ID NO: 453899 - DNA, 25 bp, Rattus norvegicus
gggcactgaccctatggcgaagagc

SEQ ID NO: 453900 - DNA, 25 bp, Rattus norvegicus
gggcactgagtaactaatctacaca

SEQ ID NO: 453901 - DNA, 25 bp, Rattus norvegicus
gggcactgagtatctaatctacaca

SEQ ID NO: 453902 - DNA, 25 bp, Rattus norvegicus
gggcactgagtcaccaaatggttgg

SEQ ID NO: 453903 - DNA, 25 bp, Rattus norvegicus
gggcactgagtctccaaatggttgg

SEQ ID NO: 453904 - DNA, 25 bp, Rattus norvegicus
gggcactgagttagcatgacgttga

SEQ ID NO: 453905 - DNA, 25 bp, Rattus norvegicus
gggcactgagtttgcatgacgttga

SEQ ID NO: 453906 - DNA, 25 bp, Rattus norvegicus
gggcactgcaacagaaacctttaac

SEQ ID NO: 453907 - DNA, 25 bp, Rattus norvegicus
gggcactgcaactgaaacctttaac

SEQ ID NO: 453908 - DNA, 25 bp, Rattus norvegicus
gggcactgcatcagcctaagtgagg

SEQ ID NO: 453909 - DNA, 25 bp, Rattus norvegicus
gggcactgcatctgcctaagtgagg

SEQ ID NO: 453910 - DNA, 25 bp, Rattus norvegicus
gggcactgcctactgtttatactgc

SEQ ID NO: 453911 - DNA, 25 bp, Rattus norvegicus
gggcactgcctagtgtttatactgc

SEQ ID NO: 453912 - DNA, 25 bp, Rattus norvegicus
gggcactgctctataatgcgcaaat

SEQ ID NO: 453913 - DNA, 25 bp, Rattus norvegicus
gggcactgctctttaatgcgcaaat

SEQ ID NO: 453914 - DNA, 25 bp, Rattus norvegicus
gggcactgctgacctatcaagtcaa

SEQ ID NO: 453915 - DNA, 25 bp, Rattus norvegicus
gggcactgctgagctatcaagtcaa

SEQ ID NO: 453916 - DNA, 25 bp, Rattus norvegicus
gggcactgctttccaaggtgacaaa

SEQ ID NO: 453917 - DNA, 25 bp, Rattus norvegicus
gggcactgctttgcaaggtgacaaa

SEQ ID NO: 453918 - DNA, 25 bp, Rattus norvegicus
gggcactggacaagaacactccctt

SEQ ID NO: 453919 - DNA, 25 bp, Rattus norvegicus
gggcactggacatgaacactccctt

SEQ ID NO: 453920 - DNA, 25 bp, Rattus norvegicus
gggcactggcacaatagtctctggg

SEQ ID NO: 453921 - DNA, 25 bp, Rattus norvegicus
gggcactggcactatagtctctggg

SEQ ID NO: 453922 - DNA, 25 bp, Rattus norvegicus
gggcactgggctctcagatgtccaa

SEQ ID NO: 453923 - DNA, 25 bp, Rattus norvegicus
gggcactgggctgtcagatgtccaa

SEQ ID NO: 453924 - DNA, 25 bp, Rattus norvegicus
gggcactgtattcatgtcttttgtc

SEQ ID NO: 453925 - DNA, 25 bp, Rattus norvegicus
gggcactgtattgatgtcttttgtc

SEQ ID NO: 453926 - DNA, 25 bp, Rattus norvegicus
gggcactgtgctacaattgcaacga

SEQ ID NO: 453927 - DNA, 25 bp, Rattus norvegicus
gggcactgtgcttcaattgcaacga

SEQ ID NO: 453928 - DNA, 25 bp, Rattus norvegicus
gggcactgtggaaataccattccaa

SEQ ID NO: 453929 - DNA, 25 bp, Rattus norvegicus
gggcactgtggatataccattccaa

SEQ ID NO: 453930 - DNA, 25 bp, Rattus norvegicus
gggcactgtttgactgctgtaagtg

SEQ ID NO: 453931 - DNA, 25 bp, Rattus norvegicus
gggcactgtttgtctgctgtaagtg

SEQ ID NO: 453932 - DNA, 25 bp, Rattus norvegicus
gggcacttaaaacctcatcctggga

SEQ ID NO: 453933 - DNA, 25 bp, Rattus norvegicus
gggcacttaaaagctcatcctggga

SEQ ID NO: 453934 - DNA, 25 bp, Rattus norvegicus
gggcacttaacaatgtcttatggtc

SEQ ID NO: 453935 - DNA, 25 bp, Rattus norvegicus
gggcacttaacattgtcttatggtc

SEQ ID NO: 453936 - DNA, 25 bp, Rattus norvegicus
gggcacttaggtactgtgtgtcctt

SEQ ID NO: 453937 - DNA, 25 bp, Rattus norvegicus
gggcacttaggtattttcactggct

SEQ ID NO: 453938 - DNA, 25 bp, Rattus norvegicus
gggcacttaggttctgtgtgtcctt

SEQ ID NO: 453939 - DNA, 25 bp, Rattus norvegicus
gggcacttaggttttttcactggct

SEQ ID NO: 453940 - DNA, 25 bp, Rattus norvegicus
gggcacttccctcattaatgactga

SEQ ID NO: 453941 - DNA, 25 bp, Rattus norvegicus
gggcacttccctgattaatgactga

SEQ ID NO: 453942 - DNA, 25 bp, Rattus norvegicus
gggcacttcgaactgcctgcagacg

SEQ ID NO: 453943 - DNA, 25 bp, Rattus norvegicus
gggcacttcgaagtgcctgcagacg

SEQ ID NO: 453944 - DNA, 25 bp, Rattus norvegicus
gggcacttcgggatgctcttcactt

SEQ ID NO: 453945 - DNA, 25 bp, Rattus norvegicus
gggcacttcgggttgctcttcactt

SEQ ID NO: 453946 - DNA, 25 bp, Rattus norvegicus
gggcacttctgaatcccaggactgg

SEQ ID NO: 453947 - DNA, 25 bp, Rattus norvegicus
gggcacttctgattcccaggactgg

SEQ ID NO: 453948 - DNA, 25 bp, Rattus norvegicus
gggcacttgcagatatgagcacata

SEQ ID NO: 453949 - DNA, 25 bp, Rattus norvegicus
gggcacttgcagttatgagcacata

SEQ ID NO: 453950 - DNA, 25 bp, Rattus norvegicus
gggcacttgctgaacccttagtctg

SEQ ID NO: 453951 - DNA, 25 bp, Rattus norvegicus
gggcacttgctgtacccttagtctg

SEQ ID NO: 453952 - DNA, 25 bp, Rattus norvegicus
gggcacttgggacttgcacctgaat

SEQ ID NO: 453953 - DNA, 25 bp, Rattus norvegicus
gggcacttgggagttgcacctgaat

SEQ ID NO: 453954 - DNA, 25 bp, Rattus norvegicus
gggcactttaccagagtacgtcctc

SEQ ID NO: 453955 - DNA, 25 bp, Rattus norvegicus
gggcactttacctgagtacgtcctc

SEQ ID NO: 453956 - DNA, 25 bp, Rattus norvegicus
gggcactttatcaattatcaccatg

SEQ ID NO: 453957 - DNA, 25 bp, Rattus norvegicus
gggcactttatctattatcaccatg

SEQ ID NO: 453958 - DNA, 25 bp, Rattus norvegicus
gggcactttctactacttatggcag

SEQ ID NO: 453959 - DNA, 25 bp, Rattus norvegicus
gggcactttctagtacttatggcag

SEQ ID NO: 453960 - DNA, 25 bp, Rattus norvegicus
gggcacttttctaattaactattga

SEQ ID NO: 453961 - DNA, 25 bp, Rattus norvegicus
gggcacttttcttattaactattga

SEQ ID NO: 453962 - DNA, 25 bp, Rattus norvegicus
gggcacttttgaaaactttgagaaa

SEQ ID NO: 453963 - DNA, 25 bp, Rattus norvegicus
gggcacttttgataactttgagaaa

SEQ ID NO: 453964 - DNA, 25 bp, Rattus norvegicus
gggcagaaacggatcacattccatt

SEQ ID NO: 453965 - DNA, 25 bp, Rattus norvegicus
gggcagaaacggttcacattccatt

SEQ ID NO: 453966 - DNA, 25 bp, Rattus norvegicus
gggcagaaagacacctatgtaggtg

SEQ ID NO: 453967 - DNA, 25 bp, Rattus norvegicus
gggcagaaagactcctatgtaggtg

SEQ ID NO: 453968 - DNA, 25 bp, Rattus norvegicus
gggcagaaaggcagcagcatcgtct

SEQ ID NO: 453969 - DNA, 25 bp, Rattus norvegicus
gggcagaaaggctgcagcatcgtct

SEQ ID NO: 453970 - DNA, 25 bp, Rattus norvegicus
gggcagaaataaatctctattcctt

SEQ ID NO: 453971 - DNA, 25 bp, Rattus norvegicus
gggcagaaataacgcctgtcccact

SEQ ID NO: 453972 - DNA, 25 bp, Rattus norvegicus
gggcagaaataaggcctgtcccact

SEQ ID NO: 453973 - DNA, 25 bp, Rattus norvegicus
gggcagaaataattctctattcctt

SEQ ID NO: 453974 - DNA, 25 bp, Rattus norvegicus
gggcagaaatccagactaaaaagta

SEQ ID NO: 453975 - DNA, 25 bp, Rattus norvegicus
gggcagaaatcctgactaaaaagta

SEQ ID NO: 453976 - DNA, 25 bp, Rattus norvegicus
gggcagaactttacttcctgtgtct

SEQ ID NO: 453977 - DNA, 25 bp, Rattus norvegicus
gggcagaacttttcttcctgtgtct

SEQ ID NO: 453978 - DNA, 25 bp, Rattus norvegicus
gggcagaaggcccataaaggaaaat

SEQ ID NO: 453979 - DNA, 25 bp, Rattus norvegicus
gggcagaaggccgataaaggaaaat

SEQ ID NO: 453980 - DNA, 25 bp, Rattus norvegicus
gggcagaatccccaattatcttttt

SEQ ID NO: 453981 - DNA, 25 bp, Rattus norvegicus
gggcagaatcccgaattatcttttt

SEQ ID NO: 453982 - DNA, 25 bp, Rattus norvegicus
gggcagaatggcacttaatctctga

SEQ ID NO: 453983 - DNA, 25 bp, Rattus norvegicus
gggcagaatggctcttaatctctga

SEQ ID NO: 453984 - DNA, 25 bp, Rattus norvegicus
gggcagacacaaacagattcctttg

SEQ ID NO: 453985 - DNA, 25 bp, Rattus norvegicus
gggcagacacaacactgggttccac

SEQ ID NO: 453986 - DNA, 25 bp, Rattus norvegicus
gggcagacacaagactgggttccac

SEQ ID NO: 453987 - DNA, 25 bp, Rattus norvegicus
gggcagacacaatcagattcctttg

SEQ ID NO: 453988 - DNA, 25 bp, Rattus norvegicus
gggcagacactgagaaatacttttt

SEQ ID NO: 453989 - DNA, 25 bp, Rattus norvegicus
gggcagacactgtgaaatacttttt

SEQ ID NO: 453990 - DNA, 25 bp, Rattus norvegicus
gggcagacattcaacgacctcatgg

SEQ ID NO: 453991 - DNA, 25 bp, Rattus norvegicus
gggcagacattctacgacctcatgg

SEQ ID NO: 453992 - DNA, 25 bp, Rattus norvegicus
gggcagaccaatacctcactaggga

SEQ ID NO: 453993 - DNA, 25 bp, Rattus norvegicus
gggcagaccaattcctcactaggga

SEQ ID NO: 453994 - DNA, 25 bp, Rattus norvegicus
gggcagaccatcatatatcagtcac

SEQ ID NO: 453995 - DNA, 25 bp, Rattus norvegicus
gggcagaccatcttatatcagtcac

SEQ ID NO: 453996 - DNA, 25 bp, Rattus norvegicus
gggcagaccgatagaatcattggta

SEQ ID NO: 453997 - DNA, 25 bp, Rattus norvegicus
gggcagaccgattgaatcattggta

SEQ ID NO: 453998 - DNA, 25 bp, Rattus norvegicus
gggcagacctaaaagcttatcttaa

SEQ ID NO: 453999 - DNA, 25 bp, Rattus norvegicus
gggcagacctaatagcttatcttaa

SEQ ID NO: 454000 - DNA, 25 bp, Rattus norvegicus
gggcagactaccaaagctcagaacc

SEQ ID NO: 454001 - DNA, 25 bp, Rattus norvegicus
gggcagactacctaagctcagaacc

SEQ ID NO: 454002 - DNA, 25 bp, Rattus norvegicus
gggcagactatgactggttcttcat

SEQ ID NO: 454003 - DNA, 25 bp, Rattus norvegicus
gggcagactatgtctggttcttcat

SEQ ID NO: 454004 - DNA, 25 bp, Rattus norvegicus
gggcagactcagcaaacttttcata

SEQ ID NO: 454005 - DNA, 25 bp, Rattus norvegicus
gggcagactcaggaaacttttcata

SEQ ID NO: 454006 - DNA, 25 bp, Rattus norvegicus
gggcagactcataacagactctgag

SEQ ID NO: 454007 - DNA, 25 bp, Rattus norvegicus
gggcagactcattacagactctgag

SEQ ID NO: 454008 - DNA, 25 bp, Rattus norvegicus
gggcagactcccatacagagagaca

SEQ ID NO: 454009 - DNA, 25 bp, Rattus norvegicus
gggcagactcccttacagagagaca

SEQ ID NO: 454010 - DNA, 25 bp, Rattus norvegicus
gggcagactctcaaactctgaggca

SEQ ID NO: 454011 - DNA, 25 bp, Rattus norvegicus
gggcagactctctaactctgaggca

SEQ ID NO: 454012 - DNA, 25 bp, Rattus norvegicus
gggcagactgcacaccacacaaaag

SEQ ID NO: 454013 - DNA, 25 bp, Rattus norvegicus
gggcagactgcagaccacacaaaag

SEQ ID NO: 454014 - DNA, 25 bp, Rattus norvegicus
gggcagactgctcttaattcaacat

SEQ ID NO: 454015 - DNA, 25 bp, Rattus norvegicus
gggcagactgctgttaattcaacat

SEQ ID NO: 454016 - DNA, 25 bp, Rattus norvegicus
gggcagagaccaagcttgactttgt

SEQ ID NO: 454017 - DNA, 25 bp, Rattus norvegicus
gggcagagaccatgcttgactttgt

SEQ ID NO: 454018 - DNA, 25 bp, Rattus norvegicus
gggcagagactcatgaattaaggca

SEQ ID NO: 454019 - DNA, 25 bp, Rattus norvegicus
gggcagagactcttgaattaaggca

SEQ ID NO: 454020 - DNA, 25 bp, Rattus norvegicus
gggcagagagcactcagaatgcata

SEQ ID NO: 454021 - DNA, 25 bp, Rattus norvegicus
gggcagagagcagtcagaatgcata

SEQ ID NO: 454022 - DNA, 25 bp, Rattus norvegicus
gggcagagcaagaagcaggaaaaaa

SEQ ID NO: 454023 - DNA, 25 bp, Rattus norvegicus
gggcagagcaagtagcaggaaaaaa

SEQ ID NO: 454024 - DNA, 25 bp, Rattus norvegicus
gggcagagcattcgctgcaagccct

SEQ ID NO: 454025 - DNA, 25 bp, Rattus norvegicus
gggcagagcattggctgcaagccct

SEQ ID NO: 454026 - DNA, 25 bp, Rattus norvegicus
gggcagagccagaattccggtccgt

SEQ ID NO: 454027 - DNA, 25 bp, Rattus norvegicus
gggcagagccagtattccggtccgt

SEQ ID NO: 454028 - DNA, 25 bp, Rattus norvegicus
gggcagagctagatcagtactccaa

SEQ ID NO: 454029 - DNA, 25 bp, Rattus norvegicus
gggcagagctagatccgaattcttt

SEQ ID NO: 454030 - DNA, 25 bp, Rattus norvegicus
gggcagagctagcagacctttacta

SEQ ID NO: 454031 - DNA, 25 bp, Rattus norvegicus
gggcagagctaggagacctttacta

SEQ ID NO: 454032 - DNA, 25 bp, Rattus norvegicus
gggcagagctagttcagtactccaa

SEQ ID NO: 454033 - DNA, 25 bp, Rattus norvegicus
gggcagagctagttccgaattcttt

SEQ ID NO: 454034 - DNA, 25 bp, Rattus norvegicus
gggcagagctgacacaggcacctct

SEQ ID NO: 454035 - DNA, 25 bp, Rattus norvegicus
gggcagagctgagacaggcacctct

SEQ ID NO: 454036 - DNA, 25 bp, Rattus norvegicus
gggcagagcttcaacatcaacttca

SEQ ID NO: 454037 - DNA, 25 bp, Rattus norvegicus
gggcagagcttctacatcaacttca

SEQ ID NO: 454038 - DNA, 25 bp, Rattus norvegicus
gggcagagtctgacttatctataac

SEQ ID NO: 454039 - DNA, 25 bp, Rattus norvegicus
gggcagagtctgtcttatctataac

SEQ ID NO: 454040 - DNA, 25 bp, Rattus norvegicus
gggcagagttagctcacagaagact

SEQ ID NO: 454041 - DNA, 25 bp, Rattus norvegicus
gggcagagttaggtcacagaagact

SEQ ID NO: 454042 - DNA, 25 bp, Rattus norvegicus
gggcagagttcaaagcttccttgta

SEQ ID NO: 454043 - DNA, 25 bp, Rattus norvegicus
gggcagagttcatagcttccttgta

SEQ ID NO: 454044 - DNA, 25 bp, Rattus norvegicus
gggcagataagacctccttgtgctt

SEQ ID NO: 454045 - DNA, 25 bp, Rattus norvegicus
gggcagataagagctccttgtgctt

SEQ ID NO: 454046 - DNA, 25 bp, Rattus norvegicus
gggcagatactgatccagatctttg

SEQ ID NO: 454047 - DNA, 25 bp, Rattus norvegicus
gggcagatactgttccagatctttg

SEQ ID NO: 454048 - DNA, 25 bp, Rattus norvegicus
gggcagatcactcagaatttgcatg

SEQ ID NO: 454049 - DNA, 25 bp, Rattus norvegicus
gggcagatcactgagaatttgcatg

SEQ ID NO: 454050 - DNA, 25 bp, Rattus norvegicus
gggcagatccatcacttgaactatc

SEQ ID NO: 454051 - DNA, 25 bp, Rattus norvegicus
gggcagatccatgacttgaactatc

SEQ ID NO: 454052 - DNA, 25 bp, Rattus norvegicus
gggcagatcttcaggaacttgcatc

SEQ ID NO: 454053 - DNA, 25 bp, Rattus norvegicus
gggcagatcttctggaacttgcatc

SEQ ID NO: 454054 - DNA, 25 bp, Rattus norvegicus
gggcagatgagcagctttctcctgt

SEQ ID NO: 454055 - DNA, 25 bp, Rattus norvegicus
gggcagatgagctgctttctcctgt

SEQ ID NO: 454056 - DNA, 25 bp, Rattus norvegicus
gggcagatgatcctattccatttga

SEQ ID NO: 454057 - DNA, 25 bp, Rattus norvegicus
gggcagatgatcgtattccatttga

SEQ ID NO: 454058 - DNA, 25 bp, Rattus norvegicus
gggcagatgccacctaaaacttcct

SEQ ID NO: 454059 - DNA, 25 bp, Rattus norvegicus
gggcagatgccagctaaaacttcct

SEQ ID NO: 454060 - DNA, 25 bp, Rattus norvegicus
gggcagatgcttcataacaccagac

SEQ ID NO: 454061 - DNA, 25 bp, Rattus norvegicus
gggcagatgcttgataacaccagac

SEQ ID NO: 454062 - DNA, 25 bp, Rattus norvegicus
gggcagatgttcagtgcacttacta

SEQ ID NO: 454063 - DNA, 25 bp, Rattus norvegicus
gggcagatgttctgtgcacttacta

SEQ ID NO: 454064 - DNA, 25 bp, Rattus norvegicus
gggcagattattcatttccttaagc

SEQ ID NO: 454065 - DNA, 25 bp, Rattus norvegicus
gggcagattattgatttccttaagc

SEQ ID NO: 454066 - DNA, 25 bp, Rattus norvegicus
gggcagattccaatgatcaaagaat

SEQ ID NO: 454067 - DNA, 25 bp, Rattus norvegicus
gggcagattccattgatcaaagaat

SEQ ID NO: 454068 - DNA, 25 bp, Rattus norvegicus
gggcagattcttatgtaccatagat

SEQ ID NO: 454069 - DNA, 25 bp, Rattus norvegicus
gggcagattcttttgtaccatagat

SEQ ID NO: 454070 - DNA, 25 bp, Rattus norvegicus
gggcagattgaaccagcatacgctc

SEQ ID NO: 454071 - DNA, 25 bp, Rattus norvegicus
gggcagattgaagcagcatacgctc

SEQ ID NO: 454072 - DNA, 25 bp, Rattus norvegicus
gggcagattgagaatgtcccctcca

SEQ ID NO: 454073 - DNA, 25 bp, Rattus norvegicus
gggcagattgagtatgtcccctcca

SEQ ID NO: 454074 - DNA, 25 bp, Rattus norvegicus
gggcagattggacagctcattctta

SEQ ID NO: 454075 - DNA, 25 bp, Rattus norvegicus
gggcagattggagagctcattctta

SEQ ID NO: 454076 - DNA, 25 bp, Rattus norvegicus
gggcagattggcagagcacatgaat

SEQ ID NO: 454077 - DNA, 25 bp, Rattus norvegicus
gggcagattggcattagcagtgtta

SEQ ID NO: 454078 - DNA, 25 bp, Rattus norvegicus
gggcagattggctgagcacatgaat

SEQ ID NO: 454079 - DNA, 25 bp, Rattus norvegicus
gggcagattggctttagcagtgtta

SEQ ID NO: 454080 - DNA, 25 bp, Rattus norvegicus
gggcagatttcaccggaggacatca

SEQ ID NO: 454081 - DNA, 25 bp, Rattus norvegicus
gggcagatttcagcggaggacatca

SEQ ID NO: 454082 - DNA, 25 bp, Rattus norvegicus
gggcagcaaactactctgtttacaa

SEQ ID NO: 454083 - DNA, 25 bp, Rattus norvegicus
gggcagcaaactccctcaggaggct

SEQ ID NO: 454084 - DNA, 25 bp, Rattus norvegicus
gggcagcaaactgcctcaggaggct

SEQ ID NO: 454085 - DNA, 25 bp, Rattus norvegicus
gggcagcaaacttctctgtttacaa

SEQ ID NO: 454086 - DNA, 25 bp, Rattus norvegicus
gggcagcaagccacagaagatctct

SEQ ID NO: 454087 - DNA, 25 bp, Rattus norvegicus
gggcagcaagcctcagaagatctct

SEQ ID NO: 454088 - DNA, 25 bp, Rattus norvegicus
gggcagcacaacacagaaaaagtga

SEQ ID NO: 454089 - DNA, 25 bp, Rattus norvegicus
gggcagcacaactcagaaaaagtga

SEQ ID NO: 454090 - DNA, 25 bp, Rattus norvegicus
gggcagcacccaatgcttgttcatc

SEQ ID NO: 454091 - DNA, 25 bp, Rattus norvegicus
gggcagcacccacatcagagcaagg

SEQ ID NO: 454092 - DNA, 25 bp, Rattus norvegicus
gggcagcacccagatcagagcaagg

SEQ ID NO: 454093 - DNA, 25 bp, Rattus norvegicus
gggcagcacccattgcttgttcatc

SEQ ID NO: 454094 - DNA, 25 bp, Rattus norvegicus
gggcagcaccttaaacaaggctgag

SEQ ID NO: 454095 - DNA, 25 bp, Rattus norvegicus
gggcagcacctttaacaaggctgag

SEQ ID NO: 454096 - DNA, 25 bp, Rattus norvegicus
gggcagcactgtctagtgaactgtt

SEQ ID NO: 454097 - DNA, 25 bp, Rattus norvegicus
gggcagcactgtgtagtgaactgtt

SEQ ID NO: 454098 - DNA, 25 bp, Rattus norvegicus
gggcagcacttgattagtacacttt

SEQ ID NO: 454099 - DNA, 25 bp, Rattus norvegicus
gggcagcacttgtttagtacacttt

SEQ ID NO: 454100 - DNA, 25 bp, Rattus norvegicus
gggcagcagactaccaaacctagaa

SEQ ID NO: 454101 - DNA, 25 bp, Rattus norvegicus
gggcagcagacttccaaacctagaa

SEQ ID NO: 454102 - DNA, 25 bp, Rattus norvegicus
gggcagcagcatatatgggacaatc

SEQ ID NO: 454103 - DNA, 25 bp, Rattus norvegicus
gggcagcagcatttatgggacaatc

SEQ ID NO: 454104 - DNA, 25 bp, Rattus norvegicus
gggcagcagccaaagtccctttctg

SEQ ID NO: 454105 - DNA, 25 bp, Rattus norvegicus
gggcagcagccatagtccctttctg

SEQ ID NO: 454106 - DNA, 25 bp, Rattus norvegicus
gggcagcagcggcaggagtctgagt

SEQ ID NO: 454107 - DNA, 25 bp, Rattus norvegicus
gggcagcagcgggaggagtctgagt

SEQ ID NO: 454108 - DNA, 25 bp, Rattus norvegicus
gggcagcaggatatcttcagtgatt

SEQ ID NO: 454109 - DNA, 25 bp, Rattus norvegicus
gggcagcaggatttcttcagtgatt

SEQ ID NO: 454110 - DNA, 25 bp, Rattus norvegicus
gggcagcaggttagagcattctcca

SEQ ID NO: 454111 - DNA, 25 bp, Rattus norvegicus
gggcagcaggtttgagcattctcca

SEQ ID NO: 454112 - DNA, 25 bp, Rattus norvegicus
gggcagcagtccaggtccgcaaagc

SEQ ID NO: 454113 - DNA, 25 bp, Rattus norvegicus
gggcagcagtcctggtccgcaaagc

SEQ ID NO: 454114 - DNA, 25 bp, Rattus norvegicus
gggcagcatcacacctgacggattg

SEQ ID NO: 454115 - DNA, 25 bp, Rattus norvegicus
gggcagcatcactcctgacggattg

SEQ ID NO: 454116 - DNA, 25 bp, Rattus norvegicus
gggcagcatctgaacaaggagtcca

SEQ ID NO: 454117 - DNA, 25 bp, Rattus norvegicus
gggcagcatctgagcggcagaactc

SEQ ID NO: 454118 - DNA, 25 bp, Rattus norvegicus
gggcagcatctgtacaaggagtcca

SEQ ID NO: 454119 - DNA, 25 bp, Rattus norvegicus
gggcagcatctgtgcggcagaactc

SEQ ID NO: 454120 - DNA, 25 bp, Rattus norvegicus
gggcagcatgcacagggaaccaaat

SEQ ID NO: 454121 - DNA, 25 bp, Rattus norvegicus
gggcagcatgcagagggaaccaaat

SEQ ID NO: 454122 - DNA, 25 bp, Rattus norvegicus
gggcagcatggaccccacgcgtgtg

SEQ ID NO: 454123 - DNA, 25 bp, Rattus norvegicus
gggcagcatggagcccacgcgtgtg

SEQ ID NO: 454124 - DNA, 25 bp, Rattus norvegicus
gggcagccaaaccagcgagacacaa

SEQ ID NO: 454125 - DNA, 25 bp, Rattus norvegicus
gggcagccaaacgagcgagacacaa

SEQ ID NO: 454126 - DNA, 25 bp, Rattus norvegicus
gggcagccacaacagtcgaactcct

SEQ ID NO: 454127 - DNA, 25 bp, Rattus norvegicus
gggcagccacaagagtcgaactcct

SEQ ID NO: 454128 - DNA, 25 bp, Rattus norvegicus
gggcagccacagctacaactccttg

SEQ ID NO: 454129 - DNA, 25 bp, Rattus norvegicus
gggcagccacaggtacaactccttg

SEQ ID NO: 454130 - DNA, 25 bp, Rattus norvegicus
gggcagccatctaccagtaactcgc

SEQ ID NO: 454131 - DNA, 25 bp, Rattus norvegicus
gggcagccatcttccagtaactcgc

SEQ ID NO: 454132 - DNA, 25 bp, Rattus norvegicus
gggcagccatgacattgctgacctg

SEQ ID NO: 454133 - DNA, 25 bp, Rattus norvegicus
gggcagccatgagattgctgacctg

SEQ ID NO: 454134 - DNA, 25 bp, Rattus norvegicus
gggcagcccagaacatcatccctgc

SEQ ID NO: 454135 - DNA, 25 bp, Rattus norvegicus
gggcagcccagatcatcatccctgc

SEQ ID NO: 454136 - DNA, 25 bp, Rattus norvegicus
gggcagcccagccttctgggttcta

SEQ ID NO: 454137 - DNA, 25 bp, Rattus norvegicus
gggcagcccagcgttctgggttcta

SEQ ID NO: 454138 - DNA, 25 bp, Rattus norvegicus
gggcagccccgcaccatgcaagtgt

SEQ ID NO: 454139 - DNA, 25 bp, Rattus norvegicus
gggcagccccgctccatgcaagtgt

SEQ ID NO: 454140 - DNA, 25 bp, Rattus norvegicus
gggcagccctgtcaatgtgttctat

SEQ ID NO: 454141 - DNA, 25 bp, Rattus norvegicus
gggcagccctgtgaatgtgttctat

SEQ ID NO: 454142 - DNA, 25 bp, Rattus norvegicus
gggcagccggtcagcccttgaccat

SEQ ID NO: 454143 - DNA, 25 bp, Rattus norvegicus
gggcagccggtctgcccttgaccat

SEQ ID NO: 454144 - DNA, 25 bp, Rattus norvegicus
gggcagcctcgtattcaaaaacaat

SEQ ID NO: 454145 - DNA, 25 bp, Rattus norvegicus
gggcagcctcgttttcaaaaacaat

SEQ ID NO: 454146 - DNA, 25 bp, Rattus norvegicus
gggcagcctctgagaagcagcatca

SEQ ID NO: 454147 - DNA, 25 bp, Rattus norvegicus
gggcagcctctgatccacatgtgca

SEQ ID NO: 454148 - DNA, 25 bp, Rattus norvegicus
gggcagcctctgtgaagcagcatca

SEQ ID NO: 454149 - DNA, 25 bp, Rattus norvegicus
gggcagcctctgttccacatgtgca

SEQ ID NO: 454150 - DNA, 25 bp, Rattus norvegicus
gggcagcctgcaacgtcagagaaag

SEQ ID NO: 454151 - DNA, 25 bp, Rattus norvegicus
gggcagcctgcaactccaataaagg

SEQ ID NO: 454152 - DNA, 25 bp, Rattus norvegicus
gggcagcctgcatcgtcagagaaag

SEQ ID NO: 454153 - DNA, 25 bp, Rattus norvegicus
gggcagcctgcatctccaataaagg

SEQ ID NO: 454154 - DNA, 25 bp, Rattus norvegicus
gggcagcctgcgacccaaccaagga

SEQ ID NO: 454155 - DNA, 25 bp, Rattus norvegicus
gggcagcctgcgtcccaaccaagga

SEQ ID NO: 454156 - DNA, 25 bp, Rattus norvegicus
gggcagcctgctaacagggcaacaa

SEQ ID NO: 454157 - DNA, 25 bp, Rattus norvegicus
gggcagcctgcttacagggcaacaa

SEQ ID NO: 454158 - DNA, 25 bp, Rattus norvegicus
gggcagcctgtaatttctgaattgc

SEQ ID NO: 454159 - DNA, 25 bp, Rattus norvegicus
gggcagcctgtattttctgaattgc

SEQ ID NO: 454160 - DNA, 25 bp, Rattus norvegicus
gggcagccttagagcagagttccat

SEQ ID NO: 454161 - DNA, 25 bp, Rattus norvegicus
gggcagccttagtgcagagttccat

SEQ ID NO: 454162 - DNA, 25 bp, Rattus norvegicus
gggcagcgagtcaccagacaaagcc

SEQ ID NO: 454163 - DNA, 25 bp, Rattus norvegicus
gggcagcgagtctccagacaaagcc

SEQ ID NO: 454164 - DNA, 25 bp, Rattus norvegicus
gggcagcgtgagcatcttctggtgt

SEQ ID NO: 454165 - DNA, 25 bp, Rattus norvegicus
gggcagcgtgaggatcttctggtgt

SEQ ID NO: 454166 - DNA, 25 bp, Rattus norvegicus
gggcagctacccaaccagatatttg

SEQ ID NO: 454167 - DNA, 25 bp, Rattus norvegicus
gggcagctaccctaccagatatttg

SEQ ID NO: 454168 - DNA, 25 bp, Rattus norvegicus
gggcagctacctcgacgactgacct

SEQ ID NO: 454169 - DNA, 25 bp, Rattus norvegicus
gggcagctacctggacgactgacct

SEQ ID NO: 454170 - DNA, 25 bp, Rattus norvegicus
gggcagctacttattatgcagcctg

SEQ ID NO: 454171 - DNA, 25 bp, Rattus norvegicus
gggcagctactttttatgcagcctg

SEQ ID NO: 454172 - DNA, 25 bp, Rattus norvegicus
gggcagctagatatccaagagtttc

SEQ ID NO: 454173 - DNA, 25 bp, Rattus norvegicus
gggcagctagatttccaagagtttc

SEQ ID NO: 454174 - DNA, 25 bp, Rattus norvegicus
gggcagctagctactatctaataaa

SEQ ID NO: 454175 - DNA, 25 bp, Rattus norvegicus
gggcagctagcttctatctaataaa

SEQ ID NO: 454176 - DNA, 25 bp, Rattus norvegicus
gggcagctagtgaccccaggagcta

SEQ ID NO: 454177 - DNA, 25 bp, Rattus norvegicus
gggcagctagtgtccccaggagcta

SEQ ID NO: 454178 - DNA, 25 bp, Rattus norvegicus
gggcagctatacataaaaaccacat

SEQ ID NO: 454179 - DNA, 25 bp, Rattus norvegicus
gggcagctatacttaaaaaccacat

SEQ ID NO: 454180 - DNA, 25 bp, Rattus norvegicus
gggcagctcaacaaaactgtctcca

SEQ ID NO: 454181 - DNA, 25 bp, Rattus norvegicus
gggcagctcaacatcgcaagacagt

SEQ ID NO: 454182 - DNA, 25 bp, Rattus norvegicus
gggcagctcaactaaactgtctcca

SEQ ID NO: 454183 - DNA, 25 bp, Rattus norvegicus
gggcagctcaacttcgcaagacagt

SEQ ID NO: 454184 - DNA, 25 bp, Rattus norvegicus
gggcagctcaggactcagccaggta

SEQ ID NO: 454185 - DNA, 25 bp, Rattus norvegicus
gggcagctcaggtctcagccaggta

SEQ ID NO: 454186 - DNA, 25 bp, Rattus norvegicus
gggcagctcagtaccgagaggcaat

SEQ ID NO: 454187 - DNA, 25 bp, Rattus norvegicus
gggcagctcagttccgagaggcaat

SEQ ID NO: 454188 - DNA, 25 bp, Rattus norvegicus
gggcagctcatgactcacttttgtg

SEQ ID NO: 454189 - DNA, 25 bp, Rattus norvegicus
gggcagctcatgtctcacttttgtg

SEQ ID NO: 454190 - DNA, 25 bp, Rattus norvegicus
gggcagctccatatcatggactaca

SEQ ID NO: 454191 - DNA, 25 bp, Rattus norvegicus
gggcagctccatcttttgaagacaa

SEQ ID NO: 454192 - DNA, 25 bp, Rattus norvegicus
gggcagctccatgttttgaagacaa

SEQ ID NO: 454193 - DNA, 25 bp, Rattus norvegicus
gggcagctccatttcatggactaca

SEQ ID NO: 454194 - DNA, 25 bp, Rattus norvegicus
gggcagctcccacagaatgaatagt

SEQ ID NO: 454195 - DNA, 25 bp, Rattus norvegicus
gggcagctcccagagaatgaatagt

SEQ ID NO: 454196 - DNA, 25 bp, Rattus norvegicus
gggcagctccccaagtttgaagatg

SEQ ID NO: 454197 - DNA, 25 bp, Rattus norvegicus
gggcagctccccaggaagaagctaa

SEQ ID NO: 454198 - DNA, 25 bp, Rattus norvegicus
gggcagctcccctagtttgaagatg

SEQ ID NO: 454199 - DNA, 25 bp, Rattus norvegicus
gggcagctcccctggaagaagctaa

SEQ ID NO: 454200 - DNA, 25 bp, Rattus norvegicus
gggcagctcctaaaaaccacttggt

SEQ ID NO: 454201 - DNA, 25 bp, Rattus norvegicus
gggcagctcctataaaccacttggt

SEQ ID NO: 454202 - DNA, 25 bp, Rattus norvegicus
gggcagctctggcaaacatgtccaa

SEQ ID NO: 454203 - DNA, 25 bp, Rattus norvegicus
gggcagctctgggaaacatgtccaa

SEQ ID NO: 454204 - DNA, 25 bp, Rattus norvegicus
gggcagctctttcaaaggtcagtat

SEQ ID NO: 454205 - DNA, 25 bp, Rattus norvegicus
gggcagctctttgaaaggtcagtat

SEQ ID NO: 454206 - DNA, 25 bp, Rattus norvegicus
gggcagctgccaaattgatgtatta

SEQ ID NO: 454207 - DNA, 25 bp, Rattus norvegicus
gggcagctgccatattgatgtatta

SEQ ID NO: 454208 - DNA, 25 bp, Rattus norvegicus
gggcagctggaaaagcttcctaccc

SEQ ID NO: 454209 - DNA, 25 bp, Rattus norvegicus
gggcagctggaatagcttcctaccc

SEQ ID NO: 454210 - DNA, 25 bp, Rattus norvegicus
gggcagctggacattgcatgttaga

SEQ ID NO: 454211 - DNA, 25 bp, Rattus norvegicus
gggcagctggactttgcatgttaga

SEQ ID NO: 454212 - DNA, 25 bp, Rattus norvegicus
gggcagctgtacctggcgaccaggg

SEQ ID NO: 454213 - DNA, 25 bp, Rattus norvegicus
gggcagctgtacgtggcgaccaggg

SEQ ID NO: 454214 - DNA, 25 bp, Rattus norvegicus
gggcagcttcagagaccacagacaa

SEQ ID NO: 454215 - DNA, 25 bp, Rattus norvegicus
gggcagcttcagtgaccacagacaa

SEQ ID NO: 454216 - DNA, 25 bp, Rattus norvegicus
gggcagcttcatcttagcggtttgc

SEQ ID NO: 454217 - DNA, 25 bp, Rattus norvegicus
gggcagcttcatgttagcggtttgc

SEQ ID NO: 454218 - DNA, 25 bp, Rattus norvegicus
gggcagcttcctaaagccaccaggg

SEQ ID NO: 454219 - DNA, 25 bp, Rattus norvegicus
gggcagcttccttaagccaccaggg

SEQ ID NO: 454220 - DNA, 25 bp, Rattus norvegicus
gggcagcttctacagactgccactg

SEQ ID NO: 454221 - DNA, 25 bp, Rattus norvegicus
gggcagcttctagagactgccactg

SEQ ID NO: 454222 - DNA, 25 bp, Rattus norvegicus
gggcagcttctgactgcctcttgcc

SEQ ID NO: 454223 - DNA, 25 bp, Rattus norvegicus
gggcagcttctgagcaagcgccatt

SEQ ID NO: 454224 - DNA, 25 bp, Rattus norvegicus
gggcagcttctgtctgcctcttgcc

SEQ ID NO: 454225 - DNA, 25 bp, Rattus norvegicus
gggcagcttctgtgcaagcgccatt

SEQ ID NO: 454226 - DNA, 25 bp, Rattus norvegicus
gggcagcttttcatgggttcaaatc

SEQ ID NO: 454227 - DNA, 25 bp, Rattus norvegicus
gggcagcttttcctcggaaggaaca

SEQ ID NO: 454228 - DNA, 25 bp, Rattus norvegicus
gggcagcttttcctggaatccatga

SEQ ID NO: 454229 - DNA, 25 bp, Rattus norvegicus
gggcagcttttcgtcggaaggaaca

SEQ ID NO: 454230 - DNA, 25 bp, Rattus norvegicus
gggcagcttttcgtggaatccatga

SEQ ID NO: 454231 - DNA, 25 bp, Rattus norvegicus
gggcagcttttcttgggttcaaatc

SEQ ID NO: 454232 - DNA, 25 bp, Rattus norvegicus
gggcaggaaatgattgaccctcgca

SEQ ID NO: 454233 - DNA, 25 bp, Rattus norvegicus
gggcaggaaatgtttgaccctcgca

SEQ ID NO: 454234 - DNA, 25 bp, Rattus norvegicus
gggcaggaacacacaaatccagccc

SEQ ID NO: 454235 - DNA, 25 bp, Rattus norvegicus
gggcaggaacactcaaatccagccc

SEQ ID NO: 454236 - DNA, 25 bp, Rattus norvegicus
gggcaggaaggcacgtcttaaaaca

SEQ ID NO: 454237 - DNA, 25 bp, Rattus norvegicus
gggcaggaaggctcgtcttaaaaca

SEQ ID NO: 454238 - DNA, 25 bp, Rattus norvegicus
gggcaggaatatagccaatcccaca

SEQ ID NO: 454239 - DNA, 25 bp, Rattus norvegicus
gggcaggaatattgccaatcccaca

SEQ ID NO: 454240 - DNA, 25 bp, Rattus norvegicus
gggcaggaatcaagctactccattc

SEQ ID NO: 454241 - DNA, 25 bp, Rattus norvegicus
gggcaggaatcatgctactccattc

SEQ ID NO: 454242 - DNA, 25 bp, Rattus norvegicus
gggcaggaatctaactcaaatacat

SEQ ID NO: 454243 - DNA, 25 bp, Rattus norvegicus
gggcaggaatcttactcaaatacat

SEQ ID NO: 454244 - DNA, 25 bp, Rattus norvegicus
gggcaggaccatataaacacctatt

SEQ ID NO: 454245 - DNA, 25 bp, Rattus norvegicus
gggcaggaccatttaaacacctatt

SEQ ID NO: 454246 - DNA, 25 bp, Rattus norvegicus
gggcaggagagcctttcacttgaaa

SEQ ID NO: 454247 - DNA, 25 bp, Rattus norvegicus
gggcaggagagcgtttcacttgaaa

SEQ ID NO: 454248 - DNA, 25 bp, Rattus norvegicus
gggcaggagcatcaccatgaattta

SEQ ID NO: 454249 - DNA, 25 bp, Rattus norvegicus
gggcaggagcatgaccatgaattta

SEQ ID NO: 454250 - DNA, 25 bp, Rattus norvegicus
gggcaggagccacacagtagtttca

SEQ ID NO: 454251 - DNA, 25 bp, Rattus norvegicus
gggcaggagccagacagtagtttca

SEQ ID NO: 454252 - DNA, 25 bp, Rattus norvegicus
gggcaggcacacatgagaagacagt

SEQ ID NO: 454253 - DNA, 25 bp, Rattus norvegicus
gggcaggcacacttgagaagacagt

SEQ ID NO: 454254 - DNA, 25 bp, Rattus norvegicus
gggcaggcagtactagttcacccct

SEQ ID NO: 454255 - DNA, 25 bp, Rattus norvegicus
gggcaggcagtagtagttcacccct

SEQ ID NO: 454256 - DNA, 25 bp, Rattus norvegicus
gggcaggcatagaagtctcctcggt

SEQ ID NO: 454257 - DNA, 25 bp, Rattus norvegicus
gggcaggcatagtagtctcctcggt

SEQ ID NO: 454258 - DNA, 25 bp, Rattus norvegicus
gggcaggcatcaagaacacttgtaa

SEQ ID NO: 454259 - DNA, 25 bp, Rattus norvegicus
gggcaggcatcatgaacacttgtaa

SEQ ID NO: 454260 - DNA, 25 bp, Rattus norvegicus
gggcaggcatgcaggaacctaacct

SEQ ID NO: 454261 - DNA, 25 bp, Rattus norvegicus
gggcaggcatgctggaacctaacct

SEQ ID NO: 454262 - DNA, 25 bp, Rattus norvegicus
gggcaggcatttcataaagttcacc

SEQ ID NO: 454263 - DNA, 25 bp, Rattus norvegicus
gggcaggcatttgataaagttcacc

SEQ ID NO: 454264 - DNA, 25 bp, Rattus norvegicus
gggcaggccaatacttagcccctga

SEQ ID NO: 454265 - DNA, 25 bp, Rattus norvegicus
gggcaggccaattcttagcccctga

SEQ ID NO: 454266 - DNA, 25 bp, Rattus norvegicus
gggcaggccctcaataaatgtgaag

SEQ ID NO: 454267 - DNA, 25 bp, Rattus norvegicus
gggcaggccctctataaatgtgaag

SEQ ID NO: 454268 - DNA, 25 bp, Rattus norvegicus
gggcaggcctatatcaggctcaact

SEQ ID NO: 454269 - DNA, 25 bp, Rattus norvegicus
gggcaggcctatttcaggctcaact

SEQ ID NO: 454270 - DNA, 25 bp, Rattus norvegicus
gggcaggctgctcgttgtctaccct

SEQ ID NO: 454271 - DNA, 25 bp, Rattus norvegicus
gggcaggctgctggttgtctaccct

SEQ ID NO: 454272 - DNA, 25 bp, Rattus norvegicus
gggcaggcttcaactcattgtaccc

SEQ ID NO: 454273 - DNA, 25 bp, Rattus norvegicus
gggcaggcttcacggagacaccctt

SEQ ID NO: 454274 - DNA, 25 bp, Rattus norvegicus
gggcaggcttcagggagacaccctt

SEQ ID NO: 454275 - DNA, 25 bp, Rattus norvegicus
gggcaggcttcatctcattgtaccc

SEQ ID NO: 454276 - DNA, 25 bp, Rattus norvegicus
gggcagggacaaatcccctgacgat

SEQ ID NO: 454277 - DNA, 25 bp, Rattus norvegicus
gggcagggacaattcccctgacgat

SEQ ID NO: 454278 - DNA, 25 bp, Rattus norvegicus
gggcagggacagcaaattacacaca

SEQ ID NO: 454279 - DNA, 25 bp, Rattus norvegicus
gggcagggacaggaaattacacaca

SEQ ID NO: 454280 - DNA, 25 bp, Rattus norvegicus
gggcagggacccagtcttcagtgct

SEQ ID NO: 454281 - DNA, 25 bp, Rattus norvegicus
gggcagggaccctgtcttcagtgct

SEQ ID NO: 454282 - DNA, 25 bp, Rattus norvegicus
gggcagggatccaggtctctataaa

SEQ ID NO: 454283 - DNA, 25 bp, Rattus norvegicus
gggcagggatcctggtctctataaa

SEQ ID NO: 454284 - DNA, 25 bp, Rattus norvegicus
gggcagggcactaggacacaatttt

SEQ ID NO: 454285 - DNA, 25 bp, Rattus norvegicus
gggcagggcacttggacacaatttt

SEQ ID NO: 454286 - DNA, 25 bp, Rattus norvegicus
gggcagggtcttcgcctattagaat

SEQ ID NO: 454287 - DNA, 25 bp, Rattus norvegicus
gggcagggtcttggcctattagaat

SEQ ID NO: 454288 - DNA, 25 bp, Rattus norvegicus
gggcagggtgcacacatcagtctcc

SEQ ID NO: 454289 - DNA, 25 bp, Rattus norvegicus
gggcagggtgcagacatcagtctcc

SEQ ID NO: 454290 - DNA, 25 bp, Rattus norvegicus
gggcaggtaccacagccagcagcat

SEQ ID NO: 454291 - DNA, 25 bp, Rattus norvegicus
gggcaggtaccagagccagcagcat

SEQ ID NO: 454292 - DNA, 25 bp, Rattus norvegicus
gggcaggtcaccagattgagcctcc

SEQ ID NO: 454293 - DNA, 25 bp, Rattus norvegicus
gggcaggtcacctgattgagcctcc

SEQ ID NO: 454294 - DNA, 25 bp, Rattus norvegicus
gggcaggtcctaaccaaagctggca

SEQ ID NO: 454295 - DNA, 25 bp, Rattus norvegicus
gggcaggtcctatccaaagctggca

SEQ ID NO: 454296 - DNA, 25 bp, Rattus norvegicus
gggcaggtctgcactcataatgctg

SEQ ID NO: 454297 - DNA, 25 bp, Rattus norvegicus
gggcaggtctgctctcataatgctg

SEQ ID NO: 454298 - DNA, 25 bp, Rattus norvegicus
gggcaggtcttaagcgtgttcacac

SEQ ID NO: 454299 - DNA, 25 bp, Rattus norvegicus
gggcaggtcttatgcgtgttcacac

SEQ ID NO: 454300 - DNA, 25 bp, Rattus norvegicus
gggcaggtcttgcatgtgtccctaa

SEQ ID NO: 454301 - DNA, 25 bp, Rattus norvegicus
gggcaggtcttggatgtgtccctaa

SEQ ID NO: 454302 - DNA, 25 bp, Rattus norvegicus
gggcaggtgattagtggtccactcc

SEQ ID NO: 454303 - DNA, 25 bp, Rattus norvegicus
gggcaggtgatttgtggtccactcc

SEQ ID NO: 454304 - DNA, 25 bp, Rattus norvegicus
gggcaggtgtgtaaccctctggact

SEQ ID NO: 454305 - DNA, 25 bp, Rattus norvegicus
gggcaggtgtgttaccctctggact

SEQ ID NO: 454306 - DNA, 25 bp, Rattus norvegicus
gggcaggtttgtacgtaatactatt

SEQ ID NO: 454307 - DNA, 25 bp, Rattus norvegicus
gggcaggtttgttcgtaatactatt

SEQ ID NO: 454308 - DNA, 25 bp, Rattus norvegicus
gggcagtacaaactaattcctcaca

SEQ ID NO: 454309 - DNA, 25 bp, Rattus norvegicus
gggcagtacaaagtaattcctcaca

SEQ ID NO: 454310 - DNA, 25 bp, Rattus norvegicus
gggcagtacaggcagtatttttgta

SEQ ID NO: 454311 - DNA, 25 bp, Rattus norvegicus
gggcagtacagggagtatttttgta

SEQ ID NO: 454312 - DNA, 25 bp, Rattus norvegicus
gggcagtaccaaaccccttatatgg

SEQ ID NO: 454313 - DNA, 25 bp, Rattus norvegicus
gggcagtaccaatccccttatatgg

SEQ ID NO: 454314 - DNA, 25 bp, Rattus norvegicus
gggcagtactacatttccaactaga

SEQ ID NO: 454315 - DNA, 25 bp, Rattus norvegicus
gggcagtactacttttccaactaga

SEQ ID NO: 454316 - DNA, 25 bp, Rattus norvegicus
gggcagtacttcatcagttccagct

SEQ ID NO: 454317 - DNA, 25 bp, Rattus norvegicus
gggcagtacttcttcagttccagct

SEQ ID NO: 454318 - DNA, 25 bp, Rattus norvegicus
gggcagtatacccatacccttgtaa

SEQ ID NO: 454319 - DNA, 25 bp, Rattus norvegicus
gggcagtataccgatacccttgtaa

SEQ ID NO: 454320 - DNA, 25 bp, Rattus norvegicus
gggcagtcagacacatacaatactc

SEQ ID NO: 454321 - DNA, 25 bp, Rattus norvegicus
gggcagtcagactcatacaatactc

SEQ ID NO: 454322 - DNA, 25 bp, Rattus norvegicus
gggcagtcatttactctagtgttaa

SEQ ID NO: 454323 - DNA, 25 bp, Rattus norvegicus
gggcagtcattttctctagtgttaa

SEQ ID NO: 454324 - DNA, 25 bp, Rattus norvegicus
gggcagtcctcaccatccagaacgg

SEQ ID NO: 454325 - DNA, 25 bp, Rattus norvegicus
gggcagtcctcagcatccagaacgg

SEQ ID NO: 454326 - DNA, 25 bp, Rattus norvegicus
gggcagtccttgagtattggcattg

SEQ ID NO: 454327 - DNA, 25 bp, Rattus norvegicus
gggcagtccttgtgtattggcattg

SEQ ID NO: 454328 - DNA, 25 bp, Rattus norvegicus
gggcagtcgccacagtaaagtttct

SEQ ID NO: 454329 - DNA, 25 bp, Rattus norvegicus
gggcagtcgccagagtaaagtttct

SEQ ID NO: 454330 - DNA, 25 bp, Rattus norvegicus
gggcagtctcataatctgtacttga

SEQ ID NO: 454331 - DNA, 25 bp, Rattus norvegicus
gggcagtctcattatctgtacttga

SEQ ID NO: 454332 - DNA, 25 bp, Rattus norvegicus
gggcagtctccacgcagagtaccaa

SEQ ID NO: 454333 - DNA, 25 bp, Rattus norvegicus
gggcagtctccaggcagagtaccaa

SEQ ID NO: 454334 - DNA, 25 bp, Rattus norvegicus
gggcagtctctcacgtcagagggaa

SEQ ID NO: 454335 - DNA, 25 bp, Rattus norvegicus
gggcagtctctctcgtcagagggaa

SEQ ID NO: 454336 - DNA, 25 bp, Rattus norvegicus
gggcagtctgccatttaaatgtaac

SEQ ID NO: 454337 - DNA, 25 bp, Rattus norvegicus
gggcagtctgccttttaaatgtaac

SEQ ID NO: 454338 - DNA, 25 bp, Rattus norvegicus
gggcagtctgtcaatcatattcacc

SEQ ID NO: 454339 - DNA, 25 bp, Rattus norvegicus
gggcagtctgtccattaaactaaaa

SEQ ID NO: 454340 - DNA, 25 bp, Rattus norvegicus
gggcagtctgtcgattaaactaaaa

SEQ ID NO: 454341 - DNA, 25 bp, Rattus norvegicus
gggcagtctgtctatcatattcacc

SEQ ID NO: 454342 - DNA, 25 bp, Rattus norvegicus
gggcagtctgttatagcactgtttt

SEQ ID NO: 454343 - DNA, 25 bp, Rattus norvegicus
gggcagtctgttttagcactgtttt

SEQ ID NO: 454344 - DNA, 25 bp, Rattus norvegicus
gggcagtcttaactaattctcacat

SEQ ID NO: 454345 - DNA, 25 bp, Rattus norvegicus
gggcagtcttaagtaattctcacat

SEQ ID NO: 454346 - DNA, 25 bp, Rattus norvegicus
gggcagtgacctagtgaaccactca

SEQ ID NO: 454347 - DNA, 25 bp, Rattus norvegicus
gggcagtgaccttgtgaaccactca

SEQ ID NO: 454348 - DNA, 25 bp, Rattus norvegicus
gggcagtgactaagcaagaacaggc

SEQ ID NO: 454349 - DNA, 25 bp, Rattus norvegicus
gggcagtgactatgcaagaacaggc

SEQ ID NO: 454350 - DNA, 25 bp, Rattus norvegicus
gggcagtgacttaccagtaggtcac

SEQ ID NO: 454351 - DNA, 25 bp, Rattus norvegicus
gggcagtgactttccagtaggtcac

SEQ ID NO: 454352 - DNA, 25 bp, Rattus norvegicus
gggcagtgagctaccagagacctat

SEQ ID NO: 454353 - DNA, 25 bp, Rattus norvegicus
gggcagtgagcttccagagacctat

SEQ ID NO: 454354 - DNA, 25 bp, Rattus norvegicus
gggcagtgatttcgctgccagccac

SEQ ID NO: 454355 - DNA, 25 bp, Rattus norvegicus
gggcagtgatttggctgccagccac

SEQ ID NO: 454356 - DNA, 25 bp, Rattus norvegicus
gggcagtgcaccaggtctgaccaac

SEQ ID NO: 454357 - DNA, 25 bp, Rattus norvegicus
gggcagtgcacctggtctgaccaac

SEQ ID NO: 454358 - DNA, 25 bp, Rattus norvegicus
gggcagtgcatgacctaagactcca

SEQ ID NO: 454359 - DNA, 25 bp, Rattus norvegicus
gggcagtgcatgtcctaagactcca

SEQ ID NO: 454360 - DNA, 25 bp, Rattus norvegicus
gggcagtgccttaggtttggctcct

SEQ ID NO: 454361 - DNA, 25 bp, Rattus norvegicus
gggcagtgccttagtagcctatgtc

SEQ ID NO: 454362 - DNA, 25 bp, Rattus norvegicus
gggcagtgcctttggtttggctcct

SEQ ID NO: 454363 - DNA, 25 bp, Rattus norvegicus
gggcagtgcctttgtagcctatgtc

SEQ ID NO: 454364 - DNA, 25 bp, Rattus norvegicus
gggcagtggaccatccggcctagaa

SEQ ID NO: 454365 - DNA, 25 bp, Rattus norvegicus
gggcagtggaccttccggcctagaa

SEQ ID NO: 454366 - DNA, 25 bp, Rattus norvegicus
gggcagtggcagaggacacctttaa

SEQ ID NO: 454367 - DNA, 25 bp, Rattus norvegicus
gggcagtggcagctgtgtgtgctgt

SEQ ID NO: 454368 - DNA, 25 bp, Rattus norvegicus
gggcagtggcaggtgtgtgtgctgt

SEQ ID NO: 454369 - DNA, 25 bp, Rattus norvegicus
gggcagtggcagtggacacctttaa

SEQ ID NO: 454370 - DNA, 25 bp, Rattus norvegicus
gggcagtgtgtcatataaacctatt

SEQ ID NO: 454371 - DNA, 25 bp, Rattus norvegicus
gggcagtgtgtcttataaacctatt

SEQ ID NO: 454372 - DNA, 25 bp, Rattus norvegicus
gggcagttaaccatcatggcgggta

SEQ ID NO: 454373 - DNA, 25 bp, Rattus norvegicus
gggcagttaaccttcatggcgggta

SEQ ID NO: 454374 - DNA, 25 bp, Rattus norvegicus
gggcagttaagcatgaccaattaat

SEQ ID NO: 454375 - DNA, 25 bp, Rattus norvegicus
gggcagttaagcttgaccaattaat

SEQ ID NO: 454376 - DNA, 25 bp, Rattus norvegicus
gggcagttacatagtgtccattgtt

SEQ ID NO: 454377 - DNA, 25 bp, Rattus norvegicus
gggcagttacattgtgtccattgtt

SEQ ID NO: 454378 - DNA, 25 bp, Rattus norvegicus
gggcagttacttctattacagagcc

SEQ ID NO: 454379 - DNA, 25 bp, Rattus norvegicus
gggcagttacttgtattacagagcc

SEQ ID NO: 454380 - DNA, 25 bp, Rattus norvegicus
gggcagttagtgacagcagccttaa

SEQ ID NO: 454381 - DNA, 25 bp, Rattus norvegicus
gggcagttagtgtcagcagccttaa

SEQ ID NO: 454382 - DNA, 25 bp, Rattus norvegicus
gggcagttcgtaaacagcacttgtt

SEQ ID NO: 454383 - DNA, 25 bp, Rattus norvegicus
gggcagttcgtatacagcacttgtt

SEQ ID NO: 454384 - DNA, 25 bp, Rattus norvegicus
gggcagttcgttaaatacttctgaa

SEQ ID NO: 454385 - DNA, 25 bp, Rattus norvegicus
gggcagttcgtttaatacttctgaa

SEQ ID NO: 454386 - DNA, 25 bp, Rattus norvegicus
gggcagttctatacatacttgcagt

SEQ ID NO: 454387 - DNA, 25 bp, Rattus norvegicus
gggcagttctattcatacttgcagt

SEQ ID NO: 454388 - DNA, 25 bp, Rattus norvegicus
gggcagttcttcaaatcagcatctt

SEQ ID NO: 454389 - DNA, 25 bp, Rattus norvegicus
gggcagttcttctaatcagcatctt

SEQ ID NO: 454390 - DNA, 25 bp, Rattus norvegicus
gggcagttgctacttgtatttattg

SEQ ID NO: 454391 - DNA, 25 bp, Rattus norvegicus
gggcagttgctagttgtatttattg

SEQ ID NO: 454392 - DNA, 25 bp, Rattus norvegicus
gggcagttgctgatgttgaatccaa

SEQ ID NO: 454393 - DNA, 25 bp, Rattus norvegicus
gggcagttgctgttgttgaatccaa

SEQ ID NO: 454394 - DNA, 25 bp, Rattus norvegicus
gggcagttgtggatagccacgtcat

SEQ ID NO: 454395 - DNA, 25 bp, Rattus norvegicus
gggcagttgtggttagccacgtcat

SEQ ID NO: 454396 - DNA, 25 bp, Rattus norvegicus
gggcagttgtgtctcatgttcagat

SEQ ID NO: 454397 - DNA, 25 bp, Rattus norvegicus
gggcagttgtgtgtcatgttcagat

SEQ ID NO: 454398 - DNA, 25 bp, Rattus norvegicus
gggcagtttccacattttaagatat

SEQ ID NO: 454399 - DNA, 25 bp, Rattus norvegicus
gggcagtttccagattttaagatat

SEQ ID NO: 454400 - DNA, 25 bp, Rattus norvegicus
gggcagttttggctttaactcaact

SEQ ID NO: 454401 - DNA, 25 bp, Rattus norvegicus
gggcagttttgggtttaactcaact

SEQ ID NO: 454402 - DNA, 25 bp, Rattus norvegicus
gggcataaatttctccagtcgttga

SEQ ID NO: 454403 - DNA, 25 bp, Rattus norvegicus
gggcataaatttgtccagtcgttga

SEQ ID NO: 454404 - DNA, 25 bp, Rattus norvegicus
gggcataacgttaagcttggcctta

SEQ ID NO: 454405 - DNA, 25 bp, Rattus norvegicus
gggcataacgtttagcttggcctta

SEQ ID NO: 454406 - DNA, 25 bp, Rattus norvegicus
gggcataagcctcattactacttga

SEQ ID NO: 454407 - DNA, 25 bp, Rattus norvegicus
gggcataagcctgattactacttga

SEQ ID NO: 454408 - DNA, 25 bp, Rattus norvegicus
gggcataaggccaacctggcaaata

SEQ ID NO: 454409 - DNA, 25 bp, Rattus norvegicus
gggcataaggcctacctggcaaata

SEQ ID NO: 454410 - DNA, 25 bp, Rattus norvegicus
gggcatacacaaccaggctgcacta

SEQ ID NO: 454411 - DNA, 25 bp, Rattus norvegicus
gggcatacacaagcaggctgcacta

SEQ ID NO: 454412 - DNA, 25 bp, Rattus norvegicus
gggcatacctgtagtccaaggaggt

SEQ ID NO: 454413 - DNA, 25 bp, Rattus norvegicus
gggcatacctgttgtccaaggaggt

SEQ ID NO: 454414 - DNA, 25 bp, Rattus norvegicus
gggcatacgatgctaattagggcac

SEQ ID NO: 454415 - DNA, 25 bp, Rattus norvegicus
gggcatacgatggtaattagggcac

SEQ ID NO: 454416 - DNA, 25 bp, Rattus norvegicus
gggcatacgtacaaatcgttcacag

SEQ ID NO: 454417 - DNA, 25 bp, Rattus norvegicus
gggcatacgtactaatcgttcacag

SEQ ID NO: 454418 - DNA, 25 bp, Rattus norvegicus
gggcatactcccactctaaataaat

SEQ ID NO: 454419 - DNA, 25 bp, Rattus norvegicus
gggcatactccctctctaaataaat

SEQ ID NO: 454420 - DNA, 25 bp, Rattus norvegicus
gggcatactctgcagttttttccac

SEQ ID NO: 454421 - DNA, 25 bp, Rattus norvegicus
gggcatactctggagttttttccac

SEQ ID NO: 454422 - DNA, 25 bp, Rattus norvegicus
gggcatactggaagtagtcattttt

SEQ ID NO: 454423 - DNA, 25 bp, Rattus norvegicus
gggcatactggatgtagtcattttt

SEQ ID NO: 454424 - DNA, 25 bp, Rattus norvegicus
gggcatacttggctgttcattctga

SEQ ID NO: 454425 - DNA, 25 bp, Rattus norvegicus
gggcatacttgggtgttcattctga

SEQ ID NO: 454426 - DNA, 25 bp, Rattus norvegicus
gggcatactttgactatagaaaaat

SEQ ID NO: 454427 - DNA, 25 bp, Rattus norvegicus
gggcatactttgtctatagaaaaat

SEQ ID NO: 454428 - DNA, 25 bp, Rattus norvegicus
gggcatacttttcagtgacatgaca

SEQ ID NO: 454429 - DNA, 25 bp, Rattus norvegicus
gggcatacttttgagtgacatgaca

SEQ ID NO: 454430 - DNA, 25 bp, Rattus norvegicus
gggcatagaccacttttctccaaag

SEQ ID NO: 454431 - DNA, 25 bp, Rattus norvegicus
gggcatagaccagttttctccaaag

SEQ ID NO: 454432 - DNA, 25 bp, Rattus norvegicus
gggcatagacctctaatctccagta

SEQ ID NO: 454433 - DNA, 25 bp, Rattus norvegicus
gggcatagacctgtaatctccagta

SEQ ID NO: 454434 - DNA, 25 bp, Rattus norvegicus
gggcatagatgtacctgtctagcat

SEQ ID NO: 454435 - DNA, 25 bp, Rattus norvegicus
gggcatagatgttcctgtctagcat

SEQ ID NO: 454436 - DNA, 25 bp, Rattus norvegicus
gggcatagcacccaagactgttcta

SEQ ID NO: 454437 - DNA, 25 bp, Rattus norvegicus
gggcatagcaccgaagactgttcta

SEQ ID NO: 454438 - DNA, 25 bp, Rattus norvegicus
gggcatagcccactcacaaatatta

SEQ ID NO: 454439 - DNA, 25 bp, Rattus norvegicus
gggcatagcccagtcacaaatatta

SEQ ID NO: 454440 - DNA, 25 bp, Rattus norvegicus
gggcatagctcactgacaagtgtat

SEQ ID NO: 454441 - DNA, 25 bp, Rattus norvegicus
gggcatagctcagtgacaagtgtat

SEQ ID NO: 454442 - DNA, 25 bp, Rattus norvegicus
gggcatagggtacaatagcctctgt

SEQ ID NO: 454443 - DNA, 25 bp, Rattus norvegicus
gggcatagggtagaatagcctctgt

SEQ ID NO: 454444 - DNA, 25 bp, Rattus norvegicus
gggcatagtcttattaacaaccaca

SEQ ID NO: 454445 - DNA, 25 bp, Rattus norvegicus
gggcatagtctttttaacaaccaca

SEQ ID NO: 454446 - DNA, 25 bp, Rattus norvegicus
gggcatagtgacctatacctgtatt

SEQ ID NO: 454447 - DNA, 25 bp, Rattus norvegicus
gggcatagtgacgtatacctgtatt

SEQ ID NO: 454448 - DNA, 25 bp, Rattus norvegicus
gggcatatatgtaggacctagcaaa

SEQ ID NO: 454449 - DNA, 25 bp, Rattus norvegicus
gggcatatatgttggacctagcaaa

SEQ ID NO: 454450 - DNA, 25 bp, Rattus norvegicus
gggcatatattcaatagtacctcta

SEQ ID NO: 454451 - DNA, 25 bp, Rattus norvegicus
gggcatatattctatagtacctcta

SEQ ID NO: 454452 - DNA, 25 bp, Rattus norvegicus
gggcatatcaggctactcacattag

SEQ ID NO: 454453 - DNA, 25 bp, Rattus norvegicus
gggcatatcagggtactcacattag

SEQ ID NO: 454454 - DNA, 25 bp, Rattus norvegicus
gggcatatccctatgtacacagtgt

SEQ ID NO: 454455 - DNA, 25 bp, Rattus norvegicus
gggcatatccctttgtacacagtgt

SEQ ID NO: 454456 - DNA, 25 bp, Rattus norvegicus
gggcatatgattattaactaacctt

SEQ ID NO: 454457 - DNA, 25 bp, Rattus norvegicus
gggcatatgatttttaactaacctt

SEQ ID NO: 454458 - DNA, 25 bp, Rattus norvegicus
gggcatatgctgagtttcaaacatt

SEQ ID NO: 454459 - DNA, 25 bp, Rattus norvegicus
gggcatatgctgtgtttcaaacatt

SEQ ID NO: 454460 - DNA, 25 bp, Rattus norvegicus
gggcatcacactcacttattagggt

SEQ ID NO: 454461 - DNA, 25 bp, Rattus norvegicus
gggcatcacactgacttattagggt

SEQ ID NO: 454462 - DNA, 25 bp, Rattus norvegicus
gggcatcacctaccctggataagaa

SEQ ID NO: 454463 - DNA, 25 bp, Rattus norvegicus
gggcatcacctagcctggataagaa

SEQ ID NO: 454464 - DNA, 25 bp, Rattus norvegicus
gggcatcactgcaacagactgtctc

SEQ ID NO: 454465 - DNA, 25 bp, Rattus norvegicus
gggcatcactgctacagactgtctc

SEQ ID NO: 454466 - DNA, 25 bp, Rattus norvegicus
gggcatcagcaccaagaaggtaaac

SEQ ID NO: 454467 - DNA, 25 bp, Rattus norvegicus
gggcatcagcacgaagaaggtaaac

SEQ ID NO: 454468 - DNA, 25 bp, Rattus norvegicus
gggcatcagtcgaggcagcagtacc

SEQ ID NO: 454469 - DNA, 25 bp, Rattus norvegicus
gggcatcagtcgtggcagcagtacc

SEQ ID NO: 454470 - DNA, 25 bp, Rattus norvegicus
gggcatcatcttcgaacacccaatt

SEQ ID NO: 454471 - DNA, 25 bp, Rattus norvegicus
gggcatcatcttggaacacccaatt

SEQ ID NO: 454472 - DNA, 25 bp, Rattus norvegicus
gggcatcatgctagtgtatgacatc

SEQ ID NO: 454473 - DNA, 25 bp, Rattus norvegicus
gggcatcatgctcagttacatccga

SEQ ID NO: 454474 - DNA, 25 bp, Rattus norvegicus
gggcatcatgctgagttacatccga

SEQ ID NO: 454475 - DNA, 25 bp, Rattus norvegicus
gggcatcatgcttgtgtatgacatc

SEQ ID NO: 454476 - DNA, 25 bp, Rattus norvegicus
gggcatcattcaccatcaggtcaag

SEQ ID NO: 454477 - DNA, 25 bp, Rattus norvegicus
gggcatcattcagcatcaggtcaag

SEQ ID NO: 454478 - DNA, 25 bp, Rattus norvegicus
gggcatccaataagaaaacactcta

SEQ ID NO: 454479 - DNA, 25 bp, Rattus norvegicus
gggcatccaatatgaaaacactcta

SEQ ID NO: 454480 - DNA, 25 bp, Rattus norvegicus
gggcatccacagactctggcacaga

SEQ ID NO: 454481 - DNA, 25 bp, Rattus norvegicus
gggcatccacagtctctggcacaga

SEQ ID NO: 454482 - DNA, 25 bp, Rattus norvegicus
gggcatccactacctggtggcaaaa

SEQ ID NO: 454483 - DNA, 25 bp, Rattus norvegicus
gggcatccactagctggtggcaaaa

SEQ ID NO: 454484 - DNA, 25 bp, Rattus norvegicus
gggcatccactgctactcgcagctg

SEQ ID NO: 454485 - DNA, 25 bp, Rattus norvegicus
gggcatccactggtactcgcagctg

SEQ ID NO: 454486 - DNA, 25 bp, Rattus norvegicus
gggcatcccagtccttccaaagaaa

SEQ ID NO: 454487 - DNA, 25 bp, Rattus norvegicus
gggcatcccagtgcttccaaagaaa

SEQ ID NO: 454488 - DNA, 25 bp, Rattus norvegicus
gggcatccccaaacacttgtgtgta

SEQ ID NO: 454489 - DNA, 25 bp, Rattus norvegicus
gggcatccccaatcacttgtgtgta

SEQ ID NO: 454490 - DNA, 25 bp, Rattus norvegicus
gggcatcccgggaagagcctgacta

SEQ ID NO: 454491 - DNA, 25 bp, Rattus norvegicus
gggcatcccgggtagagcctgacta

SEQ ID NO: 454492 - DNA, 25 bp, Rattus norvegicus
gggcatccctacctatgtggctgag

SEQ ID NO: 454493 - DNA, 25 bp, Rattus norvegicus
gggcatccctacgtatgtggctgag

SEQ ID NO: 454494 - DNA, 25 bp, Rattus norvegicus
gggcatccgtgaaaaactgaagaca

SEQ ID NO: 454495 - DNA, 25 bp, Rattus norvegicus
gggcatccgtgataaactgaagaca

SEQ ID NO: 454496 - DNA, 25 bp, Rattus norvegicus
gggcatcctcacactgggaaagcgg

SEQ ID NO: 454497 - DNA, 25 bp, Rattus norvegicus
gggcatcctcactctgggaaagcgg

SEQ ID NO: 454498 - DNA, 25 bp, Rattus norvegicus
gggcatcctcatccgtgccaggaaa

SEQ ID NO: 454499 - DNA, 25 bp, Rattus norvegicus
gggcatcctcatgcgtgccaggaaa

SEQ ID NO: 454500 - DNA, 25 bp, Rattus norvegicus
gggcatccttccattctgaagggac

SEQ ID NO: 454501 - DNA, 25 bp, Rattus norvegicus
gggcatccttcctttctgaagggac

SEQ ID NO: 454502 - DNA, 25 bp, Rattus norvegicus
gggcatcgatgcactgaggattatc

SEQ ID NO: 454503 - DNA, 25 bp, Rattus norvegicus
gggcatcgatgctctgaggattatc

SEQ ID NO: 454504 - DNA, 25 bp, Rattus norvegicus
gggcatcggccaagaaaagacttaa

SEQ ID NO: 454505 - DNA, 25 bp, Rattus norvegicus
gggcatcggccatgaaaagacttaa

SEQ ID NO: 454506 - DNA, 25 bp, Rattus norvegicus
gggcatcgtctcctatggacaaaat

SEQ ID NO: 454507 - DNA, 25 bp, Rattus norvegicus
gggcatcgtctcgtatggacaaaat

SEQ ID NO: 454508 - DNA, 25 bp, Rattus norvegicus
gggcatctacagcacaagtcttcaa

SEQ ID NO: 454509 - DNA, 25 bp, Rattus norvegicus
gggcatctacaggacaagtcttcaa

SEQ ID NO: 454510 - DNA, 25 bp, Rattus norvegicus
gggcatctacctaacttctcaggga

SEQ ID NO: 454511 - DNA, 25 bp, Rattus norvegicus
gggcatctaccttacttctcaggga

SEQ ID NO: 454512 - DNA, 25 bp, Rattus norvegicus
gggcatctatgaatcttattgtgta

SEQ ID NO: 454513 - DNA, 25 bp, Rattus norvegicus
gggcatctatgattcttattgtgta

SEQ ID NO: 454514 - DNA, 25 bp, Rattus norvegicus
gggcatctccgtagggaattgtctt

SEQ ID NO: 454515 - DNA, 25 bp, Rattus norvegicus
gggcatctccgttgggaattgtctt

SEQ ID NO: 454516 - DNA, 25 bp, Rattus norvegicus
gggcatctccttctatgcaattttt

SEQ ID NO: 454517 - DNA, 25 bp, Rattus norvegicus
gggcatctccttgtatgcaattttt

SEQ ID NO: 454518 - DNA, 25 bp, Rattus norvegicus
gggcatctcttgcaacaagccagaa

SEQ ID NO: 454519 - DNA, 25 bp, Rattus norvegicus
gggcatctcttggaacaagccagaa

SEQ ID NO: 454520 - DNA, 25 bp, Rattus norvegicus
gggcatctctttctttagagccaga

SEQ ID NO: 454521 - DNA, 25 bp, Rattus norvegicus
gggcatctctttgtttagagccaga

SEQ ID NO: 454522 - DNA, 25 bp, Rattus norvegicus
gggcatctgaacaccgacagctggc

SEQ ID NO: 454523 - DNA, 25 bp, Rattus norvegicus
gggcatctgaactccgacagctggc

SEQ ID NO: 454524 - DNA, 25 bp, Rattus norvegicus
gggcatctgctgacccatgggattc

SEQ ID NO: 454525 - DNA, 25 bp, Rattus norvegicus
gggcatctgctgtcccatgggattc

SEQ ID NO: 454526 - DNA, 25 bp, Rattus norvegicus
gggcatctgcttcgaaccaaagcca

SEQ ID NO: 454527 - DNA, 25 bp, Rattus norvegicus
gggcatctgcttggaaccaaagcca

SEQ ID NO: 454528 - DNA, 25 bp, Rattus norvegicus
gggcatctgggtattttatggactc

SEQ ID NO: 454529 - DNA, 25 bp, Rattus norvegicus
gggcatctgggttttttatggactc

SEQ ID NO: 454530 - DNA, 25 bp, Rattus norvegicus
gggcatctgtgtaactgttactgta

SEQ ID NO: 454531 - DNA, 25 bp, Rattus norvegicus
gggcatctgtgttactgttactgta

SEQ ID NO: 454532 - DNA, 25 bp, Rattus norvegicus
gggcatctgttcattcagtcatatg

SEQ ID NO: 454533 - DNA, 25 bp, Rattus norvegicus
gggcatctgttctttcagtcatatg

SEQ ID NO: 454534 - DNA, 25 bp, Rattus norvegicus
gggcatcttcagaatgcggcatatt

SEQ ID NO: 454535 - DNA, 25 bp, Rattus norvegicus
gggcatcttcagtatgcggcatatt

SEQ ID NO: 454536 - DNA, 25 bp, Rattus norvegicus
gggcatcttcccaaatggttcagga

SEQ ID NO: 454537 - DNA, 25 bp, Rattus norvegicus
gggcatcttcccatgcaaaggcgga

SEQ ID NO: 454538 - DNA, 25 bp, Rattus norvegicus
gggcatcttccctaatggttcagga

SEQ ID NO: 454539 - DNA, 25 bp, Rattus norvegicus
gggcatcttcccttgcaaaggcgga

SEQ ID NO: 454540 - DNA, 25 bp, Rattus norvegicus
gggcatcttctgacagctcacttgt

SEQ ID NO: 454541 - DNA, 25 bp, Rattus norvegicus
gggcatcttctgtcagctcacttgt

SEQ ID NO: 454542 - DNA, 25 bp, Rattus norvegicus
gggcatcttgaaagagggtctcact

SEQ ID NO: 454543 - DNA, 25 bp, Rattus norvegicus
gggcatcttgaatgagggtctcact

SEQ ID NO: 454544 - DNA, 25 bp, Rattus norvegicus
gggcatcttgatcatgtcttgacct

SEQ ID NO: 454545 - DNA, 25 bp, Rattus norvegicus
gggcatcttgatgatgtcttgacct

SEQ ID NO: 454546 - DNA, 25 bp, Rattus norvegicus
gggcatctttgaacacttggtgaac

SEQ ID NO: 454547 - DNA, 25 bp, Rattus norvegicus
gggcatctttgatcacttggtgaac

SEQ ID NO: 454548 - DNA, 25 bp, Rattus norvegicus
gggcatctttgcaaatccacttgaa

SEQ ID NO: 454549 - DNA, 25 bp, Rattus norvegicus
gggcatctttgctaatccacttgaa

SEQ ID NO: 454550 - DNA, 25 bp, Rattus norvegicus
gggcatctttggactgtgcacagca

SEQ ID NO: 454551 - DNA, 25 bp, Rattus norvegicus
gggcatctttggattcaggagctaa

SEQ ID NO: 454552 - DNA, 25 bp, Rattus norvegicus
gggcatctttggtctgtgcacagca

SEQ ID NO: 454553 - DNA, 25 bp, Rattus norvegicus
gggcatctttggtttcaggagctaa

SEQ ID NO: 454554 - DNA, 25 bp, Rattus norvegicus
gggcatgaatgtcaaaccttccttt

SEQ ID NO: 454555 - DNA, 25 bp, Rattus norvegicus
gggcatgaatgtgaaaccttccttt

SEQ ID NO: 454556 - DNA, 25 bp, Rattus norvegicus
gggcatgacctacccaggcagcctg

SEQ ID NO: 454557 - DNA, 25 bp, Rattus norvegicus
gggcatgacctagccaggcagcctg

SEQ ID NO: 454558 - DNA, 25 bp, Rattus norvegicus
gggcatgactcgagcaacttactgc

SEQ ID NO: 454559 - DNA, 25 bp, Rattus norvegicus
gggcatgactcgtgcaacttactgc

SEQ ID NO: 454560 - DNA, 25 bp, Rattus norvegicus
gggcatgatatccatggtcactcac

SEQ ID NO: 454561 - DNA, 25 bp, Rattus norvegicus
gggcatgatatcgatggtcactcac

SEQ ID NO: 454562 - DNA, 25 bp, Rattus norvegicus
gggcatgattgcagggatttcccat

SEQ ID NO: 454563 - DNA, 25 bp, Rattus norvegicus
gggcatgattgctgggatttcccat

SEQ ID NO: 454564 - DNA, 25 bp, Rattus norvegicus
gggcatgcaaatagtgcttcacttt

SEQ ID NO: 454565 - DNA, 25 bp, Rattus norvegicus
gggcatgcaaattgtgcttcacttt

SEQ ID NO: 454566 - DNA, 25 bp, Rattus norvegicus
gggcatgcagaaacagcttccgtgt

SEQ ID NO: 454567 - DNA, 25 bp, Rattus norvegicus
gggcatgcagaatcagcttccgtgt

SEQ ID NO: 454568 - DNA, 25 bp, Rattus norvegicus
gggcatgcatcactaggcgtgtcta

SEQ ID NO: 454569 - DNA, 25 bp, Rattus norvegicus
gggcatgcatcagtaggcgtgtcta

SEQ ID NO: 454570 - DNA, 25 bp, Rattus norvegicus
gggcatgcatgactctttggcaaca

SEQ ID NO: 454571 - DNA, 25 bp, Rattus norvegicus
gggcatgcatgagtctttggcaaca

SEQ ID NO: 454572 - DNA, 25 bp, Rattus norvegicus
gggcatgctaatctttctgacccat

SEQ ID NO: 454573 - DNA, 25 bp, Rattus norvegicus
gggcatgctaatgtttctgacccat

SEQ ID NO: 454574 - DNA, 25 bp, Rattus norvegicus
gggcatgctggaaatgtgcacctct

SEQ ID NO: 454575 - DNA, 25 bp, Rattus norvegicus
gggcatgctggatatgtgcacctct

SEQ ID NO: 454576 - DNA, 25 bp, Rattus norvegicus
gggcatgcttcgcaaactggacatt

SEQ ID NO: 454577 - DNA, 25 bp, Rattus norvegicus
gggcatgcttcggaaactggacatt

SEQ ID NO: 454578 - DNA, 25 bp, Rattus norvegicus
gggcatgctttccaggtagcctcta

SEQ ID NO: 454579 - DNA, 25 bp, Rattus norvegicus
gggcatgctttcgaggtagcctcta

SEQ ID NO: 454580 - DNA, 25 bp, Rattus norvegicus
gggcatgcttttcttatatcccagc

SEQ ID NO: 454581 - DNA, 25 bp, Rattus norvegicus
gggcatgcttttgttatatcccagc

SEQ ID NO: 454582 - DNA, 25 bp, Rattus norvegicus
gggcatggaatacagaccttcaatt

SEQ ID NO: 454583 - DNA, 25 bp, Rattus norvegicus
gggcatggaatagagaccttcaatt

SEQ ID NO: 454584 - DNA, 25 bp, Rattus norvegicus
gggcatggaccccattcgggtcaac

SEQ ID NO: 454585 - DNA, 25 bp, Rattus norvegicus
gggcatggacccgattcgggtcaac

SEQ ID NO: 454586 - DNA, 25 bp, Rattus norvegicus
gggcatggatggcagatactcttca

SEQ ID NO: 454587 - DNA, 25 bp, Rattus norvegicus
gggcatggatgggagatactcttca

SEQ ID NO: 454588 - DNA, 25 bp, Rattus norvegicus
gggcatggccatcattgcacatagt

SEQ ID NO: 454589 - DNA, 25 bp, Rattus norvegicus
gggcatggccatgattgcacatagt

SEQ ID NO: 454590 - DNA, 25 bp, Rattus norvegicus
gggcatggccctaggaaagaacaaa

SEQ ID NO: 454591 - DNA, 25 bp, Rattus norvegicus
gggcatggcccttggaaagaacaaa

SEQ ID NO: 454592 - DNA, 25 bp, Rattus norvegicus
gggcatggcctcatttatatatatc

SEQ ID NO: 454593 - DNA, 25 bp, Rattus norvegicus
gggcatggcctcttttatatatatc

SEQ ID NO: 454594 - DNA, 25 bp, Rattus norvegicus
gggcatggctgacactggaaaatgg

SEQ ID NO: 454595 - DNA, 25 bp, Rattus norvegicus
gggcatggctgagactggaaaatgg

SEQ ID NO: 454596 - DNA, 25 bp, Rattus norvegicus
gggcatggcttgaattagttttatt

SEQ ID NO: 454597 - DNA, 25 bp, Rattus norvegicus
gggcatggcttgtattagttttatt

SEQ ID NO: 454598 - DNA, 25 bp, Rattus norvegicus
gggcatggctttccccacaggtcct

SEQ ID NO: 454599 - DNA, 25 bp, Rattus norvegicus
gggcatggctttgcccacaggtcct

SEQ ID NO: 454600 - DNA, 25 bp, Rattus norvegicus
gggcatgggcacactccaaagaata

SEQ ID NO: 454601 - DNA, 25 bp, Rattus norvegicus
gggcatgggcactctccaaagaata

SEQ ID NO: 454602 - DNA, 25 bp, Rattus norvegicus
gggcatgggcatctcagagttctcc

SEQ ID NO: 454603 - DNA, 25 bp, Rattus norvegicus
gggcatgggcatgtcagagttctcc

SEQ ID NO: 454604 - DNA, 25 bp, Rattus norvegicus
gggcatggtagcaatatctgttatc

SEQ ID NO: 454605 - DNA, 25 bp, Rattus norvegicus
gggcatggtagctatatctgttatc

SEQ ID NO: 454606 - DNA, 25 bp, Rattus norvegicus
gggcatggtcagatctctcacaaaa

SEQ ID NO: 454607 - DNA, 25 bp, Rattus norvegicus
gggcatggtcagttctctcacaaaa

SEQ ID NO: 454608 - DNA, 25 bp, Rattus norvegicus
gggcatggtggccactcttagatta

SEQ ID NO: 454609 - DNA, 25 bp, Rattus norvegicus
gggcatggtggcgactcttagatta

SEQ ID NO: 454610 - DNA, 25 bp, Rattus norvegicus
gggcatgtaggcactggcagtctca

SEQ ID NO: 454611 - DNA, 25 bp, Rattus norvegicus
gggcatgtaggctctggcagtctca

SEQ ID NO: 454612 - DNA, 25 bp, Rattus norvegicus
gggcatgtatagcacttctctgatt

SEQ ID NO: 454613 - DNA, 25 bp, Rattus norvegicus
gggcatgtataggacttctctgatt

SEQ ID NO: 454614 - DNA, 25 bp, Rattus norvegicus
gggcatgtatataatgttcctaggt

SEQ ID NO: 454615 - DNA, 25 bp, Rattus norvegicus
gggcatgtatattatgttcctaggt

SEQ ID NO: 454616 - DNA, 25 bp, Rattus norvegicus
gggcatgtatcacccagtcatcgta

SEQ ID NO: 454617 - DNA, 25 bp, Rattus norvegicus
gggcatgtatcagccagtcatcgta

SEQ ID NO: 454618 - DNA, 25 bp, Rattus norvegicus
gggcatgtatccacttacaaggaaa

SEQ ID NO: 454619 - DNA, 25 bp, Rattus norvegicus
gggcatgtatcctcttacaaggaaa

SEQ ID NO: 454620 - DNA, 25 bp, Rattus norvegicus
gggcatgtccagcaagtacctgtaa

SEQ ID NO: 454621 - DNA, 25 bp, Rattus norvegicus
gggcatgtccaggaagtacctgtaa

SEQ ID NO: 454622 - DNA, 25 bp, Rattus norvegicus
gggcatgtccctataatcagaataa

SEQ ID NO: 454623 - DNA, 25 bp, Rattus norvegicus
gggcatgtccctttaatcagaataa

SEQ ID NO: 454624 - DNA, 25 bp, Rattus norvegicus
gggcatgtctacctcttcagtgaag

SEQ ID NO: 454625 - DNA, 25 bp, Rattus norvegicus
gggcatgtctacgtcttcagtgaag

SEQ ID NO: 454626 - DNA, 25 bp, Rattus norvegicus
gggcatgtcttgacaaggaacttat

SEQ ID NO: 454627 - DNA, 25 bp, Rattus norvegicus
gggcatgtcttgtcaaggaacttat

SEQ ID NO: 454628 - DNA, 25 bp, Rattus norvegicus
gggcatgtgacaccctttgcgttgc

SEQ ID NO: 454629 - DNA, 25 bp, Rattus norvegicus
gggcatgtgacagcctttgcgttgc

SEQ ID NO: 454630 - DNA, 25 bp, Rattus norvegicus
gggcatgtgcagataaatggaccta

SEQ ID NO: 454631 - DNA, 25 bp, Rattus norvegicus
gggcatgtgcagttaaatggaccta

SEQ ID NO: 454632 - DNA, 25 bp, Rattus norvegicus
gggcatgtgtataactctttcttct

SEQ ID NO: 454633 - DNA, 25 bp, Rattus norvegicus
gggcatgtgtattactctttcttct

SEQ ID NO: 454634 - DNA, 25 bp, Rattus norvegicus
gggcatgtgtttcttgtaattcctc

SEQ ID NO: 454635 - DNA, 25 bp, Rattus norvegicus
gggcatgtgtttgttgtaattcctc

SEQ ID NO: 454636 - DNA, 25 bp, Rattus norvegicus
gggcatgttcatcgccctcagtaag

SEQ ID NO: 454637 - DNA, 25 bp, Rattus norvegicus
gggcatgttcatggccctcagtaag

SEQ ID NO: 454638 - DNA, 25 bp, Rattus norvegicus
gggcatgttttaagcccctcagctt

SEQ ID NO: 454639 - DNA, 25 bp, Rattus norvegicus
gggcatgttttatgcccctcagctt

SEQ ID NO: 454640 - DNA, 25 bp, Rattus norvegicus
gggcattaaatgactccttttgtaa

SEQ ID NO: 454641 - DNA, 25 bp, Rattus norvegicus
gggcattaaatgtctccttttgtaa

SEQ ID NO: 454642 - DNA, 25 bp, Rattus norvegicus
gggcattaacacctcaccctagctg

SEQ ID NO: 454643 - DNA, 25 bp, Rattus norvegicus
gggcattaacacgtcaccctagctg

SEQ ID NO: 454644 - DNA, 25 bp, Rattus norvegicus
gggcattaacggacagcaagcaact

SEQ ID NO: 454645 - DNA, 25 bp, Rattus norvegicus
gggcattaacggtcagcaagcaact

SEQ ID NO: 454646 - DNA, 25 bp, Rattus norvegicus
gggcattaagtcatgtgtgttagaa

SEQ ID NO: 454647 - DNA, 25 bp, Rattus norvegicus
gggcattaagtcttgtgtgttagaa

SEQ ID NO: 454648 - DNA, 25 bp, Rattus norvegicus
gggcattacaccatattacacagga

SEQ ID NO: 454649 - DNA, 25 bp, Rattus norvegicus
gggcattacaccttattacacagga

SEQ ID NO: 454650 - DNA, 25 bp, Rattus norvegicus
gggcattacccacatgcttactttt

SEQ ID NO: 454651 - DNA, 25 bp, Rattus norvegicus
gggcattacccagatgcttactttt

SEQ ID NO: 454652 - DNA, 25 bp, Rattus norvegicus
gggcattactcaaaggacttcgtca

SEQ ID NO: 454653 - DNA, 25 bp, Rattus norvegicus
gggcattactcataggacttcgtca

SEQ ID NO: 454654 - DNA, 25 bp, Rattus norvegicus
gggcattacttcaaggatgtcagcc

SEQ ID NO: 454655 - DNA, 25 bp, Rattus norvegicus
gggcattacttctaggatgtcagcc

SEQ ID NO: 454656 - DNA, 25 bp, Rattus norvegicus
gggcattagcaccactgtcctgaag

SEQ ID NO: 454657 - DNA, 25 bp, Rattus norvegicus
gggcattagcacgactgtcctgaag

SEQ ID NO: 454658 - DNA, 25 bp, Rattus norvegicus
gggcattagggaagtcttctcccaa

SEQ ID NO: 454659 - DNA, 25 bp, Rattus norvegicus
gggcattagggatgtcttctcccaa

SEQ ID NO: 454660 - DNA, 25 bp, Rattus norvegicus
gggcattagttccatcttgttttta

SEQ ID NO: 454661 - DNA, 25 bp, Rattus norvegicus
gggcattagttcgatcttgttttta

SEQ ID NO: 454662 - DNA, 25 bp, Rattus norvegicus
gggcattataacaatttagttcggg

SEQ ID NO: 454663 - DNA, 25 bp, Rattus norvegicus
gggcattataactatttagttcggg

SEQ ID NO: 454664 - DNA, 25 bp, Rattus norvegicus
gggcattatcacaccctataccatt

SEQ ID NO: 454665 - DNA, 25 bp, Rattus norvegicus
gggcattatcactccctataccatt

SEQ ID NO: 454666 - DNA, 25 bp, Rattus norvegicus
gggcattatctgaagttaacataac

SEQ ID NO: 454667 - DNA, 25 bp, Rattus norvegicus
gggcattatctgtagttaacataac

SEQ ID NO: 454668 - DNA, 25 bp, Rattus norvegicus
gggcattattcccatgaggtccaga

SEQ ID NO: 454669 - DNA, 25 bp, Rattus norvegicus
gggcattattccgatgaggtccaga

SEQ ID NO: 454670 - DNA, 25 bp, Rattus norvegicus
gggcattatttaaggaccactttta

SEQ ID NO: 454671 - DNA, 25 bp, Rattus norvegicus
gggcattatttatggaccactttta

SEQ ID NO: 454672 - DNA, 25 bp, Rattus norvegicus
gggcattatttcctacttcatttcc

SEQ ID NO: 454673 - DNA, 25 bp, Rattus norvegicus
gggcattatttcgtacttcatttcc

SEQ ID NO: 454674 - DNA, 25 bp, Rattus norvegicus
gggcattcaagtatacatttgggtt

SEQ ID NO: 454675 - DNA, 25 bp, Rattus norvegicus
gggcattcaagtttacatttgggtt

SEQ ID NO: 454676 - DNA, 25 bp, Rattus norvegicus
gggcattcaggcaagaaatctttaa

SEQ ID NO: 454677 - DNA, 25 bp, Rattus norvegicus
gggcattcaggctagaaatctttaa

SEQ ID NO: 454678 - DNA, 25 bp, Rattus norvegicus
gggcattcagttcaaatccgtgtct

SEQ ID NO: 454679 - DNA, 25 bp, Rattus norvegicus
gggcattcagttgaaatccgtgtct

SEQ ID NO: 454680 - DNA, 25 bp, Rattus norvegicus
gggcattccagaaggagccaccaat

SEQ ID NO: 454681 - DNA, 25 bp, Rattus norvegicus
gggcattccagatggagccaccaat

SEQ ID NO: 454682 - DNA, 25 bp, Rattus norvegicus
gggcattccatgcagccttgcggaa

SEQ ID NO: 454683 - DNA, 25 bp, Rattus norvegicus
gggcattccatggagccttgcggaa

SEQ ID NO: 454684 - DNA, 25 bp, Rattus norvegicus
gggcattcccaccactgcagtgcag

SEQ ID NO: 454685 - DNA, 25 bp, Rattus norvegicus
gggcattcccacgactgcagtgcag

SEQ ID NO: 454686 - DNA, 25 bp, Rattus norvegicus
gggcattcctcgaaggattatcaag

SEQ ID NO: 454687 - DNA, 25 bp, Rattus norvegicus
gggcattcctcgtaggattatcaag

SEQ ID NO: 454688 - DNA, 25 bp, Rattus norvegicus
gggcattcctggctgcccgtccttg

SEQ ID NO: 454689 - DNA, 25 bp, Rattus norvegicus
gggcattcctgggtgcccgtccttg

SEQ ID NO: 454690 - DNA, 25 bp, Rattus norvegicus
gggcattcctgtaaagaacacttgg

SEQ ID NO: 454691 - DNA, 25 bp, Rattus norvegicus
gggcattcctgttaagaacacttgg

SEQ ID NO: 454692 - DNA, 25 bp, Rattus norvegicus
gggcattctcataaaagggttcttg

SEQ ID NO: 454693 - DNA, 25 bp, Rattus norvegicus
gggcattctcattaaagggttcttg

SEQ ID NO: 454694 - DNA, 25 bp, Rattus norvegicus
gggcattctgagagtcttgagatct

SEQ ID NO: 454695 - DNA, 25 bp, Rattus norvegicus
gggcattctgagctaacctcttttc

SEQ ID NO: 454696 - DNA, 25 bp, Rattus norvegicus
gggcattctgaggtaacctcttttc

SEQ ID NO: 454697 - DNA, 25 bp, Rattus norvegicus
gggcattctgagtgtcttgagatct

SEQ ID NO: 454698 - DNA, 25 bp, Rattus norvegicus
gggcattctgctacttttttgttaa

SEQ ID NO: 454699 - DNA, 25 bp, Rattus norvegicus
gggcattctgctatgtttcagtgtc

SEQ ID NO: 454700 - DNA, 25 bp, Rattus norvegicus
gggcattctgcttcttttttgttaa

SEQ ID NO: 454701 - DNA, 25 bp, Rattus norvegicus
gggcattctgctttgtttcagtgtc

SEQ ID NO: 454702 - DNA, 25 bp, Rattus norvegicus
gggcattcttacaggtcagttggat

SEQ ID NO: 454703 - DNA, 25 bp, Rattus norvegicus
gggcattcttactggtcagttggat

SEQ ID NO: 454704 - DNA, 25 bp, Rattus norvegicus
gggcattcttgtaatagacctagga

SEQ ID NO: 454705 - DNA, 25 bp, Rattus norvegicus
gggcattcttgttatagacctagga

SEQ ID NO: 454706 - DNA, 25 bp, Rattus norvegicus
gggcattgaagtagcatggactgat

SEQ ID NO: 454707 - DNA, 25 bp, Rattus norvegicus
gggcattgaagttgcatggactgat

SEQ ID NO: 454708 - DNA, 25 bp, Rattus norvegicus
gggcattgaccacggaccagtaaac

SEQ ID NO: 454709 - DNA, 25 bp, Rattus norvegicus
gggcattgaccagggaccagtaaac

SEQ ID NO: 454710 - DNA, 25 bp, Rattus norvegicus
gggcattgatttagttctgctttca

SEQ ID NO: 454711 - DNA, 25 bp, Rattus norvegicus
gggcattgattttgttctgctttca

SEQ ID NO: 454712 - DNA, 25 bp, Rattus norvegicus
gggcattgcccgacagtctgcaaaa

SEQ ID NO: 454713 - DNA, 25 bp, Rattus norvegicus
gggcattgcccgtcagtctgcaaaa

SEQ ID NO: 454714 - DNA, 25 bp, Rattus norvegicus
gggcattggcttagttagccagctt

SEQ ID NO: 454715 - DNA, 25 bp, Rattus norvegicus
gggcattggctttgttagccagctt

SEQ ID NO: 454716 - DNA, 25 bp, Rattus norvegicus
gggcattgggcaacacataggaacg

SEQ ID NO: 454717 - DNA, 25 bp, Rattus norvegicus
gggcattgggcatcacataggaacg

SEQ ID NO: 454718 - DNA, 25 bp, Rattus norvegicus
gggcattggtctacttgctgtcatc

SEQ ID NO: 454719 - DNA, 25 bp, Rattus norvegicus
gggcattggtcttcttgctgtcatc

SEQ ID NO: 454720 - DNA, 25 bp, Rattus norvegicus
gggcattgtagaaccatatccacca

SEQ ID NO: 454721 - DNA, 25 bp, Rattus norvegicus
gggcattgtagatccatatccacca

SEQ ID NO: 454722 - DNA, 25 bp, Rattus norvegicus
gggcattgtatgaatccacgagaaa

SEQ ID NO: 454723 - DNA, 25 bp, Rattus norvegicus
gggcattgtatgtatccacgagaaa

SEQ ID NO: 454724 - DNA, 25 bp, Rattus norvegicus
gggcattgtattaacctatgtactg

SEQ ID NO: 454725 - DNA, 25 bp, Rattus norvegicus
gggcattgtatttacctatgtactg

SEQ ID NO: 454726 - DNA, 25 bp, Rattus norvegicus
gggcattgtgaactcacttacacga

SEQ ID NO: 454727 - DNA, 25 bp, Rattus norvegicus
gggcattgtgaagtcacttacacga

SEQ ID NO: 454728 - DNA, 25 bp, Rattus norvegicus
gggcatttaatccataagagtcaac

SEQ ID NO: 454729 - DNA, 25 bp, Rattus norvegicus
gggcatttaatcgataagagtcaac

SEQ ID NO: 454730 - DNA, 25 bp, Rattus norvegicus
gggcatttatgcaccaggctggaag

SEQ ID NO: 454731 - DNA, 25 bp, Rattus norvegicus
gggcatttatgctccaggctggaag

SEQ ID NO: 454732 - DNA, 25 bp, Rattus norvegicus
gggcatttcacaacaacactaaaat

SEQ ID NO: 454733 - DNA, 25 bp, Rattus norvegicus
gggcatttcacatcaacactaaaat

SEQ ID NO: 454734 - DNA, 25 bp, Rattus norvegicus
gggcatttccagagaggcttaactg

SEQ ID NO: 454735 - DNA, 25 bp, Rattus norvegicus
gggcatttccagtgaggcttaactg

SEQ ID NO: 454736 - DNA, 25 bp, Rattus norvegicus
gggcatttcgccaaacaatactgtg

SEQ ID NO: 454737 - DNA, 25 bp, Rattus norvegicus
gggcatttcgcctaacaatactgtg

SEQ ID NO: 454738 - DNA, 25 bp, Rattus norvegicus
gggcatttcggtagcaaaagtcaaa

SEQ ID NO: 454739 - DNA, 25 bp, Rattus norvegicus
gggcatttcggttgcaaaagtcaaa

SEQ ID NO: 454740 - DNA, 25 bp, Rattus norvegicus
gggcatttctagatacgtttcctct

SEQ ID NO: 454741 - DNA, 25 bp, Rattus norvegicus
gggcatttctagttacgtttcctct

SEQ ID NO: 454742 - DNA, 25 bp, Rattus norvegicus
gggcatttgcaaagcacatacagtt

SEQ ID NO: 454743 - DNA, 25 bp, Rattus norvegicus
gggcatttgcaatgcacatacagtt

SEQ ID NO: 454744 - DNA, 25 bp, Rattus norvegicus
gggcatttgcttcctgaaccaacac

SEQ ID NO: 454745 - DNA, 25 bp, Rattus norvegicus
gggcatttgcttgctgaaccaacac

SEQ ID NO: 454746 - DNA, 25 bp, Rattus norvegicus
gggcatttgtctatcagtcttcaat

SEQ ID NO: 454747 - DNA, 25 bp, Rattus norvegicus
gggcatttgtctttcagtcttcaat

SEQ ID NO: 454748 - DNA, 25 bp, Rattus norvegicus
gggcatttgttcaatgggctttgaa

SEQ ID NO: 454749 - DNA, 25 bp, Rattus norvegicus
gggcatttgttctatgggctttgaa

SEQ ID NO: 454750 - DNA, 25 bp, Rattus norvegicus
gggcattttctcactttggtcagtc

SEQ ID NO: 454751 - DNA, 25 bp, Rattus norvegicus
gggcattttctctctttggtcagtc

SEQ ID NO: 454752 - DNA, 25 bp, Rattus norvegicus
gggcattttgatattacctcattcc

SEQ ID NO: 454753 - DNA, 25 bp, Rattus norvegicus
gggcattttgattttacctcattcc

SEQ ID NO: 454754 - DNA, 25 bp, Rattus norvegicus
gggcattttgtgatggctggagctg

SEQ ID NO: 454755 - DNA, 25 bp, Rattus norvegicus
gggcattttgtgttggctggagctg

SEQ ID NO: 454756 - DNA, 25 bp, Rattus norvegicus
gggcatttttccagttcattgacac

SEQ ID NO: 454757 - DNA, 25 bp, Rattus norvegicus
gggcatttttcctgttcattgacac

SEQ ID NO: 454758 - DNA, 25 bp, Rattus norvegicus
gggccaaaacatatcactgagtcag

SEQ ID NO: 454759 - DNA, 25 bp, Rattus norvegicus
gggccaaaacatttcactgagtcag

SEQ ID NO: 454760 - DNA, 25 bp, Rattus norvegicus
gggccaaaacccacctgaagacact

SEQ ID NO: 454761 - DNA, 25 bp, Rattus norvegicus
gggccaaaaccctcctgaagacact

SEQ ID NO: 454762 - DNA, 25 bp, Rattus norvegicus
gggccaaaacctcgaagtcaaagat

SEQ ID NO: 454763 - DNA, 25 bp, Rattus norvegicus
gggccaaaacctggaagtcaaagat

SEQ ID NO: 454764 - DNA, 25 bp, Rattus norvegicus
gggccaaaactgcaggcacatgttt

SEQ ID NO: 454765 - DNA, 25 bp, Rattus norvegicus
gggccaaaactggaggcacatgttt

SEQ ID NO: 454766 - DNA, 25 bp, Rattus norvegicus
gggccaaaagggacatcatctccgc

SEQ ID NO: 454767 - DNA, 25 bp, Rattus norvegicus
gggccaaaagggtcatcatctccgc

SEQ ID NO: 454768 - DNA, 25 bp, Rattus norvegicus
gggccaaaatgtaaggtctatgtct

SEQ ID NO: 454769 - DNA, 25 bp, Rattus norvegicus
gggccaaaatgttaggtctatgtct

SEQ ID NO: 454770 - DNA, 25 bp, Rattus norvegicus
gggccaaacacgctgctcaacttaa

SEQ ID NO: 454771 - DNA, 25 bp, Rattus norvegicus
gggccaaacacggtgctcaacttaa

SEQ ID NO: 454772 - DNA, 25 bp, Rattus norvegicus
gggccaaacattatacactcttaat

SEQ ID NO: 454773 - DNA, 25 bp, Rattus norvegicus
gggccaaacattttacactcttaat

SEQ ID NO: 454774 - DNA, 25 bp, Rattus norvegicus
gggccaaaccaaagacacatgcagt

SEQ ID NO: 454775 - DNA, 25 bp, Rattus norvegicus
gggccaaaccaatgacacatgcagt

SEQ ID NO: 454776 - DNA, 25 bp, Rattus norvegicus
gggccaaacggcacaacatctattc

SEQ ID NO: 454777 - DNA, 25 bp, Rattus norvegicus
gggccaaacggctcaacatctattc

SEQ ID NO: 454778 - DNA, 25 bp, Rattus norvegicus
gggccaaagagtcgcgcgcttttaa

SEQ ID NO: 454779 - DNA, 25 bp, Rattus norvegicus
gggccaaagagtggcgcgcttttaa

SEQ ID NO: 454780 - DNA, 25 bp, Rattus norvegicus
gggccaaagatactctgcaggtgca

SEQ ID NO: 454781 - DNA, 25 bp, Rattus norvegicus
gggccaaagatagtctgcaggtgca

SEQ ID NO: 454782 - DNA, 25 bp, Rattus norvegicus
gggccaaagatccagccttgtcatt

SEQ ID NO: 454783 - DNA, 25 bp, Rattus norvegicus
gggccaaagatcgagccttgtcatt

SEQ ID NO: 454784 - DNA, 25 bp, Rattus norvegicus
gggccaaagcctatgtcctgaacag

SEQ ID NO: 454785 - DNA, 25 bp, Rattus norvegicus
gggccaaagcctttgtcctgaacag

SEQ ID NO: 454786 - DNA, 25 bp, Rattus norvegicus
gggccaaagctgatcacatctgtgt

SEQ ID NO: 454787 - DNA, 25 bp, Rattus norvegicus
gggccaaagctgttcacatctgtgt

SEQ ID NO: 454788 - DNA, 25 bp, Rattus norvegicus
gggccaaatagcaccacatctagac

SEQ ID NO: 454789 - DNA, 25 bp, Rattus norvegicus
gggccaaatagctccacatctagac

SEQ ID NO: 454790 - DNA, 25 bp, Rattus norvegicus
gggccaacagctcgtaaactgtgat

SEQ ID NO: 454791 - DNA, 25 bp, Rattus norvegicus
gggccaacagctggtaaactgtgat

SEQ ID NO: 454792 - DNA, 25 bp, Rattus norvegicus
gggccaacataaaacctcacgttct

SEQ ID NO: 454793 - DNA, 25 bp, Rattus norvegicus
gggccaacataaatgccttttcttg

SEQ ID NO: 454794 - DNA, 25 bp, Rattus norvegicus
gggccaacataatacctcacgttct

SEQ ID NO: 454795 - DNA, 25 bp, Rattus norvegicus
gggccaacataattgccttttcttg

SEQ ID NO: 454796 - DNA, 25 bp, Rattus norvegicus
gggccaaccagtcaccaagaccatg

SEQ ID NO: 454797 - DNA, 25 bp, Rattus norvegicus
gggccaaccagtgaccaagaccatg

SEQ ID NO: 454798 - DNA, 25 bp, Rattus norvegicus
gggccaaccatccaggacctgagga

SEQ ID NO: 454799 - DNA, 25 bp, Rattus norvegicus
gggccaaccatcgaggacctgagga

SEQ ID NO: 454800 - DNA, 25 bp, Rattus norvegicus
gggccaacctcaaggacattattag

SEQ ID NO: 454801 - DNA, 25 bp, Rattus norvegicus
gggccaacctcatggacattattag

SEQ ID NO: 454802 - DNA, 25 bp, Rattus norvegicus
gggccaactatcaaattccgagaat

SEQ ID NO: 454803 - DNA, 25 bp, Rattus norvegicus
gggccaactatctaattccgagaat

SEQ ID NO: 454804 - DNA, 25 bp, Rattus norvegicus
gggccaactctactttctctttgcc

SEQ ID NO: 454805 - DNA, 25 bp, Rattus norvegicus
gggccaactctagtttctctttgcc

SEQ ID NO: 454806 - DNA, 25 bp, Rattus norvegicus
gggccaacttcaaatactttgataa

SEQ ID NO: 454807 - DNA, 25 bp, Rattus norvegicus
gggccaacttcatatactttgataa

SEQ ID NO: 454808 - DNA, 25 bp, Rattus norvegicus
gggccaactttgatcacagttccaa

SEQ ID NO: 454809 - DNA, 25 bp, Rattus norvegicus
gggccaactttgttcacagttccaa

SEQ ID NO: 454810 - DNA, 25 bp, Rattus norvegicus
gggccaagaaccaactgctgacgga

SEQ ID NO: 454811 - DNA, 25 bp, Rattus norvegicus
gggccaagaacctactgctgacgga

SEQ ID NO: 454812 - DNA, 25 bp, Rattus norvegicus
gggccaagagatcagccaggcttca

SEQ ID NO: 454813 - DNA, 25 bp, Rattus norvegicus
gggccaagagatgagccaggcttca

SEQ ID NO: 454814 - DNA, 25 bp, Rattus norvegicus
gggccaagcaaaagagctcaccttt

SEQ ID NO: 454815 - DNA, 25 bp, Rattus norvegicus
gggccaagcaaatgagctcaccttt

SEQ ID NO: 454816 - DNA, 25 bp, Rattus norvegicus
gggccaagcagaactagtagaaaaa

SEQ ID NO: 454817 - DNA, 25 bp, Rattus norvegicus
gggccaagcagatctagtagaaaaa

SEQ ID NO: 454818 - DNA, 25 bp, Rattus norvegicus
gggccaagctccatgcaagggtgac

SEQ ID NO: 454819 - DNA, 25 bp, Rattus norvegicus
gggccaagctccttgcaagggtgac

SEQ ID NO: 454820 - DNA, 25 bp, Rattus norvegicus
gggccaagctgacctcaaagtcttt

SEQ ID NO: 454821 - DNA, 25 bp, Rattus norvegicus
gggccaagctgagctcaaagtcttt

SEQ ID NO: 454822 - DNA, 25 bp, Rattus norvegicus
gggccaaggaccagagtgtctctca

SEQ ID NO: 454823 - DNA, 25 bp, Rattus norvegicus
gggccaaggacctgagtgtctctca

SEQ ID NO: 454824 - DNA, 25 bp, Rattus norvegicus
gggccaagggcaagcatcgcagcta

SEQ ID NO: 454825 - DNA, 25 bp, Rattus norvegicus
gggccaagggcatgcatcgcagcta

SEQ ID NO: 454826 - DNA, 25 bp, Rattus norvegicus
gggccaaggtatacagcggactgat

SEQ ID NO: 454827 - DNA, 25 bp, Rattus norvegicus
gggccaaggtattcagcggactgat

SEQ ID NO: 454828 - DNA, 25 bp, Rattus norvegicus
gggccaaggtgtaggaacgtcacat

SEQ ID NO: 454829 - DNA, 25 bp, Rattus norvegicus
gggccaaggtgtatccaacaggatt

SEQ ID NO: 454830 - DNA, 25 bp, Rattus norvegicus
gggccaaggtgttggaacgtcacat

SEQ ID NO: 454831 - DNA, 25 bp, Rattus norvegicus
gggccaaggtgtttccaacaggatt

SEQ ID NO: 454832 - DNA, 25 bp, Rattus norvegicus
gggccaagtactacatccgggatga

SEQ ID NO: 454833 - DNA, 25 bp, Rattus norvegicus
gggccaagtacttcatccgggatga

SEQ ID NO: 454834 - DNA, 25 bp, Rattus norvegicus
gggccaagtagcagaaccgtctttc

SEQ ID NO: 454835 - DNA, 25 bp, Rattus norvegicus
gggccaagtagctgaaccgtctttc

SEQ ID NO: 454836 - DNA, 25 bp, Rattus norvegicus
gggccaatagcccagagtactccac

SEQ ID NO: 454837 - DNA, 25 bp, Rattus norvegicus
gggccaatagccgagagtactccac

SEQ ID NO: 454838 - DNA, 25 bp, Rattus norvegicus
gggccaatagtgatgcctccagtac

SEQ ID NO: 454839 - DNA, 25 bp, Rattus norvegicus
gggccaatagtgttgcctccagtac

SEQ ID NO: 454840 - DNA, 25 bp, Rattus norvegicus
gggccaatggctaatacctacaacc

SEQ ID NO: 454841 - DNA, 25 bp, Rattus norvegicus
gggccaatggcttatacctacaacc

SEQ ID NO: 454842 - DNA, 25 bp, Rattus norvegicus
gggccaattaaaaagcattctaact

SEQ ID NO: 454843 - DNA, 25 bp, Rattus norvegicus
gggccaattaaatagcattctaact

SEQ ID NO: 454844 - DNA, 25 bp, Rattus norvegicus
gggccaattcaaacacacttagaag

SEQ ID NO: 454845 - DNA, 25 bp, Rattus norvegicus
gggccaattcaatcacacttagaag

SEQ ID NO: 454846 - DNA, 25 bp, Rattus norvegicus
gggccaattcacagcaagtgcagga

SEQ ID NO: 454847 - DNA, 25 bp, Rattus norvegicus
gggccaattcactgcaagtgcagga

SEQ ID NO: 454848 - DNA, 25 bp, Rattus norvegicus
gggccaattcataagctgaagacct

SEQ ID NO: 454849 - DNA, 25 bp, Rattus norvegicus
gggccaattcattagctgaagacct

SEQ ID NO: 454850 - DNA, 25 bp, Rattus norvegicus
gggccaattccaatcataatacgaa

SEQ ID NO: 454851 - DNA, 25 bp, Rattus norvegicus
gggccaattccattcataatacgaa

SEQ ID NO: 454852 - DNA, 25 bp, Rattus norvegicus
gggccacaactcaaaattcttgcag

SEQ ID NO: 454853 - DNA, 25 bp, Rattus norvegicus
gggccacaactctaaattcttgcag

SEQ ID NO: 454854 - DNA, 25 bp, Rattus norvegicus
gggccacaagaacgctcagttgaag

SEQ ID NO: 454855 - DNA, 25 bp, Rattus norvegicus
gggccacaagaaggctcagttgaag

SEQ ID NO: 454856 - DNA, 25 bp, Rattus norvegicus
gggccacaagcaaatgccattttaa

SEQ ID NO: 454857 - DNA, 25 bp, Rattus norvegicus
gggccacaagcatatgccattttaa

SEQ ID NO: 454858 - DNA, 25 bp, Rattus norvegicus
gggccacaagccaggacggaacacc

SEQ ID NO: 454859 - DNA, 25 bp, Rattus norvegicus
gggccacaagcctggacggaacacc

SEQ ID NO: 454860 - DNA, 25 bp, Rattus norvegicus
gggccacaagcgagaggacgccacc

SEQ ID NO: 454861 - DNA, 25 bp, Rattus norvegicus
gggccacaagcgtgaggacgccacc

SEQ ID NO: 454862 - DNA, 25 bp, Rattus norvegicus
gggccacacaagaggaatacgtttc

SEQ ID NO: 454863 - DNA, 25 bp, Rattus norvegicus
gggccacacaagtggaatacgtttc

SEQ ID NO: 454864 - DNA, 25 bp, Rattus norvegicus
gggccacacactacaagaaattcac

SEQ ID NO: 454865 - DNA, 25 bp, Rattus norvegicus
gggccacacacttcaagaaattcac

SEQ ID NO: 454866 - DNA, 25 bp, Rattus norvegicus
gggccacacagcaggcgcacagtag

SEQ ID NO: 454867 - DNA, 25 bp, Rattus norvegicus
gggccacacagctggcgcacagtag

SEQ ID NO: 454868 - DNA, 25 bp, Rattus norvegicus
gggccacaccatatttaagtctttg

SEQ ID NO: 454869 - DNA, 25 bp, Rattus norvegicus
gggccacaccatttttaagtctttg

SEQ ID NO: 454870 - DNA, 25 bp, Rattus norvegicus
gggccacaccgaaagtttagctaag

SEQ ID NO: 454871 - DNA, 25 bp, Rattus norvegicus
gggccacaccgatagtttagctaag

SEQ ID NO: 454872 - DNA, 25 bp, Rattus norvegicus
gggccacaccgtccaggctgtgttc

SEQ ID NO: 454873 - DNA, 25 bp, Rattus norvegicus
gggccacaccgtgcaggctgtgttc

SEQ ID NO: 454874 - DNA, 25 bp, Rattus norvegicus
gggccacactacatcgtcagtataa

SEQ ID NO: 454875 - DNA, 25 bp, Rattus norvegicus
gggccacactacttcgtcagtataa

SEQ ID NO: 454876 - DNA, 25 bp, Rattus norvegicus
gggccacactgaagtctgattttac

SEQ ID NO: 454877 - DNA, 25 bp, Rattus norvegicus
gggccacactgatgtctgattttac

SEQ ID NO: 454878 - DNA, 25 bp, Rattus norvegicus
gggccacactgtacatttgtctgtc

SEQ ID NO: 454879 - DNA, 25 bp, Rattus norvegicus
gggccacactgttcatttgtctgtc

SEQ ID NO: 454880 - DNA, 25 bp, Rattus norvegicus
gggccacagaaacctcttccagaag

SEQ ID NO: 454881 - DNA, 25 bp, Rattus norvegicus
gggccacagaaagctcttccagaag

SEQ ID NO: 454882 - DNA, 25 bp, Rattus norvegicus
gggccacagcatatgatttcctaat

SEQ ID NO: 454883 - DNA, 25 bp, Rattus norvegicus
gggccacagcatttgatttcctaat

SEQ ID NO: 454884 - DNA, 25 bp, Rattus norvegicus
gggccacagccgatatcttatacga

SEQ ID NO: 454885 - DNA, 25 bp, Rattus norvegicus
gggccacagccgttatcttatacga

SEQ ID NO: 454886 - DNA, 25 bp, Rattus norvegicus
gggccacagcttctaataatgccac

SEQ ID NO: 454887 - DNA, 25 bp, Rattus norvegicus
gggccacagcttgtaataatgccac

SEQ ID NO: 454888 - DNA, 25 bp, Rattus norvegicus
gggccacagggcaaaatcgccatag

SEQ ID NO: 454889 - DNA, 25 bp, Rattus norvegicus
gggccacagggctaaatcgccatag

SEQ ID NO: 454890 - DNA, 25 bp, Rattus norvegicus
gggccacatagacaaccgcagattg

SEQ ID NO: 454891 - DNA, 25 bp, Rattus norvegicus
gggccacatagagaaccgcagattg

SEQ ID NO: 454892 - DNA, 25 bp, Rattus norvegicus
gggccacatatcactgtgctggcgc

SEQ ID NO: 454893 - DNA, 25 bp, Rattus norvegicus
gggccacatatctctgtgctggcgc

SEQ ID NO: 454894 - DNA, 25 bp, Rattus norvegicus
gggccacatcagagactttcagcaa

SEQ ID NO: 454895 - DNA, 25 bp, Rattus norvegicus
gggccacatcagtgactttcagcaa

SEQ ID NO: 454896 - DNA, 25 bp, Rattus norvegicus
gggccacattccagctgacttcagt

SEQ ID NO: 454897 - DNA, 25 bp, Rattus norvegicus
gggccacattcctgctgacttcagt

SEQ ID NO: 454898 - DNA, 25 bp, Rattus norvegicus
gggccacattggaatgatctctgct

SEQ ID NO: 454899 - DNA, 25 bp, Rattus norvegicus
gggccacattggtatgatctctgct

SEQ ID NO: 454900 - DNA, 25 bp, Rattus norvegicus
gggccaccacctcggcaaggaattc

SEQ ID NO: 454901 - DNA, 25 bp, Rattus norvegicus
gggccaccacctgggcaaggaattc

SEQ ID NO: 454902 - DNA, 25 bp, Rattus norvegicus
gggccaccagacactgcagaattaa

SEQ ID NO: 454903 - DNA, 25 bp, Rattus norvegicus
gggccaccagactctgcagaattaa

SEQ ID NO: 454904 - DNA, 25 bp, Rattus norvegicus
gggccaccaggtacccacaggaagg

SEQ ID NO: 454905 - DNA, 25 bp, Rattus norvegicus
gggccaccaggttcccacaggaagg

SEQ ID NO: 454906 - DNA, 25 bp, Rattus norvegicus
gggccaccattgaggaggctcttga

SEQ ID NO: 454907 - DNA, 25 bp, Rattus norvegicus
gggccaccattgtggaggctcttga

SEQ ID NO: 454908 - DNA, 25 bp, Rattus norvegicus
gggccaccctgaagtacagctacaa

SEQ ID NO: 454909 - DNA, 25 bp, Rattus norvegicus
gggccaccctgatgtacagctacaa

SEQ ID NO: 454910 - DNA, 25 bp, Rattus norvegicus
gggccaccgagaactcagctatgtg

SEQ ID NO: 454911 - DNA, 25 bp, Rattus norvegicus
gggccaccgagatctcagctatgtg

SEQ ID NO: 454912 - DNA, 25 bp, Rattus norvegicus
gggccaccgatccatcaaaatcagg

SEQ ID NO: 454913 - DNA, 25 bp, Rattus norvegicus
gggccaccgatcgatcaaaatcagg

SEQ ID NO: 454914 - DNA, 25 bp, Rattus norvegicus
gggccacctccccttgttctgtggg

SEQ ID NO: 454915 - DNA, 25 bp, Rattus norvegicus
gggccacctcccgttgttctgtggg

SEQ ID NO: 454916 - DNA, 25 bp, Rattus norvegicus
gggccacctcttaatctagacagaa

SEQ ID NO: 454917 - DNA, 25 bp, Rattus norvegicus
gggccacctctttatctagacagaa

SEQ ID NO: 454918 - DNA, 25 bp, Rattus norvegicus
gggccacctggaaagtagtctcctg

SEQ ID NO: 454919 - DNA, 25 bp, Rattus norvegicus
gggccacctggatagtagtctcctg

SEQ ID NO: 454920 - DNA, 25 bp, Rattus norvegicus
gggccaccttctatctcaataagtg

SEQ ID NO: 454921 - DNA, 25 bp, Rattus norvegicus
gggccaccttctttctcaataagtg

SEQ ID NO: 454922 - DNA, 25 bp, Rattus norvegicus
gggccacgagtaatttaagattctt

SEQ ID NO: 454923 - DNA, 25 bp, Rattus norvegicus
gggccacgagtattttaagattctt

SEQ ID NO: 454924 - DNA, 25 bp, Rattus norvegicus
gggccacgagtgcagacaccagact

SEQ ID NO: 454925 - DNA, 25 bp, Rattus norvegicus
gggccacgagtggagacaccagact

SEQ ID NO: 454926 - DNA, 25 bp, Rattus norvegicus
gggccacgatgcagtcatagttaag

SEQ ID NO: 454927 - DNA, 25 bp, Rattus norvegicus
gggccacgatgctgtcatagttaag

SEQ ID NO: 454928 - DNA, 25 bp, Rattus norvegicus
gggccacggttgaacggacacctca

SEQ ID NO: 454929 - DNA, 25 bp, Rattus norvegicus
gggccacggttgtacggacacctca

SEQ ID NO: 454930 - DNA, 25 bp, Rattus norvegicus
gggccacgtgcaccaacaacaaact

SEQ ID NO: 454931 - DNA, 25 bp, Rattus norvegicus
gggccacgtgcagcaacaacaaact

SEQ ID NO: 454932 - DNA, 25 bp, Rattus norvegicus
gggccacgtgtgatggatgcgggag

SEQ ID NO: 454933 - DNA, 25 bp, Rattus norvegicus
gggccacgtgtgttggatgcgggag

SEQ ID NO: 454934 - DNA, 25 bp, Rattus norvegicus
gggccacgttgtatgtattgatgta

SEQ ID NO: 454935 - DNA, 25 bp, Rattus norvegicus
gggccacgttgtttgtattgatgta

SEQ ID NO: 454936 - DNA, 25 bp, Rattus norvegicus
gggccactaactcccacatgtagca

SEQ ID NO: 454937 - DNA, 25 bp, Rattus norvegicus
gggccactaactgccacatgtagca

SEQ ID NO: 454938 - DNA, 25 bp, Rattus norvegicus
gggccactagcaccttgtttgtgtc

SEQ ID NO: 454939 - DNA, 25 bp, Rattus norvegicus
gggccactagcagcttgtttgtgtc

SEQ ID NO: 454940 - DNA, 25 bp, Rattus norvegicus
gggccactatggcaaattgaaacag

SEQ ID NO: 454941 - DNA, 25 bp, Rattus norvegicus
gggccactatgggaaattgaaacag

SEQ ID NO: 454942 - DNA, 25 bp, Rattus norvegicus
gggccactcaagagggctcagctat

SEQ ID NO: 454943 - DNA, 25 bp, Rattus norvegicus
gggccactcaagtgggctcagctat

SEQ ID NO: 454944 - DNA, 25 bp, Rattus norvegicus
gggccactctaaataagactccatg

SEQ ID NO: 454945 - DNA, 25 bp, Rattus norvegicus
gggccactctaattaagactccatg

SEQ ID NO: 454946 - DNA, 25 bp, Rattus norvegicus
gggccactctcgactggagtactaa

SEQ ID NO: 454947 - DNA, 25 bp, Rattus norvegicus
gggccactctcgtctggagtactaa

SEQ ID NO: 454948 - DNA, 25 bp, Rattus norvegicus
gggccactctgacaaggagccatgt

SEQ ID NO: 454949 - DNA, 25 bp, Rattus norvegicus
gggccactctgagaaggagccatgt

SEQ ID NO: 454950 - DNA, 25 bp, Rattus norvegicus
gggccactgaaacgatatcttgctt

SEQ ID NO: 454951 - DNA, 25 bp, Rattus norvegicus
gggccactgaaaggatatcttgctt

SEQ ID NO: 454952 - DNA, 25 bp, Rattus norvegicus
gggccactgcagatcggactgtcag

SEQ ID NO: 454953 - DNA, 25 bp, Rattus norvegicus
gggccactgcagatcttagtgcaga

SEQ ID NO: 454954 - DNA, 25 bp, Rattus norvegicus
gggccactgcagttcggactgtcag

SEQ ID NO: 454955 - DNA, 25 bp, Rattus norvegicus
gggccactgcagttcttagtgcaga

SEQ ID NO: 454956 - DNA, 25 bp, Rattus norvegicus
gggccactgccgagttagtgctaaa

SEQ ID NO: 454957 - DNA, 25 bp, Rattus norvegicus
gggccactgccgtgttagtgctaaa

SEQ ID NO: 454958 - DNA, 25 bp, Rattus norvegicus
gggccactggacactctgcagagca

SEQ ID NO: 454959 - DNA, 25 bp, Rattus norvegicus
gggccactggactctctgcagagca

SEQ ID NO: 454960 - DNA, 25 bp, Rattus norvegicus
gggccactgggccaaagttttgctt

SEQ ID NO: 454961 - DNA, 25 bp, Rattus norvegicus
gggccactgggcgaaagttttgctt

SEQ ID NO: 454962 - DNA, 25 bp, Rattus norvegicus
gggccactgtttagggcaactgcct

SEQ ID NO: 454963 - DNA, 25 bp, Rattus norvegicus
gggccactgttttgggcaactgcct

SEQ ID NO: 454964 - DNA, 25 bp, Rattus norvegicus
gggccacttaagatttcacacacgg

SEQ ID NO: 454965 - DNA, 25 bp, Rattus norvegicus
gggccacttaagttttcacacacgg

SEQ ID NO: 454966 - DNA, 25 bp, Rattus norvegicus
gggccacttagtatcacagcctttc

SEQ ID NO: 454967 - DNA, 25 bp, Rattus norvegicus
gggccacttagtttcacagcctttc

SEQ ID NO: 454968 - DNA, 25 bp, Rattus norvegicus
gggccacttcataatgtttctatat

SEQ ID NO: 454969 - DNA, 25 bp, Rattus norvegicus
gggccacttcattatgtttctatat

SEQ ID NO: 454970 - DNA, 25 bp, Rattus norvegicus
gggccacttcctcaatagcactata

SEQ ID NO: 454971 - DNA, 25 bp, Rattus norvegicus
gggccacttcctgaatagcactata

SEQ ID NO: 454972 - DNA, 25 bp, Rattus norvegicus
gggccacttgtgacttgaactgttg

SEQ ID NO: 454973 - DNA, 25 bp, Rattus norvegicus
gggccacttgtgtcttgaactgttg

SEQ ID NO: 454974 - DNA, 25 bp, Rattus norvegicus
gggccacttgttaagcaattggttt

SEQ ID NO: 454975 - DNA, 25 bp, Rattus norvegicus
gggccacttgtttagcaattggttt

SEQ ID NO: 454976 - DNA, 25 bp, Rattus norvegicus
gggccactttggacctatcaacagt

SEQ ID NO: 454977 - DNA, 25 bp, Rattus norvegicus
gggccactttggtcctatcaacagt

SEQ ID NO: 454978 - DNA, 25 bp, Rattus norvegicus
gggccactttgtatagcagctgcag

SEQ ID NO: 454979 - DNA, 25 bp, Rattus norvegicus
gggccactttgtttagcagctgcag

SEQ ID NO: 454980 - DNA, 25 bp, Rattus norvegicus
gggccacttttcagtcctgtggagc

SEQ ID NO: 454981 - DNA, 25 bp, Rattus norvegicus
gggccacttttctgtcctgtggagc

SEQ ID NO: 454982 - DNA, 25 bp, Rattus norvegicus
gggccagaaatacaaggtcagtgaa

SEQ ID NO: 454983 - DNA, 25 bp, Rattus norvegicus
gggccagaaatagaaggtcagtgaa

SEQ ID NO: 454984 - DNA, 25 bp, Rattus norvegicus
gggccagaacacatgaccaatcgtc

SEQ ID NO: 454985 - DNA, 25 bp, Rattus norvegicus
gggccagaacacttgaccaatcgtc

SEQ ID NO: 454986 - DNA, 25 bp, Rattus norvegicus
gggccagaaccactagaccagcagc

SEQ ID NO: 454987 - DNA, 25 bp, Rattus norvegicus
gggccagaaccagtagaccagcagc

SEQ ID NO: 454988 - DNA, 25 bp, Rattus norvegicus
gggccagaactgatctctgtctcag

SEQ ID NO: 454989 - DNA, 25 bp, Rattus norvegicus
gggccagaactgttctctgtctcag

SEQ ID NO: 454990 - DNA, 25 bp, Rattus norvegicus
gggccagacaacactatttttacct

SEQ ID NO: 454991 - DNA, 25 bp, Rattus norvegicus
gggccagacaactctatttttacct

SEQ ID NO: 454992 - DNA, 25 bp, Rattus norvegicus
gggccagacacacagctataaattt

SEQ ID NO: 454993 - DNA, 25 bp, Rattus norvegicus
gggccagacacagagctataaattt

SEQ ID NO: 454994 - DNA, 25 bp, Rattus norvegicus
gggccagacaccaagtcctacagac

SEQ ID NO: 454995 - DNA, 25 bp, Rattus norvegicus
gggccagacacctagtcctacagac

SEQ ID NO: 454996 - DNA, 25 bp, Rattus norvegicus
gggccagactacaaggaccagagct

SEQ ID NO: 454997 - DNA, 25 bp, Rattus norvegicus
gggccagactactaggaccagagct

SEQ ID NO: 454998 - DNA, 25 bp, Rattus norvegicus
gggccagactccctttagatcagac

SEQ ID NO: 454999 - DNA, 25 bp, Rattus norvegicus
gggccagactccgtttagatcagac

SEQ ID NO: 455000 - DNA, 25 bp, Rattus norvegicus
gggccagacttcagctggagagttc

SEQ ID NO: 455001 - DNA, 25 bp, Rattus norvegicus
gggccagacttctgctggagagttc

SEQ ID NO: 455002 - DNA, 25 bp, Rattus norvegicus
gggccagagccactacctaaagcaa

SEQ ID NO: 455003 - DNA, 25 bp, Rattus norvegicus
gggccagagccagtacctaaagcaa

SEQ ID NO: 455004 - DNA, 25 bp, Rattus norvegicus
gggccagaggaaaccatcactgctg

SEQ ID NO: 455005 - DNA, 25 bp, Rattus norvegicus
gggccagaggaatccatcactgctg

SEQ ID NO: 455006 - DNA, 25 bp, Rattus norvegicus
gggccagagggtatccatgcacact

SEQ ID NO: 455007 - DNA, 25 bp, Rattus norvegicus
gggccagagggtttccatgcacact

SEQ ID NO: 455008 - DNA, 25 bp, Rattus norvegicus
gggccagataatctttctcattgaa

SEQ ID NO: 455009 - DNA, 25 bp, Rattus norvegicus
gggccagataatgtttctcattgaa

SEQ ID NO: 455010 - DNA, 25 bp, Rattus norvegicus
gggccagattatactttgcttcaaa

SEQ ID NO: 455011 - DNA, 25 bp, Rattus norvegicus
gggccagattattctttgcttcaaa

SEQ ID NO: 455012 - DNA, 25 bp, Rattus norvegicus
gggccagcaactagctatctcaggt

SEQ ID NO: 455013 - DNA, 25 bp, Rattus norvegicus
gggccagcaacttgctatctcaggt

SEQ ID NO: 455014 - DNA, 25 bp, Rattus norvegicus
gggccagcaattcggcacagccaca

SEQ ID NO: 455015 - DNA, 25 bp, Rattus norvegicus
gggccagcaattgggcacagccaca

SEQ ID NO: 455016 - DNA, 25 bp, Rattus norvegicus
gggccagcacagaaagctttcacac

SEQ ID NO: 455017 - DNA, 25 bp, Rattus norvegicus
gggccagcacagtaagctttcacac

SEQ ID NO: 455018 - DNA, 25 bp, Rattus norvegicus
gggccagcacggctcacagggcggc

SEQ ID NO: 455019 - DNA, 25 bp, Rattus norvegicus
gggccagcacgggtcacagggcggc

SEQ ID NO: 455020 - DNA, 25 bp, Rattus norvegicus
gggccagcacttaactacatggact

SEQ ID NO: 455021 - DNA, 25 bp, Rattus norvegicus
gggccagcacttcacagaggaccag

SEQ ID NO: 455022 - DNA, 25 bp, Rattus norvegicus
gggccagcacttgacagaggaccag

SEQ ID NO: 455023 - DNA, 25 bp, Rattus norvegicus
gggccagcactttactacatggact

SEQ ID NO: 455024 - DNA, 25 bp, Rattus norvegicus
gggccagcagctctgaagcacaacc

SEQ ID NO: 455025 - DNA, 25 bp, Rattus norvegicus
gggccagcagctgtgaagcacaacc

SEQ ID NO: 455026 - DNA, 25 bp, Rattus norvegicus
gggccagcataactttgtttttcct

SEQ ID NO: 455027 - DNA, 25 bp, Rattus norvegicus
gggccagcataagtttgtttttcct

SEQ ID NO: 455028 - DNA, 25 bp, Rattus norvegicus
gggccagccactctacagatgtgga

SEQ ID NO: 455029 - DNA, 25 bp, Rattus norvegicus
gggccagccactgtacagatgtgga

SEQ ID NO: 455030 - DNA, 25 bp, Rattus norvegicus
gggccagcccctagtagaatgtctg

SEQ ID NO: 455031 - DNA, 25 bp, Rattus norvegicus
gggccagccccttgtagaatgtctg

SEQ ID NO: 455032 - DNA, 25 bp, Rattus norvegicus
gggccagcccttatgtctgaaactg

SEQ ID NO: 455033 - DNA, 25 bp, Rattus norvegicus
gggccagcccttttgtctgaaactg

SEQ ID NO: 455034 - DNA, 25 bp, Rattus norvegicus
gggccagccggtagcacacttttaa

SEQ ID NO: 455035 - DNA, 25 bp, Rattus norvegicus
gggccagccggttgcacacttttaa

SEQ ID NO: 455036 - DNA, 25 bp, Rattus norvegicus
gggccagccgtgatagggtaattct

SEQ ID NO: 455037 - DNA, 25 bp, Rattus norvegicus
gggccagccgtgttagggtaattct

SEQ ID NO: 455038 - DNA, 25 bp, Rattus norvegicus
gggccagcctaacgtcgttcaactt

SEQ ID NO: 455039 - DNA, 25 bp, Rattus norvegicus
gggccagcctaaggtcgttcaactt

SEQ ID NO: 455040 - DNA, 25 bp, Rattus norvegicus
gggccagcctgcaaagttgtgactg

SEQ ID NO: 455041 - DNA, 25 bp, Rattus norvegicus
gggccagcctgcagatgtagacacc

SEQ ID NO: 455042 - DNA, 25 bp, Rattus norvegicus
gggccagcctgctaagttgtgactg

SEQ ID NO: 455043 - DNA, 25 bp, Rattus norvegicus
gggccagcctgctgatgtagacacc

SEQ ID NO: 455044 - DNA, 25 bp, Rattus norvegicus
gggccagccttgctggatcatccct

SEQ ID NO: 455045 - DNA, 25 bp, Rattus norvegicus
gggccagccttggtggatcatccct

SEQ ID NO: 455046 - DNA, 25 bp, Rattus norvegicus
gggccagcgatcagtgaaagcgctt

SEQ ID NO: 455047 - DNA, 25 bp, Rattus norvegicus
gggccagcgatctgtgaaagcgctt

SEQ ID NO: 455048 - DNA, 25 bp, Rattus norvegicus
gggccagcgcctctgttctgtgtta

SEQ ID NO: 455049 - DNA, 25 bp, Rattus norvegicus
gggccagcgcctgtgttctgtgtta

SEQ ID NO: 455050 - DNA, 25 bp, Rattus norvegicus
gggccagctagcaccaaagtgaagg

SEQ ID NO: 455051 - DNA, 25 bp, Rattus norvegicus
gggccagctagctccaaagtgaagg

SEQ ID NO: 455052 - DNA, 25 bp, Rattus norvegicus
gggccagctagtccaatatgtgagt

SEQ ID NO: 455053 - DNA, 25 bp, Rattus norvegicus
gggccagctagtgcaatatgtgagt

SEQ ID NO: 455054 - DNA, 25 bp, Rattus norvegicus
gggccagctatacttttccaaggga

SEQ ID NO: 455055 - DNA, 25 bp, Rattus norvegicus
gggccagctatagttttccaaggga

SEQ ID NO: 455056 - DNA, 25 bp, Rattus norvegicus
gggccagctcccagagttcagagaa

SEQ ID NO: 455057 - DNA, 25 bp, Rattus norvegicus
gggccagctccctgagttcagagaa

SEQ ID NO: 455058 - DNA, 25 bp, Rattus norvegicus
gggccagctctgaactgagactcac

SEQ ID NO: 455059 - DNA, 25 bp, Rattus norvegicus
gggccagctctgaagatcttcaaca

SEQ ID NO: 455060 - DNA, 25 bp, Rattus norvegicus
gggccagctctgtactgagactcac

SEQ ID NO: 455061 - DNA, 25 bp, Rattus norvegicus
gggccagctctgtagatcttcaaca

SEQ ID NO: 455062 - DNA, 25 bp, Rattus norvegicus
gggccagctgagagtccaactagga

SEQ ID NO: 455063 - DNA, 25 bp, Rattus norvegicus
gggccagctgagtgtccaactagga

SEQ ID NO: 455064 - DNA, 25 bp, Rattus norvegicus
gggccagctggcatcaagtcagtaa

SEQ ID NO: 455065 - DNA, 25 bp, Rattus norvegicus
gggccagctggcttcaagtcagtaa

SEQ ID NO: 455066 - DNA, 25 bp, Rattus norvegicus
gggccagcttgaagcttttatcttg

SEQ ID NO: 455067 - DNA, 25 bp, Rattus norvegicus
gggccagcttgatgcttttatcttg

SEQ ID NO: 455068 - DNA, 25 bp, Rattus norvegicus
gggccagctttacagaacgagtcac

SEQ ID NO: 455069 - DNA, 25 bp, Rattus norvegicus
gggccagctttagagaacgagtcac

SEQ ID NO: 455070 - DNA, 25 bp, Rattus norvegicus
gggccagctttgaccagatctcaac

SEQ ID NO: 455071 - DNA, 25 bp, Rattus norvegicus
gggccagctttgtccagatctcaac

SEQ ID NO: 455072 - DNA, 25 bp, Rattus norvegicus
gggccaggagaccttctatgatgtc

SEQ ID NO: 455073 - DNA, 25 bp, Rattus norvegicus
gggccaggagacgttctatgatgtc

SEQ ID NO: 455074 - DNA, 25 bp, Rattus norvegicus
gggccaggatcactgcagtatgcaa

SEQ ID NO: 455075 - DNA, 25 bp, Rattus norvegicus
gggccaggatcagtgcagtatgcaa

SEQ ID NO: 455076 - DNA, 25 bp, Rattus norvegicus
gggccaggcatgctatacctctgtg

SEQ ID NO: 455077 - DNA, 25 bp, Rattus norvegicus
gggccaggcatggtatacctctgtg

SEQ ID NO: 455078 - DNA, 25 bp, Rattus norvegicus
gggccagggactctgctaaaactgt

SEQ ID NO: 455079 - DNA, 25 bp, Rattus norvegicus
gggccagggactgtgctaaaactgt

SEQ ID NO: 455080 - DNA, 25 bp, Rattus norvegicus
gggccagggatccatgcagctcaaa

SEQ ID NO: 455081 - DNA, 25 bp, Rattus norvegicus
gggccagggatcgatgcagctcaaa

SEQ ID NO: 455082 - DNA, 25 bp, Rattus norvegicus
gggccagggcacactatgactttga

SEQ ID NO: 455083 - DNA, 25 bp, Rattus norvegicus
gggccagggcacagcttaccacatg

SEQ ID NO: 455084 - DNA, 25 bp, Rattus norvegicus
gggccagggcactctatgactttga

SEQ ID NO: 455085 - DNA, 25 bp, Rattus norvegicus
gggccagggcactgcttaccacatg

SEQ ID NO: 455086 - DNA, 25 bp, Rattus norvegicus
gggccagggcagagccaccatatct

SEQ ID NO: 455087 - DNA, 25 bp, Rattus norvegicus
gggccagggcagtgccaccatatct

SEQ ID NO: 455088 - DNA, 25 bp, Rattus norvegicus
gggccagggtacaatctcagttagc

SEQ ID NO: 455089 - DNA, 25 bp, Rattus norvegicus
gggccagggtactatctcagttagc

SEQ ID NO: 455090 - DNA, 25 bp, Rattus norvegicus
gggccaggtatccagcagtttttga

SEQ ID NO: 455091 - DNA, 25 bp, Rattus norvegicus
gggccaggtatcgagcagtttttga

SEQ ID NO: 455092 - DNA, 25 bp, Rattus norvegicus
gggccaggtggcagatctttctgta

SEQ ID NO: 455093 - DNA, 25 bp, Rattus norvegicus
gggccaggtggctgatctttctgta

SEQ ID NO: 455094 - DNA, 25 bp, Rattus norvegicus
gggccaggttgaatgatattgttct

SEQ ID NO: 455095 - DNA, 25 bp, Rattus norvegicus
gggccaggttgattgatattgttct

SEQ ID NO: 455096 - DNA, 25 bp, Rattus norvegicus
gggccagtaagtagctgtcccaagt

SEQ ID NO: 455097 - DNA, 25 bp, Rattus norvegicus
gggccagtaagttgctgtcccaagt

SEQ ID NO: 455098 - DNA, 25 bp, Rattus norvegicus
gggccagtacaaactgcctttctag

SEQ ID NO: 455099 - DNA, 25 bp, Rattus norvegicus
gggccagtacaatctgcctttctag

SEQ ID NO: 455100 - DNA, 25 bp, Rattus norvegicus
gggccagtactgactttggaatttt

SEQ ID NO: 455101 - DNA, 25 bp, Rattus norvegicus
gggccagtactgtctttggaatttt

SEQ ID NO: 455102 - DNA, 25 bp, Rattus norvegicus
gggccagtacttagtccaggctgta

SEQ ID NO: 455103 - DNA, 25 bp, Rattus norvegicus
gggccagtacttcagcccttggaaa

SEQ ID NO: 455104 - DNA, 25 bp, Rattus norvegicus
gggccagtacttgagcccttggaaa

SEQ ID NO: 455105 - DNA, 25 bp, Rattus norvegicus
gggccagtactttgtccaggctgta

SEQ ID NO: 455106 - DNA, 25 bp, Rattus norvegicus
gggccagtcagaagtatagatgtta

SEQ ID NO: 455107 - DNA, 25 bp, Rattus norvegicus
gggccagtcagatgtatagatgtta

SEQ ID NO: 455108 - DNA, 25 bp, Rattus norvegicus
gggccagtctaaactaagataacct

SEQ ID NO: 455109 - DNA, 25 bp, Rattus norvegicus
gggccagtctaatctaagataacct

SEQ ID NO: 455110 - DNA, 25 bp, Rattus norvegicus
gggccagtctcacctagacctgtgc

SEQ ID NO: 455111 - DNA, 25 bp, Rattus norvegicus
gggccagtctcagctagacctgtgc

SEQ ID NO: 455112 - DNA, 25 bp, Rattus norvegicus
gggccagtctccagctatatgactt

SEQ ID NO: 455113 - DNA, 25 bp, Rattus norvegicus
gggccagtctcctgctatatgactt

SEQ ID NO: 455114 - DNA, 25 bp, Rattus norvegicus
gggccagtctgtctatcatgttcat

SEQ ID NO: 455115 - DNA, 25 bp, Rattus norvegicus
gggccagtctgtgtatcatgttcat

SEQ ID NO: 455116 - DNA, 25 bp, Rattus norvegicus
gggccagtgacaagcttagaccagg

SEQ ID NO: 455117 - DNA, 25 bp, Rattus norvegicus
gggccagtgacacggcacatgctat

SEQ ID NO: 455118 - DNA, 25 bp, Rattus norvegicus
gggccagtgacagggcacatgctat

SEQ ID NO: 455119 - DNA, 25 bp, Rattus norvegicus
gggccagtgacatgcttagaccagg

SEQ ID NO: 455120 - DNA, 25 bp, Rattus norvegicus
gggccagtgatacattcaaacctag

SEQ ID NO: 455121 - DNA, 25 bp, Rattus norvegicus
gggccagtgatagattcaaacctag

SEQ ID NO: 455122 - DNA, 25 bp, Rattus norvegicus
gggccagtgcacagctgaattgttt

SEQ ID NO: 455123 - DNA, 25 bp, Rattus norvegicus
gggccagtgcactgctgaattgttt

SEQ ID NO: 455124 - DNA, 25 bp, Rattus norvegicus
gggccagtgtacacgggcgggctac

SEQ ID NO: 455125 - DNA, 25 bp, Rattus norvegicus
gggccagtgtactcgggcgggctac

SEQ ID NO: 455126 - DNA, 25 bp, Rattus norvegicus
gggccagtgtggactcatactatgt

SEQ ID NO: 455127 - DNA, 25 bp, Rattus norvegicus
gggccagtgtggtctcatactatgt

SEQ ID NO: 455128 - DNA, 25 bp, Rattus norvegicus
gggccagttactatttagcactttg

SEQ ID NO: 455129 - DNA, 25 bp, Rattus norvegicus
gggccagttactttttagcactttg

SEQ ID NO: 455130 - DNA, 25 bp, Rattus norvegicus
gggccagttatacctaatgacactt

SEQ ID NO: 455131 - DNA, 25 bp, Rattus norvegicus
gggccagttatagctaatgacactt

SEQ ID NO: 455132 - DNA, 25 bp, Rattus norvegicus
gggccagttcagatgtggtctgaac

SEQ ID NO: 455133 - DNA, 25 bp, Rattus norvegicus
gggccagttcagttgtggtctgaac

SEQ ID NO: 455134 - DNA, 25 bp, Rattus norvegicus
gggccagttcatcatcattgctttc

SEQ ID NO: 455135 - DNA, 25 bp, Rattus norvegicus
gggccagttcatgatcattgctttc

SEQ ID NO: 455136 - DNA, 25 bp, Rattus norvegicus
gggccagttccaaaagcagattgct

SEQ ID NO: 455137 - DNA, 25 bp, Rattus norvegicus
gggccagttccataagcagattgct

SEQ ID NO: 455138 - DNA, 25 bp, Rattus norvegicus
gggccagtttctccatgaagtaggt

SEQ ID NO: 455139 - DNA, 25 bp, Rattus norvegicus
gggccagtttctgcatgaagtaggt

SEQ ID NO: 455140 - DNA, 25 bp, Rattus norvegicus
gggccagttttcacaatgaactaaa

SEQ ID NO: 455141 - DNA, 25 bp, Rattus norvegicus
gggccagttttctcaatgaactaaa

SEQ ID NO: 455142 - DNA, 25 bp, Rattus norvegicus
gggccagttttgcaccagagcactc

SEQ ID NO: 455143 - DNA, 25 bp, Rattus norvegicus
gggccagttttggaccagagcactc

SEQ ID NO: 455144 - DNA, 25 bp, Rattus norvegicus
gggccataaaatccactaccccatg

SEQ ID NO: 455145 - DNA, 25 bp, Rattus norvegicus
gggccataaaatgcactaccccatg

SEQ ID NO: 455146 - DNA, 25 bp, Rattus norvegicus
gggccataaacgcagttttgactga

SEQ ID NO: 455147 - DNA, 25 bp, Rattus norvegicus
gggccataaacggagttttgactga

SEQ ID NO: 455148 - DNA, 25 bp, Rattus norvegicus
gggccataatgtacttgtgatatca

SEQ ID NO: 455149 - DNA, 25 bp, Rattus norvegicus
gggccataatgtcttgtgttctgca

SEQ ID NO: 455150 - DNA, 25 bp, Rattus norvegicus
gggccataatgtgttgtgttctgca

SEQ ID NO: 455151 - DNA, 25 bp, Rattus norvegicus
gggccataatgttcttgtgatatca

SEQ ID NO: 455152 - DNA, 25 bp, Rattus norvegicus
gggccatacacactcatttcaacgt

SEQ ID NO: 455153 - DNA, 25 bp, Rattus norvegicus
gggccatacacagtcatttcaacgt

SEQ ID NO: 455154 - DNA, 25 bp, Rattus norvegicus
gggccatactacctgaaacctgttg

SEQ ID NO: 455155 - DNA, 25 bp, Rattus norvegicus
gggccatactacgtgaaacctgttg

SEQ ID NO: 455156 - DNA, 25 bp, Rattus norvegicus
gggccatactctactacacagggac

SEQ ID NO: 455157 - DNA, 25 bp, Rattus norvegicus
gggccatactcttctacacagggac

SEQ ID NO: 455158 - DNA, 25 bp, Rattus norvegicus
gggccatactgtctcaaggctctca

SEQ ID NO: 455159 - DNA, 25 bp, Rattus norvegicus
gggccatactgtgtcaaggctctca

SEQ ID NO: 455160 - DNA, 25 bp, Rattus norvegicus
gggccatacttaatgcactcaggat

SEQ ID NO: 455161 - DNA, 25 bp, Rattus norvegicus
gggccatacttattgcactcaggat

SEQ ID NO: 455162 - DNA, 25 bp, Rattus norvegicus
gggccatagcagagcttgactccta

SEQ ID NO: 455163 - DNA, 25 bp, Rattus norvegicus
gggccatagcagtgcttgactccta

SEQ ID NO: 455164 - DNA, 25 bp, Rattus norvegicus
gggccatatcaaacacagcattttc

SEQ ID NO: 455165 - DNA, 25 bp, Rattus norvegicus
gggccatatcaatcacagcattttc

SEQ ID NO: 455166 - DNA, 25 bp, Rattus norvegicus
gggccatatcatattgaaacacttc

SEQ ID NO: 455167 - DNA, 25 bp, Rattus norvegicus
gggccatatcattttgaaacacttc

SEQ ID NO: 455168 - DNA, 25 bp, Rattus norvegicus
gggccatatcctacttagatgaact

SEQ ID NO: 455169 - DNA, 25 bp, Rattus norvegicus
gggccatatccttcttagatgaact

SEQ ID NO: 455170 - DNA, 25 bp, Rattus norvegicus
gggccatcaccgacagagggacaag

SEQ ID NO: 455171 - DNA, 25 bp, Rattus norvegicus
gggccatcaccgtcagagggacaag

SEQ ID NO: 455172 - DNA, 25 bp, Rattus norvegicus
gggccatccactatgaggactttgt

SEQ ID NO: 455173 - DNA, 25 bp, Rattus norvegicus
gggccatccactttgaggactttgt

SEQ ID NO: 455174 - DNA, 25 bp, Rattus norvegicus
gggccatcccagagatagcacactt

SEQ ID NO: 455175 - DNA, 25 bp, Rattus norvegicus
gggccatcccagtgatagcacactt

SEQ ID NO: 455176 - DNA, 25 bp, Rattus norvegicus
gggccatccgtaatcaaacagcttg

SEQ ID NO: 455177 - DNA, 25 bp, Rattus norvegicus
gggccatccgtattcaaacagcttg

SEQ ID NO: 455178 - DNA, 25 bp, Rattus norvegicus
gggccatcctgcagaatggacaaat

SEQ ID NO: 455179 - DNA, 25 bp, Rattus norvegicus
gggccatcctgctgaatggacaaat

SEQ ID NO: 455180 - DNA, 25 bp, Rattus norvegicus
gggccatcctgtcgcgaaaacgaca

SEQ ID NO: 455181 - DNA, 25 bp, Rattus norvegicus
gggccatcctgtggcgaaaacgaca

SEQ ID NO: 455182 - DNA, 25 bp, Rattus norvegicus
gggccatcgcctatgaaatcttcgg

SEQ ID NO: 455183 - DNA, 25 bp, Rattus norvegicus
gggccatcgcctttgaaatcttcgg

SEQ ID NO: 455184 - DNA, 25 bp, Rattus norvegicus
gggccatctctaaagccagatagat

SEQ ID NO: 455185 - DNA, 25 bp, Rattus norvegicus
gggccatctctatagccagatagat

SEQ ID NO: 455186 - DNA, 25 bp, Rattus norvegicus
gggccatcttatattcaagtgagac

SEQ ID NO: 455187 - DNA, 25 bp, Rattus norvegicus
gggccatcttattttcaagtgagac

SEQ ID NO: 455188 - DNA, 25 bp, Rattus norvegicus
gggccatcttcaagtgctgcttgaa

SEQ ID NO: 455189 - DNA, 25 bp, Rattus norvegicus
gggccatcttcatgtgctgcttgaa

SEQ ID NO: 455190 - DNA, 25 bp, Rattus norvegicus
gggccatctttgcagaatactttgt

SEQ ID NO: 455191 - DNA, 25 bp, Rattus norvegicus
gggccatctttggagaatactttgt

SEQ ID NO: 455192 - DNA, 25 bp, Rattus norvegicus
gggccatgcaacatgtctgcagcaa

SEQ ID NO: 455193 - DNA, 25 bp, Rattus norvegicus
gggccatgcaacttgtctgcagcaa

SEQ ID NO: 455194 - DNA, 25 bp, Rattus norvegicus
gggccatgcaccagcaatcatatct

SEQ ID NO: 455195 - DNA, 25 bp, Rattus norvegicus
gggccatgcacctgcaatcatatct

SEQ ID NO: 455196 - DNA, 25 bp, Rattus norvegicus
gggccatgcccacaagtctgtactt

SEQ ID NO: 455197 - DNA, 25 bp, Rattus norvegicus
gggccatgcccagaagtctgtactt

SEQ ID NO: 455198 - DNA, 25 bp, Rattus norvegicus
gggccatgctatctggtgaacgaaa

SEQ ID NO: 455199 - DNA, 25 bp, Rattus norvegicus
gggccatgctatgtggtgaacgaaa

SEQ ID NO: 455200 - DNA, 25 bp, Rattus norvegicus
gggccatggaaacccaagttgtcat

SEQ ID NO: 455201 - DNA, 25 bp, Rattus norvegicus
gggccatggaaagccaagttgtcat

SEQ ID NO: 455202 - DNA, 25 bp, Rattus norvegicus
gggccatggacaactgccacctttt

SEQ ID NO: 455203 - DNA, 25 bp, Rattus norvegicus
gggccatggacatctgccacctttt

SEQ ID NO: 455204 - DNA, 25 bp, Rattus norvegicus
gggccatggagtccaccgcagttaa

SEQ ID NO: 455205 - DNA, 25 bp, Rattus norvegicus
gggccatggagtctgttatcgttaa

SEQ ID NO: 455206 - DNA, 25 bp, Rattus norvegicus
gggccatggagtgcaccgcagttaa

SEQ ID NO: 455207 - DNA, 25 bp, Rattus norvegicus
gggccatggagtgtgttatcgttaa

SEQ ID NO: 455208 - DNA, 25 bp, Rattus norvegicus
gggccatggcccagcctaaatgaaa

SEQ ID NO: 455209 - DNA, 25 bp, Rattus norvegicus
gggccatggccctgcctaaatgaaa

SEQ ID NO: 455210 - DNA, 25 bp, Rattus norvegicus
gggccatggcctctgtatatactat

SEQ ID NO: 455211 - DNA, 25 bp, Rattus norvegicus
gggccatggcctgtgtatatactat

SEQ ID NO: 455212 - DNA, 25 bp, Rattus norvegicus
gggccatgtccgcagagctgacttt

SEQ ID NO: 455213 - DNA, 25 bp, Rattus norvegicus
gggccatgtccggagagctgacttt

SEQ ID NO: 455214 - DNA, 25 bp, Rattus norvegicus
gggccatgtgagagtatccttgaat

SEQ ID NO: 455215 - DNA, 25 bp, Rattus norvegicus
gggccatgtgagtgtatccttgaat

SEQ ID NO: 455216 - DNA, 25 bp, Rattus norvegicus
gggccatgtttcaccaatgcatttg

SEQ ID NO: 455217 - DNA, 25 bp, Rattus norvegicus
gggccatgtttcctcatgtctggaa

SEQ ID NO: 455218 - DNA, 25 bp, Rattus norvegicus
gggccatgtttcgtcatgtctggaa

SEQ ID NO: 455219 - DNA, 25 bp, Rattus norvegicus
gggccatgtttctccaatgcatttg

SEQ ID NO: 455220 - DNA, 25 bp, Rattus norvegicus
gggccattacacatacttcaaggtg

SEQ ID NO: 455221 - DNA, 25 bp, Rattus norvegicus
gggccattacacttacttcaaggtg

SEQ ID NO: 455222 - DNA, 25 bp, Rattus norvegicus
gggccattagaaactctgttgattg

SEQ ID NO: 455223 - DNA, 25 bp, Rattus norvegicus
gggccattagaatctctgttgattg

SEQ ID NO: 455224 - DNA, 25 bp, Rattus norvegicus
gggccattatcaagtcagtagcatt

SEQ ID NO: 455225 - DNA, 25 bp, Rattus norvegicus
gggccattatcatgtcagtagcatt

SEQ ID NO: 455226 - DNA, 25 bp, Rattus norvegicus
gggccattcagaacccagaaaggaa

SEQ ID NO: 455227 - DNA, 25 bp, Rattus norvegicus
gggccattcagatcccagaaaggaa

SEQ ID NO: 455228 - DNA, 25 bp, Rattus norvegicus
gggccattcatcaacaagtcctgat

SEQ ID NO: 455229 - DNA, 25 bp, Rattus norvegicus
gggccattcatctacaagtcctgat

SEQ ID NO: 455230 - DNA, 25 bp, Rattus norvegicus
gggccattcccaacaggaagctggt

SEQ ID NO: 455231 - DNA, 25 bp, Rattus norvegicus
gggccattcccaacgtgtgcaagga

SEQ ID NO: 455232 - DNA, 25 bp, Rattus norvegicus
gggccattcccatcaggaagctggt

SEQ ID NO: 455233 - DNA, 25 bp, Rattus norvegicus
gggccattcccatcgtgtgcaagga

SEQ ID NO: 455234 - DNA, 25 bp, Rattus norvegicus
gggccattcgaaacgcctcagttgc

SEQ ID NO: 455235 - DNA, 25 bp, Rattus norvegicus
gggccattcgaatcgcctcagttgc

SEQ ID NO: 455236 - DNA, 25 bp, Rattus norvegicus
gggccattctttcaaggctgtaaat

SEQ ID NO: 455237 - DNA, 25 bp, Rattus norvegicus
gggccattctttgaaggctgtaaat

SEQ ID NO: 455238 - DNA, 25 bp, Rattus norvegicus
gggccattgacacttaaggtgttca

SEQ ID NO: 455239 - DNA, 25 bp, Rattus norvegicus
gggccattgacagttaaggtgttca

SEQ ID NO: 455240 - DNA, 25 bp, Rattus norvegicus
gggccattgaccagtcgtgaacatt

SEQ ID NO: 455241 - DNA, 25 bp, Rattus norvegicus
gggccattgacctgtcgtgaacatt

SEQ ID NO: 455242 - DNA, 25 bp, Rattus norvegicus
gggccattgagaagcccttccagta

SEQ ID NO: 455243 - DNA, 25 bp, Rattus norvegicus
gggccattgagatgcccttccagta

SEQ ID NO: 455244 - DNA, 25 bp, Rattus norvegicus
gggccattgcagatctgtgtgtcta

SEQ ID NO: 455245 - DNA, 25 bp, Rattus norvegicus
gggccattgcagttctgtgtgtcta

SEQ ID NO: 455246 - DNA, 25 bp, Rattus norvegicus
gggccattgcccactgatggaatta

SEQ ID NO: 455247 - DNA, 25 bp, Rattus norvegicus
gggccattgccctctgatggaatta

SEQ ID NO: 455248 - DNA, 25 bp, Rattus norvegicus
gggccattgctaaggagatccccat

SEQ ID NO: 455249 - DNA, 25 bp, Rattus norvegicus
gggccattgctatggagatccccat

SEQ ID NO: 455250 - DNA, 25 bp, Rattus norvegicus
gggccatttaagcattagccttgga

SEQ ID NO: 455251 - DNA, 25 bp, Rattus norvegicus
gggccatttaaggattagccttgga

SEQ ID NO: 455252 - DNA, 25 bp, Rattus norvegicus
gggccatttaccctccttgaataga

SEQ ID NO: 455253 - DNA, 25 bp, Rattus norvegicus
gggccatttaccgtccttgaataga

SEQ ID NO: 455254 - DNA, 25 bp, Rattus norvegicus
gggccatttcacacttgtgttcaaa

SEQ ID NO: 455255 - DNA, 25 bp, Rattus norvegicus
gggccatttcactcttgtgttcaaa

SEQ ID NO: 455256 - DNA, 25 bp, Rattus norvegicus
gggccatttcctcaattgtaaatcc

SEQ ID NO: 455257 - DNA, 25 bp, Rattus norvegicus
gggccatttcctgaattgtaaatcc

SEQ ID NO: 455258 - DNA, 25 bp, Rattus norvegicus
gggccatttctcaatgcaaccatga

SEQ ID NO: 455259 - DNA, 25 bp, Rattus norvegicus
gggccatttctcataaagacagagg

SEQ ID NO: 455260 - DNA, 25 bp, Rattus norvegicus
gggccatttctctatgcaaccatga

SEQ ID NO: 455261 - DNA, 25 bp, Rattus norvegicus
gggccatttctcttaaagacagagg

SEQ ID NO: 455262 - DNA, 25 bp, Rattus norvegicus
gggccatttgctcgtcaggagactt

SEQ ID NO: 455263 - DNA, 25 bp, Rattus norvegicus
gggccatttgctggtcaggagactt

SEQ ID NO: 455264 - DNA, 25 bp, Rattus norvegicus
gggccatttggtcttccgtgatgct

SEQ ID NO: 455265 - DNA, 25 bp, Rattus norvegicus
gggccatttggtgttccgtgatgct

SEQ ID NO: 455266 - DNA, 25 bp, Rattus norvegicus
gggccatttgttctggtgcttcaat

SEQ ID NO: 455267 - DNA, 25 bp, Rattus norvegicus
gggccatttgttgtggtgcttcaat

SEQ ID NO: 455268 - DNA, 25 bp, Rattus norvegicus
gggccattttgaaccaaattttcca

SEQ ID NO: 455269 - DNA, 25 bp, Rattus norvegicus
gggccattttgatccaaattttcca

SEQ ID NO: 455270 - DNA, 25 bp, Rattus norvegicus
gggccatttttgatccgagatgcac

SEQ ID NO: 455271 - DNA, 25 bp, Rattus norvegicus
gggccatttttgttccgagatgcac

SEQ ID NO: 455272 - DNA, 25 bp, Rattus norvegicus
gggcccaaaagcaaacaggctggct

SEQ ID NO: 455273 - DNA, 25 bp, Rattus norvegicus
gggcccaaaagctaacaggctggct

SEQ ID NO: 455274 - DNA, 25 bp, Rattus norvegicus
gggcccaaacttccaagaccatatt

SEQ ID NO: 455275 - DNA, 25 bp, Rattus norvegicus
gggcccaaacttgcaagaccatatt

SEQ ID NO: 455276 - DNA, 25 bp, Rattus norvegicus
gggcccaaaggcagtacctggtgct

SEQ ID NO: 455277 - DNA, 25 bp, Rattus norvegicus
gggcccaaaggctgtacctggtgct

SEQ ID NO: 455278 - DNA, 25 bp, Rattus norvegicus
gggcccaacagtatgctttgtctaa

SEQ ID NO: 455279 - DNA, 25 bp, Rattus norvegicus
gggcccaacagtttgctttgtctaa

SEQ ID NO: 455280 - DNA, 25 bp, Rattus norvegicus
gggcccaacgttagctgtggcttat

SEQ ID NO: 455281 - DNA, 25 bp, Rattus norvegicus
gggcccaacgtttgctgtggcttat

SEQ ID NO: 455282 - DNA, 25 bp, Rattus norvegicus
gggcccaactttaacaggaactgag

SEQ ID NO: 455283 - DNA, 25 bp, Rattus norvegicus
gggcccaacttttacaggaactgag

SEQ ID NO: 455284 - DNA, 25 bp, Rattus norvegicus
gggcccaagactaatcaactcagca

SEQ ID NO: 455285 - DNA, 25 bp, Rattus norvegicus
gggcccaagacttatcaactcagca

SEQ ID NO: 455286 - DNA, 25 bp, Rattus norvegicus
gggcccaaggacatctagaatgcac

SEQ ID NO: 455287 - DNA, 25 bp, Rattus norvegicus
gggcccaaggacttctagaatgcac

SEQ ID NO: 455288 - DNA, 25 bp, Rattus norvegicus
gggcccaagtggattccatcagtga

SEQ ID NO: 455289 - DNA, 25 bp, Rattus norvegicus
gggcccaagtggtttccatcagtga

SEQ ID NO: 455290 - DNA, 25 bp, Rattus norvegicus
gggcccaagttgcttccagtatgtc

SEQ ID NO: 455291 - DNA, 25 bp, Rattus norvegicus
gggcccaagttggttccagtatgtc

SEQ ID NO: 455292 - DNA, 25 bp, Rattus norvegicus
gggcccaataaaatactctgtttct

SEQ ID NO: 455293 - DNA, 25 bp, Rattus norvegicus
gggcccaataaattactctgtttct

SEQ ID NO: 455294 - DNA, 25 bp, Rattus norvegicus
gggcccaatgccaaacgaagataca

SEQ ID NO: 455295 - DNA, 25 bp, Rattus norvegicus
gggcccaatgcctaacgaagataca

SEQ ID NO: 455296 - DNA, 25 bp, Rattus norvegicus
gggcccacaaagcactgaccagagt

SEQ ID NO: 455297 - DNA, 25 bp, Rattus norvegicus
gggcccacaaaggactgaccagagt

SEQ ID NO: 455298 - DNA, 25 bp, Rattus norvegicus
gggcccacaaatatgagcgcaaagt

SEQ ID NO: 455299 - DNA, 25 bp, Rattus norvegicus
gggcccacaaatttgagcgcaaagt

SEQ ID NO: 455300 - DNA, 25 bp, Rattus norvegicus
gggcccacaggcagtgtgcttctgt

SEQ ID NO: 455301 - DNA, 25 bp, Rattus norvegicus
gggcccacaggctgtgtgcttctgt

SEQ ID NO: 455302 - DNA, 25 bp, Rattus norvegicus
gggcccacagggactcctaatgaaa

SEQ ID NO: 455303 - DNA, 25 bp, Rattus norvegicus
gggcccacagggtctcctaatgaaa

SEQ ID NO: 455304 - DNA, 25 bp, Rattus norvegicus
gggcccacatcacactataacaaga

SEQ ID NO: 455305 - DNA, 25 bp, Rattus norvegicus
gggcccacatcagactataacaaga

SEQ ID NO: 455306 - DNA, 25 bp, Rattus norvegicus
gggcccacatgtacagtgtctgtat

SEQ ID NO: 455307 - DNA, 25 bp, Rattus norvegicus
gggcccacatgttcagtgtctgtat

SEQ ID NO: 455308 - DNA, 25 bp, Rattus norvegicus
gggcccacattcaggaaagagcctt

SEQ ID NO: 455309 - DNA, 25 bp, Rattus norvegicus
gggcccacattctggaaagagcctt

SEQ ID NO: 455310 - DNA, 25 bp, Rattus norvegicus
gggcccaccagcatcttgtggactt

SEQ ID NO: 455311 - DNA, 25 bp, Rattus norvegicus
gggcccaccagcttcttgtggactt

SEQ ID NO: 455312 - DNA, 25 bp, Rattus norvegicus
gggcccacctaaaatgcagtgtaga

SEQ ID NO: 455313 - DNA, 25 bp, Rattus norvegicus
gggcccacctaatatgcagtgtaga

SEQ ID NO: 455314 - DNA, 25 bp, Rattus norvegicus
gggcccacttccacagtaaatggtc

SEQ ID NO: 455315 - DNA, 25 bp, Rattus norvegicus
gggcccacttcctcagtaaatggtc

SEQ ID NO: 455316 - DNA, 25 bp, Rattus norvegicus
gggcccagaaggctcctgatactac

SEQ ID NO: 455317 - DNA, 25 bp, Rattus norvegicus
gggcccagaagggtcctgatactac

SEQ ID NO: 455318 - DNA, 25 bp, Rattus norvegicus
gggcccagacggattgctaaaggtt

SEQ ID NO: 455319 - DNA, 25 bp, Rattus norvegicus
gggcccagacggtttgctaaaggtt

SEQ ID NO: 455320 - DNA, 25 bp, Rattus norvegicus
gggcccagagacacagaggcttaga

SEQ ID NO: 455321 - DNA, 25 bp, Rattus norvegicus
gggcccagagactcagaggcttaga

SEQ ID NO: 455322 - DNA, 25 bp, Rattus norvegicus
gggcccagaggcagagctctagcat

SEQ ID NO: 455323 - DNA, 25 bp, Rattus norvegicus
gggcccagaggctgagctctagcat

SEQ ID NO: 455324 - DNA, 25 bp, Rattus norvegicus
gggcccagaggtcactcttagaata

SEQ ID NO: 455325 - DNA, 25 bp, Rattus norvegicus
gggcccagaggtgactcttagaata

SEQ ID NO: 455326 - DNA, 25 bp, Rattus norvegicus
gggcccagattccactgaggttaga

SEQ ID NO: 455327 - DNA, 25 bp, Rattus norvegicus
gggcccagattcgactgaggttaga

SEQ ID NO: 455328 - DNA, 25 bp, Rattus norvegicus
gggcccagcggcaccagaggattcc

SEQ ID NO: 455329 - DNA, 25 bp, Rattus norvegicus
gggcccagcggctccagaggattcc

SEQ ID NO: 455330 - DNA, 25 bp, Rattus norvegicus
gggcccagctgtacacaggactcgg

SEQ ID NO: 455331 - DNA, 25 bp, Rattus norvegicus
gggcccagctgtctgaactagactg

SEQ ID NO: 455332 - DNA, 25 bp, Rattus norvegicus
gggcccagctgtgtgaactagactg

SEQ ID NO: 455333 - DNA, 25 bp, Rattus norvegicus
gggcccagctgttcacaggactcgg

SEQ ID NO: 455334 - DNA, 25 bp, Rattus norvegicus
gggcccaggaatattcagtaccaag

SEQ ID NO: 455335 - DNA, 25 bp, Rattus norvegicus
gggcccaggaattttcagtaccaag

SEQ ID NO: 455336 - DNA, 25 bp, Rattus norvegicus
gggcccaggcatacacacggaagtg

SEQ ID NO: 455337 - DNA, 25 bp, Rattus norvegicus
gggcccaggcattcacacggaagtg

SEQ ID NO: 455338 - DNA, 25 bp, Rattus norvegicus
gggcccaggccaataactgaagttc

SEQ ID NO: 455339 - DNA, 25 bp, Rattus norvegicus
gggcccaggccattaactgaagttc

SEQ ID NO: 455340 - DNA, 25 bp, Rattus norvegicus
gggcccaggctgagatacaacatgt

SEQ ID NO: 455341 - DNA, 25 bp, Rattus norvegicus
gggcccaggctgtgatacaacatgt

SEQ ID NO: 455342 - DNA, 25 bp, Rattus norvegicus
gggcccaggcttatatcttattcta

SEQ ID NO: 455343 - DNA, 25 bp, Rattus norvegicus
gggcccaggcttttatcttattcta

SEQ ID NO: 455344 - DNA, 25 bp, Rattus norvegicus
gggcccagggatagatactctcacg

SEQ ID NO: 455345 - DNA, 25 bp, Rattus norvegicus
gggcccagggattgatactctcacg

SEQ ID NO: 455346 - DNA, 25 bp, Rattus norvegicus
gggcccagggtcactttcaaggaca

SEQ ID NO: 455347 - DNA, 25 bp, Rattus norvegicus
gggcccagggtctctttcaaggaca

SEQ ID NO: 455348 - DNA, 25 bp, Rattus norvegicus
gggcccaggtttcaacagattcttc

SEQ ID NO: 455349 - DNA, 25 bp, Rattus norvegicus
gggcccaggtttgaacagattcttc

SEQ ID NO: 455350 - DNA, 25 bp, Rattus norvegicus
gggcccagtggtcaggattcttatc

SEQ ID NO: 455351 - DNA, 25 bp, Rattus norvegicus
gggcccagtggtgaggattcttatc

SEQ ID NO: 455352 - DNA, 25 bp, Rattus norvegicus
gggcccagtgtgacagcatcacgct

SEQ ID NO: 455353 - DNA, 25 bp, Rattus norvegicus
gggcccagtgtgtcagcatcacgct

SEQ ID NO: 455354 - DNA, 25 bp, Rattus norvegicus
gggcccagttccagtgatcaagtcc

SEQ ID NO: 455355 - DNA, 25 bp, Rattus norvegicus
gggcccagttcctgtgatcaagtcc

SEQ ID NO: 455356 - DNA, 25 bp, Rattus norvegicus
gggcccatactaccgacacaggagc

SEQ ID NO: 455357 - DNA, 25 bp, Rattus norvegicus
gggcccatactagcgacacaggagc

SEQ ID NO: 455358 - DNA, 25 bp, Rattus norvegicus
gggcccatactgactgtctggaagc

SEQ ID NO: 455359 - DNA, 25 bp, Rattus norvegicus
gggcccatactgtctgtctggaagc

SEQ ID NO: 455360 - DNA, 25 bp, Rattus norvegicus
gggcccatgaccagtagcttataag

SEQ ID NO: 455361 - DNA, 25 bp, Rattus norvegicus
gggcccatgacctgtagcttataag

SEQ ID NO: 455362 - DNA, 25 bp, Rattus norvegicus
gggcccatgtgcagtagagttttct

SEQ ID NO: 455363 - DNA, 25 bp, Rattus norvegicus
gggcccatgtgctgtagagttttct

SEQ ID NO: 455364 - DNA, 25 bp, Rattus norvegicus
gggcccatgttcactcagttgtgat

SEQ ID NO: 455365 - DNA, 25 bp, Rattus norvegicus
gggcccatgttctctcagttgtgat

SEQ ID NO: 455366 - DNA, 25 bp, Rattus norvegicus
gggcccattaacacaggacattcat

SEQ ID NO: 455367 - DNA, 25 bp, Rattus norvegicus
gggcccattaactcaggacattcat

SEQ ID NO: 455368 - DNA, 25 bp, Rattus norvegicus
gggccccaaaatataaaccttgcag

SEQ ID NO: 455369 - DNA, 25 bp, Rattus norvegicus
gggccccaaaatttaaaccttgcag

SEQ ID NO: 455370 - DNA, 25 bp, Rattus norvegicus
gggccccaaagcaggtgtgctcact

SEQ ID NO: 455371 - DNA, 25 bp, Rattus norvegicus
gggccccaaagctggtgtgctcact

SEQ ID NO: 455372 - DNA, 25 bp, Rattus norvegicus
gggccccaaggcaaggttctacagg

SEQ ID NO: 455373 - DNA, 25 bp, Rattus norvegicus
gggccccaaggctaggttctacagg

SEQ ID NO: 455374 - DNA, 25 bp, Rattus norvegicus
gggccccaatacctgattcctgtat

SEQ ID NO: 455375 - DNA, 25 bp, Rattus norvegicus
gggccccaatacgtgattcctgtat

SEQ ID NO: 455376 - DNA, 25 bp, Rattus norvegicus
gggccccaatggagagatctgtgtc

SEQ ID NO: 455377 - DNA, 25 bp, Rattus norvegicus
gggccccaatggtgagatctgtgtc

SEQ ID NO: 455378 - DNA, 25 bp, Rattus norvegicus
gggccccacaaactagctgggcagc

SEQ ID NO: 455379 - DNA, 25 bp, Rattus norvegicus
gggccccacaaagtagctgggcagc

SEQ ID NO: 455380 - DNA, 25 bp, Rattus norvegicus
gggccccactcaaaccatttcttgg

SEQ ID NO: 455381 - DNA, 25 bp, Rattus norvegicus
gggccccactcactcagagtagaaa

SEQ ID NO: 455382 - DNA, 25 bp, Rattus norvegicus
gggccccactcagtcagagtagaaa

SEQ ID NO: 455383 - DNA, 25 bp, Rattus norvegicus
gggccccactcataccatttcttgg

SEQ ID NO: 455384 - DNA, 25 bp, Rattus norvegicus
gggccccagactcaagatgacctca

SEQ ID NO: 455385 - DNA, 25 bp, Rattus norvegicus
gggccccagactgaagatgacctca

SEQ ID NO: 455386 - DNA, 25 bp, Rattus norvegicus
gggccccatcaacgaaacacaattg

SEQ ID NO: 455387 - DNA, 25 bp, Rattus norvegicus
gggccccatcaaggaaacacaattg

SEQ ID NO: 455388 - DNA, 25 bp, Rattus norvegicus
gggccccatcggaagctcagaacca

SEQ ID NO: 455389 - DNA, 25 bp, Rattus norvegicus
gggccccatcggtagctcagaacca

SEQ ID NO: 455390 - DNA, 25 bp, Rattus norvegicus
gggccccattagagcaaacggtttg

SEQ ID NO: 455391 - DNA, 25 bp, Rattus norvegicus
gggccccattagtgcaaacggtttg

SEQ ID NO: 455392 - DNA, 25 bp, Rattus norvegicus
gggccccgagtcacaattctcagaa

SEQ ID NO: 455393 - DNA, 25 bp, Rattus norvegicus
gggccccgagtctcaattctcagaa

SEQ ID NO: 455394 - DNA, 25 bp, Rattus norvegicus
gggccccgatctatcctaagactag

SEQ ID NO: 455395 - DNA, 25 bp, Rattus norvegicus
gggccccgatctttcctaagactag

SEQ ID NO: 455396 - DNA, 25 bp, Rattus norvegicus
gggccccgtggactgaatatacaca

SEQ ID NO: 455397 - DNA, 25 bp, Rattus norvegicus
gggccccgtggagtgaatatacaca

SEQ ID NO: 455398 - DNA, 25 bp, Rattus norvegicus
gggcccctaagtctgtgtttagcac

SEQ ID NO: 455399 - DNA, 25 bp, Rattus norvegicus
gggcccctaagtgtgtgtttagcac

SEQ ID NO: 455400 - DNA, 25 bp, Rattus norvegicus
gggcccctatttccgagcgatcaag

SEQ ID NO: 455401 - DNA, 25 bp, Rattus norvegicus
gggcccctatttgcgagcgatcaag

SEQ ID NO: 455402 - DNA, 25 bp, Rattus norvegicus
gggcccctcccgagaggagcgtgga

SEQ ID NO: 455403 - DNA, 25 bp, Rattus norvegicus
gggcccctcccgtgaggagcgtgga

SEQ ID NO: 455404 - DNA, 25 bp, Rattus norvegicus
gggcccctgaccaccgctgtgggca

SEQ ID NO: 455405 - DNA, 25 bp, Rattus norvegicus
gggcccctgacctccgctgtgggca

SEQ ID NO: 455406 - DNA, 25 bp, Rattus norvegicus
gggcccctgagactttccagaggtt

SEQ ID NO: 455407 - DNA, 25 bp, Rattus norvegicus
gggcccctgagagtttccagaggtt

SEQ ID NO: 455408 - DNA, 25 bp, Rattus norvegicus
gggcccctgataatccttggaaaag

SEQ ID NO: 455409 - DNA, 25 bp, Rattus norvegicus
gggcccctgataccaaatgtcaagt

SEQ ID NO: 455410 - DNA, 25 bp, Rattus norvegicus
gggcccctgatagcaaatgtcaagt

SEQ ID NO: 455411 - DNA, 25 bp, Rattus norvegicus
gggcccctgatattccttggaaaag

SEQ ID NO: 455412 - DNA, 25 bp, Rattus norvegicus
gggcccctggttactttgaagaatg

SEQ ID NO: 455413 - DNA, 25 bp, Rattus norvegicus
gggcccctggtttctttgaagaatg

SEQ ID NO: 455414 - DNA, 25 bp, Rattus norvegicus
gggccccttagacatttgcttgagg

SEQ ID NO: 455415 - DNA, 25 bp, Rattus norvegicus
gggccccttagagatttgcttgagg

SEQ ID NO: 455416 - DNA, 25 bp, Rattus norvegicus
gggccccttagcctcaatgtcttca

SEQ ID NO: 455417 - DNA, 25 bp, Rattus norvegicus
gggccccttagcgtcaatgtcttca

SEQ ID NO: 455418 - DNA, 25 bp, Rattus norvegicus
gggcccgatacaagctaggcaaata

SEQ ID NO: 455419 - DNA, 25 bp, Rattus norvegicus
gggcccgatacatgctaggcaaata

SEQ ID NO: 455420 - DNA, 25 bp, Rattus norvegicus
gggcccgattgtagttcccacagct

SEQ ID NO: 455421 - DNA, 25 bp, Rattus norvegicus
gggcccgattgttgttcccacagct

SEQ ID NO: 455422 - DNA, 25 bp, Rattus norvegicus
gggcccgcaagcatgtgcaataatt

SEQ ID NO: 455423 - DNA, 25 bp, Rattus norvegicus
gggcccgcaagcttgtgcaataatt

SEQ ID NO: 455424 - DNA, 25 bp, Rattus norvegicus
gggcccgcacagcaccctggagaaa

SEQ ID NO: 455425 - DNA, 25 bp, Rattus norvegicus
gggcccgcacaggaccctggagaaa

SEQ ID NO: 455426 - DNA, 25 bp, Rattus norvegicus
gggcccgcatgaacagcagcactga

SEQ ID NO: 455427 - DNA, 25 bp, Rattus norvegicus
gggcccgcatgatcagcagcactga

SEQ ID NO: 455428 - DNA, 25 bp, Rattus norvegicus
gggcccgccttgaccataagttcga

SEQ ID NO: 455429 - DNA, 25 bp, Rattus norvegicus
gggcccgccttgtccataagttcga

SEQ ID NO: 455430 - DNA, 25 bp, Rattus norvegicus
gggcccgggagacaatttctacatt

SEQ ID NO: 455431 - DNA, 25 bp, Rattus norvegicus
gggcccgggagagaatttctacatt

SEQ ID NO: 455432 - DNA, 25 bp, Rattus norvegicus
gggcccgtgctcaacggaatttatt

SEQ ID NO: 455433 - DNA, 25 bp, Rattus norvegicus
gggcccgtgctctacggaatttatt

SEQ ID NO: 455434 - DNA, 25 bp, Rattus norvegicus
gggccctaaacaccttgaggcttca

SEQ ID NO: 455435 - DNA, 25 bp, Rattus norvegicus
gggccctaaacagcttgaggcttca

SEQ ID NO: 455436 - DNA, 25 bp, Rattus norvegicus
gggccctaaggcattggtatctgaa

SEQ ID NO: 455437 - DNA, 25 bp, Rattus norvegicus
gggccctaaggctttggtatctgaa

SEQ ID NO: 455438 - DNA, 25 bp, Rattus norvegicus
gggccctacaggacttcagcgccag

SEQ ID NO: 455439 - DNA, 25 bp, Rattus norvegicus
gggccctacaggtcttcagcgccag

SEQ ID NO: 455440 - DNA, 25 bp, Rattus norvegicus
gggccctagaagcttcaaacagagc

SEQ ID NO: 455441 - DNA, 25 bp, Rattus norvegicus
gggccctagaaggttcaaacagagc

SEQ ID NO: 455442 - DNA, 25 bp, Rattus norvegicus
gggccctagagccagtagcatcatg

SEQ ID NO: 455443 - DNA, 25 bp, Rattus norvegicus
gggccctagagcgagtagcatcatg

SEQ ID NO: 455444 - DNA, 25 bp, Rattus norvegicus
gggccctagcaaagttttcttgttg

SEQ ID NO: 455445 - DNA, 25 bp, Rattus norvegicus
gggccctagcaatgttttcttgttg

SEQ ID NO: 455446 - DNA, 25 bp, Rattus norvegicus
gggccctagcatacattttacaatt

SEQ ID NO: 455447 - DNA, 25 bp, Rattus norvegicus
gggccctagcattcattttacaatt

SEQ ID NO: 455448 - DNA, 25 bp, Rattus norvegicus
gggccctaggaacaaccaatgtgct

SEQ ID NO: 455449 - DNA, 25 bp, Rattus norvegicus
gggccctaggaagaaccaatgtgct

SEQ ID NO: 455450 - DNA, 25 bp, Rattus norvegicus
gggccctatgtgcttgccagttacc

SEQ ID NO: 455451 - DNA, 25 bp, Rattus norvegicus
gggccctatgtggttgccagttacc

SEQ ID NO: 455452 - DNA, 25 bp, Rattus norvegicus
gggccctcacacagagggccacgtg

SEQ ID NO: 455453 - DNA, 25 bp, Rattus norvegicus
gggccctcacactgagggccacgtg

SEQ ID NO: 455454 - DNA, 25 bp, Rattus norvegicus
gggccctcaggaaaatatgctctct

SEQ ID NO: 455455 - DNA, 25 bp, Rattus norvegicus
gggccctcaggataatatgctctct

SEQ ID NO: 455456 - DNA, 25 bp, Rattus norvegicus
gggccctcagggatctcgaagtctt

SEQ ID NO: 455457 - DNA, 25 bp, Rattus norvegicus
gggccctcagggttctcgaagtctt

SEQ ID NO: 455458 - DNA, 25 bp, Rattus norvegicus
gggccctctcatagttcacaagaga

SEQ ID NO: 455459 - DNA, 25 bp, Rattus norvegicus
gggccctctcatctctggaatcaaa

SEQ ID NO: 455460 - DNA, 25 bp, Rattus norvegicus
gggccctctcatgtctggaatcaaa

SEQ ID NO: 455461 - DNA, 25 bp, Rattus norvegicus
gggccctctcattgttcacaagaga

SEQ ID NO: 455462 - DNA, 25 bp, Rattus norvegicus
gggccctctcccatttctaaacatt

SEQ ID NO: 455463 - DNA, 25 bp, Rattus norvegicus
gggccctctcccttttctaaacatt

SEQ ID NO: 455464 - DNA, 25 bp, Rattus norvegicus
gggccctctggaagctcaataaagg

SEQ ID NO: 455465 - DNA, 25 bp, Rattus norvegicus
gggccctctggatgctcaataaagg

SEQ ID NO: 455466 - DNA, 25 bp, Rattus norvegicus
gggccctctgtacagttgttactga

SEQ ID NO: 455467 - DNA, 25 bp, Rattus norvegicus
gggccctctgtagagttgttactga

SEQ ID NO: 455468 - DNA, 25 bp, Rattus norvegicus
gggccctgaaggatttctggactga

SEQ ID NO: 455469 - DNA, 25 bp, Rattus norvegicus
gggccctgaaggttttctggactga

SEQ ID NO: 455470 - DNA, 25 bp, Rattus norvegicus
gggccctgactcaagcttcagagac

SEQ ID NO: 455471 - DNA, 25 bp, Rattus norvegicus
gggccctgactctagcttcagagac

SEQ ID NO: 455472 - DNA, 25 bp, Rattus norvegicus
gggccctgagaaattcaatacggtt

SEQ ID NO: 455473 - DNA, 25 bp, Rattus norvegicus
gggccctgagaatttcaatacggtt

SEQ ID NO: 455474 - DNA, 25 bp, Rattus norvegicus
gggccctgagctactgtgcagacag

SEQ ID NO: 455475 - DNA, 25 bp, Rattus norvegicus
gggccctgagcttctgtgcagacag

SEQ ID NO: 455476 - DNA, 25 bp, Rattus norvegicus
gggccctgcaaaccatttgctgttt

SEQ ID NO: 455477 - DNA, 25 bp, Rattus norvegicus
gggccctgcaaagcatttgctgttt

SEQ ID NO: 455478 - DNA, 25 bp, Rattus norvegicus
gggccctgcacaaggcaaatcaaga

SEQ ID NO: 455479 - DNA, 25 bp, Rattus norvegicus
gggccctgcacaagtacagcctgat

SEQ ID NO: 455480 - DNA, 25 bp, Rattus norvegicus
gggccctgcacacccaaagaagcga

SEQ ID NO: 455481 - DNA, 25 bp, Rattus norvegicus
gggccctgcacagccaaagaagcga

SEQ ID NO: 455482 - DNA, 25 bp, Rattus norvegicus
gggccctgcacatggcaaatcaaga

SEQ ID NO: 455483 - DNA, 25 bp, Rattus norvegicus
gggccctgcacatgtacagcctgat

SEQ ID NO: 455484 - DNA, 25 bp, Rattus norvegicus
gggccctgccaccaaaatatgagtt

SEQ ID NO: 455485 - DNA, 25 bp, Rattus norvegicus
gggccctgccacgaaaatatgagtt

SEQ ID NO: 455486 - DNA, 25 bp, Rattus norvegicus
gggccctgcgccaatgagatcaagc

SEQ ID NO: 455487 - DNA, 25 bp, Rattus norvegicus
gggccctgcgcctatgagatcaagc

SEQ ID NO: 455488 - DNA, 25 bp, Rattus norvegicus
gggccctgctgacagagcagtccaa

SEQ ID NO: 455489 - DNA, 25 bp, Rattus norvegicus
gggccctgctgagagagcagtccaa

SEQ ID NO: 455490 - DNA, 25 bp, Rattus norvegicus
gggccctggaacagcaccagctaga

SEQ ID NO: 455491 - DNA, 25 bp, Rattus norvegicus
gggccctggaactgcaccagctaga

SEQ ID NO: 455492 - DNA, 25 bp, Rattus norvegicus
gggccctggaagatgattttcttaa

SEQ ID NO: 455493 - DNA, 25 bp, Rattus norvegicus
gggccctggaagttgattttcttaa

SEQ ID NO: 455494 - DNA, 25 bp, Rattus norvegicus
gggccctggatgattttgttctctt

SEQ ID NO: 455495 - DNA, 25 bp, Rattus norvegicus
gggccctggatgtttttgttctctt

SEQ ID NO: 455496 - DNA, 25 bp, Rattus norvegicus
gggccctgggttaccagagagccta

SEQ ID NO: 455497 - DNA, 25 bp, Rattus norvegicus
gggccctgggtttccagagagccta

SEQ ID NO: 455498 - DNA, 25 bp, Rattus norvegicus
gggccctgtccccaaacatgggaag

SEQ ID NO: 455499 - DNA, 25 bp, Rattus norvegicus
gggccctgtcccgaaacatgggaag

SEQ ID NO: 455500 - DNA, 25 bp, Rattus norvegicus
gggccctgtgaacagtagaaatgca

SEQ ID NO: 455501 - DNA, 25 bp, Rattus norvegicus
gggccctgtgaagagtagaaatgca

SEQ ID NO: 455502 - DNA, 25 bp, Rattus norvegicus
gggccctgtgccaaccagaagagga

SEQ ID NO: 455503 - DNA, 25 bp, Rattus norvegicus
gggccctgtgcctaccagaagagga

SEQ ID NO: 455504 - DNA, 25 bp, Rattus norvegicus
gggccctgttatctctgatttttat

SEQ ID NO: 455505 - DNA, 25 bp, Rattus norvegicus
gggccctgttatgtctgatttttat

SEQ ID NO: 455506 - DNA, 25 bp, Rattus norvegicus
gggccctgttcaagtgtattcgtct

SEQ ID NO: 455507 - DNA, 25 bp, Rattus norvegicus
gggccctgttcatgtgtattcgtct

SEQ ID NO: 455508 - DNA, 25 bp, Rattus norvegicus
gggccctgttctctgaattgactac

SEQ ID NO: 455509 - DNA, 25 bp, Rattus norvegicus
gggccctgttctgtgaattgactac

SEQ ID NO: 455510 - DNA, 25 bp, Rattus norvegicus
gggccctgttttcatattcagacat

SEQ ID NO: 455511 - DNA, 25 bp, Rattus norvegicus
gggccctgttttgatattcagacat

SEQ ID NO: 455512 - DNA, 25 bp, Rattus norvegicus
gggcccttattcctgtcatgactat

SEQ ID NO: 455513 - DNA, 25 bp, Rattus norvegicus
gggcccttattcgtgtcatgactat

SEQ ID NO: 455514 - DNA, 25 bp, Rattus norvegicus
gggcccttcagtcaaaggctcctta

SEQ ID NO: 455515 - DNA, 25 bp, Rattus norvegicus
gggcccttcagtgaaaggctcctta

SEQ ID NO: 455516 - DNA, 25 bp, Rattus norvegicus
gggcccttccctaagtagtgatctg

SEQ ID NO: 455517 - DNA, 25 bp, Rattus norvegicus
gggcccttcccttagtagtgatctg

SEQ ID NO: 455518 - DNA, 25 bp, Rattus norvegicus
gggcccttcgtcagaatatacttcc

SEQ ID NO: 455519 - DNA, 25 bp, Rattus norvegicus
gggcccttcgtctgaatatacttcc

SEQ ID NO: 455520 - DNA, 25 bp, Rattus norvegicus
gggcccttgagccaaatggaatctt

SEQ ID NO: 455521 - DNA, 25 bp, Rattus norvegicus
gggcccttgagcgaaatggaatctt

SEQ ID NO: 455522 - DNA, 25 bp, Rattus norvegicus
gggcccttgagtactgtgatcatca

SEQ ID NO: 455523 - DNA, 25 bp, Rattus norvegicus
gggcccttgagttctgtgatcatca

SEQ ID NO: 455524 - DNA, 25 bp, Rattus norvegicus
gggcccttgtcaccaataagccagt

SEQ ID NO: 455525 - DNA, 25 bp, Rattus norvegicus
gggcccttgtcagcaataagccagt

SEQ ID NO: 455526 - DNA, 25 bp, Rattus norvegicus
gggccctttattaaacatgtctcat

SEQ ID NO: 455527 - DNA, 25 bp, Rattus norvegicus
gggccctttatttaacatgtctcat

SEQ ID NO: 455528 - DNA, 25 bp, Rattus norvegicus
gggccctttgcacacacgtaaacga

SEQ ID NO: 455529 - DNA, 25 bp, Rattus norvegicus
gggccctttgcagacacgtaaacga

SEQ ID NO: 455530 - DNA, 25 bp, Rattus norvegicus
gggccctttggtacagccagtgaag

SEQ ID NO: 455531 - DNA, 25 bp, Rattus norvegicus
gggccctttggttcagccagtgaag

SEQ ID NO: 455532 - DNA, 25 bp, Rattus norvegicus
gggccctttgtacgattttcttcag

SEQ ID NO: 455533 - DNA, 25 bp, Rattus norvegicus
gggccctttgtaggattttcttcag

SEQ ID NO: 455534 - DNA, 25 bp, Rattus norvegicus
gggccctttgtcatggagaggtcac

SEQ ID NO: 455535 - DNA, 25 bp, Rattus norvegicus
gggccctttgtcttggagaggtcac

SEQ ID NO: 455536 - DNA, 25 bp, Rattus norvegicus
gggccctttgtgaggatggtcccca

SEQ ID NO: 455537 - DNA, 25 bp, Rattus norvegicus
gggccctttgtgtggatggtcccca

SEQ ID NO: 455538 - DNA, 25 bp, Rattus norvegicus
gggcccttttaaagttgacaccaat

SEQ ID NO: 455539 - DNA, 25 bp, Rattus norvegicus
gggcccttttaatgttgacaccaat

SEQ ID NO: 455540 - DNA, 25 bp, Rattus norvegicus
gggccgaagactaccgacagcagct

SEQ ID NO: 455541 - DNA, 25 bp, Rattus norvegicus
gggccgaagacttccgacagcagct

SEQ ID NO: 455542 - DNA, 25 bp, Rattus norvegicus
gggccgaagttcaggtttccatggg

SEQ ID NO: 455543 - DNA, 25 bp, Rattus norvegicus
gggccgaagttctggtttccatggg

SEQ ID NO: 455544 - DNA, 25 bp, Rattus norvegicus
gggccgaattctagctttagtggaa

SEQ ID NO: 455545 - DNA, 25 bp, Rattus norvegicus
gggccgaattcttgctttagtggaa

SEQ ID NO: 455546 - DNA, 25 bp, Rattus norvegicus
gggccgacaagaaacctctcgcatg

SEQ ID NO: 455547 - DNA, 25 bp, Rattus norvegicus
gggccgacaagatacctctcgcatg

SEQ ID NO: 455548 - DNA, 25 bp, Rattus norvegicus
gggccgacgcatctcagtgatttgc

SEQ ID NO: 455549 - DNA, 25 bp, Rattus norvegicus
gggccgacgcatgtcagtgatttgc

SEQ ID NO: 455550 - DNA, 25 bp, Rattus norvegicus
gggccgagagtgaatgtgctcccaa

SEQ ID NO: 455551 - DNA, 25 bp, Rattus norvegicus
gggccgagagtgtatgtgctcccaa

SEQ ID NO: 455552 - DNA, 25 bp, Rattus norvegicus
gggccgaggagcataagaatcagac

SEQ ID NO: 455553 - DNA, 25 bp, Rattus norvegicus
gggccgaggagcttaagaatcagac

SEQ ID NO: 455554 - DNA, 25 bp, Rattus norvegicus
gggccgatatggcttactcaagaga

SEQ ID NO: 455555 - DNA, 25 bp, Rattus norvegicus
gggccgatatgggttactcaagaga

SEQ ID NO: 455556 - DNA, 25 bp, Rattus norvegicus
gggccgattcaccatctccagagac

SEQ ID NO: 455557 - DNA, 25 bp, Rattus norvegicus
gggccgattcacgatctccagagac

SEQ ID NO: 455558 - DNA, 25 bp, Rattus norvegicus
gggccgcaataacatgcgcgaccat

SEQ ID NO: 455559 - DNA, 25 bp, Rattus norvegicus
gggccgcaataagatgcgcgaccat

SEQ ID NO: 455560 - DNA, 25 bp, Rattus norvegicus
gggccgcaatcactacagcagtatc

SEQ ID NO: 455561 - DNA, 25 bp, Rattus norvegicus
gggccgcaatcagtacagcagtatc

SEQ ID NO: 455562 - DNA, 25 bp, Rattus norvegicus
gggccgccgtctcctagactgcagt

SEQ ID NO: 455563 - DNA, 25 bp, Rattus norvegicus
gggccgccgtctgctagactgcagt

SEQ ID NO: 455564 - DNA, 25 bp, Rattus norvegicus
gggccgcctgcaattcagctttgtg

SEQ ID NO: 455565 - DNA, 25 bp, Rattus norvegicus
gggccgcctgcatttcagctttgtg

SEQ ID NO: 455566 - DNA, 25 bp, Rattus norvegicus
gggccgccttgacctatgtaataaa

SEQ ID NO: 455567 - DNA, 25 bp, Rattus norvegicus
gggccgccttgagctatgtaataaa

SEQ ID NO: 455568 - DNA, 25 bp, Rattus norvegicus
gggccgctgataaaagccgctgagc

SEQ ID NO: 455569 - DNA, 25 bp, Rattus norvegicus
gggccgctgatataagccgctgagc

SEQ ID NO: 455570 - DNA, 25 bp, Rattus norvegicus
gggccgctgcctacaacgaatgccg

SEQ ID NO: 455571 - DNA, 25 bp, Rattus norvegicus
gggccgctgccttcaacgaatgccg

SEQ ID NO: 455572 - DNA, 25 bp, Rattus norvegicus
gggccgctgttactgcaagccgaac

SEQ ID NO: 455573 - DNA, 25 bp, Rattus norvegicus
gggccgctgttagtgcaagccgaac

SEQ ID NO: 455574 - DNA, 25 bp, Rattus norvegicus
gggccgcttacgagaataccttcca

SEQ ID NO: 455575 - DNA, 25 bp, Rattus norvegicus
gggccgcttacgtgaataccttcca

SEQ ID NO: 455576 - DNA, 25 bp, Rattus norvegicus
gggccgctttctacgagatgccaaa

SEQ ID NO: 455577 - DNA, 25 bp, Rattus norvegicus
gggccgctttcttcgagatgccaaa

SEQ ID NO: 455578 - DNA, 25 bp, Rattus norvegicus
gggccggaagaacagactcactgaa

SEQ ID NO: 455579 - DNA, 25 bp, Rattus norvegicus
gggccggaagaacgctgccatttct

SEQ ID NO: 455580 - DNA, 25 bp, Rattus norvegicus
gggccggaagaagagactcactgaa

SEQ ID NO: 455581 - DNA, 25 bp, Rattus norvegicus
gggccggaagaaggctgccatttct

SEQ ID NO: 455582 - DNA, 25 bp, Rattus norvegicus
gggccggaccgccaactggagaagg

SEQ ID NO: 455583 - DNA, 25 bp, Rattus norvegicus
gggccggaccgcgaactggagaagg

SEQ ID NO: 455584 - DNA, 25 bp, Rattus norvegicus
gggccggcaccactacatcaatgaa

SEQ ID NO: 455585 - DNA, 25 bp, Rattus norvegicus
gggccggcaccagtacatcaatgaa

SEQ ID NO: 455586 - DNA, 25 bp, Rattus norvegicus
gggccggcaggaactcgaaattgtc

SEQ ID NO: 455587 - DNA, 25 bp, Rattus norvegicus
gggccggcaggatctcgaaattgtc

SEQ ID NO: 455588 - DNA, 25 bp, Rattus norvegicus
gggccggcaggtatacttatccagg

SEQ ID NO: 455589 - DNA, 25 bp, Rattus norvegicus
gggccggcaggtttacttatccagg

SEQ ID NO: 455590 - DNA, 25 bp, Rattus norvegicus
gggccggcgcctcctggttgaggtc

SEQ ID NO: 455591 - DNA, 25 bp, Rattus norvegicus
gggccggcgcctgctggttgaggtc

SEQ ID NO: 455592 - DNA, 25 bp, Rattus norvegicus
gggccggcgtcaacgcgacgtgctg

SEQ ID NO: 455593 - DNA, 25 bp, Rattus norvegicus
gggccggcgtcatcgcgacgtgctg

SEQ ID NO: 455594 - DNA, 25 bp, Rattus norvegicus
gggccggtagctacacctgtgtagc

SEQ ID NO: 455595 - DNA, 25 bp, Rattus norvegicus
gggccggtagcttcacctgtgtagc

SEQ ID NO: 455596 - DNA, 25 bp, Rattus norvegicus
gggccggtctttctgctcgctgatc

SEQ ID NO: 455597 - DNA, 25 bp, Rattus norvegicus
gggccggtctttgtgctcgctgatc

SEQ ID NO: 455598 - DNA, 25 bp, Rattus norvegicus
gggccgtaagatcctacagtgcata

SEQ ID NO: 455599 - DNA, 25 bp, Rattus norvegicus
gggccgtaagatgctacagtgcata

SEQ ID NO: 455600 - DNA, 25 bp, Rattus norvegicus
gggccgtagctcagtgatccagcac

SEQ ID NO: 455601 - DNA, 25 bp, Rattus norvegicus
gggccgtagctctgtgatccagcac

SEQ ID NO: 455602 - DNA, 25 bp, Rattus norvegicus
gggccgtcactgatcatggagagaa

SEQ ID NO: 455603 - DNA, 25 bp, Rattus norvegicus
gggccgtcactgttcatggagagaa

SEQ ID NO: 455604 - DNA, 25 bp, Rattus norvegicus
gggccgtctccaaggacaacagcaa

SEQ ID NO: 455605 - DNA, 25 bp, Rattus norvegicus
gggccgtctccatggacaacagcaa

SEQ ID NO: 455606 - DNA, 25 bp, Rattus norvegicus
gggccgtgagaccattatgttcatt

SEQ ID NO: 455607 - DNA, 25 bp, Rattus norvegicus
gggccgtgagacgattatgttcatt

SEQ ID NO: 455608 - DNA, 25 bp, Rattus norvegicus
gggccgtgatgcactattagtcctt

SEQ ID NO: 455609 - DNA, 25 bp, Rattus norvegicus
gggccgtgatgctctattagtcctt

SEQ ID NO: 455610 - DNA, 25 bp, Rattus norvegicus
gggccgtgccttaaccataagtggg

SEQ ID NO: 455611 - DNA, 25 bp, Rattus norvegicus
gggccgtgcctttaccataagtggg

SEQ ID NO: 455612 - DNA, 25 bp, Rattus norvegicus
gggccgtgctgtctataatacattt

SEQ ID NO: 455613 - DNA, 25 bp, Rattus norvegicus
gggccgtgctgtgtataatacattt

SEQ ID NO: 455614 - DNA, 25 bp, Rattus norvegicus
gggccgtgctttctccagagcaaaa

SEQ ID NO: 455615 - DNA, 25 bp, Rattus norvegicus
gggccgtgctttgtccagagcaaaa

SEQ ID NO: 455616 - DNA, 25 bp, Rattus norvegicus
gggccgtggaaaacagaagctgaat

SEQ ID NO: 455617 - DNA, 25 bp, Rattus norvegicus
gggccgtggaaatcagaagctgaat

SEQ ID NO: 455618 - DNA, 25 bp, Rattus norvegicus
gggccgttccatctagaaagtatgt

SEQ ID NO: 455619 - DNA, 25 bp, Rattus norvegicus
gggccgttccatgtagaaagtatgt

SEQ ID NO: 455620 - DNA, 25 bp, Rattus norvegicus
gggccgttcgatcacgtcccgaaag

SEQ ID NO: 455621 - DNA, 25 bp, Rattus norvegicus
gggccgttcgatgacgtcccgaaag

SEQ ID NO: 455622 - DNA, 25 bp, Rattus norvegicus
gggccgttctacacgaatttgaaag

SEQ ID NO: 455623 - DNA, 25 bp, Rattus norvegicus
gggccgttctactcgaatttgaaag

SEQ ID NO: 455624 - DNA, 25 bp, Rattus norvegicus
gggccgtttcctcaagatcgctgag

SEQ ID NO: 455625 - DNA, 25 bp, Rattus norvegicus
gggccgtttcctgaagatcgctgag

SEQ ID NO: 455626 - DNA, 25 bp, Rattus norvegicus
gggcctaaaagacccacctgtgatg

SEQ ID NO: 455627 - DNA, 25 bp, Rattus norvegicus
gggcctaaaagagccacctgtgatg

SEQ ID NO: 455628 - DNA, 25 bp, Rattus norvegicus
gggcctaaacacagttggcactatt

SEQ ID NO: 455629 - DNA, 25 bp, Rattus norvegicus
gggcctaaacactgttggcactatt

SEQ ID NO: 455630 - DNA, 25 bp, Rattus norvegicus
gggcctaacccaaatggtgaccaag

SEQ ID NO: 455631 - DNA, 25 bp, Rattus norvegicus
gggcctaacccatatggtgaccaag

SEQ ID NO: 455632 - DNA, 25 bp, Rattus norvegicus
gggcctaactgacaggtatttaact

SEQ ID NO: 455633 - DNA, 25 bp, Rattus norvegicus
gggcctaactgagaggtatttaact

SEQ ID NO: 455634 - DNA, 25 bp, Rattus norvegicus
gggcctaactttcatgtcatcttga

SEQ ID NO: 455635 - DNA, 25 bp, Rattus norvegicus
gggcctaactttgatgtcatcttga

SEQ ID NO: 455636 - DNA, 25 bp, Rattus norvegicus
gggcctaagcttcggtttgcagcat

SEQ ID NO: 455637 - DNA, 25 bp, Rattus norvegicus
gggcctaagcttgggtttgcagcat

SEQ ID NO: 455638 - DNA, 25 bp, Rattus norvegicus
gggcctaataccatgttactgaagt

SEQ ID NO: 455639 - DNA, 25 bp, Rattus norvegicus
gggcctaataccttgttactgaagt

SEQ ID NO: 455640 - DNA, 25 bp, Rattus norvegicus
gggcctaatggtctcatggttcaca

SEQ ID NO: 455641 - DNA, 25 bp, Rattus norvegicus
gggcctaatggtgtcatggttcaca

SEQ ID NO: 455642 - DNA, 25 bp, Rattus norvegicus
gggcctaattaaactctgtcactag

SEQ ID NO: 455643 - DNA, 25 bp, Rattus norvegicus
gggcctaattaatctctgtcactag

SEQ ID NO: 455644 - DNA, 25 bp, Rattus norvegicus
gggcctaatttcatcaactcttgct

SEQ ID NO: 455645 - DNA, 25 bp, Rattus norvegicus
gggcctaatttcttcaactcttgct

SEQ ID NO: 455646 - DNA, 25 bp, Rattus norvegicus
gggcctacaaggacatctcatgctt

SEQ ID NO: 455647 - DNA, 25 bp, Rattus norvegicus
gggcctacaaggtcatctcatgctt

SEQ ID NO: 455648 - DNA, 25 bp, Rattus norvegicus
gggcctacagagatgttggtgttct

SEQ ID NO: 455649 - DNA, 25 bp, Rattus norvegicus
gggcctacagagttgttggtgttct

SEQ ID NO: 455650 - DNA, 25 bp, Rattus norvegicus
gggcctacattcatgcacatttgtg

SEQ ID NO: 455651 - DNA, 25 bp, Rattus norvegicus
gggcctacattcttgcacatttgtg

SEQ ID NO: 455652 - DNA, 25 bp, Rattus norvegicus
gggcctacctgtctagcctgaatta

SEQ ID NO: 455653 - DNA, 25 bp, Rattus norvegicus
gggcctacctgtgtagcctgaatta

SEQ ID NO: 455654 - DNA, 25 bp, Rattus norvegicus
gggcctagacctccagatgagaagc

SEQ ID NO: 455655 - DNA, 25 bp, Rattus norvegicus
gggcctagacctgcagatgagaagc

SEQ ID NO: 455656 - DNA, 25 bp, Rattus norvegicus
gggcctagagaaatctttgggttct

SEQ ID NO: 455657 - DNA, 25 bp, Rattus norvegicus
gggcctagagaattctttgggttct

SEQ ID NO: 455658 - DNA, 25 bp, Rattus norvegicus
gggcctagcacacggaacaacagtt

SEQ ID NO: 455659 - DNA, 25 bp, Rattus norvegicus
gggcctagcacagggaacaacagtt

SEQ ID NO: 455660 - DNA, 25 bp, Rattus norvegicus
gggcctagcatgcatggctctctga

SEQ ID NO: 455661 - DNA, 25 bp, Rattus norvegicus
gggcctagcatggatggctctctga

SEQ ID NO: 455662 - DNA, 25 bp, Rattus norvegicus
gggcctagcattccatgagccagta

SEQ ID NO: 455663 - DNA, 25 bp, Rattus norvegicus
gggcctagcattgcatgagccagta

SEQ ID NO: 455664 - DNA, 25 bp, Rattus norvegicus
gggcctagcctgacctggcgcggga

SEQ ID NO: 455665 - DNA, 25 bp, Rattus norvegicus
gggcctagcctgtcctggcgcggga

SEQ ID NO: 455666 - DNA, 25 bp, Rattus norvegicus
gggcctagctcgcaacactaatgta

SEQ ID NO: 455667 - DNA, 25 bp, Rattus norvegicus
gggcctagctcggaacactaatgta

SEQ ID NO: 455668 - DNA, 25 bp, Rattus norvegicus
gggcctagctgtcacctatacaata

SEQ ID NO: 455669 - DNA, 25 bp, Rattus norvegicus
gggcctagctgtgacctatacaata

SEQ ID NO: 455670 - DNA, 25 bp, Rattus norvegicus
gggcctagggatctaactgcatcac

SEQ ID NO: 455671 - DNA, 25 bp, Rattus norvegicus
gggcctagggatgtaactgcatcac

SEQ ID NO: 455672 - DNA, 25 bp, Rattus norvegicus
gggcctaggtacagcagactggcct

SEQ ID NO: 455673 - DNA, 25 bp, Rattus norvegicus
gggcctaggtactgcagactggcct

SEQ ID NO: 455674 - DNA, 25 bp, Rattus norvegicus
gggcctaggtgtagtcatgtatgaa

SEQ ID NO: 455675 - DNA, 25 bp, Rattus norvegicus
gggcctaggtgttgtcatgtatgaa

SEQ ID NO: 455676 - DNA, 25 bp, Rattus norvegicus
gggcctagtatcatctagtggttac

SEQ ID NO: 455677 - DNA, 25 bp, Rattus norvegicus
gggcctagtatcttctagtggttac

SEQ ID NO: 455678 - DNA, 25 bp, Rattus norvegicus
gggcctagtcataccagtggagagt

SEQ ID NO: 455679 - DNA, 25 bp, Rattus norvegicus
gggcctagtcattccagtggagagt

SEQ ID NO: 455680 - DNA, 25 bp, Rattus norvegicus
gggcctatcctgatggagctacaga

SEQ ID NO: 455681 - DNA, 25 bp, Rattus norvegicus
gggcctatcctgttggagctacaga

SEQ ID NO: 455682 - DNA, 25 bp, Rattus norvegicus
gggcctatttatcttccattgtaag

SEQ ID NO: 455683 - DNA, 25 bp, Rattus norvegicus
gggcctatttatgttccattgtaag

SEQ ID NO: 455684 - DNA, 25 bp, Rattus norvegicus
gggcctcaaaaaatgtgctctgttc

SEQ ID NO: 455685 - DNA, 25 bp, Rattus norvegicus
gggcctcaaaaattgtgctctgttc

SEQ ID NO: 455686 - DNA, 25 bp, Rattus norvegicus
gggcctcaaacgagacgctcatcag

SEQ ID NO: 455687 - DNA, 25 bp, Rattus norvegicus
gggcctcaaacgtgacgctcatcag

SEQ ID NO: 455688 - DNA, 25 bp, Rattus norvegicus
gggcctcaaactaagaccttctctt

SEQ ID NO: 455689 - DNA, 25 bp, Rattus norvegicus
gggcctcaaacttagaccttctctt

SEQ ID NO: 455690 - DNA, 25 bp, Rattus norvegicus
gggcctcaaattcgcagagctcgta

SEQ ID NO: 455691 - DNA, 25 bp, Rattus norvegicus
gggcctcaaattggcagagctcgta

SEQ ID NO: 455692 - DNA, 25 bp, Rattus norvegicus
gggcctcacacaccaacaggataaa

SEQ ID NO: 455693 - DNA, 25 bp, Rattus norvegicus
gggcctcacacagcaacaggataaa

SEQ ID NO: 455694 - DNA, 25 bp, Rattus norvegicus
gggcctcaccttcaaaagaggttgc

SEQ ID NO: 455695 - DNA, 25 bp, Rattus norvegicus
gggcctcaccttgaaaagaggttgc

SEQ ID NO: 455696 - DNA, 25 bp, Rattus norvegicus
gggcctcacgaccaaaaagctacat

SEQ ID NO: 455697 - DNA, 25 bp, Rattus norvegicus
gggcctcacgacgaaaaagctacat

SEQ ID NO: 455698 - DNA, 25 bp, Rattus norvegicus
gggcctcactggaacgaaccgaatc

SEQ ID NO: 455699 - DNA, 25 bp, Rattus norvegicus
gggcctcactggtacgaaccgaatc

SEQ ID NO: 455700 - DNA, 25 bp, Rattus norvegicus
gggcctcagaatctgaaacaccaag

SEQ ID NO: 455701 - DNA, 25 bp, Rattus norvegicus
gggcctcagaatgtgaaacaccaag

SEQ ID NO: 455702 - DNA, 25 bp, Rattus norvegicus
gggcctcagagacatctcaaggatt

SEQ ID NO: 455703 - DNA, 25 bp, Rattus norvegicus
gggcctcagagagatctcaaggatt

SEQ ID NO: 455704 - DNA, 25 bp, Rattus norvegicus
gggcctcagatgaaagctaccatgc

SEQ ID NO: 455705 - DNA, 25 bp, Rattus norvegicus
gggcctcagatgtaagctaccatgc

SEQ ID NO: 455706 - DNA, 25 bp, Rattus norvegicus
gggcctcagcaaccactgagaacaa

SEQ ID NO: 455707 - DNA, 25 bp, Rattus norvegicus
gggcctcagcaagcactgagaacaa

SEQ ID NO: 455708 - DNA, 25 bp, Rattus norvegicus
gggcctcagcagacaagttttgatg

SEQ ID NO: 455709 - DNA, 25 bp, Rattus norvegicus
gggcctcagcagtcaagttttgatg

SEQ ID NO: 455710 - DNA, 25 bp, Rattus norvegicus
gggcctcagcatcagattcaactct

SEQ ID NO: 455711 - DNA, 25 bp, Rattus norvegicus
gggcctcagcatcagtctggaactt

SEQ ID NO: 455712 - DNA, 25 bp, Rattus norvegicus
gggcctcagcatgagattcaactct

SEQ ID NO: 455713 - DNA, 25 bp, Rattus norvegicus
gggcctcagcatgagtctggaactt

SEQ ID NO: 455714 - DNA, 25 bp, Rattus norvegicus
gggcctcagctcctaggctgaaatc

SEQ ID NO: 455715 - DNA, 25 bp, Rattus norvegicus
gggcctcagctcgtaggctgaaatc

SEQ ID NO: 455716 - DNA, 25 bp, Rattus norvegicus
gggcctcaggagaagcatgctaacg

SEQ ID NO: 455717 - DNA, 25 bp, Rattus norvegicus
gggcctcaggagtagcatgctaacg

SEQ ID NO: 455718 - DNA, 25 bp, Rattus norvegicus
gggcctcagtcgctggcaggagtgg

SEQ ID NO: 455719 - DNA, 25 bp, Rattus norvegicus
gggcctcagtcggtggcaggagtgg

SEQ ID NO: 455720 - DNA, 25 bp, Rattus norvegicus
gggcctcagtgcagcccatgaccga

SEQ ID NO: 455721 - DNA, 25 bp, Rattus norvegicus
gggcctcagtgctgcccatgaccga

SEQ ID NO: 455722 - DNA, 25 bp, Rattus norvegicus
gggcctcagttgatgaatttgactt

SEQ ID NO: 455723 - DNA, 25 bp, Rattus norvegicus
gggcctcagttgttgaatttgactt

SEQ ID NO: 455724 - DNA, 25 bp, Rattus norvegicus
gggcctcataacaacagactctcct

SEQ ID NO: 455725 - DNA, 25 bp, Rattus norvegicus
gggcctcataactacagactctcct

SEQ ID NO: 455726 - DNA, 25 bp, Rattus norvegicus
gggcctcatagacacttcacatctc

SEQ ID NO: 455727 - DNA, 25 bp, Rattus norvegicus
gggcctcatagagacttcacatctc

SEQ ID NO: 455728 - DNA, 25 bp, Rattus norvegicus
gggcctcatcaacgtcaaagcggtt

SEQ ID NO: 455729 - DNA, 25 bp, Rattus norvegicus
gggcctcatcaaggtcaaagcggtt

SEQ ID NO: 455730 - DNA, 25 bp, Rattus norvegicus
gggcctcatcagacatttgacaggg

SEQ ID NO: 455731 - DNA, 25 bp, Rattus norvegicus
gggcctcatcagtcatttgacaggg

SEQ ID NO: 455732 - DNA, 25 bp, Rattus norvegicus
gggcctcatccaacaccgatgtggg

SEQ ID NO: 455733 - DNA, 25 bp, Rattus norvegicus
gggcctcatccatcaccgatgtggg

SEQ ID NO: 455734 - DNA, 25 bp, Rattus norvegicus
gggcctcatcgcctacatgatgaat

SEQ ID NO: 455735 - DNA, 25 bp, Rattus norvegicus
gggcctcatcgcgtacatgatgaat

SEQ ID NO: 455736 - DNA, 25 bp, Rattus norvegicus
gggcctcatgcaatctaggttttga

SEQ ID NO: 455737 - DNA, 25 bp, Rattus norvegicus
gggcctcatgcattctaggttttga

SEQ ID NO: 455738 - DNA, 25 bp, Rattus norvegicus
gggcctcatgctacagctatattca

SEQ ID NO: 455739 - DNA, 25 bp, Rattus norvegicus
gggcctcatgcttcagctatattca

SEQ ID NO: 455740 - DNA, 25 bp, Rattus norvegicus
gggcctcattagatccactgattga

SEQ ID NO: 455741 - DNA, 25 bp, Rattus norvegicus
gggcctcattagttccactgattga

SEQ ID NO: 455742 - DNA, 25 bp, Rattus norvegicus
gggcctcattcaatcaaactggaca

SEQ ID NO: 455743 - DNA, 25 bp, Rattus norvegicus
gggcctcattcattcaaactggaca

SEQ ID NO: 455744 - DNA, 25 bp, Rattus norvegicus
gggcctcatttcatgctgcagagaa

SEQ ID NO: 455745 - DNA, 25 bp, Rattus norvegicus
gggcctcatttcttgctgcagagaa

SEQ ID NO: 455746 - DNA, 25 bp, Rattus norvegicus
gggcctccaaataatagctacctcc

SEQ ID NO: 455747 - DNA, 25 bp, Rattus norvegicus
gggcctccaaattatagctacctcc

SEQ ID NO: 455748 - DNA, 25 bp, Rattus norvegicus
gggcctccaagaccaacaaattcag

SEQ ID NO: 455749 - DNA, 25 bp, Rattus norvegicus
gggcctccaagagcaacaaattcag

SEQ ID NO: 455750 - DNA, 25 bp, Rattus norvegicus
gggcctccacaccagaaggaacatc

SEQ ID NO: 455751 - DNA, 25 bp, Rattus norvegicus
gggcctccacacgagaaggaacatc

SEQ ID NO: 455752 - DNA, 25 bp, Rattus norvegicus
gggcctccacatatggatttggaac

SEQ ID NO: 455753 - DNA, 25 bp, Rattus norvegicus
gggcctccacatttggatttggaac

SEQ ID NO: 455754 - DNA, 25 bp, Rattus norvegicus
gggcctccagcaactaagaatctta

SEQ ID NO: 455755 - DNA, 25 bp, Rattus norvegicus
gggcctccagcatctaagaatctta

SEQ ID NO: 455756 - DNA, 25 bp, Rattus norvegicus
gggcctccatcacttggaatacaga

SEQ ID NO: 455757 - DNA, 25 bp, Rattus norvegicus
gggcctccatcagttggaatacaga

SEQ ID NO: 455758 - DNA, 25 bp, Rattus norvegicus
gggcctccatcgctctgaatgacgc

SEQ ID NO: 455759 - DNA, 25 bp, Rattus norvegicus
gggcctccatcggtctgaatgacgc

SEQ ID NO: 455760 - DNA, 25 bp, Rattus norvegicus
gggcctccatttcatagctggtaga

SEQ ID NO: 455761 - DNA, 25 bp, Rattus norvegicus
gggcctccatttgatagctggtaga

SEQ ID NO: 455762 - DNA, 25 bp, Rattus norvegicus
gggcctcccaatctaagccagggta

SEQ ID NO: 455763 - DNA, 25 bp, Rattus norvegicus
gggcctcccaatgtaagccagggta

SEQ ID NO: 455764 - DNA, 25 bp, Rattus norvegicus
gggcctccctgcagctagaaagcat

SEQ ID NO: 455765 - DNA, 25 bp, Rattus norvegicus
gggcctccctgctgctagaaagcat

SEQ ID NO: 455766 - DNA, 25 bp, Rattus norvegicus
gggcctccgaaaaggcaggcatgca

SEQ ID NO: 455767 - DNA, 25 bp, Rattus norvegicus
gggcctccgaaatggcaggcatgca

SEQ ID NO: 455768 - DNA, 25 bp, Rattus norvegicus
gggcctccggccagcgtggtgtccg

SEQ ID NO: 455769 - DNA, 25 bp, Rattus norvegicus
gggcctccggcctgcgtggtgtccg

SEQ ID NO: 455770 - DNA, 25 bp, Rattus norvegicus
gggcctcctcagaattcttttggta

SEQ ID NO: 455771 - DNA, 25 bp, Rattus norvegicus
gggcctcctcagtattcttttggta

SEQ ID NO: 455772 - DNA, 25 bp, Rattus norvegicus
gggcctcctctcagtaatctcattg

SEQ ID NO: 455773 - DNA, 25 bp, Rattus norvegicus
gggcctcctctctgtaatctcattg

SEQ ID NO: 455774 - DNA, 25 bp, Rattus norvegicus
gggcctcctgcaaatttgaattggt

SEQ ID NO: 455775 - DNA, 25 bp, Rattus norvegicus
gggcctcctgcatatttgaattggt

SEQ ID NO: 455776 - DNA, 25 bp, Rattus norvegicus
gggcctcgacatatctaagtaaatc

SEQ ID NO: 455777 - DNA, 25 bp, Rattus norvegicus
gggcctcgacatttctaagtaaatc

SEQ ID NO: 455778 - DNA, 25 bp, Rattus norvegicus
gggcctcggtcaacaagccatttat

SEQ ID NO: 455779 - DNA, 25 bp, Rattus norvegicus
gggcctcggtcatcaagccatttat

SEQ ID NO: 455780 - DNA, 25 bp, Rattus norvegicus
gggcctcgttgtagttcgtctcggt

SEQ ID NO: 455781 - DNA, 25 bp, Rattus norvegicus
gggcctcgttgttgttcgtctcggt

SEQ ID NO: 455782 - DNA, 25 bp, Rattus norvegicus
gggcctctaacccagtgagacagct

SEQ ID NO: 455783 - DNA, 25 bp, Rattus norvegicus
gggcctctaaccgagtgagacagct

SEQ ID NO: 455784 - DNA, 25 bp, Rattus norvegicus
gggcctctagacatttctgagatac

SEQ ID NO: 455785 - DNA, 25 bp, Rattus norvegicus
gggcctctagacttttctgagatac

SEQ ID NO: 455786 - DNA, 25 bp, Rattus norvegicus
gggcctctcagaaatagtgtttgct

SEQ ID NO: 455787 - DNA, 25 bp, Rattus norvegicus
gggcctctcagatatagtgtttgct

SEQ ID NO: 455788 - DNA, 25 bp, Rattus norvegicus
gggcctctcagtactaccaggagca

SEQ ID NO: 455789 - DNA, 25 bp, Rattus norvegicus
gggcctctcagtagtccacaggaaa

SEQ ID NO: 455790 - DNA, 25 bp, Rattus norvegicus
gggcctctcagtatcgagactgcag

SEQ ID NO: 455791 - DNA, 25 bp, Rattus norvegicus
gggcctctcagttctaccaggagca

SEQ ID NO: 455792 - DNA, 25 bp, Rattus norvegicus
gggcctctcagttgtccacaggaaa

SEQ ID NO: 455793 - DNA, 25 bp, Rattus norvegicus
gggcctctcagtttcgagactgcag

SEQ ID NO: 455794 - DNA, 25 bp, Rattus norvegicus
gggcctctcatgagtgacagtctca

SEQ ID NO: 455795 - DNA, 25 bp, Rattus norvegicus
gggcctctcatgtgtgacagtctca

SEQ ID NO: 455796 - DNA, 25 bp, Rattus norvegicus
gggcctctcccaataatcagagtat

SEQ ID NO: 455797 - DNA, 25 bp, Rattus norvegicus
gggcctctcccattaatcagagtat

SEQ ID NO: 455798 - DNA, 25 bp, Rattus norvegicus
gggcctctcctcaacaactaaagaa

SEQ ID NO: 455799 - DNA, 25 bp, Rattus norvegicus
gggcctctcctctacaactaaagaa

SEQ ID NO: 455800 - DNA, 25 bp, Rattus norvegicus
gggcctctcgagacggtggacgcgc

SEQ ID NO: 455801 - DNA, 25 bp, Rattus norvegicus
gggcctctcgagtcggtggacgcgc

SEQ ID NO: 455802 - DNA, 25 bp, Rattus norvegicus
gggcctctctagatgctgttagcaa

SEQ ID NO: 455803 - DNA, 25 bp, Rattus norvegicus
gggcctctctagttgctgttagcaa

SEQ ID NO: 455804 - DNA, 25 bp, Rattus norvegicus
gggcctctctgacaggcaatgaaga

SEQ ID NO: 455805 - DNA, 25 bp, Rattus norvegicus
gggcctctctgagaggcaatgaaga

SEQ ID NO: 455806 - DNA, 25 bp, Rattus norvegicus
gggcctctgaaaaccaggtccagtg

SEQ ID NO: 455807 - DNA, 25 bp, Rattus norvegicus
gggcctctgaaatccaggtccagtg

SEQ ID NO: 455808 - DNA, 25 bp, Rattus norvegicus
gggcctctgcacaaagagtaggttt

SEQ ID NO: 455809 - DNA, 25 bp, Rattus norvegicus
gggcctctgcactaagagtaggttt

SEQ ID NO: 455810 - DNA, 25 bp, Rattus norvegicus
gggcctctgctgctggctttgcctt

SEQ ID NO: 455811 - DNA, 25 bp, Rattus norvegicus
gggcctctgctggtggctttgcctt

SEQ ID NO: 455812 - DNA, 25 bp, Rattus norvegicus
gggcctctggagaatacctgtccaa

SEQ ID NO: 455813 - DNA, 25 bp, Rattus norvegicus
gggcctctggagtatacctgtccaa

SEQ ID NO: 455814 - DNA, 25 bp, Rattus norvegicus
gggcctctggccaaaacagtctggt

SEQ ID NO: 455815 - DNA, 25 bp, Rattus norvegicus
gggcctctggccaaagttgcctata

SEQ ID NO: 455816 - DNA, 25 bp, Rattus norvegicus
gggcctctggcctaaacagtctggt

SEQ ID NO: 455817 - DNA, 25 bp, Rattus norvegicus
gggcctctggcctaagttgcctata

SEQ ID NO: 455818 - DNA, 25 bp, Rattus norvegicus
gggcctctggtcaagcaaagagctc

SEQ ID NO: 455819 - DNA, 25 bp, Rattus norvegicus
gggcctctggtctagcaaagagctc

SEQ ID NO: 455820 - DNA, 25 bp, Rattus norvegicus
gggcctctgtccatagtgacaacag

SEQ ID NO: 455821 - DNA, 25 bp, Rattus norvegicus
gggcctctgtccttagtgacaacag

SEQ ID NO: 455822 - DNA, 25 bp, Rattus norvegicus
gggcctctgttgagtgaacccttgg

SEQ ID NO: 455823 - DNA, 25 bp, Rattus norvegicus
gggcctctgttgtgtgaacccttgg

SEQ ID NO: 455824 - DNA, 25 bp, Rattus norvegicus
gggcctcttactcattgccttatac

SEQ ID NO: 455825 - DNA, 25 bp, Rattus norvegicus
gggcctcttactgattgccttatac

SEQ ID NO: 455826 - DNA, 25 bp, Rattus norvegicus
gggcctcttgagcacttgtaaacaa

SEQ ID NO: 455827 - DNA, 25 bp, Rattus norvegicus
gggcctcttgaggacttgtaaacaa

SEQ ID NO: 455828 - DNA, 25 bp, Rattus norvegicus
gggcctcttgcacttttgcaactgt

SEQ ID NO: 455829 - DNA, 25 bp, Rattus norvegicus
gggcctcttgcagttttgcaactgt

SEQ ID NO: 455830 - DNA, 25 bp, Rattus norvegicus
gggcctcttggtagttttcgagcat

SEQ ID NO: 455831 - DNA, 25 bp, Rattus norvegicus
gggcctcttggttgttttcgagcat

SEQ ID NO: 455832 - DNA, 25 bp, Rattus norvegicus
gggcctctttacaacgagttcaagg

SEQ ID NO: 455833 - DNA, 25 bp, Rattus norvegicus
gggcctctttactacgagttcaagg

SEQ ID NO: 455834 - DNA, 25 bp, Rattus norvegicus
gggcctctttatcatcgatgccaag

SEQ ID NO: 455835 - DNA, 25 bp, Rattus norvegicus
gggcctctttatgatcgatgccaag

SEQ ID NO: 455836 - DNA, 25 bp, Rattus norvegicus
gggcctctttctatcaaggatacct

SEQ ID NO: 455837 - DNA, 25 bp, Rattus norvegicus
gggcctctttctttcaaggatacct

SEQ ID NO: 455838 - DNA, 25 bp, Rattus norvegicus
gggcctgaaagaccaaaccgtccag

SEQ ID NO: 455839 - DNA, 25 bp, Rattus norvegicus
gggcctgaaagagcaaaccgtccag

SEQ ID NO: 455840 - DNA, 25 bp, Rattus norvegicus
gggcctgaaatacagtctaccacca

SEQ ID NO: 455841 - DNA, 25 bp, Rattus norvegicus
gggcctgaaatagagtctaccacca

SEQ ID NO: 455842 - DNA, 25 bp, Rattus norvegicus
gggcctgaactgactgtggatccag

SEQ ID NO: 455843 - DNA, 25 bp, Rattus norvegicus
gggcctgaactgtctgtggatccag

SEQ ID NO: 455844 - DNA, 25 bp, Rattus norvegicus
gggcctgaagagctgactatctcct

SEQ ID NO: 455845 - DNA, 25 bp, Rattus norvegicus
gggcctgaagaggtgactatctcct

SEQ ID NO: 455846 - DNA, 25 bp, Rattus norvegicus
gggcctgaagcaacctagcttttgg

SEQ ID NO: 455847 - DNA, 25 bp, Rattus norvegicus
gggcctgaagcatcctagcttttgg

SEQ ID NO: 455848 - DNA, 25 bp, Rattus norvegicus
gggcctgaatatacacacatgaatg

SEQ ID NO: 455849 - DNA, 25 bp, Rattus norvegicus
gggcctgaatattcacacatgaatg

SEQ ID NO: 455850 - DNA, 25 bp, Rattus norvegicus
gggcctgacagacctatttctggca

SEQ ID NO: 455851 - DNA, 25 bp, Rattus norvegicus
gggcctgacagagctatttctggca

SEQ ID NO: 455852 - DNA, 25 bp, Rattus norvegicus
gggcctgaccatcaactgagcagtg

SEQ ID NO: 455853 - DNA, 25 bp, Rattus norvegicus
gggcctgaccatgaactgagcagtg

SEQ ID NO: 455854 - DNA, 25 bp, Rattus norvegicus
gggcctgactgaaacccagaagcct

SEQ ID NO: 455855 - DNA, 25 bp, Rattus norvegicus
gggcctgactgatacccagaagcct

SEQ ID NO: 455856 - DNA, 25 bp, Rattus norvegicus
gggcctgaggcacctaagacgccct

SEQ ID NO: 455857 - DNA, 25 bp, Rattus norvegicus
gggcctgaggcagctaagacgccct

SEQ ID NO: 455858 - DNA, 25 bp, Rattus norvegicus
gggcctgagggtaacattttggact

SEQ ID NO: 455859 - DNA, 25 bp, Rattus norvegicus
gggcctgagggttacattttggact

SEQ ID NO: 455860 - DNA, 25 bp, Rattus norvegicus
gggcctgatgcacctggaagacact

SEQ ID NO: 455861 - DNA, 25 bp, Rattus norvegicus
gggcctgatgcagctggaagacact

SEQ ID NO: 455862 - DNA, 25 bp, Rattus norvegicus
gggcctgatgtgaaactcctgtcaa

SEQ ID NO: 455863 - DNA, 25 bp, Rattus norvegicus
gggcctgatgtgtaactcctgtcaa

SEQ ID NO: 455864 - DNA, 25 bp, Rattus norvegicus
gggcctgattggctatcacctatac

SEQ ID NO: 455865 - DNA, 25 bp, Rattus norvegicus
gggcctgattgggtatcacctatac

SEQ ID NO: 455866 - DNA, 25 bp, Rattus norvegicus
gggcctgcaacgaactctatgcctt

SEQ ID NO: 455867 - DNA, 25 bp, Rattus norvegicus
gggcctgcaacgtactctatgcctt

SEQ ID NO: 455868 - DNA, 25 bp, Rattus norvegicus
gggcctgcagtcattgccccagaag

SEQ ID NO: 455869 - DNA, 25 bp, Rattus norvegicus
gggcctgcagtctttgccccagaag

SEQ ID NO: 455870 - DNA, 25 bp, Rattus norvegicus
gggcctgcatagctacaatgcacaa

SEQ ID NO: 455871 - DNA, 25 bp, Rattus norvegicus
gggcctgcataggtacaatgcacaa

SEQ ID NO: 455872 - DNA, 25 bp, Rattus norvegicus
gggcctgcatcactctgggtgcata

SEQ ID NO: 455873 - DNA, 25 bp, Rattus norvegicus
gggcctgcatcagtctgggtgcata

SEQ ID NO: 455874 - DNA, 25 bp, Rattus norvegicus
gggcctgccaagcacaaactggtca

SEQ ID NO: 455875 - DNA, 25 bp, Rattus norvegicus
gggcctgccaaggacaaactggtca

SEQ ID NO: 455876 - DNA, 25 bp, Rattus norvegicus
gggcctgcccatccattgtaacttg

SEQ ID NO: 455877 - DNA, 25 bp, Rattus norvegicus
gggcctgcccatgcattgtaacttg

SEQ ID NO: 455878 - DNA, 25 bp, Rattus norvegicus
gggcctgcccgaaagagtctaaagc

SEQ ID NO: 455879 - DNA, 25 bp, Rattus norvegicus
gggcctgcccgatagagtctaaagc

SEQ ID NO: 455880 - DNA, 25 bp, Rattus norvegicus
gggcctgccgagacaaggttcctta

SEQ ID NO: 455881 - DNA, 25 bp, Rattus norvegicus
gggcctgccgagtcaaggttcctta

SEQ ID NO: 455882 - DNA, 25 bp, Rattus norvegicus
gggcctgcggccagaagtaacatgc

SEQ ID NO: 455883 - DNA, 25 bp, Rattus norvegicus
gggcctgcggcctgaagtaacatgc

SEQ ID NO: 455884 - DNA, 25 bp, Rattus norvegicus
gggcctgcggctccaatggttaaac

SEQ ID NO: 455885 - DNA, 25 bp, Rattus norvegicus
gggcctgcggctgcaatggttaaac

SEQ ID NO: 455886 - DNA, 25 bp, Rattus norvegicus
gggcctgctagaatcctacagcgta

SEQ ID NO: 455887 - DNA, 25 bp, Rattus norvegicus
gggcctgctagattcctacagcgta

SEQ ID NO: 455888 - DNA, 25 bp, Rattus norvegicus
gggcctgctccaaaaaccactgagt

SEQ ID NO: 455889 - DNA, 25 bp, Rattus norvegicus
gggcctgctccataaaccactgagt

SEQ ID NO: 455890 - DNA, 25 bp, Rattus norvegicus
gggcctgctgctaaatgagatttcg

SEQ ID NO: 455891 - DNA, 25 bp, Rattus norvegicus
gggcctgctgcttaatgagatttcg

SEQ ID NO: 455892 - DNA, 25 bp, Rattus norvegicus
gggcctgctgttcttaaagactcgg

SEQ ID NO: 455893 - DNA, 25 bp, Rattus norvegicus
gggcctgctgttgttaaagactcgg

SEQ ID NO: 455894 - DNA, 25 bp, Rattus norvegicus
gggcctgcttagactgggattgaca

SEQ ID NO: 455895 - DNA, 25 bp, Rattus norvegicus
gggcctgcttagtctgggattgaca

SEQ ID NO: 455896 - DNA, 25 bp, Rattus norvegicus
gggcctgcttcaaatcatgggactc

SEQ ID NO: 455897 - DNA, 25 bp, Rattus norvegicus
gggcctgcttcatatcatgggactc

SEQ ID NO: 455898 - DNA, 25 bp, Rattus norvegicus
gggcctgcttccaacaaaggcggtt

SEQ ID NO: 455899 - DNA, 25 bp, Rattus norvegicus
gggcctgcttcctacaaaggcggtt

SEQ ID NO: 455900 - DNA, 25 bp, Rattus norvegicus
gggcctggagagatgacttgctctt

SEQ ID NO: 455901 - DNA, 25 bp, Rattus norvegicus
gggcctggagagttgacttgctctt

SEQ ID NO: 455902 - DNA, 25 bp, Rattus norvegicus
gggcctggagcaaagaagtctgcca

SEQ ID NO: 455903 - DNA, 25 bp, Rattus norvegicus
gggcctggagcatagaagtctgcca

SEQ ID NO: 455904 - DNA, 25 bp, Rattus norvegicus
gggcctggcaaaatgccagcgccat

SEQ ID NO: 455905 - DNA, 25 bp, Rattus norvegicus
gggcctggcaaattgccagcgccat

SEQ ID NO: 455906 - DNA, 25 bp, Rattus norvegicus
gggcctggcaccagcagctgaaagc

SEQ ID NO: 455907 - DNA, 25 bp, Rattus norvegicus
gggcctggcaccctcgaagctatgc

SEQ ID NO: 455908 - DNA, 25 bp, Rattus norvegicus
gggcctggcaccgtcgaagctatgc

SEQ ID NO: 455909 - DNA, 25 bp, Rattus norvegicus
gggcctggcacctgcagctgaaagc

SEQ ID NO: 455910 - DNA, 25 bp, Rattus norvegicus
gggcctggcagaacttcaagtcatt

SEQ ID NO: 455911 - DNA, 25 bp, Rattus norvegicus
gggcctggcagatcttcaagtcatt

SEQ ID NO: 455912 - DNA, 25 bp, Rattus norvegicus
gggcctggcatgctggaacatactt

SEQ ID NO: 455913 - DNA, 25 bp, Rattus norvegicus
gggcctggcatggtggaacatactt

SEQ ID NO: 455914 - DNA, 25 bp, Rattus norvegicus
gggcctggcattcaggaccctcgct

SEQ ID NO: 455915 - DNA, 25 bp, Rattus norvegicus
gggcctggcattgaggaccctcgct

SEQ ID NO: 455916 - DNA, 25 bp, Rattus norvegicus
gggcctggcctcagaagactcagga

SEQ ID NO: 455917 - DNA, 25 bp, Rattus norvegicus
gggcctggcctctgaagactcagga

SEQ ID NO: 455918 - DNA, 25 bp, Rattus norvegicus
gggcctggtatgattctgtccatac

SEQ ID NO: 455919 - DNA, 25 bp, Rattus norvegicus
gggcctggtatgtttctgtccatac

SEQ ID NO: 455920 - DNA, 25 bp, Rattus norvegicus
gggcctggtgcaactttcagatctt

SEQ ID NO: 455921 - DNA, 25 bp, Rattus norvegicus
gggcctggtgcatctttcagatctt

SEQ ID NO: 455922 - DNA, 25 bp, Rattus norvegicus
gggcctggtggaaaacggactcatc

SEQ ID NO: 455923 - DNA, 25 bp, Rattus norvegicus
gggcctggtggataacggactcatc

SEQ ID NO: 455924 - DNA, 25 bp, Rattus norvegicus
gggcctggtgtgcttttgcaaataa

SEQ ID NO: 455925 - DNA, 25 bp, Rattus norvegicus
gggcctggtgtggttttgcaaataa

SEQ ID NO: 455926 - DNA, 25 bp, Rattus norvegicus
gggcctgtaagtcttcgagttacaa

SEQ ID NO: 455927 - DNA, 25 bp, Rattus norvegicus
gggcctgtaagtgttcgagttacaa

SEQ ID NO: 455928 - DNA, 25 bp, Rattus norvegicus
gggcctgtacacacccataaatgca

SEQ ID NO: 455929 - DNA, 25 bp, Rattus norvegicus
gggcctgtacactcccataaatgca

SEQ ID NO: 455930 - DNA, 25 bp, Rattus norvegicus
gggcctgtacctaagtgtttctctc

SEQ ID NO: 455931 - DNA, 25 bp, Rattus norvegicus
gggcctgtaccttagtgtttctctc

SEQ ID NO: 455932 - DNA, 25 bp, Rattus norvegicus
gggcctgtagccaacgtgtgaacag

SEQ ID NO: 455933 - DNA, 25 bp, Rattus norvegicus
gggcctgtagcctacgtgtgaacag

SEQ ID NO: 455934 - DNA, 25 bp, Rattus norvegicus
gggcctgtaggtaccagagccttag

SEQ ID NO: 455935 - DNA, 25 bp, Rattus norvegicus
gggcctgtaggttccagagccttag

SEQ ID NO: 455936 - DNA, 25 bp, Rattus norvegicus
gggcctgtatttaacacgttgtgca

SEQ ID NO: 455937 - DNA, 25 bp, Rattus norvegicus
gggcctgtattttacacgttgtgca

SEQ ID NO: 455938 - DNA, 25 bp, Rattus norvegicus
gggcctgtccatagctgtggaaagt

SEQ ID NO: 455939 - DNA, 25 bp, Rattus norvegicus
gggcctgtccattgctgtggaaagt

SEQ ID NO: 455940 - DNA, 25 bp, Rattus norvegicus
gggcctgtctttactctaagggaca

SEQ ID NO: 455941 - DNA, 25 bp, Rattus norvegicus
gggcctgtcttttctctaagggaca

SEQ ID NO: 455942 - DNA, 25 bp, Rattus norvegicus
gggcctgtgaagaccatccaaggga

SEQ ID NO: 455943 - DNA, 25 bp, Rattus norvegicus
gggcctgtgaagtccatccaaggga

SEQ ID NO: 455944 - DNA, 25 bp, Rattus norvegicus
gggcctgtggatcaattccccaagg

SEQ ID NO: 455945 - DNA, 25 bp, Rattus norvegicus
gggcctgtggatgaattccccaagg

SEQ ID NO: 455946 - DNA, 25 bp, Rattus norvegicus
gggcctgtggccaaacagttttaca

SEQ ID NO: 455947 - DNA, 25 bp, Rattus norvegicus
gggcctgtggcctaacagttttaca

SEQ ID NO: 455948 - DNA, 25 bp, Rattus norvegicus
gggcctgtggctaagtaaaccatac

SEQ ID NO: 455949 - DNA, 25 bp, Rattus norvegicus
gggcctgtggcttagtaaaccatac

SEQ ID NO: 455950 - DNA, 25 bp, Rattus norvegicus
gggcctgtgtaaacgcaccgatggt

SEQ ID NO: 455951 - DNA, 25 bp, Rattus norvegicus
gggcctgtgtaatcgcaccgatggt

SEQ ID NO: 455952 - DNA, 25 bp, Rattus norvegicus
gggcctgtgtatcaagtgagaatca

SEQ ID NO: 455953 - DNA, 25 bp, Rattus norvegicus
gggcctgtgtatgaagtgagaatca

SEQ ID NO: 455954 - DNA, 25 bp, Rattus norvegicus
gggcctgttcagatggtatttccag

SEQ ID NO: 455955 - DNA, 25 bp, Rattus norvegicus
gggcctgttcagttggtatttccag

SEQ ID NO: 455956 - DNA, 25 bp, Rattus norvegicus
gggcctgttcctccattctgagaag

SEQ ID NO: 455957 - DNA, 25 bp, Rattus norvegicus
gggcctgttcctgcattctgagaag

SEQ ID NO: 455958 - DNA, 25 bp, Rattus norvegicus
gggcctgttgttcccagataaaaat

SEQ ID NO: 455959 - DNA, 25 bp, Rattus norvegicus
gggcctgttgttgccagataaaaat

SEQ ID NO: 455960 - DNA, 25 bp, Rattus norvegicus
gggcctgtttggattcaagacaata

SEQ ID NO: 455961 - DNA, 25 bp, Rattus norvegicus
gggcctgtttggtttcaagacaata

SEQ ID NO: 455962 - DNA, 25 bp, Rattus norvegicus
gggccttaatgtattgtccttcttt

SEQ ID NO: 455963 - DNA, 25 bp, Rattus norvegicus
gggccttaatgttttgtccttcttt

SEQ ID NO: 455964 - DNA, 25 bp, Rattus norvegicus
gggccttaccatctttttagtcaga

SEQ ID NO: 455965 - DNA, 25 bp, Rattus norvegicus
gggccttaccatgtttttagtcaga

SEQ ID NO: 455966 - DNA, 25 bp, Rattus norvegicus
gggccttactctaatgatcactcaa

SEQ ID NO: 455967 - DNA, 25 bp, Rattus norvegicus
gggccttactcttatgatcactcaa

SEQ ID NO: 455968 - DNA, 25 bp, Rattus norvegicus
gggccttagcacaccagaacactgt

SEQ ID NO: 455969 - DNA, 25 bp, Rattus norvegicus
gggccttagcactccagaacactgt

SEQ ID NO: 455970 - DNA, 25 bp, Rattus norvegicus
gggccttatctccactgtgaacaat

SEQ ID NO: 455971 - DNA, 25 bp, Rattus norvegicus
gggccttatctcgactgtgaacaat

SEQ ID NO: 455972 - DNA, 25 bp, Rattus norvegicus
gggccttatctgaggtggcactaat

SEQ ID NO: 455973 - DNA, 25 bp, Rattus norvegicus
gggccttatctgtggtggcactaat

SEQ ID NO: 455974 - DNA, 25 bp, Rattus norvegicus
gggccttatggcaaacctgcaagtt

SEQ ID NO: 455975 - DNA, 25 bp, Rattus norvegicus
gggccttatggctaacctgcaagtt

SEQ ID NO: 455976 - DNA, 25 bp, Rattus norvegicus
gggccttcaagcactgggtgctcta

SEQ ID NO: 455977 - DNA, 25 bp, Rattus norvegicus
gggccttcaagctctgggtgctcta

SEQ ID NO: 455978 - DNA, 25 bp, Rattus norvegicus
gggccttcacaaccctgatgcgaaa

SEQ ID NO: 455979 - DNA, 25 bp, Rattus norvegicus
gggccttcacaagcctgatgcgaaa

SEQ ID NO: 455980 - DNA, 25 bp, Rattus norvegicus
gggccttcacataccagagtcaatg

SEQ ID NO: 455981 - DNA, 25 bp, Rattus norvegicus
gggccttcacattccagagtcaatg

SEQ ID NO: 455982 - DNA, 25 bp, Rattus norvegicus
gggccttcaccaacagatgtcattg

SEQ ID NO: 455983 - DNA, 25 bp, Rattus norvegicus
gggccttcaccatcagatgtcattg

SEQ ID NO: 455984 - DNA, 25 bp, Rattus norvegicus
gggccttcacctctgaaccatagtg

SEQ ID NO: 455985 - DNA, 25 bp, Rattus norvegicus
gggccttcacctgtgaaccatagtg

SEQ ID NO: 455986 - DNA, 25 bp, Rattus norvegicus
gggccttcagaactgcaactcgtac

SEQ ID NO: 455987 - DNA, 25 bp, Rattus norvegicus
gggccttcagaagtgcaactcgtac

SEQ ID NO: 455988 - DNA, 25 bp, Rattus norvegicus
gggccttcatctcctttgtaattaa

SEQ ID NO: 455989 - DNA, 25 bp, Rattus norvegicus
gggccttcatctgctttgtaattaa

SEQ ID NO: 455990 - DNA, 25 bp, Rattus norvegicus
gggccttcatgcagcagtttatctt

SEQ ID NO: 455991 - DNA, 25 bp, Rattus norvegicus
gggccttcatgctgcagtttatctt

SEQ ID NO: 455992 - DNA, 25 bp, Rattus norvegicus
gggccttcctccagggaatgtaact

SEQ ID NO: 455993 - DNA, 25 bp, Rattus norvegicus
gggccttcctcctgggaatgtaact

SEQ ID NO: 455994 - DNA, 25 bp, Rattus norvegicus
gggccttccttccaaattcagaaag

SEQ ID NO: 455995 - DNA, 25 bp, Rattus norvegicus
gggccttccttcgaaattcagaaag

SEQ ID NO: 455996 - DNA, 25 bp, Rattus norvegicus
gggccttcgctgacatgcgctggaa

SEQ ID NO: 455997 - DNA, 25 bp, Rattus norvegicus
gggccttcgctgtcatgcgctggaa

SEQ ID NO: 455998 - DNA, 25 bp, Rattus norvegicus
gggccttctatcataaaaaccatga

SEQ ID NO: 455999 - DNA, 25 bp, Rattus norvegicus
gggccttctatcttaaaaaccatga

SEQ ID NO: 456000 - DNA, 25 bp, Rattus norvegicus
gggccttctccaaatgagatccaac

SEQ ID NO: 456001 - DNA, 25 bp, Rattus norvegicus
gggccttctccatatgagatccaac

SEQ ID NO: 456002 - DNA, 25 bp, Rattus norvegicus
gggccttctgcaatccaggaagcat

SEQ ID NO: 456003 - DNA, 25 bp, Rattus norvegicus
gggccttctgcattccaggaagcat

SEQ ID NO: 456004 - DNA, 25 bp, Rattus norvegicus
gggccttctgctaattggatgagca

SEQ ID NO: 456005 - DNA, 25 bp, Rattus norvegicus
gggccttctgcttattggatgagca

SEQ ID NO: 456006 - DNA, 25 bp, Rattus norvegicus
gggccttctgtaaacattgcctcaa

SEQ ID NO: 456007 - DNA, 25 bp, Rattus norvegicus
gggccttctgtatacattgcctcaa

SEQ ID NO: 456008 - DNA, 25 bp, Rattus norvegicus
gggccttcttcaaagtgtccttgaa

SEQ ID NO: 456009 - DNA, 25 bp, Rattus norvegicus
gggccttcttcatagtgtccttgaa

SEQ ID NO: 456010 - DNA, 25 bp, Rattus norvegicus
gggccttcttttatgatccaggact

SEQ ID NO: 456011 - DNA, 25 bp, Rattus norvegicus
gggccttcttttttgatccaggact

SEQ ID NO: 456012 - DNA, 25 bp, Rattus norvegicus
gggccttgacctcgaaagttgcctc

SEQ ID NO: 456013 - DNA, 25 bp, Rattus norvegicus
gggccttgacctggaaagttgcctc

SEQ ID NO: 456014 - DNA, 25 bp, Rattus norvegicus
gggccttgagggaaacgacatccgc

SEQ ID NO: 456015 - DNA, 25 bp, Rattus norvegicus
gggccttgagggtaacgacatccgc

SEQ ID NO: 456016 - DNA, 25 bp, Rattus norvegicus
gggccttgcaggctacactgacttg

SEQ ID NO: 456017 - DNA, 25 bp, Rattus norvegicus
gggccttgcagggtacactgacttg

SEQ ID NO: 456018 - DNA, 25 bp, Rattus norvegicus
gggccttgcagtaagcaggagcatt

SEQ ID NO: 456019 - DNA, 25 bp, Rattus norvegicus
gggccttgcagttagcaggagcatt

SEQ ID NO: 456020 - DNA, 25 bp, Rattus norvegicus
gggccttgcctaatagtaattgtgt

SEQ ID NO: 456021 - DNA, 25 bp, Rattus norvegicus
gggccttgcctattagtaattgtgt

SEQ ID NO: 456022 - DNA, 25 bp, Rattus norvegicus
gggccttgcctgagtaaccacagag

SEQ ID NO: 456023 - DNA, 25 bp, Rattus norvegicus
gggccttgcctgtgtaaccacagag

SEQ ID NO: 456024 - DNA, 25 bp, Rattus norvegicus
gggccttgctgcaagaacaagccag

SEQ ID NO: 456025 - DNA, 25 bp, Rattus norvegicus
gggccttgctgccaggtatgaatca

SEQ ID NO: 456026 - DNA, 25 bp, Rattus norvegicus
gggccttgctgcgaggtatgaatca

SEQ ID NO: 456027 - DNA, 25 bp, Rattus norvegicus
gggccttgctgctagaacaagccag

SEQ ID NO: 456028 - DNA, 25 bp, Rattus norvegicus
gggccttggcttagatctacaatga

SEQ ID NO: 456029 - DNA, 25 bp, Rattus norvegicus
gggccttggctttgatctacaatga

SEQ ID NO: 456030 - DNA, 25 bp, Rattus norvegicus
gggccttgggatatcagtggtaact

SEQ ID NO: 456031 - DNA, 25 bp, Rattus norvegicus
gggccttgggatttcagtggtaact

SEQ ID NO: 456032 - DNA, 25 bp, Rattus norvegicus
gggccttgggccagaacaactggaa

SEQ ID NO: 456033 - DNA, 25 bp, Rattus norvegicus
gggccttgggcctgaacaactggaa

SEQ ID NO: 456034 - DNA, 25 bp, Rattus norvegicus
gggccttgggtgaacattcagactg

SEQ ID NO: 456035 - DNA, 25 bp, Rattus norvegicus
gggccttgggtgtacattcagactg

SEQ ID NO: 456036 - DNA, 25 bp, Rattus norvegicus
gggccttggttcaataaagcactga

SEQ ID NO: 456037 - DNA, 25 bp, Rattus norvegicus
gggccttggttctataaagcactga

SEQ ID NO: 456038 - DNA, 25 bp, Rattus norvegicus
gggccttggtttctctttgaaactg

SEQ ID NO: 456039 - DNA, 25 bp, Rattus norvegicus
gggccttggtttgtctttgaaactg

SEQ ID NO: 456040 - DNA, 25 bp, Rattus norvegicus
gggccttgtactaagtttttgtcag

SEQ ID NO: 456041 - DNA, 25 bp, Rattus norvegicus
gggccttgtacttagtttttgtcag

SEQ ID NO: 456042 - DNA, 25 bp, Rattus norvegicus
gggccttgtattaatctggaacata

SEQ ID NO: 456043 - DNA, 25 bp, Rattus norvegicus
gggccttgtatttatctggaacata

SEQ ID NO: 456044 - DNA, 25 bp, Rattus norvegicus
gggccttgtcacaggtgccagatga

SEQ ID NO: 456045 - DNA, 25 bp, Rattus norvegicus
gggccttgtcactggtgccagatga

SEQ ID NO: 456046 - DNA, 25 bp, Rattus norvegicus
gggccttgtcctaagcttagtacaa

SEQ ID NO: 456047 - DNA, 25 bp, Rattus norvegicus
gggccttgtccttagcttagtacaa

SEQ ID NO: 456048 - DNA, 25 bp, Rattus norvegicus
gggccttgtgggacccagtcgctca

SEQ ID NO: 456049 - DNA, 25 bp, Rattus norvegicus
gggccttgtgggacctttaggtcat

SEQ ID NO: 456050 - DNA, 25 bp, Rattus norvegicus
gggccttgtgggtcccagtcgctca

SEQ ID NO: 456051 - DNA, 25 bp, Rattus norvegicus
gggccttgtgggtcctttaggtcat

SEQ ID NO: 456052 - DNA, 25 bp, Rattus norvegicus
gggccttgtggtacatctactccca

SEQ ID NO: 456053 - DNA, 25 bp, Rattus norvegicus
gggccttgtggttcatctactccca

SEQ ID NO: 456054 - DNA, 25 bp, Rattus norvegicus
gggccttgtgtcagagctcacggaa

SEQ ID NO: 456055 - DNA, 25 bp, Rattus norvegicus
gggccttgtgtctgagctcacggaa

SEQ ID NO: 456056 - DNA, 25 bp, Rattus norvegicus
gggccttgttagctaccctagcagg

SEQ ID NO: 456057 - DNA, 25 bp, Rattus norvegicus
gggccttgttaggtaccctagcagg

SEQ ID NO: 456058 - DNA, 25 bp, Rattus norvegicus
gggccttgttttccatgctgatgaa

SEQ ID NO: 456059 - DNA, 25 bp, Rattus norvegicus
gggccttgttttgcatgctgatgaa

SEQ ID NO: 456060 - DNA, 25 bp, Rattus norvegicus
gggcctttaaaaactgtatccacca

SEQ ID NO: 456061 - DNA, 25 bp, Rattus norvegicus
gggcctttaaaatctgtatccacca

SEQ ID NO: 456062 - DNA, 25 bp, Rattus norvegicus
gggcctttaaatacactgcgtccaa

SEQ ID NO: 456063 - DNA, 25 bp, Rattus norvegicus
gggcctttaaattcactgcgtccaa

SEQ ID NO: 456064 - DNA, 25 bp, Rattus norvegicus
gggcctttaagcacaatgcacccag

SEQ ID NO: 456065 - DNA, 25 bp, Rattus norvegicus
gggcctttaagctcaatgcacccag

SEQ ID NO: 456066 - DNA, 25 bp, Rattus norvegicus
gggcctttaaggctctgtcaaggta

SEQ ID NO: 456067 - DNA, 25 bp, Rattus norvegicus
gggcctttaagggtctgtcaaggta

SEQ ID NO: 456068 - DNA, 25 bp, Rattus norvegicus
gggcctttaatgatataattcgtgt

SEQ ID NO: 456069 - DNA, 25 bp, Rattus norvegicus
gggcctttaatgttataattcgtgt

SEQ ID NO: 456070 - DNA, 25 bp, Rattus norvegicus
gggcctttaccaattcatgcttatt

SEQ ID NO: 456071 - DNA, 25 bp, Rattus norvegicus
gggcctttaccatttcatgcttatt

SEQ ID NO: 456072 - DNA, 25 bp, Rattus norvegicus
gggcctttagctatgttcagggagt

SEQ ID NO: 456073 - DNA, 25 bp, Rattus norvegicus
gggcctttagctttgttcagggagt

SEQ ID NO: 456074 - DNA, 25 bp, Rattus norvegicus
gggcctttagttacctggatctcat

SEQ ID NO: 456075 - DNA, 25 bp, Rattus norvegicus
gggcctttagtttcctggatctcat

SEQ ID NO: 456076 - DNA, 25 bp, Rattus norvegicus
gggcctttatgcaaaaactccaata

SEQ ID NO: 456077 - DNA, 25 bp, Rattus norvegicus
gggcctttatgctaaaactccaata

SEQ ID NO: 456078 - DNA, 25 bp, Rattus norvegicus
gggcctttcagactgggcttgaaat

SEQ ID NO: 456079 - DNA, 25 bp, Rattus norvegicus
gggcctttcagagtgggcttgaaat

SEQ ID NO: 456080 - DNA, 25 bp, Rattus norvegicus
gggcctttccagaaaaccaagcagc

SEQ ID NO: 456081 - DNA, 25 bp, Rattus norvegicus
gggcctttccagtaaaccaagcagc

SEQ ID NO: 456082 - DNA, 25 bp, Rattus norvegicus
gggcctttccttcatagctggagga

SEQ ID NO: 456083 - DNA, 25 bp, Rattus norvegicus
gggcctttccttgatagctggagga

SEQ ID NO: 456084 - DNA, 25 bp, Rattus norvegicus
gggcctttcttgacatgctactgtt

SEQ ID NO: 456085 - DNA, 25 bp, Rattus norvegicus
gggcctttcttgtcatgctactgtt

SEQ ID NO: 456086 - DNA, 25 bp, Rattus norvegicus
gggcctttgaccactgcctgagtca

SEQ ID NO: 456087 - DNA, 25 bp, Rattus norvegicus
gggcctttgacctctgcctgagtca

SEQ ID NO: 456088 - DNA, 25 bp, Rattus norvegicus
gggcctttgaggatctcagcagagc

SEQ ID NO: 456089 - DNA, 25 bp, Rattus norvegicus
gggcctttgaggttctcagcagagc

SEQ ID NO: 456090 - DNA, 25 bp, Rattus norvegicus
gggcctttgatgctggacttttgaa

SEQ ID NO: 456091 - DNA, 25 bp, Rattus norvegicus
gggcctttgatggtggacttttgaa

SEQ ID NO: 456092 - DNA, 25 bp, Rattus norvegicus
gggcctttggtgaccttcagaagca

SEQ ID NO: 456093 - DNA, 25 bp, Rattus norvegicus
gggcctttggtgtccttcagaagca

SEQ ID NO: 456094 - DNA, 25 bp, Rattus norvegicus
gggccttttcatatgatctgatttc

SEQ ID NO: 456095 - DNA, 25 bp, Rattus norvegicus
gggccttttcatttgatctgatttc

SEQ ID NO: 456096 - DNA, 25 bp, Rattus norvegicus
gggccttttctaagcaggaagatgg

SEQ ID NO: 456097 - DNA, 25 bp, Rattus norvegicus
gggccttttctatgcaggaagatgg

SEQ ID NO: 456098 - DNA, 25 bp, Rattus norvegicus
gggccttttgctattcttagcagta

SEQ ID NO: 456099 - DNA, 25 bp, Rattus norvegicus
gggccttttgcttttcttagcagta

SEQ ID NO: 456100 - DNA, 25 bp, Rattus norvegicus
gggccttttggtagaagctcctgct

SEQ ID NO: 456101 - DNA, 25 bp, Rattus norvegicus
gggccttttggttgaagctcctgct

SEQ ID NO: 456102 - DNA, 25 bp, Rattus norvegicus
gggccttttgtaacgaattcttgat

SEQ ID NO: 456103 - DNA, 25 bp, Rattus norvegicus
gggccttttgtatcgaattcttgat

SEQ ID NO: 456104 - DNA, 25 bp, Rattus norvegicus
gggcgaaacgatcgcctcatgacta

SEQ ID NO: 456105 - DNA, 25 bp, Rattus norvegicus
gggcgaaacgatggcctcatgacta

SEQ ID NO: 456106 - DNA, 25 bp, Rattus norvegicus
gggcgaaatcgcaactatcttagct

SEQ ID NO: 456107 - DNA, 25 bp, Rattus norvegicus
gggcgaaatcgctactatcttagct

SEQ ID NO: 456108 - DNA, 25 bp, Rattus norvegicus
gggcgaacccatatgcagtggattt

SEQ ID NO: 456109 - DNA, 25 bp, Rattus norvegicus
gggcgaacccatttgcagtggattt

SEQ ID NO: 456110 - DNA, 25 bp, Rattus norvegicus
gggcgaacctggagtcacagtcact

SEQ ID NO: 456111 - DNA, 25 bp, Rattus norvegicus
gggcgaacctggtgtcacagtcact

SEQ ID NO: 456112 - DNA, 25 bp, Rattus norvegicus
gggcgaacgctgagagcatctaagc

SEQ ID NO: 456113 - DNA, 25 bp, Rattus norvegicus
gggcgaacgctgtgagcatctaagc

SEQ ID NO: 456114 - DNA, 25 bp, Rattus norvegicus
gggcgaagccacagtgttcccgcag

SEQ ID NO: 456115 - DNA, 25 bp, Rattus norvegicus
gggcgaagccactgtgttcccgcag

SEQ ID NO: 456116 - DNA, 25 bp, Rattus norvegicus
gggcgaagctctccaagtcttgctg

SEQ ID NO: 456117 - DNA, 25 bp, Rattus norvegicus
gggcgaagctctgcaagtcttgctg

SEQ ID NO: 456118 - DNA, 25 bp, Rattus norvegicus
gggcgaatacacatacgcattgcca

SEQ ID NO: 456119 - DNA, 25 bp, Rattus norvegicus
gggcgaatacacttacgcattgcca

SEQ ID NO: 456120 - DNA, 25 bp, Rattus norvegicus
gggcgaatacagagctcttctgaaa

SEQ ID NO: 456121 - DNA, 25 bp, Rattus norvegicus
gggcgaatacagtgctcttctgaaa

SEQ ID NO: 456122 - DNA, 25 bp, Rattus norvegicus
gggcgacaagggatatgtcccctct

SEQ ID NO: 456123 - DNA, 25 bp, Rattus norvegicus
gggcgacaagggttatgtcccctct

SEQ ID NO: 456124 - DNA, 25 bp, Rattus norvegicus
gggcgacaagtcagacccgaacctt

SEQ ID NO: 456125 - DNA, 25 bp, Rattus norvegicus
gggcgacaagtctgacccgaacctt

SEQ ID NO: 456126 - DNA, 25 bp, Rattus norvegicus
gggcgacaatcccatgcctaggaga

SEQ ID NO: 456127 - DNA, 25 bp, Rattus norvegicus
gggcgacaatccgatgcctaggaga

SEQ ID NO: 456128 - DNA, 25 bp, Rattus norvegicus
gggcgacacaaacaccaagtctctt

SEQ ID NO: 456129 - DNA, 25 bp, Rattus norvegicus
gggcgacacaaagaccaagtctctt

SEQ ID NO: 456130 - DNA, 25 bp, Rattus norvegicus
gggcgacagcagaccccaatgtcaa

SEQ ID NO: 456131 - DNA, 25 bp, Rattus norvegicus
gggcgacagcagtccccaatgtcaa

SEQ ID NO: 456132 - DNA, 25 bp, Rattus norvegicus
gggcgacatcggcacgtcctgttac

SEQ ID NO: 456133 - DNA, 25 bp, Rattus norvegicus
gggcgacatcgggacgtcctgttac

SEQ ID NO: 456134 - DNA, 25 bp, Rattus norvegicus
gggcgacatcttagcagtctgcagc

SEQ ID NO: 456135 - DNA, 25 bp, Rattus norvegicus
gggcgacatctttgcagtctgcagc

SEQ ID NO: 456136 - DNA, 25 bp, Rattus norvegicus
gggcgacatgtaatttcctctatat

SEQ ID NO: 456137 - DNA, 25 bp, Rattus norvegicus
gggcgacatgtattttcctctatat

SEQ ID NO: 456138 - DNA, 25 bp, Rattus norvegicus
gggcgaccaattcctttgggctcat

SEQ ID NO: 456139 - DNA, 25 bp, Rattus norvegicus
gggcgaccaattgctttgggctcat

SEQ ID NO: 456140 - DNA, 25 bp, Rattus norvegicus
gggcgaccccagagtcacagggacc

SEQ ID NO: 456141 - DNA, 25 bp, Rattus norvegicus
gggcgaccccagtgtcacagggacc

SEQ ID NO: 456142 - DNA, 25 bp, Rattus norvegicus
gggcgacccggcaagggccactact

SEQ ID NO: 456143 - DNA, 25 bp, Rattus norvegicus
gggcgacccggctagggccactact

SEQ ID NO: 456144 - DNA, 25 bp, Rattus norvegicus
gggcgacgctaccatacctgcgagc

SEQ ID NO: 456145 - DNA, 25 bp, Rattus norvegicus
gggcgacgctacgatacctgcgagc

SEQ ID NO: 456146 - DNA, 25 bp, Rattus norvegicus
gggcgacgtgctaaagaagcctccc

SEQ ID NO: 456147 - DNA, 25 bp, Rattus norvegicus
gggcgacgtgcttaagaagcctccc

SEQ ID NO: 456148 - DNA, 25 bp, Rattus norvegicus
gggcgactgctccatgatcttgcgc

SEQ ID NO: 456149 - DNA, 25 bp, Rattus norvegicus
gggcgactgctcgatgatcttgcgc

SEQ ID NO: 456150 - DNA, 25 bp, Rattus norvegicus
gggcgacttcaccaagtccacaggg

SEQ ID NO: 456151 - DNA, 25 bp, Rattus norvegicus
gggcgacttcacgaagtccacaggg

SEQ ID NO: 456152 - DNA, 25 bp, Rattus norvegicus
gggcgacttcagagttcacatcagc

SEQ ID NO: 456153 - DNA, 25 bp, Rattus norvegicus
gggcgacttcagtgttcacatcagc

SEQ ID NO: 456154 - DNA, 25 bp, Rattus norvegicus
gggcgagaagatacagtctgcatta

SEQ ID NO: 456155 - DNA, 25 bp, Rattus norvegicus
gggcgagaagattcagtctgcatta

SEQ ID NO: 456156 - DNA, 25 bp, Rattus norvegicus
gggcgagagtataacatggaccttt

SEQ ID NO: 456157 - DNA, 25 bp, Rattus norvegicus
gggcgagagtattacatggaccttt

SEQ ID NO: 456158 - DNA, 25 bp, Rattus norvegicus
gggcgagcacaacataccttggctg

SEQ ID NO: 456159 - DNA, 25 bp, Rattus norvegicus
gggcgagcacaagataccttggctg

SEQ ID NO: 456160 - DNA, 25 bp, Rattus norvegicus
gggcgagcctcgaggctcattcgct

SEQ ID NO: 456161 - DNA, 25 bp, Rattus norvegicus
gggcgagcctcgtggctcattcgct

SEQ ID NO: 456162 - DNA, 25 bp, Rattus norvegicus
gggcgagcgcttcaaacattggtat

SEQ ID NO: 456163 - DNA, 25 bp, Rattus norvegicus
gggcgagcgcttgaaacattggtat

SEQ ID NO: 456164 - DNA, 25 bp, Rattus norvegicus
gggcgagcgggacgacgagcgctga

SEQ ID NO: 456165 - DNA, 25 bp, Rattus norvegicus
gggcgagcgggaggacgagcgctga

SEQ ID NO: 456166 - DNA, 25 bp, Rattus norvegicus
gggcgagctattattaatactcttc

SEQ ID NO: 456167 - DNA, 25 bp, Rattus norvegicus
gggcgagctatttttaatactcttc

SEQ ID NO: 456168 - DNA, 25 bp, Rattus norvegicus
gggcgaggagctcatgtacaaccct

SEQ ID NO: 456169 - DNA, 25 bp, Rattus norvegicus
gggcgaggagctgatgtacaaccct

SEQ ID NO: 456170 - DNA, 25 bp, Rattus norvegicus
gggcgaggcaaaccatgttgaccat

SEQ ID NO: 456171 - DNA, 25 bp, Rattus norvegicus
gggcgaggcaaagcatgttgaccat

SEQ ID NO: 456172 - DNA, 25 bp, Rattus norvegicus
gggcgagtacctccagcactataga

SEQ ID NO: 456173 - DNA, 25 bp, Rattus norvegicus
gggcgagtacctgcagcactataga

SEQ ID NO: 456174 - DNA, 25 bp, Rattus norvegicus
gggcgagtgccaagagctcacagct

SEQ ID NO: 456175 - DNA, 25 bp, Rattus norvegicus
gggcgagtgccatgagctcacagct

SEQ ID NO: 456176 - DNA, 25 bp, Rattus norvegicus
gggcgagtggagacaaccgatttat

SEQ ID NO: 456177 - DNA, 25 bp, Rattus norvegicus
gggcgagtggagtcaaccgatttat

SEQ ID NO: 456178 - DNA, 25 bp, Rattus norvegicus
gggcgagttactaaagacaccagct

SEQ ID NO: 456179 - DNA, 25 bp, Rattus norvegicus
gggcgagttacttaagacaccagct

SEQ ID NO: 456180 - DNA, 25 bp, Rattus norvegicus
gggcgatatgaacctctacttaaag

SEQ ID NO: 456181 - DNA, 25 bp, Rattus norvegicus
gggcgatatgaagctctacttaaag

SEQ ID NO: 456182 - DNA, 25 bp, Rattus norvegicus
gggcgatatgttctagcacctttga

SEQ ID NO: 456183 - DNA, 25 bp, Rattus norvegicus
gggcgatatgttgtagcacctttga

SEQ ID NO: 456184 - DNA, 25 bp, Rattus norvegicus
gggcgatcctgtaatgttgtaatct

SEQ ID NO: 456185 - DNA, 25 bp, Rattus norvegicus
gggcgatcctgttatgttgtaatct

SEQ ID NO: 456186 - DNA, 25 bp, Rattus norvegicus
gggcgatgccaaaatcaacacacaa

SEQ ID NO: 456187 - DNA, 25 bp, Rattus norvegicus
gggcgatgccaacattaatactcag

SEQ ID NO: 456188 - DNA, 25 bp, Rattus norvegicus
gggcgatgccaagattaatactcag

SEQ ID NO: 456189 - DNA, 25 bp, Rattus norvegicus
gggcgatgccaatatcaacacacaa

SEQ ID NO: 456190 - DNA, 25 bp, Rattus norvegicus
gggcgatgtaccaaagcctggctat

SEQ ID NO: 456191 - DNA, 25 bp, Rattus norvegicus
gggcgatgtacctaagcctggctat

SEQ ID NO: 456192 - DNA, 25 bp, Rattus norvegicus
gggcgattgtttatcatttccacta

SEQ ID NO: 456193 - DNA, 25 bp, Rattus norvegicus
gggcgattgtttttcatttccacta

SEQ ID NO: 456194 - DNA, 25 bp, Rattus norvegicus
gggcgatttcccaccgagatgacgg

SEQ ID NO: 456195 - DNA, 25 bp, Rattus norvegicus
gggcgatttccctccgagatgacgg

SEQ ID NO: 456196 - DNA, 25 bp, Rattus norvegicus
gggcgatttcctctaccattagtga

SEQ ID NO: 456197 - DNA, 25 bp, Rattus norvegicus
gggcgatttcctgtaccattagtga

SEQ ID NO: 456198 - DNA, 25 bp, Rattus norvegicus
gggcgcacacaccaagattaggaat

SEQ ID NO: 456199 - DNA, 25 bp, Rattus norvegicus
gggcgcacacacgaagattaggaat

SEQ ID NO: 456200 - DNA, 25 bp, Rattus norvegicus
gggcgcacaggtcaccttctgcagt

SEQ ID NO: 456201 - DNA, 25 bp, Rattus norvegicus
gggcgcacaggtgaccttctgcagt

SEQ ID NO: 456202 - DNA, 25 bp, Rattus norvegicus
gggcgcacgcacatgtacaagcacg

SEQ ID NO: 456203 - DNA, 25 bp, Rattus norvegicus
gggcgcacgcacttgtacaagcacg

SEQ ID NO: 456204 - DNA, 25 bp, Rattus norvegicus
gggcgcactccaaaggccagacagg

SEQ ID NO: 456205 - DNA, 25 bp, Rattus norvegicus
gggcgcactccataggccagacagg

SEQ ID NO: 456206 - DNA, 25 bp, Rattus norvegicus
gggcgcagaactaggaacctttcct

SEQ ID NO: 456207 - DNA, 25 bp, Rattus norvegicus
gggcgcagaacttggaacctttcct

SEQ ID NO: 456208 - DNA, 25 bp, Rattus norvegicus
gggcgcagatgcaagctcatgcctg

SEQ ID NO: 456209 - DNA, 25 bp, Rattus norvegicus
gggcgcagatgctagctcatgcctg

SEQ ID NO: 456210 - DNA, 25 bp, Rattus norvegicus
gggcgcagcagactggttacctacc

SEQ ID NO: 456211 - DNA, 25 bp, Rattus norvegicus
gggcgcagcagagtggttacctacc

SEQ ID NO: 456212 - DNA, 25 bp, Rattus norvegicus
gggcgcagccaacatcactgtgcaa

SEQ ID NO: 456213 - DNA, 25 bp, Rattus norvegicus
gggcgcagccaagatcactgtgcaa

SEQ ID NO: 456214 - DNA, 25 bp, Rattus norvegicus
gggcgcaggcgtacacatctaaaat

SEQ ID NO: 456215 - DNA, 25 bp, Rattus norvegicus
gggcgcaggcgttcacatctaaaat

SEQ ID NO: 456216 - DNA, 25 bp, Rattus norvegicus
gggcgcatatctcagaacaacttct

SEQ ID NO: 456217 - DNA, 25 bp, Rattus norvegicus
gggcgcatatctgagaacaacttct

SEQ ID NO: 456218 - DNA, 25 bp, Rattus norvegicus
gggcgcatccaacggcagcttgaaa

SEQ ID NO: 456219 - DNA, 25 bp, Rattus norvegicus
gggcgcatccaagggcagcttgaaa

SEQ ID NO: 456220 - DNA, 25 bp, Rattus norvegicus
gggcgcatcgccaacgcgatcacgt

SEQ ID NO: 456221 - DNA, 25 bp, Rattus norvegicus
gggcgcatcgcctacgcgatcacgt

SEQ ID NO: 456222 - DNA, 25 bp, Rattus norvegicus
gggcgccaaacacgcgcaggcataa

SEQ ID NO: 456223 - DNA, 25 bp, Rattus norvegicus
gggcgccaaacaggcgcaggcataa

SEQ ID NO: 456224 - DNA, 25 bp, Rattus norvegicus
gggcgccaaaggacgtgtgtacatc

SEQ ID NO: 456225 - DNA, 25 bp, Rattus norvegicus
gggcgccaaaggtcgtgtgtacatc

SEQ ID NO: 456226 - DNA, 25 bp, Rattus norvegicus
gggcgccaccaaagtaacatgagca

SEQ ID NO: 456227 - DNA, 25 bp, Rattus norvegicus
gggcgccaccaatgtaacatgagca

SEQ ID NO: 456228 - DNA, 25 bp, Rattus norvegicus
gggcgccacgaaattgatcctcggg

SEQ ID NO: 456229 - DNA, 25 bp, Rattus norvegicus
gggcgccacgaatttgatcctcggg

SEQ ID NO: 456230 - DNA, 25 bp, Rattus norvegicus
gggcgccacgcaccgaacggtgagc

SEQ ID NO: 456231 - DNA, 25 bp, Rattus norvegicus
gggcgccacgcagcgaacggtgagc

SEQ ID NO: 456232 - DNA, 25 bp, Rattus norvegicus
gggcgccatgaaatcacttatgcct

SEQ ID NO: 456233 - DNA, 25 bp, Rattus norvegicus
gggcgccatgaattcacttatgcct

SEQ ID NO: 456234 - DNA, 25 bp, Rattus norvegicus
gggcgccatgtcagagatcatatgg

SEQ ID NO: 456235 - DNA, 25 bp, Rattus norvegicus
gggcgccatgtctgagatcatatgg

SEQ ID NO: 456236 - DNA, 25 bp, Rattus norvegicus
gggcgccattggcaaagtctaccac

SEQ ID NO: 456237 - DNA, 25 bp, Rattus norvegicus
gggcgccattgggaaagtctaccac

SEQ ID NO: 456238 - DNA, 25 bp, Rattus norvegicus
gggcgcccagtcatgtttgaacaca

SEQ ID NO: 456239 - DNA, 25 bp, Rattus norvegicus
gggcgcccagtcttgtttgaacaca

SEQ ID NO: 456240 - DNA, 25 bp, Rattus norvegicus
gggcgcccatggaagccagttagta

SEQ ID NO: 456241 - DNA, 25 bp, Rattus norvegicus
gggcgcccatggtagccagttagta

SEQ ID NO: 456242 - DNA, 25 bp, Rattus norvegicus
gggcgccctacacaaatggacttcg

SEQ ID NO: 456243 - DNA, 25 bp, Rattus norvegicus
gggcgccctacagaaatggacttcg

SEQ ID NO: 456244 - DNA, 25 bp, Rattus norvegicus
gggcgccctagacaggtgcatatac

SEQ ID NO: 456245 - DNA, 25 bp, Rattus norvegicus
gggcgccctagagaggtgcatatac

SEQ ID NO: 456246 - DNA, 25 bp, Rattus norvegicus
gggcgccgacatacaatttctacct

SEQ ID NO: 456247 - DNA, 25 bp, Rattus norvegicus
gggcgccgacattcaatttctacct

SEQ ID NO: 456248 - DNA, 25 bp, Rattus norvegicus
gggcgccgagccagagacacaataa

SEQ ID NO: 456249 - DNA, 25 bp, Rattus norvegicus
gggcgccgagcctgagacacaataa

SEQ ID NO: 456250 - DNA, 25 bp, Rattus norvegicus
gggcgccgagcgactcctcaagttg

SEQ ID NO: 456251 - DNA, 25 bp, Rattus norvegicus
gggcgccgagcgtctcctcaagttg

SEQ ID NO: 456252 - DNA, 25 bp, Rattus norvegicus
gggcgccggcctagagccgcagtgt

SEQ ID NO: 456253 - DNA, 25 bp, Rattus norvegicus
gggcgccggccttgagccgcagtgt

SEQ ID NO: 456254 - DNA, 25 bp, Rattus norvegicus
gggcgccgttgtactagtttgtatc

SEQ ID NO: 456255 - DNA, 25 bp, Rattus norvegicus
gggcgccgttgttctagtttgtatc

SEQ ID NO: 456256 - DNA, 25 bp, Rattus norvegicus
gggcgcgaagttaccacagttgcaa

SEQ ID NO: 456257 - DNA, 25 bp, Rattus norvegicus
gggcgcgaagtttccacagttgcaa

SEQ ID NO: 456258 - DNA, 25 bp, Rattus norvegicus
gggcgcgcacccagggaatctgcac

SEQ ID NO: 456259 - DNA, 25 bp, Rattus norvegicus
gggcgcgcaccctgggaatctgcac

SEQ ID NO: 456260 - DNA, 25 bp, Rattus norvegicus
gggcgcgcgcgtaatatttggcgcc

SEQ ID NO: 456261 - DNA, 25 bp, Rattus norvegicus
gggcgcgcgcgttatatttggcgcc

SEQ ID NO: 456262 - DNA, 25 bp, Rattus norvegicus
gggcgcgcggtgacatgcacaatta

SEQ ID NO: 456263 - DNA, 25 bp, Rattus norvegicus
gggcgcgcggtgtcatgcacaatta

SEQ ID NO: 456264 - DNA, 25 bp, Rattus norvegicus
gggcgcggaatgacaactttagatt

SEQ ID NO: 456265 - DNA, 25 bp, Rattus norvegicus
gggcgcggaatgtcaactttagatt

SEQ ID NO: 456266 - DNA, 25 bp, Rattus norvegicus
gggcgcggagacatttctgtccctc

SEQ ID NO: 456267 - DNA, 25 bp, Rattus norvegicus
gggcgcggagacttttctgtccctc

SEQ ID NO: 456268 - DNA, 25 bp, Rattus norvegicus
gggcgcggcggcagctgtaggcacg

SEQ ID NO: 456269 - DNA, 25 bp, Rattus norvegicus
gggcgcggcggctgctgtaggcacg

SEQ ID NO: 456270 - DNA, 25 bp, Rattus norvegicus
gggcgcgtttctcttgatgttgcat

SEQ ID NO: 456271 - DNA, 25 bp, Rattus norvegicus
gggcgcgtttctgttgatgttgcat

SEQ ID NO: 456272 - DNA, 25 bp, Rattus norvegicus
gggcgctactgaaggccagaccaga

SEQ ID NO: 456273 - DNA, 25 bp, Rattus norvegicus
gggcgctactgatggccagaccaga

SEQ ID NO: 456274 - DNA, 25 bp, Rattus norvegicus
gggcgctaggatatgaacttagatt

SEQ ID NO: 456275 - DNA, 25 bp, Rattus norvegicus
gggcgctaggatttgaacttagatt

SEQ ID NO: 456276 - DNA, 25 bp, Rattus norvegicus
gggcgctcactacttgatatttttt

SEQ ID NO: 456277 - DNA, 25 bp, Rattus norvegicus
gggcgctcactagttgatatttttt

SEQ ID NO: 456278 - DNA, 25 bp, Rattus norvegicus
gggcgctccgcaagatgcagaacag

SEQ ID NO: 456279 - DNA, 25 bp, Rattus norvegicus
gggcgctccgcatgatgcagaacag

SEQ ID NO: 456280 - DNA, 25 bp, Rattus norvegicus
gggcgctcctctatttcttagaata

SEQ ID NO: 456281 - DNA, 25 bp, Rattus norvegicus
gggcgctcctctttttcttagaata

SEQ ID NO: 456282 - DNA, 25 bp, Rattus norvegicus
gggcgctcctgcaggacgaatgaaa

SEQ ID NO: 456283 - DNA, 25 bp, Rattus norvegicus
gggcgctcctgctggacgaatgaaa

SEQ ID NO: 456284 - DNA, 25 bp, Rattus norvegicus
gggcgctctcagactattcgctgta

SEQ ID NO: 456285 - DNA, 25 bp, Rattus norvegicus
gggcgctctcagtctattcgctgta

SEQ ID NO: 456286 - DNA, 25 bp, Rattus norvegicus
gggcgctgcaggacaacagactctg

SEQ ID NO: 456287 - DNA, 25 bp, Rattus norvegicus
gggcgctgcaggtcaacagactctg

SEQ ID NO: 456288 - DNA, 25 bp, Rattus norvegicus
gggcgctgcagtactcaccggagaa

SEQ ID NO: 456289 - DNA, 25 bp, Rattus norvegicus
gggcgctgcagttctcaccggagaa

SEQ ID NO: 456290 - DNA, 25 bp, Rattus norvegicus
gggcgctgccacaaagatcctctaa

SEQ ID NO: 456291 - DNA, 25 bp, Rattus norvegicus
gggcgctgccactaagatcctctaa

SEQ ID NO: 456292 - DNA, 25 bp, Rattus norvegicus
gggcgctgcgtcagtggtgatctgg

SEQ ID NO: 456293 - DNA, 25 bp, Rattus norvegicus
gggcgctgcgtctgtggtgatctgg

SEQ ID NO: 456294 - DNA, 25 bp, Rattus norvegicus
gggcgctgctggatttcctgagcct

SEQ ID NO: 456295 - DNA, 25 bp, Rattus norvegicus
gggcgctgctggttttcctgagcct

SEQ ID NO: 456296 - DNA, 25 bp, Rattus norvegicus
gggcgctggcccagaccttgatgcc

SEQ ID NO: 456297 - DNA, 25 bp, Rattus norvegicus
gggcgctggccctgaccttgatgcc

SEQ ID NO: 456298 - DNA, 25 bp, Rattus norvegicus
gggcgctggcctcactgtaacgtcc

SEQ ID NO: 456299 - DNA, 25 bp, Rattus norvegicus
gggcgctggcctgactgtaacgtcc

SEQ ID NO: 456300 - DNA, 25 bp, Rattus norvegicus
gggcgctgtaaactgcttgttgtct

SEQ ID NO: 456301 - DNA, 25 bp, Rattus norvegicus
gggcgctgtaaagtgcttgttgtct

SEQ ID NO: 456302 - DNA, 25 bp, Rattus norvegicus
gggcgctgttaccatataccaagtg

SEQ ID NO: 456303 - DNA, 25 bp, Rattus norvegicus
gggcgctgttacgatataccaagtg

SEQ ID NO: 456304 - DNA, 25 bp, Rattus norvegicus
gggcgcttatgtagcacgcaaggcc

SEQ ID NO: 456305 - DNA, 25 bp, Rattus norvegicus
gggcgcttatgttgcacgcaaggcc

SEQ ID NO: 456306 - DNA, 25 bp, Rattus norvegicus
gggcgcttctgacgacaacatcatc

SEQ ID NO: 456307 - DNA, 25 bp, Rattus norvegicus
gggcgcttctgaggacaacatcatc

SEQ ID NO: 456308 - DNA, 25 bp, Rattus norvegicus
gggcgcttggacaccgtagttgaca

SEQ ID NO: 456309 - DNA, 25 bp, Rattus norvegicus
gggcgcttggacactagtatttggc

SEQ ID NO: 456310 - DNA, 25 bp, Rattus norvegicus
gggcgcttggactccgtagttgaca

SEQ ID NO: 456311 - DNA, 25 bp, Rattus norvegicus
gggcgcttggactctagtatttggc

SEQ ID NO: 456312 - DNA, 25 bp, Rattus norvegicus
gggcgctttcccctgaagtaagtat

SEQ ID NO: 456313 - DNA, 25 bp, Rattus norvegicus
gggcgctttcccgtgaagtaagtat

SEQ ID NO: 456314 - DNA, 25 bp, Rattus norvegicus
gggcgcttttacagttatcttaact

SEQ ID NO: 456315 - DNA, 25 bp, Rattus norvegicus
gggcgcttttactgttatcttaact

SEQ ID NO: 456316 - DNA, 25 bp, Rattus norvegicus
gggcggaaacagcatgttctcacaa

SEQ ID NO: 456317 - DNA, 25 bp, Rattus norvegicus
gggcggaaacaggatgttctcacaa

SEQ ID NO: 456318 - DNA, 25 bp, Rattus norvegicus
gggcggaaagctctactctatcaaa

SEQ ID NO: 456319 - DNA, 25 bp, Rattus norvegicus
gggcggaaagctgtactctatcaaa

SEQ ID NO: 456320 - DNA, 25 bp, Rattus norvegicus
gggcggaaggctagtcatccacaaa

SEQ ID NO: 456321 - DNA, 25 bp, Rattus norvegicus
gggcggaaggcttgtcatccacaaa

SEQ ID NO: 456322 - DNA, 25 bp, Rattus norvegicus
gggcggacagacatcttggaacagt

SEQ ID NO: 456323 - DNA, 25 bp, Rattus norvegicus
gggcggacagacttcttggaacagt

SEQ ID NO: 456324 - DNA, 25 bp, Rattus norvegicus
gggcggagacaacatgtcagcttta

SEQ ID NO: 456325 - DNA, 25 bp, Rattus norvegicus
gggcggagacaagatgtcagcttta

SEQ ID NO: 456326 - DNA, 25 bp, Rattus norvegicus
gggcggagacctacagactacagtt

SEQ ID NO: 456327 - DNA, 25 bp, Rattus norvegicus
gggcggagaccttcagactacagtt

SEQ ID NO: 456328 - DNA, 25 bp, Rattus norvegicus
gggcggatatgtctactgacgacca

SEQ ID NO: 456329 - DNA, 25 bp, Rattus norvegicus
gggcggatatgtgtactgacgacca

SEQ ID NO: 456330 - DNA, 25 bp, Rattus norvegicus
gggcggatccagagtctgaacccgt

SEQ ID NO: 456331 - DNA, 25 bp, Rattus norvegicus
gggcggatccagtgtctgaacccgt

SEQ ID NO: 456332 - DNA, 25 bp, Rattus norvegicus
gggcggcaactacttcttttatgga

SEQ ID NO: 456333 - DNA, 25 bp, Rattus norvegicus
gggcggcaactagttcttttatgga

SEQ ID NO: 456334 - DNA, 25 bp, Rattus norvegicus
gggcggcactaaaagacctcttgca

SEQ ID NO: 456335 - DNA, 25 bp, Rattus norvegicus
gggcggcactaatagacctcttgca

SEQ ID NO: 456336 - DNA, 25 bp, Rattus norvegicus
gggcggcatgctagcaatttgcgac

SEQ ID NO: 456337 - DNA, 25 bp, Rattus norvegicus
gggcggcatgcttgcaatttgcgac

SEQ ID NO: 456338 - DNA, 25 bp, Rattus norvegicus
gggcggccatgtaccaaaagcatat

SEQ ID NO: 456339 - DNA, 25 bp, Rattus norvegicus
gggcggccatgttccaaaagcatat

SEQ ID NO: 456340 - DNA, 25 bp, Rattus norvegicus
gggcggcctttccaaatgttgtctc

SEQ ID NO: 456341 - DNA, 25 bp, Rattus norvegicus
gggcggcctttcgaaatgttgtctc

SEQ ID NO: 456342 - DNA, 25 bp, Rattus norvegicus
gggcggcgccacacggtgaaggtga

SEQ ID NO: 456343 - DNA, 25 bp, Rattus norvegicus
gggcggcgccactcggtgaaggtga

SEQ ID NO: 456344 - DNA, 25 bp, Rattus norvegicus
gggcggctaagcattttctgccaat

SEQ ID NO: 456345 - DNA, 25 bp, Rattus norvegicus
gggcggctaagctttttctgccaat

SEQ ID NO: 456346 - DNA, 25 bp, Rattus norvegicus
gggcggctccctctgacagtcgcag

SEQ ID NO: 456347 - DNA, 25 bp, Rattus norvegicus
gggcggctccctgtgacagtcgcag

SEQ ID NO: 456348 - DNA, 25 bp, Rattus norvegicus
gggcggctgagaaggctctcccaac

SEQ ID NO: 456349 - DNA, 25 bp, Rattus norvegicus
gggcggctgagatggctctcccaac

SEQ ID NO: 456350 - DNA, 25 bp, Rattus norvegicus
gggcggcttgctcagaacctacatc

SEQ ID NO: 456351 - DNA, 25 bp, Rattus norvegicus
gggcggcttgctgagaacctacatc

SEQ ID NO: 456352 - DNA, 25 bp, Rattus norvegicus
gggcgggaagccatgctacataaca

SEQ ID NO: 456353 - DNA, 25 bp, Rattus norvegicus
gggcgggaagccttgctacataaca

SEQ ID NO: 456354 - DNA, 25 bp, Rattus norvegicus
gggcgggactttccatggcaccctt

SEQ ID NO: 456355 - DNA, 25 bp, Rattus norvegicus
gggcgggactttgcatggcaccctt

SEQ ID NO: 456356 - DNA, 25 bp, Rattus norvegicus
gggcgggatcttcaagcacctgtta

SEQ ID NO: 456357 - DNA, 25 bp, Rattus norvegicus
gggcgggatcttgaagcacctgtta

SEQ ID NO: 456358 - DNA, 25 bp, Rattus norvegicus
gggcgggccgagacccctgcggaag

SEQ ID NO: 456359 - DNA, 25 bp, Rattus norvegicus
gggcgggccgagtcccctgcggaag

SEQ ID NO: 456360 - DNA, 25 bp, Rattus norvegicus
gggcgggcctcaccatgtgtaactc

SEQ ID NO: 456361 - DNA, 25 bp, Rattus norvegicus
gggcgggcctcagcatgtgtaactc

SEQ ID NO: 456362 - DNA, 25 bp, Rattus norvegicus
gggcgggtggcgctctcagcagctc

SEQ ID NO: 456363 - DNA, 25 bp, Rattus norvegicus
gggcgggtggcggtctcagcagctc

SEQ ID NO: 456364 - DNA, 25 bp, Rattus norvegicus
gggcggtcgcacactaggcttttga

SEQ ID NO: 456365 - DNA, 25 bp, Rattus norvegicus
gggcggtcgcactctaggcttttga

SEQ ID NO: 456366 - DNA, 25 bp, Rattus norvegicus
gggcggtgtccgataccatcatccg

SEQ ID NO: 456367 - DNA, 25 bp, Rattus norvegicus
gggcggtgtccgttaccatcatccg

SEQ ID NO: 456368 - DNA, 25 bp, Rattus norvegicus
gggcggttaatcagcttcatgagga

SEQ ID NO: 456369 - DNA, 25 bp, Rattus norvegicus
gggcggttaatctgcttcatgagga

SEQ ID NO: 456370 - DNA, 25 bp, Rattus norvegicus
gggcggttcgtaatccagcataaag

SEQ ID NO: 456371 - DNA, 25 bp, Rattus norvegicus
gggcggttcgtattccagcataaag

SEQ ID NO: 456372 - DNA, 25 bp, Rattus norvegicus
gggcggttggttatcaagtcagact

SEQ ID NO: 456373 - DNA, 25 bp, Rattus norvegicus
gggcggttggttttcaagtcagact

SEQ ID NO: 456374 - DNA, 25 bp, Rattus norvegicus
gggcggttgttaatgtgccaaatac

SEQ ID NO: 456375 - DNA, 25 bp, Rattus norvegicus
gggcggttgttattgtgccaaatac

SEQ ID NO: 456376 - DNA, 25 bp, Rattus norvegicus
gggcggtttgttattcattgttatg

SEQ ID NO: 456377 - DNA, 25 bp, Rattus norvegicus
gggcggtttgtttttcattgttatg

SEQ ID NO: 456378 - DNA, 25 bp, Rattus norvegicus
gggcgtaacctacgcctatttcgat

SEQ ID NO: 456379 - DNA, 25 bp, Rattus norvegicus
gggcgtaacctaggcctatttcgat

SEQ ID NO: 456380 - DNA, 25 bp, Rattus norvegicus
gggcgtaataatactatcttactat

SEQ ID NO: 456381 - DNA, 25 bp, Rattus norvegicus
gggcgtaataattctatcttactat

SEQ ID NO: 456382 - DNA, 25 bp, Rattus norvegicus
gggcgtacattcaggccattatcgg

SEQ ID NO: 456383 - DNA, 25 bp, Rattus norvegicus
gggcgtacattcagtggcctatgca

SEQ ID NO: 456384 - DNA, 25 bp, Rattus norvegicus
gggcgtacattctggccattatcgg

SEQ ID NO: 456385 - DNA, 25 bp, Rattus norvegicus
gggcgtacattctgtggcctatgca

SEQ ID NO: 456386 - DNA, 25 bp, Rattus norvegicus
gggcgtaccagaatccaacaacgtt

SEQ ID NO: 456387 - DNA, 25 bp, Rattus norvegicus
gggcgtaccagattccaacaacgtt

SEQ ID NO: 456388 - DNA, 25 bp, Rattus norvegicus
gggcgtacttgacttctctgactaa

SEQ ID NO: 456389 - DNA, 25 bp, Rattus norvegicus
gggcgtacttgagttctctgactaa

SEQ ID NO: 456390 - DNA, 25 bp, Rattus norvegicus
gggcgtagcagtaaaaagcatatat

SEQ ID NO: 456391 - DNA, 25 bp, Rattus norvegicus
gggcgtagcagttaaaagcatatat

SEQ ID NO: 456392 - DNA, 25 bp, Rattus norvegicus
gggcgtagcttacggaccatgcact

SEQ ID NO: 456393 - DNA, 25 bp, Rattus norvegicus
gggcgtagcttagggaccatgcact

SEQ ID NO: 456394 - DNA, 25 bp, Rattus norvegicus
gggcgtagctttcgccatgattctg

SEQ ID NO: 456395 - DNA, 25 bp, Rattus norvegicus
gggcgtagctttggccatgattctg

SEQ ID NO: 456396 - DNA, 25 bp, Rattus norvegicus
gggcgtatgggacatcaataactta

SEQ ID NO: 456397 - DNA, 25 bp, Rattus norvegicus
gggcgtatgggagatcaataactta

SEQ ID NO: 456398 - DNA, 25 bp, Rattus norvegicus
gggcgtcaatgtaaactcgtttcgc

SEQ ID NO: 456399 - DNA, 25 bp, Rattus norvegicus
gggcgtcaatgttaactcgtttcgc

SEQ ID NO: 456400 - DNA, 25 bp, Rattus norvegicus
gggcgtcactttaacctcagaattt

SEQ ID NO: 456401 - DNA, 25 bp, Rattus norvegicus
gggcgtcacttttacctcagaattt

SEQ ID NO: 456402 - DNA, 25 bp, Rattus norvegicus
gggcgtcatgtcacatgcaactgag

SEQ ID NO: 456403 - DNA, 25 bp, Rattus norvegicus
gggcgtcatgtctcatgcaactgag

SEQ ID NO: 456404 - DNA, 25 bp, Rattus norvegicus
gggcgtcattgtccacatcattgaa

SEQ ID NO: 456405 - DNA, 25 bp, Rattus norvegicus
gggcgtcattgtgcacatcattgaa

SEQ ID NO: 456406 - DNA, 25 bp, Rattus norvegicus
gggcgtccatctaggtattcagcca

SEQ ID NO: 456407 - DNA, 25 bp, Rattus norvegicus
gggcgtccatcttggtattcagcca

SEQ ID NO: 456408 - DNA, 25 bp, Rattus norvegicus
gggcgtccccagctttgttgagcat

SEQ ID NO: 456409 - DNA, 25 bp, Rattus norvegicus
gggcgtccccaggtttgttgagcat

SEQ ID NO: 456410 - DNA, 25 bp, Rattus norvegicus
gggcgtccgcaacatgtagctacgt

SEQ ID NO: 456411 - DNA, 25 bp, Rattus norvegicus
gggcgtccgcaagatgtagctacgt

SEQ ID NO: 456412 - DNA, 25 bp, Rattus norvegicus
gggcgtcctcacaatggtgtaaata

SEQ ID NO: 456413 - DNA, 25 bp, Rattus norvegicus
gggcgtcctcactatggtgtaaata

SEQ ID NO: 456414 - DNA, 25 bp, Rattus norvegicus
gggcgtcctgcgctgagatttcttc

SEQ ID NO: 456415 - DNA, 25 bp, Rattus norvegicus
gggcgtcctgcggtgagatttcttc

SEQ ID NO: 456416 - DNA, 25 bp, Rattus norvegicus
gggcgtcctgtaatcagtgtcaaaa

SEQ ID NO: 456417 - DNA, 25 bp, Rattus norvegicus
gggcgtcctgtattcagtgtcaaaa

SEQ ID NO: 456418 - DNA, 25 bp, Rattus norvegicus
gggcgtcgcgcaccataattcccga

SEQ ID NO: 456419 - DNA, 25 bp, Rattus norvegicus
gggcgtcgcgcagcataattcccga

SEQ ID NO: 456420 - DNA, 25 bp, Rattus norvegicus
gggcgtctacagagagcagccatat

SEQ ID NO: 456421 - DNA, 25 bp, Rattus norvegicus
gggcgtctacagtgagcagccatat

SEQ ID NO: 456422 - DNA, 25 bp, Rattus norvegicus
gggcgtctatgtctagcaaccatga

SEQ ID NO: 456423 - DNA, 25 bp, Rattus norvegicus
gggcgtctatgtgtagcaaccatga

SEQ ID NO: 456424 - DNA, 25 bp, Rattus norvegicus
gggcgtctctacattgcaatgtcat

SEQ ID NO: 456425 - DNA, 25 bp, Rattus norvegicus
gggcgtctctactttgcaatgtcat

SEQ ID NO: 456426 - DNA, 25 bp, Rattus norvegicus
gggcgtctggctcatgaggtcgggt

SEQ ID NO: 456427 - DNA, 25 bp, Rattus norvegicus
gggcgtctggctgatgaggtcgggt

SEQ ID NO: 456428 - DNA, 25 bp, Rattus norvegicus
gggcgtctgtgaccttttcgagtcc

SEQ ID NO: 456429 - DNA, 25 bp, Rattus norvegicus
gggcgtctgtgagcttttcgagtcc

SEQ ID NO: 456430 - DNA, 25 bp, Rattus norvegicus
gggcgtcttcacagtgaattccaaa

SEQ ID NO: 456431 - DNA, 25 bp, Rattus norvegicus
gggcgtcttcactgtgaattccaaa

SEQ ID NO: 456432 - DNA, 25 bp, Rattus norvegicus
gggcgtctttgccagtggatcccct

SEQ ID NO: 456433 - DNA, 25 bp, Rattus norvegicus
gggcgtctttgcgagtggatcccct

SEQ ID NO: 456434 - DNA, 25 bp, Rattus norvegicus
gggcgtgaatcgaaagtcttccagt

SEQ ID NO: 456435 - DNA, 25 bp, Rattus norvegicus
gggcgtgaatcgtaagtcttccagt

SEQ ID NO: 456436 - DNA, 25 bp, Rattus norvegicus
gggcgtgactgaactgcatttgtga

SEQ ID NO: 456437 - DNA, 25 bp, Rattus norvegicus
gggcgtgactgatctgcatttgtga

SEQ ID NO: 456438 - DNA, 25 bp, Rattus norvegicus
gggcgtgcacacactgtttgcagat

SEQ ID NO: 456439 - DNA, 25 bp, Rattus norvegicus
gggcgtgcacactctgtttgcagat

SEQ ID NO: 456440 - DNA, 25 bp, Rattus norvegicus
gggcgtgcatttcagcagttctaca

SEQ ID NO: 456441 - DNA, 25 bp, Rattus norvegicus
gggcgtgcatttgagcagttctaca

SEQ ID NO: 456442 - DNA, 25 bp, Rattus norvegicus
gggcgtgcctacatggtagcatcaa

SEQ ID NO: 456443 - DNA, 25 bp, Rattus norvegicus
gggcgtgcctacttggtagcatcaa

SEQ ID NO: 456444 - DNA, 25 bp, Rattus norvegicus
gggcgtggaccactggagagaccaa

SEQ ID NO: 456445 - DNA, 25 bp, Rattus norvegicus
gggcgtggaccagtggagagaccaa

SEQ ID NO: 456446 - DNA, 25 bp, Rattus norvegicus
gggcgtggccagatgctctagccaa

SEQ ID NO: 456447 - DNA, 25 bp, Rattus norvegicus
gggcgtggccagttgctctagccaa

SEQ ID NO: 456448 - DNA, 25 bp, Rattus norvegicus
gggcgtggcgggactgctccgggtt

SEQ ID NO: 456449 - DNA, 25 bp, Rattus norvegicus
gggcgtggcgggtctgctccgggtt

SEQ ID NO: 456450 - DNA, 25 bp, Rattus norvegicus
gggcgtggtgatcacattgcccacc

SEQ ID NO: 456451 - DNA, 25 bp, Rattus norvegicus
gggcgtggtgatgacattgcccacc

SEQ ID NO: 456452 - DNA, 25 bp, Rattus norvegicus
gggcgtggttctctactgccaaacg

SEQ ID NO: 456453 - DNA, 25 bp, Rattus norvegicus
gggcgtggttctgtactgccaaacg

SEQ ID NO: 456454 - DNA, 25 bp, Rattus norvegicus
gggcgtgtcttcactcggtaagaaa

SEQ ID NO: 456455 - DNA, 25 bp, Rattus norvegicus
gggcgtgtcttctctcggtaagaaa

SEQ ID NO: 456456 - DNA, 25 bp, Rattus norvegicus
gggcgtgtgctacgtcacagatcat

SEQ ID NO: 456457 - DNA, 25 bp, Rattus norvegicus
gggcgtgtgctaggtcacagatcat

SEQ ID NO: 456458 - DNA, 25 bp, Rattus norvegicus
gggcgtgtttagatcagcgtacttc

SEQ ID NO: 456459 - DNA, 25 bp, Rattus norvegicus
gggcgtgtttagttcagcgtacttc

SEQ ID NO: 456460 - DNA, 25 bp, Rattus norvegicus
gggcgtgtttgaagcttatcaacca

SEQ ID NO: 456461 - DNA, 25 bp, Rattus norvegicus
gggcgtgtttgatgcttatcaacca

SEQ ID NO: 456462 - DNA, 25 bp, Rattus norvegicus
gggcgttaaagcacttgtggcactc

SEQ ID NO: 456463 - DNA, 25 bp, Rattus norvegicus
gggcgttaaagctcttgtggcactc

SEQ ID NO: 456464 - DNA, 25 bp, Rattus norvegicus
gggcgttacaccagcaatgagttca

SEQ ID NO: 456465 - DNA, 25 bp, Rattus norvegicus
gggcgttacacctgcaatgagttca

SEQ ID NO: 456466 - DNA, 25 bp, Rattus norvegicus
gggcgttcctggcattatttaaagc

SEQ ID NO: 456467 - DNA, 25 bp, Rattus norvegicus
gggcgttcctgggattatttaaagc

SEQ ID NO: 456468 - DNA, 25 bp, Rattus norvegicus
gggcgttcgtacagatgcagagata

SEQ ID NO: 456469 - DNA, 25 bp, Rattus norvegicus
gggcgttcgtactgatgcagagata

SEQ ID NO: 456470 - DNA, 25 bp, Rattus norvegicus
gggcgttctagaaactccttgtgac

SEQ ID NO: 456471 - DNA, 25 bp, Rattus norvegicus
gggcgttctagatactccttgtgac

SEQ ID NO: 456472 - DNA, 25 bp, Rattus norvegicus
gggcgttctagtcgccatgcagaaa

SEQ ID NO: 456473 - DNA, 25 bp, Rattus norvegicus
gggcgttctagtggccatgcagaaa

SEQ ID NO: 456474 - DNA, 25 bp, Rattus norvegicus
gggcgtttaactcgcagtcctccct

SEQ ID NO: 456475 - DNA, 25 bp, Rattus norvegicus
gggcgtttaactggcagtcctccct

SEQ ID NO: 456476 - DNA, 25 bp, Rattus norvegicus
gggcgtttcctcagcttttggtgtt

SEQ ID NO: 456477 - DNA, 25 bp, Rattus norvegicus
gggcgtttcctctgcttttggtgtt

SEQ ID NO: 456478 - DNA, 25 bp, Rattus norvegicus
gggcgtttctcaaccgttgtaagaa

SEQ ID NO: 456479 - DNA, 25 bp, Rattus norvegicus
gggcgtttctcatccgttgtaagaa

SEQ ID NO: 456480 - DNA, 25 bp, Rattus norvegicus
gggcgtttctgcatttggactgaaa

SEQ ID NO: 456481 - DNA, 25 bp, Rattus norvegicus
gggcgtttctgcttttggactgaaa

SEQ ID NO: 456482 - DNA, 25 bp, Rattus norvegicus
gggcgtttgagtcttactgaactta

SEQ ID NO: 456483 - DNA, 25 bp, Rattus norvegicus
gggcgtttgagtgttactgaactta

SEQ ID NO: 456484 - DNA, 25 bp, Rattus norvegicus
gggcgtttttaactcaagtgctaga

SEQ ID NO: 456485 - DNA, 25 bp, Rattus norvegicus
gggcgtttttaagtcaagtgctaga

SEQ ID NO: 456486 - DNA, 25 bp, Rattus norvegicus
gggctaaaatcacttgggcgacctt

SEQ ID NO: 456487 - DNA, 25 bp, Rattus norvegicus
gggctaaaatcagttgggcgacctt

SEQ ID NO: 456488 - DNA, 25 bp, Rattus norvegicus
gggctaaagatcagccttctcacac

SEQ ID NO: 456489 - DNA, 25 bp, Rattus norvegicus
gggctaaagatctgccttctcacac

SEQ ID NO: 456490 - DNA, 25 bp, Rattus norvegicus
gggctaaatactactctgaggtcat

SEQ ID NO: 456491 - DNA, 25 bp, Rattus norvegicus
gggctaaatacttctctgaggtcat

SEQ ID NO: 456492 - DNA, 25 bp, Rattus norvegicus
gggctaaatccgcagcaaactgccg

SEQ ID NO: 456493 - DNA, 25 bp, Rattus norvegicus
gggctaaatccggagcaaactgccg

SEQ ID NO: 456494 - DNA, 25 bp, Rattus norvegicus
gggctaacagtgcatttcaggtcat

SEQ ID NO: 456495 - DNA, 25 bp, Rattus norvegicus
gggctaacagtggatttcaggtcat

SEQ ID NO: 456496 - DNA, 25 bp, Rattus norvegicus
gggctaacatatcacttttctacct

SEQ ID NO: 456497 - DNA, 25 bp, Rattus norvegicus
gggctaacatatgacttttctacct

SEQ ID NO: 456498 - DNA, 25 bp, Rattus norvegicus
gggctaacatgtccccctaaagtga

SEQ ID NO: 456499 - DNA, 25 bp, Rattus norvegicus
gggctaacatgtgcccctaaagtga

SEQ ID NO: 456500 - DNA, 25 bp, Rattus norvegicus
gggctaaccacaccaaggtcttgac

SEQ ID NO: 456501 - DNA, 25 bp, Rattus norvegicus
gggctaaccacagcaaggtcttgac

SEQ ID NO: 456502 - DNA, 25 bp, Rattus norvegicus
gggctaaccactaaaggtgccgtgc

SEQ ID NO: 456503 - DNA, 25 bp, Rattus norvegicus
gggctaaccacttaaggtgccgtgc

SEQ ID NO: 456504 - DNA, 25 bp, Rattus norvegicus
gggctaaccattcaaacacatgcat

SEQ ID NO: 456505 - DNA, 25 bp, Rattus norvegicus
gggctaaccattgaaacacatgcat

SEQ ID NO: 456506 - DNA, 25 bp, Rattus norvegicus
gggctaacccacagaaaggtcagtt

SEQ ID NO: 456507 - DNA, 25 bp, Rattus norvegicus
gggctaacccactgaaaggtcagtt

SEQ ID NO: 456508 - DNA, 25 bp, Rattus norvegicus
gggctaactctgatcttattgtcgt

SEQ ID NO: 456509 - DNA, 25 bp, Rattus norvegicus
gggctaactctgttcttattgtcgt

SEQ ID NO: 456510 - DNA, 25 bp, Rattus norvegicus
gggctaactttaacttgattctacc

SEQ ID NO: 456511 - DNA, 25 bp, Rattus norvegicus
gggctaactttatcttgattctacc

SEQ ID NO: 456512 - DNA, 25 bp, Rattus norvegicus
gggctaagaccacctccagatttct

SEQ ID NO: 456513 - DNA, 25 bp, Rattus norvegicus
gggctaagaccagctccagatttct

SEQ ID NO: 456514 - DNA, 25 bp, Rattus norvegicus
gggctaagagctcagctattcccag

SEQ ID NO: 456515 - DNA, 25 bp, Rattus norvegicus
gggctaagagctgagctattcccag

SEQ ID NO: 456516 - DNA, 25 bp, Rattus norvegicus
gggctaagccttccagccaggactg

SEQ ID NO: 456517 - DNA, 25 bp, Rattus norvegicus
gggctaagccttgcagccaggactg

SEQ ID NO: 456518 - DNA, 25 bp, Rattus norvegicus
gggctaagcgtcaccgaactcgcgg

SEQ ID NO: 456519 - DNA, 25 bp, Rattus norvegicus
gggctaagcgtctccgaactcgcgg

SEQ ID NO: 456520 - DNA, 25 bp, Rattus norvegicus
gggctaagctagactcattaccttc

SEQ ID NO: 456521 - DNA, 25 bp, Rattus norvegicus
gggctaagctagtctcattaccttc

SEQ ID NO: 456522 - DNA, 25 bp, Rattus norvegicus
gggctaagttacacagctttttatc

SEQ ID NO: 456523 - DNA, 25 bp, Rattus norvegicus
gggctaagttactcagctttttatc

SEQ ID NO: 456524 - DNA, 25 bp, Rattus norvegicus
gggctaataatgaggttcagcagat

SEQ ID NO: 456525 - DNA, 25 bp, Rattus norvegicus
gggctaataatgtggttcagcagat

SEQ ID NO: 456526 - DNA, 25 bp, Rattus norvegicus
gggctaatagccacaactgtttgaa

SEQ ID NO: 456527 - DNA, 25 bp, Rattus norvegicus
gggctaatagcctcaactgtttgaa

SEQ ID NO: 456528 - DNA, 25 bp, Rattus norvegicus
gggctaataggcagtgttcaatttt

SEQ ID NO: 456529 - DNA, 25 bp, Rattus norvegicus
gggctaataggctgtgttcaatttt

SEQ ID NO: 456530 - DNA, 25 bp, Rattus norvegicus
gggctaatgaatatgttttcaccta

SEQ ID NO: 456531 - DNA, 25 bp, Rattus norvegicus
gggctaatgaatttgttttcaccta

SEQ ID NO: 456532 - DNA, 25 bp, Rattus norvegicus
gggctaatgcacattctcgcctttc

SEQ ID NO: 456533 - DNA, 25 bp, Rattus norvegicus
gggctaatgcactttctcgcctttc

SEQ ID NO: 456534 - DNA, 25 bp, Rattus norvegicus
gggctaatgttaattcccgttgcat

SEQ ID NO: 456535 - DNA, 25 bp, Rattus norvegicus
gggctaatgttatttcccgttgcat

SEQ ID NO: 456536 - DNA, 25 bp, Rattus norvegicus
gggctaattcaaccaaagcatcatt

SEQ ID NO: 456537 - DNA, 25 bp, Rattus norvegicus
gggctaattcaagcaaagcatcatt

SEQ ID NO: 456538 - DNA, 25 bp, Rattus norvegicus
gggctaattctcagcagtcactgta

SEQ ID NO: 456539 - DNA, 25 bp, Rattus norvegicus
gggctaattctctgcagtcactgta

SEQ ID NO: 456540 - DNA, 25 bp, Rattus norvegicus
gggctaatttttacctatctcctgg

SEQ ID NO: 456541 - DNA, 25 bp, Rattus norvegicus
gggctaattttttcctatctcctgg

SEQ ID NO: 456542 - DNA, 25 bp, Rattus norvegicus
gggctacaaatgctgcctgaagaaa

SEQ ID NO: 456543 - DNA, 25 bp, Rattus norvegicus
gggctacaaatggtgcctgaagaaa

SEQ ID NO: 456544 - DNA, 25 bp, Rattus norvegicus
gggctacaacgtacagttagattta

SEQ ID NO: 456545 - DNA, 25 bp, Rattus norvegicus
gggctacaacgttcagttagattta

SEQ ID NO: 456546 - DNA, 25 bp, Rattus norvegicus
gggctacaagttctccttcaagaag

SEQ ID NO: 456547 - DNA, 25 bp, Rattus norvegicus
gggctacaagttgtccttcaagaag

SEQ ID NO: 456548 - DNA, 25 bp, Rattus norvegicus
gggctacacacacatacattgtctc

SEQ ID NO: 456549 - DNA, 25 bp, Rattus norvegicus
gggctacacacagatacattgtctc

SEQ ID NO: 456550 - DNA, 25 bp, Rattus norvegicus
gggctacacccaatactgtaacatt

SEQ ID NO: 456551 - DNA, 25 bp, Rattus norvegicus
gggctacacccacagtataccaaag

SEQ ID NO: 456552 - DNA, 25 bp, Rattus norvegicus
gggctacacccagagtataccaaag

SEQ ID NO: 456553 - DNA, 25 bp, Rattus norvegicus
gggctacacccattactgtaacatt

SEQ ID NO: 456554 - DNA, 25 bp, Rattus norvegicus
gggctacacgctcctcaaagcacaa

SEQ ID NO: 456555 - DNA, 25 bp, Rattus norvegicus
gggctacacgctgctcaaagcacaa

SEQ ID NO: 456556 - DNA, 25 bp, Rattus norvegicus
gggctacactggattgatcaacgca

SEQ ID NO: 456557 - DNA, 25 bp, Rattus norvegicus
gggctacactggtttgatcaacgca

SEQ ID NO: 456558 - DNA, 25 bp, Rattus norvegicus
gggctacacttaattattgagggag

SEQ ID NO: 456559 - DNA, 25 bp, Rattus norvegicus
gggctacacttatttattgagggag

SEQ ID NO: 456560 - DNA, 25 bp, Rattus norvegicus
gggctacacttcattgtttattgtt

SEQ ID NO: 456561 - DNA, 25 bp, Rattus norvegicus
gggctacacttctttgtttattgtt

SEQ ID NO: 456562 - DNA, 25 bp, Rattus norvegicus
gggctacagaatcagaatgtcttca

SEQ ID NO: 456563 - DNA, 25 bp, Rattus norvegicus
gggctacagaatgagaatgtcttca

SEQ ID NO: 456564 - DNA, 25 bp, Rattus norvegicus
gggctacagccacaccagaagatac

SEQ ID NO: 456565 - DNA, 25 bp, Rattus norvegicus
gggctacagccagaccagaagatac

SEQ ID NO: 456566 - DNA, 25 bp, Rattus norvegicus
gggctacaggagactctcttttaaa

SEQ ID NO: 456567 - DNA, 25 bp, Rattus norvegicus
gggctacaggagtctctcttttaaa

SEQ ID NO: 456568 - DNA, 25 bp, Rattus norvegicus
gggctacataggcaggctcagaaaa

SEQ ID NO: 456569 - DNA, 25 bp, Rattus norvegicus
gggctacatagggaggctcagaaaa

SEQ ID NO: 456570 - DNA, 25 bp, Rattus norvegicus
gggctacatagtcaggcgacaccta

SEQ ID NO: 456571 - DNA, 25 bp, Rattus norvegicus
gggctacatagtgaggcgacaccta

SEQ ID NO: 456572 - DNA, 25 bp, Rattus norvegicus
gggctacatctcaattcctattgct

SEQ ID NO: 456573 - DNA, 25 bp, Rattus norvegicus
gggctacatctctattcctattgct

SEQ ID NO: 456574 - DNA, 25 bp, Rattus norvegicus
gggctacatcttcaacacggaagct

SEQ ID NO: 456575 - DNA, 25 bp, Rattus norvegicus
gggctacatcttgaacacggaagct

SEQ ID NO: 456576 - DNA, 25 bp, Rattus norvegicus
gggctacatgatcgctacataatga

SEQ ID NO: 456577 - DNA, 25 bp, Rattus norvegicus
gggctacatgatggctacataatga

SEQ ID NO: 456578 - DNA, 25 bp, Rattus norvegicus
gggctacatgcccactgagatggaa

SEQ ID NO: 456579 - DNA, 25 bp, Rattus norvegicus
gggctacatgccgactgagatggaa

SEQ ID NO: 456580 - DNA, 25 bp, Rattus norvegicus
gggctacatgctcaacttgaccaac

SEQ ID NO: 456581 - DNA, 25 bp, Rattus norvegicus
gggctacatgctgaacttgaccaac

SEQ ID NO: 456582 - DNA, 25 bp, Rattus norvegicus
gggctacatggcacagactacacag

SEQ ID NO: 456583 - DNA, 25 bp, Rattus norvegicus
gggctacatggctcagactacacag

SEQ ID NO: 456584 - DNA, 25 bp, Rattus norvegicus
gggctacatgtgcatacctcagcaa

SEQ ID NO: 456585 - DNA, 25 bp, Rattus norvegicus
gggctacatgtggatacctcagcaa

SEQ ID NO: 456586 - DNA, 25 bp, Rattus norvegicus
gggctaccaaccaaaaatcatacag

SEQ ID NO: 456587 - DNA, 25 bp, Rattus norvegicus
gggctaccaacctaaaatcatacag

SEQ ID NO: 456588 - DNA, 25 bp, Rattus norvegicus
gggctaccagagaaaacaccttttg

SEQ ID NO: 456589 - DNA, 25 bp, Rattus norvegicus
gggctaccagagtaaacaccttttg

SEQ ID NO: 456590 - DNA, 25 bp, Rattus norvegicus
gggctaccatgtcaaatcgatacga

SEQ ID NO: 456591 - DNA, 25 bp, Rattus norvegicus
gggctaccatgtgaaatcgatacga

SEQ ID NO: 456592 - DNA, 25 bp, Rattus norvegicus
gggctaccccttaggcagcaatgaa

SEQ ID NO: 456593 - DNA, 25 bp, Rattus norvegicus
gggctacccctttggcagcaatgaa

SEQ ID NO: 456594 - DNA, 25 bp, Rattus norvegicus
gggctaccctcaactgtatagtaag

SEQ ID NO: 456595 - DNA, 25 bp, Rattus norvegicus
gggctaccctcatctgtatagtaag

SEQ ID NO: 456596 - DNA, 25 bp, Rattus norvegicus
gggctaccctgcactatttaaaagc

SEQ ID NO: 456597 - DNA, 25 bp, Rattus norvegicus
gggctaccctgctctatttaaaagc

SEQ ID NO: 456598 - DNA, 25 bp, Rattus norvegicus
gggctacctagtaaattccaggcca

SEQ ID NO: 456599 - DNA, 25 bp, Rattus norvegicus
gggctacctagttaattccaggcca

SEQ ID NO: 456600 - DNA, 25 bp, Rattus norvegicus
gggctacctgatcggctagtacctt

SEQ ID NO: 456601 - DNA, 25 bp, Rattus norvegicus
gggctacctgatgggctagtacctt

SEQ ID NO: 456602 - DNA, 25 bp, Rattus norvegicus
gggctacctgcaagcttctgatcta

SEQ ID NO: 456603 - DNA, 25 bp, Rattus norvegicus
gggctacctgcatgcttctgatcta

SEQ ID NO: 456604 - DNA, 25 bp, Rattus norvegicus
gggctaccttcaatcatgctggtaa

SEQ ID NO: 456605 - DNA, 25 bp, Rattus norvegicus
gggctaccttcattcatgctggtaa

SEQ ID NO: 456606 - DNA, 25 bp, Rattus norvegicus
gggctacgactcacataggcctgtg

SEQ ID NO: 456607 - DNA, 25 bp, Rattus norvegicus
gggctacgactctcataggcctgtg

SEQ ID NO: 456608 - DNA, 25 bp, Rattus norvegicus
gggctacgagatacacatgtttgac

SEQ ID NO: 456609 - DNA, 25 bp, Rattus norvegicus
gggctacgagattcacatgtttgac

SEQ ID NO: 456610 - DNA, 25 bp, Rattus norvegicus
gggctacgagcacgctaattgcaag

SEQ ID NO: 456611 - DNA, 25 bp, Rattus norvegicus
gggctacgagcaggctaattgcaag

SEQ ID NO: 456612 - DNA, 25 bp, Rattus norvegicus
gggctacgtcgtcctggttaaaaca

SEQ ID NO: 456613 - DNA, 25 bp, Rattus norvegicus
gggctacgtcgtgctggttaaaaca

SEQ ID NO: 456614 - DNA, 25 bp, Rattus norvegicus
gggctactaagtctgaatctgctat

SEQ ID NO: 456615 - DNA, 25 bp, Rattus norvegicus
gggctactaagtgtgaatctgctat

SEQ ID NO: 456616 - DNA, 25 bp, Rattus norvegicus
gggctactacccaaggctgcatatc

SEQ ID NO: 456617 - DNA, 25 bp, Rattus norvegicus
gggctactaccctaggctgcatatc

SEQ ID NO: 456618 - DNA, 25 bp, Rattus norvegicus
gggctactacctcgcattatcgcat

SEQ ID NO: 456619 - DNA, 25 bp, Rattus norvegicus
gggctactacctggcattatcgcat

SEQ ID NO: 456620 - DNA, 25 bp, Rattus norvegicus
gggctactatccagacagctatgac

SEQ ID NO: 456621 - DNA, 25 bp, Rattus norvegicus
gggctactatcctgacagctatgac

SEQ ID NO: 456622 - DNA, 25 bp, Rattus norvegicus
gggctactcaagagacccgtttgtg

SEQ ID NO: 456623 - DNA, 25 bp, Rattus norvegicus
gggctactcaagtgacccgtttgtg

SEQ ID NO: 456624 - DNA, 25 bp, Rattus norvegicus
gggctactcacaaaggttactcacc

SEQ ID NO: 456625 - DNA, 25 bp, Rattus norvegicus
gggctactcacataggttactcacc

SEQ ID NO: 456626 - DNA, 25 bp, Rattus norvegicus
gggctactcactatttatatattta

SEQ ID NO: 456627 - DNA, 25 bp, Rattus norvegicus
gggctactcactctgtaatccaaat

SEQ ID NO: 456628 - DNA, 25 bp, Rattus norvegicus
gggctactcactgtgtaatccaaat

SEQ ID NO: 456629 - DNA, 25 bp, Rattus norvegicus
gggctactcactttttatatattta

SEQ ID NO: 456630 - DNA, 25 bp, Rattus norvegicus
gggctactctaactgcttgaattct

SEQ ID NO: 456631 - DNA, 25 bp, Rattus norvegicus
gggctactctaagtgcttgaattct

SEQ ID NO: 456632 - DNA, 25 bp, Rattus norvegicus
gggctactctcactctttggagtca

SEQ ID NO: 456633 - DNA, 25 bp, Rattus norvegicus
gggctactctcagtctttggagtca

SEQ ID NO: 456634 - DNA, 25 bp, Rattus norvegicus
gggctactgagtcgcaatcaccgtc

SEQ ID NO: 456635 - DNA, 25 bp, Rattus norvegicus
gggctactgagtggcaatcaccgtc

SEQ ID NO: 456636 - DNA, 25 bp, Rattus norvegicus
gggctactgatacactccatgatgc

SEQ ID NO: 456637 - DNA, 25 bp, Rattus norvegicus
gggctactgatagactccatgatgc

SEQ ID NO: 456638 - DNA, 25 bp, Rattus norvegicus
gggctactgcgaccgcgacggctac

SEQ ID NO: 456639 - DNA, 25 bp, Rattus norvegicus
gggctactgcgagcgcgacggctac

SEQ ID NO: 456640 - DNA, 25 bp, Rattus norvegicus
gggctactgctgctaatgctcctta

SEQ ID NO: 456641 - DNA, 25 bp, Rattus norvegicus
gggctactgctggtaatgctcctta

SEQ ID NO: 456642 - DNA, 25 bp, Rattus norvegicus
gggctactggaaaccccactgcaaa

SEQ ID NO: 456643 - DNA, 25 bp, Rattus norvegicus
gggctactggaatccccactgcaaa

SEQ ID NO: 456644 - DNA, 25 bp, Rattus norvegicus
gggctactgtatcctcaagtggctt

SEQ ID NO: 456645 - DNA, 25 bp, Rattus norvegicus
gggctactgtatgctcaagtggctt

SEQ ID NO: 456646 - DNA, 25 bp, Rattus norvegicus
gggctactgtgtcttttctaatgct

SEQ ID NO: 456647 - DNA, 25 bp, Rattus norvegicus
gggctactgtgtgttttctaatgct

SEQ ID NO: 456648 - DNA, 25 bp, Rattus norvegicus
gggctagaacccacactgggatagc

SEQ ID NO: 456649 - DNA, 25 bp, Rattus norvegicus
gggctagaaccctcactgggatagc

SEQ ID NO: 456650 - DNA, 25 bp, Rattus norvegicus
gggctagaagtacttttgccaagta

SEQ ID NO: 456651 - DNA, 25 bp, Rattus norvegicus
gggctagaagtagttttgccaagta

SEQ ID NO: 456652 - DNA, 25 bp, Rattus norvegicus
gggctagaattcactgacctctgga

SEQ ID NO: 456653 - DNA, 25 bp, Rattus norvegicus
gggctagaattctctgacctctgga

SEQ ID NO: 456654 - DNA, 25 bp, Rattus norvegicus
gggctagaatttagtgtcccaaatt

SEQ ID NO: 456655 - DNA, 25 bp, Rattus norvegicus
gggctagaattttgtgtcccaaatt

SEQ ID NO: 456656 - DNA, 25 bp, Rattus norvegicus
gggctagacaccatttctttgactt

SEQ ID NO: 456657 - DNA, 25 bp, Rattus norvegicus
gggctagacaccttttctttgactt

SEQ ID NO: 456658 - DNA, 25 bp, Rattus norvegicus
gggctagagcatagactggtcttcc

SEQ ID NO: 456659 - DNA, 25 bp, Rattus norvegicus
gggctagagcattgactggtcttcc

SEQ ID NO: 456660 - DNA, 25 bp, Rattus norvegicus
gggctagagcggctccttagaaact

SEQ ID NO: 456661 - DNA, 25 bp, Rattus norvegicus
gggctagagcgggtccttagaaact

SEQ ID NO: 456662 - DNA, 25 bp, Rattus norvegicus
gggctagatgatatctgtgtactac

SEQ ID NO: 456663 - DNA, 25 bp, Rattus norvegicus
gggctagatgatttctgtgtactac

SEQ ID NO: 456664 - DNA, 25 bp, Rattus norvegicus
gggctagatgcaccagacaccgagt

SEQ ID NO: 456665 - DNA, 25 bp, Rattus norvegicus
gggctagatgcagcagacaccgagt

SEQ ID NO: 456666 - DNA, 25 bp, Rattus norvegicus
gggctagcagatacccagctttctg

SEQ ID NO: 456667 - DNA, 25 bp, Rattus norvegicus
gggctagcagattcccagctttctg

SEQ ID NO: 456668 - DNA, 25 bp, Rattus norvegicus
gggctagcagcactacaaggacaga

SEQ ID NO: 456669 - DNA, 25 bp, Rattus norvegicus
gggctagcagcagtacaaggacaga

SEQ ID NO: 456670 - DNA, 25 bp, Rattus norvegicus
gggctagcagcgcagctgtacatac

SEQ ID NO: 456671 - DNA, 25 bp, Rattus norvegicus
gggctagcagcggagctgtacatac

SEQ ID NO: 456672 - DNA, 25 bp, Rattus norvegicus
gggctagcagtgactaagcagcgat

SEQ ID NO: 456673 - DNA, 25 bp, Rattus norvegicus
gggctagcagtgtctaagcagcgat

SEQ ID NO: 456674 - DNA, 25 bp, Rattus norvegicus
gggctagcctgcattaagtcagatg

SEQ ID NO: 456675 - DNA, 25 bp, Rattus norvegicus
gggctagcctgctttaagtcagatg

SEQ ID NO: 456676 - DNA, 25 bp, Rattus norvegicus
gggctagctttcagatagaccgttt

SEQ ID NO: 456677 - DNA, 25 bp, Rattus norvegicus
gggctagctttctgatagaccgttt

SEQ ID NO: 456678 - DNA, 25 bp, Rattus norvegicus
gggctagggattcgggacgtctgca

SEQ ID NO: 456679 - DNA, 25 bp, Rattus norvegicus
gggctagggattggggacgtctgca

SEQ ID NO: 456680 - DNA, 25 bp, Rattus norvegicus
gggctagggcttcttccctataaca

SEQ ID NO: 456681 - DNA, 25 bp, Rattus norvegicus
gggctagggcttgttccctataaca

SEQ ID NO: 456682 - DNA, 25 bp, Rattus norvegicus
gggctaggtgacacatgactctaac

SEQ ID NO: 456683 - DNA, 25 bp, Rattus norvegicus
gggctaggtgactcatgactctaac

SEQ ID NO: 456684 - DNA, 25 bp, Rattus norvegicus
gggctagtagctcacctgctggctc

SEQ ID NO: 456685 - DNA, 25 bp, Rattus norvegicus
gggctagtagctgacctgctggctc

SEQ ID NO: 456686 - DNA, 25 bp, Rattus norvegicus
gggctagtcagaaaaccacaggtat

SEQ ID NO: 456687 - DNA, 25 bp, Rattus norvegicus
gggctagtcagataaccacaggtat

SEQ ID NO: 456688 - DNA, 25 bp, Rattus norvegicus
gggctagtccaacttttatggctag

SEQ ID NO: 456689 - DNA, 25 bp, Rattus norvegicus
gggctagtccaagttttatggctag

SEQ ID NO: 456690 - DNA, 25 bp, Rattus norvegicus
gggctagtcgagctattttgtcttt

SEQ ID NO: 456691 - DNA, 25 bp, Rattus norvegicus
gggctagtcgaggtattttgtcttt

SEQ ID NO: 456692 - DNA, 25 bp, Rattus norvegicus
gggctagtgaacagtcctgctttct

SEQ ID NO: 456693 - DNA, 25 bp, Rattus norvegicus
gggctagtgaactgtcctgctttct

SEQ ID NO: 456694 - DNA, 25 bp, Rattus norvegicus
gggctagtgacacttccccgtagct

SEQ ID NO: 456695 - DNA, 25 bp, Rattus norvegicus
gggctagtgacagttccccgtagct

SEQ ID NO: 456696 - DNA, 25 bp, Rattus norvegicus
gggctagtgaggacttacgtccaaa

SEQ ID NO: 456697 - DNA, 25 bp, Rattus norvegicus
gggctagtgaggtcttacgtccaaa

SEQ ID NO: 456698 - DNA, 25 bp, Rattus norvegicus
gggctagtgcccatagcaacagaca

SEQ ID NO: 456699 - DNA, 25 bp, Rattus norvegicus
gggctagtgcccttagcaacagaca

SEQ ID NO: 456700 - DNA, 25 bp, Rattus norvegicus
gggctagttctactgatccaaactt

SEQ ID NO: 456701 - DNA, 25 bp, Rattus norvegicus
gggctagttctagtgatccaaactt

SEQ ID NO: 456702 - DNA, 25 bp, Rattus norvegicus
gggctagttgttcctttagctacat

SEQ ID NO: 456703 - DNA, 25 bp, Rattus norvegicus
gggctagttgttgctttagctacat

SEQ ID NO: 456704 - DNA, 25 bp, Rattus norvegicus
gggctataaaccctagctaggcaca

SEQ ID NO: 456705 - DNA, 25 bp, Rattus norvegicus
gggctataaaccgtagctaggcaca

SEQ ID NO: 456706 - DNA, 25 bp, Rattus norvegicus
gggctataaatcatttccgagacta

SEQ ID NO: 456707 - DNA, 25 bp, Rattus norvegicus
gggctataaatcttttccgagacta

SEQ ID NO: 456708 - DNA, 25 bp, Rattus norvegicus
gggctataaccaagtcggcgtgtgc

SEQ ID NO: 456709 - DNA, 25 bp, Rattus norvegicus
gggctataaccatgtcggcgtgtgc

SEQ ID NO: 456710 - DNA, 25 bp, Rattus norvegicus
gggctataacccaatttttcattga

SEQ ID NO: 456711 - DNA, 25 bp, Rattus norvegicus
gggctataaccctatttttcattga

SEQ ID NO: 456712 - DNA, 25 bp, Rattus norvegicus
gggctatagactactgtgtcctgta

SEQ ID NO: 456713 - DNA, 25 bp, Rattus norvegicus
gggctatagacttctgtgtcctgta

SEQ ID NO: 456714 - DNA, 25 bp, Rattus norvegicus
gggctatagtccagtgtgccttaga

SEQ ID NO: 456715 - DNA, 25 bp, Rattus norvegicus
gggctatagtcctgtgtgccttaga

SEQ ID NO: 456716 - DNA, 25 bp, Rattus norvegicus
gggctatcacatcttaaaacctact

SEQ ID NO: 456717 - DNA, 25 bp, Rattus norvegicus
gggctatcacatgttaaaacctact

SEQ ID NO: 456718 - DNA, 25 bp, Rattus norvegicus
gggctatcactcagaaactgctggg

SEQ ID NO: 456719 - DNA, 25 bp, Rattus norvegicus
gggctatcactctgaaactgctggg

SEQ ID NO: 456720 - DNA, 25 bp, Rattus norvegicus
gggctatcagtacactgtccacacc

SEQ ID NO: 456721 - DNA, 25 bp, Rattus norvegicus
gggctatcagtagactgtccacacc

SEQ ID NO: 456722 - DNA, 25 bp, Rattus norvegicus
gggctatcagtcattcacgctaagc

SEQ ID NO: 456723 - DNA, 25 bp, Rattus norvegicus
gggctatcagtctttcacgctaagc

SEQ ID NO: 456724 - DNA, 25 bp, Rattus norvegicus
gggctatcattaagcacttgggaga

SEQ ID NO: 456725 - DNA, 25 bp, Rattus norvegicus
gggctatcattatgcacttgggaga

SEQ ID NO: 456726 - DNA, 25 bp, Rattus norvegicus
gggctatccatacagcatatatctc

SEQ ID NO: 456727 - DNA, 25 bp, Rattus norvegicus
gggctatccatagagcatatatctc

SEQ ID NO: 456728 - DNA, 25 bp, Rattus norvegicus
gggctatcctacaaataagattgtt

SEQ ID NO: 456729 - DNA, 25 bp, Rattus norvegicus
gggctatcctactaataagattgtt

SEQ ID NO: 456730 - DNA, 25 bp, Rattus norvegicus
gggctatcctgacctacttagagag

SEQ ID NO: 456731 - DNA, 25 bp, Rattus norvegicus
gggctatcctgagctacttagagag

SEQ ID NO: 456732 - DNA, 25 bp, Rattus norvegicus
gggctatctacactgaggacctatc

SEQ ID NO: 456733 - DNA, 25 bp, Rattus norvegicus
gggctatctacagtgaggacctatc

SEQ ID NO: 456734 - DNA, 25 bp, Rattus norvegicus
gggctatctagcaggtactacaaat

SEQ ID NO: 456735 - DNA, 25 bp, Rattus norvegicus
gggctatctagctggtactacaaat

SEQ ID NO: 456736 - DNA, 25 bp, Rattus norvegicus
gggctatctccaactgtaacccagg

SEQ ID NO: 456737 - DNA, 25 bp, Rattus norvegicus
gggctatctccatctgtaacccagg

SEQ ID NO: 456738 - DNA, 25 bp, Rattus norvegicus
gggctatctgataaagtgtttcctt

SEQ ID NO: 456739 - DNA, 25 bp, Rattus norvegicus
gggctatctgattaagtgtttcctt

SEQ ID NO: 456740 - DNA, 25 bp, Rattus norvegicus
gggctatgaatgcatctgaactgat

SEQ ID NO: 456741 - DNA, 25 bp, Rattus norvegicus
gggctatgaatggatctgaactgat

SEQ ID NO: 456742 - DNA, 25 bp, Rattus norvegicus
gggctatgaattcgtctttcctaaa

SEQ ID NO: 456743 - DNA, 25 bp, Rattus norvegicus
gggctatgaattggtctttcctaaa

SEQ ID NO: 456744 - DNA, 25 bp, Rattus norvegicus
gggctatgacccaagtggtgcttcc

SEQ ID NO: 456745 - DNA, 25 bp, Rattus norvegicus
gggctatgaccctagtggtgcttcc

SEQ ID NO: 456746 - DNA, 25 bp, Rattus norvegicus
gggctatgacgcaccttgggagaca

SEQ ID NO: 456747 - DNA, 25 bp, Rattus norvegicus
gggctatgacgctccttgggagaca

SEQ ID NO: 456748 - DNA, 25 bp, Rattus norvegicus
gggctatgcaaactctctcattaat

SEQ ID NO: 456749 - DNA, 25 bp, Rattus norvegicus
gggctatgcaaagtctctcattaat

SEQ ID NO: 456750 - DNA, 25 bp, Rattus norvegicus
gggctatgcaagatggcaccccagc

SEQ ID NO: 456751 - DNA, 25 bp, Rattus norvegicus
gggctatgcaagttggcaccccagc

SEQ ID NO: 456752 - DNA, 25 bp, Rattus norvegicus
gggctatgcttaaactctttccaac

SEQ ID NO: 456753 - DNA, 25 bp, Rattus norvegicus
gggctatgcttatactctttccaac

SEQ ID NO: 456754 - DNA, 25 bp, Rattus norvegicus
gggctatggccaaggtgaccggtgg

SEQ ID NO: 456755 - DNA, 25 bp, Rattus norvegicus
gggctatggccatggtgaccggtgg

SEQ ID NO: 456756 - DNA, 25 bp, Rattus norvegicus
gggctatggcttagtcagcttcaaa

SEQ ID NO: 456757 - DNA, 25 bp, Rattus norvegicus
gggctatggctttgtcagcttcaaa

SEQ ID NO: 456758 - DNA, 25 bp, Rattus norvegicus
gggctatgggatccttgaccacctt

SEQ ID NO: 456759 - DNA, 25 bp, Rattus norvegicus
gggctatgggatgcttgaccacctt

SEQ ID NO: 456760 - DNA, 25 bp, Rattus norvegicus
gggctatgtctgattaacttttatt

SEQ ID NO: 456761 - DNA, 25 bp, Rattus norvegicus
gggctatgtctgtttaacttttatt

SEQ ID NO: 456762 - DNA, 25 bp, Rattus norvegicus
gggctatgtgccagacctctgcaac

SEQ ID NO: 456763 - DNA, 25 bp, Rattus norvegicus
gggctatgtgcctgacctctgcaac

SEQ ID NO: 456764 - DNA, 25 bp, Rattus norvegicus
gggctatgtggtcacagtatgaact

SEQ ID NO: 456765 - DNA, 25 bp, Rattus norvegicus
gggctatgtggtgacagtatgaact

SEQ ID NO: 456766 - DNA, 25 bp, Rattus norvegicus
gggctattccacaaaggatggctat

SEQ ID NO: 456767 - DNA, 25 bp, Rattus norvegicus
gggctattccactaaggatggctat

SEQ ID NO: 456768 - DNA, 25 bp, Rattus norvegicus
gggctattcccaagagattgttgaa

SEQ ID NO: 456769 - DNA, 25 bp, Rattus norvegicus
gggctattcccatgagattgttgaa

SEQ ID NO: 456770 - DNA, 25 bp, Rattus norvegicus
gggctattccggagggccagaacta

SEQ ID NO: 456771 - DNA, 25 bp, Rattus norvegicus
gggctattccggtgggccagaacta

SEQ ID NO: 456772 - DNA, 25 bp, Rattus norvegicus
gggctattcctgctaatgagaaaac

SEQ ID NO: 456773 - DNA, 25 bp, Rattus norvegicus
gggctattcctggtaatgagaaaac

SEQ ID NO: 456774 - DNA, 25 bp, Rattus norvegicus
gggctattctctcagtgatgatgat

SEQ ID NO: 456775 - DNA, 25 bp, Rattus norvegicus
gggctattctctgagtgatgatgat

SEQ ID NO: 456776 - DNA, 25 bp, Rattus norvegicus
gggctattgcaacgaggacaattag

SEQ ID NO: 456777 - DNA, 25 bp, Rattus norvegicus
gggctattgcaaggaggacaattag

SEQ ID NO: 456778 - DNA, 25 bp, Rattus norvegicus
gggctattgcttaaccgtgtgataa

SEQ ID NO: 456779 - DNA, 25 bp, Rattus norvegicus
gggctattgctttaccgtgtgataa

SEQ ID NO: 456780 - DNA, 25 bp, Rattus norvegicus
gggctattgtacagctcgccgcatt

SEQ ID NO: 456781 - DNA, 25 bp, Rattus norvegicus
gggctattgtactgctcgccgcatt

SEQ ID NO: 456782 - DNA, 25 bp, Rattus norvegicus
gggctatttaggcatcctgcataaa

SEQ ID NO: 456783 - DNA, 25 bp, Rattus norvegicus
gggctatttagggatcctgcataaa

SEQ ID NO: 456784 - DNA, 25 bp, Rattus norvegicus
gggctatttatacctgcctgcggcc

SEQ ID NO: 456785 - DNA, 25 bp, Rattus norvegicus
gggctatttatagctgcctgcggcc

SEQ ID NO: 456786 - DNA, 25 bp, Rattus norvegicus
gggctatttccgaaggctgaagtac

SEQ ID NO: 456787 - DNA, 25 bp, Rattus norvegicus
gggctatttccgtaggctgaagtac

SEQ ID NO: 456788 - DNA, 25 bp, Rattus norvegicus
gggctatttgttaggatatcctgaa

SEQ ID NO: 456789 - DNA, 25 bp, Rattus norvegicus
gggctatttgtttggatatcctgaa

SEQ ID NO: 456790 - DNA, 25 bp, Rattus norvegicus
gggctcaaacacaggtgggacagaa

SEQ ID NO: 456791 - DNA, 25 bp, Rattus norvegicus
gggctcaaacactggtgggacagaa

SEQ ID NO: 456792 - DNA, 25 bp, Rattus norvegicus
gggctcaaacagatcctgagtaaaa

SEQ ID NO: 456793 - DNA, 25 bp, Rattus norvegicus
gggctcaaacagttcctgagtaaaa

SEQ ID NO: 456794 - DNA, 25 bp, Rattus norvegicus
gggctcaaagctaggacattatgtc

SEQ ID NO: 456795 - DNA, 25 bp, Rattus norvegicus
gggctcaaagctctccacttaggaa

SEQ ID NO: 456796 - DNA, 25 bp, Rattus norvegicus
gggctcaaagctgtccacttaggaa

SEQ ID NO: 456797 - DNA, 25 bp, Rattus norvegicus
gggctcaaagcttggacattatgtc

SEQ ID NO: 456798 - DNA, 25 bp, Rattus norvegicus
gggctcaaatatcagcaccaatagg

SEQ ID NO: 456799 - DNA, 25 bp, Rattus norvegicus
gggctcaaatatgagcaccaatagg

SEQ ID NO: 456800 - DNA, 25 bp, Rattus norvegicus
gggctcaaatccacatcatgcagat

SEQ ID NO: 456801 - DNA, 25 bp, Rattus norvegicus
gggctcaaatcctcatcatgcagat

SEQ ID NO: 456802 - DNA, 25 bp, Rattus norvegicus
gggctcaaatgacctaggctggcct

SEQ ID NO: 456803 - DNA, 25 bp, Rattus norvegicus
gggctcaaatgagctaggctggcct

SEQ ID NO: 456804 - DNA, 25 bp, Rattus norvegicus
gggctcaaattaacctttcacaggg

SEQ ID NO: 456805 - DNA, 25 bp, Rattus norvegicus
gggctcaaattatcctttcacaggg

SEQ ID NO: 456806 - DNA, 25 bp, Rattus norvegicus
gggctcaacagtcaccaatgaacgt

SEQ ID NO: 456807 - DNA, 25 bp, Rattus norvegicus
gggctcaacagtgaccaatgaacgt

SEQ ID NO: 456808 - DNA, 25 bp, Rattus norvegicus
gggctcaaccagcataggacatagc

SEQ ID NO: 456809 - DNA, 25 bp, Rattus norvegicus
gggctcaaccaggataggacatagc

SEQ ID NO: 456810 - DNA, 25 bp, Rattus norvegicus
gggctcaactgcaactcagaaactt

SEQ ID NO: 456811 - DNA, 25 bp, Rattus norvegicus
gggctcaactgctactcagaaactt

SEQ ID NO: 456812 - DNA, 25 bp, Rattus norvegicus
gggctcaagcacaagaattccacag

SEQ ID NO: 456813 - DNA, 25 bp, Rattus norvegicus
gggctcaagcactagaattccacag

SEQ ID NO: 456814 - DNA, 25 bp, Rattus norvegicus
gggctcaagccaccaatctatgaag

SEQ ID NO: 456815 - DNA, 25 bp, Rattus norvegicus
gggctcaagccagcaatctatgaag

SEQ ID NO: 456816 - DNA, 25 bp, Rattus norvegicus
gggctcaagcccaaaggtgttgaag

SEQ ID NO: 456817 - DNA, 25 bp, Rattus norvegicus
gggctcaagccctaaggtgttgaag

SEQ ID NO: 456818 - DNA, 25 bp, Rattus norvegicus
gggctcaagcttcgtccagttggac

SEQ ID NO: 456819 - DNA, 25 bp, Rattus norvegicus
gggctcaagcttggtccagttggac

SEQ ID NO: 456820 - DNA, 25 bp, Rattus norvegicus
gggctcaagtccaatgggtcaagga

SEQ ID NO: 456821 - DNA, 25 bp, Rattus norvegicus
gggctcaagtcctatgggtcaagga

SEQ ID NO: 456822 - DNA, 25 bp, Rattus norvegicus
gggctcaatccccagcattaaaaaa

SEQ ID NO: 456823 - DNA, 25 bp, Rattus norvegicus
gggctcaatccccagtgatgcatga

SEQ ID NO: 456824 - DNA, 25 bp, Rattus norvegicus
gggctcaatcccgagcattaaaaaa

SEQ ID NO: 456825 - DNA, 25 bp, Rattus norvegicus
gggctcaatcccgagtgatgcatga

SEQ ID NO: 456826 - DNA, 25 bp, Rattus norvegicus
gggctcaatgatctaccctgttatt

SEQ ID NO: 456827 - DNA, 25 bp, Rattus norvegicus
gggctcaatgatgtaccctgttatt

SEQ ID NO: 456828 - DNA, 25 bp, Rattus norvegicus
gggctcaatgccactttcatggcgt

SEQ ID NO: 456829 - DNA, 25 bp, Rattus norvegicus
gggctcaatgcctctttcatggcgt

SEQ ID NO: 456830 - DNA, 25 bp, Rattus norvegicus
gggctcacacagacatcgggcaaga

SEQ ID NO: 456831 - DNA, 25 bp, Rattus norvegicus
gggctcacacagtcatcgggcaaga

SEQ ID NO: 456832 - DNA, 25 bp, Rattus norvegicus
gggctcacacttcctgatgattaga

SEQ ID NO: 456833 - DNA, 25 bp, Rattus norvegicus
gggctcacacttgctgatgattaga

SEQ ID NO: 456834 - DNA, 25 bp, Rattus norvegicus
gggctcacagcaacaaggaagggaa

SEQ ID NO: 456835 - DNA, 25 bp, Rattus norvegicus
gggctcacagcatcaaggaagggaa

SEQ ID NO: 456836 - DNA, 25 bp, Rattus norvegicus
gggctcacagtcactgtaagtaccg

SEQ ID NO: 456837 - DNA, 25 bp, Rattus norvegicus
gggctcacagtctctgtaagtaccg

SEQ ID NO: 456838 - DNA, 25 bp, Rattus norvegicus
gggctcacagtgaatccacgttcag

SEQ ID NO: 456839 - DNA, 25 bp, Rattus norvegicus
gggctcacagtgctgcgtatcctgt

SEQ ID NO: 456840 - DNA, 25 bp, Rattus norvegicus
gggctcacagtggtgcgtatcctgt

SEQ ID NO: 456841 - DNA, 25 bp, Rattus norvegicus
gggctcacagtgtatccacgttcag

SEQ ID NO: 456842 - DNA, 25 bp, Rattus norvegicus
gggctcacatggataacctctaact

SEQ ID NO: 456843 - DNA, 25 bp, Rattus norvegicus
gggctcacatggttaacctctaact

SEQ ID NO: 456844 - DNA, 25 bp, Rattus norvegicus
gggctcacatgtagcattattgttt

SEQ ID NO: 456845 - DNA, 25 bp, Rattus norvegicus
gggctcacatgttgcattattgttt

SEQ ID NO: 456846 - DNA, 25 bp, Rattus norvegicus
gggctcaccaacaggagggttcgta

SEQ ID NO: 456847 - DNA, 25 bp, Rattus norvegicus
gggctcaccaactggagggttcgta

SEQ ID NO: 456848 - DNA, 25 bp, Rattus norvegicus
gggctcaccatcacaggtggctaag

SEQ ID NO: 456849 - DNA, 25 bp, Rattus norvegicus
gggctcaccatctcaggtggctaag

SEQ ID NO: 456850 - DNA, 25 bp, Rattus norvegicus
gggctcaccccacaagattctgtag

SEQ ID NO: 456851 - DNA, 25 bp, Rattus norvegicus
gggctcaccccagaagattctgtag

SEQ ID NO: 456852 - DNA, 25 bp, Rattus norvegicus
gggctcaccctgaggcaatgttaaa

SEQ ID NO: 456853 - DNA, 25 bp, Rattus norvegicus
gggctcaccctgtggcaatgttaaa

SEQ ID NO: 456854 - DNA, 25 bp, Rattus norvegicus
gggctcacctccaatgggttaaaat

SEQ ID NO: 456855 - DNA, 25 bp, Rattus norvegicus
gggctcacctcctatgggttaaaat

SEQ ID NO: 456856 - DNA, 25 bp, Rattus norvegicus
gggctcacctgtacctggagctgtg

SEQ ID NO: 456857 - DNA, 25 bp, Rattus norvegicus
gggctcacctgttcctggagctgtg

SEQ ID NO: 456858 - DNA, 25 bp, Rattus norvegicus
gggctcacgggtccagcagtacctc

SEQ ID NO: 456859 - DNA, 25 bp, Rattus norvegicus
gggctcacgggtgcagcagtacctc

SEQ ID NO: 456860 - DNA, 25 bp, Rattus norvegicus
gggctcacgtctctgatcccagcat

SEQ ID NO: 456861 - DNA, 25 bp, Rattus norvegicus
gggctcacgtctgtgatcccagcat

SEQ ID NO: 456862 - DNA, 25 bp, Rattus norvegicus
gggctcactataaggtgcagaccat

SEQ ID NO: 456863 - DNA, 25 bp, Rattus norvegicus
gggctcactatatggtgcagaccat

SEQ ID NO: 456864 - DNA, 25 bp, Rattus norvegicus
gggctcactctactatgtgccagag

SEQ ID NO: 456865 - DNA, 25 bp, Rattus norvegicus
gggctcactctagtatgtgccagag

SEQ ID NO: 456866 - DNA, 25 bp, Rattus norvegicus
gggctcactgaaacacatggtggtg

SEQ ID NO: 456867 - DNA, 25 bp, Rattus norvegicus
gggctcactgaatcacatggtggtg

SEQ ID NO: 456868 - DNA, 25 bp, Rattus norvegicus
gggctcactgtgagttaatccacac

SEQ ID NO: 456869 - DNA, 25 bp, Rattus norvegicus
gggctcactgtgtgttaatccacac

SEQ ID NO: 456870 - DNA, 25 bp, Rattus norvegicus
gggctcagaaacaccatcgtaaaga

SEQ ID NO: 456871 - DNA, 25 bp, Rattus norvegicus
gggctcagaaactccatcgtaaaga

SEQ ID NO: 456872 - DNA, 25 bp, Rattus norvegicus
gggctcagactgagggccaccatgc

SEQ ID NO: 456873 - DNA, 25 bp, Rattus norvegicus
gggctcagactgtgggccaccatgc

SEQ ID NO: 456874 - DNA, 25 bp, Rattus norvegicus
gggctcagacttccgggctttgttt

SEQ ID NO: 456875 - DNA, 25 bp, Rattus norvegicus
gggctcagacttgcgggctttgttt

SEQ ID NO: 456876 - DNA, 25 bp, Rattus norvegicus
gggctcagagatagactcttcctgg

SEQ ID NO: 456877 - DNA, 25 bp, Rattus norvegicus
gggctcagagattgactcttcctgg

SEQ ID NO: 456878 - DNA, 25 bp, Rattus norvegicus
gggctcagaggcaaggtgactaata

SEQ ID NO: 456879 - DNA, 25 bp, Rattus norvegicus
gggctcagaggctaggtgactaata

SEQ ID NO: 456880 - DNA, 25 bp, Rattus norvegicus
gggctcagagtgatgtactcgcaaa

SEQ ID NO: 456881 - DNA, 25 bp, Rattus norvegicus
gggctcagagtgttgtactcgcaaa

SEQ ID NO: 456882 - DNA, 25 bp, Rattus norvegicus
gggctcagatgacacttgacataaa

SEQ ID NO: 456883 - DNA, 25 bp, Rattus norvegicus
gggctcagatgagacttgacataaa

SEQ ID NO: 456884 - DNA, 25 bp, Rattus norvegicus
gggctcagatgcagatcgtttgctc

SEQ ID NO: 456885 - DNA, 25 bp, Rattus norvegicus
gggctcagatgctgatcgtttgctc

SEQ ID NO: 456886 - DNA, 25 bp, Rattus norvegicus
gggctcagcaatattatactccaat

SEQ ID NO: 456887 - DNA, 25 bp, Rattus norvegicus
gggctcagcaattttatactccaat

SEQ ID NO: 456888 - DNA, 25 bp, Rattus norvegicus
gggctcagcagtaggctatgccatc

SEQ ID NO: 456889 - DNA, 25 bp, Rattus norvegicus
gggctcagcagttggctatgccatc

SEQ ID NO: 456890 - DNA, 25 bp, Rattus norvegicus
gggctcagctgaattctgtgaaata

SEQ ID NO: 456891 - DNA, 25 bp, Rattus norvegicus
gggctcagctgatttctgtgaaata

SEQ ID NO: 456892 - DNA, 25 bp, Rattus norvegicus
gggctcaggaacctggacttttgta

SEQ ID NO: 456893 - DNA, 25 bp, Rattus norvegicus
gggctcaggaacgtggacttttgta

SEQ ID NO: 456894 - DNA, 25 bp, Rattus norvegicus
gggctcaggataacacggtttggaa

SEQ ID NO: 456895 - DNA, 25 bp, Rattus norvegicus
gggctcaggatatcacggtttggaa

SEQ ID NO: 456896 - DNA, 25 bp, Rattus norvegicus
gggctcaggcacatgagttcatcct

SEQ ID NO: 456897 - DNA, 25 bp, Rattus norvegicus
gggctcaggcacttgagttcatcct

SEQ ID NO: 456898 - DNA, 25 bp, Rattus norvegicus
gggctcaggcagactcgggacccca

SEQ ID NO: 456899 - DNA, 25 bp, Rattus norvegicus
gggctcaggcagtctcgggacccca

SEQ ID NO: 456900 - DNA, 25 bp, Rattus norvegicus
gggctcaggctccattgtgtgaaat

SEQ ID NO: 456901 - DNA, 25 bp, Rattus norvegicus
gggctcaggctcgattgtgtgaaat

SEQ ID NO: 456902 - DNA, 25 bp, Rattus norvegicus
gggctcagggccagttttactaagc

SEQ ID NO: 456903 - DNA, 25 bp, Rattus norvegicus
gggctcagggcctgttttactaagc

SEQ ID NO: 456904 - DNA, 25 bp, Rattus norvegicus
gggctcagggtcactggattgtttc

SEQ ID NO: 456905 - DNA, 25 bp, Rattus norvegicus
gggctcagggtctctggattgtttc

SEQ ID NO: 456906 - DNA, 25 bp, Rattus norvegicus
gggctcaggtccagcttattgttgg

SEQ ID NO: 456907 - DNA, 25 bp, Rattus norvegicus
gggctcaggtcctgcttattgttgg

SEQ ID NO: 456908 - DNA, 25 bp, Rattus norvegicus
gggctcagtaatcgctacctcagca

SEQ ID NO: 456909 - DNA, 25 bp, Rattus norvegicus
gggctcagtaatggctacctcagca

SEQ ID NO: 456910 - DNA, 25 bp, Rattus norvegicus
gggctcagtgttaccatgcatatga

SEQ ID NO: 456911 - DNA, 25 bp, Rattus norvegicus
gggctcagtgtttccatgcatatga

SEQ ID NO: 456912 - DNA, 25 bp, Rattus norvegicus
gggctcataagaagacccgagggaa

SEQ ID NO: 456913 - DNA, 25 bp, Rattus norvegicus
gggctcataagatgacccgagggaa

SEQ ID NO: 456914 - DNA, 25 bp, Rattus norvegicus
gggctcataggaagcacagtatagt

SEQ ID NO: 456915 - DNA, 25 bp, Rattus norvegicus
gggctcataggatgcacagtatagt

SEQ ID NO: 456916 - DNA, 25 bp, Rattus norvegicus
gggctcatcagcagacattggccac

SEQ ID NO: 456917 - DNA, 25 bp, Rattus norvegicus
gggctcatcagctgacattggccac

SEQ ID NO: 456918 - DNA, 25 bp, Rattus norvegicus
gggctcatccataaaaggcactcgc

SEQ ID NO: 456919 - DNA, 25 bp, Rattus norvegicus
gggctcatccattaaaggcactcgc

SEQ ID NO: 456920 - DNA, 25 bp, Rattus norvegicus
gggctcatctgtccagggattctct

SEQ ID NO: 456921 - DNA, 25 bp, Rattus norvegicus
gggctcatctgtgcagggattctct

SEQ ID NO: 456922 - DNA, 25 bp, Rattus norvegicus
gggctcatcttgcaacacagcatga

SEQ ID NO: 456923 - DNA, 25 bp, Rattus norvegicus
gggctcatcttggaacacagcatga

SEQ ID NO: 456924 - DNA, 25 bp, Rattus norvegicus
gggctcatgattacaggttccagca

SEQ ID NO: 456925 - DNA, 25 bp, Rattus norvegicus
gggctcatgatttcaggttccagca

SEQ ID NO: 456926 - DNA, 25 bp, Rattus norvegicus
gggctcatgcctctaccaaacaaag

SEQ ID NO: 456927 - DNA, 25 bp, Rattus norvegicus
gggctcatgcctgtaccaaacaaag

SEQ ID NO: 456928 - DNA, 25 bp, Rattus norvegicus
gggctcatgcgccttgtttgatatg

SEQ ID NO: 456929 - DNA, 25 bp, Rattus norvegicus
gggctcatgcgcgttgtttgatatg

SEQ ID NO: 456930 - DNA, 25 bp, Rattus norvegicus
gggctcatgctacgcaagtgctcta

SEQ ID NO: 456931 - DNA, 25 bp, Rattus norvegicus
gggctcatgctaggcaagtgctcta

SEQ ID NO: 456932 - DNA, 25 bp, Rattus norvegicus
gggctcatgggtaagatcacgtgca

SEQ ID NO: 456933 - DNA, 25 bp, Rattus norvegicus
gggctcatgggttagatcacgtgca

SEQ ID NO: 456934 - DNA, 25 bp, Rattus norvegicus
gggctcatgtctctcagaaccggct

SEQ ID NO: 456935 - DNA, 25 bp, Rattus norvegicus
gggctcatgtctgtcagaaccggct

SEQ ID NO: 456936 - DNA, 25 bp, Rattus norvegicus
gggctcatgttcctaatcattattt

SEQ ID NO: 456937 - DNA, 25 bp, Rattus norvegicus
gggctcatgttcgtaatcattattt

SEQ ID NO: 456938 - DNA, 25 bp, Rattus norvegicus
gggctcattaatctcatttgctttg

SEQ ID NO: 456939 - DNA, 25 bp, Rattus norvegicus
gggctcattaatgtcatttgctttg

SEQ ID NO: 456940 - DNA, 25 bp, Rattus norvegicus
gggctcattatcctgtgtgtgacac

SEQ ID NO: 456941 - DNA, 25 bp, Rattus norvegicus
gggctcattatcgtgtgtgtgacac

SEQ ID NO: 456942 - DNA, 25 bp, Rattus norvegicus
gggctcattgtcctgtctaacccag

SEQ ID NO: 456943 - DNA, 25 bp, Rattus norvegicus
gggctcattgtcgtgtctaacccag

SEQ ID NO: 456944 - DNA, 25 bp, Rattus norvegicus
gggctcatttccacagatcgtatta

SEQ ID NO: 456945 - DNA, 25 bp, Rattus norvegicus
gggctcatttccaggacaagcacag

SEQ ID NO: 456946 - DNA, 25 bp, Rattus norvegicus
gggctcatttcctcagatcgtatta

SEQ ID NO: 456947 - DNA, 25 bp, Rattus norvegicus
gggctcatttcctggacaagcacag

SEQ ID NO: 456948 - DNA, 25 bp, Rattus norvegicus
gggctcatttttcgctcttttagac

SEQ ID NO: 456949 - DNA, 25 bp, Rattus norvegicus
gggctcatttttggctcttttagac

SEQ ID NO: 456950 - DNA, 25 bp, Rattus norvegicus
gggctccaaagcctgtctggcttaa

SEQ ID NO: 456951 - DNA, 25 bp, Rattus norvegicus
gggctccaaagcgtgtctggcttaa

SEQ ID NO: 456952 - DNA, 25 bp, Rattus norvegicus
gggctccaagggaaggtttcatcta

SEQ ID NO: 456953 - DNA, 25 bp, Rattus norvegicus
gggctccaagggtaggtttcatcta

SEQ ID NO: 456954 - DNA, 25 bp, Rattus norvegicus
gggctccaagtgatctacaaaggtt

SEQ ID NO: 456955 - DNA, 25 bp, Rattus norvegicus
gggctccaagtgttctacaaaggtt

SEQ ID NO: 456956 - DNA, 25 bp, Rattus norvegicus
gggctccaattacctaggaatagag

SEQ ID NO: 456957 - DNA, 25 bp, Rattus norvegicus
gggctccaattagctaggaatagag

SEQ ID NO: 456958 - DNA, 25 bp, Rattus norvegicus
gggctccacaaaataccaggcagca

SEQ ID NO: 456959 - DNA, 25 bp, Rattus norvegicus
gggctccacaaattaccaggcagca

SEQ ID NO: 456960 - DNA, 25 bp, Rattus norvegicus
gggctccacacacagtaacctaggc

SEQ ID NO: 456961 - DNA, 25 bp, Rattus norvegicus
gggctccacacagagtaacctaggc

SEQ ID NO: 456962 - DNA, 25 bp, Rattus norvegicus
gggctccacactaacccaaagaggg

SEQ ID NO: 456963 - DNA, 25 bp, Rattus norvegicus
gggctccacacttacccaaagaggg

SEQ ID NO: 456964 - DNA, 25 bp, Rattus norvegicus
gggctccacctgcagggcaaagaac

SEQ ID NO: 456965 - DNA, 25 bp, Rattus norvegicus
gggctccacctggagggcaaagaac

SEQ ID NO: 456966 - DNA, 25 bp, Rattus norvegicus
gggctccacgtccataaaactcctt

SEQ ID NO: 456967 - DNA, 25 bp, Rattus norvegicus
gggctccacgtcgataaaactcctt

SEQ ID NO: 456968 - DNA, 25 bp, Rattus norvegicus
gggctccagacaatgtattttcctt

SEQ ID NO: 456969 - DNA, 25 bp, Rattus norvegicus
gggctccagacattgtattttcctt

SEQ ID NO: 456970 - DNA, 25 bp, Rattus norvegicus
gggctccagactatctgagatggaa

SEQ ID NO: 456971 - DNA, 25 bp, Rattus norvegicus
gggctccagactttctgagatggaa

SEQ ID NO: 456972 - DNA, 25 bp, Rattus norvegicus
gggctccagcatcaagaaagcaaga

SEQ ID NO: 456973 - DNA, 25 bp, Rattus norvegicus
gggctccagcatgaagaaagcaaga

SEQ ID NO: 456974 - DNA, 25 bp, Rattus norvegicus
gggctccagccaatgatgcttcaga

SEQ ID NO: 456975 - DNA, 25 bp, Rattus norvegicus
gggctccagccattgatgcttcaga

SEQ ID NO: 456976 - DNA, 25 bp, Rattus norvegicus
gggctccaggaaactcgggcatctt

SEQ ID NO: 456977 - DNA, 25 bp, Rattus norvegicus
gggctccaggaatctcgggcatctt

SEQ ID NO: 456978 - DNA, 25 bp, Rattus norvegicus
gggctccaggctatagaaccattag

SEQ ID NO: 456979 - DNA, 25 bp, Rattus norvegicus
gggctccaggctttagaaccattag

SEQ ID NO: 456980 - DNA, 25 bp, Rattus norvegicus
gggctccaggttatcgatactgcaa

SEQ ID NO: 456981 - DNA, 25 bp, Rattus norvegicus
gggctccaggttatgactcctggtg

SEQ ID NO: 456982 - DNA, 25 bp, Rattus norvegicus
gggctccaggttttcgatactgcaa

SEQ ID NO: 456983 - DNA, 25 bp, Rattus norvegicus
gggctccaggttttgactcctggtg

SEQ ID NO: 456984 - DNA, 25 bp, Rattus norvegicus
gggctccagtgtcagggtgccctga

SEQ ID NO: 456985 - DNA, 25 bp, Rattus norvegicus
gggctccagtgtgagggtgccctga

SEQ ID NO: 456986 - DNA, 25 bp, Rattus norvegicus
gggctccagtttatcatgtatgaat

SEQ ID NO: 456987 - DNA, 25 bp, Rattus norvegicus
gggctccagtttttcatgtatgaat

SEQ ID NO: 456988 - DNA, 25 bp, Rattus norvegicus
gggctccatcgaaagagtcctcgga

SEQ ID NO: 456989 - DNA, 25 bp, Rattus norvegicus
gggctccatcgatagagtcctcgga

SEQ ID NO: 456990 - DNA, 25 bp, Rattus norvegicus
gggctcccaaccatggaggagacgc

SEQ ID NO: 456991 - DNA, 25 bp, Rattus norvegicus
gggctcccaaccttggaggagacgc

SEQ ID NO: 456992 - DNA, 25 bp, Rattus norvegicus
gggctccccaaccaagcagctgctg

SEQ ID NO: 456993 - DNA, 25 bp, Rattus norvegicus
gggctccccaacgaagcagctgctg

SEQ ID NO: 456994 - DNA, 25 bp, Rattus norvegicus
gggctcccgcccatggccaggtaga

SEQ ID NO: 456995 - DNA, 25 bp, Rattus norvegicus
gggctcccgcccttggccaggtaga

SEQ ID NO: 456996 - DNA, 25 bp, Rattus norvegicus
gggctcccgcgaagatggcggagca

SEQ ID NO: 456997 - DNA, 25 bp, Rattus norvegicus
gggctcccgcgatgatggcggagca

SEQ ID NO: 456998 - DNA, 25 bp, Rattus norvegicus
gggctcccgtttattagctgctgtt

SEQ ID NO: 456999 - DNA, 25 bp, Rattus norvegicus
gggctcccgttttttagctgctgtt

SEQ ID NO: 457000 - DNA, 25 bp, Rattus norvegicus
gggctccctactccgagcgagatta

SEQ ID NO: 457001 - DNA, 25 bp, Rattus norvegicus
gggctccctactgcgagcgagatta

SEQ ID NO: 457002 - DNA, 25 bp, Rattus norvegicus
gggctccctgtacaactaaatgtta

SEQ ID NO: 457003 - DNA, 25 bp, Rattus norvegicus
gggctccctgtagaactaaatgtta

SEQ ID NO: 457004 - DNA, 25 bp, Rattus norvegicus
gggctccctgtcacggtctgaggca

SEQ ID NO: 457005 - DNA, 25 bp, Rattus norvegicus
gggctccctgtctcggtctgaggca

SEQ ID NO: 457006 - DNA, 25 bp, Rattus norvegicus
gggctccctttgacagagtcaatga

SEQ ID NO: 457007 - DNA, 25 bp, Rattus norvegicus
gggctccctttgtcagagtcaatga

SEQ ID NO: 457008 - DNA, 25 bp, Rattus norvegicus
gggctccgacaacttcttctggtct

SEQ ID NO: 457009 - DNA, 25 bp, Rattus norvegicus
gggctccgacaagttcttctggtct

SEQ ID NO: 457010 - DNA, 25 bp, Rattus norvegicus
gggctccgagccaaagtttcggact

SEQ ID NO: 457011 - DNA, 25 bp, Rattus norvegicus
gggctccgagcctaagtttcggact

SEQ ID NO: 457012 - DNA, 25 bp, Rattus norvegicus
gggctccgagtaaggcagtcaacag

SEQ ID NO: 457013 - DNA, 25 bp, Rattus norvegicus
gggctccgagtatggcagtcaacag

SEQ ID NO: 457014 - DNA, 25 bp, Rattus norvegicus
gggctccgctacactacaagggcct

SEQ ID NO: 457015 - DNA, 25 bp, Rattus norvegicus
gggctccgctactctacaagggcct

SEQ ID NO: 457016 - DNA, 25 bp, Rattus norvegicus
gggctccggagcagcagttactgtc

SEQ ID NO: 457017 - DNA, 25 bp, Rattus norvegicus
gggctccggagctgcagttactgtc

SEQ ID NO: 457018 - DNA, 25 bp, Rattus norvegicus
gggctccgggacatgaaagagactt

SEQ ID NO: 457019 - DNA, 25 bp, Rattus norvegicus
gggctccgggacttgaaagagactt

SEQ ID NO: 457020 - DNA, 25 bp, Rattus norvegicus
gggctccgtctcagaggaaatccag

SEQ ID NO: 457021 - DNA, 25 bp, Rattus norvegicus
gggctccgtctctgaggaaatccag

SEQ ID NO: 457022 - DNA, 25 bp, Rattus norvegicus
gggctccgttgactacggtgcttct

SEQ ID NO: 457023 - DNA, 25 bp, Rattus norvegicus
gggctccgttgagtacggtgcttct

SEQ ID NO: 457024 - DNA, 25 bp, Rattus norvegicus
gggctcctagaactcagtgtgtatc

SEQ ID NO: 457025 - DNA, 25 bp, Rattus norvegicus
gggctcctagaagtcagtgtgtatc

SEQ ID NO: 457026 - DNA, 25 bp, Rattus norvegicus
gggctcctagagcagttttctaagg

SEQ ID NO: 457027 - DNA, 25 bp, Rattus norvegicus
gggctcctagaggagttttctaagg

SEQ ID NO: 457028 - DNA, 25 bp, Rattus norvegicus
gggctcctaggcatctgagttctca

SEQ ID NO: 457029 - DNA, 25 bp, Rattus norvegicus
gggctcctaggcttctgagttctca

SEQ ID NO: 457030 - DNA, 25 bp, Rattus norvegicus
gggctcctatctcaggtactagtct

SEQ ID NO: 457031 - DNA, 25 bp, Rattus norvegicus
gggctcctatctgaggtactagtct

SEQ ID NO: 457032 - DNA, 25 bp, Rattus norvegicus
gggctcctatgaagcatcatgcacc

SEQ ID NO: 457033 - DNA, 25 bp, Rattus norvegicus
gggctcctatgaaggtatgatggca

SEQ ID NO: 457034 - DNA, 25 bp, Rattus norvegicus
gggctcctatgatgcatcatgcacc

SEQ ID NO: 457035 - DNA, 25 bp, Rattus norvegicus
gggctcctatgatggtatgatggca

SEQ ID NO: 457036 - DNA, 25 bp, Rattus norvegicus
gggctcctcaaacatgttcctaggt

SEQ ID NO: 457037 - DNA, 25 bp, Rattus norvegicus
gggctcctcaaagatgttcctaggt

SEQ ID NO: 457038 - DNA, 25 bp, Rattus norvegicus
gggctcctcaaccatgtaataccag

SEQ ID NO: 457039 - DNA, 25 bp, Rattus norvegicus
gggctcctcaacgatgtaataccag

SEQ ID NO: 457040 - DNA, 25 bp, Rattus norvegicus
gggctcctcaatacctgatctataa

SEQ ID NO: 457041 - DNA, 25 bp, Rattus norvegicus
gggctcctcaattcctgatctataa

SEQ ID NO: 457042 - DNA, 25 bp, Rattus norvegicus
gggctcctcagtcgttgttcaaata

SEQ ID NO: 457043 - DNA, 25 bp, Rattus norvegicus
gggctcctcagtggttgttcaaata

SEQ ID NO: 457044 - DNA, 25 bp, Rattus norvegicus
gggctcctccatctgtcagcaaagg

SEQ ID NO: 457045 - DNA, 25 bp, Rattus norvegicus
gggctcctccatgtgtcagcaaagg

SEQ ID NO: 457046 - DNA, 25 bp, Rattus norvegicus
gggctcctgcgtcgatgcagatact

SEQ ID NO: 457047 - DNA, 25 bp, Rattus norvegicus
gggctcctgcgtggatgcagatact

SEQ ID NO: 457048 - DNA, 25 bp, Rattus norvegicus
gggctcctgcttcgtgtacaagaat

SEQ ID NO: 457049 - DNA, 25 bp, Rattus norvegicus
gggctcctgcttggtgtacaagaat

SEQ ID NO: 457050 - DNA, 25 bp, Rattus norvegicus
gggctcctggttctcactactggcc

SEQ ID NO: 457051 - DNA, 25 bp, Rattus norvegicus
gggctcctggttgtcactactggcc

SEQ ID NO: 457052 - DNA, 25 bp, Rattus norvegicus
gggctcctgtttattgttctgagtc

SEQ ID NO: 457053 - DNA, 25 bp, Rattus norvegicus
gggctcctgttttttgttctgagtc

SEQ ID NO: 457054 - DNA, 25 bp, Rattus norvegicus
gggctccttatcacggacaaatgct

SEQ ID NO: 457055 - DNA, 25 bp, Rattus norvegicus
gggctccttatctcggacaaatgct

SEQ ID NO: 457056 - DNA, 25 bp, Rattus norvegicus
gggctccttcaaccgggagttagct

SEQ ID NO: 457057 - DNA, 25 bp, Rattus norvegicus
gggctccttcaagcgggagttagct

SEQ ID NO: 457058 - DNA, 25 bp, Rattus norvegicus
gggctccttcccacttaaggaatat

SEQ ID NO: 457059 - DNA, 25 bp, Rattus norvegicus
gggctccttccctcttaaggaatat

SEQ ID NO: 457060 - DNA, 25 bp, Rattus norvegicus
gggctccttgagagcagtctgatgc

SEQ ID NO: 457061 - DNA, 25 bp, Rattus norvegicus
gggctccttgagtgcagtctgatgc

SEQ ID NO: 457062 - DNA, 25 bp, Rattus norvegicus
gggctcgaaacaccgcctaaagtaa

SEQ ID NO: 457063 - DNA, 25 bp, Rattus norvegicus
gggctcgaaacagcgcctaaagtaa

SEQ ID NO: 457064 - DNA, 25 bp, Rattus norvegicus
gggctcgaattgctggttcatgcct

SEQ ID NO: 457065 - DNA, 25 bp, Rattus norvegicus
gggctcgaattggtggttcatgcct

SEQ ID NO: 457066 - DNA, 25 bp, Rattus norvegicus
gggctcgactcacagaagacaaact

SEQ ID NO: 457067 - DNA, 25 bp, Rattus norvegicus
gggctcgactcagagaagacaaact

SEQ ID NO: 457068 - DNA, 25 bp, Rattus norvegicus
gggctcgacttaccgccgactacag

SEQ ID NO: 457069 - DNA, 25 bp, Rattus norvegicus
gggctcgacttagcgccgactacag

SEQ ID NO: 457070 - DNA, 25 bp, Rattus norvegicus
gggctcgcaagcattggtgaacaca

SEQ ID NO: 457071 - DNA, 25 bp, Rattus norvegicus
gggctcgcaagctttggtgaacaca

SEQ ID NO: 457072 - DNA, 25 bp, Rattus norvegicus
gggctcgcataccctctccttggaa

SEQ ID NO: 457073 - DNA, 25 bp, Rattus norvegicus
gggctcgcatacgctctccttggaa

SEQ ID NO: 457074 - DNA, 25 bp, Rattus norvegicus
gggctcgccaggacatcaggaatca

SEQ ID NO: 457075 - DNA, 25 bp, Rattus norvegicus
gggctcgccaggtcatcaggaatca

SEQ ID NO: 457076 - DNA, 25 bp, Rattus norvegicus
gggctcgcccagacatagggtcgaa

SEQ ID NO: 457077 - DNA, 25 bp, Rattus norvegicus
gggctcgcccagtcatagggtcgaa

SEQ ID NO: 457078 - DNA, 25 bp, Rattus norvegicus
gggctcgctatcagctcggagcaaa

SEQ ID NO: 457079 - DNA, 25 bp, Rattus norvegicus
gggctcgctatctgctcggagcaaa

SEQ ID NO: 457080 - DNA, 25 bp, Rattus norvegicus
gggctcgctcccatttttcttgaaa

SEQ ID NO: 457081 - DNA, 25 bp, Rattus norvegicus
gggctcgctcccttttttcttgaaa

SEQ ID NO: 457082 - DNA, 25 bp, Rattus norvegicus
gggctcggagcaaacaggttcccca

SEQ ID NO: 457083 - DNA, 25 bp, Rattus norvegicus
gggctcggagcatacaggttcccca

SEQ ID NO: 457084 - DNA, 25 bp, Rattus norvegicus
gggctcggagtacgagcccacacaa

SEQ ID NO: 457085 - DNA, 25 bp, Rattus norvegicus
gggctcggagtaggagcccacacaa

SEQ ID NO: 457086 - DNA, 25 bp, Rattus norvegicus
gggctcggccgcaccttgagcttga

SEQ ID NO: 457087 - DNA, 25 bp, Rattus norvegicus
gggctcggccgctccttgagcttga

SEQ ID NO: 457088 - DNA, 25 bp, Rattus norvegicus
gggctcggcctccatagcaacagcg

SEQ ID NO: 457089 - DNA, 25 bp, Rattus norvegicus
gggctcggcctcgatagcaacagcg

SEQ ID NO: 457090 - DNA, 25 bp, Rattus norvegicus
gggctcgggagaaatcagatgctca

SEQ ID NO: 457091 - DNA, 25 bp, Rattus norvegicus
gggctcgggagatatcagatgctca

SEQ ID NO: 457092 - DNA, 25 bp, Rattus norvegicus
gggctcgtatatatgtggaaggcaa

SEQ ID NO: 457093 - DNA, 25 bp, Rattus norvegicus
gggctcgtatatttgtggaaggcaa

SEQ ID NO: 457094 - DNA, 25 bp, Rattus norvegicus
gggctcgtggagcatcttcaataag

SEQ ID NO: 457095 - DNA, 25 bp, Rattus norvegicus
gggctcgtggaggatcttcaataag

SEQ ID NO: 457096 - DNA, 25 bp, Rattus norvegicus
gggctctaacccaagtggaatgcaa

SEQ ID NO: 457097 - DNA, 25 bp, Rattus norvegicus
gggctctaaccctagtggaatgcaa

SEQ ID NO: 457098 - DNA, 25 bp, Rattus norvegicus
gggctctaatcaatttgcctttatt

SEQ ID NO: 457099 - DNA, 25 bp, Rattus norvegicus
gggctctaatcattttgcctttatt

SEQ ID NO: 457100 - DNA, 25 bp, Rattus norvegicus
gggctctacgtcactatcgtgctgg

SEQ ID NO: 457101 - DNA, 25 bp, Rattus norvegicus
gggctctacgtctctatcgtgctgg

SEQ ID NO: 457102 - DNA, 25 bp, Rattus norvegicus
gggctctactacatgcagaaaacca

SEQ ID NO: 457103 - DNA, 25 bp, Rattus norvegicus
gggctctactacttgcagaaaacca

SEQ ID NO: 457104 - DNA, 25 bp, Rattus norvegicus
gggctctactcaaggtaaccttaag

SEQ ID NO: 457105 - DNA, 25 bp, Rattus norvegicus
gggctctactcatggtaaccttaag

SEQ ID NO: 457106 - DNA, 25 bp, Rattus norvegicus
gggctctactttcagtttcttcaca

SEQ ID NO: 457107 - DNA, 25 bp, Rattus norvegicus
gggctctactttgagtttcttcaca

SEQ ID NO: 457108 - DNA, 25 bp, Rattus norvegicus
gggctctagccaaattcatttttta

SEQ ID NO: 457109 - DNA, 25 bp, Rattus norvegicus
gggctctagccatattcatttttta

SEQ ID NO: 457110 - DNA, 25 bp, Rattus norvegicus
gggctctagttaaacttcactaagg

SEQ ID NO: 457111 - DNA, 25 bp, Rattus norvegicus
gggctctagttatacttcactaagg

SEQ ID NO: 457112 - DNA, 25 bp, Rattus norvegicus
gggctctatactctcaccttatgct

SEQ ID NO: 457113 - DNA, 25 bp, Rattus norvegicus
gggctctatactgtcaccttatgct

SEQ ID NO: 457114 - DNA, 25 bp, Rattus norvegicus
gggctctatatgctttgtgaacaag

SEQ ID NO: 457115 - DNA, 25 bp, Rattus norvegicus
gggctctatatggtttgtgaacaag

SEQ ID NO: 457116 - DNA, 25 bp, Rattus norvegicus
gggctctattctaaagaaatatcag

SEQ ID NO: 457117 - DNA, 25 bp, Rattus norvegicus
gggctctattcttaagaaatatcag

SEQ ID NO: 457118 - DNA, 25 bp, Rattus norvegicus
gggctctcagctatgctatggcgat

SEQ ID NO: 457119 - DNA, 25 bp, Rattus norvegicus
gggctctcagctttgctatggcgat

SEQ ID NO: 457120 - DNA, 25 bp, Rattus norvegicus
gggctctcatatcttcattgacaga

SEQ ID NO: 457121 - DNA, 25 bp, Rattus norvegicus
gggctctcatatgttcattgacaga

SEQ ID NO: 457122 - DNA, 25 bp, Rattus norvegicus
gggctctcatgtcggcaattctgga

SEQ ID NO: 457123 - DNA, 25 bp, Rattus norvegicus
gggctctcatgtgggcaattctgga

SEQ ID NO: 457124 - DNA, 25 bp, Rattus norvegicus
gggctctccaaccttgtgcatcagg

SEQ ID NO: 457125 - DNA, 25 bp, Rattus norvegicus
gggctctccaacgttgtgcatcagg

SEQ ID NO: 457126 - DNA, 25 bp, Rattus norvegicus
gggctctccagaatgcgatgtgtgc

SEQ ID NO: 457127 - DNA, 25 bp, Rattus norvegicus
gggctctccagattgcgatgtgtgc

SEQ ID NO: 457128 - DNA, 25 bp, Rattus norvegicus
gggctctcctgaatccgagtggtaa

SEQ ID NO: 457129 - DNA, 25 bp, Rattus norvegicus
gggctctcctgattccgagtggtaa

SEQ ID NO: 457130 - DNA, 25 bp, Rattus norvegicus
gggctctcctgccaacagcagagaa

SEQ ID NO: 457131 - DNA, 25 bp, Rattus norvegicus
gggctctcctgcgaacagcagagaa

SEQ ID NO: 457132 - DNA, 25 bp, Rattus norvegicus
gggctctctagactgttttacttat

SEQ ID NO: 457133 - DNA, 25 bp, Rattus norvegicus
gggctctctagagtgttttacttat

SEQ ID NO: 457134 - DNA, 25 bp, Rattus norvegicus
gggctctctagccagtctagccgta

SEQ ID NO: 457135 - DNA, 25 bp, Rattus norvegicus
gggctctctagcgagtctagccgta

SEQ ID NO: 457136 - DNA, 25 bp, Rattus norvegicus
gggctctctgcaatttttcacaaat

SEQ ID NO: 457137 - DNA, 25 bp, Rattus norvegicus
gggctctctgcattttttcacaaat

SEQ ID NO: 457138 - DNA, 25 bp, Rattus norvegicus
gggctctctgcgcagttcagttgta

SEQ ID NO: 457139 - DNA, 25 bp, Rattus norvegicus
gggctctctgcggagttcagttgta

SEQ ID NO: 457140 - DNA, 25 bp, Rattus norvegicus
gggctctctgctctacatatctgag

SEQ ID NO: 457141 - DNA, 25 bp, Rattus norvegicus
gggctctctgctgtacatatctgag

SEQ ID NO: 457142 - DNA, 25 bp, Rattus norvegicus
gggctctctgggagcctttctactg

SEQ ID NO: 457143 - DNA, 25 bp, Rattus norvegicus
gggctctctgggtgcctttctactg

SEQ ID NO: 457144 - DNA, 25 bp, Rattus norvegicus
gggctctctgtcacattgaaggaaa

SEQ ID NO: 457145 - DNA, 25 bp, Rattus norvegicus
gggctctctgtctcattgaaggaaa

SEQ ID NO: 457146 - DNA, 25 bp, Rattus norvegicus
gggctctcttgaagccatggacaaa

SEQ ID NO: 457147 - DNA, 25 bp, Rattus norvegicus
gggctctcttgatgccatggacaaa

SEQ ID NO: 457148 - DNA, 25 bp, Rattus norvegicus
gggctctgaaatattctggtcatcg

SEQ ID NO: 457149 - DNA, 25 bp, Rattus norvegicus
gggctctgaaattttctggtcatcg

SEQ ID NO: 457150 - DNA, 25 bp, Rattus norvegicus
gggctctgacccagtatgatgtaat

SEQ ID NO: 457151 - DNA, 25 bp, Rattus norvegicus
gggctctgacccagtggttgaacat

SEQ ID NO: 457152 - DNA, 25 bp, Rattus norvegicus
gggctctgaccctgtatgatgtaat

SEQ ID NO: 457153 - DNA, 25 bp, Rattus norvegicus
gggctctgaccctgtggttgaacat

SEQ ID NO: 457154 - DNA, 25 bp, Rattus norvegicus
gggctctgactacagctacgacagc

SEQ ID NO: 457155 - DNA, 25 bp, Rattus norvegicus
gggctctgactagagctacgacagc

SEQ ID NO: 457156 - DNA, 25 bp, Rattus norvegicus
gggctctgactcaacacaatggaga

SEQ ID NO: 457157 - DNA, 25 bp, Rattus norvegicus
gggctctgactctacacaatggaga

SEQ ID NO: 457158 - DNA, 25 bp, Rattus norvegicus
gggctctgactgcaatttatattca

SEQ ID NO: 457159 - DNA, 25 bp, Rattus norvegicus
gggctctgactggaatttatattca

SEQ ID NO: 457160 - DNA, 25 bp, Rattus norvegicus
gggctctgacttcggcgcgttacaa

SEQ ID NO: 457161 - DNA, 25 bp, Rattus norvegicus
gggctctgacttgggcgcgttacaa

SEQ ID NO: 457162 - DNA, 25 bp, Rattus norvegicus
gggctctgagctccttataattaaa

SEQ ID NO: 457163 - DNA, 25 bp, Rattus norvegicus
gggctctgagctgcttataattaaa

SEQ ID NO: 457164 - DNA, 25 bp, Rattus norvegicus
gggctctgaggaagccagtaccatg

SEQ ID NO: 457165 - DNA, 25 bp, Rattus norvegicus
gggctctgaggatgccagtaccatg

SEQ ID NO: 457166 - DNA, 25 bp, Rattus norvegicus
gggctctgagttcttttcgtaccaa

SEQ ID NO: 457167 - DNA, 25 bp, Rattus norvegicus
gggctctgagttgttttcgtaccaa

SEQ ID NO: 457168 - DNA, 25 bp, Rattus norvegicus
gggctctgatctagtatcttggttt

SEQ ID NO: 457169 - DNA, 25 bp, Rattus norvegicus
gggctctgatcttgtatcttggttt

SEQ ID NO: 457170 - DNA, 25 bp, Rattus norvegicus
gggctctgatgtagcactttacgtt

SEQ ID NO: 457171 - DNA, 25 bp, Rattus norvegicus
gggctctgatgttgcactttacgtt

SEQ ID NO: 457172 - DNA, 25 bp, Rattus norvegicus
gggctctgattcatacaaaggtcct

SEQ ID NO: 457173 - DNA, 25 bp, Rattus norvegicus
gggctctgattcttacaaaggtcct

SEQ ID NO: 457174 - DNA, 25 bp, Rattus norvegicus
gggctctgcactcggcagatcaaga

SEQ ID NO: 457175 - DNA, 25 bp, Rattus norvegicus
gggctctgcactgggcagatcaaga

SEQ ID NO: 457176 - DNA, 25 bp, Rattus norvegicus
gggctctgcagtcggattcattgct

SEQ ID NO: 457177 - DNA, 25 bp, Rattus norvegicus
gggctctgcagtgggattcattgct

SEQ ID NO: 457178 - DNA, 25 bp, Rattus norvegicus
gggctctgcatgaattctgcctgta

SEQ ID NO: 457179 - DNA, 25 bp, Rattus norvegicus
gggctctgcatgtattctgcctgta

SEQ ID NO: 457180 - DNA, 25 bp, Rattus norvegicus
gggctctgccatcttataatttgaa

SEQ ID NO: 457181 - DNA, 25 bp, Rattus norvegicus
gggctctgccatgttataatttgaa

SEQ ID NO: 457182 - DNA, 25 bp, Rattus norvegicus
gggctctgcccacaggtttctacct

SEQ ID NO: 457183 - DNA, 25 bp, Rattus norvegicus
gggctctgcccagaggtttctacct

SEQ ID NO: 457184 - DNA, 25 bp, Rattus norvegicus
gggctctgccctcggatagggtatg

SEQ ID NO: 457185 - DNA, 25 bp, Rattus norvegicus
gggctctgccctgggatagggtatg

SEQ ID NO: 457186 - DNA, 25 bp, Rattus norvegicus
gggctctgcctgcttacaggctctg

SEQ ID NO: 457187 - DNA, 25 bp, Rattus norvegicus
gggctctgcctggttacaggctctg

SEQ ID NO: 457188 - DNA, 25 bp, Rattus norvegicus
gggctctgctcaagaatggcttcta

SEQ ID NO: 457189 - DNA, 25 bp, Rattus norvegicus
gggctctgctcatgaatggcttcta

SEQ ID NO: 457190 - DNA, 25 bp, Rattus norvegicus
gggctctgctggctgcacaatgaac

SEQ ID NO: 457191 - DNA, 25 bp, Rattus norvegicus
gggctctgctgggtgcacaatgaac

SEQ ID NO: 457192 - DNA, 25 bp, Rattus norvegicus
gggctctgctgtataccccgggaag

SEQ ID NO: 457193 - DNA, 25 bp, Rattus norvegicus
gggctctgctgtttaccccgggaag

SEQ ID NO: 457194 - DNA, 25 bp, Rattus norvegicus
gggctctggatgcttttcacatcga

SEQ ID NO: 457195 - DNA, 25 bp, Rattus norvegicus
gggctctggatggttttcacatcga

SEQ ID NO: 457196 - DNA, 25 bp, Rattus norvegicus
gggctctggctaatttacctgactg

SEQ ID NO: 457197 - DNA, 25 bp, Rattus norvegicus
gggctctggctattttacctgactg

SEQ ID NO: 457198 - DNA, 25 bp, Rattus norvegicus
gggctctgtgtcagactgtgtgaca

SEQ ID NO: 457199 - DNA, 25 bp, Rattus norvegicus
gggctctgtgtctgactgtgtgaca

SEQ ID NO: 457200 - DNA, 25 bp, Rattus norvegicus
gggctctgtgttagacccactgtaa

SEQ ID NO: 457201 - DNA, 25 bp, Rattus norvegicus
gggctctgtgtttgacccactgtaa

SEQ ID NO: 457202 - DNA, 25 bp, Rattus norvegicus
gggctctgttacaaattcctcatgt

SEQ ID NO: 457203 - DNA, 25 bp, Rattus norvegicus
gggctctgttactaattcctcatgt

SEQ ID NO: 457204 - DNA, 25 bp, Rattus norvegicus
gggctcttatgcaaggttttgcaat

SEQ ID NO: 457205 - DNA, 25 bp, Rattus norvegicus
gggctcttatgctaggttttgcaat

SEQ ID NO: 457206 - DNA, 25 bp, Rattus norvegicus
gggctcttcactcctgtgggataaa

SEQ ID NO: 457207 - DNA, 25 bp, Rattus norvegicus
gggctcttcactgctgtgggataaa

SEQ ID NO: 457208 - DNA, 25 bp, Rattus norvegicus
gggctcttccctcagttggaagcaa

SEQ ID NO: 457209 - DNA, 25 bp, Rattus norvegicus
gggctcttccctgagttggaagcaa

SEQ ID NO: 457210 - DNA, 25 bp, Rattus norvegicus
gggctcttgattcagaccgagtttt

SEQ ID NO: 457211 - DNA, 25 bp, Rattus norvegicus
gggctcttgattgagaccgagtttt

SEQ ID NO: 457212 - DNA, 25 bp, Rattus norvegicus
gggctcttggcaatggtatgatgac

SEQ ID NO: 457213 - DNA, 25 bp, Rattus norvegicus
gggctcttggcattggtatgatgac

SEQ ID NO: 457214 - DNA, 25 bp, Rattus norvegicus
gggctcttgggtattatgtctctag

SEQ ID NO: 457215 - DNA, 25 bp, Rattus norvegicus
gggctcttgggttttatgtctctag

SEQ ID NO: 457216 - DNA, 25 bp, Rattus norvegicus
gggctcttgtgcattgattttttgt

SEQ ID NO: 457217 - DNA, 25 bp, Rattus norvegicus
gggctcttgtgctttgattttttgt

SEQ ID NO: 457218 - DNA, 25 bp, Rattus norvegicus
gggctctttaccaaataataatcat

SEQ ID NO: 457219 - DNA, 25 bp, Rattus norvegicus
gggctctttacctaataataatcat

SEQ ID NO: 457220 - DNA, 25 bp, Rattus norvegicus
gggctctttctaaggcccaacgata

SEQ ID NO: 457221 - DNA, 25 bp, Rattus norvegicus
gggctctttctatggcccaacgata

SEQ ID NO: 457222 - DNA, 25 bp, Rattus norvegicus
gggctctttgaccaatcctgagggt

SEQ ID NO: 457223 - DNA, 25 bp, Rattus norvegicus
gggctctttgacgaatcctgagggt

SEQ ID NO: 457224 - DNA, 25 bp, Rattus norvegicus
gggctcttttccactgtgagatcaa

SEQ ID NO: 457225 - DNA, 25 bp, Rattus norvegicus
gggctcttttcctctgtgagatcaa

SEQ ID NO: 457226 - DNA, 25 bp, Rattus norvegicus
gggctgaaaccaactacatcccaga

SEQ ID NO: 457227 - DNA, 25 bp, Rattus norvegicus
gggctgaaaccatctacatcccaga

SEQ ID NO: 457228 - DNA, 25 bp, Rattus norvegicus
gggctgaaagcacaggtggcatatg

SEQ ID NO: 457229 - DNA, 25 bp, Rattus norvegicus
gggctgaaagcagaggtggcatatg

SEQ ID NO: 457230 - DNA, 25 bp, Rattus norvegicus
gggctgaagcatctcactgaagact

SEQ ID NO: 457231 - DNA, 25 bp, Rattus norvegicus
gggctgaagcatgtcactgaagact

SEQ ID NO: 457232 - DNA, 25 bp, Rattus norvegicus
gggctgaaggatcactgttctgttt

SEQ ID NO: 457233 - DNA, 25 bp, Rattus norvegicus
gggctgaaggatgactgttctgttt

SEQ ID NO: 457234 - DNA, 25 bp, Rattus norvegicus
gggctgaagtataacttgccaaaat

SEQ ID NO: 457235 - DNA, 25 bp, Rattus norvegicus
gggctgaagtattacttgccaaaat

SEQ ID NO: 457236 - DNA, 25 bp, Rattus norvegicus
gggctgaatcccattttagaagtca

SEQ ID NO: 457237 - DNA, 25 bp, Rattus norvegicus
gggctgaatccctttttagaagtca

SEQ ID NO: 457238 - DNA, 25 bp, Rattus norvegicus
gggctgaatctcacatggctttttt

SEQ ID NO: 457239 - DNA, 25 bp, Rattus norvegicus
gggctgaatctcatttttccttgta

SEQ ID NO: 457240 - DNA, 25 bp, Rattus norvegicus
gggctgaatctctcatggctttttt

SEQ ID NO: 457241 - DNA, 25 bp, Rattus norvegicus
gggctgaatctcttttttccttgta

SEQ ID NO: 457242 - DNA, 25 bp, Rattus norvegicus
gggctgaatcttatgctagccaact

SEQ ID NO: 457243 - DNA, 25 bp, Rattus norvegicus
gggctgaatcttttgctagccaact

SEQ ID NO: 457244 - DNA, 25 bp, Rattus norvegicus
gggctgaatggcacttacgccgagt

SEQ ID NO: 457245 - DNA, 25 bp, Rattus norvegicus
gggctgaatggctcttacgccgagt

SEQ ID NO: 457246 - DNA, 25 bp, Rattus norvegicus
gggctgaattgtcgcccttcagaat

SEQ ID NO: 457247 - DNA, 25 bp, Rattus norvegicus
gggctgaattgtggcccttcagaat

SEQ ID NO: 457248 - DNA, 25 bp, Rattus norvegicus
gggctgacaaaccatgtcgagctat

SEQ ID NO: 457249 - DNA, 25 bp, Rattus norvegicus
gggctgacaaacgatgtcgagctat

SEQ ID NO: 457250 - DNA, 25 bp, Rattus norvegicus
gggctgacacagcactgaacaccat

SEQ ID NO: 457251 - DNA, 25 bp, Rattus norvegicus
gggctgacacaggactgaacaccat

SEQ ID NO: 457252 - DNA, 25 bp, Rattus norvegicus
gggctgacacttctgaggcattaaa

SEQ ID NO: 457253 - DNA, 25 bp, Rattus norvegicus
gggctgacacttgtgaggcattaaa

SEQ ID NO: 457254 - DNA, 25 bp, Rattus norvegicus
gggctgacaggaacactcatcatca

SEQ ID NO: 457255 - DNA, 25 bp, Rattus norvegicus
gggctgacaggatcactcatcatca

SEQ ID NO: 457256 - DNA, 25 bp, Rattus norvegicus
gggctgacaggcaccagacaggtat

SEQ ID NO: 457257 - DNA, 25 bp, Rattus norvegicus
gggctgacaggctccagacaggtat

SEQ ID NO: 457258 - DNA, 25 bp, Rattus norvegicus
gggctgacatcaaggcaatctgcac

SEQ ID NO: 457259 - DNA, 25 bp, Rattus norvegicus
gggctgacatcatggcaatctgcac

SEQ ID NO: 457260 - DNA, 25 bp, Rattus norvegicus
gggctgacatgactgactaacctct

SEQ ID NO: 457261 - DNA, 25 bp, Rattus norvegicus
gggctgacatgagtgactaacctct

SEQ ID NO: 457262 - DNA, 25 bp, Rattus norvegicus
gggctgaccacaaaaactgcatttt

SEQ ID NO: 457263 - DNA, 25 bp, Rattus norvegicus
gggctgaccacataaactgcatttt

SEQ ID NO: 457264 - DNA, 25 bp, Rattus norvegicus
gggctgacctagaccagtttgcatg

SEQ ID NO: 457265 - DNA, 25 bp, Rattus norvegicus
gggctgacctagtccagtttgcatg

SEQ ID NO: 457266 - DNA, 25 bp, Rattus norvegicus
gggctgacctatcgaatcatcaccg

SEQ ID NO: 457267 - DNA, 25 bp, Rattus norvegicus
gggctgacctatggaatcatcaccg

SEQ ID NO: 457268 - DNA, 25 bp, Rattus norvegicus
gggctgactataacctgagtgggct

SEQ ID NO: 457269 - DNA, 25 bp, Rattus norvegicus
gggctgactatatcctgagtgggct

SEQ ID NO: 457270 - DNA, 25 bp, Rattus norvegicus
gggctgactgatcgtcttgctttcc

SEQ ID NO: 457271 - DNA, 25 bp, Rattus norvegicus
gggctgactgatggtcttgctttcc

SEQ ID NO: 457272 - DNA, 25 bp, Rattus norvegicus
gggctgactgctagagcgtccccag

SEQ ID NO: 457273 - DNA, 25 bp, Rattus norvegicus
gggctgactgcttgagcgtccccag

SEQ ID NO: 457274 - DNA, 25 bp, Rattus norvegicus
gggctgacttctcaaaatccaccaa

SEQ ID NO: 457275 - DNA, 25 bp, Rattus norvegicus
gggctgacttctgaaaatccaccaa

SEQ ID NO: 457276 - DNA, 25 bp, Rattus norvegicus
gggctgagaaaactccttgcatcaa

SEQ ID NO: 457277 - DNA, 25 bp, Rattus norvegicus
gggctgagaaaagtccttgcatcaa

SEQ ID NO: 457278 - DNA, 25 bp, Rattus norvegicus
gggctgagaaatactacccctgtat

SEQ ID NO: 457279 - DNA, 25 bp, Rattus norvegicus
gggctgagaaattctacccctgtat

SEQ ID NO: 457280 - DNA, 25 bp, Rattus norvegicus
gggctgagacctcaagtccttacta

SEQ ID NO: 457281 - DNA, 25 bp, Rattus norvegicus
gggctgagacctccctggaagaaat

SEQ ID NO: 457282 - DNA, 25 bp, Rattus norvegicus
gggctgagacctgaagtccttacta

SEQ ID NO: 457283 - DNA, 25 bp, Rattus norvegicus
gggctgagacctgcctggaagaaat

SEQ ID NO: 457284 - DNA, 25 bp, Rattus norvegicus
gggctgagagcgagtacttcaaccc

SEQ ID NO: 457285 - DNA, 25 bp, Rattus norvegicus
gggctgagagcgtgtacttcaaccc

SEQ ID NO: 457286 - DNA, 25 bp, Rattus norvegicus
gggctgagatttcttacccaaagca

SEQ ID NO: 457287 - DNA, 25 bp, Rattus norvegicus
gggctgagatttgttacccaaagca

SEQ ID NO: 457288 - DNA, 25 bp, Rattus norvegicus
gggctgagcactactgggaccttgc

SEQ ID NO: 457289 - DNA, 25 bp, Rattus norvegicus
gggctgagcacttctgggaccttgc

SEQ ID NO: 457290 - DNA, 25 bp, Rattus norvegicus
gggctgagcagcactggcattgaaa

SEQ ID NO: 457291 - DNA, 25 bp, Rattus norvegicus
gggctgagcagctctggcattgaaa

SEQ ID NO: 457292 - DNA, 25 bp, Rattus norvegicus
gggctgagcccaccatactcaaagg

SEQ ID NO: 457293 - DNA, 25 bp, Rattus norvegicus
gggctgagcccagcatactcaaagg

SEQ ID NO: 457294 - DNA, 25 bp, Rattus norvegicus
gggctgagcgacaagttctgactaa

SEQ ID NO: 457295 - DNA, 25 bp, Rattus norvegicus
gggctgagcgacagaatgtacttac

SEQ ID NO: 457296 - DNA, 25 bp, Rattus norvegicus
gggctgagcgactagttctgactaa

SEQ ID NO: 457297 - DNA, 25 bp, Rattus norvegicus
gggctgagcgactgaatgtacttac

SEQ ID NO: 457298 - DNA, 25 bp, Rattus norvegicus
gggctgaggaaccacttatttattt

SEQ ID NO: 457299 - DNA, 25 bp, Rattus norvegicus
gggctgaggaacgacttatttattt

SEQ ID NO: 457300 - DNA, 25 bp, Rattus norvegicus
gggctgaggcccagatgatgcactt

SEQ ID NO: 457301 - DNA, 25 bp, Rattus norvegicus
gggctgaggccctgatgatgcactt

SEQ ID NO: 457302 - DNA, 25 bp, Rattus norvegicus
gggctgaggcggcagcgccgtcact

SEQ ID NO: 457303 - DNA, 25 bp, Rattus norvegicus
gggctgaggcgggagcgccgtcact

SEQ ID NO: 457304 - DNA, 25 bp, Rattus norvegicus
gggctgagggcacccggaccagcgc

SEQ ID NO: 457305 - DNA, 25 bp, Rattus norvegicus
gggctgagggcagccggaccagcgc

SEQ ID NO: 457306 - DNA, 25 bp, Rattus norvegicus
gggctgagtcctcaataaacactgc

SEQ ID NO: 457307 - DNA, 25 bp, Rattus norvegicus
gggctgagtcctgaataaacactgc

SEQ ID NO: 457308 - DNA, 25 bp, Rattus norvegicus
gggctgagtgacaactggactttat

SEQ ID NO: 457309 - DNA, 25 bp, Rattus norvegicus
gggctgagtgactactggactttat

SEQ ID NO: 457310 - DNA, 25 bp, Rattus norvegicus
gggctgagttctcacactcctgaga

SEQ ID NO: 457311 - DNA, 25 bp, Rattus norvegicus
gggctgagttctgacactcctgaga

SEQ ID NO: 457312 - DNA, 25 bp, Rattus norvegicus
gggctgatagctataatacaacact

SEQ ID NO: 457313 - DNA, 25 bp, Rattus norvegicus
gggctgatagctttaatacaacact

SEQ ID NO: 457314 - DNA, 25 bp, Rattus norvegicus
gggctgatcgcaatctttgtgtcca

SEQ ID NO: 457315 - DNA, 25 bp, Rattus norvegicus
gggctgatcgcattctttgtgtcca

SEQ ID NO: 457316 - DNA, 25 bp, Rattus norvegicus
gggctgatgacaatttctggtcatt

SEQ ID NO: 457317 - DNA, 25 bp, Rattus norvegicus
gggctgatgacacacctggtcttgt

SEQ ID NO: 457318 - DNA, 25 bp, Rattus norvegicus
gggctgatgacagacctggtcttgt

SEQ ID NO: 457319 - DNA, 25 bp, Rattus norvegicus
gggctgatgacattttctggtcatt

SEQ ID NO: 457320 - DNA, 25 bp, Rattus norvegicus
gggctgatgcaaacatcccatacac

SEQ ID NO: 457321 - DNA, 25 bp, Rattus norvegicus
gggctgatgcaatcatcccatacac

SEQ ID NO: 457322 - DNA, 25 bp, Rattus norvegicus
gggctgatgctaatgtcctgatccc

SEQ ID NO: 457323 - DNA, 25 bp, Rattus norvegicus
gggctgatgctattgtcctgatccc

SEQ ID NO: 457324 - DNA, 25 bp, Rattus norvegicus
gggctgatgctcatgccaaagtatt

SEQ ID NO: 457325 - DNA, 25 bp, Rattus norvegicus
gggctgatgctcttgccaaagtatt

SEQ ID NO: 457326 - DNA, 25 bp, Rattus norvegicus
gggctgatgctgcaccaactgtatc

SEQ ID NO: 457327 - DNA, 25 bp, Rattus norvegicus
gggctgatgctggaccaactgtatc

SEQ ID NO: 457328 - DNA, 25 bp, Rattus norvegicus
gggctgatggtgaaacccgttcaga

SEQ ID NO: 457329 - DNA, 25 bp, Rattus norvegicus
gggctgatggtgtaacccgttcaga

SEQ ID NO: 457330 - DNA, 25 bp, Rattus norvegicus
gggctgatggttatggcatgtcaat

SEQ ID NO: 457331 - DNA, 25 bp, Rattus norvegicus
gggctgatggttttggcatgtcaat

SEQ ID NO: 457332 - DNA, 25 bp, Rattus norvegicus
gggctgatgtccatgcccttggctt

SEQ ID NO: 457333 - DNA, 25 bp, Rattus norvegicus
gggctgatgtccttgcccttggctt

SEQ ID NO: 457334 - DNA, 25 bp, Rattus norvegicus
gggctgatgtggcaccttgaaaata

SEQ ID NO: 457335 - DNA, 25 bp, Rattus norvegicus
gggctgatgtgggaccttgaaaata

SEQ ID NO: 457336 - DNA, 25 bp, Rattus norvegicus
gggctgattattattctacaaagta

SEQ ID NO: 457337 - DNA, 25 bp, Rattus norvegicus
gggctgattatttttctacaaagta

SEQ ID NO: 457338 - DNA, 25 bp, Rattus norvegicus
gggctgatttacagactgatgttaa

SEQ ID NO: 457339 - DNA, 25 bp, Rattus norvegicus
gggctgatttactgactgatgttaa

SEQ ID NO: 457340 - DNA, 25 bp, Rattus norvegicus
gggctgcaaacaatccatcactcct

SEQ ID NO: 457341 - DNA, 25 bp, Rattus norvegicus
gggctgcaaacattccatcactcct

SEQ ID NO: 457342 - DNA, 25 bp, Rattus norvegicus
gggctgcaacagagactgtcttttt

SEQ ID NO: 457343 - DNA, 25 bp, Rattus norvegicus
gggctgcaacagtgactgtcttttt

SEQ ID NO: 457344 - DNA, 25 bp, Rattus norvegicus
gggctgcaacttcacaggccagtgt

SEQ ID NO: 457345 - DNA, 25 bp, Rattus norvegicus
gggctgcaacttgacaggccagtgt

SEQ ID NO: 457346 - DNA, 25 bp, Rattus norvegicus
gggctgcaatcaatacctgctgagg

SEQ ID NO: 457347 - DNA, 25 bp, Rattus norvegicus
gggctgcaatcattacctgctgagg

SEQ ID NO: 457348 - DNA, 25 bp, Rattus norvegicus
gggctgcaattccaagtagatcacc

SEQ ID NO: 457349 - DNA, 25 bp, Rattus norvegicus
gggctgcaattcgaagtagatcacc

SEQ ID NO: 457350 - DNA, 25 bp, Rattus norvegicus
gggctgcaatttacagcagtctcct

SEQ ID NO: 457351 - DNA, 25 bp, Rattus norvegicus
gggctgcaattttcagcagtctcct

SEQ ID NO: 457352 - DNA, 25 bp, Rattus norvegicus
gggctgcacaagaaccaggacactt

SEQ ID NO: 457353 - DNA, 25 bp, Rattus norvegicus
gggctgcacaagtaccaggacactt

SEQ ID NO: 457354 - DNA, 25 bp, Rattus norvegicus
gggctgcacagaacatggcatgtgt

SEQ ID NO: 457355 - DNA, 25 bp, Rattus norvegicus
gggctgcacagatcatggcatgtgt

SEQ ID NO: 457356 - DNA, 25 bp, Rattus norvegicus
gggctgcacagtaagactctgtttc

SEQ ID NO: 457357 - DNA, 25 bp, Rattus norvegicus
gggctgcacagttagactctgtttc

SEQ ID NO: 457358 - DNA, 25 bp, Rattus norvegicus
gggctgcacatcaggcattaccagc

SEQ ID NO: 457359 - DNA, 25 bp, Rattus norvegicus
gggctgcacatctggcattaccagc

SEQ ID NO: 457360 - DNA, 25 bp, Rattus norvegicus
gggctgcactgtcaatacagggcct

SEQ ID NO: 457361 - DNA, 25 bp, Rattus norvegicus
gggctgcactgtgaatacagggcct

SEQ ID NO: 457362 - DNA, 25 bp, Rattus norvegicus
gggctgcacttcacggagcccgaga

SEQ ID NO: 457363 - DNA, 25 bp, Rattus norvegicus
gggctgcacttctcggagcccgaga

SEQ ID NO: 457364 - DNA, 25 bp, Rattus norvegicus
gggctgcagaaccaaagtgtctctc

SEQ ID NO: 457365 - DNA, 25 bp, Rattus norvegicus
gggctgcagaacgaaagtgtctctc

SEQ ID NO: 457366 - DNA, 25 bp, Rattus norvegicus
gggctgcagttaccacatgtgtttt

SEQ ID NO: 457367 - DNA, 25 bp, Rattus norvegicus
gggctgcagttagcacatgtgtttt

SEQ ID NO: 457368 - DNA, 25 bp, Rattus norvegicus
gggctgcatactctcagttcatgga

SEQ ID NO: 457369 - DNA, 25 bp, Rattus norvegicus
gggctgcatactgtcagttcatgga

SEQ ID NO: 457370 - DNA, 25 bp, Rattus norvegicus
gggctgcatatccatagcttagatg

SEQ ID NO: 457371 - DNA, 25 bp, Rattus norvegicus
gggctgcatatcgatagcttagatg

SEQ ID NO: 457372 - DNA, 25 bp, Rattus norvegicus
gggctgcatgttcttatttaatctc

SEQ ID NO: 457373 - DNA, 25 bp, Rattus norvegicus
gggctgcatgttgttatttaatctc

SEQ ID NO: 457374 - DNA, 25 bp, Rattus norvegicus
gggctgcatttgaccctaaactctt

SEQ ID NO: 457375 - DNA, 25 bp, Rattus norvegicus
gggctgcatttgtccctaaactctt

SEQ ID NO: 457376 - DNA, 25 bp, Rattus norvegicus
gggctgccaccaagaaaagattgtc

SEQ ID NO: 457377 - DNA, 25 bp, Rattus norvegicus
gggctgccaccatgaaaagattgtc

SEQ ID NO: 457378 - DNA, 25 bp, Rattus norvegicus
gggctgccactgattgcagagtaca

SEQ ID NO: 457379 - DNA, 25 bp, Rattus norvegicus
gggctgccactgtttgcagagtaca

SEQ ID NO: 457380 - DNA, 25 bp, Rattus norvegicus
gggctgccaggcagatatcgtgtcc

SEQ ID NO: 457381 - DNA, 25 bp, Rattus norvegicus
gggctgccaggctgatatcgtgtcc

SEQ ID NO: 457382 - DNA, 25 bp, Rattus norvegicus
gggctgccatacaccatggacgcgt

SEQ ID NO: 457383 - DNA, 25 bp, Rattus norvegicus
gggctgccatactccatggacgcgt

SEQ ID NO: 457384 - DNA, 25 bp, Rattus norvegicus
gggctgccattcatacatccatgtg

SEQ ID NO: 457385 - DNA, 25 bp, Rattus norvegicus
gggctgccattcttacatccatgtg

SEQ ID NO: 457386 - DNA, 25 bp, Rattus norvegicus
gggctgcccaacagtgatgatgtat

SEQ ID NO: 457387 - DNA, 25 bp, Rattus norvegicus
gggctgcccaactgtgatgatgtat

SEQ ID NO: 457388 - DNA, 25 bp, Rattus norvegicus
gggctgcccagaacatctctaaaac

SEQ ID NO: 457389 - DNA, 25 bp, Rattus norvegicus
gggctgcccagatcatctctaaaac

SEQ ID NO: 457390 - DNA, 25 bp, Rattus norvegicus
gggctgcccctacttcacggttgct

SEQ ID NO: 457391 - DNA, 25 bp, Rattus norvegicus
gggctgcccctagttcacggttgct

SEQ ID NO: 457392 - DNA, 25 bp, Rattus norvegicus
gggctgcccttaaagagaccttgag

SEQ ID NO: 457393 - DNA, 25 bp, Rattus norvegicus
gggctgcccttatagagaccttgag

SEQ ID NO: 457394 - DNA, 25 bp, Rattus norvegicus
gggctgccctttctatgtcaacaat

SEQ ID NO: 457395 - DNA, 25 bp, Rattus norvegicus
gggctgccctttgtatgtcaacaat

SEQ ID NO: 457396 - DNA, 25 bp, Rattus norvegicus
gggctgcctgaactgacctgctagt

SEQ ID NO: 457397 - DNA, 25 bp, Rattus norvegicus
gggctgcctgaagtgacctgctagt

SEQ ID NO: 457398 - DNA, 25 bp, Rattus norvegicus
gggctgcctgccataagaactaact

SEQ ID NO: 457399 - DNA, 25 bp, Rattus norvegicus
gggctgcctgccttaagaactaact

SEQ ID NO: 457400 - DNA, 25 bp, Rattus norvegicus
gggctgcctggaaagcagtcaacct

SEQ ID NO: 457401 - DNA, 25 bp, Rattus norvegicus
gggctgcctggatagcagtcaacct

SEQ ID NO: 457402 - DNA, 25 bp, Rattus norvegicus
gggctgcctgttactctaagggatt

SEQ ID NO: 457403 - DNA, 25 bp, Rattus norvegicus
gggctgcctgtttctctaagggatt

SEQ ID NO: 457404 - DNA, 25 bp, Rattus norvegicus
gggctgccttatccatgtagaatcc

SEQ ID NO: 457405 - DNA, 25 bp, Rattus norvegicus
gggctgccttatgcatgtagaatcc

SEQ ID NO: 457406 - DNA, 25 bp, Rattus norvegicus
gggctgcgagccagaatgcccaagc

SEQ ID NO: 457407 - DNA, 25 bp, Rattus norvegicus
gggctgcgagcctgaatgcccaagc

SEQ ID NO: 457408 - DNA, 25 bp, Rattus norvegicus
gggctgcgcctacgttatttattag

SEQ ID NO: 457409 - DNA, 25 bp, Rattus norvegicus
gggctgcgcctaggttatttattag

SEQ ID NO: 457410 - DNA, 25 bp, Rattus norvegicus
gggctgcggccgagacttcaagcta

SEQ ID NO: 457411 - DNA, 25 bp, Rattus norvegicus
gggctgcggccgtgacttcaagcta

SEQ ID NO: 457412 - DNA, 25 bp, Rattus norvegicus
gggctgcgggtcattgacaaagaaa

SEQ ID NO: 457413 - DNA, 25 bp, Rattus norvegicus
gggctgcgggtctttgacaaagaaa

SEQ ID NO: 457414 - DNA, 25 bp, Rattus norvegicus
gggctgcgtaccaatcattattagg

SEQ ID NO: 457415 - DNA, 25 bp, Rattus norvegicus
gggctgcgtacctatcattattagg

SEQ ID NO: 457416 - DNA, 25 bp, Rattus norvegicus
gggctgctacagcttctgttatgga

SEQ ID NO: 457417 - DNA, 25 bp, Rattus norvegicus
gggctgctacaggttctgttatgga

SEQ ID NO: 457418 - DNA, 25 bp, Rattus norvegicus
gggctgctatggacaaatgtgctgc

SEQ ID NO: 457419 - DNA, 25 bp, Rattus norvegicus
gggctgctatggtcaaatgtgctgc

SEQ ID NO: 457420 - DNA, 25 bp, Rattus norvegicus
gggctgctcaacaggtagtttgcaa

SEQ ID NO: 457421 - DNA, 25 bp, Rattus norvegicus
gggctgctcaactggtagtttgcaa

SEQ ID NO: 457422 - DNA, 25 bp, Rattus norvegicus
gggctgctcagaaaagcgctgctct

SEQ ID NO: 457423 - DNA, 25 bp, Rattus norvegicus
gggctgctcagataagcgctgctct

SEQ ID NO: 457424 - DNA, 25 bp, Rattus norvegicus
gggctgctcatacacgctttaactt

SEQ ID NO: 457425 - DNA, 25 bp, Rattus norvegicus
gggctgctcatagacgctttaactt

SEQ ID NO: 457426 - DNA, 25 bp, Rattus norvegicus
gggctgctgctaacttggatcctga

SEQ ID NO: 457427 - DNA, 25 bp, Rattus norvegicus
gggctgctgctatcttggatcctga

SEQ ID NO: 457428 - DNA, 25 bp, Rattus norvegicus
gggctgctgctgacttgtatcacga

SEQ ID NO: 457429 - DNA, 25 bp, Rattus norvegicus
gggctgctgctgtcttgtatcacga

SEQ ID NO: 457430 - DNA, 25 bp, Rattus norvegicus
gggctgctggctactcccttggcga

SEQ ID NO: 457431 - DNA, 25 bp, Rattus norvegicus
gggctgctggcttctcccttggcga

SEQ ID NO: 457432 - DNA, 25 bp, Rattus norvegicus
gggctgctgtatctcaatctggagt

SEQ ID NO: 457433 - DNA, 25 bp, Rattus norvegicus
gggctgctgtatgtcaatctggagt

SEQ ID NO: 457434 - DNA, 25 bp, Rattus norvegicus
gggctgctgtgcatccagaggccac

SEQ ID NO: 457435 - DNA, 25 bp, Rattus norvegicus
gggctgctgtgcttccagaggccac

SEQ ID NO: 457436 - DNA, 25 bp, Rattus norvegicus
gggctgcttaagattcatctgtttc

SEQ ID NO: 457437 - DNA, 25 bp, Rattus norvegicus
gggctgcttaagtttcatctgtttc

SEQ ID NO: 457438 - DNA, 25 bp, Rattus norvegicus
gggctgcttacgactcagtttgaca

SEQ ID NO: 457439 - DNA, 25 bp, Rattus norvegicus
gggctgcttacgtctcagtttgaca

SEQ ID NO: 457440 - DNA, 25 bp, Rattus norvegicus
gggctgcttcagaaaagtccctgat

SEQ ID NO: 457441 - DNA, 25 bp, Rattus norvegicus
gggctgcttcagtaaagtccctgat

SEQ ID NO: 457442 - DNA, 25 bp, Rattus norvegicus
gggctgctttctcctattggtcaaa

SEQ ID NO: 457443 - DNA, 25 bp, Rattus norvegicus
gggctgctttctgctattggtcaaa

SEQ ID NO: 457444 - DNA, 25 bp, Rattus norvegicus
gggctgcttttcactgagcgaagta

SEQ ID NO: 457445 - DNA, 25 bp, Rattus norvegicus
gggctgcttttctctgagcgaagta

SEQ ID NO: 457446 - DNA, 25 bp, Rattus norvegicus
gggctggaaactctaggtctcaaat

SEQ ID NO: 457447 - DNA, 25 bp, Rattus norvegicus
gggctggaaactgtaggtctcaaat

SEQ ID NO: 457448 - DNA, 25 bp, Rattus norvegicus
gggctggaacatatgaacccgaagc

SEQ ID NO: 457449 - DNA, 25 bp, Rattus norvegicus
gggctggaacatttgaacccgaagc

SEQ ID NO: 457450 - DNA, 25 bp, Rattus norvegicus
gggctggaacttcatcgtggccaat

SEQ ID NO: 457451 - DNA, 25 bp, Rattus norvegicus
gggctggaacttgatcgtggccaat

SEQ ID NO: 457452 - DNA, 25 bp, Rattus norvegicus
gggctggaatcgcactcctgtactg

SEQ ID NO: 457453 - DNA, 25 bp, Rattus norvegicus
gggctggaatcggactcctgtactg

SEQ ID NO: 457454 - DNA, 25 bp, Rattus norvegicus
gggctggacacaacatcttctgagt

SEQ ID NO: 457455 - DNA, 25 bp, Rattus norvegicus
gggctggacacatcatcttctgagt

SEQ ID NO: 457456 - DNA, 25 bp, Rattus norvegicus
gggctggacattattatatttgtaa

SEQ ID NO: 457457 - DNA, 25 bp, Rattus norvegicus
gggctggacatttttatatttgtaa

SEQ ID NO: 457458 - DNA, 25 bp, Rattus norvegicus
gggctggactctacagggacttgaa

SEQ ID NO: 457459 - DNA, 25 bp, Rattus norvegicus
gggctggactcttcagggacttgaa

SEQ ID NO: 457460 - DNA, 25 bp, Rattus norvegicus
gggctggacttacgactctgatttc

SEQ ID NO: 457461 - DNA, 25 bp, Rattus norvegicus
gggctggacttaggactctgatttc

SEQ ID NO: 457462 - DNA, 25 bp, Rattus norvegicus
gggctggagcaactacttgtactaa

SEQ ID NO: 457463 - DNA, 25 bp, Rattus norvegicus
gggctggagcaagtacttgtactaa

SEQ ID NO: 457464 - DNA, 25 bp, Rattus norvegicus
gggctggagcctcctattgcattta

SEQ ID NO: 457465 - DNA, 25 bp, Rattus norvegicus
gggctggagcctgctattgcattta

SEQ ID NO: 457466 - DNA, 25 bp, Rattus norvegicus
gggctggaggccatcttccagagaa

SEQ ID NO: 457467 - DNA, 25 bp, Rattus norvegicus
gggctggaggccttcttccagagaa

SEQ ID NO: 457468 - DNA, 25 bp, Rattus norvegicus
gggctggatggacagatacctcccc

SEQ ID NO: 457469 - DNA, 25 bp, Rattus norvegicus
gggctggatggagagatacctcccc

SEQ ID NO: 457470 - DNA, 25 bp, Rattus norvegicus
gggctggattaacaattcacgtaca

SEQ ID NO: 457471 - DNA, 25 bp, Rattus norvegicus
gggctggattaagaattcacgtaca

SEQ ID NO: 457472 - DNA, 25 bp, Rattus norvegicus
gggctggcaatgaaccttagttggt

SEQ ID NO: 457473 - DNA, 25 bp, Rattus norvegicus
gggctggcaatgtaccttagttggt

SEQ ID NO: 457474 - DNA, 25 bp, Rattus norvegicus
gggctggcacctcctgtgctatcag

SEQ ID NO: 457475 - DNA, 25 bp, Rattus norvegicus
gggctggcacctgctgtgctatcag

SEQ ID NO: 457476 - DNA, 25 bp, Rattus norvegicus
gggctggcagtaatacacaaaacat

SEQ ID NO: 457477 - DNA, 25 bp, Rattus norvegicus
gggctggcagtacctcctcagctag

SEQ ID NO: 457478 - DNA, 25 bp, Rattus norvegicus
gggctggcagtagctcctcagctag

SEQ ID NO: 457479 - DNA, 25 bp, Rattus norvegicus
gggctggcagtattacacaaaacat

SEQ ID NO: 457480 - DNA, 25 bp, Rattus norvegicus
gggctggcatcgagaacaaccaaag

SEQ ID NO: 457481 - DNA, 25 bp, Rattus norvegicus
gggctggcatcgtgaacaaccaaag

SEQ ID NO: 457482 - DNA, 25 bp, Rattus norvegicus
gggctggccactaatgaagactgcg

SEQ ID NO: 457483 - DNA, 25 bp, Rattus norvegicus
gggctggccacttatgaagactgcg

SEQ ID NO: 457484 - DNA, 25 bp, Rattus norvegicus
gggctggcctagaaccagtatctgt

SEQ ID NO: 457485 - DNA, 25 bp, Rattus norvegicus
gggctggcctagtaccagtatctgt

SEQ ID NO: 457486 - DNA, 25 bp, Rattus norvegicus
gggctggccttaaaagacacctgga

SEQ ID NO: 457487 - DNA, 25 bp, Rattus norvegicus
gggctggccttataagacacctgga

SEQ ID NO: 457488 - DNA, 25 bp, Rattus norvegicus
gggctggctacaatatatttatcct

SEQ ID NO: 457489 - DNA, 25 bp, Rattus norvegicus
gggctggctacattatatttatcct

SEQ ID NO: 457490 - DNA, 25 bp, Rattus norvegicus
gggctggctgatacaagtcactaag

SEQ ID NO: 457491 - DNA, 25 bp, Rattus norvegicus
gggctggctgattcaagtcactaag

SEQ ID NO: 457492 - DNA, 25 bp, Rattus norvegicus
gggctggctggactttatcccagac

SEQ ID NO: 457493 - DNA, 25 bp, Rattus norvegicus
gggctggctggagtttatcccagac

SEQ ID NO: 457494 - DNA, 25 bp, Rattus norvegicus
gggctggctgtgaaacatgattcta

SEQ ID NO: 457495 - DNA, 25 bp, Rattus norvegicus
gggctggctgtgtaacatgattcta

SEQ ID NO: 457496 - DNA, 25 bp, Rattus norvegicus
gggctggcttacaagttccgttagc

SEQ ID NO: 457497 - DNA, 25 bp, Rattus norvegicus
gggctggcttactagttccgttagc

SEQ ID NO: 457498 - DNA, 25 bp, Rattus norvegicus
gggctggcttgccttggctttttaa

SEQ ID NO: 457499 - DNA, 25 bp, Rattus norvegicus
gggctggcttgcgttggctttttaa

SEQ ID NO: 457500 - DNA, 25 bp, Rattus norvegicus
gggctggctttcctgagtaagttca

SEQ ID NO: 457501 - DNA, 25 bp, Rattus norvegicus
gggctggctttcgtgagtaagttca

SEQ ID NO: 457502 - DNA, 25 bp, Rattus norvegicus
gggctgggagccacccttcatctac

SEQ ID NO: 457503 - DNA, 25 bp, Rattus norvegicus
gggctgggagcctcccttcatctac

SEQ ID NO: 457504 - DNA, 25 bp, Rattus norvegicus
gggctgggatgcatcattttattca

SEQ ID NO: 457505 - DNA, 25 bp, Rattus norvegicus
gggctgggatgcttcattttattca

SEQ ID NO: 457506 - DNA, 25 bp, Rattus norvegicus
gggctgggattgactatcacctttc

SEQ ID NO: 457507 - DNA, 25 bp, Rattus norvegicus
gggctgggattgtctatcacctttc

SEQ ID NO: 457508 - DNA, 25 bp, Rattus norvegicus
gggctgggcaatactcaatgcactt

SEQ ID NO: 457509 - DNA, 25 bp, Rattus norvegicus
gggctgggcaattctcaatgcactt

SEQ ID NO: 457510 - DNA, 25 bp, Rattus norvegicus
gggctgggcacacatgccaagcctc

SEQ ID NO: 457511 - DNA, 25 bp, Rattus norvegicus
gggctgggcacagatgccaagcctc

SEQ ID NO: 457512 - DNA, 25 bp, Rattus norvegicus
gggctgggcatcaatatcggaaaac

SEQ ID NO: 457513 - DNA, 25 bp, Rattus norvegicus
gggctgggcatctatatcggaaaac

SEQ ID NO: 457514 - DNA, 25 bp, Rattus norvegicus
gggctggggacaactgcaccctatc

SEQ ID NO: 457515 - DNA, 25 bp, Rattus norvegicus
gggctggggacatctgcaccctatc

SEQ ID NO: 457516 - DNA, 25 bp, Rattus norvegicus
gggctgggtagaatactcagtcata

SEQ ID NO: 457517 - DNA, 25 bp, Rattus norvegicus
gggctgggtagattactcagtcata

SEQ ID NO: 457518 - DNA, 25 bp, Rattus norvegicus
gggctgggtattagtgctcgataaa

SEQ ID NO: 457519 - DNA, 25 bp, Rattus norvegicus
gggctgggtatttgtgctcgataaa

SEQ ID NO: 457520 - DNA, 25 bp, Rattus norvegicus
gggctgggtcatatttaccatgtat

SEQ ID NO: 457521 - DNA, 25 bp, Rattus norvegicus
gggctgggtcatttttaccatgtat

SEQ ID NO: 457522 - DNA, 25 bp, Rattus norvegicus
gggctgggtgaaaacaccaccaata

SEQ ID NO: 457523 - DNA, 25 bp, Rattus norvegicus
gggctgggtgaatacaccaccaata

SEQ ID NO: 457524 - DNA, 25 bp, Rattus norvegicus
gggctgggtgtaactcacgagcact

SEQ ID NO: 457525 - DNA, 25 bp, Rattus norvegicus
gggctgggtgtatctcacgagcact

SEQ ID NO: 457526 - DNA, 25 bp, Rattus norvegicus
gggctggtacagaagttctccctga

SEQ ID NO: 457527 - DNA, 25 bp, Rattus norvegicus
gggctggtacagtagttctccctga

SEQ ID NO: 457528 - DNA, 25 bp, Rattus norvegicus
gggctggtataacttttctctgttt

SEQ ID NO: 457529 - DNA, 25 bp, Rattus norvegicus
gggctggtataagttttctctgttt

SEQ ID NO: 457530 - DNA, 25 bp, Rattus norvegicus
gggctggtcatgatctttgcacatg

SEQ ID NO: 457531 - DNA, 25 bp, Rattus norvegicus
gggctggtcatgttctttgcacatg

SEQ ID NO: 457532 - DNA, 25 bp, Rattus norvegicus
gggctggtccataacttgtcatata

SEQ ID NO: 457533 - DNA, 25 bp, Rattus norvegicus
gggctggtccattacttgtcatata

SEQ ID NO: 457534 - DNA, 25 bp, Rattus norvegicus
gggctggtctctactgtgactctag

SEQ ID NO: 457535 - DNA, 25 bp, Rattus norvegicus
gggctggtctcttctgtgactctag

SEQ ID NO: 457536 - DNA, 25 bp, Rattus norvegicus
gggctggtctggcatatctaataag

SEQ ID NO: 457537 - DNA, 25 bp, Rattus norvegicus
gggctggtctgggatatctaataag

SEQ ID NO: 457538 - DNA, 25 bp, Rattus norvegicus
gggctggtgataaggccaagtacct

SEQ ID NO: 457539 - DNA, 25 bp, Rattus norvegicus
gggctggtgatatggccaagtacct

SEQ ID NO: 457540 - DNA, 25 bp, Rattus norvegicus
gggctggtgggaagcttctaccaaa

SEQ ID NO: 457541 - DNA, 25 bp, Rattus norvegicus
gggctggtgggatgcttctaccaaa

SEQ ID NO: 457542 - DNA, 25 bp, Rattus norvegicus
gggctggttcacatgttctaactat

SEQ ID NO: 457543 - DNA, 25 bp, Rattus norvegicus
gggctggttcacttgttctaactat

SEQ ID NO: 457544 - DNA, 25 bp, Rattus norvegicus
gggctggtttatctaactttatgat

SEQ ID NO: 457545 - DNA, 25 bp, Rattus norvegicus
gggctggtttatgtaactttatgat

SEQ ID NO: 457546 - DNA, 25 bp, Rattus norvegicus
gggctggtttccaaagcattcctac

SEQ ID NO: 457547 - DNA, 25 bp, Rattus norvegicus
gggctggtttcctaagcattcctac

SEQ ID NO: 457548 - DNA, 25 bp, Rattus norvegicus
gggctgtaacttcttacatacttct

SEQ ID NO: 457549 - DNA, 25 bp, Rattus norvegicus
gggctgtaacttcttcgttgacaca

SEQ ID NO: 457550 - DNA, 25 bp, Rattus norvegicus
gggctgtaacttgttacatacttct

SEQ ID NO: 457551 - DNA, 25 bp, Rattus norvegicus
gggctgtaacttgttcgttgacaca

SEQ ID NO: 457552 - DNA, 25 bp, Rattus norvegicus
gggctgtaaggaaccaaagttcaag

SEQ ID NO: 457553 - DNA, 25 bp, Rattus norvegicus
gggctgtaaggatccaaagttcaag

SEQ ID NO: 457554 - DNA, 25 bp, Rattus norvegicus
gggctgtaatggcatcgcctattta

SEQ ID NO: 457555 - DNA, 25 bp, Rattus norvegicus
gggctgtaatgggatcgcctattta

SEQ ID NO: 457556 - DNA, 25 bp, Rattus norvegicus
gggctgtactccataaagacctaga

SEQ ID NO: 457557 - DNA, 25 bp, Rattus norvegicus
gggctgtactccttaaagacctaga

SEQ ID NO: 457558 - DNA, 25 bp, Rattus norvegicus
gggctgtactctctagaatctattt

SEQ ID NO: 457559 - DNA, 25 bp, Rattus norvegicus
gggctgtactctgtagaatctattt

SEQ ID NO: 457560 - DNA, 25 bp, Rattus norvegicus
gggctgtagctactgttgctcttgc

SEQ ID NO: 457561 - DNA, 25 bp, Rattus norvegicus
gggctgtagctagtgttgctcttgc

SEQ ID NO: 457562 - DNA, 25 bp, Rattus norvegicus
gggctgtagctcagacttgagacac

SEQ ID NO: 457563 - DNA, 25 bp, Rattus norvegicus
gggctgtagctctgacttgagacac

SEQ ID NO: 457564 - DNA, 25 bp, Rattus norvegicus
gggctgtagcttcctgactagagca

SEQ ID NO: 457565 - DNA, 25 bp, Rattus norvegicus
gggctgtagcttgctgactagagca

SEQ ID NO: 457566 - DNA, 25 bp, Rattus norvegicus
gggctgtagggaccaaacatgtaaa

SEQ ID NO: 457567 - DNA, 25 bp, Rattus norvegicus
gggctgtagggagcaaacatgtaaa

SEQ ID NO: 457568 - DNA, 25 bp, Rattus norvegicus
gggctgtagtgtcggaccctctccc

SEQ ID NO: 457569 - DNA, 25 bp, Rattus norvegicus
gggctgtagtgtgggaccctctccc

SEQ ID NO: 457570 - DNA, 25 bp, Rattus norvegicus
gggctgtatcacagaatttcatttt

SEQ ID NO: 457571 - DNA, 25 bp, Rattus norvegicus
gggctgtatcactgaatttcatttt

SEQ ID NO: 457572 - DNA, 25 bp, Rattus norvegicus
gggctgtatctcaagtgacacagtt

SEQ ID NO: 457573 - DNA, 25 bp, Rattus norvegicus
gggctgtatctctagtgacacagtt

SEQ ID NO: 457574 - DNA, 25 bp, Rattus norvegicus
gggctgtatggcaagagccacctta

SEQ ID NO: 457575 - DNA, 25 bp, Rattus norvegicus
gggctgtatggctagagccacctta

SEQ ID NO: 457576 - DNA, 25 bp, Rattus norvegicus
gggctgtatgtgctattgctgatca

SEQ ID NO: 457577 - DNA, 25 bp, Rattus norvegicus
gggctgtatgtggtattgctgatca

SEQ ID NO: 457578 - DNA, 25 bp, Rattus norvegicus
gggctgtcaccaacctggacttgta

SEQ ID NO: 457579 - DNA, 25 bp, Rattus norvegicus
gggctgtcaccatcctggacttgta

SEQ ID NO: 457580 - DNA, 25 bp, Rattus norvegicus
gggctgtcagctcagttccctctga

SEQ ID NO: 457581 - DNA, 25 bp, Rattus norvegicus
gggctgtcagctgagttccctctga

SEQ ID NO: 457582 - DNA, 25 bp, Rattus norvegicus
gggctgtcatatacagaccaaacgt

SEQ ID NO: 457583 - DNA, 25 bp, Rattus norvegicus
gggctgtcatattcagaccaaacgt

SEQ ID NO: 457584 - DNA, 25 bp, Rattus norvegicus
gggctgtcatcaacactgtgcctta

SEQ ID NO: 457585 - DNA, 25 bp, Rattus norvegicus
gggctgtcatcatcactgtgcctta

SEQ ID NO: 457586 - DNA, 25 bp, Rattus norvegicus
gggctgtcatttcagctctatgtga

SEQ ID NO: 457587 - DNA, 25 bp, Rattus norvegicus
gggctgtcatttgagctctatgtga

SEQ ID NO: 457588 - DNA, 25 bp, Rattus norvegicus
gggctgtccatacgcagagcctcac

SEQ ID NO: 457589 - DNA, 25 bp, Rattus norvegicus
gggctgtccataggcagagcctcac

SEQ ID NO: 457590 - DNA, 25 bp, Rattus norvegicus
gggctgtccatcattttaattgaat

SEQ ID NO: 457591 - DNA, 25 bp, Rattus norvegicus
gggctgtccatctttttaattgaat

SEQ ID NO: 457592 - DNA, 25 bp, Rattus norvegicus
gggctgtccctaaagctgttgctct

SEQ ID NO: 457593 - DNA, 25 bp, Rattus norvegicus
gggctgtccctatagctgttgctct

SEQ ID NO: 457594 - DNA, 25 bp, Rattus norvegicus
gggctgtcctgcatgtgccagaagt

SEQ ID NO: 457595 - DNA, 25 bp, Rattus norvegicus
gggctgtcctgcttgtgccagaagt

SEQ ID NO: 457596 - DNA, 25 bp, Rattus norvegicus
gggctgtcctttaacccagtcagtt

SEQ ID NO: 457597 - DNA, 25 bp, Rattus norvegicus
gggctgtccttttacccagtcagtt

SEQ ID NO: 457598 - DNA, 25 bp, Rattus norvegicus
gggctgtctccacaaaatactcttc

SEQ ID NO: 457599 - DNA, 25 bp, Rattus norvegicus
gggctgtctccagaaaatactcttc

SEQ ID NO: 457600 - DNA, 25 bp, Rattus norvegicus
gggctgtctggaaacatttgcagga

SEQ ID NO: 457601 - DNA, 25 bp, Rattus norvegicus
gggctgtctggatacatttgcagga

SEQ ID NO: 457602 - DNA, 25 bp, Rattus norvegicus
gggctgtctggcctaagaacccaaa

SEQ ID NO: 457603 - DNA, 25 bp, Rattus norvegicus
gggctgtctggcgtaagaacccaaa

SEQ ID NO: 457604 - DNA, 25 bp, Rattus norvegicus
gggctgtctgtgactattattaact

SEQ ID NO: 457605 - DNA, 25 bp, Rattus norvegicus
gggctgtctgtgtctattattaact

SEQ ID NO: 457606 - DNA, 25 bp, Rattus norvegicus
gggctgtcttcaaacttagaatgca

SEQ ID NO: 457607 - DNA, 25 bp, Rattus norvegicus
gggctgtcttcatacttagaatgca

SEQ ID NO: 457608 - DNA, 25 bp, Rattus norvegicus
gggctgtcttgcagaatgctcctgc

SEQ ID NO: 457609 - DNA, 25 bp, Rattus norvegicus
gggctgtcttgctgaatgctcctgc

SEQ ID NO: 457610 - DNA, 25 bp, Rattus norvegicus
gggctgtcttttaagtcctccaggc

SEQ ID NO: 457611 - DNA, 25 bp, Rattus norvegicus
gggctgtctttttagtcctccaggc

SEQ ID NO: 457612 - DNA, 25 bp, Rattus norvegicus
gggctgtgaaagacactcgctgacc

SEQ ID NO: 457613 - DNA, 25 bp, Rattus norvegicus
gggctgtgaaagtcactcgctgacc

SEQ ID NO: 457614 - DNA, 25 bp, Rattus norvegicus
gggctgtgaaggatcccactccttc

SEQ ID NO: 457615 - DNA, 25 bp, Rattus norvegicus
gggctgtgaaggttcccactccttc

SEQ ID NO: 457616 - DNA, 25 bp, Rattus norvegicus
gggctgtgagatccaccataggttt

SEQ ID NO: 457617 - DNA, 25 bp, Rattus norvegicus
gggctgtgagatgcaccataggttt

SEQ ID NO: 457618 - DNA, 25 bp, Rattus norvegicus
gggctgtgatctagtgttttaacaa

SEQ ID NO: 457619 - DNA, 25 bp, Rattus norvegicus
gggctgtgatcttgtgttttaacaa

SEQ ID NO: 457620 - DNA, 25 bp, Rattus norvegicus
gggctgtgcaacagagtgttcactt

SEQ ID NO: 457621 - DNA, 25 bp, Rattus norvegicus
gggctgtgcaactgagtgttcactt

SEQ ID NO: 457622 - DNA, 25 bp, Rattus norvegicus
gggctgtgcaccatgtactatttca

SEQ ID NO: 457623 - DNA, 25 bp, Rattus norvegicus
gggctgtgcaccttgtactatttca

SEQ ID NO: 457624 - DNA, 25 bp, Rattus norvegicus
gggctgtgcctaccctaccattaag

SEQ ID NO: 457625 - DNA, 25 bp, Rattus norvegicus
gggctgtgcctagcctaccattaag

SEQ ID NO: 457626 - DNA, 25 bp, Rattus norvegicus
gggctgtgctcaactttaaactgaa

SEQ ID NO: 457627 - DNA, 25 bp, Rattus norvegicus
gggctgtgctcacaccctgtcagta

SEQ ID NO: 457628 - DNA, 25 bp, Rattus norvegicus
gggctgtgctcagaccctgtcagta

SEQ ID NO: 457629 - DNA, 25 bp, Rattus norvegicus
gggctgtgctcatctttaaactgaa

SEQ ID NO: 457630 - DNA, 25 bp, Rattus norvegicus
gggctgtgctgtatctaattttttg

SEQ ID NO: 457631 - DNA, 25 bp, Rattus norvegicus
gggctgtgctgtttctaattttttg

SEQ ID NO: 457632 - DNA, 25 bp, Rattus norvegicus
gggctgtgcttacaggtcactacag

SEQ ID NO: 457633 - DNA, 25 bp, Rattus norvegicus
gggctgtgcttagaggtcactacag

SEQ ID NO: 457634 - DNA, 25 bp, Rattus norvegicus
gggctgtggacacaaccctgtaact

SEQ ID NO: 457635 - DNA, 25 bp, Rattus norvegicus
gggctgtggacagaaccctgtaact

SEQ ID NO: 457636 - DNA, 25 bp, Rattus norvegicus
gggctgtgggcgacatacaagctac

SEQ ID NO: 457637 - DNA, 25 bp, Rattus norvegicus
gggctgtgggcgtcatacaagctac

SEQ ID NO: 457638 - DNA, 25 bp, Rattus norvegicus
gggctgtggtagagctctcttgact

SEQ ID NO: 457639 - DNA, 25 bp, Rattus norvegicus
gggctgtggtagtgctctcttgact

SEQ ID NO: 457640 - DNA, 25 bp, Rattus norvegicus
gggctgtgtatgaaatatgtttctg

SEQ ID NO: 457641 - DNA, 25 bp, Rattus norvegicus
gggctgtgtatgtaatatgtttctg

SEQ ID NO: 457642 - DNA, 25 bp, Rattus norvegicus
gggctgtgtccacctttgtagccta

SEQ ID NO: 457643 - DNA, 25 bp, Rattus norvegicus
gggctgtgtccagctttgtagccta

SEQ ID NO: 457644 - DNA, 25 bp, Rattus norvegicus
gggctgtgtctactgtttacaaata

SEQ ID NO: 457645 - DNA, 25 bp, Rattus norvegicus
gggctgtgtctagtgtttacaaata

SEQ ID NO: 457646 - DNA, 25 bp, Rattus norvegicus
gggctgtgtgctattactcatggtg

SEQ ID NO: 457647 - DNA, 25 bp, Rattus norvegicus
gggctgtgtgcttttactcatggtg

SEQ ID NO: 457648 - DNA, 25 bp, Rattus norvegicus
gggctgtgttcaagctaccaaagtt

SEQ ID NO: 457649 - DNA, 25 bp, Rattus norvegicus
gggctgtgttcatgctaccaaagtt

SEQ ID NO: 457650 - DNA, 25 bp, Rattus norvegicus
gggctgtgttgtcctaaatcctttc

SEQ ID NO: 457651 - DNA, 25 bp, Rattus norvegicus
gggctgtgttgtgctaaatcctttc

SEQ ID NO: 457652 - DNA, 25 bp, Rattus norvegicus
gggctgttaatgattgtcttaagga

SEQ ID NO: 457653 - DNA, 25 bp, Rattus norvegicus
gggctgttaatgtttgtcttaagga

SEQ ID NO: 457654 - DNA, 25 bp, Rattus norvegicus
gggctgttacctacatgtcagatgg

SEQ ID NO: 457655 - DNA, 25 bp, Rattus norvegicus
gggctgttaccttcatgtcagatgg

SEQ ID NO: 457656 - DNA, 25 bp, Rattus norvegicus
gggctgttagtccttctactttctt

SEQ ID NO: 457657 - DNA, 25 bp, Rattus norvegicus
gggctgttagtcgttctactttctt

SEQ ID NO: 457658 - DNA, 25 bp, Rattus norvegicus
gggctgttatttctacggtaaatct

SEQ ID NO: 457659 - DNA, 25 bp, Rattus norvegicus
gggctgttatttgtacggtaaatct

SEQ ID NO: 457660 - DNA, 25 bp, Rattus norvegicus
gggctgttcatcatggtcctgatcc

SEQ ID NO: 457661 - DNA, 25 bp, Rattus norvegicus
gggctgttcatcttggtcctgatcc

SEQ ID NO: 457662 - DNA, 25 bp, Rattus norvegicus
gggctgttctatactgtgcatatga

SEQ ID NO: 457663 - DNA, 25 bp, Rattus norvegicus
gggctgttctattctgtgcatatga

SEQ ID NO: 457664 - DNA, 25 bp, Rattus norvegicus
gggctgttctcacctacacagatca

SEQ ID NO: 457665 - DNA, 25 bp, Rattus norvegicus
gggctgttctcagctacacagatca

SEQ ID NO: 457666 - DNA, 25 bp, Rattus norvegicus
gggctgttcttgatgatagaccttc

SEQ ID NO: 457667 - DNA, 25 bp, Rattus norvegicus
gggctgttcttgttgatagaccttc

SEQ ID NO: 457668 - DNA, 25 bp, Rattus norvegicus
gggctgttgacacgtatctcaatcg

SEQ ID NO: 457669 - DNA, 25 bp, Rattus norvegicus
gggctgttgacaggtatctcaatcg

SEQ ID NO: 457670 - DNA, 25 bp, Rattus norvegicus
gggctgttgcaaccctatgaactgg

SEQ ID NO: 457671 - DNA, 25 bp, Rattus norvegicus
gggctgttgcaacttggagcaccca

SEQ ID NO: 457672 - DNA, 25 bp, Rattus norvegicus
gggctgttgcaagcctatgaactgg

SEQ ID NO: 457673 - DNA, 25 bp, Rattus norvegicus
gggctgttgcaagttggagcaccca

SEQ ID NO: 457674 - DNA, 25 bp, Rattus norvegicus
gggctgttgcccatgggacactgtt

SEQ ID NO: 457675 - DNA, 25 bp, Rattus norvegicus
gggctgttgcccttgggacactgtt

SEQ ID NO: 457676 - DNA, 25 bp, Rattus norvegicus
gggctgttgcttctgacattgaacc

SEQ ID NO: 457677 - DNA, 25 bp, Rattus norvegicus
gggctgttgcttgtgacattgaacc

SEQ ID NO: 457678 - DNA, 25 bp, Rattus norvegicus
gggctgttggctccaataaacacac

SEQ ID NO: 457679 - DNA, 25 bp, Rattus norvegicus
gggctgttggctgcaataaacacac

SEQ ID NO: 457680 - DNA, 25 bp, Rattus norvegicus
gggctgttgggcaccgagtttcaat

SEQ ID NO: 457681 - DNA, 25 bp, Rattus norvegicus
gggctgttgggccaactcaacccgc

SEQ ID NO: 457682 - DNA, 25 bp, Rattus norvegicus
gggctgttgggcgaactcaacccgc

SEQ ID NO: 457683 - DNA, 25 bp, Rattus norvegicus
gggctgttgggctccgagtttcaat

SEQ ID NO: 457684 - DNA, 25 bp, Rattus norvegicus
gggctgtttacccaagctgctgatt

SEQ ID NO: 457685 - DNA, 25 bp, Rattus norvegicus
gggctgtttaccgaagctgctgatt

SEQ ID NO: 457686 - DNA, 25 bp, Rattus norvegicus
gggctgtttatgactctgctgatac

SEQ ID NO: 457687 - DNA, 25 bp, Rattus norvegicus
gggctgtttatgtctctgctgatac

SEQ ID NO: 457688 - DNA, 25 bp, Rattus norvegicus
gggctgtttcataaacaagtggttt

SEQ ID NO: 457689 - DNA, 25 bp, Rattus norvegicus
gggctgtttcattaacaagtggttt

SEQ ID NO: 457690 - DNA, 25 bp, Rattus norvegicus
gggctgtttcttatatatggtacta

SEQ ID NO: 457691 - DNA, 25 bp, Rattus norvegicus
gggctgtttcttttatatggtacta

SEQ ID NO: 457692 - DNA, 25 bp, Rattus norvegicus
gggcttaaactaagatgtgactaca

SEQ ID NO: 457693 - DNA, 25 bp, Rattus norvegicus
gggcttaaactatgatgtgactaca

SEQ ID NO: 457694 - DNA, 25 bp, Rattus norvegicus
gggcttaaagcaatggttctcaacc

SEQ ID NO: 457695 - DNA, 25 bp, Rattus norvegicus
gggcttaaagcattggttctcaacc

SEQ ID NO: 457696 - DNA, 25 bp, Rattus norvegicus
gggcttaacacaaacctatctccat

SEQ ID NO: 457697 - DNA, 25 bp, Rattus norvegicus
gggcttaacacatacctatctccat

SEQ ID NO: 457698 - DNA, 25 bp, Rattus norvegicus
gggcttaactgtagtgtgtacatct

SEQ ID NO: 457699 - DNA, 25 bp, Rattus norvegicus
gggcttaactgttgtgtgtacatct

SEQ ID NO: 457700 - DNA, 25 bp, Rattus norvegicus
gggcttacaaacagcaatagagact

SEQ ID NO: 457701 - DNA, 25 bp, Rattus norvegicus
gggcttacaaactgcaatagagact

SEQ ID NO: 457702 - DNA, 25 bp, Rattus norvegicus
gggcttacatgccaatggctccaat

SEQ ID NO: 457703 - DNA, 25 bp, Rattus norvegicus
gggcttacatgcgaatggctccaat

SEQ ID NO: 457704 - DNA, 25 bp, Rattus norvegicus
gggcttacatggcagctcctgaaat

SEQ ID NO: 457705 - DNA, 25 bp, Rattus norvegicus
gggcttacatgggagctcctgaaat

SEQ ID NO: 457706 - DNA, 25 bp, Rattus norvegicus
gggcttaccagaacacaagggcttt

SEQ ID NO: 457707 - DNA, 25 bp, Rattus norvegicus
gggcttaccagatcacaagggcttt

SEQ ID NO: 457708 - DNA, 25 bp, Rattus norvegicus
gggcttacccataaatgacaggatt

SEQ ID NO: 457709 - DNA, 25 bp, Rattus norvegicus
gggcttacccattaatgacaggatt

SEQ ID NO: 457710 - DNA, 25 bp, Rattus norvegicus
gggcttaccctaaggtctttgagaa

SEQ ID NO: 457711 - DNA, 25 bp, Rattus norvegicus
gggcttaccctatggtctttgagaa

SEQ ID NO: 457712 - DNA, 25 bp, Rattus norvegicus
gggcttacctaacactacttcagtt

SEQ ID NO: 457713 - DNA, 25 bp, Rattus norvegicus
gggcttacctaagactacttcagtt

SEQ ID NO: 457714 - DNA, 25 bp, Rattus norvegicus
gggcttacgaccatggcatcaaata

SEQ ID NO: 457715 - DNA, 25 bp, Rattus norvegicus
gggcttacgaccttggcatcaaata

SEQ ID NO: 457716 - DNA, 25 bp, Rattus norvegicus
gggcttactcacaaatacgcttgtg

SEQ ID NO: 457717 - DNA, 25 bp, Rattus norvegicus
gggcttactcacagcagtttaacca

SEQ ID NO: 457718 - DNA, 25 bp, Rattus norvegicus
gggcttactcactaatacgcttgtg

SEQ ID NO: 457719 - DNA, 25 bp, Rattus norvegicus
gggcttactcactgcagtttaacca

SEQ ID NO: 457720 - DNA, 25 bp, Rattus norvegicus
gggcttagactgcatttggcacagt

SEQ ID NO: 457721 - DNA, 25 bp, Rattus norvegicus
gggcttagactggatttggcacagt

SEQ ID NO: 457722 - DNA, 25 bp, Rattus norvegicus
gggcttagctggagcagactgcttc

SEQ ID NO: 457723 - DNA, 25 bp, Rattus norvegicus
gggcttagctggtgcagactgcttc

SEQ ID NO: 457724 - DNA, 25 bp, Rattus norvegicus
gggcttagctttcttgggacatcaa

SEQ ID NO: 457725 - DNA, 25 bp, Rattus norvegicus
gggcttagctttgttgggacatcaa

SEQ ID NO: 457726 - DNA, 25 bp, Rattus norvegicus
gggcttaggactctctttgaagact

SEQ ID NO: 457727 - DNA, 25 bp, Rattus norvegicus
gggcttaggactgtctttgaagact

SEQ ID NO: 457728 - DNA, 25 bp, Rattus norvegicus
gggcttaggcacacacttattactc

SEQ ID NO: 457729 - DNA, 25 bp, Rattus norvegicus
gggcttaggcactcacttattactc

SEQ ID NO: 457730 - DNA, 25 bp, Rattus norvegicus
gggcttagtctacctgagatccaga

SEQ ID NO: 457731 - DNA, 25 bp, Rattus norvegicus
gggcttagtctagctgagatccaga

SEQ ID NO: 457732 - DNA, 25 bp, Rattus norvegicus
gggcttagttaaatctctagacttc

SEQ ID NO: 457733 - DNA, 25 bp, Rattus norvegicus
gggcttagttaattctctagacttc

SEQ ID NO: 457734 - DNA, 25 bp, Rattus norvegicus
gggcttatatgcagactacctgttc

SEQ ID NO: 457735 - DNA, 25 bp, Rattus norvegicus
gggcttatatgctgactacctgttc

SEQ ID NO: 457736 - DNA, 25 bp, Rattus norvegicus
gggcttatgcttactttagccagca

SEQ ID NO: 457737 - DNA, 25 bp, Rattus norvegicus
gggcttatgctttctttagccagca

SEQ ID NO: 457738 - DNA, 25 bp, Rattus norvegicus
gggcttatggcacaatgacctacct

SEQ ID NO: 457739 - DNA, 25 bp, Rattus norvegicus
gggcttatggcagaatgacctacct

SEQ ID NO: 457740 - DNA, 25 bp, Rattus norvegicus
gggcttatgggcaagtttttctcat

SEQ ID NO: 457741 - DNA, 25 bp, Rattus norvegicus
gggcttatgggctagtttttctcat

SEQ ID NO: 457742 - DNA, 25 bp, Rattus norvegicus
gggcttattaagacacactccagtg

SEQ ID NO: 457743 - DNA, 25 bp, Rattus norvegicus
gggcttattaagtcacactccagtg

SEQ ID NO: 457744 - DNA, 25 bp, Rattus norvegicus
gggcttattgatcgtctctactctc

SEQ ID NO: 457745 - DNA, 25 bp, Rattus norvegicus
gggcttattgatggtctctactctc

SEQ ID NO: 457746 - DNA, 25 bp, Rattus norvegicus
gggcttatttctaagtcatccacta

SEQ ID NO: 457747 - DNA, 25 bp, Rattus norvegicus
gggcttatttcttagtcatccacta

SEQ ID NO: 457748 - DNA, 25 bp, Rattus norvegicus
gggcttcaagacctgaactgagaca

SEQ ID NO: 457749 - DNA, 25 bp, Rattus norvegicus
gggcttcaagacgtgaactgagaca

SEQ ID NO: 457750 - DNA, 25 bp, Rattus norvegicus
gggcttcacaagacatgtcttcatg

SEQ ID NO: 457751 - DNA, 25 bp, Rattus norvegicus
gggcttcacaagtcatgtcttcatg

SEQ ID NO: 457752 - DNA, 25 bp, Rattus norvegicus
gggcttcacattcacaaacctagaa

SEQ ID NO: 457753 - DNA, 25 bp, Rattus norvegicus
gggcttcacattgacaaacctagaa

SEQ ID NO: 457754 - DNA, 25 bp, Rattus norvegicus
gggcttcaccagacagtgttgccac

SEQ ID NO: 457755 - DNA, 25 bp, Rattus norvegicus
gggcttcaccagtcagtgttgccac

SEQ ID NO: 457756 - DNA, 25 bp, Rattus norvegicus
gggcttcacctcacagtatttacat

SEQ ID NO: 457757 - DNA, 25 bp, Rattus norvegicus
gggcttcacctctcagtatttacat

SEQ ID NO: 457758 - DNA, 25 bp, Rattus norvegicus
gggcttcactcactcttgagtttaa

SEQ ID NO: 457759 - DNA, 25 bp, Rattus norvegicus
gggcttcactcagtcttgagtttaa

SEQ ID NO: 457760 - DNA, 25 bp, Rattus norvegicus
gggcttcactttcacttccagaagc

SEQ ID NO: 457761 - DNA, 25 bp, Rattus norvegicus
gggcttcactttgacttccagaagc

SEQ ID NO: 457762 - DNA, 25 bp, Rattus norvegicus
gggcttcagacaaggaccttcaccc

SEQ ID NO: 457763 - DNA, 25 bp, Rattus norvegicus
gggcttcagacatggaccttcaccc

SEQ ID NO: 457764 - DNA, 25 bp, Rattus norvegicus
gggcttcagcatatagcagatcctg

SEQ ID NO: 457765 - DNA, 25 bp, Rattus norvegicus
gggcttcagcatttagcagatcctg

SEQ ID NO: 457766 - DNA, 25 bp, Rattus norvegicus
gggcttcaggacaaacctttctaga

SEQ ID NO: 457767 - DNA, 25 bp, Rattus norvegicus
gggcttcaggacatcacctccaaag

SEQ ID NO: 457768 - DNA, 25 bp, Rattus norvegicus
gggcttcaggactaacctttctaga

SEQ ID NO: 457769 - DNA, 25 bp, Rattus norvegicus
gggcttcaggacttcacctccaaag

SEQ ID NO: 457770 - DNA, 25 bp, Rattus norvegicus
gggcttcaggatcttgagtcccatg

SEQ ID NO: 457771 - DNA, 25 bp, Rattus norvegicus
gggcttcaggatgttgagtcccatg

SEQ ID NO: 457772 - DNA, 25 bp, Rattus norvegicus
gggcttcaggcactgaccctctggc

SEQ ID NO: 457773 - DNA, 25 bp, Rattus norvegicus
gggcttcaggcagtgaccctctggc

SEQ ID NO: 457774 - DNA, 25 bp, Rattus norvegicus
gggcttcaggcccagcggcatggtg

SEQ ID NO: 457775 - DNA, 25 bp, Rattus norvegicus
gggcttcaggccgagcggcatggtg

SEQ ID NO: 457776 - DNA, 25 bp, Rattus norvegicus
gggcttcatacgcacaggtgatgca

SEQ ID NO: 457777 - DNA, 25 bp, Rattus norvegicus
gggcttcatacggacaggtgatgca

SEQ ID NO: 457778 - DNA, 25 bp, Rattus norvegicus
gggcttcatagcagacacagctgag

SEQ ID NO: 457779 - DNA, 25 bp, Rattus norvegicus
gggcttcatagctgacacagctgag

SEQ ID NO: 457780 - DNA, 25 bp, Rattus norvegicus
gggcttcatcatagtgattttgttt

SEQ ID NO: 457781 - DNA, 25 bp, Rattus norvegicus
gggcttcatcattgtgattttgttt

SEQ ID NO: 457782 - DNA, 25 bp, Rattus norvegicus
gggcttcatgaccacctgagcatct

SEQ ID NO: 457783 - DNA, 25 bp, Rattus norvegicus
gggcttcatgacgacctgagcatct

SEQ ID NO: 457784 - DNA, 25 bp, Rattus norvegicus
gggcttcatgcaaagacaattctgt

SEQ ID NO: 457785 - DNA, 25 bp, Rattus norvegicus
gggcttcatgcatagacaattctgt

SEQ ID NO: 457786 - DNA, 25 bp, Rattus norvegicus
gggcttcatggaactacttcgacac

SEQ ID NO: 457787 - DNA, 25 bp, Rattus norvegicus
gggcttcatggatctacttcgacac

SEQ ID NO: 457788 - DNA, 25 bp, Rattus norvegicus
gggcttcatgtcactttgggtggaa

SEQ ID NO: 457789 - DNA, 25 bp, Rattus norvegicus
gggcttcatgtctctttgggtggaa

SEQ ID NO: 457790 - DNA, 25 bp, Rattus norvegicus
gggcttcattagcacgggccccatc

SEQ ID NO: 457791 - DNA, 25 bp, Rattus norvegicus
gggcttcattaggacgggccccatc

SEQ ID NO: 457792 - DNA, 25 bp, Rattus norvegicus
gggcttcattctaacagtaacagag

SEQ ID NO: 457793 - DNA, 25 bp, Rattus norvegicus
gggcttcattcttacagtaacagag

SEQ ID NO: 457794 - DNA, 25 bp, Rattus norvegicus
gggcttccacgtaccctatcaggag

SEQ ID NO: 457795 - DNA, 25 bp, Rattus norvegicus
gggcttccacgttccctatcaggag

SEQ ID NO: 457796 - DNA, 25 bp, Rattus norvegicus
gggcttccagcaagaccgtatcaag

SEQ ID NO: 457797 - DNA, 25 bp, Rattus norvegicus
gggcttccagcatgaccgtatcaag

SEQ ID NO: 457798 - DNA, 25 bp, Rattus norvegicus
gggcttccaggcctggtctctgcac

SEQ ID NO: 457799 - DNA, 25 bp, Rattus norvegicus
gggcttccaggcgtggtctctgcac

SEQ ID NO: 457800 - DNA, 25 bp, Rattus norvegicus
gggcttccagtcatttagctaattg

SEQ ID NO: 457801 - DNA, 25 bp, Rattus norvegicus
gggcttccagtcttttagctaattg

SEQ ID NO: 457802 - DNA, 25 bp, Rattus norvegicus
gggcttcccattactatgaacagga

SEQ ID NO: 457803 - DNA, 25 bp, Rattus norvegicus
gggcttcccatttctatgaacagga

SEQ ID NO: 457804 - DNA, 25 bp, Rattus norvegicus
gggcttccctacctcaggcaggaag

SEQ ID NO: 457805 - DNA, 25 bp, Rattus norvegicus
gggcttccctacgtcaggcaggaag

SEQ ID NO: 457806 - DNA, 25 bp, Rattus norvegicus
gggcttccctgcatctgtaaagaag

SEQ ID NO: 457807 - DNA, 25 bp, Rattus norvegicus
gggcttccctgcttctgtaaagaag

SEQ ID NO: 457808 - DNA, 25 bp, Rattus norvegicus
gggcttccctggatggaaaagtcat

SEQ ID NO: 457809 - DNA, 25 bp, Rattus norvegicus
gggcttccctggctcctgaaggcac

SEQ ID NO: 457810 - DNA, 25 bp, Rattus norvegicus
gggcttccctgggtcctgaaggcac

SEQ ID NO: 457811 - DNA, 25 bp, Rattus norvegicus
gggcttccctggttggaaaagtcat

SEQ ID NO: 457812 - DNA, 25 bp, Rattus norvegicus
gggcttccctgtctgggcttagaaa

SEQ ID NO: 457813 - DNA, 25 bp, Rattus norvegicus
gggcttccctgtgtgggcttagaaa

SEQ ID NO: 457814 - DNA, 25 bp, Rattus norvegicus
gggcttccgactaggagaccagtga

SEQ ID NO: 457815 - DNA, 25 bp, Rattus norvegicus
gggcttccgacttggagaccagtga

SEQ ID NO: 457816 - DNA, 25 bp, Rattus norvegicus
gggcttcctagacactctggtagta

SEQ ID NO: 457817 - DNA, 25 bp, Rattus norvegicus
gggcttcctagagactctggtagta

SEQ ID NO: 457818 - DNA, 25 bp, Rattus norvegicus
gggcttcctatgacttgtaactttg

SEQ ID NO: 457819 - DNA, 25 bp, Rattus norvegicus
gggcttcctatgtcttgtaactttg

SEQ ID NO: 457820 - DNA, 25 bp, Rattus norvegicus
gggcttcctccaagctatgagacaa

SEQ ID NO: 457821 - DNA, 25 bp, Rattus norvegicus
gggcttcctccatgctatgagacaa

SEQ ID NO: 457822 - DNA, 25 bp, Rattus norvegicus
gggcttcctcctagtccgtaaagag

SEQ ID NO: 457823 - DNA, 25 bp, Rattus norvegicus
gggcttcctccttgtccgtaaagag

SEQ ID NO: 457824 - DNA, 25 bp, Rattus norvegicus
gggcttcctgacctaagcagcatga

SEQ ID NO: 457825 - DNA, 25 bp, Rattus norvegicus
gggcttcctgacgtaagcagcatga

SEQ ID NO: 457826 - DNA, 25 bp, Rattus norvegicus
gggcttcctgtcagtcacagtgttt

SEQ ID NO: 457827 - DNA, 25 bp, Rattus norvegicus
gggcttcctgtctgtcacagtgttt

SEQ ID NO: 457828 - DNA, 25 bp, Rattus norvegicus
gggcttccttatattctagacctgt

SEQ ID NO: 457829 - DNA, 25 bp, Rattus norvegicus
gggcttccttattttctagacctgt

SEQ ID NO: 457830 - DNA, 25 bp, Rattus norvegicus
gggcttccttgtctattgcgtaatt

SEQ ID NO: 457831 - DNA, 25 bp, Rattus norvegicus
gggcttccttgtgtattgcgtaatt

SEQ ID NO: 457832 - DNA, 25 bp, Rattus norvegicus
gggcttccttttccaattaagtgtg

SEQ ID NO: 457833 - DNA, 25 bp, Rattus norvegicus
gggcttccttttgcaattaagtgtg

SEQ ID NO: 457834 - DNA, 25 bp, Rattus norvegicus
gggcttcgaacacacttggctctca

SEQ ID NO: 457835 - DNA, 25 bp, Rattus norvegicus
gggcttcgaacagacttggctctca

SEQ ID NO: 457836 - DNA, 25 bp, Rattus norvegicus
gggcttcgcaggcatttcctggcca

SEQ ID NO: 457837 - DNA, 25 bp, Rattus norvegicus
gggcttcgcagggatttcctggcca

SEQ ID NO: 457838 - DNA, 25 bp, Rattus norvegicus
gggcttcgcatgacaagatgggtac

SEQ ID NO: 457839 - DNA, 25 bp, Rattus norvegicus
gggcttcgcatgtcaagatgggtac

SEQ ID NO: 457840 - DNA, 25 bp, Rattus norvegicus
gggcttcggcataagttcttggtcc

SEQ ID NO: 457841 - DNA, 25 bp, Rattus norvegicus
gggcttcggcattagttcttggtcc

SEQ ID NO: 457842 - DNA, 25 bp, Rattus norvegicus
gggcttcggtcaacaggatttatct

SEQ ID NO: 457843 - DNA, 25 bp, Rattus norvegicus
gggcttcggtcatcaggatttatct

SEQ ID NO: 457844 - DNA, 25 bp, Rattus norvegicus
gggcttcgtgcacacctactatgaa

SEQ ID NO: 457845 - DNA, 25 bp, Rattus norvegicus
gggcttcgtgcagacctactatgaa

SEQ ID NO: 457846 - DNA, 25 bp, Rattus norvegicus
gggcttcgtgtaaagtactcattta

SEQ ID NO: 457847 - DNA, 25 bp, Rattus norvegicus
gggcttcgtgtacatgaggtttatt

SEQ ID NO: 457848 - DNA, 25 bp, Rattus norvegicus
gggcttcgtgtagatgaggtttatt

SEQ ID NO: 457849 - DNA, 25 bp, Rattus norvegicus
gggcttcgtgtatagtactcattta

SEQ ID NO: 457850 - DNA, 25 bp, Rattus norvegicus
gggcttctacaacgcagatacctta

SEQ ID NO: 457851 - DNA, 25 bp, Rattus norvegicus
gggcttctacaaggcagatacctta

SEQ ID NO: 457852 - DNA, 25 bp, Rattus norvegicus
gggcttctactgagatcacgtgaga

SEQ ID NO: 457853 - DNA, 25 bp, Rattus norvegicus
gggcttctactgtgatcacgtgaga

SEQ ID NO: 457854 - DNA, 25 bp, Rattus norvegicus
gggcttctccatccctgtgatggaa

SEQ ID NO: 457855 - DNA, 25 bp, Rattus norvegicus
gggcttctccatgcctgtgatggaa

SEQ ID NO: 457856 - DNA, 25 bp, Rattus norvegicus
gggcttctccttatgtttggtgctg

SEQ ID NO: 457857 - DNA, 25 bp, Rattus norvegicus
gggcttctccttttgtttggtgctg

SEQ ID NO: 457858 - DNA, 25 bp, Rattus norvegicus
gggcttctcggtagacaaatctgac

SEQ ID NO: 457859 - DNA, 25 bp, Rattus norvegicus
gggcttctcggttgacaaatctgac

SEQ ID NO: 457860 - DNA, 25 bp, Rattus norvegicus
gggcttctctttagcagggattcac

SEQ ID NO: 457861 - DNA, 25 bp, Rattus norvegicus
gggcttctcttttgcagggattcac

SEQ ID NO: 457862 - DNA, 25 bp, Rattus norvegicus
gggcttctgacaccgacactgaaag

SEQ ID NO: 457863 - DNA, 25 bp, Rattus norvegicus
gggcttctgacagcgacactgaaag

SEQ ID NO: 457864 - DNA, 25 bp, Rattus norvegicus
gggcttctgaccaggcctaactgta

SEQ ID NO: 457865 - DNA, 25 bp, Rattus norvegicus
gggcttctgacctggcctaactgta

SEQ ID NO: 457866 - DNA, 25 bp, Rattus norvegicus
gggcttctgagcacaggccaggaaa

SEQ ID NO: 457867 - DNA, 25 bp, Rattus norvegicus
gggcttctgagctcaggccaggaaa

SEQ ID NO: 457868 - DNA, 25 bp, Rattus norvegicus
gggcttctgagtaggaaacaataaa

SEQ ID NO: 457869 - DNA, 25 bp, Rattus norvegicus
gggcttctgagttggaaacaataaa

SEQ ID NO: 457870 - DNA, 25 bp, Rattus norvegicus
gggcttctgcacagagactttaaac

SEQ ID NO: 457871 - DNA, 25 bp, Rattus norvegicus
gggcttctgcacagatactcaggga

SEQ ID NO: 457872 - DNA, 25 bp, Rattus norvegicus
gggcttctgcactgagactttaaac

SEQ ID NO: 457873 - DNA, 25 bp, Rattus norvegicus
gggcttctgcactgatactcaggga

SEQ ID NO: 457874 - DNA, 25 bp, Rattus norvegicus
gggcttctgcagactttaggagtcc

SEQ ID NO: 457875 - DNA, 25 bp, Rattus norvegicus
gggcttctgcagtctttaggagtcc

SEQ ID NO: 457876 - DNA, 25 bp, Rattus norvegicus
gggcttctgcatctgaaatgctgta

SEQ ID NO: 457877 - DNA, 25 bp, Rattus norvegicus
gggcttctgcatgtgaaatgctgta

SEQ ID NO: 457878 - DNA, 25 bp, Rattus norvegicus
gggcttctgcttctcaagattttgt

SEQ ID NO: 457879 - DNA, 25 bp, Rattus norvegicus
gggcttctgcttgtcaagattttgt

SEQ ID NO: 457880 - DNA, 25 bp, Rattus norvegicus
gggcttctggacacggcaatgcaga

SEQ ID NO: 457881 - DNA, 25 bp, Rattus norvegicus
gggcttctggactcggcaatgcaga

SEQ ID NO: 457882 - DNA, 25 bp, Rattus norvegicus
gggcttctggtactcacaggagacc

SEQ ID NO: 457883 - DNA, 25 bp, Rattus norvegicus
gggcttctggtagtcacaggagacc

SEQ ID NO: 457884 - DNA, 25 bp, Rattus norvegicus
gggcttctgtatatgctgttttcac

SEQ ID NO: 457885 - DNA, 25 bp, Rattus norvegicus
gggcttctgtatttgctgttttcac

SEQ ID NO: 457886 - DNA, 25 bp, Rattus norvegicus
gggcttcttgaaactctatttccaa

SEQ ID NO: 457887 - DNA, 25 bp, Rattus norvegicus
gggcttcttgaatctctatttccaa

SEQ ID NO: 457888 - DNA, 25 bp, Rattus norvegicus
gggcttcttgcaaggaaatgctcaa

SEQ ID NO: 457889 - DNA, 25 bp, Rattus norvegicus
gggcttcttgcatggaaatgctcaa

SEQ ID NO: 457890 - DNA, 25 bp, Rattus norvegicus
gggcttcttggaacgctgtcatacc

SEQ ID NO: 457891 - DNA, 25 bp, Rattus norvegicus
gggcttcttggatcgctgtcatacc

SEQ ID NO: 457892 - DNA, 25 bp, Rattus norvegicus
gggcttcttggcactcagctaattt

SEQ ID NO: 457893 - DNA, 25 bp, Rattus norvegicus
gggcttcttggctctcagctaattt

SEQ ID NO: 457894 - DNA, 25 bp, Rattus norvegicus
gggcttctttccaagtatgtgatgg

SEQ ID NO: 457895 - DNA, 25 bp, Rattus norvegicus
gggcttctttccattcagaaattgg

SEQ ID NO: 457896 - DNA, 25 bp, Rattus norvegicus
gggcttctttcctagtatgtgatgg

SEQ ID NO: 457897 - DNA, 25 bp, Rattus norvegicus
gggcttctttcctttcagaaattgg

SEQ ID NO: 457898 - DNA, 25 bp, Rattus norvegicus
gggcttctttctccggaaaatgttg

SEQ ID NO: 457899 - DNA, 25 bp, Rattus norvegicus
gggcttctttctgcggaaaatgttg

SEQ ID NO: 457900 - DNA, 25 bp, Rattus norvegicus
gggcttgaatacctcatggtgtgtt

SEQ ID NO: 457901 - DNA, 25 bp, Rattus norvegicus
gggcttgaatacgtcatggtgtgtt

SEQ ID NO: 457902 - DNA, 25 bp, Rattus norvegicus
gggcttgaccatcacagtcaggttt

SEQ ID NO: 457903 - DNA, 25 bp, Rattus norvegicus
gggcttgaccatgacagtcaggttt

SEQ ID NO: 457904 - DNA, 25 bp, Rattus norvegicus
gggcttgacccaacatcagataggc

SEQ ID NO: 457905 - DNA, 25 bp, Rattus norvegicus
gggcttgacccatcatcagataggc

SEQ ID NO: 457906 - DNA, 25 bp, Rattus norvegicus
gggcttgactcaatctcctgtgtga

SEQ ID NO: 457907 - DNA, 25 bp, Rattus norvegicus
gggcttgactcattctcctgtgtga

SEQ ID NO: 457908 - DNA, 25 bp, Rattus norvegicus
gggcttgagcacagggatgattcat

SEQ ID NO: 457909 - DNA, 25 bp, Rattus norvegicus
gggcttgagcactgggatgattcat

SEQ ID NO: 457910 - DNA, 25 bp, Rattus norvegicus
gggcttgagccccagaacattcctg

SEQ ID NO: 457911 - DNA, 25 bp, Rattus norvegicus
gggcttgagcccgagaacattcctg

SEQ ID NO: 457912 - DNA, 25 bp, Rattus norvegicus
gggcttgagcctaggagccctcaaa

SEQ ID NO: 457913 - DNA, 25 bp, Rattus norvegicus
gggcttgagccttggagccctcaaa

SEQ ID NO: 457914 - DNA, 25 bp, Rattus norvegicus
gggcttgatggtccattctagtaga

SEQ ID NO: 457915 - DNA, 25 bp, Rattus norvegicus
gggcttgatggtgcattctagtaga

SEQ ID NO: 457916 - DNA, 25 bp, Rattus norvegicus
gggcttgattgtatgtctgttgttt

SEQ ID NO: 457917 - DNA, 25 bp, Rattus norvegicus
gggcttgattgtttgtctgttgttt

SEQ ID NO: 457918 - DNA, 25 bp, Rattus norvegicus
gggcttgcaatgagtgggctccacc

SEQ ID NO: 457919 - DNA, 25 bp, Rattus norvegicus
gggcttgcaatgtgtgggctccacc

SEQ ID NO: 457920 - DNA, 25 bp, Rattus norvegicus
gggcttgcatgtaccatccaagtgc

SEQ ID NO: 457921 - DNA, 25 bp, Rattus norvegicus
gggcttgcatgttccatccaagtgc

SEQ ID NO: 457922 - DNA, 25 bp, Rattus norvegicus
gggcttgccaaaaacttcttgtgga

SEQ ID NO: 457923 - DNA, 25 bp, Rattus norvegicus
gggcttgccaaatacttcttgtgga

SEQ ID NO: 457924 - DNA, 25 bp, Rattus norvegicus
gggcttgccaacagcactatcatgg

SEQ ID NO: 457925 - DNA, 25 bp, Rattus norvegicus
gggcttgccaactgcactatcatgg

SEQ ID NO: 457926 - DNA, 25 bp, Rattus norvegicus
gggcttgcctaccataaaataactt

SEQ ID NO: 457927 - DNA, 25 bp, Rattus norvegicus
gggcttgcctacgataaaataactt

SEQ ID NO: 457928 - DNA, 25 bp, Rattus norvegicus
gggcttgcctatcatccactgtgac

SEQ ID NO: 457929 - DNA, 25 bp, Rattus norvegicus
gggcttgcctatgatccactgtgac

SEQ ID NO: 457930 - DNA, 25 bp, Rattus norvegicus
gggcttgccttaattcagtagtttc

SEQ ID NO: 457931 - DNA, 25 bp, Rattus norvegicus
gggcttgccttatttcagtagtttc

SEQ ID NO: 457932 - DNA, 25 bp, Rattus norvegicus
gggcttgcgtgactgttctttaaaa

SEQ ID NO: 457933 - DNA, 25 bp, Rattus norvegicus
gggcttgcgtgagtgttctttaaaa

SEQ ID NO: 457934 - DNA, 25 bp, Rattus norvegicus
gggcttgctacacccgagagcagat

SEQ ID NO: 457935 - DNA, 25 bp, Rattus norvegicus
gggcttgctacagccgagagcagat

SEQ ID NO: 457936 - DNA, 25 bp, Rattus norvegicus
gggcttgctactcttcatactagga

SEQ ID NO: 457937 - DNA, 25 bp, Rattus norvegicus
gggcttgctactgttcatactagga

SEQ ID NO: 457938 - DNA, 25 bp, Rattus norvegicus
gggcttgctcttctagattgcattc

SEQ ID NO: 457939 - DNA, 25 bp, Rattus norvegicus
gggcttgctcttgtagattgcattc

SEQ ID NO: 457940 - DNA, 25 bp, Rattus norvegicus
gggcttgctgtgatatatccatgat

SEQ ID NO: 457941 - DNA, 25 bp, Rattus norvegicus
gggcttgctgtgttatatccatgat

SEQ ID NO: 457942 - DNA, 25 bp, Rattus norvegicus
gggcttgcttcacgctgtacagcac

SEQ ID NO: 457943 - DNA, 25 bp, Rattus norvegicus
gggcttgcttcaggctgtacagcac

SEQ ID NO: 457944 - DNA, 25 bp, Rattus norvegicus
gggcttgcttgcatgttcctgaaac

SEQ ID NO: 457945 - DNA, 25 bp, Rattus norvegicus
gggcttgcttgcttgttcctgaaac

SEQ ID NO: 457946 - DNA, 25 bp, Rattus norvegicus
gggcttgctttcagaggatacctgc

SEQ ID NO: 457947 - DNA, 25 bp, Rattus norvegicus
gggcttgctttctgaggatacctgc

SEQ ID NO: 457948 - DNA, 25 bp, Rattus norvegicus
gggcttggacatctgtgcagtcaaa

SEQ ID NO: 457949 - DNA, 25 bp, Rattus norvegicus
gggcttggacatgtgtgcagtcaaa

SEQ ID NO: 457950 - DNA, 25 bp, Rattus norvegicus
gggcttggaccaaggtcaccctgtt

SEQ ID NO: 457951 - DNA, 25 bp, Rattus norvegicus
gggcttggaccatggtcaccctgtt

SEQ ID NO: 457952 - DNA, 25 bp, Rattus norvegicus
gggcttggactaatactgcttgtac

SEQ ID NO: 457953 - DNA, 25 bp, Rattus norvegicus
gggcttggactattactgcttgtac

SEQ ID NO: 457954 - DNA, 25 bp, Rattus norvegicus
gggcttggcaccaacgcagaagccg

SEQ ID NO: 457955 - DNA, 25 bp, Rattus norvegicus
gggcttggcacctacgcagaagccg

SEQ ID NO: 457956 - DNA, 25 bp, Rattus norvegicus
gggcttggcattatgactctggaag

SEQ ID NO: 457957 - DNA, 25 bp, Rattus norvegicus
gggcttggcattttgactctggaag

SEQ ID NO: 457958 - DNA, 25 bp, Rattus norvegicus
gggcttggccttcttatgtcataat

SEQ ID NO: 457959 - DNA, 25 bp, Rattus norvegicus
gggcttggccttgttatgtcataat

SEQ ID NO: 457960 - DNA, 25 bp, Rattus norvegicus
gggcttggctgacatttacatcttc

SEQ ID NO: 457961 - DNA, 25 bp, Rattus norvegicus
gggcttggctgagatttacatcttc

SEQ ID NO: 457962 - DNA, 25 bp, Rattus norvegicus
gggcttggctggcttagcactaaca

SEQ ID NO: 457963 - DNA, 25 bp, Rattus norvegicus
gggcttggctgggttagcactaaca

SEQ ID NO: 457964 - DNA, 25 bp, Rattus norvegicus
gggcttgggaccagtgcctacctga

SEQ ID NO: 457965 - DNA, 25 bp, Rattus norvegicus
gggcttgggacctgtgcctacctga

SEQ ID NO: 457966 - DNA, 25 bp, Rattus norvegicus
gggcttgggagcatccaggtcatct

SEQ ID NO: 457967 - DNA, 25 bp, Rattus norvegicus
gggcttgggagcttccaggtcatct

SEQ ID NO: 457968 - DNA, 25 bp, Rattus norvegicus
gggcttgggcagaaccttggatcaa

SEQ ID NO: 457969 - DNA, 25 bp, Rattus norvegicus
gggcttgggcagtaccttggatcaa

SEQ ID NO: 457970 - DNA, 25 bp, Rattus norvegicus
gggcttggttcaatattactgatct

SEQ ID NO: 457971 - DNA, 25 bp, Rattus norvegicus
gggcttggttcattattactgatct

SEQ ID NO: 457972 - DNA, 25 bp, Rattus norvegicus
gggcttgtacatctgcagtcagtgc

SEQ ID NO: 457973 - DNA, 25 bp, Rattus norvegicus
gggcttgtacatgtgcagtcagtgc

SEQ ID NO: 457974 - DNA, 25 bp, Rattus norvegicus
gggcttgtaccccagtcatggacat

SEQ ID NO: 457975 - DNA, 25 bp, Rattus norvegicus
gggcttgtacccgagtcatggacat

SEQ ID NO: 457976 - DNA, 25 bp, Rattus norvegicus
gggcttgtagccaaatctgacagca

SEQ ID NO: 457977 - DNA, 25 bp, Rattus norvegicus
gggcttgtagcctaatctgacagca

SEQ ID NO: 457978 - DNA, 25 bp, Rattus norvegicus
gggcttgtcacacaactcattcaaa

SEQ ID NO: 457979 - DNA, 25 bp, Rattus norvegicus
gggcttgtcacagaactcattcaaa

SEQ ID NO: 457980 - DNA, 25 bp, Rattus norvegicus
gggcttgtcattaagacaggttacc

SEQ ID NO: 457981 - DNA, 25 bp, Rattus norvegicus
gggcttgtcatttagacaggttacc

SEQ ID NO: 457982 - DNA, 25 bp, Rattus norvegicus
gggcttgtcccacacgaaacaggat

SEQ ID NO: 457983 - DNA, 25 bp, Rattus norvegicus
gggcttgtcccagacgaaacaggat

SEQ ID NO: 457984 - DNA, 25 bp, Rattus norvegicus
gggcttgtccccaggtttgctgtac

SEQ ID NO: 457985 - DNA, 25 bp, Rattus norvegicus
gggcttgtcccctggtttgctgtac

SEQ ID NO: 457986 - DNA, 25 bp, Rattus norvegicus
gggcttgtctcaatatagaggcaca

SEQ ID NO: 457987 - DNA, 25 bp, Rattus norvegicus
gggcttgtctcattatagaggcaca

SEQ ID NO: 457988 - DNA, 25 bp, Rattus norvegicus
gggcttgtgacacgcatttgatttg

SEQ ID NO: 457989 - DNA, 25 bp, Rattus norvegicus
gggcttgtgacaggcatttgatttg

SEQ ID NO: 457990 - DNA, 25 bp, Rattus norvegicus
gggcttgtggtgacaggtctctata

SEQ ID NO: 457991 - DNA, 25 bp, Rattus norvegicus
gggcttgtggtgtcaggtctctata

SEQ ID NO: 457992 - DNA, 25 bp, Rattus norvegicus
gggcttgtgtctagctaagagcact

SEQ ID NO: 457993 - DNA, 25 bp, Rattus norvegicus
gggcttgtgtcttgctaagagcact

SEQ ID NO: 457994 - DNA, 25 bp, Rattus norvegicus
gggcttgtgtgcattccgagagaat

SEQ ID NO: 457995 - DNA, 25 bp, Rattus norvegicus
gggcttgtgtgctttccgagagaat

SEQ ID NO: 457996 - DNA, 25 bp, Rattus norvegicus
gggcttgtgttcatcgggcaacaca

SEQ ID NO: 457997 - DNA, 25 bp, Rattus norvegicus
gggcttgtgttcttcgggcaacaca

SEQ ID NO: 457998 - DNA, 25 bp, Rattus norvegicus
gggcttgttcacactctcgtcttgg

SEQ ID NO: 457999 - DNA, 25 bp, Rattus norvegicus
gggcttgttcactctctcgtcttgg

SEQ ID NO: 458000 - DNA, 25 bp, Rattus norvegicus
gggcttgttgaaccctaagcacaaa

SEQ ID NO: 458001 - DNA, 25 bp, Rattus norvegicus
gggcttgttgaagcctaagcacaaa

SEQ ID NO: 458002 - DNA, 25 bp, Rattus norvegicus
gggcttgttgctatatccatatatg

SEQ ID NO: 458003 - DNA, 25 bp, Rattus norvegicus
gggcttgttgctttatccatatatg

SEQ ID NO: 458004 - DNA, 25 bp, Rattus norvegicus
gggcttgttggcagactaccagata

SEQ ID NO: 458005 - DNA, 25 bp, Rattus norvegicus
gggcttgttggctgactaccagata

SEQ ID NO: 458006 - DNA, 25 bp, Rattus norvegicus
gggcttgttgtaccagagaaccctt

SEQ ID NO: 458007 - DNA, 25 bp, Rattus norvegicus
gggcttgttgtagcagagaaccctt

SEQ ID NO: 458008 - DNA, 25 bp, Rattus norvegicus
gggcttgttgtgatacttgtcagat

SEQ ID NO: 458009 - DNA, 25 bp, Rattus norvegicus
gggcttgttgtgttacttgtcagat

SEQ ID NO: 458010 - DNA, 25 bp, Rattus norvegicus
gggcttgtttcacatctatagtcct

SEQ ID NO: 458011 - DNA, 25 bp, Rattus norvegicus
gggcttgtttcagatctatagtcct

SEQ ID NO: 458012 - DNA, 25 bp, Rattus norvegicus
gggctttaacccagtacaatgccac

SEQ ID NO: 458013 - DNA, 25 bp, Rattus norvegicus
gggctttaaccctgtacaatgccac

SEQ ID NO: 458014 - DNA, 25 bp, Rattus norvegicus
gggctttaatgccagtccttagata

SEQ ID NO: 458015 - DNA, 25 bp, Rattus norvegicus
gggctttaatgcgagtccttagata

SEQ ID NO: 458016 - DNA, 25 bp, Rattus norvegicus
gggctttaattccaagacctgacac

SEQ ID NO: 458017 - DNA, 25 bp, Rattus norvegicus
gggctttaattcgaagacctgacac

SEQ ID NO: 458018 - DNA, 25 bp, Rattus norvegicus
gggctttacagactccaggcagcag

SEQ ID NO: 458019 - DNA, 25 bp, Rattus norvegicus
gggctttacagagtccaggcagcag

SEQ ID NO: 458020 - DNA, 25 bp, Rattus norvegicus
gggctttacgccactgctttgaagc

SEQ ID NO: 458021 - DNA, 25 bp, Rattus norvegicus
gggctttacgcctctgctttgaagc

SEQ ID NO: 458022 - DNA, 25 bp, Rattus norvegicus
gggctttactcaatcatttcattta

SEQ ID NO: 458023 - DNA, 25 bp, Rattus norvegicus
gggctttactcattcatttcattta

SEQ ID NO: 458024 - DNA, 25 bp, Rattus norvegicus
gggctttacttgagacaggctgtca

SEQ ID NO: 458025 - DNA, 25 bp, Rattus norvegicus
gggctttacttgtgacaggctgtca

SEQ ID NO: 458026 - DNA, 25 bp, Rattus norvegicus
gggctttagtcaaataggaacctag

SEQ ID NO: 458027 - DNA, 25 bp, Rattus norvegicus
gggctttagtcactgatgtcttagt

SEQ ID NO: 458028 - DNA, 25 bp, Rattus norvegicus
gggctttagtcagtgatgtcttagt

SEQ ID NO: 458029 - DNA, 25 bp, Rattus norvegicus
gggctttagtcatataggaacctag

SEQ ID NO: 458030 - DNA, 25 bp, Rattus norvegicus
gggctttatcatccagacaactgtt

SEQ ID NO: 458031 - DNA, 25 bp, Rattus norvegicus
gggctttatcatgcagacaactgtt

SEQ ID NO: 458032 - DNA, 25 bp, Rattus norvegicus
gggctttatctaattttctaagtcg

SEQ ID NO: 458033 - DNA, 25 bp, Rattus norvegicus
gggctttatctatttttctaagtcg

SEQ ID NO: 458034 - DNA, 25 bp, Rattus norvegicus
gggctttatcttaagcaaccagttc

SEQ ID NO: 458035 - DNA, 25 bp, Rattus norvegicus
gggctttatctttagcaaccagttc

SEQ ID NO: 458036 - DNA, 25 bp, Rattus norvegicus
gggctttattcgcagactctgtcgg

SEQ ID NO: 458037 - DNA, 25 bp, Rattus norvegicus
gggctttattcggagactctgtcgg

SEQ ID NO: 458038 - DNA, 25 bp, Rattus norvegicus
gggctttattctaagagacgtgcat

SEQ ID NO: 458039 - DNA, 25 bp, Rattus norvegicus
gggctttattcttagagacgtgcat

SEQ ID NO: 458040 - DNA, 25 bp, Rattus norvegicus
gggctttcaaaaatactgccacttg

SEQ ID NO: 458041 - DNA, 25 bp, Rattus norvegicus
gggctttcaaaattactgccacttg

SEQ ID NO: 458042 - DNA, 25 bp, Rattus norvegicus
gggctttcacggataatgggattgt

SEQ ID NO: 458043 - DNA, 25 bp, Rattus norvegicus
gggctttcacggttaatgggattgt

SEQ ID NO: 458044 - DNA, 25 bp, Rattus norvegicus
gggctttcagatacctctaggtaca

SEQ ID NO: 458045 - DNA, 25 bp, Rattus norvegicus
gggctttcagattcctctaggtaca

SEQ ID NO: 458046 - DNA, 25 bp, Rattus norvegicus
gggctttcatctcagtaattctctt

SEQ ID NO: 458047 - DNA, 25 bp, Rattus norvegicus
gggctttcatctgagtaattctctt

SEQ ID NO: 458048 - DNA, 25 bp, Rattus norvegicus
gggctttcatgactcagtgcagtgt

SEQ ID NO: 458049 - DNA, 25 bp, Rattus norvegicus
gggctttcatgagtcagtgcagtgt

SEQ ID NO: 458050 - DNA, 25 bp, Rattus norvegicus
gggctttcatggactggagacatct

SEQ ID NO: 458051 - DNA, 25 bp, Rattus norvegicus
gggctttcatggtctggagacatct

SEQ ID NO: 458052 - DNA, 25 bp, Rattus norvegicus
gggctttccaaaataagtctgtcca

SEQ ID NO: 458053 - DNA, 25 bp, Rattus norvegicus
gggctttccaaattaagtctgtcca

SEQ ID NO: 458054 - DNA, 25 bp, Rattus norvegicus
gggctttccatacaacagattctaa

SEQ ID NO: 458055 - DNA, 25 bp, Rattus norvegicus
gggctttccatacatgcagtttgag

SEQ ID NO: 458056 - DNA, 25 bp, Rattus norvegicus
gggctttccatagaacagattctaa

SEQ ID NO: 458057 - DNA, 25 bp, Rattus norvegicus
gggctttccatagatgcagtttgag

SEQ ID NO: 458058 - DNA, 25 bp, Rattus norvegicus
gggctttcctcactgcagggtgata

SEQ ID NO: 458059 - DNA, 25 bp, Rattus norvegicus
gggctttcctcagtgcagggtgata

SEQ ID NO: 458060 - DNA, 25 bp, Rattus norvegicus
gggctttcgaccactgcagttatag

SEQ ID NO: 458061 - DNA, 25 bp, Rattus norvegicus
gggctttcgacctctgcagttatag

SEQ ID NO: 458062 - DNA, 25 bp, Rattus norvegicus
gggctttcgttactctctatagcag

SEQ ID NO: 458063 - DNA, 25 bp, Rattus norvegicus
gggctttcgttagtctctatagcag

SEQ ID NO: 458064 - DNA, 25 bp, Rattus norvegicus
gggctttctctaaatatttgcgctg

SEQ ID NO: 458065 - DNA, 25 bp, Rattus norvegicus
gggctttctctatatatttgcgctg

SEQ ID NO: 458066 - DNA, 25 bp, Rattus norvegicus
gggctttctgataaatacttgctgc

SEQ ID NO: 458067 - DNA, 25 bp, Rattus norvegicus
gggctttctgatcctctagaaacac

SEQ ID NO: 458068 - DNA, 25 bp, Rattus norvegicus
gggctttctgatgctctagaaacac

SEQ ID NO: 458069 - DNA, 25 bp, Rattus norvegicus
gggctttctgattaatacttgctgc

SEQ ID NO: 458070 - DNA, 25 bp, Rattus norvegicus
gggctttctgcacgtgtaacaccca

SEQ ID NO: 458071 - DNA, 25 bp, Rattus norvegicus
gggctttctgcaggtgtaacaccca

SEQ ID NO: 458072 - DNA, 25 bp, Rattus norvegicus
gggctttctgccaataatatcctag

SEQ ID NO: 458073 - DNA, 25 bp, Rattus norvegicus
gggctttctgcctataatatcctag

SEQ ID NO: 458074 - DNA, 25 bp, Rattus norvegicus
gggctttcttatatctgttttctca

SEQ ID NO: 458075 - DNA, 25 bp, Rattus norvegicus
gggctttcttatttctgttttctca

SEQ ID NO: 458076 - DNA, 25 bp, Rattus norvegicus
gggctttctttgatgatcctgtcac

SEQ ID NO: 458077 - DNA, 25 bp, Rattus norvegicus
gggctttctttgttgatcctgtcac

SEQ ID NO: 458078 - DNA, 25 bp, Rattus norvegicus
gggctttgaataccaaaggcctaca

SEQ ID NO: 458079 - DNA, 25 bp, Rattus norvegicus
gggctttgaatagcaaaggcctaca

SEQ ID NO: 458080 - DNA, 25 bp, Rattus norvegicus
gggctttgaggcacttgagaatctg

SEQ ID NO: 458081 - DNA, 25 bp, Rattus norvegicus
gggctttgaggcataaaccacttct

SEQ ID NO: 458082 - DNA, 25 bp, Rattus norvegicus
gggctttgaggccacatcaggtcaa

SEQ ID NO: 458083 - DNA, 25 bp, Rattus norvegicus
gggctttgaggcgacatcaggtcaa

SEQ ID NO: 458084 - DNA, 25 bp, Rattus norvegicus
gggctttgaggctcttgagaatctg

SEQ ID NO: 458085 - DNA, 25 bp, Rattus norvegicus
gggctttgaggcttaaaccacttct

SEQ ID NO: 458086 - DNA, 25 bp, Rattus norvegicus
gggctttgatttaaatcttaccttg

SEQ ID NO: 458087 - DNA, 25 bp, Rattus norvegicus
gggctttgattttaatcttaccttg

SEQ ID NO: 458088 - DNA, 25 bp, Rattus norvegicus
gggctttgcaacacaaactgttagt

SEQ ID NO: 458089 - DNA, 25 bp, Rattus norvegicus
gggctttgcaactcaaactgttagt

SEQ ID NO: 458090 - DNA, 25 bp, Rattus norvegicus
gggctttgcatgacattgctgatca

SEQ ID NO: 458091 - DNA, 25 bp, Rattus norvegicus
gggctttgcatgtcattgctgatca

SEQ ID NO: 458092 - DNA, 25 bp, Rattus norvegicus
gggctttgccaacaactggtatcta

SEQ ID NO: 458093 - DNA, 25 bp, Rattus norvegicus
gggctttgccaagaactggtatcta

SEQ ID NO: 458094 - DNA, 25 bp, Rattus norvegicus
gggctttgccagacaggaaaacaca

SEQ ID NO: 458095 - DNA, 25 bp, Rattus norvegicus
gggctttgccagtcaggaaaacaca

SEQ ID NO: 458096 - DNA, 25 bp, Rattus norvegicus
gggctttgccctagtcatggaagga

SEQ ID NO: 458097 - DNA, 25 bp, Rattus norvegicus
gggctttgcccttgtcatggaagga

SEQ ID NO: 458098 - DNA, 25 bp, Rattus norvegicus
gggctttgccgcatggaaagaccta

SEQ ID NO: 458099 - DNA, 25 bp, Rattus norvegicus
gggctttgccgcttggaaagaccta

SEQ ID NO: 458100 - DNA, 25 bp, Rattus norvegicus
gggctttgcctaagatccaagacag

SEQ ID NO: 458101 - DNA, 25 bp, Rattus norvegicus
gggctttgcctatgatccaagacag

SEQ ID NO: 458102 - DNA, 25 bp, Rattus norvegicus
gggctttgccttccccaaaacagac

SEQ ID NO: 458103 - DNA, 25 bp, Rattus norvegicus
gggctttgccttgcccaaaacagac

SEQ ID NO: 458104 - DNA, 25 bp, Rattus norvegicus
gggctttggctcatacatcagtgaa

SEQ ID NO: 458105 - DNA, 25 bp, Rattus norvegicus
gggctttggctcttacatcagtgaa

SEQ ID NO: 458106 - DNA, 25 bp, Rattus norvegicus
gggctttgggacatcagccataatg

SEQ ID NO: 458107 - DNA, 25 bp, Rattus norvegicus
gggctttgggacttcagccataatg

SEQ ID NO: 458108 - DNA, 25 bp, Rattus norvegicus
gggctttggttcagtccacatgagc

SEQ ID NO: 458109 - DNA, 25 bp, Rattus norvegicus
gggctttggttctgtccacatgagc

SEQ ID NO: 458110 - DNA, 25 bp, Rattus norvegicus
gggctttggtttctaccagcttcca

SEQ ID NO: 458111 - DNA, 25 bp, Rattus norvegicus
gggctttggtttgtaccagcttcca

SEQ ID NO: 458112 - DNA, 25 bp, Rattus norvegicus
gggctttgtatacctgtcctagact

SEQ ID NO: 458113 - DNA, 25 bp, Rattus norvegicus
gggctttgtatagctgtcctagact

SEQ ID NO: 458114 - DNA, 25 bp, Rattus norvegicus
gggctttgtggtcgctgtactctac

SEQ ID NO: 458115 - DNA, 25 bp, Rattus norvegicus
gggctttgtggtggctgtactctac

SEQ ID NO: 458116 - DNA, 25 bp, Rattus norvegicus
gggctttgtgtcagtggagacccac

SEQ ID NO: 458117 - DNA, 25 bp, Rattus norvegicus
gggctttgtgtctgtggagacccac

SEQ ID NO: 458118 - DNA, 25 bp, Rattus norvegicus
gggctttgttagcactgcgactgac

SEQ ID NO: 458119 - DNA, 25 bp, Rattus norvegicus
gggctttgttaggactgcgactgac

SEQ ID NO: 458120 - DNA, 25 bp, Rattus norvegicus
gggcttttacttatgtctgattcat

SEQ ID NO: 458121 - DNA, 25 bp, Rattus norvegicus
gggcttttacttttgtctgattcat

SEQ ID NO: 458122 - DNA, 25 bp, Rattus norvegicus
gggcttttagtcactgaatatgcat

SEQ ID NO: 458123 - DNA, 25 bp, Rattus norvegicus
gggcttttagtctctgaatatgcat

SEQ ID NO: 458124 - DNA, 25 bp, Rattus norvegicus
gggcttttattcacatggcttctat

SEQ ID NO: 458125 - DNA, 25 bp, Rattus norvegicus
gggcttttattctcatggcttctat

SEQ ID NO: 458126 - DNA, 25 bp, Rattus norvegicus
gggcttttcagaatctagatgctaa

SEQ ID NO: 458127 - DNA, 25 bp, Rattus norvegicus
gggcttttcagattctagatgctaa

SEQ ID NO: 458128 - DNA, 25 bp, Rattus norvegicus
gggcttttcagcagttaaatcctaa

SEQ ID NO: 458129 - DNA, 25 bp, Rattus norvegicus
gggcttttcagctgttaaatcctaa

SEQ ID NO: 458130 - DNA, 25 bp, Rattus norvegicus
gggcttttccagagtagttcttgct

SEQ ID NO: 458131 - DNA, 25 bp, Rattus norvegicus
gggcttttccagtgtagttcttgct

SEQ ID NO: 458132 - DNA, 25 bp, Rattus norvegicus
gggcttttccttagttgtgctgcag

SEQ ID NO: 458133 - DNA, 25 bp, Rattus norvegicus
gggcttttcctttgttgtgctgcag

SEQ ID NO: 458134 - DNA, 25 bp, Rattus norvegicus
gggcttttctcacagttgtcttaac

SEQ ID NO: 458135 - DNA, 25 bp, Rattus norvegicus
gggcttttctcagagttgtcttaac

SEQ ID NO: 458136 - DNA, 25 bp, Rattus norvegicus
gggcttttgacacttagtgacacac

SEQ ID NO: 458137 - DNA, 25 bp, Rattus norvegicus
gggcttttgacagttagtgacacac

SEQ ID NO: 458138 - DNA, 25 bp, Rattus norvegicus
gggcttttgactaatgctatgaaca

SEQ ID NO: 458139 - DNA, 25 bp, Rattus norvegicus
gggcttttgacttatgctatgaaca

SEQ ID NO: 458140 - DNA, 25 bp, Rattus norvegicus
gggcttttgagacttatgagactac

SEQ ID NO: 458141 - DNA, 25 bp, Rattus norvegicus
gggcttttgagagttatgagactac

SEQ ID NO: 458142 - DNA, 25 bp, Rattus norvegicus
gggcttttgaggctgaatgctactt

SEQ ID NO: 458143 - DNA, 25 bp, Rattus norvegicus
gggcttttgagggtgaatgctactt

SEQ ID NO: 458144 - DNA, 25 bp, Rattus norvegicus
gggcttttgtacaccattaatgctg

SEQ ID NO: 458145 - DNA, 25 bp, Rattus norvegicus
gggcttttgtactccattaatgctg

SEQ ID NO: 458146 - DNA, 25 bp, Rattus norvegicus
gggcttttgtcccttcagcctgcaa

SEQ ID NO: 458147 - DNA, 25 bp, Rattus norvegicus
gggcttttgtccgttcagcctgcaa

SEQ ID NO: 458148 - DNA, 25 bp, Rattus norvegicus
gggctttttaacctcacctgattgg

SEQ ID NO: 458149 - DNA, 25 bp, Rattus norvegicus
gggctttttaacgtcacctgattgg

SEQ ID NO: 458150 - DNA, 25 bp, Rattus norvegicus
gggctttttatcagccatctaatgg

SEQ ID NO: 458151 - DNA, 25 bp, Rattus norvegicus
gggctttttatctgccatctaatgg

SEQ ID NO: 458152 - DNA, 25 bp, Rattus norvegicus
gggctttttattatgcagcatgaca

SEQ ID NO: 458153 - DNA, 25 bp, Rattus norvegicus
gggctttttattttgcagcatgaca

SEQ ID NO: 458154 - DNA, 25 bp, Rattus norvegicus
gggctttttcacaaggcaccagaga

SEQ ID NO: 458155 - DNA, 25 bp, Rattus norvegicus
gggctttttcactaggcaccagaga

SEQ ID NO: 458156 - DNA, 25 bp, Rattus norvegicus
gggctttttcatcatgtttgcttag

SEQ ID NO: 458157 - DNA, 25 bp, Rattus norvegicus
gggctttttcatcttacatccatat

SEQ ID NO: 458158 - DNA, 25 bp, Rattus norvegicus
gggctttttcatgatgtttgcttag

SEQ ID NO: 458159 - DNA, 25 bp, Rattus norvegicus
gggctttttcatgttacatccatat

SEQ ID NO: 458160 - DNA, 25 bp, Rattus norvegicus
gggctttttcctcaagcctgggaga

SEQ ID NO: 458161 - DNA, 25 bp, Rattus norvegicus
gggctttttcctgaagcctgggaga

SEQ ID NO: 458162 - DNA, 25 bp, Rattus norvegicus
gggctttttgagaacctgttcttga

SEQ ID NO: 458163 - DNA, 25 bp, Rattus norvegicus
gggctttttgagtacctgttcttga

SEQ ID NO: 458164 - DNA, 25 bp, Rattus norvegicus
gggctttttgatctgtgtgtcctaa

SEQ ID NO: 458165 - DNA, 25 bp, Rattus norvegicus
gggctttttgatgtgtgtgtcctaa

SEQ ID NO: 458166 - DNA, 25 bp, Rattus norvegicus
gggctttttgtcagttgtatagtgg

SEQ ID NO: 458167 - DNA, 25 bp, Rattus norvegicus
gggctttttgtctgttgtatagtgg

SEQ ID NO: 458168 - DNA, 25 bp, Rattus norvegicus
ggggcactcccacaaagctcaaaaa

SEQ ID NO: 458169 - DNA, 25 bp, Rattus norvegicus
ggggcactcccagaaagctcaaaaa

SEQ ID NO: 458170 - DNA, 25 bp, Rattus norvegicus
ggggccctgctcagtgctaagacag

SEQ ID NO: 458171 - DNA, 25 bp, Rattus norvegicus
ggggccctgctctgtgctaagacag

SEQ ID NO: 458172 - DNA, 25 bp, Rattus norvegicus
gggggacctaggagactctgcctca

SEQ ID NO: 458173 - DNA, 25 bp, Rattus norvegicus
gggggacctaggtgactctgcctca

SEQ ID NO: 458174 - DNA, 25 bp, Rattus norvegicus
ggggtttattaactcctgtgccagc

SEQ ID NO: 458175 - DNA, 25 bp, Rattus norvegicus
ggggtttattaagtcctgtgccagc

SEQ ID NO: 458176 - DNA, 25 bp, Rattus norvegicus
gggtaaacaaccaatgggcccatgt

SEQ ID NO: 458177 - DNA, 25 bp, Rattus norvegicus
gggtaaacaacctatgggcccatgt

SEQ ID NO: 458178 - DNA, 25 bp, Rattus norvegicus
gggtaaaccaagactgatcttttgt

SEQ ID NO: 458179 - DNA, 25 bp, Rattus norvegicus
gggtaaaccaagtctgatcttttgt

SEQ ID NO: 458180 - DNA, 25 bp, Rattus norvegicus
gggtaaacccagcattagcctgtcc

SEQ ID NO: 458181 - DNA, 25 bp, Rattus norvegicus
gggtaaacccaggattagcctgtcc

SEQ ID NO: 458182 - DNA, 25 bp, Rattus norvegicus
gggtaaagacatcgcactctgacaa

SEQ ID NO: 458183 - DNA, 25 bp, Rattus norvegicus
gggtaaagacatggcactctgacaa

SEQ ID NO: 458184 - DNA, 25 bp, Rattus norvegicus
gggtaaagaccaaaagccacagcag

SEQ ID NO: 458185 - DNA, 25 bp, Rattus norvegicus
gggtaaagaccataagccacagcag

SEQ ID NO: 458186 - DNA, 25 bp, Rattus norvegicus
gggtaaagatggcagcctcccatgt

SEQ ID NO: 458187 - DNA, 25 bp, Rattus norvegicus
gggtaaagatgggagcctcccatgt

SEQ ID NO: 458188 - DNA, 25 bp, Rattus norvegicus
gggtaaagtctacatccagtgagag

SEQ ID NO: 458189 - DNA, 25 bp, Rattus norvegicus
gggtaaagtctagatccagtgagag

SEQ ID NO: 458190 - DNA, 25 bp, Rattus norvegicus
gggtaaagtggcacttgccttcatc

SEQ ID NO: 458191 - DNA, 25 bp, Rattus norvegicus
gggtaaagtggctcttgccttcatc

SEQ ID NO: 458192 - DNA, 25 bp, Rattus norvegicus
gggtaaagtgttctctctgcagact

SEQ ID NO: 458193 - DNA, 25 bp, Rattus norvegicus
gggtaaagtgttgtctctgcagact

SEQ ID NO: 458194 - DNA, 25 bp, Rattus norvegicus
gggtaaagttccattcttgctctat

SEQ ID NO: 458195 - DNA, 25 bp, Rattus norvegicus
gggtaaagttcctttcttgctctat

SEQ ID NO: 458196 - DNA, 25 bp, Rattus norvegicus
gggtaaatggctctcaggcctgcct

SEQ ID NO: 458197 - DNA, 25 bp, Rattus norvegicus
gggtaaatggctgtcaggcctgcct

SEQ ID NO: 458198 - DNA, 25 bp, Rattus norvegicus
gggtaaattcacagcccctcactgg

SEQ ID NO: 458199 - DNA, 25 bp, Rattus norvegicus
gggtaaattcactgcccctcactgg

SEQ ID NO: 458200 - DNA, 25 bp, Rattus norvegicus
gggtaacaaaccatggtctctcttc

SEQ ID NO: 458201 - DNA, 25 bp, Rattus norvegicus
gggtaacaaaccttggtctctcttc

SEQ ID NO: 458202 - DNA, 25 bp, Rattus norvegicus
gggtaacaacaaagtccgccttcca

SEQ ID NO: 458203 - DNA, 25 bp, Rattus norvegicus
gggtaacaacaatgtccgccttcca

SEQ ID NO: 458204 - DNA, 25 bp, Rattus norvegicus
gggtaacaacacaagccgcggtggc

SEQ ID NO: 458205 - DNA, 25 bp, Rattus norvegicus
gggtaacaacactagccgcggtggc

SEQ ID NO: 458206 - DNA, 25 bp, Rattus norvegicus
gggtaacaaccacggcagaacatcc

SEQ ID NO: 458207 - DNA, 25 bp, Rattus norvegicus
gggtaacaaccagggcagaacatcc

SEQ ID NO: 458208 - DNA, 25 bp, Rattus norvegicus
gggtaacacaatactataactgcag

SEQ ID NO: 458209 - DNA, 25 bp, Rattus norvegicus
gggtaacacaattctataactgcag

SEQ ID NO: 458210 - DNA, 25 bp, Rattus norvegicus
gggtaacagtatctctgggtccctg

SEQ ID NO: 458211 - DNA, 25 bp, Rattus norvegicus
gggtaacagtatgtctgggtccctg

SEQ ID NO: 458212 - DNA, 25 bp, Rattus norvegicus
gggtaacatcatattccgagcttgc

SEQ ID NO: 458213 - DNA, 25 bp, Rattus norvegicus
gggtaacatcattttccgagcttgc

SEQ ID NO: 458214 - DNA, 25 bp, Rattus norvegicus
gggtaacatcctagtgattctcttt

SEQ ID NO: 458215 - DNA, 25 bp, Rattus norvegicus
gggtaacatccttgtgattctcttt

SEQ ID NO: 458216 - DNA, 25 bp, Rattus norvegicus
gggtaacatctccatcagccttgta

SEQ ID NO: 458217 - DNA, 25 bp, Rattus norvegicus
gggtaacatctcgatcagccttgta

SEQ ID NO: 458218 - DNA, 25 bp, Rattus norvegicus
gggtaaccaatacctttctcagtat

SEQ ID NO: 458219 - DNA, 25 bp, Rattus norvegicus
gggtaaccaatagctttctcagtat

SEQ ID NO: 458220 - DNA, 25 bp, Rattus norvegicus
gggtaaccacctcaaacctgtaatg

SEQ ID NO: 458221 - DNA, 25 bp, Rattus norvegicus
gggtaaccacctgaaacctgtaatg

SEQ ID NO: 458222 - DNA, 25 bp, Rattus norvegicus
gggtaaccgagaccgtgctcaagct

SEQ ID NO: 458223 - DNA, 25 bp, Rattus norvegicus
gggtaaccgagagcgtgctcaagct

SEQ ID NO: 458224 - DNA, 25 bp, Rattus norvegicus
gggtaacctcacagacctggagacc

SEQ ID NO: 458225 - DNA, 25 bp, Rattus norvegicus
gggtaacctcactgacctggagacc

SEQ ID NO: 458226 - DNA, 25 bp, Rattus norvegicus
gggtaacctctcacaatagatttgt

SEQ ID NO: 458227 - DNA, 25 bp, Rattus norvegicus
gggtaacctctctcaatagatttgt

SEQ ID NO: 458228 - DNA, 25 bp, Rattus norvegicus
gggtaacctgacagggatcttttgt

SEQ ID NO: 458229 - DNA, 25 bp, Rattus norvegicus
gggtaacctgactgggatcttttgt

SEQ ID NO: 458230 - DNA, 25 bp, Rattus norvegicus
gggtaacctgcgactgtgttccaca

SEQ ID NO: 458231 - DNA, 25 bp, Rattus norvegicus
gggtaacctgcgtctgtgttccaca

SEQ ID NO: 458232 - DNA, 25 bp, Rattus norvegicus
gggtaacctgtcatgtcagtaaatt

SEQ ID NO: 458233 - DNA, 25 bp, Rattus norvegicus
gggtaacctgtcttgtcagtaaatt

SEQ ID NO: 458234 - DNA, 25 bp, Rattus norvegicus
gggtaactaagtcccctccttacag

SEQ ID NO: 458235 - DNA, 25 bp, Rattus norvegicus
gggtaactaagtgccctccttacag

SEQ ID NO: 458236 - DNA, 25 bp, Rattus norvegicus
gggtaactaatgattgtgttcactt

SEQ ID NO: 458237 - DNA, 25 bp, Rattus norvegicus
gggtaactaatgtttgtgttcactt

SEQ ID NO: 458238 - DNA, 25 bp, Rattus norvegicus
gggtaactactgagtgactcctaaa

SEQ ID NO: 458239 - DNA, 25 bp, Rattus norvegicus
gggtaactactgtgtgactcctaaa

SEQ ID NO: 458240 - DNA, 25 bp, Rattus norvegicus
gggtaactattactgcgcattttca

SEQ ID NO: 458241 - DNA, 25 bp, Rattus norvegicus
gggtaactattagtgcgcattttca

SEQ ID NO: 458242 - DNA, 25 bp, Rattus norvegicus
gggtaactggacaccaaggctggat

SEQ ID NO: 458243 - DNA, 25 bp, Rattus norvegicus
gggtaactggactccaaggctggat

SEQ ID NO: 458244 - DNA, 25 bp, Rattus norvegicus
gggtaacttactcgtcaactgcatt

SEQ ID NO: 458245 - DNA, 25 bp, Rattus norvegicus
gggtaacttactggtcaactgcatt

SEQ ID NO: 458246 - DNA, 25 bp, Rattus norvegicus
gggtaacttcacagccttaacatgt

SEQ ID NO: 458247 - DNA, 25 bp, Rattus norvegicus
gggtaacttcactgccttaacatgt

SEQ ID NO: 458248 - DNA, 25 bp, Rattus norvegicus
gggtaagaacttaccatctgtatgt

SEQ ID NO: 458249 - DNA, 25 bp, Rattus norvegicus
gggtaagaactttccatctgtatgt

SEQ ID NO: 458250 - DNA, 25 bp, Rattus norvegicus
gggtaagaagatccctacctgcttc

SEQ ID NO: 458251 - DNA, 25 bp, Rattus norvegicus
gggtaagaagatgcctacctgcttc

SEQ ID NO: 458252 - DNA, 25 bp, Rattus norvegicus
gggtaagacaacacttgcgaagaag

SEQ ID NO: 458253 - DNA, 25 bp, Rattus norvegicus
gggtaagacaactcttgcgaagaag

SEQ ID NO: 458254 - DNA, 25 bp, Rattus norvegicus
gggtaagactccattccagtccttc

SEQ ID NO: 458255 - DNA, 25 bp, Rattus norvegicus
gggtaagactcctttccagtccttc

SEQ ID NO: 458256 - DNA, 25 bp, Rattus norvegicus
gggtaagatcctcaccttcgaccag

SEQ ID NO: 458257 - DNA, 25 bp, Rattus norvegicus
gggtaagatcctgaccttcgaccag

SEQ ID NO: 458258 - DNA, 25 bp, Rattus norvegicus
gggtaagcaacaaacagccacatgt

SEQ ID NO: 458259 - DNA, 25 bp, Rattus norvegicus
gggtaagcaacatacagccacatgt

SEQ ID NO: 458260 - DNA, 25 bp, Rattus norvegicus
gggtaagcaatcagcccctgagcta

SEQ ID NO: 458261 - DNA, 25 bp, Rattus norvegicus
gggtaagcaatctgcccctgagcta

SEQ ID NO: 458262 - DNA, 25 bp, Rattus norvegicus
gggtaagccagtcctagcagtacag

SEQ ID NO: 458263 - DNA, 25 bp, Rattus norvegicus
gggtaagccagtgctagcagtacag

SEQ ID NO: 458264 - DNA, 25 bp, Rattus norvegicus
gggtaagccctaatgtctgagaaaa

SEQ ID NO: 458265 - DNA, 25 bp, Rattus norvegicus
gggtaagccctattgtctgagaaaa

SEQ ID NO: 458266 - DNA, 25 bp, Rattus norvegicus
gggtaagcgccaacaacttctcgac

SEQ ID NO: 458267 - DNA, 25 bp, Rattus norvegicus
gggtaagcgccatcaacttctcgac

SEQ ID NO: 458268 - DNA, 25 bp, Rattus norvegicus
gggtaagctcacaacatctcggaac

SEQ ID NO: 458269 - DNA, 25 bp, Rattus norvegicus
gggtaagctcactacatctcggaac

SEQ ID NO: 458270 - DNA, 25 bp, Rattus norvegicus
gggtaagctgagacttcgtgaacta

SEQ ID NO: 458271 - DNA, 25 bp, Rattus norvegicus
gggtaagctgagtcttcgtgaacta

SEQ ID NO: 458272 - DNA, 25 bp, Rattus norvegicus
gggtaagggcacagactcggttctc

SEQ ID NO: 458273 - DNA, 25 bp, Rattus norvegicus
gggtaagggcactgactcggttctc

SEQ ID NO: 458274 - DNA, 25 bp, Rattus norvegicus
gggtaagtacatctgtgcctgttca

SEQ ID NO: 458275 - DNA, 25 bp, Rattus norvegicus
gggtaagtacatgtgtgcctgttca

SEQ ID NO: 458276 - DNA, 25 bp, Rattus norvegicus
gggtaagtcctcactgtgatcagaa

SEQ ID NO: 458277 - DNA, 25 bp, Rattus norvegicus
gggtaagtcctctctgtgatcagaa

SEQ ID NO: 458278 - DNA, 25 bp, Rattus norvegicus
gggtaagttgggacacatatcctat

SEQ ID NO: 458279 - DNA, 25 bp, Rattus norvegicus
gggtaagttgggtcacatatcctat

SEQ ID NO: 458280 - DNA, 25 bp, Rattus norvegicus
gggtaataagatcagtaagcatgtt

SEQ ID NO: 458281 - DNA, 25 bp, Rattus norvegicus
gggtaataagatgagtaagcatgtt

SEQ ID NO: 458282 - DNA, 25 bp, Rattus norvegicus
gggtaataatcaacctgccaaatca

SEQ ID NO: 458283 - DNA, 25 bp, Rattus norvegicus
gggtaataatcatcctgccaaatca

SEQ ID NO: 458284 - DNA, 25 bp, Rattus norvegicus
gggtaataccagctgcaaccattga

SEQ ID NO: 458285 - DNA, 25 bp, Rattus norvegicus
gggtaataccaggtgcaaccattga

SEQ ID NO: 458286 - DNA, 25 bp, Rattus norvegicus
gggtaatacttaaaccttgccaagt

SEQ ID NO: 458287 - DNA, 25 bp, Rattus norvegicus
gggtaatacttataccttgccaagt

SEQ ID NO: 458288 - DNA, 25 bp, Rattus norvegicus
gggtaatatcttaccttaacttgtg

SEQ ID NO: 458289 - DNA, 25 bp, Rattus norvegicus
gggtaatatctttccttaacttgtg

SEQ ID NO: 458290 - DNA, 25 bp, Rattus norvegicus
gggtaatcccagatggtccaggcca

SEQ ID NO: 458291 - DNA, 25 bp, Rattus norvegicus
gggtaatcccagttggtccaggcca

SEQ ID NO: 458292 - DNA, 25 bp, Rattus norvegicus
gggtaatcgactaggagctagcagc

SEQ ID NO: 458293 - DNA, 25 bp, Rattus norvegicus
gggtaatcgacttggagctagcagc

SEQ ID NO: 458294 - DNA, 25 bp, Rattus norvegicus
gggtaatgagccctagcagctgacc

SEQ ID NO: 458295 - DNA, 25 bp, Rattus norvegicus
gggtaatgagccgtagcagctgacc

SEQ ID NO: 458296 - DNA, 25 bp, Rattus norvegicus
gggtaatgcttacattcgttcccgc

SEQ ID NO: 458297 - DNA, 25 bp, Rattus norvegicus
gggtaatgcttagattcgttcccgc

SEQ ID NO: 458298 - DNA, 25 bp, Rattus norvegicus
gggtaatgcttcacctttcaaaatg

SEQ ID NO: 458299 - DNA, 25 bp, Rattus norvegicus
gggtaatgcttctcctttcaaaatg

SEQ ID NO: 458300 - DNA, 25 bp, Rattus norvegicus
gggtaatggctcagcccatagaata

SEQ ID NO: 458301 - DNA, 25 bp, Rattus norvegicus
gggtaatggctctgcccatagaata

SEQ ID NO: 458302 - DNA, 25 bp, Rattus norvegicus
gggtaatgggacacgcacctgtcac

SEQ ID NO: 458303 - DNA, 25 bp, Rattus norvegicus
gggtaatgggactcgcacctgtcac

SEQ ID NO: 458304 - DNA, 25 bp, Rattus norvegicus
gggtaattacagcacaatttgtctt

SEQ ID NO: 458305 - DNA, 25 bp, Rattus norvegicus
gggtaattacaggacaatttgtctt

SEQ ID NO: 458306 - DNA, 25 bp, Rattus norvegicus
gggtaattcaagattttggcctaat

SEQ ID NO: 458307 - DNA, 25 bp, Rattus norvegicus
gggtaattcaagtttttggcctaat

SEQ ID NO: 458308 - DNA, 25 bp, Rattus norvegicus
gggtaattgcctacagatagcttct

SEQ ID NO: 458309 - DNA, 25 bp, Rattus norvegicus
gggtaattgccttcagatagcttct

SEQ ID NO: 458310 - DNA, 25 bp, Rattus norvegicus
gggtaattggtgaccatggctgcaa

SEQ ID NO: 458311 - DNA, 25 bp, Rattus norvegicus
gggtaattggtgtccatggctgcaa

SEQ ID NO: 458312 - DNA, 25 bp, Rattus norvegicus
gggtaatttttcacagctcctttag

SEQ ID NO: 458313 - DNA, 25 bp, Rattus norvegicus
gggtaatttttctcagctcctttag

SEQ ID NO: 458314 - DNA, 25 bp, Rattus norvegicus
gggtacaaacgtctacttcgcaaga

SEQ ID NO: 458315 - DNA, 25 bp, Rattus norvegicus
gggtacaaacgtgtacttcgcaaga

SEQ ID NO: 458316 - DNA, 25 bp, Rattus norvegicus
gggtacaaactaccctcaaaaacat

SEQ ID NO: 458317 - DNA, 25 bp, Rattus norvegicus
gggtacaaactagcctcaaaaacat

SEQ ID NO: 458318 - DNA, 25 bp, Rattus norvegicus
gggtacaaacttaattcttctcaga

SEQ ID NO: 458319 - DNA, 25 bp, Rattus norvegicus
gggtacaaactttattcttctcaga

SEQ ID NO: 458320 - DNA, 25 bp, Rattus norvegicus
gggtacaacaacaggacgcatcaaa

SEQ ID NO: 458321 - DNA, 25 bp, Rattus norvegicus
gggtacaacaactggacgcatcaaa

SEQ ID NO: 458322 - DNA, 25 bp, Rattus norvegicus
gggtacaataccaatcctgctggga

SEQ ID NO: 458323 - DNA, 25 bp, Rattus norvegicus
gggtacaatacctatcctgctggga

SEQ ID NO: 458324 - DNA, 25 bp, Rattus norvegicus
gggtacacacatatagactctgcta

SEQ ID NO: 458325 - DNA, 25 bp, Rattus norvegicus
gggtacacacatttagactctgcta

SEQ ID NO: 458326 - DNA, 25 bp, Rattus norvegicus
gggtacacatatattccctatattt

SEQ ID NO: 458327 - DNA, 25 bp, Rattus norvegicus
gggtacacatattttccctatattt

SEQ ID NO: 458328 - DNA, 25 bp, Rattus norvegicus
gggtacacatcacggacgccgatcc

SEQ ID NO: 458329 - DNA, 25 bp, Rattus norvegicus
gggtacacatcagggacgccgatcc

SEQ ID NO: 458330 - DNA, 25 bp, Rattus norvegicus
gggtacacgccccatgagaagctgc

SEQ ID NO: 458331 - DNA, 25 bp, Rattus norvegicus
gggtacacgcccgatgagaagctgc

SEQ ID NO: 458332 - DNA, 25 bp, Rattus norvegicus
gggtacactactctgcccagctggc

SEQ ID NO: 458333 - DNA, 25 bp, Rattus norvegicus
gggtacactactgtgcccagctggc

SEQ ID NO: 458334 - DNA, 25 bp, Rattus norvegicus
gggtacagacttcctaatgacaact

SEQ ID NO: 458335 - DNA, 25 bp, Rattus norvegicus
gggtacagacttgctaatgacaact

SEQ ID NO: 458336 - DNA, 25 bp, Rattus norvegicus
gggtacagcccaacttgaataagca

SEQ ID NO: 458337 - DNA, 25 bp, Rattus norvegicus
gggtacagcccatcttgaataagca

SEQ ID NO: 458338 - DNA, 25 bp, Rattus norvegicus
gggtacagcgatattgccagttgct

SEQ ID NO: 458339 - DNA, 25 bp, Rattus norvegicus
gggtacagcgattttgccagttgct

SEQ ID NO: 458340 - DNA, 25 bp, Rattus norvegicus
gggtacagcttaaaacacggacagt

SEQ ID NO: 458341 - DNA, 25 bp, Rattus norvegicus
gggtacagcttataacacggacagt

SEQ ID NO: 458342 - DNA, 25 bp, Rattus norvegicus
gggtacaggtatcctccactgcacc

SEQ ID NO: 458343 - DNA, 25 bp, Rattus norvegicus
gggtacaggtatgctccactgcacc

SEQ ID NO: 458344 - DNA, 25 bp, Rattus norvegicus
gggtacataacacacagtcctttgg

SEQ ID NO: 458345 - DNA, 25 bp, Rattus norvegicus
gggtacataacagacagtcctttgg

SEQ ID NO: 458346 - DNA, 25 bp, Rattus norvegicus
gggtacatatgtctataggcctgac

SEQ ID NO: 458347 - DNA, 25 bp, Rattus norvegicus
gggtacatatgtgtataggcctgac

SEQ ID NO: 458348 - DNA, 25 bp, Rattus norvegicus
gggtacatattactgaacttctctt

SEQ ID NO: 458349 - DNA, 25 bp, Rattus norvegicus
gggtacatattagtgaacttctctt

SEQ ID NO: 458350 - DNA, 25 bp, Rattus norvegicus
gggtacatcagaaactccgggcagt

SEQ ID NO: 458351 - DNA, 25 bp, Rattus norvegicus
gggtacatcagatactccgggcagt

SEQ ID NO: 458352 - DNA, 25 bp, Rattus norvegicus
gggtacatccagaggcctaagaaaa

SEQ ID NO: 458353 - DNA, 25 bp, Rattus norvegicus
gggtacatccagtggcctaagaaaa

SEQ ID NO: 458354 - DNA, 25 bp, Rattus norvegicus
gggtacatctgcacataaataagta

SEQ ID NO: 458355 - DNA, 25 bp, Rattus norvegicus
gggtacatctgctcataaataagta

SEQ ID NO: 458356 - DNA, 25 bp, Rattus norvegicus
gggtacatgaacactacggctcttc

SEQ ID NO: 458357 - DNA, 25 bp, Rattus norvegicus
gggtacatgaactctacggctcttc

SEQ ID NO: 458358 - DNA, 25 bp, Rattus norvegicus
gggtacatgcacactacagattcct

SEQ ID NO: 458359 - DNA, 25 bp, Rattus norvegicus
gggtacatgcactctacagattcct

SEQ ID NO: 458360 - DNA, 25 bp, Rattus norvegicus
gggtacattcacatctgttggttaa

SEQ ID NO: 458361 - DNA, 25 bp, Rattus norvegicus
gggtacattcacttctgttggttaa

SEQ ID NO: 458362 - DNA, 25 bp, Rattus norvegicus
gggtacattgagagttacagcagca

SEQ ID NO: 458363 - DNA, 25 bp, Rattus norvegicus
gggtacattgagtgttacagcagca

SEQ ID NO: 458364 - DNA, 25 bp, Rattus norvegicus
gggtacattttaacagatgactttg

SEQ ID NO: 458365 - DNA, 25 bp, Rattus norvegicus
gggtacattttatcagatgactttg

SEQ ID NO: 458366 - DNA, 25 bp, Rattus norvegicus
gggtaccaactgaaggtctttgcct

SEQ ID NO: 458367 - DNA, 25 bp, Rattus norvegicus
gggtaccaactgtaggtctttgcct

SEQ ID NO: 458368 - DNA, 25 bp, Rattus norvegicus
gggtaccacctcaatggattactgt

SEQ ID NO: 458369 - DNA, 25 bp, Rattus norvegicus
gggtaccacctctatggattactgt

SEQ ID NO: 458370 - DNA, 25 bp, Rattus norvegicus
gggtaccactatactgttcaattat

SEQ ID NO: 458371 - DNA, 25 bp, Rattus norvegicus
gggtaccactattctgttcaattat

SEQ ID NO: 458372 - DNA, 25 bp, Rattus norvegicus
gggtaccactttccagagctggtga

SEQ ID NO: 458373 - DNA, 25 bp, Rattus norvegicus
gggtaccactttgcagagctggtga

SEQ ID NO: 458374 - DNA, 25 bp, Rattus norvegicus
gggtaccaggagactattcttctag

SEQ ID NO: 458375 - DNA, 25 bp, Rattus norvegicus
gggtaccaggagtctattcttctag

SEQ ID NO: 458376 - DNA, 25 bp, Rattus norvegicus
gggtaccaggttcgtctggaactct

SEQ ID NO: 458377 - DNA, 25 bp, Rattus norvegicus
gggtaccaggttggtctggaactct

SEQ ID NO: 458378 - DNA, 25 bp, Rattus norvegicus
gggtaccataaacgagcatattctg

SEQ ID NO: 458379 - DNA, 25 bp, Rattus norvegicus
gggtaccataaaggagcatattctg

SEQ ID NO: 458380 - DNA, 25 bp, Rattus norvegicus
gggtaccatgacaagccagactgat

SEQ ID NO: 458381 - DNA, 25 bp, Rattus norvegicus
gggtaccatgactagccagactgat

SEQ ID NO: 458382 - DNA, 25 bp, Rattus norvegicus
gggtaccatggacctccgaactacc

SEQ ID NO: 458383 - DNA, 25 bp, Rattus norvegicus
gggtaccatggagctccgaactacc

SEQ ID NO: 458384 - DNA, 25 bp, Rattus norvegicus
gggtaccatggccatttccaaggat

SEQ ID NO: 458385 - DNA, 25 bp, Rattus norvegicus
gggtaccatggcgatttccaaggat

SEQ ID NO: 458386 - DNA, 25 bp, Rattus norvegicus
gggtacccaaagagctacacagcga

SEQ ID NO: 458387 - DNA, 25 bp, Rattus norvegicus
gggtacccaaagtgctacacagcga

SEQ ID NO: 458388 - DNA, 25 bp, Rattus norvegicus
gggtacccaatcaactttctgatta

SEQ ID NO: 458389 - DNA, 25 bp, Rattus norvegicus
gggtacccaatctactttctgatta

SEQ ID NO: 458390 - DNA, 25 bp, Rattus norvegicus
gggtacccatcaatgtcactttatg

SEQ ID NO: 458391 - DNA, 25 bp, Rattus norvegicus
gggtacccatcattgtcactttatg

SEQ ID NO: 458392 - DNA, 25 bp, Rattus norvegicus
gggtacccatgtctactattcagat

SEQ ID NO: 458393 - DNA, 25 bp, Rattus norvegicus
gggtacccatgtgtactattcagat

SEQ ID NO: 458394 - DNA, 25 bp, Rattus norvegicus
gggtaccccacgagttgctggacgt

SEQ ID NO: 458395 - DNA, 25 bp, Rattus norvegicus
gggtaccccacgtgttgctggacgt

SEQ ID NO: 458396 - DNA, 25 bp, Rattus norvegicus
gggtaccccataatacacgttggtg

SEQ ID NO: 458397 - DNA, 25 bp, Rattus norvegicus
gggtaccccatattacacgttggtg

SEQ ID NO: 458398 - DNA, 25 bp, Rattus norvegicus
gggtaccccatgactaaagccactg

SEQ ID NO: 458399 - DNA, 25 bp, Rattus norvegicus
gggtaccccatgtctaaagccactg

SEQ ID NO: 458400 - DNA, 25 bp, Rattus norvegicus
gggtaccccgggagaccatgtgact

SEQ ID NO: 458401 - DNA, 25 bp, Rattus norvegicus
gggtaccccgggtgaccatgtgact

SEQ ID NO: 458402 - DNA, 25 bp, Rattus norvegicus
gggtaccctattccagaaaacctgt

SEQ ID NO: 458403 - DNA, 25 bp, Rattus norvegicus
gggtaccctattgcagaaaacctgt

SEQ ID NO: 458404 - DNA, 25 bp, Rattus norvegicus
gggtaccctgtcaacatggtggact

SEQ ID NO: 458405 - DNA, 25 bp, Rattus norvegicus
gggtaccctgtctacatggtggact

SEQ ID NO: 458406 - DNA, 25 bp, Rattus norvegicus
gggtacccttgcactggctatgcac

SEQ ID NO: 458407 - DNA, 25 bp, Rattus norvegicus
gggtacccttgctctggctatgcac

SEQ ID NO: 458408 - DNA, 25 bp, Rattus norvegicus
gggtaccgagacagcgagcctcttc

SEQ ID NO: 458409 - DNA, 25 bp, Rattus norvegicus
gggtaccgagactgcgagcctcttc

SEQ ID NO: 458410 - DNA, 25 bp, Rattus norvegicus
gggtaccgggatcacaagctatatt

SEQ ID NO: 458411 - DNA, 25 bp, Rattus norvegicus
gggtaccgggatgacaagctatatt

SEQ ID NO: 458412 - DNA, 25 bp, Rattus norvegicus
gggtacctaaatccacacaaatcag

SEQ ID NO: 458413 - DNA, 25 bp, Rattus norvegicus
gggtacctaaatgcacacaaatcag

SEQ ID NO: 458414 - DNA, 25 bp, Rattus norvegicus
gggtacctacatacacaagcatata

SEQ ID NO: 458415 - DNA, 25 bp, Rattus norvegicus
gggtacctacattcacaagcatata

SEQ ID NO: 458416 - DNA, 25 bp, Rattus norvegicus
gggtacctaccaaacagagctatac

SEQ ID NO: 458417 - DNA, 25 bp, Rattus norvegicus
gggtacctaccatacagagctatac

SEQ ID NO: 458418 - DNA, 25 bp, Rattus norvegicus
gggtacctattaaccagcaggacat

SEQ ID NO: 458419 - DNA, 25 bp, Rattus norvegicus
gggtacctattatccagcaggacat

SEQ ID NO: 458420 - DNA, 25 bp, Rattus norvegicus
gggtacctcaaaaacttctgtcata

SEQ ID NO: 458421 - DNA, 25 bp, Rattus norvegicus
gggtacctcaaatacttctgtcata

SEQ ID NO: 458422 - DNA, 25 bp, Rattus norvegicus
gggtacctctatcacctgggagcat

SEQ ID NO: 458423 - DNA, 25 bp, Rattus norvegicus
gggtacctctatgacctgggagcat

SEQ ID NO: 458424 - DNA, 25 bp, Rattus norvegicus
gggtacctcttccagaaggcaagga

SEQ ID NO: 458425 - DNA, 25 bp, Rattus norvegicus
gggtacctcttcgagaaggcaagga

SEQ ID NO: 458426 - DNA, 25 bp, Rattus norvegicus
gggtacctgaaaatcctaagctcaa

SEQ ID NO: 458427 - DNA, 25 bp, Rattus norvegicus
gggtacctgaaattcctaagctcaa

SEQ ID NO: 458428 - DNA, 25 bp, Rattus norvegicus
gggtacctgatcatccatttaagtt

SEQ ID NO: 458429 - DNA, 25 bp, Rattus norvegicus
gggtacctgatcttccatttaagtt

SEQ ID NO: 458430 - DNA, 25 bp, Rattus norvegicus
gggtacctggaacaagctctgacta

SEQ ID NO: 458431 - DNA, 25 bp, Rattus norvegicus
gggtacctggaagaagctctgacta

SEQ ID NO: 458432 - DNA, 25 bp, Rattus norvegicus
gggtacctgggcaacgcaagtcctc

SEQ ID NO: 458433 - DNA, 25 bp, Rattus norvegicus
gggtacctgggctacgcaagtcctc

SEQ ID NO: 458434 - DNA, 25 bp, Rattus norvegicus
gggtacctttgacttcaataacaag

SEQ ID NO: 458435 - DNA, 25 bp, Rattus norvegicus
gggtacctttgagttcaataacaag

SEQ ID NO: 458436 - DNA, 25 bp, Rattus norvegicus
gggtacctttttccagaatgtgaca

SEQ ID NO: 458437 - DNA, 25 bp, Rattus norvegicus
gggtacctttttgcagaatgtgaca

SEQ ID NO: 458438 - DNA, 25 bp, Rattus norvegicus
gggtacgtgcagactcaggaactga

SEQ ID NO: 458439 - DNA, 25 bp, Rattus norvegicus
gggtacgtgcagtctcaggaactga

SEQ ID NO: 458440 - DNA, 25 bp, Rattus norvegicus
gggtacgtgcgtcaaacatacatct

SEQ ID NO: 458441 - DNA, 25 bp, Rattus norvegicus
gggtacgtgcgtgaaacatacatct

SEQ ID NO: 458442 - DNA, 25 bp, Rattus norvegicus
gggtacgttcaaagccaaggcctgc

SEQ ID NO: 458443 - DNA, 25 bp, Rattus norvegicus
gggtacgttcaatgccaaggcctgc

SEQ ID NO: 458444 - DNA, 25 bp, Rattus norvegicus
gggtacgttctcaaaccagggagct

SEQ ID NO: 458445 - DNA, 25 bp, Rattus norvegicus
gggtacgttctctaaccagggagct

SEQ ID NO: 458446 - DNA, 25 bp, Rattus norvegicus
gggtactagcttcctacttgtagaa

SEQ ID NO: 458447 - DNA, 25 bp, Rattus norvegicus
gggtactagcttgctacttgtagaa

SEQ ID NO: 458448 - DNA, 25 bp, Rattus norvegicus
gggtactaggtcaccaacctgtgga

SEQ ID NO: 458449 - DNA, 25 bp, Rattus norvegicus
gggtactaggtctccaacctgtgga

SEQ ID NO: 458450 - DNA, 25 bp, Rattus norvegicus
gggtactagtgtaaactgatttcta

SEQ ID NO: 458451 - DNA, 25 bp, Rattus norvegicus
gggtactagtgttaactgatttcta

SEQ ID NO: 458452 - DNA, 25 bp, Rattus norvegicus
gggtactataacagaatggcctaaa

SEQ ID NO: 458453 - DNA, 25 bp, Rattus norvegicus
gggtactataactgaatggcctaaa

SEQ ID NO: 458454 - DNA, 25 bp, Rattus norvegicus
gggtactatgctcacagactcccac

SEQ ID NO: 458455 - DNA, 25 bp, Rattus norvegicus
gggtactatgctgacagactcccac

SEQ ID NO: 458456 - DNA, 25 bp, Rattus norvegicus
gggtactcagaaagggcctctcaag

SEQ ID NO: 458457 - DNA, 25 bp, Rattus norvegicus
gggtactcagaatgggcctctcaag

SEQ ID NO: 458458 - DNA, 25 bp, Rattus norvegicus
gggtactcctgtaggtggctcctag

SEQ ID NO: 458459 - DNA, 25 bp, Rattus norvegicus
gggtactcctgttggtggctcctag

SEQ ID NO: 458460 - DNA, 25 bp, Rattus norvegicus
gggtactcgtttctagcctgcagag

SEQ ID NO: 458461 - DNA, 25 bp, Rattus norvegicus
gggtactcgtttgtagcctgcagag

SEQ ID NO: 458462 - DNA, 25 bp, Rattus norvegicus
gggtactctggcaacctggagacca

SEQ ID NO: 458463 - DNA, 25 bp, Rattus norvegicus
gggtactctggctacctggagacca

SEQ ID NO: 458464 - DNA, 25 bp, Rattus norvegicus
gggtactgacaaaccaaattcatgt

SEQ ID NO: 458465 - DNA, 25 bp, Rattus norvegicus
gggtactgacaatccaaattcatgt

SEQ ID NO: 458466 - DNA, 25 bp, Rattus norvegicus
gggtactgcagtctgaacctaggta

SEQ ID NO: 458467 - DNA, 25 bp, Rattus norvegicus
gggtactgcagtgtgaacctaggta

SEQ ID NO: 458468 - DNA, 25 bp, Rattus norvegicus
gggtactgccagagcagcactgcat

SEQ ID NO: 458469 - DNA, 25 bp, Rattus norvegicus
gggtactgccagtgcagcactgcat

SEQ ID NO: 458470 - DNA, 25 bp, Rattus norvegicus
gggtactgccatacctgtgtggtat

SEQ ID NO: 458471 - DNA, 25 bp, Rattus norvegicus
gggtactgccattcctgtgtggtat

SEQ ID NO: 458472 - DNA, 25 bp, Rattus norvegicus
gggtactggcatacatgacgtcttt

SEQ ID NO: 458473 - DNA, 25 bp, Rattus norvegicus
gggtactggcattcatgacgtcttt

SEQ ID NO: 458474 - DNA, 25 bp, Rattus norvegicus
gggtactgtcagcatcccacatagt

SEQ ID NO: 458475 - DNA, 25 bp, Rattus norvegicus
gggtactgtcaggatcccacatagt

SEQ ID NO: 458476 - DNA, 25 bp, Rattus norvegicus
gggtactgtggcagcctaggaacca

SEQ ID NO: 458477 - DNA, 25 bp, Rattus norvegicus
gggtactgtggctgcctaggaacca

SEQ ID NO: 458478 - DNA, 25 bp, Rattus norvegicus
gggtactgtttcatgcctgtaaccc

SEQ ID NO: 458479 - DNA, 25 bp, Rattus norvegicus
gggtactgtttcttgcctgtaaccc

SEQ ID NO: 458480 - DNA, 25 bp, Rattus norvegicus
gggtacttactgactccccagaggg

SEQ ID NO: 458481 - DNA, 25 bp, Rattus norvegicus
gggtacttactgtctccccagaggg

SEQ ID NO: 458482 - DNA, 25 bp, Rattus norvegicus
gggtacttgaggctgacttgcaaat

SEQ ID NO: 458483 - DNA, 25 bp, Rattus norvegicus
gggtacttgagggtgacttgcaaat

SEQ ID NO: 458484 - DNA, 25 bp, Rattus norvegicus
gggtacttggaaccacgggacactt

SEQ ID NO: 458485 - DNA, 25 bp, Rattus norvegicus
gggtacttggaagcacgggacactt

SEQ ID NO: 458486 - DNA, 25 bp, Rattus norvegicus
gggtacttggtcatgttcccagcat

SEQ ID NO: 458487 - DNA, 25 bp, Rattus norvegicus
gggtacttggtcttgttcccagcat

SEQ ID NO: 458488 - DNA, 25 bp, Rattus norvegicus
gggtactttgagaacatccccaagg

SEQ ID NO: 458489 - DNA, 25 bp, Rattus norvegicus
gggtactttgagtacatccccaagg

SEQ ID NO: 458490 - DNA, 25 bp, Rattus norvegicus
gggtactttgtacttcatctcaatg

SEQ ID NO: 458491 - DNA, 25 bp, Rattus norvegicus
gggtactttgtagttcatctcaatg

SEQ ID NO: 458492 - DNA, 25 bp, Rattus norvegicus
gggtacttttatcaatactgctcca

SEQ ID NO: 458493 - DNA, 25 bp, Rattus norvegicus
gggtacttttatgaatactgctcca

SEQ ID NO: 458494 - DNA, 25 bp, Rattus norvegicus
gggtacttttcaatctcttgatttt

SEQ ID NO: 458495 - DNA, 25 bp, Rattus norvegicus
gggtacttttcattctcttgatttt

SEQ ID NO: 458496 - DNA, 25 bp, Rattus norvegicus
gggtactttttactcagcacacctg

SEQ ID NO: 458497 - DNA, 25 bp, Rattus norvegicus
gggtactttttagtcagcacacctg

SEQ ID NO: 458498 - DNA, 25 bp, Rattus norvegicus
gggtagaaacgtagcatcccatttt

SEQ ID NO: 458499 - DNA, 25 bp, Rattus norvegicus
gggtagaaacgttgcatcccatttt

SEQ ID NO: 458500 - DNA, 25 bp, Rattus norvegicus
gggtagaaacttcctggtcctgctc

SEQ ID NO: 458501 - DNA, 25 bp, Rattus norvegicus
gggtagaaacttgctggtcctgctc

SEQ ID NO: 458502 - DNA, 25 bp, Rattus norvegicus
gggtagaaggctcagtccccaactt

SEQ ID NO: 458503 - DNA, 25 bp, Rattus norvegicus
gggtagaaggctgagtccccaactt

SEQ ID NO: 458504 - DNA, 25 bp, Rattus norvegicus
gggtagacagacattcggcagcttt

SEQ ID NO: 458505 - DNA, 25 bp, Rattus norvegicus
gggtagacagactttcggcagcttt

SEQ ID NO: 458506 - DNA, 25 bp, Rattus norvegicus
gggtagacagtcataacaacagaga

SEQ ID NO: 458507 - DNA, 25 bp, Rattus norvegicus
gggtagacagtcttaacaacagaga

SEQ ID NO: 458508 - DNA, 25 bp, Rattus norvegicus
gggtagaccacgagatagcttgata

SEQ ID NO: 458509 - DNA, 25 bp, Rattus norvegicus
gggtagaccacgtgatagcttgata

SEQ ID NO: 458510 - DNA, 25 bp, Rattus norvegicus
gggtagaccccgataatatatgcaa

SEQ ID NO: 458511 - DNA, 25 bp, Rattus norvegicus
gggtagaccccgttaatatatgcaa

SEQ ID NO: 458512 - DNA, 25 bp, Rattus norvegicus
gggtagacctaactttcctgcagct

SEQ ID NO: 458513 - DNA, 25 bp, Rattus norvegicus
gggtagacctaagtttcctgcagct

SEQ ID NO: 458514 - DNA, 25 bp, Rattus norvegicus
gggtagacctacattgggagtcaag

SEQ ID NO: 458515 - DNA, 25 bp, Rattus norvegicus
gggtagacctactttgggagtcaag

SEQ ID NO: 458516 - DNA, 25 bp, Rattus norvegicus
gggtagacctgcacccctgattctc

SEQ ID NO: 458517 - DNA, 25 bp, Rattus norvegicus
gggtagacctgctcccctgattctc

SEQ ID NO: 458518 - DNA, 25 bp, Rattus norvegicus
gggtagacttttaacaccttgatgt

SEQ ID NO: 458519 - DNA, 25 bp, Rattus norvegicus
gggtagacttttactaggtctcaca

SEQ ID NO: 458520 - DNA, 25 bp, Rattus norvegicus
gggtagactttttacaccttgatgt

SEQ ID NO: 458521 - DNA, 25 bp, Rattus norvegicus
gggtagactttttctaggtctcaca

SEQ ID NO: 458522 - DNA, 25 bp, Rattus norvegicus
gggtagagcgccaccgggaagggcg

SEQ ID NO: 458523 - DNA, 25 bp, Rattus norvegicus
gggtagagcgcctccgggaagggcg

SEQ ID NO: 458524 - DNA, 25 bp, Rattus norvegicus
gggtagagcgtaaggcttcgcccac

SEQ ID NO: 458525 - DNA, 25 bp, Rattus norvegicus
gggtagagcgtatggcttcgcccac

SEQ ID NO: 458526 - DNA, 25 bp, Rattus norvegicus
gggtagagctctaaattttgacatg

SEQ ID NO: 458527 - DNA, 25 bp, Rattus norvegicus
gggtagagctcttaattttgacatg

SEQ ID NO: 458528 - DNA, 25 bp, Rattus norvegicus
gggtagaggcatagacctgtgatcc

SEQ ID NO: 458529 - DNA, 25 bp, Rattus norvegicus
gggtagaggcattgacctgtgatcc

SEQ ID NO: 458530 - DNA, 25 bp, Rattus norvegicus
gggtagatacaaagtttctttgcta

SEQ ID NO: 458531 - DNA, 25 bp, Rattus norvegicus
gggtagatacaatgtttctttgcta

SEQ ID NO: 458532 - DNA, 25 bp, Rattus norvegicus
gggtagataggtatgcagcagcaat

SEQ ID NO: 458533 - DNA, 25 bp, Rattus norvegicus
gggtagataggtttgcagcagcaat

SEQ ID NO: 458534 - DNA, 25 bp, Rattus norvegicus
gggtagatatgaccttcgttgtatt

SEQ ID NO: 458535 - DNA, 25 bp, Rattus norvegicus
gggtagatatgagcttcgttgtatt

SEQ ID NO: 458536 - DNA, 25 bp, Rattus norvegicus
gggtagatgcaaatttcccaccagc

SEQ ID NO: 458537 - DNA, 25 bp, Rattus norvegicus
gggtagatgcaattttcccaccagc

SEQ ID NO: 458538 - DNA, 25 bp, Rattus norvegicus
gggtagcaaccaaagattccagtgt

SEQ ID NO: 458539 - DNA, 25 bp, Rattus norvegicus
gggtagcaaccatagattccagtgt

SEQ ID NO: 458540 - DNA, 25 bp, Rattus norvegicus
gggtagcaccaaacccctgaattgg

SEQ ID NO: 458541 - DNA, 25 bp, Rattus norvegicus
gggtagcaccaatcccctgaattgg

SEQ ID NO: 458542 - DNA, 25 bp, Rattus norvegicus
gggtagcaccctaaaagccagatcc

SEQ ID NO: 458543 - DNA, 25 bp, Rattus norvegicus
gggtagcacccttaaagccagatcc

SEQ ID NO: 458544 - DNA, 25 bp, Rattus norvegicus
gggtagcacctgataatcaaacaca

SEQ ID NO: 458545 - DNA, 25 bp, Rattus norvegicus
gggtagcacctgttaatcaaacaca

SEQ ID NO: 458546 - DNA, 25 bp, Rattus norvegicus
gggtagcactgcattgcattacttt

SEQ ID NO: 458547 - DNA, 25 bp, Rattus norvegicus
gggtagcactgctttgcattacttt

SEQ ID NO: 458548 - DNA, 25 bp, Rattus norvegicus
gggtagcatgtcacctagagcccct

SEQ ID NO: 458549 - DNA, 25 bp, Rattus norvegicus
gggtagcatgtctcctagagcccct

SEQ ID NO: 458550 - DNA, 25 bp, Rattus norvegicus
gggtagcattccaatttccaaagtc

SEQ ID NO: 458551 - DNA, 25 bp, Rattus norvegicus
gggtagcattcctatttccaaagtc

SEQ ID NO: 458552 - DNA, 25 bp, Rattus norvegicus
gggtagccaacaactctgaggagct

SEQ ID NO: 458553 - DNA, 25 bp, Rattus norvegicus
gggtagccaacatctctgaggagct

SEQ ID NO: 458554 - DNA, 25 bp, Rattus norvegicus
gggtagccctgacttgtagtccctc

SEQ ID NO: 458555 - DNA, 25 bp, Rattus norvegicus
gggtagccctgagttgtagtccctc

SEQ ID NO: 458556 - DNA, 25 bp, Rattus norvegicus
gggtagccctttcaagtggcctgaa

SEQ ID NO: 458557 - DNA, 25 bp, Rattus norvegicus
gggtagccctttctagagtgctcat

SEQ ID NO: 458558 - DNA, 25 bp, Rattus norvegicus
gggtagccctttgaagtggcctgaa

SEQ ID NO: 458559 - DNA, 25 bp, Rattus norvegicus
gggtagccctttgtagagtgctcat

SEQ ID NO: 458560 - DNA, 25 bp, Rattus norvegicus
gggtagcctcacatgtgattagcat

SEQ ID NO: 458561 - DNA, 25 bp, Rattus norvegicus
gggtagcctcacttgtgattagcat

SEQ ID NO: 458562 - DNA, 25 bp, Rattus norvegicus
gggtagcgcactagcaaaccaggta

SEQ ID NO: 458563 - DNA, 25 bp, Rattus norvegicus
gggtagcgcacttgcaaaccaggta

SEQ ID NO: 458564 - DNA, 25 bp, Rattus norvegicus
gggtagctagagctctcccaccagg

SEQ ID NO: 458565 - DNA, 25 bp, Rattus norvegicus
gggtagctagaggtctcccaccagg

SEQ ID NO: 458566 - DNA, 25 bp, Rattus norvegicus
gggtagctatgtccttttgcaagaa

SEQ ID NO: 458567 - DNA, 25 bp, Rattus norvegicus
gggtagctatgtgcttttgcaagaa

SEQ ID NO: 458568 - DNA, 25 bp, Rattus norvegicus
gggtagctattcaaccaataaactg

SEQ ID NO: 458569 - DNA, 25 bp, Rattus norvegicus
gggtagctattctaccaataaactg

SEQ ID NO: 458570 - DNA, 25 bp, Rattus norvegicus
gggtagctctatctattctgtgtaa

SEQ ID NO: 458571 - DNA, 25 bp, Rattus norvegicus
gggtagctctatgtattctgtgtaa

SEQ ID NO: 458572 - DNA, 25 bp, Rattus norvegicus
gggtagctctgactatccaaaaact

SEQ ID NO: 458573 - DNA, 25 bp, Rattus norvegicus
gggtagctctgagtatccaaaaact

SEQ ID NO: 458574 - DNA, 25 bp, Rattus norvegicus
gggtagctgggcaaaccatgactct

SEQ ID NO: 458575 - DNA, 25 bp, Rattus norvegicus
gggtagctgggctaaccatgactct

SEQ ID NO: 458576 - DNA, 25 bp, Rattus norvegicus
gggtagcttagaactgtagctgctg

SEQ ID NO: 458577 - DNA, 25 bp, Rattus norvegicus
gggtagcttagatctgtagctgctg

SEQ ID NO: 458578 - DNA, 25 bp, Rattus norvegicus
gggtaggaaacactgtctaaaatct

SEQ ID NO: 458579 - DNA, 25 bp, Rattus norvegicus
gggtaggaaacagtgtctaaaatct

SEQ ID NO: 458580 - DNA, 25 bp, Rattus norvegicus
gggtaggactgtaccaggacactgt

SEQ ID NO: 458581 - DNA, 25 bp, Rattus norvegicus
gggtaggactgttccaggacactgt

SEQ ID NO: 458582 - DNA, 25 bp, Rattus norvegicus
gggtaggaggtgacttccattccac

SEQ ID NO: 458583 - DNA, 25 bp, Rattus norvegicus
gggtaggaggtgtcttccattccac

SEQ ID NO: 458584 - DNA, 25 bp, Rattus norvegicus
gggtaggcaaatccgccctgaccgt

SEQ ID NO: 458585 - DNA, 25 bp, Rattus norvegicus
gggtaggcaaatgcgccctgaccgt

SEQ ID NO: 458586 - DNA, 25 bp, Rattus norvegicus
gggtaggcaagtcacagccgccata

SEQ ID NO: 458587 - DNA, 25 bp, Rattus norvegicus
gggtaggcaagtgacagccgccata

SEQ ID NO: 458588 - DNA, 25 bp, Rattus norvegicus
gggtaggcagctaccattaaggtcc

SEQ ID NO: 458589 - DNA, 25 bp, Rattus norvegicus
gggtaggcagcttccattaaggtcc

SEQ ID NO: 458590 - DNA, 25 bp, Rattus norvegicus
gggtaggcagttcttgtacacactt

SEQ ID NO: 458591 - DNA, 25 bp, Rattus norvegicus
gggtaggcagttgttgtacacactt

SEQ ID NO: 458592 - DNA, 25 bp, Rattus norvegicus
gggtaggcctcactgaagtcatgca

SEQ ID NO: 458593 - DNA, 25 bp, Rattus norvegicus
gggtaggcctcagtgaagtcatgca

SEQ ID NO: 458594 - DNA, 25 bp, Rattus norvegicus
gggtaggctgagaccccaccaccaa

SEQ ID NO: 458595 - DNA, 25 bp, Rattus norvegicus
gggtaggctgagtccccaccaccaa

SEQ ID NO: 458596 - DNA, 25 bp, Rattus norvegicus
gggtaggcttcaacttgtaactaat

SEQ ID NO: 458597 - DNA, 25 bp, Rattus norvegicus
gggtaggcttcatcttgtaactaat

SEQ ID NO: 458598 - DNA, 25 bp, Rattus norvegicus
gggtagggacctcagcaccacagcc

SEQ ID NO: 458599 - DNA, 25 bp, Rattus norvegicus
gggtagggacctgagcaccacagcc

SEQ ID NO: 458600 - DNA, 25 bp, Rattus norvegicus
gggtaggtaaccagtctgctgcgcc

SEQ ID NO: 458601 - DNA, 25 bp, Rattus norvegicus
gggtaggtaacctgtctgctgcgcc

SEQ ID NO: 458602 - DNA, 25 bp, Rattus norvegicus
gggtaggtatttcctttctagaact

SEQ ID NO: 458603 - DNA, 25 bp, Rattus norvegicus
gggtaggtatttgctttctagaact

SEQ ID NO: 458604 - DNA, 25 bp, Rattus norvegicus
gggtaggtcctgataacctctgtaa

SEQ ID NO: 458605 - DNA, 25 bp, Rattus norvegicus
gggtaggtcctgttaacctctgtaa

SEQ ID NO: 458606 - DNA, 25 bp, Rattus norvegicus
gggtaggtgatacagtgcttactta

SEQ ID NO: 458607 - DNA, 25 bp, Rattus norvegicus
gggtaggtgatagagtgcttactta

SEQ ID NO: 458608 - DNA, 25 bp, Rattus norvegicus
gggtaggttactcgttgtcatggaa

SEQ ID NO: 458609 - DNA, 25 bp, Rattus norvegicus
gggtaggttactggttgtcatggaa

SEQ ID NO: 458610 - DNA, 25 bp, Rattus norvegicus
gggtagtaaatacagccgcctgctc

SEQ ID NO: 458611 - DNA, 25 bp, Rattus norvegicus
gggtagtaaatagagccgcctgctc

SEQ ID NO: 458612 - DNA, 25 bp, Rattus norvegicus
gggtagtaccagaccttatcaatgc

SEQ ID NO: 458613 - DNA, 25 bp, Rattus norvegicus
gggtagtaccagtccttatcaatgc

SEQ ID NO: 458614 - DNA, 25 bp, Rattus norvegicus
gggtagtagccaaactcacaacttg

SEQ ID NO: 458615 - DNA, 25 bp, Rattus norvegicus
gggtagtagccatactcacaacttg

SEQ ID NO: 458616 - DNA, 25 bp, Rattus norvegicus
gggtagtctaggatagttacatggt

SEQ ID NO: 458617 - DNA, 25 bp, Rattus norvegicus
gggtagtctaggttagttacatggt

SEQ ID NO: 458618 - DNA, 25 bp, Rattus norvegicus
gggtagtctcagcactaggatgttt

SEQ ID NO: 458619 - DNA, 25 bp, Rattus norvegicus
gggtagtctcaggactaggatgttt

SEQ ID NO: 458620 - DNA, 25 bp, Rattus norvegicus
gggtagtctgggacaggccaatcac

SEQ ID NO: 458621 - DNA, 25 bp, Rattus norvegicus
gggtagtctgggtcaggccaatcac

SEQ ID NO: 458622 - DNA, 25 bp, Rattus norvegicus
gggtagtcttgtaccaccaccgtgg

SEQ ID NO: 458623 - DNA, 25 bp, Rattus norvegicus
gggtagtcttgttccaccaccgtgg

SEQ ID NO: 458624 - DNA, 25 bp, Rattus norvegicus
gggtagtgaggaacagtgcccttcc

SEQ ID NO: 458625 - DNA, 25 bp, Rattus norvegicus
gggtagtgaggatcagtgcccttcc

SEQ ID NO: 458626 - DNA, 25 bp, Rattus norvegicus
gggtagtgatttactcagtggcttc

SEQ ID NO: 458627 - DNA, 25 bp, Rattus norvegicus
gggtagtgattttctcagtggcttc

SEQ ID NO: 458628 - DNA, 25 bp, Rattus norvegicus
gggtagtggctaatctctcactaaa

SEQ ID NO: 458629 - DNA, 25 bp, Rattus norvegicus
gggtagtggctacaggaataaataa

SEQ ID NO: 458630 - DNA, 25 bp, Rattus norvegicus
gggtagtggctagaggaataaataa

SEQ ID NO: 458631 - DNA, 25 bp, Rattus norvegicus
gggtagtggctattctctcactaaa

SEQ ID NO: 458632 - DNA, 25 bp, Rattus norvegicus
gggtagtggtagatctctgcttttt

SEQ ID NO: 458633 - DNA, 25 bp, Rattus norvegicus
gggtagtggtagttctctgcttttt

SEQ ID NO: 458634 - DNA, 25 bp, Rattus norvegicus
gggtagtttagtagctctcatggat

SEQ ID NO: 458635 - DNA, 25 bp, Rattus norvegicus
gggtagtttagttgctctcatggat

SEQ ID NO: 458636 - DNA, 25 bp, Rattus norvegicus
gggtagtttgccctgacacctcagg

SEQ ID NO: 458637 - DNA, 25 bp, Rattus norvegicus
gggtagtttgccgtgacacctcagg

SEQ ID NO: 458638 - DNA, 25 bp, Rattus norvegicus
gggtagtttgttcatgtattgacat

SEQ ID NO: 458639 - DNA, 25 bp, Rattus norvegicus
gggtagtttgttgatgtattgacat

SEQ ID NO: 458640 - DNA, 25 bp, Rattus norvegicus
gggtataaacccctctccagaagct

SEQ ID NO: 458641 - DNA, 25 bp, Rattus norvegicus
gggtataaacccgtctccagaagct

SEQ ID NO: 458642 - DNA, 25 bp, Rattus norvegicus
gggtataaagtgaaaccatcagtta

SEQ ID NO: 458643 - DNA, 25 bp, Rattus norvegicus
gggtataaagtgtaaccatcagtta

SEQ ID NO: 458644 - DNA, 25 bp, Rattus norvegicus
gggtataaatgcatgcctatcagat

SEQ ID NO: 458645 - DNA, 25 bp, Rattus norvegicus
gggtataaatgcttgcctatcagat

SEQ ID NO: 458646 - DNA, 25 bp, Rattus norvegicus
gggtataaattcacaggccacctaa

SEQ ID NO: 458647 - DNA, 25 bp, Rattus norvegicus
gggtataaattctcaggccacctaa

SEQ ID NO: 458648 - DNA, 25 bp, Rattus norvegicus
gggtataaccgcaatgtgacagatt

SEQ ID NO: 458649 - DNA, 25 bp, Rattus norvegicus
gggtataaccgctatgtgacagatt

SEQ ID NO: 458650 - DNA, 25 bp, Rattus norvegicus
gggtataactaacaccaggatatca

SEQ ID NO: 458651 - DNA, 25 bp, Rattus norvegicus
gggtataactaagaccaggatatca

SEQ ID NO: 458652 - DNA, 25 bp, Rattus norvegicus
gggtataagggtcccaccaggcatc

SEQ ID NO: 458653 - DNA, 25 bp, Rattus norvegicus
gggtataagggtgccaccaggcatc

SEQ ID NO: 458654 - DNA, 25 bp, Rattus norvegicus
gggtataagtgccaatctctcaaga

SEQ ID NO: 458655 - DNA, 25 bp, Rattus norvegicus
gggtataagtgcgaatctctcaaga

SEQ ID NO: 458656 - DNA, 25 bp, Rattus norvegicus
gggtataatttcagcgtgggctaca

SEQ ID NO: 458657 - DNA, 25 bp, Rattus norvegicus
gggtataatttctgcgtgggctaca

SEQ ID NO: 458658 - DNA, 25 bp, Rattus norvegicus
gggtataattttctctgatcattga

SEQ ID NO: 458659 - DNA, 25 bp, Rattus norvegicus
gggtataattttgtctgatcattga

SEQ ID NO: 458660 - DNA, 25 bp, Rattus norvegicus
gggtatacaccacaatttcctctga

SEQ ID NO: 458661 - DNA, 25 bp, Rattus norvegicus
gggtatacaccagaatttcctctga

SEQ ID NO: 458662 - DNA, 25 bp, Rattus norvegicus
gggtatacactacccaatccgaggc

SEQ ID NO: 458663 - DNA, 25 bp, Rattus norvegicus
gggtatacactagccaatccgaggc

SEQ ID NO: 458664 - DNA, 25 bp, Rattus norvegicus
gggtatacactgactacatctacca

SEQ ID NO: 458665 - DNA, 25 bp, Rattus norvegicus
gggtatacactgtctacatctacca

SEQ ID NO: 458666 - DNA, 25 bp, Rattus norvegicus
gggtatacatgcaactgtccaacaa

SEQ ID NO: 458667 - DNA, 25 bp, Rattus norvegicus
gggtatacatgctactgtccaacaa

SEQ ID NO: 458668 - DNA, 25 bp, Rattus norvegicus
gggtatacccatctgttagcatttg

SEQ ID NO: 458669 - DNA, 25 bp, Rattus norvegicus
gggtatacccatgtgttagcatttg

SEQ ID NO: 458670 - DNA, 25 bp, Rattus norvegicus
gggtataccccactaaatcttacag

SEQ ID NO: 458671 - DNA, 25 bp, Rattus norvegicus
gggtataccccagtaaatcttacag

SEQ ID NO: 458672 - DNA, 25 bp, Rattus norvegicus
gggtatacctacctggcagggcacc

SEQ ID NO: 458673 - DNA, 25 bp, Rattus norvegicus
gggtatacctacgtggcagggcacc

SEQ ID NO: 458674 - DNA, 25 bp, Rattus norvegicus
gggtatacctccaatttagtccttg

SEQ ID NO: 458675 - DNA, 25 bp, Rattus norvegicus
gggtatacctcctatttagtccttg

SEQ ID NO: 458676 - DNA, 25 bp, Rattus norvegicus
gggtatactacccagcctgaaagat

SEQ ID NO: 458677 - DNA, 25 bp, Rattus norvegicus
gggtatactaccgagcctgaaagat

SEQ ID NO: 458678 - DNA, 25 bp, Rattus norvegicus
gggtatactggacactacagcatct

SEQ ID NO: 458679 - DNA, 25 bp, Rattus norvegicus
gggtatactggagactacagcatct

SEQ ID NO: 458680 - DNA, 25 bp, Rattus norvegicus
gggtatagacctacatactccatta

SEQ ID NO: 458681 - DNA, 25 bp, Rattus norvegicus
gggtatagaccttcatactccatta

SEQ ID NO: 458682 - DNA, 25 bp, Rattus norvegicus
gggtatagcaatccacacctgtgat

SEQ ID NO: 458683 - DNA, 25 bp, Rattus norvegicus
gggtatagcaatgcacacctgtgat

SEQ ID NO: 458684 - DNA, 25 bp, Rattus norvegicus
gggtatagcatacctgagaagttct

SEQ ID NO: 458685 - DNA, 25 bp, Rattus norvegicus
gggtatagcatagctgagaagttct

SEQ ID NO: 458686 - DNA, 25 bp, Rattus norvegicus
gggtatatgtgtattgtctgccaag

SEQ ID NO: 458687 - DNA, 25 bp, Rattus norvegicus
gggtatatgtgttttgtctgccaag

SEQ ID NO: 458688 - DNA, 25 bp, Rattus norvegicus
gggtatattcccaatcggccgagta

SEQ ID NO: 458689 - DNA, 25 bp, Rattus norvegicus
gggtatattccctatcggccgagta

SEQ ID NO: 458690 - DNA, 25 bp, Rattus norvegicus
gggtatcaacatcgccaacagcatt

SEQ ID NO: 458691 - DNA, 25 bp, Rattus norvegicus
gggtatcaacatggccaacagcatt

SEQ ID NO: 458692 - DNA, 25 bp, Rattus norvegicus
gggtatcaccttcgagacacctgca

SEQ ID NO: 458693 - DNA, 25 bp, Rattus norvegicus
gggtatcaccttggagacacctgca

SEQ ID NO: 458694 - DNA, 25 bp, Rattus norvegicus
gggtatcacgccatttactgccacg

SEQ ID NO: 458695 - DNA, 25 bp, Rattus norvegicus
gggtatcacgccttttactgccacg

SEQ ID NO: 458696 - DNA, 25 bp, Rattus norvegicus
gggtatcactcacaaatcgggagga

SEQ ID NO: 458697 - DNA, 25 bp, Rattus norvegicus
gggtatcactcagaaatcgggagga

SEQ ID NO: 458698 - DNA, 25 bp, Rattus norvegicus
gggtatcactgcacaggcccgggat

SEQ ID NO: 458699 - DNA, 25 bp, Rattus norvegicus
gggtatcactgctcaggcccgggat

SEQ ID NO: 458700 - DNA, 25 bp, Rattus norvegicus
gggtatcagcacctggaggtcttaa

SEQ ID NO: 458701 - DNA, 25 bp, Rattus norvegicus
gggtatcagcacgtggaggtcttaa

SEQ ID NO: 458702 - DNA, 25 bp, Rattus norvegicus
gggtatcagtaaattccccactcca

SEQ ID NO: 458703 - DNA, 25 bp, Rattus norvegicus
gggtatcagtaatttccccactcca

SEQ ID NO: 458704 - DNA, 25 bp, Rattus norvegicus
gggtatcagtgaccctctgagacta

SEQ ID NO: 458705 - DNA, 25 bp, Rattus norvegicus
gggtatcagtgagcctctgagacta

SEQ ID NO: 458706 - DNA, 25 bp, Rattus norvegicus
gggtatcataccattctcagaaaaa

SEQ ID NO: 458707 - DNA, 25 bp, Rattus norvegicus
gggtatcatacctttctcagaaaaa

SEQ ID NO: 458708 - DNA, 25 bp, Rattus norvegicus
gggtatcatagcacacatctataat

SEQ ID NO: 458709 - DNA, 25 bp, Rattus norvegicus
gggtatcatagctcacatctataat

SEQ ID NO: 458710 - DNA, 25 bp, Rattus norvegicus
gggtatcatcttacttgtgggaact

SEQ ID NO: 458711 - DNA, 25 bp, Rattus norvegicus
gggtatcatctttcttgtgggaact

SEQ ID NO: 458712 - DNA, 25 bp, Rattus norvegicus
gggtatcatggtaacagaattgact

SEQ ID NO: 458713 - DNA, 25 bp, Rattus norvegicus
gggtatcatggttacagaattgact

SEQ ID NO: 458714 - DNA, 25 bp, Rattus norvegicus
gggtatcatttaagtttctgtcata

SEQ ID NO: 458715 - DNA, 25 bp, Rattus norvegicus
gggtatcatttatgtttctgtcata

SEQ ID NO: 458716 - DNA, 25 bp, Rattus norvegicus
gggtatcatttcactaccttatgac

SEQ ID NO: 458717 - DNA, 25 bp, Rattus norvegicus
gggtatcatttctctaccttatgac

SEQ ID NO: 458718 - DNA, 25 bp, Rattus norvegicus
gggtatccaccacttggccatggga

SEQ ID NO: 458719 - DNA, 25 bp, Rattus norvegicus
gggtatccaccagttggccatggga

SEQ ID NO: 458720 - DNA, 25 bp, Rattus norvegicus
gggtatccagccattgcgttatctt

SEQ ID NO: 458721 - DNA, 25 bp, Rattus norvegicus
gggtatccagcctttgcgttatctt

SEQ ID NO: 458722 - DNA, 25 bp, Rattus norvegicus
gggtatccagttagtccagtgattg

SEQ ID NO: 458723 - DNA, 25 bp, Rattus norvegicus
gggtatccagtttgtccagtgattg

SEQ ID NO: 458724 - DNA, 25 bp, Rattus norvegicus
gggtatcccacacagctaacagcag

SEQ ID NO: 458725 - DNA, 25 bp, Rattus norvegicus
gggtatcccacagagctaacagcag

SEQ ID NO: 458726 - DNA, 25 bp, Rattus norvegicus
gggtatcccactagttccttgtgat

SEQ ID NO: 458727 - DNA, 25 bp, Rattus norvegicus
gggtatcccacttgttccttgtgat

SEQ ID NO: 458728 - DNA, 25 bp, Rattus norvegicus
gggtatcccagaaccggaagctaga

SEQ ID NO: 458729 - DNA, 25 bp, Rattus norvegicus
gggtatcccagatccggaagctaga

SEQ ID NO: 458730 - DNA, 25 bp, Rattus norvegicus
gggtatcccgatatgagcgctgccg

SEQ ID NO: 458731 - DNA, 25 bp, Rattus norvegicus
gggtatcccgatttgagcgctgccg

SEQ ID NO: 458732 - DNA, 25 bp, Rattus norvegicus
gggtatcccttgctgtgccttgcag

SEQ ID NO: 458733 - DNA, 25 bp, Rattus norvegicus
gggtatcccttggtgtgccttgcag

SEQ ID NO: 458734 - DNA, 25 bp, Rattus norvegicus
gggtatccgtgccagaatgtgccta

SEQ ID NO: 458735 - DNA, 25 bp, Rattus norvegicus
gggtatccgtgcgagaatgtgccta

SEQ ID NO: 458736 - DNA, 25 bp, Rattus norvegicus
gggtatcctgtgcaccaccatgaga

SEQ ID NO: 458737 - DNA, 25 bp, Rattus norvegicus
gggtatcctgtggaccaccatgaga

SEQ ID NO: 458738 - DNA, 25 bp, Rattus norvegicus
gggtatccttctacagaagccagcc

SEQ ID NO: 458739 - DNA, 25 bp, Rattus norvegicus
gggtatccttcttcagaagccagcc

SEQ ID NO: 458740 - DNA, 25 bp, Rattus norvegicus
gggtatcgaccgagtcaccatgttt

SEQ ID NO: 458741 - DNA, 25 bp, Rattus norvegicus
gggtatcgaccgtgtcaccatgttt

SEQ ID NO: 458742 - DNA, 25 bp, Rattus norvegicus
gggtatcggcttatccttagacttg

SEQ ID NO: 458743 - DNA, 25 bp, Rattus norvegicus
gggtatcggcttatgatttttcatt

SEQ ID NO: 458744 - DNA, 25 bp, Rattus norvegicus
gggtatcggcttttccttagacttg

SEQ ID NO: 458745 - DNA, 25 bp, Rattus norvegicus
gggtatcggcttttgatttttcatt

SEQ ID NO: 458746 - DNA, 25 bp, Rattus norvegicus
gggtatcgtaatcatttttgcctat

SEQ ID NO: 458747 - DNA, 25 bp, Rattus norvegicus
gggtatcgtaatgatttttgcctat

SEQ ID NO: 458748 - DNA, 25 bp, Rattus norvegicus
gggtatcgttttcgatcctgtcaca

SEQ ID NO: 458749 - DNA, 25 bp, Rattus norvegicus
gggtatcgttttggatcctgtcaca

SEQ ID NO: 458750 - DNA, 25 bp, Rattus norvegicus
gggtatctaagactgcttctgcaga

SEQ ID NO: 458751 - DNA, 25 bp, Rattus norvegicus
gggtatctaagagtgcttctgcaga

SEQ ID NO: 458752 - DNA, 25 bp, Rattus norvegicus
gggtatctagccagtccgtttagta

SEQ ID NO: 458753 - DNA, 25 bp, Rattus norvegicus
gggtatctagcctgtccgtttagta

SEQ ID NO: 458754 - DNA, 25 bp, Rattus norvegicus
gggtatctcgtgacattccggtatc

SEQ ID NO: 458755 - DNA, 25 bp, Rattus norvegicus
gggtatctcgtgtcattccggtatc

SEQ ID NO: 458756 - DNA, 25 bp, Rattus norvegicus
gggtatctctggagcttacagccaa

SEQ ID NO: 458757 - DNA, 25 bp, Rattus norvegicus
gggtatctctggtgcttacagccaa

SEQ ID NO: 458758 - DNA, 25 bp, Rattus norvegicus
gggtatctcttacgactatcttaac

SEQ ID NO: 458759 - DNA, 25 bp, Rattus norvegicus
gggtatctcttaggactatcttaac

SEQ ID NO: 458760 - DNA, 25 bp, Rattus norvegicus
gggtatctgaacaccaacccacatg

SEQ ID NO: 458761 - DNA, 25 bp, Rattus norvegicus
gggtatctgaactccaacccacatg

SEQ ID NO: 458762 - DNA, 25 bp, Rattus norvegicus
gggtatctggtaaactggaataatt

SEQ ID NO: 458763 - DNA, 25 bp, Rattus norvegicus
gggtatctggtatactggaataatt

SEQ ID NO: 458764 - DNA, 25 bp, Rattus norvegicus
gggtatctgtagaatgtgccttaaa

SEQ ID NO: 458765 - DNA, 25 bp, Rattus norvegicus
gggtatctgtagtatgtgccttaaa

SEQ ID NO: 458766 - DNA, 25 bp, Rattus norvegicus
gggtatctgtctctcagctgccatc

SEQ ID NO: 458767 - DNA, 25 bp, Rattus norvegicus
gggtatctgtctgtcagctgccatc

SEQ ID NO: 458768 - DNA, 25 bp, Rattus norvegicus
gggtatcttcatatctatttcacag

SEQ ID NO: 458769 - DNA, 25 bp, Rattus norvegicus
gggtatcttcatttctatttcacag

SEQ ID NO: 458770 - DNA, 25 bp, Rattus norvegicus
gggtatctttctatgagctcaagct

SEQ ID NO: 458771 - DNA, 25 bp, Rattus norvegicus
gggtatctttctttgagctcaagct

SEQ ID NO: 458772 - DNA, 25 bp, Rattus norvegicus
gggtatgagaagcatgcccagcccc

SEQ ID NO: 458773 - DNA, 25 bp, Rattus norvegicus
gggtatgagaaggatgcccagcccc

SEQ ID NO: 458774 - DNA, 25 bp, Rattus norvegicus
gggtatgcataaccgcacaccagct

SEQ ID NO: 458775 - DNA, 25 bp, Rattus norvegicus
gggtatgcataagcgcacaccagct

SEQ ID NO: 458776 - DNA, 25 bp, Rattus norvegicus
gggtatgccaagacatcacaacagt

SEQ ID NO: 458777 - DNA, 25 bp, Rattus norvegicus
gggtatgccaagtcatcacaacagt

SEQ ID NO: 458778 - DNA, 25 bp, Rattus norvegicus
gggtatgccataactatccacagag

SEQ ID NO: 458779 - DNA, 25 bp, Rattus norvegicus
gggtatgccatatctatccacagag

SEQ ID NO: 458780 - DNA, 25 bp, Rattus norvegicus
gggtatgcgagaccctttagctgcc

SEQ ID NO: 458781 - DNA, 25 bp, Rattus norvegicus
gggtatgcgagagcctttagctgcc

SEQ ID NO: 458782 - DNA, 25 bp, Rattus norvegicus
gggtatgctgtcaagatccaggcaa

SEQ ID NO: 458783 - DNA, 25 bp, Rattus norvegicus
gggtatgctgtctagatccaggcaa

SEQ ID NO: 458784 - DNA, 25 bp, Rattus norvegicus
gggtatgctttactgcctggctttc

SEQ ID NO: 458785 - DNA, 25 bp, Rattus norvegicus
gggtatgctttagtgcctggctttc

SEQ ID NO: 458786 - DNA, 25 bp, Rattus norvegicus
gggtatggacagaatcttcaacttc

SEQ ID NO: 458787 - DNA, 25 bp, Rattus norvegicus
gggtatggacagtatcttcaacttc

SEQ ID NO: 458788 - DNA, 25 bp, Rattus norvegicus
gggtatggctatctgagtcttaata

SEQ ID NO: 458789 - DNA, 25 bp, Rattus norvegicus
gggtatggctatgtgagtcttaata

SEQ ID NO: 458790 - DNA, 25 bp, Rattus norvegicus
gggtatggctccaacataatctgga

SEQ ID NO: 458791 - DNA, 25 bp, Rattus norvegicus
gggtatggctcctacataatctgga

SEQ ID NO: 458792 - DNA, 25 bp, Rattus norvegicus
gggtatggcttactgtcttcttccc

SEQ ID NO: 458793 - DNA, 25 bp, Rattus norvegicus
gggtatggcttagtgtcttcttccc

SEQ ID NO: 458794 - DNA, 25 bp, Rattus norvegicus
gggtatgggcaacctattgttatta

SEQ ID NO: 458795 - DNA, 25 bp, Rattus norvegicus
gggtatgggcaagctattgttatta

SEQ ID NO: 458796 - DNA, 25 bp, Rattus norvegicus
gggtatggtattagacctgcctcaa

SEQ ID NO: 458797 - DNA, 25 bp, Rattus norvegicus
gggtatggtatttgacctgcctcaa

SEQ ID NO: 458798 - DNA, 25 bp, Rattus norvegicus
gggtatggtggcatgagcttttcca

SEQ ID NO: 458799 - DNA, 25 bp, Rattus norvegicus
gggtatggtggcttgagcttttcca

SEQ ID NO: 458800 - DNA, 25 bp, Rattus norvegicus
gggtatgtaccaattactctcttct

SEQ ID NO: 458801 - DNA, 25 bp, Rattus norvegicus
gggtatgtaccatttactctcttct

SEQ ID NO: 458802 - DNA, 25 bp, Rattus norvegicus
gggtatgtcagcactcacgccaaga

SEQ ID NO: 458803 - DNA, 25 bp, Rattus norvegicus
gggtatgtcagctctcacgccaaga

SEQ ID NO: 458804 - DNA, 25 bp, Rattus norvegicus
gggtatgtctgccagcactgcaaag

SEQ ID NO: 458805 - DNA, 25 bp, Rattus norvegicus
gggtatgtctgcgagcactgcaaag

SEQ ID NO: 458806 - DNA, 25 bp, Rattus norvegicus
gggtatgtgaatcctaaagtctaat

SEQ ID NO: 458807 - DNA, 25 bp, Rattus norvegicus
gggtatgtgaatgctaaagtctaat

SEQ ID NO: 458808 - DNA, 25 bp, Rattus norvegicus
gggtatgttcctcggacgtattcac

SEQ ID NO: 458809 - DNA, 25 bp, Rattus norvegicus
gggtatgttcctgggacgtattcac

SEQ ID NO: 458810 - DNA, 25 bp, Rattus norvegicus
gggtatgttctcactaacagtagca

SEQ ID NO: 458811 - DNA, 25 bp, Rattus norvegicus
gggtatgttctctctaacagtagca

SEQ ID NO: 458812 - DNA, 25 bp, Rattus norvegicus
gggtatgttcttcatgtttctggca

SEQ ID NO: 458813 - DNA, 25 bp, Rattus norvegicus
gggtatgttcttgatgtttctggca

SEQ ID NO: 458814 - DNA, 25 bp, Rattus norvegicus
gggtatgtttacagctgtcctgacc

SEQ ID NO: 458815 - DNA, 25 bp, Rattus norvegicus
gggtatgtttactgctgtcctgacc

SEQ ID NO: 458816 - DNA, 25 bp, Rattus norvegicus
gggtatgtttgcctatttattatga

SEQ ID NO: 458817 - DNA, 25 bp, Rattus norvegicus
gggtatgtttgcgtatttattatga

SEQ ID NO: 458818 - DNA, 25 bp, Rattus norvegicus
gggtattaacaacgccatcctggct

SEQ ID NO: 458819 - DNA, 25 bp, Rattus norvegicus
gggtattaacaaggccatcctggct

SEQ ID NO: 458820 - DNA, 25 bp, Rattus norvegicus
gggtattacctcaaggccatgtaag

SEQ ID NO: 458821 - DNA, 25 bp, Rattus norvegicus
gggtattacctctaggccatgtaag

SEQ ID NO: 458822 - DNA, 25 bp, Rattus norvegicus
gggtattactatctgttggttcctt

SEQ ID NO: 458823 - DNA, 25 bp, Rattus norvegicus
gggtattactatgtgttggttcctt

SEQ ID NO: 458824 - DNA, 25 bp, Rattus norvegicus
gggtattatatcacactagcacatt

SEQ ID NO: 458825 - DNA, 25 bp, Rattus norvegicus
gggtattatatctcactagcacatt

SEQ ID NO: 458826 - DNA, 25 bp, Rattus norvegicus
gggtattatgatagagccacaacaa

SEQ ID NO: 458827 - DNA, 25 bp, Rattus norvegicus
gggtattatgattgagccacaacaa

SEQ ID NO: 458828 - DNA, 25 bp, Rattus norvegicus
gggtattatttactcaagtcactgt

SEQ ID NO: 458829 - DNA, 25 bp, Rattus norvegicus
gggtattatttagtcaagtcactgt

SEQ ID NO: 458830 - DNA, 25 bp, Rattus norvegicus
gggtattcacatatgaagattcctt

SEQ ID NO: 458831 - DNA, 25 bp, Rattus norvegicus
gggtattcacatttgaagattcctt

SEQ ID NO: 458832 - DNA, 25 bp, Rattus norvegicus
gggtattcagagagcttcctgctga

SEQ ID NO: 458833 - DNA, 25 bp, Rattus norvegicus
gggtattcagagtgcttcctgctga

SEQ ID NO: 458834 - DNA, 25 bp, Rattus norvegicus
gggtattccagtcttatccacgctt

SEQ ID NO: 458835 - DNA, 25 bp, Rattus norvegicus
gggtattccagtgttatccacgctt

SEQ ID NO: 458836 - DNA, 25 bp, Rattus norvegicus
gggtattctgcacccaattctaatt

SEQ ID NO: 458837 - DNA, 25 bp, Rattus norvegicus
gggtattctgcagccaattctaatt

SEQ ID NO: 458838 - DNA, 25 bp, Rattus norvegicus
gggtattcttggatctccatcacag

SEQ ID NO: 458839 - DNA, 25 bp, Rattus norvegicus
gggtattcttggttctccatcacag

SEQ ID NO: 458840 - DNA, 25 bp, Rattus norvegicus
gggtattgacccattttgagcatta

SEQ ID NO: 458841 - DNA, 25 bp, Rattus norvegicus
gggtattgaccctttttgagcatta

SEQ ID NO: 458842 - DNA, 25 bp, Rattus norvegicus
gggtattgagcccaatgccttgcac

SEQ ID NO: 458843 - DNA, 25 bp, Rattus norvegicus
gggtattgagccgaatgccttgcac

SEQ ID NO: 458844 - DNA, 25 bp, Rattus norvegicus
gggtattgccttcctgacagaagta

SEQ ID NO: 458845 - DNA, 25 bp, Rattus norvegicus
gggtattgccttgctgacagaagta

SEQ ID NO: 458846 - DNA, 25 bp, Rattus norvegicus
gggtattgtaggcaacctttccact

SEQ ID NO: 458847 - DNA, 25 bp, Rattus norvegicus
gggtattgtagggaacctttccact

SEQ ID NO: 458848 - DNA, 25 bp, Rattus norvegicus
gggtatttactcctgtcaggcacat

SEQ ID NO: 458849 - DNA, 25 bp, Rattus norvegicus
gggtatttactcgtgtcaggcacat

SEQ ID NO: 458850 - DNA, 25 bp, Rattus norvegicus
gggtatttacttatctcttagctga

SEQ ID NO: 458851 - DNA, 25 bp, Rattus norvegicus
gggtatttacttttctcttagctga

SEQ ID NO: 458852 - DNA, 25 bp, Rattus norvegicus
gggtatttagcaacctacacgaaca

SEQ ID NO: 458853 - DNA, 25 bp, Rattus norvegicus
gggtatttagcatcctacacgaaca

SEQ ID NO: 458854 - DNA, 25 bp, Rattus norvegicus
gggtatttattcagtccttttcatt

SEQ ID NO: 458855 - DNA, 25 bp, Rattus norvegicus
gggtatttattctgtccttttcatt

SEQ ID NO: 458856 - DNA, 25 bp, Rattus norvegicus
gggtatttatttcattctggccact

SEQ ID NO: 458857 - DNA, 25 bp, Rattus norvegicus
gggtatttatttccaacgatgtcta

SEQ ID NO: 458858 - DNA, 25 bp, Rattus norvegicus
gggtatttatttgattctggccact

SEQ ID NO: 458859 - DNA, 25 bp, Rattus norvegicus
gggtatttatttgcaacgatgtcta

SEQ ID NO: 458860 - DNA, 25 bp, Rattus norvegicus
gggtatttctaaatcttactctgtc

SEQ ID NO: 458861 - DNA, 25 bp, Rattus norvegicus
gggtatttctaattcttactctgtc

SEQ ID NO: 458862 - DNA, 25 bp, Rattus norvegicus
gggtatttctctaacatttcactac

SEQ ID NO: 458863 - DNA, 25 bp, Rattus norvegicus
gggtatttctcttacatttcactac

SEQ ID NO: 458864 - DNA, 25 bp, Rattus norvegicus
gggtatttctgtccatagggttctt

SEQ ID NO: 458865 - DNA, 25 bp, Rattus norvegicus
gggtatttctgtgcatagggttctt

SEQ ID NO: 458866 - DNA, 25 bp, Rattus norvegicus
gggtatttggacacttggacacatt

SEQ ID NO: 458867 - DNA, 25 bp, Rattus norvegicus
gggtatttggactcttggacacatt

SEQ ID NO: 458868 - DNA, 25 bp, Rattus norvegicus
gggtatttgttgacttctctttata

SEQ ID NO: 458869 - DNA, 25 bp, Rattus norvegicus
gggtatttgttgtcttctctttata

SEQ ID NO: 458870 - DNA, 25 bp, Rattus norvegicus
gggtattttaccacatgaatctgac

SEQ ID NO: 458871 - DNA, 25 bp, Rattus norvegicus
gggtattttacctcatgaatctgac

SEQ ID NO: 458872 - DNA, 25 bp, Rattus norvegicus
gggtattttattaccttcctatcag

SEQ ID NO: 458873 - DNA, 25 bp, Rattus norvegicus
gggtattttatttccttcctatcag

SEQ ID NO: 458874 - DNA, 25 bp, Rattus norvegicus
gggtattttccaaaacacctgatat

SEQ ID NO: 458875 - DNA, 25 bp, Rattus norvegicus
gggtattttccataacacctgatat

SEQ ID NO: 458876 - DNA, 25 bp, Rattus norvegicus
gggtattttgccaatgttgaacgtg

SEQ ID NO: 458877 - DNA, 25 bp, Rattus norvegicus
gggtattttgcctatgttgaacgtg

SEQ ID NO: 458878 - DNA, 25 bp, Rattus norvegicus
gggtatttttaccatcatagaaaga

SEQ ID NO: 458879 - DNA, 25 bp, Rattus norvegicus
gggtatttttacgatcatagaaaga

SEQ ID NO: 458880 - DNA, 25 bp, Rattus norvegicus
gggtcaaaataacctatctgaagat

SEQ ID NO: 458881 - DNA, 25 bp, Rattus norvegicus
gggtcaaaataagctatctgaagat

SEQ ID NO: 458882 - DNA, 25 bp, Rattus norvegicus
gggtcaaaatctactcaactgcatt

SEQ ID NO: 458883 - DNA, 25 bp, Rattus norvegicus
gggtcaaaatcttctcaactgcatt

SEQ ID NO: 458884 - DNA, 25 bp, Rattus norvegicus
gggtcaaacctaactaacctcagtc

SEQ ID NO: 458885 - DNA, 25 bp, Rattus norvegicus
gggtcaaacctatctaacctcagtc

SEQ ID NO: 458886 - DNA, 25 bp, Rattus norvegicus
gggtcaaactcactcagcaaggctt

SEQ ID NO: 458887 - DNA, 25 bp, Rattus norvegicus
gggtcaaactcagtcagcaaggctt

SEQ ID NO: 458888 - DNA, 25 bp, Rattus norvegicus
gggtcaaagcacaaactgaacatct

SEQ ID NO: 458889 - DNA, 25 bp, Rattus norvegicus
gggtcaaagcacaatgtttacgtta

SEQ ID NO: 458890 - DNA, 25 bp, Rattus norvegicus
gggtcaaagcactaactgaacatct

SEQ ID NO: 458891 - DNA, 25 bp, Rattus norvegicus
gggtcaaagcactatgtttacgtta

SEQ ID NO: 458892 - DNA, 25 bp, Rattus norvegicus
gggtcaaagcttaccatcatgattc

SEQ ID NO: 458893 - DNA, 25 bp, Rattus norvegicus
gggtcaaagctttccatcatgattc

SEQ ID NO: 458894 - DNA, 25 bp, Rattus norvegicus
gggtcaaagttcaatccacttagtt

SEQ ID NO: 458895 - DNA, 25 bp, Rattus norvegicus
gggtcaaagttctatccacttagtt

SEQ ID NO: 458896 - DNA, 25 bp, Rattus norvegicus
gggtcaaatcctatgccagtgtgga

SEQ ID NO: 458897 - DNA, 25 bp, Rattus norvegicus
gggtcaaatcctttgccagtgtgga

SEQ ID NO: 458898 - DNA, 25 bp, Rattus norvegicus
gggtcaacagctccccaggctgaaa

SEQ ID NO: 458899 - DNA, 25 bp, Rattus norvegicus
gggtcaacagctgcccaggctgaaa

SEQ ID NO: 458900 - DNA, 25 bp, Rattus norvegicus
gggtcaaccaataccaggatcctaa

SEQ ID NO: 458901 - DNA, 25 bp, Rattus norvegicus
gggtcaaccaattccaggatcctaa

SEQ ID NO: 458902 - DNA, 25 bp, Rattus norvegicus
gggtcaacctgaaccagtttgccaa

SEQ ID NO: 458903 - DNA, 25 bp, Rattus norvegicus
gggtcaacctgatccagtttgccaa

SEQ ID NO: 458904 - DNA, 25 bp, Rattus norvegicus
gggtcaacggctccggtttaagact

SEQ ID NO: 458905 - DNA, 25 bp, Rattus norvegicus
gggtcaacggctgcggtttaagact

SEQ ID NO: 458906 - DNA, 25 bp, Rattus norvegicus
gggtcaactgacatccattgtatat

SEQ ID NO: 458907 - DNA, 25 bp, Rattus norvegicus
gggtcaactgacttccattgtatat

SEQ ID NO: 458908 - DNA, 25 bp, Rattus norvegicus
gggtcaactggcactctgagtataa

SEQ ID NO: 458909 - DNA, 25 bp, Rattus norvegicus
gggtcaactggctctctgagtataa

SEQ ID NO: 458910 - DNA, 25 bp, Rattus norvegicus
gggtcaagaccccacaggagtcatc

SEQ ID NO: 458911 - DNA, 25 bp, Rattus norvegicus
gggtcaagacccgacaggagtcatc

SEQ ID NO: 458912 - DNA, 25 bp, Rattus norvegicus
gggtcaagacctaacagacatttca

SEQ ID NO: 458913 - DNA, 25 bp, Rattus norvegicus
gggtcaagaccttacagacatttca

SEQ ID NO: 458914 - DNA, 25 bp, Rattus norvegicus
gggtcaagagtccttcaaaaaacag

SEQ ID NO: 458915 - DNA, 25 bp, Rattus norvegicus
gggtcaagagtcgttcaaaaaacag

SEQ ID NO: 458916 - DNA, 25 bp, Rattus norvegicus
gggtcaagatcacactcttcatatt

SEQ ID NO: 458917 - DNA, 25 bp, Rattus norvegicus
gggtcaagatcagactcttcatatt

SEQ ID NO: 458918 - DNA, 25 bp, Rattus norvegicus
gggtcaagcataccacatagcagca

SEQ ID NO: 458919 - DNA, 25 bp, Rattus norvegicus
gggtcaagcatagcacatagcagca

SEQ ID NO: 458920 - DNA, 25 bp, Rattus norvegicus
gggtcaagctctcttgtttaatctt

SEQ ID NO: 458921 - DNA, 25 bp, Rattus norvegicus
gggtcaagctctgttgtttaatctt

SEQ ID NO: 458922 - DNA, 25 bp, Rattus norvegicus
gggtcaagggacacgccttctgaga

SEQ ID NO: 458923 - DNA, 25 bp, Rattus norvegicus
gggtcaagggactcgccttctgaga

SEQ ID NO: 458924 - DNA, 25 bp, Rattus norvegicus
gggtcaagtatcagtgcaccgccga

SEQ ID NO: 458925 - DNA, 25 bp, Rattus norvegicus
gggtcaagtatctgtgcaccgccga

SEQ ID NO: 458926 - DNA, 25 bp, Rattus norvegicus
gggtcaagtcagagggttccacctg

SEQ ID NO: 458927 - DNA, 25 bp, Rattus norvegicus
gggtcaagtcagtgggttccacctg

SEQ ID NO: 458928 - DNA, 25 bp, Rattus norvegicus
gggtcaagtcccctcagatccgagg

SEQ ID NO: 458929 - DNA, 25 bp, Rattus norvegicus
gggtcaagtcccgtcagatccgagg

SEQ ID NO: 458930 - DNA, 25 bp, Rattus norvegicus
gggtcaagttctaagtacacagcct

SEQ ID NO: 458931 - DNA, 25 bp, Rattus norvegicus
gggtcaagttcttagtacacagcct

SEQ ID NO: 458932 - DNA, 25 bp, Rattus norvegicus
gggtcaatacagacaccactttggt

SEQ ID NO: 458933 - DNA, 25 bp, Rattus norvegicus
gggtcaatacagtcaccactttggt

SEQ ID NO: 458934 - DNA, 25 bp, Rattus norvegicus
gggtcaatcccaactgtgtataagt

SEQ ID NO: 458935 - DNA, 25 bp, Rattus norvegicus
gggtcaatcccatctgtgtataagt

SEQ ID NO: 458936 - DNA, 25 bp, Rattus norvegicus
gggtcaatccggaccaggcttggtt

SEQ ID NO: 458937 - DNA, 25 bp, Rattus norvegicus
gggtcaatccggtccaggcttggtt

SEQ ID NO: 458938 - DNA, 25 bp, Rattus norvegicus
gggtcaatgacaactcaccgatgct

SEQ ID NO: 458939 - DNA, 25 bp, Rattus norvegicus
gggtcaatgacatctcaccgatgct

SEQ ID NO: 458940 - DNA, 25 bp, Rattus norvegicus
gggtcaatgatacccagtgggcata

SEQ ID NO: 458941 - DNA, 25 bp, Rattus norvegicus
gggtcaatgataccttcgatagaac

SEQ ID NO: 458942 - DNA, 25 bp, Rattus norvegicus
gggtcaatgatagccagtgggcata

SEQ ID NO: 458943 - DNA, 25 bp, Rattus norvegicus
gggtcaatgatagcttcgatagaac

SEQ ID NO: 458944 - DNA, 25 bp, Rattus norvegicus
gggtcaattttcatttcctcccagt

SEQ ID NO: 458945 - DNA, 25 bp, Rattus norvegicus
gggtcaattttccactgctaatatt

SEQ ID NO: 458946 - DNA, 25 bp, Rattus norvegicus
gggtcaattttcgactgctaatatt

SEQ ID NO: 458947 - DNA, 25 bp, Rattus norvegicus
gggtcaattttcttttcctcccagt

SEQ ID NO: 458948 - DNA, 25 bp, Rattus norvegicus
gggtcaatttttagcgtttgtcatg

SEQ ID NO: 458949 - DNA, 25 bp, Rattus norvegicus
gggtcaattttttgcgtttgtcatg

SEQ ID NO: 458950 - DNA, 25 bp, Rattus norvegicus
gggtcacaatagctaagttctcaat

SEQ ID NO: 458951 - DNA, 25 bp, Rattus norvegicus
gggtcacaataggtaagttctcaat

SEQ ID NO: 458952 - DNA, 25 bp, Rattus norvegicus
gggtcacaattacactttcacggtc

SEQ ID NO: 458953 - DNA, 25 bp, Rattus norvegicus
gggtcacaattactactaccatgat

SEQ ID NO: 458954 - DNA, 25 bp, Rattus norvegicus
gggtcacaattagactttcacggtc

SEQ ID NO: 458955 - DNA, 25 bp, Rattus norvegicus
gggtcacaattagtactaccatgat

SEQ ID NO: 458956 - DNA, 25 bp, Rattus norvegicus
gggtcacacaggatcacgcaactga

SEQ ID NO: 458957 - DNA, 25 bp, Rattus norvegicus
gggtcacacaggttcacgcaactga

SEQ ID NO: 458958 - DNA, 25 bp, Rattus norvegicus
gggtcacacctgatggcagagcagt

SEQ ID NO: 458959 - DNA, 25 bp, Rattus norvegicus
gggtcacacctgttggcagagcagt

SEQ ID NO: 458960 - DNA, 25 bp, Rattus norvegicus
gggtcacacgcccaaccgaagcttg

SEQ ID NO: 458961 - DNA, 25 bp, Rattus norvegicus
gggtcacacgccgaaccgaagcttg

SEQ ID NO: 458962 - DNA, 25 bp, Rattus norvegicus
gggtcacactaacagtaattctctc

SEQ ID NO: 458963 - DNA, 25 bp, Rattus norvegicus
gggtcacactaagagtaattctctc

SEQ ID NO: 458964 - DNA, 25 bp, Rattus norvegicus
gggtcacactatcatgcttctggca

SEQ ID NO: 458965 - DNA, 25 bp, Rattus norvegicus
gggtcacactatgatgcttctggca

SEQ ID NO: 458966 - DNA, 25 bp, Rattus norvegicus
gggtcacactcacactgtttcatag

SEQ ID NO: 458967 - DNA, 25 bp, Rattus norvegicus
gggtcacactcagactgtttcatag

SEQ ID NO: 458968 - DNA, 25 bp, Rattus norvegicus
gggtcacactgaaaacacagcacag

SEQ ID NO: 458969 - DNA, 25 bp, Rattus norvegicus
gggtcacactgataacacagcacag

SEQ ID NO: 458970 - DNA, 25 bp, Rattus norvegicus
gggtcacagactcagtaacatctta

SEQ ID NO: 458971 - DNA, 25 bp, Rattus norvegicus
gggtcacagactgagtaacatctta

SEQ ID NO: 458972 - DNA, 25 bp, Rattus norvegicus
gggtcacagctccaacaggtcctgg

SEQ ID NO: 458973 - DNA, 25 bp, Rattus norvegicus
gggtcacagctcgaacaggtcctgg

SEQ ID NO: 458974 - DNA, 25 bp, Rattus norvegicus
gggtcacagtaaacatggtctgctc

SEQ ID NO: 458975 - DNA, 25 bp, Rattus norvegicus
gggtcacagtaatcatggtctgctc

SEQ ID NO: 458976 - DNA, 25 bp, Rattus norvegicus
gggtcacagtctctgttttcaagta

SEQ ID NO: 458977 - DNA, 25 bp, Rattus norvegicus
gggtcacagtctgtgttttcaagta

SEQ ID NO: 458978 - DNA, 25 bp, Rattus norvegicus
gggtcacagtggacccgcccatgga

SEQ ID NO: 458979 - DNA, 25 bp, Rattus norvegicus
gggtcacagtggtcccgcccatgga

SEQ ID NO: 458980 - DNA, 25 bp, Rattus norvegicus
gggtcacagtgtacccagcactcct

SEQ ID NO: 458981 - DNA, 25 bp, Rattus norvegicus
gggtcacagtgttcccagcactcct

SEQ ID NO: 458982 - DNA, 25 bp, Rattus norvegicus
gggtcacagttacagcctaagttaa

SEQ ID NO: 458983 - DNA, 25 bp, Rattus norvegicus
gggtcacagttactctttcatgtat

SEQ ID NO: 458984 - DNA, 25 bp, Rattus norvegicus
gggtcacagttagagcctaagttaa

SEQ ID NO: 458985 - DNA, 25 bp, Rattus norvegicus
gggtcacagttagtctttcatgtat

SEQ ID NO: 458986 - DNA, 25 bp, Rattus norvegicus
gggtcacatagcatgttccaggcca

SEQ ID NO: 458987 - DNA, 25 bp, Rattus norvegicus
gggtcacatagcttgttccaggcca

SEQ ID NO: 458988 - DNA, 25 bp, Rattus norvegicus
gggtcacatcaaatctcttcttaga

SEQ ID NO: 458989 - DNA, 25 bp, Rattus norvegicus
gggtcacatcaattctcttcttaga

SEQ ID NO: 458990 - DNA, 25 bp, Rattus norvegicus
gggtcacatctcaaaagttctttct

SEQ ID NO: 458991 - DNA, 25 bp, Rattus norvegicus
gggtcacatctcatcaaaacacttg

SEQ ID NO: 458992 - DNA, 25 bp, Rattus norvegicus
gggtcacatctctaaagttctttct

SEQ ID NO: 458993 - DNA, 25 bp, Rattus norvegicus
gggtcacatctcttcaaaacacttg

SEQ ID NO: 458994 - DNA, 25 bp, Rattus norvegicus
gggtcacatgacatgtacacatatt

SEQ ID NO: 458995 - DNA, 25 bp, Rattus norvegicus
gggtcacatgacttgtacacatatt

SEQ ID NO: 458996 - DNA, 25 bp, Rattus norvegicus
gggtcacatgcaaacgcagtctgaa

SEQ ID NO: 458997 - DNA, 25 bp, Rattus norvegicus
gggtcacatgcatacgcagtctgaa

SEQ ID NO: 458998 - DNA, 25 bp, Rattus norvegicus
gggtcacatggacacaggtgcatct

SEQ ID NO: 458999 - DNA, 25 bp, Rattus norvegicus
gggtcacatggagacaggtgcatct

SEQ ID NO: 459000 - DNA, 25 bp, Rattus norvegicus
gggtcacatgggagggtcctcctct

SEQ ID NO: 459001 - DNA, 25 bp, Rattus norvegicus
gggtcacatgggtgggtcctcctct

SEQ ID NO: 459002 - DNA, 25 bp, Rattus norvegicus
gggtcaccagatcctgcctcttatc

SEQ ID NO: 459003 - DNA, 25 bp, Rattus norvegicus
gggtcaccagatgctgcctcttatc

SEQ ID NO: 459004 - DNA, 25 bp, Rattus norvegicus
gggtcaccaggaatgttaacgatac

SEQ ID NO: 459005 - DNA, 25 bp, Rattus norvegicus
gggtcaccaggattgttaacgatac

SEQ ID NO: 459006 - DNA, 25 bp, Rattus norvegicus
gggtcaccatccattccaaatggta

SEQ ID NO: 459007 - DNA, 25 bp, Rattus norvegicus
gggtcaccatcctttccaaatggta

SEQ ID NO: 459008 - DNA, 25 bp, Rattus norvegicus
gggtcaccatgacggactcagactg

SEQ ID NO: 459009 - DNA, 25 bp, Rattus norvegicus
gggtcaccatgagggactcagactg

SEQ ID NO: 459010 - DNA, 25 bp, Rattus norvegicus
gggtcaccatgtcggaggccttctc

SEQ ID NO: 459011 - DNA, 25 bp, Rattus norvegicus
gggtcaccatgtgggaggccttctc

SEQ ID NO: 459012 - DNA, 25 bp, Rattus norvegicus
gggtcaccattccaaagaatggttg

SEQ ID NO: 459013 - DNA, 25 bp, Rattus norvegicus
gggtcaccattcgaaagaatggttg

SEQ ID NO: 459014 - DNA, 25 bp, Rattus norvegicus
gggtcaccattgcacatatgaaggt

SEQ ID NO: 459015 - DNA, 25 bp, Rattus norvegicus
gggtcaccattggacatatgaaggt

SEQ ID NO: 459016 - DNA, 25 bp, Rattus norvegicus
gggtcaccatttcctgggacactca

SEQ ID NO: 459017 - DNA, 25 bp, Rattus norvegicus
gggtcaccatttgctgggacactca

SEQ ID NO: 459018 - DNA, 25 bp, Rattus norvegicus
gggtcacccactctcctataaataa

SEQ ID NO: 459019 - DNA, 25 bp, Rattus norvegicus
gggtcacccactgtcctataaataa

SEQ ID NO: 459020 - DNA, 25 bp, Rattus norvegicus
gggtcacccagtatgtggtcctcag

SEQ ID NO: 459021 - DNA, 25 bp, Rattus norvegicus
gggtcacccagtttgtggtcctcag

SEQ ID NO: 459022 - DNA, 25 bp, Rattus norvegicus
gggtcaccccagagatggtgtcaaa

SEQ ID NO: 459023 - DNA, 25 bp, Rattus norvegicus
gggtcaccccagtgatggtgtcaaa

SEQ ID NO: 459024 - DNA, 25 bp, Rattus norvegicus
gggtcaccgacacgcataacttctg

SEQ ID NO: 459025 - DNA, 25 bp, Rattus norvegicus
gggtcaccgacaggcataacttctg

SEQ ID NO: 459026 - DNA, 25 bp, Rattus norvegicus
gggtcaccgcaaatggagccaaagc

SEQ ID NO: 459027 - DNA, 25 bp, Rattus norvegicus
gggtcaccgcaattggagccaaagc

SEQ ID NO: 459028 - DNA, 25 bp, Rattus norvegicus
gggtcaccgtgaagggaaactcaat

SEQ ID NO: 459029 - DNA, 25 bp, Rattus norvegicus
gggtcaccgtgatgggaaactcaat

SEQ ID NO: 459030 - DNA, 25 bp, Rattus norvegicus
gggtcaccgtgtaccttggtcacct

SEQ ID NO: 459031 - DNA, 25 bp, Rattus norvegicus
gggtcaccgtgttccttggtcacct

SEQ ID NO: 459032 - DNA, 25 bp, Rattus norvegicus
gggtcacctacgacatctatgggtt

SEQ ID NO: 459033 - DNA, 25 bp, Rattus norvegicus
gggtcacctacgtcatctatgggtt

SEQ ID NO: 459034 - DNA, 25 bp, Rattus norvegicus
gggtcacctattacctggactggat

SEQ ID NO: 459035 - DNA, 25 bp, Rattus norvegicus
gggtcacctatttcctggactggat

SEQ ID NO: 459036 - DNA, 25 bp, Rattus norvegicus
gggtcacctcatagtcagctgacaa

SEQ ID NO: 459037 - DNA, 25 bp, Rattus norvegicus
gggtcacctcattgtcagctgacaa

SEQ ID NO: 459038 - DNA, 25 bp, Rattus norvegicus
gggtcacctgaaatagacttccatc

SEQ ID NO: 459039 - DNA, 25 bp, Rattus norvegicus
gggtcacctgaattagacttccatc

SEQ ID NO: 459040 - DNA, 25 bp, Rattus norvegicus
gggtcacctggaatagtctcactgc

SEQ ID NO: 459041 - DNA, 25 bp, Rattus norvegicus
gggtcacctggattagtctcactgc

SEQ ID NO: 459042 - DNA, 25 bp, Rattus norvegicus
gggtcacctttgagtttgctcagaa

SEQ ID NO: 459043 - DNA, 25 bp, Rattus norvegicus
gggtcacctttgtgtttgctcagaa

SEQ ID NO: 459044 - DNA, 25 bp, Rattus norvegicus
gggtcacgaggcagcattgtcgaca

SEQ ID NO: 459045 - DNA, 25 bp, Rattus norvegicus
gggtcacgaggctgcattgtcgaca

SEQ ID NO: 459046 - DNA, 25 bp, Rattus norvegicus
gggtcacgatgaaaggtctcattca

SEQ ID NO: 459047 - DNA, 25 bp, Rattus norvegicus
gggtcacgatgataggtctcattca

SEQ ID NO: 459048 - DNA, 25 bp, Rattus norvegicus
gggtcacggattctcaagtatctca

SEQ ID NO: 459049 - DNA, 25 bp, Rattus norvegicus
gggtcacggattgtcaagtatctca

SEQ ID NO: 459050 - DNA, 25 bp, Rattus norvegicus
gggtcacgttatcctagcgatgatt

SEQ ID NO: 459051 - DNA, 25 bp, Rattus norvegicus
gggtcacgttatgctagcgatgatt

SEQ ID NO: 459052 - DNA, 25 bp, Rattus norvegicus
gggtcactaatgacttccctttctg

SEQ ID NO: 459053 - DNA, 25 bp, Rattus norvegicus
gggtcactaatgtcttccctttctg

SEQ ID NO: 459054 - DNA, 25 bp, Rattus norvegicus
gggtcactacaacactaaagggtca

SEQ ID NO: 459055 - DNA, 25 bp, Rattus norvegicus
gggtcactacaagactaaagggtca

SEQ ID NO: 459056 - DNA, 25 bp, Rattus norvegicus
gggtcactacagctaagcttgcttt

SEQ ID NO: 459057 - DNA, 25 bp, Rattus norvegicus
gggtcactacaggtaagcttgcttt

SEQ ID NO: 459058 - DNA, 25 bp, Rattus norvegicus
gggtcactacgacatgaggaactgc

SEQ ID NO: 459059 - DNA, 25 bp, Rattus norvegicus
gggtcactacgagatgaggaactgc

SEQ ID NO: 459060 - DNA, 25 bp, Rattus norvegicus
gggtcactcagacctgtgaactagg

SEQ ID NO: 459061 - DNA, 25 bp, Rattus norvegicus
gggtcactcagagctgtgaactagg

SEQ ID NO: 459062 - DNA, 25 bp, Rattus norvegicus
gggtcactctaaagcctgatattgt

SEQ ID NO: 459063 - DNA, 25 bp, Rattus norvegicus
gggtcactctaatgcctgatattgt

SEQ ID NO: 459064 - DNA, 25 bp, Rattus norvegicus
gggtcactctctacaaccattacac

SEQ ID NO: 459065 - DNA, 25 bp, Rattus norvegicus
gggtcactctcttcaaccattacac

SEQ ID NO: 459066 - DNA, 25 bp, Rattus norvegicus
gggtcactctgaagtttcttcatga

SEQ ID NO: 459067 - DNA, 25 bp, Rattus norvegicus
gggtcactctgatgtttcttcatga

SEQ ID NO: 459068 - DNA, 25 bp, Rattus norvegicus
gggtcactctgcattggccgtagac

SEQ ID NO: 459069 - DNA, 25 bp, Rattus norvegicus
gggtcactctgctttggccgtagac

SEQ ID NO: 459070 - DNA, 25 bp, Rattus norvegicus
gggtcactgcatatggatctgggtc

SEQ ID NO: 459071 - DNA, 25 bp, Rattus norvegicus
gggtcactgcatttggatctgggtc

SEQ ID NO: 459072 - DNA, 25 bp, Rattus norvegicus
gggtcactggacaattatgaagaga

SEQ ID NO: 459073 - DNA, 25 bp, Rattus norvegicus
gggtcactggactattatgaagaga

SEQ ID NO: 459074 - DNA, 25 bp, Rattus norvegicus
gggtcactgtcaatcatcggaataa

SEQ ID NO: 459075 - DNA, 25 bp, Rattus norvegicus
gggtcactgtcattcatcggaataa

SEQ ID NO: 459076 - DNA, 25 bp, Rattus norvegicus
gggtcactgtccctgttttaagctg

SEQ ID NO: 459077 - DNA, 25 bp, Rattus norvegicus
gggtcactgtccgtgttttaagctg

SEQ ID NO: 459078 - DNA, 25 bp, Rattus norvegicus
gggtcactgtgtattttccatacga

SEQ ID NO: 459079 - DNA, 25 bp, Rattus norvegicus
gggtcactgtgttttttccatacga

SEQ ID NO: 459080 - DNA, 25 bp, Rattus norvegicus
gggtcactgttgacttcttgtccat

SEQ ID NO: 459081 - DNA, 25 bp, Rattus norvegicus
gggtcactgttgtcttcttgtccat

SEQ ID NO: 459082 - DNA, 25 bp, Rattus norvegicus
gggtcacttaagataatgcctttgg

SEQ ID NO: 459083 - DNA, 25 bp, Rattus norvegicus
gggtcacttaagttaatgcctttgg

SEQ ID NO: 459084 - DNA, 25 bp, Rattus norvegicus
gggtcacttacaattcagcatacag

SEQ ID NO: 459085 - DNA, 25 bp, Rattus norvegicus
gggtcacttacatttcagcatacag

SEQ ID NO: 459086 - DNA, 25 bp, Rattus norvegicus
gggtcacttctgatcccataagtaa

SEQ ID NO: 459087 - DNA, 25 bp, Rattus norvegicus
gggtcacttctgttcccataagtaa

SEQ ID NO: 459088 - DNA, 25 bp, Rattus norvegicus
gggtcacttgatagccgtgtgcctt

SEQ ID NO: 459089 - DNA, 25 bp, Rattus norvegicus
gggtcacttgattgccgtgtgcctt

SEQ ID NO: 459090 - DNA, 25 bp, Rattus norvegicus
gggtcactttaaagcctctcataaa

SEQ ID NO: 459091 - DNA, 25 bp, Rattus norvegicus
gggtcactttaatgcctctcataaa

SEQ ID NO: 459092 - DNA, 25 bp, Rattus norvegicus
gggtcactttacatatcatcatcat

SEQ ID NO: 459093 - DNA, 25 bp, Rattus norvegicus
gggtcactttacttatcatcatcat

SEQ ID NO: 459094 - DNA, 25 bp, Rattus norvegicus
gggtcactttgtctgcagtgcgctc

SEQ ID NO: 459095 - DNA, 25 bp, Rattus norvegicus
gggtcactttgtgtgcagtgcgctc

SEQ ID NO: 459096 - DNA, 25 bp, Rattus norvegicus
gggtcagaaaccctatctagtgctg

SEQ ID NO: 459097 - DNA, 25 bp, Rattus norvegicus
gggtcagaaaccgtatctagtgctg

SEQ ID NO: 459098 - DNA, 25 bp, Rattus norvegicus
gggtcagaacagagctcctacagtg

SEQ ID NO: 459099 - DNA, 25 bp, Rattus norvegicus
gggtcagaacagtgctcctacagtg

SEQ ID NO: 459100 - DNA, 25 bp, Rattus norvegicus
gggtcagaacgcacaggtactaatt

SEQ ID NO: 459101 - DNA, 25 bp, Rattus norvegicus
gggtcagaacgctcaggtactaatt

SEQ ID NO: 459102 - DNA, 25 bp, Rattus norvegicus
gggtcagaactcaacctgggtggct

SEQ ID NO: 459103 - DNA, 25 bp, Rattus norvegicus
gggtcagaactctacctgggtggct

SEQ ID NO: 459104 - DNA, 25 bp, Rattus norvegicus
gggtcagaagcacacggccacgctc

SEQ ID NO: 459105 - DNA, 25 bp, Rattus norvegicus
gggtcagaagcagacggccacgctc

SEQ ID NO: 459106 - DNA, 25 bp, Rattus norvegicus
gggtcagaatgaattgatcttcctt

SEQ ID NO: 459107 - DNA, 25 bp, Rattus norvegicus
gggtcagaatgatttgatcttcctt

SEQ ID NO: 459108 - DNA, 25 bp, Rattus norvegicus
gggtcagacatccattttggcttga

SEQ ID NO: 459109 - DNA, 25 bp, Rattus norvegicus
gggtcagacatcgattttggcttga

SEQ ID NO: 459110 - DNA, 25 bp, Rattus norvegicus
gggtcagaccagctgccagtccaca

SEQ ID NO: 459111 - DNA, 25 bp, Rattus norvegicus
gggtcagaccaggtgccagtccaca

SEQ ID NO: 459112 - DNA, 25 bp, Rattus norvegicus
gggtcagacccacctattgaggtgt

SEQ ID NO: 459113 - DNA, 25 bp, Rattus norvegicus
gggtcagacccagctattgaggtgt

SEQ ID NO: 459114 - DNA, 25 bp, Rattus norvegicus
gggtcagacttaattatttggccta

SEQ ID NO: 459115 - DNA, 25 bp, Rattus norvegicus
gggtcagacttatttatttggccta

SEQ ID NO: 459116 - DNA, 25 bp, Rattus norvegicus
gggtcagagaccactcactcgagaa

SEQ ID NO: 459117 - DNA, 25 bp, Rattus norvegicus
gggtcagagacctctcactcgagaa

SEQ ID NO: 459118 - DNA, 25 bp, Rattus norvegicus
gggtcagagcatctcccagatcttt

SEQ ID NO: 459119 - DNA, 25 bp, Rattus norvegicus
gggtcagagcatgtcccagatcttt

SEQ ID NO: 459120 - DNA, 25 bp, Rattus norvegicus
gggtcagagccacttatccggcttc

SEQ ID NO: 459121 - DNA, 25 bp, Rattus norvegicus
gggtcagagccagttatccggcttc

SEQ ID NO: 459122 - DNA, 25 bp, Rattus norvegicus
gggtcagagcgtccagaacacaccg

SEQ ID NO: 459123 - DNA, 25 bp, Rattus norvegicus
gggtcagagcgtgcagaacacaccg

SEQ ID NO: 459124 - DNA, 25 bp, Rattus norvegicus
gggtcagagctcaagttcccagcat

SEQ ID NO: 459125 - DNA, 25 bp, Rattus norvegicus
gggtcagagctctagttcccagcat

SEQ ID NO: 459126 - DNA, 25 bp, Rattus norvegicus
gggtcagaggtcaagctcaccctta

SEQ ID NO: 459127 - DNA, 25 bp, Rattus norvegicus
gggtcagaggtctagctcaccctta

SEQ ID NO: 459128 - DNA, 25 bp, Rattus norvegicus
gggtcagatcatctttctgcgccaa

SEQ ID NO: 459129 - DNA, 25 bp, Rattus norvegicus
gggtcagatcatgtttctgcgccaa

SEQ ID NO: 459130 - DNA, 25 bp, Rattus norvegicus
gggtcagatctaaaccaggctcaag

SEQ ID NO: 459131 - DNA, 25 bp, Rattus norvegicus
gggtcagatctataccaggctcaag

SEQ ID NO: 459132 - DNA, 25 bp, Rattus norvegicus
gggtcagcaaggaaggtttcatttc

SEQ ID NO: 459133 - DNA, 25 bp, Rattus norvegicus
gggtcagcaaggtaggtttcatttc

SEQ ID NO: 459134 - DNA, 25 bp, Rattus norvegicus
gggtcagcaagtcatcccgatagtc

SEQ ID NO: 459135 - DNA, 25 bp, Rattus norvegicus
gggtcagcaagtgatcccgatagtc

SEQ ID NO: 459136 - DNA, 25 bp, Rattus norvegicus
gggtcagcagtgatagcccatacct

SEQ ID NO: 459137 - DNA, 25 bp, Rattus norvegicus
gggtcagcagtgttagcccatacct

SEQ ID NO: 459138 - DNA, 25 bp, Rattus norvegicus
gggtcagccaacatttgttctggac

SEQ ID NO: 459139 - DNA, 25 bp, Rattus norvegicus
gggtcagccaacttttgttctggac

SEQ ID NO: 459140 - DNA, 25 bp, Rattus norvegicus
gggtcagccagcagtaaacttctag

SEQ ID NO: 459141 - DNA, 25 bp, Rattus norvegicus
gggtcagccagctgtaaacttctag

SEQ ID NO: 459142 - DNA, 25 bp, Rattus norvegicus
gggtcagcccacagaagcctacaga

SEQ ID NO: 459143 - DNA, 25 bp, Rattus norvegicus
gggtcagcccactgaagcctacaga

SEQ ID NO: 459144 - DNA, 25 bp, Rattus norvegicus
gggtcagcccatcattgtgaccatg

SEQ ID NO: 459145 - DNA, 25 bp, Rattus norvegicus
gggtcagcccatgattgtgaccatg

SEQ ID NO: 459146 - DNA, 25 bp, Rattus norvegicus
gggtcagcctaccatagcttatagg

SEQ ID NO: 459147 - DNA, 25 bp, Rattus norvegicus
gggtcagcctacgatagcttatagg

SEQ ID NO: 459148 - DNA, 25 bp, Rattus norvegicus
gggtcagccttgataggtgtacttt

SEQ ID NO: 459149 - DNA, 25 bp, Rattus norvegicus
gggtcagccttgttaggtgtacttt

SEQ ID NO: 459150 - DNA, 25 bp, Rattus norvegicus
gggtcagcgcatcgatccagacatt

SEQ ID NO: 459151 - DNA, 25 bp, Rattus norvegicus
gggtcagcgcatggatccagacatt

SEQ ID NO: 459152 - DNA, 25 bp, Rattus norvegicus
gggtcagcgccacagatgctccaag

SEQ ID NO: 459153 - DNA, 25 bp, Rattus norvegicus
gggtcagcgccagagatgctccaag

SEQ ID NO: 459154 - DNA, 25 bp, Rattus norvegicus
gggtcagctagcaggcttagccacg

SEQ ID NO: 459155 - DNA, 25 bp, Rattus norvegicus
gggtcagctagctggcttagccacg

SEQ ID NO: 459156 - DNA, 25 bp, Rattus norvegicus
gggtcagctcacagtacagctcggc

SEQ ID NO: 459157 - DNA, 25 bp, Rattus norvegicus
gggtcagctcactgtacagctcggc

SEQ ID NO: 459158 - DNA, 25 bp, Rattus norvegicus
gggtcagctcctccgaaggctgcaa

SEQ ID NO: 459159 - DNA, 25 bp, Rattus norvegicus
gggtcagctcctgcgaaggctgcaa

SEQ ID NO: 459160 - DNA, 25 bp, Rattus norvegicus
gggtcagctctcaaactcagacagc

SEQ ID NO: 459161 - DNA, 25 bp, Rattus norvegicus
gggtcagctctctaactcagacagc

SEQ ID NO: 459162 - DNA, 25 bp, Rattus norvegicus
gggtcagctgtaccaggaacaccat

SEQ ID NO: 459163 - DNA, 25 bp, Rattus norvegicus
gggtcagctgtagcaggaacaccat

SEQ ID NO: 459164 - DNA, 25 bp, Rattus norvegicus
gggtcaggaaccatttgtatgtggt

SEQ ID NO: 459165 - DNA, 25 bp, Rattus norvegicus
gggtcaggaaccttttgtatgtggt

SEQ ID NO: 459166 - DNA, 25 bp, Rattus norvegicus
gggtcaggaccactttctatctgta

SEQ ID NO: 459167 - DNA, 25 bp, Rattus norvegicus
gggtcaggaccagtttctatctgta

SEQ ID NO: 459168 - DNA, 25 bp, Rattus norvegicus
gggtcaggactgctgtctctcagaa

SEQ ID NO: 459169 - DNA, 25 bp, Rattus norvegicus
gggtcaggactggtgtctctcagaa

SEQ ID NO: 459170 - DNA, 25 bp, Rattus norvegicus
gggtcaggcacaccaccaggaacag

SEQ ID NO: 459171 - DNA, 25 bp, Rattus norvegicus
gggtcaggcacagcaccaggaacag

SEQ ID NO: 459172 - DNA, 25 bp, Rattus norvegicus
gggtcaggcaccagtatctgtagac

SEQ ID NO: 459173 - DNA, 25 bp, Rattus norvegicus
gggtcaggcacctgtatctgtagac

SEQ ID NO: 459174 - DNA, 25 bp, Rattus norvegicus
gggtcaggctacaccatatcagtgg

SEQ ID NO: 459175 - DNA, 25 bp, Rattus norvegicus
gggtcaggctactccatatcagtgg

SEQ ID NO: 459176 - DNA, 25 bp, Rattus norvegicus
gggtcaggtgctatcatatgccata

SEQ ID NO: 459177 - DNA, 25 bp, Rattus norvegicus
gggtcaggtgctttcatatgccata

SEQ ID NO: 459178 - DNA, 25 bp, Rattus norvegicus
gggtcagtaattacatcacttccaa

SEQ ID NO: 459179 - DNA, 25 bp, Rattus norvegicus
gggtcagtaatttcatcacttccaa

SEQ ID NO: 459180 - DNA, 25 bp, Rattus norvegicus
gggtcagtcacacagcctgtcggaa

SEQ ID NO: 459181 - DNA, 25 bp, Rattus norvegicus
gggtcagtcacagagcctgtcggaa

SEQ ID NO: 459182 - DNA, 25 bp, Rattus norvegicus
gggtcagtcattaccttgacagaca

SEQ ID NO: 459183 - DNA, 25 bp, Rattus norvegicus
gggtcagtcatttccttgacagaca

SEQ ID NO: 459184 - DNA, 25 bp, Rattus norvegicus
gggtcagtccagctgtctctgccca

SEQ ID NO: 459185 - DNA, 25 bp, Rattus norvegicus
gggtcagtccaggtgtctctgccca

SEQ ID NO: 459186 - DNA, 25 bp, Rattus norvegicus
gggtcagtcctaacatttctagcat

SEQ ID NO: 459187 - DNA, 25 bp, Rattus norvegicus
gggtcagtcctatcatttctagcat

SEQ ID NO: 459188 - DNA, 25 bp, Rattus norvegicus
gggtcagtctggacaagccatcatg

SEQ ID NO: 459189 - DNA, 25 bp, Rattus norvegicus
gggtcagtctggtcaagccatcatg

SEQ ID NO: 459190 - DNA, 25 bp, Rattus norvegicus
gggtcagtcttaagaactccacatc

SEQ ID NO: 459191 - DNA, 25 bp, Rattus norvegicus
gggtcagtcttatgaactccacatc

SEQ ID NO: 459192 - DNA, 25 bp, Rattus norvegicus
gggtcagtcttgctttgtgatctta

SEQ ID NO: 459193 - DNA, 25 bp, Rattus norvegicus
gggtcagtcttggtttgtgatctta

SEQ ID NO: 459194 - DNA, 25 bp, Rattus norvegicus
gggtcagtgctacaccacatggcta

SEQ ID NO: 459195 - DNA, 25 bp, Rattus norvegicus
gggtcagtgctagaccacatggcta

SEQ ID NO: 459196 - DNA, 25 bp, Rattus norvegicus
gggtcagtgggactctctcaatcat

SEQ ID NO: 459197 - DNA, 25 bp, Rattus norvegicus
gggtcagtgggagtctctcaatcat

SEQ ID NO: 459198 - DNA, 25 bp, Rattus norvegicus
gggtcagttagaatattcagcaggt

SEQ ID NO: 459199 - DNA, 25 bp, Rattus norvegicus
gggtcagttagattattcagcaggt

SEQ ID NO: 459200 - DNA, 25 bp, Rattus norvegicus
gggtcagttccacaagatcgtcagg

SEQ ID NO: 459201 - DNA, 25 bp, Rattus norvegicus
gggtcagttccagaagatcgtcagg

SEQ ID NO: 459202 - DNA, 25 bp, Rattus norvegicus
gggtcagttgaacaacctgctctgt

SEQ ID NO: 459203 - DNA, 25 bp, Rattus norvegicus
gggtcagttgaagaacctgctctgt

SEQ ID NO: 459204 - DNA, 25 bp, Rattus norvegicus
gggtcagttgtgataagactgctca

SEQ ID NO: 459205 - DNA, 25 bp, Rattus norvegicus
gggtcagttgtgttaagactgctca

SEQ ID NO: 459206 - DNA, 25 bp, Rattus norvegicus
gggtcagtttatcctgtatctgctc

SEQ ID NO: 459207 - DNA, 25 bp, Rattus norvegicus
gggtcagtttatgctgtatctgctc

SEQ ID NO: 459208 - DNA, 25 bp, Rattus norvegicus
gggtcataaaatcaaagccagtgta

SEQ ID NO: 459209 - DNA, 25 bp, Rattus norvegicus
gggtcataaaatgaaagccagtgta

SEQ ID NO: 459210 - DNA, 25 bp, Rattus norvegicus
gggtcataactcacagtctcctttg

SEQ ID NO: 459211 - DNA, 25 bp, Rattus norvegicus
gggtcataactctcagtctcctttg

SEQ ID NO: 459212 - DNA, 25 bp, Rattus norvegicus
gggtcataccagcatatcaagaaaa

SEQ ID NO: 459213 - DNA, 25 bp, Rattus norvegicus
gggtcataccaggatatcaagaaaa

SEQ ID NO: 459214 - DNA, 25 bp, Rattus norvegicus
gggtcatacttccttgtcagacaat

SEQ ID NO: 459215 - DNA, 25 bp, Rattus norvegicus
gggtcatacttcgttgtcagacaat

SEQ ID NO: 459216 - DNA, 25 bp, Rattus norvegicus
gggtcatatagtacattgatttgga

SEQ ID NO: 459217 - DNA, 25 bp, Rattus norvegicus
gggtcatatagttcattgatttgga

SEQ ID NO: 459218 - DNA, 25 bp, Rattus norvegicus
gggtcatatatgctccatgtctgtg

SEQ ID NO: 459219 - DNA, 25 bp, Rattus norvegicus
gggtcatatatggtccatgtctgtg

SEQ ID NO: 459220 - DNA, 25 bp, Rattus norvegicus
gggtcatatccacgccataagaggg

SEQ ID NO: 459221 - DNA, 25 bp, Rattus norvegicus
gggtcatatccaggccataagaggg

SEQ ID NO: 459222 - DNA, 25 bp, Rattus norvegicus
gggtcatattccacagaaagtcttc

SEQ ID NO: 459223 - DNA, 25 bp, Rattus norvegicus
gggtcatattcctcagaaagtcttc

SEQ ID NO: 459224 - DNA, 25 bp, Rattus norvegicus
gggtcatcaaatcacactccgatat

SEQ ID NO: 459225 - DNA, 25 bp, Rattus norvegicus
gggtcatcaaatgacactccgatat

SEQ ID NO: 459226 - DNA, 25 bp, Rattus norvegicus
gggtcatcaaggcttcttaatttgt

SEQ ID NO: 459227 - DNA, 25 bp, Rattus norvegicus
gggtcatcaagggttcttaatttgt

SEQ ID NO: 459228 - DNA, 25 bp, Rattus norvegicus
gggtcatcacagcattaactcgcca

SEQ ID NO: 459229 - DNA, 25 bp, Rattus norvegicus
gggtcatcacaggattaactcgcca

SEQ ID NO: 459230 - DNA, 25 bp, Rattus norvegicus
gggtcatcaggtactcccgatctgg

SEQ ID NO: 459231 - DNA, 25 bp, Rattus norvegicus
gggtcatcaggttctcccgatctgg

SEQ ID NO: 459232 - DNA, 25 bp, Rattus norvegicus
gggtcatcatatcgtcgtccaataa

SEQ ID NO: 459233 - DNA, 25 bp, Rattus norvegicus
gggtcatcatatggtcgtccaataa

SEQ ID NO: 459234 - DNA, 25 bp, Rattus norvegicus
gggtcatcattgacctcagaatgta

SEQ ID NO: 459235 - DNA, 25 bp, Rattus norvegicus
gggtcatcattgtcctcagaatgta

SEQ ID NO: 459236 - DNA, 25 bp, Rattus norvegicus
gggtcatccaggaccttcagaattc

SEQ ID NO: 459237 - DNA, 25 bp, Rattus norvegicus
gggtcatccaggtccttcagaattc

SEQ ID NO: 459238 - DNA, 25 bp, Rattus norvegicus
gggtcatcccatcggtggcacacca

SEQ ID NO: 459239 - DNA, 25 bp, Rattus norvegicus
gggtcatcccatgggtggcacacca

SEQ ID NO: 459240 - DNA, 25 bp, Rattus norvegicus
gggtcatccccgaggtgagaaataa

SEQ ID NO: 459241 - DNA, 25 bp, Rattus norvegicus
gggtcatccccgtggtgagaaataa

SEQ ID NO: 459242 - DNA, 25 bp, Rattus norvegicus
gggtcatcccgacatctatgaggat

SEQ ID NO: 459243 - DNA, 25 bp, Rattus norvegicus
gggtcatcccgagatctatgaggat

SEQ ID NO: 459244 - DNA, 25 bp, Rattus norvegicus
gggtcatccctccattgtagagtac

SEQ ID NO: 459245 - DNA, 25 bp, Rattus norvegicus
gggtcatccctcgattgtagagtac

SEQ ID NO: 459246 - DNA, 25 bp, Rattus norvegicus
gggtcatccgtgatcataggaatct

SEQ ID NO: 459247 - DNA, 25 bp, Rattus norvegicus
gggtcatccgtgttcataggaatct

SEQ ID NO: 459248 - DNA, 25 bp, Rattus norvegicus
gggtcatcgtcacaggctggcccca

SEQ ID NO: 459249 - DNA, 25 bp, Rattus norvegicus
gggtcatcgtcagaggctggcccca

SEQ ID NO: 459250 - DNA, 25 bp, Rattus norvegicus
gggtcatcgtcgcaatccttcagac

SEQ ID NO: 459251 - DNA, 25 bp, Rattus norvegicus
gggtcatcgtcggaatccttcagac

SEQ ID NO: 459252 - DNA, 25 bp, Rattus norvegicus
gggtcatctataagctcatccaagc

SEQ ID NO: 459253 - DNA, 25 bp, Rattus norvegicus
gggtcatctatatgctcatccaagc

SEQ ID NO: 459254 - DNA, 25 bp, Rattus norvegicus
gggtcatctcctacatgcagagtga

SEQ ID NO: 459255 - DNA, 25 bp, Rattus norvegicus
gggtcatctccttcatgcagagtga

SEQ ID NO: 459256 - DNA, 25 bp, Rattus norvegicus
gggtcatctgttatttacttcttat

SEQ ID NO: 459257 - DNA, 25 bp, Rattus norvegicus
gggtcatctgttttttacttcttat

SEQ ID NO: 459258 - DNA, 25 bp, Rattus norvegicus
gggtcatgaactacacctgctgtaa

SEQ ID NO: 459259 - DNA, 25 bp, Rattus norvegicus
gggtcatgaacttcacctgctgtaa

SEQ ID NO: 459260 - DNA, 25 bp, Rattus norvegicus
gggtcatgacccacaagttctagaa

SEQ ID NO: 459261 - DNA, 25 bp, Rattus norvegicus
gggtcatgaccctcaagttctagaa

SEQ ID NO: 459262 - DNA, 25 bp, Rattus norvegicus
gggtcatgactaaaattgcttgctc

SEQ ID NO: 459263 - DNA, 25 bp, Rattus norvegicus
gggtcatgactataattgcttgctc

SEQ ID NO: 459264 - DNA, 25 bp, Rattus norvegicus
gggtcatgatgaagcctcaaggccc

SEQ ID NO: 459265 - DNA, 25 bp, Rattus norvegicus
gggtcatgatgatgcctcaaggccc

SEQ ID NO: 459266 - DNA, 25 bp, Rattus norvegicus
gggtcatgatgcacatatcctgtga

SEQ ID NO: 459267 - DNA, 25 bp, Rattus norvegicus
gggtcatgatgctcatatcctgtga

SEQ ID NO: 459268 - DNA, 25 bp, Rattus norvegicus
gggtcatgccagctttttcttagga

SEQ ID NO: 459269 - DNA, 25 bp, Rattus norvegicus
gggtcatgccaggtttttcttagga

SEQ ID NO: 459270 - DNA, 25 bp, Rattus norvegicus
gggtcatggtacacaatgaggaaga

SEQ ID NO: 459271 - DNA, 25 bp, Rattus norvegicus
gggtcatggtactcaatgaggaaga

SEQ ID NO: 459272 - DNA, 25 bp, Rattus norvegicus
gggtcatggtttagttttcgaatct

SEQ ID NO: 459273 - DNA, 25 bp, Rattus norvegicus
gggtcatggttttgttttcgaatct

SEQ ID NO: 459274 - DNA, 25 bp, Rattus norvegicus
gggtcatgtgtacctttttctgtgg

SEQ ID NO: 459275 - DNA, 25 bp, Rattus norvegicus
gggtcatgtgtagctttttctgtgg

SEQ ID NO: 459276 - DNA, 25 bp, Rattus norvegicus
gggtcatgtgttcctgccctcatac

SEQ ID NO: 459277 - DNA, 25 bp, Rattus norvegicus
gggtcatgtgttgctgccctcatac

SEQ ID NO: 459278 - DNA, 25 bp, Rattus norvegicus
gggtcatgttcgactgatgctttca

SEQ ID NO: 459279 - DNA, 25 bp, Rattus norvegicus
gggtcatgttcgtctgatgctttca

SEQ ID NO: 459280 - DNA, 25 bp, Rattus norvegicus
gggtcattaattctgctcgctgaca

SEQ ID NO: 459281 - DNA, 25 bp, Rattus norvegicus
gggtcattaattgtgctcgctgaca

SEQ ID NO: 459282 - DNA, 25 bp, Rattus norvegicus
gggtcattagcaacaaggatagcct

SEQ ID NO: 459283 - DNA, 25 bp, Rattus norvegicus
gggtcattagcatcaaggatagcct

SEQ ID NO: 459284 - DNA, 25 bp, Rattus norvegicus
gggtcattatcaattgattcccact

SEQ ID NO: 459285 - DNA, 25 bp, Rattus norvegicus
gggtcattatcatttgattcccact

SEQ ID NO: 459286 - DNA, 25 bp, Rattus norvegicus
gggtcattcaaaacctgggtgtcaa

SEQ ID NO: 459287 - DNA, 25 bp, Rattus norvegicus
gggtcattcaaatcctgggtgtcaa

SEQ ID NO: 459288 - DNA, 25 bp, Rattus norvegicus
gggtcattcactatcctgtattttt

SEQ ID NO: 459289 - DNA, 25 bp, Rattus norvegicus
gggtcattcactttcctgtattttt

SEQ ID NO: 459290 - DNA, 25 bp, Rattus norvegicus
gggtcattcagaacaacccacatct

SEQ ID NO: 459291 - DNA, 25 bp, Rattus norvegicus
gggtcattcagatcaacccacatct

SEQ ID NO: 459292 - DNA, 25 bp, Rattus norvegicus
gggtcattccaactggtcgagtgtc

SEQ ID NO: 459293 - DNA, 25 bp, Rattus norvegicus
gggtcattccaagtggtcgagtgtc

SEQ ID NO: 459294 - DNA, 25 bp, Rattus norvegicus
gggtcattctcaacaaaccagcaca

SEQ ID NO: 459295 - DNA, 25 bp, Rattus norvegicus
gggtcattctcatcaaaccagcaca

SEQ ID NO: 459296 - DNA, 25 bp, Rattus norvegicus
gggtcattgagactggcctttaaag

SEQ ID NO: 459297 - DNA, 25 bp, Rattus norvegicus
gggtcattgagagtggcctttaaag

SEQ ID NO: 459298 - DNA, 25 bp, Rattus norvegicus
gggtcattgcccactcagggaaaca

SEQ ID NO: 459299 - DNA, 25 bp, Rattus norvegicus
gggtcattgccctctcagggaaaca

SEQ ID NO: 459300 - DNA, 25 bp, Rattus norvegicus
gggtcattggtacttaggactgcta

SEQ ID NO: 459301 - DNA, 25 bp, Rattus norvegicus
gggtcattggtagttaggactgcta

SEQ ID NO: 459302 - DNA, 25 bp, Rattus norvegicus
gggtcattgtcccaaagtaattcaa

SEQ ID NO: 459303 - DNA, 25 bp, Rattus norvegicus
gggtcattgtccgaaagtaattcaa

SEQ ID NO: 459304 - DNA, 25 bp, Rattus norvegicus
gggtcatttatcctcatagacaaag

SEQ ID NO: 459305 - DNA, 25 bp, Rattus norvegicus
gggtcatttatcgtcatagacaaag

SEQ ID NO: 459306 - DNA, 25 bp, Rattus norvegicus
gggtcatttccccagtgtcgctgcc

SEQ ID NO: 459307 - DNA, 25 bp, Rattus norvegicus
gggtcatttcccgagtgtcgctgcc

SEQ ID NO: 459308 - DNA, 25 bp, Rattus norvegicus
gggtcatttggcagcgccgtacctg

SEQ ID NO: 459309 - DNA, 25 bp, Rattus norvegicus
gggtcatttggctgcgccgtacctg

SEQ ID NO: 459310 - DNA, 25 bp, Rattus norvegicus
gggtcatttgtaatctttcatttta

SEQ ID NO: 459311 - DNA, 25 bp, Rattus norvegicus
gggtcatttgtattctttcatttta

SEQ ID NO: 459312 - DNA, 25 bp, Rattus norvegicus
gggtcattttctatcccttcgggat

SEQ ID NO: 459313 - DNA, 25 bp, Rattus norvegicus
gggtcattttctttcccttcgggat

SEQ ID NO: 459314 - DNA, 25 bp, Rattus norvegicus
gggtcatttttcacaaactgtgtat

SEQ ID NO: 459315 - DNA, 25 bp, Rattus norvegicus
gggtcatttttctcaaactgtgtat

SEQ ID NO: 459316 - DNA, 25 bp, Rattus norvegicus
gggtccaaaacaactaggcgtcagt

SEQ ID NO: 459317 - DNA, 25 bp, Rattus norvegicus
gggtccaaaacatctaggcgtcagt

SEQ ID NO: 459318 - DNA, 25 bp, Rattus norvegicus
gggtccaaagtgcttagctcccagg

SEQ ID NO: 459319 - DNA, 25 bp, Rattus norvegicus
gggtccaaagtggttagctcccagg

SEQ ID NO: 459320 - DNA, 25 bp, Rattus norvegicus
gggtccaaatatattcaagccatgt

SEQ ID NO: 459321 - DNA, 25 bp, Rattus norvegicus
gggtccaaatattttcaagccatgt

SEQ ID NO: 459322 - DNA, 25 bp, Rattus norvegicus
gggtccaacactagtaccagcttca

SEQ ID NO: 459323 - DNA, 25 bp, Rattus norvegicus
gggtccaacacttgtaccagcttca

SEQ ID NO: 459324 - DNA, 25 bp, Rattus norvegicus
gggtccaagaatacatcactgagct

SEQ ID NO: 459325 - DNA, 25 bp, Rattus norvegicus
gggtccaagaattcatcactgagct

SEQ ID NO: 459326 - DNA, 25 bp, Rattus norvegicus
gggtccaaggccacttaacaagaca

SEQ ID NO: 459327 - DNA, 25 bp, Rattus norvegicus
gggtccaaggccatgtattgtttac

SEQ ID NO: 459328 - DNA, 25 bp, Rattus norvegicus
gggtccaaggcctcttaacaagaca

SEQ ID NO: 459329 - DNA, 25 bp, Rattus norvegicus
gggtccaaggccttgtattgtttac

SEQ ID NO: 459330 - DNA, 25 bp, Rattus norvegicus
gggtccaagggtcaagccaatgaat

SEQ ID NO: 459331 - DNA, 25 bp, Rattus norvegicus
gggtccaagggtgaagccaatgaat

SEQ ID NO: 459332 - DNA, 25 bp, Rattus norvegicus
gggtccaagtgacttcacgaatctt

SEQ ID NO: 459333 - DNA, 25 bp, Rattus norvegicus
gggtccaagtgagttcacgaatctt

SEQ ID NO: 459334 - DNA, 25 bp, Rattus norvegicus
gggtccaagtttatacaagcagaat

SEQ ID NO: 459335 - DNA, 25 bp, Rattus norvegicus
gggtccaagtttttacaagcagaat

SEQ ID NO: 459336 - DNA, 25 bp, Rattus norvegicus
gggtccaataagaactcacagagtg

SEQ ID NO: 459337 - DNA, 25 bp, Rattus norvegicus
gggtccaataagtactcacagagtg

SEQ ID NO: 459338 - DNA, 25 bp, Rattus norvegicus
gggtccacactgagatatgcaaggt

SEQ ID NO: 459339 - DNA, 25 bp, Rattus norvegicus
gggtccacactgtgatatgcaaggt

SEQ ID NO: 459340 - DNA, 25 bp, Rattus norvegicus
gggtccacagaacaaccgccagcgt

SEQ ID NO: 459341 - DNA, 25 bp, Rattus norvegicus
gggtccacagaagaaccgccagcgt

SEQ ID NO: 459342 - DNA, 25 bp, Rattus norvegicus
gggtccacagcacccaagaggtgat

SEQ ID NO: 459343 - DNA, 25 bp, Rattus norvegicus
gggtccacagcagccaagaggtgat

SEQ ID NO: 459344 - DNA, 25 bp, Rattus norvegicus
gggtccacagtgcttggctatattc

SEQ ID NO: 459345 - DNA, 25 bp, Rattus norvegicus
gggtccacagtggttggctatattc

SEQ ID NO: 459346 - DNA, 25 bp, Rattus norvegicus
gggtccacatacaggacagtccatc

SEQ ID NO: 459347 - DNA, 25 bp, Rattus norvegicus
gggtccacatactggacagtccatc

SEQ ID NO: 459348 - DNA, 25 bp, Rattus norvegicus
gggtccacatgaatggcccaatgcc

SEQ ID NO: 459349 - DNA, 25 bp, Rattus norvegicus
gggtccacatgattggcccaatgcc

SEQ ID NO: 459350 - DNA, 25 bp, Rattus norvegicus
gggtccaccgcaacgatgctgagga

SEQ ID NO: 459351 - DNA, 25 bp, Rattus norvegicus
gggtccaccgcatcgatgctgagga

SEQ ID NO: 459352 - DNA, 25 bp, Rattus norvegicus
gggtccacctaaaaactgcagtcgt

SEQ ID NO: 459353 - DNA, 25 bp, Rattus norvegicus
gggtccacctaataactgcagtcgt

SEQ ID NO: 459354 - DNA, 25 bp, Rattus norvegicus
gggtccacggctatcagctcaagag

SEQ ID NO: 459355 - DNA, 25 bp, Rattus norvegicus
gggtccacggctttcagctcaagag

SEQ ID NO: 459356 - DNA, 25 bp, Rattus norvegicus
gggtccactagacagtttccaggtt

SEQ ID NO: 459357 - DNA, 25 bp, Rattus norvegicus
gggtccactagagagtttccaggtt

SEQ ID NO: 459358 - DNA, 25 bp, Rattus norvegicus
gggtccactatcagtactttgccat

SEQ ID NO: 459359 - DNA, 25 bp, Rattus norvegicus
gggtccactatctgtactttgccat

SEQ ID NO: 459360 - DNA, 25 bp, Rattus norvegicus
gggtccactctcaaaaagtacatgt

SEQ ID NO: 459361 - DNA, 25 bp, Rattus norvegicus
gggtccactctctaaaagtacatgt

SEQ ID NO: 459362 - DNA, 25 bp, Rattus norvegicus
gggtccactctgagatctggtgaag

SEQ ID NO: 459363 - DNA, 25 bp, Rattus norvegicus
gggtccactctgtgatctggtgaag

SEQ ID NO: 459364 - DNA, 25 bp, Rattus norvegicus
gggtccagaacaccgccagtagcct

SEQ ID NO: 459365 - DNA, 25 bp, Rattus norvegicus
gggtccagaacagcgccagtagcct

SEQ ID NO: 459366 - DNA, 25 bp, Rattus norvegicus
gggtccagacccacacagaggagga

SEQ ID NO: 459367 - DNA, 25 bp, Rattus norvegicus
gggtccagaccctcacagaggagga

SEQ ID NO: 459368 - DNA, 25 bp, Rattus norvegicus
gggtccagactgagaatcctgtgct

SEQ ID NO: 459369 - DNA, 25 bp, Rattus norvegicus
gggtccagactgtgaatcctgtgct

SEQ ID NO: 459370 - DNA, 25 bp, Rattus norvegicus
gggtccagagcaaggtagttcaaac

SEQ ID NO: 459371 - DNA, 25 bp, Rattus norvegicus
gggtccagagcacagaacagacatt

SEQ ID NO: 459372 - DNA, 25 bp, Rattus norvegicus
gggtccagagcagagaacagacatt

SEQ ID NO: 459373 - DNA, 25 bp, Rattus norvegicus
gggtccagagcatggtagttcaaac

SEQ ID NO: 459374 - DNA, 25 bp, Rattus norvegicus
gggtccagagccatcctgggaagaa

SEQ ID NO: 459375 - DNA, 25 bp, Rattus norvegicus
gggtccagagccttcctgggaagaa

SEQ ID NO: 459376 - DNA, 25 bp, Rattus norvegicus
gggtccagagtcacctcagaagaca

SEQ ID NO: 459377 - DNA, 25 bp, Rattus norvegicus
gggtccagagtctcctcagaagaca

SEQ ID NO: 459378 - DNA, 25 bp, Rattus norvegicus
gggtccagcaccacctctggagttc

SEQ ID NO: 459379 - DNA, 25 bp, Rattus norvegicus
gggtccagcacctcctctggagttc

SEQ ID NO: 459380 - DNA, 25 bp, Rattus norvegicus
gggtccagccatctcatttacagac

SEQ ID NO: 459381 - DNA, 25 bp, Rattus norvegicus
gggtccagccatgtcatttacagac

SEQ ID NO: 459382 - DNA, 25 bp, Rattus norvegicus
gggtccagctgcaatatctgagttg

SEQ ID NO: 459383 - DNA, 25 bp, Rattus norvegicus
gggtccagctgctatatctgagttg

SEQ ID NO: 459384 - DNA, 25 bp, Rattus norvegicus
gggtccagcttgcttcagacagaaa

SEQ ID NO: 459385 - DNA, 25 bp, Rattus norvegicus
gggtccagcttggttcagacagaaa

SEQ ID NO: 459386 - DNA, 25 bp, Rattus norvegicus
gggtccaggagtcacctccactctg

SEQ ID NO: 459387 - DNA, 25 bp, Rattus norvegicus
gggtccaggagtgacctccactctg

SEQ ID NO: 459388 - DNA, 25 bp, Rattus norvegicus
gggtccaggattccagactgtatga

SEQ ID NO: 459389 - DNA, 25 bp, Rattus norvegicus
gggtccaggattgcagactgtatga

SEQ ID NO: 459390 - DNA, 25 bp, Rattus norvegicus
gggtccaggctccatttaggattcg

SEQ ID NO: 459391 - DNA, 25 bp, Rattus norvegicus
gggtccaggctcgatttaggattcg

SEQ ID NO: 459392 - DNA, 25 bp, Rattus norvegicus
gggtccaggctgacatgggttacaa

SEQ ID NO: 459393 - DNA, 25 bp, Rattus norvegicus
gggtccaggctgtcatgggttacaa

SEQ ID NO: 459394 - DNA, 25 bp, Rattus norvegicus
gggtccaggtagagacttccccaag

SEQ ID NO: 459395 - DNA, 25 bp, Rattus norvegicus
gggtccaggtagtgacttccccaag

SEQ ID NO: 459396 - DNA, 25 bp, Rattus norvegicus
gggtccagtacaaatttccaggtgt

SEQ ID NO: 459397 - DNA, 25 bp, Rattus norvegicus
gggtccagtacatatttccaggtgt

SEQ ID NO: 459398 - DNA, 25 bp, Rattus norvegicus
gggtccagtcacagagcttccatca

SEQ ID NO: 459399 - DNA, 25 bp, Rattus norvegicus
gggtccagtcactgagcttccatca

SEQ ID NO: 459400 - DNA, 25 bp, Rattus norvegicus
gggtccagtgaaaaggcttcctacg

SEQ ID NO: 459401 - DNA, 25 bp, Rattus norvegicus
gggtccagtgaataggcttcctacg

SEQ ID NO: 459402 - DNA, 25 bp, Rattus norvegicus
gggtccagttatccagttagttgtt

SEQ ID NO: 459403 - DNA, 25 bp, Rattus norvegicus
gggtccagttatgcagttagttgtt

SEQ ID NO: 459404 - DNA, 25 bp, Rattus norvegicus
gggtccagttgaattgtgtattttt

SEQ ID NO: 459405 - DNA, 25 bp, Rattus norvegicus
gggtccagttgatttgtgtattttt

SEQ ID NO: 459406 - DNA, 25 bp, Rattus norvegicus
gggtccagtttaaactgaggtggct

SEQ ID NO: 459407 - DNA, 25 bp, Rattus norvegicus
gggtccagtttatactgaggtggct

SEQ ID NO: 459408 - DNA, 25 bp, Rattus norvegicus
gggtccataacaacaatgccatcgc

SEQ ID NO: 459409 - DNA, 25 bp, Rattus norvegicus
gggtccataacatcaatgccatcgc

SEQ ID NO: 459410 - DNA, 25 bp, Rattus norvegicus
gggtccatagctagagctcaataga

SEQ ID NO: 459411 - DNA, 25 bp, Rattus norvegicus
gggtccatagctccttgatttgctt

SEQ ID NO: 459412 - DNA, 25 bp, Rattus norvegicus
gggtccatagctgcttgatttgctt

SEQ ID NO: 459413 - DNA, 25 bp, Rattus norvegicus
gggtccatagcttgagctcaataga

SEQ ID NO: 459414 - DNA, 25 bp, Rattus norvegicus
gggtccatcaaaagccaccaaagcg

SEQ ID NO: 459415 - DNA, 25 bp, Rattus norvegicus
gggtccatcaaatgccaccaaagcg

SEQ ID NO: 459416 - DNA, 25 bp, Rattus norvegicus
gggtccatcattctacttatgcttc

SEQ ID NO: 459417 - DNA, 25 bp, Rattus norvegicus
gggtccatcattgtacttatgcttc

SEQ ID NO: 459418 - DNA, 25 bp, Rattus norvegicus
gggtccatcccactgatgcatgaac

SEQ ID NO: 459419 - DNA, 25 bp, Rattus norvegicus
gggtccatcccagtgatgcatgaac

SEQ ID NO: 459420 - DNA, 25 bp, Rattus norvegicus
gggtccatcgcacgatgctaatgct

SEQ ID NO: 459421 - DNA, 25 bp, Rattus norvegicus
gggtccatcgcaggatgctaatgct

SEQ ID NO: 459422 - DNA, 25 bp, Rattus norvegicus
gggtccatctctctgtgagacgcta

SEQ ID NO: 459423 - DNA, 25 bp, Rattus norvegicus
gggtccatctctgtgtgagacgcta

SEQ ID NO: 459424 - DNA, 25 bp, Rattus norvegicus
gggtccatcttgcatggctacactt

SEQ ID NO: 459425 - DNA, 25 bp, Rattus norvegicus
gggtccatcttggatggctacactt

SEQ ID NO: 459426 - DNA, 25 bp, Rattus norvegicus
gggtccatgcacaggcggttttcga

SEQ ID NO: 459427 - DNA, 25 bp, Rattus norvegicus
gggtccatgcactggcggttttcga

SEQ ID NO: 459428 - DNA, 25 bp, Rattus norvegicus
gggtccatgcctacaattatcattt

SEQ ID NO: 459429 - DNA, 25 bp, Rattus norvegicus
gggtccatgccttcaattatcattt

SEQ ID NO: 459430 - DNA, 25 bp, Rattus norvegicus
gggtccatggcacaagttacatcta

SEQ ID NO: 459431 - DNA, 25 bp, Rattus norvegicus
gggtccatggcagaagttacatcta

SEQ ID NO: 459432 - DNA, 25 bp, Rattus norvegicus
gggtccatgggtcactgatgactaa

SEQ ID NO: 459433 - DNA, 25 bp, Rattus norvegicus
gggtccatgggtgactgatgactaa

SEQ ID NO: 459434 - DNA, 25 bp, Rattus norvegicus
gggtccatgtccagatttttctttg

SEQ ID NO: 459435 - DNA, 25 bp, Rattus norvegicus
gggtccatgtcctgatttttctttg

SEQ ID NO: 459436 - DNA, 25 bp, Rattus norvegicus
gggtccatgtgcagacagactcact

SEQ ID NO: 459437 - DNA, 25 bp, Rattus norvegicus
gggtccatgtgctgacagactcact

SEQ ID NO: 459438 - DNA, 25 bp, Rattus norvegicus
gggtccatgttcagctgcagcagaa

SEQ ID NO: 459439 - DNA, 25 bp, Rattus norvegicus
gggtccatgttctgctgcagcagaa

SEQ ID NO: 459440 - DNA, 25 bp, Rattus norvegicus
gggtccattcgtatgttgcctttat

SEQ ID NO: 459441 - DNA, 25 bp, Rattus norvegicus
gggtccattcgtttgttgcctttat

SEQ ID NO: 459442 - DNA, 25 bp, Rattus norvegicus
gggtccattctacaattcgtcattt

SEQ ID NO: 459443 - DNA, 25 bp, Rattus norvegicus
gggtccattctagaattcgtcattt

SEQ ID NO: 459444 - DNA, 25 bp, Rattus norvegicus
gggtccattctgaagggcttctcct

SEQ ID NO: 459445 - DNA, 25 bp, Rattus norvegicus
gggtccattctgtagggcttctcct

SEQ ID NO: 459446 - DNA, 25 bp, Rattus norvegicus
gggtccatttggcaggtctctcttg

SEQ ID NO: 459447 - DNA, 25 bp, Rattus norvegicus
gggtccatttgggaggtctctcttg

SEQ ID NO: 459448 - DNA, 25 bp, Rattus norvegicus
gggtcccaacccaaatggcagaagg

SEQ ID NO: 459449 - DNA, 25 bp, Rattus norvegicus
gggtcccaaccctaatggcagaagg

SEQ ID NO: 459450 - DNA, 25 bp, Rattus norvegicus
gggtcccaacctcatggttaatgca

SEQ ID NO: 459451 - DNA, 25 bp, Rattus norvegicus
gggtcccaacctgatggttaatgca

SEQ ID NO: 459452 - DNA, 25 bp, Rattus norvegicus
gggtcccaatctcctttgaggtgaa

SEQ ID NO: 459453 - DNA, 25 bp, Rattus norvegicus
gggtcccaatctgctttgaggtgaa

SEQ ID NO: 459454 - DNA, 25 bp, Rattus norvegicus
gggtcccacggaagcatctcagatg

SEQ ID NO: 459455 - DNA, 25 bp, Rattus norvegicus
gggtcccacggatgcatctcagatg

SEQ ID NO: 459456 - DNA, 25 bp, Rattus norvegicus
gggtcccactcaccatgagtgtgag

SEQ ID NO: 459457 - DNA, 25 bp, Rattus norvegicus
gggtcccactcagcatgagtgtgag

SEQ ID NO: 459458 - DNA, 25 bp, Rattus norvegicus
gggtcccactgaatgactatgtgtg

SEQ ID NO: 459459 - DNA, 25 bp, Rattus norvegicus
gggtcccactgattgactatgtgtg

SEQ ID NO: 459460 - DNA, 25 bp, Rattus norvegicus
gggtcccagaaaagagggccagcta

SEQ ID NO: 459461 - DNA, 25 bp, Rattus norvegicus
gggtcccagaaatgagggccagcta

SEQ ID NO: 459462 - DNA, 25 bp, Rattus norvegicus
gggtcccagaacaaccatgtttgtc

SEQ ID NO: 459463 - DNA, 25 bp, Rattus norvegicus
gggtcccagaactaccatgtttgtc

SEQ ID NO: 459464 - DNA, 25 bp, Rattus norvegicus
gggtcccagacaaatgcatgcttct

SEQ ID NO: 459465 - DNA, 25 bp, Rattus norvegicus
gggtcccagacatatgcatgcttct

SEQ ID NO: 459466 - DNA, 25 bp, Rattus norvegicus
gggtcccagcatcagttcggctact

SEQ ID NO: 459467 - DNA, 25 bp, Rattus norvegicus
gggtcccagcatgagttcggctact

SEQ ID NO: 459468 - DNA, 25 bp, Rattus norvegicus
gggtcccagccaagaggcacattta

SEQ ID NO: 459469 - DNA, 25 bp, Rattus norvegicus
gggtcccagccatgaggcacattta

SEQ ID NO: 459470 - DNA, 25 bp, Rattus norvegicus
gggtcccaggaaactagtgcaactt

SEQ ID NO: 459471 - DNA, 25 bp, Rattus norvegicus
gggtcccaggaatctagtgcaactt

SEQ ID NO: 459472 - DNA, 25 bp, Rattus norvegicus
gggtcccaggatagcaacactcatt

SEQ ID NO: 459473 - DNA, 25 bp, Rattus norvegicus
gggtcccaggattgcaacactcatt

SEQ ID NO: 459474 - DNA, 25 bp, Rattus norvegicus
gggtcccagggaactaactcaggct

SEQ ID NO: 459475 - DNA, 25 bp, Rattus norvegicus
gggtcccagggatctaactcaggct

SEQ ID NO: 459476 - DNA, 25 bp, Rattus norvegicus
gggtcccagggcatgtgtacaccat

SEQ ID NO: 459477 - DNA, 25 bp, Rattus norvegicus
gggtcccagggcttgtgtacaccat

SEQ ID NO: 459478 - DNA, 25 bp, Rattus norvegicus
gggtcccagggtacttcagaaatct

SEQ ID NO: 459479 - DNA, 25 bp, Rattus norvegicus
gggtcccagggttcttcagaaatct

SEQ ID NO: 459480 - DNA, 25 bp, Rattus norvegicus
gggtcccagtataacaatcctaggt

SEQ ID NO: 459481 - DNA, 25 bp, Rattus norvegicus
gggtcccagtattacaatcctaggt

SEQ ID NO: 459482 - DNA, 25 bp, Rattus norvegicus
gggtcccagtgcagccttgctgcag

SEQ ID NO: 459483 - DNA, 25 bp, Rattus norvegicus
gggtcccagtgctgccttgctgcag

SEQ ID NO: 459484 - DNA, 25 bp, Rattus norvegicus
gggtcccatactcttatacacagaa

SEQ ID NO: 459485 - DNA, 25 bp, Rattus norvegicus
gggtcccatactgttatacacagaa

SEQ ID NO: 459486 - DNA, 25 bp, Rattus norvegicus
gggtcccatcaacagatttataact

SEQ ID NO: 459487 - DNA, 25 bp, Rattus norvegicus
gggtcccatcaagagatttataact

SEQ ID NO: 459488 - DNA, 25 bp, Rattus norvegicus
gggtcccatctaaacagaccgagag

SEQ ID NO: 459489 - DNA, 25 bp, Rattus norvegicus
gggtcccatctatacagaccgagag

SEQ ID NO: 459490 - DNA, 25 bp, Rattus norvegicus
gggtcccatgttctacctctgagga

SEQ ID NO: 459491 - DNA, 25 bp, Rattus norvegicus
gggtcccatgttgtacctctgagga

SEQ ID NO: 459492 - DNA, 25 bp, Rattus norvegicus
gggtcccattaaccttctcattaat

SEQ ID NO: 459493 - DNA, 25 bp, Rattus norvegicus
gggtcccattaagcttctcattaat

SEQ ID NO: 459494 - DNA, 25 bp, Rattus norvegicus
gggtcccatttgcatatcagcacat

SEQ ID NO: 459495 - DNA, 25 bp, Rattus norvegicus
gggtcccatttggatatcagcacat

SEQ ID NO: 459496 - DNA, 25 bp, Rattus norvegicus
gggtccccaacgcagaagaactgtt

SEQ ID NO: 459497 - DNA, 25 bp, Rattus norvegicus
gggtccccaacggagaagaactgtt

SEQ ID NO: 459498 - DNA, 25 bp, Rattus norvegicus
gggtccccaactccaagtctggtga

SEQ ID NO: 459499 - DNA, 25 bp, Rattus norvegicus
gggtccccaactgcaagtctggtga

SEQ ID NO: 459500 - DNA, 25 bp, Rattus norvegicus
gggtccccagagacatcccagctgt

SEQ ID NO: 459501 - DNA, 25 bp, Rattus norvegicus
gggtccccagagtcatcccagctgt

SEQ ID NO: 459502 - DNA, 25 bp, Rattus norvegicus
gggtccccagtgatatccacggaga

SEQ ID NO: 459503 - DNA, 25 bp, Rattus norvegicus
gggtccccagtgttatccacggaga

SEQ ID NO: 459504 - DNA, 25 bp, Rattus norvegicus
gggtccccatgtatgacagcgagtc

SEQ ID NO: 459505 - DNA, 25 bp, Rattus norvegicus
gggtccccatgtttgacagcgagtc

SEQ ID NO: 459506 - DNA, 25 bp, Rattus norvegicus
gggtccccgagaactcaggaatttt

SEQ ID NO: 459507 - DNA, 25 bp, Rattus norvegicus
gggtccccgagatctcaggaatttt

SEQ ID NO: 459508 - DNA, 25 bp, Rattus norvegicus
gggtccccggaacatgtgcaagaat

SEQ ID NO: 459509 - DNA, 25 bp, Rattus norvegicus
gggtccccggaagatgtgcaagaat

SEQ ID NO: 459510 - DNA, 25 bp, Rattus norvegicus
gggtcccctctgcaagctcagagag

SEQ ID NO: 459511 - DNA, 25 bp, Rattus norvegicus
gggtcccctctggaagctcagagag

SEQ ID NO: 459512 - DNA, 25 bp, Rattus norvegicus
gggtcccctcttctcagattgtccg

SEQ ID NO: 459513 - DNA, 25 bp, Rattus norvegicus
gggtcccctcttgtcagattgtccg

SEQ ID NO: 459514 - DNA, 25 bp, Rattus norvegicus
gggtcccctgccagataaattatta

SEQ ID NO: 459515 - DNA, 25 bp, Rattus norvegicus
gggtcccctgcctgataaattatta

SEQ ID NO: 459516 - DNA, 25 bp, Rattus norvegicus
gggtccccttccagtgccaagcaaa

SEQ ID NO: 459517 - DNA, 25 bp, Rattus norvegicus
gggtccccttcctgtgccaagcaaa

SEQ ID NO: 459518 - DNA, 25 bp, Rattus norvegicus
gggtcccctttgacggagatgacat

SEQ ID NO: 459519 - DNA, 25 bp, Rattus norvegicus
gggtcccctttgagaaatatcgatg

SEQ ID NO: 459520 - DNA, 25 bp, Rattus norvegicus
gggtcccctttgcagcacaaagcag

SEQ ID NO: 459521 - DNA, 25 bp, Rattus norvegicus
gggtcccctttggagcacaaagcag

SEQ ID NO: 459522 - DNA, 25 bp, Rattus norvegicus
gggtcccctttgtcggagatgacat

SEQ ID NO: 459523 - DNA, 25 bp, Rattus norvegicus
gggtcccctttgtgaaatatcgatg

SEQ ID NO: 459524 - DNA, 25 bp, Rattus norvegicus
gggtcccggcagatgtaaatttgaa

SEQ ID NO: 459525 - DNA, 25 bp, Rattus norvegicus
gggtcccggcagttgtaaatttgaa

SEQ ID NO: 459526 - DNA, 25 bp, Rattus norvegicus
gggtcccgtcttcgcaaagtaatgt

SEQ ID NO: 459527 - DNA, 25 bp, Rattus norvegicus
gggtcccgtcttggcaaagtaatgt

SEQ ID NO: 459528 - DNA, 25 bp, Rattus norvegicus
gggtccctaactccaaaatcattgt

SEQ ID NO: 459529 - DNA, 25 bp, Rattus norvegicus
gggtccctaactgcaaaatcattgt

SEQ ID NO: 459530 - DNA, 25 bp, Rattus norvegicus
gggtccctacagctggctgctaata

SEQ ID NO: 459531 - DNA, 25 bp, Rattus norvegicus
gggtccctacaggtggctgctaata

SEQ ID NO: 459532 - DNA, 25 bp, Rattus norvegicus
gggtccctcaacactggagtatttt

SEQ ID NO: 459533 - DNA, 25 bp, Rattus norvegicus
gggtccctcaactctggagtatttt

SEQ ID NO: 459534 - DNA, 25 bp, Rattus norvegicus
gggtccctccttacaaatgcaagat

SEQ ID NO: 459535 - DNA, 25 bp, Rattus norvegicus
gggtccctcctttcaaatgcaagat

SEQ ID NO: 459536 - DNA, 25 bp, Rattus norvegicus
gggtccctctgtcatatttctttgt

SEQ ID NO: 459537 - DNA, 25 bp, Rattus norvegicus
gggtccctctgtgatatttctttgt

SEQ ID NO: 459538 - DNA, 25 bp, Rattus norvegicus
gggtccctgctcaagggagtcagat

SEQ ID NO: 459539 - DNA, 25 bp, Rattus norvegicus
gggtccctgctctagggagtcagat

SEQ ID NO: 459540 - DNA, 25 bp, Rattus norvegicus
gggtcccttctgctatgataaaagc

SEQ ID NO: 459541 - DNA, 25 bp, Rattus norvegicus
gggtcccttctggtatgataaaagc

SEQ ID NO: 459542 - DNA, 25 bp, Rattus norvegicus
gggtcccttgcaacacaaagctaaa

SEQ ID NO: 459543 - DNA, 25 bp, Rattus norvegicus
gggtcccttgcatcacaaagctaaa

SEQ ID NO: 459544 - DNA, 25 bp, Rattus norvegicus
gggtcccttgttatcaacaggtctt

SEQ ID NO: 459545 - DNA, 25 bp, Rattus norvegicus
gggtcccttgttttcaacaggtctt

SEQ ID NO: 459546 - DNA, 25 bp, Rattus norvegicus
gggtccgaaagcatcagttgcagtt

SEQ ID NO: 459547 - DNA, 25 bp, Rattus norvegicus
gggtccgaaagcttcagttgcagtt

SEQ ID NO: 459548 - DNA, 25 bp, Rattus norvegicus
gggtccgaactgcagccagcagaac

SEQ ID NO: 459549 - DNA, 25 bp, Rattus norvegicus
gggtccgaactggagccagcagaac

SEQ ID NO: 459550 - DNA, 25 bp, Rattus norvegicus
gggtccgaagtcaccaaactgaaat

SEQ ID NO: 459551 - DNA, 25 bp, Rattus norvegicus
gggtccgaagtctccaaactgaaat

SEQ ID NO: 459552 - DNA, 25 bp, Rattus norvegicus
gggtccgaatttaccttacggcatg

SEQ ID NO: 459553 - DNA, 25 bp, Rattus norvegicus
gggtccgaattttccttacggcatg

SEQ ID NO: 459554 - DNA, 25 bp, Rattus norvegicus
gggtccgaccgcaaaatccaacatg

SEQ ID NO: 459555 - DNA, 25 bp, Rattus norvegicus
gggtccgaccgctaaatccaacatg

SEQ ID NO: 459556 - DNA, 25 bp, Rattus norvegicus
gggtccgctgcaacttcaacaggag

SEQ ID NO: 459557 - DNA, 25 bp, Rattus norvegicus
gggtccgctgcatcttcaacaggag

SEQ ID NO: 459558 - DNA, 25 bp, Rattus norvegicus
gggtccgcttccatggcttctcctg

SEQ ID NO: 459559 - DNA, 25 bp, Rattus norvegicus
gggtccgcttccttggcttctcctg

SEQ ID NO: 459560 - DNA, 25 bp, Rattus norvegicus
gggtccgcttggagctaacataaat

SEQ ID NO: 459561 - DNA, 25 bp, Rattus norvegicus
gggtccgcttggtgctaacataaat

SEQ ID NO: 459562 - DNA, 25 bp, Rattus norvegicus
gggtccggaagtcccctgaaacctg

SEQ ID NO: 459563 - DNA, 25 bp, Rattus norvegicus
gggtccggaagtgccctgaaacctg

SEQ ID NO: 459564 - DNA, 25 bp, Rattus norvegicus
gggtccgggaagactacaaggatca

SEQ ID NO: 459565 - DNA, 25 bp, Rattus norvegicus
gggtccgggaagtctacaaggatca

SEQ ID NO: 459566 - DNA, 25 bp, Rattus norvegicus
gggtccgtgatgaggagctcctcac

SEQ ID NO: 459567 - DNA, 25 bp, Rattus norvegicus
gggtccgtgatgtggagctcctcac

SEQ ID NO: 459568 - DNA, 25 bp, Rattus norvegicus
gggtccgtggacacactgatgcccc

SEQ ID NO: 459569 - DNA, 25 bp, Rattus norvegicus
gggtccgtggactcactgatgcccc

SEQ ID NO: 459570 - DNA, 25 bp, Rattus norvegicus
gggtcctaaaggctccaacagacaa

SEQ ID NO: 459571 - DNA, 25 bp, Rattus norvegicus
gggtcctaaagggtccaacagacaa

SEQ ID NO: 459572 - DNA, 25 bp, Rattus norvegicus
gggtcctaacacaatcactttgatc

SEQ ID NO: 459573 - DNA, 25 bp, Rattus norvegicus
gggtcctaacactatcactttgatc

SEQ ID NO: 459574 - DNA, 25 bp, Rattus norvegicus
gggtcctaacgtaacctcagcacca

SEQ ID NO: 459575 - DNA, 25 bp, Rattus norvegicus
gggtcctaacgttacctcagcacca

SEQ ID NO: 459576 - DNA, 25 bp, Rattus norvegicus
gggtcctaactccacagtgtgataa

SEQ ID NO: 459577 - DNA, 25 bp, Rattus norvegicus
gggtcctaactcgacagtgtgataa

SEQ ID NO: 459578 - DNA, 25 bp, Rattus norvegicus
gggtcctaagtcagcctgcttgagc

SEQ ID NO: 459579 - DNA, 25 bp, Rattus norvegicus
gggtcctaagtctgcctgcttgagc

SEQ ID NO: 459580 - DNA, 25 bp, Rattus norvegicus
gggtcctacgagagatcgcctacgc

SEQ ID NO: 459581 - DNA, 25 bp, Rattus norvegicus
gggtcctacgagtgatcgcctacgc

SEQ ID NO: 459582 - DNA, 25 bp, Rattus norvegicus
gggtcctactgcaggatgaagccac

SEQ ID NO: 459583 - DNA, 25 bp, Rattus norvegicus
gggtcctactgctggatgaagccac

SEQ ID NO: 459584 - DNA, 25 bp, Rattus norvegicus
gggtcctagggactaaagtcatcag

SEQ ID NO: 459585 - DNA, 25 bp, Rattus norvegicus
gggtcctagggagtaaagtcatcag

SEQ ID NO: 459586 - DNA, 25 bp, Rattus norvegicus
gggtcctagtgtccaataaatggtt

SEQ ID NO: 459587 - DNA, 25 bp, Rattus norvegicus
gggtcctagtgtgcaataaatggtt

SEQ ID NO: 459588 - DNA, 25 bp, Rattus norvegicus
gggtcctatatgaaaggttgcactc

SEQ ID NO: 459589 - DNA, 25 bp, Rattus norvegicus
gggtcctatatgtaaggttgcactc

SEQ ID NO: 459590 - DNA, 25 bp, Rattus norvegicus
gggtcctatctgctgcttcgtcaaa

SEQ ID NO: 459591 - DNA, 25 bp, Rattus norvegicus
gggtcctatctggtgcttcgtcaaa

SEQ ID NO: 459592 - DNA, 25 bp, Rattus norvegicus
gggtcctattgtactaatttgttga

SEQ ID NO: 459593 - DNA, 25 bp, Rattus norvegicus
gggtcctattgttctaatttgttga

SEQ ID NO: 459594 - DNA, 25 bp, Rattus norvegicus
gggtcctcaaccatgtggtatttat

SEQ ID NO: 459595 - DNA, 25 bp, Rattus norvegicus
gggtcctcaaccttgtggtatttat

SEQ ID NO: 459596 - DNA, 25 bp, Rattus norvegicus
gggtcctcaaggagaagcccacctg

SEQ ID NO: 459597 - DNA, 25 bp, Rattus norvegicus
gggtcctcaaggtgaagcccacctg

SEQ ID NO: 459598 - DNA, 25 bp, Rattus norvegicus
gggtcctcaagtaatttattgccaa

SEQ ID NO: 459599 - DNA, 25 bp, Rattus norvegicus
gggtcctcaagttatttattgccaa

SEQ ID NO: 459600 - DNA, 25 bp, Rattus norvegicus
gggtcctcaattatcttcctagaat

SEQ ID NO: 459601 - DNA, 25 bp, Rattus norvegicus
gggtcctcaattttcttcctagaat

SEQ ID NO: 459602 - DNA, 25 bp, Rattus norvegicus
gggtcctcacatacagaggtcttgt

SEQ ID NO: 459603 - DNA, 25 bp, Rattus norvegicus
gggtcctcacattcagaggtcttgt

SEQ ID NO: 459604 - DNA, 25 bp, Rattus norvegicus
gggtcctcagttccgattctgagaa

SEQ ID NO: 459605 - DNA, 25 bp, Rattus norvegicus
gggtcctcagttgcgattctgagaa

SEQ ID NO: 459606 - DNA, 25 bp, Rattus norvegicus
gggtcctccagtcgtgctgttcatt

SEQ ID NO: 459607 - DNA, 25 bp, Rattus norvegicus
gggtcctccagtggtgctgttcatt

SEQ ID NO: 459608 - DNA, 25 bp, Rattus norvegicus
gggtcctccattactacagcaataa

SEQ ID NO: 459609 - DNA, 25 bp, Rattus norvegicus
gggtcctccatttctacagcaataa

SEQ ID NO: 459610 - DNA, 25 bp, Rattus norvegicus
gggtcctcccaaagtgtcagttcca

SEQ ID NO: 459611 - DNA, 25 bp, Rattus norvegicus
gggtcctcccaatgtgtcagttcca

SEQ ID NO: 459612 - DNA, 25 bp, Rattus norvegicus
gggtcctcccataaagaaacagaag

SEQ ID NO: 459613 - DNA, 25 bp, Rattus norvegicus
gggtcctcccattaagaaacagaag

SEQ ID NO: 459614 - DNA, 25 bp, Rattus norvegicus
gggtcctcccttacactggtctggg

SEQ ID NO: 459615 - DNA, 25 bp, Rattus norvegicus
gggtcctcccttagctgaattctaa

SEQ ID NO: 459616 - DNA, 25 bp, Rattus norvegicus
gggtcctccctttcactggtctggg

SEQ ID NO: 459617 - DNA, 25 bp, Rattus norvegicus
gggtcctccctttgctgaattctaa

SEQ ID NO: 459618 - DNA, 25 bp, Rattus norvegicus
gggtcctcctgtatgaagtccagcc

SEQ ID NO: 459619 - DNA, 25 bp, Rattus norvegicus
gggtcctcctgtttgaagtccagcc

SEQ ID NO: 459620 - DNA, 25 bp, Rattus norvegicus
gggtcctcctttaagcagattgccc

SEQ ID NO: 459621 - DNA, 25 bp, Rattus norvegicus
gggtcctccttttagcagattgccc

SEQ ID NO: 459622 - DNA, 25 bp, Rattus norvegicus
gggtcctcggctattgagccctaca

SEQ ID NO: 459623 - DNA, 25 bp, Rattus norvegicus
gggtcctcggcttttgagccctaca

SEQ ID NO: 459624 - DNA, 25 bp, Rattus norvegicus
gggtcctcgtgtacctacagtggtc

SEQ ID NO: 459625 - DNA, 25 bp, Rattus norvegicus
gggtcctcgtgttcctacagtggtc

SEQ ID NO: 459626 - DNA, 25 bp, Rattus norvegicus
gggtcctctaccagttgtattacga

SEQ ID NO: 459627 - DNA, 25 bp, Rattus norvegicus
gggtcctctacctgttgtattacga

SEQ ID NO: 459628 - DNA, 25 bp, Rattus norvegicus
gggtcctctataaacgcagccagtg

SEQ ID NO: 459629 - DNA, 25 bp, Rattus norvegicus
gggtcctctatatacgcagccagtg

SEQ ID NO: 459630 - DNA, 25 bp, Rattus norvegicus
gggtcctgaccaatagactcagcaa

SEQ ID NO: 459631 - DNA, 25 bp, Rattus norvegicus
gggtcctgaccattagactcagcaa

SEQ ID NO: 459632 - DNA, 25 bp, Rattus norvegicus
gggtcctgagccaccacactgagaa

SEQ ID NO: 459633 - DNA, 25 bp, Rattus norvegicus
gggtcctgagcctccacactgagaa

SEQ ID NO: 459634 - DNA, 25 bp, Rattus norvegicus
gggtcctgatgtaggctatgaagct

SEQ ID NO: 459635 - DNA, 25 bp, Rattus norvegicus
gggtcctgatgttggctatgaagct

SEQ ID NO: 459636 - DNA, 25 bp, Rattus norvegicus
gggtcctgcacacggcagactgact

SEQ ID NO: 459637 - DNA, 25 bp, Rattus norvegicus
gggtcctgcacagggcagactgact

SEQ ID NO: 459638 - DNA, 25 bp, Rattus norvegicus
gggtcctgccgtaccggtggcatca

SEQ ID NO: 459639 - DNA, 25 bp, Rattus norvegicus
gggtcctgccgttccggtggcatca

SEQ ID NO: 459640 - DNA, 25 bp, Rattus norvegicus
gggtcctgcgacagaagcttcacaa

SEQ ID NO: 459641 - DNA, 25 bp, Rattus norvegicus
gggtcctgcgactgaagcttcacaa

SEQ ID NO: 459642 - DNA, 25 bp, Rattus norvegicus
gggtcctggatgaacaccgccagca

SEQ ID NO: 459643 - DNA, 25 bp, Rattus norvegicus
gggtcctggatgtacaccgccagca

SEQ ID NO: 459644 - DNA, 25 bp, Rattus norvegicus
gggtcctggctcataaatgtaatat

SEQ ID NO: 459645 - DNA, 25 bp, Rattus norvegicus
gggtcctggctcttaaatgtaatat

SEQ ID NO: 459646 - DNA, 25 bp, Rattus norvegicus
gggtcctgggcacatgtcattgata

SEQ ID NO: 459647 - DNA, 25 bp, Rattus norvegicus
gggtcctgggcagatgtcattgata

SEQ ID NO: 459648 - DNA, 25 bp, Rattus norvegicus
gggtcctgggtcatcacgggctccc

SEQ ID NO: 459649 - DNA, 25 bp, Rattus norvegicus
gggtcctgggtcttcacgggctccc

SEQ ID NO: 459650 - DNA, 25 bp, Rattus norvegicus
gggtcctggtgaacagagtcgccta

SEQ ID NO: 459651 - DNA, 25 bp, Rattus norvegicus
gggtcctggtgatcagagtcgccta

SEQ ID NO: 459652 - DNA, 25 bp, Rattus norvegicus
gggtcctggttgacagcaattctgt

SEQ ID NO: 459653 - DNA, 25 bp, Rattus norvegicus
gggtcctggttgtcagcaattctgt

SEQ ID NO: 459654 - DNA, 25 bp, Rattus norvegicus
gggtcctgtcctccaacatagaaga

SEQ ID NO: 459655 - DNA, 25 bp, Rattus norvegicus
gggtcctgtcctgcaacatagaaga

SEQ ID NO: 459656 - DNA, 25 bp, Rattus norvegicus
gggtcctgtgcaatttgtagatttt

SEQ ID NO: 459657 - DNA, 25 bp, Rattus norvegicus
gggtcctgtgcattttgtagatttt

SEQ ID NO: 459658 - DNA, 25 bp, Rattus norvegicus
gggtcctgtggacaccaaacagtgt

SEQ ID NO: 459659 - DNA, 25 bp, Rattus norvegicus
gggtcctgtggagaccaaacagtgt

SEQ ID NO: 459660 - DNA, 25 bp, Rattus norvegicus
gggtcctgtggccatgctaagaaat

SEQ ID NO: 459661 - DNA, 25 bp, Rattus norvegicus
gggtcctgtggcgatgctaagaaat

SEQ ID NO: 459662 - DNA, 25 bp, Rattus norvegicus
gggtcctgtgtgacccagcagatga

SEQ ID NO: 459663 - DNA, 25 bp, Rattus norvegicus
gggtcctgtgtgagtctatgtgtct

SEQ ID NO: 459664 - DNA, 25 bp, Rattus norvegicus
gggtcctgtgtgtcccagcagatga

SEQ ID NO: 459665 - DNA, 25 bp, Rattus norvegicus
gggtcctgtgtgtgtctatgtgtct

SEQ ID NO: 459666 - DNA, 25 bp, Rattus norvegicus
gggtcctgttatagtaagctgcctc

SEQ ID NO: 459667 - DNA, 25 bp, Rattus norvegicus
gggtcctgttattgtaagctgcctc

SEQ ID NO: 459668 - DNA, 25 bp, Rattus norvegicus
gggtccttaagccagtgtctttcag

SEQ ID NO: 459669 - DNA, 25 bp, Rattus norvegicus
gggtccttaagcgagtgtctttcag

SEQ ID NO: 459670 - DNA, 25 bp, Rattus norvegicus
gggtccttaattaatattgtgccaa

SEQ ID NO: 459671 - DNA, 25 bp, Rattus norvegicus
gggtccttaatttatattgtgccaa

SEQ ID NO: 459672 - DNA, 25 bp, Rattus norvegicus
gggtccttaccaatgctatgctatc

SEQ ID NO: 459673 - DNA, 25 bp, Rattus norvegicus
gggtccttaccattgctatgctatc

SEQ ID NO: 459674 - DNA, 25 bp, Rattus norvegicus
gggtccttagaaacgctggtgcatg

SEQ ID NO: 459675 - DNA, 25 bp, Rattus norvegicus
gggtccttagaacacgcgcgcttaa

SEQ ID NO: 459676 - DNA, 25 bp, Rattus norvegicus
gggtccttagaagacgcgcgcttaa

SEQ ID NO: 459677 - DNA, 25 bp, Rattus norvegicus
gggtccttagaatcgctggtgcatg

SEQ ID NO: 459678 - DNA, 25 bp, Rattus norvegicus
gggtccttagaccaaatccctggat

SEQ ID NO: 459679 - DNA, 25 bp, Rattus norvegicus
gggtccttagacgaaatccctggat

SEQ ID NO: 459680 - DNA, 25 bp, Rattus norvegicus
gggtccttagatcagtgacttccca

SEQ ID NO: 459681 - DNA, 25 bp, Rattus norvegicus
gggtccttagatgagtgacttccca

SEQ ID NO: 459682 - DNA, 25 bp, Rattus norvegicus
gggtccttagttcggcttctgctgc

SEQ ID NO: 459683 - DNA, 25 bp, Rattus norvegicus
gggtccttagttgggcttctgctgc

SEQ ID NO: 459684 - DNA, 25 bp, Rattus norvegicus
gggtccttatatcttgtacagtcta

SEQ ID NO: 459685 - DNA, 25 bp, Rattus norvegicus
gggtccttatatgttgtacagtcta

SEQ ID NO: 459686 - DNA, 25 bp, Rattus norvegicus
gggtccttatgtagagcttcgtgct

SEQ ID NO: 459687 - DNA, 25 bp, Rattus norvegicus
gggtccttatgttgagcttcgtgct

SEQ ID NO: 459688 - DNA, 25 bp, Rattus norvegicus
gggtccttcagaacatattcgtgtc

SEQ ID NO: 459689 - DNA, 25 bp, Rattus norvegicus
gggtccttcagatcatattcgtgtc

SEQ ID NO: 459690 - DNA, 25 bp, Rattus norvegicus
gggtccttccatctcaatcattaat

SEQ ID NO: 459691 - DNA, 25 bp, Rattus norvegicus
gggtccttccatgtcaatcattaat

SEQ ID NO: 459692 - DNA, 25 bp, Rattus norvegicus
gggtccttccctcaaatgtgtgaca

SEQ ID NO: 459693 - DNA, 25 bp, Rattus norvegicus
gggtccttccctgaaatgtgtgaca

SEQ ID NO: 459694 - DNA, 25 bp, Rattus norvegicus
gggtccttcgcaaatcttacaatta

SEQ ID NO: 459695 - DNA, 25 bp, Rattus norvegicus
gggtccttcgcatatcttacaatta

SEQ ID NO: 459696 - DNA, 25 bp, Rattus norvegicus
gggtccttctgaatatctgatcaca

SEQ ID NO: 459697 - DNA, 25 bp, Rattus norvegicus
gggtccttctgactattgatggtga

SEQ ID NO: 459698 - DNA, 25 bp, Rattus norvegicus
gggtccttctgagtattgatggtga

SEQ ID NO: 459699 - DNA, 25 bp, Rattus norvegicus
gggtccttctgattatctgatcaca

SEQ ID NO: 459700 - DNA, 25 bp, Rattus norvegicus
gggtccttctgcatctggaatcaga

SEQ ID NO: 459701 - DNA, 25 bp, Rattus norvegicus
gggtccttctgcttctggaatcaga

SEQ ID NO: 459702 - DNA, 25 bp, Rattus norvegicus
gggtccttgaccatacatgatctgt

SEQ ID NO: 459703 - DNA, 25 bp, Rattus norvegicus
gggtccttgaccttacatgatctgt

SEQ ID NO: 459704 - DNA, 25 bp, Rattus norvegicus
gggtccttgacgaccatcatggatc

SEQ ID NO: 459705 - DNA, 25 bp, Rattus norvegicus
gggtccttgacgtccatcatggatc

SEQ ID NO: 459706 - DNA, 25 bp, Rattus norvegicus
gggtccttgagaaagatgtctctgt

SEQ ID NO: 459707 - DNA, 25 bp, Rattus norvegicus
gggtccttgagatagatgtctctgt

SEQ ID NO: 459708 - DNA, 25 bp, Rattus norvegicus
gggtccttggctccctggtatgctc

SEQ ID NO: 459709 - DNA, 25 bp, Rattus norvegicus
gggtccttggctgcctggtatgctc

SEQ ID NO: 459710 - DNA, 25 bp, Rattus norvegicus
gggtccttgtcaactgaactgctga

SEQ ID NO: 459711 - DNA, 25 bp, Rattus norvegicus
gggtccttgtcacttaatgtcctca

SEQ ID NO: 459712 - DNA, 25 bp, Rattus norvegicus
gggtccttgtcagttaatgtcctca

SEQ ID NO: 459713 - DNA, 25 bp, Rattus norvegicus
gggtccttgtcatctgaactgctga

SEQ ID NO: 459714 - DNA, 25 bp, Rattus norvegicus
gggtccttgtgcctatatacaaaca

SEQ ID NO: 459715 - DNA, 25 bp, Rattus norvegicus
gggtccttgtgcgtatatacaaaca

SEQ ID NO: 459716 - DNA, 25 bp, Rattus norvegicus
gggtcctttagcatgcgtagcattc

SEQ ID NO: 459717 - DNA, 25 bp, Rattus norvegicus
gggtcctttagcttgcgtagcattc

SEQ ID NO: 459718 - DNA, 25 bp, Rattus norvegicus
gggtcctttcctacaggaaggcaca

SEQ ID NO: 459719 - DNA, 25 bp, Rattus norvegicus
gggtcctttccttcaggaaggcaca

SEQ ID NO: 459720 - DNA, 25 bp, Rattus norvegicus
gggtccttttgaactctagtacatc

SEQ ID NO: 459721 - DNA, 25 bp, Rattus norvegicus
gggtccttttgatctctagtacatc

SEQ ID NO: 459722 - DNA, 25 bp, Rattus norvegicus
gggtcgaattatccccgggaagcaa

SEQ ID NO: 459723 - DNA, 25 bp, Rattus norvegicus
gggtcgaattatgcccgggaagcaa

SEQ ID NO: 459724 - DNA, 25 bp, Rattus norvegicus
gggtcgacacataggcattttagaa

SEQ ID NO: 459725 - DNA, 25 bp, Rattus norvegicus
gggtcgacacattggcattttagaa

SEQ ID NO: 459726 - DNA, 25 bp, Rattus norvegicus
gggtcgacatatctagcctatttcc

SEQ ID NO: 459727 - DNA, 25 bp, Rattus norvegicus
gggtcgacatatgtagcctatttcc

SEQ ID NO: 459728 - DNA, 25 bp, Rattus norvegicus
gggtcgactcaaataggtcttactg

SEQ ID NO: 459729 - DNA, 25 bp, Rattus norvegicus
gggtcgactcaattaggtcttactg

SEQ ID NO: 459730 - DNA, 25 bp, Rattus norvegicus
gggtcgagtcttaacctctgaagtt

SEQ ID NO: 459731 - DNA, 25 bp, Rattus norvegicus
gggtcgagtctttacctctgaagtt

SEQ ID NO: 459732 - DNA, 25 bp, Rattus norvegicus
gggtcgatatttcggcctttggcct

SEQ ID NO: 459733 - DNA, 25 bp, Rattus norvegicus
gggtcgatatttgggcctttggcct

SEQ ID NO: 459734 - DNA, 25 bp, Rattus norvegicus
gggtcgcaaagcagctcgtgacttt

SEQ ID NO: 459735 - DNA, 25 bp, Rattus norvegicus
gggtcgcaaagctgctcgtgacttt

SEQ ID NO: 459736 - DNA, 25 bp, Rattus norvegicus
gggtcgccagaaaggcatctgtgta

SEQ ID NO: 459737 - DNA, 25 bp, Rattus norvegicus
gggtcgccagaatggcatctgtgta

SEQ ID NO: 459738 - DNA, 25 bp, Rattus norvegicus
gggtcgcccggacgaggtacagaag

SEQ ID NO: 459739 - DNA, 25 bp, Rattus norvegicus
gggtcgcccggaggaggtacagaag

SEQ ID NO: 459740 - DNA, 25 bp, Rattus norvegicus
gggtcgcctcacaggatcggtttga

SEQ ID NO: 459741 - DNA, 25 bp, Rattus norvegicus
gggtcgcctcactggatcggtttga

SEQ ID NO: 459742 - DNA, 25 bp, Rattus norvegicus
gggtcgcctgaccaccgtagaactt

SEQ ID NO: 459743 - DNA, 25 bp, Rattus norvegicus
gggtcgcctgacgaccgtagaactt

SEQ ID NO: 459744 - DNA, 25 bp, Rattus norvegicus
gggtcgccttcaacaagttcccgta

SEQ ID NO: 459745 - DNA, 25 bp, Rattus norvegicus
gggtcgccttcatcaagttcccgta

SEQ ID NO: 459746 - DNA, 25 bp, Rattus norvegicus
gggtcgcgccgcatagaaggctcca

SEQ ID NO: 459747 - DNA, 25 bp, Rattus norvegicus
gggtcgcgccgcttagaaggctcca

SEQ ID NO: 459748 - DNA, 25 bp, Rattus norvegicus
gggtcgctacagacatacgtagaca

SEQ ID NO: 459749 - DNA, 25 bp, Rattus norvegicus
gggtcgctacagtcatacgtagaca

SEQ ID NO: 459750 - DNA, 25 bp, Rattus norvegicus
gggtcgcttgctctgcgatttccgt

SEQ ID NO: 459751 - DNA, 25 bp, Rattus norvegicus
gggtcgcttgctgtgcgatttccgt

SEQ ID NO: 459752 - DNA, 25 bp, Rattus norvegicus
gggtcgcttgtcagcaattaccatg

SEQ ID NO: 459753 - DNA, 25 bp, Rattus norvegicus
gggtcgcttgtctgcaattaccatg

SEQ ID NO: 459754 - DNA, 25 bp, Rattus norvegicus
gggtcggaagcaattgctgtctccc

SEQ ID NO: 459755 - DNA, 25 bp, Rattus norvegicus
gggtcggaagcatttgctgtctccc

SEQ ID NO: 459756 - DNA, 25 bp, Rattus norvegicus
gggtcggagccaacctgctggctac

SEQ ID NO: 459757 - DNA, 25 bp, Rattus norvegicus
gggtcggagccatcctgctggctac

SEQ ID NO: 459758 - DNA, 25 bp, Rattus norvegicus
gggtcggatggcactcaggataaca

SEQ ID NO: 459759 - DNA, 25 bp, Rattus norvegicus
gggtcggatggctctcaggataaca

SEQ ID NO: 459760 - DNA, 25 bp, Rattus norvegicus
gggtcggcaaagcagctctagaact

SEQ ID NO: 459761 - DNA, 25 bp, Rattus norvegicus
gggtcggcaaaggagctctagaact

SEQ ID NO: 459762 - DNA, 25 bp, Rattus norvegicus
gggtcggcagacagggacactaata

SEQ ID NO: 459763 - DNA, 25 bp, Rattus norvegicus
gggtcggcagactgggacactaata

SEQ ID NO: 459764 - DNA, 25 bp, Rattus norvegicus
gggtcggctccaaagcgtgtgttcc

SEQ ID NO: 459765 - DNA, 25 bp, Rattus norvegicus
gggtcggctccatagcgtgtgttcc

SEQ ID NO: 459766 - DNA, 25 bp, Rattus norvegicus
gggtcggtcagcagacaaccggcta

SEQ ID NO: 459767 - DNA, 25 bp, Rattus norvegicus
gggtcggtcagctgacaaccggcta

SEQ ID NO: 459768 - DNA, 25 bp, Rattus norvegicus
gggtcggtcatgagacatttttctt

SEQ ID NO: 459769 - DNA, 25 bp, Rattus norvegicus
gggtcggtcatgtgacatttttctt

SEQ ID NO: 459770 - DNA, 25 bp, Rattus norvegicus
gggtcggtctatcatggccaagcaa

SEQ ID NO: 459771 - DNA, 25 bp, Rattus norvegicus
gggtcggtctatgatggccaagcaa

SEQ ID NO: 459772 - DNA, 25 bp, Rattus norvegicus
gggtcggtctttcatgatactgcat

SEQ ID NO: 459773 - DNA, 25 bp, Rattus norvegicus
gggtcggtctttgatgatactgcat

SEQ ID NO: 459774 - DNA, 25 bp, Rattus norvegicus
gggtcggttttcaagtgtgctcatc

SEQ ID NO: 459775 - DNA, 25 bp, Rattus norvegicus
gggtcggttttctagtgtgctcatc

SEQ ID NO: 459776 - DNA, 25 bp, Rattus norvegicus
gggtcgtacaataactgtgagaact

SEQ ID NO: 459777 - DNA, 25 bp, Rattus norvegicus
gggtcgtacaattactgtgagaact

SEQ ID NO: 459778 - DNA, 25 bp, Rattus norvegicus
gggtcgtacccaccgaggatcacgt

SEQ ID NO: 459779 - DNA, 25 bp, Rattus norvegicus
gggtcgtacccagcgaggatcacgt

SEQ ID NO: 459780 - DNA, 25 bp, Rattus norvegicus
gggtcgtcggtgcttcccaccatga

SEQ ID NO: 459781 - DNA, 25 bp, Rattus norvegicus
gggtcgtcggtggttcccaccatga

SEQ ID NO: 459782 - DNA, 25 bp, Rattus norvegicus
gggtcgtcttctcctaaactgcttc

SEQ ID NO: 459783 - DNA, 25 bp, Rattus norvegicus
gggtcgtcttctgctaaactgcttc

SEQ ID NO: 459784 - DNA, 25 bp, Rattus norvegicus
gggtcgtgagccataaacgggcata

SEQ ID NO: 459785 - DNA, 25 bp, Rattus norvegicus
gggtcgtgagccttaaacgggcata

SEQ ID NO: 459786 - DNA, 25 bp, Rattus norvegicus
gggtcgtttaagaggcagatgctgt

SEQ ID NO: 459787 - DNA, 25 bp, Rattus norvegicus
gggtcgtttaagtggcagatgctgt

SEQ ID NO: 459788 - DNA, 25 bp, Rattus norvegicus
gggtcgtttctgatttagtgtcaat

SEQ ID NO: 459789 - DNA, 25 bp, Rattus norvegicus
gggtcgtttctgttttagtgtcaat

SEQ ID NO: 459790 - DNA, 25 bp, Rattus norvegicus
gggtctaaaactcccctccaatgag

SEQ ID NO: 459791 - DNA, 25 bp, Rattus norvegicus
gggtctaaaactgccctccaatgag

SEQ ID NO: 459792 - DNA, 25 bp, Rattus norvegicus
gggtctaaccctcagttagctgaaa

SEQ ID NO: 459793 - DNA, 25 bp, Rattus norvegicus
gggtctaaccctgagttagctgaaa

SEQ ID NO: 459794 - DNA, 25 bp, Rattus norvegicus
gggtctaactgacgtcttgtatttg

SEQ ID NO: 459795 - DNA, 25 bp, Rattus norvegicus
gggtctaactgaggtcttgtatttg

SEQ ID NO: 459796 - DNA, 25 bp, Rattus norvegicus
gggtctaacttacttatttattgct

SEQ ID NO: 459797 - DNA, 25 bp, Rattus norvegicus
gggtctaacttagttatttattgct

SEQ ID NO: 459798 - DNA, 25 bp, Rattus norvegicus
gggtctaagctacgcttcccctagc

SEQ ID NO: 459799 - DNA, 25 bp, Rattus norvegicus
gggtctaagctaggcttcccctagc

SEQ ID NO: 459800 - DNA, 25 bp, Rattus norvegicus
gggtctaattctaattacttcaaca

SEQ ID NO: 459801 - DNA, 25 bp, Rattus norvegicus
gggtctaattcttattacttcaaca

SEQ ID NO: 459802 - DNA, 25 bp, Rattus norvegicus
gggtctacaagcattcttcatggtt

SEQ ID NO: 459803 - DNA, 25 bp, Rattus norvegicus
gggtctacaagctttcttcatggtt

SEQ ID NO: 459804 - DNA, 25 bp, Rattus norvegicus
gggtctacatccattgttatctctc

SEQ ID NO: 459805 - DNA, 25 bp, Rattus norvegicus
gggtctacatcctttgttatctctc

SEQ ID NO: 459806 - DNA, 25 bp, Rattus norvegicus
gggtctacatggcaccttatcaaga

SEQ ID NO: 459807 - DNA, 25 bp, Rattus norvegicus
gggtctacatgggaccttatcaaga

SEQ ID NO: 459808 - DNA, 25 bp, Rattus norvegicus
gggtctacattcacgttgactgttt

SEQ ID NO: 459809 - DNA, 25 bp, Rattus norvegicus
gggtctacattctcgttgactgttt

SEQ ID NO: 459810 - DNA, 25 bp, Rattus norvegicus
gggtctacgcttcaaggtgataaat

SEQ ID NO: 459811 - DNA, 25 bp, Rattus norvegicus
gggtctacgcttgaaggtgataaat

SEQ ID NO: 459812 - DNA, 25 bp, Rattus norvegicus
gggtctactaccagagcctctattc

SEQ ID NO: 459813 - DNA, 25 bp, Rattus norvegicus
gggtctactacctgagcctctattc

SEQ ID NO: 459814 - DNA, 25 bp, Rattus norvegicus
gggtctactcgaagcaggtggcttc

SEQ ID NO: 459815 - DNA, 25 bp, Rattus norvegicus
gggtctactcgatgcaggtggcttc

SEQ ID NO: 459816 - DNA, 25 bp, Rattus norvegicus
gggtctactgagaccacagcaaata

SEQ ID NO: 459817 - DNA, 25 bp, Rattus norvegicus
gggtctactgagtccacagcaaata

SEQ ID NO: 459818 - DNA, 25 bp, Rattus norvegicus
gggtctactttgacgggctgctgca

SEQ ID NO: 459819 - DNA, 25 bp, Rattus norvegicus
gggtctactttgtcgggctgctgca

SEQ ID NO: 459820 - DNA, 25 bp, Rattus norvegicus
gggtctagaacacccctgaggcctg

SEQ ID NO: 459821 - DNA, 25 bp, Rattus norvegicus
gggtctagaacagccctgaggcctg

SEQ ID NO: 459822 - DNA, 25 bp, Rattus norvegicus
gggtctagcatcaggactatccctt

SEQ ID NO: 459823 - DNA, 25 bp, Rattus norvegicus
gggtctagcatctggactatccctt

SEQ ID NO: 459824 - DNA, 25 bp, Rattus norvegicus
gggtctagtctcagatttgctcctt

SEQ ID NO: 459825 - DNA, 25 bp, Rattus norvegicus
gggtctagtctctgatttgctcctt

SEQ ID NO: 459826 - DNA, 25 bp, Rattus norvegicus
gggtctagtgacctgcatctgaaag

SEQ ID NO: 459827 - DNA, 25 bp, Rattus norvegicus
gggtctagtgacgtgcatctgaaag

SEQ ID NO: 459828 - DNA, 25 bp, Rattus norvegicus
gggtctataaacctgacactttaca

SEQ ID NO: 459829 - DNA, 25 bp, Rattus norvegicus
gggtctataaacgtgacactttaca

SEQ ID NO: 459830 - DNA, 25 bp, Rattus norvegicus
gggtctataacaaccacagtcgagc

SEQ ID NO: 459831 - DNA, 25 bp, Rattus norvegicus
gggtctataacatccacagtcgagc

SEQ ID NO: 459832 - DNA, 25 bp, Rattus norvegicus
gggtctatacatattcttcatgttt

SEQ ID NO: 459833 - DNA, 25 bp, Rattus norvegicus
gggtctatacattttcttcatgttt

SEQ ID NO: 459834 - DNA, 25 bp, Rattus norvegicus
gggtctatcaccatcatgtatttaa

SEQ ID NO: 459835 - DNA, 25 bp, Rattus norvegicus
gggtctatcaccttcatgtatttaa

SEQ ID NO: 459836 - DNA, 25 bp, Rattus norvegicus
gggtctatcagtctgtctttcagaa

SEQ ID NO: 459837 - DNA, 25 bp, Rattus norvegicus
gggtctatcagtgtgtctttcagaa

SEQ ID NO: 459838 - DNA, 25 bp, Rattus norvegicus
gggtctatccttaaaaggctacctg

SEQ ID NO: 459839 - DNA, 25 bp, Rattus norvegicus
gggtctatcctttaaaggctacctg

SEQ ID NO: 459840 - DNA, 25 bp, Rattus norvegicus
gggtctatctgaactggatggactt

SEQ ID NO: 459841 - DNA, 25 bp, Rattus norvegicus
gggtctatctgatctggatggactt

SEQ ID NO: 459842 - DNA, 25 bp, Rattus norvegicus
gggtctatgagtagaagcctagtct

SEQ ID NO: 459843 - DNA, 25 bp, Rattus norvegicus
gggtctatgagttgaagcctagtct

SEQ ID NO: 459844 - DNA, 25 bp, Rattus norvegicus
gggtctattgctaccgagcatacaa

SEQ ID NO: 459845 - DNA, 25 bp, Rattus norvegicus
gggtctattgcttccgagcatacaa

SEQ ID NO: 459846 - DNA, 25 bp, Rattus norvegicus
gggtctattgttagcctgtgagaat

SEQ ID NO: 459847 - DNA, 25 bp, Rattus norvegicus
gggtctattgtttgcctgtgagaat

SEQ ID NO: 459848 - DNA, 25 bp, Rattus norvegicus
gggtctcaaacactgaaggacctga

SEQ ID NO: 459849 - DNA, 25 bp, Rattus norvegicus
gggtctcaaacagtgaaggacctga

SEQ ID NO: 459850 - DNA, 25 bp, Rattus norvegicus
gggtctcaaactctctgcagtagga

SEQ ID NO: 459851 - DNA, 25 bp, Rattus norvegicus
gggtctcaaactgtctgcagtagga

SEQ ID NO: 459852 - DNA, 25 bp, Rattus norvegicus
gggtctcaacacagcaggagtctct

SEQ ID NO: 459853 - DNA, 25 bp, Rattus norvegicus
gggtctcaacactgcaggagtctct

SEQ ID NO: 459854 - DNA, 25 bp, Rattus norvegicus
gggtctcaagtaatcaaggatgcca

SEQ ID NO: 459855 - DNA, 25 bp, Rattus norvegicus
gggtctcaagtattcaaggatgcca

SEQ ID NO: 459856 - DNA, 25 bp, Rattus norvegicus
gggtctcaatgtatattccgtggtg

SEQ ID NO: 459857 - DNA, 25 bp, Rattus norvegicus
gggtctcaatgtttattccgtggtg

SEQ ID NO: 459858 - DNA, 25 bp, Rattus norvegicus
gggtctcacatcattgcactgtgcc

SEQ ID NO: 459859 - DNA, 25 bp, Rattus norvegicus
gggtctcacatctttgcactgtgcc

SEQ ID NO: 459860 - DNA, 25 bp, Rattus norvegicus
gggtctcacattaggctactggctt

SEQ ID NO: 459861 - DNA, 25 bp, Rattus norvegicus
gggtctcacatttggctactggctt

SEQ ID NO: 459862 - DNA, 25 bp, Rattus norvegicus
gggtctcacccaattaaaagtactg

SEQ ID NO: 459863 - DNA, 25 bp, Rattus norvegicus
gggtctcacccatttaaaagtactg

SEQ ID NO: 459864 - DNA, 25 bp, Rattus norvegicus
gggtctcacctgatggttcatttct

SEQ ID NO: 459865 - DNA, 25 bp, Rattus norvegicus
gggtctcacctgttggttcatttct

SEQ ID NO: 459866 - DNA, 25 bp, Rattus norvegicus
gggtctcactccagtaggtggcaag

SEQ ID NO: 459867 - DNA, 25 bp, Rattus norvegicus
gggtctcactcctgtaggtggcaag

SEQ ID NO: 459868 - DNA, 25 bp, Rattus norvegicus
gggtctcagaggcatgcacatgaat

SEQ ID NO: 459869 - DNA, 25 bp, Rattus norvegicus
gggtctcagagggatgcacatgaat

SEQ ID NO: 459870 - DNA, 25 bp, Rattus norvegicus
gggtctcagcacatctgtgtggatt

SEQ ID NO: 459871 - DNA, 25 bp, Rattus norvegicus
gggtctcagcacttctgtgtggatt

SEQ ID NO: 459872 - DNA, 25 bp, Rattus norvegicus
gggtctcaggagcatacaagcaaag

SEQ ID NO: 459873 - DNA, 25 bp, Rattus norvegicus
gggtctcaggaggatacaagcaaag

SEQ ID NO: 459874 - DNA, 25 bp, Rattus norvegicus
gggtctcagggcaccccaggcactg

SEQ ID NO: 459875 - DNA, 25 bp, Rattus norvegicus
gggtctcagggctccccaggcactg

SEQ ID NO: 459876 - DNA, 25 bp, Rattus norvegicus
gggtctcaggttaatctagtttcat

SEQ ID NO: 459877 - DNA, 25 bp, Rattus norvegicus
gggtctcaggtttatctagtttcat

SEQ ID NO: 459878 - DNA, 25 bp, Rattus norvegicus
gggtctcatactatacttttctgat

SEQ ID NO: 459879 - DNA, 25 bp, Rattus norvegicus
gggtctcatactttacttttctgat

SEQ ID NO: 459880 - DNA, 25 bp, Rattus norvegicus
gggtctcatgcactgtaggaatgct

SEQ ID NO: 459881 - DNA, 25 bp, Rattus norvegicus
gggtctcatgcagtgtaggaatgct

SEQ ID NO: 459882 - DNA, 25 bp, Rattus norvegicus
gggtctcatgtgacttgtccttgca

SEQ ID NO: 459883 - DNA, 25 bp, Rattus norvegicus
gggtctcatgtgtcttgtccttgca

SEQ ID NO: 459884 - DNA, 25 bp, Rattus norvegicus
gggtctcattgcacattactcaggt

SEQ ID NO: 459885 - DNA, 25 bp, Rattus norvegicus
gggtctcattgctcattactcaggt

SEQ ID NO: 459886 - DNA, 25 bp, Rattus norvegicus
gggtctccaaagacgggccaaatgg

SEQ ID NO: 459887 - DNA, 25 bp, Rattus norvegicus
gggtctccaaagtcgggccaaatgg

SEQ ID NO: 459888 - DNA, 25 bp, Rattus norvegicus
gggtctccacttcatgcctagagaa

SEQ ID NO: 459889 - DNA, 25 bp, Rattus norvegicus
gggtctccacttgatgcctagagaa

SEQ ID NO: 459890 - DNA, 25 bp, Rattus norvegicus
gggtctccatctcccattgcatagc

SEQ ID NO: 459891 - DNA, 25 bp, Rattus norvegicus
gggtctccatctgccattgcatagc

SEQ ID NO: 459892 - DNA, 25 bp, Rattus norvegicus
gggtctccatgtctggctggaactt

SEQ ID NO: 459893 - DNA, 25 bp, Rattus norvegicus
gggtctccatgtgtggctggaactt

SEQ ID NO: 459894 - DNA, 25 bp, Rattus norvegicus
gggtctcccaaaccatgactttaag

SEQ ID NO: 459895 - DNA, 25 bp, Rattus norvegicus
gggtctcccaaagcatgactttaag

SEQ ID NO: 459896 - DNA, 25 bp, Rattus norvegicus
gggtctcccacgagatttacatggc

SEQ ID NO: 459897 - DNA, 25 bp, Rattus norvegicus
gggtctcccacgtgatttacatggc

SEQ ID NO: 459898 - DNA, 25 bp, Rattus norvegicus
gggtctcccagtatgtcactctgta

SEQ ID NO: 459899 - DNA, 25 bp, Rattus norvegicus
gggtctcccagtttgtcactctgta

SEQ ID NO: 459900 - DNA, 25 bp, Rattus norvegicus
gggtctccctcaaggttctgatagg

SEQ ID NO: 459901 - DNA, 25 bp, Rattus norvegicus
gggtctccctcatggttctgatagg

SEQ ID NO: 459902 - DNA, 25 bp, Rattus norvegicus
gggtctccgactctgtacgccccgg

SEQ ID NO: 459903 - DNA, 25 bp, Rattus norvegicus
gggtctccgactgtgtacgccccgg

SEQ ID NO: 459904 - DNA, 25 bp, Rattus norvegicus
gggtctcctcacatggtcaaacgga

SEQ ID NO: 459905 - DNA, 25 bp, Rattus norvegicus
gggtctcctcacttggtcaaacgga

SEQ ID NO: 459906 - DNA, 25 bp, Rattus norvegicus
gggtctcctctaacagtgtgctgtc

SEQ ID NO: 459907 - DNA, 25 bp, Rattus norvegicus
gggtctcctctatcagtgtgctgtc

SEQ ID NO: 459908 - DNA, 25 bp, Rattus norvegicus
gggtctcctgctctagaagagcaat

SEQ ID NO: 459909 - DNA, 25 bp, Rattus norvegicus
gggtctcctgctgtagaagagcaat

SEQ ID NO: 459910 - DNA, 25 bp, Rattus norvegicus
gggtctcgagccaacaaggccttag

SEQ ID NO: 459911 - DNA, 25 bp, Rattus norvegicus
gggtctcgagcctacaaggccttag

SEQ ID NO: 459912 - DNA, 25 bp, Rattus norvegicus
gggtctcgagctctatcaagctctt

SEQ ID NO: 459913 - DNA, 25 bp, Rattus norvegicus
gggtctcgagctgtatcaagctctt

SEQ ID NO: 459914 - DNA, 25 bp, Rattus norvegicus
gggtctcgctcaccttcagcaacgt

SEQ ID NO: 459915 - DNA, 25 bp, Rattus norvegicus
gggtctcgctcagcttcagcaacgt

SEQ ID NO: 459916 - DNA, 25 bp, Rattus norvegicus
gggtctcgtcaaacatgaaatttat

SEQ ID NO: 459917 - DNA, 25 bp, Rattus norvegicus
gggtctcgtcaatcatgaaatttat

SEQ ID NO: 459918 - DNA, 25 bp, Rattus norvegicus
gggtctctaccaagtagatccggga

SEQ ID NO: 459919 - DNA, 25 bp, Rattus norvegicus
gggtctctaccatgtagatccggga

SEQ ID NO: 459920 - DNA, 25 bp, Rattus norvegicus
gggtctctacttctccaatgtaaag

SEQ ID NO: 459921 - DNA, 25 bp, Rattus norvegicus
gggtctctacttgtccaatgtaaag

SEQ ID NO: 459922 - DNA, 25 bp, Rattus norvegicus
gggtctctagctattctgtggatgg

SEQ ID NO: 459923 - DNA, 25 bp, Rattus norvegicus
gggtctctagcttttctgtggatgg

SEQ ID NO: 459924 - DNA, 25 bp, Rattus norvegicus
gggtctctatagacttagcattcag

SEQ ID NO: 459925 - DNA, 25 bp, Rattus norvegicus
gggtctctatagtcttagcattcag

SEQ ID NO: 459926 - DNA, 25 bp, Rattus norvegicus
gggtctctatctcacatggagaaaa

SEQ ID NO: 459927 - DNA, 25 bp, Rattus norvegicus
gggtctctatctgacatggagaaaa

SEQ ID NO: 459928 - DNA, 25 bp, Rattus norvegicus
gggtctctcacacgaattcaaccat

SEQ ID NO: 459929 - DNA, 25 bp, Rattus norvegicus
gggtctctcacaggaattcaaccat

SEQ ID NO: 459930 - DNA, 25 bp, Rattus norvegicus
gggtctctcagaattagacatttga

SEQ ID NO: 459931 - DNA, 25 bp, Rattus norvegicus
gggtctctcagatttagacatttga

SEQ ID NO: 459932 - DNA, 25 bp, Rattus norvegicus
gggtctctcgttatcatcgcagaca

SEQ ID NO: 459933 - DNA, 25 bp, Rattus norvegicus
gggtctctcgttttcatcgcagaca

SEQ ID NO: 459934 - DNA, 25 bp, Rattus norvegicus
gggtctctctctactgtttgtaggt

SEQ ID NO: 459935 - DNA, 25 bp, Rattus norvegicus
gggtctctctcttctgtttgtaggt

SEQ ID NO: 459936 - DNA, 25 bp, Rattus norvegicus
gggtctctcttcaagtccagaacag

SEQ ID NO: 459937 - DNA, 25 bp, Rattus norvegicus
gggtctctcttctagtccagaacag

SEQ ID NO: 459938 - DNA, 25 bp, Rattus norvegicus
gggtctctcttgactgttgctacca

SEQ ID NO: 459939 - DNA, 25 bp, Rattus norvegicus
gggtctctcttgtctgttgctacca

SEQ ID NO: 459940 - DNA, 25 bp, Rattus norvegicus
gggtctctgacaatgtgctaactct

SEQ ID NO: 459941 - DNA, 25 bp, Rattus norvegicus
gggtctctgacattgtgctaactct

SEQ ID NO: 459942 - DNA, 25 bp, Rattus norvegicus
gggtctctgagactgttcatcacca

SEQ ID NO: 459943 - DNA, 25 bp, Rattus norvegicus
gggtctctgagagtgttcatcacca

SEQ ID NO: 459944 - DNA, 25 bp, Rattus norvegicus
gggtctctgataattactctgttcc

SEQ ID NO: 459945 - DNA, 25 bp, Rattus norvegicus
gggtctctgatatttactctgttcc

SEQ ID NO: 459946 - DNA, 25 bp, Rattus norvegicus
gggtctctgcacagaactaactgat

SEQ ID NO: 459947 - DNA, 25 bp, Rattus norvegicus
gggtctctgcactgaactaactgat

SEQ ID NO: 459948 - DNA, 25 bp, Rattus norvegicus
gggtctctgcatctaggaatctgtc

SEQ ID NO: 459949 - DNA, 25 bp, Rattus norvegicus
gggtctctgcatgtaggaatctgtc

SEQ ID NO: 459950 - DNA, 25 bp, Rattus norvegicus
gggtctctgctaatatgtatctcat

SEQ ID NO: 459951 - DNA, 25 bp, Rattus norvegicus
gggtctctgctattatgtatctcat

SEQ ID NO: 459952 - DNA, 25 bp, Rattus norvegicus
gggtctctgctgagcccagcgaggg

SEQ ID NO: 459953 - DNA, 25 bp, Rattus norvegicus
gggtctctgctgcagagaactcttt

SEQ ID NO: 459954 - DNA, 25 bp, Rattus norvegicus
gggtctctgctggagagaactcttt

SEQ ID NO: 459955 - DNA, 25 bp, Rattus norvegicus
gggtctctgctgtgcccagcgaggg

SEQ ID NO: 459956 - DNA, 25 bp, Rattus norvegicus
gggtctctggcaaacagtctcttga

SEQ ID NO: 459957 - DNA, 25 bp, Rattus norvegicus
gggtctctggcatacagtctcttga

SEQ ID NO: 459958 - DNA, 25 bp, Rattus norvegicus
gggtctctgggtctatatgtgtcta

SEQ ID NO: 459959 - DNA, 25 bp, Rattus norvegicus
gggtctctgggtgtatatgtgtcta

SEQ ID NO: 459960 - DNA, 25 bp, Rattus norvegicus
gggtctctgtacattgactgctgtc

SEQ ID NO: 459961 - DNA, 25 bp, Rattus norvegicus
gggtctctgtactttgactgctgtc

SEQ ID NO: 459962 - DNA, 25 bp, Rattus norvegicus
gggtctctgtcaccaagcttgcaag

SEQ ID NO: 459963 - DNA, 25 bp, Rattus norvegicus
gggtctctgtcagcaagcttgcaag

SEQ ID NO: 459964 - DNA, 25 bp, Rattus norvegicus
gggtctctgtttcaggcatttttta

SEQ ID NO: 459965 - DNA, 25 bp, Rattus norvegicus
gggtctctgtttgaggcatttttta

SEQ ID NO: 459966 - DNA, 25 bp, Rattus norvegicus
gggtctcttaaacgtgtggcagtcc

SEQ ID NO: 459967 - DNA, 25 bp, Rattus norvegicus
gggtctcttaaaggtgtggcagtcc

SEQ ID NO: 459968 - DNA, 25 bp, Rattus norvegicus
gggtctcttcagaatgtcaacatct

SEQ ID NO: 459969 - DNA, 25 bp, Rattus norvegicus
gggtctcttcagtatgtcaacatct

SEQ ID NO: 459970 - DNA, 25 bp, Rattus norvegicus
gggtctcttctgagtgagcacgaat

SEQ ID NO: 459971 - DNA, 25 bp, Rattus norvegicus
gggtctcttctgtgtgagcacgaat

SEQ ID NO: 459972 - DNA, 25 bp, Rattus norvegicus
gggtctcttgttatggacatctcat

SEQ ID NO: 459973 - DNA, 25 bp, Rattus norvegicus
gggtctcttgttttggacatctcat

SEQ ID NO: 459974 - DNA, 25 bp, Rattus norvegicus
gggtctgaacaccaagcctctacct

SEQ ID NO: 459975 - DNA, 25 bp, Rattus norvegicus
gggtctgaacacgaagcctctacct

SEQ ID NO: 459976 - DNA, 25 bp, Rattus norvegicus
gggtctgaatggaaggtcatccctt

SEQ ID NO: 459977 - DNA, 25 bp, Rattus norvegicus
gggtctgaatggtaggtcatccctt

SEQ ID NO: 459978 - DNA, 25 bp, Rattus norvegicus
gggtctgacaccagttttgcccatc

SEQ ID NO: 459979 - DNA, 25 bp, Rattus norvegicus
gggtctgacacctgttttgcccatc

SEQ ID NO: 459980 - DNA, 25 bp, Rattus norvegicus
gggtctgacaggctcagtctactaa

SEQ ID NO: 459981 - DNA, 25 bp, Rattus norvegicus
gggtctgacagggtcagtctactaa

SEQ ID NO: 459982 - DNA, 25 bp, Rattus norvegicus
gggtctgaccgtacggctgcatcct

SEQ ID NO: 459983 - DNA, 25 bp, Rattus norvegicus
gggtctgaccgttcggctgcatcct

SEQ ID NO: 459984 - DNA, 25 bp, Rattus norvegicus
gggtctgagagacgaccctcagttt

SEQ ID NO: 459985 - DNA, 25 bp, Rattus norvegicus
gggtctgagagaggaccctcagttt

SEQ ID NO: 459986 - DNA, 25 bp, Rattus norvegicus
gggtctgagctcactcatccctaag

SEQ ID NO: 459987 - DNA, 25 bp, Rattus norvegicus
gggtctgagctctctcatccctaag

SEQ ID NO: 459988 - DNA, 25 bp, Rattus norvegicus
gggtctgagcttcactatcagggtt

SEQ ID NO: 459989 - DNA, 25 bp, Rattus norvegicus
gggtctgagcttgactatcagggtt

SEQ ID NO: 459990 - DNA, 25 bp, Rattus norvegicus
gggtctgaggttccacagtctatta

SEQ ID NO: 459991 - DNA, 25 bp, Rattus norvegicus
gggtctgaggttgcacagtctatta

SEQ ID NO: 459992 - DNA, 25 bp, Rattus norvegicus
gggtctgataaacatctctcctgga

SEQ ID NO: 459993 - DNA, 25 bp, Rattus norvegicus
gggtctgataaagatctctcctgga

SEQ ID NO: 459994 - DNA, 25 bp, Rattus norvegicus
gggtctgataagacaccttcctaac

SEQ ID NO: 459995 - DNA, 25 bp, Rattus norvegicus
gggtctgataagtcaccttcctaac

SEQ ID NO: 459996 - DNA, 25 bp, Rattus norvegicus
gggtctgatactctggaaacataaa

SEQ ID NO: 459997 - DNA, 25 bp, Rattus norvegicus
gggtctgatactgtggaaacataaa

SEQ ID NO: 459998 - DNA, 25 bp, Rattus norvegicus
gggtctgatcaaaacctgctgttta

SEQ ID NO: 459999 - DNA, 25 bp, Rattus norvegicus
gggtctgatcaatacctgctgttta

SEQ ID NO: 460000 - DNA, 25 bp, Rattus norvegicus
gggtctgatcgaccccatgatgaaa

SEQ ID NO: 460001 - DNA, 25 bp, Rattus norvegicus
gggtctgatcgagcccatgatgaaa

SEQ ID NO: 460002 - DNA, 25 bp, Rattus norvegicus
gggtctgcaaaactctgatagcatt

SEQ ID NO: 460003 - DNA, 25 bp, Rattus norvegicus
gggtctgcaaaagtctgatagcatt

SEQ ID NO: 460004 - DNA, 25 bp, Rattus norvegicus
gggtctgcaagtaggactgcttcca

SEQ ID NO: 460005 - DNA, 25 bp, Rattus norvegicus
gggtctgcaagttggactgcttcca

SEQ ID NO: 460006 - DNA, 25 bp, Rattus norvegicus
gggtctgcacgacatcctttagggc

SEQ ID NO: 460007 - DNA, 25 bp, Rattus norvegicus
gggtctgcacgagatcctttagggc

SEQ ID NO: 460008 - DNA, 25 bp, Rattus norvegicus
gggtctgcactgctaagtcaggact

SEQ ID NO: 460009 - DNA, 25 bp, Rattus norvegicus
gggtctgcactggtaagtcaggact

SEQ ID NO: 460010 - DNA, 25 bp, Rattus norvegicus
gggtctgcaggactgctgctctcct

SEQ ID NO: 460011 - DNA, 25 bp, Rattus norvegicus
gggtctgcaggagtgctgctctcct

SEQ ID NO: 460012 - DNA, 25 bp, Rattus norvegicus
gggtctgcaggcacaatgactctcc

SEQ ID NO: 460013 - DNA, 25 bp, Rattus norvegicus
gggtctgcaggctcaatgactctcc

SEQ ID NO: 460014 - DNA, 25 bp, Rattus norvegicus
gggtctgccagacgccagaactgtt

SEQ ID NO: 460015 - DNA, 25 bp, Rattus norvegicus
gggtctgccagaggccagaactgtt

SEQ ID NO: 460016 - DNA, 25 bp, Rattus norvegicus
gggtctgccctaagctagactatga

SEQ ID NO: 460017 - DNA, 25 bp, Rattus norvegicus
gggtctgccctatgctagactatga

SEQ ID NO: 460018 - DNA, 25 bp, Rattus norvegicus
gggtctgcctaaaagtctgcatcat

SEQ ID NO: 460019 - DNA, 25 bp, Rattus norvegicus
gggtctgcctaatagtctgcatcat

SEQ ID NO: 460020 - DNA, 25 bp, Rattus norvegicus
gggtctgccttcatgcatgaacaca

SEQ ID NO: 460021 - DNA, 25 bp, Rattus norvegicus
gggtctgccttcttgcatgaacaca

SEQ ID NO: 460022 - DNA, 25 bp, Rattus norvegicus
gggtctgccttgagcgtgctagcaa

SEQ ID NO: 460023 - DNA, 25 bp, Rattus norvegicus
gggtctgccttgtgcgtgctagcaa

SEQ ID NO: 460024 - DNA, 25 bp, Rattus norvegicus
gggtctgctaaacaagaactggtag

SEQ ID NO: 460025 - DNA, 25 bp, Rattus norvegicus
gggtctgctaaagaagaactggtag

SEQ ID NO: 460026 - DNA, 25 bp, Rattus norvegicus
gggtctgctaatatgattggccatg

SEQ ID NO: 460027 - DNA, 25 bp, Rattus norvegicus
gggtctgctaatttgattggccatg

SEQ ID NO: 460028 - DNA, 25 bp, Rattus norvegicus
gggtctgctactcggcttctcagag

SEQ ID NO: 460029 - DNA, 25 bp, Rattus norvegicus
gggtctgctactgggcttctcagag

SEQ ID NO: 460030 - DNA, 25 bp, Rattus norvegicus
gggtctgctcctacacatagtgtgt

SEQ ID NO: 460031 - DNA, 25 bp, Rattus norvegicus
gggtctgctccttcacatagtgtgt

SEQ ID NO: 460032 - DNA, 25 bp, Rattus norvegicus
gggtctgctgcaattatgtacttac

SEQ ID NO: 460033 - DNA, 25 bp, Rattus norvegicus
gggtctgctgcatttatgtacttac

SEQ ID NO: 460034 - DNA, 25 bp, Rattus norvegicus
gggtctgctgctctgttctggcacc

SEQ ID NO: 460035 - DNA, 25 bp, Rattus norvegicus
gggtctgctgctgtgttctggcacc

SEQ ID NO: 460036 - DNA, 25 bp, Rattus norvegicus
gggtctgcttgaaaacctagctgtt

SEQ ID NO: 460037 - DNA, 25 bp, Rattus norvegicus
gggtctgcttgataacctagctgtt

SEQ ID NO: 460038 - DNA, 25 bp, Rattus norvegicus
gggtctgctttcaacttgacacagg

SEQ ID NO: 460039 - DNA, 25 bp, Rattus norvegicus
gggtctgctttccacatttaacagc

SEQ ID NO: 460040 - DNA, 25 bp, Rattus norvegicus
gggtctgctttcgacatttaacagc

SEQ ID NO: 460041 - DNA, 25 bp, Rattus norvegicus
gggtctgctttctacttgacacagg

SEQ ID NO: 460042 - DNA, 25 bp, Rattus norvegicus
gggtctggaccaagtgtactgtata

SEQ ID NO: 460043 - DNA, 25 bp, Rattus norvegicus
gggtctggaccatgtgtactgtata

SEQ ID NO: 460044 - DNA, 25 bp, Rattus norvegicus
gggtctggagaactcaactctactc

SEQ ID NO: 460045 - DNA, 25 bp, Rattus norvegicus
gggtctggagaagtcaactctactc

SEQ ID NO: 460046 - DNA, 25 bp, Rattus norvegicus
gggtctggagaccattcgcctgaaa

SEQ ID NO: 460047 - DNA, 25 bp, Rattus norvegicus
gggtctggagacgattcgcctgaaa

SEQ ID NO: 460048 - DNA, 25 bp, Rattus norvegicus
gggtctggagcacactttcagcact

SEQ ID NO: 460049 - DNA, 25 bp, Rattus norvegicus
gggtctggagcagactttcagcact

SEQ ID NO: 460050 - DNA, 25 bp, Rattus norvegicus
gggtctggagttcttgtatccctgc

SEQ ID NO: 460051 - DNA, 25 bp, Rattus norvegicus
gggtctggagttgttgtatccctgc

SEQ ID NO: 460052 - DNA, 25 bp, Rattus norvegicus
gggtctggatccaggtcttggcaac

SEQ ID NO: 460053 - DNA, 25 bp, Rattus norvegicus
gggtctggatcctggtcttggcaac

SEQ ID NO: 460054 - DNA, 25 bp, Rattus norvegicus
gggtctggatctaaacccagccaat

SEQ ID NO: 460055 - DNA, 25 bp, Rattus norvegicus
gggtctggatcttaacccagccaat

SEQ ID NO: 460056 - DNA, 25 bp, Rattus norvegicus
gggtctggatggagttgctcattaa

SEQ ID NO: 460057 - DNA, 25 bp, Rattus norvegicus
gggtctggatggtgttgctcattaa

SEQ ID NO: 460058 - DNA, 25 bp, Rattus norvegicus
gggtctggcatcattctgaagggat

SEQ ID NO: 460059 - DNA, 25 bp, Rattus norvegicus
gggtctggcatctttctgaagggat

SEQ ID NO: 460060 - DNA, 25 bp, Rattus norvegicus
gggtctggcctaacgtcacacagct

SEQ ID NO: 460061 - DNA, 25 bp, Rattus norvegicus
gggtctggcctatcgtcacacagct

SEQ ID NO: 460062 - DNA, 25 bp, Rattus norvegicus
gggtctggcctgagttgaatgatta

SEQ ID NO: 460063 - DNA, 25 bp, Rattus norvegicus
gggtctggcctgtgttgaatgatta

SEQ ID NO: 460064 - DNA, 25 bp, Rattus norvegicus
gggtctggctcactagaatttgcca

SEQ ID NO: 460065 - DNA, 25 bp, Rattus norvegicus
gggtctggctcagtagaatttgcca

SEQ ID NO: 460066 - DNA, 25 bp, Rattus norvegicus
gggtctggtcagcaatggactccaa

SEQ ID NO: 460067 - DNA, 25 bp, Rattus norvegicus
gggtctggtcaggaatggactccaa

SEQ ID NO: 460068 - DNA, 25 bp, Rattus norvegicus
gggtctggtctaatctctctagaca

SEQ ID NO: 460069 - DNA, 25 bp, Rattus norvegicus
gggtctggtctattctctctagaca

SEQ ID NO: 460070 - DNA, 25 bp, Rattus norvegicus
gggtctggtgacactcaggccccag

SEQ ID NO: 460071 - DNA, 25 bp, Rattus norvegicus
gggtctggtgactctcaggccccag

SEQ ID NO: 460072 - DNA, 25 bp, Rattus norvegicus
gggtctgtacgcctttatcttacca

SEQ ID NO: 460073 - DNA, 25 bp, Rattus norvegicus
gggtctgtacgcgtttatcttacca

SEQ ID NO: 460074 - DNA, 25 bp, Rattus norvegicus
gggtctgtccatcagtagtaacctg

SEQ ID NO: 460075 - DNA, 25 bp, Rattus norvegicus
gggtctgtccatgagtagtaacctg

SEQ ID NO: 460076 - DNA, 25 bp, Rattus norvegicus
gggtctgtcctacgtatggaaaagt

SEQ ID NO: 460077 - DNA, 25 bp, Rattus norvegicus
gggtctgtcctaggtatggaaaagt

SEQ ID NO: 460078 - DNA, 25 bp, Rattus norvegicus
gggtctgtctggcaacaccatgcta

SEQ ID NO: 460079 - DNA, 25 bp, Rattus norvegicus
gggtctgtctgggaacaccatgcta

SEQ ID NO: 460080 - DNA, 25 bp, Rattus norvegicus
gggtctgtgcacaccaccatgtgga

SEQ ID NO: 460081 - DNA, 25 bp, Rattus norvegicus
gggtctgtgcacatatgttctaact

SEQ ID NO: 460082 - DNA, 25 bp, Rattus norvegicus
gggtctgtgcactccaccatgtgga

SEQ ID NO: 460083 - DNA, 25 bp, Rattus norvegicus
gggtctgtgcacttatgttctaact

SEQ ID NO: 460084 - DNA, 25 bp, Rattus norvegicus
gggtctgtgggacttactaattaca

SEQ ID NO: 460085 - DNA, 25 bp, Rattus norvegicus
gggtctgtgggagttactaattaca

SEQ ID NO: 460086 - DNA, 25 bp, Rattus norvegicus
gggtctgtgtaactgtcttcccctg

SEQ ID NO: 460087 - DNA, 25 bp, Rattus norvegicus
gggtctgtgtaagtgtcttcccctg

SEQ ID NO: 460088 - DNA, 25 bp, Rattus norvegicus
gggtctgtgtaccttctcttgtaga

SEQ ID NO: 460089 - DNA, 25 bp, Rattus norvegicus
gggtctgtgtacgttctcttgtaga

SEQ ID NO: 460090 - DNA, 25 bp, Rattus norvegicus
gggtctgttacaacggcaagggatc

SEQ ID NO: 460091 - DNA, 25 bp, Rattus norvegicus
gggtctgttacacgctttctattca

SEQ ID NO: 460092 - DNA, 25 bp, Rattus norvegicus
gggtctgttacaggctttctattca

SEQ ID NO: 460093 - DNA, 25 bp, Rattus norvegicus
gggtctgttacatcggcaagggatc

SEQ ID NO: 460094 - DNA, 25 bp, Rattus norvegicus
gggtctgttcccagcaacaataaac

SEQ ID NO: 460095 - DNA, 25 bp, Rattus norvegicus
gggtctgttccctgcaacaataaac

SEQ ID NO: 460096 - DNA, 25 bp, Rattus norvegicus
gggtctgttcgtagaagaatctgtt

SEQ ID NO: 460097 - DNA, 25 bp, Rattus norvegicus
gggtctgttcgttgaagaatctgtt

SEQ ID NO: 460098 - DNA, 25 bp, Rattus norvegicus
gggtctgttgtaattgtatgatcta

SEQ ID NO: 460099 - DNA, 25 bp, Rattus norvegicus
gggtctgttgtatttgtatgatcta

SEQ ID NO: 460100 - DNA, 25 bp, Rattus norvegicus
gggtctgtttggataggcctgtcac

SEQ ID NO: 460101 - DNA, 25 bp, Rattus norvegicus
gggtctgtttggttaggcctgtcac

SEQ ID NO: 460102 - DNA, 25 bp, Rattus norvegicus
gggtcttaacacatagcctaacctt

SEQ ID NO: 460103 - DNA, 25 bp, Rattus norvegicus
gggtcttaacacttagcctaacctt

SEQ ID NO: 460104 - DNA, 25 bp, Rattus norvegicus
gggtcttaagttatctggtgtgcag

SEQ ID NO: 460105 - DNA, 25 bp, Rattus norvegicus
gggtcttaagttttctggtgtgcag

SEQ ID NO: 460106 - DNA, 25 bp, Rattus norvegicus
gggtcttacaagaggtacttgccat

SEQ ID NO: 460107 - DNA, 25 bp, Rattus norvegicus
gggtcttacaagtggtacttgccat

SEQ ID NO: 460108 - DNA, 25 bp, Rattus norvegicus
gggtcttacaatcagtccagatggg

SEQ ID NO: 460109 - DNA, 25 bp, Rattus norvegicus
gggtcttacaatgagtccagatggg

SEQ ID NO: 460110 - DNA, 25 bp, Rattus norvegicus
gggtcttacacacacatatacttta

SEQ ID NO: 460111 - DNA, 25 bp, Rattus norvegicus
gggtcttacacacatgctgggtgaa

SEQ ID NO: 460112 - DNA, 25 bp, Rattus norvegicus
gggtcttacacagacatatacttta

SEQ ID NO: 460113 - DNA, 25 bp, Rattus norvegicus
gggtcttacacagatgctgggtgaa

SEQ ID NO: 460114 - DNA, 25 bp, Rattus norvegicus
gggtcttacaccactcaaatgctca

SEQ ID NO: 460115 - DNA, 25 bp, Rattus norvegicus
gggtcttacacctctcaaatgctca

SEQ ID NO: 460116 - DNA, 25 bp, Rattus norvegicus
gggtcttacataaggatctcctgct

SEQ ID NO: 460117 - DNA, 25 bp, Rattus norvegicus
gggtcttacatatggatctcctgct

SEQ ID NO: 460118 - DNA, 25 bp, Rattus norvegicus
gggtcttacatcatcttacggcttc

SEQ ID NO: 460119 - DNA, 25 bp, Rattus norvegicus
gggtcttacatcttcttacggcttc

SEQ ID NO: 460120 - DNA, 25 bp, Rattus norvegicus
gggtcttaccctctatttaaatgct

SEQ ID NO: 460121 - DNA, 25 bp, Rattus norvegicus
gggtcttaccctgtatttaaatgct

SEQ ID NO: 460122 - DNA, 25 bp, Rattus norvegicus
gggtcttacttcaagtcactgcagt

SEQ ID NO: 460123 - DNA, 25 bp, Rattus norvegicus
gggtcttacttctagtcactgcagt

SEQ ID NO: 460124 - DNA, 25 bp, Rattus norvegicus
gggtcttagaagctgccgttttagc

SEQ ID NO: 460125 - DNA, 25 bp, Rattus norvegicus
gggtcttagaaggtgccgttttagc

SEQ ID NO: 460126 - DNA, 25 bp, Rattus norvegicus
gggtcttagagacaaactcatccaa

SEQ ID NO: 460127 - DNA, 25 bp, Rattus norvegicus
gggtcttagagagaaactcatccaa

SEQ ID NO: 460128 - DNA, 25 bp, Rattus norvegicus
gggtcttagctaagactggccagga

SEQ ID NO: 460129 - DNA, 25 bp, Rattus norvegicus
gggtcttagctatgactggccagga

SEQ ID NO: 460130 - DNA, 25 bp, Rattus norvegicus
gggtcttagtgtctatatttcatgt

SEQ ID NO: 460131 - DNA, 25 bp, Rattus norvegicus
gggtcttagtgtgtatatttcatgt

SEQ ID NO: 460132 - DNA, 25 bp, Rattus norvegicus
gggtcttataaaatatctccatgtt

SEQ ID NO: 460133 - DNA, 25 bp, Rattus norvegicus
gggtcttataaattatctccatgtt

SEQ ID NO: 460134 - DNA, 25 bp, Rattus norvegicus
gggtcttataacatatctctaactc

SEQ ID NO: 460135 - DNA, 25 bp, Rattus norvegicus
gggtcttataacttatctctaactc

SEQ ID NO: 460136 - DNA, 25 bp, Rattus norvegicus
gggtcttatgacagcttacttagga

SEQ ID NO: 460137 - DNA, 25 bp, Rattus norvegicus
gggtcttatgactgcttacttagga

SEQ ID NO: 460138 - DNA, 25 bp, Rattus norvegicus
gggtcttatgctcagcaccctggcc

SEQ ID NO: 460139 - DNA, 25 bp, Rattus norvegicus
gggtcttatgctgagcaccctggcc

SEQ ID NO: 460140 - DNA, 25 bp, Rattus norvegicus
gggtcttcaaacaactcgaggcaga

SEQ ID NO: 460141 - DNA, 25 bp, Rattus norvegicus
gggtcttcaaactactcgaggcaga

SEQ ID NO: 460142 - DNA, 25 bp, Rattus norvegicus
gggtcttcaaatacaacccctggtg

SEQ ID NO: 460143 - DNA, 25 bp, Rattus norvegicus
gggtcttcaaattcaacccctggtg

SEQ ID NO: 460144 - DNA, 25 bp, Rattus norvegicus
gggtcttcaacaagtcctgtgccat

SEQ ID NO: 460145 - DNA, 25 bp, Rattus norvegicus
gggtcttcaacatgtcctgtgccat

SEQ ID NO: 460146 - DNA, 25 bp, Rattus norvegicus
gggtcttcaagcaggacttgctccg

SEQ ID NO: 460147 - DNA, 25 bp, Rattus norvegicus
gggtcttcaagctggacttgctccg

SEQ ID NO: 460148 - DNA, 25 bp, Rattus norvegicus
gggtcttcacggacaggcaagcaag

SEQ ID NO: 460149 - DNA, 25 bp, Rattus norvegicus
gggtcttcacggtcaggcaagcaag

SEQ ID NO: 460150 - DNA, 25 bp, Rattus norvegicus
gggtcttcaggaactcaggcccttc

SEQ ID NO: 460151 - DNA, 25 bp, Rattus norvegicus
gggtcttcaggatctcaggcccttc

SEQ ID NO: 460152 - DNA, 25 bp, Rattus norvegicus
gggtcttcataaatgctttcatctg

SEQ ID NO: 460153 - DNA, 25 bp, Rattus norvegicus
gggtcttcataattgctttcatctg

SEQ ID NO: 460154 - DNA, 25 bp, Rattus norvegicus
gggtcttcatagaaaccatgtcttt

SEQ ID NO: 460155 - DNA, 25 bp, Rattus norvegicus
gggtcttcatagtaaccatgtcttt

SEQ ID NO: 460156 - DNA, 25 bp, Rattus norvegicus
gggtcttccagcctctacaaaactg

SEQ ID NO: 460157 - DNA, 25 bp, Rattus norvegicus
gggtcttccagcgtctacaaaactg

SEQ ID NO: 460158 - DNA, 25 bp, Rattus norvegicus
gggtcttccatactcgggaacaaga

SEQ ID NO: 460159 - DNA, 25 bp, Rattus norvegicus
gggtcttccatagtcgggaacaaga

SEQ ID NO: 460160 - DNA, 25 bp, Rattus norvegicus
gggtcttcccaaagctgactcgggc

SEQ ID NO: 460161 - DNA, 25 bp, Rattus norvegicus
gggtcttcccaatgctgactcgggc

SEQ ID NO: 460162 - DNA, 25 bp, Rattus norvegicus
gggtcttcccttacatctggtaaag

SEQ ID NO: 460163 - DNA, 25 bp, Rattus norvegicus
gggtcttccctttcatctggtaaag

SEQ ID NO: 460164 - DNA, 25 bp, Rattus norvegicus
gggtcttccttcagtgattcttgaa

SEQ ID NO: 460165 - DNA, 25 bp, Rattus norvegicus
gggtcttccttctgtgattcttgaa

SEQ ID NO: 460166 - DNA, 25 bp, Rattus norvegicus
gggtcttcctttccagctcgggaga

SEQ ID NO: 460167 - DNA, 25 bp, Rattus norvegicus
gggtcttcctttcttgcccaggcaa

SEQ ID NO: 460168 - DNA, 25 bp, Rattus norvegicus
gggtcttcctttgcagctcgggaga

SEQ ID NO: 460169 - DNA, 25 bp, Rattus norvegicus
gggtcttcctttgttgcccaggcaa

SEQ ID NO: 460170 - DNA, 25 bp, Rattus norvegicus
gggtcttcgatcaagcaaatctgaa

SEQ ID NO: 460171 - DNA, 25 bp, Rattus norvegicus
gggtcttcgatctagcaaatctgaa

SEQ ID NO: 460172 - DNA, 25 bp, Rattus norvegicus
gggtcttcgccgcagatataccact

SEQ ID NO: 460173 - DNA, 25 bp, Rattus norvegicus
gggtcttcgccggagatataccact

SEQ ID NO: 460174 - DNA, 25 bp, Rattus norvegicus
gggtcttctctgacagctgaaagca

SEQ ID NO: 460175 - DNA, 25 bp, Rattus norvegicus
gggtcttctctgtcagctgaaagca

SEQ ID NO: 460176 - DNA, 25 bp, Rattus norvegicus
gggtcttctgggaatgacatttaat

SEQ ID NO: 460177 - DNA, 25 bp, Rattus norvegicus
gggtcttctgggtatgacatttaat

SEQ ID NO: 460178 - DNA, 25 bp, Rattus norvegicus
gggtcttcttttcctgacaaacttg

SEQ ID NO: 460179 - DNA, 25 bp, Rattus norvegicus
gggtcttcttttgctgacaaacttg

SEQ ID NO: 460180 - DNA, 25 bp, Rattus norvegicus
gggtcttgaaaacccctctgtggta

SEQ ID NO: 460181 - DNA, 25 bp, Rattus norvegicus
gggtcttgaaaagccctctgtggta

SEQ ID NO: 460182 - DNA, 25 bp, Rattus norvegicus
gggtcttgaacaactgggacagtgt

SEQ ID NO: 460183 - DNA, 25 bp, Rattus norvegicus
gggtcttgaacatctgggacagtgt

SEQ ID NO: 460184 - DNA, 25 bp, Rattus norvegicus
gggtcttgaaggagactcagctact

SEQ ID NO: 460185 - DNA, 25 bp, Rattus norvegicus
gggtcttgaaggtgactcagctact

SEQ ID NO: 460186 - DNA, 25 bp, Rattus norvegicus
gggtcttgagatatccttatgcata

SEQ ID NO: 460187 - DNA, 25 bp, Rattus norvegicus
gggtcttgagatttccttatgcata

SEQ ID NO: 460188 - DNA, 25 bp, Rattus norvegicus
gggtcttgaggaaccaactgtgcaa

SEQ ID NO: 460189 - DNA, 25 bp, Rattus norvegicus
gggtcttgaggatccaactgtgcaa

SEQ ID NO: 460190 - DNA, 25 bp, Rattus norvegicus
gggtcttgatttctggatacatgta

SEQ ID NO: 460191 - DNA, 25 bp, Rattus norvegicus
gggtcttgatttgtggatacatgta

SEQ ID NO: 460192 - DNA, 25 bp, Rattus norvegicus
gggtcttgcaacagcacccagaagc

SEQ ID NO: 460193 - DNA, 25 bp, Rattus norvegicus
gggtcttgcaactgcacccagaagc

SEQ ID NO: 460194 - DNA, 25 bp, Rattus norvegicus
gggtcttgctccaagagctgcgaga

SEQ ID NO: 460195 - DNA, 25 bp, Rattus norvegicus
gggtcttgctcctagagctgcgaga

SEQ ID NO: 460196 - DNA, 25 bp, Rattus norvegicus
gggtcttgcttccatgagctgttac

SEQ ID NO: 460197 - DNA, 25 bp, Rattus norvegicus
gggtcttgcttcgatgagctgttac

SEQ ID NO: 460198 - DNA, 25 bp, Rattus norvegicus
gggtcttggcatactttgcagtgag

SEQ ID NO: 460199 - DNA, 25 bp, Rattus norvegicus
gggtcttggcattctttgcagtgag

SEQ ID NO: 460200 - DNA, 25 bp, Rattus norvegicus
gggtcttgtaaaagtaccatgacaa

SEQ ID NO: 460201 - DNA, 25 bp, Rattus norvegicus
gggtcttgtaaatgtaccatgacaa

SEQ ID NO: 460202 - DNA, 25 bp, Rattus norvegicus
gggtcttgtctccttgaatattcaa

SEQ ID NO: 460203 - DNA, 25 bp, Rattus norvegicus
gggtcttgtctcgttgaatattcaa

SEQ ID NO: 460204 - DNA, 25 bp, Rattus norvegicus
gggtctttaaatccacacagccgtt

SEQ ID NO: 460205 - DNA, 25 bp, Rattus norvegicus
gggtctttaaatgcacacagccgtt

SEQ ID NO: 460206 - DNA, 25 bp, Rattus norvegicus
gggtctttacatatgatcttccaca

SEQ ID NO: 460207 - DNA, 25 bp, Rattus norvegicus
gggtctttacatttgatcttccaca

SEQ ID NO: 460208 - DNA, 25 bp, Rattus norvegicus
gggtctttagatagcccaggctgcc

SEQ ID NO: 460209 - DNA, 25 bp, Rattus norvegicus
gggtctttagattgcccaggctgcc

SEQ ID NO: 460210 - DNA, 25 bp, Rattus norvegicus
gggtctttagcaatggtggccacct

SEQ ID NO: 460211 - DNA, 25 bp, Rattus norvegicus
gggtctttagcattggtggccacct

SEQ ID NO: 460212 - DNA, 25 bp, Rattus norvegicus
gggtctttatcaaagtgttctagta

SEQ ID NO: 460213 - DNA, 25 bp, Rattus norvegicus
gggtctttatcatagtgttctagta

SEQ ID NO: 460214 - DNA, 25 bp, Rattus norvegicus
gggtctttatccattgttctgtgga

SEQ ID NO: 460215 - DNA, 25 bp, Rattus norvegicus
gggtctttatcctttgttctgtgga

SEQ ID NO: 460216 - DNA, 25 bp, Rattus norvegicus
gggtctttatctagaaagccacggt

SEQ ID NO: 460217 - DNA, 25 bp, Rattus norvegicus
gggtctttatcttgaaagccacggt

SEQ ID NO: 460218 - DNA, 25 bp, Rattus norvegicus
gggtctttatggactgacgtgcaag

SEQ ID NO: 460219 - DNA, 25 bp, Rattus norvegicus
gggtctttatggtctgacgtgcaag

SEQ ID NO: 460220 - DNA, 25 bp, Rattus norvegicus
gggtctttattgacatctcactttt

SEQ ID NO: 460221 - DNA, 25 bp, Rattus norvegicus
gggtctttattgtcatctcactttt

SEQ ID NO: 460222 - DNA, 25 bp, Rattus norvegicus
gggtctttcagaatgcctctttcaa

SEQ ID NO: 460223 - DNA, 25 bp, Rattus norvegicus
gggtctttcagattgcctctttcaa

SEQ ID NO: 460224 - DNA, 25 bp, Rattus norvegicus
gggtctttcataaggcctcactctt

SEQ ID NO: 460225 - DNA, 25 bp, Rattus norvegicus
gggtctttcatatggcctcactctt

SEQ ID NO: 460226 - DNA, 25 bp, Rattus norvegicus
gggtctttcattatctctacaagca

SEQ ID NO: 460227 - DNA, 25 bp, Rattus norvegicus
gggtctttcattttctctacaagca

SEQ ID NO: 460228 - DNA, 25 bp, Rattus norvegicus
gggtctttcctcaagatcctggatc

SEQ ID NO: 460229 - DNA, 25 bp, Rattus norvegicus
gggtctttcctctagatcctggatc

SEQ ID NO: 460230 - DNA, 25 bp, Rattus norvegicus
gggtctttcgcaacatattcgttag

SEQ ID NO: 460231 - DNA, 25 bp, Rattus norvegicus
gggtctttcgcatcatattcgttag

SEQ ID NO: 460232 - DNA, 25 bp, Rattus norvegicus
gggtctttctgcctgttgaatagtc

SEQ ID NO: 460233 - DNA, 25 bp, Rattus norvegicus
gggtctttctgcgtgttgaatagtc

SEQ ID NO: 460234 - DNA, 25 bp, Rattus norvegicus
gggtctttgctcatgaagcccagga

SEQ ID NO: 460235 - DNA, 25 bp, Rattus norvegicus
gggtctttgctcttgaagcccagga

SEQ ID NO: 460236 - DNA, 25 bp, Rattus norvegicus
gggtctttggatcttgccaaatgag

SEQ ID NO: 460237 - DNA, 25 bp, Rattus norvegicus
gggtctttggatgttgccaaatgag

SEQ ID NO: 460238 - DNA, 25 bp, Rattus norvegicus
gggtcttttcatccatcagtgtgtg

SEQ ID NO: 460239 - DNA, 25 bp, Rattus norvegicus
gggtcttttcatgcatcagtgtgtg

SEQ ID NO: 460240 - DNA, 25 bp, Rattus norvegicus
gggtcttttgtaccccgcaagccgt

SEQ ID NO: 460241 - DNA, 25 bp, Rattus norvegicus
gggtcttttgtagcccgcaagccgt

SEQ ID NO: 460242 - DNA, 25 bp, Rattus norvegicus
gggtctttttctctgagtgtctgcc

SEQ ID NO: 460243 - DNA, 25 bp, Rattus norvegicus
gggtctttttctgtgagtgtctgcc

SEQ ID NO: 460244 - DNA, 25 bp, Rattus norvegicus
gggtgaaacatcagagcagggttct

SEQ ID NO: 460245 - DNA, 25 bp, Rattus norvegicus
gggtgaaacatctgagcagggttct

SEQ ID NO: 460246 - DNA, 25 bp, Rattus norvegicus
gggtgaaaccctacctcagtagagt

SEQ ID NO: 460247 - DNA, 25 bp, Rattus norvegicus
gggtgaaacccttcctcagtagagt

SEQ ID NO: 460248 - DNA, 25 bp, Rattus norvegicus
gggtgaaatcaacactgggtacatt

SEQ ID NO: 460249 - DNA, 25 bp, Rattus norvegicus
gggtgaaatcaagactgggtacatt

SEQ ID NO: 460250 - DNA, 25 bp, Rattus norvegicus
gggtgaaatgacagccccatgggca

SEQ ID NO: 460251 - DNA, 25 bp, Rattus norvegicus
gggtgaaatgaccttgccgattcac

SEQ ID NO: 460252 - DNA, 25 bp, Rattus norvegicus
gggtgaaatgacgttgccgattcac

SEQ ID NO: 460253 - DNA, 25 bp, Rattus norvegicus
gggtgaaatgactgccccatgggca

SEQ ID NO: 460254 - DNA, 25 bp, Rattus norvegicus
gggtgaaatggtcagcagcctttaa

SEQ ID NO: 460255 - DNA, 25 bp, Rattus norvegicus
gggtgaaatggtgagcagcctttaa

SEQ ID NO: 460256 - DNA, 25 bp, Rattus norvegicus
gggtgaaattgtctctactttggaa

SEQ ID NO: 460257 - DNA, 25 bp, Rattus norvegicus
gggtgaaattgtgtctactttggaa

SEQ ID NO: 460258 - DNA, 25 bp, Rattus norvegicus
gggtgaacagagctctcccttgcta

SEQ ID NO: 460259 - DNA, 25 bp, Rattus norvegicus
gggtgaacagaggtctcccttgcta

SEQ ID NO: 460260 - DNA, 25 bp, Rattus norvegicus
gggtgaacaggcctacttctactgc

SEQ ID NO: 460261 - DNA, 25 bp, Rattus norvegicus
gggtgaacaggcgtacttctactgc

SEQ ID NO: 460262 - DNA, 25 bp, Rattus norvegicus
gggtgaaccacaaccttgagcctta

SEQ ID NO: 460263 - DNA, 25 bp, Rattus norvegicus
gggtgaaccacatccttgagcctta

SEQ ID NO: 460264 - DNA, 25 bp, Rattus norvegicus
gggtgaaccacgctcagtgctataa

SEQ ID NO: 460265 - DNA, 25 bp, Rattus norvegicus
gggtgaaccacggtcagtgctataa

SEQ ID NO: 460266 - DNA, 25 bp, Rattus norvegicus
gggtgaaccctgagcgtaactactg

SEQ ID NO: 460267 - DNA, 25 bp, Rattus norvegicus
gggtgaaccctgtgcgtaactactg

SEQ ID NO: 460268 - DNA, 25 bp, Rattus norvegicus
gggtgaacctcaatttcgggatccg

SEQ ID NO: 460269 - DNA, 25 bp, Rattus norvegicus
gggtgaacctcattttcgggatccg

SEQ ID NO: 460270 - DNA, 25 bp, Rattus norvegicus
gggtgaacgataaactctcctccag

SEQ ID NO: 460271 - DNA, 25 bp, Rattus norvegicus
gggtgaacgatatactctcctccag

SEQ ID NO: 460272 - DNA, 25 bp, Rattus norvegicus
gggtgaagacgccattctgcaaaca

SEQ ID NO: 460273 - DNA, 25 bp, Rattus norvegicus
gggtgaagacgcgattctgcaaaca

SEQ ID NO: 460274 - DNA, 25 bp, Rattus norvegicus
gggtgaagatgaccccattctagaa

SEQ ID NO: 460275 - DNA, 25 bp, Rattus norvegicus
gggtgaagatgagcccattctagaa

SEQ ID NO: 460276 - DNA, 25 bp, Rattus norvegicus
gggtgaagcaatatggccgccccac

SEQ ID NO: 460277 - DNA, 25 bp, Rattus norvegicus
gggtgaagcaatttggccgccccac

SEQ ID NO: 460278 - DNA, 25 bp, Rattus norvegicus
gggtgaagccagatgtttccctcta

SEQ ID NO: 460279 - DNA, 25 bp, Rattus norvegicus
gggtgaagccagttgtttccctcta

SEQ ID NO: 460280 - DNA, 25 bp, Rattus norvegicus
gggtgaagtaggagtcccgcaccaa

SEQ ID NO: 460281 - DNA, 25 bp, Rattus norvegicus
gggtgaagtaggtgtcccgcaccaa

SEQ ID NO: 460282 - DNA, 25 bp, Rattus norvegicus
gggtgaagttccagggctctgtcca

SEQ ID NO: 460283 - DNA, 25 bp, Rattus norvegicus
gggtgaagttcctgggctctgtcca

SEQ ID NO: 460284 - DNA, 25 bp, Rattus norvegicus
gggtgaatatacaacctgaattttg

SEQ ID NO: 460285 - DNA, 25 bp, Rattus norvegicus
gggtgaatatactacctgaattttg

SEQ ID NO: 460286 - DNA, 25 bp, Rattus norvegicus
gggtgaatcatgagccttacttttt

SEQ ID NO: 460287 - DNA, 25 bp, Rattus norvegicus
gggtgaatcatgtgccttacttttt

SEQ ID NO: 460288 - DNA, 25 bp, Rattus norvegicus
gggtgaatcccacacattgagcatt

SEQ ID NO: 460289 - DNA, 25 bp, Rattus norvegicus
gggtgaatcccagacattgagcatt

SEQ ID NO: 460290 - DNA, 25 bp, Rattus norvegicus
gggtgaatctctacgatcaagaact

SEQ ID NO: 460291 - DNA, 25 bp, Rattus norvegicus
gggtgaatctcttcgatcaagaact

SEQ ID NO: 460292 - DNA, 25 bp, Rattus norvegicus
gggtgaatcttaacttttggaaatc

SEQ ID NO: 460293 - DNA, 25 bp, Rattus norvegicus
gggtgaatcttatcttttggaaatc

SEQ ID NO: 460294 - DNA, 25 bp, Rattus norvegicus
gggtgaatgaacagtatttcctgtt

SEQ ID NO: 460295 - DNA, 25 bp, Rattus norvegicus
gggtgaatgaacatatccaacggtc

SEQ ID NO: 460296 - DNA, 25 bp, Rattus norvegicus
gggtgaatgaactgtatttcctgtt

SEQ ID NO: 460297 - DNA, 25 bp, Rattus norvegicus
gggtgaatgaacttatccaacggtc

SEQ ID NO: 460298 - DNA, 25 bp, Rattus norvegicus
gggtgaatgttcagttgcctcaatt

SEQ ID NO: 460299 - DNA, 25 bp, Rattus norvegicus
gggtgaatgttctgttgcctcaatt

SEQ ID NO: 460300 - DNA, 25 bp, Rattus norvegicus
gggtgacaaccacctaatgtgctaa

SEQ ID NO: 460301 - DNA, 25 bp, Rattus norvegicus
gggtgacaaccagctaatgtgctaa

SEQ ID NO: 460302 - DNA, 25 bp, Rattus norvegicus
gggtgacaagccatggcctagcctg

SEQ ID NO: 460303 - DNA, 25 bp, Rattus norvegicus
gggtgacaagccttggcctagcctg

SEQ ID NO: 460304 - DNA, 25 bp, Rattus norvegicus
gggtgacacatgcttgacctgccag

SEQ ID NO: 460305 - DNA, 25 bp, Rattus norvegicus
gggtgacacatggttgacctgccag

SEQ ID NO: 460306 - DNA, 25 bp, Rattus norvegicus
gggtgacaccatcacaaacagagct

SEQ ID NO: 460307 - DNA, 25 bp, Rattus norvegicus
gggtgacaccatgacaaacagagct

SEQ ID NO: 460308 - DNA, 25 bp, Rattus norvegicus
gggtgacagagtattctaaaggctc

SEQ ID NO: 460309 - DNA, 25 bp, Rattus norvegicus
gggtgacagagttttctaaaggctc

SEQ ID NO: 460310 - DNA, 25 bp, Rattus norvegicus
gggtgacagcatctattccatcggg

SEQ ID NO: 460311 - DNA, 25 bp, Rattus norvegicus
gggtgacagcatgtattccatcggg

SEQ ID NO: 460312 - DNA, 25 bp, Rattus norvegicus
gggtgacagggcactcatttgcccc

SEQ ID NO: 460313 - DNA, 25 bp, Rattus norvegicus
gggtgacagggcacttacttgctcc

SEQ ID NO: 460314 - DNA, 25 bp, Rattus norvegicus
gggtgacagggctctcatttgcccc

SEQ ID NO: 460315 - DNA, 25 bp, Rattus norvegicus
gggtgacagggctcttacttgctcc

SEQ ID NO: 460316 - DNA, 25 bp, Rattus norvegicus
gggtgacagttcatacttggctcaa

SEQ ID NO: 460317 - DNA, 25 bp, Rattus norvegicus
gggtgacagttcttacttggctcaa

SEQ ID NO: 460318 - DNA, 25 bp, Rattus norvegicus
gggtgacatcataacatgcttccag

SEQ ID NO: 460319 - DNA, 25 bp, Rattus norvegicus
gggtgacatcattacatgcttccag

SEQ ID NO: 460320 - DNA, 25 bp, Rattus norvegicus
gggtgacatgatctttttccattcc

SEQ ID NO: 460321 - DNA, 25 bp, Rattus norvegicus
gggtgacatgatgtttttccattcc

SEQ ID NO: 460322 - DNA, 25 bp, Rattus norvegicus
gggtgacatttacggcagcctccag

SEQ ID NO: 460323 - DNA, 25 bp, Rattus norvegicus
gggtgacatttagggcagcctccag

SEQ ID NO: 460324 - DNA, 25 bp, Rattus norvegicus
gggtgaccacaaagtccttggagct

SEQ ID NO: 460325 - DNA, 25 bp, Rattus norvegicus
gggtgaccacaatgtccttggagct

SEQ ID NO: 460326 - DNA, 25 bp, Rattus norvegicus
gggtgaccaggaagcacacagctgc

SEQ ID NO: 460327 - DNA, 25 bp, Rattus norvegicus
gggtgaccaggatgcacacagctgc

SEQ ID NO: 460328 - DNA, 25 bp, Rattus norvegicus
gggtgaccagtccttggcatacaaa

SEQ ID NO: 460329 - DNA, 25 bp, Rattus norvegicus
gggtgaccagtcgttggcatacaaa

SEQ ID NO: 460330 - DNA, 25 bp, Rattus norvegicus
gggtgaccatcactatagatgatca

SEQ ID NO: 460331 - DNA, 25 bp, Rattus norvegicus
gggtgaccatcagtatagatgatca

SEQ ID NO: 460332 - DNA, 25 bp, Rattus norvegicus
gggtgaccatgtacatcgattcatt

SEQ ID NO: 460333 - DNA, 25 bp, Rattus norvegicus
gggtgaccatgttcatcgattcatt

SEQ ID NO: 460334 - DNA, 25 bp, Rattus norvegicus
gggtgacccaacctggtgccaataa

SEQ ID NO: 460335 - DNA, 25 bp, Rattus norvegicus
gggtgacccaacgtggtgccaataa

SEQ ID NO: 460336 - DNA, 25 bp, Rattus norvegicus
gggtgaccccaaaggctcggctagc

SEQ ID NO: 460337 - DNA, 25 bp, Rattus norvegicus
gggtgaccccaatggctcggctagc

SEQ ID NO: 460338 - DNA, 25 bp, Rattus norvegicus
gggtgacccgaactgctgactcacc

SEQ ID NO: 460339 - DNA, 25 bp, Rattus norvegicus
gggtgacccgaagtgctgactcacc

SEQ ID NO: 460340 - DNA, 25 bp, Rattus norvegicus
gggtgaccctgaatgtcctggaaat

SEQ ID NO: 460341 - DNA, 25 bp, Rattus norvegicus
gggtgaccctgattgtcctggaaat

SEQ ID NO: 460342 - DNA, 25 bp, Rattus norvegicus
gggtgaccctttcatttatagcaaa

SEQ ID NO: 460343 - DNA, 25 bp, Rattus norvegicus
gggtgaccctttgatttatagcaaa

SEQ ID NO: 460344 - DNA, 25 bp, Rattus norvegicus
gggtgacctgagagccttcaaagtg

SEQ ID NO: 460345 - DNA, 25 bp, Rattus norvegicus
gggtgacctgagtgccttcaaagtg

SEQ ID NO: 460346 - DNA, 25 bp, Rattus norvegicus
gggtgacctggcaataactggaata

SEQ ID NO: 460347 - DNA, 25 bp, Rattus norvegicus
gggtgacctggctataactggaata

SEQ ID NO: 460348 - DNA, 25 bp, Rattus norvegicus
gggtgacctgtcaaggccacaaact

SEQ ID NO: 460349 - DNA, 25 bp, Rattus norvegicus
gggtgacctgtctaggccacaaact

SEQ ID NO: 460350 - DNA, 25 bp, Rattus norvegicus
gggtgaccttgtaagtgtgcctttc

SEQ ID NO: 460351 - DNA, 25 bp, Rattus norvegicus
gggtgaccttgttagtgtgcctttc

SEQ ID NO: 460352 - DNA, 25 bp, Rattus norvegicus
gggtgacctttcatggccccaatgt

SEQ ID NO: 460353 - DNA, 25 bp, Rattus norvegicus
gggtgacctttcttggccccaatgt

SEQ ID NO: 460354 - DNA, 25 bp, Rattus norvegicus
gggtgacgaactcaagctacaatat

SEQ ID NO: 460355 - DNA, 25 bp, Rattus norvegicus
gggtgacgaactgaagctacaatat

SEQ ID NO: 460356 - DNA, 25 bp, Rattus norvegicus
gggtgacgcaacatccttgctggag

SEQ ID NO: 460357 - DNA, 25 bp, Rattus norvegicus
gggtgacgcaacttccttgctggag

SEQ ID NO: 460358 - DNA, 25 bp, Rattus norvegicus
gggtgacgtaatatgctcaaggcaa

SEQ ID NO: 460359 - DNA, 25 bp, Rattus norvegicus
gggtgacgtaatttgctcaaggcaa

SEQ ID NO: 460360 - DNA, 25 bp, Rattus norvegicus
gggtgactatacagaaactttacca

SEQ ID NO: 460361 - DNA, 25 bp, Rattus norvegicus
gggtgactatactgaaactttacca

SEQ ID NO: 460362 - DNA, 25 bp, Rattus norvegicus
gggtgactatagctagtgcaagcct

SEQ ID NO: 460363 - DNA, 25 bp, Rattus norvegicus
gggtgactataggtagtgcaagcct

SEQ ID NO: 460364 - DNA, 25 bp, Rattus norvegicus
gggtgactcacacgccaaggacaaa

SEQ ID NO: 460365 - DNA, 25 bp, Rattus norvegicus
gggtgactcacaggccaaggacaaa

SEQ ID NO: 460366 - DNA, 25 bp, Rattus norvegicus
gggtgactccaaaactgcagtcctg

SEQ ID NO: 460367 - DNA, 25 bp, Rattus norvegicus
gggtgactccaatactgcagtcctg

SEQ ID NO: 460368 - DNA, 25 bp, Rattus norvegicus
gggtgactctgaaataccacaacag

SEQ ID NO: 460369 - DNA, 25 bp, Rattus norvegicus
gggtgactctgatataccacaacag

SEQ ID NO: 460370 - DNA, 25 bp, Rattus norvegicus
gggtgactctgtagggattgctcct

SEQ ID NO: 460371 - DNA, 25 bp, Rattus norvegicus
gggtgactctgttgggattgctcct

SEQ ID NO: 460372 - DNA, 25 bp, Rattus norvegicus
gggtgactcttgattatctgttatg

SEQ ID NO: 460373 - DNA, 25 bp, Rattus norvegicus
gggtgactcttgtttatctgttatg

SEQ ID NO: 460374 - DNA, 25 bp, Rattus norvegicus
gggtgactgaccacagctaagacct

SEQ ID NO: 460375 - DNA, 25 bp, Rattus norvegicus
gggtgactgacctcagctaagacct

SEQ ID NO: 460376 - DNA, 25 bp, Rattus norvegicus
gggtgactgactactgagatcactt

SEQ ID NO: 460377 - DNA, 25 bp, Rattus norvegicus
gggtgactgacttctgagatcactt

SEQ ID NO: 460378 - DNA, 25 bp, Rattus norvegicus
gggtgactgctcctttagaccataa

SEQ ID NO: 460379 - DNA, 25 bp, Rattus norvegicus
gggtgactgctcgtttagaccataa

SEQ ID NO: 460380 - DNA, 25 bp, Rattus norvegicus
gggtgacttactcagccagtgcttc

SEQ ID NO: 460381 - DNA, 25 bp, Rattus norvegicus
gggtgacttactgagccagtgcttc

SEQ ID NO: 460382 - DNA, 25 bp, Rattus norvegicus
gggtgactttctcaggattcctaac

SEQ ID NO: 460383 - DNA, 25 bp, Rattus norvegicus
gggtgactttctgaggattcctaac

SEQ ID NO: 460384 - DNA, 25 bp, Rattus norvegicus
gggtgacttttgagctttattactg

SEQ ID NO: 460385 - DNA, 25 bp, Rattus norvegicus
gggtgacttttgtgctttattactg

SEQ ID NO: 460386 - DNA, 25 bp, Rattus norvegicus
gggtgagaacacatcctgagaaact

SEQ ID NO: 460387 - DNA, 25 bp, Rattus norvegicus
gggtgagaacacttcctgagaaact

SEQ ID NO: 460388 - DNA, 25 bp, Rattus norvegicus
gggtgagaacccagatgcccaggat

SEQ ID NO: 460389 - DNA, 25 bp, Rattus norvegicus
gggtgagaaccctgatgcccaggat

SEQ ID NO: 460390 - DNA, 25 bp, Rattus norvegicus
gggtgagaacctatagtcaaagcca

SEQ ID NO: 460391 - DNA, 25 bp, Rattus norvegicus
gggtgagaacctttagtcaaagcca

SEQ ID NO: 460392 - DNA, 25 bp, Rattus norvegicus
gggtgagacccacaaatccatgcta

SEQ ID NO: 460393 - DNA, 25 bp, Rattus norvegicus
gggtgagacccaccattagacacca

SEQ ID NO: 460394 - DNA, 25 bp, Rattus norvegicus
gggtgagacccagaaatccatgcta

SEQ ID NO: 460395 - DNA, 25 bp, Rattus norvegicus
gggtgagacccagcattagacacca

SEQ ID NO: 460396 - DNA, 25 bp, Rattus norvegicus
gggtgagataccactactccaagca

SEQ ID NO: 460397 - DNA, 25 bp, Rattus norvegicus
gggtgagatacctctactccaagca

SEQ ID NO: 460398 - DNA, 25 bp, Rattus norvegicus
gggtgagcaacacaactgctaccgt

SEQ ID NO: 460399 - DNA, 25 bp, Rattus norvegicus
gggtgagcaacagaactgctaccgt

SEQ ID NO: 460400 - DNA, 25 bp, Rattus norvegicus
gggtgagcagtaatcctattatgat

SEQ ID NO: 460401 - DNA, 25 bp, Rattus norvegicus
gggtgagcagtattcctattatgat

SEQ ID NO: 460402 - DNA, 25 bp, Rattus norvegicus
gggtgagcatccctgatgttttgaa

SEQ ID NO: 460403 - DNA, 25 bp, Rattus norvegicus
gggtgagcatccgtgatgttttgaa

SEQ ID NO: 460404 - DNA, 25 bp, Rattus norvegicus
gggtgagcatctactagccctgaag

SEQ ID NO: 460405 - DNA, 25 bp, Rattus norvegicus
gggtgagcatcttctagccctgaag

SEQ ID NO: 460406 - DNA, 25 bp, Rattus norvegicus
gggtgagccacactgccagactgaa

SEQ ID NO: 460407 - DNA, 25 bp, Rattus norvegicus
gggtgagccacagtgccagactgaa

SEQ ID NO: 460408 - DNA, 25 bp, Rattus norvegicus
gggtgagccagtatcaaattacaat

SEQ ID NO: 460409 - DNA, 25 bp, Rattus norvegicus
gggtgagccagtttcaaattacaat

SEQ ID NO: 460410 - DNA, 25 bp, Rattus norvegicus
gggtgagcttgccatgtaatctgat

SEQ ID NO: 460411 - DNA, 25 bp, Rattus norvegicus
gggtgagcttgcgatgtaatctgat

SEQ ID NO: 460412 - DNA, 25 bp, Rattus norvegicus
gggtgaggcacccttctgaactctt

SEQ ID NO: 460413 - DNA, 25 bp, Rattus norvegicus
gggtgaggcaccgttctgaactctt

SEQ ID NO: 460414 - DNA, 25 bp, Rattus norvegicus
gggtgaggcggaatgttttcataca

SEQ ID NO: 460415 - DNA, 25 bp, Rattus norvegicus
gggtgaggcggattgttttcataca

SEQ ID NO: 460416 - DNA, 25 bp, Rattus norvegicus
gggtgaggctacagaccctcaacgc

SEQ ID NO: 460417 - DNA, 25 bp, Rattus norvegicus
gggtgaggctactgaccctcaacgc

SEQ ID NO: 460418 - DNA, 25 bp, Rattus norvegicus
gggtgagggcccaggcgcctaccct

SEQ ID NO: 460419 - DNA, 25 bp, Rattus norvegicus
gggtgagggccctggcgcctaccct

SEQ ID NO: 460420 - DNA, 25 bp, Rattus norvegicus
gggtgaggtgatcttttatccctta

SEQ ID NO: 460421 - DNA, 25 bp, Rattus norvegicus
gggtgaggtgatgttttatccctta

SEQ ID NO: 460422 - DNA, 25 bp, Rattus norvegicus
gggtgagtccacaagccagcagagc

SEQ ID NO: 460423 - DNA, 25 bp, Rattus norvegicus
gggtgagtccactagccagcagagc

SEQ ID NO: 460424 - DNA, 25 bp, Rattus norvegicus
gggtgagtccctcttttgtagactt

SEQ ID NO: 460425 - DNA, 25 bp, Rattus norvegicus
gggtgagtccctgttttgtagactt

SEQ ID NO: 460426 - DNA, 25 bp, Rattus norvegicus
gggtgagtgaatctttaactgcttt

SEQ ID NO: 460427 - DNA, 25 bp, Rattus norvegicus
gggtgagtgaatgtttaactgcttt

SEQ ID NO: 460428 - DNA, 25 bp, Rattus norvegicus
gggtgagtgcccatcccatacaact

SEQ ID NO: 460429 - DNA, 25 bp, Rattus norvegicus
gggtgagtgcccttcccatacaact

SEQ ID NO: 460430 - DNA, 25 bp, Rattus norvegicus
gggtgagttcttaccagccatgtgg

SEQ ID NO: 460431 - DNA, 25 bp, Rattus norvegicus
gggtgagttctttccagccatgtgg

SEQ ID NO: 460432 - DNA, 25 bp, Rattus norvegicus
gggtgataccataccatcccagcct

SEQ ID NO: 460433 - DNA, 25 bp, Rattus norvegicus
gggtgataccattccatcccagcct

SEQ ID NO: 460434 - DNA, 25 bp, Rattus norvegicus
gggtgatagaatagccatgggcttt

SEQ ID NO: 460435 - DNA, 25 bp, Rattus norvegicus
gggtgatagaattgccatgggcttt

SEQ ID NO: 460436 - DNA, 25 bp, Rattus norvegicus
gggtgatagagtacttgcctaccat

SEQ ID NO: 460437 - DNA, 25 bp, Rattus norvegicus
gggtgatagagttcttgcctaccat

SEQ ID NO: 460438 - DNA, 25 bp, Rattus norvegicus
gggtgatcaccacaagttccatgac

SEQ ID NO: 460439 - DNA, 25 bp, Rattus norvegicus
gggtgatcaccagaagttccatgac

SEQ ID NO: 460440 - DNA, 25 bp, Rattus norvegicus
gggtgatcactaaagcttctccaag

SEQ ID NO: 460441 - DNA, 25 bp, Rattus norvegicus
gggtgatcactatagcttctccaag

SEQ ID NO: 460442 - DNA, 25 bp, Rattus norvegicus
gggtgatccacaagcaagttactga

SEQ ID NO: 460443 - DNA, 25 bp, Rattus norvegicus
gggtgatccacatgcaagttactga

SEQ ID NO: 460444 - DNA, 25 bp, Rattus norvegicus
gggtgatcccaacgtagtctttctg

SEQ ID NO: 460445 - DNA, 25 bp, Rattus norvegicus
gggtgatcccaaggtagtctttctg

SEQ ID NO: 460446 - DNA, 25 bp, Rattus norvegicus
gggtgatcgcgactctcctcttcat

SEQ ID NO: 460447 - DNA, 25 bp, Rattus norvegicus
gggtgatcgcgagtctcctcttcat

SEQ ID NO: 460448 - DNA, 25 bp, Rattus norvegicus
gggtgatctatgaaaccacagcatc

SEQ ID NO: 460449 - DNA, 25 bp, Rattus norvegicus
gggtgatctatgtaaccacagcatc

SEQ ID NO: 460450 - DNA, 25 bp, Rattus norvegicus
gggtgatctcatcgtcagttgactt

SEQ ID NO: 460451 - DNA, 25 bp, Rattus norvegicus
gggtgatctcatggtcagttgactt

SEQ ID NO: 460452 - DNA, 25 bp, Rattus norvegicus
gggtgatgaaaccacctctgtaaag

SEQ ID NO: 460453 - DNA, 25 bp, Rattus norvegicus
gggtgatgaaacgacctctgtaaag

SEQ ID NO: 460454 - DNA, 25 bp, Rattus norvegicus
gggtgatgacccagtgttgttttac

SEQ ID NO: 460455 - DNA, 25 bp, Rattus norvegicus
gggtgatgaccctgtgttgttttac

SEQ ID NO: 460456 - DNA, 25 bp, Rattus norvegicus
gggtgatgagccaagtaacctgcat

SEQ ID NO: 460457 - DNA, 25 bp, Rattus norvegicus
gggtgatgagcctagtaacctgcat

SEQ ID NO: 460458 - DNA, 25 bp, Rattus norvegicus
gggtgatgctcaatgcagaccttta

SEQ ID NO: 460459 - DNA, 25 bp, Rattus norvegicus
gggtgatgctcattgcagaccttta

SEQ ID NO: 460460 - DNA, 25 bp, Rattus norvegicus
gggtgatgtaatccctacctctaag

SEQ ID NO: 460461 - DNA, 25 bp, Rattus norvegicus
gggtgatgtaatgcctacctctaag

SEQ ID NO: 460462 - DNA, 25 bp, Rattus norvegicus
gggtgatgtgccattgatttaattg

SEQ ID NO: 460463 - DNA, 25 bp, Rattus norvegicus
gggtgatgtgcctttgatttaattg

SEQ ID NO: 460464 - DNA, 25 bp, Rattus norvegicus
gggtgattaatgatacttccacaaa

SEQ ID NO: 460465 - DNA, 25 bp, Rattus norvegicus
gggtgattaatgttacttccacaaa

SEQ ID NO: 460466 - DNA, 25 bp, Rattus norvegicus
gggtgattacataggcatctatgcc

SEQ ID NO: 460467 - DNA, 25 bp, Rattus norvegicus
gggtgattacattggcatctatgcc

SEQ ID NO: 460468 - DNA, 25 bp, Rattus norvegicus
gggtgattcacactaaaattgccaa

SEQ ID NO: 460469 - DNA, 25 bp, Rattus norvegicus
gggtgattcacagtaaaattgccaa

SEQ ID NO: 460470 - DNA, 25 bp, Rattus norvegicus
gggtgattcattaagagcaaggtac

SEQ ID NO: 460471 - DNA, 25 bp, Rattus norvegicus
gggtgattcatttagagcaaggtac

SEQ ID NO: 460472 - DNA, 25 bp, Rattus norvegicus
gggtgattccccaattcactgacaa

SEQ ID NO: 460473 - DNA, 25 bp, Rattus norvegicus
gggtgattcccctattcactgacaa

SEQ ID NO: 460474 - DNA, 25 bp, Rattus norvegicus
gggtgattgatgatcgctccttaat

SEQ ID NO: 460475 - DNA, 25 bp, Rattus norvegicus
gggtgattgatgttcgctccttaat

SEQ ID NO: 460476 - DNA, 25 bp, Rattus norvegicus
gggtgattgcccagctggaacctca

SEQ ID NO: 460477 - DNA, 25 bp, Rattus norvegicus
gggtgattgccctgctggaacctca

SEQ ID NO: 460478 - DNA, 25 bp, Rattus norvegicus
gggtgattgtctcatcctcttggcc

SEQ ID NO: 460479 - DNA, 25 bp, Rattus norvegicus
gggtgattgtctgatcctcttggcc

SEQ ID NO: 460480 - DNA, 25 bp, Rattus norvegicus
gggtgatttcatctttgttcctaga

SEQ ID NO: 460481 - DNA, 25 bp, Rattus norvegicus
gggtgatttcatgtttgttcctaga

SEQ ID NO: 460482 - DNA, 25 bp, Rattus norvegicus
gggtgatttcctagcattcttgctg

SEQ ID NO: 460483 - DNA, 25 bp, Rattus norvegicus
gggtgatttccttgcattcttgctg

SEQ ID NO: 460484 - DNA, 25 bp, Rattus norvegicus
gggtgatttctactccaacatcaag

SEQ ID NO: 460485 - DNA, 25 bp, Rattus norvegicus
gggtgatttctagtccaacatcaag

SEQ ID NO: 460486 - DNA, 25 bp, Rattus norvegicus
gggtgatttctccaaacgccagaac

SEQ ID NO: 460487 - DNA, 25 bp, Rattus norvegicus
gggtgatttctcgaaacgccagaac

SEQ ID NO: 460488 - DNA, 25 bp, Rattus norvegicus
gggtgatttcttaggcatgtccaac

SEQ ID NO: 460489 - DNA, 25 bp, Rattus norvegicus
gggtgatttctttggcatgtccaac

SEQ ID NO: 460490 - DNA, 25 bp, Rattus norvegicus
gggtgatttgcccatgaaactccaa

SEQ ID NO: 460491 - DNA, 25 bp, Rattus norvegicus
gggtgatttgccgatgaaactccaa

SEQ ID NO: 460492 - DNA, 25 bp, Rattus norvegicus
gggtgcaaaccacgacttttaatct

SEQ ID NO: 460493 - DNA, 25 bp, Rattus norvegicus
gggtgcaaaccaggacttttaatct

SEQ ID NO: 460494 - DNA, 25 bp, Rattus norvegicus
gggtgcaaatctctagcaaatcttt

SEQ ID NO: 460495 - DNA, 25 bp, Rattus norvegicus
gggtgcaaatctgtagcaaatcttt

SEQ ID NO: 460496 - DNA, 25 bp, Rattus norvegicus
gggtgcaaatgcctagagcagttta

SEQ ID NO: 460497 - DNA, 25 bp, Rattus norvegicus
gggtgcaaatgcgtagagcagttta

SEQ ID NO: 460498 - DNA, 25 bp, Rattus norvegicus
gggtgcaactccatagtagataaag

SEQ ID NO: 460499 - DNA, 25 bp, Rattus norvegicus
gggtgcaactccttagtagataaag

SEQ ID NO: 460500 - DNA, 25 bp, Rattus norvegicus
gggtgcaagatgcatctctccccac

SEQ ID NO: 460501 - DNA, 25 bp, Rattus norvegicus
gggtgcaagatggatctctccccac

SEQ ID NO: 460502 - DNA, 25 bp, Rattus norvegicus
gggtgcaagcacaaattcctctaac

SEQ ID NO: 460503 - DNA, 25 bp, Rattus norvegicus
gggtgcaagcactaattcctctaac

SEQ ID NO: 460504 - DNA, 25 bp, Rattus norvegicus
gggtgcaatgtgaccagccacctca

SEQ ID NO: 460505 - DNA, 25 bp, Rattus norvegicus
gggtgcaatgtgtccagccacctca

SEQ ID NO: 460506 - DNA, 25 bp, Rattus norvegicus
gggtgcacacacaggtataatctga

SEQ ID NO: 460507 - DNA, 25 bp, Rattus norvegicus
gggtgcacacactggtataatctga

SEQ ID NO: 460508 - DNA, 25 bp, Rattus norvegicus
gggtgcacagacaaatgtcatctat

SEQ ID NO: 460509 - DNA, 25 bp, Rattus norvegicus
gggtgcacagactaatgtcatctat

SEQ ID NO: 460510 - DNA, 25 bp, Rattus norvegicus
gggtgcaccaggacacggaatcagt

SEQ ID NO: 460511 - DNA, 25 bp, Rattus norvegicus
gggtgcaccaggtcacggaatcagt

SEQ ID NO: 460512 - DNA, 25 bp, Rattus norvegicus
gggtgcaccataatgcccagtgtct

SEQ ID NO: 460513 - DNA, 25 bp, Rattus norvegicus
gggtgcaccatattgcccagtgtct

SEQ ID NO: 460514 - DNA, 25 bp, Rattus norvegicus
gggtgcacccatagtatcaacacta

SEQ ID NO: 460515 - DNA, 25 bp, Rattus norvegicus
gggtgcacccattgtatcaacacta

SEQ ID NO: 460516 - DNA, 25 bp, Rattus norvegicus
gggtgcacctagctggcctacttaa

SEQ ID NO: 460517 - DNA, 25 bp, Rattus norvegicus
gggtgcacctaggtggcctacttaa

SEQ ID NO: 460518 - DNA, 25 bp, Rattus norvegicus
gggtgcacgtctacttcacaagacc

SEQ ID NO: 460519 - DNA, 25 bp, Rattus norvegicus
gggtgcacgtcttcttcacaagacc

SEQ ID NO: 460520 - DNA, 25 bp, Rattus norvegicus
gggtgcactgaacaatatttctttt

SEQ ID NO: 460521 - DNA, 25 bp, Rattus norvegicus
gggtgcactgaacacttgcagcctg

SEQ ID NO: 460522 - DNA, 25 bp, Rattus norvegicus
gggtgcactgaagaatatttctttt

SEQ ID NO: 460523 - DNA, 25 bp, Rattus norvegicus
gggtgcactgaagacttgcagcctg

SEQ ID NO: 460524 - DNA, 25 bp, Rattus norvegicus
gggtgcactgctcgtatatgacatt

SEQ ID NO: 460525 - DNA, 25 bp, Rattus norvegicus
gggtgcactgctggtatatgacatt

SEQ ID NO: 460526 - DNA, 25 bp, Rattus norvegicus
gggtgcactgggaactcacaccgcg

SEQ ID NO: 460527 - DNA, 25 bp, Rattus norvegicus
gggtgcactgggtactcacaccgcg

SEQ ID NO: 460528 - DNA, 25 bp, Rattus norvegicus
gggtgcacttgcaaatttgtcacat

SEQ ID NO: 460529 - DNA, 25 bp, Rattus norvegicus
gggtgcacttgctaatttgtcacat

SEQ ID NO: 460530 - DNA, 25 bp, Rattus norvegicus
gggtgcagaaacaactctcttgatg

SEQ ID NO: 460531 - DNA, 25 bp, Rattus norvegicus
gggtgcagaaactactctcttgatg

SEQ ID NO: 460532 - DNA, 25 bp, Rattus norvegicus
gggtgcagacctcattgtgtaaact

SEQ ID NO: 460533 - DNA, 25 bp, Rattus norvegicus
gggtgcagacctgattgtgtaaact

SEQ ID NO: 460534 - DNA, 25 bp, Rattus norvegicus
gggtgcagagacacagccactcata

SEQ ID NO: 460535 - DNA, 25 bp, Rattus norvegicus
gggtgcagagacactcctctttggg

SEQ ID NO: 460536 - DNA, 25 bp, Rattus norvegicus
gggtgcagagactcagccactcata

SEQ ID NO: 460537 - DNA, 25 bp, Rattus norvegicus
gggtgcagagactctcctctttggg

SEQ ID NO: 460538 - DNA, 25 bp, Rattus norvegicus
gggtgcagagctcaacactgacagt

SEQ ID NO: 460539 - DNA, 25 bp, Rattus norvegicus
gggtgcagagctgaacactgacagt

SEQ ID NO: 460540 - DNA, 25 bp, Rattus norvegicus
gggtgcagatttcttagaatagtta

SEQ ID NO: 460541 - DNA, 25 bp, Rattus norvegicus
gggtgcagatttgttagaatagtta

SEQ ID NO: 460542 - DNA, 25 bp, Rattus norvegicus
gggtgcagccagagggtttaaaagc

SEQ ID NO: 460543 - DNA, 25 bp, Rattus norvegicus
gggtgcagccagtgggtttaaaagc

SEQ ID NO: 460544 - DNA, 25 bp, Rattus norvegicus
gggtgcaggattaccttccaaggat

SEQ ID NO: 460545 - DNA, 25 bp, Rattus norvegicus
gggtgcaggatttccttccaaggat

SEQ ID NO: 460546 - DNA, 25 bp, Rattus norvegicus
gggtgcaggcatcgttttaaagaac

SEQ ID NO: 460547 - DNA, 25 bp, Rattus norvegicus
gggtgcaggcatggttttaaagaac

SEQ ID NO: 460548 - DNA, 25 bp, Rattus norvegicus
gggtgcagtcatcctactgacatga

SEQ ID NO: 460549 - DNA, 25 bp, Rattus norvegicus
gggtgcagtcatgctactgacatga

SEQ ID NO: 460550 - DNA, 25 bp, Rattus norvegicus
gggtgcagtcccaaagaagtcaaca

SEQ ID NO: 460551 - DNA, 25 bp, Rattus norvegicus
gggtgcagtccctaagaagtcaaca

SEQ ID NO: 460552 - DNA, 25 bp, Rattus norvegicus
gggtgcagttgtacaaacctctcac

SEQ ID NO: 460553 - DNA, 25 bp, Rattus norvegicus
gggtgcagttgttcaaacctctcac

SEQ ID NO: 460554 - DNA, 25 bp, Rattus norvegicus
gggtgcatacctcggccacaagtga

SEQ ID NO: 460555 - DNA, 25 bp, Rattus norvegicus
gggtgcatacctgggccacaagtga

SEQ ID NO: 460556 - DNA, 25 bp, Rattus norvegicus
gggtgcatactgcaagtcttccttc

SEQ ID NO: 460557 - DNA, 25 bp, Rattus norvegicus
gggtgcatactggaagtcttccttc

SEQ ID NO: 460558 - DNA, 25 bp, Rattus norvegicus
gggtgcataggtactaaaccaagca

SEQ ID NO: 460559 - DNA, 25 bp, Rattus norvegicus
gggtgcataggttctaaaccaagca

SEQ ID NO: 460560 - DNA, 25 bp, Rattus norvegicus
gggtgcatctgcacgatctcgccct

SEQ ID NO: 460561 - DNA, 25 bp, Rattus norvegicus
gggtgcatctgctcgatctcgccct

SEQ ID NO: 460562 - DNA, 25 bp, Rattus norvegicus
gggtgcattctcaggattctggatc

SEQ ID NO: 460563 - DNA, 25 bp, Rattus norvegicus
gggtgcattctctggattctggatc

SEQ ID NO: 460564 - DNA, 25 bp, Rattus norvegicus
gggtgcattgctaattgaagtcatt

SEQ ID NO: 460565 - DNA, 25 bp, Rattus norvegicus
gggtgcattgcttattgaagtcatt

SEQ ID NO: 460566 - DNA, 25 bp, Rattus norvegicus
gggtgcattttcattgaaagggtct

SEQ ID NO: 460567 - DNA, 25 bp, Rattus norvegicus
gggtgcattttctttgaaagggtct

SEQ ID NO: 460568 - DNA, 25 bp, Rattus norvegicus
gggtgccaaaatctgaggttcccac

SEQ ID NO: 460569 - DNA, 25 bp, Rattus norvegicus
gggtgccaaaatgtgaggttcccac

SEQ ID NO: 460570 - DNA, 25 bp, Rattus norvegicus
gggtgccaaggcactgctaggcctt

SEQ ID NO: 460571 - DNA, 25 bp, Rattus norvegicus
gggtgccaaggctctgctaggcctt

SEQ ID NO: 460572 - DNA, 25 bp, Rattus norvegicus
gggtgccacaataatgacacgttca

SEQ ID NO: 460573 - DNA, 25 bp, Rattus norvegicus
gggtgccacaattatgacacgttca

SEQ ID NO: 460574 - DNA, 25 bp, Rattus norvegicus
gggtgccacacaacaagaaccttaa

SEQ ID NO: 460575 - DNA, 25 bp, Rattus norvegicus
gggtgccacacatcaagaaccttaa

SEQ ID NO: 460576 - DNA, 25 bp, Rattus norvegicus
gggtgccacagtatttccccaagag

SEQ ID NO: 460577 - DNA, 25 bp, Rattus norvegicus
gggtgccacagtttttccccaagag

SEQ ID NO: 460578 - DNA, 25 bp, Rattus norvegicus
gggtgccacgtgacgggcctacaaa

SEQ ID NO: 460579 - DNA, 25 bp, Rattus norvegicus
gggtgccacgtgtcgggcctacaaa

SEQ ID NO: 460580 - DNA, 25 bp, Rattus norvegicus
gggtgccagcaactccaagctattt

SEQ ID NO: 460581 - DNA, 25 bp, Rattus norvegicus
gggtgccagcaagtccaagctattt

SEQ ID NO: 460582 - DNA, 25 bp, Rattus norvegicus
gggtgccagctgattctgttgatac

SEQ ID NO: 460583 - DNA, 25 bp, Rattus norvegicus
gggtgccagctgtttctgttgatac

SEQ ID NO: 460584 - DNA, 25 bp, Rattus norvegicus
gggtgccaggcaaacatgtagtgca

SEQ ID NO: 460585 - DNA, 25 bp, Rattus norvegicus
gggtgccaggcaagacaagtctctt

SEQ ID NO: 460586 - DNA, 25 bp, Rattus norvegicus
gggtgccaggcatacatgtagtgca

SEQ ID NO: 460587 - DNA, 25 bp, Rattus norvegicus
gggtgccaggcatgacaagtctctt

SEQ ID NO: 460588 - DNA, 25 bp, Rattus norvegicus
gggtgccagtacactgatgttctaa

SEQ ID NO: 460589 - DNA, 25 bp, Rattus norvegicus
gggtgccagtactctgatgttctaa

SEQ ID NO: 460590 - DNA, 25 bp, Rattus norvegicus
gggtgccatacaattcagagttgct

SEQ ID NO: 460591 - DNA, 25 bp, Rattus norvegicus
gggtgccatacatttcagagttgct

SEQ ID NO: 460592 - DNA, 25 bp, Rattus norvegicus
gggtgccatcagaaatcatgccact

SEQ ID NO: 460593 - DNA, 25 bp, Rattus norvegicus
gggtgccatcagtaatcatgccact

SEQ ID NO: 460594 - DNA, 25 bp, Rattus norvegicus
gggtgccatgcaaacaggcaaagca

SEQ ID NO: 460595 - DNA, 25 bp, Rattus norvegicus
gggtgccatgcatacaggcaaagca

SEQ ID NO: 460596 - DNA, 25 bp, Rattus norvegicus
gggtgccattgaatttagcttgttt

SEQ ID NO: 460597 - DNA, 25 bp, Rattus norvegicus
gggtgccattgattttagcttgttt

SEQ ID NO: 460598 - DNA, 25 bp, Rattus norvegicus
gggtgccatttccaggcattgcaag

SEQ ID NO: 460599 - DNA, 25 bp, Rattus norvegicus
gggtgccatttcgaggcattgcaag

SEQ ID NO: 460600 - DNA, 25 bp, Rattus norvegicus
gggtgcccacacagggaaactgtat

SEQ ID NO: 460601 - DNA, 25 bp, Rattus norvegicus
gggtgcccacactgggaaactgtat

SEQ ID NO: 460602 - DNA, 25 bp, Rattus norvegicus
gggtgcccactgataggaccatcta

SEQ ID NO: 460603 - DNA, 25 bp, Rattus norvegicus
gggtgcccactgttaggaccatcta

SEQ ID NO: 460604 - DNA, 25 bp, Rattus norvegicus
gggtgcccagaaaagacccctcagc

SEQ ID NO: 460605 - DNA, 25 bp, Rattus norvegicus
gggtgcccagaatagacccctcagc

SEQ ID NO: 460606 - DNA, 25 bp, Rattus norvegicus
gggtgcccagatatgtcccagtaca

SEQ ID NO: 460607 - DNA, 25 bp, Rattus norvegicus
gggtgcccagatttgtcccagtaca

SEQ ID NO: 460608 - DNA, 25 bp, Rattus norvegicus
gggtgcccaggacctagtatcctta

SEQ ID NO: 460609 - DNA, 25 bp, Rattus norvegicus
gggtgcccaggagctagtatcctta

SEQ ID NO: 460610 - DNA, 25 bp, Rattus norvegicus
gggtgcccgcacagaagacgatgaa

SEQ ID NO: 460611 - DNA, 25 bp, Rattus norvegicus
gggtgcccgcactgaagacgatgaa

SEQ ID NO: 460612 - DNA, 25 bp, Rattus norvegicus
gggtgccctataatctggatggaaa

SEQ ID NO: 460613 - DNA, 25 bp, Rattus norvegicus
gggtgccctatattctggatggaaa

SEQ ID NO: 460614 - DNA, 25 bp, Rattus norvegicus
gggtgccctctgaaggtacttcttg

SEQ ID NO: 460615 - DNA, 25 bp, Rattus norvegicus
gggtgccctctgtaggtacttcttg

SEQ ID NO: 460616 - DNA, 25 bp, Rattus norvegicus
gggtgccctgagcataggactcttt

SEQ ID NO: 460617 - DNA, 25 bp, Rattus norvegicus
gggtgccctgaggataggactcttt

SEQ ID NO: 460618 - DNA, 25 bp, Rattus norvegicus
gggtgccctttgaggacatgcagaa

SEQ ID NO: 460619 - DNA, 25 bp, Rattus norvegicus
gggtgccctttgtggacatgcagaa

SEQ ID NO: 460620 - DNA, 25 bp, Rattus norvegicus
gggtgccgacatcattgtgatcaaa

SEQ ID NO: 460621 - DNA, 25 bp, Rattus norvegicus
gggtgccgacatgattgtgatcaaa

SEQ ID NO: 460622 - DNA, 25 bp, Rattus norvegicus
gggtgccgcctaagggccacaaatc

SEQ ID NO: 460623 - DNA, 25 bp, Rattus norvegicus
gggtgccgcctatgggccacaaatc

SEQ ID NO: 460624 - DNA, 25 bp, Rattus norvegicus
gggtgcctaccacgatttcatgtga

SEQ ID NO: 460625 - DNA, 25 bp, Rattus norvegicus
gggtgcctaccaggatttcatgtga

SEQ ID NO: 460626 - DNA, 25 bp, Rattus norvegicus
gggtgcctcaatcaagcttttcctg

SEQ ID NO: 460627 - DNA, 25 bp, Rattus norvegicus
gggtgcctcaatgaagcttttcctg

SEQ ID NO: 460628 - DNA, 25 bp, Rattus norvegicus
gggtgcctcaggactcactggcagt

SEQ ID NO: 460629 - DNA, 25 bp, Rattus norvegicus
gggtgcctcaggtctcactggcagt

SEQ ID NO: 460630 - DNA, 25 bp, Rattus norvegicus
gggtgcctcatcatgtgaagccttg

SEQ ID NO: 460631 - DNA, 25 bp, Rattus norvegicus
gggtgcctcatcttgtgaagccttg

SEQ ID NO: 460632 - DNA, 25 bp, Rattus norvegicus
gggtgcctcccaatcattggacggc

SEQ ID NO: 460633 - DNA, 25 bp, Rattus norvegicus
gggtgcctcccattcattggacggc

SEQ ID NO: 460634 - DNA, 25 bp, Rattus norvegicus
gggtgcctctcacgcaaagggaatt

SEQ ID NO: 460635 - DNA, 25 bp, Rattus norvegicus
gggtgcctctcaggcaaagggaatt

SEQ ID NO: 460636 - DNA, 25 bp, Rattus norvegicus
gggtgcctctgaatagagctccgcc

SEQ ID NO: 460637 - DNA, 25 bp, Rattus norvegicus
gggtgcctctgattagagctccgcc

SEQ ID NO: 460638 - DNA, 25 bp, Rattus norvegicus
gggtgcctgaacctattccaaagta

SEQ ID NO: 460639 - DNA, 25 bp, Rattus norvegicus
gggtgcctgaacgtattccaaagta

SEQ ID NO: 460640 - DNA, 25 bp, Rattus norvegicus
gggtgcctgatactgagacctgaat

SEQ ID NO: 460641 - DNA, 25 bp, Rattus norvegicus
gggtgcctgatagtgagacctgaat

SEQ ID NO: 460642 - DNA, 25 bp, Rattus norvegicus
gggtgcctggtaattttgttgtcaa

SEQ ID NO: 460643 - DNA, 25 bp, Rattus norvegicus
gggtgcctggtatttttgttgtcaa

SEQ ID NO: 460644 - DNA, 25 bp, Rattus norvegicus
gggtgcctgtcaattcaaagaccaa

SEQ ID NO: 460645 - DNA, 25 bp, Rattus norvegicus
gggtgcctgtcatttcaaagaccaa

SEQ ID NO: 460646 - DNA, 25 bp, Rattus norvegicus
gggtgccttctcaggtggctcccga

SEQ ID NO: 460647 - DNA, 25 bp, Rattus norvegicus
gggtgccttctctggtggctcccga

SEQ ID NO: 460648 - DNA, 25 bp, Rattus norvegicus
gggtgccttgggaacactcaaccaa

SEQ ID NO: 460649 - DNA, 25 bp, Rattus norvegicus
gggtgccttgggtacactcaaccaa

SEQ ID NO: 460650 - DNA, 25 bp, Rattus norvegicus
gggtgccttgtcagtgagctcatcc

SEQ ID NO: 460651 - DNA, 25 bp, Rattus norvegicus
gggtgccttgtctgtgagctcatcc

SEQ ID NO: 460652 - DNA, 25 bp, Rattus norvegicus
gggtgcctttccaatgtatagctta

SEQ ID NO: 460653 - DNA, 25 bp, Rattus norvegicus
gggtgcctttcctatgtatagctta

SEQ ID NO: 460654 - DNA, 25 bp, Rattus norvegicus
gggtgcgaccttctttgcgctcgat

SEQ ID NO: 460655 - DNA, 25 bp, Rattus norvegicus
gggtgcgaccttgtttgcgctcgat

SEQ ID NO: 460656 - DNA, 25 bp, Rattus norvegicus
gggtgcgaggaccactacaactatt

SEQ ID NO: 460657 - DNA, 25 bp, Rattus norvegicus
gggtgcgaggacgactacaactatt

SEQ ID NO: 460658 - DNA, 25 bp, Rattus norvegicus
gggtgcgcccgtacactcaggtaca

SEQ ID NO: 460659 - DNA, 25 bp, Rattus norvegicus
gggtgcgcccgttcactcaggtaca

SEQ ID NO: 460660 - DNA, 25 bp, Rattus norvegicus
gggtgcgcggaaaacaacgatcccg

SEQ ID NO: 460661 - DNA, 25 bp, Rattus norvegicus
gggtgcgcggaatacaacgatcccg

SEQ ID NO: 460662 - DNA, 25 bp, Rattus norvegicus
gggtgcggattacggatgtggataa

SEQ ID NO: 460663 - DNA, 25 bp, Rattus norvegicus
gggtgcggattagggatgtggataa

SEQ ID NO: 460664 - DNA, 25 bp, Rattus norvegicus
gggtgcgtcagcacttcagtgccat

SEQ ID NO: 460665 - DNA, 25 bp, Rattus norvegicus
gggtgcgtcagctcttcagtgccat

SEQ ID NO: 460666 - DNA, 25 bp, Rattus norvegicus
gggtgcgtcttaactgcaatacact

SEQ ID NO: 460667 - DNA, 25 bp, Rattus norvegicus
gggtgcgtcttatctgcaatacact

SEQ ID NO: 460668 - DNA, 25 bp, Rattus norvegicus
gggtgcgttcaacattcggcgtcac

SEQ ID NO: 460669 - DNA, 25 bp, Rattus norvegicus
gggtgcgttcaagattcggcgtcac

SEQ ID NO: 460670 - DNA, 25 bp, Rattus norvegicus
gggtgctaattcagcactgctccaa

SEQ ID NO: 460671 - DNA, 25 bp, Rattus norvegicus
gggtgctaattctgcactgctccaa

SEQ ID NO: 460672 - DNA, 25 bp, Rattus norvegicus
gggtgctacagcaaagggacactct

SEQ ID NO: 460673 - DNA, 25 bp, Rattus norvegicus
gggtgctacagctaagggacactct

SEQ ID NO: 460674 - DNA, 25 bp, Rattus norvegicus
gggtgctacagtacgccatctgtaa

SEQ ID NO: 460675 - DNA, 25 bp, Rattus norvegicus
gggtgctacagttcgccatctgtaa

SEQ ID NO: 460676 - DNA, 25 bp, Rattus norvegicus
gggtgctagtgcctactggaacctt

SEQ ID NO: 460677 - DNA, 25 bp, Rattus norvegicus
gggtgctagtgcgtactggaacctt

SEQ ID NO: 460678 - DNA, 25 bp, Rattus norvegicus
gggtgctatagaacgcaataatgca

SEQ ID NO: 460679 - DNA, 25 bp, Rattus norvegicus
gggtgctatagatcgcaataatgca

SEQ ID NO: 460680 - DNA, 25 bp, Rattus norvegicus
gggtgctatatcaacggactgttcc

SEQ ID NO: 460681 - DNA, 25 bp, Rattus norvegicus
gggtgctatatctacggactgttcc

SEQ ID NO: 460682 - DNA, 25 bp, Rattus norvegicus
gggtgctatcccaattacatgaaga

SEQ ID NO: 460683 - DNA, 25 bp, Rattus norvegicus
gggtgctatccctattacatgaaga

SEQ ID NO: 460684 - DNA, 25 bp, Rattus norvegicus
gggtgctatctgacttatgtacact

SEQ ID NO: 460685 - DNA, 25 bp, Rattus norvegicus
gggtgctatctgtcttatgtacact

SEQ ID NO: 460686 - DNA, 25 bp, Rattus norvegicus
gggtgctatgtcaacttatcaaagt

SEQ ID NO: 460687 - DNA, 25 bp, Rattus norvegicus
gggtgctatgtctacttatcaaagt

SEQ ID NO: 460688 - DNA, 25 bp, Rattus norvegicus
gggtgctatttacctagaaccattg

SEQ ID NO: 460689 - DNA, 25 bp, Rattus norvegicus
gggtgctatttagctagaaccattg

SEQ ID NO: 460690 - DNA, 25 bp, Rattus norvegicus
gggtgctattttctcaacacggcaa

SEQ ID NO: 460691 - DNA, 25 bp, Rattus norvegicus
gggtgctattttgtcaacacggcaa

SEQ ID NO: 460692 - DNA, 25 bp, Rattus norvegicus
gggtgctcaccaacctagaacagat

SEQ ID NO: 460693 - DNA, 25 bp, Rattus norvegicus
gggtgctcaccatcctagaacagat

SEQ ID NO: 460694 - DNA, 25 bp, Rattus norvegicus
gggtgctcatagcatagcgctcatg

SEQ ID NO: 460695 - DNA, 25 bp, Rattus norvegicus
gggtgctcataggatagcgctcatg

SEQ ID NO: 460696 - DNA, 25 bp, Rattus norvegicus
gggtgctcatctagtacagagaatt

SEQ ID NO: 460697 - DNA, 25 bp, Rattus norvegicus
gggtgctcatcttgtacagagaatt

SEQ ID NO: 460698 - DNA, 25 bp, Rattus norvegicus
gggtgctccctcatcccggttgccg

SEQ ID NO: 460699 - DNA, 25 bp, Rattus norvegicus
gggtgctccctcttcccggttgccg

SEQ ID NO: 460700 - DNA, 25 bp, Rattus norvegicus
gggtgctcggcaacaatggataaag

SEQ ID NO: 460701 - DNA, 25 bp, Rattus norvegicus
gggtgctcggcatcaatggataaag

SEQ ID NO: 460702 - DNA, 25 bp, Rattus norvegicus
gggtgctcggtaaaatctgtgacct

SEQ ID NO: 460703 - DNA, 25 bp, Rattus norvegicus
gggtgctcggtataatctgtgacct

SEQ ID NO: 460704 - DNA, 25 bp, Rattus norvegicus
gggtgctctcttcccattgagggtc

SEQ ID NO: 460705 - DNA, 25 bp, Rattus norvegicus
gggtgctctcttgccattgagggtc

SEQ ID NO: 460706 - DNA, 25 bp, Rattus norvegicus
gggtgctctgtgagatcctgactca

SEQ ID NO: 460707 - DNA, 25 bp, Rattus norvegicus
gggtgctctgtgtgatcctgactca

SEQ ID NO: 460708 - DNA, 25 bp, Rattus norvegicus
gggtgctctgttaaatccagggttg

SEQ ID NO: 460709 - DNA, 25 bp, Rattus norvegicus
gggtgctctgtttaatccagggttg

SEQ ID NO: 460710 - DNA, 25 bp, Rattus norvegicus
gggtgctcttttatatagactggca

SEQ ID NO: 460711 - DNA, 25 bp, Rattus norvegicus
gggtgctcttttttatagactggca

SEQ ID NO: 460712 - DNA, 25 bp, Rattus norvegicus
gggtgctgcagccattcatcaggaa

SEQ ID NO: 460713 - DNA, 25 bp, Rattus norvegicus
gggtgctgcagcgattcatcaggaa

SEQ ID NO: 460714 - DNA, 25 bp, Rattus norvegicus
gggtgctgctccagagatctctgag

SEQ ID NO: 460715 - DNA, 25 bp, Rattus norvegicus
gggtgctgctcctgagatctctgag

SEQ ID NO: 460716 - DNA, 25 bp, Rattus norvegicus
gggtgctgctggaaagacctgcaat

SEQ ID NO: 460717 - DNA, 25 bp, Rattus norvegicus
gggtgctgctggtaagacctgcaat

SEQ ID NO: 460718 - DNA, 25 bp, Rattus norvegicus
gggtgctggaggactgcttcacctt

SEQ ID NO: 460719 - DNA, 25 bp, Rattus norvegicus
gggtgctggaggtctgcttcacctt

SEQ ID NO: 460720 - DNA, 25 bp, Rattus norvegicus
gggtgctggcttatgacagtattct

SEQ ID NO: 460721 - DNA, 25 bp, Rattus norvegicus
gggtgctggcttttgacagtattct

SEQ ID NO: 460722 - DNA, 25 bp, Rattus norvegicus
gggtgctgggatcttctccaataaa

SEQ ID NO: 460723 - DNA, 25 bp, Rattus norvegicus
gggtgctgggatgttctccaataaa

SEQ ID NO: 460724 - DNA, 25 bp, Rattus norvegicus
gggtgctgggcaagacttcattttt

SEQ ID NO: 460725 - DNA, 25 bp, Rattus norvegicus
gggtgctgggcatgacttcattttt

SEQ ID NO: 460726 - DNA, 25 bp, Rattus norvegicus
gggtgctgggccataaaccacatta

SEQ ID NO: 460727 - DNA, 25 bp, Rattus norvegicus
gggtgctgggccttaaaccacatta

SEQ ID NO: 460728 - DNA, 25 bp, Rattus norvegicus
gggtgctgtgctcagtgtacacttt

SEQ ID NO: 460729 - DNA, 25 bp, Rattus norvegicus
gggtgctgtgctgagtgtacacttt

SEQ ID NO: 460730 - DNA, 25 bp, Rattus norvegicus
gggtgcttacagcattatctccact

SEQ ID NO: 460731 - DNA, 25 bp, Rattus norvegicus
gggtgcttacaggattatctccact

SEQ ID NO: 460732 - DNA, 25 bp, Rattus norvegicus
gggtgcttatggacctgtcacacaa

SEQ ID NO: 460733 - DNA, 25 bp, Rattus norvegicus
gggtgcttatggtcctgtcacacaa

SEQ ID NO: 460734 - DNA, 25 bp, Rattus norvegicus
gggtgcttattgctattgtctcctg

SEQ ID NO: 460735 - DNA, 25 bp, Rattus norvegicus
gggtgcttattgctcagcctcctgc

SEQ ID NO: 460736 - DNA, 25 bp, Rattus norvegicus
gggtgcttattggtattgtctcctg

SEQ ID NO: 460737 - DNA, 25 bp, Rattus norvegicus
gggtgcttattggtcagcctcctgc

SEQ ID NO: 460738 - DNA, 25 bp, Rattus norvegicus
gggtgcttccttctagatatcctaa

SEQ ID NO: 460739 - DNA, 25 bp, Rattus norvegicus
gggtgcttccttgtagatatcctaa

SEQ ID NO: 460740 - DNA, 25 bp, Rattus norvegicus
gggtgcttcttccagctgaatgctg

SEQ ID NO: 460741 - DNA, 25 bp, Rattus norvegicus
gggtgcttcttcgagctgaatgctg

SEQ ID NO: 460742 - DNA, 25 bp, Rattus norvegicus
gggtgcttgaatataaactcctaat

SEQ ID NO: 460743 - DNA, 25 bp, Rattus norvegicus
gggtgcttgaatttaaactcctaat

SEQ ID NO: 460744 - DNA, 25 bp, Rattus norvegicus
gggtgcttgactagctcacaacatg

SEQ ID NO: 460745 - DNA, 25 bp, Rattus norvegicus
gggtgcttgacttgctcacaacatg

SEQ ID NO: 460746 - DNA, 25 bp, Rattus norvegicus
gggtgcttgcacatgtcttaaaaat

SEQ ID NO: 460747 - DNA, 25 bp, Rattus norvegicus
gggtgcttgcacttgtcttaaaaat

SEQ ID NO: 460748 - DNA, 25 bp, Rattus norvegicus
gggtgcttgcttaggcaacacacat

SEQ ID NO: 460749 - DNA, 25 bp, Rattus norvegicus
gggtgcttgctttggcaacacacat

SEQ ID NO: 460750 - DNA, 25 bp, Rattus norvegicus
gggtgcttggccagaataccagcat

SEQ ID NO: 460751 - DNA, 25 bp, Rattus norvegicus
gggtgcttggcctgaataccagcat

SEQ ID NO: 460752 - DNA, 25 bp, Rattus norvegicus
gggtgcttggctctcctcgtaatca

SEQ ID NO: 460753 - DNA, 25 bp, Rattus norvegicus
gggtgcttggctgtcctcgtaatca

SEQ ID NO: 460754 - DNA, 25 bp, Rattus norvegicus
gggtgcttgtccacaaaacctataa

SEQ ID NO: 460755 - DNA, 25 bp, Rattus norvegicus
gggtgcttgtcctcaaaacctataa

SEQ ID NO: 460756 - DNA, 25 bp, Rattus norvegicus
gggtgctttaacaacaaggagaagg

SEQ ID NO: 460757 - DNA, 25 bp, Rattus norvegicus
gggtgctttaactacaaggagaagg

SEQ ID NO: 460758 - DNA, 25 bp, Rattus norvegicus
gggtgctttgaactgccttgcatca

SEQ ID NO: 460759 - DNA, 25 bp, Rattus norvegicus
gggtgctttgaagtgccttgcatca

SEQ ID NO: 460760 - DNA, 25 bp, Rattus norvegicus
gggtgctttgtaactcgaggagtcc

SEQ ID NO: 460761 - DNA, 25 bp, Rattus norvegicus
gggtgctttgtatctcgaggagtcc

SEQ ID NO: 460762 - DNA, 25 bp, Rattus norvegicus
gggtgcttttacagtcctggaagag

SEQ ID NO: 460763 - DNA, 25 bp, Rattus norvegicus
gggtgcttttactgtcctggaagag

SEQ ID NO: 460764 - DNA, 25 bp, Rattus norvegicus
gggtgcttttctagtgtccccagcc

SEQ ID NO: 460765 - DNA, 25 bp, Rattus norvegicus
gggtgcttttcttgtgtccccagcc

SEQ ID NO: 460766 - DNA, 25 bp, Rattus norvegicus
gggtggaaagtcactgcccatgcat

SEQ ID NO: 460767 - DNA, 25 bp, Rattus norvegicus
gggtggaaagtctctgcccatgcat

SEQ ID NO: 460768 - DNA, 25 bp, Rattus norvegicus
gggtggaacacaattgctgcataca

SEQ ID NO: 460769 - DNA, 25 bp, Rattus norvegicus
gggtggaacacatttgctgcataca

SEQ ID NO: 460770 - DNA, 25 bp, Rattus norvegicus
gggtggaacactacattctttttag

SEQ ID NO: 460771 - DNA, 25 bp, Rattus norvegicus
gggtggaacacttcattctttttag

SEQ ID NO: 460772 - DNA, 25 bp, Rattus norvegicus
gggtggaataagacctctgtcccct

SEQ ID NO: 460773 - DNA, 25 bp, Rattus norvegicus
gggtggaataagtcctctgtcccct

SEQ ID NO: 460774 - DNA, 25 bp, Rattus norvegicus
gggtggaatatcaggcccggtacca

SEQ ID NO: 460775 - DNA, 25 bp, Rattus norvegicus
gggtggaatatctggcccggtacca

SEQ ID NO: 460776 - DNA, 25 bp, Rattus norvegicus
gggtggaattccaatttcttctgcc

SEQ ID NO: 460777 - DNA, 25 bp, Rattus norvegicus
gggtggaattcctatttcttctgcc

SEQ ID NO: 460778 - DNA, 25 bp, Rattus norvegicus
gggtggacaaaacatggctgctcat

SEQ ID NO: 460779 - DNA, 25 bp, Rattus norvegicus
gggtggacaaaagatggctgctcat

SEQ ID NO: 460780 - DNA, 25 bp, Rattus norvegicus
gggtggacacatagggacctctgat

SEQ ID NO: 460781 - DNA, 25 bp, Rattus norvegicus
gggtggacacattgggacctctgat

SEQ ID NO: 460782 - DNA, 25 bp, Rattus norvegicus
gggtggacaccactatcctagcagg

SEQ ID NO: 460783 - DNA, 25 bp, Rattus norvegicus
gggtggacaccagtatcctagcagg

SEQ ID NO: 460784 - DNA, 25 bp, Rattus norvegicus
gggtggacacccaaaatctgcgcaa

SEQ ID NO: 460785 - DNA, 25 bp, Rattus norvegicus
gggtggacaccctaaatctgcgcaa

SEQ ID NO: 460786 - DNA, 25 bp, Rattus norvegicus
gggtggacactacactacccagctc

SEQ ID NO: 460787 - DNA, 25 bp, Rattus norvegicus
gggtggacactagactacccagctc

SEQ ID NO: 460788 - DNA, 25 bp, Rattus norvegicus
gggtggacatcaccgaccagctcaa

SEQ ID NO: 460789 - DNA, 25 bp, Rattus norvegicus
gggtggacatcagcgaccagctcaa

SEQ ID NO: 460790 - DNA, 25 bp, Rattus norvegicus
gggtggacattcagactcagctcta

SEQ ID NO: 460791 - DNA, 25 bp, Rattus norvegicus
gggtggacattctgactcagctcta

SEQ ID NO: 460792 - DNA, 25 bp, Rattus norvegicus
gggtggacatttctactccttctga

SEQ ID NO: 460793 - DNA, 25 bp, Rattus norvegicus
gggtggacatttgtactccttctga

SEQ ID NO: 460794 - DNA, 25 bp, Rattus norvegicus
gggtggaccccgcagttcactctca

SEQ ID NO: 460795 - DNA, 25 bp, Rattus norvegicus
gggtggaccccggagttcactctca

SEQ ID NO: 460796 - DNA, 25 bp, Rattus norvegicus
gggtggagcccaaactagaactaca

SEQ ID NO: 460797 - DNA, 25 bp, Rattus norvegicus
gggtggagcccatactagaactaca

SEQ ID NO: 460798 - DNA, 25 bp, Rattus norvegicus
gggtggagctacataaggccttaga

SEQ ID NO: 460799 - DNA, 25 bp, Rattus norvegicus
gggtggagctacttaaggccttaga

SEQ ID NO: 460800 - DNA, 25 bp, Rattus norvegicus
gggtggaggctcacacaacctaaga

SEQ ID NO: 460801 - DNA, 25 bp, Rattus norvegicus
gggtggaggctctcacaacctaaga

SEQ ID NO: 460802 - DNA, 25 bp, Rattus norvegicus
gggtggagtttgacgaacacacaaa

SEQ ID NO: 460803 - DNA, 25 bp, Rattus norvegicus
gggtggagtttgtcgaacacacaaa

SEQ ID NO: 460804 - DNA, 25 bp, Rattus norvegicus
gggtggatcccaatgacctgacaaa

SEQ ID NO: 460805 - DNA, 25 bp, Rattus norvegicus
gggtggatcccattgacctgacaaa

SEQ ID NO: 460806 - DNA, 25 bp, Rattus norvegicus
gggtggatgctcacagcaatgttta

SEQ ID NO: 460807 - DNA, 25 bp, Rattus norvegicus
gggtggatgctctcagcaatgttta

SEQ ID NO: 460808 - DNA, 25 bp, Rattus norvegicus
gggtggatggtactctaatccaaaa

SEQ ID NO: 460809 - DNA, 25 bp, Rattus norvegicus
gggtggatggtagtctaatccaaaa

SEQ ID NO: 460810 - DNA, 25 bp, Rattus norvegicus
gggtggattgctaccattctgcacg

SEQ ID NO: 460811 - DNA, 25 bp, Rattus norvegicus
gggtggattgcttccattctgcacg

SEQ ID NO: 460812 - DNA, 25 bp, Rattus norvegicus
gggtggattggtagtcccatgcact

SEQ ID NO: 460813 - DNA, 25 bp, Rattus norvegicus
gggtggattggttgtcccatgcact

SEQ ID NO: 460814 - DNA, 25 bp, Rattus norvegicus
gggtggcaaactaatccgcagaggt

SEQ ID NO: 460815 - DNA, 25 bp, Rattus norvegicus
gggtggcaaacttatccgcagaggt

SEQ ID NO: 460816 - DNA, 25 bp, Rattus norvegicus
gggtggcacagcagcttgggtcccc

SEQ ID NO: 460817 - DNA, 25 bp, Rattus norvegicus
gggtggcacagctgcttgggtcccc

SEQ ID NO: 460818 - DNA, 25 bp, Rattus norvegicus
gggtggcaccatctctgcccacggt

SEQ ID NO: 460819 - DNA, 25 bp, Rattus norvegicus
gggtggcaccatgtctgcccacggt

SEQ ID NO: 460820 - DNA, 25 bp, Rattus norvegicus
gggtggcactaacacggacaagcta

SEQ ID NO: 460821 - DNA, 25 bp, Rattus norvegicus
gggtggcactaagacggacaagcta

SEQ ID NO: 460822 - DNA, 25 bp, Rattus norvegicus
gggtggcactttcggcacttatgtc

SEQ ID NO: 460823 - DNA, 25 bp, Rattus norvegicus
gggtggcactttgggcacttatgtc

SEQ ID NO: 460824 - DNA, 25 bp, Rattus norvegicus
gggtggcagaaaagaagtcccctgt

SEQ ID NO: 460825 - DNA, 25 bp, Rattus norvegicus
gggtggcagaaatgaagtcccctgt

SEQ ID NO: 460826 - DNA, 25 bp, Rattus norvegicus
gggtggcagacaattcgtttgcttt

SEQ ID NO: 460827 - DNA, 25 bp, Rattus norvegicus
gggtggcagacatttcgtttgcttt

SEQ ID NO: 460828 - DNA, 25 bp, Rattus norvegicus
gggtggcagagaacatctgccccaa

SEQ ID NO: 460829 - DNA, 25 bp, Rattus norvegicus
gggtggcagagatcatctgccccaa

SEQ ID NO: 460830 - DNA, 25 bp, Rattus norvegicus
gggtggccacataggcttcctggaa

SEQ ID NO: 460831 - DNA, 25 bp, Rattus norvegicus
gggtggccacattggcttcctggaa

SEQ ID NO: 460832 - DNA, 25 bp, Rattus norvegicus
gggtggccagttatgctttaagatc

SEQ ID NO: 460833 - DNA, 25 bp, Rattus norvegicus
gggtggccagttttgctttaagatc

SEQ ID NO: 460834 - DNA, 25 bp, Rattus norvegicus
gggtggccataacttctatcagaaa

SEQ ID NO: 460835 - DNA, 25 bp, Rattus norvegicus
gggtggccataagttctatcagaaa

SEQ ID NO: 460836 - DNA, 25 bp, Rattus norvegicus
gggtggccatacatgtcttagacag

SEQ ID NO: 460837 - DNA, 25 bp, Rattus norvegicus
gggtggccatacttgtcttagacag

SEQ ID NO: 460838 - DNA, 25 bp, Rattus norvegicus
gggtggccatcgcagctacttgcca

SEQ ID NO: 460839 - DNA, 25 bp, Rattus norvegicus
gggtggccatcggagctacttgcca

SEQ ID NO: 460840 - DNA, 25 bp, Rattus norvegicus
gggtggccattcactacaatatcat

SEQ ID NO: 460841 - DNA, 25 bp, Rattus norvegicus
gggtggccattctctacaatatcat

SEQ ID NO: 460842 - DNA, 25 bp, Rattus norvegicus
gggtggcccgccagtgtgactttaa

SEQ ID NO: 460843 - DNA, 25 bp, Rattus norvegicus
gggtggcccgcctgtgtgactttaa

SEQ ID NO: 460844 - DNA, 25 bp, Rattus norvegicus
gggtggccgctaacaggaccgtcca

SEQ ID NO: 460845 - DNA, 25 bp, Rattus norvegicus
gggtggccgctatcaggaccgtcca

SEQ ID NO: 460846 - DNA, 25 bp, Rattus norvegicus
gggtggcctaacaacaacattatag

SEQ ID NO: 460847 - DNA, 25 bp, Rattus norvegicus
gggtggcctaactacaacattatag

SEQ ID NO: 460848 - DNA, 25 bp, Rattus norvegicus
gggtggccttcccaaagtcagattg

SEQ ID NO: 460849 - DNA, 25 bp, Rattus norvegicus
gggtggccttccgaaagtcagattg

SEQ ID NO: 460850 - DNA, 25 bp, Rattus norvegicus
gggtggcgaaaacagccctgatcac

SEQ ID NO: 460851 - DNA, 25 bp, Rattus norvegicus
gggtggcgaaaagagccctgatcac

SEQ ID NO: 460852 - DNA, 25 bp, Rattus norvegicus
gggtggctagcgagagacattcccc

SEQ ID NO: 460853 - DNA, 25 bp, Rattus norvegicus
gggtggctagcgtgagacattcccc

SEQ ID NO: 460854 - DNA, 25 bp, Rattus norvegicus
gggtggctatgcagttcgagataaa

SEQ ID NO: 460855 - DNA, 25 bp, Rattus norvegicus
gggtggctatgctgttcgagataaa

SEQ ID NO: 460856 - DNA, 25 bp, Rattus norvegicus
gggtggctattaattcttcagtctg

SEQ ID NO: 460857 - DNA, 25 bp, Rattus norvegicus
gggtggctattatttcttcagtctg

SEQ ID NO: 460858 - DNA, 25 bp, Rattus norvegicus
gggtggctcattccacaaatgtcca

SEQ ID NO: 460859 - DNA, 25 bp, Rattus norvegicus
gggtggctcattgcacaaatgtcca

SEQ ID NO: 460860 - DNA, 25 bp, Rattus norvegicus
gggtggctccacaggtttgaactac

SEQ ID NO: 460861 - DNA, 25 bp, Rattus norvegicus
gggtggctccactggtttgaactac

SEQ ID NO: 460862 - DNA, 25 bp, Rattus norvegicus
gggtggctcccaaggtgaaagaaaa

SEQ ID NO: 460863 - DNA, 25 bp, Rattus norvegicus
gggtggctcccatggtgaaagaaaa

SEQ ID NO: 460864 - DNA, 25 bp, Rattus norvegicus
gggtggctctgaaaacttgtccatc

SEQ ID NO: 460865 - DNA, 25 bp, Rattus norvegicus
gggtggctctgataacttgtccatc

SEQ ID NO: 460866 - DNA, 25 bp, Rattus norvegicus
gggtggctgagaacacctgccgtct

SEQ ID NO: 460867 - DNA, 25 bp, Rattus norvegicus
gggtggctgagatcacctgccgtct

SEQ ID NO: 460868 - DNA, 25 bp, Rattus norvegicus
gggtggctgcagaattattttataa

SEQ ID NO: 460869 - DNA, 25 bp, Rattus norvegicus
gggtggctgcagtattattttataa

SEQ ID NO: 460870 - DNA, 25 bp, Rattus norvegicus
gggtggctgccaaagtctcacaaga

SEQ ID NO: 460871 - DNA, 25 bp, Rattus norvegicus
gggtggctgccatagtctcacaaga

SEQ ID NO: 460872 - DNA, 25 bp, Rattus norvegicus
gggtggctttcaatggattctctca

SEQ ID NO: 460873 - DNA, 25 bp, Rattus norvegicus
gggtggctttcattggattctctca

SEQ ID NO: 460874 - DNA, 25 bp, Rattus norvegicus
gggtggctttgtaaatgtagctaat

SEQ ID NO: 460875 - DNA, 25 bp, Rattus norvegicus
gggtggctttgttaatgtagctaat

SEQ ID NO: 460876 - DNA, 25 bp, Rattus norvegicus
gggtggctttttcagatgtatgtct

SEQ ID NO: 460877 - DNA, 25 bp, Rattus norvegicus
gggtggctttttgagatgtatgtct

SEQ ID NO: 460878 - DNA, 25 bp, Rattus norvegicus
gggtgggaaacaccctctactgcac

SEQ ID NO: 460879 - DNA, 25 bp, Rattus norvegicus
gggtgggaaacagcctctactgcac

SEQ ID NO: 460880 - DNA, 25 bp, Rattus norvegicus
gggtgggaacatcctttctgtactt

SEQ ID NO: 460881 - DNA, 25 bp, Rattus norvegicus
gggtgggaacatgctttctgtactt

SEQ ID NO: 460882 - DNA, 25 bp, Rattus norvegicus
gggtgggaacctcacaaattgtgac

SEQ ID NO: 460883 - DNA, 25 bp, Rattus norvegicus
gggtgggaacctgacaaattgtgac

SEQ ID NO: 460884 - DNA, 25 bp, Rattus norvegicus
gggtgggaagcactgatcctcctcc

SEQ ID NO: 460885 - DNA, 25 bp, Rattus norvegicus
gggtgggaagcagtgatcctcctcc

SEQ ID NO: 460886 - DNA, 25 bp, Rattus norvegicus
gggtgggaatgtcccagctctctaa

SEQ ID NO: 460887 - DNA, 25 bp, Rattus norvegicus
gggtgggaatgtgccagctctctaa

SEQ ID NO: 460888 - DNA, 25 bp, Rattus norvegicus
gggtgggaccacagatacaacgatc

SEQ ID NO: 460889 - DNA, 25 bp, Rattus norvegicus
gggtgggaccactgatacaacgatc

SEQ ID NO: 460890 - DNA, 25 bp, Rattus norvegicus
gggtgggaccagacatcctcaaggt

SEQ ID NO: 460891 - DNA, 25 bp, Rattus norvegicus
gggtgggaccagtcatcctcaaggt

SEQ ID NO: 460892 - DNA, 25 bp, Rattus norvegicus
gggtgggaccttagaccatgctatg

SEQ ID NO: 460893 - DNA, 25 bp, Rattus norvegicus
gggtgggacctttgaccatgctatg

SEQ ID NO: 460894 - DNA, 25 bp, Rattus norvegicus
gggtgggactttctgttactaacag

SEQ ID NO: 460895 - DNA, 25 bp, Rattus norvegicus
gggtgggactttgtgttactaacag

SEQ ID NO: 460896 - DNA, 25 bp, Rattus norvegicus
gggtgggagatcacagtgacatcaa

SEQ ID NO: 460897 - DNA, 25 bp, Rattus norvegicus
gggtgggagatctcagtgacatcaa

SEQ ID NO: 460898 - DNA, 25 bp, Rattus norvegicus
gggtgggagtcaacatccgcttcca

SEQ ID NO: 460899 - DNA, 25 bp, Rattus norvegicus
gggtgggagtcatcatccgcttcca

SEQ ID NO: 460900 - DNA, 25 bp, Rattus norvegicus
gggtgggagtgcatctagcttcaca

SEQ ID NO: 460901 - DNA, 25 bp, Rattus norvegicus
gggtgggagtgcttctagcttcaca

SEQ ID NO: 460902 - DNA, 25 bp, Rattus norvegicus
gggtgggagtttattcttgtgctca

SEQ ID NO: 460903 - DNA, 25 bp, Rattus norvegicus
gggtgggagttttttcttgtgctca

SEQ ID NO: 460904 - DNA, 25 bp, Rattus norvegicus
gggtgggatcagctcttagaacttt

SEQ ID NO: 460905 - DNA, 25 bp, Rattus norvegicus
gggtgggatcaggtcttagaacttt

SEQ ID NO: 460906 - DNA, 25 bp, Rattus norvegicus
gggtgggcagaaccatccaagcatt

SEQ ID NO: 460907 - DNA, 25 bp, Rattus norvegicus
gggtgggcagaagcatccaagcatt

SEQ ID NO: 460908 - DNA, 25 bp, Rattus norvegicus
gggtgggcagctactgatttacaga

SEQ ID NO: 460909 - DNA, 25 bp, Rattus norvegicus
gggtgggcagcttctgatttacaga

SEQ ID NO: 460910 - DNA, 25 bp, Rattus norvegicus
gggtgggccaaacgaatcccatcta

SEQ ID NO: 460911 - DNA, 25 bp, Rattus norvegicus
gggtgggccaaaggaatcccatcta

SEQ ID NO: 460912 - DNA, 25 bp, Rattus norvegicus
gggtgggcggctcatttctttccct

SEQ ID NO: 460913 - DNA, 25 bp, Rattus norvegicus
gggtgggcggctgatttctttccct

SEQ ID NO: 460914 - DNA, 25 bp, Rattus norvegicus
gggtgggctcttactaaaataagca

SEQ ID NO: 460915 - DNA, 25 bp, Rattus norvegicus
gggtgggctctttctaaaataagca

SEQ ID NO: 460916 - DNA, 25 bp, Rattus norvegicus
gggtgggctttgacctctcaaaaag

SEQ ID NO: 460917 - DNA, 25 bp, Rattus norvegicus
gggtgggctttgtcctctcaaaaag

SEQ ID NO: 460918 - DNA, 25 bp, Rattus norvegicus
gggtgggtacctagcgggcgctcgg

SEQ ID NO: 460919 - DNA, 25 bp, Rattus norvegicus
gggtgggtaccttgcgggcgctcgg

SEQ ID NO: 460920 - DNA, 25 bp, Rattus norvegicus
gggtgggtcactctgtcagccattt

SEQ ID NO: 460921 - DNA, 25 bp, Rattus norvegicus
gggtgggtcactgtgtcagccattt

SEQ ID NO: 460922 - DNA, 25 bp, Rattus norvegicus
gggtgggtccagattgcaacctgta

SEQ ID NO: 460923 - DNA, 25 bp, Rattus norvegicus
gggtgggtccagtttgcaacctgta

SEQ ID NO: 460924 - DNA, 25 bp, Rattus norvegicus
gggtgggtggtcagccctcacaaat

SEQ ID NO: 460925 - DNA, 25 bp, Rattus norvegicus
gggtgggtggtctgccctcacaaat

SEQ ID NO: 460926 - DNA, 25 bp, Rattus norvegicus
gggtgggtgtctcacattcaaacct

SEQ ID NO: 460927 - DNA, 25 bp, Rattus norvegicus
gggtgggtgtctgacattcaaacct

SEQ ID NO: 460928 - DNA, 25 bp, Rattus norvegicus
gggtgggttctgactctgtgtcaca

SEQ ID NO: 460929 - DNA, 25 bp, Rattus norvegicus
gggtgggttctgtctctgtgtcaca

SEQ ID NO: 460930 - DNA, 25 bp, Rattus norvegicus
gggtggtagattccagccacagccc

SEQ ID NO: 460931 - DNA, 25 bp, Rattus norvegicus
gggtggtagattgcagccacagccc

SEQ ID NO: 460932 - DNA, 25 bp, Rattus norvegicus
gggtggtatataattttctatcttt

SEQ ID NO: 460933 - DNA, 25 bp, Rattus norvegicus
gggtggtatatatttttctatcttt

SEQ ID NO: 460934 - DNA, 25 bp, Rattus norvegicus
gggtggtcaatgaggagatattttc

SEQ ID NO: 460935 - DNA, 25 bp, Rattus norvegicus
gggtggtcaatgtggagatattttc

SEQ ID NO: 460936 - DNA, 25 bp, Rattus norvegicus
gggtggtcagccaggacttccccaa

SEQ ID NO: 460937 - DNA, 25 bp, Rattus norvegicus
gggtggtcagcctggacttccccaa

SEQ ID NO: 460938 - DNA, 25 bp, Rattus norvegicus
gggtggtccaagactacacagagtc

SEQ ID NO: 460939 - DNA, 25 bp, Rattus norvegicus
gggtggtccaagtctacacagagtc

SEQ ID NO: 460940 - DNA, 25 bp, Rattus norvegicus
gggtggtccagaagtcagcagaata

SEQ ID NO: 460941 - DNA, 25 bp, Rattus norvegicus
gggtggtccagatgtcagcagaata

SEQ ID NO: 460942 - DNA, 25 bp, Rattus norvegicus
gggtggtccttcatgaattcatgta

SEQ ID NO: 460943 - DNA, 25 bp, Rattus norvegicus
gggtggtccttcttgaattcatgta

SEQ ID NO: 460944 - DNA, 25 bp, Rattus norvegicus
gggtggtctctgattcagtgtatta

SEQ ID NO: 460945 - DNA, 25 bp, Rattus norvegicus
gggtggtctctgtttcagtgtatta

SEQ ID NO: 460946 - DNA, 25 bp, Rattus norvegicus
gggtggtcttaaatcagttgccatt

SEQ ID NO: 460947 - DNA, 25 bp, Rattus norvegicus
gggtggtcttaattcagttgccatt

SEQ ID NO: 460948 - DNA, 25 bp, Rattus norvegicus
gggtggtgaccgagtcccacccact

SEQ ID NO: 460949 - DNA, 25 bp, Rattus norvegicus
gggtggtgaccgtgtcccacccact

SEQ ID NO: 460950 - DNA, 25 bp, Rattus norvegicus
gggtggtgacgcatgtctttagtcc

SEQ ID NO: 460951 - DNA, 25 bp, Rattus norvegicus
gggtggtgacgcttgtctttagtcc

SEQ ID NO: 460952 - DNA, 25 bp, Rattus norvegicus
gggtggtgcctaaatgacaactcat

SEQ ID NO: 460953 - DNA, 25 bp, Rattus norvegicus
gggtggtgcctatatgacaactcat

SEQ ID NO: 460954 - DNA, 25 bp, Rattus norvegicus
gggtggtgcttcagatgtctctgcc

SEQ ID NO: 460955 - DNA, 25 bp, Rattus norvegicus
gggtggtgcttctgatgtctctgcc

SEQ ID NO: 460956 - DNA, 25 bp, Rattus norvegicus
gggtggtggctaaccttatccaagt

SEQ ID NO: 460957 - DNA, 25 bp, Rattus norvegicus
gggtggtggctatccttatccaagt

SEQ ID NO: 460958 - DNA, 25 bp, Rattus norvegicus
gggtggtgggccacaattcgaatac

SEQ ID NO: 460959 - DNA, 25 bp, Rattus norvegicus
gggtggtgggcctcaattcgaatac

SEQ ID NO: 460960 - DNA, 25 bp, Rattus norvegicus
gggtggtggtggatggctttgagac

SEQ ID NO: 460961 - DNA, 25 bp, Rattus norvegicus
gggtggtggtggttggctttgagac

SEQ ID NO: 460962 - DNA, 25 bp, Rattus norvegicus
gggtggttcaacagcagacattgct

SEQ ID NO: 460963 - DNA, 25 bp, Rattus norvegicus
gggtggttcaactgcagacattgct

SEQ ID NO: 460964 - DNA, 25 bp, Rattus norvegicus
gggtggttccttccctaacatcact

SEQ ID NO: 460965 - DNA, 25 bp, Rattus norvegicus
gggtggttccttgcctaacatcact

SEQ ID NO: 460966 - DNA, 25 bp, Rattus norvegicus
gggtggttctggcaacagctcctcc

SEQ ID NO: 460967 - DNA, 25 bp, Rattus norvegicus
gggtggttctgggaacagctcctcc

SEQ ID NO: 460968 - DNA, 25 bp, Rattus norvegicus
gggtggttggccaaaatgacagcaa

SEQ ID NO: 460969 - DNA, 25 bp, Rattus norvegicus
gggtggttggcctaaatgacagcaa

SEQ ID NO: 460970 - DNA, 25 bp, Rattus norvegicus
gggtggttgtttctcaatctctata

SEQ ID NO: 460971 - DNA, 25 bp, Rattus norvegicus
gggtggttgtttgtcaatctctata

SEQ ID NO: 460972 - DNA, 25 bp, Rattus norvegicus
gggtggtttatcatcgacatcttaa

SEQ ID NO: 460973 - DNA, 25 bp, Rattus norvegicus
gggtggtttatcttcgacatcttaa

SEQ ID NO: 460974 - DNA, 25 bp, Rattus norvegicus
gggtggtttctcagtgtccctcgcc

SEQ ID NO: 460975 - DNA, 25 bp, Rattus norvegicus
gggtggtttctctgtgtccctcgcc

SEQ ID NO: 460976 - DNA, 25 bp, Rattus norvegicus
gggtggttttgaccccatgagtcaa

SEQ ID NO: 460977 - DNA, 25 bp, Rattus norvegicus
gggtggttttgagcccatgagtcaa

SEQ ID NO: 460978 - DNA, 25 bp, Rattus norvegicus
gggtgtaaaggacccattcctcatc

SEQ ID NO: 460979 - DNA, 25 bp, Rattus norvegicus
gggtgtaaaggagccattcctcatc

SEQ ID NO: 460980 - DNA, 25 bp, Rattus norvegicus
gggtgtaactcacgagcactttcct

SEQ ID NO: 460981 - DNA, 25 bp, Rattus norvegicus
gggtgtaactcaggagcactttcct

SEQ ID NO: 460982 - DNA, 25 bp, Rattus norvegicus
gggtgtaactgacagcatatagctt

SEQ ID NO: 460983 - DNA, 25 bp, Rattus norvegicus
gggtgtaactgagagcatatagctt

SEQ ID NO: 460984 - DNA, 25 bp, Rattus norvegicus
gggtgtaactttcctgctataattc

SEQ ID NO: 460985 - DNA, 25 bp, Rattus norvegicus
gggtgtaactttgctgctataattc

SEQ ID NO: 460986 - DNA, 25 bp, Rattus norvegicus
gggtgtaagacccatacctggcaga

SEQ ID NO: 460987 - DNA, 25 bp, Rattus norvegicus
gggtgtaagaccgatacctggcaga

SEQ ID NO: 460988 - DNA, 25 bp, Rattus norvegicus
gggtgtaatagaactctagccagag

SEQ ID NO: 460989 - DNA, 25 bp, Rattus norvegicus
gggtgtaatagatctctagccagag

SEQ ID NO: 460990 - DNA, 25 bp, Rattus norvegicus
gggtgtaatgccacctggtgcaaga

SEQ ID NO: 460991 - DNA, 25 bp, Rattus norvegicus
gggtgtaatgcctcctggtgcaaga

SEQ ID NO: 460992 - DNA, 25 bp, Rattus norvegicus
gggtgtaattctatcatccactctc

SEQ ID NO: 460993 - DNA, 25 bp, Rattus norvegicus
gggtgtaattctttcatccactctc

SEQ ID NO: 460994 - DNA, 25 bp, Rattus norvegicus
gggtgtacacaaacctcgtgttatt

SEQ ID NO: 460995 - DNA, 25 bp, Rattus norvegicus
gggtgtacacaaagattcctggatg

SEQ ID NO: 460996 - DNA, 25 bp, Rattus norvegicus
gggtgtacacaatcctcgtgttatt

SEQ ID NO: 460997 - DNA, 25 bp, Rattus norvegicus
gggtgtacacaatgattcctggatg

SEQ ID NO: 460998 - DNA, 25 bp, Rattus norvegicus
gggtgtacattgctccttcatgtgc

SEQ ID NO: 460999 - DNA, 25 bp, Rattus norvegicus
gggtgtacattggtccttcatgtgc

SEQ ID NO: 461000 - DNA, 25 bp, Rattus norvegicus
gggtgtaccattatgcctagctaag

SEQ ID NO: 461001 - DNA, 25 bp, Rattus norvegicus
gggtgtaccattttgcctagctaag

SEQ ID NO: 461002 - DNA, 25 bp, Rattus norvegicus
gggtgtaccccaattttgcaattat

SEQ ID NO: 461003 - DNA, 25 bp, Rattus norvegicus
gggtgtaccccatttttgcaattat

SEQ ID NO: 461004 - DNA, 25 bp, Rattus norvegicus
gggtgtactacacgacacactacag

SEQ ID NO: 461005 - DNA, 25 bp, Rattus norvegicus
gggtgtactacaggacacactacag

SEQ ID NO: 461006 - DNA, 25 bp, Rattus norvegicus
gggtgtactgggatccaactcaata

SEQ ID NO: 461007 - DNA, 25 bp, Rattus norvegicus
gggtgtactgggttccaactcaata

SEQ ID NO: 461008 - DNA, 25 bp, Rattus norvegicus
gggtgtaggctgagttcttctgtaa

SEQ ID NO: 461009 - DNA, 25 bp, Rattus norvegicus
gggtgtaggctgtgttcttctgtaa

SEQ ID NO: 461010 - DNA, 25 bp, Rattus norvegicus
gggtgtagtctgattagattccgta

SEQ ID NO: 461011 - DNA, 25 bp, Rattus norvegicus
gggtgtagtctgtttagattccgta

SEQ ID NO: 461012 - DNA, 25 bp, Rattus norvegicus
gggtgtataattcattctcaagaag

SEQ ID NO: 461013 - DNA, 25 bp, Rattus norvegicus
gggtgtataattgattctcaagaag

SEQ ID NO: 461014 - DNA, 25 bp, Rattus norvegicus
gggtgtatatatatgctgagccatt

SEQ ID NO: 461015 - DNA, 25 bp, Rattus norvegicus
gggtgtatatatccagctagtatgt

SEQ ID NO: 461016 - DNA, 25 bp, Rattus norvegicus
gggtgtatatatgcagctagtatgt

SEQ ID NO: 461017 - DNA, 25 bp, Rattus norvegicus
gggtgtatatatttgctgagccatt

SEQ ID NO: 461018 - DNA, 25 bp, Rattus norvegicus
gggtgtatatgtctcaggctccaag

SEQ ID NO: 461019 - DNA, 25 bp, Rattus norvegicus
gggtgtatatgtgtcaggctccaag

SEQ ID NO: 461020 - DNA, 25 bp, Rattus norvegicus
gggtgtatccacaaaaaccgtcagg

SEQ ID NO: 461021 - DNA, 25 bp, Rattus norvegicus
gggtgtatccactaaaaccgtcagg

SEQ ID NO: 461022 - DNA, 25 bp, Rattus norvegicus
gggtgtattcctatatctccagtaa

SEQ ID NO: 461023 - DNA, 25 bp, Rattus norvegicus
gggtgtattcctttatctccagtaa

SEQ ID NO: 461024 - DNA, 25 bp, Rattus norvegicus
gggtgtatttgtaccttcttagatt

SEQ ID NO: 461025 - DNA, 25 bp, Rattus norvegicus
gggtgtatttgttccttcttagatt

SEQ ID NO: 461026 - DNA, 25 bp, Rattus norvegicus
gggtgtattttcagcttagcatgct

SEQ ID NO: 461027 - DNA, 25 bp, Rattus norvegicus
gggtgtattttctgcttagcatgct

SEQ ID NO: 461028 - DNA, 25 bp, Rattus norvegicus
gggtgtcaacaacgaagccccttca

SEQ ID NO: 461029 - DNA, 25 bp, Rattus norvegicus
gggtgtcaacaaggaagccccttca

SEQ ID NO: 461030 - DNA, 25 bp, Rattus norvegicus
gggtgtcaacagcatacttgcccaa

SEQ ID NO: 461031 - DNA, 25 bp, Rattus norvegicus
gggtgtcaacaggatacttgcccaa

SEQ ID NO: 461032 - DNA, 25 bp, Rattus norvegicus
gggtgtcacatcctcatattgcagc

SEQ ID NO: 461033 - DNA, 25 bp, Rattus norvegicus
gggtgtcacatcgtcatattgcagc

SEQ ID NO: 461034 - DNA, 25 bp, Rattus norvegicus
gggtgtcaccatagtacatctttga

SEQ ID NO: 461035 - DNA, 25 bp, Rattus norvegicus
gggtgtcaccattgtacatctttga

SEQ ID NO: 461036 - DNA, 25 bp, Rattus norvegicus
gggtgtcacccacaagagattgttt

SEQ ID NO: 461037 - DNA, 25 bp, Rattus norvegicus
gggtgtcacccagaagagattgttt

SEQ ID NO: 461038 - DNA, 25 bp, Rattus norvegicus
gggtgtcaccccatttccagagaag

SEQ ID NO: 461039 - DNA, 25 bp, Rattus norvegicus
gggtgtcaccccttttccagagaag

SEQ ID NO: 461040 - DNA, 25 bp, Rattus norvegicus
gggtgtcaccggaacatttgatcat

SEQ ID NO: 461041 - DNA, 25 bp, Rattus norvegicus
gggtgtcaccggtacatttgatcat

SEQ ID NO: 461042 - DNA, 25 bp, Rattus norvegicus
gggtgtcaccttagattttgtaaat

SEQ ID NO: 461043 - DNA, 25 bp, Rattus norvegicus
gggtgtcacctttgattttgtaaat

SEQ ID NO: 461044 - DNA, 25 bp, Rattus norvegicus
gggtgtcaggaactcatactcctca

SEQ ID NO: 461045 - DNA, 25 bp, Rattus norvegicus
gggtgtcaggaagtcatactcctca

SEQ ID NO: 461046 - DNA, 25 bp, Rattus norvegicus
gggtgtcagtggcaggccgggtaca

SEQ ID NO: 461047 - DNA, 25 bp, Rattus norvegicus
gggtgtcagtgggaggccgggtaca

SEQ ID NO: 461048 - DNA, 25 bp, Rattus norvegicus
gggtgtcatacaactggatgccttt

SEQ ID NO: 461049 - DNA, 25 bp, Rattus norvegicus
gggtgtcatacatctggatgccttt

SEQ ID NO: 461050 - DNA, 25 bp, Rattus norvegicus
gggtgtcatcagatcagattcctaa

SEQ ID NO: 461051 - DNA, 25 bp, Rattus norvegicus
gggtgtcatcagttcagattcctaa

SEQ ID NO: 461052 - DNA, 25 bp, Rattus norvegicus
gggtgtcatgcacaatattgagcct

SEQ ID NO: 461053 - DNA, 25 bp, Rattus norvegicus
gggtgtcatgcagaatattgagcct

SEQ ID NO: 461054 - DNA, 25 bp, Rattus norvegicus
gggtgtccaagcacagtcgcagttt

SEQ ID NO: 461055 - DNA, 25 bp, Rattus norvegicus
gggtgtccaagctcagtcgcagttt

SEQ ID NO: 461056 - DNA, 25 bp, Rattus norvegicus
gggtgtccacaaacagatcctaaaa

SEQ ID NO: 461057 - DNA, 25 bp, Rattus norvegicus
gggtgtccacaatcagatcctaaaa

SEQ ID NO: 461058 - DNA, 25 bp, Rattus norvegicus
gggtgtccacatctaaagaagcctc

SEQ ID NO: 461059 - DNA, 25 bp, Rattus norvegicus
gggtgtccacatgtaaagaagcctc

SEQ ID NO: 461060 - DNA, 25 bp, Rattus norvegicus
gggtgtccatgaagtgtgcccagcc

SEQ ID NO: 461061 - DNA, 25 bp, Rattus norvegicus
gggtgtccatgatgtgtgcccagcc

SEQ ID NO: 461062 - DNA, 25 bp, Rattus norvegicus
gggtgtccatgtagtatatggctga

SEQ ID NO: 461063 - DNA, 25 bp, Rattus norvegicus
gggtgtccatgttgtatatggctga

SEQ ID NO: 461064 - DNA, 25 bp, Rattus norvegicus
gggtgtccattacgccatattaaaa

SEQ ID NO: 461065 - DNA, 25 bp, Rattus norvegicus
gggtgtccattaggccatattaaaa

SEQ ID NO: 461066 - DNA, 25 bp, Rattus norvegicus
gggtgtccattcatagtctgttcct

SEQ ID NO: 461067 - DNA, 25 bp, Rattus norvegicus
gggtgtccattcttagtctgttcct

SEQ ID NO: 461068 - DNA, 25 bp, Rattus norvegicus
gggtgtcccgagagctctggttcaa

SEQ ID NO: 461069 - DNA, 25 bp, Rattus norvegicus
gggtgtcccgagtgctctggttcaa

SEQ ID NO: 461070 - DNA, 25 bp, Rattus norvegicus
gggtgtcccggcaaagctgatgttc

SEQ ID NO: 461071 - DNA, 25 bp, Rattus norvegicus
gggtgtcccggctaagctgatgttc

SEQ ID NO: 461072 - DNA, 25 bp, Rattus norvegicus
gggtgtccctacactgtagaatctg

SEQ ID NO: 461073 - DNA, 25 bp, Rattus norvegicus
gggtgtccctactctgtagaatctg

SEQ ID NO: 461074 - DNA, 25 bp, Rattus norvegicus
gggtgtccctttcatgggaccatca

SEQ ID NO: 461075 - DNA, 25 bp, Rattus norvegicus
gggtgtccctttgatgggaccatca

SEQ ID NO: 461076 - DNA, 25 bp, Rattus norvegicus
gggtgtcctcaccaatgatgataaa

SEQ ID NO: 461077 - DNA, 25 bp, Rattus norvegicus
gggtgtcctcacgaatgatgataaa

SEQ ID NO: 461078 - DNA, 25 bp, Rattus norvegicus
gggtgtcctcttatctcaaaatgag

SEQ ID NO: 461079 - DNA, 25 bp, Rattus norvegicus
gggtgtcctcttttctcaaaatgag

SEQ ID NO: 461080 - DNA, 25 bp, Rattus norvegicus
gggtgtcctgacattacttcataaa

SEQ ID NO: 461081 - DNA, 25 bp, Rattus norvegicus
gggtgtcctgaccatgatggcacat

SEQ ID NO: 461082 - DNA, 25 bp, Rattus norvegicus
gggtgtcctgacgatgatggcacat

SEQ ID NO: 461083 - DNA, 25 bp, Rattus norvegicus
gggtgtcctgactttacttcataaa

SEQ ID NO: 461084 - DNA, 25 bp, Rattus norvegicus
gggtgtcctgtgaaccttcaggtat

SEQ ID NO: 461085 - DNA, 25 bp, Rattus norvegicus
gggtgtcctgtgtaccttcaggtat

SEQ ID NO: 461086 - DNA, 25 bp, Rattus norvegicus
gggtgtccttaaatgcagccagatg

SEQ ID NO: 461087 - DNA, 25 bp, Rattus norvegicus
gggtgtccttaattgcagccagatg

SEQ ID NO: 461088 - DNA, 25 bp, Rattus norvegicus
gggtgtcgacttaccgccacaggcg

SEQ ID NO: 461089 - DNA, 25 bp, Rattus norvegicus
gggtgtcgactttccgccacaggcg

SEQ ID NO: 461090 - DNA, 25 bp, Rattus norvegicus
gggtgtcgccccaacagaagtggac

SEQ ID NO: 461091 - DNA, 25 bp, Rattus norvegicus
gggtgtcgcccctacagaagtggac

SEQ ID NO: 461092 - DNA, 25 bp, Rattus norvegicus
gggtgtcgcctcaaacctattgaat

SEQ ID NO: 461093 - DNA, 25 bp, Rattus norvegicus
gggtgtcgcctctaacctattgaat

SEQ ID NO: 461094 - DNA, 25 bp, Rattus norvegicus
gggtgtcgtttcaagccagctacct

SEQ ID NO: 461095 - DNA, 25 bp, Rattus norvegicus
gggtgtcgtttctagccagctacct

SEQ ID NO: 461096 - DNA, 25 bp, Rattus norvegicus
gggtgtctaccacatgcctcagagg

SEQ ID NO: 461097 - DNA, 25 bp, Rattus norvegicus
gggtgtctaccagatgcctcagagg

SEQ ID NO: 461098 - DNA, 25 bp, Rattus norvegicus
gggtgtctcaacaacaaggcatagg

SEQ ID NO: 461099 - DNA, 25 bp, Rattus norvegicus
gggtgtctcaactacaaggcatagg

SEQ ID NO: 461100 - DNA, 25 bp, Rattus norvegicus
gggtgtctctcacggacagagcact

SEQ ID NO: 461101 - DNA, 25 bp, Rattus norvegicus
gggtgtctctcagggacagagcact

SEQ ID NO: 461102 - DNA, 25 bp, Rattus norvegicus
gggtgtctctccagatgaacttaaa

SEQ ID NO: 461103 - DNA, 25 bp, Rattus norvegicus
gggtgtctctcctgatgaacttaaa

SEQ ID NO: 461104 - DNA, 25 bp, Rattus norvegicus
gggtgtctctgtctcccagctcagc

SEQ ID NO: 461105 - DNA, 25 bp, Rattus norvegicus
gggtgtctctgtgtcccagctcagc

SEQ ID NO: 461106 - DNA, 25 bp, Rattus norvegicus
gggtgtctctttcgcctgtgaagac

SEQ ID NO: 461107 - DNA, 25 bp, Rattus norvegicus
gggtgtctctttggcctgtgaagac

SEQ ID NO: 461108 - DNA, 25 bp, Rattus norvegicus
gggtgtctgctgaacagttctagta

SEQ ID NO: 461109 - DNA, 25 bp, Rattus norvegicus
gggtgtctgctgtacagttctagta

SEQ ID NO: 461110 - DNA, 25 bp, Rattus norvegicus
gggtgtctggctatggctacgacca

SEQ ID NO: 461111 - DNA, 25 bp, Rattus norvegicus
gggtgtctggctttggctacgacca

SEQ ID NO: 461112 - DNA, 25 bp, Rattus norvegicus
gggtgtctgtaaacaaatgtcaaaa

SEQ ID NO: 461113 - DNA, 25 bp, Rattus norvegicus
gggtgtctgtaatcaaatgtcaaaa

SEQ ID NO: 461114 - DNA, 25 bp, Rattus norvegicus
gggtgtctgtctccaaactgcatgt

SEQ ID NO: 461115 - DNA, 25 bp, Rattus norvegicus
gggtgtctgtctgcaaactgcatgt

SEQ ID NO: 461116 - DNA, 25 bp, Rattus norvegicus
gggtgtcttcacatttcttagagct

SEQ ID NO: 461117 - DNA, 25 bp, Rattus norvegicus
gggtgtcttcacttttcttagagct

SEQ ID NO: 461118 - DNA, 25 bp, Rattus norvegicus
gggtgtcttccaactgaaatctcaa

SEQ ID NO: 461119 - DNA, 25 bp, Rattus norvegicus
gggtgtcttccatctgaaatctcaa

SEQ ID NO: 461120 - DNA, 25 bp, Rattus norvegicus
gggtgtcttctaaatttgctgagga

SEQ ID NO: 461121 - DNA, 25 bp, Rattus norvegicus
gggtgtcttctatatttgctgagga

SEQ ID NO: 461122 - DNA, 25 bp, Rattus norvegicus
gggtgtcttggcaaactgagtctga

SEQ ID NO: 461123 - DNA, 25 bp, Rattus norvegicus
gggtgtcttggctaactgagtctga

SEQ ID NO: 461124 - DNA, 25 bp, Rattus norvegicus
gggtgtctttagagtgtacagtcca

SEQ ID NO: 461125 - DNA, 25 bp, Rattus norvegicus
gggtgtctttagtgtgtacagtcca

SEQ ID NO: 461126 - DNA, 25 bp, Rattus norvegicus
gggtgtctttctcgtgtccaaactt

SEQ ID NO: 461127 - DNA, 25 bp, Rattus norvegicus
gggtgtctttctggtgtccaaactt

SEQ ID NO: 461128 - DNA, 25 bp, Rattus norvegicus
gggtgtcttttcaggaacatgccga

SEQ ID NO: 461129 - DNA, 25 bp, Rattus norvegicus
gggtgtcttttctggaacatgccga

SEQ ID NO: 461130 - DNA, 25 bp, Rattus norvegicus
gggtgtgaactaactggcttcatca

SEQ ID NO: 461131 - DNA, 25 bp, Rattus norvegicus
gggtgtgaactatctggcttcatca

SEQ ID NO: 461132 - DNA, 25 bp, Rattus norvegicus
gggtgtgaactcatttccctgggaa

SEQ ID NO: 461133 - DNA, 25 bp, Rattus norvegicus
gggtgtgaactcttttccctgggaa

SEQ ID NO: 461134 - DNA, 25 bp, Rattus norvegicus
gggtgtgaattcagtgtcttaggtc

SEQ ID NO: 461135 - DNA, 25 bp, Rattus norvegicus
gggtgtgaattctgtgtcttaggtc

SEQ ID NO: 461136 - DNA, 25 bp, Rattus norvegicus
gggtgtgacaacatgacgtgcatca

SEQ ID NO: 461137 - DNA, 25 bp, Rattus norvegicus
gggtgtgacaacttgacgtgcatca

SEQ ID NO: 461138 - DNA, 25 bp, Rattus norvegicus
gggtgtgacatacagcccaagctct

SEQ ID NO: 461139 - DNA, 25 bp, Rattus norvegicus
gggtgtgacatagagcccaagctct

SEQ ID NO: 461140 - DNA, 25 bp, Rattus norvegicus
gggtgtgactttcagttttatggtt

SEQ ID NO: 461141 - DNA, 25 bp, Rattus norvegicus
gggtgtgactttgagttttatggtt

SEQ ID NO: 461142 - DNA, 25 bp, Rattus norvegicus
gggtgtgagttacccttacgttctg

SEQ ID NO: 461143 - DNA, 25 bp, Rattus norvegicus
gggtgtgagttagccttacgttctg

SEQ ID NO: 461144 - DNA, 25 bp, Rattus norvegicus
gggtgtgatctcagcaggtgcaact

SEQ ID NO: 461145 - DNA, 25 bp, Rattus norvegicus
gggtgtgatctctgcaggtgcaact

SEQ ID NO: 461146 - DNA, 25 bp, Rattus norvegicus
gggtgtgcaataccttcagccatat

SEQ ID NO: 461147 - DNA, 25 bp, Rattus norvegicus
gggtgtgcaatagcttcagccatat

SEQ ID NO: 461148 - DNA, 25 bp, Rattus norvegicus
gggtgtgcagtccattagagtaaaa

SEQ ID NO: 461149 - DNA, 25 bp, Rattus norvegicus
gggtgtgcagtcgattagagtaaaa

SEQ ID NO: 461150 - DNA, 25 bp, Rattus norvegicus
gggtgtgccctaaaaaatcatgtta

SEQ ID NO: 461151 - DNA, 25 bp, Rattus norvegicus
gggtgtgccctataaaatcatgtta

SEQ ID NO: 461152 - DNA, 25 bp, Rattus norvegicus
gggtgtgccttaagcttcttgcact

SEQ ID NO: 461153 - DNA, 25 bp, Rattus norvegicus
gggtgtgccttatgcttcttgcact

SEQ ID NO: 461154 - DNA, 25 bp, Rattus norvegicus
gggtgtgcctttaaaagccatcctc

SEQ ID NO: 461155 - DNA, 25 bp, Rattus norvegicus
gggtgtgccttttaaagccatcctc

SEQ ID NO: 461156 - DNA, 25 bp, Rattus norvegicus
gggtgtgctagcaactggctgcaat

SEQ ID NO: 461157 - DNA, 25 bp, Rattus norvegicus
gggtgtgctagctactggctgcaat

SEQ ID NO: 461158 - DNA, 25 bp, Rattus norvegicus
gggtgtgctggtacaaacctgtcat

SEQ ID NO: 461159 - DNA, 25 bp, Rattus norvegicus
gggtgtgctggttcaaacctgtcat

SEQ ID NO: 461160 - DNA, 25 bp, Rattus norvegicus
gggtgtgcttcaatacgtcactaac

SEQ ID NO: 461161 - DNA, 25 bp, Rattus norvegicus
gggtgtgcttcattacgtcactaac

SEQ ID NO: 461162 - DNA, 25 bp, Rattus norvegicus
gggtgtgctttcaattctgacagcc

SEQ ID NO: 461163 - DNA, 25 bp, Rattus norvegicus
gggtgtgctttctattctgacagcc

SEQ ID NO: 461164 - DNA, 25 bp, Rattus norvegicus
gggtgtggagacctcagcttctttc

SEQ ID NO: 461165 - DNA, 25 bp, Rattus norvegicus
gggtgtggagacgtcagcttctttc

SEQ ID NO: 461166 - DNA, 25 bp, Rattus norvegicus
gggtgtggccctatagatgatttga

SEQ ID NO: 461167 - DNA, 25 bp, Rattus norvegicus
gggtgtggccctttagatgatttga

SEQ ID NO: 461168 - DNA, 25 bp, Rattus norvegicus
gggtgtggcctcagcagtatcctga

SEQ ID NO: 461169 - DNA, 25 bp, Rattus norvegicus
gggtgtggcctctgcagtatcctga

SEQ ID NO: 461170 - DNA, 25 bp, Rattus norvegicus
gggtgtggcgggacatacctacaat

SEQ ID NO: 461171 - DNA, 25 bp, Rattus norvegicus
gggtgtggcgggtcatacctacaat

SEQ ID NO: 461172 - DNA, 25 bp, Rattus norvegicus
gggtgtggctgcaccttcacacagg

SEQ ID NO: 461173 - DNA, 25 bp, Rattus norvegicus
gggtgtggctgctccttcacacagg

SEQ ID NO: 461174 - DNA, 25 bp, Rattus norvegicus
gggtgtggctgtaacacttcaccac

SEQ ID NO: 461175 - DNA, 25 bp, Rattus norvegicus
gggtgtggctgttacacttcaccac

SEQ ID NO: 461176 - DNA, 25 bp, Rattus norvegicus
gggtgtgggaataaagcgaaggcat

SEQ ID NO: 461177 - DNA, 25 bp, Rattus norvegicus
gggtgtgggaattaagcgaaggcat

SEQ ID NO: 461178 - DNA, 25 bp, Rattus norvegicus
gggtgtggtctaagactgatccaaa

SEQ ID NO: 461179 - DNA, 25 bp, Rattus norvegicus
gggtgtggtctatgactgatccaaa

SEQ ID NO: 461180 - DNA, 25 bp, Rattus norvegicus
gggtgtgtagcgatttctgctgaat

SEQ ID NO: 461181 - DNA, 25 bp, Rattus norvegicus
gggtgtgtagcgttttctgctgaat

SEQ ID NO: 461182 - DNA, 25 bp, Rattus norvegicus
gggtgtgtatagacccactgtacag

SEQ ID NO: 461183 - DNA, 25 bp, Rattus norvegicus
gggtgtgtatagtcccactgtacag

SEQ ID NO: 461184 - DNA, 25 bp, Rattus norvegicus
gggtgtgtcgtgactaacatgcaat

SEQ ID NO: 461185 - DNA, 25 bp, Rattus norvegicus
gggtgtgtcgtgtctaacatgcaat

SEQ ID NO: 461186 - DNA, 25 bp, Rattus norvegicus
gggtgtgtgacccatccagtacaca

SEQ ID NO: 461187 - DNA, 25 bp, Rattus norvegicus
gggtgtgtgaccgatccagtacaca

SEQ ID NO: 461188 - DNA, 25 bp, Rattus norvegicus
gggtgtgtgcaaacctctgtcctgc

SEQ ID NO: 461189 - DNA, 25 bp, Rattus norvegicus
gggtgtgtgcaatcctctgtcctgc

SEQ ID NO: 461190 - DNA, 25 bp, Rattus norvegicus
gggtgtgtgcgcctagaatctatat

SEQ ID NO: 461191 - DNA, 25 bp, Rattus norvegicus
gggtgtgtgcgcgtagaatctatat

SEQ ID NO: 461192 - DNA, 25 bp, Rattus norvegicus
gggtgtgtgggtactcatcagcacc

SEQ ID NO: 461193 - DNA, 25 bp, Rattus norvegicus
gggtgtgtgggttctcatcagcacc

SEQ ID NO: 461194 - DNA, 25 bp, Rattus norvegicus
gggtgtgttcacaatcttgtggtat

SEQ ID NO: 461195 - DNA, 25 bp, Rattus norvegicus
gggtgtgttcactatcttgtggtat

SEQ ID NO: 461196 - DNA, 25 bp, Rattus norvegicus
gggtgtgttctaagtgctttctgag

SEQ ID NO: 461197 - DNA, 25 bp, Rattus norvegicus
gggtgtgttctatgtgctttctgag

SEQ ID NO: 461198 - DNA, 25 bp, Rattus norvegicus
gggtgtgttctgagtttatgtccaa

SEQ ID NO: 461199 - DNA, 25 bp, Rattus norvegicus
gggtgtgttctgtgtttatgtccaa

SEQ ID NO: 461200 - DNA, 25 bp, Rattus norvegicus
gggtgtgtttccattaattcaaata

SEQ ID NO: 461201 - DNA, 25 bp, Rattus norvegicus
gggtgtgtttcctttaattcaaata

SEQ ID NO: 461202 - DNA, 25 bp, Rattus norvegicus
gggtgttaacacaactaaggcttca

SEQ ID NO: 461203 - DNA, 25 bp, Rattus norvegicus
gggtgttaacactactaaggcttca

SEQ ID NO: 461204 - DNA, 25 bp, Rattus norvegicus
gggtgttacaaacctatggagccta

SEQ ID NO: 461205 - DNA, 25 bp, Rattus norvegicus
gggtgttacaaagctatggagccta

SEQ ID NO: 461206 - DNA, 25 bp, Rattus norvegicus
gggtgttacagcaacttttatatct

SEQ ID NO: 461207 - DNA, 25 bp, Rattus norvegicus
gggtgttacagctacttttatatct

SEQ ID NO: 461208 - DNA, 25 bp, Rattus norvegicus
gggtgttacattccaaaaaattctc

SEQ ID NO: 461209 - DNA, 25 bp, Rattus norvegicus
gggtgttacattgcaaaaaattctc

SEQ ID NO: 461210 - DNA, 25 bp, Rattus norvegicus
gggtgttacgtgagtttgtttcctg

SEQ ID NO: 461211 - DNA, 25 bp, Rattus norvegicus
gggtgttacgtgtgtttgtttcctg

SEQ ID NO: 461212 - DNA, 25 bp, Rattus norvegicus
gggtgttactccctttttgatacat

SEQ ID NO: 461213 - DNA, 25 bp, Rattus norvegicus
gggtgttactccgtttttgatacat

SEQ ID NO: 461214 - DNA, 25 bp, Rattus norvegicus
gggtgttagaacctattcatctgta

SEQ ID NO: 461215 - DNA, 25 bp, Rattus norvegicus
gggtgttagaacgtattcatctgta

SEQ ID NO: 461216 - DNA, 25 bp, Rattus norvegicus
gggtgttagatgaagctttctgcat

SEQ ID NO: 461217 - DNA, 25 bp, Rattus norvegicus
gggtgttagatgtagctttctgcat

SEQ ID NO: 461218 - DNA, 25 bp, Rattus norvegicus
gggtgttatacgatattactgctta

SEQ ID NO: 461219 - DNA, 25 bp, Rattus norvegicus
gggtgttatacgttattactgctta

SEQ ID NO: 461220 - DNA, 25 bp, Rattus norvegicus
gggtgttatcagatcgtaaacaaca

SEQ ID NO: 461221 - DNA, 25 bp, Rattus norvegicus
gggtgttatcagttcgtaaacaaca

SEQ ID NO: 461222 - DNA, 25 bp, Rattus norvegicus
gggtgttcatttccagtaccgcaag

SEQ ID NO: 461223 - DNA, 25 bp, Rattus norvegicus
gggtgttcatttgcagtaccgcaag

SEQ ID NO: 461224 - DNA, 25 bp, Rattus norvegicus
gggtgttcctaccagcatcacagaa

SEQ ID NO: 461225 - DNA, 25 bp, Rattus norvegicus
gggtgttcctacgagcatcacagaa

SEQ ID NO: 461226 - DNA, 25 bp, Rattus norvegicus
gggtgttcctatcagcccagagttt

SEQ ID NO: 461227 - DNA, 25 bp, Rattus norvegicus
gggtgttcctatgagcccagagttt

SEQ ID NO: 461228 - DNA, 25 bp, Rattus norvegicus
gggtgttcgtttcgatgataattac

SEQ ID NO: 461229 - DNA, 25 bp, Rattus norvegicus
gggtgttcgtttggatgataattac

SEQ ID NO: 461230 - DNA, 25 bp, Rattus norvegicus
gggtgttctaacaagacgcatcaac

SEQ ID NO: 461231 - DNA, 25 bp, Rattus norvegicus
gggtgttctaactagacgcatcaac

SEQ ID NO: 461232 - DNA, 25 bp, Rattus norvegicus
gggtgttctcctcaaaaagcttcca

SEQ ID NO: 461233 - DNA, 25 bp, Rattus norvegicus
gggtgttctcctgaaaaagcttcca

SEQ ID NO: 461234 - DNA, 25 bp, Rattus norvegicus
gggtgttctctcaggtgtcagactt

SEQ ID NO: 461235 - DNA, 25 bp, Rattus norvegicus
gggtgttctctctggtgtcagactt

SEQ ID NO: 461236 - DNA, 25 bp, Rattus norvegicus
gggtgttctgcaagtgtctggtcca

SEQ ID NO: 461237 - DNA, 25 bp, Rattus norvegicus
gggtgttctgcatgtgtctggtcca

SEQ ID NO: 461238 - DNA, 25 bp, Rattus norvegicus
gggtgttctgccatcacattcccac

SEQ ID NO: 461239 - DNA, 25 bp, Rattus norvegicus
gggtgttctgccatcatcaataagg

SEQ ID NO: 461240 - DNA, 25 bp, Rattus norvegicus
gggtgttctgccttcacattcccac

SEQ ID NO: 461241 - DNA, 25 bp, Rattus norvegicus
gggtgttctgccttcatcaataagg

SEQ ID NO: 461242 - DNA, 25 bp, Rattus norvegicus
gggtgttctggaaactctcacaagc

SEQ ID NO: 461243 - DNA, 25 bp, Rattus norvegicus
gggtgttctggatactctcacaagc

SEQ ID NO: 461244 - DNA, 25 bp, Rattus norvegicus
gggtgttgaaccagccagcaagcat

SEQ ID NO: 461245 - DNA, 25 bp, Rattus norvegicus
gggtgttgaacctgccagcaagcat

SEQ ID NO: 461246 - DNA, 25 bp, Rattus norvegicus
gggtgttgagttcatctgctagatt

SEQ ID NO: 461247 - DNA, 25 bp, Rattus norvegicus
gggtgttgagttgatctgctagatt

SEQ ID NO: 461248 - DNA, 25 bp, Rattus norvegicus
gggtgttgatgtctttccttaaatt

SEQ ID NO: 461249 - DNA, 25 bp, Rattus norvegicus
gggtgttgatgtgtttccttaaatt

SEQ ID NO: 461250 - DNA, 25 bp, Rattus norvegicus
gggtgttgccaaccatatgcgacta

SEQ ID NO: 461251 - DNA, 25 bp, Rattus norvegicus
gggtgttgccaagcatatgcgacta

SEQ ID NO: 461252 - DNA, 25 bp, Rattus norvegicus
gggtgttgggaccatttccactagt

SEQ ID NO: 461253 - DNA, 25 bp, Rattus norvegicus
gggtgttgggacgatttccactagt

SEQ ID NO: 461254 - DNA, 25 bp, Rattus norvegicus
gggtgttgtagccaaacctcagccc

SEQ ID NO: 461255 - DNA, 25 bp, Rattus norvegicus
gggtgttgtagcgaaacctcagccc

SEQ ID NO: 461256 - DNA, 25 bp, Rattus norvegicus
gggtgttgtcggcacatgcctttaa

SEQ ID NO: 461257 - DNA, 25 bp, Rattus norvegicus
gggtgttgtcgggacatgcctttaa

SEQ ID NO: 461258 - DNA, 25 bp, Rattus norvegicus
gggtgttgtctgaagctgtcatgca

SEQ ID NO: 461259 - DNA, 25 bp, Rattus norvegicus
gggtgttgtctgtagctgtcatgca

SEQ ID NO: 461260 - DNA, 25 bp, Rattus norvegicus
gggtgtttacatcatccagttttac

SEQ ID NO: 461261 - DNA, 25 bp, Rattus norvegicus
gggtgtttacatgatccagttttac

SEQ ID NO: 461262 - DNA, 25 bp, Rattus norvegicus
gggtgtttactgaccctaaaggcag

SEQ ID NO: 461263 - DNA, 25 bp, Rattus norvegicus
gggtgtttactgtccctaaaggcag

SEQ ID NO: 461264 - DNA, 25 bp, Rattus norvegicus
gggtgtttacttatgttggtgcctt

SEQ ID NO: 461265 - DNA, 25 bp, Rattus norvegicus
gggtgtttacttttgttggtgcctt

SEQ ID NO: 461266 - DNA, 25 bp, Rattus norvegicus
gggtgtttcaggcatggtctactct

SEQ ID NO: 461267 - DNA, 25 bp, Rattus norvegicus
gggtgtttcagggatggtctactct

SEQ ID NO: 461268 - DNA, 25 bp, Rattus norvegicus
gggtgtttccttcatcgatggctgc

SEQ ID NO: 461269 - DNA, 25 bp, Rattus norvegicus
gggtgtttccttgatcgatggctgc

SEQ ID NO: 461270 - DNA, 25 bp, Rattus norvegicus
gggtgtttctaaacatttgtgtcgt

SEQ ID NO: 461271 - DNA, 25 bp, Rattus norvegicus
gggtgtttctaatcatttgtgtcgt

SEQ ID NO: 461272 - DNA, 25 bp, Rattus norvegicus
gggtgtttctatcagtgttgccctc

SEQ ID NO: 461273 - DNA, 25 bp, Rattus norvegicus
gggtgtttctatgagtgttgccctc

SEQ ID NO: 461274 - DNA, 25 bp, Rattus norvegicus
gggtgtttgatcaggtagtaaccat

SEQ ID NO: 461275 - DNA, 25 bp, Rattus norvegicus
gggtgtttgatctggtagtaaccat

SEQ ID NO: 461276 - DNA, 25 bp, Rattus norvegicus
gggtgtttgcgcacaagcagccaac

SEQ ID NO: 461277 - DNA, 25 bp, Rattus norvegicus
gggtgtttgcgctcaagcagccaac

SEQ ID NO: 461278 - DNA, 25 bp, Rattus norvegicus
gggtgtttgtcaccatggcttctca

SEQ ID NO: 461279 - DNA, 25 bp, Rattus norvegicus
gggtgtttgtcagcatggcttctca

SEQ ID NO: 461280 - DNA, 25 bp, Rattus norvegicus
gggtgttttcaactgtcggcttaga

SEQ ID NO: 461281 - DNA, 25 bp, Rattus norvegicus
gggtgttttcaagtgtcggcttaga

SEQ ID NO: 461282 - DNA, 25 bp, Rattus norvegicus
gggtgttttcttacataaccaggca

SEQ ID NO: 461283 - DNA, 25 bp, Rattus norvegicus
gggtgttttctttcataaccaggca

SEQ ID NO: 461284 - DNA, 25 bp, Rattus norvegicus
gggtgtttttccactgttgtcaagg

SEQ ID NO: 461285 - DNA, 25 bp, Rattus norvegicus
gggtgtttttcctctgttgtcaagg

SEQ ID NO: 461286 - DNA, 25 bp, Rattus norvegicus
gggtgtttttctcccagcttccagt

SEQ ID NO: 461287 - DNA, 25 bp, Rattus norvegicus
gggtgtttttctgccagcttccagt

SEQ ID NO: 461288 - DNA, 25 bp, Rattus norvegicus
gggtgttttttaattctggtgatgt

SEQ ID NO: 461289 - DNA, 25 bp, Rattus norvegicus
gggtgttttttatttctggtgatgt

SEQ ID NO: 461290 - DNA, 25 bp, Rattus norvegicus
gggttaaaaggtatgtgccacatgc

SEQ ID NO: 461291 - DNA, 25 bp, Rattus norvegicus
gggttaaaaggtttgtgccacatgc

SEQ ID NO: 461292 - DNA, 25 bp, Rattus norvegicus
gggttaaaagtcagccatccctgct

SEQ ID NO: 461293 - DNA, 25 bp, Rattus norvegicus
gggttaaaagtctgccatccctgct

SEQ ID NO: 461294 - DNA, 25 bp, Rattus norvegicus
gggttaaatgtcaagggtgcttcct

SEQ ID NO: 461295 - DNA, 25 bp, Rattus norvegicus
gggttaaatgtctagggtgcttcct

SEQ ID NO: 461296 - DNA, 25 bp, Rattus norvegicus
gggttaaatgttattcacttgatgc

SEQ ID NO: 461297 - DNA, 25 bp, Rattus norvegicus
gggttaaatgtttttcacttgatgc

SEQ ID NO: 461298 - DNA, 25 bp, Rattus norvegicus
gggttaacctttcacactcagttca

SEQ ID NO: 461299 - DNA, 25 bp, Rattus norvegicus
gggttaacctttgacactcagttca

SEQ ID NO: 461300 - DNA, 25 bp, Rattus norvegicus
gggttaactatcctaatctgtcttt

SEQ ID NO: 461301 - DNA, 25 bp, Rattus norvegicus
gggttaactatcgtaatctgtcttt

SEQ ID NO: 461302 - DNA, 25 bp, Rattus norvegicus
gggttaagaacactgctgacgttgc

SEQ ID NO: 461303 - DNA, 25 bp, Rattus norvegicus
gggttaagaacagtgctgacgttgc

SEQ ID NO: 461304 - DNA, 25 bp, Rattus norvegicus
gggttaagtgtaacggccgactctc

SEQ ID NO: 461305 - DNA, 25 bp, Rattus norvegicus
gggttaagtgtatcggccgactctc

SEQ ID NO: 461306 - DNA, 25 bp, Rattus norvegicus
gggttaatctatcaaaatacacatc

SEQ ID NO: 461307 - DNA, 25 bp, Rattus norvegicus
gggttaatctatgaaaatacacatc

SEQ ID NO: 461308 - DNA, 25 bp, Rattus norvegicus
gggttaatctggcttcacatttcta

SEQ ID NO: 461309 - DNA, 25 bp, Rattus norvegicus
gggttaatctgggttcacatttcta

SEQ ID NO: 461310 - DNA, 25 bp, Rattus norvegicus
gggttaatgcaccagacttaccagt

SEQ ID NO: 461311 - DNA, 25 bp, Rattus norvegicus
gggttaatgcacgagacttaccagt

SEQ ID NO: 461312 - DNA, 25 bp, Rattus norvegicus
gggttaatgctactatctttctgac

SEQ ID NO: 461313 - DNA, 25 bp, Rattus norvegicus
gggttaatgctagtatctttctgac

SEQ ID NO: 461314 - DNA, 25 bp, Rattus norvegicus
gggttaatgtcacttgccactcact

SEQ ID NO: 461315 - DNA, 25 bp, Rattus norvegicus
gggttaatgtcagttgccactcact

SEQ ID NO: 461316 - DNA, 25 bp, Rattus norvegicus
gggttaattatccaatctgtttctg

SEQ ID NO: 461317 - DNA, 25 bp, Rattus norvegicus
gggttaattatcgaatctgtttctg

SEQ ID NO: 461318 - DNA, 25 bp, Rattus norvegicus
gggttaattcctcgcttattctcaa

SEQ ID NO: 461319 - DNA, 25 bp, Rattus norvegicus
gggttaattcctggcttattctcaa

SEQ ID NO: 461320 - DNA, 25 bp, Rattus norvegicus
gggttaattcttccttgagcacagt

SEQ ID NO: 461321 - DNA, 25 bp, Rattus norvegicus
gggttaattcttgcttgagcacagt

SEQ ID NO: 461322 - DNA, 25 bp, Rattus norvegicus
gggttacaaactcagctgggcccct

SEQ ID NO: 461323 - DNA, 25 bp, Rattus norvegicus
gggttacaaactgagctgggcccct

SEQ ID NO: 461324 - DNA, 25 bp, Rattus norvegicus
gggttacaaatgctcattagctgca

SEQ ID NO: 461325 - DNA, 25 bp, Rattus norvegicus
gggttacaaatggtcattagctgca

SEQ ID NO: 461326 - DNA, 25 bp, Rattus norvegicus
gggttacagaccacgattccgcagg

SEQ ID NO: 461327 - DNA, 25 bp, Rattus norvegicus
gggttacagacctcgattccgcagg

SEQ ID NO: 461328 - DNA, 25 bp, Rattus norvegicus
gggttacagatcaatactcctttgg

SEQ ID NO: 461329 - DNA, 25 bp, Rattus norvegicus
gggttacagatctatactcctttgg

SEQ ID NO: 461330 - DNA, 25 bp, Rattus norvegicus
gggttacagcttcaattacacgggt

SEQ ID NO: 461331 - DNA, 25 bp, Rattus norvegicus
gggttacagcttgaattacacgggt

SEQ ID NO: 461332 - DNA, 25 bp, Rattus norvegicus
gggttacaggcaacctcagtggctg

SEQ ID NO: 461333 - DNA, 25 bp, Rattus norvegicus
gggttacaggcatcctcagtggctg

SEQ ID NO: 461334 - DNA, 25 bp, Rattus norvegicus
gggttacaggtaaggcaccatgcct

SEQ ID NO: 461335 - DNA, 25 bp, Rattus norvegicus
gggttacaggtatggcaccatgcct

SEQ ID NO: 461336 - DNA, 25 bp, Rattus norvegicus
gggttaccatctcgagttcctaaga

SEQ ID NO: 461337 - DNA, 25 bp, Rattus norvegicus
gggttaccatctggagttcctaaga

SEQ ID NO: 461338 - DNA, 25 bp, Rattus norvegicus
gggttaccccgcagctgccgagaag

SEQ ID NO: 461339 - DNA, 25 bp, Rattus norvegicus
gggttaccccgctgctgccgagaag

SEQ ID NO: 461340 - DNA, 25 bp, Rattus norvegicus
gggttaccctagcatgataccagga

SEQ ID NO: 461341 - DNA, 25 bp, Rattus norvegicus
gggttaccctaggatgataccagga

SEQ ID NO: 461342 - DNA, 25 bp, Rattus norvegicus
gggttaccgcaccagagttaaatgt

SEQ ID NO: 461343 - DNA, 25 bp, Rattus norvegicus
gggttaccgcacgagagttaaatgt

SEQ ID NO: 461344 - DNA, 25 bp, Rattus norvegicus
gggttaccgctgagtggacaccaac

SEQ ID NO: 461345 - DNA, 25 bp, Rattus norvegicus
gggttaccgctgtgtggacaccaac

SEQ ID NO: 461346 - DNA, 25 bp, Rattus norvegicus
gggttacctatgacagcttccttta

SEQ ID NO: 461347 - DNA, 25 bp, Rattus norvegicus
gggttacctatgtcagcttccttta

SEQ ID NO: 461348 - DNA, 25 bp, Rattus norvegicus
gggttacctattccaaatgataaag

SEQ ID NO: 461349 - DNA, 25 bp, Rattus norvegicus
gggttacctattgcaaatgataaag

SEQ ID NO: 461350 - DNA, 25 bp, Rattus norvegicus
gggttaccttaccatgggcagtgcc

SEQ ID NO: 461351 - DNA, 25 bp, Rattus norvegicus
gggttaccttacgatgggcagtgcc

SEQ ID NO: 461352 - DNA, 25 bp, Rattus norvegicus
gggttacgagagacactatccggaa

SEQ ID NO: 461353 - DNA, 25 bp, Rattus norvegicus
gggttacgagagtcactatccggaa

SEQ ID NO: 461354 - DNA, 25 bp, Rattus norvegicus
gggttacgtcaacctcttattcaga

SEQ ID NO: 461355 - DNA, 25 bp, Rattus norvegicus
gggttacgtcaagctcttattcaga

SEQ ID NO: 461356 - DNA, 25 bp, Rattus norvegicus
gggttactagcacaccctccttcag

SEQ ID NO: 461357 - DNA, 25 bp, Rattus norvegicus
gggttactagcagaccctccttcag

SEQ ID NO: 461358 - DNA, 25 bp, Rattus norvegicus
gggttactatgacattgttacttgt

SEQ ID NO: 461359 - DNA, 25 bp, Rattus norvegicus
gggttactatgagattgttacttgt

SEQ ID NO: 461360 - DNA, 25 bp, Rattus norvegicus
gggttactattacagcatgccccac

SEQ ID NO: 461361 - DNA, 25 bp, Rattus norvegicus
gggttactattagagcatgccccac

SEQ ID NO: 461362 - DNA, 25 bp, Rattus norvegicus
gggttactggtacctactgatgcat

SEQ ID NO: 461363 - DNA, 25 bp, Rattus norvegicus
gggttactggtagctactgatgcat

SEQ ID NO: 461364 - DNA, 25 bp, Rattus norvegicus
gggttactgtgcagctgcggccccc

SEQ ID NO: 461365 - DNA, 25 bp, Rattus norvegicus
gggttactgtgctgctgcggccccc

SEQ ID NO: 461366 - DNA, 25 bp, Rattus norvegicus
gggttacttcagagtgtttgacaag

SEQ ID NO: 461367 - DNA, 25 bp, Rattus norvegicus
gggttacttcagtgtgtttgacaag

SEQ ID NO: 461368 - DNA, 25 bp, Rattus norvegicus
gggttacttctcctagtattccagc

SEQ ID NO: 461369 - DNA, 25 bp, Rattus norvegicus
gggttacttctcgtagtattccagc

SEQ ID NO: 461370 - DNA, 25 bp, Rattus norvegicus
gggttagaaactcggccaccatcct

SEQ ID NO: 461371 - DNA, 25 bp, Rattus norvegicus
gggttagaaactgggccaccatcct

SEQ ID NO: 461372 - DNA, 25 bp, Rattus norvegicus
gggttagaagctcactctcagtaga

SEQ ID NO: 461373 - DNA, 25 bp, Rattus norvegicus
gggttagaagctgactctcagtaga

SEQ ID NO: 461374 - DNA, 25 bp, Rattus norvegicus
gggttagaatggaccagtcctcact

SEQ ID NO: 461375 - DNA, 25 bp, Rattus norvegicus
gggttagaatggtccagtcctcact

SEQ ID NO: 461376 - DNA, 25 bp, Rattus norvegicus
gggttagaattacccctccaacatt

SEQ ID NO: 461377 - DNA, 25 bp, Rattus norvegicus
gggttagaattagccctccaacatt

SEQ ID NO: 461378 - DNA, 25 bp, Rattus norvegicus
gggttagacagacccctcaaacctc

SEQ ID NO: 461379 - DNA, 25 bp, Rattus norvegicus
gggttagacagagccctcaaacctc

SEQ ID NO: 461380 - DNA, 25 bp, Rattus norvegicus
gggttagacccaacagagcacaaga

SEQ ID NO: 461381 - DNA, 25 bp, Rattus norvegicus
gggttagacccactgcatggcaaaa

SEQ ID NO: 461382 - DNA, 25 bp, Rattus norvegicus
gggttagacccagtgcatggcaaaa

SEQ ID NO: 461383 - DNA, 25 bp, Rattus norvegicus
gggttagacccatcagagcacaaga

SEQ ID NO: 461384 - DNA, 25 bp, Rattus norvegicus
gggttagacctcagtgctgggcaca

SEQ ID NO: 461385 - DNA, 25 bp, Rattus norvegicus
gggttagacctctgtgctgggcaca

SEQ ID NO: 461386 - DNA, 25 bp, Rattus norvegicus
gggttagactgcctacatctcaaga

SEQ ID NO: 461387 - DNA, 25 bp, Rattus norvegicus
gggttagactgcgtacatctcaaga

SEQ ID NO: 461388 - DNA, 25 bp, Rattus norvegicus
gggttagagaagacgcagcaccatg

SEQ ID NO: 461389 - DNA, 25 bp, Rattus norvegicus
gggttagagaagtcgcagcaccatg

SEQ ID NO: 461390 - DNA, 25 bp, Rattus norvegicus
gggttagatagtcatgctctgtctt

SEQ ID NO: 461391 - DNA, 25 bp, Rattus norvegicus
gggttagatagtgatgctctgtctt

SEQ ID NO: 461392 - DNA, 25 bp, Rattus norvegicus
gggttagatcagatgcagctcgaca

SEQ ID NO: 461393 - DNA, 25 bp, Rattus norvegicus
gggttagatcagttgcagctcgaca

SEQ ID NO: 461394 - DNA, 25 bp, Rattus norvegicus
gggttagatcccacttataattggc

SEQ ID NO: 461395 - DNA, 25 bp, Rattus norvegicus
gggttagatccctcttataattggc

SEQ ID NO: 461396 - DNA, 25 bp, Rattus norvegicus
gggttagcacagcaagcctcgtgta

SEQ ID NO: 461397 - DNA, 25 bp, Rattus norvegicus
gggttagcacaggaagcctcgtgta

SEQ ID NO: 461398 - DNA, 25 bp, Rattus norvegicus
gggttagctgatcagaccacagccc

SEQ ID NO: 461399 - DNA, 25 bp, Rattus norvegicus
gggttagctgatgagaccacagccc

SEQ ID NO: 461400 - DNA, 25 bp, Rattus norvegicus
gggttagcttctccttctaagaaca

SEQ ID NO: 461401 - DNA, 25 bp, Rattus norvegicus
gggttagcttctgcttctaagaaca

SEQ ID NO: 461402 - DNA, 25 bp, Rattus norvegicus
gggttagcttggatccataagcgat

SEQ ID NO: 461403 - DNA, 25 bp, Rattus norvegicus
gggttagcttggttccataagcgat

SEQ ID NO: 461404 - DNA, 25 bp, Rattus norvegicus
gggttaggaagccacaactttatat

SEQ ID NO: 461405 - DNA, 25 bp, Rattus norvegicus
gggttaggaagcgacaactttatat

SEQ ID NO: 461406 - DNA, 25 bp, Rattus norvegicus
gggttaggacttactctttctgata

SEQ ID NO: 461407 - DNA, 25 bp, Rattus norvegicus
gggttaggactttctctttctgata

SEQ ID NO: 461408 - DNA, 25 bp, Rattus norvegicus
gggttaggcagcactggtcaagcat

SEQ ID NO: 461409 - DNA, 25 bp, Rattus norvegicus
gggttaggcagctctggtcaagcat

SEQ ID NO: 461410 - DNA, 25 bp, Rattus norvegicus
gggttaggcctgcacaatttaagtg

SEQ ID NO: 461411 - DNA, 25 bp, Rattus norvegicus
gggttaggcctggacaatttaagtg

SEQ ID NO: 461412 - DNA, 25 bp, Rattus norvegicus
gggttaggtgccactgtctattacc

SEQ ID NO: 461413 - DNA, 25 bp, Rattus norvegicus
gggttaggtgcctctgtctattacc

SEQ ID NO: 461414 - DNA, 25 bp, Rattus norvegicus
gggttagtaatgatacacagtttgt

SEQ ID NO: 461415 - DNA, 25 bp, Rattus norvegicus
gggttagtaatgttacacagtttgt

SEQ ID NO: 461416 - DNA, 25 bp, Rattus norvegicus
gggttagtaccaacactgagccttt

SEQ ID NO: 461417 - DNA, 25 bp, Rattus norvegicus
gggttagtaccatcactgagccttt

SEQ ID NO: 461418 - DNA, 25 bp, Rattus norvegicus
gggttagtgctgctcgttccttgcc

SEQ ID NO: 461419 - DNA, 25 bp, Rattus norvegicus
gggttagtgctggtcgttccttgcc

SEQ ID NO: 461420 - DNA, 25 bp, Rattus norvegicus
gggttagttctgaatgacagtccag

SEQ ID NO: 461421 - DNA, 25 bp, Rattus norvegicus
gggttagttctgtatgacagtccag

SEQ ID NO: 461422 - DNA, 25 bp, Rattus norvegicus
gggttagttgcacacattattgcta

SEQ ID NO: 461423 - DNA, 25 bp, Rattus norvegicus
gggttagttgcagacattattgcta

SEQ ID NO: 461424 - DNA, 25 bp, Rattus norvegicus
gggttataaccactggattctgaat

SEQ ID NO: 461425 - DNA, 25 bp, Rattus norvegicus
gggttataaccagtggattctgaat

SEQ ID NO: 461426 - DNA, 25 bp, Rattus norvegicus
gggttatacatgattcctctactta

SEQ ID NO: 461427 - DNA, 25 bp, Rattus norvegicus
gggttatacatgtttcctctactta

SEQ ID NO: 461428 - DNA, 25 bp, Rattus norvegicus
gggttatagtatctctctcacacag

SEQ ID NO: 461429 - DNA, 25 bp, Rattus norvegicus
gggttatagtatgtctctcacacag

SEQ ID NO: 461430 - DNA, 25 bp, Rattus norvegicus
gggttatcagacagtccaggtacat

SEQ ID NO: 461431 - DNA, 25 bp, Rattus norvegicus
gggttatcagactgtccaggtacat

SEQ ID NO: 461432 - DNA, 25 bp, Rattus norvegicus
gggttatccactcccttaaaatgac

SEQ ID NO: 461433 - DNA, 25 bp, Rattus norvegicus
gggttatccactgccttaaaatgac

SEQ ID NO: 461434 - DNA, 25 bp, Rattus norvegicus
gggttatccagaagcgagtccctaa

SEQ ID NO: 461435 - DNA, 25 bp, Rattus norvegicus
gggttatccagatgcgagtccctaa

SEQ ID NO: 461436 - DNA, 25 bp, Rattus norvegicus
gggttatccattagggctattttca

SEQ ID NO: 461437 - DNA, 25 bp, Rattus norvegicus
gggttatccatttgggctattttca

SEQ ID NO: 461438 - DNA, 25 bp, Rattus norvegicus
gggttatcctggaccacacaatcag

SEQ ID NO: 461439 - DNA, 25 bp, Rattus norvegicus
gggttatcctggtccacacaatcag

SEQ ID NO: 461440 - DNA, 25 bp, Rattus norvegicus
gggttatcgttcaagactggactgt

SEQ ID NO: 461441 - DNA, 25 bp, Rattus norvegicus
gggttatcgttctagactggactgt

SEQ ID NO: 461442 - DNA, 25 bp, Rattus norvegicus
gggttatctggaacaggctgacctg

SEQ ID NO: 461443 - DNA, 25 bp, Rattus norvegicus
gggttatctggatcaggctgacctg

SEQ ID NO: 461444 - DNA, 25 bp, Rattus norvegicus
gggttatgactaacggcacagactt

SEQ ID NO: 461445 - DNA, 25 bp, Rattus norvegicus
gggttatgactatcggcacagactt

SEQ ID NO: 461446 - DNA, 25 bp, Rattus norvegicus
gggttatgataaagtatcctgacaa

SEQ ID NO: 461447 - DNA, 25 bp, Rattus norvegicus
gggttatgataatgtatcctgacaa

SEQ ID NO: 461448 - DNA, 25 bp, Rattus norvegicus
gggttatgatccacagccagatcta

SEQ ID NO: 461449 - DNA, 25 bp, Rattus norvegicus
gggttatgatcctcagccagatcta

SEQ ID NO: 461450 - DNA, 25 bp, Rattus norvegicus
gggttatggctaaacacacacttat

SEQ ID NO: 461451 - DNA, 25 bp, Rattus norvegicus
gggttatggctatacacacacttat

SEQ ID NO: 461452 - DNA, 25 bp, Rattus norvegicus
gggttatggcttattacttcagttg

SEQ ID NO: 461453 - DNA, 25 bp, Rattus norvegicus
gggttatggctttttacttcagttg

SEQ ID NO: 461454 - DNA, 25 bp, Rattus norvegicus
gggttatgtctcagttcatggtttc

SEQ ID NO: 461455 - DNA, 25 bp, Rattus norvegicus
gggttatgtctctgttcatggtttc

SEQ ID NO: 461456 - DNA, 25 bp, Rattus norvegicus
gggttatgtttcagttcttcctcaa

SEQ ID NO: 461457 - DNA, 25 bp, Rattus norvegicus
gggttatgtttctgttcttcctcaa

SEQ ID NO: 461458 - DNA, 25 bp, Rattus norvegicus
gggttattactcagtggaaaacatg

SEQ ID NO: 461459 - DNA, 25 bp, Rattus norvegicus
gggttattactctgtggaaaacatg

SEQ ID NO: 461460 - DNA, 25 bp, Rattus norvegicus
gggttattatgaacttcttgcttca

SEQ ID NO: 461461 - DNA, 25 bp, Rattus norvegicus
gggttattatgatcttcttgcttca

SEQ ID NO: 461462 - DNA, 25 bp, Rattus norvegicus
gggttattgaccaaacgaggatgct

SEQ ID NO: 461463 - DNA, 25 bp, Rattus norvegicus
gggttattgacctaacgaggatgct

SEQ ID NO: 461464 - DNA, 25 bp, Rattus norvegicus
gggttattgaggattgtattacata

SEQ ID NO: 461465 - DNA, 25 bp, Rattus norvegicus
gggttattgaggtttgtattacata

SEQ ID NO: 461466 - DNA, 25 bp, Rattus norvegicus
gggttattggttctcttatgtgtaa

SEQ ID NO: 461467 - DNA, 25 bp, Rattus norvegicus
gggttattggttgtcttatgtgtaa

SEQ ID NO: 461468 - DNA, 25 bp, Rattus norvegicus
gggttattgtgactcatcagagcat

SEQ ID NO: 461469 - DNA, 25 bp, Rattus norvegicus
gggttattgtgagtcatcagagcat

SEQ ID NO: 461470 - DNA, 25 bp, Rattus norvegicus
gggttattttttccttgatgactga

SEQ ID NO: 461471 - DNA, 25 bp, Rattus norvegicus
gggttattttttgcttgatgactga

SEQ ID NO: 461472 - DNA, 25 bp, Rattus norvegicus
gggttcaaacatcacaagctaagag

SEQ ID NO: 461473 - DNA, 25 bp, Rattus norvegicus
gggttcaaacatgacaagctaagag

SEQ ID NO: 461474 - DNA, 25 bp, Rattus norvegicus
gggttcaaacccaggaagctaggat

SEQ ID NO: 461475 - DNA, 25 bp, Rattus norvegicus
gggttcaaaccctggaagctaggat

SEQ ID NO: 461476 - DNA, 25 bp, Rattus norvegicus
gggttcaaaggtatgcactatcacc

SEQ ID NO: 461477 - DNA, 25 bp, Rattus norvegicus
gggttcaaaggtttgcactatcacc

SEQ ID NO: 461478 - DNA, 25 bp, Rattus norvegicus
gggttcaaattcatgctccagcata

SEQ ID NO: 461479 - DNA, 25 bp, Rattus norvegicus
gggttcaaattcttgctccagcata

SEQ ID NO: 461480 - DNA, 25 bp, Rattus norvegicus
gggttcaacgaacgtccatcactgt

SEQ ID NO: 461481 - DNA, 25 bp, Rattus norvegicus
gggttcaacgaaggtccatcactgt

SEQ ID NO: 461482 - DNA, 25 bp, Rattus norvegicus
gggttcaacttcaactggaccaaca

SEQ ID NO: 461483 - DNA, 25 bp, Rattus norvegicus
gggttcaacttctactggaccaaca

SEQ ID NO: 461484 - DNA, 25 bp, Rattus norvegicus
gggttcaaggtcctgcagctgcata

SEQ ID NO: 461485 - DNA, 25 bp, Rattus norvegicus
gggttcaaggtcgtgcagctgcata

SEQ ID NO: 461486 - DNA, 25 bp, Rattus norvegicus
gggttcaataggacaccaaccaaat

SEQ ID NO: 461487 - DNA, 25 bp, Rattus norvegicus
gggttcaataggtcaccaaccaaat

SEQ ID NO: 461488 - DNA, 25 bp, Rattus norvegicus
gggttcaatgtaactgagctgcttt

SEQ ID NO: 461489 - DNA, 25 bp, Rattus norvegicus
gggttcaatgtatctgagctgcttt

SEQ ID NO: 461490 - DNA, 25 bp, Rattus norvegicus
gggttcaattctaagcactcaaatg

SEQ ID NO: 461491 - DNA, 25 bp, Rattus norvegicus
gggttcaattcttagcactcaaatg

SEQ ID NO: 461492 - DNA, 25 bp, Rattus norvegicus
gggttcacagcaatgtctcctataa

SEQ ID NO: 461493 - DNA, 25 bp, Rattus norvegicus
gggttcacagcacgaaacacactgg

SEQ ID NO: 461494 - DNA, 25 bp, Rattus norvegicus
gggttcacagcaggaaacacactgg

SEQ ID NO: 461495 - DNA, 25 bp, Rattus norvegicus
gggttcacagcattgtctcctataa

SEQ ID NO: 461496 - DNA, 25 bp, Rattus norvegicus
gggttcacagctacactgaaaaatt

SEQ ID NO: 461497 - DNA, 25 bp, Rattus norvegicus
gggttcacagcttcactgaaaaatt

SEQ ID NO: 461498 - DNA, 25 bp, Rattus norvegicus
gggttcacaggtcccaccttaggat

SEQ ID NO: 461499 - DNA, 25 bp, Rattus norvegicus
gggttcacaggtgccaccttaggat

SEQ ID NO: 461500 - DNA, 25 bp, Rattus norvegicus
gggttcacatacagagcagttctag

SEQ ID NO: 461501 - DNA, 25 bp, Rattus norvegicus
gggttcacatactgagcagttctag

SEQ ID NO: 461502 - DNA, 25 bp, Rattus norvegicus
gggttcacatcaccagcaatcatca

SEQ ID NO: 461503 - DNA, 25 bp, Rattus norvegicus
gggttcacatcagcagcaatcatca

SEQ ID NO: 461504 - DNA, 25 bp, Rattus norvegicus
gggttcacattcctgcttacaggga

SEQ ID NO: 461505 - DNA, 25 bp, Rattus norvegicus
gggttcacattcgtgcttacaggga

SEQ ID NO: 461506 - DNA, 25 bp, Rattus norvegicus
gggttcacggttctttgcagaactg

SEQ ID NO: 461507 - DNA, 25 bp, Rattus norvegicus
gggttcacggttgtttgcagaactg

SEQ ID NO: 461508 - DNA, 25 bp, Rattus norvegicus
gggttcactactactaagtcagcca

SEQ ID NO: 461509 - DNA, 25 bp, Rattus norvegicus
gggttcactacttctaagtcagcca

SEQ ID NO: 461510 - DNA, 25 bp, Rattus norvegicus
gggttcactagcatctgaggtcatc

SEQ ID NO: 461511 - DNA, 25 bp, Rattus norvegicus
gggttcactagcttctgaggtcatc

SEQ ID NO: 461512 - DNA, 25 bp, Rattus norvegicus
gggttcactgttaggttggctccac

SEQ ID NO: 461513 - DNA, 25 bp, Rattus norvegicus
gggttcactgtttggttggctccac

SEQ ID NO: 461514 - DNA, 25 bp, Rattus norvegicus
gggttcagaactacttagcgttggt

SEQ ID NO: 461515 - DNA, 25 bp, Rattus norvegicus
gggttcagaacttcttagcgttggt

SEQ ID NO: 461516 - DNA, 25 bp, Rattus norvegicus
gggttcagaataagactctgtttca

SEQ ID NO: 461517 - DNA, 25 bp, Rattus norvegicus
gggttcagaatatgactctgtttca

SEQ ID NO: 461518 - DNA, 25 bp, Rattus norvegicus
gggttcagccaaagctcccaagaaa

SEQ ID NO: 461519 - DNA, 25 bp, Rattus norvegicus
gggttcagccaatgctcccaagaaa

SEQ ID NO: 461520 - DNA, 25 bp, Rattus norvegicus
gggttcagccagaatgcccacctgg

SEQ ID NO: 461521 - DNA, 25 bp, Rattus norvegicus
gggttcagccagtatgcccacctgg

SEQ ID NO: 461522 - DNA, 25 bp, Rattus norvegicus
gggttcagccctcgatgccaacaga

SEQ ID NO: 461523 - DNA, 25 bp, Rattus norvegicus
gggttcagccctggatgccaacaga

SEQ ID NO: 461524 - DNA, 25 bp, Rattus norvegicus
gggttcagccggcagcaccagaaaa

SEQ ID NO: 461525 - DNA, 25 bp, Rattus norvegicus
gggttcagccggcagccccaatcgc

SEQ ID NO: 461526 - DNA, 25 bp, Rattus norvegicus
gggttcagccgggagcaccagaaaa

SEQ ID NO: 461527 - DNA, 25 bp, Rattus norvegicus
gggttcagccgggagccccaatcgc

SEQ ID NO: 461528 - DNA, 25 bp, Rattus norvegicus
gggttcagcctgatggaccagcatc

SEQ ID NO: 461529 - DNA, 25 bp, Rattus norvegicus
gggttcagcctgttggaccagcatc

SEQ ID NO: 461530 - DNA, 25 bp, Rattus norvegicus
gggttcagcgtgatgtcacacttat

SEQ ID NO: 461531 - DNA, 25 bp, Rattus norvegicus
gggttcagcgtgttgtcacacttat

SEQ ID NO: 461532 - DNA, 25 bp, Rattus norvegicus
gggttcagctccagatcctcgcagg

SEQ ID NO: 461533 - DNA, 25 bp, Rattus norvegicus
gggttcagctcctgatcctcgcagg

SEQ ID NO: 461534 - DNA, 25 bp, Rattus norvegicus
gggttcagctttaagagcaggtgta

SEQ ID NO: 461535 - DNA, 25 bp, Rattus norvegicus
gggttcagcttttagagcaggtgta

SEQ ID NO: 461536 - DNA, 25 bp, Rattus norvegicus
gggttcaggagcctgtgttttcatt

SEQ ID NO: 461537 - DNA, 25 bp, Rattus norvegicus
gggttcaggagcgtgtgttttcatt

SEQ ID NO: 461538 - DNA, 25 bp, Rattus norvegicus
gggttcaggatcagccttagctaca

SEQ ID NO: 461539 - DNA, 25 bp, Rattus norvegicus
gggttcaggatctgccttagctaca

SEQ ID NO: 461540 - DNA, 25 bp, Rattus norvegicus
gggttcaggtaactctggatccttt

SEQ ID NO: 461541 - DNA, 25 bp, Rattus norvegicus
gggttcaggtaagtctggatccttt

SEQ ID NO: 461542 - DNA, 25 bp, Rattus norvegicus
gggttcagtcccaagtactatagta

SEQ ID NO: 461543 - DNA, 25 bp, Rattus norvegicus
gggttcagtccctagtactatagta

SEQ ID NO: 461544 - DNA, 25 bp, Rattus norvegicus
gggttcagttttcttcacaggaaga

SEQ ID NO: 461545 - DNA, 25 bp, Rattus norvegicus
gggttcagttttgttcacaggaaga

SEQ ID NO: 461546 - DNA, 25 bp, Rattus norvegicus
gggttcataactagcacggcttacc

SEQ ID NO: 461547 - DNA, 25 bp, Rattus norvegicus
gggttcataacttgcacggcttacc

SEQ ID NO: 461548 - DNA, 25 bp, Rattus norvegicus
gggttcataccgatatgtatgataa

SEQ ID NO: 461549 - DNA, 25 bp, Rattus norvegicus
gggttcataccgttatgtatgataa

SEQ ID NO: 461550 - DNA, 25 bp, Rattus norvegicus
gggttcatatcaacagtctttacaa

SEQ ID NO: 461551 - DNA, 25 bp, Rattus norvegicus
gggttcatatcatcagtctttacaa

SEQ ID NO: 461552 - DNA, 25 bp, Rattus norvegicus
gggttcatccccagcactaaagaaa

SEQ ID NO: 461553 - DNA, 25 bp, Rattus norvegicus
gggttcatcccctgcactaaagaaa

SEQ ID NO: 461554 - DNA, 25 bp, Rattus norvegicus
gggttcatcggcatctttgtgaaac

SEQ ID NO: 461555 - DNA, 25 bp, Rattus norvegicus
gggttcatcggcttctttgtgaaac

SEQ ID NO: 461556 - DNA, 25 bp, Rattus norvegicus
gggttcatctttagcaaactactta

SEQ ID NO: 461557 - DNA, 25 bp, Rattus norvegicus
gggttcatcttttgcaaactactta

SEQ ID NO: 461558 - DNA, 25 bp, Rattus norvegicus
gggttcatgaagacacttgccccgc

SEQ ID NO: 461559 - DNA, 25 bp, Rattus norvegicus
gggttcatgaagtcacttgccccgc

SEQ ID NO: 461560 - DNA, 25 bp, Rattus norvegicus
gggttcatgaggacctcttcacttt

SEQ ID NO: 461561 - DNA, 25 bp, Rattus norvegicus
gggttcatgaggtcctcttcacttt

SEQ ID NO: 461562 - DNA, 25 bp, Rattus norvegicus
gggttcatgcctctaaggtgcttaa

SEQ ID NO: 461563 - DNA, 25 bp, Rattus norvegicus
gggttcatgcctgtaaggtgcttaa

SEQ ID NO: 461564 - DNA, 25 bp, Rattus norvegicus
gggttcatgtctagaccatgtcatg

SEQ ID NO: 461565 - DNA, 25 bp, Rattus norvegicus
gggttcatgtcttgaccatgtcatg

SEQ ID NO: 461566 - DNA, 25 bp, Rattus norvegicus
gggttcattacccaataccacagat

SEQ ID NO: 461567 - DNA, 25 bp, Rattus norvegicus
gggttcattaccgaataccacagat

SEQ ID NO: 461568 - DNA, 25 bp, Rattus norvegicus
gggttccaaatcatactgtgtcact

SEQ ID NO: 461569 - DNA, 25 bp, Rattus norvegicus
gggttccaaatcttactgtgtcact

SEQ ID NO: 461570 - DNA, 25 bp, Rattus norvegicus
gggttccaacacaagcagcagggct

SEQ ID NO: 461571 - DNA, 25 bp, Rattus norvegicus
gggttccaacactagcagcagggct

SEQ ID NO: 461572 - DNA, 25 bp, Rattus norvegicus
gggttccaacagctctcgaggttct

SEQ ID NO: 461573 - DNA, 25 bp, Rattus norvegicus
gggttccaacaggtctcgaggttct

SEQ ID NO: 461574 - DNA, 25 bp, Rattus norvegicus
gggttccaatggacgtcacctttct

SEQ ID NO: 461575 - DNA, 25 bp, Rattus norvegicus
gggttccaatggtcgtcacctttct

SEQ ID NO: 461576 - DNA, 25 bp, Rattus norvegicus
gggttccacaaactagcctaggctg

SEQ ID NO: 461577 - DNA, 25 bp, Rattus norvegicus
gggttccacaaagtagcctaggctg

SEQ ID NO: 461578 - DNA, 25 bp, Rattus norvegicus
gggttccacatccatttcttgccag

SEQ ID NO: 461579 - DNA, 25 bp, Rattus norvegicus
gggttccacatcgatttcttgccag

SEQ ID NO: 461580 - DNA, 25 bp, Rattus norvegicus
gggttccacctcaaatataactgtt

SEQ ID NO: 461581 - DNA, 25 bp, Rattus norvegicus
gggttccacctctaatataactgtt

SEQ ID NO: 461582 - DNA, 25 bp, Rattus norvegicus
gggttccacttcaactgcattttag

SEQ ID NO: 461583 - DNA, 25 bp, Rattus norvegicus
gggttccacttctactgcattttag

SEQ ID NO: 461584 - DNA, 25 bp, Rattus norvegicus
gggttccagaagagccatcgcaagt

SEQ ID NO: 461585 - DNA, 25 bp, Rattus norvegicus
gggttccagaagtgccatcgcaagt

SEQ ID NO: 461586 - DNA, 25 bp, Rattus norvegicus
gggttccagatacgcactcgcatgc

SEQ ID NO: 461587 - DNA, 25 bp, Rattus norvegicus
gggttccagataggcactcgcatgc

SEQ ID NO: 461588 - DNA, 25 bp, Rattus norvegicus
gggttccagattcgattcctagcac

SEQ ID NO: 461589 - DNA, 25 bp, Rattus norvegicus
gggttccagattggattcctagcac

SEQ ID NO: 461590 - DNA, 25 bp, Rattus norvegicus
gggttccaggtcagaggctcagtat

SEQ ID NO: 461591 - DNA, 25 bp, Rattus norvegicus
gggttccaggtctgaggctcagtat

SEQ ID NO: 461592 - DNA, 25 bp, Rattus norvegicus
gggttccatcaacctcatcagggaa

SEQ ID NO: 461593 - DNA, 25 bp, Rattus norvegicus
gggttccatcaagctcatcagggaa

SEQ ID NO: 461594 - DNA, 25 bp, Rattus norvegicus
gggttccatgggatcttctgtcttg

SEQ ID NO: 461595 - DNA, 25 bp, Rattus norvegicus
gggttccatgggttcttctgtcttg

SEQ ID NO: 461596 - DNA, 25 bp, Rattus norvegicus
gggttccattacagccagtgaggcc

SEQ ID NO: 461597 - DNA, 25 bp, Rattus norvegicus
gggttccattactgccagtgaggcc

SEQ ID NO: 461598 - DNA, 25 bp, Rattus norvegicus
gggttccattatatgccaagggcat

SEQ ID NO: 461599 - DNA, 25 bp, Rattus norvegicus
gggttccattatttgccaagggcat

SEQ ID NO: 461600 - DNA, 25 bp, Rattus norvegicus
gggttcccaaggaatctgcacgcac

SEQ ID NO: 461601 - DNA, 25 bp, Rattus norvegicus
gggttcccaaggtatctgcacgcac

SEQ ID NO: 461602 - DNA, 25 bp, Rattus norvegicus
gggttcccaagtctcaataaagttg

SEQ ID NO: 461603 - DNA, 25 bp, Rattus norvegicus
gggttcccaagtgtcaataaagttg

SEQ ID NO: 461604 - DNA, 25 bp, Rattus norvegicus
gggttcccaccgctaattataatga

SEQ ID NO: 461605 - DNA, 25 bp, Rattus norvegicus
gggttcccaccggtaattataatga

SEQ ID NO: 461606 - DNA, 25 bp, Rattus norvegicus
gggttcccactaagacacaaacatt

SEQ ID NO: 461607 - DNA, 25 bp, Rattus norvegicus
gggttcccactatgacacaaacatt

SEQ ID NO: 461608 - DNA, 25 bp, Rattus norvegicus
gggttcccattccaagaactggcta

SEQ ID NO: 461609 - DNA, 25 bp, Rattus norvegicus
gggttcccattcgaagaactggcta

SEQ ID NO: 461610 - DNA, 25 bp, Rattus norvegicus
gggttccccaatcagggctgagcct

SEQ ID NO: 461611 - DNA, 25 bp, Rattus norvegicus
gggttccccaatgagggctgagcct

SEQ ID NO: 461612 - DNA, 25 bp, Rattus norvegicus
gggttccctagacccatgaagtctg

SEQ ID NO: 461613 - DNA, 25 bp, Rattus norvegicus
gggttccctagagccatgaagtctg

SEQ ID NO: 461614 - DNA, 25 bp, Rattus norvegicus
gggttccctttgacaaactggcctg

SEQ ID NO: 461615 - DNA, 25 bp, Rattus norvegicus
gggttccctttgtcaaactggcctg

SEQ ID NO: 461616 - DNA, 25 bp, Rattus norvegicus
gggttccgaggaacacacaggtcat

SEQ ID NO: 461617 - DNA, 25 bp, Rattus norvegicus
gggttccgaggatcacacaggtcat

SEQ ID NO: 461618 - DNA, 25 bp, Rattus norvegicus
gggttccgcccgagatcagccagtg

SEQ ID NO: 461619 - DNA, 25 bp, Rattus norvegicus
gggttccgcccgtgatcagccagtg

SEQ ID NO: 461620 - DNA, 25 bp, Rattus norvegicus
gggttccgtagaagccaccagtaag

SEQ ID NO: 461621 - DNA, 25 bp, Rattus norvegicus
gggttccgtagatgccaccagtaag

SEQ ID NO: 461622 - DNA, 25 bp, Rattus norvegicus
gggttcctcaatcccaatggaagca

SEQ ID NO: 461623 - DNA, 25 bp, Rattus norvegicus
gggttcctcaatgccaatggaagca

SEQ ID NO: 461624 - DNA, 25 bp, Rattus norvegicus
gggttcctccacactgtggtaaact

SEQ ID NO: 461625 - DNA, 25 bp, Rattus norvegicus
gggttcctccactctgtggtaaact

SEQ ID NO: 461626 - DNA, 25 bp, Rattus norvegicus
gggttcctccgcaagttccgagcgc

SEQ ID NO: 461627 - DNA, 25 bp, Rattus norvegicus
gggttcctccgctagttccgagcgc

SEQ ID NO: 461628 - DNA, 25 bp, Rattus norvegicus
gggttcctctaaaaaggaccagcct

SEQ ID NO: 461629 - DNA, 25 bp, Rattus norvegicus
gggttcctctaataaggaccagcct

SEQ ID NO: 461630 - DNA, 25 bp, Rattus norvegicus
gggttcctcttgagttggtagccat

SEQ ID NO: 461631 - DNA, 25 bp, Rattus norvegicus
gggttcctcttgtgttggtagccat

SEQ ID NO: 461632 - DNA, 25 bp, Rattus norvegicus
gggttcctgcagaggctaggattaa

SEQ ID NO: 461633 - DNA, 25 bp, Rattus norvegicus
gggttcctgcagtggctaggattaa

SEQ ID NO: 461634 - DNA, 25 bp, Rattus norvegicus
gggttcctggagaatcagtctttcc

SEQ ID NO: 461635 - DNA, 25 bp, Rattus norvegicus
gggttcctggagtatcagtctttcc

SEQ ID NO: 461636 - DNA, 25 bp, Rattus norvegicus
gggttcctggcaacaggcctgaccc

SEQ ID NO: 461637 - DNA, 25 bp, Rattus norvegicus
gggttcctggcatcaggcctgaccc

SEQ ID NO: 461638 - DNA, 25 bp, Rattus norvegicus
gggttcctggtgaccaatgttttct

SEQ ID NO: 461639 - DNA, 25 bp, Rattus norvegicus
gggttcctggtgtccaatgttttct

SEQ ID NO: 461640 - DNA, 25 bp, Rattus norvegicus
gggttcctgtccagagactccaaag

SEQ ID NO: 461641 - DNA, 25 bp, Rattus norvegicus
gggttcctgtcctgagactccaaag

SEQ ID NO: 461642 - DNA, 25 bp, Rattus norvegicus
gggttcctgtcgctgaatcaagtcg

SEQ ID NO: 461643 - DNA, 25 bp, Rattus norvegicus
gggttcctgtcggtgaatcaagtcg

SEQ ID NO: 461644 - DNA, 25 bp, Rattus norvegicus
gggttcctgtctcactatctatcac

SEQ ID NO: 461645 - DNA, 25 bp, Rattus norvegicus
gggttcctgtctgactatctatcac

SEQ ID NO: 461646 - DNA, 25 bp, Rattus norvegicus
gggttcctgtggaaatctcatgatt

SEQ ID NO: 461647 - DNA, 25 bp, Rattus norvegicus
gggttcctgtggtaatctcatgatt

SEQ ID NO: 461648 - DNA, 25 bp, Rattus norvegicus
gggttccttcgtcacattacaactt

SEQ ID NO: 461649 - DNA, 25 bp, Rattus norvegicus
gggttccttcgtgacattacaactt

SEQ ID NO: 461650 - DNA, 25 bp, Rattus norvegicus
gggttcctttaaactgagcagctaa

SEQ ID NO: 461651 - DNA, 25 bp, Rattus norvegicus
gggttcctttaatctgagcagctaa

SEQ ID NO: 461652 - DNA, 25 bp, Rattus norvegicus
gggttcctttacatgtgtgggtaca

SEQ ID NO: 461653 - DNA, 25 bp, Rattus norvegicus
gggttcctttacttgtgtgggtaca

SEQ ID NO: 461654 - DNA, 25 bp, Rattus norvegicus
gggttcctttgtcgatagtatcctt

SEQ ID NO: 461655 - DNA, 25 bp, Rattus norvegicus
gggttcctttgtggatagtatcctt

SEQ ID NO: 461656 - DNA, 25 bp, Rattus norvegicus
gggttcgaacttaagaatcttgctt

SEQ ID NO: 461657 - DNA, 25 bp, Rattus norvegicus
gggttcgaactttagaatcttgctt

SEQ ID NO: 461658 - DNA, 25 bp, Rattus norvegicus
gggttcgaggaccagatcctcattc

SEQ ID NO: 461659 - DNA, 25 bp, Rattus norvegicus
gggttcgaggacgagatcctcattc

SEQ ID NO: 461660 - DNA, 25 bp, Rattus norvegicus
gggttcgatttacactgtgcctttc

SEQ ID NO: 461661 - DNA, 25 bp, Rattus norvegicus
gggttcgatttagactgtgcctttc

SEQ ID NO: 461662 - DNA, 25 bp, Rattus norvegicus
gggttcgccgacaggtatattttat

SEQ ID NO: 461663 - DNA, 25 bp, Rattus norvegicus
gggttcgccgactggtatattttat

SEQ ID NO: 461664 - DNA, 25 bp, Rattus norvegicus
gggttcgcctctatggaatcaacaa

SEQ ID NO: 461665 - DNA, 25 bp, Rattus norvegicus
gggttcgcctctttggaatcaacaa

SEQ ID NO: 461666 - DNA, 25 bp, Rattus norvegicus
gggttcgtctccaggttaagagcca

SEQ ID NO: 461667 - DNA, 25 bp, Rattus norvegicus
gggttcgtctcctggttaagagcca

SEQ ID NO: 461668 - DNA, 25 bp, Rattus norvegicus
gggttcgtgtccagcatcagctcac

SEQ ID NO: 461669 - DNA, 25 bp, Rattus norvegicus
gggttcgtgtcctgcatcagctcac

SEQ ID NO: 461670 - DNA, 25 bp, Rattus norvegicus
gggttctaatctcagtagcttacta

SEQ ID NO: 461671 - DNA, 25 bp, Rattus norvegicus
gggttctaatctgagtagcttacta

SEQ ID NO: 461672 - DNA, 25 bp, Rattus norvegicus
gggttctacccaagacagcagataa

SEQ ID NO: 461673 - DNA, 25 bp, Rattus norvegicus
gggttctacccatgacagcagataa

SEQ ID NO: 461674 - DNA, 25 bp, Rattus norvegicus
gggttctagactctatcttggtagt

SEQ ID NO: 461675 - DNA, 25 bp, Rattus norvegicus
gggttctagactgtatcttggtagt

SEQ ID NO: 461676 - DNA, 25 bp, Rattus norvegicus
gggttctagctgacaaactcagatt

SEQ ID NO: 461677 - DNA, 25 bp, Rattus norvegicus
gggttctagctgtcaaactcagatt

SEQ ID NO: 461678 - DNA, 25 bp, Rattus norvegicus
gggttctagtcaaaattctctcaac

SEQ ID NO: 461679 - DNA, 25 bp, Rattus norvegicus
gggttctagtcataattctctcaac

SEQ ID NO: 461680 - DNA, 25 bp, Rattus norvegicus
gggttctatcgccattaagtatttg

SEQ ID NO: 461681 - DNA, 25 bp, Rattus norvegicus
gggttctatcgcgattaagtatttg

SEQ ID NO: 461682 - DNA, 25 bp, Rattus norvegicus
gggttctatctaaccccagaggctg

SEQ ID NO: 461683 - DNA, 25 bp, Rattus norvegicus
gggttctatctatccccagaggctg

SEQ ID NO: 461684 - DNA, 25 bp, Rattus norvegicus
gggttctatcttcctccagaaacat

SEQ ID NO: 461685 - DNA, 25 bp, Rattus norvegicus
gggttctatcttgctccagaaacat

SEQ ID NO: 461686 - DNA, 25 bp, Rattus norvegicus
gggttctatgttattgaagcttcaa

SEQ ID NO: 461687 - DNA, 25 bp, Rattus norvegicus
gggttctatgtttttgaagcttcaa

SEQ ID NO: 461688 - DNA, 25 bp, Rattus norvegicus
gggttctcaaccactttggaatctt

SEQ ID NO: 461689 - DNA, 25 bp, Rattus norvegicus
gggttctcaacctctttggaatctt

SEQ ID NO: 461690 - DNA, 25 bp, Rattus norvegicus
gggttctcaaggatgcatttcgcac

SEQ ID NO: 461691 - DNA, 25 bp, Rattus norvegicus
gggttctcaaggttgcatttcgcac

SEQ ID NO: 461692 - DNA, 25 bp, Rattus norvegicus
gggttctcactgataactggctcat

SEQ ID NO: 461693 - DNA, 25 bp, Rattus norvegicus
gggttctcactgttaactggctcat

SEQ ID NO: 461694 - DNA, 25 bp, Rattus norvegicus
gggttctcacttataccacagacag

SEQ ID NO: 461695 - DNA, 25 bp, Rattus norvegicus
gggttctcacttttaccacagacag

SEQ ID NO: 461696 - DNA, 25 bp, Rattus norvegicus
gggttctcagccacttggatgtcag

SEQ ID NO: 461697 - DNA, 25 bp, Rattus norvegicus
gggttctcagcctcttggatgtcag

SEQ ID NO: 461698 - DNA, 25 bp, Rattus norvegicus
gggttctcatgactgccgtcacgtc

SEQ ID NO: 461699 - DNA, 25 bp, Rattus norvegicus
gggttctcatgagtgccgtcacgtc

SEQ ID NO: 461700 - DNA, 25 bp, Rattus norvegicus
gggttctcatgccagtgtctgaatc

SEQ ID NO: 461701 - DNA, 25 bp, Rattus norvegicus
gggttctcatgcgagtgtctgaatc

SEQ ID NO: 461702 - DNA, 25 bp, Rattus norvegicus
gggttctcatgtatcagccatcttc

SEQ ID NO: 461703 - DNA, 25 bp, Rattus norvegicus
gggttctcatgtttcagccatcttc

SEQ ID NO: 461704 - DNA, 25 bp, Rattus norvegicus
gggttctcccagactcgggctaagt

SEQ ID NO: 461705 - DNA, 25 bp, Rattus norvegicus
gggttctcccagtctcgggctaagt

SEQ ID NO: 461706 - DNA, 25 bp, Rattus norvegicus
gggttctcctgcatttagatagctc

SEQ ID NO: 461707 - DNA, 25 bp, Rattus norvegicus
gggttctcctgcttttagatagctc

SEQ ID NO: 461708 - DNA, 25 bp, Rattus norvegicus
gggttctctagactcactgggaaag

SEQ ID NO: 461709 - DNA, 25 bp, Rattus norvegicus
gggttctctagagtcactgggaaag

SEQ ID NO: 461710 - DNA, 25 bp, Rattus norvegicus
gggttctctgaaaccagtctacgta

SEQ ID NO: 461711 - DNA, 25 bp, Rattus norvegicus
gggttctctgaacccttagcattag

SEQ ID NO: 461712 - DNA, 25 bp, Rattus norvegicus
gggttctctgaagccttagcattag

SEQ ID NO: 461713 - DNA, 25 bp, Rattus norvegicus
gggttctctgaatccagtctacgta

SEQ ID NO: 461714 - DNA, 25 bp, Rattus norvegicus
gggttctctgtaatccatctagtgt

SEQ ID NO: 461715 - DNA, 25 bp, Rattus norvegicus
gggttctctgtattccatctagtgt

SEQ ID NO: 461716 - DNA, 25 bp, Rattus norvegicus
gggttctctgttccacctataaaga

SEQ ID NO: 461717 - DNA, 25 bp, Rattus norvegicus
gggttctctgttgcacctataaaga

SEQ ID NO: 461718 - DNA, 25 bp, Rattus norvegicus
gggttctcttggaattgccatatca

SEQ ID NO: 461719 - DNA, 25 bp, Rattus norvegicus
gggttctcttggtattgccatatca

SEQ ID NO: 461720 - DNA, 25 bp, Rattus norvegicus
gggttctgacctacgtcatgcttag

SEQ ID NO: 461721 - DNA, 25 bp, Rattus norvegicus
gggttctgaccttcgtcatgcttag

SEQ ID NO: 461722 - DNA, 25 bp, Rattus norvegicus
gggttctgcaaactttacagtattt

SEQ ID NO: 461723 - DNA, 25 bp, Rattus norvegicus
gggttctgcaaagtttacagtattt

SEQ ID NO: 461724 - DNA, 25 bp, Rattus norvegicus
gggttctgcatgacttttttattat

SEQ ID NO: 461725 - DNA, 25 bp, Rattus norvegicus
gggttctgcatgtcttttttattat

SEQ ID NO: 461726 - DNA, 25 bp, Rattus norvegicus
gggttctgccataccttgcatgtgc

SEQ ID NO: 461727 - DNA, 25 bp, Rattus norvegicus
gggttctgccattccttgcatgtgc

SEQ ID NO: 461728 - DNA, 25 bp, Rattus norvegicus
gggttctgccttaaaccatccaaat

SEQ ID NO: 461729 - DNA, 25 bp, Rattus norvegicus
gggttctgcctttaaccatccaaat

SEQ ID NO: 461730 - DNA, 25 bp, Rattus norvegicus
gggttctgcgctcagtatttcagag

SEQ ID NO: 461731 - DNA, 25 bp, Rattus norvegicus
gggttctgcgctgagtatttcagag

SEQ ID NO: 461732 - DNA, 25 bp, Rattus norvegicus
gggttctgctggacacaacttcttt

SEQ ID NO: 461733 - DNA, 25 bp, Rattus norvegicus
gggttctgctggtcacaacttcttt

SEQ ID NO: 461734 - DNA, 25 bp, Rattus norvegicus
gggttctgcttcagctttgacaaag

SEQ ID NO: 461735 - DNA, 25 bp, Rattus norvegicus
gggttctgcttctgctttgacaaag

SEQ ID NO: 461736 - DNA, 25 bp, Rattus norvegicus
gggttctggactagacaccaggaca

SEQ ID NO: 461737 - DNA, 25 bp, Rattus norvegicus
gggttctggacttgacaccaggaca

SEQ ID NO: 461738 - DNA, 25 bp, Rattus norvegicus
gggttctgggccataccattgtgca

SEQ ID NO: 461739 - DNA, 25 bp, Rattus norvegicus
gggttctgggccttaccattgtgca

SEQ ID NO: 461740 - DNA, 25 bp, Rattus norvegicus
gggttctgggtgaacaccactatgc

SEQ ID NO: 461741 - DNA, 25 bp, Rattus norvegicus
gggttctgggtgtacaccactatgc

SEQ ID NO: 461742 - DNA, 25 bp, Rattus norvegicus
gggttctgtacccagcaatgcattt

SEQ ID NO: 461743 - DNA, 25 bp, Rattus norvegicus
gggttctgtaccgagcaatgcattt

SEQ ID NO: 461744 - DNA, 25 bp, Rattus norvegicus
gggttctgtactcggcatccacagt

SEQ ID NO: 461745 - DNA, 25 bp, Rattus norvegicus
gggttctgtactgggcatccacagt

SEQ ID NO: 461746 - DNA, 25 bp, Rattus norvegicus
gggttctgtcctccatttttaagag

SEQ ID NO: 461747 - DNA, 25 bp, Rattus norvegicus
gggttctgtcctgcatttttaagag

SEQ ID NO: 461748 - DNA, 25 bp, Rattus norvegicus
gggttctgtgacaatttcacttcag

SEQ ID NO: 461749 - DNA, 25 bp, Rattus norvegicus
gggttctgtgactatttcacttcag

SEQ ID NO: 461750 - DNA, 25 bp, Rattus norvegicus
gggttcttaactacagctcaagctc

SEQ ID NO: 461751 - DNA, 25 bp, Rattus norvegicus
gggttcttaactattgcaatataat

SEQ ID NO: 461752 - DNA, 25 bp, Rattus norvegicus
gggttcttaacttcagctcaagctc

SEQ ID NO: 461753 - DNA, 25 bp, Rattus norvegicus
gggttcttaacttttgcaatataat

SEQ ID NO: 461754 - DNA, 25 bp, Rattus norvegicus
gggttcttcataattagactccgag

SEQ ID NO: 461755 - DNA, 25 bp, Rattus norvegicus
gggttcttcatatttagactccgag

SEQ ID NO: 461756 - DNA, 25 bp, Rattus norvegicus
gggttcttccacagatatctaattc

SEQ ID NO: 461757 - DNA, 25 bp, Rattus norvegicus
gggttcttccactgatatctaattc

SEQ ID NO: 461758 - DNA, 25 bp, Rattus norvegicus
gggttcttccagaggttagcacctg

SEQ ID NO: 461759 - DNA, 25 bp, Rattus norvegicus
gggttcttccagtggttagcacctg

SEQ ID NO: 461760 - DNA, 25 bp, Rattus norvegicus
gggttcttccttaattgctctctaa

SEQ ID NO: 461761 - DNA, 25 bp, Rattus norvegicus
gggttcttcctttattgctctctaa

SEQ ID NO: 461762 - DNA, 25 bp, Rattus norvegicus
gggttcttctcaagcacagatacag

SEQ ID NO: 461763 - DNA, 25 bp, Rattus norvegicus
gggttcttctcatgcacagatacag

SEQ ID NO: 461764 - DNA, 25 bp, Rattus norvegicus
gggttcttgacacaaggtccccttg

SEQ ID NO: 461765 - DNA, 25 bp, Rattus norvegicus
gggttcttgacagaaggtccccttg

SEQ ID NO: 461766 - DNA, 25 bp, Rattus norvegicus
gggttcttgccactgtgataacact

SEQ ID NO: 461767 - DNA, 25 bp, Rattus norvegicus
gggttcttgccagtgtgataacact

SEQ ID NO: 461768 - DNA, 25 bp, Rattus norvegicus
gggttcttgtctaggcttcagaaga

SEQ ID NO: 461769 - DNA, 25 bp, Rattus norvegicus
gggttcttgtcttggcttcagaaga

SEQ ID NO: 461770 - DNA, 25 bp, Rattus norvegicus
gggttcttgtttccaccaaatctgt

SEQ ID NO: 461771 - DNA, 25 bp, Rattus norvegicus
gggttcttgtttgcaccaaatctgt

SEQ ID NO: 461772 - DNA, 25 bp, Rattus norvegicus
gggttctttatgaaaatctcttctg

SEQ ID NO: 461773 - DNA, 25 bp, Rattus norvegicus
gggttctttatgtaaatctcttctg

SEQ ID NO: 461774 - DNA, 25 bp, Rattus norvegicus
gggttctttcctcccgtgtaatctt

SEQ ID NO: 461775 - DNA, 25 bp, Rattus norvegicus
gggttctttcctgccgtgtaatctt

SEQ ID NO: 461776 - DNA, 25 bp, Rattus norvegicus
gggttcttttaaatccaggcataca

SEQ ID NO: 461777 - DNA, 25 bp, Rattus norvegicus
gggttcttttaattccaggcataca

SEQ ID NO: 461778 - DNA, 25 bp, Rattus norvegicus
gggttcttttacagtacctgtcact

SEQ ID NO: 461779 - DNA, 25 bp, Rattus norvegicus
gggttcttttactgtacctgtcact

SEQ ID NO: 461780 - DNA, 25 bp, Rattus norvegicus
gggttcttttagaagctgcatgctc

SEQ ID NO: 461781 - DNA, 25 bp, Rattus norvegicus
gggttcttttagtagctgcatgctc

SEQ ID NO: 461782 - DNA, 25 bp, Rattus norvegicus
gggttgaaaacaacagatctactct

SEQ ID NO: 461783 - DNA, 25 bp, Rattus norvegicus
gggttgaaaacatcagatctactct

SEQ ID NO: 461784 - DNA, 25 bp, Rattus norvegicus
gggttgaacaacactttctcaggag

SEQ ID NO: 461785 - DNA, 25 bp, Rattus norvegicus
gggttgaacaactctttctcaggag

SEQ ID NO: 461786 - DNA, 25 bp, Rattus norvegicus
gggttgaactgaattggcttgtcat

SEQ ID NO: 461787 - DNA, 25 bp, Rattus norvegicus
gggttgaactgatttggcttgtcat

SEQ ID NO: 461788 - DNA, 25 bp, Rattus norvegicus
gggttgaagattcctctccatgcat

SEQ ID NO: 461789 - DNA, 25 bp, Rattus norvegicus
gggttgaagattgctctccatgcat

SEQ ID NO: 461790 - DNA, 25 bp, Rattus norvegicus
gggttgaagtgccttttggactcat

SEQ ID NO: 461791 - DNA, 25 bp, Rattus norvegicus
gggttgaagtgcgttttggactcat

SEQ ID NO: 461792 - DNA, 25 bp, Rattus norvegicus
gggttgaatctccagtaatctgtaa

SEQ ID NO: 461793 - DNA, 25 bp, Rattus norvegicus
gggttgaatctcgagtaatctgtaa

SEQ ID NO: 461794 - DNA, 25 bp, Rattus norvegicus
gggttgaatgtgatactgcaggcca

SEQ ID NO: 461795 - DNA, 25 bp, Rattus norvegicus
gggttgaatgtgttactgcaggcca

SEQ ID NO: 461796 - DNA, 25 bp, Rattus norvegicus
gggttgacaaacatacaatgagcca

SEQ ID NO: 461797 - DNA, 25 bp, Rattus norvegicus
gggttgacaaacttacaatgagcca

SEQ ID NO: 461798 - DNA, 25 bp, Rattus norvegicus
gggttgacagtgacctttcgagtgt

SEQ ID NO: 461799 - DNA, 25 bp, Rattus norvegicus
gggttgacagtgtcctttcgagtgt

SEQ ID NO: 461800 - DNA, 25 bp, Rattus norvegicus
gggttgaccaaacacccattgtcag

SEQ ID NO: 461801 - DNA, 25 bp, Rattus norvegicus
gggttgaccaaagacccattgtcag

SEQ ID NO: 461802 - DNA, 25 bp, Rattus norvegicus
gggttgaccataactcaagttccag

SEQ ID NO: 461803 - DNA, 25 bp, Rattus norvegicus
gggttgaccatatctcaagttccag

SEQ ID NO: 461804 - DNA, 25 bp, Rattus norvegicus
gggttgacccacactaggcgaaact

SEQ ID NO: 461805 - DNA, 25 bp, Rattus norvegicus
gggttgacccactctaggcgaaact

SEQ ID NO: 461806 - DNA, 25 bp, Rattus norvegicus
gggttgacgagcaccccagtaacat

SEQ ID NO: 461807 - DNA, 25 bp, Rattus norvegicus
gggttgacgagctccccagtaacat

SEQ ID NO: 461808 - DNA, 25 bp, Rattus norvegicus
gggttgacgccccacgccttacgtg

SEQ ID NO: 461809 - DNA, 25 bp, Rattus norvegicus
gggttgacgcccgacgccttacgtg

SEQ ID NO: 461810 - DNA, 25 bp, Rattus norvegicus
gggttgacggtgataagccctctca

SEQ ID NO: 461811 - DNA, 25 bp, Rattus norvegicus
gggttgacggtgttaagccctctca

SEQ ID NO: 461812 - DNA, 25 bp, Rattus norvegicus
gggttgacttaacgctctaatttat

SEQ ID NO: 461813 - DNA, 25 bp, Rattus norvegicus
gggttgacttaaggctctaatttat

SEQ ID NO: 461814 - DNA, 25 bp, Rattus norvegicus
gggttgacttctaactcagtggact

SEQ ID NO: 461815 - DNA, 25 bp, Rattus norvegicus
gggttgacttcttactcagtggact

SEQ ID NO: 461816 - DNA, 25 bp, Rattus norvegicus
gggttgactttgaatcagatctgtt

SEQ ID NO: 461817 - DNA, 25 bp, Rattus norvegicus
gggttgactttgtatcagatctgtt

SEQ ID NO: 461818 - DNA, 25 bp, Rattus norvegicus
gggttgagaaatagccacccttcaa

SEQ ID NO: 461819 - DNA, 25 bp, Rattus norvegicus
gggttgagaaattgccacccttcaa

SEQ ID NO: 461820 - DNA, 25 bp, Rattus norvegicus
gggttgagagaaacctccatcctcc

SEQ ID NO: 461821 - DNA, 25 bp, Rattus norvegicus
gggttgagagaatcctccatcctcc

SEQ ID NO: 461822 - DNA, 25 bp, Rattus norvegicus
gggttgaggacccttctcatctcat

SEQ ID NO: 461823 - DNA, 25 bp, Rattus norvegicus
gggttgaggaccgttctcatctcat

SEQ ID NO: 461824 - DNA, 25 bp, Rattus norvegicus
gggttgaggccgaactgtctgcatc

SEQ ID NO: 461825 - DNA, 25 bp, Rattus norvegicus
gggttgaggccgtactgtctgcatc

SEQ ID NO: 461826 - DNA, 25 bp, Rattus norvegicus
gggttgagtgctaacttacaataga

SEQ ID NO: 461827 - DNA, 25 bp, Rattus norvegicus
gggttgagtgcttacttacaataga

SEQ ID NO: 461828 - DNA, 25 bp, Rattus norvegicus
gggttgatgtcaagactacactgat

SEQ ID NO: 461829 - DNA, 25 bp, Rattus norvegicus
gggttgatgtcatgactacactgat

SEQ ID NO: 461830 - DNA, 25 bp, Rattus norvegicus
gggttgatttacaagctccagccac

SEQ ID NO: 461831 - DNA, 25 bp, Rattus norvegicus
gggttgatttactagctccagccac

SEQ ID NO: 461832 - DNA, 25 bp, Rattus norvegicus
gggttgcaatctccaagttgatctt

SEQ ID NO: 461833 - DNA, 25 bp, Rattus norvegicus
gggttgcaatctgcaagttgatctt

SEQ ID NO: 461834 - DNA, 25 bp, Rattus norvegicus
gggttgcaccaacagcatgctccaa

SEQ ID NO: 461835 - DNA, 25 bp, Rattus norvegicus
gggttgcaccaagagcatgctccaa

SEQ ID NO: 461836 - DNA, 25 bp, Rattus norvegicus
gggttgcaccatatgacatgaccaa

SEQ ID NO: 461837 - DNA, 25 bp, Rattus norvegicus
gggttgcaccatttgacatgaccaa

SEQ ID NO: 461838 - DNA, 25 bp, Rattus norvegicus
gggttgcacctgacgcatgtacttt

SEQ ID NO: 461839 - DNA, 25 bp, Rattus norvegicus
gggttgcacctgtcgcatgtacttt

SEQ ID NO: 461840 - DNA, 25 bp, Rattus norvegicus
gggttgcaggctacacacatgagca

SEQ ID NO: 461841 - DNA, 25 bp, Rattus norvegicus
gggttgcaggcttcacacatgagca

SEQ ID NO: 461842 - DNA, 25 bp, Rattus norvegicus
gggttgcagtacattcttaataagt

SEQ ID NO: 461843 - DNA, 25 bp, Rattus norvegicus
gggttgcagtactttcttaataagt

SEQ ID NO: 461844 - DNA, 25 bp, Rattus norvegicus
gggttgcagtccatttcattagatc

SEQ ID NO: 461845 - DNA, 25 bp, Rattus norvegicus
gggttgcagtccttttcattagatc

SEQ ID NO: 461846 - DNA, 25 bp, Rattus norvegicus
gggttgcatactatattcccttcaa

SEQ ID NO: 461847 - DNA, 25 bp, Rattus norvegicus
gggttgcatactttattcccttcaa

SEQ ID NO: 461848 - DNA, 25 bp, Rattus norvegicus
gggttgcatcttatttcagctatta

SEQ ID NO: 461849 - DNA, 25 bp, Rattus norvegicus
gggttgcatcttttttcagctatta

SEQ ID NO: 461850 - DNA, 25 bp, Rattus norvegicus
gggttgcatgttactccctaacacg

SEQ ID NO: 461851 - DNA, 25 bp, Rattus norvegicus
gggttgcatgtttctccctaacacg

SEQ ID NO: 461852 - DNA, 25 bp, Rattus norvegicus
gggttgcattttaatatagtcagta

SEQ ID NO: 461853 - DNA, 25 bp, Rattus norvegicus
gggttgcatttttatatagtcagta

SEQ ID NO: 461854 - DNA, 25 bp, Rattus norvegicus
gggttgccaatcaagctgctaatca

SEQ ID NO: 461855 - DNA, 25 bp, Rattus norvegicus
gggttgccaatctagctgctaatca

SEQ ID NO: 461856 - DNA, 25 bp, Rattus norvegicus
gggttgccaccacggctgcggcggg

SEQ ID NO: 461857 - DNA, 25 bp, Rattus norvegicus
gggttgccaccagggctgcggcggg

SEQ ID NO: 461858 - DNA, 25 bp, Rattus norvegicus
gggttgccagagatctgcagctctt

SEQ ID NO: 461859 - DNA, 25 bp, Rattus norvegicus
gggttgccagagttctgcagctctt

SEQ ID NO: 461860 - DNA, 25 bp, Rattus norvegicus
gggttgccatggaagcccatgactg

SEQ ID NO: 461861 - DNA, 25 bp, Rattus norvegicus
gggttgccatggtagcccatgactg

SEQ ID NO: 461862 - DNA, 25 bp, Rattus norvegicus
gggttgccatgtacagtgagattta

SEQ ID NO: 461863 - DNA, 25 bp, Rattus norvegicus
gggttgccatgttcagtgagattta

SEQ ID NO: 461864 - DNA, 25 bp, Rattus norvegicus
gggttgcctaaaactgcactttact

SEQ ID NO: 461865 - DNA, 25 bp, Rattus norvegicus
gggttgcctaaatctgcactttact

SEQ ID NO: 461866 - DNA, 25 bp, Rattus norvegicus
gggttgcctagtctacataacaact

SEQ ID NO: 461867 - DNA, 25 bp, Rattus norvegicus
gggttgcctagtgtacataacaact

SEQ ID NO: 461868 - DNA, 25 bp, Rattus norvegicus
gggttgcctcttacagaacactacc

SEQ ID NO: 461869 - DNA, 25 bp, Rattus norvegicus
gggttgcctctttcagaacactacc

SEQ ID NO: 461870 - DNA, 25 bp, Rattus norvegicus
gggttgccttcacaatacagcctga

SEQ ID NO: 461871 - DNA, 25 bp, Rattus norvegicus
gggttgccttcagaatacagcctga

SEQ ID NO: 461872 - DNA, 25 bp, Rattus norvegicus
gggttgcgataacttcatccacaga

SEQ ID NO: 461873 - DNA, 25 bp, Rattus norvegicus
gggttgcgataagttcatccacaga

SEQ ID NO: 461874 - DNA, 25 bp, Rattus norvegicus
gggttgctaggaatttgctcctgct

SEQ ID NO: 461875 - DNA, 25 bp, Rattus norvegicus
gggttgctaggattttgctcctgct

SEQ ID NO: 461876 - DNA, 25 bp, Rattus norvegicus
gggttgctcaaaagtgcagtgtgtc

SEQ ID NO: 461877 - DNA, 25 bp, Rattus norvegicus
gggttgctcaaatgtgcagtgtgtc

SEQ ID NO: 461878 - DNA, 25 bp, Rattus norvegicus
gggttgctcactcaggacctaactg

SEQ ID NO: 461879 - DNA, 25 bp, Rattus norvegicus
gggttgctcactgaggacctaactg

SEQ ID NO: 461880 - DNA, 25 bp, Rattus norvegicus
gggttgctccaccttgcagaaaaat

SEQ ID NO: 461881 - DNA, 25 bp, Rattus norvegicus
gggttgctccacgttgcagaaaaat

SEQ ID NO: 461882 - DNA, 25 bp, Rattus norvegicus
gggttgctctctacattgcaaagga

SEQ ID NO: 461883 - DNA, 25 bp, Rattus norvegicus
gggttgctctcttcattgcaaagga

SEQ ID NO: 461884 - DNA, 25 bp, Rattus norvegicus
gggttgctctggatgactgacgccc

SEQ ID NO: 461885 - DNA, 25 bp, Rattus norvegicus
gggttgctctggttgactgacgccc

SEQ ID NO: 461886 - DNA, 25 bp, Rattus norvegicus
gggttgctctttataatgcttttgg

SEQ ID NO: 461887 - DNA, 25 bp, Rattus norvegicus
gggttgctctttttaatgcttttgg

SEQ ID NO: 461888 - DNA, 25 bp, Rattus norvegicus
gggttgctgactcattgtgccatga

SEQ ID NO: 461889 - DNA, 25 bp, Rattus norvegicus
gggttgctgactgattgtgccatga

SEQ ID NO: 461890 - DNA, 25 bp, Rattus norvegicus
gggttgctgcccataaatcttattt

SEQ ID NO: 461891 - DNA, 25 bp, Rattus norvegicus
gggttgctgcccttaaatcttattt

SEQ ID NO: 461892 - DNA, 25 bp, Rattus norvegicus
gggttgctgcttccagtctgtagaa

SEQ ID NO: 461893 - DNA, 25 bp, Rattus norvegicus
gggttgctgcttgcagtctgtagaa

SEQ ID NO: 461894 - DNA, 25 bp, Rattus norvegicus
gggttgctggtaatttatctttgta

SEQ ID NO: 461895 - DNA, 25 bp, Rattus norvegicus
gggttgctggtattttatctttgta

SEQ ID NO: 461896 - DNA, 25 bp, Rattus norvegicus
gggttgctgtacctctgtaatcaga

SEQ ID NO: 461897 - DNA, 25 bp, Rattus norvegicus
gggttgctgtacgtctgtaatcaga

SEQ ID NO: 461898 - DNA, 25 bp, Rattus norvegicus
gggttgcttcggctgctgctcactt

SEQ ID NO: 461899 - DNA, 25 bp, Rattus norvegicus
gggttgcttcgggtgctgctcactt

SEQ ID NO: 461900 - DNA, 25 bp, Rattus norvegicus
gggttgcttctcaatttattgacag

SEQ ID NO: 461901 - DNA, 25 bp, Rattus norvegicus
gggttgcttctctatttattgacag

SEQ ID NO: 461902 - DNA, 25 bp, Rattus norvegicus
gggttgcttgaaagattgtcaccaa

SEQ ID NO: 461903 - DNA, 25 bp, Rattus norvegicus
gggttgcttgaatgattgtcaccaa

SEQ ID NO: 461904 - DNA, 25 bp, Rattus norvegicus
gggttgctttgcattgcaaatacta

SEQ ID NO: 461905 - DNA, 25 bp, Rattus norvegicus
gggttgctttgctttgcaaatacta

SEQ ID NO: 461906 - DNA, 25 bp, Rattus norvegicus
gggttggaaactaccatggctacta

SEQ ID NO: 461907 - DNA, 25 bp, Rattus norvegicus
gggttggaaacttccatggctacta

SEQ ID NO: 461908 - DNA, 25 bp, Rattus norvegicus
gggttggaacgacctgcttttgttt

SEQ ID NO: 461909 - DNA, 25 bp, Rattus norvegicus
gggttggaacgagctgcttttgttt

SEQ ID NO: 461910 - DNA, 25 bp, Rattus norvegicus
gggttggaatggatgcctctgcact

SEQ ID NO: 461911 - DNA, 25 bp, Rattus norvegicus
gggttggaatggttgcctctgcact

SEQ ID NO: 461912 - DNA, 25 bp, Rattus norvegicus
gggttggagtcacagtcccctgccc

SEQ ID NO: 461913 - DNA, 25 bp, Rattus norvegicus
gggttggagtcagagtcccctgccc

SEQ ID NO: 461914 - DNA, 25 bp, Rattus norvegicus
gggttggatagcatccgagcgccca

SEQ ID NO: 461915 - DNA, 25 bp, Rattus norvegicus
gggttggatagcttccgagcgccca

SEQ ID NO: 461916 - DNA, 25 bp, Rattus norvegicus
gggttggccctcagaacacgagctt

SEQ ID NO: 461917 - DNA, 25 bp, Rattus norvegicus
gggttggccctctgaacacgagctt

SEQ ID NO: 461918 - DNA, 25 bp, Rattus norvegicus
gggttggcgtaccttttcattgcct

SEQ ID NO: 461919 - DNA, 25 bp, Rattus norvegicus
gggttggcgtacgttttcattgcct

SEQ ID NO: 461920 - DNA, 25 bp, Rattus norvegicus
gggttggctaatctggacagacttc

SEQ ID NO: 461921 - DNA, 25 bp, Rattus norvegicus
gggttggctaatgtggacagacttc

SEQ ID NO: 461922 - DNA, 25 bp, Rattus norvegicus
gggttggctcctaataggtcaatca

SEQ ID NO: 461923 - DNA, 25 bp, Rattus norvegicus
gggttggctccttataggtcaatca

SEQ ID NO: 461924 - DNA, 25 bp, Rattus norvegicus
gggttggctgatcgtcatttctact

SEQ ID NO: 461925 - DNA, 25 bp, Rattus norvegicus
gggttggctgatggtcatttctact

SEQ ID NO: 461926 - DNA, 25 bp, Rattus norvegicus
gggttggctttaatacaccattact

SEQ ID NO: 461927 - DNA, 25 bp, Rattus norvegicus
gggttggctttacctgacctgctac

SEQ ID NO: 461928 - DNA, 25 bp, Rattus norvegicus
gggttggctttagctgacctgctac

SEQ ID NO: 461929 - DNA, 25 bp, Rattus norvegicus
gggttggctttattacaccattact

SEQ ID NO: 461930 - DNA, 25 bp, Rattus norvegicus
gggttgggccacaagcacacaatgc

SEQ ID NO: 461931 - DNA, 25 bp, Rattus norvegicus
gggttgggccactagcacacaatgc

SEQ ID NO: 461932 - DNA, 25 bp, Rattus norvegicus
gggttgggtttcaatagccaccatt

SEQ ID NO: 461933 - DNA, 25 bp, Rattus norvegicus
gggttgggtttctatagccaccatt

SEQ ID NO: 461934 - DNA, 25 bp, Rattus norvegicus
gggttggtccacacaatacactcaa

SEQ ID NO: 461935 - DNA, 25 bp, Rattus norvegicus
gggttggtccactcaatacactcaa

SEQ ID NO: 461936 - DNA, 25 bp, Rattus norvegicus
gggttggtcctcctatagaagctga

SEQ ID NO: 461937 - DNA, 25 bp, Rattus norvegicus
gggttggtcctcgtatagaagctga

SEQ ID NO: 461938 - DNA, 25 bp, Rattus norvegicus
gggttggtctacagctctgcatttc

SEQ ID NO: 461939 - DNA, 25 bp, Rattus norvegicus
gggttggtctactgctctgcatttc

SEQ ID NO: 461940 - DNA, 25 bp, Rattus norvegicus
gggttggtgacaagctgcacgtaaa

SEQ ID NO: 461941 - DNA, 25 bp, Rattus norvegicus
gggttggtgacatgctgcacgtaaa

SEQ ID NO: 461942 - DNA, 25 bp, Rattus norvegicus
gggttggtggcacagtttttatcca

SEQ ID NO: 461943 - DNA, 25 bp, Rattus norvegicus
gggttggtggcagagtttttatcca

SEQ ID NO: 461944 - DNA, 25 bp, Rattus norvegicus
gggttggttctcatgtatcattttt

SEQ ID NO: 461945 - DNA, 25 bp, Rattus norvegicus
gggttggttctcttgtatcattttt

SEQ ID NO: 461946 - DNA, 25 bp, Rattus norvegicus
gggttggttgtcactcacacgccag

SEQ ID NO: 461947 - DNA, 25 bp, Rattus norvegicus
gggttggttgtctctcacacgccag

SEQ ID NO: 461948 - DNA, 25 bp, Rattus norvegicus
gggttggtttacacttgcacatact

SEQ ID NO: 461949 - DNA, 25 bp, Rattus norvegicus
gggttggtttactcttgcacatact

SEQ ID NO: 461950 - DNA, 25 bp, Rattus norvegicus
gggttgtacatgacccattgtaaaa

SEQ ID NO: 461951 - DNA, 25 bp, Rattus norvegicus
gggttgtacatgtcccattgtaaaa

SEQ ID NO: 461952 - DNA, 25 bp, Rattus norvegicus
gggttgtaccaaatgctagttgcac

SEQ ID NO: 461953 - DNA, 25 bp, Rattus norvegicus
gggttgtaccaattgctagttgcac

SEQ ID NO: 461954 - DNA, 25 bp, Rattus norvegicus
gggttgtatgaacctgtcagatatt

SEQ ID NO: 461955 - DNA, 25 bp, Rattus norvegicus
gggttgtatgaagctgtcagatatt

SEQ ID NO: 461956 - DNA, 25 bp, Rattus norvegicus
gggttgtatgtaagagagttcacac

SEQ ID NO: 461957 - DNA, 25 bp, Rattus norvegicus
gggttgtatgtatgagagttcacac

SEQ ID NO: 461958 - DNA, 25 bp, Rattus norvegicus
gggttgtcaactctgctgacatcta

SEQ ID NO: 461959 - DNA, 25 bp, Rattus norvegicus
gggttgtcaactgtgctgacatcta

SEQ ID NO: 461960 - DNA, 25 bp, Rattus norvegicus
gggttgtcaatgcatatctcaaatc

SEQ ID NO: 461961 - DNA, 25 bp, Rattus norvegicus
gggttgtcaatggatatctcaaatc

SEQ ID NO: 461962 - DNA, 25 bp, Rattus norvegicus
gggttgtcacacagcctattgcaag

SEQ ID NO: 461963 - DNA, 25 bp, Rattus norvegicus
gggttgtcacactgcctattgcaag

SEQ ID NO: 461964 - DNA, 25 bp, Rattus norvegicus
gggttgtcacataattttccttagt

SEQ ID NO: 461965 - DNA, 25 bp, Rattus norvegicus
gggttgtcacattattttccttagt

SEQ ID NO: 461966 - DNA, 25 bp, Rattus norvegicus
gggttgtcccctcacatttatatgt

SEQ ID NO: 461967 - DNA, 25 bp, Rattus norvegicus
gggttgtcccctgacatttatatgt

SEQ ID NO: 461968 - DNA, 25 bp, Rattus norvegicus
gggttgtccgtcacagggattactc

SEQ ID NO: 461969 - DNA, 25 bp, Rattus norvegicus
gggttgtccgtctcagggattactc

SEQ ID NO: 461970 - DNA, 25 bp, Rattus norvegicus
gggttgtcctctctactagggtagc

SEQ ID NO: 461971 - DNA, 25 bp, Rattus norvegicus
gggttgtcctctgtactagggtagc

SEQ ID NO: 461972 - DNA, 25 bp, Rattus norvegicus
gggttgtccttgagttcatactgag

SEQ ID NO: 461973 - DNA, 25 bp, Rattus norvegicus
gggttgtccttgtgttcatactgag

SEQ ID NO: 461974 - DNA, 25 bp, Rattus norvegicus
gggttgtcgccgcagccccagggcg

SEQ ID NO: 461975 - DNA, 25 bp, Rattus norvegicus
gggttgtcgccggagccccagggcg

SEQ ID NO: 461976 - DNA, 25 bp, Rattus norvegicus
gggttgtctactaaggtcagcctcc

SEQ ID NO: 461977 - DNA, 25 bp, Rattus norvegicus
gggttgtctacttaggtcagcctcc

SEQ ID NO: 461978 - DNA, 25 bp, Rattus norvegicus
gggttgtcttcaatttgcttttatt

SEQ ID NO: 461979 - DNA, 25 bp, Rattus norvegicus
gggttgtcttcattttgcttttatt

SEQ ID NO: 461980 - DNA, 25 bp, Rattus norvegicus
gggttgtcttctcaataaggcatgt

SEQ ID NO: 461981 - DNA, 25 bp, Rattus norvegicus
gggttgtcttctgaataaggcatgt

SEQ ID NO: 461982 - DNA, 25 bp, Rattus norvegicus
gggttgtgccttacctcaggagcca

SEQ ID NO: 461983 - DNA, 25 bp, Rattus norvegicus
gggttgtgcctttcctcaggagcca

SEQ ID NO: 461984 - DNA, 25 bp, Rattus norvegicus
gggttgtgctatactgtaacactaa

SEQ ID NO: 461985 - DNA, 25 bp, Rattus norvegicus
gggttgtgctattctgtaacactaa

SEQ ID NO: 461986 - DNA, 25 bp, Rattus norvegicus
gggttgtggaccaggctggatgagc

SEQ ID NO: 461987 - DNA, 25 bp, Rattus norvegicus
gggttgtggacctggctggatgagc

SEQ ID NO: 461988 - DNA, 25 bp, Rattus norvegicus
gggttgtggagcacacgctgcttca

SEQ ID NO: 461989 - DNA, 25 bp, Rattus norvegicus
gggttgtggagctcacgctgcttca

SEQ ID NO: 461990 - DNA, 25 bp, Rattus norvegicus
gggttgtgggatatcctgtagactt

SEQ ID NO: 461991 - DNA, 25 bp, Rattus norvegicus
gggttgtgggatttcctgtagactt

SEQ ID NO: 461992 - DNA, 25 bp, Rattus norvegicus
gggttgtggtgtatctgtcgcctaa

SEQ ID NO: 461993 - DNA, 25 bp, Rattus norvegicus
gggttgtggtgtttctgtcgcctaa

SEQ ID NO: 461994 - DNA, 25 bp, Rattus norvegicus
gggttgttaaccctctactgcatgg

SEQ ID NO: 461995 - DNA, 25 bp, Rattus norvegicus
gggttgttaaccgtctactgcatgg

SEQ ID NO: 461996 - DNA, 25 bp, Rattus norvegicus
gggttgttaattacagtcctgtagt

SEQ ID NO: 461997 - DNA, 25 bp, Rattus norvegicus
gggttgttaatttcagtcctgtagt

SEQ ID NO: 461998 - DNA, 25 bp, Rattus norvegicus
gggttgttcactcacactaaatatt

SEQ ID NO: 461999 - DNA, 25 bp, Rattus norvegicus
gggttgttcactgacactaaatatt

SEQ ID NO: 462000 - DNA, 25 bp, Rattus norvegicus
gggttgttctagaggttctgtttct

SEQ ID NO: 462001 - DNA, 25 bp, Rattus norvegicus
gggttgttctagtggttctgtttct

SEQ ID NO: 462002 - DNA, 25 bp, Rattus norvegicus
gggttgtttcttatgtgatcttcag

SEQ ID NO: 462003 - DNA, 25 bp, Rattus norvegicus
gggttgtttcttttgtgatcttcag

SEQ ID NO: 462004 - DNA, 25 bp, Rattus norvegicus
gggttgtttgtgattgattcccaag

SEQ ID NO: 462005 - DNA, 25 bp, Rattus norvegicus
gggttgtttgtgtttgattcccaag

SEQ ID NO: 462006 - DNA, 25 bp, Rattus norvegicus
gggtttaaatctcaggtcagcagcc

SEQ ID NO: 462007 - DNA, 25 bp, Rattus norvegicus
gggtttaaatctgaggtcagcagcc

SEQ ID NO: 462008 - DNA, 25 bp, Rattus norvegicus
gggtttaactgtactcactcagcag

SEQ ID NO: 462009 - DNA, 25 bp, Rattus norvegicus
gggtttaactgttctcactcagcag

SEQ ID NO: 462010 - DNA, 25 bp, Rattus norvegicus
gggtttaagatcacaccatcccatg

SEQ ID NO: 462011 - DNA, 25 bp, Rattus norvegicus
gggtttaagatctcaccatcccatg

SEQ ID NO: 462012 - DNA, 25 bp, Rattus norvegicus
gggtttaatcatctgcacaattgtg

SEQ ID NO: 462013 - DNA, 25 bp, Rattus norvegicus
gggtttaatcatgtgcacaattgtg

SEQ ID NO: 462014 - DNA, 25 bp, Rattus norvegicus
gggtttaatctcatcagagctgcac

SEQ ID NO: 462015 - DNA, 25 bp, Rattus norvegicus
gggtttaatctcttcagagctgcac

SEQ ID NO: 462016 - DNA, 25 bp, Rattus norvegicus
gggtttaattgcatgactaccattt

SEQ ID NO: 462017 - DNA, 25 bp, Rattus norvegicus
gggtttaattgcttgactaccattt

SEQ ID NO: 462018 - DNA, 25 bp, Rattus norvegicus
gggtttacacacctggctgctagac

SEQ ID NO: 462019 - DNA, 25 bp, Rattus norvegicus
gggtttacacacgtggctgctagac

SEQ ID NO: 462020 - DNA, 25 bp, Rattus norvegicus
gggtttacacatcggcagaccaaac

SEQ ID NO: 462021 - DNA, 25 bp, Rattus norvegicus
gggtttacacatgggcagaccaaac

SEQ ID NO: 462022 - DNA, 25 bp, Rattus norvegicus
gggtttacagcaagcttgatttctc

SEQ ID NO: 462023 - DNA, 25 bp, Rattus norvegicus
gggtttacagcatgcttgatttctc

SEQ ID NO: 462024 - DNA, 25 bp, Rattus norvegicus
gggtttacagcccatccgtgctgtt

SEQ ID NO: 462025 - DNA, 25 bp, Rattus norvegicus
gggtttacagccgatccgtgctgtt

SEQ ID NO: 462026 - DNA, 25 bp, Rattus norvegicus
gggtttacatcaaagcacgttgttt

SEQ ID NO: 462027 - DNA, 25 bp, Rattus norvegicus
gggtttacatcatagcacgttgttt

SEQ ID NO: 462028 - DNA, 25 bp, Rattus norvegicus
gggtttaccccaaatggagctgcag

SEQ ID NO: 462029 - DNA, 25 bp, Rattus norvegicus
gggtttaccccatatggagctgcag

SEQ ID NO: 462030 - DNA, 25 bp, Rattus norvegicus
gggtttaccctgagcatttcaaatg

SEQ ID NO: 462031 - DNA, 25 bp, Rattus norvegicus
gggtttaccctgtgcatttcaaatg

SEQ ID NO: 462032 - DNA, 25 bp, Rattus norvegicus
gggtttaccgaaagtgctctcttag

SEQ ID NO: 462033 - DNA, 25 bp, Rattus norvegicus
gggtttaccgaatgtgctctcttag

SEQ ID NO: 462034 - DNA, 25 bp, Rattus norvegicus
gggtttactgggatctcacttcaaa

SEQ ID NO: 462035 - DNA, 25 bp, Rattus norvegicus
gggtttactgggttctcacttcaaa

SEQ ID NO: 462036 - DNA, 25 bp, Rattus norvegicus
gggtttacttctcagacagactcta

SEQ ID NO: 462037 - DNA, 25 bp, Rattus norvegicus
gggtttacttctgagacagactcta

SEQ ID NO: 462038 - DNA, 25 bp, Rattus norvegicus
gggtttagctatagcttacctgctt

SEQ ID NO: 462039 - DNA, 25 bp, Rattus norvegicus
gggtttagctattgcttacctgctt

SEQ ID NO: 462040 - DNA, 25 bp, Rattus norvegicus
gggtttagggataggcacttccaga

SEQ ID NO: 462041 - DNA, 25 bp, Rattus norvegicus
gggtttagggattggcacttccaga

SEQ ID NO: 462042 - DNA, 25 bp, Rattus norvegicus
gggtttaggtacatcactgattaca

SEQ ID NO: 462043 - DNA, 25 bp, Rattus norvegicus
gggtttaggtacttcactgattaca

SEQ ID NO: 462044 - DNA, 25 bp, Rattus norvegicus
gggtttataaaaagtcaacagcagc

SEQ ID NO: 462045 - DNA, 25 bp, Rattus norvegicus
gggtttataaaatgtcaacagcagc

SEQ ID NO: 462046 - DNA, 25 bp, Rattus norvegicus
gggtttataaacacctacctcgcag

SEQ ID NO: 462047 - DNA, 25 bp, Rattus norvegicus
gggtttataaactcctacctcgcag

SEQ ID NO: 462048 - DNA, 25 bp, Rattus norvegicus
gggtttataacaacctttcgttgct

SEQ ID NO: 462049 - DNA, 25 bp, Rattus norvegicus
gggtttataacatcctttcgttgct

SEQ ID NO: 462050 - DNA, 25 bp, Rattus norvegicus
gggtttatccaaacatgagaattct

SEQ ID NO: 462051 - DNA, 25 bp, Rattus norvegicus
gggtttatccaatcatgagaattct

SEQ ID NO: 462052 - DNA, 25 bp, Rattus norvegicus
gggtttatgctcaatctgtgttcta

SEQ ID NO: 462053 - DNA, 25 bp, Rattus norvegicus
gggtttatgctctatctgtgttcta

SEQ ID NO: 462054 - DNA, 25 bp, Rattus norvegicus
gggtttatgtcaactgactgccatg

SEQ ID NO: 462055 - DNA, 25 bp, Rattus norvegicus
gggtttatgtcatctgactgccatg

SEQ ID NO: 462056 - DNA, 25 bp, Rattus norvegicus
gggtttattcacatgcaggtttgga

SEQ ID NO: 462057 - DNA, 25 bp, Rattus norvegicus
gggtttattcacttgcaggtttgga

SEQ ID NO: 462058 - DNA, 25 bp, Rattus norvegicus
gggtttattctcaagctacatcccc

SEQ ID NO: 462059 - DNA, 25 bp, Rattus norvegicus
gggtttattctctagctacatcccc

SEQ ID NO: 462060 - DNA, 25 bp, Rattus norvegicus
gggtttattttcatctcacatctgt

SEQ ID NO: 462061 - DNA, 25 bp, Rattus norvegicus
gggtttattttcttctcacatctgt

SEQ ID NO: 462062 - DNA, 25 bp, Rattus norvegicus
gggtttcaacttaggtatgcctgaa

SEQ ID NO: 462063 - DNA, 25 bp, Rattus norvegicus
gggtttcaactttggtatgcctgaa

SEQ ID NO: 462064 - DNA, 25 bp, Rattus norvegicus
gggtttcaatgaaggctttacataa

SEQ ID NO: 462065 - DNA, 25 bp, Rattus norvegicus
gggtttcaatgatggctttacataa

SEQ ID NO: 462066 - DNA, 25 bp, Rattus norvegicus
gggtttcaatgtattccagtgacct

SEQ ID NO: 462067 - DNA, 25 bp, Rattus norvegicus
gggtttcaatgttttccagtgacct

SEQ ID NO: 462068 - DNA, 25 bp, Rattus norvegicus
gggtttcaattgaatctgttatgtt

SEQ ID NO: 462069 - DNA, 25 bp, Rattus norvegicus
gggtttcaattgtatctgttatgtt

SEQ ID NO: 462070 - DNA, 25 bp, Rattus norvegicus
gggtttcacactcgtcagccttgga

SEQ ID NO: 462071 - DNA, 25 bp, Rattus norvegicus
gggtttcacactggtcagccttgga

SEQ ID NO: 462072 - DNA, 25 bp, Rattus norvegicus
gggtttcacggaactccagatgctg

SEQ ID NO: 462073 - DNA, 25 bp, Rattus norvegicus
gggtttcacggatctccagatgctg

SEQ ID NO: 462074 - DNA, 25 bp, Rattus norvegicus
gggtttcactgtagtgggcctccat

SEQ ID NO: 462075 - DNA, 25 bp, Rattus norvegicus
gggtttcactgttgtgggcctccat

SEQ ID NO: 462076 - DNA, 25 bp, Rattus norvegicus
gggtttcacttaattccagctgctc

SEQ ID NO: 462077 - DNA, 25 bp, Rattus norvegicus
gggtttcacttatttccagctgctc

SEQ ID NO: 462078 - DNA, 25 bp, Rattus norvegicus
gggtttcagaatcccaagcctggcc

SEQ ID NO: 462079 - DNA, 25 bp, Rattus norvegicus
gggtttcagaatgccaagcctggcc

SEQ ID NO: 462080 - DNA, 25 bp, Rattus norvegicus
gggtttcagagcaccattttccaaa

SEQ ID NO: 462081 - DNA, 25 bp, Rattus norvegicus
gggtttcagagctccattttccaaa

SEQ ID NO: 462082 - DNA, 25 bp, Rattus norvegicus
gggtttcagagtagcccctcaccct

SEQ ID NO: 462083 - DNA, 25 bp, Rattus norvegicus
gggtttcagagttgcccctcaccct

SEQ ID NO: 462084 - DNA, 25 bp, Rattus norvegicus
gggtttcagcaaatcagtgtcatgg

SEQ ID NO: 462085 - DNA, 25 bp, Rattus norvegicus
gggtttcagcaattcagtgtcatgg

SEQ ID NO: 462086 - DNA, 25 bp, Rattus norvegicus
gggtttcagctcattacactaagat

SEQ ID NO: 462087 - DNA, 25 bp, Rattus norvegicus
gggtttcagctctttacactaagat

SEQ ID NO: 462088 - DNA, 25 bp, Rattus norvegicus
gggtttcaggagaagctgctcctct

SEQ ID NO: 462089 - DNA, 25 bp, Rattus norvegicus
gggtttcaggagtagctgctcctct

SEQ ID NO: 462090 - DNA, 25 bp, Rattus norvegicus
gggtttcagtccacagcgatcagat

SEQ ID NO: 462091 - DNA, 25 bp, Rattus norvegicus
gggtttcagtcctcagcgatcagat

SEQ ID NO: 462092 - DNA, 25 bp, Rattus norvegicus
gggtttcatattcccgtcacaatac

SEQ ID NO: 462093 - DNA, 25 bp, Rattus norvegicus
gggtttcatattgccgtcacaatac

SEQ ID NO: 462094 - DNA, 25 bp, Rattus norvegicus
gggtttcatcacaacaattagtaac

SEQ ID NO: 462095 - DNA, 25 bp, Rattus norvegicus
gggtttcatcactacaattagtaac

SEQ ID NO: 462096 - DNA, 25 bp, Rattus norvegicus
gggtttcatccccaggactgcaaaa

SEQ ID NO: 462097 - DNA, 25 bp, Rattus norvegicus
gggtttcatcccgaggactgcaaaa

SEQ ID NO: 462098 - DNA, 25 bp, Rattus norvegicus
gggtttcatcttaatctgcaattca

SEQ ID NO: 462099 - DNA, 25 bp, Rattus norvegicus
gggtttcatctttatctgcaattca

SEQ ID NO: 462100 - DNA, 25 bp, Rattus norvegicus
gggtttcatgcacccaagtcttgac

SEQ ID NO: 462101 - DNA, 25 bp, Rattus norvegicus
gggtttcatgcagccaagtcttgac

SEQ ID NO: 462102 - DNA, 25 bp, Rattus norvegicus
gggtttcatgccaagtagcaactta

SEQ ID NO: 462103 - DNA, 25 bp, Rattus norvegicus
gggtttcatgcctagtagcaactta

SEQ ID NO: 462104 - DNA, 25 bp, Rattus norvegicus
gggtttcatgtactccaatctccag

SEQ ID NO: 462105 - DNA, 25 bp, Rattus norvegicus
gggtttcatgtagtccaatctccag

SEQ ID NO: 462106 - DNA, 25 bp, Rattus norvegicus
gggtttcatgttagagccttctgtc

SEQ ID NO: 462107 - DNA, 25 bp, Rattus norvegicus
gggtttcatgtttgagccttctgtc

SEQ ID NO: 462108 - DNA, 25 bp, Rattus norvegicus
gggtttcattcccaacaacctatat

SEQ ID NO: 462109 - DNA, 25 bp, Rattus norvegicus
gggtttcattccgaacaacctatat

SEQ ID NO: 462110 - DNA, 25 bp, Rattus norvegicus
gggtttcattttcaagtgtgttcct

SEQ ID NO: 462111 - DNA, 25 bp, Rattus norvegicus
gggtttcattttgaagtgtgttcct

SEQ ID NO: 462112 - DNA, 25 bp, Rattus norvegicus
gggtttccaccacatgtttctatta

SEQ ID NO: 462113 - DNA, 25 bp, Rattus norvegicus
gggtttccaccagatgtttctatta

SEQ ID NO: 462114 - DNA, 25 bp, Rattus norvegicus
gggtttccatcgcactgaacataca

SEQ ID NO: 462115 - DNA, 25 bp, Rattus norvegicus
gggtttccatcggactgaacataca

SEQ ID NO: 462116 - DNA, 25 bp, Rattus norvegicus
gggtttccatctccgcccagagctg

SEQ ID NO: 462117 - DNA, 25 bp, Rattus norvegicus
gggtttccatctgcgcccagagctg

SEQ ID NO: 462118 - DNA, 25 bp, Rattus norvegicus
gggtttccccagagcagtgccacaa

SEQ ID NO: 462119 - DNA, 25 bp, Rattus norvegicus
gggtttccccagtgcagtgccacaa

SEQ ID NO: 462120 - DNA, 25 bp, Rattus norvegicus
gggtttcctaacacatctgaacact

SEQ ID NO: 462121 - DNA, 25 bp, Rattus norvegicus
gggtttcctaactcatctgaacact

SEQ ID NO: 462122 - DNA, 25 bp, Rattus norvegicus
gggtttcctgaaaactaggcaagca

SEQ ID NO: 462123 - DNA, 25 bp, Rattus norvegicus
gggtttcctgaatactaggcaagca

SEQ ID NO: 462124 - DNA, 25 bp, Rattus norvegicus
gggtttcctgagcaagctcttgctg

SEQ ID NO: 462125 - DNA, 25 bp, Rattus norvegicus
gggtttcctgaggaagctcttgctg

SEQ ID NO: 462126 - DNA, 25 bp, Rattus norvegicus
gggtttcctggtctgaagagtctcc

SEQ ID NO: 462127 - DNA, 25 bp, Rattus norvegicus
gggtttcctggtgtgaagagtctcc

SEQ ID NO: 462128 - DNA, 25 bp, Rattus norvegicus
gggtttcctgtgctcaggcttccag

SEQ ID NO: 462129 - DNA, 25 bp, Rattus norvegicus
gggtttcctgtggtcaggcttccag

SEQ ID NO: 462130 - DNA, 25 bp, Rattus norvegicus
gggtttccttctagacagtgggatg

SEQ ID NO: 462131 - DNA, 25 bp, Rattus norvegicus
gggtttccttcttgacagtgggatg

SEQ ID NO: 462132 - DNA, 25 bp, Rattus norvegicus
gggtttcgcaagctctctactacaa

SEQ ID NO: 462133 - DNA, 25 bp, Rattus norvegicus
gggtttcgcaaggtctctactacaa

SEQ ID NO: 462134 - DNA, 25 bp, Rattus norvegicus
gggtttctaactctcttgtgcggaa

SEQ ID NO: 462135 - DNA, 25 bp, Rattus norvegicus
gggtttctaactgtcttgtgcggaa

SEQ ID NO: 462136 - DNA, 25 bp, Rattus norvegicus
gggtttctaagtcagtatgtgcatt

SEQ ID NO: 462137 - DNA, 25 bp, Rattus norvegicus
gggtttctaagtgagtatgtgcatt

SEQ ID NO: 462138 - DNA, 25 bp, Rattus norvegicus
gggtttctacctaaatcactgtatt

SEQ ID NO: 462139 - DNA, 25 bp, Rattus norvegicus
gggtttctaccttaatcactgtatt

SEQ ID NO: 462140 - DNA, 25 bp, Rattus norvegicus
gggtttctagaccagactgccagct

SEQ ID NO: 462141 - DNA, 25 bp, Rattus norvegicus
gggtttctagacgagactgccagct

SEQ ID NO: 462142 - DNA, 25 bp, Rattus norvegicus
gggtttctatcactatgcaagtcct

SEQ ID NO: 462143 - DNA, 25 bp, Rattus norvegicus
gggtttctatcagtatgcaagtcct

SEQ ID NO: 462144 - DNA, 25 bp, Rattus norvegicus
gggtttctatggagaccacgcactt

SEQ ID NO: 462145 - DNA, 25 bp, Rattus norvegicus
gggtttctatggtgaccacgcactt

SEQ ID NO: 462146 - DNA, 25 bp, Rattus norvegicus
gggtttctcaatccatgggacatat

SEQ ID NO: 462147 - DNA, 25 bp, Rattus norvegicus
gggtttctcaatgcatgggacatat

SEQ ID NO: 462148 - DNA, 25 bp, Rattus norvegicus
gggtttctcacaaattgccttggct

SEQ ID NO: 462149 - DNA, 25 bp, Rattus norvegicus
gggtttctcacatattgccttggct

SEQ ID NO: 462150 - DNA, 25 bp, Rattus norvegicus
gggtttctccctacgcagagaatga

SEQ ID NO: 462151 - DNA, 25 bp, Rattus norvegicus
gggtttctcccttcgcagagaatga

SEQ ID NO: 462152 - DNA, 25 bp, Rattus norvegicus
gggtttctccttcagattcttgtgt

SEQ ID NO: 462153 - DNA, 25 bp, Rattus norvegicus
gggtttctccttgagattcttgtgt

SEQ ID NO: 462154 - DNA, 25 bp, Rattus norvegicus
gggtttctcgtcaactgcacgaatg

SEQ ID NO: 462155 - DNA, 25 bp, Rattus norvegicus
gggtttctcgtctactgcacgaatg

SEQ ID NO: 462156 - DNA, 25 bp, Rattus norvegicus
gggtttctctgtattgctgttcaaa

SEQ ID NO: 462157 - DNA, 25 bp, Rattus norvegicus
gggtttctctgttttgctgttcaaa

SEQ ID NO: 462158 - DNA, 25 bp, Rattus norvegicus
gggtttctgacactcattaacacaa

SEQ ID NO: 462159 - DNA, 25 bp, Rattus norvegicus
gggtttctgacagtcattaacacaa

SEQ ID NO: 462160 - DNA, 25 bp, Rattus norvegicus
gggtttctgaccattggacaccaca

SEQ ID NO: 462161 - DNA, 25 bp, Rattus norvegicus
gggtttctgacctttggacaccaca

SEQ ID NO: 462162 - DNA, 25 bp, Rattus norvegicus
gggtttctgcagctcacctgtatag

SEQ ID NO: 462163 - DNA, 25 bp, Rattus norvegicus
gggtttctgcaggtcacctgtatag

SEQ ID NO: 462164 - DNA, 25 bp, Rattus norvegicus
gggtttctgcttagggtagtagcct

SEQ ID NO: 462165 - DNA, 25 bp, Rattus norvegicus
gggtttctgctttgggtagtagcct

SEQ ID NO: 462166 - DNA, 25 bp, Rattus norvegicus
gggtttctgttacacttgaatgaaa

SEQ ID NO: 462167 - DNA, 25 bp, Rattus norvegicus
gggtttctgttagacttgaatgaaa

SEQ ID NO: 462168 - DNA, 25 bp, Rattus norvegicus
gggtttctgttgcatagctcgtaat

SEQ ID NO: 462169 - DNA, 25 bp, Rattus norvegicus
gggtttctgttggatagctcgtaat

SEQ ID NO: 462170 - DNA, 25 bp, Rattus norvegicus
gggtttcttaccagttgctgtactt

SEQ ID NO: 462171 - DNA, 25 bp, Rattus norvegicus
gggtttcttacctgttgctgtactt

SEQ ID NO: 462172 - DNA, 25 bp, Rattus norvegicus
gggtttcttataaggagcttcctgc

SEQ ID NO: 462173 - DNA, 25 bp, Rattus norvegicus
gggtttcttatatggagcttcctgc

SEQ ID NO: 462174 - DNA, 25 bp, Rattus norvegicus
gggtttcttatcagtgcagtttttt

SEQ ID NO: 462175 - DNA, 25 bp, Rattus norvegicus
gggtttcttatctgtgcagtttttt

SEQ ID NO: 462176 - DNA, 25 bp, Rattus norvegicus
gggtttcttcgaattggagctatag

SEQ ID NO: 462177 - DNA, 25 bp, Rattus norvegicus
gggtttcttcgatttggagctatag

SEQ ID NO: 462178 - DNA, 25 bp, Rattus norvegicus
gggtttcttgatcttttgtcacgtc

SEQ ID NO: 462179 - DNA, 25 bp, Rattus norvegicus
gggtttcttgatgttttgtcacgtc

SEQ ID NO: 462180 - DNA, 25 bp, Rattus norvegicus
gggtttcttgccagagtgctaagga

SEQ ID NO: 462181 - DNA, 25 bp, Rattus norvegicus
gggtttcttgcctgagtgctaagga

SEQ ID NO: 462182 - DNA, 25 bp, Rattus norvegicus
gggtttcttgttaatcttccaagtg

SEQ ID NO: 462183 - DNA, 25 bp, Rattus norvegicus
gggtttcttgtttatcttccaagtg

SEQ ID NO: 462184 - DNA, 25 bp, Rattus norvegicus
gggtttctttaacatcctgaccaat

SEQ ID NO: 462185 - DNA, 25 bp, Rattus norvegicus
gggtttctttaagatcctgaccaat

SEQ ID NO: 462186 - DNA, 25 bp, Rattus norvegicus
gggtttgaacctcaccatatggact

SEQ ID NO: 462187 - DNA, 25 bp, Rattus norvegicus
gggtttgaacctgaccatatggact

SEQ ID NO: 462188 - DNA, 25 bp, Rattus norvegicus
gggtttgaactcagacctagtctcc

SEQ ID NO: 462189 - DNA, 25 bp, Rattus norvegicus
gggtttgaactctgacctagtctcc

SEQ ID NO: 462190 - DNA, 25 bp, Rattus norvegicus
gggtttgaactgagtcccactacct

SEQ ID NO: 462191 - DNA, 25 bp, Rattus norvegicus
gggtttgaactgtgtcccactacct

SEQ ID NO: 462192 - DNA, 25 bp, Rattus norvegicus
gggtttgaatggcacctccaggtca

SEQ ID NO: 462193 - DNA, 25 bp, Rattus norvegicus
gggtttgaatgggacctccaggtca

SEQ ID NO: 462194 - DNA, 25 bp, Rattus norvegicus
gggtttgacattagcttccgtggac

SEQ ID NO: 462195 - DNA, 25 bp, Rattus norvegicus
gggtttgacatttgcttccgtggac

SEQ ID NO: 462196 - DNA, 25 bp, Rattus norvegicus
gggtttgaccctagcactgtataaa

SEQ ID NO: 462197 - DNA, 25 bp, Rattus norvegicus
gggtttgacccttgcactgtataaa

SEQ ID NO: 462198 - DNA, 25 bp, Rattus norvegicus
gggtttgacctgagcattctgggaa

SEQ ID NO: 462199 - DNA, 25 bp, Rattus norvegicus
gggtttgacctgtgcattctgggaa

SEQ ID NO: 462200 - DNA, 25 bp, Rattus norvegicus
gggtttgaccttcttctcacgagac

SEQ ID NO: 462201 - DNA, 25 bp, Rattus norvegicus
gggtttgaccttgttctcacgagac

SEQ ID NO: 462202 - DNA, 25 bp, Rattus norvegicus
gggtttgagaggatctgcgttccaa

SEQ ID NO: 462203 - DNA, 25 bp, Rattus norvegicus
gggtttgagaggttctgcgttccaa

SEQ ID NO: 462204 - DNA, 25 bp, Rattus norvegicus
gggtttgagcacaatctgttctact

SEQ ID NO: 462205 - DNA, 25 bp, Rattus norvegicus
gggtttgagcactatctgttctact

SEQ ID NO: 462206 - DNA, 25 bp, Rattus norvegicus
gggtttgagcccatttgtgagttgt

SEQ ID NO: 462207 - DNA, 25 bp, Rattus norvegicus
gggtttgagcccttttgtgagttgt

SEQ ID NO: 462208 - DNA, 25 bp, Rattus norvegicus
gggtttgagcttctttttatttgag

SEQ ID NO: 462209 - DNA, 25 bp, Rattus norvegicus
gggtttgagcttgtttttatttgag

SEQ ID NO: 462210 - DNA, 25 bp, Rattus norvegicus
gggtttgagggaaacttctcttgta

SEQ ID NO: 462211 - DNA, 25 bp, Rattus norvegicus
gggtttgagggatacttctcttgta

SEQ ID NO: 462212 - DNA, 25 bp, Rattus norvegicus
gggtttgagtcacagcactgaatga

SEQ ID NO: 462213 - DNA, 25 bp, Rattus norvegicus
gggtttgagtcagagcactgaatga

SEQ ID NO: 462214 - DNA, 25 bp, Rattus norvegicus
gggtttgataagattctgcctggaa

SEQ ID NO: 462215 - DNA, 25 bp, Rattus norvegicus
gggtttgataagtttctgcctggaa

SEQ ID NO: 462216 - DNA, 25 bp, Rattus norvegicus
gggtttgatgtcactgccaaccaaa

SEQ ID NO: 462217 - DNA, 25 bp, Rattus norvegicus
gggtttgatgtctctgccaaccaaa

SEQ ID NO: 462218 - DNA, 25 bp, Rattus norvegicus
gggtttgattacaatctgccaggtt

SEQ ID NO: 462219 - DNA, 25 bp, Rattus norvegicus
gggtttgattactatctgccaggtt

SEQ ID NO: 462220 - DNA, 25 bp, Rattus norvegicus
gggtttgattccattgagtccatta

SEQ ID NO: 462221 - DNA, 25 bp, Rattus norvegicus
gggtttgattcctttgagtccatta

SEQ ID NO: 462222 - DNA, 25 bp, Rattus norvegicus
gggtttgcagcaatggcctctctaa

SEQ ID NO: 462223 - DNA, 25 bp, Rattus norvegicus
gggtttgcagcattggcctctctaa

SEQ ID NO: 462224 - DNA, 25 bp, Rattus norvegicus
gggtttgcagctcactctagctaaa

SEQ ID NO: 462225 - DNA, 25 bp, Rattus norvegicus
gggtttgcagctgactctagctaaa

SEQ ID NO: 462226 - DNA, 25 bp, Rattus norvegicus
gggtttgcaggcacatcactgggaa

SEQ ID NO: 462227 - DNA, 25 bp, Rattus norvegicus
gggtttgcaggctcatcactgggaa

SEQ ID NO: 462228 - DNA, 25 bp, Rattus norvegicus
gggtttgcagttataagtttccaca

SEQ ID NO: 462229 - DNA, 25 bp, Rattus norvegicus
gggtttgcagttttaagtttccaca

SEQ ID NO: 462230 - DNA, 25 bp, Rattus norvegicus
gggtttgcatgactgcatgctcaca

SEQ ID NO: 462231 - DNA, 25 bp, Rattus norvegicus
gggtttgcatgagtgcatgctcaca

SEQ ID NO: 462232 - DNA, 25 bp, Rattus norvegicus
gggtttgcatgtatacaggctccac

SEQ ID NO: 462233 - DNA, 25 bp, Rattus norvegicus
gggtttgcatgtttacaggctccac

SEQ ID NO: 462234 - DNA, 25 bp, Rattus norvegicus
gggtttgccatacctgctgggacct

SEQ ID NO: 462235 - DNA, 25 bp, Rattus norvegicus
gggtttgccatagctgctgggacct

SEQ ID NO: 462236 - DNA, 25 bp, Rattus norvegicus
gggtttgcctagcatgtgttatgaa

SEQ ID NO: 462237 - DNA, 25 bp, Rattus norvegicus
gggtttgcctaggatgtgttatgaa

SEQ ID NO: 462238 - DNA, 25 bp, Rattus norvegicus
gggtttgccttcatggcccttattg

SEQ ID NO: 462239 - DNA, 25 bp, Rattus norvegicus
gggtttgccttcttggcccttattg

SEQ ID NO: 462240 - DNA, 25 bp, Rattus norvegicus
gggtttgctacaagaagtccaatca

SEQ ID NO: 462241 - DNA, 25 bp, Rattus norvegicus
gggtttgctacatgaagtccaatca

SEQ ID NO: 462242 - DNA, 25 bp, Rattus norvegicus
gggtttgctcttcaagatgccctca

SEQ ID NO: 462243 - DNA, 25 bp, Rattus norvegicus
gggtttgctcttgaagatgccctca

SEQ ID NO: 462244 - DNA, 25 bp, Rattus norvegicus
gggtttgctgaacaagccccttacg

SEQ ID NO: 462245 - DNA, 25 bp, Rattus norvegicus
gggtttgctgaagaagccccttacg

SEQ ID NO: 462246 - DNA, 25 bp, Rattus norvegicus
gggtttgctgacataatgccatgta

SEQ ID NO: 462247 - DNA, 25 bp, Rattus norvegicus
gggtttgctgacttaatgccatgta

SEQ ID NO: 462248 - DNA, 25 bp, Rattus norvegicus
gggtttgcttctccacaaaggtctt

SEQ ID NO: 462249 - DNA, 25 bp, Rattus norvegicus
gggtttgcttctgcacaaaggtctt

SEQ ID NO: 462250 - DNA, 25 bp, Rattus norvegicus
gggtttgcttttcagtatgtctaca

SEQ ID NO: 462251 - DNA, 25 bp, Rattus norvegicus
gggtttgcttttgagtatgtctaca

SEQ ID NO: 462252 - DNA, 25 bp, Rattus norvegicus
gggtttggaacacctgctcttgcct

SEQ ID NO: 462253 - DNA, 25 bp, Rattus norvegicus
gggtttggaacagctgctcttgcct

SEQ ID NO: 462254 - DNA, 25 bp, Rattus norvegicus
gggtttggacccagaaccaagtgtg

SEQ ID NO: 462255 - DNA, 25 bp, Rattus norvegicus
gggtttggaccctgaaccaagtgtg

SEQ ID NO: 462256 - DNA, 25 bp, Rattus norvegicus
gggtttggactaacacctcacatgt

SEQ ID NO: 462257 - DNA, 25 bp, Rattus norvegicus
gggtttggactatcacctcacatgt

SEQ ID NO: 462258 - DNA, 25 bp, Rattus norvegicus
gggtttggatatagcactgccccac

SEQ ID NO: 462259 - DNA, 25 bp, Rattus norvegicus
gggtttggatattgcactgccccac

SEQ ID NO: 462260 - DNA, 25 bp, Rattus norvegicus
gggtttggctgtctctaaactgcat

SEQ ID NO: 462261 - DNA, 25 bp, Rattus norvegicus
gggtttggctgtgtctaaactgcat

SEQ ID NO: 462262 - DNA, 25 bp, Rattus norvegicus
gggtttggctttctagacttcaaca

SEQ ID NO: 462263 - DNA, 25 bp, Rattus norvegicus
gggtttggctttgtagacttcaaca

SEQ ID NO: 462264 - DNA, 25 bp, Rattus norvegicus
gggtttggttctaacatccatgtga

SEQ ID NO: 462265 - DNA, 25 bp, Rattus norvegicus
gggtttggttcttacatccatgtga

SEQ ID NO: 462266 - DNA, 25 bp, Rattus norvegicus
gggtttgtattgatacttcaatcca

SEQ ID NO: 462267 - DNA, 25 bp, Rattus norvegicus
gggtttgtattgttacttcaatcca

SEQ ID NO: 462268 - DNA, 25 bp, Rattus norvegicus
gggtttgtcattcacagttctgagt

SEQ ID NO: 462269 - DNA, 25 bp, Rattus norvegicus
gggtttgtcattgacagttctgagt

SEQ ID NO: 462270 - DNA, 25 bp, Rattus norvegicus
gggtttgtctttcaatagatcgcag

SEQ ID NO: 462271 - DNA, 25 bp, Rattus norvegicus
gggtttgtctttgaatagatcgcag

SEQ ID NO: 462272 - DNA, 25 bp, Rattus norvegicus
gggtttgtgtcgaccagaaagatga

SEQ ID NO: 462273 - DNA, 25 bp, Rattus norvegicus
gggtttgtgtcgtccagaaagatga

SEQ ID NO: 462274 - DNA, 25 bp, Rattus norvegicus
gggtttgttctgcttttccttcagg

SEQ ID NO: 462275 - DNA, 25 bp, Rattus norvegicus
gggtttgttctggttttccttcagg

SEQ ID NO: 462276 - DNA, 25 bp, Rattus norvegicus
gggtttgttgaacagtcactgcaga

SEQ ID NO: 462277 - DNA, 25 bp, Rattus norvegicus
gggtttgttgaagagtcactgcaga

SEQ ID NO: 462278 - DNA, 25 bp, Rattus norvegicus
gggtttgtttacaccacagcctgta

SEQ ID NO: 462279 - DNA, 25 bp, Rattus norvegicus
gggtttgtttactccacagcctgta

SEQ ID NO: 462280 - DNA, 25 bp, Rattus norvegicus
gggtttgtttcaactgacacgtcat

SEQ ID NO: 462281 - DNA, 25 bp, Rattus norvegicus
gggtttgtttcatctgacacgtcat

SEQ ID NO: 462282 - DNA, 25 bp, Rattus norvegicus
gggtttgttttgatgtccattagct

SEQ ID NO: 462283 - DNA, 25 bp, Rattus norvegicus
gggtttgttttgttgtccattagct

SEQ ID NO: 462284 - DNA, 25 bp, Rattus norvegicus
gggttttaaattcctgcagcaatag

SEQ ID NO: 462285 - DNA, 25 bp, Rattus norvegicus
gggttttaaattgctgcagcaatag

SEQ ID NO: 462286 - DNA, 25 bp, Rattus norvegicus
gggttttaccatcacctttgtagtg

SEQ ID NO: 462287 - DNA, 25 bp, Rattus norvegicus
gggttttaccatgacctttgtagtg

SEQ ID NO: 462288 - DNA, 25 bp, Rattus norvegicus
gggttttagaacaggctctggccaa

SEQ ID NO: 462289 - DNA, 25 bp, Rattus norvegicus
gggttttagaactggctctggccaa

SEQ ID NO: 462290 - DNA, 25 bp, Rattus norvegicus
gggttttagtgtccagtacgcatgt

SEQ ID NO: 462291 - DNA, 25 bp, Rattus norvegicus
gggttttagtgtgcagtacgcatgt

SEQ ID NO: 462292 - DNA, 25 bp, Rattus norvegicus
gggttttatgatactcaatgccatt

SEQ ID NO: 462293 - DNA, 25 bp, Rattus norvegicus
gggttttatgattctcaatgccatt

SEQ ID NO: 462294 - DNA, 25 bp, Rattus norvegicus
gggttttatgcgcatcttagcgttt

SEQ ID NO: 462295 - DNA, 25 bp, Rattus norvegicus
gggttttatgcggatcttagcgttt

SEQ ID NO: 462296 - DNA, 25 bp, Rattus norvegicus
gggttttatggcatcacctacacag

SEQ ID NO: 462297 - DNA, 25 bp, Rattus norvegicus
gggttttatggcttcacctacacag

SEQ ID NO: 462298 - DNA, 25 bp, Rattus norvegicus
gggttttattcaagcctctctgaga

SEQ ID NO: 462299 - DNA, 25 bp, Rattus norvegicus
gggttttattcaatggagcacacag

SEQ ID NO: 462300 - DNA, 25 bp, Rattus norvegicus
gggttttattcatgcctctctgaga

SEQ ID NO: 462301 - DNA, 25 bp, Rattus norvegicus
gggttttattcattggagcacacag

SEQ ID NO: 462302 - DNA, 25 bp, Rattus norvegicus
gggttttcaatcctgccaaagaact

SEQ ID NO: 462303 - DNA, 25 bp, Rattus norvegicus
gggttttcaatcgtgccaaagaact

SEQ ID NO: 462304 - DNA, 25 bp, Rattus norvegicus
gggttttcacatacgtaggtattca

SEQ ID NO: 462305 - DNA, 25 bp, Rattus norvegicus
gggttttcacattcgtaggtattca

SEQ ID NO: 462306 - DNA, 25 bp, Rattus norvegicus
gggttttcagatctgcagaccacta

SEQ ID NO: 462307 - DNA, 25 bp, Rattus norvegicus
gggttttcagatgtgcagaccacta

SEQ ID NO: 462308 - DNA, 25 bp, Rattus norvegicus
gggttttcatatccttaagttgcat

SEQ ID NO: 462309 - DNA, 25 bp, Rattus norvegicus
gggttttcatatgcttaagttgcat

SEQ ID NO: 462310 - DNA, 25 bp, Rattus norvegicus
gggttttcatcacaatccagcatgt

SEQ ID NO: 462311 - DNA, 25 bp, Rattus norvegicus
gggttttcatcagaatccagcatgt

SEQ ID NO: 462312 - DNA, 25 bp, Rattus norvegicus
gggttttcatctcactatgctggat

SEQ ID NO: 462313 - DNA, 25 bp, Rattus norvegicus
gggttttcatctgactatgctggat

SEQ ID NO: 462314 - DNA, 25 bp, Rattus norvegicus
gggttttccagcagcaacagtcagg

SEQ ID NO: 462315 - DNA, 25 bp, Rattus norvegicus
gggttttccagctgcaacagtcagg

SEQ ID NO: 462316 - DNA, 25 bp, Rattus norvegicus
gggttttcccaacatgagcgtctgt

SEQ ID NO: 462317 - DNA, 25 bp, Rattus norvegicus
gggttttcccaagatgagcgtctgt

SEQ ID NO: 462318 - DNA, 25 bp, Rattus norvegicus
gggttttcctgacttgcattgcatg

SEQ ID NO: 462319 - DNA, 25 bp, Rattus norvegicus
gggttttcctgagttgcattgcatg

SEQ ID NO: 462320 - DNA, 25 bp, Rattus norvegicus
gggttttcctgtatatccttgcctg

SEQ ID NO: 462321 - DNA, 25 bp, Rattus norvegicus
gggttttcctgtttatccttgcctg

SEQ ID NO: 462322 - DNA, 25 bp, Rattus norvegicus
gggttttcgaaccaccagaatcagt

SEQ ID NO: 462323 - DNA, 25 bp, Rattus norvegicus
gggttttcgaacgaccagaatcagt

SEQ ID NO: 462324 - DNA, 25 bp, Rattus norvegicus
gggttttctcacaatgccgagaagc

SEQ ID NO: 462325 - DNA, 25 bp, Rattus norvegicus
gggttttctcactatgccgagaagc

SEQ ID NO: 462326 - DNA, 25 bp, Rattus norvegicus
gggttttctcatagtctttttgcat

SEQ ID NO: 462327 - DNA, 25 bp, Rattus norvegicus
gggttttctcattgtctttttgcat

SEQ ID NO: 462328 - DNA, 25 bp, Rattus norvegicus
gggttttctcccagaacagtaacag

SEQ ID NO: 462329 - DNA, 25 bp, Rattus norvegicus
gggttttctccctgaacagtaacag

SEQ ID NO: 462330 - DNA, 25 bp, Rattus norvegicus
gggttttctctactcggaagacagc

SEQ ID NO: 462331 - DNA, 25 bp, Rattus norvegicus
gggttttctctagtcggaagacagc

SEQ ID NO: 462332 - DNA, 25 bp, Rattus norvegicus
gggttttctctcagtccaaatataa

SEQ ID NO: 462333 - DNA, 25 bp, Rattus norvegicus
gggttttctctctgtccaaatataa

SEQ ID NO: 462334 - DNA, 25 bp, Rattus norvegicus
gggttttctgcaatcacagttcctg

SEQ ID NO: 462335 - DNA, 25 bp, Rattus norvegicus
gggttttctgcattcacagttcctg

SEQ ID NO: 462336 - DNA, 25 bp, Rattus norvegicus
gggttttcttgcatagttcctcagc

SEQ ID NO: 462337 - DNA, 25 bp, Rattus norvegicus
gggttttcttgcttagttcctcagc

SEQ ID NO: 462338 - DNA, 25 bp, Rattus norvegicus
gggttttctttcacataaggcgagt

SEQ ID NO: 462339 - DNA, 25 bp, Rattus norvegicus
gggttttctttctcataaggcgagt

SEQ ID NO: 462340 - DNA, 25 bp, Rattus norvegicus
gggttttgaattaactgcagctgtc

SEQ ID NO: 462341 - DNA, 25 bp, Rattus norvegicus
gggttttgaatttactgcagctgtc

SEQ ID NO: 462342 - DNA, 25 bp, Rattus norvegicus
gggttttgattgattctggcctctc

SEQ ID NO: 462343 - DNA, 25 bp, Rattus norvegicus
gggttttgattgtttctggcctctc

SEQ ID NO: 462344 - DNA, 25 bp, Rattus norvegicus
gggttttgcagactgagccttacct

SEQ ID NO: 462345 - DNA, 25 bp, Rattus norvegicus
gggttttgcagagtgagccttacct

SEQ ID NO: 462346 - DNA, 25 bp, Rattus norvegicus
gggttttgcctccttcagaaatatg

SEQ ID NO: 462347 - DNA, 25 bp, Rattus norvegicus
gggttttgcctcgttcagaaatatg

SEQ ID NO: 462348 - DNA, 25 bp, Rattus norvegicus
gggttttgctcacacccatgttttt

SEQ ID NO: 462349 - DNA, 25 bp, Rattus norvegicus
gggttttgctcagacccatgttttt

SEQ ID NO: 462350 - DNA, 25 bp, Rattus norvegicus
gggttttggcatacctctaggacct

SEQ ID NO: 462351 - DNA, 25 bp, Rattus norvegicus
gggttttggcattcctctaggacct

SEQ ID NO: 462352 - DNA, 25 bp, Rattus norvegicus
gggttttggctaatgacttacaaga

SEQ ID NO: 462353 - DNA, 25 bp, Rattus norvegicus
gggttttggctattgacttacaaga

SEQ ID NO: 462354 - DNA, 25 bp, Rattus norvegicus
gggttttgtcagaggaactctggat

SEQ ID NO: 462355 - DNA, 25 bp, Rattus norvegicus
gggttttgtcagtggaactctggat

SEQ ID NO: 462356 - DNA, 25 bp, Rattus norvegicus
gggttttgttacagccaagtgccaa

SEQ ID NO: 462357 - DNA, 25 bp, Rattus norvegicus
gggttttgttactgccaagtgccaa

SEQ ID NO: 462358 - DNA, 25 bp, Rattus norvegicus
gggtttttaacaagttcctgagcat

SEQ ID NO: 462359 - DNA, 25 bp, Rattus norvegicus
gggtttttaacatgttcctgagcat

SEQ ID NO: 462360 - DNA, 25 bp, Rattus norvegicus
gggtttttacctctcacattgcatt

SEQ ID NO: 462361 - DNA, 25 bp, Rattus norvegicus
gggtttttacctgtcacattgcatt

SEQ ID NO: 462362 - DNA, 25 bp, Rattus norvegicus
gggtttttagcaccggttccaggat

SEQ ID NO: 462363 - DNA, 25 bp, Rattus norvegicus
gggtttttagcagcggttccaggat

SEQ ID NO: 462364 - DNA, 25 bp, Rattus norvegicus
gggtttttcacactggcacaatggt

SEQ ID NO: 462365 - DNA, 25 bp, Rattus norvegicus
gggtttttcacagtggcacaatggt

SEQ ID NO: 462366 - DNA, 25 bp, Rattus norvegicus
gggtttttctcacagcaacgctcac

SEQ ID NO: 462367 - DNA, 25 bp, Rattus norvegicus
gggtttttctcagagcaacgctcac

SEQ ID NO: 462368 - DNA, 25 bp, Rattus norvegicus
gggtttttctttacaatgatcctca

SEQ ID NO: 462369 - DNA, 25 bp, Rattus norvegicus
gggtttttctttctctggttggctg

SEQ ID NO: 462370 - DNA, 25 bp, Rattus norvegicus
gggtttttctttgtctggttggctg

SEQ ID NO: 462371 - DNA, 25 bp, Rattus norvegicus
gggtttttcttttcaatgatcctca

SEQ ID NO: 462372 - DNA, 25 bp, Rattus norvegicus
gggtttttgattccatccacatttt

SEQ ID NO: 462373 - DNA, 25 bp, Rattus norvegicus
gggtttttgattgcatccacatttt

SEQ ID NO: 462374 - DNA, 25 bp, Rattus norvegicus
gggtttttggatcaacaatgttatt

SEQ ID NO: 462375 - DNA, 25 bp, Rattus norvegicus
gggtttttggatgaacaatgttatt

SEQ ID NO: 462376 - DNA, 25 bp, Rattus norvegicus
gggttttttgacagacttgtgtgca

SEQ ID NO: 462377 - DNA, 25 bp, Rattus norvegicus
gggttttttgactgacttgtgtgca

SEQ ID NO: 462378 - DNA, 25 bp, Rattus norvegicus
gggttttttgctagaggctggcctt

SEQ ID NO: 462379 - DNA, 25 bp, Rattus norvegicus
gggttttttgcttgaggctggcctt

SEQ ID NO: 462380 - DNA, 25 bp, Rattus norvegicus
ggtaaaaacctgagtccacatgttt

SEQ ID NO: 462381 - DNA, 25 bp, Rattus norvegicus
ggtaaaaacctgtgtccacatgttt

SEQ ID NO: 462382 - DNA, 25 bp, Rattus norvegicus
ggtaaaaagccacccttatgtctca

SEQ ID NO: 462383 - DNA, 25 bp, Rattus norvegicus
ggtaaaaagccagccttatgtctca

SEQ ID NO: 462384 - DNA, 25 bp, Rattus norvegicus
ggtaaaaagctcaagcgtcctcctt

SEQ ID NO: 462385 - DNA, 25 bp, Rattus norvegicus
ggtaaaaagctctagcgtcctcctt

SEQ ID NO: 462386 - DNA, 25 bp, Rattus norvegicus
ggtaaaaaggcacgcatgtatgtat

SEQ ID NO: 462387 - DNA, 25 bp, Rattus norvegicus
ggtaaaaaggcaggcatgtatgtat

SEQ ID NO: 462388 - DNA, 25 bp, Rattus norvegicus
ggtaaaacatatactcatggcagct

SEQ ID NO: 462389 - DNA, 25 bp, Rattus norvegicus
ggtaaaacatattctcatggcagct

SEQ ID NO: 462390 - DNA, 25 bp, Rattus norvegicus
ggtaaaactggtccctgtgctctgt

SEQ ID NO: 462391 - DNA, 25 bp, Rattus norvegicus
ggtaaaactggtgcctgtgctctgt

SEQ ID NO: 462392 - DNA, 25 bp, Rattus norvegicus
ggtaaaactgtaagaggctcaaatg

SEQ ID NO: 462393 - DNA, 25 bp, Rattus norvegicus
ggtaaaactgtatgaggctcaaatg

SEQ ID NO: 462394 - DNA, 25 bp, Rattus norvegicus
ggtaaaagactgaatagcatctatt

SEQ ID NO: 462395 - DNA, 25 bp, Rattus norvegicus
ggtaaaagactgtatagcatctatt

SEQ ID NO: 462396 - DNA, 25 bp, Rattus norvegicus
ggtaaaagatgcctgctctccgcag

SEQ ID NO: 462397 - DNA, 25 bp, Rattus norvegicus
ggtaaaagatgcgtgctctccgcag

SEQ ID NO: 462398 - DNA, 25 bp, Rattus norvegicus
ggtaaaagctgcagctccatgatcc

SEQ ID NO: 462399 - DNA, 25 bp, Rattus norvegicus
ggtaaaagctgctgctccatgatcc

SEQ ID NO: 462400 - DNA, 25 bp, Rattus norvegicus
ggtaaaaggagcactccgtctcctt

SEQ ID NO: 462401 - DNA, 25 bp, Rattus norvegicus
ggtaaaaggagctctccgtctcctt

SEQ ID NO: 462402 - DNA, 25 bp, Rattus norvegicus
ggtaaaaggattcttcagctccttg

SEQ ID NO: 462403 - DNA, 25 bp, Rattus norvegicus
ggtaaaaggattgttcagctccttg

SEQ ID NO: 462404 - DNA, 25 bp, Rattus norvegicus
ggtaaaatacctaagcaatcagact

SEQ ID NO: 462405 - DNA, 25 bp, Rattus norvegicus
ggtaaaataccttagcaatcagact

SEQ ID NO: 462406 - DNA, 25 bp, Rattus norvegicus
ggtaaaatccaaccctgagataaca

SEQ ID NO: 462407 - DNA, 25 bp, Rattus norvegicus
ggtaaaatccaagcctgagataaca

SEQ ID NO: 462408 - DNA, 25 bp, Rattus norvegicus
ggtaaaatgcagactcacatgatca

SEQ ID NO: 462409 - DNA, 25 bp, Rattus norvegicus
ggtaaaatgcagtctcacatgatca

SEQ ID NO: 462410 - DNA, 25 bp, Rattus norvegicus
ggtaaaatgtgtcccatcttccctt

SEQ ID NO: 462411 - DNA, 25 bp, Rattus norvegicus
ggtaaaatgtgtgccatcttccctt

SEQ ID NO: 462412 - DNA, 25 bp, Rattus norvegicus
ggtaaaatgtttctattctctctct

SEQ ID NO: 462413 - DNA, 25 bp, Rattus norvegicus
ggtaaaatgtttgtattctctctct

SEQ ID NO: 462414 - DNA, 25 bp, Rattus norvegicus
ggtaaaattatcatggctcctttct

SEQ ID NO: 462415 - DNA, 25 bp, Rattus norvegicus
ggtaaaattatcttggctcctttct

SEQ ID NO: 462416 - DNA, 25 bp, Rattus norvegicus
ggtaaacagtctaccagtcatcttc

SEQ ID NO: 462417 - DNA, 25 bp, Rattus norvegicus
ggtaaacagtcttccagtcatcttc

SEQ ID NO: 462418 - DNA, 25 bp, Rattus norvegicus
ggtaaaccatgtctttgattccaat

SEQ ID NO: 462419 - DNA, 25 bp, Rattus norvegicus
ggtaaaccatgtgtttgattccaat

SEQ ID NO: 462420 - DNA, 25 bp, Rattus norvegicus
ggtaaacctgttcagcgagcagccc

SEQ ID NO: 462421 - DNA, 25 bp, Rattus norvegicus
ggtaaacctgttgagcgagcagccc

SEQ ID NO: 462422 - DNA, 25 bp, Rattus norvegicus
ggtaaacggaatatgggagccatga

SEQ ID NO: 462423 - DNA, 25 bp, Rattus norvegicus
ggtaaacggaatttgggagccatga

SEQ ID NO: 462424 - DNA, 25 bp, Rattus norvegicus
ggtaaactcacaattcctgggttat

SEQ ID NO: 462425 - DNA, 25 bp, Rattus norvegicus
ggtaaactcacatttcctgggttat

SEQ ID NO: 462426 - DNA, 25 bp, Rattus norvegicus
ggtaaactcatcataggctgaaagt

SEQ ID NO: 462427 - DNA, 25 bp, Rattus norvegicus
ggtaaactcatcattatggctttcc

SEQ ID NO: 462428 - DNA, 25 bp, Rattus norvegicus
ggtaaactcatcttaggctgaaagt

SEQ ID NO: 462429 - DNA, 25 bp, Rattus norvegicus
ggtaaactcatctttatggctttcc

SEQ ID NO: 462430 - DNA, 25 bp, Rattus norvegicus
ggtaaactggaaaacgcattctagt

SEQ ID NO: 462431 - DNA, 25 bp, Rattus norvegicus
ggtaaactggaatacgcattctagt

SEQ ID NO: 462432 - DNA, 25 bp, Rattus norvegicus
ggtaaactgtagcttccctgaagat

SEQ ID NO: 462433 - DNA, 25 bp, Rattus norvegicus
ggtaaactgtaggttccctgaagat

SEQ ID NO: 462434 - DNA, 25 bp, Rattus norvegicus
ggtaaactgtttatccatccatatt

SEQ ID NO: 462435 - DNA, 25 bp, Rattus norvegicus
ggtaaactgtttttccatccatatt

SEQ ID NO: 462436 - DNA, 25 bp, Rattus norvegicus
ggtaaacttgatcagtgcggccata

SEQ ID NO: 462437 - DNA, 25 bp, Rattus norvegicus
ggtaaacttgatgagtgcggccata

SEQ ID NO: 462438 - DNA, 25 bp, Rattus norvegicus
ggtaaactttggctcttatggataa

SEQ ID NO: 462439 - DNA, 25 bp, Rattus norvegicus
ggtaaactttgggtcttatggataa

SEQ ID NO: 462440 - DNA, 25 bp, Rattus norvegicus
ggtaaagacactcggcttgtggcct

SEQ ID NO: 462441 - DNA, 25 bp, Rattus norvegicus
ggtaaagacactgggcttgtggcct

SEQ ID NO: 462442 - DNA, 25 bp, Rattus norvegicus
ggtaaagaccggatctcagggagat

SEQ ID NO: 462443 - DNA, 25 bp, Rattus norvegicus
ggtaaagaccggttctcagggagat

SEQ ID NO: 462444 - DNA, 25 bp, Rattus norvegicus
ggtaaagcacacatccattggacta

SEQ ID NO: 462445 - DNA, 25 bp, Rattus norvegicus
ggtaaagcacacttccattggacta

SEQ ID NO: 462446 - DNA, 25 bp, Rattus norvegicus
ggtaaagccacaattccatgcaata

SEQ ID NO: 462447 - DNA, 25 bp, Rattus norvegicus
ggtaaagccacatttccatgcaata

SEQ ID NO: 462448 - DNA, 25 bp, Rattus norvegicus
ggtaaagccatacatccatgtggat

SEQ ID NO: 462449 - DNA, 25 bp, Rattus norvegicus
ggtaaagccatagatccatgtggat

SEQ ID NO: 462450 - DNA, 25 bp, Rattus norvegicus
ggtaaagccgtcctctgcggagaac

SEQ ID NO: 462451 - DNA, 25 bp, Rattus norvegicus
ggtaaagccgtcgtctgcggagaac

SEQ ID NO: 462452 - DNA, 25 bp, Rattus norvegicus
ggtaaagcgtgtcctgaaccaggtt

SEQ ID NO: 462453 - DNA, 25 bp, Rattus norvegicus
ggtaaagcgtgtgctgaaccaggtt

SEQ ID NO: 462454 - DNA, 25 bp, Rattus norvegicus
ggtaaagctcaacatcgtcagctgt

SEQ ID NO: 462455 - DNA, 25 bp, Rattus norvegicus
ggtaaagctcaagatcgtcagctgt

SEQ ID NO: 462456 - DNA, 25 bp, Rattus norvegicus
ggtaaagcttccagtgtacaggctg

SEQ ID NO: 462457 - DNA, 25 bp, Rattus norvegicus
ggtaaagcttcctgtgtacaggctg

SEQ ID NO: 462458 - DNA, 25 bp, Rattus norvegicus
ggtaaaggtataagctactcacaat

SEQ ID NO: 462459 - DNA, 25 bp, Rattus norvegicus
ggtaaaggtatatgctactcacaat

SEQ ID NO: 462460 - DNA, 25 bp, Rattus norvegicus
ggtaaaggtatcagctatcaagccc

SEQ ID NO: 462461 - DNA, 25 bp, Rattus norvegicus
ggtaaaggtatctgctatcaagccc

SEQ ID NO: 462462 - DNA, 25 bp, Rattus norvegicus
ggtaaagtgtcaatcattaggctaa

SEQ ID NO: 462463 - DNA, 25 bp, Rattus norvegicus
ggtaaagtgtcattcattaggctaa

SEQ ID NO: 462464 - DNA, 25 bp, Rattus norvegicus
ggtaaagtgtggctgttccagaccc

SEQ ID NO: 462465 - DNA, 25 bp, Rattus norvegicus
ggtaaagtgtgggtgttccagaccc

SEQ ID NO: 462466 - DNA, 25 bp, Rattus norvegicus
ggtaaagtttgccacattcaccatc

SEQ ID NO: 462467 - DNA, 25 bp, Rattus norvegicus
ggtaaagtttgcgacattcaccatc

SEQ ID NO: 462468 - DNA, 25 bp, Rattus norvegicus
ggtaaataactcacctacttgcaga

SEQ ID NO: 462469 - DNA, 25 bp, Rattus norvegicus
ggtaaataactctcctacttgcaga

SEQ ID NO: 462470 - DNA, 25 bp, Rattus norvegicus
ggtaaataattacttcttggctttg

SEQ ID NO: 462471 - DNA, 25 bp, Rattus norvegicus
ggtaaataattagttcttggctttg

SEQ ID NO: 462472 - DNA, 25 bp, Rattus norvegicus
ggtaaatacgccataggccgactca

SEQ ID NO: 462473 - DNA, 25 bp, Rattus norvegicus
ggtaaatacgccttaggccgactca

SEQ ID NO: 462474 - DNA, 25 bp, Rattus norvegicus
ggtaaatcaaccactgtccagttaa

SEQ ID NO: 462475 - DNA, 25 bp, Rattus norvegicus
ggtaaatcaacctctgtccagttaa

SEQ ID NO: 462476 - DNA, 25 bp, Rattus norvegicus
ggtaaatcacctcttcctaagtcgt

SEQ ID NO: 462477 - DNA, 25 bp, Rattus norvegicus
ggtaaatcacctgttcctaagtcgt

SEQ ID NO: 462478 - DNA, 25 bp, Rattus norvegicus
ggtaaatcatgcagcttcctctgac

SEQ ID NO: 462479 - DNA, 25 bp, Rattus norvegicus
ggtaaatcatgctgcttcctctgac

SEQ ID NO: 462480 - DNA, 25 bp, Rattus norvegicus
ggtaaatcccacacttggatccatt

SEQ ID NO: 462481 - DNA, 25 bp, Rattus norvegicus
ggtaaatcccactcttggatccatt

SEQ ID NO: 462482 - DNA, 25 bp, Rattus norvegicus
ggtaaatccgctagtccaaagcctg

SEQ ID NO: 462483 - DNA, 25 bp, Rattus norvegicus
ggtaaatccgcttgtccaaagcctg

SEQ ID NO: 462484 - DNA, 25 bp, Rattus norvegicus
ggtaaatctctgagtgttactcccc

SEQ ID NO: 462485 - DNA, 25 bp, Rattus norvegicus
ggtaaatctctgtgtgttactcccc

SEQ ID NO: 462486 - DNA, 25 bp, Rattus norvegicus
ggtaaatctgaccaacttctagttg

SEQ ID NO: 462487 - DNA, 25 bp, Rattus norvegicus
ggtaaatctgacgaacttctagttg

SEQ ID NO: 462488 - DNA, 25 bp, Rattus norvegicus
ggtaaatgacatagccagctgaaga

SEQ ID NO: 462489 - DNA, 25 bp, Rattus norvegicus
ggtaaatgacattgccagctgaaga

SEQ ID NO: 462490 - DNA, 25 bp, Rattus norvegicus
ggtaaatgcttactcctgtctattc

SEQ ID NO: 462491 - DNA, 25 bp, Rattus norvegicus
ggtaaatgcttagtcctgtctattc

SEQ ID NO: 462492 - DNA, 25 bp, Rattus norvegicus
ggtaaattgcttagatgttctagac

SEQ ID NO: 462493 - DNA, 25 bp, Rattus norvegicus
ggtaaattgctttgatgttctagac

SEQ ID NO: 462494 - DNA, 25 bp, Rattus norvegicus
ggtaaatttcccctgtgcaatatta

SEQ ID NO: 462495 - DNA, 25 bp, Rattus norvegicus
ggtaaatttcccgtgtgcaatatta

SEQ ID NO: 462496 - DNA, 25 bp, Rattus norvegicus
ggtaaatttggaactgcaggtccct

SEQ ID NO: 462497 - DNA, 25 bp, Rattus norvegicus
ggtaaatttggatctgcaggtccct

SEQ ID NO: 462498 - DNA, 25 bp, Rattus norvegicus
ggtaaatttggcatcctatattgga

SEQ ID NO: 462499 - DNA, 25 bp, Rattus norvegicus
ggtaaatttggcttcctatattgga

SEQ ID NO: 462500 - DNA, 25 bp, Rattus norvegicus
ggtaacaaccttcaaagtccactgg

SEQ ID NO: 462501 - DNA, 25 bp, Rattus norvegicus
ggtaacaaccttgaaagtccactgg

SEQ ID NO: 462502 - DNA, 25 bp, Rattus norvegicus
ggtaacaactacctttgaacttgtg

SEQ ID NO: 462503 - DNA, 25 bp, Rattus norvegicus
ggtaacaactacgtttgaacttgtg

SEQ ID NO: 462504 - DNA, 25 bp, Rattus norvegicus
ggtaacaagtagagcgcccgtaata

SEQ ID NO: 462505 - DNA, 25 bp, Rattus norvegicus
ggtaacaagtagtgcgcccgtaata

SEQ ID NO: 462506 - DNA, 25 bp, Rattus norvegicus
ggtaacaatatacacaggctggcct

SEQ ID NO: 462507 - DNA, 25 bp, Rattus norvegicus
ggtaacaatatagacaggctggcct

SEQ ID NO: 462508 - DNA, 25 bp, Rattus norvegicus
ggtaacaatatgctactcccctcca

SEQ ID NO: 462509 - DNA, 25 bp, Rattus norvegicus
ggtaacaatatggtactcccctcca

SEQ ID NO: 462510 - DNA, 25 bp, Rattus norvegicus
ggtaacacacctatattttcactca

SEQ ID NO: 462511 - DNA, 25 bp, Rattus norvegicus
ggtaacacacctttattttcactca

SEQ ID NO: 462512 - DNA, 25 bp, Rattus norvegicus
ggtaacacacttatcagtcagcttg

SEQ ID NO: 462513 - DNA, 25 bp, Rattus norvegicus
ggtaacacacttttcagtcagcttg

SEQ ID NO: 462514 - DNA, 25 bp, Rattus norvegicus
ggtaacaccgttatagcatatttgg

SEQ ID NO: 462515 - DNA, 25 bp, Rattus norvegicus
ggtaacaccgttttagcatatttgg

SEQ ID NO: 462516 - DNA, 25 bp, Rattus norvegicus
ggtaacacctgaccagggcctgaat

SEQ ID NO: 462517 - DNA, 25 bp, Rattus norvegicus
ggtaacacctgagcagggcctgaat

SEQ ID NO: 462518 - DNA, 25 bp, Rattus norvegicus
ggtaacactccaatttccagcactt

SEQ ID NO: 462519 - DNA, 25 bp, Rattus norvegicus
ggtaacactccattttccagcactt

SEQ ID NO: 462520 - DNA, 25 bp, Rattus norvegicus
ggtaacagcctcacaggccaaagga

SEQ ID NO: 462521 - DNA, 25 bp, Rattus norvegicus
ggtaacagcctctcaggccaaagga

SEQ ID NO: 462522 - DNA, 25 bp, Rattus norvegicus
ggtaacagggcaagttttctacatt

SEQ ID NO: 462523 - DNA, 25 bp, Rattus norvegicus
ggtaacagggcatgttttctacatt

SEQ ID NO: 462524 - DNA, 25 bp, Rattus norvegicus
ggtaacagggtaacttgattttcaa

SEQ ID NO: 462525 - DNA, 25 bp, Rattus norvegicus
ggtaacagggtatcttgattttcaa

SEQ ID NO: 462526 - DNA, 25 bp, Rattus norvegicus
ggtaacagtgatatcagacctggaa

SEQ ID NO: 462527 - DNA, 25 bp, Rattus norvegicus
ggtaacagtgatttcagacctggaa

SEQ ID NO: 462528 - DNA, 25 bp, Rattus norvegicus
ggtaacagtggtagcctggcataca

SEQ ID NO: 462529 - DNA, 25 bp, Rattus norvegicus
ggtaacagtggttgcctggcataca

SEQ ID NO: 462530 - DNA, 25 bp, Rattus norvegicus
ggtaacagttctagcatgcctggct

SEQ ID NO: 462531 - DNA, 25 bp, Rattus norvegicus
ggtaacagttcttgcatgcctggct

SEQ ID NO: 462532 - DNA, 25 bp, Rattus norvegicus
ggtaacagtttgctattatccagtc

SEQ ID NO: 462533 - DNA, 25 bp, Rattus norvegicus
ggtaacagtttggtattatccagtc

SEQ ID NO: 462534 - DNA, 25 bp, Rattus norvegicus
ggtaacatacgaagccaggctgctt

SEQ ID NO: 462535 - DNA, 25 bp, Rattus norvegicus
ggtaacatacgatgccaggctgctt

SEQ ID NO: 462536 - DNA, 25 bp, Rattus norvegicus
ggtaacatgttaccttgaaccattc

SEQ ID NO: 462537 - DNA, 25 bp, Rattus norvegicus
ggtaacatgttagcttgaaccattc

SEQ ID NO: 462538 - DNA, 25 bp, Rattus norvegicus
ggtaaccaaaaacccattcacgctg

SEQ ID NO: 462539 - DNA, 25 bp, Rattus norvegicus
ggtaaccaaaaagccattcacgctg

SEQ ID NO: 462540 - DNA, 25 bp, Rattus norvegicus
ggtaaccaagcacttatcaccctca

SEQ ID NO: 462541 - DNA, 25 bp, Rattus norvegicus
ggtaaccaagcagttatcaccctca

SEQ ID NO: 462542 - DNA, 25 bp, Rattus norvegicus
ggtaaccaatcacacactgtccttc

SEQ ID NO: 462543 - DNA, 25 bp, Rattus norvegicus
ggtaaccaatcagacactgtccttc

SEQ ID NO: 462544 - DNA, 25 bp, Rattus norvegicus
ggtaaccacacactcttacatcact

SEQ ID NO: 462545 - DNA, 25 bp, Rattus norvegicus
ggtaaccacacagtcttacatcact

SEQ ID NO: 462546 - DNA, 25 bp, Rattus norvegicus
ggtaaccagattacttcagggcaca

SEQ ID NO: 462547 - DNA, 25 bp, Rattus norvegicus
ggtaaccagatttcttcagggcaca

SEQ ID NO: 462548 - DNA, 25 bp, Rattus norvegicus
ggtaaccaggccaccagaaaagaag

SEQ ID NO: 462549 - DNA, 25 bp, Rattus norvegicus
ggtaaccaggcctccagaaaagaag

SEQ ID NO: 462550 - DNA, 25 bp, Rattus norvegicus
ggtaaccatggaaacttagacactt

SEQ ID NO: 462551 - DNA, 25 bp, Rattus norvegicus
ggtaaccatggatacttagacactt

SEQ ID NO: 462552 - DNA, 25 bp, Rattus norvegicus
ggtaaccatgtaagctgccacttgg

SEQ ID NO: 462553 - DNA, 25 bp, Rattus norvegicus
ggtaaccatgtatgctgccacttgg

SEQ ID NO: 462554 - DNA, 25 bp, Rattus norvegicus
ggtaacccaagactcaaagcccatg

SEQ ID NO: 462555 - DNA, 25 bp, Rattus norvegicus
ggtaacccaagagtcaaagcccatg

SEQ ID NO: 462556 - DNA, 25 bp, Rattus norvegicus
ggtaacccaatgatgtatgatctaa

SEQ ID NO: 462557 - DNA, 25 bp, Rattus norvegicus
ggtaacccaatgttgtatgatctaa

SEQ ID NO: 462558 - DNA, 25 bp, Rattus norvegicus
ggtaaccccaggaactcaggcagag

SEQ ID NO: 462559 - DNA, 25 bp, Rattus norvegicus
ggtaaccccaggtactcaggcagag

SEQ ID NO: 462560 - DNA, 25 bp, Rattus norvegicus
ggtaaccctggactacacagtgcag

SEQ ID NO: 462561 - DNA, 25 bp, Rattus norvegicus
ggtaaccctggagtacacagtgcag

SEQ ID NO: 462562 - DNA, 25 bp, Rattus norvegicus
ggtaaccctgtgctattttacactg

SEQ ID NO: 462563 - DNA, 25 bp, Rattus norvegicus
ggtaaccctgtggtattttacactg

SEQ ID NO: 462564 - DNA, 25 bp, Rattus norvegicus
ggtaaccgaggacgctgcaacttta

SEQ ID NO: 462565 - DNA, 25 bp, Rattus norvegicus
ggtaaccgaggaggctgcaacttta

SEQ ID NO: 462566 - DNA, 25 bp, Rattus norvegicus
ggtaaccgtgcacagtaggcccgtt

SEQ ID NO: 462567 - DNA, 25 bp, Rattus norvegicus
ggtaaccgtgcagagtaggcccgtt

SEQ ID NO: 462568 - DNA, 25 bp, Rattus norvegicus
ggtaaccgtgttaaagcgccctgag

SEQ ID NO: 462569 - DNA, 25 bp, Rattus norvegicus
ggtaaccgtgtttaagcgccctgag

SEQ ID NO: 462570 - DNA, 25 bp, Rattus norvegicus
ggtaacctcaaaagactccagaatc

SEQ ID NO: 462571 - DNA, 25 bp, Rattus norvegicus
ggtaacctcaaatgactccagaatc

SEQ ID NO: 462572 - DNA, 25 bp, Rattus norvegicus
ggtaacctcatactacttaggaaag

SEQ ID NO: 462573 - DNA, 25 bp, Rattus norvegicus
ggtaacctcatagtacttaggaaag

SEQ ID NO: 462574 - DNA, 25 bp, Rattus norvegicus
ggtaacctcggaacctaaggcttag

SEQ ID NO: 462575 - DNA, 25 bp, Rattus norvegicus
ggtaacctcggatcctaaggcttag

SEQ ID NO: 462576 - DNA, 25 bp, Rattus norvegicus
ggtaacctctaaactgatcttcttc

SEQ ID NO: 462577 - DNA, 25 bp, Rattus norvegicus
ggtaacctctaatctgatcttcttc

SEQ ID NO: 462578 - DNA, 25 bp, Rattus norvegicus
ggtaacctgctaatcatttttatgg

SEQ ID NO: 462579 - DNA, 25 bp, Rattus norvegicus
ggtaacctgctattcatttttatgg

SEQ ID NO: 462580 - DNA, 25 bp, Rattus norvegicus
ggtaaccttagtctcttttattgct

SEQ ID NO: 462581 - DNA, 25 bp, Rattus norvegicus
ggtaaccttagtgtcttttattgct

SEQ ID NO: 462582 - DNA, 25 bp, Rattus norvegicus
ggtaaccttcatccagtaagtaaat

SEQ ID NO: 462583 - DNA, 25 bp, Rattus norvegicus
ggtaaccttcatgcagtaagtaaat

SEQ ID NO: 462584 - DNA, 25 bp, Rattus norvegicus
ggtaacgagctgaaatcattttata

SEQ ID NO: 462585 - DNA, 25 bp, Rattus norvegicus
ggtaacgagctgtaatcattttata

SEQ ID NO: 462586 - DNA, 25 bp, Rattus norvegicus
ggtaacgcacagacatgaactcttt

SEQ ID NO: 462587 - DNA, 25 bp, Rattus norvegicus
ggtaacgcacagtcatgaactcttt

SEQ ID NO: 462588 - DNA, 25 bp, Rattus norvegicus
ggtaacggacagatgttccaatctt

SEQ ID NO: 462589 - DNA, 25 bp, Rattus norvegicus
ggtaacggacagttgttccaatctt

SEQ ID NO: 462590 - DNA, 25 bp, Rattus norvegicus
ggtaacggccatcgtaactcagggt

SEQ ID NO: 462591 - DNA, 25 bp, Rattus norvegicus
ggtaacggccatggtaactcagggt

SEQ ID NO: 462592 - DNA, 25 bp, Rattus norvegicus
ggtaacgtaccaactcatttcttat

SEQ ID NO: 462593 - DNA, 25 bp, Rattus norvegicus
ggtaacgtaccatctcatttcttat

SEQ ID NO: 462594 - DNA, 25 bp, Rattus norvegicus
ggtaacgttcatatttaacatcttt

SEQ ID NO: 462595 - DNA, 25 bp, Rattus norvegicus
ggtaacgttcatttttaacatcttt

SEQ ID NO: 462596 - DNA, 25 bp, Rattus norvegicus
ggtaactaacccctggagatccctg

SEQ ID NO: 462597 - DNA, 25 bp, Rattus norvegicus
ggtaactaacccgtggagatccctg

SEQ ID NO: 462598 - DNA, 25 bp, Rattus norvegicus
ggtaactaagagctcctgcaagcat

SEQ ID NO: 462599 - DNA, 25 bp, Rattus norvegicus
ggtaactaagaggtcctgcaagcat

SEQ ID NO: 462600 - DNA, 25 bp, Rattus norvegicus
ggtaactaagttctcaggatgtgta

SEQ ID NO: 462601 - DNA, 25 bp, Rattus norvegicus
ggtaactaagttgtcaggatgtgta

SEQ ID NO: 462602 - DNA, 25 bp, Rattus norvegicus
ggtaactacctgacttcttttattg

SEQ ID NO: 462603 - DNA, 25 bp, Rattus norvegicus
ggtaactacctgtcttcttttattg

SEQ ID NO: 462604 - DNA, 25 bp, Rattus norvegicus
ggtaactactgacatacgtctggct

SEQ ID NO: 462605 - DNA, 25 bp, Rattus norvegicus
ggtaactactgagatacgtctggct

SEQ ID NO: 462606 - DNA, 25 bp, Rattus norvegicus
ggtaactatctcagtgttgtctcac

SEQ ID NO: 462607 - DNA, 25 bp, Rattus norvegicus
ggtaactatctctgtgttgtctcac

SEQ ID NO: 462608 - DNA, 25 bp, Rattus norvegicus
ggtaactatttcacagcacagcagg

SEQ ID NO: 462609 - DNA, 25 bp, Rattus norvegicus
ggtaactatttcattgctcaaacag

SEQ ID NO: 462610 - DNA, 25 bp, Rattus norvegicus
ggtaactatttctcagcacagcagg

SEQ ID NO: 462611 - DNA, 25 bp, Rattus norvegicus
ggtaactatttctttgctcaaacag

SEQ ID NO: 462612 - DNA, 25 bp, Rattus norvegicus
ggtaactcagcaccagtggccacaa

SEQ ID NO: 462613 - DNA, 25 bp, Rattus norvegicus
ggtaactcagcagcagtggccacaa

SEQ ID NO: 462614 - DNA, 25 bp, Rattus norvegicus
ggtaactcagtcaaattcccaaggt

SEQ ID NO: 462615 - DNA, 25 bp, Rattus norvegicus
ggtaactcagtctaattcccaaggt

SEQ ID NO: 462616 - DNA, 25 bp, Rattus norvegicus
ggtaactcatgcatataacccgagc

SEQ ID NO: 462617 - DNA, 25 bp, Rattus norvegicus
ggtaactcatgcttataacccgagc

SEQ ID NO: 462618 - DNA, 25 bp, Rattus norvegicus
ggtaactcccatctagattgtctta

SEQ ID NO: 462619 - DNA, 25 bp, Rattus norvegicus
ggtaactcccatgtagattgtctta

SEQ ID NO: 462620 - DNA, 25 bp, Rattus norvegicus
ggtaactctcccagaaggacatgag

SEQ ID NO: 462621 - DNA, 25 bp, Rattus norvegicus
ggtaactctccctgaaggacatgag

SEQ ID NO: 462622 - DNA, 25 bp, Rattus norvegicus
ggtaactgagtccacaaacagctgt

SEQ ID NO: 462623 - DNA, 25 bp, Rattus norvegicus
ggtaactgagtcgacaaacagctgt

SEQ ID NO: 462624 - DNA, 25 bp, Rattus norvegicus
ggtaactgcattctttgtattccaa

SEQ ID NO: 462625 - DNA, 25 bp, Rattus norvegicus
ggtaactgcattgtttgtattccaa

SEQ ID NO: 462626 - DNA, 25 bp, Rattus norvegicus
ggtaactggtacctggctagcctgc

SEQ ID NO: 462627 - DNA, 25 bp, Rattus norvegicus
ggtaactggtacgtggctagcctgc

SEQ ID NO: 462628 - DNA, 25 bp, Rattus norvegicus
ggtaactggttcaaaagccctctct

SEQ ID NO: 462629 - DNA, 25 bp, Rattus norvegicus
ggtaactggttcaataccatgtatg

SEQ ID NO: 462630 - DNA, 25 bp, Rattus norvegicus
ggtaactggttctaaagccctctct

SEQ ID NO: 462631 - DNA, 25 bp, Rattus norvegicus
ggtaactggttctataccatgtatg

SEQ ID NO: 462632 - DNA, 25 bp, Rattus norvegicus
ggtaactgtcgtctgaatcttttgt

SEQ ID NO: 462633 - DNA, 25 bp, Rattus norvegicus
ggtaactgtcgtgtgaatcttttgt

SEQ ID NO: 462634 - DNA, 25 bp, Rattus norvegicus
ggtaactgtgtcaggtgccaccatg

SEQ ID NO: 462635 - DNA, 25 bp, Rattus norvegicus
ggtaactgtgtctggtgccaccatg

SEQ ID NO: 462636 - DNA, 25 bp, Rattus norvegicus
ggtaacttacctcttctgtgtattc

SEQ ID NO: 462637 - DNA, 25 bp, Rattus norvegicus
ggtaacttacctgttctgtgtattc

SEQ ID NO: 462638 - DNA, 25 bp, Rattus norvegicus
ggtaacttagcccttaaccaagcat

SEQ ID NO: 462639 - DNA, 25 bp, Rattus norvegicus
ggtaacttagccgttaaccaagcat

SEQ ID NO: 462640 - DNA, 25 bp, Rattus norvegicus
ggtaacttatcacagccaagccttt

SEQ ID NO: 462641 - DNA, 25 bp, Rattus norvegicus
ggtaacttatcagagccaagccttt

SEQ ID NO: 462642 - DNA, 25 bp, Rattus norvegicus
ggtaacttgcttcagtttccatgaa

SEQ ID NO: 462643 - DNA, 25 bp, Rattus norvegicus
ggtaacttgcttgagtttccatgaa

SEQ ID NO: 462644 - DNA, 25 bp, Rattus norvegicus
ggtaactttgaacactttcttgcat

SEQ ID NO: 462645 - DNA, 25 bp, Rattus norvegicus
ggtaactttgaagactttcttgcat

SEQ ID NO: 462646 - DNA, 25 bp, Rattus norvegicus
ggtaactttttgcttctcaggaata

SEQ ID NO: 462647 - DNA, 25 bp, Rattus norvegicus
ggtaactttttggttctcaggaata

SEQ ID NO: 462648 - DNA, 25 bp, Rattus norvegicus
ggtaagaaacacagttgcctccctc

SEQ ID NO: 462649 - DNA, 25 bp, Rattus norvegicus
ggtaagaaacactgttgcctccctc

SEQ ID NO: 462650 - DNA, 25 bp, Rattus norvegicus
ggtaagaaacttcctgggcctgact

SEQ ID NO: 462651 - DNA, 25 bp, Rattus norvegicus
ggtaagaaacttgctgggcctgact

SEQ ID NO: 462652 - DNA, 25 bp, Rattus norvegicus
ggtaagaacactatctaaggaatag

SEQ ID NO: 462653 - DNA, 25 bp, Rattus norvegicus
ggtaagaacactttctaaggaatag

SEQ ID NO: 462654 - DNA, 25 bp, Rattus norvegicus
ggtaagaactgtccctaaccacgca

SEQ ID NO: 462655 - DNA, 25 bp, Rattus norvegicus
ggtaagaactgtgcctaaccacgca

SEQ ID NO: 462656 - DNA, 25 bp, Rattus norvegicus
ggtaagacttctctctttcattttt

SEQ ID NO: 462657 - DNA, 25 bp, Rattus norvegicus
ggtaagacttctgtctttcattttt

SEQ ID NO: 462658 - DNA, 25 bp, Rattus norvegicus
ggtaagagccctaaacagcaggcat

SEQ ID NO: 462659 - DNA, 25 bp, Rattus norvegicus
ggtaagagcccttaacagcaggcat

SEQ ID NO: 462660 - DNA, 25 bp, Rattus norvegicus
ggtaagagctccattctgaacatgg

SEQ ID NO: 462661 - DNA, 25 bp, Rattus norvegicus
ggtaagagctcctttctgaacatgg

SEQ ID NO: 462662 - DNA, 25 bp, Rattus norvegicus
ggtaagaggtcaccattacatggga

SEQ ID NO: 462663 - DNA, 25 bp, Rattus norvegicus
ggtaagaggtcagcattacatggga

SEQ ID NO: 462664 - DNA, 25 bp, Rattus norvegicus
ggtaagatacagcaggcccagttct

SEQ ID NO: 462665 - DNA, 25 bp, Rattus norvegicus
ggtaagatacaggaggcccagttct

SEQ ID NO: 462666 - DNA, 25 bp, Rattus norvegicus
ggtaagatattccagctagcacaag

SEQ ID NO: 462667 - DNA, 25 bp, Rattus norvegicus
ggtaagatattcgagctagcacaag

SEQ ID NO: 462668 - DNA, 25 bp, Rattus norvegicus
ggtaagcaagccattcaattcaatg

SEQ ID NO: 462669 - DNA, 25 bp, Rattus norvegicus
ggtaagcaagcctttcaattcaatg

SEQ ID NO: 462670 - DNA, 25 bp, Rattus norvegicus
ggtaagcatggtagccatccgcaat

SEQ ID NO: 462671 - DNA, 25 bp, Rattus norvegicus
ggtaagcatggttgccatccgcaat

SEQ ID NO: 462672 - DNA, 25 bp, Rattus norvegicus
ggtaagcatttacccctggatcaca

SEQ ID NO: 462673 - DNA, 25 bp, Rattus norvegicus
ggtaagcatttagccctggatcaca

SEQ ID NO: 462674 - DNA, 25 bp, Rattus norvegicus
ggtaagccacacaccttggagaatt

SEQ ID NO: 462675 - DNA, 25 bp, Rattus norvegicus
ggtaagccacactccttggagaatt

SEQ ID NO: 462676 - DNA, 25 bp, Rattus norvegicus
ggtaagccatccattgaaattttca

SEQ ID NO: 462677 - DNA, 25 bp, Rattus norvegicus
ggtaagccatcctttgaaattttca

SEQ ID NO: 462678 - DNA, 25 bp, Rattus norvegicus
ggtaagccattgaaaccgttctcta

SEQ ID NO: 462679 - DNA, 25 bp, Rattus norvegicus
ggtaagccattgtaaccgttctcta

SEQ ID NO: 462680 - DNA, 25 bp, Rattus norvegicus
ggtaagcctcgtatcctggaatgat

SEQ ID NO: 462681 - DNA, 25 bp, Rattus norvegicus
ggtaagcctcgtttcctggaatgat

SEQ ID NO: 462682 - DNA, 25 bp, Rattus norvegicus
ggtaagccttgcaaacatatccagc

SEQ ID NO: 462683 - DNA, 25 bp, Rattus norvegicus
ggtaagccttgctaacatatccagc

SEQ ID NO: 462684 - DNA, 25 bp, Rattus norvegicus
ggtaagcgctccataaatgtctttt

SEQ ID NO: 462685 - DNA, 25 bp, Rattus norvegicus
ggtaagcgctccttaaatgtctttt

SEQ ID NO: 462686 - DNA, 25 bp, Rattus norvegicus
ggtaagctcacaaaagtccaatctg

SEQ ID NO: 462687 - DNA, 25 bp, Rattus norvegicus
ggtaagctcacataagtccaatctg

SEQ ID NO: 462688 - DNA, 25 bp, Rattus norvegicus
ggtaagctgagcaaaaggattcttt

SEQ ID NO: 462689 - DNA, 25 bp, Rattus norvegicus
ggtaagctgagctaaaggattcttt

SEQ ID NO: 462690 - DNA, 25 bp, Rattus norvegicus
ggtaagctgccacgcttgttcagca

SEQ ID NO: 462691 - DNA, 25 bp, Rattus norvegicus
ggtaagctgccaggcttgttcagca

SEQ ID NO: 462692 - DNA, 25 bp, Rattus norvegicus
ggtaaggaagggaactgacacgatc

SEQ ID NO: 462693 - DNA, 25 bp, Rattus norvegicus
ggtaaggaagggtactgacacgatc

SEQ ID NO: 462694 - DNA, 25 bp, Rattus norvegicus
ggtaaggacaatcgcaccatgccca

SEQ ID NO: 462695 - DNA, 25 bp, Rattus norvegicus
ggtaaggacaatggcaccatgccca

SEQ ID NO: 462696 - DNA, 25 bp, Rattus norvegicus
ggtaaggactctcagacgactcact

SEQ ID NO: 462697 - DNA, 25 bp, Rattus norvegicus
ggtaaggactctgagacgactcact

SEQ ID NO: 462698 - DNA, 25 bp, Rattus norvegicus
ggtaaggaggagactcctccatcca

SEQ ID NO: 462699 - DNA, 25 bp, Rattus norvegicus
ggtaaggaggagtctcctccatcca

SEQ ID NO: 462700 - DNA, 25 bp, Rattus norvegicus
ggtaaggatgcaattctagcctcat

SEQ ID NO: 462701 - DNA, 25 bp, Rattus norvegicus
ggtaaggatgcatttctagcctcat

SEQ ID NO: 462702 - DNA, 25 bp, Rattus norvegicus
ggtaaggcgtatactatgtaaggaa

SEQ ID NO: 462703 - DNA, 25 bp, Rattus norvegicus
ggtaaggcgtattctatgtaaggaa

SEQ ID NO: 462704 - DNA, 25 bp, Rattus norvegicus
ggtaaggcttatatctggctcagta

SEQ ID NO: 462705 - DNA, 25 bp, Rattus norvegicus
ggtaaggcttatttctggctcagta

SEQ ID NO: 462706 - DNA, 25 bp, Rattus norvegicus
ggtaagggcacacagccaactgaat

SEQ ID NO: 462707 - DNA, 25 bp, Rattus norvegicus
ggtaagggcacagagccaactgaat

SEQ ID NO: 462708 - DNA, 25 bp, Rattus norvegicus
ggtaagggccacacatatacttaat

SEQ ID NO: 462709 - DNA, 25 bp, Rattus norvegicus
ggtaagggccactcatatacttaat

SEQ ID NO: 462710 - DNA, 25 bp, Rattus norvegicus
ggtaaggtactgctttgcaaactca

SEQ ID NO: 462711 - DNA, 25 bp, Rattus norvegicus
ggtaaggtactggtttgcaaactca

SEQ ID NO: 462712 - DNA, 25 bp, Rattus norvegicus
ggtaagtattggctttccatgtcat

SEQ ID NO: 462713 - DNA, 25 bp, Rattus norvegicus
ggtaagtattgggtttccatgtcat

SEQ ID NO: 462714 - DNA, 25 bp, Rattus norvegicus
ggtaagtcctttaacattctatgat

SEQ ID NO: 462715 - DNA, 25 bp, Rattus norvegicus
ggtaagtccttttacattctatgat

SEQ ID NO: 462716 - DNA, 25 bp, Rattus norvegicus
ggtaagtgcaggagggcgggtccct

SEQ ID NO: 462717 - DNA, 25 bp, Rattus norvegicus
ggtaagtgcaggtgggcgggtccct

SEQ ID NO: 462718 - DNA, 25 bp, Rattus norvegicus
ggtaagtgggccagttgccatagca

SEQ ID NO: 462719 - DNA, 25 bp, Rattus norvegicus
ggtaagtgggcctgttgccatagca

SEQ ID NO: 462720 - DNA, 25 bp, Rattus norvegicus
ggtaagttatgtaaagtctatgtgt

SEQ ID NO: 462721 - DNA, 25 bp, Rattus norvegicus
ggtaagttatgttaagtctatgtgt

SEQ ID NO: 462722 - DNA, 25 bp, Rattus norvegicus
ggtaagttttgcactgggtactact

SEQ ID NO: 462723 - DNA, 25 bp, Rattus norvegicus
ggtaagttttgctctgggtactact

SEQ ID NO: 462724 - DNA, 25 bp, Rattus norvegicus
ggtaataaccatccgtgatgcccat

SEQ ID NO: 462725 - DNA, 25 bp, Rattus norvegicus
ggtaataaccatgcgtgatgcccat

SEQ ID NO: 462726 - DNA, 25 bp, Rattus norvegicus
ggtaataccaaacctcatggccaat

SEQ ID NO: 462727 - DNA, 25 bp, Rattus norvegicus
ggtaataccaaagctcatggccaat

SEQ ID NO: 462728 - DNA, 25 bp, Rattus norvegicus
ggtaatagcagcaagaatcactctt

SEQ ID NO: 462729 - DNA, 25 bp, Rattus norvegicus
ggtaatagcagctagaatcactctt

SEQ ID NO: 462730 - DNA, 25 bp, Rattus norvegicus
ggtaataggagacccctcaccctgt

SEQ ID NO: 462731 - DNA, 25 bp, Rattus norvegicus
ggtaataggagagccctcaccctgt

SEQ ID NO: 462732 - DNA, 25 bp, Rattus norvegicus
ggtaatagtggcagtcccggccgtc

SEQ ID NO: 462733 - DNA, 25 bp, Rattus norvegicus
ggtaatagtggctgtcccggccgtc

SEQ ID NO: 462734 - DNA, 25 bp, Rattus norvegicus
ggtaatatcattattgttctgaata

SEQ ID NO: 462735 - DNA, 25 bp, Rattus norvegicus
ggtaatatcattcccaccagtgcaa

SEQ ID NO: 462736 - DNA, 25 bp, Rattus norvegicus
ggtaatatcattgccaccagtgcaa

SEQ ID NO: 462737 - DNA, 25 bp, Rattus norvegicus
ggtaatatcatttttgttctgaata

SEQ ID NO: 462738 - DNA, 25 bp, Rattus norvegicus
ggtaatatgcttcagttttctagat

SEQ ID NO: 462739 - DNA, 25 bp, Rattus norvegicus
ggtaatatgcttgagttttctagat

SEQ ID NO: 462740 - DNA, 25 bp, Rattus norvegicus
ggtaatatgtgaccgtggctcccat

SEQ ID NO: 462741 - DNA, 25 bp, Rattus norvegicus
ggtaatatgtgagcgtggctcccat

SEQ ID NO: 462742 - DNA, 25 bp, Rattus norvegicus
ggtaatattcctatgccagacatgg

SEQ ID NO: 462743 - DNA, 25 bp, Rattus norvegicus
ggtaatattcctttgccagacatgg

SEQ ID NO: 462744 - DNA, 25 bp, Rattus norvegicus
ggtaatattctaaccttatgacact

SEQ ID NO: 462745 - DNA, 25 bp, Rattus norvegicus
ggtaatattctatccttatgacact

SEQ ID NO: 462746 - DNA, 25 bp, Rattus norvegicus
ggtaatatttccaaagcgtgcctaa

SEQ ID NO: 462747 - DNA, 25 bp, Rattus norvegicus
ggtaatatttcctaagcgtgcctaa

SEQ ID NO: 462748 - DNA, 25 bp, Rattus norvegicus
ggtaatattttccacttgctcttga

SEQ ID NO: 462749 - DNA, 25 bp, Rattus norvegicus
ggtaatattttcgacttgctcttga

SEQ ID NO: 462750 - DNA, 25 bp, Rattus norvegicus
ggtaatcaaaatctcagtcagtctt

SEQ ID NO: 462751 - DNA, 25 bp, Rattus norvegicus
ggtaatcaaaatgtcagtcagtctt

SEQ ID NO: 462752 - DNA, 25 bp, Rattus norvegicus
ggtaatcaagatcttgcctccccag

SEQ ID NO: 462753 - DNA, 25 bp, Rattus norvegicus
ggtaatcaagatgttgcctccccag

SEQ ID NO: 462754 - DNA, 25 bp, Rattus norvegicus
ggtaatcacccaaggagttaaacat

SEQ ID NO: 462755 - DNA, 25 bp, Rattus norvegicus
ggtaatcacccatggagttaaacat

SEQ ID NO: 462756 - DNA, 25 bp, Rattus norvegicus
ggtaatcagttcatgggatctctct

SEQ ID NO: 462757 - DNA, 25 bp, Rattus norvegicus
ggtaatcagttcttgggatctctct

SEQ ID NO: 462758 - DNA, 25 bp, Rattus norvegicus
ggtaatcagtttaatctttcgaaag

SEQ ID NO: 462759 - DNA, 25 bp, Rattus norvegicus
ggtaatcagttttatctttcgaaag

SEQ ID NO: 462760 - DNA, 25 bp, Rattus norvegicus
ggtaatcatcttagtctctggttag

SEQ ID NO: 462761 - DNA, 25 bp, Rattus norvegicus
ggtaatcatctttgtctctggttag

SEQ ID NO: 462762 - DNA, 25 bp, Rattus norvegicus
ggtaatccagtaagacgaccattgt

SEQ ID NO: 462763 - DNA, 25 bp, Rattus norvegicus
ggtaatccagtatgacgaccattgt

SEQ ID NO: 462764 - DNA, 25 bp, Rattus norvegicus
ggtaatcccaacatctgttagtatg

SEQ ID NO: 462765 - DNA, 25 bp, Rattus norvegicus
ggtaatcccaacttctgttagtatg

SEQ ID NO: 462766 - DNA, 25 bp, Rattus norvegicus
ggtaatccctcaacagaactcattc

SEQ ID NO: 462767 - DNA, 25 bp, Rattus norvegicus
ggtaatccctcatcagaactcattc

SEQ ID NO: 462768 - DNA, 25 bp, Rattus norvegicus
ggtaatcccttgagagagtccctaa

SEQ ID NO: 462769 - DNA, 25 bp, Rattus norvegicus
ggtaatcccttgtgagagtccctaa

SEQ ID NO: 462770 - DNA, 25 bp, Rattus norvegicus
ggtaatccttaaacgtcaacatctg

SEQ ID NO: 462771 - DNA, 25 bp, Rattus norvegicus
ggtaatccttaatcgtcaacatctg

SEQ ID NO: 462772 - DNA, 25 bp, Rattus norvegicus
ggtaatcgggttatcaggcactagt

SEQ ID NO: 462773 - DNA, 25 bp, Rattus norvegicus
ggtaatcgggttttcaggcactagt

SEQ ID NO: 462774 - DNA, 25 bp, Rattus norvegicus
ggtaatctcataagacactgccctt

SEQ ID NO: 462775 - DNA, 25 bp, Rattus norvegicus
ggtaatctcatatgacactgccctt

SEQ ID NO: 462776 - DNA, 25 bp, Rattus norvegicus
ggtaatctctgaaattcttcctctt

SEQ ID NO: 462777 - DNA, 25 bp, Rattus norvegicus
ggtaatctctgatattcttcctctt

SEQ ID NO: 462778 - DNA, 25 bp, Rattus norvegicus
ggtaatctgctgctgaattgtatgt

SEQ ID NO: 462779 - DNA, 25 bp, Rattus norvegicus
ggtaatctgctggtgaattgtatgt

SEQ ID NO: 462780 - DNA, 25 bp, Rattus norvegicus
ggtaatctgggcactaaagccttca

SEQ ID NO: 462781 - DNA, 25 bp, Rattus norvegicus
ggtaatctgggctctaaagccttca

SEQ ID NO: 462782 - DNA, 25 bp, Rattus norvegicus
ggtaatcttatgacagcacagttta

SEQ ID NO: 462783 - DNA, 25 bp, Rattus norvegicus
ggtaatcttatgtcagcacagttta

SEQ ID NO: 462784 - DNA, 25 bp, Rattus norvegicus
ggtaatcttgacataacactgccat

SEQ ID NO: 462785 - DNA, 25 bp, Rattus norvegicus
ggtaatcttgacttaacactgccat

SEQ ID NO: 462786 - DNA, 25 bp, Rattus norvegicus
ggtaatctttccactgtttgctgtc

SEQ ID NO: 462787 - DNA, 25 bp, Rattus norvegicus
ggtaatctttcctctgtttgctgtc

SEQ ID NO: 462788 - DNA, 25 bp, Rattus norvegicus
ggtaatctttggacctttgtgtgga

SEQ ID NO: 462789 - DNA, 25 bp, Rattus norvegicus
ggtaatctttggtcctttgtgtgga

SEQ ID NO: 462790 - DNA, 25 bp, Rattus norvegicus
ggtaatgaacccagttgacttctga

SEQ ID NO: 462791 - DNA, 25 bp, Rattus norvegicus
ggtaatgaaccctgttgacttctga

SEQ ID NO: 462792 - DNA, 25 bp, Rattus norvegicus
ggtaatgaactaaccttctgaaagt

SEQ ID NO: 462793 - DNA, 25 bp, Rattus norvegicus
ggtaatgaactatccttctgaaagt

SEQ ID NO: 462794 - DNA, 25 bp, Rattus norvegicus
ggtaatgaccgactgtgaggcccca

SEQ ID NO: 462795 - DNA, 25 bp, Rattus norvegicus
ggtaatgaccgagtgtgaggcccca

SEQ ID NO: 462796 - DNA, 25 bp, Rattus norvegicus
ggtaatgacttcagttcttttgtaa

SEQ ID NO: 462797 - DNA, 25 bp, Rattus norvegicus
ggtaatgacttctgttcttttgtaa

SEQ ID NO: 462798 - DNA, 25 bp, Rattus norvegicus
ggtaatgactttcttcttgctgatc

SEQ ID NO: 462799 - DNA, 25 bp, Rattus norvegicus
ggtaatgactttgttcttgctgatc

SEQ ID NO: 462800 - DNA, 25 bp, Rattus norvegicus
ggtaatgatcagctgtatcaccaga

SEQ ID NO: 462801 - DNA, 25 bp, Rattus norvegicus
ggtaatgatcaggtgtatcaccaga

SEQ ID NO: 462802 - DNA, 25 bp, Rattus norvegicus
ggtaatgcataccatacatttatct

SEQ ID NO: 462803 - DNA, 25 bp, Rattus norvegicus
ggtaatgcatacgatacatttatct

SEQ ID NO: 462804 - DNA, 25 bp, Rattus norvegicus
ggtaatgccaaacccattgtttcac

SEQ ID NO: 462805 - DNA, 25 bp, Rattus norvegicus
ggtaatgccaaagccattgtttcac

SEQ ID NO: 462806 - DNA, 25 bp, Rattus norvegicus
ggtaatgctgcaagtacagaccttc

SEQ ID NO: 462807 - DNA, 25 bp, Rattus norvegicus
ggtaatgctgcatgtacagaccttc

SEQ ID NO: 462808 - DNA, 25 bp, Rattus norvegicus
ggtaatggaagtcaagacccttcaa

SEQ ID NO: 462809 - DNA, 25 bp, Rattus norvegicus
ggtaatggaagtgaagacccttcaa

SEQ ID NO: 462810 - DNA, 25 bp, Rattus norvegicus
ggtaatgggtgtccaggcaccacac

SEQ ID NO: 462811 - DNA, 25 bp, Rattus norvegicus
ggtaatgggtgtgcaggcaccacac

SEQ ID NO: 462812 - DNA, 25 bp, Rattus norvegicus
ggtaatgtcatgctagcatttccca

SEQ ID NO: 462813 - DNA, 25 bp, Rattus norvegicus
ggtaatgtcatggtagcatttccca

SEQ ID NO: 462814 - DNA, 25 bp, Rattus norvegicus
ggtaatgtctgcatcatgacttgca

SEQ ID NO: 462815 - DNA, 25 bp, Rattus norvegicus
ggtaatgtctgcttcatgacttgca

SEQ ID NO: 462816 - DNA, 25 bp, Rattus norvegicus
ggtaatgtttcgcttattttgtgac

SEQ ID NO: 462817 - DNA, 25 bp, Rattus norvegicus
ggtaatgtttcggttattttgtgac

SEQ ID NO: 462818 - DNA, 25 bp, Rattus norvegicus
ggtaatgtttgtaaagcgctttgta

SEQ ID NO: 462819 - DNA, 25 bp, Rattus norvegicus
ggtaatgtttgtactctgttgctat

SEQ ID NO: 462820 - DNA, 25 bp, Rattus norvegicus
ggtaatgtttgttaagcgctttgta

SEQ ID NO: 462821 - DNA, 25 bp, Rattus norvegicus
ggtaatgtttgttctctgttgctat

SEQ ID NO: 462822 - DNA, 25 bp, Rattus norvegicus
ggtaattagcaactgactctgcctt

SEQ ID NO: 462823 - DNA, 25 bp, Rattus norvegicus
ggtaattagcaagtgactctgcctt

SEQ ID NO: 462824 - DNA, 25 bp, Rattus norvegicus
ggtaattattccactggactttcag

SEQ ID NO: 462825 - DNA, 25 bp, Rattus norvegicus
ggtaattattcctctggactttcag

SEQ ID NO: 462826 - DNA, 25 bp, Rattus norvegicus
ggtaattcacagcatttttccctta

SEQ ID NO: 462827 - DNA, 25 bp, Rattus norvegicus
ggtaattcacaggatttttccctta

SEQ ID NO: 462828 - DNA, 25 bp, Rattus norvegicus
ggtaattcccctctacgcatgtgca

SEQ ID NO: 462829 - DNA, 25 bp, Rattus norvegicus
ggtaattcccctgtacgcatgtgca

SEQ ID NO: 462830 - DNA, 25 bp, Rattus norvegicus
ggtaattcggaaccatgtgcctgca

SEQ ID NO: 462831 - DNA, 25 bp, Rattus norvegicus
ggtaattcggaagcatgtgcctgca

SEQ ID NO: 462832 - DNA, 25 bp, Rattus norvegicus
ggtaattctaggatctgattaggat

SEQ ID NO: 462833 - DNA, 25 bp, Rattus norvegicus
ggtaattctaggttctgattaggat

SEQ ID NO: 462834 - DNA, 25 bp, Rattus norvegicus
ggtaattgccacagtacctgtgcaa

SEQ ID NO: 462835 - DNA, 25 bp, Rattus norvegicus
ggtaattgccactgtacctgtgcaa

SEQ ID NO: 462836 - DNA, 25 bp, Rattus norvegicus
ggtaattggatgactttctcctaca

SEQ ID NO: 462837 - DNA, 25 bp, Rattus norvegicus
ggtaattggatgtctttctcctaca

SEQ ID NO: 462838 - DNA, 25 bp, Rattus norvegicus
ggtaattgtattacatccttatgtt

SEQ ID NO: 462839 - DNA, 25 bp, Rattus norvegicus
ggtaattgtatttcatccttatgtt

SEQ ID NO: 462840 - DNA, 25 bp, Rattus norvegicus
ggtaatttatctccactactatttt

SEQ ID NO: 462841 - DNA, 25 bp, Rattus norvegicus
ggtaatttatctgcactactatttt

SEQ ID NO: 462842 - DNA, 25 bp, Rattus norvegicus
ggtaatttattcaagccgtctccct

SEQ ID NO: 462843 - DNA, 25 bp, Rattus norvegicus
ggtaatttattctagccgtctccct

SEQ ID NO: 462844 - DNA, 25 bp, Rattus norvegicus
ggtaatttccacatttctgactgtt

SEQ ID NO: 462845 - DNA, 25 bp, Rattus norvegicus
ggtaatttccacttttctgactgtt

SEQ ID NO: 462846 - DNA, 25 bp, Rattus norvegicus
ggtaatttctaacagtccctcacct

SEQ ID NO: 462847 - DNA, 25 bp, Rattus norvegicus
ggtaatttctaagagtccctcacct

SEQ ID NO: 462848 - DNA, 25 bp, Rattus norvegicus
ggtaatttgcctctttgctttgaaa

SEQ ID NO: 462849 - DNA, 25 bp, Rattus norvegicus
ggtaatttgcctgtttgctttgaaa

SEQ ID NO: 462850 - DNA, 25 bp, Rattus norvegicus
ggtaattttgtcatccaggtggctt

SEQ ID NO: 462851 - DNA, 25 bp, Rattus norvegicus
ggtaattttgtcttccaggtggctt

SEQ ID NO: 462852 - DNA, 25 bp, Rattus norvegicus
ggtacaaactacacgaggtgcatct

SEQ ID NO: 462853 - DNA, 25 bp, Rattus norvegicus
ggtacaaactactcgaggtgcatct

SEQ ID NO: 462854 - DNA, 25 bp, Rattus norvegicus
ggtacaaagctgatggcctgggctc

SEQ ID NO: 462855 - DNA, 25 bp, Rattus norvegicus
ggtacaaagctgttggcctgggctc

SEQ ID NO: 462856 - DNA, 25 bp, Rattus norvegicus
ggtacaaagtctaccttggaacgag

SEQ ID NO: 462857 - DNA, 25 bp, Rattus norvegicus
ggtacaaagtcttccttggaacgag

SEQ ID NO: 462858 - DNA, 25 bp, Rattus norvegicus
ggtacaaagtgtccgacgtgccctt

SEQ ID NO: 462859 - DNA, 25 bp, Rattus norvegicus
ggtacaaagtgtgcgacgtgccctt

SEQ ID NO: 462860 - DNA, 25 bp, Rattus norvegicus
ggtacaaatgacaatcgtccttgga

SEQ ID NO: 462861 - DNA, 25 bp, Rattus norvegicus
ggtacaaatgactatcgtccttgga

SEQ ID NO: 462862 - DNA, 25 bp, Rattus norvegicus
ggtacaactgttaccactgagtaaa

SEQ ID NO: 462863 - DNA, 25 bp, Rattus norvegicus
ggtacaactgtttccactgagtaaa

SEQ ID NO: 462864 - DNA, 25 bp, Rattus norvegicus
ggtacaagctctcggtcgacgcctg

SEQ ID NO: 462865 - DNA, 25 bp, Rattus norvegicus
ggtacaagctctgggtcgacgcctg

SEQ ID NO: 462866 - DNA, 25 bp, Rattus norvegicus
ggtacaaggacacgtatcccagcaa

SEQ ID NO: 462867 - DNA, 25 bp, Rattus norvegicus
ggtacaaggacaggtatcccagcaa

SEQ ID NO: 462868 - DNA, 25 bp, Rattus norvegicus
ggtacaaggaccagctttcttaatg

SEQ ID NO: 462869 - DNA, 25 bp, Rattus norvegicus
ggtacaaggacctgctttcttaatg

SEQ ID NO: 462870 - DNA, 25 bp, Rattus norvegicus
ggtacaagtagacgttcaagagccc

SEQ ID NO: 462871 - DNA, 25 bp, Rattus norvegicus
ggtacaagtagaggttcaagagccc

SEQ ID NO: 462872 - DNA, 25 bp, Rattus norvegicus
ggtacaagtcttccatcagctctat

SEQ ID NO: 462873 - DNA, 25 bp, Rattus norvegicus
ggtacaagtcttgcatcagctctat

SEQ ID NO: 462874 - DNA, 25 bp, Rattus norvegicus
ggtacaagtgccatcagagttcaga

SEQ ID NO: 462875 - DNA, 25 bp, Rattus norvegicus
ggtacaagtgccttcagagttcaga

SEQ ID NO: 462876 - DNA, 25 bp, Rattus norvegicus
ggtacaagttcaccgtgacggagtt

SEQ ID NO: 462877 - DNA, 25 bp, Rattus norvegicus
ggtacaagttcagcgtgacggagtt

SEQ ID NO: 462878 - DNA, 25 bp, Rattus norvegicus
ggtacaatcattcaccgagtcgatc

SEQ ID NO: 462879 - DNA, 25 bp, Rattus norvegicus
ggtacaatcattgaccgagtcgatc

SEQ ID NO: 462880 - DNA, 25 bp, Rattus norvegicus
ggtacaatcttaatcatgggacgag

SEQ ID NO: 462881 - DNA, 25 bp, Rattus norvegicus
ggtacaatcttattcatgggacgag

SEQ ID NO: 462882 - DNA, 25 bp, Rattus norvegicus
ggtacaatgacaaacagccctgcat

SEQ ID NO: 462883 - DNA, 25 bp, Rattus norvegicus
ggtacaatgacatacagccctgcat

SEQ ID NO: 462884 - DNA, 25 bp, Rattus norvegicus
ggtacaatgactaccttcatgaccc

SEQ ID NO: 462885 - DNA, 25 bp, Rattus norvegicus
ggtacaatgacttccttcatgaccc

SEQ ID NO: 462886 - DNA, 25 bp, Rattus norvegicus
ggtacaatgcccaagtggagtggtt

SEQ ID NO: 462887 - DNA, 25 bp, Rattus norvegicus
ggtacaatgcccagtgccaggagac

SEQ ID NO: 462888 - DNA, 25 bp, Rattus norvegicus
ggtacaatgccctagtggagtggtt

SEQ ID NO: 462889 - DNA, 25 bp, Rattus norvegicus
ggtacaatgccctgtgccaggagac

SEQ ID NO: 462890 - DNA, 25 bp, Rattus norvegicus
ggtacaatgcctctgctcactccaa

SEQ ID NO: 462891 - DNA, 25 bp, Rattus norvegicus
ggtacaatgcctgtgctcactccaa

SEQ ID NO: 462892 - DNA, 25 bp, Rattus norvegicus
ggtacaatggcccagtgttcacatg

SEQ ID NO: 462893 - DNA, 25 bp, Rattus norvegicus
ggtacaatggccgagtgttcacatg

SEQ ID NO: 462894 - DNA, 25 bp, Rattus norvegicus
ggtacaatgtgtctctttcaaaaaa

SEQ ID NO: 462895 - DNA, 25 bp, Rattus norvegicus
ggtacaatgtgtgtctttcaaaaaa

SEQ ID NO: 462896 - DNA, 25 bp, Rattus norvegicus
ggtacaattaccctgactgatagca

SEQ ID NO: 462897 - DNA, 25 bp, Rattus norvegicus
ggtacaattaccgtgactgatagca

SEQ ID NO: 462898 - DNA, 25 bp, Rattus norvegicus
ggtacaattatcctcgcacacaatt

SEQ ID NO: 462899 - DNA, 25 bp, Rattus norvegicus
ggtacaattatcgtcgcacacaatt

SEQ ID NO: 462900 - DNA, 25 bp, Rattus norvegicus
ggtacacaactacccaagggagtag

SEQ ID NO: 462901 - DNA, 25 bp, Rattus norvegicus
ggtacacaactagccaagggagtag

SEQ ID NO: 462902 - DNA, 25 bp, Rattus norvegicus
ggtacacaagtgactgttgagtgct

SEQ ID NO: 462903 - DNA, 25 bp, Rattus norvegicus
ggtacacaagtgtctgttgagtgct

SEQ ID NO: 462904 - DNA, 25 bp, Rattus norvegicus
ggtacacacaacagaggagctcctg

SEQ ID NO: 462905 - DNA, 25 bp, Rattus norvegicus
ggtacacacaactgaggagctcctg

SEQ ID NO: 462906 - DNA, 25 bp, Rattus norvegicus
ggtacacactaaagaacccagcatt

SEQ ID NO: 462907 - DNA, 25 bp, Rattus norvegicus
ggtacacactaatgaacccagcatt

SEQ ID NO: 462908 - DNA, 25 bp, Rattus norvegicus
ggtacacagacacgcagatcccaat

SEQ ID NO: 462909 - DNA, 25 bp, Rattus norvegicus
ggtacacagacaggcagatcccaat

SEQ ID NO: 462910 - DNA, 25 bp, Rattus norvegicus
ggtacacagcctaacatcttgctaa

SEQ ID NO: 462911 - DNA, 25 bp, Rattus norvegicus
ggtacacagccttacatcttgctaa

SEQ ID NO: 462912 - DNA, 25 bp, Rattus norvegicus
ggtacacaggctattgcaggcccag

SEQ ID NO: 462913 - DNA, 25 bp, Rattus norvegicus
ggtacacaggcttttgcaggcccag

SEQ ID NO: 462914 - DNA, 25 bp, Rattus norvegicus
ggtacacagtccatatcttactgga

SEQ ID NO: 462915 - DNA, 25 bp, Rattus norvegicus
ggtacacagtccttatcttactgga

SEQ ID NO: 462916 - DNA, 25 bp, Rattus norvegicus
ggtacacagttgcacttccctggaa

SEQ ID NO: 462917 - DNA, 25 bp, Rattus norvegicus
ggtacacagttggacttccctggaa

SEQ ID NO: 462918 - DNA, 25 bp, Rattus norvegicus
ggtacacatcacactacagttgagt

SEQ ID NO: 462919 - DNA, 25 bp, Rattus norvegicus
ggtacacatcactctacagttgagt

SEQ ID NO: 462920 - DNA, 25 bp, Rattus norvegicus
ggtacacatggaaacctgccagcaa

SEQ ID NO: 462921 - DNA, 25 bp, Rattus norvegicus
ggtacacatggatacctgccagcaa

SEQ ID NO: 462922 - DNA, 25 bp, Rattus norvegicus
ggtacacccatcaggtttcttacag

SEQ ID NO: 462923 - DNA, 25 bp, Rattus norvegicus
ggtacacccatctggtttcttacag

SEQ ID NO: 462924 - DNA, 25 bp, Rattus norvegicus
ggtacaccccgacgagacatgacat

SEQ ID NO: 462925 - DNA, 25 bp, Rattus norvegicus
ggtacaccccgaggagacatgacat

SEQ ID NO: 462926 - DNA, 25 bp, Rattus norvegicus
ggtacaccgactatgtagagctttt

SEQ ID NO: 462927 - DNA, 25 bp, Rattus norvegicus
ggtacaccgactttgtagagctttt

SEQ ID NO: 462928 - DNA, 25 bp, Rattus norvegicus
ggtacacctccacaactttagcgtt

SEQ ID NO: 462929 - DNA, 25 bp, Rattus norvegicus
ggtacacctccagaactttagcgtt

SEQ ID NO: 462930 - DNA, 25 bp, Rattus norvegicus
ggtacacctccccaaatctaattgg

SEQ ID NO: 462931 - DNA, 25 bp, Rattus norvegicus
ggtacacctcccgaaatctaattgg

SEQ ID NO: 462932 - DNA, 25 bp, Rattus norvegicus
ggtacacctgaacagttccttcaga

SEQ ID NO: 462933 - DNA, 25 bp, Rattus norvegicus
ggtacacctgaagagttccttcaga

SEQ ID NO: 462934 - DNA, 25 bp, Rattus norvegicus
ggtacacgtaagctcacacagacat

SEQ ID NO: 462935 - DNA, 25 bp, Rattus norvegicus
ggtacacgtaaggtcacacagacat

SEQ ID NO: 462936 - DNA, 25 bp, Rattus norvegicus
ggtacacgtgccctgaggatgtcac

SEQ ID NO: 462937 - DNA, 25 bp, Rattus norvegicus
ggtacacgtgccgtgaggatgtcac

SEQ ID NO: 462938 - DNA, 25 bp, Rattus norvegicus
ggtacactcagtacactcggtacac

SEQ ID NO: 462939 - DNA, 25 bp, Rattus norvegicus
ggtacactcagttcactcggtacac

SEQ ID NO: 462940 - DNA, 25 bp, Rattus norvegicus
ggtacactgaccaaaagttctcttt

SEQ ID NO: 462941 - DNA, 25 bp, Rattus norvegicus
ggtacactgacctaaagttctcttt

SEQ ID NO: 462942 - DNA, 25 bp, Rattus norvegicus
ggtacactgagaccaactacacagc

SEQ ID NO: 462943 - DNA, 25 bp, Rattus norvegicus
ggtacactgagagcaactacacagc

SEQ ID NO: 462944 - DNA, 25 bp, Rattus norvegicus
ggtacactggtcacccatgggtaat

SEQ ID NO: 462945 - DNA, 25 bp, Rattus norvegicus
ggtacactggtctcccatgggtaat

SEQ ID NO: 462946 - DNA, 25 bp, Rattus norvegicus
ggtacactgtatcagcaccgaattc

SEQ ID NO: 462947 - DNA, 25 bp, Rattus norvegicus
ggtacactgtatgagcaccgaattc

SEQ ID NO: 462948 - DNA, 25 bp, Rattus norvegicus
ggtacactgtgaatcggcgctggca

SEQ ID NO: 462949 - DNA, 25 bp, Rattus norvegicus
ggtacactgtgattcggcgctggca

SEQ ID NO: 462950 - DNA, 25 bp, Rattus norvegicus
ggtacacttgacatttagttcctag

SEQ ID NO: 462951 - DNA, 25 bp, Rattus norvegicus
ggtacacttgacttttagttcctag

SEQ ID NO: 462952 - DNA, 25 bp, Rattus norvegicus
ggtacacttgatcttatgtccatat

SEQ ID NO: 462953 - DNA, 25 bp, Rattus norvegicus
ggtacacttgatgttatgtccatat

SEQ ID NO: 462954 - DNA, 25 bp, Rattus norvegicus
ggtacagacatgacacagggccaca

SEQ ID NO: 462955 - DNA, 25 bp, Rattus norvegicus
ggtacagacatgtcacagggccaca

SEQ ID NO: 462956 - DNA, 25 bp, Rattus norvegicus
ggtacagacccaagagtgactcagt

SEQ ID NO: 462957 - DNA, 25 bp, Rattus norvegicus
ggtacagacccatgagtgactcagt

SEQ ID NO: 462958 - DNA, 25 bp, Rattus norvegicus
ggtacagacgctccagtttgtccga

SEQ ID NO: 462959 - DNA, 25 bp, Rattus norvegicus
ggtacagacgctgcagtttgtccga

SEQ ID NO: 462960 - DNA, 25 bp, Rattus norvegicus
ggtacagagaatcagttcgcctccc

SEQ ID NO: 462961 - DNA, 25 bp, Rattus norvegicus
ggtacagagaatgagttcgcctccc

SEQ ID NO: 462962 - DNA, 25 bp, Rattus norvegicus
ggtacagagcccagggacgaccgtc

SEQ ID NO: 462963 - DNA, 25 bp, Rattus norvegicus
ggtacagagccctgggacgaccgtc

SEQ ID NO: 462964 - DNA, 25 bp, Rattus norvegicus
ggtacagaggaacctcccttacatt

SEQ ID NO: 462965 - DNA, 25 bp, Rattus norvegicus
ggtacagaggaagctcccttacatt

SEQ ID NO: 462966 - DNA, 25 bp, Rattus norvegicus
ggtacagatgttcgcctgatcccag

SEQ ID NO: 462967 - DNA, 25 bp, Rattus norvegicus
ggtacagatgttggcctgatcccag

SEQ ID NO: 462968 - DNA, 25 bp, Rattus norvegicus
ggtacagcaacaagtgcacacgcat

SEQ ID NO: 462969 - DNA, 25 bp, Rattus norvegicus
ggtacagcaacatgtgcacacgcat

SEQ ID NO: 462970 - DNA, 25 bp, Rattus norvegicus
ggtacagcactgagaattgaatcta

SEQ ID NO: 462971 - DNA, 25 bp, Rattus norvegicus
ggtacagcactgtgaattgaatcta

SEQ ID NO: 462972 - DNA, 25 bp, Rattus norvegicus
ggtacagcagtgatcttgatatcat

SEQ ID NO: 462973 - DNA, 25 bp, Rattus norvegicus
ggtacagcagtgttcttgatatcat

SEQ ID NO: 462974 - DNA, 25 bp, Rattus norvegicus
ggtacagcatccagctgcattgctg

SEQ ID NO: 462975 - DNA, 25 bp, Rattus norvegicus
ggtacagcatccatagtaacccgag

SEQ ID NO: 462976 - DNA, 25 bp, Rattus norvegicus
ggtacagcatcctgctgcattgctg

SEQ ID NO: 462977 - DNA, 25 bp, Rattus norvegicus
ggtacagcatccttagtaacccgag

SEQ ID NO: 462978 - DNA, 25 bp, Rattus norvegicus
ggtacagcatggcttcaacttcaac

SEQ ID NO: 462979 - DNA, 25 bp, Rattus norvegicus
ggtacagcatgggttcaacttcaac

SEQ ID NO: 462980 - DNA, 25 bp, Rattus norvegicus
ggtacagcgacgatcctagttcaaa

SEQ ID NO: 462981 - DNA, 25 bp, Rattus norvegicus
ggtacagcgacgttcctagttcaaa

SEQ ID NO: 462982 - DNA, 25 bp, Rattus norvegicus
ggtacagcgagacatatccaacttt

SEQ ID NO: 462983 - DNA, 25 bp, Rattus norvegicus
ggtacagcgagagatatccaacttt

SEQ ID NO: 462984 - DNA, 25 bp, Rattus norvegicus
ggtacagctacaactcttgcatgaa

SEQ ID NO: 462985 - DNA, 25 bp, Rattus norvegicus
ggtacagctacatctcttgcatgaa

SEQ ID NO: 462986 - DNA, 25 bp, Rattus norvegicus
ggtacagctgtcaaggctacacctg

SEQ ID NO: 462987 - DNA, 25 bp, Rattus norvegicus
ggtacagctgtctaggctacacctg

SEQ ID NO: 462988 - DNA, 25 bp, Rattus norvegicus
ggtacagcttctcacttgtttagtt

SEQ ID NO: 462989 - DNA, 25 bp, Rattus norvegicus
ggtacagcttctgacttgtttagtt

SEQ ID NO: 462990 - DNA, 25 bp, Rattus norvegicus
ggtacaggactaagactccatctct

SEQ ID NO: 462991 - DNA, 25 bp, Rattus norvegicus
ggtacaggactatgactccatctct

SEQ ID NO: 462992 - DNA, 25 bp, Rattus norvegicus
ggtacaggagcccacttccttgact

SEQ ID NO: 462993 - DNA, 25 bp, Rattus norvegicus
ggtacaggagccgacttccttgact

SEQ ID NO: 462994 - DNA, 25 bp, Rattus norvegicus
ggtacaggcctgcttggacattaat

SEQ ID NO: 462995 - DNA, 25 bp, Rattus norvegicus
ggtacaggcctggttggacattaat

SEQ ID NO: 462996 - DNA, 25 bp, Rattus norvegicus
ggtacaggcgcgactcagttgtgaa

SEQ ID NO: 462997 - DNA, 25 bp, Rattus norvegicus
ggtacaggcgcgtctcagttgtgaa

SEQ ID NO: 462998 - DNA, 25 bp, Rattus norvegicus
ggtacagggtttctcataacttaca

SEQ ID NO: 462999 - DNA, 25 bp, Rattus norvegicus
ggtacagggtttgtcataacttaca

SEQ ID NO: 463000 - DNA, 25 bp, Rattus norvegicus
ggtacagtatagcttctccctcagg

SEQ ID NO: 463001 - DNA, 25 bp, Rattus norvegicus
ggtacagtataggttctccctcagg

SEQ ID NO: 463002 - DNA, 25 bp, Rattus norvegicus
ggtacagtccatcctggtctgagaa

SEQ ID NO: 463003 - DNA, 25 bp, Rattus norvegicus
ggtacagtccatgctggtctgagaa

SEQ ID NO: 463004 - DNA, 25 bp, Rattus norvegicus
ggtacagtcgacatccagaacctga

SEQ ID NO: 463005 - DNA, 25 bp, Rattus norvegicus
ggtacagtcgacttccagaacctga

SEQ ID NO: 463006 - DNA, 25 bp, Rattus norvegicus
ggtacagtcgttattattcctaagc

SEQ ID NO: 463007 - DNA, 25 bp, Rattus norvegicus
ggtacagtcgtttttattcctaagc

SEQ ID NO: 463008 - DNA, 25 bp, Rattus norvegicus
ggtacagtctcacatcctgggagcc

SEQ ID NO: 463009 - DNA, 25 bp, Rattus norvegicus
ggtacagtctcagatcctgggagcc

SEQ ID NO: 463010 - DNA, 25 bp, Rattus norvegicus
ggtacagtcttgatctacatggccc

SEQ ID NO: 463011 - DNA, 25 bp, Rattus norvegicus
ggtacagtcttgttctacatggccc

SEQ ID NO: 463012 - DNA, 25 bp, Rattus norvegicus
ggtacagtggctacacagactcaca

SEQ ID NO: 463013 - DNA, 25 bp, Rattus norvegicus
ggtacagtggcttcacagactcaca

SEQ ID NO: 463014 - DNA, 25 bp, Rattus norvegicus
ggtacagtgtcacatgcctataatc

SEQ ID NO: 463015 - DNA, 25 bp, Rattus norvegicus
ggtacagtgtcagatgcctataatc

SEQ ID NO: 463016 - DNA, 25 bp, Rattus norvegicus
ggtacagttggaccaccacgagtgc

SEQ ID NO: 463017 - DNA, 25 bp, Rattus norvegicus
ggtacagttggagcaccacgagtgc

SEQ ID NO: 463018 - DNA, 25 bp, Rattus norvegicus
ggtacagtttgtaagtcgtccttag

SEQ ID NO: 463019 - DNA, 25 bp, Rattus norvegicus
ggtacagtttgttagtcgtccttag

SEQ ID NO: 463020 - DNA, 25 bp, Rattus norvegicus
ggtacataaatcctggaacgcagag

SEQ ID NO: 463021 - DNA, 25 bp, Rattus norvegicus
ggtacataaatcgtggaacgcagag

SEQ ID NO: 463022 - DNA, 25 bp, Rattus norvegicus
ggtacataatggcatcctgcctttt

SEQ ID NO: 463023 - DNA, 25 bp, Rattus norvegicus
ggtacataatgggatcctgcctttt

SEQ ID NO: 463024 - DNA, 25 bp, Rattus norvegicus
ggtacatacaccatttaacctatat

SEQ ID NO: 463025 - DNA, 25 bp, Rattus norvegicus
ggtacatacaccttttaacctatat

SEQ ID NO: 463026 - DNA, 25 bp, Rattus norvegicus
ggtacatacatgatggccggtgtta

SEQ ID NO: 463027 - DNA, 25 bp, Rattus norvegicus
ggtacatacatgttggccggtgtta

SEQ ID NO: 463028 - DNA, 25 bp, Rattus norvegicus
ggtacatagtctaacttgccttttt

SEQ ID NO: 463029 - DNA, 25 bp, Rattus norvegicus
ggtacatagtcttacttgccttttt

SEQ ID NO: 463030 - DNA, 25 bp, Rattus norvegicus
ggtacatataggaggtatccctgaa

SEQ ID NO: 463031 - DNA, 25 bp, Rattus norvegicus
ggtacatataggtggtatccctgaa

SEQ ID NO: 463032 - DNA, 25 bp, Rattus norvegicus
ggtacatatctgaaatccagcactt

SEQ ID NO: 463033 - DNA, 25 bp, Rattus norvegicus
ggtacatatctgtaatccagcactt

SEQ ID NO: 463034 - DNA, 25 bp, Rattus norvegicus
ggtacatatggtagcgcccacgagg

SEQ ID NO: 463035 - DNA, 25 bp, Rattus norvegicus
ggtacatatggttgcgcccacgagg

SEQ ID NO: 463036 - DNA, 25 bp, Rattus norvegicus
ggtacatcaagtagtctaagtaaga

SEQ ID NO: 463037 - DNA, 25 bp, Rattus norvegicus
ggtacatcaagttgtctaagtaaga

SEQ ID NO: 463038 - DNA, 25 bp, Rattus norvegicus
ggtacatcatgaatttttgaccatt

SEQ ID NO: 463039 - DNA, 25 bp, Rattus norvegicus
ggtacatcatgattttttgaccatt

SEQ ID NO: 463040 - DNA, 25 bp, Rattus norvegicus
ggtacatcatttctaagatcctcaa

SEQ ID NO: 463041 - DNA, 25 bp, Rattus norvegicus
ggtacatcatttgtaagatcctcaa

SEQ ID NO: 463042 - DNA, 25 bp, Rattus norvegicus
ggtacatcccggctgtgcagacact

SEQ ID NO: 463043 - DNA, 25 bp, Rattus norvegicus
ggtacatcccgggtgtgcagacact

SEQ ID NO: 463044 - DNA, 25 bp, Rattus norvegicus
ggtacatcctctccacagtgaacaa

SEQ ID NO: 463045 - DNA, 25 bp, Rattus norvegicus
ggtacatcctctgcacagtgaacaa

SEQ ID NO: 463046 - DNA, 25 bp, Rattus norvegicus
ggtacatcgggccaagctcacatgt

SEQ ID NO: 463047 - DNA, 25 bp, Rattus norvegicus
ggtacatcgggcgaagctcacatgt

SEQ ID NO: 463048 - DNA, 25 bp, Rattus norvegicus
ggtacatcgtctatcacaaacttgc

SEQ ID NO: 463049 - DNA, 25 bp, Rattus norvegicus
ggtacatcgtctttcacaaacttgc

SEQ ID NO: 463050 - DNA, 25 bp, Rattus norvegicus
ggtacatcgtggcagtgtttttcat

SEQ ID NO: 463051 - DNA, 25 bp, Rattus norvegicus
ggtacatcgtgggagtgtttttcat

SEQ ID NO: 463052 - DNA, 25 bp, Rattus norvegicus
ggtacatgatttagtgccacccttg

SEQ ID NO: 463053 - DNA, 25 bp, Rattus norvegicus
ggtacatgattttgtgccacccttg

SEQ ID NO: 463054 - DNA, 25 bp, Rattus norvegicus
ggtacatgcattatgtgtcacatta

SEQ ID NO: 463055 - DNA, 25 bp, Rattus norvegicus
ggtacatgcattttgtgtcacatta

SEQ ID NO: 463056 - DNA, 25 bp, Rattus norvegicus
ggtacatgccccaaaacagaggttt

SEQ ID NO: 463057 - DNA, 25 bp, Rattus norvegicus
ggtacatgcccctaaacagaggttt

SEQ ID NO: 463058 - DNA, 25 bp, Rattus norvegicus
ggtacatgctgactactcctcggaa

SEQ ID NO: 463059 - DNA, 25 bp, Rattus norvegicus
ggtacatgctgagtactcctcggaa

SEQ ID NO: 463060 - DNA, 25 bp, Rattus norvegicus
ggtacatgctggatggtagttacat

SEQ ID NO: 463061 - DNA, 25 bp, Rattus norvegicus
ggtacatgctggttggtagttacat

SEQ ID NO: 463062 - DNA, 25 bp, Rattus norvegicus
ggtacatggcctagagagtgacact

SEQ ID NO: 463063 - DNA, 25 bp, Rattus norvegicus
ggtacatggccttgagagtgacact

SEQ ID NO: 463064 - DNA, 25 bp, Rattus norvegicus
ggtacatgtctaaaatcccttggga

SEQ ID NO: 463065 - DNA, 25 bp, Rattus norvegicus
ggtacatgtctataatcccttggga

SEQ ID NO: 463066 - DNA, 25 bp, Rattus norvegicus
ggtacatgtggcatcagcattcact

SEQ ID NO: 463067 - DNA, 25 bp, Rattus norvegicus
ggtacatgtggcttcagcattcact

SEQ ID NO: 463068 - DNA, 25 bp, Rattus norvegicus
ggtacatgttgcaaattctgcccct

SEQ ID NO: 463069 - DNA, 25 bp, Rattus norvegicus
ggtacatgttgctaattctgcccct

SEQ ID NO: 463070 - DNA, 25 bp, Rattus norvegicus
ggtacattcctccttatttttgaag

SEQ ID NO: 463071 - DNA, 25 bp, Rattus norvegicus
ggtacattcctcgttatttttgaag

SEQ ID NO: 463072 - DNA, 25 bp, Rattus norvegicus
ggtacattctctattgacacatttg

SEQ ID NO: 463073 - DNA, 25 bp, Rattus norvegicus
ggtacattctcttttgacacatttg

SEQ ID NO: 463074 - DNA, 25 bp, Rattus norvegicus
ggtacattctttaaccagcctcgag

SEQ ID NO: 463075 - DNA, 25 bp, Rattus norvegicus
ggtacattcttttaccagcctcgag

SEQ ID NO: 463076 - DNA, 25 bp, Rattus norvegicus
ggtacattgtaaataaaggcactta

SEQ ID NO: 463077 - DNA, 25 bp, Rattus norvegicus
ggtacattgtaattaaaggcactta

SEQ ID NO: 463078 - DNA, 25 bp, Rattus norvegicus
ggtacatttaaacttccccagctat

SEQ ID NO: 463079 - DNA, 25 bp, Rattus norvegicus
ggtacatttaaagttccccagctat

SEQ ID NO: 463080 - DNA, 25 bp, Rattus norvegicus
ggtaccaacttcaatcttagtcagt

SEQ ID NO: 463081 - DNA, 25 bp, Rattus norvegicus
ggtaccaacttctatcttagtcagt

SEQ ID NO: 463082 - DNA, 25 bp, Rattus norvegicus
ggtaccaagaacagtgcatatgcgt

SEQ ID NO: 463083 - DNA, 25 bp, Rattus norvegicus
ggtaccaagaactgtgcatatgcgt

SEQ ID NO: 463084 - DNA, 25 bp, Rattus norvegicus
ggtaccacaggtaagccagatagta

SEQ ID NO: 463085 - DNA, 25 bp, Rattus norvegicus
ggtaccacaggttagccagatagta

SEQ ID NO: 463086 - DNA, 25 bp, Rattus norvegicus
ggtaccacagtactcgtctgtatga

SEQ ID NO: 463087 - DNA, 25 bp, Rattus norvegicus
ggtaccacagtagtcgtctgtatga

SEQ ID NO: 463088 - DNA, 25 bp, Rattus norvegicus
ggtaccaccaagactctactagaga

SEQ ID NO: 463089 - DNA, 25 bp, Rattus norvegicus
ggtaccaccaagtctctactagaga

SEQ ID NO: 463090 - DNA, 25 bp, Rattus norvegicus
ggtaccaccaccagcaataattgac

SEQ ID NO: 463091 - DNA, 25 bp, Rattus norvegicus
ggtaccaccacctgcaataattgac

SEQ ID NO: 463092 - DNA, 25 bp, Rattus norvegicus
ggtaccacccctagacagaaatcga

SEQ ID NO: 463093 - DNA, 25 bp, Rattus norvegicus
ggtaccaccccttgacagaaatcga

SEQ ID NO: 463094 - DNA, 25 bp, Rattus norvegicus
ggtaccactagcctctgaaacgtgt

SEQ ID NO: 463095 - DNA, 25 bp, Rattus norvegicus
ggtaccactagcgtctgaaacgtgt

SEQ ID NO: 463096 - DNA, 25 bp, Rattus norvegicus
ggtaccactatcagacacacagtat

SEQ ID NO: 463097 - DNA, 25 bp, Rattus norvegicus
ggtaccactatctgacacacagtat

SEQ ID NO: 463098 - DNA, 25 bp, Rattus norvegicus
ggtaccacttaaaggcatgtgttct

SEQ ID NO: 463099 - DNA, 25 bp, Rattus norvegicus
ggtaccacttaatggcatgtgttct

SEQ ID NO: 463100 - DNA, 25 bp, Rattus norvegicus
ggtaccacttttctgagcactctgc

SEQ ID NO: 463101 - DNA, 25 bp, Rattus norvegicus
ggtaccacttttgtgagcactctgc

SEQ ID NO: 463102 - DNA, 25 bp, Rattus norvegicus
ggtaccagagtaagattccccagag

SEQ ID NO: 463103 - DNA, 25 bp, Rattus norvegicus
ggtaccagagtatgattccccagag

SEQ ID NO: 463104 - DNA, 25 bp, Rattus norvegicus
ggtaccagcaacatcggtcagtggg

SEQ ID NO: 463105 - DNA, 25 bp, Rattus norvegicus
ggtaccagcaacttcggtcagtggg

SEQ ID NO: 463106 - DNA, 25 bp, Rattus norvegicus
ggtaccagcattaacagatctcttg

SEQ ID NO: 463107 - DNA, 25 bp, Rattus norvegicus
ggtaccagcatttacagatctcttg

SEQ ID NO: 463108 - DNA, 25 bp, Rattus norvegicus
ggtaccagccataggttgctctagt

SEQ ID NO: 463109 - DNA, 25 bp, Rattus norvegicus
ggtaccagccattggttgctctagt

SEQ ID NO: 463110 - DNA, 25 bp, Rattus norvegicus
ggtaccagcctcatcaatacttata

SEQ ID NO: 463111 - DNA, 25 bp, Rattus norvegicus
ggtaccagcctcttcaatacttata

SEQ ID NO: 463112 - DNA, 25 bp, Rattus norvegicus
ggtaccagcgagaagacatgtcact

SEQ ID NO: 463113 - DNA, 25 bp, Rattus norvegicus
ggtaccagcgagtagacatgtcact

SEQ ID NO: 463114 - DNA, 25 bp, Rattus norvegicus
ggtaccagctccatagctactaggt

SEQ ID NO: 463115 - DNA, 25 bp, Rattus norvegicus
ggtaccagctccttagctactaggt

SEQ ID NO: 463116 - DNA, 25 bp, Rattus norvegicus
ggtaccaggcacatgtgtgatgcat

SEQ ID NO: 463117 - DNA, 25 bp, Rattus norvegicus
ggtaccaggcacttgtgtgatgcat

SEQ ID NO: 463118 - DNA, 25 bp, Rattus norvegicus
ggtaccagggttctgcaagcatctc

SEQ ID NO: 463119 - DNA, 25 bp, Rattus norvegicus
ggtaccagggttgtgcaagcatctc

SEQ ID NO: 463120 - DNA, 25 bp, Rattus norvegicus
ggtaccagtttcacagcaatcacat

SEQ ID NO: 463121 - DNA, 25 bp, Rattus norvegicus
ggtaccagtttcatgccagagtcag

SEQ ID NO: 463122 - DNA, 25 bp, Rattus norvegicus
ggtaccagtttctcagcaatcacat

SEQ ID NO: 463123 - DNA, 25 bp, Rattus norvegicus
ggtaccagtttcttgccagagtcag

SEQ ID NO: 463124 - DNA, 25 bp, Rattus norvegicus
ggtaccatactgaatttcccactgg

SEQ ID NO: 463125 - DNA, 25 bp, Rattus norvegicus
ggtaccatactgtatttcccactgg

SEQ ID NO: 463126 - DNA, 25 bp, Rattus norvegicus
ggtaccatatgaccctggctgcttg

SEQ ID NO: 463127 - DNA, 25 bp, Rattus norvegicus
ggtaccatatgagcctggctgcttg

SEQ ID NO: 463128 - DNA, 25 bp, Rattus norvegicus
ggtaccatcacactactcttatgaa

SEQ ID NO: 463129 - DNA, 25 bp, Rattus norvegicus
ggtaccatcacagtactcttatgaa

SEQ ID NO: 463130 - DNA, 25 bp, Rattus norvegicus
ggtaccatgaaccacacttctcaag

SEQ ID NO: 463131 - DNA, 25 bp, Rattus norvegicus
ggtaccatgaacgacacttctcaag

SEQ ID NO: 463132 - DNA, 25 bp, Rattus norvegicus
ggtaccatgaagatctccacagctg

SEQ ID NO: 463133 - DNA, 25 bp, Rattus norvegicus
ggtaccatgaagttctccacagctg

SEQ ID NO: 463134 - DNA, 25 bp, Rattus norvegicus
ggtaccatgacaagttatgcttctt

SEQ ID NO: 463135 - DNA, 25 bp, Rattus norvegicus
ggtaccatgacatgttatgcttctt

SEQ ID NO: 463136 - DNA, 25 bp, Rattus norvegicus
ggtaccatggagactcatcttacta

SEQ ID NO: 463137 - DNA, 25 bp, Rattus norvegicus
ggtaccatggagtctcatcttacta

SEQ ID NO: 463138 - DNA, 25 bp, Rattus norvegicus
ggtaccatgtgtctgtttacttatg

SEQ ID NO: 463139 - DNA, 25 bp, Rattus norvegicus
ggtaccatgtgtgtgtttacttatg

SEQ ID NO: 463140 - DNA, 25 bp, Rattus norvegicus
ggtaccattgaaaatcattgtcagc

SEQ ID NO: 463141 - DNA, 25 bp, Rattus norvegicus
ggtaccattgaatatcattgtcagc

SEQ ID NO: 463142 - DNA, 25 bp, Rattus norvegicus
ggtacccaaggaattccagtttctg

SEQ ID NO: 463143 - DNA, 25 bp, Rattus norvegicus
ggtacccaaggatttccagtttctg

SEQ ID NO: 463144 - DNA, 25 bp, Rattus norvegicus
ggtacccagactctcaatcaataag

SEQ ID NO: 463145 - DNA, 25 bp, Rattus norvegicus
ggtacccagactgtcaatcaataag

SEQ ID NO: 463146 - DNA, 25 bp, Rattus norvegicus
ggtacccagctaccaaagcagggaa

SEQ ID NO: 463147 - DNA, 25 bp, Rattus norvegicus
ggtacccagctagcaaagcagggaa

SEQ ID NO: 463148 - DNA, 25 bp, Rattus norvegicus
ggtacccaggcccttatgcaagata

SEQ ID NO: 463149 - DNA, 25 bp, Rattus norvegicus
ggtacccaggccgttatgcaagata

SEQ ID NO: 463150 - DNA, 25 bp, Rattus norvegicus
ggtacccatatcatgccattaacta

SEQ ID NO: 463151 - DNA, 25 bp, Rattus norvegicus
ggtacccatatcttgccattaacta

SEQ ID NO: 463152 - DNA, 25 bp, Rattus norvegicus
ggtacccatcttaatacagcagaag

SEQ ID NO: 463153 - DNA, 25 bp, Rattus norvegicus
ggtacccatctttatacagcagaag

SEQ ID NO: 463154 - DNA, 25 bp, Rattus norvegicus
ggtacccattatagagaacactcct

SEQ ID NO: 463155 - DNA, 25 bp, Rattus norvegicus
ggtacccattattgagaacactcct

SEQ ID NO: 463156 - DNA, 25 bp, Rattus norvegicus
ggtacccattctatcagctagataa

SEQ ID NO: 463157 - DNA, 25 bp, Rattus norvegicus
ggtacccattctttcagctagataa

SEQ ID NO: 463158 - DNA, 25 bp, Rattus norvegicus
ggtacccatttcatactggtgtcat

SEQ ID NO: 463159 - DNA, 25 bp, Rattus norvegicus
ggtacccatttcttactggtgtcat

SEQ ID NO: 463160 - DNA, 25 bp, Rattus norvegicus
ggtaccccataaaaggctgtgtcca

SEQ ID NO: 463161 - DNA, 25 bp, Rattus norvegicus
ggtaccccataataggctgtgtcca

SEQ ID NO: 463162 - DNA, 25 bp, Rattus norvegicus
ggtaccccttggctgtgactgagta

SEQ ID NO: 463163 - DNA, 25 bp, Rattus norvegicus
ggtaccccttgggtgtgactgagta

SEQ ID NO: 463164 - DNA, 25 bp, Rattus norvegicus
ggtacccgataaacatgtctcgaca

SEQ ID NO: 463165 - DNA, 25 bp, Rattus norvegicus
ggtacccgataatcatgtctcgaca

SEQ ID NO: 463166 - DNA, 25 bp, Rattus norvegicus
ggtacccgccgaagacattgtagaa

SEQ ID NO: 463167 - DNA, 25 bp, Rattus norvegicus
ggtacccgccgatgacattgtagaa

SEQ ID NO: 463168 - DNA, 25 bp, Rattus norvegicus
ggtacccgtgtaaatctgtatgctc

SEQ ID NO: 463169 - DNA, 25 bp, Rattus norvegicus
ggtacccgtgtatatctgtatgctc

SEQ ID NO: 463170 - DNA, 25 bp, Rattus norvegicus
ggtaccctagcacaggtgccacagt

SEQ ID NO: 463171 - DNA, 25 bp, Rattus norvegicus
ggtaccctagcagaggtgccacagt

SEQ ID NO: 463172 - DNA, 25 bp, Rattus norvegicus
ggtaccctgcaaaccaaatactgat

SEQ ID NO: 463173 - DNA, 25 bp, Rattus norvegicus
ggtaccctgcaatccaaatactgat

SEQ ID NO: 463174 - DNA, 25 bp, Rattus norvegicus
ggtaccctgctgacaatagcaacag

SEQ ID NO: 463175 - DNA, 25 bp, Rattus norvegicus
ggtaccctgctgtcaatagcaacag

SEQ ID NO: 463176 - DNA, 25 bp, Rattus norvegicus
ggtaccctggctatcagtccaaaca

SEQ ID NO: 463177 - DNA, 25 bp, Rattus norvegicus
ggtaccctggctttcagtccaaaca

SEQ ID NO: 463178 - DNA, 25 bp, Rattus norvegicus
ggtaccctgtcgcatgagcatgctg

SEQ ID NO: 463179 - DNA, 25 bp, Rattus norvegicus
ggtaccctgtcggatgagcatgctg

SEQ ID NO: 463180 - DNA, 25 bp, Rattus norvegicus
ggtacccttatcacagagcacatgg

SEQ ID NO: 463181 - DNA, 25 bp, Rattus norvegicus
ggtacccttatctcagagcacatgg

SEQ ID NO: 463182 - DNA, 25 bp, Rattus norvegicus
ggtacccttgtcactgtaattacta

SEQ ID NO: 463183 - DNA, 25 bp, Rattus norvegicus
ggtacccttgtcaggcatgtacaat

SEQ ID NO: 463184 - DNA, 25 bp, Rattus norvegicus
ggtacccttgtctctgtaattacta

SEQ ID NO: 463185 - DNA, 25 bp, Rattus norvegicus
ggtacccttgtctggcatgtacaat

SEQ ID NO: 463186 - DNA, 25 bp, Rattus norvegicus
ggtaccggaggaatgaaccagcctt

SEQ ID NO: 463187 - DNA, 25 bp, Rattus norvegicus
ggtaccggaggattgaaccagcctt

SEQ ID NO: 463188 - DNA, 25 bp, Rattus norvegicus
ggtaccggcgagagtacaagtccct

SEQ ID NO: 463189 - DNA, 25 bp, Rattus norvegicus
ggtaccggcgagtgtacaagtccct

SEQ ID NO: 463190 - DNA, 25 bp, Rattus norvegicus
ggtaccgggagcacagagcttctaa

SEQ ID NO: 463191 - DNA, 25 bp, Rattus norvegicus
ggtaccgggagctcagagcttctaa

SEQ ID NO: 463192 - DNA, 25 bp, Rattus norvegicus
ggtaccgggaggagccaaacactgt

SEQ ID NO: 463193 - DNA, 25 bp, Rattus norvegicus
ggtaccgggaggtgccaaacactgt

SEQ ID NO: 463194 - DNA, 25 bp, Rattus norvegicus
ggtaccgtatgcctcgaccagataa

SEQ ID NO: 463195 - DNA, 25 bp, Rattus norvegicus
ggtaccgtatgcgtcgaccagataa

SEQ ID NO: 463196 - DNA, 25 bp, Rattus norvegicus
ggtaccgtggcgcatgcacgcacac

SEQ ID NO: 463197 - DNA, 25 bp, Rattus norvegicus
ggtaccgtggcggatgcacgcacac

SEQ ID NO: 463198 - DNA, 25 bp, Rattus norvegicus
ggtaccgttgtccatgtgaatactg

SEQ ID NO: 463199 - DNA, 25 bp, Rattus norvegicus
ggtaccgttgtcgatgtgaatactg

SEQ ID NO: 463200 - DNA, 25 bp, Rattus norvegicus
ggtacctaacccactaagacttatg

SEQ ID NO: 463201 - DNA, 25 bp, Rattus norvegicus
ggtacctaaccctctaagacttatg

SEQ ID NO: 463202 - DNA, 25 bp, Rattus norvegicus
ggtacctacagtcgaaaatctttat

SEQ ID NO: 463203 - DNA, 25 bp, Rattus norvegicus
ggtacctacagtggaaaatctttat

SEQ ID NO: 463204 - DNA, 25 bp, Rattus norvegicus
ggtacctaccaaagatcgtgtgcgc

SEQ ID NO: 463205 - DNA, 25 bp, Rattus norvegicus
ggtacctaccaatgatcgtgtgcgc

SEQ ID NO: 463206 - DNA, 25 bp, Rattus norvegicus
ggtacctactaccttcaagcctgtg

SEQ ID NO: 463207 - DNA, 25 bp, Rattus norvegicus
ggtacctactacgttcaagcctgtg

SEQ ID NO: 463208 - DNA, 25 bp, Rattus norvegicus
ggtacctactccatggctgtgaata

SEQ ID NO: 463209 - DNA, 25 bp, Rattus norvegicus
ggtacctactccttggctgtgaata

SEQ ID NO: 463210 - DNA, 25 bp, Rattus norvegicus
ggtacctagaagacctgagccaata

SEQ ID NO: 463211 - DNA, 25 bp, Rattus norvegicus
ggtacctagaagtcctgagccaata

SEQ ID NO: 463212 - DNA, 25 bp, Rattus norvegicus
ggtacctatcctaatctgaactgtg

SEQ ID NO: 463213 - DNA, 25 bp, Rattus norvegicus
ggtacctatccttatctgaactgtg

SEQ ID NO: 463214 - DNA, 25 bp, Rattus norvegicus
ggtacctatgttcgtgtgatgtcac

SEQ ID NO: 463215 - DNA, 25 bp, Rattus norvegicus
ggtacctatgttggtgtgatgtcac

SEQ ID NO: 463216 - DNA, 25 bp, Rattus norvegicus
ggtacctatttgcatgcacagccag

SEQ ID NO: 463217 - DNA, 25 bp, Rattus norvegicus
ggtacctatttggatgcacagccag

SEQ ID NO: 463218 - DNA, 25 bp, Rattus norvegicus
ggtacctcaactagatagcaccggg

SEQ ID NO: 463219 - DNA, 25 bp, Rattus norvegicus
ggtacctcaacttgatagcaccggg

SEQ ID NO: 463220 - DNA, 25 bp, Rattus norvegicus
ggtacctcacagaactccttggact

SEQ ID NO: 463221 - DNA, 25 bp, Rattus norvegicus
ggtacctcacagtactccttggact

SEQ ID NO: 463222 - DNA, 25 bp, Rattus norvegicus
ggtacctcagtcaggatcaatggga

SEQ ID NO: 463223 - DNA, 25 bp, Rattus norvegicus
ggtacctcagtctggatcaatggga

SEQ ID NO: 463224 - DNA, 25 bp, Rattus norvegicus
ggtacctcatgtactcatgaaagct

SEQ ID NO: 463225 - DNA, 25 bp, Rattus norvegicus
ggtacctcatgttctcatgaaagct

SEQ ID NO: 463226 - DNA, 25 bp, Rattus norvegicus
ggtacctcccgacatgttgatctta

SEQ ID NO: 463227 - DNA, 25 bp, Rattus norvegicus
ggtacctcccgagatgttgatctta

SEQ ID NO: 463228 - DNA, 25 bp, Rattus norvegicus
ggtacctcccttagcatgctttatg

SEQ ID NO: 463229 - DNA, 25 bp, Rattus norvegicus
ggtacctccctttgcatgctttatg

SEQ ID NO: 463230 - DNA, 25 bp, Rattus norvegicus
ggtacctcgccgctaccaaagggcg

SEQ ID NO: 463231 - DNA, 25 bp, Rattus norvegicus
ggtacctcgccggtaccaaagggcg

SEQ ID NO: 463232 - DNA, 25 bp, Rattus norvegicus
ggtacctcggagagacagttgtgtt

SEQ ID NO: 463233 - DNA, 25 bp, Rattus norvegicus
ggtacctcggagtgacagttgtgtt

SEQ ID NO: 463234 - DNA, 25 bp, Rattus norvegicus
ggtacctctatgaccctgaggccag

SEQ ID NO: 463235 - DNA, 25 bp, Rattus norvegicus
ggtacctctatgtccctgaggccag

SEQ ID NO: 463236 - DNA, 25 bp, Rattus norvegicus
ggtacctgaagaatggtgcctcaac

SEQ ID NO: 463237 - DNA, 25 bp, Rattus norvegicus
ggtacctgaagattggtgcctcaac

SEQ ID NO: 463238 - DNA, 25 bp, Rattus norvegicus
ggtacctgaatgcaccaaatgctca

SEQ ID NO: 463239 - DNA, 25 bp, Rattus norvegicus
ggtacctgaatggaccaaatgctca

SEQ ID NO: 463240 - DNA, 25 bp, Rattus norvegicus
ggtacctggattcctggtttcttta

SEQ ID NO: 463241 - DNA, 25 bp, Rattus norvegicus
ggtacctggattgctggtttcttta

SEQ ID NO: 463242 - DNA, 25 bp, Rattus norvegicus
ggtacctggcctagtaagcaccata

SEQ ID NO: 463243 - DNA, 25 bp, Rattus norvegicus
ggtacctggccttgtaagcaccata

SEQ ID NO: 463244 - DNA, 25 bp, Rattus norvegicus
ggtacctggctgactagctgaggca

SEQ ID NO: 463245 - DNA, 25 bp, Rattus norvegicus
ggtacctggctgtctagctgaggca

SEQ ID NO: 463246 - DNA, 25 bp, Rattus norvegicus
ggtaccttcagtctatggtcagaca

SEQ ID NO: 463247 - DNA, 25 bp, Rattus norvegicus
ggtaccttcagtgtatggtcagaca

SEQ ID NO: 463248 - DNA, 25 bp, Rattus norvegicus
ggtaccttcccacagaggcataaat

SEQ ID NO: 463249 - DNA, 25 bp, Rattus norvegicus
ggtaccttcccagagaggcataaat

SEQ ID NO: 463250 - DNA, 25 bp, Rattus norvegicus
ggtaccttctaccagtagtgacttg

SEQ ID NO: 463251 - DNA, 25 bp, Rattus norvegicus
ggtaccttctacgagtagtgacttg

SEQ ID NO: 463252 - DNA, 25 bp, Rattus norvegicus
ggtaccttgaaacctcaagtcttgg

SEQ ID NO: 463253 - DNA, 25 bp, Rattus norvegicus
ggtaccttgaaagctcaagtcttgg

SEQ ID NO: 463254 - DNA, 25 bp, Rattus norvegicus
ggtaccttgcccaggataacagaat

SEQ ID NO: 463255 - DNA, 25 bp, Rattus norvegicus
ggtaccttgccctggataacagaat

SEQ ID NO: 463256 - DNA, 25 bp, Rattus norvegicus
ggtaccttggttatccttggtcatc

SEQ ID NO: 463257 - DNA, 25 bp, Rattus norvegicus
ggtaccttggttttccttggtcatc

SEQ ID NO: 463258 - DNA, 25 bp, Rattus norvegicus
ggtacctttatgcattcactctgag

SEQ ID NO: 463259 - DNA, 25 bp, Rattus norvegicus
ggtacctttatggattcactctgag

SEQ ID NO: 463260 - DNA, 25 bp, Rattus norvegicus
ggtacctttctgcagggaactctca

SEQ ID NO: 463261 - DNA, 25 bp, Rattus norvegicus
ggtacctttctggagggaactctca

SEQ ID NO: 463262 - DNA, 25 bp, Rattus norvegicus
ggtacctttgtgatccgaacttcaa

SEQ ID NO: 463263 - DNA, 25 bp, Rattus norvegicus
ggtacctttgtgttccgaacttcaa

SEQ ID NO: 463264 - DNA, 25 bp, Rattus norvegicus
ggtacgaacactctccttcaagagg

SEQ ID NO: 463265 - DNA, 25 bp, Rattus norvegicus
ggtacgaacactgtccttcaagagg

SEQ ID NO: 463266 - DNA, 25 bp, Rattus norvegicus
ggtacgagctagactttcacatcct

SEQ ID NO: 463267 - DNA, 25 bp, Rattus norvegicus
ggtacgagctagtctttcacatcct

SEQ ID NO: 463268 - DNA, 25 bp, Rattus norvegicus
ggtacgcagccactggttatacata

SEQ ID NO: 463269 - DNA, 25 bp, Rattus norvegicus
ggtacgcagccagtggttatacata

SEQ ID NO: 463270 - DNA, 25 bp, Rattus norvegicus
ggtacgccggcgaggtatcaactgc

SEQ ID NO: 463271 - DNA, 25 bp, Rattus norvegicus
ggtacgccggcgtggtatcaactgc

SEQ ID NO: 463272 - DNA, 25 bp, Rattus norvegicus
ggtacgccgggaacacagccagaaa

SEQ ID NO: 463273 - DNA, 25 bp, Rattus norvegicus
ggtacgccgggatcacagccagaaa

SEQ ID NO: 463274 - DNA, 25 bp, Rattus norvegicus
ggtacgcctgtgctcgaaatgttca

SEQ ID NO: 463275 - DNA, 25 bp, Rattus norvegicus
ggtacgcctgtggtcgaaatgttca

SEQ ID NO: 463276 - DNA, 25 bp, Rattus norvegicus
ggtacgcgggatccccataaggata

SEQ ID NO: 463277 - DNA, 25 bp, Rattus norvegicus
ggtacgcgggatgcccataaggata

SEQ ID NO: 463278 - DNA, 25 bp, Rattus norvegicus
ggtacggaccctacagatggactta

SEQ ID NO: 463279 - DNA, 25 bp, Rattus norvegicus
ggtacggacccttcagatggactta

SEQ ID NO: 463280 - DNA, 25 bp, Rattus norvegicus
ggtacggacgccatgctgctttctg

SEQ ID NO: 463281 - DNA, 25 bp, Rattus norvegicus
ggtacggacgccttgctgctttctg

SEQ ID NO: 463282 - DNA, 25 bp, Rattus norvegicus
ggtacggactacagcggttgccttt

SEQ ID NO: 463283 - DNA, 25 bp, Rattus norvegicus
ggtacggactactgcggttgccttt

SEQ ID NO: 463284 - DNA, 25 bp, Rattus norvegicus
ggtacggctttcacaaatgattttc

SEQ ID NO: 463285 - DNA, 25 bp, Rattus norvegicus
ggtacggctttctcaaatgattttc

SEQ ID NO: 463286 - DNA, 25 bp, Rattus norvegicus
ggtacggtgattaagccttggctgt

SEQ ID NO: 463287 - DNA, 25 bp, Rattus norvegicus
ggtacggtgatttagccttggctgt

SEQ ID NO: 463288 - DNA, 25 bp, Rattus norvegicus
ggtacggtgggtctcaccttagatt

SEQ ID NO: 463289 - DNA, 25 bp, Rattus norvegicus
ggtacggtgggtgtcaccttagatt

SEQ ID NO: 463290 - DNA, 25 bp, Rattus norvegicus
ggtacgtactcaccacattggagaa

SEQ ID NO: 463291 - DNA, 25 bp, Rattus norvegicus
ggtacgtactcagcacattggagaa

SEQ ID NO: 463292 - DNA, 25 bp, Rattus norvegicus
ggtacgtatacccagctttgcagga

SEQ ID NO: 463293 - DNA, 25 bp, Rattus norvegicus
ggtacgtataccgagctttgcagga

SEQ ID NO: 463294 - DNA, 25 bp, Rattus norvegicus
ggtacgtcatgaacagtgtctaaga

SEQ ID NO: 463295 - DNA, 25 bp, Rattus norvegicus
ggtacgtcatgatcagtgtctaaga

SEQ ID NO: 463296 - DNA, 25 bp, Rattus norvegicus
ggtacgtgccatcagcaaacacagt

SEQ ID NO: 463297 - DNA, 25 bp, Rattus norvegicus
ggtacgtgccatgagcaaacacagt

SEQ ID NO: 463298 - DNA, 25 bp, Rattus norvegicus
ggtactaaatccagctttcttcaaa

SEQ ID NO: 463299 - DNA, 25 bp, Rattus norvegicus
ggtactaaatcctgctttcttcaaa

SEQ ID NO: 463300 - DNA, 25 bp, Rattus norvegicus
ggtactaacttgatattctctagaa

SEQ ID NO: 463301 - DNA, 25 bp, Rattus norvegicus
ggtactaacttgttattctctagaa

SEQ ID NO: 463302 - DNA, 25 bp, Rattus norvegicus
ggtactacacgcattaataaagggt

SEQ ID NO: 463303 - DNA, 25 bp, Rattus norvegicus
ggtactacacgctttaataaagggt

SEQ ID NO: 463304 - DNA, 25 bp, Rattus norvegicus
ggtactacagacaagcccaggatgg

SEQ ID NO: 463305 - DNA, 25 bp, Rattus norvegicus
ggtactacagactagcccaggatgg

SEQ ID NO: 463306 - DNA, 25 bp, Rattus norvegicus
ggtactacgtacagtccgtggagca

SEQ ID NO: 463307 - DNA, 25 bp, Rattus norvegicus
ggtactacgtactgtccgtggagca

SEQ ID NO: 463308 - DNA, 25 bp, Rattus norvegicus
ggtactactcttccagactaacttt

SEQ ID NO: 463309 - DNA, 25 bp, Rattus norvegicus
ggtactactcttgcagactaacttt

SEQ ID NO: 463310 - DNA, 25 bp, Rattus norvegicus
ggtactactgtacctgccttcaaag

SEQ ID NO: 463311 - DNA, 25 bp, Rattus norvegicus
ggtactactgtagctgccttcaaag

SEQ ID NO: 463312 - DNA, 25 bp, Rattus norvegicus
ggtactactttcctaattcatggta

SEQ ID NO: 463313 - DNA, 25 bp, Rattus norvegicus
ggtactactttcgtaattcatggta

SEQ ID NO: 463314 - DNA, 25 bp, Rattus norvegicus
ggtactagagttagcttctctctca

SEQ ID NO: 463315 - DNA, 25 bp, Rattus norvegicus
ggtactagagtttgcttctctctca

SEQ ID NO: 463316 - DNA, 25 bp, Rattus norvegicus
ggtactagccataagcctgaagacg

SEQ ID NO: 463317 - DNA, 25 bp, Rattus norvegicus
ggtactagccattagcctgaagacg

SEQ ID NO: 463318 - DNA, 25 bp, Rattus norvegicus
ggtactaggacaccacagtgggccc

SEQ ID NO: 463319 - DNA, 25 bp, Rattus norvegicus
ggtactaggacagcacagtgggccc

SEQ ID NO: 463320 - DNA, 25 bp, Rattus norvegicus
ggtactaggcctcatcttgaaccta

SEQ ID NO: 463321 - DNA, 25 bp, Rattus norvegicus
ggtactaggcctgatcttgaaccta

SEQ ID NO: 463322 - DNA, 25 bp, Rattus norvegicus
ggtactagtcacagccaatatgtgt

SEQ ID NO: 463323 - DNA, 25 bp, Rattus norvegicus
ggtactagtcactgccaatatgtgt

SEQ ID NO: 463324 - DNA, 25 bp, Rattus norvegicus
ggtactagtctgcttttgctttgaa

SEQ ID NO: 463325 - DNA, 25 bp, Rattus norvegicus
ggtactagtctggttttgctttgaa

SEQ ID NO: 463326 - DNA, 25 bp, Rattus norvegicus
ggtactagttcaacaagggcgaaga

SEQ ID NO: 463327 - DNA, 25 bp, Rattus norvegicus
ggtactagttcatcaagggcgaaga

SEQ ID NO: 463328 - DNA, 25 bp, Rattus norvegicus
ggtactataggcacatgtcaccatg

SEQ ID NO: 463329 - DNA, 25 bp, Rattus norvegicus
ggtactataggctcatgtcaccatg

SEQ ID NO: 463330 - DNA, 25 bp, Rattus norvegicus
ggtactatagtgagattgccatgat

SEQ ID NO: 463331 - DNA, 25 bp, Rattus norvegicus
ggtactatagtgtgattgccatgat

SEQ ID NO: 463332 - DNA, 25 bp, Rattus norvegicus
ggtactatgcttctgttgatattcc

SEQ ID NO: 463333 - DNA, 25 bp, Rattus norvegicus
ggtactatgcttgtgttgatattcc

SEQ ID NO: 463334 - DNA, 25 bp, Rattus norvegicus
ggtactatggcaacgtccttgtgta

SEQ ID NO: 463335 - DNA, 25 bp, Rattus norvegicus
ggtactatggcatcgtccttgtgta

SEQ ID NO: 463336 - DNA, 25 bp, Rattus norvegicus
ggtactcaaactccagaaccgtctc

SEQ ID NO: 463337 - DNA, 25 bp, Rattus norvegicus
ggtactcaaactgcagaaccgtctc

SEQ ID NO: 463338 - DNA, 25 bp, Rattus norvegicus
ggtactcacacgaacgcgtggtaga

SEQ ID NO: 463339 - DNA, 25 bp, Rattus norvegicus
ggtactcacacgtacgcgtggtaga

SEQ ID NO: 463340 - DNA, 25 bp, Rattus norvegicus
ggtactcacgacctgaactttttag

SEQ ID NO: 463341 - DNA, 25 bp, Rattus norvegicus
ggtactcacgacgtgaactttttag

SEQ ID NO: 463342 - DNA, 25 bp, Rattus norvegicus
ggtactcactagagctgacggccgc

SEQ ID NO: 463343 - DNA, 25 bp, Rattus norvegicus
ggtactcactagtgctgacggccgc

SEQ ID NO: 463344 - DNA, 25 bp, Rattus norvegicus
ggtactcactgcatgtggtgcacgg

SEQ ID NO: 463345 - DNA, 25 bp, Rattus norvegicus
ggtactcactgcttgtggtgcacgg

SEQ ID NO: 463346 - DNA, 25 bp, Rattus norvegicus
ggtactcaggtcacagggcttgtcc

SEQ ID NO: 463347 - DNA, 25 bp, Rattus norvegicus
ggtactcaggtctcagggcttgtcc

SEQ ID NO: 463348 - DNA, 25 bp, Rattus norvegicus
ggtactcagtccagatggcctgggc

SEQ ID NO: 463349 - DNA, 25 bp, Rattus norvegicus
ggtactcagtcctgatggcctgggc

SEQ ID NO: 463350 - DNA, 25 bp, Rattus norvegicus
ggtactcatctgctaactagctttg

SEQ ID NO: 463351 - DNA, 25 bp, Rattus norvegicus
ggtactcatctggtaactagctttg

SEQ ID NO: 463352 - DNA, 25 bp, Rattus norvegicus
ggtactccagaaagacgctcatcag

SEQ ID NO: 463353 - DNA, 25 bp, Rattus norvegicus
ggtactccagaatgacgctcatcag

SEQ ID NO: 463354 - DNA, 25 bp, Rattus norvegicus
ggtactccagatccggttccaggct

SEQ ID NO: 463355 - DNA, 25 bp, Rattus norvegicus
ggtactccagatgcggttccaggct

SEQ ID NO: 463356 - DNA, 25 bp, Rattus norvegicus
ggtactcccttgagaggcgcgctta

SEQ ID NO: 463357 - DNA, 25 bp, Rattus norvegicus
ggtactcccttgtgaggcgcgctta

SEQ ID NO: 463358 - DNA, 25 bp, Rattus norvegicus
ggtactccgctcagatcctcggcat

SEQ ID NO: 463359 - DNA, 25 bp, Rattus norvegicus
ggtactccgctctgatcctcggcat

SEQ ID NO: 463360 - DNA, 25 bp, Rattus norvegicus
ggtactcctgagataagctaggact

SEQ ID NO: 463361 - DNA, 25 bp, Rattus norvegicus
ggtactcctgagttaagctaggact

SEQ ID NO: 463362 - DNA, 25 bp, Rattus norvegicus
ggtactcgccagaagtctttattaa

SEQ ID NO: 463363 - DNA, 25 bp, Rattus norvegicus
ggtactcgccagtagtctttattaa

SEQ ID NO: 463364 - DNA, 25 bp, Rattus norvegicus
ggtactcgcgcaaaacgtaagcctg

SEQ ID NO: 463365 - DNA, 25 bp, Rattus norvegicus
ggtactcgcgcataacgtaagcctg

SEQ ID NO: 463366 - DNA, 25 bp, Rattus norvegicus
ggtactcggagcatttggcctacta

SEQ ID NO: 463367 - DNA, 25 bp, Rattus norvegicus
ggtactcggagcttttggcctacta

SEQ ID NO: 463368 - DNA, 25 bp, Rattus norvegicus
ggtactcggctgaggtgcggaacat

SEQ ID NO: 463369 - DNA, 25 bp, Rattus norvegicus
ggtactcggctgtggtgcggaacat

SEQ ID NO: 463370 - DNA, 25 bp, Rattus norvegicus
ggtactcgtggtatttcccaggact

SEQ ID NO: 463371 - DNA, 25 bp, Rattus norvegicus
ggtactcgtggtttttcccaggact

SEQ ID NO: 463372 - DNA, 25 bp, Rattus norvegicus
ggtactctaaatatgggacagccca

SEQ ID NO: 463373 - DNA, 25 bp, Rattus norvegicus
ggtactctaaatttgggacagccca

SEQ ID NO: 463374 - DNA, 25 bp, Rattus norvegicus
ggtactctaacccaacacaagacat

SEQ ID NO: 463375 - DNA, 25 bp, Rattus norvegicus
ggtactctaaccgaacacaagacat

SEQ ID NO: 463376 - DNA, 25 bp, Rattus norvegicus
ggtactctacatcataccatcttca

SEQ ID NO: 463377 - DNA, 25 bp, Rattus norvegicus
ggtactctacatgataccatcttca

SEQ ID NO: 463378 - DNA, 25 bp, Rattus norvegicus
ggtactctagatcatcacattaaaa

SEQ ID NO: 463379 - DNA, 25 bp, Rattus norvegicus
ggtactctagatgatcacattaaaa

SEQ ID NO: 463380 - DNA, 25 bp, Rattus norvegicus
ggtactctgctcatattgcatttgc

SEQ ID NO: 463381 - DNA, 25 bp, Rattus norvegicus
ggtactctgctcttattgcatttgc

SEQ ID NO: 463382 - DNA, 25 bp, Rattus norvegicus
ggtactctggacagcaggactactt

SEQ ID NO: 463383 - DNA, 25 bp, Rattus norvegicus
ggtactctggactgcaggactactt

SEQ ID NO: 463384 - DNA, 25 bp, Rattus norvegicus
ggtactctttatcctgcatttcgta

SEQ ID NO: 463385 - DNA, 25 bp, Rattus norvegicus
ggtactctttatgctgcatttcgta

SEQ ID NO: 463386 - DNA, 25 bp, Rattus norvegicus
ggtactgaaccaccctaggagaaaa

SEQ ID NO: 463387 - DNA, 25 bp, Rattus norvegicus
ggtactgaaccagcctaggagaaaa

SEQ ID NO: 463388 - DNA, 25 bp, Rattus norvegicus
ggtactgaagttagagcctggacat

SEQ ID NO: 463389 - DNA, 25 bp, Rattus norvegicus
ggtactgaagtttgagcctggacat

SEQ ID NO: 463390 - DNA, 25 bp, Rattus norvegicus
ggtactgacactacacaggctaagt

SEQ ID NO: 463391 - DNA, 25 bp, Rattus norvegicus
ggtactgacacttcacaggctaagt

SEQ ID NO: 463392 - DNA, 25 bp, Rattus norvegicus
ggtactgacagcacgcacatggtta

SEQ ID NO: 463393 - DNA, 25 bp, Rattus norvegicus
ggtactgacagctcgcacatggtta

SEQ ID NO: 463394 - DNA, 25 bp, Rattus norvegicus
ggtactgaccatagctaggatgtaa

SEQ ID NO: 463395 - DNA, 25 bp, Rattus norvegicus
ggtactgaccatagtatctccagga

SEQ ID NO: 463396 - DNA, 25 bp, Rattus norvegicus
ggtactgaccattgctaggatgtaa

SEQ ID NO: 463397 - DNA, 25 bp, Rattus norvegicus
ggtactgaccattgtatctccagga

SEQ ID NO: 463398 - DNA, 25 bp, Rattus norvegicus
ggtactgacgtcatgaatttcctga

SEQ ID NO: 463399 - DNA, 25 bp, Rattus norvegicus
ggtactgacgtcttgaatttcctga

SEQ ID NO: 463400 - DNA, 25 bp, Rattus norvegicus
ggtactgagaaaaatcaccttcttt

SEQ ID NO: 463401 - DNA, 25 bp, Rattus norvegicus
ggtactgagaaatatcaccttcttt

SEQ ID NO: 463402 - DNA, 25 bp, Rattus norvegicus
ggtactgagcagctcaacactgctg

SEQ ID NO: 463403 - DNA, 25 bp, Rattus norvegicus
ggtactgagcaggtcaacactgctg

SEQ ID NO: 463404 - DNA, 25 bp, Rattus norvegicus
ggtactgaggaccattgctccagat

SEQ ID NO: 463405 - DNA, 25 bp, Rattus norvegicus
ggtactgaggacgattgctccagat

SEQ ID NO: 463406 - DNA, 25 bp, Rattus norvegicus
ggtactgagtaactataattgtgtt

SEQ ID NO: 463407 - DNA, 25 bp, Rattus norvegicus
ggtactgagtaagtataattgtgtt

SEQ ID NO: 463408 - DNA, 25 bp, Rattus norvegicus
ggtactgataccagccactacagaa

SEQ ID NO: 463409 - DNA, 25 bp, Rattus norvegicus
ggtactgatacctgccactacagaa

SEQ ID NO: 463410 - DNA, 25 bp, Rattus norvegicus
ggtactgcagctaacatttcatttg

SEQ ID NO: 463411 - DNA, 25 bp, Rattus norvegicus
ggtactgcagcttacatttcatttg

SEQ ID NO: 463412 - DNA, 25 bp, Rattus norvegicus
ggtactgcaggcatttgggagcata

SEQ ID NO: 463413 - DNA, 25 bp, Rattus norvegicus
ggtactgcaggcttttgggagcata

SEQ ID NO: 463414 - DNA, 25 bp, Rattus norvegicus
ggtactgccgccctaattcaccgcg

SEQ ID NO: 463415 - DNA, 25 bp, Rattus norvegicus
ggtactgccgccgtaattcaccgcg

SEQ ID NO: 463416 - DNA, 25 bp, Rattus norvegicus
ggtactgcgcggctgttcccatcat

SEQ ID NO: 463417 - DNA, 25 bp, Rattus norvegicus
ggtactgcgcgggtgttcccatcat

SEQ ID NO: 463418 - DNA, 25 bp, Rattus norvegicus
ggtactgcgcttctagcagctggaa

SEQ ID NO: 463419 - DNA, 25 bp, Rattus norvegicus
ggtactgcgcttgtagcagctggaa

SEQ ID NO: 463420 - DNA, 25 bp, Rattus norvegicus
ggtactgcgggaatctccattttga

SEQ ID NO: 463421 - DNA, 25 bp, Rattus norvegicus
ggtactgcgggattctccattttga

SEQ ID NO: 463422 - DNA, 25 bp, Rattus norvegicus
ggtactgctccaactcagctgtgtg

SEQ ID NO: 463423 - DNA, 25 bp, Rattus norvegicus
ggtactgctccatctcagctgtgtg

SEQ ID NO: 463424 - DNA, 25 bp, Rattus norvegicus
ggtactgctgtcagccaggtctgcg

SEQ ID NO: 463425 - DNA, 25 bp, Rattus norvegicus
ggtactgctgtctgccaggtctgcg

SEQ ID NO: 463426 - DNA, 25 bp, Rattus norvegicus
ggtactgcttatctatggctgcctc

SEQ ID NO: 463427 - DNA, 25 bp, Rattus norvegicus
ggtactgcttatgtatggctgcctc

SEQ ID NO: 463428 - DNA, 25 bp, Rattus norvegicus
ggtactggaagcctgttctatcgcc

SEQ ID NO: 463429 - DNA, 25 bp, Rattus norvegicus
ggtactggaagcgtgttctatcgcc

SEQ ID NO: 463430 - DNA, 25 bp, Rattus norvegicus
ggtactggacgcagagcagacagaa

SEQ ID NO: 463431 - DNA, 25 bp, Rattus norvegicus
ggtactggacgctgagcagacagaa

SEQ ID NO: 463432 - DNA, 25 bp, Rattus norvegicus
ggtactggcgacagatgatgtcatt

SEQ ID NO: 463433 - DNA, 25 bp, Rattus norvegicus
ggtactggcgactgatgatgtcatt

SEQ ID NO: 463434 - DNA, 25 bp, Rattus norvegicus
ggtactgggccgctcacgacaaaga

SEQ ID NO: 463435 - DNA, 25 bp, Rattus norvegicus
ggtactgggccggtcacgacaaaga

SEQ ID NO: 463436 - DNA, 25 bp, Rattus norvegicus
ggtactggtcagattatgcaagcca

SEQ ID NO: 463437 - DNA, 25 bp, Rattus norvegicus
ggtactggtcagtttatgcaagcca

SEQ ID NO: 463438 - DNA, 25 bp, Rattus norvegicus
ggtactgtacacactttctagttta

SEQ ID NO: 463439 - DNA, 25 bp, Rattus norvegicus
ggtactgtacactctttctagttta

SEQ ID NO: 463440 - DNA, 25 bp, Rattus norvegicus
ggtactgtacccataactatagtca

SEQ ID NO: 463441 - DNA, 25 bp, Rattus norvegicus
ggtactgtacccttaactatagtca

SEQ ID NO: 463442 - DNA, 25 bp, Rattus norvegicus
ggtactgtactgacaatcctcatgt

SEQ ID NO: 463443 - DNA, 25 bp, Rattus norvegicus
ggtactgtactgtcaatcctcatgt

SEQ ID NO: 463444 - DNA, 25 bp, Rattus norvegicus
ggtactgtacttctagggtcctgag

SEQ ID NO: 463445 - DNA, 25 bp, Rattus norvegicus
ggtactgtacttgtagggtcctgag

SEQ ID NO: 463446 - DNA, 25 bp, Rattus norvegicus
ggtactgtatctagtttttctcact

SEQ ID NO: 463447 - DNA, 25 bp, Rattus norvegicus
ggtactgtatcttgtttttctcact

SEQ ID NO: 463448 - DNA, 25 bp, Rattus norvegicus
ggtactgtatttcccagactctaga

SEQ ID NO: 463449 - DNA, 25 bp, Rattus norvegicus
ggtactgtatttgccagactctaga

SEQ ID NO: 463450 - DNA, 25 bp, Rattus norvegicus
ggtactgtcaaacaccttttcagaa

SEQ ID NO: 463451 - DNA, 25 bp, Rattus norvegicus
ggtactgtcaaagaccttttcagaa

SEQ ID NO: 463452 - DNA, 25 bp, Rattus norvegicus
ggtactgtcaacaacactggtggct

SEQ ID NO: 463453 - DNA, 25 bp, Rattus norvegicus
ggtactgtcaactacactggtggct

SEQ ID NO: 463454 - DNA, 25 bp, Rattus norvegicus
ggtactgtcacaaacacctttcgac

SEQ ID NO: 463455 - DNA, 25 bp, Rattus norvegicus
ggtactgtcacatacacctttcgac

SEQ ID NO: 463456 - DNA, 25 bp, Rattus norvegicus
ggtactgtcaccacactaaatatat

SEQ ID NO: 463457 - DNA, 25 bp, Rattus norvegicus
ggtactgtcacctcactaaatatat

SEQ ID NO: 463458 - DNA, 25 bp, Rattus norvegicus
ggtactgtcctgattggttccagat

SEQ ID NO: 463459 - DNA, 25 bp, Rattus norvegicus
ggtactgtcctgtttggttccagat

SEQ ID NO: 463460 - DNA, 25 bp, Rattus norvegicus
ggtactgtcggtagcgctcggtcaa

SEQ ID NO: 463461 - DNA, 25 bp, Rattus norvegicus
ggtactgtcggttgcgctcggtcaa

SEQ ID NO: 463462 - DNA, 25 bp, Rattus norvegicus
ggtactgtctccagttggtcgggca

SEQ ID NO: 463463 - DNA, 25 bp, Rattus norvegicus
ggtactgtctcctgttggtcgggca

SEQ ID NO: 463464 - DNA, 25 bp, Rattus norvegicus
ggtactgtgggcaagatggactctc

SEQ ID NO: 463465 - DNA, 25 bp, Rattus norvegicus
ggtactgtgggctagatggactctc

SEQ ID NO: 463466 - DNA, 25 bp, Rattus norvegicus
ggtactgtgtatacctatgtgcata

SEQ ID NO: 463467 - DNA, 25 bp, Rattus norvegicus
ggtactgtgtattcctatgtgcata

SEQ ID NO: 463468 - DNA, 25 bp, Rattus norvegicus
ggtactgtgtccctggtttgctgct

SEQ ID NO: 463469 - DNA, 25 bp, Rattus norvegicus
ggtactgtgtccgtggtttgctgct

SEQ ID NO: 463470 - DNA, 25 bp, Rattus norvegicus
ggtactgtgtgtatttcaaatcatc

SEQ ID NO: 463471 - DNA, 25 bp, Rattus norvegicus
ggtactgtgtgtttttcaaatcatc

SEQ ID NO: 463472 - DNA, 25 bp, Rattus norvegicus
ggtactgttaggactactatctcaa

SEQ ID NO: 463473 - DNA, 25 bp, Rattus norvegicus
ggtactgttaggtctactatctcaa

SEQ ID NO: 463474 - DNA, 25 bp, Rattus norvegicus
ggtactgttgcaataattcttcttg

SEQ ID NO: 463475 - DNA, 25 bp, Rattus norvegicus
ggtactgttgcattaattcttcttg

SEQ ID NO: 463476 - DNA, 25 bp, Rattus norvegicus
ggtacttaccagactactactgctt

SEQ ID NO: 463477 - DNA, 25 bp, Rattus norvegicus
ggtacttaccagtctactactgctt

SEQ ID NO: 463478 - DNA, 25 bp, Rattus norvegicus
ggtacttcacataggacttcccatc

SEQ ID NO: 463479 - DNA, 25 bp, Rattus norvegicus
ggtacttcacattggacttcccatc

SEQ ID NO: 463480 - DNA, 25 bp, Rattus norvegicus
ggtacttcagtgaccctcccctgta

SEQ ID NO: 463481 - DNA, 25 bp, Rattus norvegicus
ggtacttcagtgtccctcccctgta

SEQ ID NO: 463482 - DNA, 25 bp, Rattus norvegicus
ggtacttcatgcagattgcccggga

SEQ ID NO: 463483 - DNA, 25 bp, Rattus norvegicus
ggtacttcatgcagtactgcatata

SEQ ID NO: 463484 - DNA, 25 bp, Rattus norvegicus
ggtacttcatgctgattgcccggga

SEQ ID NO: 463485 - DNA, 25 bp, Rattus norvegicus
ggtacttcatgctgtactgcatata

SEQ ID NO: 463486 - DNA, 25 bp, Rattus norvegicus
ggtacttccaaactgaatccactaa

SEQ ID NO: 463487 - DNA, 25 bp, Rattus norvegicus
ggtacttccaaagtgaatccactaa

SEQ ID NO: 463488 - DNA, 25 bp, Rattus norvegicus
ggtacttccgaaagcttttcagact

SEQ ID NO: 463489 - DNA, 25 bp, Rattus norvegicus
ggtacttccgaatgcttttcagact

SEQ ID NO: 463490 - DNA, 25 bp, Rattus norvegicus
ggtacttctactaaattgtctattg

SEQ ID NO: 463491 - DNA, 25 bp, Rattus norvegicus
ggtacttctacttaattgtctattg

SEQ ID NO: 463492 - DNA, 25 bp, Rattus norvegicus
ggtacttctatacatctgcctaatg

SEQ ID NO: 463493 - DNA, 25 bp, Rattus norvegicus
ggtacttctatagatctgcctaatg

SEQ ID NO: 463494 - DNA, 25 bp, Rattus norvegicus
ggtacttctttaacagcatgcttgg

SEQ ID NO: 463495 - DNA, 25 bp, Rattus norvegicus
ggtacttctttatcagcatgcttgg

SEQ ID NO: 463496 - DNA, 25 bp, Rattus norvegicus
ggtacttgacacatacagcatggat

SEQ ID NO: 463497 - DNA, 25 bp, Rattus norvegicus
ggtacttgacacttacagcatggat

SEQ ID NO: 463498 - DNA, 25 bp, Rattus norvegicus
ggtacttgagcaccattcacaggtc

SEQ ID NO: 463499 - DNA, 25 bp, Rattus norvegicus
ggtacttgagcagcattcacaggtc

SEQ ID NO: 463500 - DNA, 25 bp, Rattus norvegicus
ggtacttgagtcaactgccaagccc

SEQ ID NO: 463501 - DNA, 25 bp, Rattus norvegicus
ggtacttgagtctactgccaagccc

SEQ ID NO: 463502 - DNA, 25 bp, Rattus norvegicus
ggtacttgcaacatatctctgacgt

SEQ ID NO: 463503 - DNA, 25 bp, Rattus norvegicus
ggtacttgcaacttatctctgacgt

SEQ ID NO: 463504 - DNA, 25 bp, Rattus norvegicus
ggtacttgccatcattgttgaaagc

SEQ ID NO: 463505 - DNA, 25 bp, Rattus norvegicus
ggtacttgccatgattgttgaaagc

SEQ ID NO: 463506 - DNA, 25 bp, Rattus norvegicus
ggtacttgcctcattgaaatctgtt

SEQ ID NO: 463507 - DNA, 25 bp, Rattus norvegicus
ggtacttgcctctttgaaatctgtt

SEQ ID NO: 463508 - DNA, 25 bp, Rattus norvegicus
ggtacttgctacactaggaagtctt

SEQ ID NO: 463509 - DNA, 25 bp, Rattus norvegicus
ggtacttgctactctaggaagtctt

SEQ ID NO: 463510 - DNA, 25 bp, Rattus norvegicus
ggtacttgctagagactgtatccag

SEQ ID NO: 463511 - DNA, 25 bp, Rattus norvegicus
ggtacttgctagtgactgtatccag

SEQ ID NO: 463512 - DNA, 25 bp, Rattus norvegicus
ggtacttgtacaacatctgctactg

SEQ ID NO: 463513 - DNA, 25 bp, Rattus norvegicus
ggtacttgtacatcatctgctactg

SEQ ID NO: 463514 - DNA, 25 bp, Rattus norvegicus
ggtactttatacagcatctcaggac

SEQ ID NO: 463515 - DNA, 25 bp, Rattus norvegicus
ggtactttatactgcatctcaggac

SEQ ID NO: 463516 - DNA, 25 bp, Rattus norvegicus
ggtactttatctcaccaggtctgat

SEQ ID NO: 463517 - DNA, 25 bp, Rattus norvegicus
ggtactttatctgaccaggtctgat

SEQ ID NO: 463518 - DNA, 25 bp, Rattus norvegicus
ggtactttcaagagccccgtgtgct

SEQ ID NO: 463519 - DNA, 25 bp, Rattus norvegicus
ggtactttcaagtgccccgtgtgct

SEQ ID NO: 463520 - DNA, 25 bp, Rattus norvegicus
ggtactttctccacaaatgaacata

SEQ ID NO: 463521 - DNA, 25 bp, Rattus norvegicus
ggtactttctcctcaaatgaacata

SEQ ID NO: 463522 - DNA, 25 bp, Rattus norvegicus
ggtactttctctaagaccttcagta

SEQ ID NO: 463523 - DNA, 25 bp, Rattus norvegicus
ggtactttctctcgcctcctcagat

SEQ ID NO: 463524 - DNA, 25 bp, Rattus norvegicus
ggtactttctctggcctcctcagat

SEQ ID NO: 463525 - DNA, 25 bp, Rattus norvegicus
ggtactttctcttagaccttcagta

SEQ ID NO: 463526 - DNA, 25 bp, Rattus norvegicus
ggtactttctgaactgcacagctgc

SEQ ID NO: 463527 - DNA, 25 bp, Rattus norvegicus
ggtactttctgatctgcacagctgc

SEQ ID NO: 463528 - DNA, 25 bp, Rattus norvegicus
ggtactttctggatctcagtgagct

SEQ ID NO: 463529 - DNA, 25 bp, Rattus norvegicus
ggtactttctggttctcagtgagct

SEQ ID NO: 463530 - DNA, 25 bp, Rattus norvegicus
ggtactttgaatactgctgttcttg

SEQ ID NO: 463531 - DNA, 25 bp, Rattus norvegicus
ggtactttgaattctgctgttcttg

SEQ ID NO: 463532 - DNA, 25 bp, Rattus norvegicus
ggtactttgagcaggaacacaggaa

SEQ ID NO: 463533 - DNA, 25 bp, Rattus norvegicus
ggtactttgagctggaacacaggaa

SEQ ID NO: 463534 - DNA, 25 bp, Rattus norvegicus
ggtactttgcggatggcgttgtcca

SEQ ID NO: 463535 - DNA, 25 bp, Rattus norvegicus
ggtactttgcggttggcgttgtcca

SEQ ID NO: 463536 - DNA, 25 bp, Rattus norvegicus
ggtactttgtccatcagatttttgt

SEQ ID NO: 463537 - DNA, 25 bp, Rattus norvegicus
ggtactttgtccttcagatttttgt

SEQ ID NO: 463538 - DNA, 25 bp, Rattus norvegicus
ggtacttttcaacaacaatctgagt

SEQ ID NO: 463539 - DNA, 25 bp, Rattus norvegicus
ggtacttttcaagaacaatctgagt

SEQ ID NO: 463540 - DNA, 25 bp, Rattus norvegicus
ggtacttttctgatgtggtcgcttc

SEQ ID NO: 463541 - DNA, 25 bp, Rattus norvegicus
ggtacttttctgttgtggtcgcttc

SEQ ID NO: 463542 - DNA, 25 bp, Rattus norvegicus
ggtagaaaacatccctgctgacaag

SEQ ID NO: 463543 - DNA, 25 bp, Rattus norvegicus
ggtagaaaacatgcctgctgacaag

SEQ ID NO: 463544 - DNA, 25 bp, Rattus norvegicus
ggtagaaaacgtcccgcctgtgaca

SEQ ID NO: 463545 - DNA, 25 bp, Rattus norvegicus
ggtagaaaacgtgccgcctgtgaca

SEQ ID NO: 463546 - DNA, 25 bp, Rattus norvegicus
ggtagaaagcccaggacagctcagg

SEQ ID NO: 463547 - DNA, 25 bp, Rattus norvegicus
ggtagaaagccctggacagctcagg

SEQ ID NO: 463548 - DNA, 25 bp, Rattus norvegicus
ggtagaaagtccctgacagtcctgc

SEQ ID NO: 463549 - DNA, 25 bp, Rattus norvegicus
ggtagaaagtccgtgacagtcctgc

SEQ ID NO: 463550 - DNA, 25 bp, Rattus norvegicus
ggtagaaatcccactaagagcagat

SEQ ID NO: 463551 - DNA, 25 bp, Rattus norvegicus
ggtagaaatccctctaagagcagat

SEQ ID NO: 463552 - DNA, 25 bp, Rattus norvegicus
ggtagaacagctctccgttttttat

SEQ ID NO: 463553 - DNA, 25 bp, Rattus norvegicus
ggtagaacagctgtccgttttttat

SEQ ID NO: 463554 - DNA, 25 bp, Rattus norvegicus
ggtagaacattccatctggtcccag

SEQ ID NO: 463555 - DNA, 25 bp, Rattus norvegicus
ggtagaacattcgatctggtcccag

SEQ ID NO: 463556 - DNA, 25 bp, Rattus norvegicus
ggtagaaccttgagggcatcacctt

SEQ ID NO: 463557 - DNA, 25 bp, Rattus norvegicus
ggtagaaccttgcaaccactgctgt

SEQ ID NO: 463558 - DNA, 25 bp, Rattus norvegicus
ggtagaaccttggaaccactgctgt

SEQ ID NO: 463559 - DNA, 25 bp, Rattus norvegicus
ggtagaaccttgtgggcatcacctt

SEQ ID NO: 463560 - DNA, 25 bp, Rattus norvegicus
ggtagaataaccagccaacacgcat

SEQ ID NO: 463561 - DNA, 25 bp, Rattus norvegicus
ggtagaataacctgccaacacgcat

SEQ ID NO: 463562 - DNA, 25 bp, Rattus norvegicus
ggtagaatcaggcttgcctccgtga

SEQ ID NO: 463563 - DNA, 25 bp, Rattus norvegicus
ggtagaatcagggttgcctccgtga

SEQ ID NO: 463564 - DNA, 25 bp, Rattus norvegicus
ggtagaatcagtctctgcttctcaa

SEQ ID NO: 463565 - DNA, 25 bp, Rattus norvegicus
ggtagaatcagtgtctgcttctcaa

SEQ ID NO: 463566 - DNA, 25 bp, Rattus norvegicus
ggtagaatcatcacctggcgtggct

SEQ ID NO: 463567 - DNA, 25 bp, Rattus norvegicus
ggtagaatcatctcctggcgtggct

SEQ ID NO: 463568 - DNA, 25 bp, Rattus norvegicus
ggtagaatcattattgtggccagtt

SEQ ID NO: 463569 - DNA, 25 bp, Rattus norvegicus
ggtagaatcatttttgtggccagtt

SEQ ID NO: 463570 - DNA, 25 bp, Rattus norvegicus
ggtagaatctccattaaacaggcat

SEQ ID NO: 463571 - DNA, 25 bp, Rattus norvegicus
ggtagaatctcctttaaacaggcat

SEQ ID NO: 463572 - DNA, 25 bp, Rattus norvegicus
ggtagacaacagaaggcctggccaa

SEQ ID NO: 463573 - DNA, 25 bp, Rattus norvegicus
ggtagacaacagtaggcctggccaa

SEQ ID NO: 463574 - DNA, 25 bp, Rattus norvegicus
ggtagacaagccaatcaattctgaa

SEQ ID NO: 463575 - DNA, 25 bp, Rattus norvegicus
ggtagacaagcctatcaattctgaa

SEQ ID NO: 463576 - DNA, 25 bp, Rattus norvegicus
ggtagacaatccattcaattctaag

SEQ ID NO: 463577 - DNA, 25 bp, Rattus norvegicus
ggtagacaatcctttcaattctaag

SEQ ID NO: 463578 - DNA, 25 bp, Rattus norvegicus
ggtagacacagaccccgaagttaag

SEQ ID NO: 463579 - DNA, 25 bp, Rattus norvegicus
ggtagacacagagcccgaagttaag

SEQ ID NO: 463580 - DNA, 25 bp, Rattus norvegicus
ggtagacacgtgctttgcttcccag

SEQ ID NO: 463581 - DNA, 25 bp, Rattus norvegicus
ggtagacacgtggtttgcttcccag

SEQ ID NO: 463582 - DNA, 25 bp, Rattus norvegicus
ggtagacactggcatcttggacaca

SEQ ID NO: 463583 - DNA, 25 bp, Rattus norvegicus
ggtagacactgggatcttggacaca

SEQ ID NO: 463584 - DNA, 25 bp, Rattus norvegicus
ggtagacacttacaagcccagtact

SEQ ID NO: 463585 - DNA, 25 bp, Rattus norvegicus
ggtagacacttagaagcccagtact

SEQ ID NO: 463586 - DNA, 25 bp, Rattus norvegicus
ggtagacaggtacgcagatctcatt

SEQ ID NO: 463587 - DNA, 25 bp, Rattus norvegicus
ggtagacaggtaggcagatctcatt

SEQ ID NO: 463588 - DNA, 25 bp, Rattus norvegicus
ggtagacagtcaatcctattgtaag

SEQ ID NO: 463589 - DNA, 25 bp, Rattus norvegicus
ggtagacagtcattcctattgtaag

SEQ ID NO: 463590 - DNA, 25 bp, Rattus norvegicus
ggtagacatccacctgctggaactt

SEQ ID NO: 463591 - DNA, 25 bp, Rattus norvegicus
ggtagacatccagctgctggaactt

SEQ ID NO: 463592 - DNA, 25 bp, Rattus norvegicus
ggtagacatcttccccaatgggtat

SEQ ID NO: 463593 - DNA, 25 bp, Rattus norvegicus
ggtagacatcttccgaaagcttggt

SEQ ID NO: 463594 - DNA, 25 bp, Rattus norvegicus
ggtagacatcttgcccaatgggtat

SEQ ID NO: 463595 - DNA, 25 bp, Rattus norvegicus
ggtagacatcttgcgaaagcttggt

SEQ ID NO: 463596 - DNA, 25 bp, Rattus norvegicus
ggtagacatggaactaactccctgt

SEQ ID NO: 463597 - DNA, 25 bp, Rattus norvegicus
ggtagacatggatctaactccctgt

SEQ ID NO: 463598 - DNA, 25 bp, Rattus norvegicus
ggtagacatgtgcattccaagctgt

SEQ ID NO: 463599 - DNA, 25 bp, Rattus norvegicus
ggtagacatgtggattccaagctgt

SEQ ID NO: 463600 - DNA, 25 bp, Rattus norvegicus
ggtagacattacaaacactggctgt

SEQ ID NO: 463601 - DNA, 25 bp, Rattus norvegicus
ggtagacattactaacactggctgt

SEQ ID NO: 463602 - DNA, 25 bp, Rattus norvegicus
ggtagacattagctggcccaagaat

SEQ ID NO: 463603 - DNA, 25 bp, Rattus norvegicus
ggtagacattaggtggcccaagaat

SEQ ID NO: 463604 - DNA, 25 bp, Rattus norvegicus
ggtagacattttaagcaggtttcat

SEQ ID NO: 463605 - DNA, 25 bp, Rattus norvegicus
ggtagacatttttagcaggtttcat

SEQ ID NO: 463606 - DNA, 25 bp, Rattus norvegicus
ggtagaccagaactgcccatgggat

SEQ ID NO: 463607 - DNA, 25 bp, Rattus norvegicus
ggtagaccagaagtgcccatgggat

SEQ ID NO: 463608 - DNA, 25 bp, Rattus norvegicus
ggtagaccatcacagcaatttcatc

SEQ ID NO: 463609 - DNA, 25 bp, Rattus norvegicus
ggtagaccatcagagcaatttcatc

SEQ ID NO: 463610 - DNA, 25 bp, Rattus norvegicus
ggtagacgcatccaatttgcagaac

SEQ ID NO: 463611 - DNA, 25 bp, Rattus norvegicus
ggtagacgcatcgaatttgcagaac

SEQ ID NO: 463612 - DNA, 25 bp, Rattus norvegicus
ggtagactactcagttacgaggatc

SEQ ID NO: 463613 - DNA, 25 bp, Rattus norvegicus
ggtagactactctgttacgaggatc

SEQ ID NO: 463614 - DNA, 25 bp, Rattus norvegicus
ggtagactatgactgcatcggccac

SEQ ID NO: 463615 - DNA, 25 bp, Rattus norvegicus
ggtagactatgagtgcatcggccac

SEQ ID NO: 463616 - DNA, 25 bp, Rattus norvegicus
ggtagactatgcaggcctcaaggtc

SEQ ID NO: 463617 - DNA, 25 bp, Rattus norvegicus
ggtagactatgctggcctcaaggtc

SEQ ID NO: 463618 - DNA, 25 bp, Rattus norvegicus
ggtagactcacacgtaacgccgtta

SEQ ID NO: 463619 - DNA, 25 bp, Rattus norvegicus
ggtagactcacaggtaacgccgtta

SEQ ID NO: 463620 - DNA, 25 bp, Rattus norvegicus
ggtagactcagaatcgtttcggttc

SEQ ID NO: 463621 - DNA, 25 bp, Rattus norvegicus
ggtagactcagattcgtttcggttc

SEQ ID NO: 463622 - DNA, 25 bp, Rattus norvegicus
ggtagactcagtactgtcagtcctg

SEQ ID NO: 463623 - DNA, 25 bp, Rattus norvegicus
ggtagactcagttctgtcagtcctg

SEQ ID NO: 463624 - DNA, 25 bp, Rattus norvegicus
ggtagactccctatgcattagtgaa

SEQ ID NO: 463625 - DNA, 25 bp, Rattus norvegicus
ggtagactccctttgcattagtgaa

SEQ ID NO: 463626 - DNA, 25 bp, Rattus norvegicus
ggtagactgagtcgtgcacacccca

SEQ ID NO: 463627 - DNA, 25 bp, Rattus norvegicus
ggtagactgagtggtgcacacccca

SEQ ID NO: 463628 - DNA, 25 bp, Rattus norvegicus
ggtagactgtccatgctactcgaat

SEQ ID NO: 463629 - DNA, 25 bp, Rattus norvegicus
ggtagactgtccttgctactcgaat

SEQ ID NO: 463630 - DNA, 25 bp, Rattus norvegicus
ggtagacttcagcactctgccttga

SEQ ID NO: 463631 - DNA, 25 bp, Rattus norvegicus
ggtagacttcaggactctgccttga

SEQ ID NO: 463632 - DNA, 25 bp, Rattus norvegicus
ggtagagaacacactggaatccctt

SEQ ID NO: 463633 - DNA, 25 bp, Rattus norvegicus
ggtagagaacactctggaatccctt

SEQ ID NO: 463634 - DNA, 25 bp, Rattus norvegicus
ggtagagaacccaggatctccatcc

SEQ ID NO: 463635 - DNA, 25 bp, Rattus norvegicus
ggtagagaaccctggatctccatcc

SEQ ID NO: 463636 - DNA, 25 bp, Rattus norvegicus
ggtagagacaagactgccttccttc

SEQ ID NO: 463637 - DNA, 25 bp, Rattus norvegicus
ggtagagacaagtctgccttccttc

SEQ ID NO: 463638 - DNA, 25 bp, Rattus norvegicus
ggtagagacaccagagactgcatct

SEQ ID NO: 463639 - DNA, 25 bp, Rattus norvegicus
ggtagagacaccatgtgggccagta

SEQ ID NO: 463640 - DNA, 25 bp, Rattus norvegicus
ggtagagacacctgagactgcatct

SEQ ID NO: 463641 - DNA, 25 bp, Rattus norvegicus
ggtagagacaccttgtgggccagta

SEQ ID NO: 463642 - DNA, 25 bp, Rattus norvegicus
ggtagagacagtcatggttcctaaa

SEQ ID NO: 463643 - DNA, 25 bp, Rattus norvegicus
ggtagagacagtgatggttcctaaa

SEQ ID NO: 463644 - DNA, 25 bp, Rattus norvegicus
ggtagagaccgtaaagtacatcaaa

SEQ ID NO: 463645 - DNA, 25 bp, Rattus norvegicus
ggtagagaccgttaagtacatcaaa

SEQ ID NO: 463646 - DNA, 25 bp, Rattus norvegicus
ggtagagacttgcacctgcgatccc

SEQ ID NO: 463647 - DNA, 25 bp, Rattus norvegicus
ggtagagacttggacctgcgatccc

SEQ ID NO: 463648 - DNA, 25 bp, Rattus norvegicus
ggtagagcacagacatattcattga

SEQ ID NO: 463649 - DNA, 25 bp, Rattus norvegicus
ggtagagcacagtcatattcattga

SEQ ID NO: 463650 - DNA, 25 bp, Rattus norvegicus
ggtagagcacatcagtctccatttg

SEQ ID NO: 463651 - DNA, 25 bp, Rattus norvegicus
ggtagagcacatgagtctccatttg

SEQ ID NO: 463652 - DNA, 25 bp, Rattus norvegicus
ggtagagcacggatcccacgatgga

SEQ ID NO: 463653 - DNA, 25 bp, Rattus norvegicus
ggtagagcacggttcccacgatgga

SEQ ID NO: 463654 - DNA, 25 bp, Rattus norvegicus
ggtagagcacgtacgctgcttccag

SEQ ID NO: 463655 - DNA, 25 bp, Rattus norvegicus
ggtagagcacgttcgctgcttccag

SEQ ID NO: 463656 - DNA, 25 bp, Rattus norvegicus
ggtagagctaagaaatactcccagt

SEQ ID NO: 463657 - DNA, 25 bp, Rattus norvegicus
ggtagagctaagtaatactcccagt

SEQ ID NO: 463658 - DNA, 25 bp, Rattus norvegicus
ggtagagctctccagtctcaatcga

SEQ ID NO: 463659 - DNA, 25 bp, Rattus norvegicus
ggtagagctctcgagtctcaatcga

SEQ ID NO: 463660 - DNA, 25 bp, Rattus norvegicus
ggtagagctgccaagccgaacgtga

SEQ ID NO: 463661 - DNA, 25 bp, Rattus norvegicus
ggtagagctgcctagccgaacgtga

SEQ ID NO: 463662 - DNA, 25 bp, Rattus norvegicus
ggtagaggcattcttcatggcagga

SEQ ID NO: 463663 - DNA, 25 bp, Rattus norvegicus
ggtagaggcattgttcatggcagga

SEQ ID NO: 463664 - DNA, 25 bp, Rattus norvegicus
ggtagaggctacatgtgctttgcaa

SEQ ID NO: 463665 - DNA, 25 bp, Rattus norvegicus
ggtagaggctacttgtgctttgcaa

SEQ ID NO: 463666 - DNA, 25 bp, Rattus norvegicus
ggtagaggcttacccagcagcctgt

SEQ ID NO: 463667 - DNA, 25 bp, Rattus norvegicus
ggtagaggcttagccagcagcctgt

SEQ ID NO: 463668 - DNA, 25 bp, Rattus norvegicus
ggtagaggtacccatctaatgcatt

SEQ ID NO: 463669 - DNA, 25 bp, Rattus norvegicus
ggtagaggtaccgatctaatgcatt

SEQ ID NO: 463670 - DNA, 25 bp, Rattus norvegicus
ggtagaggtgcaccacttgtgactc

SEQ ID NO: 463671 - DNA, 25 bp, Rattus norvegicus
ggtagaggtgcagcacttgtgactc

SEQ ID NO: 463672 - DNA, 25 bp, Rattus norvegicus
ggtagaggttctccgcatgcgttct

SEQ ID NO: 463673 - DNA, 25 bp, Rattus norvegicus
ggtagaggttctgcgcatgcgttct

SEQ ID NO: 463674 - DNA, 25 bp, Rattus norvegicus
ggtagagtacttacccagtatgcag

SEQ ID NO: 463675 - DNA, 25 bp, Rattus norvegicus
ggtagagtactttcccagtatgcag

SEQ ID NO: 463676 - DNA, 25 bp, Rattus norvegicus
ggtagagtattgactgacaccagat

SEQ ID NO: 463677 - DNA, 25 bp, Rattus norvegicus
ggtagagtattgtctgacaccagat

SEQ ID NO: 463678 - DNA, 25 bp, Rattus norvegicus
ggtagagtcaccatcatgatgcctt

SEQ ID NO: 463679 - DNA, 25 bp, Rattus norvegicus
ggtagagtcaccttcatgatgcctt

SEQ ID NO: 463680 - DNA, 25 bp, Rattus norvegicus
ggtagagtcactatttctggttaat

SEQ ID NO: 463681 - DNA, 25 bp, Rattus norvegicus
ggtagagtcactttttctggttaat

SEQ ID NO: 463682 - DNA, 25 bp, Rattus norvegicus
ggtagagtccacatcatttgcaaga

SEQ ID NO: 463683 - DNA, 25 bp, Rattus norvegicus
ggtagagtccacttcatttgcaaga

SEQ ID NO: 463684 - DNA, 25 bp, Rattus norvegicus
ggtagagtctatccggctgctgatc

SEQ ID NO: 463685 - DNA, 25 bp, Rattus norvegicus
ggtagagtctatgcggctgctgatc

SEQ ID NO: 463686 - DNA, 25 bp, Rattus norvegicus
ggtagagtctttcctgaaggcgaat

SEQ ID NO: 463687 - DNA, 25 bp, Rattus norvegicus
ggtagagtctttgctgaaggcgaat

SEQ ID NO: 463688 - DNA, 25 bp, Rattus norvegicus
ggtagagtgcttccccaataagcgc

SEQ ID NO: 463689 - DNA, 25 bp, Rattus norvegicus
ggtagagtgcttgcccaataagcgc

SEQ ID NO: 463690 - DNA, 25 bp, Rattus norvegicus
ggtagagtttggaaatccccagaca

SEQ ID NO: 463691 - DNA, 25 bp, Rattus norvegicus
ggtagagtttggcagtctttcctgc

SEQ ID NO: 463692 - DNA, 25 bp, Rattus norvegicus
ggtagagtttgggagtctttcctgc

SEQ ID NO: 463693 - DNA, 25 bp, Rattus norvegicus
ggtagagtttggtaatccccagaca

SEQ ID NO: 463694 - DNA, 25 bp, Rattus norvegicus
ggtagatatttacgagttcctccca

SEQ ID NO: 463695 - DNA, 25 bp, Rattus norvegicus
ggtagatatttaggagttcctccca

SEQ ID NO: 463696 - DNA, 25 bp, Rattus norvegicus
ggtagatcactgcatagtccctctc

SEQ ID NO: 463697 - DNA, 25 bp, Rattus norvegicus
ggtagatcactggatagtccctctc

SEQ ID NO: 463698 - DNA, 25 bp, Rattus norvegicus
ggtagatccaaaaagcctccatcgc

SEQ ID NO: 463699 - DNA, 25 bp, Rattus norvegicus
ggtagatccaaatagcctccatcgc

SEQ ID NO: 463700 - DNA, 25 bp, Rattus norvegicus
ggtagatctctcctcatggtaactg

SEQ ID NO: 463701 - DNA, 25 bp, Rattus norvegicus
ggtagatctctcgtcatggtaactg

SEQ ID NO: 463702 - DNA, 25 bp, Rattus norvegicus
ggtagatgcattaccagcagcagat

SEQ ID NO: 463703 - DNA, 25 bp, Rattus norvegicus
ggtagatgcatttccagcagcagat

SEQ ID NO: 463704 - DNA, 25 bp, Rattus norvegicus
ggtagatggcaaaatccctatcata

SEQ ID NO: 463705 - DNA, 25 bp, Rattus norvegicus
ggtagatggcaatatccctatcata

SEQ ID NO: 463706 - DNA, 25 bp, Rattus norvegicus
ggtagatggccaagtgagcactcag

SEQ ID NO: 463707 - DNA, 25 bp, Rattus norvegicus
ggtagatggccatgtgagcactcag

SEQ ID NO: 463708 - DNA, 25 bp, Rattus norvegicus
ggtagattacccagccatactttag

SEQ ID NO: 463709 - DNA, 25 bp, Rattus norvegicus
ggtagattaccctgccatactttag

SEQ ID NO: 463710 - DNA, 25 bp, Rattus norvegicus
ggtagattactcaggctgctcaggg

SEQ ID NO: 463711 - DNA, 25 bp, Rattus norvegicus
ggtagattactctggctgctcaggg

SEQ ID NO: 463712 - DNA, 25 bp, Rattus norvegicus
ggtagattgtctcacactgtagcaa

SEQ ID NO: 463713 - DNA, 25 bp, Rattus norvegicus
ggtagattgtctgacactgtagcaa

SEQ ID NO: 463714 - DNA, 25 bp, Rattus norvegicus
ggtagatttccgcactttatagttg

SEQ ID NO: 463715 - DNA, 25 bp, Rattus norvegicus
ggtagatttccggactttatagttg

SEQ ID NO: 463716 - DNA, 25 bp, Rattus norvegicus
ggtagatttctgacagacgctctgc

SEQ ID NO: 463717 - DNA, 25 bp, Rattus norvegicus
ggtagatttctgtcagacgctctgc

SEQ ID NO: 463718 - DNA, 25 bp, Rattus norvegicus
ggtagatttttcaggaacacctaag

SEQ ID NO: 463719 - DNA, 25 bp, Rattus norvegicus
ggtagatttttctggaacacctaag

SEQ ID NO: 463720 - DNA, 25 bp, Rattus norvegicus
ggtagcaaaggtactatcacacaaa

SEQ ID NO: 463721 - DNA, 25 bp, Rattus norvegicus
ggtagcaaaggttctatcacacaaa

SEQ ID NO: 463722 - DNA, 25 bp, Rattus norvegicus
ggtagcaacccaatcagtgacatct

SEQ ID NO: 463723 - DNA, 25 bp, Rattus norvegicus
ggtagcaacccattcagtgacatct

SEQ ID NO: 463724 - DNA, 25 bp, Rattus norvegicus
ggtagcaatcttacagtggtggtta

SEQ ID NO: 463725 - DNA, 25 bp, Rattus norvegicus
ggtagcaatctttcagtggtggtta

SEQ ID NO: 463726 - DNA, 25 bp, Rattus norvegicus
ggtagcaatgcaacaagctcagttg

SEQ ID NO: 463727 - DNA, 25 bp, Rattus norvegicus
ggtagcaatgcatcaagctcagttg

SEQ ID NO: 463728 - DNA, 25 bp, Rattus norvegicus
ggtagcacaagacagtatccatctg

SEQ ID NO: 463729 - DNA, 25 bp, Rattus norvegicus
ggtagcacaagagagtatccatctg

SEQ ID NO: 463730 - DNA, 25 bp, Rattus norvegicus
ggtagcacaagtctctttcttgctt

SEQ ID NO: 463731 - DNA, 25 bp, Rattus norvegicus
ggtagcacaagtgtctttcttgctt

SEQ ID NO: 463732 - DNA, 25 bp, Rattus norvegicus
ggtagcacacagaccccgcacagag

SEQ ID NO: 463733 - DNA, 25 bp, Rattus norvegicus
ggtagcacacagtccccgcacagag

SEQ ID NO: 463734 - DNA, 25 bp, Rattus norvegicus
ggtagcacacatctggatcctagta

SEQ ID NO: 463735 - DNA, 25 bp, Rattus norvegicus
ggtagcacacatgtggatcctagta

SEQ ID NO: 463736 - DNA, 25 bp, Rattus norvegicus
ggtagcacagaaagcaagctcccta

SEQ ID NO: 463737 - DNA, 25 bp, Rattus norvegicus
ggtagcacagaatgcaagctcccta

SEQ ID NO: 463738 - DNA, 25 bp, Rattus norvegicus
ggtagcacagacaccaagcacacat

SEQ ID NO: 463739 - DNA, 25 bp, Rattus norvegicus
ggtagcacagactccaagcacacat

SEQ ID NO: 463740 - DNA, 25 bp, Rattus norvegicus
ggtagcaccaaaacaatctgttata

SEQ ID NO: 463741 - DNA, 25 bp, Rattus norvegicus
ggtagcaccaaatcaatctgttata

SEQ ID NO: 463742 - DNA, 25 bp, Rattus norvegicus
ggtagcacccagcagccagtaggcc

SEQ ID NO: 463743 - DNA, 25 bp, Rattus norvegicus
ggtagcacccaggagccagtaggcc

SEQ ID NO: 463744 - DNA, 25 bp, Rattus norvegicus
ggtagcacccgaatttgtgtttaca

SEQ ID NO: 463745 - DNA, 25 bp, Rattus norvegicus
ggtagcacccgattttgtgtttaca

SEQ ID NO: 463746 - DNA, 25 bp, Rattus norvegicus
ggtagcacctgcagctagatggatt

SEQ ID NO: 463747 - DNA, 25 bp, Rattus norvegicus
ggtagcacctgctgctagatggatt

SEQ ID NO: 463748 - DNA, 25 bp, Rattus norvegicus
ggtagcactgtcatctcaggacttt

SEQ ID NO: 463749 - DNA, 25 bp, Rattus norvegicus
ggtagcactgtcttctcaggacttt

SEQ ID NO: 463750 - DNA, 25 bp, Rattus norvegicus
ggtagcacttagcaaattccactat

SEQ ID NO: 463751 - DNA, 25 bp, Rattus norvegicus
ggtagcacttaggaaattccactat

SEQ ID NO: 463752 - DNA, 25 bp, Rattus norvegicus
ggtagcacttggcatagactgattt

SEQ ID NO: 463753 - DNA, 25 bp, Rattus norvegicus
ggtagcacttgggatagactgattt

SEQ ID NO: 463754 - DNA, 25 bp, Rattus norvegicus
ggtagcagactgaccagaaagcatt

SEQ ID NO: 463755 - DNA, 25 bp, Rattus norvegicus
ggtagcagactgtccagaaagcatt

SEQ ID NO: 463756 - DNA, 25 bp, Rattus norvegicus
ggtagcagagttctccccaatagct

SEQ ID NO: 463757 - DNA, 25 bp, Rattus norvegicus
ggtagcagagttgtccccaatagct

SEQ ID NO: 463758 - DNA, 25 bp, Rattus norvegicus
ggtagcagatctacatccagttggc

SEQ ID NO: 463759 - DNA, 25 bp, Rattus norvegicus
ggtagcagatcttcatccagttggc

SEQ ID NO: 463760 - DNA, 25 bp, Rattus norvegicus
ggtagcagccatccgtgcatggaaa

SEQ ID NO: 463761 - DNA, 25 bp, Rattus norvegicus
ggtagcagccatgcgtgcatggaaa

SEQ ID NO: 463762 - DNA, 25 bp, Rattus norvegicus
ggtagcagctacctattcaacacgc

SEQ ID NO: 463763 - DNA, 25 bp, Rattus norvegicus
ggtagcagctacgtattcaacacgc

SEQ ID NO: 463764 - DNA, 25 bp, Rattus norvegicus
ggtagcagctctcgtgaacctcagg

SEQ ID NO: 463765 - DNA, 25 bp, Rattus norvegicus
ggtagcagctctggtgaacctcagg

SEQ ID NO: 463766 - DNA, 25 bp, Rattus norvegicus
ggtagcaggcaaccagcccaaggct

SEQ ID NO: 463767 - DNA, 25 bp, Rattus norvegicus
ggtagcaggcaagcagcccaaggct

SEQ ID NO: 463768 - DNA, 25 bp, Rattus norvegicus
ggtagcagtacaacgggcatgccca

SEQ ID NO: 463769 - DNA, 25 bp, Rattus norvegicus
ggtagcagtacatcgggcatgccca

SEQ ID NO: 463770 - DNA, 25 bp, Rattus norvegicus
ggtagcagttccacaagcaagtgaa

SEQ ID NO: 463771 - DNA, 25 bp, Rattus norvegicus
ggtagcagttcctcaagcaagtgaa

SEQ ID NO: 463772 - DNA, 25 bp, Rattus norvegicus
ggtagcataaatccctgaggtactt

SEQ ID NO: 463773 - DNA, 25 bp, Rattus norvegicus
ggtagcataaatgcctgaggtactt

SEQ ID NO: 463774 - DNA, 25 bp, Rattus norvegicus
ggtagcatacacctataattctagc

SEQ ID NO: 463775 - DNA, 25 bp, Rattus norvegicus
ggtagcatacacgtataattctagc

SEQ ID NO: 463776 - DNA, 25 bp, Rattus norvegicus
ggtagcatagcactttacgtgctta

SEQ ID NO: 463777 - DNA, 25 bp, Rattus norvegicus
ggtagcatagcagtttacgtgctta

SEQ ID NO: 463778 - DNA, 25 bp, Rattus norvegicus
ggtagcatcgctaagactttaactt

SEQ ID NO: 463779 - DNA, 25 bp, Rattus norvegicus
ggtagcatcgcttagactttaactt

SEQ ID NO: 463780 - DNA, 25 bp, Rattus norvegicus
ggtagcatctccagtgcatctaggc

SEQ ID NO: 463781 - DNA, 25 bp, Rattus norvegicus
ggtagcatctcctgtgcatctaggc

SEQ ID NO: 463782 - DNA, 25 bp, Rattus norvegicus
ggtagcatgccaatgattacttttt

SEQ ID NO: 463783 - DNA, 25 bp, Rattus norvegicus
ggtagcatgccattgattacttttt

SEQ ID NO: 463784 - DNA, 25 bp, Rattus norvegicus
ggtagcatggaacgccccgatgaca

SEQ ID NO: 463785 - DNA, 25 bp, Rattus norvegicus
ggtagcatggaaggccccgatgaca

SEQ ID NO: 463786 - DNA, 25 bp, Rattus norvegicus
ggtagcatgttcagtaaagtatcac

SEQ ID NO: 463787 - DNA, 25 bp, Rattus norvegicus
ggtagcatgttctgtaaagtatcac

SEQ ID NO: 463788 - DNA, 25 bp, Rattus norvegicus
ggtagcattgttaacggctccacta

SEQ ID NO: 463789 - DNA, 25 bp, Rattus norvegicus
ggtagcattgttagcacacacaaaa

SEQ ID NO: 463790 - DNA, 25 bp, Rattus norvegicus
ggtagcattgtttacggctccacta

SEQ ID NO: 463791 - DNA, 25 bp, Rattus norvegicus
ggtagcattgtttgcacacacaaaa

SEQ ID NO: 463792 - DNA, 25 bp, Rattus norvegicus
ggtagcatttctcaactgttaatca

SEQ ID NO: 463793 - DNA, 25 bp, Rattus norvegicus
ggtagcatttctgaactgttaatca

SEQ ID NO: 463794 - DNA, 25 bp, Rattus norvegicus
ggtagccaaataaactcggacttct

SEQ ID NO: 463795 - DNA, 25 bp, Rattus norvegicus
ggtagccaaatatactcggacttct

SEQ ID NO: 463796 - DNA, 25 bp, Rattus norvegicus
ggtagccaaccacgatgcaatgaat

SEQ ID NO: 463797 - DNA, 25 bp, Rattus norvegicus
ggtagccaaccaggatgcaatgaat

SEQ ID NO: 463798 - DNA, 25 bp, Rattus norvegicus
ggtagccaatagcagtgtcccatgt

SEQ ID NO: 463799 - DNA, 25 bp, Rattus norvegicus
ggtagccaataggagtgtcccatgt

SEQ ID NO: 463800 - DNA, 25 bp, Rattus norvegicus
ggtagccaatgtatccttaaattca

SEQ ID NO: 463801 - DNA, 25 bp, Rattus norvegicus
ggtagccaatgtttccttaaattca

SEQ ID NO: 463802 - DNA, 25 bp, Rattus norvegicus
ggtagccacaggacctaatgcagtt

SEQ ID NO: 463803 - DNA, 25 bp, Rattus norvegicus
ggtagccacaggtcctaatgcagtt

SEQ ID NO: 463804 - DNA, 25 bp, Rattus norvegicus
ggtagccaccctattttggtggatg

SEQ ID NO: 463805 - DNA, 25 bp, Rattus norvegicus
ggtagccacccttttttggtggatg

SEQ ID NO: 463806 - DNA, 25 bp, Rattus norvegicus
ggtagccacctgacgaacaaaaaag

SEQ ID NO: 463807 - DNA, 25 bp, Rattus norvegicus
ggtagccacctgtcgaacaaaaaag

SEQ ID NO: 463808 - DNA, 25 bp, Rattus norvegicus
ggtagccactctcacatttgttgtt

SEQ ID NO: 463809 - DNA, 25 bp, Rattus norvegicus
ggtagccactctgacatttgttgtt

SEQ ID NO: 463810 - DNA, 25 bp, Rattus norvegicus
ggtagccagattattacagttccag

SEQ ID NO: 463811 - DNA, 25 bp, Rattus norvegicus
ggtagccagatttttacagttccag

SEQ ID NO: 463812 - DNA, 25 bp, Rattus norvegicus
ggtagccagggacccctagaacagt

SEQ ID NO: 463813 - DNA, 25 bp, Rattus norvegicus
ggtagccagggagccctagaacagt

SEQ ID NO: 463814 - DNA, 25 bp, Rattus norvegicus
ggtagccagtaaaccagtgttcatt

SEQ ID NO: 463815 - DNA, 25 bp, Rattus norvegicus
ggtagccagtaatccagtgttcatt

SEQ ID NO: 463816 - DNA, 25 bp, Rattus norvegicus
ggtagccatcccatattttagaaca

SEQ ID NO: 463817 - DNA, 25 bp, Rattus norvegicus
ggtagccatcccttattttagaaca

SEQ ID NO: 463818 - DNA, 25 bp, Rattus norvegicus
ggtagccatccgatggagatgccta

SEQ ID NO: 463819 - DNA, 25 bp, Rattus norvegicus
ggtagccatccgttggagatgccta

SEQ ID NO: 463820 - DNA, 25 bp, Rattus norvegicus
ggtagccatcttagaatgttccaga

SEQ ID NO: 463821 - DNA, 25 bp, Rattus norvegicus
ggtagccatctttgaatgttccaga

SEQ ID NO: 463822 - DNA, 25 bp, Rattus norvegicus
ggtagccatggcacgaaaactccag

SEQ ID NO: 463823 - DNA, 25 bp, Rattus norvegicus
ggtagccatggctcgaaaactccag

SEQ ID NO: 463824 - DNA, 25 bp, Rattus norvegicus
ggtagccattgtaaaccttggcctt

SEQ ID NO: 463825 - DNA, 25 bp, Rattus norvegicus
ggtagccattgttaaccttggcctt

SEQ ID NO: 463826 - DNA, 25 bp, Rattus norvegicus
ggtagccatttgaacttactagtct

SEQ ID NO: 463827 - DNA, 25 bp, Rattus norvegicus
ggtagccatttgtacttactagtct

SEQ ID NO: 463828 - DNA, 25 bp, Rattus norvegicus
ggtagcccaagtcctgtaatcacag

SEQ ID NO: 463829 - DNA, 25 bp, Rattus norvegicus
ggtagcccaagtgctgtaatcacag

SEQ ID NO: 463830 - DNA, 25 bp, Rattus norvegicus
ggtagcccataaactggcccatgag

SEQ ID NO: 463831 - DNA, 25 bp, Rattus norvegicus
ggtagcccataatctggcccatgag

SEQ ID NO: 463832 - DNA, 25 bp, Rattus norvegicus
ggtagcccgggaagccccaacacag

SEQ ID NO: 463833 - DNA, 25 bp, Rattus norvegicus
ggtagcccgggatgccccaacacag

SEQ ID NO: 463834 - DNA, 25 bp, Rattus norvegicus
ggtagccgaagactttgccgcacag

SEQ ID NO: 463835 - DNA, 25 bp, Rattus norvegicus
ggtagccgaagagtttgccgcacag

SEQ ID NO: 463836 - DNA, 25 bp, Rattus norvegicus
ggtagccgacctaaagatctcttct

SEQ ID NO: 463837 - DNA, 25 bp, Rattus norvegicus
ggtagccgaccttaagatctcttct

SEQ ID NO: 463838 - DNA, 25 bp, Rattus norvegicus
ggtagccgatccatgataagttact

SEQ ID NO: 463839 - DNA, 25 bp, Rattus norvegicus
ggtagccgatccttgataagttact

SEQ ID NO: 463840 - DNA, 25 bp, Rattus norvegicus
ggtagccgccatcttaccgccggga

SEQ ID NO: 463841 - DNA, 25 bp, Rattus norvegicus
ggtagccgccatgttaccgccggga

SEQ ID NO: 463842 - DNA, 25 bp, Rattus norvegicus
ggtagccgtgatcatgttcattcca

SEQ ID NO: 463843 - DNA, 25 bp, Rattus norvegicus
ggtagccgtgatgatgttcattcca

SEQ ID NO: 463844 - DNA, 25 bp, Rattus norvegicus
ggtagcctccagctggagcatcaaa

SEQ ID NO: 463845 - DNA, 25 bp, Rattus norvegicus
ggtagcctccaggtggagcatcaaa

SEQ ID NO: 463846 - DNA, 25 bp, Rattus norvegicus
ggtagcctcgccatatatgcaatag

SEQ ID NO: 463847 - DNA, 25 bp, Rattus norvegicus
ggtagcctcgccttatatgcaatag

SEQ ID NO: 463848 - DNA, 25 bp, Rattus norvegicus
ggtagcctctatataagagcccaat

SEQ ID NO: 463849 - DNA, 25 bp, Rattus norvegicus
ggtagcctctatttaagagcccaat

SEQ ID NO: 463850 - DNA, 25 bp, Rattus norvegicus
ggtagcctgagtccaatccctggga

SEQ ID NO: 463851 - DNA, 25 bp, Rattus norvegicus
ggtagcctgagtgcaatccctggga

SEQ ID NO: 463852 - DNA, 25 bp, Rattus norvegicus
ggtagccttaagagaaacatgcttc

SEQ ID NO: 463853 - DNA, 25 bp, Rattus norvegicus
ggtagccttaagtgaaacatgcttc

SEQ ID NO: 463854 - DNA, 25 bp, Rattus norvegicus
ggtagcctttgaacgtgtgtgcatc

SEQ ID NO: 463855 - DNA, 25 bp, Rattus norvegicus
ggtagcctttgatcgtgtgtgcatc

SEQ ID NO: 463856 - DNA, 25 bp, Rattus norvegicus
ggtagcgagccacaagactccaatg

SEQ ID NO: 463857 - DNA, 25 bp, Rattus norvegicus
ggtagcgagccagaagactccaatg

SEQ ID NO: 463858 - DNA, 25 bp, Rattus norvegicus
ggtagcgcatagaagcttagagtca

SEQ ID NO: 463859 - DNA, 25 bp, Rattus norvegicus
ggtagcgcatagtagcttagagtca

SEQ ID NO: 463860 - DNA, 25 bp, Rattus norvegicus
ggtagcgctcaaagccctaatggaa

SEQ ID NO: 463861 - DNA, 25 bp, Rattus norvegicus
ggtagcgctcaatgccctaatggaa

SEQ ID NO: 463862 - DNA, 25 bp, Rattus norvegicus
ggtagcggcgatcctccctgcatgt

SEQ ID NO: 463863 - DNA, 25 bp, Rattus norvegicus
ggtagcggcgatgctccctgcatgt

SEQ ID NO: 463864 - DNA, 25 bp, Rattus norvegicus
ggtagcgtgtgtatggtcaccctca

SEQ ID NO: 463865 - DNA, 25 bp, Rattus norvegicus
ggtagcgtgtgtttggtcaccctca

SEQ ID NO: 463866 - DNA, 25 bp, Rattus norvegicus
ggtagcgttctgagcttgcactaac

SEQ ID NO: 463867 - DNA, 25 bp, Rattus norvegicus
ggtagcgttctgtgcttgcactaac

SEQ ID NO: 463868 - DNA, 25 bp, Rattus norvegicus
ggtagctaactcagtattttcttca

SEQ ID NO: 463869 - DNA, 25 bp, Rattus norvegicus
ggtagctaactctgtattttcttca

SEQ ID NO: 463870 - DNA, 25 bp, Rattus norvegicus
ggtagctaatgtatttcttcatttt

SEQ ID NO: 463871 - DNA, 25 bp, Rattus norvegicus
ggtagctaatgtctttgagttttaa

SEQ ID NO: 463872 - DNA, 25 bp, Rattus norvegicus
ggtagctaatgtgtttgagttttaa

SEQ ID NO: 463873 - DNA, 25 bp, Rattus norvegicus
ggtagctaatgtttttcttcatttt

SEQ ID NO: 463874 - DNA, 25 bp, Rattus norvegicus
ggtagctaccctcgactggaagagt

SEQ ID NO: 463875 - DNA, 25 bp, Rattus norvegicus
ggtagctaccctggactggaagagt

SEQ ID NO: 463876 - DNA, 25 bp, Rattus norvegicus
ggtagctacctcaaatggatccaca

SEQ ID NO: 463877 - DNA, 25 bp, Rattus norvegicus
ggtagctacctctaatggatccaca

SEQ ID NO: 463878 - DNA, 25 bp, Rattus norvegicus
ggtagctacggaaggccaactgaat

SEQ ID NO: 463879 - DNA, 25 bp, Rattus norvegicus
ggtagctacggatggccaactgaat

SEQ ID NO: 463880 - DNA, 25 bp, Rattus norvegicus
ggtagctactgtctatacggacaaa

SEQ ID NO: 463881 - DNA, 25 bp, Rattus norvegicus
ggtagctactgtgtatacggacaaa

SEQ ID NO: 463882 - DNA, 25 bp, Rattus norvegicus
ggtagctacttccacagagggtttt

SEQ ID NO: 463883 - DNA, 25 bp, Rattus norvegicus
ggtagctacttcgacagagggtttt

SEQ ID NO: 463884 - DNA, 25 bp, Rattus norvegicus
ggtagctatcttatctctagtcatt

SEQ ID NO: 463885 - DNA, 25 bp, Rattus norvegicus
ggtagctatcttttctctagtcatt

SEQ ID NO: 463886 - DNA, 25 bp, Rattus norvegicus
ggtagctattgccaggaatttttga

SEQ ID NO: 463887 - DNA, 25 bp, Rattus norvegicus
ggtagctattgcgaggaatttttga

SEQ ID NO: 463888 - DNA, 25 bp, Rattus norvegicus
ggtagctcaaatatcgtggttcccg

SEQ ID NO: 463889 - DNA, 25 bp, Rattus norvegicus
ggtagctcaaatttcgtggttcccg

SEQ ID NO: 463890 - DNA, 25 bp, Rattus norvegicus
ggtagctcacagactaatcacaaaa

SEQ ID NO: 463891 - DNA, 25 bp, Rattus norvegicus
ggtagctcacagtctaatcacaaaa

SEQ ID NO: 463892 - DNA, 25 bp, Rattus norvegicus
ggtagctcatacctattgatttgcc

SEQ ID NO: 463893 - DNA, 25 bp, Rattus norvegicus
ggtagctcatacgtattgatttgcc

SEQ ID NO: 463894 - DNA, 25 bp, Rattus norvegicus
ggtagctccacgctgagtagcgacc

SEQ ID NO: 463895 - DNA, 25 bp, Rattus norvegicus
ggtagctccacggtgagtagcgacc

SEQ ID NO: 463896 - DNA, 25 bp, Rattus norvegicus
ggtagctccatcctgttgagtaggt

SEQ ID NO: 463897 - DNA, 25 bp, Rattus norvegicus
ggtagctccatcgtgttgagtaggt

SEQ ID NO: 463898 - DNA, 25 bp, Rattus norvegicus
ggtagctccatgcaccccagagaaa

SEQ ID NO: 463899 - DNA, 25 bp, Rattus norvegicus
ggtagctccatggaccccagagaaa

SEQ ID NO: 463900 - DNA, 25 bp, Rattus norvegicus
ggtagctccccgaaaggatgccaca

SEQ ID NO: 463901 - DNA, 25 bp, Rattus norvegicus
ggtagctccccgtaaggatgccaca

SEQ ID NO: 463902 - DNA, 25 bp, Rattus norvegicus
ggtagctcgtgcagtccttctgcag

SEQ ID NO: 463903 - DNA, 25 bp, Rattus norvegicus
ggtagctcgtgctgtccttctgcag

SEQ ID NO: 463904 - DNA, 25 bp, Rattus norvegicus
ggtagctctctcatgcagaccaaag

SEQ ID NO: 463905 - DNA, 25 bp, Rattus norvegicus
ggtagctctctcttgcagaccaaag

SEQ ID NO: 463906 - DNA, 25 bp, Rattus norvegicus
ggtagctgccttagacatttacaca

SEQ ID NO: 463907 - DNA, 25 bp, Rattus norvegicus
ggtagctgcctttgacatttacaca

SEQ ID NO: 463908 - DNA, 25 bp, Rattus norvegicus
ggtagctgctatagtgacagcccct

SEQ ID NO: 463909 - DNA, 25 bp, Rattus norvegicus
ggtagctgctattgtgacagcccct

SEQ ID NO: 463910 - DNA, 25 bp, Rattus norvegicus
ggtagctggctcatgtctaatggga

SEQ ID NO: 463911 - DNA, 25 bp, Rattus norvegicus
ggtagctggctcttgtctaatggga

SEQ ID NO: 463912 - DNA, 25 bp, Rattus norvegicus
ggtagctgtgaactgtctcagaaca

SEQ ID NO: 463913 - DNA, 25 bp, Rattus norvegicus
ggtagctgtgaagtgtctcagaaca

SEQ ID NO: 463914 - DNA, 25 bp, Rattus norvegicus
ggtagcttacatacatggatacagg

SEQ ID NO: 463915 - DNA, 25 bp, Rattus norvegicus
ggtagcttacattcatggatacagg

SEQ ID NO: 463916 - DNA, 25 bp, Rattus norvegicus
ggtagcttaccacagcagttttcat

SEQ ID NO: 463917 - DNA, 25 bp, Rattus norvegicus
ggtagcttaccagagcagttttcat

SEQ ID NO: 463918 - DNA, 25 bp, Rattus norvegicus
ggtagcttactcagctggaagcact

SEQ ID NO: 463919 - DNA, 25 bp, Rattus norvegicus
ggtagcttactctgctggaagcact

SEQ ID NO: 463920 - DNA, 25 bp, Rattus norvegicus
ggtagcttagctacacactgttgag

SEQ ID NO: 463921 - DNA, 25 bp, Rattus norvegicus
ggtagcttagcttcacactgttgag

SEQ ID NO: 463922 - DNA, 25 bp, Rattus norvegicus
ggtagcttatgcctcagggtcagat

SEQ ID NO: 463923 - DNA, 25 bp, Rattus norvegicus
ggtagcttatgcgtcagggtcagat

SEQ ID NO: 463924 - DNA, 25 bp, Rattus norvegicus
ggtagcttccgtagtttatttcaga

SEQ ID NO: 463925 - DNA, 25 bp, Rattus norvegicus
ggtagcttccgttgtttatttcaga

SEQ ID NO: 463926 - DNA, 25 bp, Rattus norvegicus
ggtagcttcgttagagcggaatctg

SEQ ID NO: 463927 - DNA, 25 bp, Rattus norvegicus
ggtagcttcgtttgagcggaatctg

SEQ ID NO: 463928 - DNA, 25 bp, Rattus norvegicus
ggtagcttgactactccgagcaaga

SEQ ID NO: 463929 - DNA, 25 bp, Rattus norvegicus
ggtagcttgacttctccgagcaaga

SEQ ID NO: 463930 - DNA, 25 bp, Rattus norvegicus
ggtagcttgcttatattttgagaca

SEQ ID NO: 463931 - DNA, 25 bp, Rattus norvegicus
ggtagcttgcttttattttgagaca

SEQ ID NO: 463932 - DNA, 25 bp, Rattus norvegicus
ggtagcttgtgcagctggactgata

SEQ ID NO: 463933 - DNA, 25 bp, Rattus norvegicus
ggtagcttgtgcatacactgtgtca

SEQ ID NO: 463934 - DNA, 25 bp, Rattus norvegicus
ggtagcttgtgctgctggactgata

SEQ ID NO: 463935 - DNA, 25 bp, Rattus norvegicus
ggtagcttgtgcttacactgtgtca

SEQ ID NO: 463936 - DNA, 25 bp, Rattus norvegicus
ggtagcttgttcacttccagaaatt

SEQ ID NO: 463937 - DNA, 25 bp, Rattus norvegicus
ggtagcttgttctcttccagaaatt

SEQ ID NO: 463938 - DNA, 25 bp, Rattus norvegicus
ggtagctttattcattgccagggaa

SEQ ID NO: 463939 - DNA, 25 bp, Rattus norvegicus
ggtagctttattgattgccagggaa

SEQ ID NO: 463940 - DNA, 25 bp, Rattus norvegicus
ggtagctttcatctccttaagatgt

SEQ ID NO: 463941 - DNA, 25 bp, Rattus norvegicus
ggtagctttcatgtccttaagatgt

SEQ ID NO: 463942 - DNA, 25 bp, Rattus norvegicus
ggtagctttctgattcaagcgcttt

SEQ ID NO: 463943 - DNA, 25 bp, Rattus norvegicus
ggtagctttctgtttcaagcgcttt

SEQ ID NO: 463944 - DNA, 25 bp, Rattus norvegicus
ggtagcttttttcgtgctctttctc

SEQ ID NO: 463945 - DNA, 25 bp, Rattus norvegicus
ggtagcttttttggtgctctttctc

SEQ ID NO: 463946 - DNA, 25 bp, Rattus norvegicus
ggtaggaactgtctctgctctcata

SEQ ID NO: 463947 - DNA, 25 bp, Rattus norvegicus
ggtaggaactgtgtctgctctcata

SEQ ID NO: 463948 - DNA, 25 bp, Rattus norvegicus
ggtaggaagttcactttataatggg

SEQ ID NO: 463949 - DNA, 25 bp, Rattus norvegicus
ggtaggaagttctctttataatggg

SEQ ID NO: 463950 - DNA, 25 bp, Rattus norvegicus
ggtaggacatgccattcacaatgac

SEQ ID NO: 463951 - DNA, 25 bp, Rattus norvegicus
ggtaggacatgcgattcacaatgac

SEQ ID NO: 463952 - DNA, 25 bp, Rattus norvegicus
ggtaggaccctgcatcatctggagc

SEQ ID NO: 463953 - DNA, 25 bp, Rattus norvegicus
ggtaggaccctggatcatctggagc

SEQ ID NO: 463954 - DNA, 25 bp, Rattus norvegicus
ggtaggacctcacactaaatttgtt

SEQ ID NO: 463955 - DNA, 25 bp, Rattus norvegicus
ggtaggacctcagactaaatttgtt

SEQ ID NO: 463956 - DNA, 25 bp, Rattus norvegicus
ggtaggactcacatgtctcttaagt

SEQ ID NO: 463957 - DNA, 25 bp, Rattus norvegicus
ggtaggactcacttgtctcttaagt

SEQ ID NO: 463958 - DNA, 25 bp, Rattus norvegicus
ggtaggaggcccagctcagagcttt

SEQ ID NO: 463959 - DNA, 25 bp, Rattus norvegicus
ggtaggaggccctgctcagagcttt

SEQ ID NO: 463960 - DNA, 25 bp, Rattus norvegicus
ggtaggatctgtctcctatgttaat

SEQ ID NO: 463961 - DNA, 25 bp, Rattus norvegicus
ggtaggatctgtgtcctatgttaat

SEQ ID NO: 463962 - DNA, 25 bp, Rattus norvegicus
ggtaggatgaccctgtctcaagagt

SEQ ID NO: 463963 - DNA, 25 bp, Rattus norvegicus
ggtaggatgaccgtgtctcaagagt

SEQ ID NO: 463964 - DNA, 25 bp, Rattus norvegicus
ggtaggatgctcctgcagctgcaaa

SEQ ID NO: 463965 - DNA, 25 bp, Rattus norvegicus
ggtaggatgctcgtgcagctgcaaa

SEQ ID NO: 463966 - DNA, 25 bp, Rattus norvegicus
ggtaggatgttgaatggctagcatt

SEQ ID NO: 463967 - DNA, 25 bp, Rattus norvegicus
ggtaggatgttgtatggctagcatt

SEQ ID NO: 463968 - DNA, 25 bp, Rattus norvegicus
ggtaggcaatacatttctctgccaa

SEQ ID NO: 463969 - DNA, 25 bp, Rattus norvegicus
ggtaggcaatacttttctctgccaa

SEQ ID NO: 463970 - DNA, 25 bp, Rattus norvegicus
ggtaggcacctgaaatactgtagaa

SEQ ID NO: 463971 - DNA, 25 bp, Rattus norvegicus
ggtaggcacctgtaatactgtagaa

SEQ ID NO: 463972 - DNA, 25 bp, Rattus norvegicus
ggtaggcagcccaaatcccaaaggt

SEQ ID NO: 463973 - DNA, 25 bp, Rattus norvegicus
ggtaggcagccctaatcccaaaggt

SEQ ID NO: 463974 - DNA, 25 bp, Rattus norvegicus
ggtaggcagctgactcagccataaa

SEQ ID NO: 463975 - DNA, 25 bp, Rattus norvegicus
ggtaggcagctgtctcagccataaa

SEQ ID NO: 463976 - DNA, 25 bp, Rattus norvegicus
ggtaggcagtatactttgttctcat

SEQ ID NO: 463977 - DNA, 25 bp, Rattus norvegicus
ggtaggcagtattctttgttctcat

SEQ ID NO: 463978 - DNA, 25 bp, Rattus norvegicus
ggtaggcattacatgtctcttttaa

SEQ ID NO: 463979 - DNA, 25 bp, Rattus norvegicus
ggtaggcattacttgtctcttttaa

SEQ ID NO: 463980 - DNA, 25 bp, Rattus norvegicus
ggtaggccacgaagttggccgtcca

SEQ ID NO: 463981 - DNA, 25 bp, Rattus norvegicus
ggtaggccacgatgttggccgtcca

SEQ ID NO: 463982 - DNA, 25 bp, Rattus norvegicus
ggtaggcctctgaaaaatcgatcga

SEQ ID NO: 463983 - DNA, 25 bp, Rattus norvegicus
ggtaggcctctgtaaaatcgatcga

SEQ ID NO: 463984 - DNA, 25 bp, Rattus norvegicus
ggtaggcctggaaagtagcgtccca

SEQ ID NO: 463985 - DNA, 25 bp, Rattus norvegicus
ggtaggcctggatagtagcgtccca

SEQ ID NO: 463986 - DNA, 25 bp, Rattus norvegicus
ggtaggccttgcatagccagtgcaa

SEQ ID NO: 463987 - DNA, 25 bp, Rattus norvegicus
ggtaggccttgcttagccagtgcaa

SEQ ID NO: 463988 - DNA, 25 bp, Rattus norvegicus
ggtaggcgccgtaagcccagccgtt

SEQ ID NO: 463989 - DNA, 25 bp, Rattus norvegicus
ggtaggcgccgttagcccagccgtt

SEQ ID NO: 463990 - DNA, 25 bp, Rattus norvegicus
ggtaggcgggtcacagatttctcag

SEQ ID NO: 463991 - DNA, 25 bp, Rattus norvegicus
ggtaggcgggtctcagatttctcag

SEQ ID NO: 463992 - DNA, 25 bp, Rattus norvegicus
ggtaggctaagcacacggatcccag

SEQ ID NO: 463993 - DNA, 25 bp, Rattus norvegicus
ggtaggctaagctcacggatcccag

SEQ ID NO: 463994 - DNA, 25 bp, Rattus norvegicus
ggtaggcttccgactgagctaaact

SEQ ID NO: 463995 - DNA, 25 bp, Rattus norvegicus
ggtaggcttccgtctgagctaaact

SEQ ID NO: 463996 - DNA, 25 bp, Rattus norvegicus
ggtaggcttgtcctgtttttgataa

SEQ ID NO: 463997 - DNA, 25 bp, Rattus norvegicus
ggtaggcttgtcgtgtttttgataa

SEQ ID NO: 463998 - DNA, 25 bp, Rattus norvegicus
ggtagggacccaatttctagtattg

SEQ ID NO: 463999 - DNA, 25 bp, Rattus norvegicus
ggtagggacccattttctagtattg

SEQ ID NO: 464000 - DNA, 25 bp, Rattus norvegicus
ggtagggacgctatcacggctttgc

SEQ ID NO: 464001 - DNA, 25 bp, Rattus norvegicus
ggtagggacgctttcacggctttgc

SEQ ID NO: 464002 - DNA, 25 bp, Rattus norvegicus
ggtagggaggtgaccattcttcaaa

SEQ ID NO: 464003 - DNA, 25 bp, Rattus norvegicus
ggtagggaggtgtccattcttcaaa

SEQ ID NO: 464004 - DNA, 25 bp, Rattus norvegicus
ggtagggatccacgccaacacagag

SEQ ID NO: 464005 - DNA, 25 bp, Rattus norvegicus
ggtagggatccaggccaacacagag

SEQ ID NO: 464006 - DNA, 25 bp, Rattus norvegicus
ggtagggcacatactagcaggtatc

SEQ ID NO: 464007 - DNA, 25 bp, Rattus norvegicus
ggtagggcacattctagcaggtatc

SEQ ID NO: 464008 - DNA, 25 bp, Rattus norvegicus
ggtagggcactgaccattgcagaaa

SEQ ID NO: 464009 - DNA, 25 bp, Rattus norvegicus
ggtagggcactgtccattgcagaaa

SEQ ID NO: 464010 - DNA, 25 bp, Rattus norvegicus
ggtagggcagcaagactggcttttt

SEQ ID NO: 464011 - DNA, 25 bp, Rattus norvegicus
ggtagggcagcatgactggcttttt

SEQ ID NO: 464012 - DNA, 25 bp, Rattus norvegicus
ggtagggcatccagtgagtgtccct

SEQ ID NO: 464013 - DNA, 25 bp, Rattus norvegicus
ggtagggcatcctgtgagtgtccct

SEQ ID NO: 464014 - DNA, 25 bp, Rattus norvegicus
ggtagggcctgcaccaaaaaccact

SEQ ID NO: 464015 - DNA, 25 bp, Rattus norvegicus
ggtagggcctgctccaaaaaccact

SEQ ID NO: 464016 - DNA, 25 bp, Rattus norvegicus
ggtagggctgtaaaggaaatgcaaa

SEQ ID NO: 464017 - DNA, 25 bp, Rattus norvegicus
ggtagggctgtataggaaatgcaaa

SEQ ID NO: 464018 - DNA, 25 bp, Rattus norvegicus
ggtagggtagccagacagtagcata

SEQ ID NO: 464019 - DNA, 25 bp, Rattus norvegicus
ggtagggtagcctgacagtagcata

SEQ ID NO: 464020 - DNA, 25 bp, Rattus norvegicus
ggtagggtatcaatgcctcgttcaa

SEQ ID NO: 464021 - DNA, 25 bp, Rattus norvegicus
ggtagggtatcattgcctcgttcaa

SEQ ID NO: 464022 - DNA, 25 bp, Rattus norvegicus
ggtagggtattcagccccaatgttt

SEQ ID NO: 464023 - DNA, 25 bp, Rattus norvegicus
ggtagggtattctgccccaatgttt

SEQ ID NO: 464024 - DNA, 25 bp, Rattus norvegicus
ggtagggtccctcaagccaagactc

SEQ ID NO: 464025 - DNA, 25 bp, Rattus norvegicus
ggtagggtccctgaagccaagactc

SEQ ID NO: 464026 - DNA, 25 bp, Rattus norvegicus
ggtagggtctttaattgcatttgtc

SEQ ID NO: 464027 - DNA, 25 bp, Rattus norvegicus
ggtagggtcttttattgcatttgtc

SEQ ID NO: 464028 - DNA, 25 bp, Rattus norvegicus
ggtagggtgatcattctcaggacaa

SEQ ID NO: 464029 - DNA, 25 bp, Rattus norvegicus
ggtagggtgatctttctcaggacaa

SEQ ID NO: 464030 - DNA, 25 bp, Rattus norvegicus
ggtagggtgcttatcttacaggcat

SEQ ID NO: 464031 - DNA, 25 bp, Rattus norvegicus
ggtagggtgcttttcttacaggcat

SEQ ID NO: 464032 - DNA, 25 bp, Rattus norvegicus
ggtagggtttgcacttattgctgtt

SEQ ID NO: 464033 - DNA, 25 bp, Rattus norvegicus
ggtagggtttgctcttattgctgtt

SEQ ID NO: 464034 - DNA, 25 bp, Rattus norvegicus
ggtaggtaatgaagtccactcacag

SEQ ID NO: 464035 - DNA, 25 bp, Rattus norvegicus
ggtaggtaatgatgtccactcacag

SEQ ID NO: 464036 - DNA, 25 bp, Rattus norvegicus
ggtaggtattggcttctctttaatg

SEQ ID NO: 464037 - DNA, 25 bp, Rattus norvegicus
ggtaggtattgggttctctttaatg

SEQ ID NO: 464038 - DNA, 25 bp, Rattus norvegicus
ggtaggtctcatctcgcgtgccgcc

SEQ ID NO: 464039 - DNA, 25 bp, Rattus norvegicus
ggtaggtctcatgtcgcgtgccgcc

SEQ ID NO: 464040 - DNA, 25 bp, Rattus norvegicus
ggtaggtgagccacgtcttgcaaag

SEQ ID NO: 464041 - DNA, 25 bp, Rattus norvegicus
ggtaggtgagcctcgtcttgcaaag

SEQ ID NO: 464042 - DNA, 25 bp, Rattus norvegicus
ggtaggtgctgcagacacacgctct

SEQ ID NO: 464043 - DNA, 25 bp, Rattus norvegicus
ggtaggtgctgctgacacacgctct

SEQ ID NO: 464044 - DNA, 25 bp, Rattus norvegicus
ggtaggtgggctacacctcactgac

SEQ ID NO: 464045 - DNA, 25 bp, Rattus norvegicus
ggtaggtgggcttcacctcactgac

SEQ ID NO: 464046 - DNA, 25 bp, Rattus norvegicus
ggtaggttagtgattcagcctccaa

SEQ ID NO: 464047 - DNA, 25 bp, Rattus norvegicus
ggtaggttagtgtttcagcctccaa

SEQ ID NO: 464048 - DNA, 25 bp, Rattus norvegicus
ggtagtaactgtaaagtctgactca

SEQ ID NO: 464049 - DNA, 25 bp, Rattus norvegicus
ggtagtaactgttaagtctgactca

SEQ ID NO: 464050 - DNA, 25 bp, Rattus norvegicus
ggtagtacacacacggcacatagga

SEQ ID NO: 464051 - DNA, 25 bp, Rattus norvegicus
ggtagtacacactcggcacatagga

SEQ ID NO: 464052 - DNA, 25 bp, Rattus norvegicus
ggtagtacacatatttaatccagca

SEQ ID NO: 464053 - DNA, 25 bp, Rattus norvegicus
ggtagtacacatttttaatccagca

SEQ ID NO: 464054 - DNA, 25 bp, Rattus norvegicus
ggtagtacatttagcactgcccaga

SEQ ID NO: 464055 - DNA, 25 bp, Rattus norvegicus
ggtagtacattttgcactgcccaga

SEQ ID NO: 464056 - DNA, 25 bp, Rattus norvegicus
ggtagtaccaccacgcaaatctgcg

SEQ ID NO: 464057 - DNA, 25 bp, Rattus norvegicus
ggtagtaccacctcgcaaatctgcg

SEQ ID NO: 464058 - DNA, 25 bp, Rattus norvegicus
ggtagtaccattctctaaacgtgtt

SEQ ID NO: 464059 - DNA, 25 bp, Rattus norvegicus
ggtagtaccattgtctaaacgtgtt

SEQ ID NO: 464060 - DNA, 25 bp, Rattus norvegicus
ggtagtacctcgctagtacctcgag

SEQ ID NO: 464061 - DNA, 25 bp, Rattus norvegicus
ggtagtacctcggtagtacctcgag

SEQ ID NO: 464062 - DNA, 25 bp, Rattus norvegicus
ggtagtacgccgctttgatctgtgc

SEQ ID NO: 464063 - DNA, 25 bp, Rattus norvegicus
ggtagtacgccggtttgatctgtgc

SEQ ID NO: 464064 - DNA, 25 bp, Rattus norvegicus
ggtagtacgtgcagttggttccatt

SEQ ID NO: 464065 - DNA, 25 bp, Rattus norvegicus
ggtagtacgtgctgttggttccatt

SEQ ID NO: 464066 - DNA, 25 bp, Rattus norvegicus
ggtagtactgagcagaccttgtttc

SEQ ID NO: 464067 - DNA, 25 bp, Rattus norvegicus
ggtagtactgaggagaccttgtttc

SEQ ID NO: 464068 - DNA, 25 bp, Rattus norvegicus
ggtagtactggtagagctcggcctc

SEQ ID NO: 464069 - DNA, 25 bp, Rattus norvegicus
ggtagtactggttgagctcggcctc

SEQ ID NO: 464070 - DNA, 25 bp, Rattus norvegicus
ggtagtacttgtcattttcacataa

SEQ ID NO: 464071 - DNA, 25 bp, Rattus norvegicus
ggtagtacttgtgattttcacataa

SEQ ID NO: 464072 - DNA, 25 bp, Rattus norvegicus
ggtagtaggctgagtttcctgccac

SEQ ID NO: 464073 - DNA, 25 bp, Rattus norvegicus
ggtagtaggctgtgtttcctgccac

SEQ ID NO: 464074 - DNA, 25 bp, Rattus norvegicus
ggtagtatacacatttagccctagc

SEQ ID NO: 464075 - DNA, 25 bp, Rattus norvegicus
ggtagtatacacttttagccctagc

SEQ ID NO: 464076 - DNA, 25 bp, Rattus norvegicus
ggtagtatatacctgcaatcccaac

SEQ ID NO: 464077 - DNA, 25 bp, Rattus norvegicus
ggtagtatatacgtgcaatcccaac

SEQ ID NO: 464078 - DNA, 25 bp, Rattus norvegicus
ggtagtatatgccattaaccccaat

SEQ ID NO: 464079 - DNA, 25 bp, Rattus norvegicus
ggtagtatatgcgattaaccccaat

SEQ ID NO: 464080 - DNA, 25 bp, Rattus norvegicus
ggtagtatcactccgctatcttaga

SEQ ID NO: 464081 - DNA, 25 bp, Rattus norvegicus
ggtagtatcactgcgctatcttaga

SEQ ID NO: 464082 - DNA, 25 bp, Rattus norvegicus
ggtagtcaaccccaactacttgctt

SEQ ID NO: 464083 - DNA, 25 bp, Rattus norvegicus
ggtagtcaacccgaactacttgctt

SEQ ID NO: 464084 - DNA, 25 bp, Rattus norvegicus
ggtagtcacatgaccggcaggaccg

SEQ ID NO: 464085 - DNA, 25 bp, Rattus norvegicus
ggtagtcacatgtccggcaggaccg

SEQ ID NO: 464086 - DNA, 25 bp, Rattus norvegicus
ggtagtcaccagcaacaggaagttt

SEQ ID NO: 464087 - DNA, 25 bp, Rattus norvegicus
ggtagtcaccaggaacaggaagttt

SEQ ID NO: 464088 - DNA, 25 bp, Rattus norvegicus
ggtagtcaggaacaggcttcctctc

SEQ ID NO: 464089 - DNA, 25 bp, Rattus norvegicus
ggtagtcaggaagaggcttcctctc

SEQ ID NO: 464090 - DNA, 25 bp, Rattus norvegicus
ggtagtcaggttatcatgagcatca

SEQ ID NO: 464091 - DNA, 25 bp, Rattus norvegicus
ggtagtcaggttttcatgagcatca

SEQ ID NO: 464092 - DNA, 25 bp, Rattus norvegicus
ggtagtcatttgatatggccgtttt

SEQ ID NO: 464093 - DNA, 25 bp, Rattus norvegicus
ggtagtcatttgttatggccgtttt

SEQ ID NO: 464094 - DNA, 25 bp, Rattus norvegicus
ggtagtccctcaactggcaaagaaa

SEQ ID NO: 464095 - DNA, 25 bp, Rattus norvegicus
ggtagtccctcatctggcaaagaaa

SEQ ID NO: 464096 - DNA, 25 bp, Rattus norvegicus
ggtagtcctaacagtttgatcacaa

SEQ ID NO: 464097 - DNA, 25 bp, Rattus norvegicus
ggtagtcctaactgtttgatcacaa

SEQ ID NO: 464098 - DNA, 25 bp, Rattus norvegicus
ggtagtctacagcataccatctgca

SEQ ID NO: 464099 - DNA, 25 bp, Rattus norvegicus
ggtagtctacaggataccatctgca

SEQ ID NO: 464100 - DNA, 25 bp, Rattus norvegicus
ggtagtctatgccaacttcaggtag

SEQ ID NO: 464101 - DNA, 25 bp, Rattus norvegicus
ggtagtctatgcgaacttcaggtag

SEQ ID NO: 464102 - DNA, 25 bp, Rattus norvegicus
ggtagtctcaggcagctccggaaat

SEQ ID NO: 464103 - DNA, 25 bp, Rattus norvegicus
ggtagtctcagggagctccggaaat

SEQ ID NO: 464104 - DNA, 25 bp, Rattus norvegicus
ggtagtctgattctgcatcaaccta

SEQ ID NO: 464105 - DNA, 25 bp, Rattus norvegicus
ggtagtctgattgtgcatcaaccta

SEQ ID NO: 464106 - DNA, 25 bp, Rattus norvegicus
ggtagtctgcccagggatatacaag

SEQ ID NO: 464107 - DNA, 25 bp, Rattus norvegicus
ggtagtctgccctgggatatacaag

SEQ ID NO: 464108 - DNA, 25 bp, Rattus norvegicus
ggtagtctgtgcaacaccagatgtt

SEQ ID NO: 464109 - DNA, 25 bp, Rattus norvegicus
ggtagtctgtgctacaccagatgtt

SEQ ID NO: 464110 - DNA, 25 bp, Rattus norvegicus
ggtagtgaaagacatgtttccagta

SEQ ID NO: 464111 - DNA, 25 bp, Rattus norvegicus
ggtagtgaaagagatgtttccagta

SEQ ID NO: 464112 - DNA, 25 bp, Rattus norvegicus
ggtagtgaacctcacttttcacatt

SEQ ID NO: 464113 - DNA, 25 bp, Rattus norvegicus
ggtagtgaacctgacttttcacatt

SEQ ID NO: 464114 - DNA, 25 bp, Rattus norvegicus
ggtagtgacaggacgagctctagtt

SEQ ID NO: 464115 - DNA, 25 bp, Rattus norvegicus
ggtagtgacaggtcgagctctagtt

SEQ ID NO: 464116 - DNA, 25 bp, Rattus norvegicus
ggtagtgaccacaagagctccagcc

SEQ ID NO: 464117 - DNA, 25 bp, Rattus norvegicus
ggtagtgaccactagagctccagcc

SEQ ID NO: 464118 - DNA, 25 bp, Rattus norvegicus
ggtagtgagcacagaaactccccgt

SEQ ID NO: 464119 - DNA, 25 bp, Rattus norvegicus
ggtagtgagcactgaaactccccgt

SEQ ID NO: 464120 - DNA, 25 bp, Rattus norvegicus
ggtagtgagctgaagcttcaagctt

SEQ ID NO: 464121 - DNA, 25 bp, Rattus norvegicus
ggtagtgagctgtagcttcaagctt

SEQ ID NO: 464122 - DNA, 25 bp, Rattus norvegicus
ggtagtgagtaccttcaagagaagc

SEQ ID NO: 464123 - DNA, 25 bp, Rattus norvegicus
ggtagtgagtacgttcaagagaagc

SEQ ID NO: 464124 - DNA, 25 bp, Rattus norvegicus
ggtagtgatgcaccgtactgagccc

SEQ ID NO: 464125 - DNA, 25 bp, Rattus norvegicus
ggtagtgatgcagcgtactgagccc

SEQ ID NO: 464126 - DNA, 25 bp, Rattus norvegicus
ggtagtgcacatcctggagccagat

SEQ ID NO: 464127 - DNA, 25 bp, Rattus norvegicus
ggtagtgcacatgctggagccagat

SEQ ID NO: 464128 - DNA, 25 bp, Rattus norvegicus
ggtagtgcatagctatgtcgtacgt

SEQ ID NO: 464129 - DNA, 25 bp, Rattus norvegicus
ggtagtgcataggtatgtcgtacgt

SEQ ID NO: 464130 - DNA, 25 bp, Rattus norvegicus
ggtagtgccactctgacaaagccct

SEQ ID NO: 464131 - DNA, 25 bp, Rattus norvegicus
ggtagtgccactgtgacaaagccct

SEQ ID NO: 464132 - DNA, 25 bp, Rattus norvegicus
ggtagtgccttgaagactctgagag

SEQ ID NO: 464133 - DNA, 25 bp, Rattus norvegicus
ggtagtgccttgtagactctgagag

SEQ ID NO: 464134 - DNA, 25 bp, Rattus norvegicus
ggtagtggaaatactatgccttgga

SEQ ID NO: 464135 - DNA, 25 bp, Rattus norvegicus
ggtagtggaaattctatgccttgga

SEQ ID NO: 464136 - DNA, 25 bp, Rattus norvegicus
ggtagtggcccacggtaacactcac

SEQ ID NO: 464137 - DNA, 25 bp, Rattus norvegicus
ggtagtggcccagggtaacactcac

SEQ ID NO: 464138 - DNA, 25 bp, Rattus norvegicus
ggtagtggcggacgcagtcccggca

SEQ ID NO: 464139 - DNA, 25 bp, Rattus norvegicus
ggtagtggcggaggcagtcccggca

SEQ ID NO: 464140 - DNA, 25 bp, Rattus norvegicus
ggtagtgggactcttgagctttctt

SEQ ID NO: 464141 - DNA, 25 bp, Rattus norvegicus
ggtagtgggactgttgagctttctt

SEQ ID NO: 464142 - DNA, 25 bp, Rattus norvegicus
ggtagtggttgcagtcttcatcatc

SEQ ID NO: 464143 - DNA, 25 bp, Rattus norvegicus
ggtagtggttgctgtcttcatcatc

SEQ ID NO: 464144 - DNA, 25 bp, Rattus norvegicus
ggtagtgtaaacagtggccctccgg

SEQ ID NO: 464145 - DNA, 25 bp, Rattus norvegicus
ggtagtgtaaactgtggccctccgg

SEQ ID NO: 464146 - DNA, 25 bp, Rattus norvegicus
ggtagtgtacgtcctacagactgtc

SEQ ID NO: 464147 - DNA, 25 bp, Rattus norvegicus
ggtagtgtacgtgctacagactgtc

SEQ ID NO: 464148 - DNA, 25 bp, Rattus norvegicus
ggtagtgtcgggacagtcatccatc

SEQ ID NO: 464149 - DNA, 25 bp, Rattus norvegicus
ggtagtgtcgggtcagtcatccatc

SEQ ID NO: 464150 - DNA, 25 bp, Rattus norvegicus
ggtagtgtctgaagtcttaaccatc

SEQ ID NO: 464151 - DNA, 25 bp, Rattus norvegicus
ggtagtgtctgatgtcttaaccatc

SEQ ID NO: 464152 - DNA, 25 bp, Rattus norvegicus
ggtagtgttactatcctggaactct

SEQ ID NO: 464153 - DNA, 25 bp, Rattus norvegicus
ggtagtgttactttcctggaactct

SEQ ID NO: 464154 - DNA, 25 bp, Rattus norvegicus
ggtagtgttatgattgcaccgtcaa

SEQ ID NO: 464155 - DNA, 25 bp, Rattus norvegicus
ggtagtgttatgtttgcaccgtcaa

SEQ ID NO: 464156 - DNA, 25 bp, Rattus norvegicus
ggtagttatcagaatccccaaggct

SEQ ID NO: 464157 - DNA, 25 bp, Rattus norvegicus
ggtagttatcagtatccccaaggct

SEQ ID NO: 464158 - DNA, 25 bp, Rattus norvegicus
ggtagttattttaccatcatcacga

SEQ ID NO: 464159 - DNA, 25 bp, Rattus norvegicus
ggtagttatttttccatcatcacga

SEQ ID NO: 464160 - DNA, 25 bp, Rattus norvegicus
ggtagttcacaaagatctccagctt

SEQ ID NO: 464161 - DNA, 25 bp, Rattus norvegicus
ggtagttcacaatgatctccagctt

SEQ ID NO: 464162 - DNA, 25 bp, Rattus norvegicus
ggtagttcagaaccatctctcaact

SEQ ID NO: 464163 - DNA, 25 bp, Rattus norvegicus
ggtagttcagaagcatctctcaact

SEQ ID NO: 464164 - DNA, 25 bp, Rattus norvegicus
ggtagttctcccatctatcatgaag

SEQ ID NO: 464165 - DNA, 25 bp, Rattus norvegicus
ggtagttctcccttctatcatgaag

SEQ ID NO: 464166 - DNA, 25 bp, Rattus norvegicus
ggtagttctgatatttactctgtga

SEQ ID NO: 464167 - DNA, 25 bp, Rattus norvegicus
ggtagttctgatttttactctgtga

SEQ ID NO: 464168 - DNA, 25 bp, Rattus norvegicus
ggtagttgatctctagccagccgcc

SEQ ID NO: 464169 - DNA, 25 bp, Rattus norvegicus
ggtagttgatctgtagccagccgcc

SEQ ID NO: 464170 - DNA, 25 bp, Rattus norvegicus
ggtagttgctatactgttctttaaa

SEQ ID NO: 464171 - DNA, 25 bp, Rattus norvegicus
ggtagttgctattctgttctttaaa

SEQ ID NO: 464172 - DNA, 25 bp, Rattus norvegicus
ggtagttgctgcagattccagttct

SEQ ID NO: 464173 - DNA, 25 bp, Rattus norvegicus
ggtagttgctgctgattccagttct

SEQ ID NO: 464174 - DNA, 25 bp, Rattus norvegicus
ggtagtttaaacactgtgcaattaa

SEQ ID NO: 464175 - DNA, 25 bp, Rattus norvegicus
ggtagtttaaactctgtgcaattaa

SEQ ID NO: 464176 - DNA, 25 bp, Rattus norvegicus
ggtagtttccctaatagatcagtga

SEQ ID NO: 464177 - DNA, 25 bp, Rattus norvegicus
ggtagtttcccttatagatcagtga

SEQ ID NO: 464178 - DNA, 25 bp, Rattus norvegicus
ggtagtttctacactgcatcaacac

SEQ ID NO: 464179 - DNA, 25 bp, Rattus norvegicus
ggtagtttctactctgcatcaacac

SEQ ID NO: 464180 - DNA, 25 bp, Rattus norvegicus
ggtagtttctctacacagtatcatt

SEQ ID NO: 464181 - DNA, 25 bp, Rattus norvegicus
ggtagtttctcttcacagtatcatt

SEQ ID NO: 464182 - DNA, 25 bp, Rattus norvegicus
ggtagtttgaatagtatcacttcta

SEQ ID NO: 464183 - DNA, 25 bp, Rattus norvegicus
ggtagtttgaattgtatcacttcta

SEQ ID NO: 464184 - DNA, 25 bp, Rattus norvegicus
ggtagttttacacttctgaacatat

SEQ ID NO: 464185 - DNA, 25 bp, Rattus norvegicus
ggtagttttacagttctgaacatat

SEQ ID NO: 464186 - DNA, 25 bp, Rattus norvegicus
ggtagttttcatcggatccttccat

SEQ ID NO: 464187 - DNA, 25 bp, Rattus norvegicus
ggtagttttcatgggatccttccat

SEQ ID NO: 464188 - DNA, 25 bp, Rattus norvegicus
ggtataaaatgcagcagacctgtgc

SEQ ID NO: 464189 - DNA, 25 bp, Rattus norvegicus
ggtataaaatgctgcagacctgtgc

SEQ ID NO: 464190 - DNA, 25 bp, Rattus norvegicus
ggtataaaccacagtaatgtctgca

SEQ ID NO: 464191 - DNA, 25 bp, Rattus norvegicus
ggtataaaccactgtaatgtctgca

SEQ ID NO: 464192 - DNA, 25 bp, Rattus norvegicus
ggtataaaccctctgtgctgttgtt

SEQ ID NO: 464193 - DNA, 25 bp, Rattus norvegicus
ggtataaaccctgtgtgctgttgtt

SEQ ID NO: 464194 - DNA, 25 bp, Rattus norvegicus
ggtataaacctactaaatgtctcac

SEQ ID NO: 464195 - DNA, 25 bp, Rattus norvegicus
ggtataaacctagtaaatgtctcac

SEQ ID NO: 464196 - DNA, 25 bp, Rattus norvegicus
ggtataaaccttagatcctaattct

SEQ ID NO: 464197 - DNA, 25 bp, Rattus norvegicus
ggtataaacctttgatcctaattct

SEQ ID NO: 464198 - DNA, 25 bp, Rattus norvegicus
ggtataaactgacgcccacgggagc

SEQ ID NO: 464199 - DNA, 25 bp, Rattus norvegicus
ggtataaactgaggcccacgggagc

SEQ ID NO: 464200 - DNA, 25 bp, Rattus norvegicus
ggtataaatattcagccgtgacatt

SEQ ID NO: 464201 - DNA, 25 bp, Rattus norvegicus
ggtataaatattgagccgtgacatt

SEQ ID NO: 464202 - DNA, 25 bp, Rattus norvegicus
ggtataacgtttcggctggactctt

SEQ ID NO: 464203 - DNA, 25 bp, Rattus norvegicus
ggtataacgtttgggctggactctt

SEQ ID NO: 464204 - DNA, 25 bp, Rattus norvegicus
ggtataactttgcttcactgccatt

SEQ ID NO: 464205 - DNA, 25 bp, Rattus norvegicus
ggtataactttggttcactgccatt

SEQ ID NO: 464206 - DNA, 25 bp, Rattus norvegicus
ggtatacagagaacccctatttcaa

SEQ ID NO: 464207 - DNA, 25 bp, Rattus norvegicus
ggtatacagagatcccctatttcaa

SEQ ID NO: 464208 - DNA, 25 bp, Rattus norvegicus
ggtataccacaaaatcactctagaa

SEQ ID NO: 464209 - DNA, 25 bp, Rattus norvegicus
ggtataccacaaactcaggagaaca

SEQ ID NO: 464210 - DNA, 25 bp, Rattus norvegicus
ggtataccacaaatgtattcctcat

SEQ ID NO: 464211 - DNA, 25 bp, Rattus norvegicus
ggtataccacaatatcactctagaa

SEQ ID NO: 464212 - DNA, 25 bp, Rattus norvegicus
ggtataccacaatctcaggagaaca

SEQ ID NO: 464213 - DNA, 25 bp, Rattus norvegicus
ggtataccacaattgtattcctcat

SEQ ID NO: 464214 - DNA, 25 bp, Rattus norvegicus
ggtataccattccagctagtcatca

SEQ ID NO: 464215 - DNA, 25 bp, Rattus norvegicus
ggtataccattcgagctagtcatca

SEQ ID NO: 464216 - DNA, 25 bp, Rattus norvegicus
ggtatacccagacccaagactttgc

SEQ ID NO: 464217 - DNA, 25 bp, Rattus norvegicus
ggtatacccagagccaagactttgc

SEQ ID NO: 464218 - DNA, 25 bp, Rattus norvegicus
ggtatacccagtctgaaccctgtgt

SEQ ID NO: 464219 - DNA, 25 bp, Rattus norvegicus
ggtatacccagtgtgaaccctgtgt

SEQ ID NO: 464220 - DNA, 25 bp, Rattus norvegicus
ggtatacgctaaacccctcaagagg

SEQ ID NO: 464221 - DNA, 25 bp, Rattus norvegicus
ggtatacgctaatcccctcaagagg

SEQ ID NO: 464222 - DNA, 25 bp, Rattus norvegicus
ggtatacgctgtagaggctggttat

SEQ ID NO: 464223 - DNA, 25 bp, Rattus norvegicus
ggtatacgctgttgaggctggttat

SEQ ID NO: 464224 - DNA, 25 bp, Rattus norvegicus
ggtatactatatatacttctccata

SEQ ID NO: 464225 - DNA, 25 bp, Rattus norvegicus
ggtatactatatttacttctccata

SEQ ID NO: 464226 - DNA, 25 bp, Rattus norvegicus
ggtatactccttcttcggtagttca

SEQ ID NO: 464227 - DNA, 25 bp, Rattus norvegicus
ggtatactccttgttcggtagttca

SEQ ID NO: 464228 - DNA, 25 bp, Rattus norvegicus
ggtatactggctctctccctcagtg

SEQ ID NO: 464229 - DNA, 25 bp, Rattus norvegicus
ggtatactggctgtctccctcagtg

SEQ ID NO: 464230 - DNA, 25 bp, Rattus norvegicus
ggtatactttatagagggatcgaga

SEQ ID NO: 464231 - DNA, 25 bp, Rattus norvegicus
ggtatactttattgagggatcgaga

SEQ ID NO: 464232 - DNA, 25 bp, Rattus norvegicus
ggtatagagggactatctcctccct

SEQ ID NO: 464233 - DNA, 25 bp, Rattus norvegicus
ggtatagagggagtatctcctccct

SEQ ID NO: 464234 - DNA, 25 bp, Rattus norvegicus
ggtatagattatacttcccattctt

SEQ ID NO: 464235 - DNA, 25 bp, Rattus norvegicus
ggtatagattattcttcccattctt

SEQ ID NO: 464236 - DNA, 25 bp, Rattus norvegicus
ggtatagccatcagatgtgcgctac

SEQ ID NO: 464237 - DNA, 25 bp, Rattus norvegicus
ggtatagccatctgatgtgcgctac

SEQ ID NO: 464238 - DNA, 25 bp, Rattus norvegicus
ggtatagccttcaccactagtgctt

SEQ ID NO: 464239 - DNA, 25 bp, Rattus norvegicus
ggtatagccttctccactagtgctt

SEQ ID NO: 464240 - DNA, 25 bp, Rattus norvegicus
ggtatagcttaactgacatcctcca

SEQ ID NO: 464241 - DNA, 25 bp, Rattus norvegicus
ggtatagcttaagtgacatcctcca

SEQ ID NO: 464242 - DNA, 25 bp, Rattus norvegicus
ggtataggttctagctgatgggcca

SEQ ID NO: 464243 - DNA, 25 bp, Rattus norvegicus
ggtataggttcttgctgatgggcca

SEQ ID NO: 464244 - DNA, 25 bp, Rattus norvegicus
ggtatagtacccagttctgacacca

SEQ ID NO: 464245 - DNA, 25 bp, Rattus norvegicus
ggtatagtaccctgttctgacacca

SEQ ID NO: 464246 - DNA, 25 bp, Rattus norvegicus
ggtatagtcctgaaagtactcacaa

SEQ ID NO: 464247 - DNA, 25 bp, Rattus norvegicus
ggtatagtcctgtaagtactcacaa

SEQ ID NO: 464248 - DNA, 25 bp, Rattus norvegicus
ggtatagttcctcctttgcaatctt

SEQ ID NO: 464249 - DNA, 25 bp, Rattus norvegicus
ggtatagttcctgctttgcaatctt

SEQ ID NO: 464250 - DNA, 25 bp, Rattus norvegicus
ggtatatacataccattccattttt

SEQ ID NO: 464251 - DNA, 25 bp, Rattus norvegicus
ggtatatacatagcattccattttt

SEQ ID NO: 464252 - DNA, 25 bp, Rattus norvegicus
ggtatatacgtaacctctgtgagtg

SEQ ID NO: 464253 - DNA, 25 bp, Rattus norvegicus
ggtatatacgtatcctctgtgagtg

SEQ ID NO: 464254 - DNA, 25 bp, Rattus norvegicus
ggtatatatttcagtgtctggtgat

SEQ ID NO: 464255 - DNA, 25 bp, Rattus norvegicus
ggtatatatttctgtgtctggtgat

SEQ ID NO: 464256 - DNA, 25 bp, Rattus norvegicus
ggtatatctcagctcctttttcaac

SEQ ID NO: 464257 - DNA, 25 bp, Rattus norvegicus
ggtatatctcaggtcctttttcaac

SEQ ID NO: 464258 - DNA, 25 bp, Rattus norvegicus
ggtatatctcctagccagaaatcac

SEQ ID NO: 464259 - DNA, 25 bp, Rattus norvegicus
ggtatatctccttgccagaaatcac

SEQ ID NO: 464260 - DNA, 25 bp, Rattus norvegicus
ggtatatctctccttggcttttcga

SEQ ID NO: 464261 - DNA, 25 bp, Rattus norvegicus
ggtatatctctcgttggcttttcga

SEQ ID NO: 464262 - DNA, 25 bp, Rattus norvegicus
ggtatatctgttaagtctcgctaag

SEQ ID NO: 464263 - DNA, 25 bp, Rattus norvegicus
ggtatatctgtttagtctcgctaag

SEQ ID NO: 464264 - DNA, 25 bp, Rattus norvegicus
ggtatatgatacacagccttgcact

SEQ ID NO: 464265 - DNA, 25 bp, Rattus norvegicus
ggtatatgatactcagccttgcact

SEQ ID NO: 464266 - DNA, 25 bp, Rattus norvegicus
ggtatatgccatatcttctattaca

SEQ ID NO: 464267 - DNA, 25 bp, Rattus norvegicus
ggtatatgccatttcttctattaca

SEQ ID NO: 464268 - DNA, 25 bp, Rattus norvegicus
ggtatatgctatacacggcctcggt

SEQ ID NO: 464269 - DNA, 25 bp, Rattus norvegicus
ggtatatgctattcacggcctcggt

SEQ ID NO: 464270 - DNA, 25 bp, Rattus norvegicus
ggtatatgctgtagactggagtcca

SEQ ID NO: 464271 - DNA, 25 bp, Rattus norvegicus
ggtatatgctgtcctttatcaagga

SEQ ID NO: 464272 - DNA, 25 bp, Rattus norvegicus
ggtatatgctgtgctttatcaagga

SEQ ID NO: 464273 - DNA, 25 bp, Rattus norvegicus
ggtatatgctgttgactggagtcca

SEQ ID NO: 464274 - DNA, 25 bp, Rattus norvegicus
ggtatatgcttaaaatggtggcaat

SEQ ID NO: 464275 - DNA, 25 bp, Rattus norvegicus
ggtatatgcttataatggtggcaat

SEQ ID NO: 464276 - DNA, 25 bp, Rattus norvegicus
ggtatatggtatactgcctgccaca

SEQ ID NO: 464277 - DNA, 25 bp, Rattus norvegicus
ggtatatggtattctgcctgccaca

SEQ ID NO: 464278 - DNA, 25 bp, Rattus norvegicus
ggtatatgttgaccctgcacactgg

SEQ ID NO: 464279 - DNA, 25 bp, Rattus norvegicus
ggtatatgttgagcctgcacactgg

SEQ ID NO: 464280 - DNA, 25 bp, Rattus norvegicus
ggtatattcaagaccccagcactag

SEQ ID NO: 464281 - DNA, 25 bp, Rattus norvegicus
ggtatattcaagtccccagcactag

SEQ ID NO: 464282 - DNA, 25 bp, Rattus norvegicus
ggtatattcacaatgtagaacagca

SEQ ID NO: 464283 - DNA, 25 bp, Rattus norvegicus
ggtatattcacattgtagaacagca

SEQ ID NO: 464284 - DNA, 25 bp, Rattus norvegicus
ggtatattcagaagctttaaggtct

SEQ ID NO: 464285 - DNA, 25 bp, Rattus norvegicus
ggtatattcagatgctttaaggtct

SEQ ID NO: 464286 - DNA, 25 bp, Rattus norvegicus
ggtatattccagacccaacaggcaa

SEQ ID NO: 464287 - DNA, 25 bp, Rattus norvegicus
ggtatattccagtcccaacaggcaa

SEQ ID NO: 464288 - DNA, 25 bp, Rattus norvegicus
ggtatattcttgatcctgcccgaga

SEQ ID NO: 464289 - DNA, 25 bp, Rattus norvegicus
ggtatattcttgttcctgcccgaga

SEQ ID NO: 464290 - DNA, 25 bp, Rattus norvegicus
ggtatattgaaaacgttgaagcgag

SEQ ID NO: 464291 - DNA, 25 bp, Rattus norvegicus
ggtatattgaaatcgttgaagcgag

SEQ ID NO: 464292 - DNA, 25 bp, Rattus norvegicus
ggtatattgcccagtaaattgtggt

SEQ ID NO: 464293 - DNA, 25 bp, Rattus norvegicus
ggtatattgccctgtaaattgtggt

SEQ ID NO: 464294 - DNA, 25 bp, Rattus norvegicus
ggtatatttcagcactgggaccctt

SEQ ID NO: 464295 - DNA, 25 bp, Rattus norvegicus
ggtatatttcaggactgggaccctt

SEQ ID NO: 464296 - DNA, 25 bp, Rattus norvegicus
ggtatatttcatccacctcattatt

SEQ ID NO: 464297 - DNA, 25 bp, Rattus norvegicus
ggtatatttcatgcacctcattatt

SEQ ID NO: 464298 - DNA, 25 bp, Rattus norvegicus
ggtatatttttgacgcaggctagat

SEQ ID NO: 464299 - DNA, 25 bp, Rattus norvegicus
ggtatatttttgtcgcaggctagat

SEQ ID NO: 464300 - DNA, 25 bp, Rattus norvegicus
ggtatcaaagtgatacctccccttg

SEQ ID NO: 464301 - DNA, 25 bp, Rattus norvegicus
ggtatcaaagtgttacctccccttg

SEQ ID NO: 464302 - DNA, 25 bp, Rattus norvegicus
ggtatcaaatacaactgccgtgttt

SEQ ID NO: 464303 - DNA, 25 bp, Rattus norvegicus
ggtatcaaatactactgccgtgttt

SEQ ID NO: 464304 - DNA, 25 bp, Rattus norvegicus
ggtatcaacacccttccgaagaaga

SEQ ID NO: 464305 - DNA, 25 bp, Rattus norvegicus
ggtatcaacaccgttccgaagaaga

SEQ ID NO: 464306 - DNA, 25 bp, Rattus norvegicus
ggtatcaagaccaagtcagccaata

SEQ ID NO: 464307 - DNA, 25 bp, Rattus norvegicus
ggtatcaagacctagtcagccaata

SEQ ID NO: 464308 - DNA, 25 bp, Rattus norvegicus
ggtatcaatatccaacccctgaaaa

SEQ ID NO: 464309 - DNA, 25 bp, Rattus norvegicus
ggtatcaatatcgaacccctgaaaa

SEQ ID NO: 464310 - DNA, 25 bp, Rattus norvegicus
ggtatcaatttgatcctgggtggtc

SEQ ID NO: 464311 - DNA, 25 bp, Rattus norvegicus
ggtatcaatttgttcctgggtggtc

SEQ ID NO: 464312 - DNA, 25 bp, Rattus norvegicus
ggtatcacaataaaatccttccatt

SEQ ID NO: 464313 - DNA, 25 bp, Rattus norvegicus
ggtatcacaatataatccttccatt

SEQ ID NO: 464314 - DNA, 25 bp, Rattus norvegicus
ggtatcacacttcattctaggcaat

SEQ ID NO: 464315 - DNA, 25 bp, Rattus norvegicus
ggtatcacacttgattctaggcaat

SEQ ID NO: 464316 - DNA, 25 bp, Rattus norvegicus
ggtatcacagtgaattcaacatttt

SEQ ID NO: 464317 - DNA, 25 bp, Rattus norvegicus
ggtatcacagtgtattcaacatttt

SEQ ID NO: 464318 - DNA, 25 bp, Rattus norvegicus
ggtatcacgtaaatctccttttcct

SEQ ID NO: 464319 - DNA, 25 bp, Rattus norvegicus
ggtatcacgtaattctccttttcct

SEQ ID NO: 464320 - DNA, 25 bp, Rattus norvegicus
ggtatcactcaaaatgtctcctttt

SEQ ID NO: 464321 - DNA, 25 bp, Rattus norvegicus
ggtatcactcaatatgtctcctttt

SEQ ID NO: 464322 - DNA, 25 bp, Rattus norvegicus
ggtatcactgatctttttgacccac

SEQ ID NO: 464323 - DNA, 25 bp, Rattus norvegicus
ggtatcactgatgtttttgacccac

SEQ ID NO: 464324 - DNA, 25 bp, Rattus norvegicus
ggtatcacttgaaaacttgtccctg

SEQ ID NO: 464325 - DNA, 25 bp, Rattus norvegicus
ggtatcacttgataacttgtccctg

SEQ ID NO: 464326 - DNA, 25 bp, Rattus norvegicus
ggtatcagacgtctagtgtattgct

SEQ ID NO: 464327 - DNA, 25 bp, Rattus norvegicus
ggtatcagacgtgtagtgtattgct

SEQ ID NO: 464328 - DNA, 25 bp, Rattus norvegicus
ggtatcagtgcaactgggttttcaa

SEQ ID NO: 464329 - DNA, 25 bp, Rattus norvegicus
ggtatcagtgcatctgggttttcaa

SEQ ID NO: 464330 - DNA, 25 bp, Rattus norvegicus
ggtatcagttctactgtcatttgac

SEQ ID NO: 464331 - DNA, 25 bp, Rattus norvegicus
ggtatcagttcttctgtcatttgac

SEQ ID NO: 464332 - DNA, 25 bp, Rattus norvegicus
ggtatcatacaaatctctctactat

SEQ ID NO: 464333 - DNA, 25 bp, Rattus norvegicus
ggtatcatacaattctctctactat

SEQ ID NO: 464334 - DNA, 25 bp, Rattus norvegicus
ggtatcataccacgaatccagcctt

SEQ ID NO: 464335 - DNA, 25 bp, Rattus norvegicus
ggtatcataccaggaatccagcctt

SEQ ID NO: 464336 - DNA, 25 bp, Rattus norvegicus
ggtatcatagacatcctgttgtggg

SEQ ID NO: 464337 - DNA, 25 bp, Rattus norvegicus
ggtatcatagacttcctgttgtggg

SEQ ID NO: 464338 - DNA, 25 bp, Rattus norvegicus
ggtatcatctagcatctgtcattta

SEQ ID NO: 464339 - DNA, 25 bp, Rattus norvegicus
ggtatcatctaggatctgtcattta

SEQ ID NO: 464340 - DNA, 25 bp, Rattus norvegicus
ggtatccaaaatcacactgttctcc

SEQ ID NO: 464341 - DNA, 25 bp, Rattus norvegicus
ggtatccaaaatgacactgttctcc

SEQ ID NO: 464342 - DNA, 25 bp, Rattus norvegicus
ggtatccaaggacacagttcaacta

SEQ ID NO: 464343 - DNA, 25 bp, Rattus norvegicus
ggtatccaaggagacagttcaacta

SEQ ID NO: 464344 - DNA, 25 bp, Rattus norvegicus
ggtatccactgaacaatgtttgcta

SEQ ID NO: 464345 - DNA, 25 bp, Rattus norvegicus
ggtatccactgatcaatgtttgcta

SEQ ID NO: 464346 - DNA, 25 bp, Rattus norvegicus
ggtatccagaataatgtctgcatag

SEQ ID NO: 464347 - DNA, 25 bp, Rattus norvegicus
ggtatccagaatagtattcccgttt

SEQ ID NO: 464348 - DNA, 25 bp, Rattus norvegicus
ggtatccagaattatgtctgcatag

SEQ ID NO: 464349 - DNA, 25 bp, Rattus norvegicus
ggtatccagaattgtattcccgttt

SEQ ID NO: 464350 - DNA, 25 bp, Rattus norvegicus
ggtatccatcacagctacagaacag

SEQ ID NO: 464351 - DNA, 25 bp, Rattus norvegicus
ggtatccatcactgctacagaacag

SEQ ID NO: 464352 - DNA, 25 bp, Rattus norvegicus
ggtatcccaaacactccaagaacaa

SEQ ID NO: 464353 - DNA, 25 bp, Rattus norvegicus
ggtatcccaaactctccaagaacaa

SEQ ID NO: 464354 - DNA, 25 bp, Rattus norvegicus
ggtatcccaggacaatgtttctcac

SEQ ID NO: 464355 - DNA, 25 bp, Rattus norvegicus
ggtatcccaggagaatgtttctcac

SEQ ID NO: 464356 - DNA, 25 bp, Rattus norvegicus
ggtatcccatttcttggagggcaca

SEQ ID NO: 464357 - DNA, 25 bp, Rattus norvegicus
ggtatcccatttgttggagggcaca

SEQ ID NO: 464358 - DNA, 25 bp, Rattus norvegicus
ggtatcccgtgccatgtgatgagta

SEQ ID NO: 464359 - DNA, 25 bp, Rattus norvegicus
ggtatcccgtgcgatgtgatgagta

SEQ ID NO: 464360 - DNA, 25 bp, Rattus norvegicus
ggtatccgacataccccagagggtg

SEQ ID NO: 464361 - DNA, 25 bp, Rattus norvegicus
ggtatccgacattccccagagggtg

SEQ ID NO: 464362 - DNA, 25 bp, Rattus norvegicus
ggtatccgatagacctgtagaattt

SEQ ID NO: 464363 - DNA, 25 bp, Rattus norvegicus
ggtatccgatagtcctgtagaattt

SEQ ID NO: 464364 - DNA, 25 bp, Rattus norvegicus
ggtatcctaaagcagtatctcaaga

SEQ ID NO: 464365 - DNA, 25 bp, Rattus norvegicus
ggtatcctaaaggagtatctcaaga

SEQ ID NO: 464366 - DNA, 25 bp, Rattus norvegicus
ggtatcctaccaccacaatgaggct

SEQ ID NO: 464367 - DNA, 25 bp, Rattus norvegicus
ggtatcctaccagcacaatgaggct

SEQ ID NO: 464368 - DNA, 25 bp, Rattus norvegicus
ggtatcctctggatcttctcattca

SEQ ID NO: 464369 - DNA, 25 bp, Rattus norvegicus
ggtatcctctggttcttctcattca

SEQ ID NO: 464370 - DNA, 25 bp, Rattus norvegicus
ggtatcctcttgatgacctgagctt

SEQ ID NO: 464371 - DNA, 25 bp, Rattus norvegicus
ggtatcctcttgttgacctgagctt

SEQ ID NO: 464372 - DNA, 25 bp, Rattus norvegicus
ggtatcctgagtaagcatcgtgcct

SEQ ID NO: 464373 - DNA, 25 bp, Rattus norvegicus
ggtatcctgagttagcatcgtgcct

SEQ ID NO: 464374 - DNA, 25 bp, Rattus norvegicus
ggtatcctgcatattttgaatttag

SEQ ID NO: 464375 - DNA, 25 bp, Rattus norvegicus
ggtatcctgcattttttgaatttag

SEQ ID NO: 464376 - DNA, 25 bp, Rattus norvegicus
ggtatcctgctgagttttgtccaga

SEQ ID NO: 464377 - DNA, 25 bp, Rattus norvegicus
ggtatcctgctgtgttttgtccaga

SEQ ID NO: 464378 - DNA, 25 bp, Rattus norvegicus
ggtatcctgtgtcatctggcatagt

SEQ ID NO: 464379 - DNA, 25 bp, Rattus norvegicus
ggtatcctgtgtgatctggcatagt

SEQ ID NO: 464380 - DNA, 25 bp, Rattus norvegicus
ggtatccttaccacaaaagagtgac

SEQ ID NO: 464381 - DNA, 25 bp, Rattus norvegicus
ggtatccttacctcaaaagagtgac

SEQ ID NO: 464382 - DNA, 25 bp, Rattus norvegicus
ggtatcctttggaaaacagcactga

SEQ ID NO: 464383 - DNA, 25 bp, Rattus norvegicus
ggtatcctttggtaaacagcactga

SEQ ID NO: 464384 - DNA, 25 bp, Rattus norvegicus
ggtatcgggcctaaatttctcattg

SEQ ID NO: 464385 - DNA, 25 bp, Rattus norvegicus
ggtatcgggccttaatttctcattg

SEQ ID NO: 464386 - DNA, 25 bp, Rattus norvegicus
ggtatcgggttcaccaggctttaat

SEQ ID NO: 464387 - DNA, 25 bp, Rattus norvegicus
ggtatcgggttctccaggctttaat

SEQ ID NO: 464388 - DNA, 25 bp, Rattus norvegicus
ggtatctaaatcctggcttccaaaa

SEQ ID NO: 464389 - DNA, 25 bp, Rattus norvegicus
ggtatctaaatcgtggcttccaaaa

SEQ ID NO: 464390 - DNA, 25 bp, Rattus norvegicus
ggtatctacaccatcctaagaggca

SEQ ID NO: 464391 - DNA, 25 bp, Rattus norvegicus
ggtatctacaccttcctaagaggca

SEQ ID NO: 464392 - DNA, 25 bp, Rattus norvegicus
ggtatctaccttctgcaaggactgt

SEQ ID NO: 464393 - DNA, 25 bp, Rattus norvegicus
ggtatctaccttgtgcaaggactgt

SEQ ID NO: 464394 - DNA, 25 bp, Rattus norvegicus
ggtatctactatcaacccaactgta

SEQ ID NO: 464395 - DNA, 25 bp, Rattus norvegicus
ggtatctactatgaacccaactgta

SEQ ID NO: 464396 - DNA, 25 bp, Rattus norvegicus
ggtatctatccccaaagtaactggt

SEQ ID NO: 464397 - DNA, 25 bp, Rattus norvegicus
ggtatctatcccgaaagtaactggt

SEQ ID NO: 464398 - DNA, 25 bp, Rattus norvegicus
ggtatctcaataactctaggcacta

SEQ ID NO: 464399 - DNA, 25 bp, Rattus norvegicus
ggtatctcaatatctctaggcacta

SEQ ID NO: 464400 - DNA, 25 bp, Rattus norvegicus
ggtatctcagaaattgtcatctcct

SEQ ID NO: 464401 - DNA, 25 bp, Rattus norvegicus
ggtatctcagaatttgtcatctcct

SEQ ID NO: 464402 - DNA, 25 bp, Rattus norvegicus
ggtatctcatacaaataatccaaac

SEQ ID NO: 464403 - DNA, 25 bp, Rattus norvegicus
ggtatctcatactaataatccaaac

SEQ ID NO: 464404 - DNA, 25 bp, Rattus norvegicus
ggtatctccattagggccctgggaa

SEQ ID NO: 464405 - DNA, 25 bp, Rattus norvegicus
ggtatctccatttgggccctgggaa

SEQ ID NO: 464406 - DNA, 25 bp, Rattus norvegicus
ggtatctcccaacattaaccttcac

SEQ ID NO: 464407 - DNA, 25 bp, Rattus norvegicus
ggtatctcccaagattaaccttcac

SEQ ID NO: 464408 - DNA, 25 bp, Rattus norvegicus
ggtatctctcaaaaagccccgattt

SEQ ID NO: 464409 - DNA, 25 bp, Rattus norvegicus
ggtatctctcaataagccccgattt

SEQ ID NO: 464410 - DNA, 25 bp, Rattus norvegicus
ggtatctctccaactcaagggtttg

SEQ ID NO: 464411 - DNA, 25 bp, Rattus norvegicus
ggtatctctccatctcaagggtttg

SEQ ID NO: 464412 - DNA, 25 bp, Rattus norvegicus
ggtatctctgagagtacttctttaa

SEQ ID NO: 464413 - DNA, 25 bp, Rattus norvegicus
ggtatctctgagtgtacttctttaa

SEQ ID NO: 464414 - DNA, 25 bp, Rattus norvegicus
ggtatctctttcatagcagccattc

SEQ ID NO: 464415 - DNA, 25 bp, Rattus norvegicus
ggtatctctttcttagcagccattc

SEQ ID NO: 464416 - DNA, 25 bp, Rattus norvegicus
ggtatctgagaacccactccaggca

SEQ ID NO: 464417 - DNA, 25 bp, Rattus norvegicus
ggtatctgagaagccactccaggca

SEQ ID NO: 464418 - DNA, 25 bp, Rattus norvegicus
ggtatctgcggacagactccacgca

SEQ ID NO: 464419 - DNA, 25 bp, Rattus norvegicus
ggtatctgcggagagactccacgca

SEQ ID NO: 464420 - DNA, 25 bp, Rattus norvegicus
ggtatctgtccacacactattacaa

SEQ ID NO: 464421 - DNA, 25 bp, Rattus norvegicus
ggtatctgtccagacactattacaa

SEQ ID NO: 464422 - DNA, 25 bp, Rattus norvegicus
ggtatcttactaattctctgggttt

SEQ ID NO: 464423 - DNA, 25 bp, Rattus norvegicus
ggtatcttactatttctctgggttt

SEQ ID NO: 464424 - DNA, 25 bp, Rattus norvegicus
ggtatcttagatcctcagtgcctag

SEQ ID NO: 464425 - DNA, 25 bp, Rattus norvegicus
ggtatcttagatgctcagtgcctag

SEQ ID NO: 464426 - DNA, 25 bp, Rattus norvegicus
ggtatcttcattcgccaagtgacag

SEQ ID NO: 464427 - DNA, 25 bp, Rattus norvegicus
ggtatcttcattggccaagtgacag

SEQ ID NO: 464428 - DNA, 25 bp, Rattus norvegicus
ggtatctttattactccagaatctg

SEQ ID NO: 464429 - DNA, 25 bp, Rattus norvegicus
ggtatctttatttctccagaatctg

SEQ ID NO: 464430 - DNA, 25 bp, Rattus norvegicus
ggtatctttctgaagttgcatctgg

SEQ ID NO: 464431 - DNA, 25 bp, Rattus norvegicus
ggtatctttctgtagttgcatctgg

SEQ ID NO: 464432 - DNA, 25 bp, Rattus norvegicus
ggtatctttgataaaacttccactt

SEQ ID NO: 464433 - DNA, 25 bp, Rattus norvegicus
ggtatctttgattaaacttccactt

SEQ ID NO: 464434 - DNA, 25 bp, Rattus norvegicus
ggtatcttttgacgatcaggctcca

SEQ ID NO: 464435 - DNA, 25 bp, Rattus norvegicus
ggtatcttttgaggatcaggctcca

SEQ ID NO: 464436 - DNA, 25 bp, Rattus norvegicus
ggtatgaaatggcaggcgtcacctt

SEQ ID NO: 464437 - DNA, 25 bp, Rattus norvegicus
ggtatgaaatgggaggcgtcacctt

SEQ ID NO: 464438 - DNA, 25 bp, Rattus norvegicus
ggtatgaacagaaatgctcctcaaa

SEQ ID NO: 464439 - DNA, 25 bp, Rattus norvegicus
ggtatgaacagatatgctcctcaaa

SEQ ID NO: 464440 - DNA, 25 bp, Rattus norvegicus
ggtatgaaccacagtgtctggctta

SEQ ID NO: 464441 - DNA, 25 bp, Rattus norvegicus
ggtatgaaccactgtgtctggctta

SEQ ID NO: 464442 - DNA, 25 bp, Rattus norvegicus
ggtatgaataaaacccgtgaacaca

SEQ ID NO: 464443 - DNA, 25 bp, Rattus norvegicus
ggtatgaataaatcccgtgaacaca

SEQ ID NO: 464444 - DNA, 25 bp, Rattus norvegicus
ggtatgacagcccagctaggtctgc

SEQ ID NO: 464445 - DNA, 25 bp, Rattus norvegicus
ggtatgacagccgagctaggtctgc

SEQ ID NO: 464446 - DNA, 25 bp, Rattus norvegicus
ggtatgacccaacacacaatcgctg

SEQ ID NO: 464447 - DNA, 25 bp, Rattus norvegicus
ggtatgacccaagacacaatcgctg

SEQ ID NO: 464448 - DNA, 25 bp, Rattus norvegicus
ggtatgagcaaaacacacacacaca

SEQ ID NO: 464449 - DNA, 25 bp, Rattus norvegicus
ggtatgagcaaatcacacacacaca

SEQ ID NO: 464450 - DNA, 25 bp, Rattus norvegicus
ggtatgagccttcatcaagtgttat

SEQ ID NO: 464451 - DNA, 25 bp, Rattus norvegicus
ggtatgagccttgatcaagtgttat

SEQ ID NO: 464452 - DNA, 25 bp, Rattus norvegicus
ggtatgagtctgacctttgatgaag

SEQ ID NO: 464453 - DNA, 25 bp, Rattus norvegicus
ggtatgagtctgtcctttgatgaag

SEQ ID NO: 464454 - DNA, 25 bp, Rattus norvegicus
ggtatgatcaacaactgccctttgc

SEQ ID NO: 464455 - DNA, 25 bp, Rattus norvegicus
ggtatgatcaactactgccctttgc

SEQ ID NO: 464456 - DNA, 25 bp, Rattus norvegicus
ggtatgcactgtcattttctgaaag

SEQ ID NO: 464457 - DNA, 25 bp, Rattus norvegicus
ggtatgcactgtgattttctgaaag

SEQ ID NO: 464458 - DNA, 25 bp, Rattus norvegicus
ggtatgcagaaccactgtcagtcac

SEQ ID NO: 464459 - DNA, 25 bp, Rattus norvegicus
ggtatgcagaacgactgtcagtcac

SEQ ID NO: 464460 - DNA, 25 bp, Rattus norvegicus
ggtatgcagctcattttctagtttt

SEQ ID NO: 464461 - DNA, 25 bp, Rattus norvegicus
ggtatgcagctctttttctagtttt

SEQ ID NO: 464462 - DNA, 25 bp, Rattus norvegicus
ggtatgccaacaattatcttcctga

SEQ ID NO: 464463 - DNA, 25 bp, Rattus norvegicus
ggtatgccaacatttatcttcctga

SEQ ID NO: 464464 - DNA, 25 bp, Rattus norvegicus
ggtatgccagcaacaatgcacatct

SEQ ID NO: 464465 - DNA, 25 bp, Rattus norvegicus
ggtatgccagcatcaatgcacatct

SEQ ID NO: 464466 - DNA, 25 bp, Rattus norvegicus
ggtatgcgactgattccaagccaag

SEQ ID NO: 464467 - DNA, 25 bp, Rattus norvegicus
ggtatgcgactgtttccaagccaag

SEQ ID NO: 464468 - DNA, 25 bp, Rattus norvegicus
ggtatgcgccacatctgtgaaaaca

SEQ ID NO: 464469 - DNA, 25 bp, Rattus norvegicus
ggtatgcgccacttctgtgaaaaca

SEQ ID NO: 464470 - DNA, 25 bp, Rattus norvegicus
ggtatgcgtgacaacatggcctatg

SEQ ID NO: 464471 - DNA, 25 bp, Rattus norvegicus
ggtatgcgtgactacatggcctatg

SEQ ID NO: 464472 - DNA, 25 bp, Rattus norvegicus
ggtatgctcactcactggtaactcc

SEQ ID NO: 464473 - DNA, 25 bp, Rattus norvegicus
ggtatgctcactgactggtaactcc

SEQ ID NO: 464474 - DNA, 25 bp, Rattus norvegicus
ggtatgctcattacaacattcttta

SEQ ID NO: 464475 - DNA, 25 bp, Rattus norvegicus
ggtatgctcatttcaacattcttta

SEQ ID NO: 464476 - DNA, 25 bp, Rattus norvegicus
ggtatgcttctgcagtctaatggct

SEQ ID NO: 464477 - DNA, 25 bp, Rattus norvegicus
ggtatgcttctggagtctaatggct

SEQ ID NO: 464478 - DNA, 25 bp, Rattus norvegicus
ggtatgcttgttattcccagatgca

SEQ ID NO: 464479 - DNA, 25 bp, Rattus norvegicus
ggtatgcttgtttttcccagatgca

SEQ ID NO: 464480 - DNA, 25 bp, Rattus norvegicus
ggtatggaatccaccacgattctgt

SEQ ID NO: 464481 - DNA, 25 bp, Rattus norvegicus
ggtatggaatcctccacgattctgt

SEQ ID NO: 464482 - DNA, 25 bp, Rattus norvegicus
ggtatggacaccaagggcacttggt

SEQ ID NO: 464483 - DNA, 25 bp, Rattus norvegicus
ggtatggacacctagggcacttggt

SEQ ID NO: 464484 - DNA, 25 bp, Rattus norvegicus
ggtatggaggcaagtgcccacctta

SEQ ID NO: 464485 - DNA, 25 bp, Rattus norvegicus
ggtatggaggcatgtgcccacctta

SEQ ID NO: 464486 - DNA, 25 bp, Rattus norvegicus
ggtatggagtgcagctcttcacctc

SEQ ID NO: 464487 - DNA, 25 bp, Rattus norvegicus
ggtatggagtgctgctcttcacctc

SEQ ID NO: 464488 - DNA, 25 bp, Rattus norvegicus
ggtatggcacagaggtaggtctcac

SEQ ID NO: 464489 - DNA, 25 bp, Rattus norvegicus
ggtatggcacagtggtaggtctcac

SEQ ID NO: 464490 - DNA, 25 bp, Rattus norvegicus
ggtatggccactagggatttttctc

SEQ ID NO: 464491 - DNA, 25 bp, Rattus norvegicus
ggtatggccacttgggatttttctc

SEQ ID NO: 464492 - DNA, 25 bp, Rattus norvegicus
ggtatggccccaaagacttatgtga

SEQ ID NO: 464493 - DNA, 25 bp, Rattus norvegicus
ggtatggccccatagacttatgtga

SEQ ID NO: 464494 - DNA, 25 bp, Rattus norvegicus
ggtatgggctttaatttcaccccag

SEQ ID NO: 464495 - DNA, 25 bp, Rattus norvegicus
ggtatgggcttttatttcaccccag

SEQ ID NO: 464496 - DNA, 25 bp, Rattus norvegicus
ggtatgggtaccactttccagagct

SEQ ID NO: 464497 - DNA, 25 bp, Rattus norvegicus
ggtatgggtacctctttccagagct

SEQ ID NO: 464498 - DNA, 25 bp, Rattus norvegicus
ggtatggtggtccaagctcgtactc

SEQ ID NO: 464499 - DNA, 25 bp, Rattus norvegicus
ggtatggtggtcgaagctcgtactc

SEQ ID NO: 464500 - DNA, 25 bp, Rattus norvegicus
ggtatgtactgtaagtcctcatctt

SEQ ID NO: 464501 - DNA, 25 bp, Rattus norvegicus
ggtatgtactgttagtcctcatctt

SEQ ID NO: 464502 - DNA, 25 bp, Rattus norvegicus
ggtatgtactttaagtattgccact

SEQ ID NO: 464503 - DNA, 25 bp, Rattus norvegicus
ggtatgtacttttagtattgccact

SEQ ID NO: 464504 - DNA, 25 bp, Rattus norvegicus
ggtatgtcaacaccttactttctag

SEQ ID NO: 464505 - DNA, 25 bp, Rattus norvegicus
ggtatgtcaacagcttactttctag

SEQ ID NO: 464506 - DNA, 25 bp, Rattus norvegicus
ggtatgtcacagctcaccatggact

SEQ ID NO: 464507 - DNA, 25 bp, Rattus norvegicus
ggtatgtcacaggtcaccatggact

SEQ ID NO: 464508 - DNA, 25 bp, Rattus norvegicus
ggtatgtcacccacagcagcactaa

SEQ ID NO: 464509 - DNA, 25 bp, Rattus norvegicus
ggtatgtcaccctcagcagcactaa

SEQ ID NO: 464510 - DNA, 25 bp, Rattus norvegicus
ggtatgtccgacatttaactctggt

SEQ ID NO: 464511 - DNA, 25 bp, Rattus norvegicus
ggtatgtccgacttttaactctggt

SEQ ID NO: 464512 - DNA, 25 bp, Rattus norvegicus
ggtatgtcctaaactttcctgcctt

SEQ ID NO: 464513 - DNA, 25 bp, Rattus norvegicus
ggtatgtcctaatctttcctgcctt

SEQ ID NO: 464514 - DNA, 25 bp, Rattus norvegicus
ggtatgtctgctccatgccttgaaa

SEQ ID NO: 464515 - DNA, 25 bp, Rattus norvegicus
ggtatgtctgctgcatgccttgaaa

SEQ ID NO: 464516 - DNA, 25 bp, Rattus norvegicus
ggtatgtggattaccttctgttttc

SEQ ID NO: 464517 - DNA, 25 bp, Rattus norvegicus
ggtatgtggatttccttctgttttc

SEQ ID NO: 464518 - DNA, 25 bp, Rattus norvegicus
ggtatgtgggctcctgtaccaacca

SEQ ID NO: 464519 - DNA, 25 bp, Rattus norvegicus
ggtatgtgggctgctgtaccaacca

SEQ ID NO: 464520 - DNA, 25 bp, Rattus norvegicus
ggtatgtgtactcggccttgtgaac

SEQ ID NO: 464521 - DNA, 25 bp, Rattus norvegicus
ggtatgtgtactgggccttgtgaac

SEQ ID NO: 464522 - DNA, 25 bp, Rattus norvegicus
ggtatgtgtcacagtctcaaggtaa

SEQ ID NO: 464523 - DNA, 25 bp, Rattus norvegicus
ggtatgtgtcactgtctcaaggtaa

SEQ ID NO: 464524 - DNA, 25 bp, Rattus norvegicus
ggtatgttccagcttatgtgtttct

SEQ ID NO: 464525 - DNA, 25 bp, Rattus norvegicus
ggtatgttccaggttatgtgtttct

SEQ ID NO: 464526 - DNA, 25 bp, Rattus norvegicus
ggtatgttctaactgtgtctctcaa

SEQ ID NO: 464527 - DNA, 25 bp, Rattus norvegicus
ggtatgttctaagtgtgtctctcaa

SEQ ID NO: 464528 - DNA, 25 bp, Rattus norvegicus
ggtatgttctttaaatcccctctca

SEQ ID NO: 464529 - DNA, 25 bp, Rattus norvegicus
ggtatgttcttttaatcccctctca

SEQ ID NO: 464530 - DNA, 25 bp, Rattus norvegicus
ggtatgttgatcatggctttgcttt

SEQ ID NO: 464531 - DNA, 25 bp, Rattus norvegicus
ggtatgttgatcttggctttgcttt

SEQ ID NO: 464532 - DNA, 25 bp, Rattus norvegicus
ggtatgttggctatatccacccaag

SEQ ID NO: 464533 - DNA, 25 bp, Rattus norvegicus
ggtatgttggctttatccacccaag

SEQ ID NO: 464534 - DNA, 25 bp, Rattus norvegicus
ggtatgtttctaatccagacaaagt

SEQ ID NO: 464535 - DNA, 25 bp, Rattus norvegicus
ggtatgtttctattccagacaaagt

SEQ ID NO: 464536 - DNA, 25 bp, Rattus norvegicus
ggtatgtttgcaatccgagcccgga

SEQ ID NO: 464537 - DNA, 25 bp, Rattus norvegicus
ggtatgtttgcattccgagcccgga

SEQ ID NO: 464538 - DNA, 25 bp, Rattus norvegicus
ggtatgtttgtaatgccagggctag

SEQ ID NO: 464539 - DNA, 25 bp, Rattus norvegicus
ggtatgtttgtattgccagggctag

SEQ ID NO: 464540 - DNA, 25 bp, Rattus norvegicus
ggtatgttttagattgtattttgcc

SEQ ID NO: 464541 - DNA, 25 bp, Rattus norvegicus
ggtatgttttagtttgtattttgcc

SEQ ID NO: 464542 - DNA, 25 bp, Rattus norvegicus
ggtattaaaattctgtttcaaacat

SEQ ID NO: 464543 - DNA, 25 bp, Rattus norvegicus
ggtattaaaattgtgtttcaaacat

SEQ ID NO: 464544 - DNA, 25 bp, Rattus norvegicus
ggtattaacagcagtgctaacctta

SEQ ID NO: 464545 - DNA, 25 bp, Rattus norvegicus
ggtattaacagctgtgctaacctta

SEQ ID NO: 464546 - DNA, 25 bp, Rattus norvegicus
ggtattaccaggaaggacactttca

SEQ ID NO: 464547 - DNA, 25 bp, Rattus norvegicus
ggtattaccaggtaggacactttca

SEQ ID NO: 464548 - DNA, 25 bp, Rattus norvegicus
ggtattactgaccatattgcccaag

SEQ ID NO: 464549 - DNA, 25 bp, Rattus norvegicus
ggtattactgacgatattgcccaag

SEQ ID NO: 464550 - DNA, 25 bp, Rattus norvegicus
ggtattagcattcggtactgaatta

SEQ ID NO: 464551 - DNA, 25 bp, Rattus norvegicus
ggtattagcattgggtactgaatta

SEQ ID NO: 464552 - DNA, 25 bp, Rattus norvegicus
ggtattagccatcaagtatccttgt

SEQ ID NO: 464553 - DNA, 25 bp, Rattus norvegicus
ggtattagccatgaagtatccttgt

SEQ ID NO: 464554 - DNA, 25 bp, Rattus norvegicus
ggtattagccctccagttctagtaa

SEQ ID NO: 464555 - DNA, 25 bp, Rattus norvegicus
ggtattagccctgcagttctagtaa

SEQ ID NO: 464556 - DNA, 25 bp, Rattus norvegicus
ggtattataatgcagcgggcttcaa

SEQ ID NO: 464557 - DNA, 25 bp, Rattus norvegicus
ggtattataatggagcgggcttcaa

SEQ ID NO: 464558 - DNA, 25 bp, Rattus norvegicus
ggtattatacaaagatgtctgaccc

SEQ ID NO: 464559 - DNA, 25 bp, Rattus norvegicus
ggtattatacaatgatgtctgaccc

SEQ ID NO: 464560 - DNA, 25 bp, Rattus norvegicus
ggtattatcacaaactatctagcag

SEQ ID NO: 464561 - DNA, 25 bp, Rattus norvegicus
ggtattatcacatactatctagcag

SEQ ID NO: 464562 - DNA, 25 bp, Rattus norvegicus
ggtattattatactttgccatatcc

SEQ ID NO: 464563 - DNA, 25 bp, Rattus norvegicus
ggtattattatagtttgccatatcc

SEQ ID NO: 464564 - DNA, 25 bp, Rattus norvegicus
ggtattattttcctccatgtacaaa

SEQ ID NO: 464565 - DNA, 25 bp, Rattus norvegicus
ggtattattttcgtccatgtacaaa

SEQ ID NO: 464566 - DNA, 25 bp, Rattus norvegicus
ggtattcacaacagccagggacttg

SEQ ID NO: 464567 - DNA, 25 bp, Rattus norvegicus
ggtattcacaactgccagggacttg

SEQ ID NO: 464568 - DNA, 25 bp, Rattus norvegicus
ggtattcacagtaatttaccataca

SEQ ID NO: 464569 - DNA, 25 bp, Rattus norvegicus
ggtattcacagttatttaccataca

SEQ ID NO: 464570 - DNA, 25 bp, Rattus norvegicus
ggtattcacctacctcatacggcat

SEQ ID NO: 464571 - DNA, 25 bp, Rattus norvegicus
ggtattcacctagctcatacggcat

SEQ ID NO: 464572 - DNA, 25 bp, Rattus norvegicus
ggtattcactaactgaggtactcaa

SEQ ID NO: 464573 - DNA, 25 bp, Rattus norvegicus
ggtattcactaagtgaggtactcaa

SEQ ID NO: 464574 - DNA, 25 bp, Rattus norvegicus
ggtattcagcagaatgggccctgtt

SEQ ID NO: 464575 - DNA, 25 bp, Rattus norvegicus
ggtattcagcagtatgggccctgtt

SEQ ID NO: 464576 - DNA, 25 bp, Rattus norvegicus
ggtattcagcataagattagacact

SEQ ID NO: 464577 - DNA, 25 bp, Rattus norvegicus
ggtattcagcattagattagacact

SEQ ID NO: 464578 - DNA, 25 bp, Rattus norvegicus
ggtattcatgctacacttgactctt

SEQ ID NO: 464579 - DNA, 25 bp, Rattus norvegicus
ggtattcatgcttcacttgactctt

SEQ ID NO: 464580 - DNA, 25 bp, Rattus norvegicus
ggtattcatgtactttcctgcatca

SEQ ID NO: 464581 - DNA, 25 bp, Rattus norvegicus
ggtattcatgtagtttcctgcatca

SEQ ID NO: 464582 - DNA, 25 bp, Rattus norvegicus
ggtattcattttctaaatcaatccg

SEQ ID NO: 464583 - DNA, 25 bp, Rattus norvegicus
ggtattcattttgtaaatcaatccg

SEQ ID NO: 464584 - DNA, 25 bp, Rattus norvegicus
ggtattcccagacctctttggagga

SEQ ID NO: 464585 - DNA, 25 bp, Rattus norvegicus
ggtattcccagagctctttggagga

SEQ ID NO: 464586 - DNA, 25 bp, Rattus norvegicus
ggtattcccctgcaagctctaggag

SEQ ID NO: 464587 - DNA, 25 bp, Rattus norvegicus
ggtattcccctggaagctctaggag

SEQ ID NO: 464588 - DNA, 25 bp, Rattus norvegicus
ggtattccctataatgtcctcattt

SEQ ID NO: 464589 - DNA, 25 bp, Rattus norvegicus
ggtattccctattatgtcctcattt

SEQ ID NO: 464590 - DNA, 25 bp, Rattus norvegicus
ggtattccttccctagagacggaca

SEQ ID NO: 464591 - DNA, 25 bp, Rattus norvegicus
ggtattccttccgtagagacggaca

SEQ ID NO: 464592 - DNA, 25 bp, Rattus norvegicus
ggtattcgattcacctcttctattt

SEQ ID NO: 464593 - DNA, 25 bp, Rattus norvegicus
ggtattcgattctcctcttctattt

SEQ ID NO: 464594 - DNA, 25 bp, Rattus norvegicus
ggtattctcagaatagtcacgcgaa

SEQ ID NO: 464595 - DNA, 25 bp, Rattus norvegicus
ggtattctcagattagtcacgcgaa

SEQ ID NO: 464596 - DNA, 25 bp, Rattus norvegicus
ggtattctcctaatgacgtaagcac

SEQ ID NO: 464597 - DNA, 25 bp, Rattus norvegicus
ggtattctcctattgacgtaagcac

SEQ ID NO: 464598 - DNA, 25 bp, Rattus norvegicus
ggtattctctgcattttaattacta

SEQ ID NO: 464599 - DNA, 25 bp, Rattus norvegicus
ggtattctctgctttttaattacta

SEQ ID NO: 464600 - DNA, 25 bp, Rattus norvegicus
ggtattctgaggctgcttgtccaat

SEQ ID NO: 464601 - DNA, 25 bp, Rattus norvegicus
ggtattctgagggtgcttgtccaat

SEQ ID NO: 464602 - DNA, 25 bp, Rattus norvegicus
ggtattcttacaaatttaggtcaca

SEQ ID NO: 464603 - DNA, 25 bp, Rattus norvegicus
ggtattcttacatatttaggtcaca

SEQ ID NO: 464604 - DNA, 25 bp, Rattus norvegicus
ggtattcttaccaccaagacagatc

SEQ ID NO: 464605 - DNA, 25 bp, Rattus norvegicus
ggtattcttacctccaagacagatc

SEQ ID NO: 464606 - DNA, 25 bp, Rattus norvegicus
ggtattcttcagatcaccgagctct

SEQ ID NO: 464607 - DNA, 25 bp, Rattus norvegicus
ggtattcttcagttcaccgagctct

SEQ ID NO: 464608 - DNA, 25 bp, Rattus norvegicus
ggtattcttggcaattgcagcagta

SEQ ID NO: 464609 - DNA, 25 bp, Rattus norvegicus
ggtattcttggctattgcagcagta

SEQ ID NO: 464610 - DNA, 25 bp, Rattus norvegicus
ggtattctttttcggtcacaaagca

SEQ ID NO: 464611 - DNA, 25 bp, Rattus norvegicus
ggtattctttttgggtcacaaagca

SEQ ID NO: 464612 - DNA, 25 bp, Rattus norvegicus
ggtattgacaatcctcacatatgat

SEQ ID NO: 464613 - DNA, 25 bp, Rattus norvegicus
ggtattgacaatgctcacatatgat

SEQ ID NO: 464614 - DNA, 25 bp, Rattus norvegicus
ggtattgcacccattatttctctag

SEQ ID NO: 464615 - DNA, 25 bp, Rattus norvegicus
ggtattgcaccctttatttctctag

SEQ ID NO: 464616 - DNA, 25 bp, Rattus norvegicus
ggtattgcacctaaacaggccgagg

SEQ ID NO: 464617 - DNA, 25 bp, Rattus norvegicus
ggtattgcaccttaacaggccgagg

SEQ ID NO: 464618 - DNA, 25 bp, Rattus norvegicus
ggtattgcactaccagcacgcatca

SEQ ID NO: 464619 - DNA, 25 bp, Rattus norvegicus
ggtattgcactagcagcacgcatca

SEQ ID NO: 464620 - DNA, 25 bp, Rattus norvegicus
ggtattgccaaaagttagctcactg

SEQ ID NO: 464621 - DNA, 25 bp, Rattus norvegicus
ggtattgccaaatgttagctcactg

SEQ ID NO: 464622 - DNA, 25 bp, Rattus norvegicus
ggtattgcccttagcagtgtttaat

SEQ ID NO: 464623 - DNA, 25 bp, Rattus norvegicus
ggtattgccctttgcagtgtttaat

SEQ ID NO: 464624 - DNA, 25 bp, Rattus norvegicus
ggtattgccttaagatcctctgaaa

SEQ ID NO: 464625 - DNA, 25 bp, Rattus norvegicus
ggtattgccttaattttgttgcttt

SEQ ID NO: 464626 - DNA, 25 bp, Rattus norvegicus
ggtattgccttatgatcctctgaaa

SEQ ID NO: 464627 - DNA, 25 bp, Rattus norvegicus
ggtattgccttatttttgttgcttt

SEQ ID NO: 464628 - DNA, 25 bp, Rattus norvegicus
ggtattgctgtcatgttcttggaat

SEQ ID NO: 464629 - DNA, 25 bp, Rattus norvegicus
ggtattgctgtcttgttcttggaat

SEQ ID NO: 464630 - DNA, 25 bp, Rattus norvegicus
ggtattggcttaatattcttgttgg

SEQ ID NO: 464631 - DNA, 25 bp, Rattus norvegicus
ggtattggcttattattcttgttgg

SEQ ID NO: 464632 - DNA, 25 bp, Rattus norvegicus
ggtattggtaaacccctctttctga

SEQ ID NO: 464633 - DNA, 25 bp, Rattus norvegicus
ggtattggtaaagccctctttctga

SEQ ID NO: 464634 - DNA, 25 bp, Rattus norvegicus
ggtattggtcaaatatcctagtgtc

SEQ ID NO: 464635 - DNA, 25 bp, Rattus norvegicus
ggtattggtcaattatcctagtgtc

SEQ ID NO: 464636 - DNA, 25 bp, Rattus norvegicus
ggtattggtcagaccttttctaaag

SEQ ID NO: 464637 - DNA, 25 bp, Rattus norvegicus
ggtattggtcagtccttttctaaag

SEQ ID NO: 464638 - DNA, 25 bp, Rattus norvegicus
ggtattgtacaacttcacactgttt

SEQ ID NO: 464639 - DNA, 25 bp, Rattus norvegicus
ggtattgtacaagttcacactgttt

SEQ ID NO: 464640 - DNA, 25 bp, Rattus norvegicus
ggtattgtataaatcctacgcaagt

SEQ ID NO: 464641 - DNA, 25 bp, Rattus norvegicus
ggtattgtataattcctacgcaagt

SEQ ID NO: 464642 - DNA, 25 bp, Rattus norvegicus
ggtattgtatcccaaactgcataga

SEQ ID NO: 464643 - DNA, 25 bp, Rattus norvegicus
ggtattgtatccgaaactgcataga

SEQ ID NO: 464644 - DNA, 25 bp, Rattus norvegicus
ggtattgtatgcatgcaatgcacat

SEQ ID NO: 464645 - DNA, 25 bp, Rattus norvegicus
ggtattgtatgcttgcaatgcacat

SEQ ID NO: 464646 - DNA, 25 bp, Rattus norvegicus
ggtattgtcttgagccttaactgat

SEQ ID NO: 464647 - DNA, 25 bp, Rattus norvegicus
ggtattgtcttgtgccttaactgat

SEQ ID NO: 464648 - DNA, 25 bp, Rattus norvegicus
ggtattgtgacaccgctttagcagc

SEQ ID NO: 464649 - DNA, 25 bp, Rattus norvegicus
ggtattgtgacagcgctttagcagc

SEQ ID NO: 464650 - DNA, 25 bp, Rattus norvegicus
ggtattgttctcatggctaatctaa

SEQ ID NO: 464651 - DNA, 25 bp, Rattus norvegicus
ggtattgttctcttggctaatctaa

SEQ ID NO: 464652 - DNA, 25 bp, Rattus norvegicus
ggtattgtttcacggcgcagatcac

SEQ ID NO: 464653 - DNA, 25 bp, Rattus norvegicus
ggtattgtttcagggcgcagatcac

SEQ ID NO: 464654 - DNA, 25 bp, Rattus norvegicus
ggtattgtttctctattgttccact

SEQ ID NO: 464655 - DNA, 25 bp, Rattus norvegicus
ggtattgtttctgtattgttccact

SEQ ID NO: 464656 - DNA, 25 bp, Rattus norvegicus
ggtatttaagccatgttccatgtta

SEQ ID NO: 464657 - DNA, 25 bp, Rattus norvegicus
ggtatttaagccttgttccatgtta

SEQ ID NO: 464658 - DNA, 25 bp, Rattus norvegicus
ggtatttaccctccagagcaaccat

SEQ ID NO: 464659 - DNA, 25 bp, Rattus norvegicus
ggtatttaccctgcagagcaaccat

SEQ ID NO: 464660 - DNA, 25 bp, Rattus norvegicus
ggtatttacttacttccattcagta

SEQ ID NO: 464661 - DNA, 25 bp, Rattus norvegicus
ggtatttacttagttccattcagta

SEQ ID NO: 464662 - DNA, 25 bp, Rattus norvegicus
ggtatttataataccctgtacactc

SEQ ID NO: 464663 - DNA, 25 bp, Rattus norvegicus
ggtatttataattccctgtacactc

SEQ ID NO: 464664 - DNA, 25 bp, Rattus norvegicus
ggtatttattgaccatccacacaga

SEQ ID NO: 464665 - DNA, 25 bp, Rattus norvegicus
ggtatttattgagcatccacacaga

SEQ ID NO: 464666 - DNA, 25 bp, Rattus norvegicus
ggtatttatttcaactgctgagtga

SEQ ID NO: 464667 - DNA, 25 bp, Rattus norvegicus
ggtatttatttctactgctgagtga

SEQ ID NO: 464668 - DNA, 25 bp, Rattus norvegicus
ggtatttcatatattctaggtatct

SEQ ID NO: 464669 - DNA, 25 bp, Rattus norvegicus
ggtatttcatattttctaggtatct

SEQ ID NO: 464670 - DNA, 25 bp, Rattus norvegicus
ggtatttccagcacctttgataggc

SEQ ID NO: 464671 - DNA, 25 bp, Rattus norvegicus
ggtatttccagctcctttgataggc

SEQ ID NO: 464672 - DNA, 25 bp, Rattus norvegicus
ggtatttctgatcactctaagactg

SEQ ID NO: 464673 - DNA, 25 bp, Rattus norvegicus
ggtatttctgatgactctaagactg

SEQ ID NO: 464674 - DNA, 25 bp, Rattus norvegicus
ggtatttctgtaatgtaacccagta

SEQ ID NO: 464675 - DNA, 25 bp, Rattus norvegicus
ggtatttctgtattgtaacccagta

SEQ ID NO: 464676 - DNA, 25 bp, Rattus norvegicus
ggtatttctttgaggtctgacctac

SEQ ID NO: 464677 - DNA, 25 bp, Rattus norvegicus
ggtatttctttgtggtctgacctac

SEQ ID NO: 464678 - DNA, 25 bp, Rattus norvegicus
ggtatttgaccaacttagttttaat

SEQ ID NO: 464679 - DNA, 25 bp, Rattus norvegicus
ggtatttgaccatcttagttttaat

SEQ ID NO: 464680 - DNA, 25 bp, Rattus norvegicus
ggtatttgccaactgtcactcatta

SEQ ID NO: 464681 - DNA, 25 bp, Rattus norvegicus
ggtatttgccaagtgtcactcatta

SEQ ID NO: 464682 - DNA, 25 bp, Rattus norvegicus
ggtatttgccgccagcatgcttact

SEQ ID NO: 464683 - DNA, 25 bp, Rattus norvegicus
ggtatttgccgcgagcatgcttact

SEQ ID NO: 464684 - DNA, 25 bp, Rattus norvegicus
ggtatttgtcataatctgactcact

SEQ ID NO: 464685 - DNA, 25 bp, Rattus norvegicus
ggtatttgtcattatctgactcact

SEQ ID NO: 464686 - DNA, 25 bp, Rattus norvegicus
ggtatttgtcttagttcatctgaaa

SEQ ID NO: 464687 - DNA, 25 bp, Rattus norvegicus
ggtatttgtctttgttcatctgaaa

SEQ ID NO: 464688 - DNA, 25 bp, Rattus norvegicus
ggtatttgtgccacatctattactg

SEQ ID NO: 464689 - DNA, 25 bp, Rattus norvegicus
ggtatttgtgcctcatctattactg

SEQ ID NO: 464690 - DNA, 25 bp, Rattus norvegicus
ggtatttgtgtaatgtctcctgtta

SEQ ID NO: 464691 - DNA, 25 bp, Rattus norvegicus
ggtatttgtgtattgtctcctgtta

SEQ ID NO: 464692 - DNA, 25 bp, Rattus norvegicus
ggtatttgtgtgcaatatcccctct

SEQ ID NO: 464693 - DNA, 25 bp, Rattus norvegicus
ggtatttgtgtggaatatcccctct

SEQ ID NO: 464694 - DNA, 25 bp, Rattus norvegicus
ggtattttacaactgttcgcagcat

SEQ ID NO: 464695 - DNA, 25 bp, Rattus norvegicus
ggtattttacaagtgttcgcagcat

SEQ ID NO: 464696 - DNA, 25 bp, Rattus norvegicus
ggtattttcattcccttctatataa

SEQ ID NO: 464697 - DNA, 25 bp, Rattus norvegicus
ggtattttcattgccttctatataa

SEQ ID NO: 464698 - DNA, 25 bp, Rattus norvegicus
ggtattttctatagcccactatcag

SEQ ID NO: 464699 - DNA, 25 bp, Rattus norvegicus
ggtattttctattgcccactatcag

SEQ ID NO: 464700 - DNA, 25 bp, Rattus norvegicus
ggtattttctgtccttcctagaaca

SEQ ID NO: 464701 - DNA, 25 bp, Rattus norvegicus
ggtattttctgtgcttcctagaaca

SEQ ID NO: 464702 - DNA, 25 bp, Rattus norvegicus
ggtattttgactccctgcttaatga

SEQ ID NO: 464703 - DNA, 25 bp, Rattus norvegicus
ggtattttgactgcctgcttaatga

SEQ ID NO: 464704 - DNA, 25 bp, Rattus norvegicus
ggtattttgagacactctatttgtg

SEQ ID NO: 464705 - DNA, 25 bp, Rattus norvegicus
ggtattttgagagactctatttgtg

SEQ ID NO: 464706 - DNA, 25 bp, Rattus norvegicus
ggtattttgatgattgtactgacac

SEQ ID NO: 464707 - DNA, 25 bp, Rattus norvegicus
ggtattttgatgtttgtactgacac

SEQ ID NO: 464708 - DNA, 25 bp, Rattus norvegicus
ggtattttgccccatttgagttgag

SEQ ID NO: 464709 - DNA, 25 bp, Rattus norvegicus
ggtattttgcccgatttgagttgag

SEQ ID NO: 464710 - DNA, 25 bp, Rattus norvegicus
ggtattttgtacagagtgccgctta

SEQ ID NO: 464711 - DNA, 25 bp, Rattus norvegicus
ggtattttgtactgagtgccgctta

SEQ ID NO: 464712 - DNA, 25 bp, Rattus norvegicus
ggtattttgtagatccattcatttg

SEQ ID NO: 464713 - DNA, 25 bp, Rattus norvegicus
ggtattttgtagttccattcatttg

SEQ ID NO: 464714 - DNA, 25 bp, Rattus norvegicus
ggtattttttccatgagtgccagtg

SEQ ID NO: 464715 - DNA, 25 bp, Rattus norvegicus
ggtattttttccttgagtgccagtg

SEQ ID NO: 464716 - DNA, 25 bp, Rattus norvegicus
ggtcaaaagaagctcctcccagtct

SEQ ID NO: 464717 - DNA, 25 bp, Rattus norvegicus
ggtcaaaagaaggtcctcccagtct

SEQ ID NO: 464718 - DNA, 25 bp, Rattus norvegicus
ggtcaaacaacaaattcctcagctt

SEQ ID NO: 464719 - DNA, 25 bp, Rattus norvegicus
ggtcaaacaacatattcctcagctt

SEQ ID NO: 464720 - DNA, 25 bp, Rattus norvegicus
ggtcaaacaagcatttttctttcag

SEQ ID NO: 464721 - DNA, 25 bp, Rattus norvegicus
ggtcaaacaagcttttttctttcag

SEQ ID NO: 464722 - DNA, 25 bp, Rattus norvegicus
ggtcaaacataaacacaagccaatt

SEQ ID NO: 464723 - DNA, 25 bp, Rattus norvegicus
ggtcaaacataatcacaagccaatt

SEQ ID NO: 464724 - DNA, 25 bp, Rattus norvegicus
ggtcaaacccggcatgaccttttca

SEQ ID NO: 464725 - DNA, 25 bp, Rattus norvegicus
ggtcaaacccgggatgaccttttca

SEQ ID NO: 464726 - DNA, 25 bp, Rattus norvegicus
ggtcaaacgtccactagactagctc

SEQ ID NO: 464727 - DNA, 25 bp, Rattus norvegicus
ggtcaaacgtcccacaatggtctta

SEQ ID NO: 464728 - DNA, 25 bp, Rattus norvegicus
ggtcaaacgtccgacaatggtctta

SEQ ID NO: 464729 - DNA, 25 bp, Rattus norvegicus
ggtcaaacgtcctctagactagctc

SEQ ID NO: 464730 - DNA, 25 bp, Rattus norvegicus
ggtcaaactaggcattggccactat

SEQ ID NO: 464731 - DNA, 25 bp, Rattus norvegicus
ggtcaaactagggattggccactat

SEQ ID NO: 464732 - DNA, 25 bp, Rattus norvegicus
ggtcaaactataatttcccattcaa

SEQ ID NO: 464733 - DNA, 25 bp, Rattus norvegicus
ggtcaaactatattttcccattcaa

SEQ ID NO: 464734 - DNA, 25 bp, Rattus norvegicus
ggtcaaactccaaaaagcagggcaa

SEQ ID NO: 464735 - DNA, 25 bp, Rattus norvegicus
ggtcaaactccataaagcagggcaa

SEQ ID NO: 464736 - DNA, 25 bp, Rattus norvegicus
ggtcaaactgctcccagtactacca

SEQ ID NO: 464737 - DNA, 25 bp, Rattus norvegicus
ggtcaaactgctgccagtactacca

SEQ ID NO: 464738 - DNA, 25 bp, Rattus norvegicus
ggtcaaagacatcctatgcctgctg

SEQ ID NO: 464739 - DNA, 25 bp, Rattus norvegicus
ggtcaaagacatgctatgcctgctg

SEQ ID NO: 464740 - DNA, 25 bp, Rattus norvegicus
ggtcaaagagatcaatgactcctct

SEQ ID NO: 464741 - DNA, 25 bp, Rattus norvegicus
ggtcaaagagatgaatgactcctct

SEQ ID NO: 464742 - DNA, 25 bp, Rattus norvegicus
ggtcaaagcacaaggaaccctgcag

SEQ ID NO: 464743 - DNA, 25 bp, Rattus norvegicus
ggtcaaagcacatggaaccctgcag

SEQ ID NO: 464744 - DNA, 25 bp, Rattus norvegicus
ggtcaaagcagacatggcctggcta

SEQ ID NO: 464745 - DNA, 25 bp, Rattus norvegicus
ggtcaaagcagagatggcctggcta

SEQ ID NO: 464746 - DNA, 25 bp, Rattus norvegicus
ggtcaaagcatcaaggtggtctcca

SEQ ID NO: 464747 - DNA, 25 bp, Rattus norvegicus
ggtcaaagcatctaggtggtctcca

SEQ ID NO: 464748 - DNA, 25 bp, Rattus norvegicus
ggtcaaagccagcaatcccaattaa

SEQ ID NO: 464749 - DNA, 25 bp, Rattus norvegicus
ggtcaaagccaggaatcccaattaa

SEQ ID NO: 464750 - DNA, 25 bp, Rattus norvegicus
ggtcaaagcctcagatcaaagcctc

SEQ ID NO: 464751 - DNA, 25 bp, Rattus norvegicus
ggtcaaagcctctgatcaaagcctc

SEQ ID NO: 464752 - DNA, 25 bp, Rattus norvegicus
ggtcaaaggcgacggtaccatctct

SEQ ID NO: 464753 - DNA, 25 bp, Rattus norvegicus
ggtcaaaggcgagggtaccatctct

SEQ ID NO: 464754 - DNA, 25 bp, Rattus norvegicus
ggtcaaaggctacacattttaatgg

SEQ ID NO: 464755 - DNA, 25 bp, Rattus norvegicus
ggtcaaaggctagacattttaatgg

SEQ ID NO: 464756 - DNA, 25 bp, Rattus norvegicus
ggtcaaagggtcaagagtccttcaa

SEQ ID NO: 464757 - DNA, 25 bp, Rattus norvegicus
ggtcaaagggtctagagtccttcaa

SEQ ID NO: 464758 - DNA, 25 bp, Rattus norvegicus
ggtcaaagtgtgaccatcatgtcca

SEQ ID NO: 464759 - DNA, 25 bp, Rattus norvegicus
ggtcaaagtgtgtccatcatgtcca

SEQ ID NO: 464760 - DNA, 25 bp, Rattus norvegicus
ggtcaaagttcactgtcttcttcta

SEQ ID NO: 464761 - DNA, 25 bp, Rattus norvegicus
ggtcaaagttcagtgtcttcttcta

SEQ ID NO: 464762 - DNA, 25 bp, Rattus norvegicus
ggtcaaatatcacacatgtctagct

SEQ ID NO: 464763 - DNA, 25 bp, Rattus norvegicus
ggtcaaatatcagacatgtctagct

SEQ ID NO: 464764 - DNA, 25 bp, Rattus norvegicus
ggtcaaatcagcaatttactgccaa

SEQ ID NO: 464765 - DNA, 25 bp, Rattus norvegicus
ggtcaaatcagctatttactgccaa

SEQ ID NO: 464766 - DNA, 25 bp, Rattus norvegicus
ggtcaaatcctcactattctacata

SEQ ID NO: 464767 - DNA, 25 bp, Rattus norvegicus
ggtcaaatcctctctattctacata

SEQ ID NO: 464768 - DNA, 25 bp, Rattus norvegicus
ggtcaaatgttaatgtccttgtgat

SEQ ID NO: 464769 - DNA, 25 bp, Rattus norvegicus
ggtcaaatgttattgtccttgtgat

SEQ ID NO: 464770 - DNA, 25 bp, Rattus norvegicus
ggtcaaatttctatacatgcccagt

SEQ ID NO: 464771 - DNA, 25 bp, Rattus norvegicus
ggtcaaatttctttacatgcccagt

SEQ ID NO: 464772 - DNA, 25 bp, Rattus norvegicus
ggtcaaatttgaactccatgtcgca

SEQ ID NO: 464773 - DNA, 25 bp, Rattus norvegicus
ggtcaaatttgatctccatgtcgca

SEQ ID NO: 464774 - DNA, 25 bp, Rattus norvegicus
ggtcaacaccctccgctaaggaagg

SEQ ID NO: 464775 - DNA, 25 bp, Rattus norvegicus
ggtcaacaccctgcgctaaggaagg

SEQ ID NO: 464776 - DNA, 25 bp, Rattus norvegicus
ggtcaacagaatctcagcaagcccc

SEQ ID NO: 464777 - DNA, 25 bp, Rattus norvegicus
ggtcaacagaatgtcagcaagcccc

SEQ ID NO: 464778 - DNA, 25 bp, Rattus norvegicus
ggtcaacagcgcagagaggcccaag

SEQ ID NO: 464779 - DNA, 25 bp, Rattus norvegicus
ggtcaacagcgctgagaggcccaag

SEQ ID NO: 464780 - DNA, 25 bp, Rattus norvegicus
ggtcaacataataccccaagctttt

SEQ ID NO: 464781 - DNA, 25 bp, Rattus norvegicus
ggtcaacataattccccaagctttt

SEQ ID NO: 464782 - DNA, 25 bp, Rattus norvegicus
ggtcaacatcatcagaaaccacctc

SEQ ID NO: 464783 - DNA, 25 bp, Rattus norvegicus
ggtcaacatcatgagaaaccacctc

SEQ ID NO: 464784 - DNA, 25 bp, Rattus norvegicus
ggtcaaccaatacccttacatataa

SEQ ID NO: 464785 - DNA, 25 bp, Rattus norvegicus
ggtcaaccaatagccttacatataa

SEQ ID NO: 464786 - DNA, 25 bp, Rattus norvegicus
ggtcaaccagacaagcgcaggcagt

SEQ ID NO: 464787 - DNA, 25 bp, Rattus norvegicus
ggtcaaccagactagcgcaggcagt

SEQ ID NO: 464788 - DNA, 25 bp, Rattus norvegicus
ggtcaaccaggcagaagcaacatgt

SEQ ID NO: 464789 - DNA, 25 bp, Rattus norvegicus
ggtcaaccaggctgaagcaacatgt

SEQ ID NO: 464790 - DNA, 25 bp, Rattus norvegicus
ggtcaaccagttcagccagtgtttg

SEQ ID NO: 464791 - DNA, 25 bp, Rattus norvegicus
ggtcaaccagttgagccagtgtttg

SEQ ID NO: 464792 - DNA, 25 bp, Rattus norvegicus
ggtcaacccagtacctgtaggacta

SEQ ID NO: 464793 - DNA, 25 bp, Rattus norvegicus
ggtcaacccagttcctgtaggacta

SEQ ID NO: 464794 - DNA, 25 bp, Rattus norvegicus
ggtcaacccgcacccatgaaaataa

SEQ ID NO: 464795 - DNA, 25 bp, Rattus norvegicus
ggtcaacccgcagccatgaaaataa

SEQ ID NO: 464796 - DNA, 25 bp, Rattus norvegicus
ggtcaacctccaagtactaagatgt

SEQ ID NO: 464797 - DNA, 25 bp, Rattus norvegicus
ggtcaacctccatgtactaagatgt

SEQ ID NO: 464798 - DNA, 25 bp, Rattus norvegicus
ggtcaacctctaagacaggcactgt

SEQ ID NO: 464799 - DNA, 25 bp, Rattus norvegicus
ggtcaacctctatgacaggcactgt

SEQ ID NO: 464800 - DNA, 25 bp, Rattus norvegicus
ggtcaactaattacctctgggtcat

SEQ ID NO: 464801 - DNA, 25 bp, Rattus norvegicus
ggtcaactaattctgcagtctgcag

SEQ ID NO: 464802 - DNA, 25 bp, Rattus norvegicus
ggtcaactaattgtgcagtctgcag

SEQ ID NO: 464803 - DNA, 25 bp, Rattus norvegicus
ggtcaactaatttcctctgggtcat

SEQ ID NO: 464804 - DNA, 25 bp, Rattus norvegicus
ggtcaactacaactggatcctcaat

SEQ ID NO: 464805 - DNA, 25 bp, Rattus norvegicus
ggtcaactacaagtggatcctcaat

SEQ ID NO: 464806 - DNA, 25 bp, Rattus norvegicus
ggtcaactatgtccagcagatcctg

SEQ ID NO: 464807 - DNA, 25 bp, Rattus norvegicus
ggtcaactatgtgcagcagatcctg

SEQ ID NO: 464808 - DNA, 25 bp, Rattus norvegicus
ggtcaactatttacaggtaatgcca

SEQ ID NO: 464809 - DNA, 25 bp, Rattus norvegicus
ggtcaactattttcaggtaatgcca

SEQ ID NO: 464810 - DNA, 25 bp, Rattus norvegicus
ggtcaactgaggaatctgccccact

SEQ ID NO: 464811 - DNA, 25 bp, Rattus norvegicus
ggtcaactgaggtatctgccccact

SEQ ID NO: 464812 - DNA, 25 bp, Rattus norvegicus
ggtcaactgttcctcttgtttgtgg

SEQ ID NO: 464813 - DNA, 25 bp, Rattus norvegicus
ggtcaactgttcgtcttgtttgtgg

SEQ ID NO: 464814 - DNA, 25 bp, Rattus norvegicus
ggtcaacttggactcactagtcaag

SEQ ID NO: 464815 - DNA, 25 bp, Rattus norvegicus
ggtcaacttggagtcactagtcaag

SEQ ID NO: 464816 - DNA, 25 bp, Rattus norvegicus
ggtcaacttgttacttctatttgta

SEQ ID NO: 464817 - DNA, 25 bp, Rattus norvegicus
ggtcaacttgtttcttctatttgta

SEQ ID NO: 464818 - DNA, 25 bp, Rattus norvegicus
ggtcaactttagagagatcccttca

SEQ ID NO: 464819 - DNA, 25 bp, Rattus norvegicus
ggtcaactttagtgagatcccttca

SEQ ID NO: 464820 - DNA, 25 bp, Rattus norvegicus
ggtcaagaccttaagccggcgatat

SEQ ID NO: 464821 - DNA, 25 bp, Rattus norvegicus
ggtcaagacctttagccggcgatat

SEQ ID NO: 464822 - DNA, 25 bp, Rattus norvegicus
ggtcaagagcggcagcacttcctaa

SEQ ID NO: 464823 - DNA, 25 bp, Rattus norvegicus
ggtcaagagcgggagcacttcctaa

SEQ ID NO: 464824 - DNA, 25 bp, Rattus norvegicus
ggtcaagagtttatccctgggtaca

SEQ ID NO: 464825 - DNA, 25 bp, Rattus norvegicus
ggtcaagagtttttccctgggtaca

SEQ ID NO: 464826 - DNA, 25 bp, Rattus norvegicus
ggtcaagatccacacacaggcatag

SEQ ID NO: 464827 - DNA, 25 bp, Rattus norvegicus
ggtcaagatccagacacaggcatag

SEQ ID NO: 464828 - DNA, 25 bp, Rattus norvegicus
ggtcaagcaagtacacgatcccagg

SEQ ID NO: 464829 - DNA, 25 bp, Rattus norvegicus
ggtcaagcaagttcacgatcccagg

SEQ ID NO: 464830 - DNA, 25 bp, Rattus norvegicus
ggtcaagcactgcaatggccaccac

SEQ ID NO: 464831 - DNA, 25 bp, Rattus norvegicus
ggtcaagcactggaatggccaccac

SEQ ID NO: 464832 - DNA, 25 bp, Rattus norvegicus
ggtcaagcattgatataccttcaga

SEQ ID NO: 464833 - DNA, 25 bp, Rattus norvegicus
ggtcaagcattgttataccttcaga

SEQ ID NO: 464834 - DNA, 25 bp, Rattus norvegicus
ggtcaagccattattctaccatttg

SEQ ID NO: 464835 - DNA, 25 bp, Rattus norvegicus
ggtcaagccatttttctaccatttg

SEQ ID NO: 464836 - DNA, 25 bp, Rattus norvegicus
ggtcaagccctcaggacagtttcag

SEQ ID NO: 464837 - DNA, 25 bp, Rattus norvegicus
ggtcaagccctctggacagtttcag

SEQ ID NO: 464838 - DNA, 25 bp, Rattus norvegicus
ggtcaagcctttatgcaggagaaaa

SEQ ID NO: 464839 - DNA, 25 bp, Rattus norvegicus
ggtcaagcctttttgcaggagaaaa

SEQ ID NO: 464840 - DNA, 25 bp, Rattus norvegicus
ggtcaagctcctaaactgatactgt

SEQ ID NO: 464841 - DNA, 25 bp, Rattus norvegicus
ggtcaagctccttaactgatactgt

SEQ ID NO: 464842 - DNA, 25 bp, Rattus norvegicus
ggtcaagctctcaagaagtgcccag

SEQ ID NO: 464843 - DNA, 25 bp, Rattus norvegicus
ggtcaagctctctagaagtgcccag

SEQ ID NO: 464844 - DNA, 25 bp, Rattus norvegicus
ggtcaagctgtcaaggtcatcttgg

SEQ ID NO: 464845 - DNA, 25 bp, Rattus norvegicus
ggtcaagctgtctaggtcatcttgg

SEQ ID NO: 464846 - DNA, 25 bp, Rattus norvegicus
ggtcaaggactgaatattatccaaa

SEQ ID NO: 464847 - DNA, 25 bp, Rattus norvegicus
ggtcaaggactgtatattatccaaa

SEQ ID NO: 464848 - DNA, 25 bp, Rattus norvegicus
ggtcaaggagctaggccacagcact

SEQ ID NO: 464849 - DNA, 25 bp, Rattus norvegicus
ggtcaaggagcttggccacagcact

SEQ ID NO: 464850 - DNA, 25 bp, Rattus norvegicus
ggtcaaggccaacctcatacggagg

SEQ ID NO: 464851 - DNA, 25 bp, Rattus norvegicus
ggtcaaggccaagctcatacggagg

SEQ ID NO: 464852 - DNA, 25 bp, Rattus norvegicus
ggtcaaggcgtaagcccaggcggcg

SEQ ID NO: 464853 - DNA, 25 bp, Rattus norvegicus
ggtcaaggcgtatgcccaggcggcg

SEQ ID NO: 464854 - DNA, 25 bp, Rattus norvegicus
ggtcaaggctcacggcaagaaggtt

SEQ ID NO: 464855 - DNA, 25 bp, Rattus norvegicus
ggtcaaggctcagggcaagaaggtt

SEQ ID NO: 464856 - DNA, 25 bp, Rattus norvegicus
ggtcaaggctggagacttactaaca

SEQ ID NO: 464857 - DNA, 25 bp, Rattus norvegicus
ggtcaaggctggtgacttactaaca

SEQ ID NO: 464858 - DNA, 25 bp, Rattus norvegicus
ggtcaaggtcagcactggtcaccat

SEQ ID NO: 464859 - DNA, 25 bp, Rattus norvegicus
ggtcaaggtcaggactggtcaccat

SEQ ID NO: 464860 - DNA, 25 bp, Rattus norvegicus
ggtcaaggtcttagcttaagcctaa

SEQ ID NO: 464861 - DNA, 25 bp, Rattus norvegicus
ggtcaaggtctttgcttaagcctaa

SEQ ID NO: 464862 - DNA, 25 bp, Rattus norvegicus
ggtcaaggttgtacctacatgtctt

SEQ ID NO: 464863 - DNA, 25 bp, Rattus norvegicus
ggtcaaggttgttcctacatgtctt

SEQ ID NO: 464864 - DNA, 25 bp, Rattus norvegicus
ggtcaagtacccaggaatcacgtaa

SEQ ID NO: 464865 - DNA, 25 bp, Rattus norvegicus
ggtcaagtaccctggaatcacgtaa

SEQ ID NO: 464866 - DNA, 25 bp, Rattus norvegicus
ggtcaagtcaacacttagttcggtt

SEQ ID NO: 464867 - DNA, 25 bp, Rattus norvegicus
ggtcaagtcaactcttagttcggtt

SEQ ID NO: 464868 - DNA, 25 bp, Rattus norvegicus
ggtcaagtcttacgaaccctcacac

SEQ ID NO: 464869 - DNA, 25 bp, Rattus norvegicus
ggtcaagtcttacgaagcccaggat

SEQ ID NO: 464870 - DNA, 25 bp, Rattus norvegicus
ggtcaagtcttaggaaccctcacac

SEQ ID NO: 464871 - DNA, 25 bp, Rattus norvegicus
ggtcaagtcttaggaagcccaggat

SEQ ID NO: 464872 - DNA, 25 bp, Rattus norvegicus
ggtcaagtcttgatcaacatgctca

SEQ ID NO: 464873 - DNA, 25 bp, Rattus norvegicus
ggtcaagtcttgttcaacatgctca

SEQ ID NO: 464874 - DNA, 25 bp, Rattus norvegicus
ggtcaagttcagatagccagtgctc

SEQ ID NO: 464875 - DNA, 25 bp, Rattus norvegicus
ggtcaagttcagttagccagtgctc

SEQ ID NO: 464876 - DNA, 25 bp, Rattus norvegicus
ggtcaagttttaacccttctggcag

SEQ ID NO: 464877 - DNA, 25 bp, Rattus norvegicus
ggtcaagttttatcccttctggcag

SEQ ID NO: 464878 - DNA, 25 bp, Rattus norvegicus
ggtcaataaactatcctgatcttaa

SEQ ID NO: 464879 - DNA, 25 bp, Rattus norvegicus
ggtcaataaactttcctgatcttaa

SEQ ID NO: 464880 - DNA, 25 bp, Rattus norvegicus
ggtcaataaagcacacctgtgtcct

SEQ ID NO: 464881 - DNA, 25 bp, Rattus norvegicus
ggtcaataaagctcacctgtgtcct

SEQ ID NO: 464882 - DNA, 25 bp, Rattus norvegicus
ggtcaataaagtagcccagccacaa

SEQ ID NO: 464883 - DNA, 25 bp, Rattus norvegicus
ggtcaataaagttgcccagccacaa

SEQ ID NO: 464884 - DNA, 25 bp, Rattus norvegicus
ggtcaataacaccatctttgcgtcg

SEQ ID NO: 464885 - DNA, 25 bp, Rattus norvegicus
ggtcaataacacgatctttgcgtcg

SEQ ID NO: 464886 - DNA, 25 bp, Rattus norvegicus
ggtcaatatcatcttcccggagaag

SEQ ID NO: 464887 - DNA, 25 bp, Rattus norvegicus
ggtcaatatcatgttcccggagaag

SEQ ID NO: 464888 - DNA, 25 bp, Rattus norvegicus
ggtcaatcaagtctgtctgtctttc

SEQ ID NO: 464889 - DNA, 25 bp, Rattus norvegicus
ggtcaatcaagtgtgtctgtctttc

SEQ ID NO: 464890 - DNA, 25 bp, Rattus norvegicus
ggtcaatctcctacaggcggtggcc

SEQ ID NO: 464891 - DNA, 25 bp, Rattus norvegicus
ggtcaatctccttcaggcggtggcc

SEQ ID NO: 464892 - DNA, 25 bp, Rattus norvegicus
ggtcaatgacacagactccgggagt

SEQ ID NO: 464893 - DNA, 25 bp, Rattus norvegicus
ggtcaatgacactgactccgggagt

SEQ ID NO: 464894 - DNA, 25 bp, Rattus norvegicus
ggtcaatggcccaggcttggccctt

SEQ ID NO: 464895 - DNA, 25 bp, Rattus norvegicus
ggtcaatggccctggcttggccctt

SEQ ID NO: 464896 - DNA, 25 bp, Rattus norvegicus
ggtcaatggcttagctatcaccttg

SEQ ID NO: 464897 - DNA, 25 bp, Rattus norvegicus
ggtcaatggctttgctatcaccttg

SEQ ID NO: 464898 - DNA, 25 bp, Rattus norvegicus
ggtcaattattccagcaatccacaa

SEQ ID NO: 464899 - DNA, 25 bp, Rattus norvegicus
ggtcaattattcgagcaatccacaa

SEQ ID NO: 464900 - DNA, 25 bp, Rattus norvegicus
ggtcaattctctattcagttttcca

SEQ ID NO: 464901 - DNA, 25 bp, Rattus norvegicus
ggtcaattctcttttcagttttcca

SEQ ID NO: 464902 - DNA, 25 bp, Rattus norvegicus
ggtcaatttactactgccttttgct

SEQ ID NO: 464903 - DNA, 25 bp, Rattus norvegicus
ggtcaatttacttctgccttttgct

SEQ ID NO: 464904 - DNA, 25 bp, Rattus norvegicus
ggtcacaaacttcccgttggacgct

SEQ ID NO: 464905 - DNA, 25 bp, Rattus norvegicus
ggtcacaaacttgccgttggacgct

SEQ ID NO: 464906 - DNA, 25 bp, Rattus norvegicus
ggtcacaaagatatgcttaagctat

SEQ ID NO: 464907 - DNA, 25 bp, Rattus norvegicus
ggtcacaaagatttgcttaagctat

SEQ ID NO: 464908 - DNA, 25 bp, Rattus norvegicus
ggtcacaacacgacattgatgaagt

SEQ ID NO: 464909 - DNA, 25 bp, Rattus norvegicus
ggtcacaacacgtcattgatgaagt

SEQ ID NO: 464910 - DNA, 25 bp, Rattus norvegicus
ggtcacaacttacctatctttgcaa

SEQ ID NO: 464911 - DNA, 25 bp, Rattus norvegicus
ggtcacaacttagctatctttgcaa

SEQ ID NO: 464912 - DNA, 25 bp, Rattus norvegicus
ggtcacaacttcaacagctgggcgg

SEQ ID NO: 464913 - DNA, 25 bp, Rattus norvegicus
ggtcacaacttctacagctgggcgg

SEQ ID NO: 464914 - DNA, 25 bp, Rattus norvegicus
ggtcacaaggacattagtgccctct

SEQ ID NO: 464915 - DNA, 25 bp, Rattus norvegicus
ggtcacaaggactttagtgccctct

SEQ ID NO: 464916 - DNA, 25 bp, Rattus norvegicus
ggtcacaagtacaccagtgagcagt

SEQ ID NO: 464917 - DNA, 25 bp, Rattus norvegicus
ggtcacaagtactccagtgagcagt

SEQ ID NO: 464918 - DNA, 25 bp, Rattus norvegicus
ggtcacaatgatcgcttcctacatg

SEQ ID NO: 464919 - DNA, 25 bp, Rattus norvegicus
ggtcacaatgatggcttcctacatg

SEQ ID NO: 464920 - DNA, 25 bp, Rattus norvegicus
ggtcacacagtgctaccgagacatg

SEQ ID NO: 464921 - DNA, 25 bp, Rattus norvegicus
ggtcacacagtggtaccgagacatg

SEQ ID NO: 464922 - DNA, 25 bp, Rattus norvegicus
ggtcacacataaactgcaatcctct

SEQ ID NO: 464923 - DNA, 25 bp, Rattus norvegicus
ggtcacacataatctgcaatcctct

SEQ ID NO: 464924 - DNA, 25 bp, Rattus norvegicus
ggtcacacgtggattgggcttccga

SEQ ID NO: 464925 - DNA, 25 bp, Rattus norvegicus
ggtcacacgtggtttgggcttccga

SEQ ID NO: 464926 - DNA, 25 bp, Rattus norvegicus
ggtcacactaggagtcacacagact

SEQ ID NO: 464927 - DNA, 25 bp, Rattus norvegicus
ggtcacactaggtgtcacacagact

SEQ ID NO: 464928 - DNA, 25 bp, Rattus norvegicus
ggtcacactgtacaaactggtattt

SEQ ID NO: 464929 - DNA, 25 bp, Rattus norvegicus
ggtcacactgtagaaactggtattt

SEQ ID NO: 464930 - DNA, 25 bp, Rattus norvegicus
ggtcacagaaagcttcctgctctca

SEQ ID NO: 464931 - DNA, 25 bp, Rattus norvegicus
ggtcacagaaaggttcctgctctca

SEQ ID NO: 464932 - DNA, 25 bp, Rattus norvegicus
ggtcacagacgaacctgagagaatc

SEQ ID NO: 464933 - DNA, 25 bp, Rattus norvegicus
ggtcacagacgatcctgagagaatc

SEQ ID NO: 464934 - DNA, 25 bp, Rattus norvegicus
ggtcacagagtcctttagaaatcct

SEQ ID NO: 464935 - DNA, 25 bp, Rattus norvegicus
ggtcacagagtcgtttagaaatcct

SEQ ID NO: 464936 - DNA, 25 bp, Rattus norvegicus
ggtcacagatgcaagaacggcctct

SEQ ID NO: 464937 - DNA, 25 bp, Rattus norvegicus
ggtcacagatgctagaacggcctct

SEQ ID NO: 464938 - DNA, 25 bp, Rattus norvegicus
ggtcacagcaacacaaggcttctca

SEQ ID NO: 464939 - DNA, 25 bp, Rattus norvegicus
ggtcacagcaactcaaggcttctca

SEQ ID NO: 464940 - DNA, 25 bp, Rattus norvegicus
ggtcacagcgctataagaacagaat

SEQ ID NO: 464941 - DNA, 25 bp, Rattus norvegicus
ggtcacagcgctttaagaacagaat

SEQ ID NO: 464942 - DNA, 25 bp, Rattus norvegicus
ggtcacaggacacaaggtagatctt

SEQ ID NO: 464943 - DNA, 25 bp, Rattus norvegicus
ggtcacaggacagaaggtagatctt

SEQ ID NO: 464944 - DNA, 25 bp, Rattus norvegicus
ggtcacaggcacaagttgcatagct

SEQ ID NO: 464945 - DNA, 25 bp, Rattus norvegicus
ggtcacaggcactagttgcatagct

SEQ ID NO: 464946 - DNA, 25 bp, Rattus norvegicus
ggtcacaggcagacaaacacacata

SEQ ID NO: 464947 - DNA, 25 bp, Rattus norvegicus
ggtcacaggcagcactcacacaggt

SEQ ID NO: 464948 - DNA, 25 bp, Rattus norvegicus
ggtcacaggcaggactcacacaggt

SEQ ID NO: 464949 - DNA, 25 bp, Rattus norvegicus
ggtcacaggcagtcaaacacacata

SEQ ID NO: 464950 - DNA, 25 bp, Rattus norvegicus
ggtcacagtcatcactgtacctgag

SEQ ID NO: 464951 - DNA, 25 bp, Rattus norvegicus
ggtcacagtcatgactgtacctgag

SEQ ID NO: 464952 - DNA, 25 bp, Rattus norvegicus
ggtcacagtgccctttatatcttcc

SEQ ID NO: 464953 - DNA, 25 bp, Rattus norvegicus
ggtcacagtgccgtttatatcttcc

SEQ ID NO: 464954 - DNA, 25 bp, Rattus norvegicus
ggtcacagtgtccttcagagaagga

SEQ ID NO: 464955 - DNA, 25 bp, Rattus norvegicus
ggtcacagtgtcgttcagagaagga

SEQ ID NO: 464956 - DNA, 25 bp, Rattus norvegicus
ggtcacatactgaatctgcctaacg

SEQ ID NO: 464957 - DNA, 25 bp, Rattus norvegicus
ggtcacatactgtatctgcctaacg

SEQ ID NO: 464958 - DNA, 25 bp, Rattus norvegicus
ggtcacatagtcaacgccaaggttt

SEQ ID NO: 464959 - DNA, 25 bp, Rattus norvegicus
ggtcacatagtctacgccaaggttt

SEQ ID NO: 464960 - DNA, 25 bp, Rattus norvegicus
ggtcacatatcacatcttctgcaca

SEQ ID NO: 464961 - DNA, 25 bp, Rattus norvegicus
ggtcacatatcagatcttctgcaca

SEQ ID NO: 464962 - DNA, 25 bp, Rattus norvegicus
ggtcacatcgtcagactgtcacatt

SEQ ID NO: 464963 - DNA, 25 bp, Rattus norvegicus
ggtcacatcgtctgactgtcacatt

SEQ ID NO: 464964 - DNA, 25 bp, Rattus norvegicus
ggtcacatgaagatgttagccttaa

SEQ ID NO: 464965 - DNA, 25 bp, Rattus norvegicus
ggtcacatgaagttgttagccttaa

SEQ ID NO: 464966 - DNA, 25 bp, Rattus norvegicus
ggtcacatgacaaaggatgctgcga

SEQ ID NO: 464967 - DNA, 25 bp, Rattus norvegicus
ggtcacatgacataggatgctgcga

SEQ ID NO: 464968 - DNA, 25 bp, Rattus norvegicus
ggtcacatgggcaactttacaatct

SEQ ID NO: 464969 - DNA, 25 bp, Rattus norvegicus
ggtcacatgggctactttacaatct

SEQ ID NO: 464970 - DNA, 25 bp, Rattus norvegicus
ggtcacatgtgtcataagtacccca

SEQ ID NO: 464971 - DNA, 25 bp, Rattus norvegicus
ggtcacatgtgtgataagtacccca

SEQ ID NO: 464972 - DNA, 25 bp, Rattus norvegicus
ggtcacattaagagcacagccgagt

SEQ ID NO: 464973 - DNA, 25 bp, Rattus norvegicus
ggtcacattaagtgcacagccgagt

SEQ ID NO: 464974 - DNA, 25 bp, Rattus norvegicus
ggtcacattttcagagtaccctcag

SEQ ID NO: 464975 - DNA, 25 bp, Rattus norvegicus
ggtcacattttctgagtaccctcag

SEQ ID NO: 464976 - DNA, 25 bp, Rattus norvegicus
ggtcaccaaccaaatgtttctaaat

SEQ ID NO: 464977 - DNA, 25 bp, Rattus norvegicus
ggtcaccaaccatatgtttctaaat

SEQ ID NO: 464978 - DNA, 25 bp, Rattus norvegicus
ggtcaccaagatccctaagatgcta

SEQ ID NO: 464979 - DNA, 25 bp, Rattus norvegicus
ggtcaccaagatgcctaagatgcta

SEQ ID NO: 464980 - DNA, 25 bp, Rattus norvegicus
ggtcaccacatgagggttgcagcat

SEQ ID NO: 464981 - DNA, 25 bp, Rattus norvegicus
ggtcaccacatgtgggttgcagcat

SEQ ID NO: 464982 - DNA, 25 bp, Rattus norvegicus
ggtcaccacgtaactaacgggtatg

SEQ ID NO: 464983 - DNA, 25 bp, Rattus norvegicus
ggtcaccacgtatctaacgggtatg

SEQ ID NO: 464984 - DNA, 25 bp, Rattus norvegicus
ggtcaccactcaatgtggcctcgaa

SEQ ID NO: 464985 - DNA, 25 bp, Rattus norvegicus
ggtcaccactcattgtggcctcgaa

SEQ ID NO: 464986 - DNA, 25 bp, Rattus norvegicus
ggtcaccactccatgcaggtattga

SEQ ID NO: 464987 - DNA, 25 bp, Rattus norvegicus
ggtcaccactccttgcaggtattga

SEQ ID NO: 464988 - DNA, 25 bp, Rattus norvegicus
ggtcaccacttgaagccagataatg

SEQ ID NO: 464989 - DNA, 25 bp, Rattus norvegicus
ggtcaccacttgtagccagataatg

SEQ ID NO: 464990 - DNA, 25 bp, Rattus norvegicus
ggtcaccagtggcaagcgtttgcat

SEQ ID NO: 464991 - DNA, 25 bp, Rattus norvegicus
ggtcaccagtgggaagcgtttgcat

SEQ ID NO: 464992 - DNA, 25 bp, Rattus norvegicus
ggtcaccagtgtccggctgcagcct

SEQ ID NO: 464993 - DNA, 25 bp, Rattus norvegicus
ggtcaccagtgtgcggctgcagcct

SEQ ID NO: 464994 - DNA, 25 bp, Rattus norvegicus
ggtcaccataacattccgtagaggg

SEQ ID NO: 464995 - DNA, 25 bp, Rattus norvegicus
ggtcaccataactttccgtagaggg

SEQ ID NO: 464996 - DNA, 25 bp, Rattus norvegicus
ggtcaccatacaatgtggcctgcta

SEQ ID NO: 464997 - DNA, 25 bp, Rattus norvegicus
ggtcaccatacattgtggcctgcta

SEQ ID NO: 464998 - DNA, 25 bp, Rattus norvegicus
ggtcaccatgaaagtctcaacgttt

SEQ ID NO: 464999 - DNA, 25 bp, Rattus norvegicus
ggtcaccatgaatgtctcaacgttt

SEQ ID NO: 465000 - DNA, 25 bp, Rattus norvegicus
ggtcaccatgttatctcagtaagcc

SEQ ID NO: 465001 - DNA, 25 bp, Rattus norvegicus
ggtcaccatgttttctcagtaagcc

SEQ ID NO: 465002 - DNA, 25 bp, Rattus norvegicus
ggtcacccaacccaaatgatgtacg

SEQ ID NO: 465003 - DNA, 25 bp, Rattus norvegicus
ggtcacccaaccgaaatgatgtacg

SEQ ID NO: 465004 - DNA, 25 bp, Rattus norvegicus
ggtcacccacacagtgcccatctat

SEQ ID NO: 465005 - DNA, 25 bp, Rattus norvegicus
ggtcacccacactgtgcccatctat

SEQ ID NO: 465006 - DNA, 25 bp, Rattus norvegicus
ggtcacccagaaaatccattttcag

SEQ ID NO: 465007 - DNA, 25 bp, Rattus norvegicus
ggtcacccagaatatccattttcag

SEQ ID NO: 465008 - DNA, 25 bp, Rattus norvegicus
ggtcacccagtacagttagccaata

SEQ ID NO: 465009 - DNA, 25 bp, Rattus norvegicus
ggtcacccagtagagttagccaata

SEQ ID NO: 465010 - DNA, 25 bp, Rattus norvegicus
ggtcacccctgaagttttcatagtg

SEQ ID NO: 465011 - DNA, 25 bp, Rattus norvegicus
ggtcacccctgatgttttcatagtg

SEQ ID NO: 465012 - DNA, 25 bp, Rattus norvegicus
ggtcaccctgaaataacctctcaga

SEQ ID NO: 465013 - DNA, 25 bp, Rattus norvegicus
ggtcaccctgaattaacctctcaga

SEQ ID NO: 465014 - DNA, 25 bp, Rattus norvegicus
ggtcaccctgttagactgtacagta

SEQ ID NO: 465015 - DNA, 25 bp, Rattus norvegicus
ggtcaccctgtttgactgtacagta

SEQ ID NO: 465016 - DNA, 25 bp, Rattus norvegicus
ggtcaccgaggaattcaacggcagt

SEQ ID NO: 465017 - DNA, 25 bp, Rattus norvegicus
ggtcaccgaggatttcaacggcagt

SEQ ID NO: 465018 - DNA, 25 bp, Rattus norvegicus
ggtcaccgtctaacaatgactcaga

SEQ ID NO: 465019 - DNA, 25 bp, Rattus norvegicus
ggtcaccgtctatcaatgactcaga

SEQ ID NO: 465020 - DNA, 25 bp, Rattus norvegicus
ggtcacctaaccagatctgtggcac

SEQ ID NO: 465021 - DNA, 25 bp, Rattus norvegicus
ggtcacctaacctgatctgtggcac

SEQ ID NO: 465022 - DNA, 25 bp, Rattus norvegicus
ggtcacctagaacatgcatcccttt

SEQ ID NO: 465023 - DNA, 25 bp, Rattus norvegicus
ggtcacctagaagatgcatcccttt

SEQ ID NO: 465024 - DNA, 25 bp, Rattus norvegicus
ggtcacctcaataaactctgtgcct

SEQ ID NO: 465025 - DNA, 25 bp, Rattus norvegicus
ggtcacctcaattaactctgtgcct

SEQ ID NO: 465026 - DNA, 25 bp, Rattus norvegicus
ggtcacctccgacggattgtgtcat

SEQ ID NO: 465027 - DNA, 25 bp, Rattus norvegicus
ggtcacctccgagggattgtgtcat

SEQ ID NO: 465028 - DNA, 25 bp, Rattus norvegicus
ggtcacctgcctaagtggtaggaca

SEQ ID NO: 465029 - DNA, 25 bp, Rattus norvegicus
ggtcacctgccttagtggtaggaca

SEQ ID NO: 465030 - DNA, 25 bp, Rattus norvegicus
ggtcacctgcttctggacgctgtga

SEQ ID NO: 465031 - DNA, 25 bp, Rattus norvegicus
ggtcacctgcttgtggacgctgtga

SEQ ID NO: 465032 - DNA, 25 bp, Rattus norvegicus
ggtcacctgggacatgaacctctga

SEQ ID NO: 465033 - DNA, 25 bp, Rattus norvegicus
ggtcacctgggagatgaacctctga

SEQ ID NO: 465034 - DNA, 25 bp, Rattus norvegicus
ggtcaccttctcattgttgtgttaa

SEQ ID NO: 465035 - DNA, 25 bp, Rattus norvegicus
ggtcaccttctctttgttgtgttaa

SEQ ID NO: 465036 - DNA, 25 bp, Rattus norvegicus
ggtcacgatgcactactctgtgaga

SEQ ID NO: 465037 - DNA, 25 bp, Rattus norvegicus
ggtcacgatgcagtactctgtgaga

SEQ ID NO: 465038 - DNA, 25 bp, Rattus norvegicus
ggtcacgatggccatattttcaatg

SEQ ID NO: 465039 - DNA, 25 bp, Rattus norvegicus
ggtcacgatggcgatattttcaatg

SEQ ID NO: 465040 - DNA, 25 bp, Rattus norvegicus
ggtcacgccaaactgctgtttctat

SEQ ID NO: 465041 - DNA, 25 bp, Rattus norvegicus
ggtcacgccaaagtgctgtttctat

SEQ ID NO: 465042 - DNA, 25 bp, Rattus norvegicus
ggtcacggagcaaactgaggaactt

SEQ ID NO: 465043 - DNA, 25 bp, Rattus norvegicus
ggtcacggagcatactgaggaactt

SEQ ID NO: 465044 - DNA, 25 bp, Rattus norvegicus
ggtcacggtgtcatatcacagcagt

SEQ ID NO: 465045 - DNA, 25 bp, Rattus norvegicus
ggtcacggtgtcttatcacagcagt

SEQ ID NO: 465046 - DNA, 25 bp, Rattus norvegicus
ggtcacgtgaccaagccattagatg

SEQ ID NO: 465047 - DNA, 25 bp, Rattus norvegicus
ggtcacgtgacctagccattagatg

SEQ ID NO: 465048 - DNA, 25 bp, Rattus norvegicus
ggtcacgtgagaagcttccagcagc

SEQ ID NO: 465049 - DNA, 25 bp, Rattus norvegicus
ggtcacgtgagatgcttccagcagc

SEQ ID NO: 465050 - DNA, 25 bp, Rattus norvegicus
ggtcacgtgtacagtcctggaggac

SEQ ID NO: 465051 - DNA, 25 bp, Rattus norvegicus
ggtcacgtgtactgtcctggaggac

SEQ ID NO: 465052 - DNA, 25 bp, Rattus norvegicus
ggtcacgtgtagcttttggtctgaa

SEQ ID NO: 465053 - DNA, 25 bp, Rattus norvegicus
ggtcacgtgtaggttttggtctgaa

SEQ ID NO: 465054 - DNA, 25 bp, Rattus norvegicus
ggtcacgtgtgtattctttttgttg

SEQ ID NO: 465055 - DNA, 25 bp, Rattus norvegicus
ggtcacgtgtgttttctttttgttg

SEQ ID NO: 465056 - DNA, 25 bp, Rattus norvegicus
ggtcacgtttatagcacagatcccg

SEQ ID NO: 465057 - DNA, 25 bp, Rattus norvegicus
ggtcacgtttattgcacagatcccg

SEQ ID NO: 465058 - DNA, 25 bp, Rattus norvegicus
ggtcactaacagctcacttttattt

SEQ ID NO: 465059 - DNA, 25 bp, Rattus norvegicus
ggtcactaacagcttgtgtttatag

SEQ ID NO: 465060 - DNA, 25 bp, Rattus norvegicus
ggtcactaacaggtcacttttattt

SEQ ID NO: 465061 - DNA, 25 bp, Rattus norvegicus
ggtcactaacaggttgtgtttatag

SEQ ID NO: 465062 - DNA, 25 bp, Rattus norvegicus
ggtcactacagtatacaaacccagg

SEQ ID NO: 465063 - DNA, 25 bp, Rattus norvegicus
ggtcactacagtttacaaacccagg

SEQ ID NO: 465064 - DNA, 25 bp, Rattus norvegicus
ggtcactagactcacctgcaaggaa

SEQ ID NO: 465065 - DNA, 25 bp, Rattus norvegicus
ggtcactagactgacctgcaaggaa

SEQ ID NO: 465066 - DNA, 25 bp, Rattus norvegicus
ggtcactagcccaaccagcgatgag

SEQ ID NO: 465067 - DNA, 25 bp, Rattus norvegicus
ggtcactagccctaccagcgatgag

SEQ ID NO: 465068 - DNA, 25 bp, Rattus norvegicus
ggtcactatcctccaactctaggaa

SEQ ID NO: 465069 - DNA, 25 bp, Rattus norvegicus
ggtcactatcctgcaactctaggaa

SEQ ID NO: 465070 - DNA, 25 bp, Rattus norvegicus
ggtcactatgacactgcagttgctt

SEQ ID NO: 465071 - DNA, 25 bp, Rattus norvegicus
ggtcactatgactctgcagttgctt

SEQ ID NO: 465072 - DNA, 25 bp, Rattus norvegicus
ggtcactatgagctctactcggcaa

SEQ ID NO: 465073 - DNA, 25 bp, Rattus norvegicus
ggtcactatgaggtctactcggcaa

SEQ ID NO: 465074 - DNA, 25 bp, Rattus norvegicus
ggtcactcaagacagccgctcagcg

SEQ ID NO: 465075 - DNA, 25 bp, Rattus norvegicus
ggtcactcaagagagccgctcagcg

SEQ ID NO: 465076 - DNA, 25 bp, Rattus norvegicus
ggtcactcacatattagtgcagaat

SEQ ID NO: 465077 - DNA, 25 bp, Rattus norvegicus
ggtcactcacattttagtgcagaat

SEQ ID NO: 465078 - DNA, 25 bp, Rattus norvegicus
ggtcactcactgctcaagaatagat

SEQ ID NO: 465079 - DNA, 25 bp, Rattus norvegicus
ggtcactcactggtcaagaatagat

SEQ ID NO: 465080 - DNA, 25 bp, Rattus norvegicus
ggtcactcagcaattcatgcttcta

SEQ ID NO: 465081 - DNA, 25 bp, Rattus norvegicus
ggtcactcagcaccatgttgagcaa

SEQ ID NO: 465082 - DNA, 25 bp, Rattus norvegicus
ggtcactcagcagcatgttgagcaa

SEQ ID NO: 465083 - DNA, 25 bp, Rattus norvegicus
ggtcactcagcatttcatgcttcta

SEQ ID NO: 465084 - DNA, 25 bp, Rattus norvegicus
ggtcactcagcgatcaaccccatgt

SEQ ID NO: 465085 - DNA, 25 bp, Rattus norvegicus
ggtcactcagcgttcaaccccatgt

SEQ ID NO: 465086 - DNA, 25 bp, Rattus norvegicus
ggtcactcataaagtcaaagccctt

SEQ ID NO: 465087 - DNA, 25 bp, Rattus norvegicus
ggtcactcataatgtcaaagccctt

SEQ ID NO: 465088 - DNA, 25 bp, Rattus norvegicus
ggtcactccagcagttgaatttata

SEQ ID NO: 465089 - DNA, 25 bp, Rattus norvegicus
ggtcactccagctgttgaatttata

SEQ ID NO: 465090 - DNA, 25 bp, Rattus norvegicus
ggtcactccgaaactctatggacaa

SEQ ID NO: 465091 - DNA, 25 bp, Rattus norvegicus
ggtcactccgaatctctatggacaa

SEQ ID NO: 465092 - DNA, 25 bp, Rattus norvegicus
ggtcactcctagatttcatgtacat

SEQ ID NO: 465093 - DNA, 25 bp, Rattus norvegicus
ggtcactcctagttttcatgtacat

SEQ ID NO: 465094 - DNA, 25 bp, Rattus norvegicus
ggtcactcctttactgtgggttata

SEQ ID NO: 465095 - DNA, 25 bp, Rattus norvegicus
ggtcactccttttctgtgggttata

SEQ ID NO: 465096 - DNA, 25 bp, Rattus norvegicus
ggtcactcgcaacgatatcccaggg

SEQ ID NO: 465097 - DNA, 25 bp, Rattus norvegicus
ggtcactcgcaaggatatcccaggg

SEQ ID NO: 465098 - DNA, 25 bp, Rattus norvegicus
ggtcactctaataaagcctctttgg

SEQ ID NO: 465099 - DNA, 25 bp, Rattus norvegicus
ggtcactctaattaagcctctttgg

SEQ ID NO: 465100 - DNA, 25 bp, Rattus norvegicus
ggtcactctagcaacattacatgat

SEQ ID NO: 465101 - DNA, 25 bp, Rattus norvegicus
ggtcactctagctacattacatgat

SEQ ID NO: 465102 - DNA, 25 bp, Rattus norvegicus
ggtcactctgtacccacacggagaa

SEQ ID NO: 465103 - DNA, 25 bp, Rattus norvegicus
ggtcactctgtagccacacggagaa

SEQ ID NO: 465104 - DNA, 25 bp, Rattus norvegicus
ggtcactgaaccaacaaaggcccct

SEQ ID NO: 465105 - DNA, 25 bp, Rattus norvegicus
ggtcactgaacctacaaaggcccct

SEQ ID NO: 465106 - DNA, 25 bp, Rattus norvegicus
ggtcactgaagacttctgctctttt

SEQ ID NO: 465107 - DNA, 25 bp, Rattus norvegicus
ggtcactgaagagttctgctctttt

SEQ ID NO: 465108 - DNA, 25 bp, Rattus norvegicus
ggtcactgagcaactggttgatctg

SEQ ID NO: 465109 - DNA, 25 bp, Rattus norvegicus
ggtcactgagcatctggttgatctg

SEQ ID NO: 465110 - DNA, 25 bp, Rattus norvegicus
ggtcactgcactcaaattccaatgt

SEQ ID NO: 465111 - DNA, 25 bp, Rattus norvegicus
ggtcactgcactgaaattccaatgt

SEQ ID NO: 465112 - DNA, 25 bp, Rattus norvegicus
ggtcactgctacataaggtcctagg

SEQ ID NO: 465113 - DNA, 25 bp, Rattus norvegicus
ggtcactgctacttaaggtcctagg

SEQ ID NO: 465114 - DNA, 25 bp, Rattus norvegicus
ggtcactgctggataaagcggccgc

SEQ ID NO: 465115 - DNA, 25 bp, Rattus norvegicus
ggtcactgctggttaaagcggccgc

SEQ ID NO: 465116 - DNA, 25 bp, Rattus norvegicus
ggtcactgggaaaaatttagctttg

SEQ ID NO: 465117 - DNA, 25 bp, Rattus norvegicus
ggtcactgggaataatttagctttg

SEQ ID NO: 465118 - DNA, 25 bp, Rattus norvegicus
ggtcactggtgcagatttccctttc

SEQ ID NO: 465119 - DNA, 25 bp, Rattus norvegicus
ggtcactggtgctgatttccctttc

SEQ ID NO: 465120 - DNA, 25 bp, Rattus norvegicus
ggtcactgtaacagactgccacata

SEQ ID NO: 465121 - DNA, 25 bp, Rattus norvegicus
ggtcactgtaactgactgccacata

SEQ ID NO: 465122 - DNA, 25 bp, Rattus norvegicus
ggtcactgtagactctgtgcagaca

SEQ ID NO: 465123 - DNA, 25 bp, Rattus norvegicus
ggtcactgtagagtctgtgcagaca

SEQ ID NO: 465124 - DNA, 25 bp, Rattus norvegicus
ggtcactgtctaaacttaccaacaa

SEQ ID NO: 465125 - DNA, 25 bp, Rattus norvegicus
ggtcactgtctatacttaccaacaa

SEQ ID NO: 465126 - DNA, 25 bp, Rattus norvegicus
ggtcactgtgacacttctacacaaa

SEQ ID NO: 465127 - DNA, 25 bp, Rattus norvegicus
ggtcactgtgactcttctacacaaa

SEQ ID NO: 465128 - DNA, 25 bp, Rattus norvegicus
ggtcactgtgatatctgttttgtct

SEQ ID NO: 465129 - DNA, 25 bp, Rattus norvegicus
ggtcactgtgatttctgttttgtct

SEQ ID NO: 465130 - DNA, 25 bp, Rattus norvegicus
ggtcactgttgccacactcctttgt

SEQ ID NO: 465131 - DNA, 25 bp, Rattus norvegicus
ggtcactgttgcgacactcctttgt

SEQ ID NO: 465132 - DNA, 25 bp, Rattus norvegicus
ggtcacttaatcaaacagtccactt

SEQ ID NO: 465133 - DNA, 25 bp, Rattus norvegicus
ggtcacttaatctaacagtccactt

SEQ ID NO: 465134 - DNA, 25 bp, Rattus norvegicus
ggtcacttacatacaaatgcttatt

SEQ ID NO: 465135 - DNA, 25 bp, Rattus norvegicus
ggtcacttacattcaaatgcttatt

SEQ ID NO: 465136 - DNA, 25 bp, Rattus norvegicus
ggtcacttcaaaccaaagcaaccgt

SEQ ID NO: 465137 - DNA, 25 bp, Rattus norvegicus
ggtcacttcaaagcaaagcaaccgt

SEQ ID NO: 465138 - DNA, 25 bp, Rattus norvegicus
ggtcacttccacatacaaacacgat

SEQ ID NO: 465139 - DNA, 25 bp, Rattus norvegicus
ggtcacttccacttacaaacacgat

SEQ ID NO: 465140 - DNA, 25 bp, Rattus norvegicus
ggtcacttcccgattatagaatagc

SEQ ID NO: 465141 - DNA, 25 bp, Rattus norvegicus
ggtcacttcccgtttatagaatagc

SEQ ID NO: 465142 - DNA, 25 bp, Rattus norvegicus
ggtcacttcgcgattgtactccttg

SEQ ID NO: 465143 - DNA, 25 bp, Rattus norvegicus
ggtcacttcgcgtttgtactccttg

SEQ ID NO: 465144 - DNA, 25 bp, Rattus norvegicus
ggtcacttctaccttggctgtatag

SEQ ID NO: 465145 - DNA, 25 bp, Rattus norvegicus
ggtcacttctacgttggctgtatag

SEQ ID NO: 465146 - DNA, 25 bp, Rattus norvegicus
ggtcacttgcttatgagttctccaa

SEQ ID NO: 465147 - DNA, 25 bp, Rattus norvegicus
ggtcacttgcttttgagttctccaa

SEQ ID NO: 465148 - DNA, 25 bp, Rattus norvegicus
ggtcacttggaaccggagttacatt

SEQ ID NO: 465149 - DNA, 25 bp, Rattus norvegicus
ggtcacttggaagcggagttacatt

SEQ ID NO: 465150 - DNA, 25 bp, Rattus norvegicus
ggtcactttcaaatcctcatcagga

SEQ ID NO: 465151 - DNA, 25 bp, Rattus norvegicus
ggtcactttcaattcctcatcagga

SEQ ID NO: 465152 - DNA, 25 bp, Rattus norvegicus
ggtcactttcagctcaaaaacaggg

SEQ ID NO: 465153 - DNA, 25 bp, Rattus norvegicus
ggtcactttcaggtcaaaaacaggg

SEQ ID NO: 465154 - DNA, 25 bp, Rattus norvegicus
ggtcacttttcaaatccagatccat

SEQ ID NO: 465155 - DNA, 25 bp, Rattus norvegicus
ggtcacttttcatatccagatccat

SEQ ID NO: 465156 - DNA, 25 bp, Rattus norvegicus
ggtcagaaaatccttacagagcaac

SEQ ID NO: 465157 - DNA, 25 bp, Rattus norvegicus
ggtcagaaaatcgttacagagcaac

SEQ ID NO: 465158 - DNA, 25 bp, Rattus norvegicus
ggtcagaacatccagtccaggagta

SEQ ID NO: 465159 - DNA, 25 bp, Rattus norvegicus
ggtcagaacatcgagtccaggagta

SEQ ID NO: 465160 - DNA, 25 bp, Rattus norvegicus
ggtcagaaccatcgctggctgcgct

SEQ ID NO: 465161 - DNA, 25 bp, Rattus norvegicus
ggtcagaaccatggctggctgcgct

SEQ ID NO: 465162 - DNA, 25 bp, Rattus norvegicus
ggtcagaactggagttttctcccct

SEQ ID NO: 465163 - DNA, 25 bp, Rattus norvegicus
ggtcagaactggtgttttctcccct

SEQ ID NO: 465164 - DNA, 25 bp, Rattus norvegicus
ggtcagaacttgctgcaggctacca

SEQ ID NO: 465165 - DNA, 25 bp, Rattus norvegicus
ggtcagaacttggtgcaggctacca

SEQ ID NO: 465166 - DNA, 25 bp, Rattus norvegicus
ggtcagaagtccaagatgttacaca

SEQ ID NO: 465167 - DNA, 25 bp, Rattus norvegicus
ggtcagaagtcctagatgttacaca

SEQ ID NO: 465168 - DNA, 25 bp, Rattus norvegicus
ggtcagaatctgaatttcaagtcgt

SEQ ID NO: 465169 - DNA, 25 bp, Rattus norvegicus
ggtcagaatctgtatttcaagtcgt

SEQ ID NO: 465170 - DNA, 25 bp, Rattus norvegicus
ggtcagaatgaccttaaaaggcatg

SEQ ID NO: 465171 - DNA, 25 bp, Rattus norvegicus
ggtcagaatgacgttaaaaggcatg

SEQ ID NO: 465172 - DNA, 25 bp, Rattus norvegicus
ggtcagaatggacctgccagcaccc

SEQ ID NO: 465173 - DNA, 25 bp, Rattus norvegicus
ggtcagaatggagctgccagcaccc

SEQ ID NO: 465174 - DNA, 25 bp, Rattus norvegicus
ggtcagaatggcatacacactttat

SEQ ID NO: 465175 - DNA, 25 bp, Rattus norvegicus
ggtcagaatggcttacacactttat

SEQ ID NO: 465176 - DNA, 25 bp, Rattus norvegicus
ggtcagaattctcatagttggtttt

SEQ ID NO: 465177 - DNA, 25 bp, Rattus norvegicus
ggtcagaattctgatagttggtttt

SEQ ID NO: 465178 - DNA, 25 bp, Rattus norvegicus
ggtcagaatttcctacatagcaatg

SEQ ID NO: 465179 - DNA, 25 bp, Rattus norvegicus
ggtcagaatttcgtacatagcaatg

SEQ ID NO: 465180 - DNA, 25 bp, Rattus norvegicus
ggtcagacaaaccacttgatactgt

SEQ ID NO: 465181 - DNA, 25 bp, Rattus norvegicus
ggtcagacaaacgacttgatactgt

SEQ ID NO: 465182 - DNA, 25 bp, Rattus norvegicus
ggtcagacacagaggtccaggcagt

SEQ ID NO: 465183 - DNA, 25 bp, Rattus norvegicus
ggtcagacacagtggtccaggcagt

SEQ ID NO: 465184 - DNA, 25 bp, Rattus norvegicus
ggtcagaccttgagtttttggcttt

SEQ ID NO: 465185 - DNA, 25 bp, Rattus norvegicus
ggtcagaccttgtgtttttggcttt

SEQ ID NO: 465186 - DNA, 25 bp, Rattus norvegicus
ggtcagacgaataagtccgccatca

SEQ ID NO: 465187 - DNA, 25 bp, Rattus norvegicus
ggtcagacgaattagtccgccatca

SEQ ID NO: 465188 - DNA, 25 bp, Rattus norvegicus
ggtcagactgaacttgtggagctca

SEQ ID NO: 465189 - DNA, 25 bp, Rattus norvegicus
ggtcagactgaagttgtggagctca

SEQ ID NO: 465190 - DNA, 25 bp, Rattus norvegicus
ggtcagagctcacctgggccagtca

SEQ ID NO: 465191 - DNA, 25 bp, Rattus norvegicus
ggtcagagctcagctgggccagtca

SEQ ID NO: 465192 - DNA, 25 bp, Rattus norvegicus
ggtcagagggtcacttcagatccac

SEQ ID NO: 465193 - DNA, 25 bp, Rattus norvegicus
ggtcagagggtctcttcagatccac

SEQ ID NO: 465194 - DNA, 25 bp, Rattus norvegicus
ggtcagagttcacacttcatcgcaa

SEQ ID NO: 465195 - DNA, 25 bp, Rattus norvegicus
ggtcagagttcagacttcatcgcaa

SEQ ID NO: 465196 - DNA, 25 bp, Rattus norvegicus
ggtcagatacagaagctagtgccaa

SEQ ID NO: 465197 - DNA, 25 bp, Rattus norvegicus
ggtcagatacagtagctagtgccaa

SEQ ID NO: 465198 - DNA, 25 bp, Rattus norvegicus
ggtcagatatgcctggtgcactaca

SEQ ID NO: 465199 - DNA, 25 bp, Rattus norvegicus
ggtcagatatgcgtggtgcactaca

SEQ ID NO: 465200 - DNA, 25 bp, Rattus norvegicus
ggtcagatcaccacaatcagcatca

SEQ ID NO: 465201 - DNA, 25 bp, Rattus norvegicus
ggtcagatcacctcaatcagcatca

SEQ ID NO: 465202 - DNA, 25 bp, Rattus norvegicus
ggtcagatgactccaacattttcct

SEQ ID NO: 465203 - DNA, 25 bp, Rattus norvegicus
ggtcagatgactgcaacattttcct

SEQ ID NO: 465204 - DNA, 25 bp, Rattus norvegicus
ggtcagatgattacactggttgtct

SEQ ID NO: 465205 - DNA, 25 bp, Rattus norvegicus
ggtcagatgatttcactggttgtct

SEQ ID NO: 465206 - DNA, 25 bp, Rattus norvegicus
ggtcagatggtcatagcactggctt

SEQ ID NO: 465207 - DNA, 25 bp, Rattus norvegicus
ggtcagatggtcttagcactggctt

SEQ ID NO: 465208 - DNA, 25 bp, Rattus norvegicus
ggtcagatgtgaaacgtgcgtgtta

SEQ ID NO: 465209 - DNA, 25 bp, Rattus norvegicus
ggtcagatgtgatacgtgcgtgtta

SEQ ID NO: 465210 - DNA, 25 bp, Rattus norvegicus
ggtcagattcacagtctcattcata

SEQ ID NO: 465211 - DNA, 25 bp, Rattus norvegicus
ggtcagattcactgtctcattcata

SEQ ID NO: 465212 - DNA, 25 bp, Rattus norvegicus
ggtcagattccccacgtgtttgttc

SEQ ID NO: 465213 - DNA, 25 bp, Rattus norvegicus
ggtcagattcccgacgtgtttgttc

SEQ ID NO: 465214 - DNA, 25 bp, Rattus norvegicus
ggtcagcaaggcagtcagattttta

SEQ ID NO: 465215 - DNA, 25 bp, Rattus norvegicus
ggtcagcaaggctgtcagattttta

SEQ ID NO: 465216 - DNA, 25 bp, Rattus norvegicus
ggtcagcaatgtattcactttgtca

SEQ ID NO: 465217 - DNA, 25 bp, Rattus norvegicus
ggtcagcaatgttttcactttgtca

SEQ ID NO: 465218 - DNA, 25 bp, Rattus norvegicus
ggtcagcaccgtctacaggacaagt

SEQ ID NO: 465219 - DNA, 25 bp, Rattus norvegicus
ggtcagcaccgtgtacaggacaagt

SEQ ID NO: 465220 - DNA, 25 bp, Rattus norvegicus
ggtcagcagaacacagggtccggca

SEQ ID NO: 465221 - DNA, 25 bp, Rattus norvegicus
ggtcagcagaactcagggtccggca

SEQ ID NO: 465222 - DNA, 25 bp, Rattus norvegicus
ggtcagcagcagcaaactacaggca

SEQ ID NO: 465223 - DNA, 25 bp, Rattus norvegicus
ggtcagcagcaggaaactacaggca

SEQ ID NO: 465224 - DNA, 25 bp, Rattus norvegicus
ggtcagcagcctataggacttctac

SEQ ID NO: 465225 - DNA, 25 bp, Rattus norvegicus
ggtcagcagcctttaggacttctac

SEQ ID NO: 465226 - DNA, 25 bp, Rattus norvegicus
ggtcagcaggcccagactctggctc

SEQ ID NO: 465227 - DNA, 25 bp, Rattus norvegicus
ggtcagcaggccgagactctggctc

SEQ ID NO: 465228 - DNA, 25 bp, Rattus norvegicus
ggtcagcaggtgagattccggaaac

SEQ ID NO: 465229 - DNA, 25 bp, Rattus norvegicus
ggtcagcaggtgtgattccggaaac

SEQ ID NO: 465230 - DNA, 25 bp, Rattus norvegicus
ggtcagcatgacaaccgttgggtat

SEQ ID NO: 465231 - DNA, 25 bp, Rattus norvegicus
ggtcagcatgacatctctaccatta

SEQ ID NO: 465232 - DNA, 25 bp, Rattus norvegicus
ggtcagcatgactaccgttgggtat

SEQ ID NO: 465233 - DNA, 25 bp, Rattus norvegicus
ggtcagcatgacttctctaccatta

SEQ ID NO: 465234 - DNA, 25 bp, Rattus norvegicus
ggtcagcattcaaagtgtagcttaa

SEQ ID NO: 465235 - DNA, 25 bp, Rattus norvegicus
ggtcagcattcatagtgtagcttaa

SEQ ID NO: 465236 - DNA, 25 bp, Rattus norvegicus
ggtcagccacctcggtacacaagaa

SEQ ID NO: 465237 - DNA, 25 bp, Rattus norvegicus
ggtcagccacctgggtacacaagaa

SEQ ID NO: 465238 - DNA, 25 bp, Rattus norvegicus
ggtcagccagataacagtgcagcct

SEQ ID NO: 465239 - DNA, 25 bp, Rattus norvegicus
ggtcagccagattacagtgcagcct

SEQ ID NO: 465240 - DNA, 25 bp, Rattus norvegicus
ggtcagccatgaatctaactgctaa

SEQ ID NO: 465241 - DNA, 25 bp, Rattus norvegicus
ggtcagccatgattctaactgctaa

SEQ ID NO: 465242 - DNA, 25 bp, Rattus norvegicus
ggtcagccgcagaccttgccttggg

SEQ ID NO: 465243 - DNA, 25 bp, Rattus norvegicus
ggtcagccgcagtccttgccttggg

SEQ ID NO: 465244 - DNA, 25 bp, Rattus norvegicus
ggtcagccgcggaatagctgcacaa

SEQ ID NO: 465245 - DNA, 25 bp, Rattus norvegicus
ggtcagccgcggtatagctgcacaa

SEQ ID NO: 465246 - DNA, 25 bp, Rattus norvegicus
ggtcagcctacaacacgttcattaa

SEQ ID NO: 465247 - DNA, 25 bp, Rattus norvegicus
ggtcagcctacatcacgttcattaa

SEQ ID NO: 465248 - DNA, 25 bp, Rattus norvegicus
ggtcagcctgagatacacagtgaaa

SEQ ID NO: 465249 - DNA, 25 bp, Rattus norvegicus
ggtcagcctgagttacacagtgaaa

SEQ ID NO: 465250 - DNA, 25 bp, Rattus norvegicus
ggtcagcctggaaaggtcacttcac

SEQ ID NO: 465251 - DNA, 25 bp, Rattus norvegicus
ggtcagcctggataggtcacttcac

SEQ ID NO: 465252 - DNA, 25 bp, Rattus norvegicus
ggtcagcctggccttgagcatatga

SEQ ID NO: 465253 - DNA, 25 bp, Rattus norvegicus
ggtcagcctggcgttgagcatatga

SEQ ID NO: 465254 - DNA, 25 bp, Rattus norvegicus
ggtcagcctggtatgcatagaaagt

SEQ ID NO: 465255 - DNA, 25 bp, Rattus norvegicus
ggtcagcctggtttgcatagaaagt

SEQ ID NO: 465256 - DNA, 25 bp, Rattus norvegicus
ggtcagccttcaactacaaggtcta

SEQ ID NO: 465257 - DNA, 25 bp, Rattus norvegicus
ggtcagccttcatctacaaggtcta

SEQ ID NO: 465258 - DNA, 25 bp, Rattus norvegicus
ggtcagccttttccaaactggtggg

SEQ ID NO: 465259 - DNA, 25 bp, Rattus norvegicus
ggtcagccttttgcaaactggtggg

SEQ ID NO: 465260 - DNA, 25 bp, Rattus norvegicus
ggtcagcgaattcacctgagctttt

SEQ ID NO: 465261 - DNA, 25 bp, Rattus norvegicus
ggtcagcgaattgacctgagctttt

SEQ ID NO: 465262 - DNA, 25 bp, Rattus norvegicus
ggtcagcgattaccacccaacaatt

SEQ ID NO: 465263 - DNA, 25 bp, Rattus norvegicus
ggtcagcgattagcacccaacaatt

SEQ ID NO: 465264 - DNA, 25 bp, Rattus norvegicus
ggtcagcggacacaacgctcagcta

SEQ ID NO: 465265 - DNA, 25 bp, Rattus norvegicus
ggtcagcggacagaacgctcagcta

SEQ ID NO: 465266 - DNA, 25 bp, Rattus norvegicus
ggtcagcggtacagccatgcagtga

SEQ ID NO: 465267 - DNA, 25 bp, Rattus norvegicus
ggtcagcggtactgccatgcagtga

SEQ ID NO: 465268 - DNA, 25 bp, Rattus norvegicus
ggtcagcgtccacgccacaggaaca

SEQ ID NO: 465269 - DNA, 25 bp, Rattus norvegicus
ggtcagcgtccaggccacaggaaca

SEQ ID NO: 465270 - DNA, 25 bp, Rattus norvegicus
ggtcagctaagtctgtctccagatg

SEQ ID NO: 465271 - DNA, 25 bp, Rattus norvegicus
ggtcagctaagtgtgtctccagatg

SEQ ID NO: 465272 - DNA, 25 bp, Rattus norvegicus
ggtcagctccatactctctccagag

SEQ ID NO: 465273 - DNA, 25 bp, Rattus norvegicus
ggtcagctccattctctctccagag

SEQ ID NO: 465274 - DNA, 25 bp, Rattus norvegicus
ggtcagctctgacaagtgagacaca

SEQ ID NO: 465275 - DNA, 25 bp, Rattus norvegicus
ggtcagctctgagaagtgagacaca

SEQ ID NO: 465276 - DNA, 25 bp, Rattus norvegicus
ggtcagctgagtatccatggcatgt

SEQ ID NO: 465277 - DNA, 25 bp, Rattus norvegicus
ggtcagctgagtttccatggcatgt

SEQ ID NO: 465278 - DNA, 25 bp, Rattus norvegicus
ggtcagctgtccacaggatgtgatc

SEQ ID NO: 465279 - DNA, 25 bp, Rattus norvegicus
ggtcagctgtcctcaggatgtgatc

SEQ ID NO: 465280 - DNA, 25 bp, Rattus norvegicus
ggtcagcttgaaacagactgcccta

SEQ ID NO: 465281 - DNA, 25 bp, Rattus norvegicus
ggtcagcttgaaccctgattccctt

SEQ ID NO: 465282 - DNA, 25 bp, Rattus norvegicus
ggtcagcttgaagcctgattccctt

SEQ ID NO: 465283 - DNA, 25 bp, Rattus norvegicus
ggtcagcttgaatcagactgcccta

SEQ ID NO: 465284 - DNA, 25 bp, Rattus norvegicus
ggtcagctttatagttgggcagtgc

SEQ ID NO: 465285 - DNA, 25 bp, Rattus norvegicus
ggtcagctttattgttgggcagtgc

SEQ ID NO: 465286 - DNA, 25 bp, Rattus norvegicus
ggtcagctttgcacacgacattgag

SEQ ID NO: 465287 - DNA, 25 bp, Rattus norvegicus
ggtcagctttgctcacgacattgag

SEQ ID NO: 465288 - DNA, 25 bp, Rattus norvegicus
ggtcagcttttgctatctacgttta

SEQ ID NO: 465289 - DNA, 25 bp, Rattus norvegicus
ggtcagcttttggtatctacgttta

SEQ ID NO: 465290 - DNA, 25 bp, Rattus norvegicus
ggtcaggaaagacctctgctcttcc

SEQ ID NO: 465291 - DNA, 25 bp, Rattus norvegicus
ggtcaggaaagagctctgctcttcc

SEQ ID NO: 465292 - DNA, 25 bp, Rattus norvegicus
ggtcaggaaagtccacccgggatcc

SEQ ID NO: 465293 - DNA, 25 bp, Rattus norvegicus
ggtcaggaaagtgcacccgggatcc

SEQ ID NO: 465294 - DNA, 25 bp, Rattus norvegicus
ggtcaggaagacaacattgctagta

SEQ ID NO: 465295 - DNA, 25 bp, Rattus norvegicus
ggtcaggaagactacattgctagta

SEQ ID NO: 465296 - DNA, 25 bp, Rattus norvegicus
ggtcaggagaatattgttatcataa

SEQ ID NO: 465297 - DNA, 25 bp, Rattus norvegicus
ggtcaggagaattttgttatcataa

SEQ ID NO: 465298 - DNA, 25 bp, Rattus norvegicus
ggtcaggagattactccacattttc

SEQ ID NO: 465299 - DNA, 25 bp, Rattus norvegicus
ggtcaggagatttctccacattttc

SEQ ID NO: 465300 - DNA, 25 bp, Rattus norvegicus
ggtcaggaggaaagcctggtcccac

SEQ ID NO: 465301 - DNA, 25 bp, Rattus norvegicus
ggtcaggaggaatgcctggtcccac

SEQ ID NO: 465302 - DNA, 25 bp, Rattus norvegicus
ggtcaggaggttatctcagcctcaa

SEQ ID NO: 465303 - DNA, 25 bp, Rattus norvegicus
ggtcaggaggttttctcagcctcaa

SEQ ID NO: 465304 - DNA, 25 bp, Rattus norvegicus
ggtcaggatgccaaatgatatcaca

SEQ ID NO: 465305 - DNA, 25 bp, Rattus norvegicus
ggtcaggatgcctaatgatatcaca

SEQ ID NO: 465306 - DNA, 25 bp, Rattus norvegicus
ggtcaggatttcatcagatcggcat

SEQ ID NO: 465307 - DNA, 25 bp, Rattus norvegicus
ggtcaggatttcttcagatcggcat

SEQ ID NO: 465308 - DNA, 25 bp, Rattus norvegicus
ggtcaggctatcagtgtacctatca

SEQ ID NO: 465309 - DNA, 25 bp, Rattus norvegicus
ggtcaggctatctgtgtacctatca

SEQ ID NO: 465310 - DNA, 25 bp, Rattus norvegicus
ggtcaggctgtaatctgaattctta

SEQ ID NO: 465311 - DNA, 25 bp, Rattus norvegicus
ggtcaggctgtattctgaattctta

SEQ ID NO: 465312 - DNA, 25 bp, Rattus norvegicus
ggtcaggcttaacagcaagtgccct

SEQ ID NO: 465313 - DNA, 25 bp, Rattus norvegicus
ggtcaggcttaagagcaagtgccct

SEQ ID NO: 465314 - DNA, 25 bp, Rattus norvegicus
ggtcagggctagagcccatttttaa

SEQ ID NO: 465315 - DNA, 25 bp, Rattus norvegicus
ggtcagggctagtgcccatttttaa

SEQ ID NO: 465316 - DNA, 25 bp, Rattus norvegicus
ggtcagggtcatccttgattctata

SEQ ID NO: 465317 - DNA, 25 bp, Rattus norvegicus
ggtcagggtcatgcttgattctata

SEQ ID NO: 465318 - DNA, 25 bp, Rattus norvegicus
ggtcaggtctcaactgtaagttcag

SEQ ID NO: 465319 - DNA, 25 bp, Rattus norvegicus
ggtcaggtctcatctgtaagttcag

SEQ ID NO: 465320 - DNA, 25 bp, Rattus norvegicus
ggtcaggttccaattactgagctgt

SEQ ID NO: 465321 - DNA, 25 bp, Rattus norvegicus
ggtcaggttccatttactgagctgt

SEQ ID NO: 465322 - DNA, 25 bp, Rattus norvegicus
ggtcaggtttggatcatgtcttcta

SEQ ID NO: 465323 - DNA, 25 bp, Rattus norvegicus
ggtcaggtttggttcatgtcttcta

SEQ ID NO: 465324 - DNA, 25 bp, Rattus norvegicus
ggtcagtaacacagtatgcttgggt

SEQ ID NO: 465325 - DNA, 25 bp, Rattus norvegicus
ggtcagtaacactgtatgcttgggt

SEQ ID NO: 465326 - DNA, 25 bp, Rattus norvegicus
ggtcagtaacccaaaagccagaaag

SEQ ID NO: 465327 - DNA, 25 bp, Rattus norvegicus
ggtcagtaaccctaaagccagaaag

SEQ ID NO: 465328 - DNA, 25 bp, Rattus norvegicus
ggtcagtaactgctaaacatatgtt

SEQ ID NO: 465329 - DNA, 25 bp, Rattus norvegicus
ggtcagtaactggtaaacatatgtt

SEQ ID NO: 465330 - DNA, 25 bp, Rattus norvegicus
ggtcagtacctaatacagagtgtct

SEQ ID NO: 465331 - DNA, 25 bp, Rattus norvegicus
ggtcagtacctattacagagtgtct

SEQ ID NO: 465332 - DNA, 25 bp, Rattus norvegicus
ggtcagtactatatttataccttat

SEQ ID NO: 465333 - DNA, 25 bp, Rattus norvegicus
ggtcagtactatttttataccttat

SEQ ID NO: 465334 - DNA, 25 bp, Rattus norvegicus
ggtcagtagagtccctgcctcaaaa

SEQ ID NO: 465335 - DNA, 25 bp, Rattus norvegicus
ggtcagtagagtgcctgcctcaaaa

SEQ ID NO: 465336 - DNA, 25 bp, Rattus norvegicus
ggtcagtagcttcagtcacacataa

SEQ ID NO: 465337 - DNA, 25 bp, Rattus norvegicus
ggtcagtagcttgagtcacacataa

SEQ ID NO: 465338 - DNA, 25 bp, Rattus norvegicus
ggtcagtaggttcatcaaaagtgat

SEQ ID NO: 465339 - DNA, 25 bp, Rattus norvegicus
ggtcagtaggttgatcaaaagtgat

SEQ ID NO: 465340 - DNA, 25 bp, Rattus norvegicus
ggtcagtatgtcagagctcctcaga

SEQ ID NO: 465341 - DNA, 25 bp, Rattus norvegicus
ggtcagtatgtctgagctcctcaga

SEQ ID NO: 465342 - DNA, 25 bp, Rattus norvegicus
ggtcagtcactcacagtaagctatg

SEQ ID NO: 465343 - DNA, 25 bp, Rattus norvegicus
ggtcagtcactctcagtaagctatg

SEQ ID NO: 465344 - DNA, 25 bp, Rattus norvegicus
ggtcagtcagtcatagaatccttca

SEQ ID NO: 465345 - DNA, 25 bp, Rattus norvegicus
ggtcagtcagtcttagaatccttca

SEQ ID NO: 465346 - DNA, 25 bp, Rattus norvegicus
ggtcagtccccacaagagctcagtt

SEQ ID NO: 465347 - DNA, 25 bp, Rattus norvegicus
ggtcagtccccagaagagctcagtt

SEQ ID NO: 465348 - DNA, 25 bp, Rattus norvegicus
ggtcagtcgagtccaccatgaacac

SEQ ID NO: 465349 - DNA, 25 bp, Rattus norvegicus
ggtcagtcgagtgcaccatgaacac

SEQ ID NO: 465350 - DNA, 25 bp, Rattus norvegicus
ggtcagtctcaacgctttatactac

SEQ ID NO: 465351 - DNA, 25 bp, Rattus norvegicus
ggtcagtctcaaggctttatactac

SEQ ID NO: 465352 - DNA, 25 bp, Rattus norvegicus
ggtcagtctcctcggccaaaggtga

SEQ ID NO: 465353 - DNA, 25 bp, Rattus norvegicus
ggtcagtctcctgggccaaaggtga

SEQ ID NO: 465354 - DNA, 25 bp, Rattus norvegicus
ggtcagtctcgtcttacttggttat

SEQ ID NO: 465355 - DNA, 25 bp, Rattus norvegicus
ggtcagtctcgtgttacttggttat

SEQ ID NO: 465356 - DNA, 25 bp, Rattus norvegicus
ggtcagtctgcaccaagcatgaact

SEQ ID NO: 465357 - DNA, 25 bp, Rattus norvegicus
ggtcagtctgcagcaagcatgaact

SEQ ID NO: 465358 - DNA, 25 bp, Rattus norvegicus
ggtcagtcttagcatgttttcttaa

SEQ ID NO: 465359 - DNA, 25 bp, Rattus norvegicus
ggtcagtcttaggatgttttcttaa

SEQ ID NO: 465360 - DNA, 25 bp, Rattus norvegicus
ggtcagtcttctcccaacaaaaatg

SEQ ID NO: 465361 - DNA, 25 bp, Rattus norvegicus
ggtcagtcttctgccaacaaaaatg

SEQ ID NO: 465362 - DNA, 25 bp, Rattus norvegicus
ggtcagtgaccgctctccgtacaca

SEQ ID NO: 465363 - DNA, 25 bp, Rattus norvegicus
ggtcagtgaccggtctccgtacaca

SEQ ID NO: 465364 - DNA, 25 bp, Rattus norvegicus
ggtcagtgagaccacagaaagcaca

SEQ ID NO: 465365 - DNA, 25 bp, Rattus norvegicus
ggtcagtgagacgacagaaagcaca

SEQ ID NO: 465366 - DNA, 25 bp, Rattus norvegicus
ggtcagtgagtaatccacacacact

SEQ ID NO: 465367 - DNA, 25 bp, Rattus norvegicus
ggtcagtgagtattccacacacact

SEQ ID NO: 465368 - DNA, 25 bp, Rattus norvegicus
ggtcagtgcctaaaccagacagtga

SEQ ID NO: 465369 - DNA, 25 bp, Rattus norvegicus
ggtcagtgcctataccagacagtga

SEQ ID NO: 465370 - DNA, 25 bp, Rattus norvegicus
ggtcagtgctgcctagaacatgtct

SEQ ID NO: 465371 - DNA, 25 bp, Rattus norvegicus
ggtcagtgctgcgtagaacatgtct

SEQ ID NO: 465372 - DNA, 25 bp, Rattus norvegicus
ggtcagtggcttataactgtttaca

SEQ ID NO: 465373 - DNA, 25 bp, Rattus norvegicus
ggtcagtggcttttaactgtttaca

SEQ ID NO: 465374 - DNA, 25 bp, Rattus norvegicus
ggtcagtgtacgaggttgcattttt

SEQ ID NO: 465375 - DNA, 25 bp, Rattus norvegicus
ggtcagtgtacgtggttgcattttt

SEQ ID NO: 465376 - DNA, 25 bp, Rattus norvegicus
ggtcagtgtagtcctgtcagttccc

SEQ ID NO: 465377 - DNA, 25 bp, Rattus norvegicus
ggtcagtgtagtgctgtcagttccc

SEQ ID NO: 465378 - DNA, 25 bp, Rattus norvegicus
ggtcagtgtcttcggtttatgttac

SEQ ID NO: 465379 - DNA, 25 bp, Rattus norvegicus
ggtcagtgtcttgggtttatgttac

SEQ ID NO: 465380 - DNA, 25 bp, Rattus norvegicus
ggtcagtgttatatttgtcccaaat

SEQ ID NO: 465381 - DNA, 25 bp, Rattus norvegicus
ggtcagtgttatttttgtcccaaat

SEQ ID NO: 465382 - DNA, 25 bp, Rattus norvegicus
ggtcagtgttttcctagggattcta

SEQ ID NO: 465383 - DNA, 25 bp, Rattus norvegicus
ggtcagtgttttgctagggattcta

SEQ ID NO: 465384 - DNA, 25 bp, Rattus norvegicus
ggtcagttactcagttcttgttaat

SEQ ID NO: 465385 - DNA, 25 bp, Rattus norvegicus
ggtcagttactctgttcttgttaat

SEQ ID NO: 465386 - DNA, 25 bp, Rattus norvegicus
ggtcagttgttcaacacagagttcc

SEQ ID NO: 465387 - DNA, 25 bp, Rattus norvegicus
ggtcagttgttctacacagagttcc

SEQ ID NO: 465388 - DNA, 25 bp, Rattus norvegicus
ggtcagttttaaatcctgaaacaca

SEQ ID NO: 465389 - DNA, 25 bp, Rattus norvegicus
ggtcagttttaattcctgaaacaca

SEQ ID NO: 465390 - DNA, 25 bp, Rattus norvegicus
ggtcagtttttcagaattcttccaa

SEQ ID NO: 465391 - DNA, 25 bp, Rattus norvegicus
ggtcagtttttctgaattcttccaa

SEQ ID NO: 465392 - DNA, 25 bp, Rattus norvegicus
ggtcataaacgtcgagcagagctct

SEQ ID NO: 465393 - DNA, 25 bp, Rattus norvegicus
ggtcataaacgtggagcagagctct

SEQ ID NO: 465394 - DNA, 25 bp, Rattus norvegicus
ggtcataaagggaaaaagtctatag

SEQ ID NO: 465395 - DNA, 25 bp, Rattus norvegicus
ggtcataaagggtaaaagtctatag

SEQ ID NO: 465396 - DNA, 25 bp, Rattus norvegicus
ggtcataacgacacttaccctttgt

SEQ ID NO: 465397 - DNA, 25 bp, Rattus norvegicus
ggtcataacgactcttaccctttgt

SEQ ID NO: 465398 - DNA, 25 bp, Rattus norvegicus
ggtcataatgtgaaatcttcctaat

SEQ ID NO: 465399 - DNA, 25 bp, Rattus norvegicus
ggtcataatgtgtaatcttcctaat

SEQ ID NO: 465400 - DNA, 25 bp, Rattus norvegicus
ggtcatacacatacatcagtcttct

SEQ ID NO: 465401 - DNA, 25 bp, Rattus norvegicus
ggtcatacacattcatcagtcttct

SEQ ID NO: 465402 - DNA, 25 bp, Rattus norvegicus
ggtcatactattaagccctgactat

SEQ ID NO: 465403 - DNA, 25 bp, Rattus norvegicus
ggtcatactatttagccctgactat

SEQ ID NO: 465404 - DNA, 25 bp, Rattus norvegicus
ggtcatactcctagagagcagtgca

SEQ ID NO: 465405 - DNA, 25 bp, Rattus norvegicus
ggtcatactccttgagagcagtgca

SEQ ID NO: 465406 - DNA, 25 bp, Rattus norvegicus
ggtcatactgatacatgctcttgag

SEQ ID NO: 465407 - DNA, 25 bp, Rattus norvegicus
ggtcatactgattcatgctcttgag

SEQ ID NO: 465408 - DNA, 25 bp, Rattus norvegicus
ggtcatagacatagccactaggcca

SEQ ID NO: 465409 - DNA, 25 bp, Rattus norvegicus
ggtcatagacattgccactaggcca

SEQ ID NO: 465410 - DNA, 25 bp, Rattus norvegicus
ggtcatagacgtcactattccagat

SEQ ID NO: 465411 - DNA, 25 bp, Rattus norvegicus
ggtcatagacgtgactattccagat

SEQ ID NO: 465412 - DNA, 25 bp, Rattus norvegicus
ggtcatagctatccgagactggtct

SEQ ID NO: 465413 - DNA, 25 bp, Rattus norvegicus
ggtcatagctatgcgagactggtct

SEQ ID NO: 465414 - DNA, 25 bp, Rattus norvegicus
ggtcatatacagctgagctcagtaa

SEQ ID NO: 465415 - DNA, 25 bp, Rattus norvegicus
ggtcatatacaggtgagctcagtaa

SEQ ID NO: 465416 - DNA, 25 bp, Rattus norvegicus
ggtcatatacttctcacctcctaca

SEQ ID NO: 465417 - DNA, 25 bp, Rattus norvegicus
ggtcatatacttgtcacctcctaca

SEQ ID NO: 465418 - DNA, 25 bp, Rattus norvegicus
ggtcatatcatcaagttcttctgtg

SEQ ID NO: 465419 - DNA, 25 bp, Rattus norvegicus
ggtcatatcatctagttcttctgtg

SEQ ID NO: 465420 - DNA, 25 bp, Rattus norvegicus
ggtcatatgaacactgcacctttgt

SEQ ID NO: 465421 - DNA, 25 bp, Rattus norvegicus
ggtcatatgaactctgcacctttgt

SEQ ID NO: 465422 - DNA, 25 bp, Rattus norvegicus
ggtcatatgtatcagacttgctcta

SEQ ID NO: 465423 - DNA, 25 bp, Rattus norvegicus
ggtcatatgtatgagacttgctcta

SEQ ID NO: 465424 - DNA, 25 bp, Rattus norvegicus
ggtcatcaacatcggtattccaact

SEQ ID NO: 465425 - DNA, 25 bp, Rattus norvegicus
ggtcatcaacatgggtattccaact

SEQ ID NO: 465426 - DNA, 25 bp, Rattus norvegicus
ggtcatcaatatagcccacgaacac

SEQ ID NO: 465427 - DNA, 25 bp, Rattus norvegicus
ggtcatcaatattgcccacgaacac

SEQ ID NO: 465428 - DNA, 25 bp, Rattus norvegicus
ggtcatcacacaacactacagtaaa

SEQ ID NO: 465429 - DNA, 25 bp, Rattus norvegicus
ggtcatcacacatcactacagtaaa

SEQ ID NO: 465430 - DNA, 25 bp, Rattus norvegicus
ggtcatcacactactcatgctgcta

SEQ ID NO: 465431 - DNA, 25 bp, Rattus norvegicus
ggtcatcacacttctcatgctgcta

SEQ ID NO: 465432 - DNA, 25 bp, Rattus norvegicus
ggtcatcaccataggcaacgagcgt

SEQ ID NO: 465433 - DNA, 25 bp, Rattus norvegicus
ggtcatcaccattggcaacgagcgt

SEQ ID NO: 465434 - DNA, 25 bp, Rattus norvegicus
ggtcatcactatcggcaatgagcgg

SEQ ID NO: 465435 - DNA, 25 bp, Rattus norvegicus
ggtcatcactatgggcaatgagcgg

SEQ ID NO: 465436 - DNA, 25 bp, Rattus norvegicus
ggtcatcactgtaggacattaccat

SEQ ID NO: 465437 - DNA, 25 bp, Rattus norvegicus
ggtcatcactgttggacattaccat

SEQ ID NO: 465438 - DNA, 25 bp, Rattus norvegicus
ggtcatcagcagagtcagtgcactt

SEQ ID NO: 465439 - DNA, 25 bp, Rattus norvegicus
ggtcatcagcagtgtcagtgcactt

SEQ ID NO: 465440 - DNA, 25 bp, Rattus norvegicus
ggtcatcaggacacggctccgggaa

SEQ ID NO: 465441 - DNA, 25 bp, Rattus norvegicus
ggtcatcaggactcggctccgggaa

SEQ ID NO: 465442 - DNA, 25 bp, Rattus norvegicus
ggtcatcagtgcctgagccagttac

SEQ ID NO: 465443 - DNA, 25 bp, Rattus norvegicus
ggtcatcagtgcgtgagccagttac

SEQ ID NO: 465444 - DNA, 25 bp, Rattus norvegicus
ggtcatcatcatagtagtggtgtca

SEQ ID NO: 465445 - DNA, 25 bp, Rattus norvegicus
ggtcatcatcattgtagtggtgtca

SEQ ID NO: 465446 - DNA, 25 bp, Rattus norvegicus
ggtcatcatcctagttatatcagtt

SEQ ID NO: 465447 - DNA, 25 bp, Rattus norvegicus
ggtcatcatccttgttatatcagtt

SEQ ID NO: 465448 - DNA, 25 bp, Rattus norvegicus
ggtcatcatgaacttccctgtgctg

SEQ ID NO: 465449 - DNA, 25 bp, Rattus norvegicus
ggtcatcatgaagttccctgtgctg

SEQ ID NO: 465450 - DNA, 25 bp, Rattus norvegicus
ggtcatccaaaacatggtggcccat

SEQ ID NO: 465451 - DNA, 25 bp, Rattus norvegicus
ggtcatccaaaagatggtggcccat

SEQ ID NO: 465452 - DNA, 25 bp, Rattus norvegicus
ggtcatccaagcacatctcaaagtt

SEQ ID NO: 465453 - DNA, 25 bp, Rattus norvegicus
ggtcatccaagctcatctcaaagtt

SEQ ID NO: 465454 - DNA, 25 bp, Rattus norvegicus
ggtcatccaattccggttacacaca

SEQ ID NO: 465455 - DNA, 25 bp, Rattus norvegicus
ggtcatccaattgcggttacacaca

SEQ ID NO: 465456 - DNA, 25 bp, Rattus norvegicus
ggtcatccataacgcctttgtagag

SEQ ID NO: 465457 - DNA, 25 bp, Rattus norvegicus
ggtcatccataaggcctttgtagag

SEQ ID NO: 465458 - DNA, 25 bp, Rattus norvegicus
ggtcatccatgacaactttggcatc

SEQ ID NO: 465459 - DNA, 25 bp, Rattus norvegicus
ggtcatccatgagaactttggcatc

SEQ ID NO: 465460 - DNA, 25 bp, Rattus norvegicus
ggtcatccctgcaaagccaatatgt

SEQ ID NO: 465461 - DNA, 25 bp, Rattus norvegicus
ggtcatccctgctaagccaatatgt

SEQ ID NO: 465462 - DNA, 25 bp, Rattus norvegicus
ggtcatcctcaaatacagcaagttt

SEQ ID NO: 465463 - DNA, 25 bp, Rattus norvegicus
ggtcatcctcaattacagcaagttt

SEQ ID NO: 465464 - DNA, 25 bp, Rattus norvegicus
ggtcatcctgggacctaagaaagca

SEQ ID NO: 465465 - DNA, 25 bp, Rattus norvegicus
ggtcatcctgggtcctaagaaagca

SEQ ID NO: 465466 - DNA, 25 bp, Rattus norvegicus
ggtcatcgactacatcctcaagagt

SEQ ID NO: 465467 - DNA, 25 bp, Rattus norvegicus
ggtcatcgactagatcctcaagagt

SEQ ID NO: 465468 - DNA, 25 bp, Rattus norvegicus
ggtcatcgcctcattgcagctgaga

SEQ ID NO: 465469 - DNA, 25 bp, Rattus norvegicus
ggtcatcgcctctttgcagctgaga

SEQ ID NO: 465470 - DNA, 25 bp, Rattus norvegicus
ggtcatcgtgtgaggtggcaacaac

SEQ ID NO: 465471 - DNA, 25 bp, Rattus norvegicus
ggtcatcgtgtgtggtggcaacaac

SEQ ID NO: 465472 - DNA, 25 bp, Rattus norvegicus
ggtcatctacaacccaactagtgga

SEQ ID NO: 465473 - DNA, 25 bp, Rattus norvegicus
ggtcatctacaagccaactagtgga

SEQ ID NO: 465474 - DNA, 25 bp, Rattus norvegicus
ggtcatctaggacgagagaacttca

SEQ ID NO: 465475 - DNA, 25 bp, Rattus norvegicus
ggtcatctaggaggagagaacttca

SEQ ID NO: 465476 - DNA, 25 bp, Rattus norvegicus
ggtcatctcccaattgaagtaaagg

SEQ ID NO: 465477 - DNA, 25 bp, Rattus norvegicus
ggtcatctcccatttgaagtaaagg

SEQ ID NO: 465478 - DNA, 25 bp, Rattus norvegicus
ggtcatctctgtactaaaggccaaa

SEQ ID NO: 465479 - DNA, 25 bp, Rattus norvegicus
ggtcatctctgttctaaaggccaaa

SEQ ID NO: 465480 - DNA, 25 bp, Rattus norvegicus
ggtcatctgaaacctgctacagccc

SEQ ID NO: 465481 - DNA, 25 bp, Rattus norvegicus
ggtcatctgaaagctgctacagccc

SEQ ID NO: 465482 - DNA, 25 bp, Rattus norvegicus
ggtcatctgccacaattctatgcat

SEQ ID NO: 465483 - DNA, 25 bp, Rattus norvegicus
ggtcatctgccagaattctatgcat

SEQ ID NO: 465484 - DNA, 25 bp, Rattus norvegicus
ggtcatctgggacgcactaaaattt

SEQ ID NO: 465485 - DNA, 25 bp, Rattus norvegicus
ggtcatctgggaggcactaaaattt

SEQ ID NO: 465486 - DNA, 25 bp, Rattus norvegicus
ggtcatcttcctctacataatttga

SEQ ID NO: 465487 - DNA, 25 bp, Rattus norvegicus
ggtcatcttcctgtacataatttga

SEQ ID NO: 465488 - DNA, 25 bp, Rattus norvegicus
ggtcatgaaatgataactctctcta

SEQ ID NO: 465489 - DNA, 25 bp, Rattus norvegicus
ggtcatgaaatgttaactctctcta

SEQ ID NO: 465490 - DNA, 25 bp, Rattus norvegicus
ggtcatgaactactgatctgcttta

SEQ ID NO: 465491 - DNA, 25 bp, Rattus norvegicus
ggtcatgaactagtgatctgcttta

SEQ ID NO: 465492 - DNA, 25 bp, Rattus norvegicus
ggtcatgaattaccttccagggttt

SEQ ID NO: 465493 - DNA, 25 bp, Rattus norvegicus
ggtcatgaattagcttccagggttt

SEQ ID NO: 465494 - DNA, 25 bp, Rattus norvegicus
ggtcatgacatcctgaagtgtggca

SEQ ID NO: 465495 - DNA, 25 bp, Rattus norvegicus
ggtcatgacatcgtgaagtgtggca

SEQ ID NO: 465496 - DNA, 25 bp, Rattus norvegicus
ggtcatgacccacaagttctagaat

SEQ ID NO: 465497 - DNA, 25 bp, Rattus norvegicus
ggtcatgacccagaagttctagaat

SEQ ID NO: 465498 - DNA, 25 bp, Rattus norvegicus
ggtcatgactgcatttggaggcaaa

SEQ ID NO: 465499 - DNA, 25 bp, Rattus norvegicus
ggtcatgactgcttttggaggcaaa

SEQ ID NO: 465500 - DNA, 25 bp, Rattus norvegicus
ggtcatgagctgagtaaacttgcat

SEQ ID NO: 465501 - DNA, 25 bp, Rattus norvegicus
ggtcatgagctgtgtaaacttgcat

SEQ ID NO: 465502 - DNA, 25 bp, Rattus norvegicus
ggtcatgaggaaaccactcctgcag

SEQ ID NO: 465503 - DNA, 25 bp, Rattus norvegicus
ggtcatgaggaatccactcctgcag

SEQ ID NO: 465504 - DNA, 25 bp, Rattus norvegicus
ggtcatgagttcaagttatccctat

SEQ ID NO: 465505 - DNA, 25 bp, Rattus norvegicus
ggtcatgagttctagttatccctat

SEQ ID NO: 465506 - DNA, 25 bp, Rattus norvegicus
ggtcatgatccaaccctagggaggg

SEQ ID NO: 465507 - DNA, 25 bp, Rattus norvegicus
ggtcatgatccatccctagggaggg

SEQ ID NO: 465508 - DNA, 25 bp, Rattus norvegicus
ggtcatgattatatacttattgagt

SEQ ID NO: 465509 - DNA, 25 bp, Rattus norvegicus
ggtcatgattatttacttattgagt

SEQ ID NO: 465510 - DNA, 25 bp, Rattus norvegicus
ggtcatgatttgaactccctgtcaa

SEQ ID NO: 465511 - DNA, 25 bp, Rattus norvegicus
ggtcatgatttgtactccctgtcaa

SEQ ID NO: 465512 - DNA, 25 bp, Rattus norvegicus
ggtcatgcaagaccaccttcagcag

SEQ ID NO: 465513 - DNA, 25 bp, Rattus norvegicus
ggtcatgcaagagcaccttcagcag

SEQ ID NO: 465514 - DNA, 25 bp, Rattus norvegicus
ggtcatgcaccccaaagagctccag

SEQ ID NO: 465515 - DNA, 25 bp, Rattus norvegicus
ggtcatgcacccgaaagagctccag

SEQ ID NO: 465516 - DNA, 25 bp, Rattus norvegicus
ggtcatgcagtgatggtggtccatc

SEQ ID NO: 465517 - DNA, 25 bp, Rattus norvegicus
ggtcatgcagtgttggtggtccatc

SEQ ID NO: 465518 - DNA, 25 bp, Rattus norvegicus
ggtcatgcatttaagtaactcatta

SEQ ID NO: 465519 - DNA, 25 bp, Rattus norvegicus
ggtcatgcattttagtaactcatta

SEQ ID NO: 465520 - DNA, 25 bp, Rattus norvegicus
ggtcatgcctgcagtgttgaactaa

SEQ ID NO: 465521 - DNA, 25 bp, Rattus norvegicus
ggtcatgcctgccttctgtgtgtaa

SEQ ID NO: 465522 - DNA, 25 bp, Rattus norvegicus
ggtcatgcctgcgttctgtgtgtaa

SEQ ID NO: 465523 - DNA, 25 bp, Rattus norvegicus
ggtcatgcctgctgtgttgaactaa

SEQ ID NO: 465524 - DNA, 25 bp, Rattus norvegicus
ggtcatgctccaaggcactaggcag

SEQ ID NO: 465525 - DNA, 25 bp, Rattus norvegicus
ggtcatgctccatggcactaggcag

SEQ ID NO: 465526 - DNA, 25 bp, Rattus norvegicus
ggtcatgctctcagcaaggactaag

SEQ ID NO: 465527 - DNA, 25 bp, Rattus norvegicus
ggtcatgctctctgcaaggactaag

SEQ ID NO: 465528 - DNA, 25 bp, Rattus norvegicus
ggtcatgctggacgtttttaccgta

SEQ ID NO: 465529 - DNA, 25 bp, Rattus norvegicus
ggtcatgctggaggtttttaccgta

SEQ ID NO: 465530 - DNA, 25 bp, Rattus norvegicus
ggtcatgcttgtatttatcccttgt

SEQ ID NO: 465531 - DNA, 25 bp, Rattus norvegicus
ggtcatgcttgtttttatcccttgt

SEQ ID NO: 465532 - DNA, 25 bp, Rattus norvegicus
ggtcatggacaacctgaacttgccc

SEQ ID NO: 465533 - DNA, 25 bp, Rattus norvegicus
ggtcatggacaagctgaacttgccc

SEQ ID NO: 465534 - DNA, 25 bp, Rattus norvegicus
ggtcatggccatcatgtacactgtg

SEQ ID NO: 465535 - DNA, 25 bp, Rattus norvegicus
ggtcatggccatgatgtacactgtg

SEQ ID NO: 465536 - DNA, 25 bp, Rattus norvegicus
ggtcatggctaaacatctgaagttc

SEQ ID NO: 465537 - DNA, 25 bp, Rattus norvegicus
ggtcatggctaatcatctgaagttc

SEQ ID NO: 465538 - DNA, 25 bp, Rattus norvegicus
ggtcatggctttcatcctgcaggat

SEQ ID NO: 465539 - DNA, 25 bp, Rattus norvegicus
ggtcatggctttgatcctgcaggat

SEQ ID NO: 465540 - DNA, 25 bp, Rattus norvegicus
ggtcatgggcagaattaccaccttc

SEQ ID NO: 465541 - DNA, 25 bp, Rattus norvegicus
ggtcatgggcagtattaccaccttc

SEQ ID NO: 465542 - DNA, 25 bp, Rattus norvegicus
ggtcatggtgatccgaagccactgc

SEQ ID NO: 465543 - DNA, 25 bp, Rattus norvegicus
ggtcatggtgatgcgaagccactgc

SEQ ID NO: 465544 - DNA, 25 bp, Rattus norvegicus
ggtcatggtgttagtcatagcaaca

SEQ ID NO: 465545 - DNA, 25 bp, Rattus norvegicus
ggtcatggtgtttgtcatagcaaca

SEQ ID NO: 465546 - DNA, 25 bp, Rattus norvegicus
ggtcatgtagcacttttttcctaaa

SEQ ID NO: 465547 - DNA, 25 bp, Rattus norvegicus
ggtcatgtagcagttttttcctaaa

SEQ ID NO: 465548 - DNA, 25 bp, Rattus norvegicus
ggtcatgtcaaaactaacttcgcaa

SEQ ID NO: 465549 - DNA, 25 bp, Rattus norvegicus
ggtcatgtcaaatctaacttcgcaa

SEQ ID NO: 465550 - DNA, 25 bp, Rattus norvegicus
ggtcatgtccatcagttagtgcgaa

SEQ ID NO: 465551 - DNA, 25 bp, Rattus norvegicus
ggtcatgtccatgagttagtgcgaa

SEQ ID NO: 465552 - DNA, 25 bp, Rattus norvegicus
ggtcatgtccgcctggactctcctg

SEQ ID NO: 465553 - DNA, 25 bp, Rattus norvegicus
ggtcatgtccgcgtggactctcctg

SEQ ID NO: 465554 - DNA, 25 bp, Rattus norvegicus
ggtcatgtgtcaactttatgcatta

SEQ ID NO: 465555 - DNA, 25 bp, Rattus norvegicus
ggtcatgtgtcatctttatgcatta

SEQ ID NO: 465556 - DNA, 25 bp, Rattus norvegicus
ggtcatgtgtttcaccagaattgca

SEQ ID NO: 465557 - DNA, 25 bp, Rattus norvegicus
ggtcatgtgtttgaccagaattgca

SEQ ID NO: 465558 - DNA, 25 bp, Rattus norvegicus
ggtcatgttcagcattttgttttta

SEQ ID NO: 465559 - DNA, 25 bp, Rattus norvegicus
ggtcatgttcaggattttgttttta

SEQ ID NO: 465560 - DNA, 25 bp, Rattus norvegicus
ggtcatgttcccaacatcctaaatc

SEQ ID NO: 465561 - DNA, 25 bp, Rattus norvegicus
ggtcatgttccctacatcctaaatc

SEQ ID NO: 465562 - DNA, 25 bp, Rattus norvegicus
ggtcatgttctaattttctcgttca

SEQ ID NO: 465563 - DNA, 25 bp, Rattus norvegicus
ggtcatgttctatttttctcgttca

SEQ ID NO: 465564 - DNA, 25 bp, Rattus norvegicus
ggtcatgttcttaccttgctaagca

SEQ ID NO: 465565 - DNA, 25 bp, Rattus norvegicus
ggtcatgttctttccttgctaagca

SEQ ID NO: 465566 - DNA, 25 bp, Rattus norvegicus
ggtcatgttgtcaaagcatcatatg

SEQ ID NO: 465567 - DNA, 25 bp, Rattus norvegicus
ggtcatgttgtctaagcatcatatg

SEQ ID NO: 465568 - DNA, 25 bp, Rattus norvegicus
ggtcatgttgttacttcatcgcaat

SEQ ID NO: 465569 - DNA, 25 bp, Rattus norvegicus
ggtcatgttgtttcttcatcgcaat

SEQ ID NO: 465570 - DNA, 25 bp, Rattus norvegicus
ggtcatgtttcaaaccgaggcctaa

SEQ ID NO: 465571 - DNA, 25 bp, Rattus norvegicus
ggtcatgtttcataccgaggcctaa

SEQ ID NO: 465572 - DNA, 25 bp, Rattus norvegicus
ggtcattaaaagctttgcatgttgt

SEQ ID NO: 465573 - DNA, 25 bp, Rattus norvegicus
ggtcattaaaaggtttgcatgttgt

SEQ ID NO: 465574 - DNA, 25 bp, Rattus norvegicus
ggtcattaatgtctgctacctcatg

SEQ ID NO: 465575 - DNA, 25 bp, Rattus norvegicus
ggtcattaatgtgtgctacctcatg

SEQ ID NO: 465576 - DNA, 25 bp, Rattus norvegicus
ggtcattagctccaacagaggaaga

SEQ ID NO: 465577 - DNA, 25 bp, Rattus norvegicus
ggtcattagctcgaacagaggaaga

SEQ ID NO: 465578 - DNA, 25 bp, Rattus norvegicus
ggtcattataagcaattactttcaa

SEQ ID NO: 465579 - DNA, 25 bp, Rattus norvegicus
ggtcattataaggaattactttcaa

SEQ ID NO: 465580 - DNA, 25 bp, Rattus norvegicus
ggtcattataccatccatcagattt

SEQ ID NO: 465581 - DNA, 25 bp, Rattus norvegicus
ggtcattataccttccatcagattt

SEQ ID NO: 465582 - DNA, 25 bp, Rattus norvegicus
ggtcattatcacaattgttactgtc

SEQ ID NO: 465583 - DNA, 25 bp, Rattus norvegicus
ggtcattatcactattgttactgtc

SEQ ID NO: 465584 - DNA, 25 bp, Rattus norvegicus
ggtcattcactgcagtcagcttcag

SEQ ID NO: 465585 - DNA, 25 bp, Rattus norvegicus
ggtcattcactggagtcagcttcag

SEQ ID NO: 465586 - DNA, 25 bp, Rattus norvegicus
ggtcattcagtgcaaccataaaatt

SEQ ID NO: 465587 - DNA, 25 bp, Rattus norvegicus
ggtcattcagtggaaccataaaatt

SEQ ID NO: 465588 - DNA, 25 bp, Rattus norvegicus
ggtcattccggactggtgactaagt

SEQ ID NO: 465589 - DNA, 25 bp, Rattus norvegicus
ggtcattccggagtggtgactaagt

SEQ ID NO: 465590 - DNA, 25 bp, Rattus norvegicus
ggtcattctctgcttcgttatgaag

SEQ ID NO: 465591 - DNA, 25 bp, Rattus norvegicus
ggtcattctctggttcgttatgaag

SEQ ID NO: 465592 - DNA, 25 bp, Rattus norvegicus
ggtcattctgggatacctagtgagt

SEQ ID NO: 465593 - DNA, 25 bp, Rattus norvegicus
ggtcattctgggttacctagtgagt

SEQ ID NO: 465594 - DNA, 25 bp, Rattus norvegicus
ggtcattctggtcgtgtttacttca

SEQ ID NO: 465595 - DNA, 25 bp, Rattus norvegicus
ggtcattctggtggtgtttacttca

SEQ ID NO: 465596 - DNA, 25 bp, Rattus norvegicus
ggtcattcttagctatagcattcaa

SEQ ID NO: 465597 - DNA, 25 bp, Rattus norvegicus
ggtcattcttaggtatagcattcaa

SEQ ID NO: 465598 - DNA, 25 bp, Rattus norvegicus
ggtcattcttgcaatcagggcatgc

SEQ ID NO: 465599 - DNA, 25 bp, Rattus norvegicus
ggtcattcttgctatcagggcatgc

SEQ ID NO: 465600 - DNA, 25 bp, Rattus norvegicus
ggtcattgacatataagcatcccga

SEQ ID NO: 465601 - DNA, 25 bp, Rattus norvegicus
ggtcattgacatttaagcatcccga

SEQ ID NO: 465602 - DNA, 25 bp, Rattus norvegicus
ggtcattgagtcacacctgctgaag

SEQ ID NO: 465603 - DNA, 25 bp, Rattus norvegicus
ggtcattgagtctcacctgctgaag

SEQ ID NO: 465604 - DNA, 25 bp, Rattus norvegicus
ggtcattgcaccataagattctatc

SEQ ID NO: 465605 - DNA, 25 bp, Rattus norvegicus
ggtcattgcaccttaagattctatc

SEQ ID NO: 465606 - DNA, 25 bp, Rattus norvegicus
ggtcattgcagtcgagaataggctc

SEQ ID NO: 465607 - DNA, 25 bp, Rattus norvegicus
ggtcattgcagtggagaataggctc

SEQ ID NO: 465608 - DNA, 25 bp, Rattus norvegicus
ggtcattggcagaccattagccaga

SEQ ID NO: 465609 - DNA, 25 bp, Rattus norvegicus
ggtcattggcagtccattagccaga

SEQ ID NO: 465610 - DNA, 25 bp, Rattus norvegicus
ggtcattgtaaaaatccctttccag

SEQ ID NO: 465611 - DNA, 25 bp, Rattus norvegicus
ggtcattgtaaatatccctttccag

SEQ ID NO: 465612 - DNA, 25 bp, Rattus norvegicus
ggtcattgtgagaagtgtgcaccat

SEQ ID NO: 465613 - DNA, 25 bp, Rattus norvegicus
ggtcattgtgagtagtgtgcaccat

SEQ ID NO: 465614 - DNA, 25 bp, Rattus norvegicus
ggtcatttaagcaatctacttcatt

SEQ ID NO: 465615 - DNA, 25 bp, Rattus norvegicus
ggtcatttaagctatctacttcatt

SEQ ID NO: 465616 - DNA, 25 bp, Rattus norvegicus
ggtcatttatcaattatttaactaa

SEQ ID NO: 465617 - DNA, 25 bp, Rattus norvegicus
ggtcatttatcatttatttaactaa

SEQ ID NO: 465618 - DNA, 25 bp, Rattus norvegicus
ggtcatttccccagagattcatact

SEQ ID NO: 465619 - DNA, 25 bp, Rattus norvegicus
ggtcatttcccctgagattcatact

SEQ ID NO: 465620 - DNA, 25 bp, Rattus norvegicus
ggtcatttctcaacctgaggtgcgt

SEQ ID NO: 465621 - DNA, 25 bp, Rattus norvegicus
ggtcatttctcatcctgaggtgcgt

SEQ ID NO: 465622 - DNA, 25 bp, Rattus norvegicus
ggtcatttgaaaattcccaggctag

SEQ ID NO: 465623 - DNA, 25 bp, Rattus norvegicus
ggtcatttgaaatttcccaggctag

SEQ ID NO: 465624 - DNA, 25 bp, Rattus norvegicus
ggtcatttggaacgcatttctctat

SEQ ID NO: 465625 - DNA, 25 bp, Rattus norvegicus
ggtcatttggaaggcatttctctat

SEQ ID NO: 465626 - DNA, 25 bp, Rattus norvegicus
ggtcatttggtgagtccgagataga

SEQ ID NO: 465627 - DNA, 25 bp, Rattus norvegicus
ggtcatttggtgtgtccgagataga

SEQ ID NO: 465628 - DNA, 25 bp, Rattus norvegicus
ggtcatttgtctatatgtccagcta

SEQ ID NO: 465629 - DNA, 25 bp, Rattus norvegicus
ggtcatttgtctttatgtccagcta

SEQ ID NO: 465630 - DNA, 25 bp, Rattus norvegicus
ggtcattttatactaatttcttcca

SEQ ID NO: 465631 - DNA, 25 bp, Rattus norvegicus
ggtcattttatagtaatttcttcca

SEQ ID NO: 465632 - DNA, 25 bp, Rattus norvegicus
ggtcattttcaacccatagactgtc

SEQ ID NO: 465633 - DNA, 25 bp, Rattus norvegicus
ggtcattttcaagccatagactgtc

SEQ ID NO: 465634 - DNA, 25 bp, Rattus norvegicus
ggtcattttcagctacttcaagagt

SEQ ID NO: 465635 - DNA, 25 bp, Rattus norvegicus
ggtcattttcaggtacttcaagagt

SEQ ID NO: 465636 - DNA, 25 bp, Rattus norvegicus
ggtcattttcctaaaggttgctgga

SEQ ID NO: 465637 - DNA, 25 bp, Rattus norvegicus
ggtcattttccttaaggttgctgga

SEQ ID NO: 465638 - DNA, 25 bp, Rattus norvegicus
ggtcattttggtcatgatggccagc

SEQ ID NO: 465639 - DNA, 25 bp, Rattus norvegicus
ggtcattttggtgatgatggccagc

SEQ ID NO: 465640 - DNA, 25 bp, Rattus norvegicus
ggtcatttttacacttaagccattt

SEQ ID NO: 465641 - DNA, 25 bp, Rattus norvegicus
ggtcatttttactcttaagccattt

SEQ ID NO: 465642 - DNA, 25 bp, Rattus norvegicus
ggtccaaaggcgaatgctatcccag

SEQ ID NO: 465643 - DNA, 25 bp, Rattus norvegicus
ggtccaaaggcgtatgctatcccag

SEQ ID NO: 465644 - DNA, 25 bp, Rattus norvegicus
ggtccaaatggacacatcctcactc

SEQ ID NO: 465645 - DNA, 25 bp, Rattus norvegicus
ggtccaaatggagacatcctcactc

SEQ ID NO: 465646 - DNA, 25 bp, Rattus norvegicus
ggtccaaattggaaagcagcccatt

SEQ ID NO: 465647 - DNA, 25 bp, Rattus norvegicus
ggtccaaattggtaagcagcccatt

SEQ ID NO: 465648 - DNA, 25 bp, Rattus norvegicus
ggtccaacaagcatggtgtccaatt

SEQ ID NO: 465649 - DNA, 25 bp, Rattus norvegicus
ggtccaacaagcttggtgtccaatt

SEQ ID NO: 465650 - DNA, 25 bp, Rattus norvegicus
ggtccaacacagaacatggctctta

SEQ ID NO: 465651 - DNA, 25 bp, Rattus norvegicus
ggtccaacacagtacatggctctta

SEQ ID NO: 465652 - DNA, 25 bp, Rattus norvegicus
ggtccaacaggaccttttcaatgag

SEQ ID NO: 465653 - DNA, 25 bp, Rattus norvegicus
ggtccaacaggagcttttcaatgag

SEQ ID NO: 465654 - DNA, 25 bp, Rattus norvegicus
ggtccaagatctatttcaaatgctc

SEQ ID NO: 465655 - DNA, 25 bp, Rattus norvegicus
ggtccaagatctttttcaaatgctc

SEQ ID NO: 465656 - DNA, 25 bp, Rattus norvegicus
ggtccaagattcctagtgcactgag

SEQ ID NO: 465657 - DNA, 25 bp, Rattus norvegicus
ggtccaagattcgtagtgcactgag

SEQ ID NO: 465658 - DNA, 25 bp, Rattus norvegicus
ggtccaagctccactgtgcagagta

SEQ ID NO: 465659 - DNA, 25 bp, Rattus norvegicus
ggtccaagctcctctgtgcagagta

SEQ ID NO: 465660 - DNA, 25 bp, Rattus norvegicus
ggtccaaggcagatctggtttcatt

SEQ ID NO: 465661 - DNA, 25 bp, Rattus norvegicus
ggtccaaggcagttctggtttcatt

SEQ ID NO: 465662 - DNA, 25 bp, Rattus norvegicus
ggtccaaggcccatgagagtacata

SEQ ID NO: 465663 - DNA, 25 bp, Rattus norvegicus
ggtccaaggcccttgagagtacata

SEQ ID NO: 465664 - DNA, 25 bp, Rattus norvegicus
ggtccaaggccgagtgagagcccac

SEQ ID NO: 465665 - DNA, 25 bp, Rattus norvegicus
ggtccaaggccgtgtgagagcccac

SEQ ID NO: 465666 - DNA, 25 bp, Rattus norvegicus
ggtccaagggtcacggcttcatcac

SEQ ID NO: 465667 - DNA, 25 bp, Rattus norvegicus
ggtccaagggtctcggcttcatcac

SEQ ID NO: 465668 - DNA, 25 bp, Rattus norvegicus
ggtccaagtacaaccagactctgaa

SEQ ID NO: 465669 - DNA, 25 bp, Rattus norvegicus
ggtccaagtacatccagactctgaa

SEQ ID NO: 465670 - DNA, 25 bp, Rattus norvegicus
ggtccaagttttcttcatgcaacgg

SEQ ID NO: 465671 - DNA, 25 bp, Rattus norvegicus
ggtccaagttttgttcatgcaacgg

SEQ ID NO: 465672 - DNA, 25 bp, Rattus norvegicus
ggtccaatgaccagcaggttccaga

SEQ ID NO: 465673 - DNA, 25 bp, Rattus norvegicus
ggtccaatgacctgcaggttccaga

SEQ ID NO: 465674 - DNA, 25 bp, Rattus norvegicus
ggtccaatggccatacttctacaga

SEQ ID NO: 465675 - DNA, 25 bp, Rattus norvegicus
ggtccaatggccctgtaaaatgtca

SEQ ID NO: 465676 - DNA, 25 bp, Rattus norvegicus
ggtccaatggccgtgtaaaatgtca

SEQ ID NO: 465677 - DNA, 25 bp, Rattus norvegicus
ggtccaatggccttacttctacaga

SEQ ID NO: 465678 - DNA, 25 bp, Rattus norvegicus
ggtccaatgtacatggtgggccaag

SEQ ID NO: 465679 - DNA, 25 bp, Rattus norvegicus
ggtccaatgtacttggtgggccaag

SEQ ID NO: 465680 - DNA, 25 bp, Rattus norvegicus
ggtccaattcaaatcagcgtcttct

SEQ ID NO: 465681 - DNA, 25 bp, Rattus norvegicus
ggtccaattcaattcagcgtcttct

SEQ ID NO: 465682 - DNA, 25 bp, Rattus norvegicus
ggtccaattgatagcccattaaatt

SEQ ID NO: 465683 - DNA, 25 bp, Rattus norvegicus
ggtccaattgattgcccattaaatt

SEQ ID NO: 465684 - DNA, 25 bp, Rattus norvegicus
ggtccaattgctcgccagatctata

SEQ ID NO: 465685 - DNA, 25 bp, Rattus norvegicus
ggtccaattgctggccagatctata

SEQ ID NO: 465686 - DNA, 25 bp, Rattus norvegicus
ggtccaatttctattattctccttc

SEQ ID NO: 465687 - DNA, 25 bp, Rattus norvegicus
ggtccaatttcttttattctccttc

SEQ ID NO: 465688 - DNA, 25 bp, Rattus norvegicus
ggtccacaagacctcccgggagatc

SEQ ID NO: 465689 - DNA, 25 bp, Rattus norvegicus
ggtccacaagacgtcccgggagatc

SEQ ID NO: 465690 - DNA, 25 bp, Rattus norvegicus
ggtccacacaacatagatctgttct

SEQ ID NO: 465691 - DNA, 25 bp, Rattus norvegicus
ggtccacacaacttagatctgttct

SEQ ID NO: 465692 - DNA, 25 bp, Rattus norvegicus
ggtccacaccgtatacatttgtcaa

SEQ ID NO: 465693 - DNA, 25 bp, Rattus norvegicus
ggtccacaccgtttacatttgtcaa

SEQ ID NO: 465694 - DNA, 25 bp, Rattus norvegicus
ggtccacactgtacatgcatctttc

SEQ ID NO: 465695 - DNA, 25 bp, Rattus norvegicus
ggtccacactgttcatgcatctttc

SEQ ID NO: 465696 - DNA, 25 bp, Rattus norvegicus
ggtccacacttgagcagtctgcagc

SEQ ID NO: 465697 - DNA, 25 bp, Rattus norvegicus
ggtccacacttgtgcagtctgcagc

SEQ ID NO: 465698 - DNA, 25 bp, Rattus norvegicus
ggtccacagagcaggctgatcaaga

SEQ ID NO: 465699 - DNA, 25 bp, Rattus norvegicus
ggtccacagagctggctgatcaaga

SEQ ID NO: 465700 - DNA, 25 bp, Rattus norvegicus
ggtccacagcacagtatattatgat

SEQ ID NO: 465701 - DNA, 25 bp, Rattus norvegicus
ggtccacagcactgtatattatgat

SEQ ID NO: 465702 - DNA, 25 bp, Rattus norvegicus
ggtccacaggccacacagcaatagg

SEQ ID NO: 465703 - DNA, 25 bp, Rattus norvegicus
ggtccacaggcctcacagcaatagg

SEQ ID NO: 465704 - DNA, 25 bp, Rattus norvegicus
ggtccacatcataatctatacactg

SEQ ID NO: 465705 - DNA, 25 bp, Rattus norvegicus
ggtccacatcattatctatacactg

SEQ ID NO: 465706 - DNA, 25 bp, Rattus norvegicus
ggtccacatctcaagggccatgata

SEQ ID NO: 465707 - DNA, 25 bp, Rattus norvegicus
ggtccacatctctagggccatgata

SEQ ID NO: 465708 - DNA, 25 bp, Rattus norvegicus
ggtccacatgacctagcaaagatgc

SEQ ID NO: 465709 - DNA, 25 bp, Rattus norvegicus
ggtccacatgacgtagcaaagatgc

SEQ ID NO: 465710 - DNA, 25 bp, Rattus norvegicus
ggtccacatgtaagtgtctgcttcc

SEQ ID NO: 465711 - DNA, 25 bp, Rattus norvegicus
ggtccacatgtatgtgtctgcttcc

SEQ ID NO: 465712 - DNA, 25 bp, Rattus norvegicus
ggtccacccatgatgcccagcagaa

SEQ ID NO: 465713 - DNA, 25 bp, Rattus norvegicus
ggtccacccatgttgcccagcagaa

SEQ ID NO: 465714 - DNA, 25 bp, Rattus norvegicus
ggtccaccccatcgctatgcaaatg

SEQ ID NO: 465715 - DNA, 25 bp, Rattus norvegicus
ggtccaccccatggctatgcaaatg

SEQ ID NO: 465716 - DNA, 25 bp, Rattus norvegicus
ggtccaccctgacgagttggtatgt

SEQ ID NO: 465717 - DNA, 25 bp, Rattus norvegicus
ggtccaccctgaggagttggtatgt

SEQ ID NO: 465718 - DNA, 25 bp, Rattus norvegicus
ggtccactgcaacggaagagtcgat

SEQ ID NO: 465719 - DNA, 25 bp, Rattus norvegicus
ggtccactgcaagggaagagtcgat

SEQ ID NO: 465720 - DNA, 25 bp, Rattus norvegicus
ggtccactgcccaatactgaagcaa

SEQ ID NO: 465721 - DNA, 25 bp, Rattus norvegicus
ggtccactgccctatactgaagcaa

SEQ ID NO: 465722 - DNA, 25 bp, Rattus norvegicus
ggtccactggcaatcagcaagagat

SEQ ID NO: 465723 - DNA, 25 bp, Rattus norvegicus
ggtccactggcattcagcaagagat

SEQ ID NO: 465724 - DNA, 25 bp, Rattus norvegicus
ggtccacttcatagttatggaactt

SEQ ID NO: 465725 - DNA, 25 bp, Rattus norvegicus
ggtccacttcattgttatggaactt

SEQ ID NO: 465726 - DNA, 25 bp, Rattus norvegicus
ggtccacttccgaagttctgtatcc

SEQ ID NO: 465727 - DNA, 25 bp, Rattus norvegicus
ggtccacttccgtagttctgtatcc

SEQ ID NO: 465728 - DNA, 25 bp, Rattus norvegicus
ggtccacttgaccacccatgggatc

SEQ ID NO: 465729 - DNA, 25 bp, Rattus norvegicus
ggtccacttgacgacccatgggatc

SEQ ID NO: 465730 - DNA, 25 bp, Rattus norvegicus
ggtccagaagttcaggcccagcaat

SEQ ID NO: 465731 - DNA, 25 bp, Rattus norvegicus
ggtccagaagttgaggcccagcaat

SEQ ID NO: 465732 - DNA, 25 bp, Rattus norvegicus
ggtccagactgaagtcacctcgtga

SEQ ID NO: 465733 - DNA, 25 bp, Rattus norvegicus
ggtccagactgatgtcacctcgtga

SEQ ID NO: 465734 - DNA, 25 bp, Rattus norvegicus
ggtccagaggaccagctctttgaca

SEQ ID NO: 465735 - DNA, 25 bp, Rattus norvegicus
ggtccagaggacgagctctttgaca

SEQ ID NO: 465736 - DNA, 25 bp, Rattus norvegicus
ggtccagaggtacgtagcccatgca

SEQ ID NO: 465737 - DNA, 25 bp, Rattus norvegicus
ggtccagaggtaggtagcccatgca

SEQ ID NO: 465738 - DNA, 25 bp, Rattus norvegicus
ggtccagaggttcattgacctcatt

SEQ ID NO: 465739 - DNA, 25 bp, Rattus norvegicus
ggtccagaggttgattgacctcatt

SEQ ID NO: 465740 - DNA, 25 bp, Rattus norvegicus
ggtccagatcagaggctaactggcc

SEQ ID NO: 465741 - DNA, 25 bp, Rattus norvegicus
ggtccagatcagtggctaactggcc

SEQ ID NO: 465742 - DNA, 25 bp, Rattus norvegicus
ggtccagatgtgaaccaggtctcag

SEQ ID NO: 465743 - DNA, 25 bp, Rattus norvegicus
ggtccagatgtgtaccaggtctcag

SEQ ID NO: 465744 - DNA, 25 bp, Rattus norvegicus
ggtccagattacatgagaaacttgt

SEQ ID NO: 465745 - DNA, 25 bp, Rattus norvegicus
ggtccagattacttgagaaacttgt

SEQ ID NO: 465746 - DNA, 25 bp, Rattus norvegicus
ggtccagcaacaccaatccatgtgg

SEQ ID NO: 465747 - DNA, 25 bp, Rattus norvegicus
ggtccagcaacagcaatccatgtgg

SEQ ID NO: 465748 - DNA, 25 bp, Rattus norvegicus
ggtccagcaacgcaaccgggagaac

SEQ ID NO: 465749 - DNA, 25 bp, Rattus norvegicus
ggtccagcaacggaaccgggagaac

SEQ ID NO: 465750 - DNA, 25 bp, Rattus norvegicus
ggtccagcacagaactgacaaccca

SEQ ID NO: 465751 - DNA, 25 bp, Rattus norvegicus
ggtccagcacagtactgacaaccca

SEQ ID NO: 465752 - DNA, 25 bp, Rattus norvegicus
ggtccagcacttcacaaaagccaga

SEQ ID NO: 465753 - DNA, 25 bp, Rattus norvegicus
ggtccagcacttgacaaaagccaga

SEQ ID NO: 465754 - DNA, 25 bp, Rattus norvegicus
ggtccagcagtgcttggtgcctcca

SEQ ID NO: 465755 - DNA, 25 bp, Rattus norvegicus
ggtccagcagtggttggtgcctcca

SEQ ID NO: 465756 - DNA, 25 bp, Rattus norvegicus
ggtccagcctggaagatctcccgaa

SEQ ID NO: 465757 - DNA, 25 bp, Rattus norvegicus
ggtccagcctggtagatctcccgaa

SEQ ID NO: 465758 - DNA, 25 bp, Rattus norvegicus
ggtccagcggccacaaggatggaac

SEQ ID NO: 465759 - DNA, 25 bp, Rattus norvegicus
ggtccagcggcctcaaggatggaac

SEQ ID NO: 465760 - DNA, 25 bp, Rattus norvegicus
ggtccagctgctctgttgagagatc

SEQ ID NO: 465761 - DNA, 25 bp, Rattus norvegicus
ggtccagctgctgtgttgagagatc

SEQ ID NO: 465762 - DNA, 25 bp, Rattus norvegicus
ggtccagctgttctgttctgtggtc

SEQ ID NO: 465763 - DNA, 25 bp, Rattus norvegicus
ggtccagctgttgtgttctgtggtc

SEQ ID NO: 465764 - DNA, 25 bp, Rattus norvegicus
ggtccaggaagcatctatcaaacat

SEQ ID NO: 465765 - DNA, 25 bp, Rattus norvegicus
ggtccaggaagcttctatcaaacat

SEQ ID NO: 465766 - DNA, 25 bp, Rattus norvegicus
ggtccaggaggcaaggctctaagct

SEQ ID NO: 465767 - DNA, 25 bp, Rattus norvegicus
ggtccaggaggctaggctctaagct

SEQ ID NO: 465768 - DNA, 25 bp, Rattus norvegicus
ggtccaggattcagtaatgcttcat

SEQ ID NO: 465769 - DNA, 25 bp, Rattus norvegicus
ggtccaggattctgtaatgcttcat

SEQ ID NO: 465770 - DNA, 25 bp, Rattus norvegicus
ggtccaggatttccatagtgccaca

SEQ ID NO: 465771 - DNA, 25 bp, Rattus norvegicus
ggtccaggatttgcatagtgccaca

SEQ ID NO: 465772 - DNA, 25 bp, Rattus norvegicus
ggtccaggccagctttgtctataaa

SEQ ID NO: 465773 - DNA, 25 bp, Rattus norvegicus
ggtccaggccaggtttgtctataaa

SEQ ID NO: 465774 - DNA, 25 bp, Rattus norvegicus
ggtccaggctgtatatataccccat

SEQ ID NO: 465775 - DNA, 25 bp, Rattus norvegicus
ggtccaggctgtttatataccccat

SEQ ID NO: 465776 - DNA, 25 bp, Rattus norvegicus
ggtccagggcacagcagtccaggcc

SEQ ID NO: 465777 - DNA, 25 bp, Rattus norvegicus
ggtccagggcactgcagtccaggcc

SEQ ID NO: 465778 - DNA, 25 bp, Rattus norvegicus
ggtccagggctcaactggagagttt

SEQ ID NO: 465779 - DNA, 25 bp, Rattus norvegicus
ggtccagggctctactggagagttt

SEQ ID NO: 465780 - DNA, 25 bp, Rattus norvegicus
ggtccaggtagcctgtcgattttat

SEQ ID NO: 465781 - DNA, 25 bp, Rattus norvegicus
ggtccaggtagcgtgtcgattttat

SEQ ID NO: 465782 - DNA, 25 bp, Rattus norvegicus
ggtccaggtctaataaggctcgttc

SEQ ID NO: 465783 - DNA, 25 bp, Rattus norvegicus
ggtccaggtctattaaggctcgttc

SEQ ID NO: 465784 - DNA, 25 bp, Rattus norvegicus
ggtccaggtgctatctgctgtgtgt

SEQ ID NO: 465785 - DNA, 25 bp, Rattus norvegicus
ggtccaggtgctttctgctgtgtgt

SEQ ID NO: 465786 - DNA, 25 bp, Rattus norvegicus
ggtccaggttttcagctcaccagct

SEQ ID NO: 465787 - DNA, 25 bp, Rattus norvegicus
ggtccaggttttgagctcaccagct

SEQ ID NO: 465788 - DNA, 25 bp, Rattus norvegicus
ggtccagtaggacaggctgcaccta

SEQ ID NO: 465789 - DNA, 25 bp, Rattus norvegicus
ggtccagtaggagaggctgcaccta

SEQ ID NO: 465790 - DNA, 25 bp, Rattus norvegicus
ggtccagtgacaagtagactcctct

SEQ ID NO: 465791 - DNA, 25 bp, Rattus norvegicus
ggtccagtgacatgtagactcctct

SEQ ID NO: 465792 - DNA, 25 bp, Rattus norvegicus
ggtccagtgtccatgcagatgtaat

SEQ ID NO: 465793 - DNA, 25 bp, Rattus norvegicus
ggtccagtgtccttgcagatgtaat

SEQ ID NO: 465794 - DNA, 25 bp, Rattus norvegicus
ggtccagtgtgaaggcagctgcaat

SEQ ID NO: 465795 - DNA, 25 bp, Rattus norvegicus
ggtccagtgtgatggcagctgcaat

SEQ ID NO: 465796 - DNA, 25 bp, Rattus norvegicus
ggtccagttaccacagggcagtcaa

SEQ ID NO: 465797 - DNA, 25 bp, Rattus norvegicus
ggtccagttacctcagggcagtcaa

SEQ ID NO: 465798 - DNA, 25 bp, Rattus norvegicus
ggtccagttgataaaggcagtccct

SEQ ID NO: 465799 - DNA, 25 bp, Rattus norvegicus
ggtccagttgattaaggcagtccct

SEQ ID NO: 465800 - DNA, 25 bp, Rattus norvegicus
ggtccagtttatccaggtccagcct

SEQ ID NO: 465801 - DNA, 25 bp, Rattus norvegicus
ggtccagtttatgcaggtccagcct

SEQ ID NO: 465802 - DNA, 25 bp, Rattus norvegicus
ggtccataagctccacatagtgttg

SEQ ID NO: 465803 - DNA, 25 bp, Rattus norvegicus
ggtccataagctgcacatagtgttg

SEQ ID NO: 465804 - DNA, 25 bp, Rattus norvegicus
ggtccatagctgctactgggttgac

SEQ ID NO: 465805 - DNA, 25 bp, Rattus norvegicus
ggtccatagctggtactgggttgac

SEQ ID NO: 465806 - DNA, 25 bp, Rattus norvegicus
ggtccataggcaagagagtttattt

SEQ ID NO: 465807 - DNA, 25 bp, Rattus norvegicus
ggtccataggcatgagagtttattt

SEQ ID NO: 465808 - DNA, 25 bp, Rattus norvegicus
ggtccatatatcagtaccataataa

SEQ ID NO: 465809 - DNA, 25 bp, Rattus norvegicus
ggtccatatatctgtaccataataa

SEQ ID NO: 465810 - DNA, 25 bp, Rattus norvegicus
ggtccatatgtaattttccccattt

SEQ ID NO: 465811 - DNA, 25 bp, Rattus norvegicus
ggtccatatgtatttttccccattt

SEQ ID NO: 465812 - DNA, 25 bp, Rattus norvegicus
ggtccatattttactaatgacttca

SEQ ID NO: 465813 - DNA, 25 bp, Rattus norvegicus
ggtccatatttttctaatgacttca

SEQ ID NO: 465814 - DNA, 25 bp, Rattus norvegicus
ggtccatcatataaactgtcagtat

SEQ ID NO: 465815 - DNA, 25 bp, Rattus norvegicus
ggtccatcatattaactgtcagtat

SEQ ID NO: 465816 - DNA, 25 bp, Rattus norvegicus
ggtccatcccaacaaggaagcactg

SEQ ID NO: 465817 - DNA, 25 bp, Rattus norvegicus
ggtccatcccaagaaggaagcactg

SEQ ID NO: 465818 - DNA, 25 bp, Rattus norvegicus
ggtccatcgagccaaagcattcctc

SEQ ID NO: 465819 - DNA, 25 bp, Rattus norvegicus
ggtccatcgagcgaaagcattcctc

SEQ ID NO: 465820 - DNA, 25 bp, Rattus norvegicus
ggtccatcgtggatgtgtgtgacaa

SEQ ID NO: 465821 - DNA, 25 bp, Rattus norvegicus
ggtccatcgtggttgtgtgtgacaa

SEQ ID NO: 465822 - DNA, 25 bp, Rattus norvegicus
ggtccatcttggcatgagttctcat

SEQ ID NO: 465823 - DNA, 25 bp, Rattus norvegicus
ggtccatcttgggatgagttctcat

SEQ ID NO: 465824 - DNA, 25 bp, Rattus norvegicus
ggtccatgcagtagtttgtttccaa

SEQ ID NO: 465825 - DNA, 25 bp, Rattus norvegicus
ggtccatgcagttgtttgtttccaa

SEQ ID NO: 465826 - DNA, 25 bp, Rattus norvegicus
ggtccatgcctaagtttagtccttg

SEQ ID NO: 465827 - DNA, 25 bp, Rattus norvegicus
ggtccatgcctatgtttagtccttg

SEQ ID NO: 465828 - DNA, 25 bp, Rattus norvegicus
ggtccatgggtaattgctgtcactt

SEQ ID NO: 465829 - DNA, 25 bp, Rattus norvegicus
ggtccatgggtatttgctgtcactt

SEQ ID NO: 465830 - DNA, 25 bp, Rattus norvegicus
ggtccatgtattacactgtttctgt

SEQ ID NO: 465831 - DNA, 25 bp, Rattus norvegicus
ggtccatgtatttcactgtttctgt

SEQ ID NO: 465832 - DNA, 25 bp, Rattus norvegicus
ggtccatgtcctcaaaagcaggctg

SEQ ID NO: 465833 - DNA, 25 bp, Rattus norvegicus
ggtccatgtcctgaaaagcaggctg

SEQ ID NO: 465834 - DNA, 25 bp, Rattus norvegicus
ggtccatgtggtaacttcgcttaac

SEQ ID NO: 465835 - DNA, 25 bp, Rattus norvegicus
ggtccatgtggttacttcgcttaac

SEQ ID NO: 465836 - DNA, 25 bp, Rattus norvegicus
ggtccatgtgttcatttttccaggc

SEQ ID NO: 465837 - DNA, 25 bp, Rattus norvegicus
ggtccatgtgttgatttttccaggc

SEQ ID NO: 465838 - DNA, 25 bp, Rattus norvegicus
ggtccattcagtatgcacttaggca

SEQ ID NO: 465839 - DNA, 25 bp, Rattus norvegicus
ggtccattcagtttgcacttaggca

SEQ ID NO: 465840 - DNA, 25 bp, Rattus norvegicus
ggtccattgcctacagatgcctgta

SEQ ID NO: 465841 - DNA, 25 bp, Rattus norvegicus
ggtccattgccttcagatgcctgta

SEQ ID NO: 465842 - DNA, 25 bp, Rattus norvegicus
ggtccatttaccagactgggctaat

SEQ ID NO: 465843 - DNA, 25 bp, Rattus norvegicus
ggtccatttacctgactgggctaat

SEQ ID NO: 465844 - DNA, 25 bp, Rattus norvegicus
ggtccatttagtagcctatccagta

SEQ ID NO: 465845 - DNA, 25 bp, Rattus norvegicus
ggtccatttagttgcctatccagta

SEQ ID NO: 465846 - DNA, 25 bp, Rattus norvegicus
ggtccatttatcaacacaaactgct

SEQ ID NO: 465847 - DNA, 25 bp, Rattus norvegicus
ggtccatttatctacacaaactgct

SEQ ID NO: 465848 - DNA, 25 bp, Rattus norvegicus
ggtccattttttcatgatccatttc

SEQ ID NO: 465849 - DNA, 25 bp, Rattus norvegicus
ggtccattttttgatgatccatttc

SEQ ID NO: 465850 - DNA, 25 bp, Rattus norvegicus
ggtcccaaagttccatcctgaaatt

SEQ ID NO: 465851 - DNA, 25 bp, Rattus norvegicus
ggtcccaaagttgcatcctgaaatt

SEQ ID NO: 465852 - DNA, 25 bp, Rattus norvegicus
ggtcccaaggagaaactagtgtatc

SEQ ID NO: 465853 - DNA, 25 bp, Rattus norvegicus
ggtcccaaggagtaactagtgtatc

SEQ ID NO: 465854 - DNA, 25 bp, Rattus norvegicus
ggtcccaagtgaagaactgtcacat

SEQ ID NO: 465855 - DNA, 25 bp, Rattus norvegicus
ggtcccaagtgatgaactgtcacat

SEQ ID NO: 465856 - DNA, 25 bp, Rattus norvegicus
ggtcccaagtttagtgcaatctgaa

SEQ ID NO: 465857 - DNA, 25 bp, Rattus norvegicus
ggtcccaagttttgtgcaatctgaa

SEQ ID NO: 465858 - DNA, 25 bp, Rattus norvegicus
ggtcccaatggcaaagcagcgcggc

SEQ ID NO: 465859 - DNA, 25 bp, Rattus norvegicus
ggtcccaatggctaagcagcgcggc

SEQ ID NO: 465860 - DNA, 25 bp, Rattus norvegicus
ggtcccacaggcaatctcagggtgc

SEQ ID NO: 465861 - DNA, 25 bp, Rattus norvegicus
ggtcccacaggccagacactgattg

SEQ ID NO: 465862 - DNA, 25 bp, Rattus norvegicus
ggtcccacaggcgagacactgattg

SEQ ID NO: 465863 - DNA, 25 bp, Rattus norvegicus
ggtcccacaggctatctcagggtgc

SEQ ID NO: 465864 - DNA, 25 bp, Rattus norvegicus
ggtcccaccaccattctggtcagag

SEQ ID NO: 465865 - DNA, 25 bp, Rattus norvegicus
ggtcccaccacctttctggtcagag

SEQ ID NO: 465866 - DNA, 25 bp, Rattus norvegicus
ggtcccacgttgctgtgttgttaaa

SEQ ID NO: 465867 - DNA, 25 bp, Rattus norvegicus
ggtcccacgttggtgtgttgttaaa

SEQ ID NO: 465868 - DNA, 25 bp, Rattus norvegicus
ggtcccactgaccagttctatgtat

SEQ ID NO: 465869 - DNA, 25 bp, Rattus norvegicus
ggtcccactgacgagttctatgtat

SEQ ID NO: 465870 - DNA, 25 bp, Rattus norvegicus
ggtcccactggcctggattgtgaac

SEQ ID NO: 465871 - DNA, 25 bp, Rattus norvegicus
ggtcccactggcgtggattgtgaac

SEQ ID NO: 465872 - DNA, 25 bp, Rattus norvegicus
ggtcccacttggacaatgagtttgt

SEQ ID NO: 465873 - DNA, 25 bp, Rattus norvegicus
ggtcccacttggtcaatgagtttgt

SEQ ID NO: 465874 - DNA, 25 bp, Rattus norvegicus
ggtcccagaaccctgtgaagtgttc

SEQ ID NO: 465875 - DNA, 25 bp, Rattus norvegicus
ggtcccagaaccgtgtgaagtgttc

SEQ ID NO: 465876 - DNA, 25 bp, Rattus norvegicus
ggtcccagacacaaaggcgtcagtt

SEQ ID NO: 465877 - DNA, 25 bp, Rattus norvegicus
ggtcccagacactaaggcgtcagtt

SEQ ID NO: 465878 - DNA, 25 bp, Rattus norvegicus
ggtcccagcatcagttcggctactc

SEQ ID NO: 465879 - DNA, 25 bp, Rattus norvegicus
ggtcccagcatctgttcggctactc

SEQ ID NO: 465880 - DNA, 25 bp, Rattus norvegicus
ggtcccagcctgcactgtatatgtg

SEQ ID NO: 465881 - DNA, 25 bp, Rattus norvegicus
ggtcccagcctggactgtatatgtg

SEQ ID NO: 465882 - DNA, 25 bp, Rattus norvegicus
ggtcccagctttacattttcagtac

SEQ ID NO: 465883 - DNA, 25 bp, Rattus norvegicus
ggtcccagcttttcattttcagtac

SEQ ID NO: 465884 - DNA, 25 bp, Rattus norvegicus
ggtcccaggatacactcaaggagca

SEQ ID NO: 465885 - DNA, 25 bp, Rattus norvegicus
ggtcccaggatagactcaaggagca

SEQ ID NO: 465886 - DNA, 25 bp, Rattus norvegicus
ggtcccaggcccagacttagaaaag

SEQ ID NO: 465887 - DNA, 25 bp, Rattus norvegicus
ggtcccaggccctgacttagaaaag

SEQ ID NO: 465888 - DNA, 25 bp, Rattus norvegicus
ggtcccaggcggacccttctgttat

SEQ ID NO: 465889 - DNA, 25 bp, Rattus norvegicus
ggtcccaggcggtcccttctgttat

SEQ ID NO: 465890 - DNA, 25 bp, Rattus norvegicus
ggtcccaggctcacaaaaatagtgt

SEQ ID NO: 465891 - DNA, 25 bp, Rattus norvegicus
ggtcccaggctctcaaaaatagtgt

SEQ ID NO: 465892 - DNA, 25 bp, Rattus norvegicus
ggtcccaggtttcttctttctgagc

SEQ ID NO: 465893 - DNA, 25 bp, Rattus norvegicus
ggtcccaggtttgttctttctgagc

SEQ ID NO: 465894 - DNA, 25 bp, Rattus norvegicus
ggtcccagtattctcagatctagtc

SEQ ID NO: 465895 - DNA, 25 bp, Rattus norvegicus
ggtcccagtattgtcagatctagtc

SEQ ID NO: 465896 - DNA, 25 bp, Rattus norvegicus
ggtcccagtcacagaagtctgagca

SEQ ID NO: 465897 - DNA, 25 bp, Rattus norvegicus
ggtcccagtcactgaagtctgagca

SEQ ID NO: 465898 - DNA, 25 bp, Rattus norvegicus
ggtcccagtgataatcctgttggat

SEQ ID NO: 465899 - DNA, 25 bp, Rattus norvegicus
ggtcccagtgattatcctgttggat

SEQ ID NO: 465900 - DNA, 25 bp, Rattus norvegicus
ggtcccagtggaatttctctctttg

SEQ ID NO: 465901 - DNA, 25 bp, Rattus norvegicus
ggtcccagtggattttctctctttg

SEQ ID NO: 465902 - DNA, 25 bp, Rattus norvegicus
ggtcccataagacgatcttgtctaa

SEQ ID NO: 465903 - DNA, 25 bp, Rattus norvegicus
ggtcccataagaggatcttgtctaa

SEQ ID NO: 465904 - DNA, 25 bp, Rattus norvegicus
ggtcccatatcacatattctgcata

SEQ ID NO: 465905 - DNA, 25 bp, Rattus norvegicus
ggtcccatatcagatattctgcata

SEQ ID NO: 465906 - DNA, 25 bp, Rattus norvegicus
ggtcccatccccagatgacaaaaat

SEQ ID NO: 465907 - DNA, 25 bp, Rattus norvegicus
ggtcccatcccctgatgacaaaaat

SEQ ID NO: 465908 - DNA, 25 bp, Rattus norvegicus
ggtcccatgatgatgactttcctta

SEQ ID NO: 465909 - DNA, 25 bp, Rattus norvegicus
ggtcccatgatgttgactttcctta

SEQ ID NO: 465910 - DNA, 25 bp, Rattus norvegicus
ggtcccatggcacttgtagcagtga

SEQ ID NO: 465911 - DNA, 25 bp, Rattus norvegicus
ggtcccatggcagttgtagcagtga

SEQ ID NO: 465912 - DNA, 25 bp, Rattus norvegicus
ggtcccattccgcttacaggagcat

SEQ ID NO: 465913 - DNA, 25 bp, Rattus norvegicus
ggtcccattccggttacaggagcat

SEQ ID NO: 465914 - DNA, 25 bp, Rattus norvegicus
ggtcccattctgatccagggtggga

SEQ ID NO: 465915 - DNA, 25 bp, Rattus norvegicus
ggtcccattctgttccagggtggga

SEQ ID NO: 465916 - DNA, 25 bp, Rattus norvegicus
ggtcccattgggagcaacagtgatt

SEQ ID NO: 465917 - DNA, 25 bp, Rattus norvegicus
ggtcccattgggtgcaacagtgatt

SEQ ID NO: 465918 - DNA, 25 bp, Rattus norvegicus
ggtcccattgtgaccaaatgcagtc

SEQ ID NO: 465919 - DNA, 25 bp, Rattus norvegicus
ggtcccattgtgtccaaatgcagtc

SEQ ID NO: 465920 - DNA, 25 bp, Rattus norvegicus
ggtcccatttcccaggagcacattg

SEQ ID NO: 465921 - DNA, 25 bp, Rattus norvegicus
ggtcccatttccgaggagcacattg

SEQ ID NO: 465922 - DNA, 25 bp, Rattus norvegicus
ggtccccaaggaacatcattcgttg

SEQ ID NO: 465923 - DNA, 25 bp, Rattus norvegicus
ggtccccaaggatcatcattcgttg

SEQ ID NO: 465924 - DNA, 25 bp, Rattus norvegicus
ggtccccaagtgcagaaagggaaca

SEQ ID NO: 465925 - DNA, 25 bp, Rattus norvegicus
ggtccccaagtggagaaagggaaca

SEQ ID NO: 465926 - DNA, 25 bp, Rattus norvegicus
ggtccccactgcaacagagtatcag

SEQ ID NO: 465927 - DNA, 25 bp, Rattus norvegicus
ggtccccactgctacagagtatcag

SEQ ID NO: 465928 - DNA, 25 bp, Rattus norvegicus
ggtccccacttcaatatctaatatc

SEQ ID NO: 465929 - DNA, 25 bp, Rattus norvegicus
ggtccccacttctatatctaatatc

SEQ ID NO: 465930 - DNA, 25 bp, Rattus norvegicus
ggtccccagaatcatcctaaagcca

SEQ ID NO: 465931 - DNA, 25 bp, Rattus norvegicus
ggtccccagaatgatcctaaagcca

SEQ ID NO: 465932 - DNA, 25 bp, Rattus norvegicus
ggtccccagagaaagcaggcaaact

SEQ ID NO: 465933 - DNA, 25 bp, Rattus norvegicus
ggtccccagagatagcaggcaaact

SEQ ID NO: 465934 - DNA, 25 bp, Rattus norvegicus
ggtccccagcgtattatgacctgta

SEQ ID NO: 465935 - DNA, 25 bp, Rattus norvegicus
ggtccccagcgttttatgacctgta

SEQ ID NO: 465936 - DNA, 25 bp, Rattus norvegicus
ggtccccatattaagagttttctct

SEQ ID NO: 465937 - DNA, 25 bp, Rattus norvegicus
ggtccccatatttagagttttctct

SEQ ID NO: 465938 - DNA, 25 bp, Rattus norvegicus
ggtccccatcaactaatgttccagc

SEQ ID NO: 465939 - DNA, 25 bp, Rattus norvegicus
ggtccccatcaagtaatgttccagc

SEQ ID NO: 465940 - DNA, 25 bp, Rattus norvegicus
ggtccccatcctctatattttagtt

SEQ ID NO: 465941 - DNA, 25 bp, Rattus norvegicus
ggtccccatcctgtatattttagtt

SEQ ID NO: 465942 - DNA, 25 bp, Rattus norvegicus
ggtccccatgtacgtgtgtgttcaa

SEQ ID NO: 465943 - DNA, 25 bp, Rattus norvegicus
ggtccccatgtaggtgtgtgttcaa

SEQ ID NO: 465944 - DNA, 25 bp, Rattus norvegicus
ggtccccatttgaacattcagctga

SEQ ID NO: 465945 - DNA, 25 bp, Rattus norvegicus
ggtccccatttgtacattcagctga

SEQ ID NO: 465946 - DNA, 25 bp, Rattus norvegicus
ggtcccccatcacgtgctcagggag

SEQ ID NO: 465947 - DNA, 25 bp, Rattus norvegicus
ggtcccccatcaggtgctcagggag

SEQ ID NO: 465948 - DNA, 25 bp, Rattus norvegicus
ggtccccgactaatgtttatctcta

SEQ ID NO: 465949 - DNA, 25 bp, Rattus norvegicus
ggtccccgactattgtttatctcta

SEQ ID NO: 465950 - DNA, 25 bp, Rattus norvegicus
ggtccccgagcactactgtgtatca

SEQ ID NO: 465951 - DNA, 25 bp, Rattus norvegicus
ggtccccgagcagtactgtgtatca

SEQ ID NO: 465952 - DNA, 25 bp, Rattus norvegicus
ggtccccggaccatatatttattgc

SEQ ID NO: 465953 - DNA, 25 bp, Rattus norvegicus
ggtccccggaccttatatttattgc

SEQ ID NO: 465954 - DNA, 25 bp, Rattus norvegicus
ggtccccgggaaacgaattcaatca

SEQ ID NO: 465955 - DNA, 25 bp, Rattus norvegicus
ggtccccgggaatcgaattcaatca

SEQ ID NO: 465956 - DNA, 25 bp, Rattus norvegicus
ggtccccgtcgaacagagcatctgg

SEQ ID NO: 465957 - DNA, 25 bp, Rattus norvegicus
ggtccccgtcgatcagagcatctgg

SEQ ID NO: 465958 - DNA, 25 bp, Rattus norvegicus
ggtccccgttggacagtgcaaactg

SEQ ID NO: 465959 - DNA, 25 bp, Rattus norvegicus
ggtccccgttggtcagtgcaaactg

SEQ ID NO: 465960 - DNA, 25 bp, Rattus norvegicus
ggtcccctatatctctctggaggaa

SEQ ID NO: 465961 - DNA, 25 bp, Rattus norvegicus
ggtcccctatatgtctctggaggaa

SEQ ID NO: 465962 - DNA, 25 bp, Rattus norvegicus
ggtcccctgaccaaggcacgcggat

SEQ ID NO: 465963 - DNA, 25 bp, Rattus norvegicus
ggtcccctgacctaggcacgcggat

SEQ ID NO: 465964 - DNA, 25 bp, Rattus norvegicus
ggtcccctggaaagcaaaaacctct

SEQ ID NO: 465965 - DNA, 25 bp, Rattus norvegicus
ggtcccctggaatgcaaaaacctct

SEQ ID NO: 465966 - DNA, 25 bp, Rattus norvegicus
ggtcccctggatagattattggtac

SEQ ID NO: 465967 - DNA, 25 bp, Rattus norvegicus
ggtcccctggattgattattggtac

SEQ ID NO: 465968 - DNA, 25 bp, Rattus norvegicus
ggtcccctggctacaggtggaatta

SEQ ID NO: 465969 - DNA, 25 bp, Rattus norvegicus
ggtcccctggcttcaggtggaatta

SEQ ID NO: 465970 - DNA, 25 bp, Rattus norvegicus
ggtcccctggtaactacagaggatt

SEQ ID NO: 465971 - DNA, 25 bp, Rattus norvegicus
ggtcccctggtatctacagaggatt

SEQ ID NO: 465972 - DNA, 25 bp, Rattus norvegicus
ggtcccctgtggatgcaggcaaagc

SEQ ID NO: 465973 - DNA, 25 bp, Rattus norvegicus
ggtcccctgtggttgcaggcaaagc

SEQ ID NO: 465974 - DNA, 25 bp, Rattus norvegicus
ggtcccgaatcccttattgtgcaaa

SEQ ID NO: 465975 - DNA, 25 bp, Rattus norvegicus
ggtcccgaatccgttattgtgcaaa

SEQ ID NO: 465976 - DNA, 25 bp, Rattus norvegicus
ggtcccgacttgagatgtccaccta

SEQ ID NO: 465977 - DNA, 25 bp, Rattus norvegicus
ggtcccgacttgtgatgtccaccta

SEQ ID NO: 465978 - DNA, 25 bp, Rattus norvegicus
ggtcccgagactacacagctgagag

SEQ ID NO: 465979 - DNA, 25 bp, Rattus norvegicus
ggtcccgagacttcacagctgagag

SEQ ID NO: 465980 - DNA, 25 bp, Rattus norvegicus
ggtcccgataaccagatcacatgtc

SEQ ID NO: 465981 - DNA, 25 bp, Rattus norvegicus
ggtcccgataacgagatcacatgtc

SEQ ID NO: 465982 - DNA, 25 bp, Rattus norvegicus
ggtcccgcaaggctttcttttatag

SEQ ID NO: 465983 - DNA, 25 bp, Rattus norvegicus
ggtcccgcaagggtttcttttatag

SEQ ID NO: 465984 - DNA, 25 bp, Rattus norvegicus
ggtcccgcaggaagctgtggttaat

SEQ ID NO: 465985 - DNA, 25 bp, Rattus norvegicus
ggtcccgcaggatgctgtggttaat

SEQ ID NO: 465986 - DNA, 25 bp, Rattus norvegicus
ggtcccgcgagcatgcggagacttt

SEQ ID NO: 465987 - DNA, 25 bp, Rattus norvegicus
ggtcccgcgagcttgcggagacttt

SEQ ID NO: 465988 - DNA, 25 bp, Rattus norvegicus
ggtcccggtgagatgccagacaaat

SEQ ID NO: 465989 - DNA, 25 bp, Rattus norvegicus
ggtcccggtgagttgccagacaaat

SEQ ID NO: 465990 - DNA, 25 bp, Rattus norvegicus
ggtcccgtaattccactataaatat

SEQ ID NO: 465991 - DNA, 25 bp, Rattus norvegicus
ggtcccgtaattgcactataaatat

SEQ ID NO: 465992 - DNA, 25 bp, Rattus norvegicus
ggtcccgtgtacatacttttcagtg

SEQ ID NO: 465993 - DNA, 25 bp, Rattus norvegicus
ggtcccgtgtacttacttttcagtg

SEQ ID NO: 465994 - DNA, 25 bp, Rattus norvegicus
ggtcccgtgtataacacaggcagct

SEQ ID NO: 465995 - DNA, 25 bp, Rattus norvegicus
ggtcccgtgtattacacaggcagct

SEQ ID NO: 465996 - DNA, 25 bp, Rattus norvegicus
ggtcccgttgacattagtgacttgc

SEQ ID NO: 465997 - DNA, 25 bp, Rattus norvegicus
ggtcccgttgactttagtgacttgc

SEQ ID NO: 465998 - DNA, 25 bp, Rattus norvegicus
ggtccctaactcacacagaaactat

SEQ ID NO: 465999 - DNA, 25 bp, Rattus norvegicus
ggtccctaactctcacagaaactat

SEQ ID NO: 466000 - DNA, 25 bp, Rattus norvegicus
ggtccctaagatctgggcttcctta

SEQ ID NO: 466001 - DNA, 25 bp, Rattus norvegicus
ggtccctaagatgtgggcttcctta

SEQ ID NO: 466002 - DNA, 25 bp, Rattus norvegicus
ggtccctaccacaatcgccaagaaa

SEQ ID NO: 466003 - DNA, 25 bp, Rattus norvegicus
ggtccctaccactatcgccaagaaa

SEQ ID NO: 466004 - DNA, 25 bp, Rattus norvegicus
ggtccctagggtcatagctatccga

SEQ ID NO: 466005 - DNA, 25 bp, Rattus norvegicus
ggtccctagggtgatagctatccga

SEQ ID NO: 466006 - DNA, 25 bp, Rattus norvegicus
ggtccctataggatcatatgtttga

SEQ ID NO: 466007 - DNA, 25 bp, Rattus norvegicus
ggtccctataggttcatatgtttga

SEQ ID NO: 466008 - DNA, 25 bp, Rattus norvegicus
ggtccctatgaaattacacacttgt

SEQ ID NO: 466009 - DNA, 25 bp, Rattus norvegicus
ggtccctatgaatttacacacttgt

SEQ ID NO: 466010 - DNA, 25 bp, Rattus norvegicus
ggtccctatgttcaactcagcaata

SEQ ID NO: 466011 - DNA, 25 bp, Rattus norvegicus
ggtccctatgttgaactcagcaata

SEQ ID NO: 466012 - DNA, 25 bp, Rattus norvegicus
ggtccctcaagcctcggccatgaag

SEQ ID NO: 466013 - DNA, 25 bp, Rattus norvegicus
ggtccctcaagcgtcggccatgaag

SEQ ID NO: 466014 - DNA, 25 bp, Rattus norvegicus
ggtccctcagtccttctaaaagatt

SEQ ID NO: 466015 - DNA, 25 bp, Rattus norvegicus
ggtccctcagtcgttctaaaagatt

SEQ ID NO: 466016 - DNA, 25 bp, Rattus norvegicus
ggtccctcctacaggcatattaatt

SEQ ID NO: 466017 - DNA, 25 bp, Rattus norvegicus
ggtccctcctactggcatattaatt

SEQ ID NO: 466018 - DNA, 25 bp, Rattus norvegicus
ggtccctcctcacatgtgatgttga

SEQ ID NO: 466019 - DNA, 25 bp, Rattus norvegicus
ggtccctcctcagatgtgatgttga

SEQ ID NO: 466020 - DNA, 25 bp, Rattus norvegicus
ggtccctcgccaattcctggagaaa

SEQ ID NO: 466021 - DNA, 25 bp, Rattus norvegicus
ggtccctcgccatttcctggagaaa

SEQ ID NO: 466022 - DNA, 25 bp, Rattus norvegicus
ggtccctcgggtcaaacagaaagcg

SEQ ID NO: 466023 - DNA, 25 bp, Rattus norvegicus
ggtccctcgggtgaaacagaaagcg

SEQ ID NO: 466024 - DNA, 25 bp, Rattus norvegicus
ggtccctgagacatgcatgtaaaac

SEQ ID NO: 466025 - DNA, 25 bp, Rattus norvegicus
ggtccctgagacttgcatgtaaaac

SEQ ID NO: 466026 - DNA, 25 bp, Rattus norvegicus
ggtccctgagggagctgcatctgcc

SEQ ID NO: 466027 - DNA, 25 bp, Rattus norvegicus
ggtccctgagggtgctgcatctgcc

SEQ ID NO: 466028 - DNA, 25 bp, Rattus norvegicus
ggtccctggaataaagtgatacaat

SEQ ID NO: 466029 - DNA, 25 bp, Rattus norvegicus
ggtccctggaattaagtgatacaat

SEQ ID NO: 466030 - DNA, 25 bp, Rattus norvegicus
ggtccctggacaccaacttcaagaa

SEQ ID NO: 466031 - DNA, 25 bp, Rattus norvegicus
ggtccctggacagcaacttcaagaa

SEQ ID NO: 466032 - DNA, 25 bp, Rattus norvegicus
ggtccctggctcagatggcaaacca

SEQ ID NO: 466033 - DNA, 25 bp, Rattus norvegicus
ggtccctggctctgatggcaaacca

SEQ ID NO: 466034 - DNA, 25 bp, Rattus norvegicus
ggtccctgggcgataatgagttact

SEQ ID NO: 466035 - DNA, 25 bp, Rattus norvegicus
ggtccctgggcgttaatgagttact

SEQ ID NO: 466036 - DNA, 25 bp, Rattus norvegicus
ggtccctgggtgctgagcctaatca

SEQ ID NO: 466037 - DNA, 25 bp, Rattus norvegicus
ggtccctgggtggtgagcctaatca

SEQ ID NO: 466038 - DNA, 25 bp, Rattus norvegicus
ggtccctgtacaacctgacaaaagc

SEQ ID NO: 466039 - DNA, 25 bp, Rattus norvegicus
ggtccctgtacatcctgacaaaagc

SEQ ID NO: 466040 - DNA, 25 bp, Rattus norvegicus
ggtccctgtatgcttgtattgtagt

SEQ ID NO: 466041 - DNA, 25 bp, Rattus norvegicus
ggtccctgtatggttgtattgtagt

SEQ ID NO: 466042 - DNA, 25 bp, Rattus norvegicus
ggtccctgtcctcaagttcttaact

SEQ ID NO: 466043 - DNA, 25 bp, Rattus norvegicus
ggtccctgtcctgaagttcttaact

SEQ ID NO: 466044 - DNA, 25 bp, Rattus norvegicus
ggtccctgtcttcattaggtaaaga

SEQ ID NO: 466045 - DNA, 25 bp, Rattus norvegicus
ggtccctgtcttgattaggtaaaga

SEQ ID NO: 466046 - DNA, 25 bp, Rattus norvegicus
ggtccctgttgaaagcacattcacc

SEQ ID NO: 466047 - DNA, 25 bp, Rattus norvegicus
ggtccctgttgatagcacattcacc

SEQ ID NO: 466048 - DNA, 25 bp, Rattus norvegicus
ggtcccttaatgaagtctacagcgt

SEQ ID NO: 466049 - DNA, 25 bp, Rattus norvegicus
ggtcccttaatgtagtctacagcgt

SEQ ID NO: 466050 - DNA, 25 bp, Rattus norvegicus
ggtcccttatcactaagattcccca

SEQ ID NO: 466051 - DNA, 25 bp, Rattus norvegicus
ggtcccttatcagtaagattcccca

SEQ ID NO: 466052 - DNA, 25 bp, Rattus norvegicus
ggtcccttcaagcagagccatgatt

SEQ ID NO: 466053 - DNA, 25 bp, Rattus norvegicus
ggtcccttcaaggagagccatgatt

SEQ ID NO: 466054 - DNA, 25 bp, Rattus norvegicus
ggtcccttcacactctgtacttaaa

SEQ ID NO: 466055 - DNA, 25 bp, Rattus norvegicus
ggtcccttcacagtctgtacttaaa

SEQ ID NO: 466056 - DNA, 25 bp, Rattus norvegicus
ggtcccttcctgacttgaaaggatt

SEQ ID NO: 466057 - DNA, 25 bp, Rattus norvegicus
ggtcccttcctgtcttgaaaggatt

SEQ ID NO: 466058 - DNA, 25 bp, Rattus norvegicus
ggtcccttctaccttatgcgggaat

SEQ ID NO: 466059 - DNA, 25 bp, Rattus norvegicus
ggtcccttctacgttatgcgggaat

SEQ ID NO: 466060 - DNA, 25 bp, Rattus norvegicus
ggtcccttggacaagcaagctcagg

SEQ ID NO: 466061 - DNA, 25 bp, Rattus norvegicus
ggtcccttggactagcaagctcagg

SEQ ID NO: 466062 - DNA, 25 bp, Rattus norvegicus
ggtcccttgggactgctgttacaag

SEQ ID NO: 466063 - DNA, 25 bp, Rattus norvegicus
ggtcccttgggagtgctgttacaag

SEQ ID NO: 466064 - DNA, 25 bp, Rattus norvegicus
ggtcccttgtgacgcgtctcccgcg

SEQ ID NO: 466065 - DNA, 25 bp, Rattus norvegicus
ggtcccttgtgaggcgtctcccgcg

SEQ ID NO: 466066 - DNA, 25 bp, Rattus norvegicus
ggtccctttactaggagcattcaaa

SEQ ID NO: 466067 - DNA, 25 bp, Rattus norvegicus
ggtccctttacttggagcattcaaa

SEQ ID NO: 466068 - DNA, 25 bp, Rattus norvegicus
ggtccctttgtacataactccttat

SEQ ID NO: 466069 - DNA, 25 bp, Rattus norvegicus
ggtccctttgtagataactccttat

SEQ ID NO: 466070 - DNA, 25 bp, Rattus norvegicus
ggtccctttgttaatgaggctgtct

SEQ ID NO: 466071 - DNA, 25 bp, Rattus norvegicus
ggtccctttgtttatgaggctgtct

SEQ ID NO: 466072 - DNA, 25 bp, Rattus norvegicus
ggtccgaaccttccaggataattgt

SEQ ID NO: 466073 - DNA, 25 bp, Rattus norvegicus
ggtccgaaccttgcaggataattgt

SEQ ID NO: 466074 - DNA, 25 bp, Rattus norvegicus
ggtccgaatcgcacatggcttgtaa

SEQ ID NO: 466075 - DNA, 25 bp, Rattus norvegicus
ggtccgaatcgctcatggcttgtaa

SEQ ID NO: 466076 - DNA, 25 bp, Rattus norvegicus
ggtccgaattaaacgtgtccacaag

SEQ ID NO: 466077 - DNA, 25 bp, Rattus norvegicus
ggtccgaattaatcgtgtccacaag

SEQ ID NO: 466078 - DNA, 25 bp, Rattus norvegicus
ggtccgacaaccctttctgtatcag

SEQ ID NO: 466079 - DNA, 25 bp, Rattus norvegicus
ggtccgacaaccgtttctgtatcag

SEQ ID NO: 466080 - DNA, 25 bp, Rattus norvegicus
ggtccgaggactaaagcactagagt

SEQ ID NO: 466081 - DNA, 25 bp, Rattus norvegicus
ggtccgaggacttaagcactagagt

SEQ ID NO: 466082 - DNA, 25 bp, Rattus norvegicus
ggtccgaggtggagctcagacactc

SEQ ID NO: 466083 - DNA, 25 bp, Rattus norvegicus
ggtccgaggtggtgctcagacactc

SEQ ID NO: 466084 - DNA, 25 bp, Rattus norvegicus
ggtccgagttagctatttactgaca

SEQ ID NO: 466085 - DNA, 25 bp, Rattus norvegicus
ggtccgagttaggtatttactgaca

SEQ ID NO: 466086 - DNA, 25 bp, Rattus norvegicus
ggtccgattgccactgtttggtaac

SEQ ID NO: 466087 - DNA, 25 bp, Rattus norvegicus
ggtccgattgcctctgtttggtaac

SEQ ID NO: 466088 - DNA, 25 bp, Rattus norvegicus
ggtccgcaaagccagagccacagaa

SEQ ID NO: 466089 - DNA, 25 bp, Rattus norvegicus
ggtccgcaaagcgagagccacagaa

SEQ ID NO: 466090 - DNA, 25 bp, Rattus norvegicus
ggtccgcgcgctcacaacgggcttt

SEQ ID NO: 466091 - DNA, 25 bp, Rattus norvegicus
ggtccgcgcgctgacaacgggcttt

SEQ ID NO: 466092 - DNA, 25 bp, Rattus norvegicus
ggtccgcgttccctggcatcctgga

SEQ ID NO: 466093 - DNA, 25 bp, Rattus norvegicus
ggtccgcgttccgtggcatcctgga

SEQ ID NO: 466094 - DNA, 25 bp, Rattus norvegicus
ggtccggaaagccttatcctccatc

SEQ ID NO: 466095 - DNA, 25 bp, Rattus norvegicus
ggtccggaaagcgttatcctccatc

SEQ ID NO: 466096 - DNA, 25 bp, Rattus norvegicus
ggtccggaaattatttacacctgag

SEQ ID NO: 466097 - DNA, 25 bp, Rattus norvegicus
ggtccggaaattttttacacctgag

SEQ ID NO: 466098 - DNA, 25 bp, Rattus norvegicus
ggtccggaagcaaatcgagtccata

SEQ ID NO: 466099 - DNA, 25 bp, Rattus norvegicus
ggtccggaagcatatcgagtccata

SEQ ID NO: 466100 - DNA, 25 bp, Rattus norvegicus
ggtccggcactcaattgcattcaat

SEQ ID NO: 466101 - DNA, 25 bp, Rattus norvegicus
ggtccggcactctattgcattcaat

SEQ ID NO: 466102 - DNA, 25 bp, Rattus norvegicus
ggtccggcccgtcgcgtcgcgaatt

SEQ ID NO: 466103 - DNA, 25 bp, Rattus norvegicus
ggtccggcccgtggcgtcgcgaatt

SEQ ID NO: 466104 - DNA, 25 bp, Rattus norvegicus
ggtccgggaatgagctactgtccaa

SEQ ID NO: 466105 - DNA, 25 bp, Rattus norvegicus
ggtccgggaatgtgctactgtccaa

SEQ ID NO: 466106 - DNA, 25 bp, Rattus norvegicus
ggtccgggattccactgcaggacta

SEQ ID NO: 466107 - DNA, 25 bp, Rattus norvegicus
ggtccgggattcgactgcaggacta

SEQ ID NO: 466108 - DNA, 25 bp, Rattus norvegicus
ggtccgggctctcctggcggagccg

SEQ ID NO: 466109 - DNA, 25 bp, Rattus norvegicus
ggtccgggctctgctggcggagccg

SEQ ID NO: 466110 - DNA, 25 bp, Rattus norvegicus
ggtccggtataacgtgtacttcaca

SEQ ID NO: 466111 - DNA, 25 bp, Rattus norvegicus
ggtccggtataaggtgtacttcaca

SEQ ID NO: 466112 - DNA, 25 bp, Rattus norvegicus
ggtccgtacagtccagagtccagtg

SEQ ID NO: 466113 - DNA, 25 bp, Rattus norvegicus
ggtccgtacagtgcagagtccagtg

SEQ ID NO: 466114 - DNA, 25 bp, Rattus norvegicus
ggtccgtagcttcttttagttaatg

SEQ ID NO: 466115 - DNA, 25 bp, Rattus norvegicus
ggtccgtagcttgttttagttaatg

SEQ ID NO: 466116 - DNA, 25 bp, Rattus norvegicus
ggtccgtccgacatgggcatgatag

SEQ ID NO: 466117 - DNA, 25 bp, Rattus norvegicus
ggtccgtccgacttgggcatgatag

SEQ ID NO: 466118 - DNA, 25 bp, Rattus norvegicus
ggtccgtgactgaaactccaaattt

SEQ ID NO: 466119 - DNA, 25 bp, Rattus norvegicus
ggtccgtgactgtaactccaaattt

SEQ ID NO: 466120 - DNA, 25 bp, Rattus norvegicus
ggtccgtgatgaaaagcctaaattt

SEQ ID NO: 466121 - DNA, 25 bp, Rattus norvegicus
ggtccgtgatgataagcctaaattt

SEQ ID NO: 466122 - DNA, 25 bp, Rattus norvegicus
ggtccgtgtggacatataattttac

SEQ ID NO: 466123 - DNA, 25 bp, Rattus norvegicus
ggtccgtgtggagatataattttac

SEQ ID NO: 466124 - DNA, 25 bp, Rattus norvegicus
ggtccgttactgatgttctttccag

SEQ ID NO: 466125 - DNA, 25 bp, Rattus norvegicus
ggtccgttactgttgttctttccag

SEQ ID NO: 466126 - DNA, 25 bp, Rattus norvegicus
ggtcctaaagctcaggtcaccataa

SEQ ID NO: 466127 - DNA, 25 bp, Rattus norvegicus
ggtcctaaagctgaggtcaccataa

SEQ ID NO: 466128 - DNA, 25 bp, Rattus norvegicus
ggtcctaagctgcaggcagtttccc

SEQ ID NO: 466129 - DNA, 25 bp, Rattus norvegicus
ggtcctaagctggaggcagtttccc

SEQ ID NO: 466130 - DNA, 25 bp, Rattus norvegicus
ggtcctaagtagatgtgctgctcct

SEQ ID NO: 466131 - DNA, 25 bp, Rattus norvegicus
ggtcctaagtagttgtgctgctcct

SEQ ID NO: 466132 - DNA, 25 bp, Rattus norvegicus
ggtcctaataatcttctgcttctcc

SEQ ID NO: 466133 - DNA, 25 bp, Rattus norvegicus
ggtcctaataatgttctgcttctcc

SEQ ID NO: 466134 - DNA, 25 bp, Rattus norvegicus
ggtcctaatgtcacagtcctgactg

SEQ ID NO: 466135 - DNA, 25 bp, Rattus norvegicus
ggtcctaatgtctcagtcctgactg

SEQ ID NO: 466136 - DNA, 25 bp, Rattus norvegicus
ggtcctacatccaacagttcttaaa

SEQ ID NO: 466137 - DNA, 25 bp, Rattus norvegicus
ggtcctacatcctacagttcttaaa

SEQ ID NO: 466138 - DNA, 25 bp, Rattus norvegicus
ggtcctaccaccacaagatctaaag

SEQ ID NO: 466139 - DNA, 25 bp, Rattus norvegicus
ggtcctaccacctcaagatctaaag

SEQ ID NO: 466140 - DNA, 25 bp, Rattus norvegicus
ggtcctaccccaaaagtgcttaaca

SEQ ID NO: 466141 - DNA, 25 bp, Rattus norvegicus
ggtcctaccccataagtgcttaaca

SEQ ID NO: 466142 - DNA, 25 bp, Rattus norvegicus
ggtcctactgatctgggcaagtcca

SEQ ID NO: 466143 - DNA, 25 bp, Rattus norvegicus
ggtcctactgatgtgggcaagtcca

SEQ ID NO: 466144 - DNA, 25 bp, Rattus norvegicus
ggtcctactgcacctgtggacagta

SEQ ID NO: 466145 - DNA, 25 bp, Rattus norvegicus
ggtcctactgcagctgtggacagta

SEQ ID NO: 466146 - DNA, 25 bp, Rattus norvegicus
ggtcctactgcccagagtgtatgtt

SEQ ID NO: 466147 - DNA, 25 bp, Rattus norvegicus
ggtcctactgccgagagtgtatgtt

SEQ ID NO: 466148 - DNA, 25 bp, Rattus norvegicus
ggtcctactgtgacaccagagaggt

SEQ ID NO: 466149 - DNA, 25 bp, Rattus norvegicus
ggtcctactgtgtcaccagagaggt

SEQ ID NO: 466150 - DNA, 25 bp, Rattus norvegicus
ggtcctagaaacagacctctgacct

SEQ ID NO: 466151 - DNA, 25 bp, Rattus norvegicus
ggtcctagaaactgacctctgacct

SEQ ID NO: 466152 - DNA, 25 bp, Rattus norvegicus
ggtcctagcagaccgaaagtgtatt

SEQ ID NO: 466153 - DNA, 25 bp, Rattus norvegicus
ggtcctagcagagcgaaagtgtatt

SEQ ID NO: 466154 - DNA, 25 bp, Rattus norvegicus
ggtcctagcaggatccacagaagaa

SEQ ID NO: 466155 - DNA, 25 bp, Rattus norvegicus
ggtcctagcaggttccacagaagaa

SEQ ID NO: 466156 - DNA, 25 bp, Rattus norvegicus
ggtcctagcatcaagctggctacta

SEQ ID NO: 466157 - DNA, 25 bp, Rattus norvegicus
ggtcctagcatctagctggctacta

SEQ ID NO: 466158 - DNA, 25 bp, Rattus norvegicus
ggtcctagccagatgttgtttacag

SEQ ID NO: 466159 - DNA, 25 bp, Rattus norvegicus
ggtcctagccagttgttgtttacag

SEQ ID NO: 466160 - DNA, 25 bp, Rattus norvegicus
ggtcctatagtcctttgtactcaat

SEQ ID NO: 466161 - DNA, 25 bp, Rattus norvegicus
ggtcctatagtcgtttgtactcaat

SEQ ID NO: 466162 - DNA, 25 bp, Rattus norvegicus
ggtcctatatgcacaagtctcctgt

SEQ ID NO: 466163 - DNA, 25 bp, Rattus norvegicus
ggtcctatatgctcaagtctcctgt

SEQ ID NO: 466164 - DNA, 25 bp, Rattus norvegicus
ggtcctatctagcatcacagtcaat

SEQ ID NO: 466165 - DNA, 25 bp, Rattus norvegicus
ggtcctatctaggatcacagtcaat

SEQ ID NO: 466166 - DNA, 25 bp, Rattus norvegicus
ggtcctatctataactgtgtccata

SEQ ID NO: 466167 - DNA, 25 bp, Rattus norvegicus
ggtcctatctattactgtgtccata

SEQ ID NO: 466168 - DNA, 25 bp, Rattus norvegicus
ggtcctatgttgactgtttctcaca

SEQ ID NO: 466169 - DNA, 25 bp, Rattus norvegicus
ggtcctatgttgtctgtttctcaca

SEQ ID NO: 466170 - DNA, 25 bp, Rattus norvegicus
ggtcctattcaacaaatgagcacct

SEQ ID NO: 466171 - DNA, 25 bp, Rattus norvegicus
ggtcctattcaagaaatgagcacct

SEQ ID NO: 466172 - DNA, 25 bp, Rattus norvegicus
ggtcctatttggctaagcatctgct

SEQ ID NO: 466173 - DNA, 25 bp, Rattus norvegicus
ggtcctatttgggtaagcatctgct

SEQ ID NO: 466174 - DNA, 25 bp, Rattus norvegicus
ggtcctcaactacctttttaacatg

SEQ ID NO: 466175 - DNA, 25 bp, Rattus norvegicus
ggtcctcaactagctttttaacatg

SEQ ID NO: 466176 - DNA, 25 bp, Rattus norvegicus
ggtcctcacatcacagagtcactca

SEQ ID NO: 466177 - DNA, 25 bp, Rattus norvegicus
ggtcctcacatctcagagtcactca

SEQ ID NO: 466178 - DNA, 25 bp, Rattus norvegicus
ggtcctcagataccagttctccaga

SEQ ID NO: 466179 - DNA, 25 bp, Rattus norvegicus
ggtcctcagatagcagttctccaga

SEQ ID NO: 466180 - DNA, 25 bp, Rattus norvegicus
ggtcctcagatcctttccacaaaag

SEQ ID NO: 466181 - DNA, 25 bp, Rattus norvegicus
ggtcctcagatcgtttccacaaaag

SEQ ID NO: 466182 - DNA, 25 bp, Rattus norvegicus
ggtcctcagtgcagcgatgatgact

SEQ ID NO: 466183 - DNA, 25 bp, Rattus norvegicus
ggtcctcagtgctgcgatgatgact

SEQ ID NO: 466184 - DNA, 25 bp, Rattus norvegicus
ggtcctcattatcgtcattcacagc

SEQ ID NO: 466185 - DNA, 25 bp, Rattus norvegicus
ggtcctcattatggtcattcacagc

SEQ ID NO: 466186 - DNA, 25 bp, Rattus norvegicus
ggtcctccagagctcaaatacttag

SEQ ID NO: 466187 - DNA, 25 bp, Rattus norvegicus
ggtcctccagaggtcaaatacttag

SEQ ID NO: 466188 - DNA, 25 bp, Rattus norvegicus
ggtcctccagtactaatagcagtat

SEQ ID NO: 466189 - DNA, 25 bp, Rattus norvegicus
ggtcctccagtagtaatagcagtat

SEQ ID NO: 466190 - DNA, 25 bp, Rattus norvegicus
ggtcctccgccaccgcaaagttagg

SEQ ID NO: 466191 - DNA, 25 bp, Rattus norvegicus
ggtcctccgccagcgcaaagttagg

SEQ ID NO: 466192 - DNA, 25 bp, Rattus norvegicus
ggtcctcctggaaattgtgattcat

SEQ ID NO: 466193 - DNA, 25 bp, Rattus norvegicus
ggtcctcctggatattgtgattcat

SEQ ID NO: 466194 - DNA, 25 bp, Rattus norvegicus
ggtcctcctttgctttcattagtag

SEQ ID NO: 466195 - DNA, 25 bp, Rattus norvegicus
ggtcctcctttggtttcattagtag

SEQ ID NO: 466196 - DNA, 25 bp, Rattus norvegicus
ggtcctcgagcgcttgcagcaaaga

SEQ ID NO: 466197 - DNA, 25 bp, Rattus norvegicus
ggtcctcgagcggttgcagcaaaga

SEQ ID NO: 466198 - DNA, 25 bp, Rattus norvegicus
ggtcctcgcacccaattcagtgatt

SEQ ID NO: 466199 - DNA, 25 bp, Rattus norvegicus
ggtcctcgcaccgaattcagtgatt

SEQ ID NO: 466200 - DNA, 25 bp, Rattus norvegicus
ggtcctcgcgctcagcaagttagca

SEQ ID NO: 466201 - DNA, 25 bp, Rattus norvegicus
ggtcctcgcgctgagcaagttagca

SEQ ID NO: 466202 - DNA, 25 bp, Rattus norvegicus
ggtcctcggcccattctgaggagga

SEQ ID NO: 466203 - DNA, 25 bp, Rattus norvegicus
ggtcctcggccctttctgaggagga

SEQ ID NO: 466204 - DNA, 25 bp, Rattus norvegicus
ggtcctcgtgatctgtagttctttc

SEQ ID NO: 466205 - DNA, 25 bp, Rattus norvegicus
ggtcctcgtgatgtgtagttctttc

SEQ ID NO: 466206 - DNA, 25 bp, Rattus norvegicus
ggtcctcgttaaccggatgattttg

SEQ ID NO: 466207 - DNA, 25 bp, Rattus norvegicus
ggtcctcgttaagcggatgattttg

SEQ ID NO: 466208 - DNA, 25 bp, Rattus norvegicus
ggtcctctacctcaaaactgggaga

SEQ ID NO: 466209 - DNA, 25 bp, Rattus norvegicus
ggtcctctacctgaaaactgggaga

SEQ ID NO: 466210 - DNA, 25 bp, Rattus norvegicus
ggtcctctatatacaagtcttggtt

SEQ ID NO: 466211 - DNA, 25 bp, Rattus norvegicus
ggtcctctatattcaagtcttggtt

SEQ ID NO: 466212 - DNA, 25 bp, Rattus norvegicus
ggtcctctcacacccaataattggt

SEQ ID NO: 466213 - DNA, 25 bp, Rattus norvegicus
ggtcctctcacagccaataattggt

SEQ ID NO: 466214 - DNA, 25 bp, Rattus norvegicus
ggtcctctcatgactaaaggcgtta

SEQ ID NO: 466215 - DNA, 25 bp, Rattus norvegicus
ggtcctctcatgtctaaaggcgtta

SEQ ID NO: 466216 - DNA, 25 bp, Rattus norvegicus
ggtcctctctagagtaccaggtggg

SEQ ID NO: 466217 - DNA, 25 bp, Rattus norvegicus
ggtcctctctagtgtaccaggtggg

SEQ ID NO: 466218 - DNA, 25 bp, Rattus norvegicus
ggtcctctctgcaggaatatgctat

SEQ ID NO: 466219 - DNA, 25 bp, Rattus norvegicus
ggtcctctctgctggaatatgctat

SEQ ID NO: 466220 - DNA, 25 bp, Rattus norvegicus
ggtcctctgagaacctgtttcttca

SEQ ID NO: 466221 - DNA, 25 bp, Rattus norvegicus
ggtcctctgagatcctgtttcttca

SEQ ID NO: 466222 - DNA, 25 bp, Rattus norvegicus
ggtcctctgaggacatacacacatg

SEQ ID NO: 466223 - DNA, 25 bp, Rattus norvegicus
ggtcctctgaggtcatacacacatg

SEQ ID NO: 466224 - DNA, 25 bp, Rattus norvegicus
ggtcctctgattcgaatcatcaaag

SEQ ID NO: 466225 - DNA, 25 bp, Rattus norvegicus
ggtcctctgattggaatcatcaaag

SEQ ID NO: 466226 - DNA, 25 bp, Rattus norvegicus
ggtcctctgccacaaagtgcaacaa

SEQ ID NO: 466227 - DNA, 25 bp, Rattus norvegicus
ggtcctctgccagaaagtgcaacaa

SEQ ID NO: 466228 - DNA, 25 bp, Rattus norvegicus
ggtcctctgctgaactatcaatctc

SEQ ID NO: 466229 - DNA, 25 bp, Rattus norvegicus
ggtcctctgctgtactatcaatctc

SEQ ID NO: 466230 - DNA, 25 bp, Rattus norvegicus
ggtcctctgtgcatgctagcaaggg

SEQ ID NO: 466231 - DNA, 25 bp, Rattus norvegicus
ggtcctctgtgcattgggcagtaag

SEQ ID NO: 466232 - DNA, 25 bp, Rattus norvegicus
ggtcctctgtgcttgctagcaaggg

SEQ ID NO: 466233 - DNA, 25 bp, Rattus norvegicus
ggtcctctgtgctttgggcagtaag

SEQ ID NO: 466234 - DNA, 25 bp, Rattus norvegicus
ggtcctgaaacaaccgaggctgtct

SEQ ID NO: 466235 - DNA, 25 bp, Rattus norvegicus
ggtcctgaaacatccgaggctgtct

SEQ ID NO: 466236 - DNA, 25 bp, Rattus norvegicus
ggtcctgaagctatctaccttgaaa

SEQ ID NO: 466237 - DNA, 25 bp, Rattus norvegicus
ggtcctgaagctttctaccttgaaa

SEQ ID NO: 466238 - DNA, 25 bp, Rattus norvegicus
ggtcctgacctcattacaaatgcca

SEQ ID NO: 466239 - DNA, 25 bp, Rattus norvegicus
ggtcctgacctctttacaaatgcca

SEQ ID NO: 466240 - DNA, 25 bp, Rattus norvegicus
ggtcctgactcaaggcatgcatgta

SEQ ID NO: 466241 - DNA, 25 bp, Rattus norvegicus
ggtcctgactcatggcatgcatgta

SEQ ID NO: 466242 - DNA, 25 bp, Rattus norvegicus
ggtcctgagaaacattccagagtca

SEQ ID NO: 466243 - DNA, 25 bp, Rattus norvegicus
ggtcctgagaaagattccagagtca

SEQ ID NO: 466244 - DNA, 25 bp, Rattus norvegicus
ggtcctgaggtaaaactgatgattc

SEQ ID NO: 466245 - DNA, 25 bp, Rattus norvegicus
ggtcctgaggtataactgatgattc

SEQ ID NO: 466246 - DNA, 25 bp, Rattus norvegicus
ggtcctgagtttaaatcctggcaaa

SEQ ID NO: 466247 - DNA, 25 bp, Rattus norvegicus
ggtcctgagttttaatcctggcaaa

SEQ ID NO: 466248 - DNA, 25 bp, Rattus norvegicus
ggtcctgatgaactcaatggctgca

SEQ ID NO: 466249 - DNA, 25 bp, Rattus norvegicus
ggtcctgatgaagtcaatggctgca

SEQ ID NO: 466250 - DNA, 25 bp, Rattus norvegicus
ggtcctgatgtcactgtacttgtca

SEQ ID NO: 466251 - DNA, 25 bp, Rattus norvegicus
ggtcctgatgtctctgtacttgtca

SEQ ID NO: 466252 - DNA, 25 bp, Rattus norvegicus
ggtcctgatgttcgatagggtccca

SEQ ID NO: 466253 - DNA, 25 bp, Rattus norvegicus
ggtcctgatgttggatagggtccca

SEQ ID NO: 466254 - DNA, 25 bp, Rattus norvegicus
ggtcctgcacataacatgactgaag

SEQ ID NO: 466255 - DNA, 25 bp, Rattus norvegicus
ggtcctgcacatcgaacacttacct

SEQ ID NO: 466256 - DNA, 25 bp, Rattus norvegicus
ggtcctgcacatggaacacttacct

SEQ ID NO: 466257 - DNA, 25 bp, Rattus norvegicus
ggtcctgcacattacatgactgaag

SEQ ID NO: 466258 - DNA, 25 bp, Rattus norvegicus
ggtcctgcagtgaatggcccaattc

SEQ ID NO: 466259 - DNA, 25 bp, Rattus norvegicus
ggtcctgcagtgtatggcccaattc

SEQ ID NO: 466260 - DNA, 25 bp, Rattus norvegicus
ggtcctgcatcccaaagtaggtcct

SEQ ID NO: 466261 - DNA, 25 bp, Rattus norvegicus
ggtcctgcatccgaaagtaggtcct

SEQ ID NO: 466262 - DNA, 25 bp, Rattus norvegicus
ggtcctgccagacggttctaaattc

SEQ ID NO: 466263 - DNA, 25 bp, Rattus norvegicus
ggtcctgccagagggttctaaattc

SEQ ID NO: 466264 - DNA, 25 bp, Rattus norvegicus
ggtcctgcgcagcttgttgtagaat

SEQ ID NO: 466265 - DNA, 25 bp, Rattus norvegicus
ggtcctgcgcaggttgttgtagaat

SEQ ID NO: 466266 - DNA, 25 bp, Rattus norvegicus
ggtcctgctactaaagtgttcactc

SEQ ID NO: 466267 - DNA, 25 bp, Rattus norvegicus
ggtcctgctacttaagtgttcactc

SEQ ID NO: 466268 - DNA, 25 bp, Rattus norvegicus
ggtcctgctagcctagcgatagtct

SEQ ID NO: 466269 - DNA, 25 bp, Rattus norvegicus
ggtcctgctagcgtagcgatagtct

SEQ ID NO: 466270 - DNA, 25 bp, Rattus norvegicus
ggtcctgctgagctacagtatgcat

SEQ ID NO: 466271 - DNA, 25 bp, Rattus norvegicus
ggtcctgctgaggtacagtatgcat

SEQ ID NO: 466272 - DNA, 25 bp, Rattus norvegicus
ggtcctgctgatcaactttatcttt

SEQ ID NO: 466273 - DNA, 25 bp, Rattus norvegicus
ggtcctgctgatgaactttatcttt

SEQ ID NO: 466274 - DNA, 25 bp, Rattus norvegicus
ggtcctggaggaaatccatcatctt

SEQ ID NO: 466275 - DNA, 25 bp, Rattus norvegicus
ggtcctggaggatatccatcatctt

SEQ ID NO: 466276 - DNA, 25 bp, Rattus norvegicus
ggtcctggagtgagctggcatccat

SEQ ID NO: 466277 - DNA, 25 bp, Rattus norvegicus
ggtcctggagtgtgctggcatccat

SEQ ID NO: 466278 - DNA, 25 bp, Rattus norvegicus
ggtcctggctctagaaaaagtcaca

SEQ ID NO: 466279 - DNA, 25 bp, Rattus norvegicus
ggtcctggctcttgaaaaagtcaca

SEQ ID NO: 466280 - DNA, 25 bp, Rattus norvegicus
ggtcctggggttccctagacaagcc

SEQ ID NO: 466281 - DNA, 25 bp, Rattus norvegicus
ggtcctggggttgcctagacaagcc

SEQ ID NO: 466282 - DNA, 25 bp, Rattus norvegicus
ggtcctgggtacactaagaaagcaa

SEQ ID NO: 466283 - DNA, 25 bp, Rattus norvegicus
ggtcctgggtactctaagaaagcaa

SEQ ID NO: 466284 - DNA, 25 bp, Rattus norvegicus
ggtcctgggtagctactgcctagta

SEQ ID NO: 466285 - DNA, 25 bp, Rattus norvegicus
ggtcctgggtaggtactgcctagta

SEQ ID NO: 466286 - DNA, 25 bp, Rattus norvegicus
ggtcctgggtctatacgaagtctat

SEQ ID NO: 466287 - DNA, 25 bp, Rattus norvegicus
ggtcctgggtctttacgaagtctat

SEQ ID NO: 466288 - DNA, 25 bp, Rattus norvegicus
ggtcctggttacaggagccaattca

SEQ ID NO: 466289 - DNA, 25 bp, Rattus norvegicus
ggtcctggttactggagccaattca

SEQ ID NO: 466290 - DNA, 25 bp, Rattus norvegicus
ggtcctgtaattatgagcactgctc

SEQ ID NO: 466291 - DNA, 25 bp, Rattus norvegicus
ggtcctgtaattttgagcactgctc

SEQ ID NO: 466292 - DNA, 25 bp, Rattus norvegicus
ggtcctgtacacaatttttcatgct

SEQ ID NO: 466293 - DNA, 25 bp, Rattus norvegicus
ggtcctgtacactatttttcatgct

SEQ ID NO: 466294 - DNA, 25 bp, Rattus norvegicus
ggtcctgtatccagtattatgcttt

SEQ ID NO: 466295 - DNA, 25 bp, Rattus norvegicus
ggtcctgtatcctgtattatgcttt

SEQ ID NO: 466296 - DNA, 25 bp, Rattus norvegicus
ggtcctgtatgaacccacagggcat

SEQ ID NO: 466297 - DNA, 25 bp, Rattus norvegicus
ggtcctgtatgatcccacagggcat

SEQ ID NO: 466298 - DNA, 25 bp, Rattus norvegicus
ggtcctgtcaggagcagcagaatct

SEQ ID NO: 466299 - DNA, 25 bp, Rattus norvegicus
ggtcctgtcaggcttacttctggaa

SEQ ID NO: 466300 - DNA, 25 bp, Rattus norvegicus
ggtcctgtcagggttacttctggaa

SEQ ID NO: 466301 - DNA, 25 bp, Rattus norvegicus
ggtcctgtcaggtgcagcagaatct

SEQ ID NO: 466302 - DNA, 25 bp, Rattus norvegicus
ggtcctgtccacctgtcttaagaca

SEQ ID NO: 466303 - DNA, 25 bp, Rattus norvegicus
ggtcctgtccacgtgtcttaagaca

SEQ ID NO: 466304 - DNA, 25 bp, Rattus norvegicus
ggtcctgtcctgataagggagttct

SEQ ID NO: 466305 - DNA, 25 bp, Rattus norvegicus
ggtcctgtcctgcagatgtctaata

SEQ ID NO: 466306 - DNA, 25 bp, Rattus norvegicus
ggtcctgtcctggagatgtctaata

SEQ ID NO: 466307 - DNA, 25 bp, Rattus norvegicus
ggtcctgtcctgttaagggagttct

SEQ ID NO: 466308 - DNA, 25 bp, Rattus norvegicus
ggtcctgtctacatcattcttggta

SEQ ID NO: 466309 - DNA, 25 bp, Rattus norvegicus
ggtcctgtctacttcattcttggta

SEQ ID NO: 466310 - DNA, 25 bp, Rattus norvegicus
ggtcctgtgctgatcagtgaaggaa

SEQ ID NO: 466311 - DNA, 25 bp, Rattus norvegicus
ggtcctgtgctgttcagtgaaggaa

SEQ ID NO: 466312 - DNA, 25 bp, Rattus norvegicus
ggtcctgtgcttacctggacaagaa

SEQ ID NO: 466313 - DNA, 25 bp, Rattus norvegicus
ggtcctgtgctttcctggacaagaa

SEQ ID NO: 466314 - DNA, 25 bp, Rattus norvegicus
ggtcctgttagcatgagaggcacaa

SEQ ID NO: 466315 - DNA, 25 bp, Rattus norvegicus
ggtcctgttagcttgagaggcacaa

SEQ ID NO: 466316 - DNA, 25 bp, Rattus norvegicus
ggtcctgttccaagtcaatgatcta

SEQ ID NO: 466317 - DNA, 25 bp, Rattus norvegicus
ggtcctgttccatgtcaatgatcta

SEQ ID NO: 466318 - DNA, 25 bp, Rattus norvegicus
ggtcctgttcttcaaattccatggt

SEQ ID NO: 466319 - DNA, 25 bp, Rattus norvegicus
ggtcctgttcttgaaattccatggt

SEQ ID NO: 466320 - DNA, 25 bp, Rattus norvegicus
ggtccttacaggattgatctaaatg

SEQ ID NO: 466321 - DNA, 25 bp, Rattus norvegicus
ggtccttacaggtttgatctaaatg

SEQ ID NO: 466322 - DNA, 25 bp, Rattus norvegicus
ggtccttaggtcctgggtctcctct

SEQ ID NO: 466323 - DNA, 25 bp, Rattus norvegicus
ggtccttaggtcgtgggtctcctct

SEQ ID NO: 466324 - DNA, 25 bp, Rattus norvegicus
ggtccttatcaaatttctagcccaa

SEQ ID NO: 466325 - DNA, 25 bp, Rattus norvegicus
ggtccttatcaattttctagcccaa

SEQ ID NO: 466326 - DNA, 25 bp, Rattus norvegicus
ggtccttatcctctgacaactatag

SEQ ID NO: 466327 - DNA, 25 bp, Rattus norvegicus
ggtccttatcctgtgacaactatag

SEQ ID NO: 466328 - DNA, 25 bp, Rattus norvegicus
ggtccttcaagacaaacatctcctt

SEQ ID NO: 466329 - DNA, 25 bp, Rattus norvegicus
ggtccttcaagagaaacatctcctt

SEQ ID NO: 466330 - DNA, 25 bp, Rattus norvegicus
ggtccttccatgctacagttccttg

SEQ ID NO: 466331 - DNA, 25 bp, Rattus norvegicus
ggtccttccatggtacagttccttg

SEQ ID NO: 466332 - DNA, 25 bp, Rattus norvegicus
ggtccttcctgtacctagataaatc

SEQ ID NO: 466333 - DNA, 25 bp, Rattus norvegicus
ggtccttcctgttcctagataaatc

SEQ ID NO: 466334 - DNA, 25 bp, Rattus norvegicus
ggtccttccttcatcatttaggtag

SEQ ID NO: 466335 - DNA, 25 bp, Rattus norvegicus
ggtccttccttcttcatttaggtag

SEQ ID NO: 466336 - DNA, 25 bp, Rattus norvegicus
ggtccttccttgcaagctgaagcat

SEQ ID NO: 466337 - DNA, 25 bp, Rattus norvegicus
ggtccttccttggaagctgaagcat

SEQ ID NO: 466338 - DNA, 25 bp, Rattus norvegicus
ggtccttcggaaatctcctgtacga

SEQ ID NO: 466339 - DNA, 25 bp, Rattus norvegicus
ggtccttcggaattctcctgtacga

SEQ ID NO: 466340 - DNA, 25 bp, Rattus norvegicus
ggtccttgaataaccattccagcgt

SEQ ID NO: 466341 - DNA, 25 bp, Rattus norvegicus
ggtccttgaatatccattccagcgt

SEQ ID NO: 466342 - DNA, 25 bp, Rattus norvegicus
ggtccttgatcactgtatcttcgat

SEQ ID NO: 466343 - DNA, 25 bp, Rattus norvegicus
ggtccttgatcagtgtatcttcgat

SEQ ID NO: 466344 - DNA, 25 bp, Rattus norvegicus
ggtccttgcaaaagaagctaatgtg

SEQ ID NO: 466345 - DNA, 25 bp, Rattus norvegicus
ggtccttgcaaatgaagctaatgtg

SEQ ID NO: 466346 - DNA, 25 bp, Rattus norvegicus
ggtccttgcaggcaacttgtttcat

SEQ ID NO: 466347 - DNA, 25 bp, Rattus norvegicus
ggtccttgcagggaacttgtttcat

SEQ ID NO: 466348 - DNA, 25 bp, Rattus norvegicus
ggtccttgcatcaacgggatgccac

SEQ ID NO: 466349 - DNA, 25 bp, Rattus norvegicus
ggtccttgcatctacgggatgccac

SEQ ID NO: 466350 - DNA, 25 bp, Rattus norvegicus
ggtccttgccagaccggtgacagga

SEQ ID NO: 466351 - DNA, 25 bp, Rattus norvegicus
ggtccttgccagtccggtgacagga

SEQ ID NO: 466352 - DNA, 25 bp, Rattus norvegicus
ggtccttgctatcggctggattcta

SEQ ID NO: 466353 - DNA, 25 bp, Rattus norvegicus
ggtccttgctatgggctggattcta

SEQ ID NO: 466354 - DNA, 25 bp, Rattus norvegicus
ggtccttgctgaacagcctggaaat

SEQ ID NO: 466355 - DNA, 25 bp, Rattus norvegicus
ggtccttgctgatcagcctggaaat

SEQ ID NO: 466356 - DNA, 25 bp, Rattus norvegicus
ggtccttgcttcactgatatccaga

SEQ ID NO: 466357 - DNA, 25 bp, Rattus norvegicus
ggtccttgcttctctgatatccaga

SEQ ID NO: 466358 - DNA, 25 bp, Rattus norvegicus
ggtccttggaggacaggcagttcca

SEQ ID NO: 466359 - DNA, 25 bp, Rattus norvegicus
ggtccttggaggtcaggcagttcca

SEQ ID NO: 466360 - DNA, 25 bp, Rattus norvegicus
ggtccttggataacgacactcatct

SEQ ID NO: 466361 - DNA, 25 bp, Rattus norvegicus
ggtccttggatatcgacactcatct

SEQ ID NO: 466362 - DNA, 25 bp, Rattus norvegicus
ggtccttggcgcaattgaatcatgg

SEQ ID NO: 466363 - DNA, 25 bp, Rattus norvegicus
ggtccttggcgctattgaatcatgg

SEQ ID NO: 466364 - DNA, 25 bp, Rattus norvegicus
ggtccttgggagatcatggccttca

SEQ ID NO: 466365 - DNA, 25 bp, Rattus norvegicus
ggtccttgggagttcatggccttca

SEQ ID NO: 466366 - DNA, 25 bp, Rattus norvegicus
ggtccttggtaaattcattcatggg

SEQ ID NO: 466367 - DNA, 25 bp, Rattus norvegicus
ggtccttggtaatttcattcatggg

SEQ ID NO: 466368 - DNA, 25 bp, Rattus norvegicus
ggtccttggtatagtagctttgcct

SEQ ID NO: 466369 - DNA, 25 bp, Rattus norvegicus
ggtccttggtattgtagctttgcct

SEQ ID NO: 466370 - DNA, 25 bp, Rattus norvegicus
ggtccttgtctcagtgatgggctac

SEQ ID NO: 466371 - DNA, 25 bp, Rattus norvegicus
ggtccttgtctctgtgatgggctac

SEQ ID NO: 466372 - DNA, 25 bp, Rattus norvegicus
ggtccttgtgtcatcccataatgct

SEQ ID NO: 466373 - DNA, 25 bp, Rattus norvegicus
ggtccttgtgtcttcccataatgct

SEQ ID NO: 466374 - DNA, 25 bp, Rattus norvegicus
ggtccttgtgttagatagctgttac

SEQ ID NO: 466375 - DNA, 25 bp, Rattus norvegicus
ggtccttgtgtttgatagctgttac

SEQ ID NO: 466376 - DNA, 25 bp, Rattus norvegicus
ggtcctttacacactgttcaccaag

SEQ ID NO: 466377 - DNA, 25 bp, Rattus norvegicus
ggtcctttacactctgttcaccaag

SEQ ID NO: 466378 - DNA, 25 bp, Rattus norvegicus
ggtcctttagaaactgtgtcctcgt

SEQ ID NO: 466379 - DNA, 25 bp, Rattus norvegicus
ggtcctttagaatctgtgtcctcgt

SEQ ID NO: 466380 - DNA, 25 bp, Rattus norvegicus
ggtcctttagcacacatgtgacttc

SEQ ID NO: 466381 - DNA, 25 bp, Rattus norvegicus
ggtcctttagcagacatgtgacttc

SEQ ID NO: 466382 - DNA, 25 bp, Rattus norvegicus
ggtcctttaggaattggattcccat

SEQ ID NO: 466383 - DNA, 25 bp, Rattus norvegicus
ggtcctttaggatttggattcccat

SEQ ID NO: 466384 - DNA, 25 bp, Rattus norvegicus
ggtcctttattgacttgccttaatg

SEQ ID NO: 466385 - DNA, 25 bp, Rattus norvegicus
ggtcctttattgtcttgccttaatg

SEQ ID NO: 466386 - DNA, 25 bp, Rattus norvegicus
ggtcctttcagcagaaccttgcaaa

SEQ ID NO: 466387 - DNA, 25 bp, Rattus norvegicus
ggtcctttcagctgaaccttgcaaa

SEQ ID NO: 466388 - DNA, 25 bp, Rattus norvegicus
ggtcctttcataagaagcctccaag

SEQ ID NO: 466389 - DNA, 25 bp, Rattus norvegicus
ggtcctttcatatgaagcctccaag

SEQ ID NO: 466390 - DNA, 25 bp, Rattus norvegicus
ggtcctttccttagtcgtactgtga

SEQ ID NO: 466391 - DNA, 25 bp, Rattus norvegicus
ggtcctttcctttgtcgtactgtga

SEQ ID NO: 466392 - DNA, 25 bp, Rattus norvegicus
ggtcctttctcacttggaggcgcaa

SEQ ID NO: 466393 - DNA, 25 bp, Rattus norvegicus
ggtcctttctcagttggaggcgcaa

SEQ ID NO: 466394 - DNA, 25 bp, Rattus norvegicus
ggtcctttctggctattcacacaga

SEQ ID NO: 466395 - DNA, 25 bp, Rattus norvegicus
ggtcctttctgggtattcacacaga

SEQ ID NO: 466396 - DNA, 25 bp, Rattus norvegicus
ggtcctttctttctttgtagtgact

SEQ ID NO: 466397 - DNA, 25 bp, Rattus norvegicus
ggtcctttctttgtttgtagtgact

SEQ ID NO: 466398 - DNA, 25 bp, Rattus norvegicus
ggtcctttgcctagtgtagcacatg

SEQ ID NO: 466399 - DNA, 25 bp, Rattus norvegicus
ggtcctttgccttgtgtagcacatg

SEQ ID NO: 466400 - DNA, 25 bp, Rattus norvegicus
ggtcctttgctcatactgtaagtgc

SEQ ID NO: 466401 - DNA, 25 bp, Rattus norvegicus
ggtcctttgctcttactgtaagtgc

SEQ ID NO: 466402 - DNA, 25 bp, Rattus norvegicus
ggtccttttaacatgtacctgtagt

SEQ ID NO: 466403 - DNA, 25 bp, Rattus norvegicus
ggtccttttaacttgtacctgtagt

SEQ ID NO: 466404 - DNA, 25 bp, Rattus norvegicus
ggtccttttactcctgatgttgcta

SEQ ID NO: 466405 - DNA, 25 bp, Rattus norvegicus
ggtccttttactgctgatgttgcta

SEQ ID NO: 466406 - DNA, 25 bp, Rattus norvegicus
ggtcctttttctcatttggtggtat

SEQ ID NO: 466407 - DNA, 25 bp, Rattus norvegicus
ggtcctttttctgatttggtggtat

SEQ ID NO: 466408 - DNA, 25 bp, Rattus norvegicus
ggtcctttttgcagaaattttccat

SEQ ID NO: 466409 - DNA, 25 bp, Rattus norvegicus
ggtcctttttgctgaaattttccat

SEQ ID NO: 466410 - DNA, 25 bp, Rattus norvegicus
ggtcgaactgttactacacaatcct

SEQ ID NO: 466411 - DNA, 25 bp, Rattus norvegicus
ggtcgaactgtttctacacaatcct

SEQ ID NO: 466412 - DNA, 25 bp, Rattus norvegicus
ggtcgaagcaatcagcaaacacaat

SEQ ID NO: 466413 - DNA, 25 bp, Rattus norvegicus
ggtcgaagcaatgagcaaacacaat

SEQ ID NO: 466414 - DNA, 25 bp, Rattus norvegicus
ggtcgaattaccagccaagtgcttg

SEQ ID NO: 466415 - DNA, 25 bp, Rattus norvegicus
ggtcgaattacctgccaagtgcttg

SEQ ID NO: 466416 - DNA, 25 bp, Rattus norvegicus
ggtcgaccactgagaaaggctccaa

SEQ ID NO: 466417 - DNA, 25 bp, Rattus norvegicus
ggtcgaccactgtgaaaggctccaa

SEQ ID NO: 466418 - DNA, 25 bp, Rattus norvegicus
ggtcgaccctcacgacttaagtact

SEQ ID NO: 466419 - DNA, 25 bp, Rattus norvegicus
ggtcgaccctcaggacttaagtact

SEQ ID NO: 466420 - DNA, 25 bp, Rattus norvegicus
ggtcgactacttccccgagttcgat

SEQ ID NO: 466421 - DNA, 25 bp, Rattus norvegicus
ggtcgactacttgcccgagttcgat

SEQ ID NO: 466422 - DNA, 25 bp, Rattus norvegicus
ggtcgactcaatcatgtggccatag

SEQ ID NO: 466423 - DNA, 25 bp, Rattus norvegicus
ggtcgactcaatgatgtggccatag

SEQ ID NO: 466424 - DNA, 25 bp, Rattus norvegicus
ggtcgactgctcagtgacacagtgc

SEQ ID NO: 466425 - DNA, 25 bp, Rattus norvegicus
ggtcgactgctctgtgacacagtgc

SEQ ID NO: 466426 - DNA, 25 bp, Rattus norvegicus
ggtcgactttgcattataaacggcg

SEQ ID NO: 466427 - DNA, 25 bp, Rattus norvegicus
ggtcgactttgctttataaacggcg

SEQ ID NO: 466428 - DNA, 25 bp, Rattus norvegicus
ggtcgagaggctatggtcacctgta

SEQ ID NO: 466429 - DNA, 25 bp, Rattus norvegicus
ggtcgagaggctttggtcacctgta

SEQ ID NO: 466430 - DNA, 25 bp, Rattus norvegicus
ggtcgagcgatgcatttccgtctct

SEQ ID NO: 466431 - DNA, 25 bp, Rattus norvegicus
ggtcgagcgatggatttccgtctct

SEQ ID NO: 466432 - DNA, 25 bp, Rattus norvegicus
ggtcgaggcgaaacttggctctgaa

SEQ ID NO: 466433 - DNA, 25 bp, Rattus norvegicus
ggtcgaggcgaatcttggctctgaa

SEQ ID NO: 466434 - DNA, 25 bp, Rattus norvegicus
ggtcgaggcgctctgtatatactgt

SEQ ID NO: 466435 - DNA, 25 bp, Rattus norvegicus
ggtcgaggcgctgtgtatatactgt

SEQ ID NO: 466436 - DNA, 25 bp, Rattus norvegicus
ggtcgagtctacatcaacatgcctg

SEQ ID NO: 466437 - DNA, 25 bp, Rattus norvegicus
ggtcgagtctacttcaacatgcctg

SEQ ID NO: 466438 - DNA, 25 bp, Rattus norvegicus
ggtcgagtgcagagcccgggaggct

SEQ ID NO: 466439 - DNA, 25 bp, Rattus norvegicus
ggtcgagtgcagtgcccgggaggct

SEQ ID NO: 466440 - DNA, 25 bp, Rattus norvegicus
ggtcgataccaccaatgatctaaaa

SEQ ID NO: 466441 - DNA, 25 bp, Rattus norvegicus
ggtcgataccacgaatgatctaaaa

SEQ ID NO: 466442 - DNA, 25 bp, Rattus norvegicus
ggtcgataccttaagcaaacaatgt

SEQ ID NO: 466443 - DNA, 25 bp, Rattus norvegicus
ggtcgatacctttagcaaacaatgt

SEQ ID NO: 466444 - DNA, 25 bp, Rattus norvegicus
ggtcgatgctatagtttagccttcc

SEQ ID NO: 466445 - DNA, 25 bp, Rattus norvegicus
ggtcgatgctattgtttagccttcc

SEQ ID NO: 466446 - DNA, 25 bp, Rattus norvegicus
ggtcgcaaagctctctacatcgtga

SEQ ID NO: 466447 - DNA, 25 bp, Rattus norvegicus
ggtcgcaaagctgtctacatcgtga

SEQ ID NO: 466448 - DNA, 25 bp, Rattus norvegicus
ggtcgcaaaggacaccctggagttt

SEQ ID NO: 466449 - DNA, 25 bp, Rattus norvegicus
ggtcgcaaaggagaccctggagttt

SEQ ID NO: 466450 - DNA, 25 bp, Rattus norvegicus
ggtcgcaaggctctgcttaagaact

SEQ ID NO: 466451 - DNA, 25 bp, Rattus norvegicus
ggtcgcaaggctgtgcttaagaact

SEQ ID NO: 466452 - DNA, 25 bp, Rattus norvegicus
ggtcgcacagctcgaactcgcggtt

SEQ ID NO: 466453 - DNA, 25 bp, Rattus norvegicus
ggtcgcacagctggaactcgcggtt

SEQ ID NO: 466454 - DNA, 25 bp, Rattus norvegicus
ggtcgcacggagctagctccacgct

SEQ ID NO: 466455 - DNA, 25 bp, Rattus norvegicus
ggtcgcacggaggtagctccacgct

SEQ ID NO: 466456 - DNA, 25 bp, Rattus norvegicus
ggtcgcaggtatattgtagcactta

SEQ ID NO: 466457 - DNA, 25 bp, Rattus norvegicus
ggtcgcaggtattttgtagcactta

SEQ ID NO: 466458 - DNA, 25 bp, Rattus norvegicus
ggtcgcagtcttcgctcttaggaaa

SEQ ID NO: 466459 - DNA, 25 bp, Rattus norvegicus
ggtcgcagtcttggctcttaggaaa

SEQ ID NO: 466460 - DNA, 25 bp, Rattus norvegicus
ggtcgcatgaccatgactgtgatca

SEQ ID NO: 466461 - DNA, 25 bp, Rattus norvegicus
ggtcgcatgaccttgactgtgatca

SEQ ID NO: 466462 - DNA, 25 bp, Rattus norvegicus
ggtcgcattttcctgatttcaaaga

SEQ ID NO: 466463 - DNA, 25 bp, Rattus norvegicus
ggtcgcattttcgtgatttcaaaga

SEQ ID NO: 466464 - DNA, 25 bp, Rattus norvegicus
ggtcgccaacgaaacggttcagata

SEQ ID NO: 466465 - DNA, 25 bp, Rattus norvegicus
ggtcgccaacgatacggttcagata

SEQ ID NO: 466466 - DNA, 25 bp, Rattus norvegicus
ggtcgccaagcacaggatccgtatg

SEQ ID NO: 466467 - DNA, 25 bp, Rattus norvegicus
ggtcgccaagcagaggatccgtatg

SEQ ID NO: 466468 - DNA, 25 bp, Rattus norvegicus
ggtcgccacatcatttggaggatca

SEQ ID NO: 466469 - DNA, 25 bp, Rattus norvegicus
ggtcgccacatcttttggaggatca

SEQ ID NO: 466470 - DNA, 25 bp, Rattus norvegicus
ggtcgccagcaacctgaatctcaaa

SEQ ID NO: 466471 - DNA, 25 bp, Rattus norvegicus
ggtcgccagcaagctgaatctcaaa

SEQ ID NO: 466472 - DNA, 25 bp, Rattus norvegicus
ggtcgccatgacactcggagccgga

SEQ ID NO: 466473 - DNA, 25 bp, Rattus norvegicus
ggtcgccatgactctcggagccgga

SEQ ID NO: 466474 - DNA, 25 bp, Rattus norvegicus
ggtcgcccgtgtagctggaaatgta

SEQ ID NO: 466475 - DNA, 25 bp, Rattus norvegicus
ggtcgcccgtgttgctggaaatgta

SEQ ID NO: 466476 - DNA, 25 bp, Rattus norvegicus
ggtcgccctcccaatgttggcagtg

SEQ ID NO: 466477 - DNA, 25 bp, Rattus norvegicus
ggtcgccctccctatgttggcagtg

SEQ ID NO: 466478 - DNA, 25 bp, Rattus norvegicus
ggtcgccgtcagaacagtcaatgct

SEQ ID NO: 466479 - DNA, 25 bp, Rattus norvegicus
ggtcgccgtcagtacagtcaatgct

SEQ ID NO: 466480 - DNA, 25 bp, Rattus norvegicus
ggtcgcctagatcttcagttttatg

SEQ ID NO: 466481 - DNA, 25 bp, Rattus norvegicus
ggtcgcctagatgttcagttttatg

SEQ ID NO: 466482 - DNA, 25 bp, Rattus norvegicus
ggtcgcctagttatgttcacttgaa

SEQ ID NO: 466483 - DNA, 25 bp, Rattus norvegicus
ggtcgcctagttttgttcacttgaa

SEQ ID NO: 466484 - DNA, 25 bp, Rattus norvegicus
ggtcgcctcactagaaccaggaagc

SEQ ID NO: 466485 - DNA, 25 bp, Rattus norvegicus
ggtcgcctcacttgaaccaggaagc

SEQ ID NO: 466486 - DNA, 25 bp, Rattus norvegicus
ggtcgcctctgtccagattacaggg

SEQ ID NO: 466487 - DNA, 25 bp, Rattus norvegicus
ggtcgcctctgtgcagattacaggg

SEQ ID NO: 466488 - DNA, 25 bp, Rattus norvegicus
ggtcgcctgggtatttatgagtttc

SEQ ID NO: 466489 - DNA, 25 bp, Rattus norvegicus
ggtcgcctgggtttttatgagtttc

SEQ ID NO: 466490 - DNA, 25 bp, Rattus norvegicus
ggtcgcgcggatcatgatgccaacc

SEQ ID NO: 466491 - DNA, 25 bp, Rattus norvegicus
ggtcgcgcggatgatgatgccaacc

SEQ ID NO: 466492 - DNA, 25 bp, Rattus norvegicus
ggtcgcgctcaaaatgtatgcccta

SEQ ID NO: 466493 - DNA, 25 bp, Rattus norvegicus
ggtcgcgctcaatatgtatgcccta

SEQ ID NO: 466494 - DNA, 25 bp, Rattus norvegicus
ggtcgcgtagtgatactccattgta

SEQ ID NO: 466495 - DNA, 25 bp, Rattus norvegicus
ggtcgcgtagtgttactccattgta

SEQ ID NO: 466496 - DNA, 25 bp, Rattus norvegicus
ggtcgcgtgtgcagtgccatttctc

SEQ ID NO: 466497 - DNA, 25 bp, Rattus norvegicus
ggtcgcgtgtgctgtgccatttctc

SEQ ID NO: 466498 - DNA, 25 bp, Rattus norvegicus
ggtcgcgtttcgctcgtgccactga

SEQ ID NO: 466499 - DNA, 25 bp, Rattus norvegicus
ggtcgcgtttcggtcgtgccactga

SEQ ID NO: 466500 - DNA, 25 bp, Rattus norvegicus
ggtcgctagatcagggctttgttcc

SEQ ID NO: 466501 - DNA, 25 bp, Rattus norvegicus
ggtcgctagatctgggctttgttcc

SEQ ID NO: 466502 - DNA, 25 bp, Rattus norvegicus
ggtcgctcaaacatagatacccacg

SEQ ID NO: 466503 - DNA, 25 bp, Rattus norvegicus
ggtcgctcaaacttagatacccacg

SEQ ID NO: 466504 - DNA, 25 bp, Rattus norvegicus
ggtcgctccattacttgttttgtga

SEQ ID NO: 466505 - DNA, 25 bp, Rattus norvegicus
ggtcgctccatttcttgttttgtga

SEQ ID NO: 466506 - DNA, 25 bp, Rattus norvegicus
ggtcgctcggccaataattatgtca

SEQ ID NO: 466507 - DNA, 25 bp, Rattus norvegicus
ggtcgctcggcctataattatgtca

SEQ ID NO: 466508 - DNA, 25 bp, Rattus norvegicus
ggtcgctgaagaagctggcctgcca

SEQ ID NO: 466509 - DNA, 25 bp, Rattus norvegicus
ggtcgctgaagatgctggcctgcca

SEQ ID NO: 466510 - DNA, 25 bp, Rattus norvegicus
ggtcgctgggtcatttaagacgcaa

SEQ ID NO: 466511 - DNA, 25 bp, Rattus norvegicus
ggtcgctgggtcttttaagacgcaa

SEQ ID NO: 466512 - DNA, 25 bp, Rattus norvegicus
ggtcgctggtttctgtgattcatca

SEQ ID NO: 466513 - DNA, 25 bp, Rattus norvegicus
ggtcgctggtttgtgtgattcatca

SEQ ID NO: 466514 - DNA, 25 bp, Rattus norvegicus
ggtcgcttaagcctgcatggagata

SEQ ID NO: 466515 - DNA, 25 bp, Rattus norvegicus
ggtcgcttaagcgtgcatggagata

SEQ ID NO: 466516 - DNA, 25 bp, Rattus norvegicus
ggtcgcttacggcagttccacacag

SEQ ID NO: 466517 - DNA, 25 bp, Rattus norvegicus
ggtcgcttacgggagttccacacag

SEQ ID NO: 466518 - DNA, 25 bp, Rattus norvegicus
ggtcgcttccacaggtttggagaga

SEQ ID NO: 466519 - DNA, 25 bp, Rattus norvegicus
ggtcgcttccactggtttggagaga

SEQ ID NO: 466520 - DNA, 25 bp, Rattus norvegicus
ggtcgcttcttgctgtaacaaatga

SEQ ID NO: 466521 - DNA, 25 bp, Rattus norvegicus
ggtcgcttcttggtgtaacaaatga

SEQ ID NO: 466522 - DNA, 25 bp, Rattus norvegicus
ggtcgcttgcttacagacagagtct

SEQ ID NO: 466523 - DNA, 25 bp, Rattus norvegicus
ggtcgcttgctttcagacagagtct

SEQ ID NO: 466524 - DNA, 25 bp, Rattus norvegicus
ggtcggacgactaggctggctcatt

SEQ ID NO: 466525 - DNA, 25 bp, Rattus norvegicus
ggtcggacgacttggctggctcatt

SEQ ID NO: 466526 - DNA, 25 bp, Rattus norvegicus
ggtcggagcctcatatgaagtgttt

SEQ ID NO: 466527 - DNA, 25 bp, Rattus norvegicus
ggtcggagcctcttatgaagtgttt

SEQ ID NO: 466528 - DNA, 25 bp, Rattus norvegicus
ggtcggatggagactttcattcagg

SEQ ID NO: 466529 - DNA, 25 bp, Rattus norvegicus
ggtcggatggagtctttcattcagg

SEQ ID NO: 466530 - DNA, 25 bp, Rattus norvegicus
ggtcggattaagctatgtctagtat

SEQ ID NO: 466531 - DNA, 25 bp, Rattus norvegicus
ggtcggattaaggtatgtctagtat

SEQ ID NO: 466532 - DNA, 25 bp, Rattus norvegicus
ggtcggcacaggacgtgaagtcact

SEQ ID NO: 466533 - DNA, 25 bp, Rattus norvegicus
ggtcggcacaggtcgtgaagtcact

SEQ ID NO: 466534 - DNA, 25 bp, Rattus norvegicus
ggtcggcgtacgacaggttgcccca

SEQ ID NO: 466535 - DNA, 25 bp, Rattus norvegicus
ggtcggcgtacgtcaggttgcccca

SEQ ID NO: 466536 - DNA, 25 bp, Rattus norvegicus
ggtcggcgtgtgactctgagaactt

SEQ ID NO: 466537 - DNA, 25 bp, Rattus norvegicus
ggtcggcgtgtgtctctgagaactt

SEQ ID NO: 466538 - DNA, 25 bp, Rattus norvegicus
ggtcggctttgcacctgtaaagcga

SEQ ID NO: 466539 - DNA, 25 bp, Rattus norvegicus
ggtcggctttgctcctgtaaagcga

SEQ ID NO: 466540 - DNA, 25 bp, Rattus norvegicus
ggtcgggacctcactgactacctta

SEQ ID NO: 466541 - DNA, 25 bp, Rattus norvegicus
ggtcgggacctctctgactacctta

SEQ ID NO: 466542 - DNA, 25 bp, Rattus norvegicus
ggtcgggagcgtctgctggtggagc

SEQ ID NO: 466543 - DNA, 25 bp, Rattus norvegicus
ggtcgggagcgtgtgctggtggagc

SEQ ID NO: 466544 - DNA, 25 bp, Rattus norvegicus
ggtcgggcagataaatagctccatg

SEQ ID NO: 466545 - DNA, 25 bp, Rattus norvegicus
ggtcgggcagattaatagctccatg

SEQ ID NO: 466546 - DNA, 25 bp, Rattus norvegicus
ggtcgggcttccagccttagcaatg

SEQ ID NO: 466547 - DNA, 25 bp, Rattus norvegicus
ggtcgggcttcctgccttagcaatg

SEQ ID NO: 466548 - DNA, 25 bp, Rattus norvegicus
ggtcggtattcaaacctttcatctt

SEQ ID NO: 466549 - DNA, 25 bp, Rattus norvegicus
ggtcggtattcatacctttcatctt

SEQ ID NO: 466550 - DNA, 25 bp, Rattus norvegicus
ggtcggtatttgatcaggtccaaca

SEQ ID NO: 466551 - DNA, 25 bp, Rattus norvegicus
ggtcggtatttgttcaggtccaaca

SEQ ID NO: 466552 - DNA, 25 bp, Rattus norvegicus
ggtcggtctcaaaccatataatttt

SEQ ID NO: 466553 - DNA, 25 bp, Rattus norvegicus
ggtcggtctcaatccatataatttt

SEQ ID NO: 466554 - DNA, 25 bp, Rattus norvegicus
ggtcggtgacatcgacgctcagttc

SEQ ID NO: 466555 - DNA, 25 bp, Rattus norvegicus
ggtcggtgacatggacgctcagttc

SEQ ID NO: 466556 - DNA, 25 bp, Rattus norvegicus
ggtcgtaacccaaaggttctgaaca

SEQ ID NO: 466557 - DNA, 25 bp, Rattus norvegicus
ggtcgtaacccataggttctgaaca

SEQ ID NO: 466558 - DNA, 25 bp, Rattus norvegicus
ggtcgtaaggcaccagctccaggaa

SEQ ID NO: 466559 - DNA, 25 bp, Rattus norvegicus
ggtcgtaaggcagcagctccaggaa

SEQ ID NO: 466560 - DNA, 25 bp, Rattus norvegicus
ggtcgtaggaatctcgctgatcata

SEQ ID NO: 466561 - DNA, 25 bp, Rattus norvegicus
ggtcgtaggaatgtcgctgatcata

SEQ ID NO: 466562 - DNA, 25 bp, Rattus norvegicus
ggtcgtagggtactcttcagccata

SEQ ID NO: 466563 - DNA, 25 bp, Rattus norvegicus
ggtcgtagggtagtcttcagccata

SEQ ID NO: 466564 - DNA, 25 bp, Rattus norvegicus
ggtcgtagtggcatttatactttca

SEQ ID NO: 466565 - DNA, 25 bp, Rattus norvegicus
ggtcgtagtggcttttatactttca

SEQ ID NO: 466566 - DNA, 25 bp, Rattus norvegicus
ggtcgtagtttgattatggcccata

SEQ ID NO: 466567 - DNA, 25 bp, Rattus norvegicus
ggtcgtagtttgtttatggcccata

SEQ ID NO: 466568 - DNA, 25 bp, Rattus norvegicus
ggtcgtatcaatcaactccaactgt

SEQ ID NO: 466569 - DNA, 25 bp, Rattus norvegicus
ggtcgtatcaatgaactccaactgt

SEQ ID NO: 466570 - DNA, 25 bp, Rattus norvegicus
ggtcgtcacaagcactggtggctta

SEQ ID NO: 466571 - DNA, 25 bp, Rattus norvegicus
ggtcgtcacaaggactggtggctta

SEQ ID NO: 466572 - DNA, 25 bp, Rattus norvegicus
ggtcgtcacacacaaagacttagtc

SEQ ID NO: 466573 - DNA, 25 bp, Rattus norvegicus
ggtcgtcacacagaaagacttagtc

SEQ ID NO: 466574 - DNA, 25 bp, Rattus norvegicus
ggtcgtccacaccaagtgactactg

SEQ ID NO: 466575 - DNA, 25 bp, Rattus norvegicus
ggtcgtccacacgaagtgactactg

SEQ ID NO: 466576 - DNA, 25 bp, Rattus norvegicus
ggtcgtctacctacataacaacaac

SEQ ID NO: 466577 - DNA, 25 bp, Rattus norvegicus
ggtcgtctaccttcataacaacaac

SEQ ID NO: 466578 - DNA, 25 bp, Rattus norvegicus
ggtcgtctatggatttgtacacatt

SEQ ID NO: 466579 - DNA, 25 bp, Rattus norvegicus
ggtcgtctatggttttgtacacatt

SEQ ID NO: 466580 - DNA, 25 bp, Rattus norvegicus
ggtcgtctctccatagcacaagtga

SEQ ID NO: 466581 - DNA, 25 bp, Rattus norvegicus
ggtcgtctctccttagcacaagtga

SEQ ID NO: 466582 - DNA, 25 bp, Rattus norvegicus
ggtcgtctgaacaaagctcgtagct

SEQ ID NO: 466583 - DNA, 25 bp, Rattus norvegicus
ggtcgtctgaactaagctcgtagct

SEQ ID NO: 466584 - DNA, 25 bp, Rattus norvegicus
ggtcgtctgatcaccgcaagcacat

SEQ ID NO: 466585 - DNA, 25 bp, Rattus norvegicus
ggtcgtctgatctccgcaagcacat

SEQ ID NO: 466586 - DNA, 25 bp, Rattus norvegicus
ggtcgtctgccccaaggaattgtgc

SEQ ID NO: 466587 - DNA, 25 bp, Rattus norvegicus
ggtcgtctgcccgaaggaattgtgc

SEQ ID NO: 466588 - DNA, 25 bp, Rattus norvegicus
ggtcgtctgggcatggccccatgca

SEQ ID NO: 466589 - DNA, 25 bp, Rattus norvegicus
ggtcgtctgggcttggccccatgca

SEQ ID NO: 466590 - DNA, 25 bp, Rattus norvegicus
ggtcgtctggtgagcgccatcgtac

SEQ ID NO: 466591 - DNA, 25 bp, Rattus norvegicus
ggtcgtctggtgtgcgccatcgtac

SEQ ID NO: 466592 - DNA, 25 bp, Rattus norvegicus
ggtcgtctggttagaaggcacgccc

SEQ ID NO: 466593 - DNA, 25 bp, Rattus norvegicus
ggtcgtctggtttgaaggcacgccc

SEQ ID NO: 466594 - DNA, 25 bp, Rattus norvegicus
ggtcgtctgtttagtgtatgcctac

SEQ ID NO: 466595 - DNA, 25 bp, Rattus norvegicus
ggtcgtctgttttgtgtatgcctac

SEQ ID NO: 466596 - DNA, 25 bp, Rattus norvegicus
ggtcgtgactagagatttacccgtc

SEQ ID NO: 466597 - DNA, 25 bp, Rattus norvegicus
ggtcgtgactagtgatttacccgtc

SEQ ID NO: 466598 - DNA, 25 bp, Rattus norvegicus
ggtcgtgcctgtcctgagttcctgc

SEQ ID NO: 466599 - DNA, 25 bp, Rattus norvegicus
ggtcgtgcctgtgctgagttcctgc

SEQ ID NO: 466600 - DNA, 25 bp, Rattus norvegicus
ggtcgtggaaacatgtgcctaatct

SEQ ID NO: 466601 - DNA, 25 bp, Rattus norvegicus
ggtcgtggaaacttgtgcctaatct

SEQ ID NO: 466602 - DNA, 25 bp, Rattus norvegicus
ggtcgtggccaacatcagatagagc

SEQ ID NO: 466603 - DNA, 25 bp, Rattus norvegicus
ggtcgtggccaagatcagatagagc

SEQ ID NO: 466604 - DNA, 25 bp, Rattus norvegicus
ggtcgtggtggtcgcacgggtctcc

SEQ ID NO: 466605 - DNA, 25 bp, Rattus norvegicus
ggtcgtggtggtggcacgggtctcc

SEQ ID NO: 466606 - DNA, 25 bp, Rattus norvegicus
ggtcgtgtactgaaggaatccttct

SEQ ID NO: 466607 - DNA, 25 bp, Rattus norvegicus
ggtcgtgtactgtaggaatccttct

SEQ ID NO: 466608 - DNA, 25 bp, Rattus norvegicus
ggtcgtgtatttatccatttggctt

SEQ ID NO: 466609 - DNA, 25 bp, Rattus norvegicus
ggtcgtgtatttttccatttggctt

SEQ ID NO: 466610 - DNA, 25 bp, Rattus norvegicus
ggtcgttcaactaggcggctcccgg

SEQ ID NO: 466611 - DNA, 25 bp, Rattus norvegicus
ggtcgttcaacttggcggctcccgg

SEQ ID NO: 466612 - DNA, 25 bp, Rattus norvegicus
ggtcgttcaattccaattgtgcagt

SEQ ID NO: 466613 - DNA, 25 bp, Rattus norvegicus
ggtcgttcaattgcaattgtgcagt

SEQ ID NO: 466614 - DNA, 25 bp, Rattus norvegicus
ggtcgttcagtcaaacttccttaag

SEQ ID NO: 466615 - DNA, 25 bp, Rattus norvegicus
ggtcgttcagtctaacttccttaag

SEQ ID NO: 466616 - DNA, 25 bp, Rattus norvegicus
ggtcgttgagatccaagagcacagt

SEQ ID NO: 466617 - DNA, 25 bp, Rattus norvegicus
ggtcgttgagatgcaagagcacagt

SEQ ID NO: 466618 - DNA, 25 bp, Rattus norvegicus
ggtcgtttgacacttggagctcttc

SEQ ID NO: 466619 - DNA, 25 bp, Rattus norvegicus
ggtcgtttgacagttggagctcttc

SEQ ID NO: 466620 - DNA, 25 bp, Rattus norvegicus
ggtcgtttgatgagtctcgggcaaa

SEQ ID NO: 466621 - DNA, 25 bp, Rattus norvegicus
ggtcgtttgatgtgtctcgggcaaa

SEQ ID NO: 466622 - DNA, 25 bp, Rattus norvegicus
ggtcgtttgcctatgaatggcttta

SEQ ID NO: 466623 - DNA, 25 bp, Rattus norvegicus
ggtcgtttgcctttgaatggcttta

SEQ ID NO: 466624 - DNA, 25 bp, Rattus norvegicus
ggtcgtttgtctactgaggacgtga

SEQ ID NO: 466625 - DNA, 25 bp, Rattus norvegicus
ggtcgtttgtcttctgaggacgtga

SEQ ID NO: 466626 - DNA, 25 bp, Rattus norvegicus
ggtcgttttccacagctcagtatca

SEQ ID NO: 466627 - DNA, 25 bp, Rattus norvegicus
ggtcgttttccagagctcagtatca

SEQ ID NO: 466628 - DNA, 25 bp, Rattus norvegicus
ggtcgttttgcccagatcgtacaga

SEQ ID NO: 466629 - DNA, 25 bp, Rattus norvegicus
ggtcgttttgccgagatcgtacaga

SEQ ID NO: 466630 - DNA, 25 bp, Rattus norvegicus
ggtctaaaagtcacagtctgggttc

SEQ ID NO: 466631 - DNA, 25 bp, Rattus norvegicus
ggtctaaaagtctcagtctgggttc

SEQ ID NO: 466632 - DNA, 25 bp, Rattus norvegicus
ggtctaaacattaatatctaggcct

SEQ ID NO: 466633 - DNA, 25 bp, Rattus norvegicus
ggtctaaacatttatatctaggcct

SEQ ID NO: 466634 - DNA, 25 bp, Rattus norvegicus
ggtctaaacccaaagcattgtagtc

SEQ ID NO: 466635 - DNA, 25 bp, Rattus norvegicus
ggtctaaacccatagcattgtagtc

SEQ ID NO: 466636 - DNA, 25 bp, Rattus norvegicus
ggtctaacacacagtatttcacatt

SEQ ID NO: 466637 - DNA, 25 bp, Rattus norvegicus
ggtctaacacactgtatttcacatt

SEQ ID NO: 466638 - DNA, 25 bp, Rattus norvegicus
ggtctaacagttctttttgtcattt

SEQ ID NO: 466639 - DNA, 25 bp, Rattus norvegicus
ggtctaacagttgtttttgtcattt

SEQ ID NO: 466640 - DNA, 25 bp, Rattus norvegicus
ggtctaacttcactgctttttcaaa

SEQ ID NO: 466641 - DNA, 25 bp, Rattus norvegicus
ggtctaacttcagtgctttttcaaa

SEQ ID NO: 466642 - DNA, 25 bp, Rattus norvegicus
ggtctaagatcacaacccagggcct

SEQ ID NO: 466643 - DNA, 25 bp, Rattus norvegicus
ggtctaagatcagaacccagggcct

SEQ ID NO: 466644 - DNA, 25 bp, Rattus norvegicus
ggtctaagatccatctgggctgtaa

SEQ ID NO: 466645 - DNA, 25 bp, Rattus norvegicus
ggtctaagatccttctgggctgtaa

SEQ ID NO: 466646 - DNA, 25 bp, Rattus norvegicus
ggtctaagctggctgtcatcaataa

SEQ ID NO: 466647 - DNA, 25 bp, Rattus norvegicus
ggtctaagctgggtgtcatcaataa

SEQ ID NO: 466648 - DNA, 25 bp, Rattus norvegicus
ggtctaaggctcagggcctagtgta

SEQ ID NO: 466649 - DNA, 25 bp, Rattus norvegicus
ggtctaaggctctgggcctagtgta

SEQ ID NO: 466650 - DNA, 25 bp, Rattus norvegicus
ggtctaagtgagatccaggatgtta

SEQ ID NO: 466651 - DNA, 25 bp, Rattus norvegicus
ggtctaagtgagttccaggatgtta

SEQ ID NO: 466652 - DNA, 25 bp, Rattus norvegicus
ggtctaatattgactgcctctgcct

SEQ ID NO: 466653 - DNA, 25 bp, Rattus norvegicus
ggtctaatattgtctgcctctgcct

SEQ ID NO: 466654 - DNA, 25 bp, Rattus norvegicus
ggtctaatcagtctcatttgccaaa

SEQ ID NO: 466655 - DNA, 25 bp, Rattus norvegicus
ggtctaatcagtgtcatttgccaaa

SEQ ID NO: 466656 - DNA, 25 bp, Rattus norvegicus
ggtctaatctccagtaccgatgcaa

SEQ ID NO: 466657 - DNA, 25 bp, Rattus norvegicus
ggtctaatctcctgtaccgatgcaa

SEQ ID NO: 466658 - DNA, 25 bp, Rattus norvegicus
ggtctaatgtaccttgggccttcat

SEQ ID NO: 466659 - DNA, 25 bp, Rattus norvegicus
ggtctaatgtacgttgggccttcat

SEQ ID NO: 466660 - DNA, 25 bp, Rattus norvegicus
ggtctacaacaccttgctcttagga

SEQ ID NO: 466661 - DNA, 25 bp, Rattus norvegicus
ggtctacaacacgttgctcttagga

SEQ ID NO: 466662 - DNA, 25 bp, Rattus norvegicus
ggtctacactcaacataacaaagga

SEQ ID NO: 466663 - DNA, 25 bp, Rattus norvegicus
ggtctacactcatcataacaaagga

SEQ ID NO: 466664 - DNA, 25 bp, Rattus norvegicus
ggtctacagagccaattccaattcc

SEQ ID NO: 466665 - DNA, 25 bp, Rattus norvegicus
ggtctacagagcgaattccaattcc

SEQ ID NO: 466666 - DNA, 25 bp, Rattus norvegicus
ggtctacagattcagactgtcccct

SEQ ID NO: 466667 - DNA, 25 bp, Rattus norvegicus
ggtctacagattgagactgtcccct

SEQ ID NO: 466668 - DNA, 25 bp, Rattus norvegicus
ggtctacaggtgcagttactcatga

SEQ ID NO: 466669 - DNA, 25 bp, Rattus norvegicus
ggtctacaggtggagttactcatga

SEQ ID NO: 466670 - DNA, 25 bp, Rattus norvegicus
ggtctacatgttccagtatgactct

SEQ ID NO: 466671 - DNA, 25 bp, Rattus norvegicus
ggtctacatgttgcagtatgactct

SEQ ID NO: 466672 - DNA, 25 bp, Rattus norvegicus
ggtctaccaagacgcaacctccaaa

SEQ ID NO: 466673 - DNA, 25 bp, Rattus norvegicus
ggtctaccaagaggcaacctccaaa

SEQ ID NO: 466674 - DNA, 25 bp, Rattus norvegicus
ggtctacctacaccaagtctgtgag

SEQ ID NO: 466675 - DNA, 25 bp, Rattus norvegicus
ggtctacctacagcaagtctgtgag

SEQ ID NO: 466676 - DNA, 25 bp, Rattus norvegicus
ggtctacctcaccagcagagggcaa

SEQ ID NO: 466677 - DNA, 25 bp, Rattus norvegicus
ggtctacctcacgagcagagggcaa

SEQ ID NO: 466678 - DNA, 25 bp, Rattus norvegicus
ggtctaccttgcacttgtattagaa

SEQ ID NO: 466679 - DNA, 25 bp, Rattus norvegicus
ggtctaccttgctcttgtattagaa

SEQ ID NO: 466680 - DNA, 25 bp, Rattus norvegicus
ggtctaccttttacggacttcagat

SEQ ID NO: 466681 - DNA, 25 bp, Rattus norvegicus
ggtctacctttttcggacttcagat

SEQ ID NO: 466682 - DNA, 25 bp, Rattus norvegicus
ggtctacgaccactgaagtattcaa

SEQ ID NO: 466683 - DNA, 25 bp, Rattus norvegicus
ggtctacgaccagtgaagtattcaa

SEQ ID NO: 466684 - DNA, 25 bp, Rattus norvegicus
ggtctacgcatcatgtaaggccagg

SEQ ID NO: 466685 - DNA, 25 bp, Rattus norvegicus
ggtctacgcatcttgtaaggccagg

SEQ ID NO: 466686 - DNA, 25 bp, Rattus norvegicus
ggtctacgttcaagacatcctgcag

SEQ ID NO: 466687 - DNA, 25 bp, Rattus norvegicus
ggtctacgttcatgacatcctgcag

SEQ ID NO: 466688 - DNA, 25 bp, Rattus norvegicus
ggtctactatctacagtgaggtcta

SEQ ID NO: 466689 - DNA, 25 bp, Rattus norvegicus
ggtctactatcttcagtgaggtcta

SEQ ID NO: 466690 - DNA, 25 bp, Rattus norvegicus
ggtctactcgggaatggcctcactg

SEQ ID NO: 466691 - DNA, 25 bp, Rattus norvegicus
ggtctactcgggtatggcctcactg

SEQ ID NO: 466692 - DNA, 25 bp, Rattus norvegicus
ggtctactgctaaaaagcacaccag

SEQ ID NO: 466693 - DNA, 25 bp, Rattus norvegicus
ggtctactgctataaagcacaccag

SEQ ID NO: 466694 - DNA, 25 bp, Rattus norvegicus
ggtctactgggtcatttgccttaac

SEQ ID NO: 466695 - DNA, 25 bp, Rattus norvegicus
ggtctactgggtgatttgccttaac

SEQ ID NO: 466696 - DNA, 25 bp, Rattus norvegicus
ggtctacttactcttgctagcactg

SEQ ID NO: 466697 - DNA, 25 bp, Rattus norvegicus
ggtctacttactgttgctagcactg

SEQ ID NO: 466698 - DNA, 25 bp, Rattus norvegicus
ggtctagagtgtactgtgcctccaa

SEQ ID NO: 466699 - DNA, 25 bp, Rattus norvegicus
ggtctagagtgttctgtgcctccaa

SEQ ID NO: 466700 - DNA, 25 bp, Rattus norvegicus
ggtctagcagtacttgggatcccag

SEQ ID NO: 466701 - DNA, 25 bp, Rattus norvegicus
ggtctagcagtagttgggatcccag

SEQ ID NO: 466702 - DNA, 25 bp, Rattus norvegicus
ggtctagcctccattaggattctgt

SEQ ID NO: 466703 - DNA, 25 bp, Rattus norvegicus
ggtctagcctcctttaggattctgt

SEQ ID NO: 466704 - DNA, 25 bp, Rattus norvegicus
ggtctagctgagactggccccgcaa

SEQ ID NO: 466705 - DNA, 25 bp, Rattus norvegicus
ggtctagctgagtctggccccgcaa

SEQ ID NO: 466706 - DNA, 25 bp, Rattus norvegicus
ggtctaggacagataccacctgtaa

SEQ ID NO: 466707 - DNA, 25 bp, Rattus norvegicus
ggtctaggacagttaccacctgtaa

SEQ ID NO: 466708 - DNA, 25 bp, Rattus norvegicus
ggtctaggactgagctggtttccaa

SEQ ID NO: 466709 - DNA, 25 bp, Rattus norvegicus
ggtctaggactgtgctggtttccaa

SEQ ID NO: 466710 - DNA, 25 bp, Rattus norvegicus
ggtctaggagctcagccatggtcat

SEQ ID NO: 466711 - DNA, 25 bp, Rattus norvegicus
ggtctaggagctgagccatggtcat

SEQ ID NO: 466712 - DNA, 25 bp, Rattus norvegicus
ggtctaggcatactactggagcagc

SEQ ID NO: 466713 - DNA, 25 bp, Rattus norvegicus
ggtctaggcatagtactggagcagc

SEQ ID NO: 466714 - DNA, 25 bp, Rattus norvegicus
ggtctagtaagtcagctgctttgtc

SEQ ID NO: 466715 - DNA, 25 bp, Rattus norvegicus
ggtctagtaagtgagctgctttgtc

SEQ ID NO: 466716 - DNA, 25 bp, Rattus norvegicus
ggtctagtcttccttatctgtaaat

SEQ ID NO: 466717 - DNA, 25 bp, Rattus norvegicus
ggtctagtcttcgttatctgtaaat

SEQ ID NO: 466718 - DNA, 25 bp, Rattus norvegicus
ggtctagttcccaaattggttcttg

SEQ ID NO: 466719 - DNA, 25 bp, Rattus norvegicus
ggtctagttccctaattggttcttg

SEQ ID NO: 466720 - DNA, 25 bp, Rattus norvegicus
ggtctataataaccgaggtctgcaa

SEQ ID NO: 466721 - DNA, 25 bp, Rattus norvegicus
ggtctataataagcgaggtctgcaa

SEQ ID NO: 466722 - DNA, 25 bp, Rattus norvegicus
ggtctataccagagagtgtgtgtta

SEQ ID NO: 466723 - DNA, 25 bp, Rattus norvegicus
ggtctataccagtgagtgtgtgtta

SEQ ID NO: 466724 - DNA, 25 bp, Rattus norvegicus
ggtctatatctgaacaaatctctgg

SEQ ID NO: 466725 - DNA, 25 bp, Rattus norvegicus
ggtctatatctgtacaaatctctgg

SEQ ID NO: 466726 - DNA, 25 bp, Rattus norvegicus
ggtctatccacaagtttgtccctta

SEQ ID NO: 466727 - DNA, 25 bp, Rattus norvegicus
ggtctatccacatgtttgtccctta

SEQ ID NO: 466728 - DNA, 25 bp, Rattus norvegicus
ggtctatcctatacagttcttggta

SEQ ID NO: 466729 - DNA, 25 bp, Rattus norvegicus
ggtctatcctattcagttcttggta

SEQ ID NO: 466730 - DNA, 25 bp, Rattus norvegicus
ggtctatctcatattctgttctcat

SEQ ID NO: 466731 - DNA, 25 bp, Rattus norvegicus
ggtctatctcattttctgttctcat

SEQ ID NO: 466732 - DNA, 25 bp, Rattus norvegicus
ggtctatcttcaacaaagtactcct

SEQ ID NO: 466733 - DNA, 25 bp, Rattus norvegicus
ggtctatcttcatcaaagtactcct

SEQ ID NO: 466734 - DNA, 25 bp, Rattus norvegicus
ggtctatcttccatacactttattt

SEQ ID NO: 466735 - DNA, 25 bp, Rattus norvegicus
ggtctatcttccttacactttattt

SEQ ID NO: 466736 - DNA, 25 bp, Rattus norvegicus
ggtctatggaaaagtgcttgcctgt

SEQ ID NO: 466737 - DNA, 25 bp, Rattus norvegicus
ggtctatggaaatgtgcttgcctgt

SEQ ID NO: 466738 - DNA, 25 bp, Rattus norvegicus
ggtctatggtaaagtgtatccttaa

SEQ ID NO: 466739 - DNA, 25 bp, Rattus norvegicus
ggtctatggtaatgtgtatccttaa

SEQ ID NO: 466740 - DNA, 25 bp, Rattus norvegicus
ggtctatgtaacatattcactgtgt

SEQ ID NO: 466741 - DNA, 25 bp, Rattus norvegicus
ggtctatgtaacttattcactgtgt

SEQ ID NO: 466742 - DNA, 25 bp, Rattus norvegicus
ggtctattaagaacccaaagataat

SEQ ID NO: 466743 - DNA, 25 bp, Rattus norvegicus
ggtctattaagatcccaaagataat

SEQ ID NO: 466744 - DNA, 25 bp, Rattus norvegicus
ggtctattcctacaactgacacaat

SEQ ID NO: 466745 - DNA, 25 bp, Rattus norvegicus
ggtctattcctacaattgtcataat

SEQ ID NO: 466746 - DNA, 25 bp, Rattus norvegicus
ggtctattcctagaactgacacaat

SEQ ID NO: 466747 - DNA, 25 bp, Rattus norvegicus
ggtctattcctagaattgtcataat

SEQ ID NO: 466748 - DNA, 25 bp, Rattus norvegicus
ggtctattggaacccttgtccgaca

SEQ ID NO: 466749 - DNA, 25 bp, Rattus norvegicus
ggtctattggaagccttgtccgaca

SEQ ID NO: 466750 - DNA, 25 bp, Rattus norvegicus
ggtctatttcttcatgagccacatt

SEQ ID NO: 466751 - DNA, 25 bp, Rattus norvegicus
ggtctatttcttgatgagccacatt

SEQ ID NO: 466752 - DNA, 25 bp, Rattus norvegicus
ggtctattttataccaatgccctga

SEQ ID NO: 466753 - DNA, 25 bp, Rattus norvegicus
ggtctattttattccaatgccctga

SEQ ID NO: 466754 - DNA, 25 bp, Rattus norvegicus
ggtctcaacactcaagggctctatc

SEQ ID NO: 466755 - DNA, 25 bp, Rattus norvegicus
ggtctcaacactgaagggctctatc

SEQ ID NO: 466756 - DNA, 25 bp, Rattus norvegicus
ggtctcaagataagtctctcgggtt

SEQ ID NO: 466757 - DNA, 25 bp, Rattus norvegicus
ggtctcaagatatgtctctcgggtt

SEQ ID NO: 466758 - DNA, 25 bp, Rattus norvegicus
ggtctcaagctcaggtacctgcctg

SEQ ID NO: 466759 - DNA, 25 bp, Rattus norvegicus
ggtctcaagctctggtacctgcctg

SEQ ID NO: 466760 - DNA, 25 bp, Rattus norvegicus
ggtctcaaggacaacagccagttct

SEQ ID NO: 466761 - DNA, 25 bp, Rattus norvegicus
ggtctcaaggactacagccagttct

SEQ ID NO: 466762 - DNA, 25 bp, Rattus norvegicus
ggtctcaagggacccatttcaggat

SEQ ID NO: 466763 - DNA, 25 bp, Rattus norvegicus
ggtctcaagggagccatttcaggat

SEQ ID NO: 466764 - DNA, 25 bp, Rattus norvegicus
ggtctcaatccgactcttgtattaa

SEQ ID NO: 466765 - DNA, 25 bp, Rattus norvegicus
ggtctcaatccgtctcttgtattaa

SEQ ID NO: 466766 - DNA, 25 bp, Rattus norvegicus
ggtctcacaatcagcttacactgtg

SEQ ID NO: 466767 - DNA, 25 bp, Rattus norvegicus
ggtctcacaatctgcttacactgtg

SEQ ID NO: 466768 - DNA, 25 bp, Rattus norvegicus
ggtctcaccctaatttatgacattg

SEQ ID NO: 466769 - DNA, 25 bp, Rattus norvegicus
ggtctcaccctattttatgacattg

SEQ ID NO: 466770 - DNA, 25 bp, Rattus norvegicus
ggtctcaccttgattctcacaagaa

SEQ ID NO: 466771 - DNA, 25 bp, Rattus norvegicus
ggtctcaccttgtttctcacaagaa

SEQ ID NO: 466772 - DNA, 25 bp, Rattus norvegicus
ggtctcactaaaatgctctggctgt

SEQ ID NO: 466773 - DNA, 25 bp, Rattus norvegicus
ggtctcactaaattgctctggctgt

SEQ ID NO: 466774 - DNA, 25 bp, Rattus norvegicus
ggtctcactatccactgtgtgtaga

SEQ ID NO: 466775 - DNA, 25 bp, Rattus norvegicus
ggtctcactatcgactgtgtgtaga

SEQ ID NO: 466776 - DNA, 25 bp, Rattus norvegicus
ggtctcactcaacaatctcaatgaa

SEQ ID NO: 466777 - DNA, 25 bp, Rattus norvegicus
ggtctcactcaagaatctcaatgaa

SEQ ID NO: 466778 - DNA, 25 bp, Rattus norvegicus
ggtctcactcgcactggaatgcaaa

SEQ ID NO: 466779 - DNA, 25 bp, Rattus norvegicus
ggtctcactcgctctggaatgcaaa

SEQ ID NO: 466780 - DNA, 25 bp, Rattus norvegicus
ggtctcactgtaacaccctgattga

SEQ ID NO: 466781 - DNA, 25 bp, Rattus norvegicus
ggtctcactgtatcaccctgattga

SEQ ID NO: 466782 - DNA, 25 bp, Rattus norvegicus
ggtctcacttctcctctttattgaa

SEQ ID NO: 466783 - DNA, 25 bp, Rattus norvegicus
ggtctcacttctgctctttattgaa

SEQ ID NO: 466784 - DNA, 25 bp, Rattus norvegicus
ggtctcacttttatcatatcgtcca

SEQ ID NO: 466785 - DNA, 25 bp, Rattus norvegicus
ggtctcacttttttcatatcgtcca

SEQ ID NO: 466786 - DNA, 25 bp, Rattus norvegicus
ggtctcagacaactccagtgaaagt

SEQ ID NO: 466787 - DNA, 25 bp, Rattus norvegicus
ggtctcagacaagtccagtgaaagt

SEQ ID NO: 466788 - DNA, 25 bp, Rattus norvegicus
ggtctcagacttacttcctgcttgt

SEQ ID NO: 466789 - DNA, 25 bp, Rattus norvegicus
ggtctcagactttcttcctgcttgt

SEQ ID NO: 466790 - DNA, 25 bp, Rattus norvegicus
ggtctcagattcatccccatgtgtc

SEQ ID NO: 466791 - DNA, 25 bp, Rattus norvegicus
ggtctcagattcttccccatgtgtc

SEQ ID NO: 466792 - DNA, 25 bp, Rattus norvegicus
ggtctcagctgaagtccttttggaa

SEQ ID NO: 466793 - DNA, 25 bp, Rattus norvegicus
ggtctcagctgatgtccttttggaa

SEQ ID NO: 466794 - DNA, 25 bp, Rattus norvegicus
ggtctcagcttgatctgcattgcaa

SEQ ID NO: 466795 - DNA, 25 bp, Rattus norvegicus
ggtctcagcttgttctgcattgcaa

SEQ ID NO: 466796 - DNA, 25 bp, Rattus norvegicus
ggtctcaggagaataactttcatat

SEQ ID NO: 466797 - DNA, 25 bp, Rattus norvegicus
ggtctcaggagattaactttcatat

SEQ ID NO: 466798 - DNA, 25 bp, Rattus norvegicus
ggtctcaggcccaaggtatatgcaa

SEQ ID NO: 466799 - DNA, 25 bp, Rattus norvegicus
ggtctcaggccctaggtatatgcaa

SEQ ID NO: 466800 - DNA, 25 bp, Rattus norvegicus
ggtctcagtctaaaactctggtgtt

SEQ ID NO: 466801 - DNA, 25 bp, Rattus norvegicus
ggtctcagtctataactctggtgtt

SEQ ID NO: 466802 - DNA, 25 bp, Rattus norvegicus
ggtctcagtgacctcatgacgaacc

SEQ ID NO: 466803 - DNA, 25 bp, Rattus norvegicus
ggtctcagtgacgtcatgacgaacc

SEQ ID NO: 466804 - DNA, 25 bp, Rattus norvegicus
ggtctcagtgtgaatctctggctgc

SEQ ID NO: 466805 - DNA, 25 bp, Rattus norvegicus
ggtctcagtgtgtatctctggctgc

SEQ ID NO: 466806 - DNA, 25 bp, Rattus norvegicus
ggtctcagtgttacctgccaaaaca

SEQ ID NO: 466807 - DNA, 25 bp, Rattus norvegicus
ggtctcagtgttctcggaatctaca

SEQ ID NO: 466808 - DNA, 25 bp, Rattus norvegicus
ggtctcagtgttgtcggaatctaca

SEQ ID NO: 466809 - DNA, 25 bp, Rattus norvegicus
ggtctcagtgtttcctgccaaaaca

SEQ ID NO: 466810 - DNA, 25 bp, Rattus norvegicus
ggtctcatagttactaccttaaaca

SEQ ID NO: 466811 - DNA, 25 bp, Rattus norvegicus
ggtctcatagtttctaccttaaaca

SEQ ID NO: 466812 - DNA, 25 bp, Rattus norvegicus
ggtctcatataactcagactggcct

SEQ ID NO: 466813 - DNA, 25 bp, Rattus norvegicus
ggtctcatataagtcagactggcct

SEQ ID NO: 466814 - DNA, 25 bp, Rattus norvegicus
ggtctcatcatgaatcctaggctag

SEQ ID NO: 466815 - DNA, 25 bp, Rattus norvegicus
ggtctcatcatgtatcctaggctag

SEQ ID NO: 466816 - DNA, 25 bp, Rattus norvegicus
ggtctcatctctccatcaggaattt

SEQ ID NO: 466817 - DNA, 25 bp, Rattus norvegicus
ggtctcatctctgcatcaggaattt

SEQ ID NO: 466818 - DNA, 25 bp, Rattus norvegicus
ggtctcatgaagatcaggctggctt

SEQ ID NO: 466819 - DNA, 25 bp, Rattus norvegicus
ggtctcatgaagttcaggctggctt

SEQ ID NO: 466820 - DNA, 25 bp, Rattus norvegicus
ggtctcatgaataaggctcctttta

SEQ ID NO: 466821 - DNA, 25 bp, Rattus norvegicus
ggtctcatgaattaggctcctttta

SEQ ID NO: 466822 - DNA, 25 bp, Rattus norvegicus
ggtctcatgattattaagtgtcctc

SEQ ID NO: 466823 - DNA, 25 bp, Rattus norvegicus
ggtctcatgatttttaagtgtcctc

SEQ ID NO: 466824 - DNA, 25 bp, Rattus norvegicus
ggtctcatgcttaaatctgttcctc

SEQ ID NO: 466825 - DNA, 25 bp, Rattus norvegicus
ggtctcatgctttaatctgttcctc

SEQ ID NO: 466826 - DNA, 25 bp, Rattus norvegicus
ggtctcatgtaacctacactggtct

SEQ ID NO: 466827 - DNA, 25 bp, Rattus norvegicus
ggtctcatgtaagctacactggtct

SEQ ID NO: 466828 - DNA, 25 bp, Rattus norvegicus
ggtctccaaattaccaggtcattgc

SEQ ID NO: 466829 - DNA, 25 bp, Rattus norvegicus
ggtctccaaatttccaggtcattgc

SEQ ID NO: 466830 - DNA, 25 bp, Rattus norvegicus
ggtctccaacaaacaggtatctgcg

SEQ ID NO: 466831 - DNA, 25 bp, Rattus norvegicus
ggtctccaacaatcaggtatctgcg

SEQ ID NO: 466832 - DNA, 25 bp, Rattus norvegicus
ggtctccaactaataatcctcctgt

SEQ ID NO: 466833 - DNA, 25 bp, Rattus norvegicus
ggtctccaactattaatcctcctgt

SEQ ID NO: 466834 - DNA, 25 bp, Rattus norvegicus
ggtctccaagcaattccgtaaaggt

SEQ ID NO: 466835 - DNA, 25 bp, Rattus norvegicus
ggtctccaagcatttccgtaaaggt

SEQ ID NO: 466836 - DNA, 25 bp, Rattus norvegicus
ggtctccaatatctcaacatgtgcc

SEQ ID NO: 466837 - DNA, 25 bp, Rattus norvegicus
ggtctccaatatgtcaacatgtgcc

SEQ ID NO: 466838 - DNA, 25 bp, Rattus norvegicus
ggtctccaatggctacagctctaag

SEQ ID NO: 466839 - DNA, 25 bp, Rattus norvegicus
ggtctccaatgggtacagctctaag

SEQ ID NO: 466840 - DNA, 25 bp, Rattus norvegicus
ggtctccacacacgtctcataaaaa

SEQ ID NO: 466841 - DNA, 25 bp, Rattus norvegicus
ggtctccacacaggtctcataaaaa

SEQ ID NO: 466842 - DNA, 25 bp, Rattus norvegicus
ggtctccacagtcagcaggacacaa

SEQ ID NO: 466843 - DNA, 25 bp, Rattus norvegicus
ggtctccacagtgagcaggacacaa

SEQ ID NO: 466844 - DNA, 25 bp, Rattus norvegicus
ggtctccacatcctacatgttagaa

SEQ ID NO: 466845 - DNA, 25 bp, Rattus norvegicus
ggtctccacatcgtacatgttagaa

SEQ ID NO: 466846 - DNA, 25 bp, Rattus norvegicus
ggtctccagcacaataatagccatg

SEQ ID NO: 466847 - DNA, 25 bp, Rattus norvegicus
ggtctccagcactataatagccatg

SEQ ID NO: 466848 - DNA, 25 bp, Rattus norvegicus
ggtctccagtggcaggcagcaacct

SEQ ID NO: 466849 - DNA, 25 bp, Rattus norvegicus
ggtctccagtgggaggcagcaacct

SEQ ID NO: 466850 - DNA, 25 bp, Rattus norvegicus
ggtctccagtttaaatactcagttt

SEQ ID NO: 466851 - DNA, 25 bp, Rattus norvegicus
ggtctccagttttaatactcagttt

SEQ ID NO: 466852 - DNA, 25 bp, Rattus norvegicus
ggtctccattgtagtcaggatgata

SEQ ID NO: 466853 - DNA, 25 bp, Rattus norvegicus
ggtctccattgttgtcaggatgata

SEQ ID NO: 466854 - DNA, 25 bp, Rattus norvegicus
ggtctcccagctattggaaaacacg

SEQ ID NO: 466855 - DNA, 25 bp, Rattus norvegicus
ggtctcccagcttttggaaaacacg

SEQ ID NO: 466856 - DNA, 25 bp, Rattus norvegicus
ggtctccctaaaacagaggccaact

SEQ ID NO: 466857 - DNA, 25 bp, Rattus norvegicus
ggtctccctaaatcagaggccaact

SEQ ID NO: 466858 - DNA, 25 bp, Rattus norvegicus
ggtctccctgaccaatggctaataa

SEQ ID NO: 466859 - DNA, 25 bp, Rattus norvegicus
ggtctccctgacgaatggctaataa

SEQ ID NO: 466860 - DNA, 25 bp, Rattus norvegicus
ggtctccgaatcctcagaacaattt

SEQ ID NO: 466861 - DNA, 25 bp, Rattus norvegicus
ggtctccgaatcgtcagaacaattt

SEQ ID NO: 466862 - DNA, 25 bp, Rattus norvegicus
ggtctccgagatccatgcggatgat

SEQ ID NO: 466863 - DNA, 25 bp, Rattus norvegicus
ggtctccgagatgcatgcggatgat

SEQ ID NO: 466864 - DNA, 25 bp, Rattus norvegicus
ggtctccgattaatggcacacagcc

SEQ ID NO: 466865 - DNA, 25 bp, Rattus norvegicus
ggtctccgattattggcacacagcc

SEQ ID NO: 466866 - DNA, 25 bp, Rattus norvegicus
ggtctccggaggctggtgggtgtgc

SEQ ID NO: 466867 - DNA, 25 bp, Rattus norvegicus
ggtctccggagggtggtgggtgtgc

SEQ ID NO: 466868 - DNA, 25 bp, Rattus norvegicus
ggtctccggtctacgctgatcttca

SEQ ID NO: 466869 - DNA, 25 bp, Rattus norvegicus
ggtctccggtcttcgctgatcttca

SEQ ID NO: 466870 - DNA, 25 bp, Rattus norvegicus
ggtctcctacagagactcagagtgt

SEQ ID NO: 466871 - DNA, 25 bp, Rattus norvegicus
ggtctcctacagtgactcagagtgt

SEQ ID NO: 466872 - DNA, 25 bp, Rattus norvegicus
ggtctcctacttactatgtggctaa

SEQ ID NO: 466873 - DNA, 25 bp, Rattus norvegicus
ggtctcctacttctgggattgcaga

SEQ ID NO: 466874 - DNA, 25 bp, Rattus norvegicus
ggtctcctacttgtgggattgcaga

SEQ ID NO: 466875 - DNA, 25 bp, Rattus norvegicus
ggtctcctactttctatgtggctaa

SEQ ID NO: 466876 - DNA, 25 bp, Rattus norvegicus
ggtctcctcattatatttccaggga

SEQ ID NO: 466877 - DNA, 25 bp, Rattus norvegicus
ggtctcctcattttatttccaggga

SEQ ID NO: 466878 - DNA, 25 bp, Rattus norvegicus
ggtctcctccacaaagaggcactga

SEQ ID NO: 466879 - DNA, 25 bp, Rattus norvegicus
ggtctcctccactaagaggcactga

SEQ ID NO: 466880 - DNA, 25 bp, Rattus norvegicus
ggtctcctctctaatgtactaacag

SEQ ID NO: 466881 - DNA, 25 bp, Rattus norvegicus
ggtctcctctcttatgtactaacag

SEQ ID NO: 466882 - DNA, 25 bp, Rattus norvegicus
ggtctcctgcttaaactatttctaa

SEQ ID NO: 466883 - DNA, 25 bp, Rattus norvegicus
ggtctcctgctttaactatttctaa

SEQ ID NO: 466884 - DNA, 25 bp, Rattus norvegicus
ggtctcctggaaacttaagtgctgt

SEQ ID NO: 466885 - DNA, 25 bp, Rattus norvegicus
ggtctcctggaatcttaagtgctgt

SEQ ID NO: 466886 - DNA, 25 bp, Rattus norvegicus
ggtctcctgggacagcttgaaactt

SEQ ID NO: 466887 - DNA, 25 bp, Rattus norvegicus
ggtctcctgggagagcttgaaactt

SEQ ID NO: 466888 - DNA, 25 bp, Rattus norvegicus
ggtctcctgtgcactgagggccaga

SEQ ID NO: 466889 - DNA, 25 bp, Rattus norvegicus
ggtctcctgtgctctgagggccaga

SEQ ID NO: 466890 - DNA, 25 bp, Rattus norvegicus
ggtctcctgttcaccaagtttaatg

SEQ ID NO: 466891 - DNA, 25 bp, Rattus norvegicus
ggtctcctgttctccaagtttaatg

SEQ ID NO: 466892 - DNA, 25 bp, Rattus norvegicus
ggtctcctgtttcggcctgagtgta

SEQ ID NO: 466893 - DNA, 25 bp, Rattus norvegicus
ggtctcctgtttgggcctgagtgta

SEQ ID NO: 466894 - DNA, 25 bp, Rattus norvegicus
ggtctccttaagacctagaaacaat

SEQ ID NO: 466895 - DNA, 25 bp, Rattus norvegicus
ggtctccttaagtcctagaaacaat

SEQ ID NO: 466896 - DNA, 25 bp, Rattus norvegicus
ggtctccttagcaaatacaggtagt

SEQ ID NO: 466897 - DNA, 25 bp, Rattus norvegicus
ggtctccttagctaatacaggtagt

SEQ ID NO: 466898 - DNA, 25 bp, Rattus norvegicus
ggtctccttgcaagttgccaaagtc

SEQ ID NO: 466899 - DNA, 25 bp, Rattus norvegicus
ggtctccttgcatgttgccaaagtc

SEQ ID NO: 466900 - DNA, 25 bp, Rattus norvegicus
ggtctccttttaacagttgccattt

SEQ ID NO: 466901 - DNA, 25 bp, Rattus norvegicus
ggtctccttttatcagttgccattt

SEQ ID NO: 466902 - DNA, 25 bp, Rattus norvegicus
ggtctccttttgcattagccaacca

SEQ ID NO: 466903 - DNA, 25 bp, Rattus norvegicus
ggtctccttttggattagccaacca

SEQ ID NO: 466904 - DNA, 25 bp, Rattus norvegicus
ggtctcgacacacagcgtttatatg

SEQ ID NO: 466905 - DNA, 25 bp, Rattus norvegicus
ggtctcgacacagagcgtttatatg

SEQ ID NO: 466906 - DNA, 25 bp, Rattus norvegicus
ggtctcgagctcaagggcttccagc

SEQ ID NO: 466907 - DNA, 25 bp, Rattus norvegicus
ggtctcgagctctagggcttccagc

SEQ ID NO: 466908 - DNA, 25 bp, Rattus norvegicus
ggtctcgcggcgcaagacatttagc

SEQ ID NO: 466909 - DNA, 25 bp, Rattus norvegicus
ggtctcgcggcggaagacatttagc

SEQ ID NO: 466910 - DNA, 25 bp, Rattus norvegicus
ggtctcggcctgaatgaaaactgta

SEQ ID NO: 466911 - DNA, 25 bp, Rattus norvegicus
ggtctcggcctgtatgaaaactgta

SEQ ID NO: 466912 - DNA, 25 bp, Rattus norvegicus
ggtctctaaaccaagctcgggatga

SEQ ID NO: 466913 - DNA, 25 bp, Rattus norvegicus
ggtctctaaacctagctcgggatga

SEQ ID NO: 466914 - DNA, 25 bp, Rattus norvegicus
ggtctctaattgaaagtgtctcagt

SEQ ID NO: 466915 - DNA, 25 bp, Rattus norvegicus
ggtctctaattgtaagtgtctcagt

SEQ ID NO: 466916 - DNA, 25 bp, Rattus norvegicus
ggtctctacagacagatcctgctgg

SEQ ID NO: 466917 - DNA, 25 bp, Rattus norvegicus
ggtctctacagagagatcctgctgg

SEQ ID NO: 466918 - DNA, 25 bp, Rattus norvegicus
ggtctctacgtgcagttctggcaga

SEQ ID NO: 466919 - DNA, 25 bp, Rattus norvegicus
ggtctctacgtggagttctggcaga

SEQ ID NO: 466920 - DNA, 25 bp, Rattus norvegicus
ggtctctactgaattcgaaggtctt

SEQ ID NO: 466921 - DNA, 25 bp, Rattus norvegicus
ggtctctactgaattgttcatactt

SEQ ID NO: 466922 - DNA, 25 bp, Rattus norvegicus
ggtctctactgatttcgaaggtctt

SEQ ID NO: 466923 - DNA, 25 bp, Rattus norvegicus
ggtctctactgatttgttcatactt

SEQ ID NO: 466924 - DNA, 25 bp, Rattus norvegicus
ggtctctagcaccttccttttaaag

SEQ ID NO: 466925 - DNA, 25 bp, Rattus norvegicus
ggtctctagcacgttccttttaaag

SEQ ID NO: 466926 - DNA, 25 bp, Rattus norvegicus
ggtctctagttgctggaattaccct

SEQ ID NO: 466927 - DNA, 25 bp, Rattus norvegicus
ggtctctagttggtggaattaccct

SEQ ID NO: 466928 - DNA, 25 bp, Rattus norvegicus
ggtctctataaaattgttgaactct

SEQ ID NO: 466929 - DNA, 25 bp, Rattus norvegicus
ggtctctataaatttgttgaactct

SEQ ID NO: 466930 - DNA, 25 bp, Rattus norvegicus
ggtctctatgaacccctggaaaagc

SEQ ID NO: 466931 - DNA, 25 bp, Rattus norvegicus
ggtctctatgaagccctggaaaagc

SEQ ID NO: 466932 - DNA, 25 bp, Rattus norvegicus
ggtctctattacataggtcaaatcc

SEQ ID NO: 466933 - DNA, 25 bp, Rattus norvegicus
ggtctctattacttaggtcaaatcc

SEQ ID NO: 466934 - DNA, 25 bp, Rattus norvegicus
ggtctctatttaagtccatcaggtg

SEQ ID NO: 466935 - DNA, 25 bp, Rattus norvegicus
ggtctctatttatgtccatcaggtg

SEQ ID NO: 466936 - DNA, 25 bp, Rattus norvegicus
ggtctctatttcattgttggcatca

SEQ ID NO: 466937 - DNA, 25 bp, Rattus norvegicus
ggtctctatttctttgttggcatca

SEQ ID NO: 466938 - DNA, 25 bp, Rattus norvegicus
ggtctctcaattcccatcctgagaa

SEQ ID NO: 466939 - DNA, 25 bp, Rattus norvegicus
ggtctctcaattgccatcctgagaa

SEQ ID NO: 466940 - DNA, 25 bp, Rattus norvegicus
ggtctctcaggactgctgacatata

SEQ ID NO: 466941 - DNA, 25 bp, Rattus norvegicus
ggtctctcaggagtgctgacatata

SEQ ID NO: 466942 - DNA, 25 bp, Rattus norvegicus
ggtctctccataacttactgtcaag

SEQ ID NO: 466943 - DNA, 25 bp, Rattus norvegicus
ggtctctccatatcttactgtcaag

SEQ ID NO: 466944 - DNA, 25 bp, Rattus norvegicus
ggtctctccattactggcagttaat

SEQ ID NO: 466945 - DNA, 25 bp, Rattus norvegicus
ggtctctccatttctggcagttaat

SEQ ID NO: 466946 - DNA, 25 bp, Rattus norvegicus
ggtctctcccacatgtgtagctcag

SEQ ID NO: 466947 - DNA, 25 bp, Rattus norvegicus
ggtctctcccacttgtgtagctcag

SEQ ID NO: 466948 - DNA, 25 bp, Rattus norvegicus
ggtctctcgtgtcatagcccaggca

SEQ ID NO: 466949 - DNA, 25 bp, Rattus norvegicus
ggtctctcgtgtgatagcccaggca

SEQ ID NO: 466950 - DNA, 25 bp, Rattus norvegicus
ggtctctctaatctagaacctcaat

SEQ ID NO: 466951 - DNA, 25 bp, Rattus norvegicus
ggtctctctaatgtagaacctcaat

SEQ ID NO: 466952 - DNA, 25 bp, Rattus norvegicus
ggtctctctagcaaaatcttcgtaa

SEQ ID NO: 466953 - DNA, 25 bp, Rattus norvegicus
ggtctctctagctaaatcttcgtaa

SEQ ID NO: 466954 - DNA, 25 bp, Rattus norvegicus
ggtctctctagtaaatgtcgcttca

SEQ ID NO: 466955 - DNA, 25 bp, Rattus norvegicus
ggtctctctagttaatgtcgcttca

SEQ ID NO: 466956 - DNA, 25 bp, Rattus norvegicus
ggtctctctatgaaggcctggcttg

SEQ ID NO: 466957 - DNA, 25 bp, Rattus norvegicus
ggtctctctatgtaggcctggcttg

SEQ ID NO: 466958 - DNA, 25 bp, Rattus norvegicus
ggtctctctcatcctaagatcacag

SEQ ID NO: 466959 - DNA, 25 bp, Rattus norvegicus
ggtctctctcatgctaagatcacag

SEQ ID NO: 466960 - DNA, 25 bp, Rattus norvegicus
ggtctctctcttaaacagtttcagc

SEQ ID NO: 466961 - DNA, 25 bp, Rattus norvegicus
ggtctctctctttaacagtttcagc

SEQ ID NO: 466962 - DNA, 25 bp, Rattus norvegicus
ggtctctctgaaaaccaggcatgca

SEQ ID NO: 466963 - DNA, 25 bp, Rattus norvegicus
ggtctctctgaataccaggcatgca

SEQ ID NO: 466964 - DNA, 25 bp, Rattus norvegicus
ggtctctctgagacacagttcaatt

SEQ ID NO: 466965 - DNA, 25 bp, Rattus norvegicus
ggtctctctgagcagctacggcgta

SEQ ID NO: 466966 - DNA, 25 bp, Rattus norvegicus
ggtctctctgaggagctacggcgta

SEQ ID NO: 466967 - DNA, 25 bp, Rattus norvegicus
ggtctctctgagtcacagttcaatt

SEQ ID NO: 466968 - DNA, 25 bp, Rattus norvegicus
ggtctctctgatctattcatcacaa

SEQ ID NO: 466969 - DNA, 25 bp, Rattus norvegicus
ggtctctctgatgtattcatcacaa

SEQ ID NO: 466970 - DNA, 25 bp, Rattus norvegicus
ggtctctcttcgcttttgcattaac

SEQ ID NO: 466971 - DNA, 25 bp, Rattus norvegicus
ggtctctcttcggttttgcattaac

SEQ ID NO: 466972 - DNA, 25 bp, Rattus norvegicus
ggtctctgagctcattttcttcaca

SEQ ID NO: 466973 - DNA, 25 bp, Rattus norvegicus
ggtctctgagctgattttcttcaca

SEQ ID NO: 466974 - DNA, 25 bp, Rattus norvegicus
ggtctctgcaacatttctgtgaatc

SEQ ID NO: 466975 - DNA, 25 bp, Rattus norvegicus
ggtctctgcaacttttctgtgaatc

SEQ ID NO: 466976 - DNA, 25 bp, Rattus norvegicus
ggtctctgcaatatatagcccaagg

SEQ ID NO: 466977 - DNA, 25 bp, Rattus norvegicus
ggtctctgcaatttatagcccaagg

SEQ ID NO: 466978 - DNA, 25 bp, Rattus norvegicus
ggtctctgccttaaaacacatccaa

SEQ ID NO: 466979 - DNA, 25 bp, Rattus norvegicus
ggtctctgcctttaaacacatccaa

SEQ ID NO: 466980 - DNA, 25 bp, Rattus norvegicus
ggtctctggaatacaaggtctcatc

SEQ ID NO: 466981 - DNA, 25 bp, Rattus norvegicus
ggtctctggaattcaaggtctcatc

SEQ ID NO: 466982 - DNA, 25 bp, Rattus norvegicus
ggtctctggacacctccaaagtcta

SEQ ID NO: 466983 - DNA, 25 bp, Rattus norvegicus
ggtctctggacagctccaaagtcta

SEQ ID NO: 466984 - DNA, 25 bp, Rattus norvegicus
ggtctctgtaaaagctagctcctgt

SEQ ID NO: 466985 - DNA, 25 bp, Rattus norvegicus
ggtctctgtaaatgctagctcctgt

SEQ ID NO: 466986 - DNA, 25 bp, Rattus norvegicus
ggtctctgtaacattcctgagccag

SEQ ID NO: 466987 - DNA, 25 bp, Rattus norvegicus
ggtctctgtaactttcctgagccag

SEQ ID NO: 466988 - DNA, 25 bp, Rattus norvegicus
ggtctctgtgttactgagtggtttt

SEQ ID NO: 466989 - DNA, 25 bp, Rattus norvegicus
ggtctctgtgtttctgagtggtttt

SEQ ID NO: 466990 - DNA, 25 bp, Rattus norvegicus
ggtctctgttgtagtatcctgtaaa

SEQ ID NO: 466991 - DNA, 25 bp, Rattus norvegicus
ggtctctgttgttgtatcctgtaaa

SEQ ID NO: 466992 - DNA, 25 bp, Rattus norvegicus
ggtctctgtttaccacaattgtgga

SEQ ID NO: 466993 - DNA, 25 bp, Rattus norvegicus
ggtctctgtttagcacaattgtgga

SEQ ID NO: 466994 - DNA, 25 bp, Rattus norvegicus
ggtctcttacctctgggtggcccgt

SEQ ID NO: 466995 - DNA, 25 bp, Rattus norvegicus
ggtctcttacctgtgggtggcccgt

SEQ ID NO: 466996 - DNA, 25 bp, Rattus norvegicus
ggtctcttacttaacgggcatggga

SEQ ID NO: 466997 - DNA, 25 bp, Rattus norvegicus
ggtctcttactttacgggcatggga

SEQ ID NO: 466998 - DNA, 25 bp, Rattus norvegicus
ggtctcttatccctggacattgtag

SEQ ID NO: 466999 - DNA, 25 bp, Rattus norvegicus
ggtctcttatccgtggacattgtag

SEQ ID NO: 467000 - DNA, 25 bp, Rattus norvegicus
ggtctcttcccacgtagactttgtc

SEQ ID NO: 467001 - DNA, 25 bp, Rattus norvegicus
ggtctcttcccactagactgagggt

SEQ ID NO: 467002 - DNA, 25 bp, Rattus norvegicus
ggtctcttcccaggtagactttgtc

SEQ ID NO: 467003 - DNA, 25 bp, Rattus norvegicus
ggtctcttcccagtagactgagggt

SEQ ID NO: 467004 - DNA, 25 bp, Rattus norvegicus
ggtctcttcggaccgtgacgccagt

SEQ ID NO: 467005 - DNA, 25 bp, Rattus norvegicus
ggtctcttcggagcgtgacgccagt

SEQ ID NO: 467006 - DNA, 25 bp, Rattus norvegicus
ggtctcttgaacactagtccctgaa

SEQ ID NO: 467007 - DNA, 25 bp, Rattus norvegicus
ggtctcttgaactctagtccctgaa

SEQ ID NO: 467008 - DNA, 25 bp, Rattus norvegicus
ggtctcttgctgataccaactaaaa

SEQ ID NO: 467009 - DNA, 25 bp, Rattus norvegicus
ggtctcttgctgttaccaactaaaa

SEQ ID NO: 467010 - DNA, 25 bp, Rattus norvegicus
ggtctctttgtaagtgtcatcctga

SEQ ID NO: 467011 - DNA, 25 bp, Rattus norvegicus
ggtctctttgtatgtgtcatcctga

SEQ ID NO: 467012 - DNA, 25 bp, Rattus norvegicus
ggtctcttttgcatgtctatggttt

SEQ ID NO: 467013 - DNA, 25 bp, Rattus norvegicus
ggtctcttttgcttgtctatggttt

SEQ ID NO: 467014 - DNA, 25 bp, Rattus norvegicus
ggtctgaaagcacctctgggtccga

SEQ ID NO: 467015 - DNA, 25 bp, Rattus norvegicus
ggtctgaaagcagctctgggtccga

SEQ ID NO: 467016 - DNA, 25 bp, Rattus norvegicus
ggtctgaaccaaagtgcattctttt

SEQ ID NO: 467017 - DNA, 25 bp, Rattus norvegicus
ggtctgaaccaatgtgcattctttt

SEQ ID NO: 467018 - DNA, 25 bp, Rattus norvegicus
ggtctgaactaactgccatactcgt

SEQ ID NO: 467019 - DNA, 25 bp, Rattus norvegicus
ggtctgaactaagtgccatactcgt

SEQ ID NO: 467020 - DNA, 25 bp, Rattus norvegicus
ggtctgaagcatagtccatgcatct

SEQ ID NO: 467021 - DNA, 25 bp, Rattus norvegicus
ggtctgaagcattgtccatgcatct

SEQ ID NO: 467022 - DNA, 25 bp, Rattus norvegicus
ggtctgaaggtcatgcccactcggc

SEQ ID NO: 467023 - DNA, 25 bp, Rattus norvegicus
ggtctgaaggtcttgcccactcggc

SEQ ID NO: 467024 - DNA, 25 bp, Rattus norvegicus
ggtctgaagttgaagttgtcgttaa

SEQ ID NO: 467025 - DNA, 25 bp, Rattus norvegicus
ggtctgaagttgtagttgtcgttaa

SEQ ID NO: 467026 - DNA, 25 bp, Rattus norvegicus
ggtctgaagtttctccgagtaaaca

SEQ ID NO: 467027 - DNA, 25 bp, Rattus norvegicus
ggtctgaagtttgtccgagtaaaca

SEQ ID NO: 467028 - DNA, 25 bp, Rattus norvegicus
ggtctgaatttgattgcccctgaag

SEQ ID NO: 467029 - DNA, 25 bp, Rattus norvegicus
ggtctgaatttgtttgcccctgaag

SEQ ID NO: 467030 - DNA, 25 bp, Rattus norvegicus
ggtctgacaccgaaccaaggcaaga

SEQ ID NO: 467031 - DNA, 25 bp, Rattus norvegicus
ggtctgacaccgtaccaaggcaaga

SEQ ID NO: 467032 - DNA, 25 bp, Rattus norvegicus
ggtctgaccatcatccgagaaccag

SEQ ID NO: 467033 - DNA, 25 bp, Rattus norvegicus
ggtctgaccatcttccgagaaccag

SEQ ID NO: 467034 - DNA, 25 bp, Rattus norvegicus
ggtctgaccattcatgccctgctaa

SEQ ID NO: 467035 - DNA, 25 bp, Rattus norvegicus
ggtctgaccattgatgccctgctaa

SEQ ID NO: 467036 - DNA, 25 bp, Rattus norvegicus
ggtctgacctgaatatgcccaagat

SEQ ID NO: 467037 - DNA, 25 bp, Rattus norvegicus
ggtctgacctgattatgcccaagat

SEQ ID NO: 467038 - DNA, 25 bp, Rattus norvegicus
ggtctgacgattaggcttgcctgaa

SEQ ID NO: 467039 - DNA, 25 bp, Rattus norvegicus
ggtctgacgatttggcttgcctgaa

SEQ ID NO: 467040 - DNA, 25 bp, Rattus norvegicus
ggtctgactaccctgtgatgaatat

SEQ ID NO: 467041 - DNA, 25 bp, Rattus norvegicus
ggtctgactaccgtgtgatgaatat

SEQ ID NO: 467042 - DNA, 25 bp, Rattus norvegicus
ggtctgactttcaaatccgcgttaa

SEQ ID NO: 467043 - DNA, 25 bp, Rattus norvegicus
ggtctgactttctaatccgcgttaa

SEQ ID NO: 467044 - DNA, 25 bp, Rattus norvegicus
ggtctgagacatatgtttataccat

SEQ ID NO: 467045 - DNA, 25 bp, Rattus norvegicus
ggtctgagacatttgtttataccat

SEQ ID NO: 467046 - DNA, 25 bp, Rattus norvegicus
ggtctgagacccagaaagaagtgca

SEQ ID NO: 467047 - DNA, 25 bp, Rattus norvegicus
ggtctgagaccctgaaagaagtgca

SEQ ID NO: 467048 - DNA, 25 bp, Rattus norvegicus
ggtctgagccaaacagcatggttgt

SEQ ID NO: 467049 - DNA, 25 bp, Rattus norvegicus
ggtctgagccaatcagcatggttgt

SEQ ID NO: 467050 - DNA, 25 bp, Rattus norvegicus
ggtctgatatccagcacccaggagt

SEQ ID NO: 467051 - DNA, 25 bp, Rattus norvegicus
ggtctgatatcctgcacccaggagt

SEQ ID NO: 467052 - DNA, 25 bp, Rattus norvegicus
ggtctgatcgggagacaccagttct

SEQ ID NO: 467053 - DNA, 25 bp, Rattus norvegicus
ggtctgatcgggtgacaccagttct

SEQ ID NO: 467054 - DNA, 25 bp, Rattus norvegicus
ggtctgatgagtcttcccagagtga

SEQ ID NO: 467055 - DNA, 25 bp, Rattus norvegicus
ggtctgatgagtgttcccagagtga

SEQ ID NO: 467056 - DNA, 25 bp, Rattus norvegicus
ggtctgatgcggactcggacaccga

SEQ ID NO: 467057 - DNA, 25 bp, Rattus norvegicus
ggtctgatgcggtctcggacaccga

SEQ ID NO: 467058 - DNA, 25 bp, Rattus norvegicus
ggtctgattacccttaatttgttgt

SEQ ID NO: 467059 - DNA, 25 bp, Rattus norvegicus
ggtctgattaccgttaatttgttgt

SEQ ID NO: 467060 - DNA, 25 bp, Rattus norvegicus
ggtctgattcttaacctagagctct

SEQ ID NO: 467061 - DNA, 25 bp, Rattus norvegicus
ggtctgattctttacctagagctct

SEQ ID NO: 467062 - DNA, 25 bp, Rattus norvegicus
ggtctgatttcactctcatttctag

SEQ ID NO: 467063 - DNA, 25 bp, Rattus norvegicus
ggtctgatttcagtctcatttctag

SEQ ID NO: 467064 - DNA, 25 bp, Rattus norvegicus
ggtctgcaaaatcccttggtacttt

SEQ ID NO: 467065 - DNA, 25 bp, Rattus norvegicus
ggtctgcaaaatgccttggtacttt

SEQ ID NO: 467066 - DNA, 25 bp, Rattus norvegicus
ggtctgcaactcaggtgctaatggc

SEQ ID NO: 467067 - DNA, 25 bp, Rattus norvegicus
ggtctgcaactctggtgctaatggc

SEQ ID NO: 467068 - DNA, 25 bp, Rattus norvegicus
ggtctgcaagcactgttgtctgaaa

SEQ ID NO: 467069 - DNA, 25 bp, Rattus norvegicus
ggtctgcaagcagtgttgtctgaaa

SEQ ID NO: 467070 - DNA, 25 bp, Rattus norvegicus
ggtctgcaagccctgttggccaaag

SEQ ID NO: 467071 - DNA, 25 bp, Rattus norvegicus
ggtctgcaagccgtgttggccaaag

SEQ ID NO: 467072 - DNA, 25 bp, Rattus norvegicus
ggtctgcactggcagagtcttttcc

SEQ ID NO: 467073 - DNA, 25 bp, Rattus norvegicus
ggtctgcactgggagagtcttttcc

SEQ ID NO: 467074 - DNA, 25 bp, Rattus norvegicus
ggtctgcacttcacagggagtccgt

SEQ ID NO: 467075 - DNA, 25 bp, Rattus norvegicus
ggtctgcacttctcagggagtccgt

SEQ ID NO: 467076 - DNA, 25 bp, Rattus norvegicus
ggtctgcagaccacaactttatcaa

SEQ ID NO: 467077 - DNA, 25 bp, Rattus norvegicus
ggtctgcagacctcaactttatcaa

SEQ ID NO: 467078 - DNA, 25 bp, Rattus norvegicus
ggtctgcagagccacttctacacag

SEQ ID NO: 467079 - DNA, 25 bp, Rattus norvegicus
ggtctgcagagcgacttctacacag

SEQ ID NO: 467080 - DNA, 25 bp, Rattus norvegicus
ggtctgcagttgctgggttacaaaa

SEQ ID NO: 467081 - DNA, 25 bp, Rattus norvegicus
ggtctgcagttggtgggttacaaaa

SEQ ID NO: 467082 - DNA, 25 bp, Rattus norvegicus
ggtctgcatagtcagatctaagcca

SEQ ID NO: 467083 - DNA, 25 bp, Rattus norvegicus
ggtctgcatagtgagatctaagcca

SEQ ID NO: 467084 - DNA, 25 bp, Rattus norvegicus
ggtctgcatcagataaaccgggtca

SEQ ID NO: 467085 - DNA, 25 bp, Rattus norvegicus
ggtctgcatcagttaaaccgggtca

SEQ ID NO: 467086 - DNA, 25 bp, Rattus norvegicus
ggtctgcatgagacttttcctcaat

SEQ ID NO: 467087 - DNA, 25 bp, Rattus norvegicus
ggtctgcatgagatggatctgtcaa

SEQ ID NO: 467088 - DNA, 25 bp, Rattus norvegicus
ggtctgcatgagtcttttcctcaat

SEQ ID NO: 467089 - DNA, 25 bp, Rattus norvegicus
ggtctgcatgagttggatctgtcaa

SEQ ID NO: 467090 - DNA, 25 bp, Rattus norvegicus
ggtctgcattccattatctgtaatt

SEQ ID NO: 467091 - DNA, 25 bp, Rattus norvegicus
ggtctgcattcctttatctgtaatt

SEQ ID NO: 467092 - DNA, 25 bp, Rattus norvegicus
ggtctgccaagcacttcaggatgta

SEQ ID NO: 467093 - DNA, 25 bp, Rattus norvegicus
ggtctgccaagctcttcaggatgta

SEQ ID NO: 467094 - DNA, 25 bp, Rattus norvegicus
ggtctgcccatgcaaggagcttcta

SEQ ID NO: 467095 - DNA, 25 bp, Rattus norvegicus
ggtctgcccatggaaggagcttcta

SEQ ID NO: 467096 - DNA, 25 bp, Rattus norvegicus
ggtctgcccgcgaatactcgtgagt

SEQ ID NO: 467097 - DNA, 25 bp, Rattus norvegicus
ggtctgcccgcgtatactcgtgagt

SEQ ID NO: 467098 - DNA, 25 bp, Rattus norvegicus
ggtctgcccttcattagtcacatga

SEQ ID NO: 467099 - DNA, 25 bp, Rattus norvegicus
ggtctgcccttctttagtcacatga

SEQ ID NO: 467100 - DNA, 25 bp, Rattus norvegicus
ggtctgcctctgagtatggtattat

SEQ ID NO: 467101 - DNA, 25 bp, Rattus norvegicus
ggtctgcctctgtgtatggtattat

SEQ ID NO: 467102 - DNA, 25 bp, Rattus norvegicus
ggtctgcctgcaagtgttcatgtac

SEQ ID NO: 467103 - DNA, 25 bp, Rattus norvegicus
ggtctgcctgcatgtgttcatgtac

SEQ ID NO: 467104 - DNA, 25 bp, Rattus norvegicus
ggtctgccttttccagaacagatca

SEQ ID NO: 467105 - DNA, 25 bp, Rattus norvegicus
ggtctgccttttgcagaacagatca

SEQ ID NO: 467106 - DNA, 25 bp, Rattus norvegicus
ggtctgcgacaacgtgactaaaaag

SEQ ID NO: 467107 - DNA, 25 bp, Rattus norvegicus
ggtctgcgacaaggtgactaaaaag

SEQ ID NO: 467108 - DNA, 25 bp, Rattus norvegicus
ggtctgcgccctccactgctggagt

SEQ ID NO: 467109 - DNA, 25 bp, Rattus norvegicus
ggtctgcgccctgcactgctggagt

SEQ ID NO: 467110 - DNA, 25 bp, Rattus norvegicus
ggtctgcgtcctcatacctagtgga

SEQ ID NO: 467111 - DNA, 25 bp, Rattus norvegicus
ggtctgcgtcctgatacctagtgga

SEQ ID NO: 467112 - DNA, 25 bp, Rattus norvegicus
ggtctgctacctatcctgtaatgac

SEQ ID NO: 467113 - DNA, 25 bp, Rattus norvegicus
ggtctgctacctttcctgtaatgac

SEQ ID NO: 467114 - DNA, 25 bp, Rattus norvegicus
ggtctgctatgtcgaaagcctcctt

SEQ ID NO: 467115 - DNA, 25 bp, Rattus norvegicus
ggtctgctatgtggaaagcctcctt

SEQ ID NO: 467116 - DNA, 25 bp, Rattus norvegicus
ggtctgctcggaacatgggccctag

SEQ ID NO: 467117 - DNA, 25 bp, Rattus norvegicus
ggtctgctcggatcatgggccctag

SEQ ID NO: 467118 - DNA, 25 bp, Rattus norvegicus
ggtctgcttctactatactctaaaa

SEQ ID NO: 467119 - DNA, 25 bp, Rattus norvegicus
ggtctgcttctagtatactctaaaa

SEQ ID NO: 467120 - DNA, 25 bp, Rattus norvegicus
ggtctggaacacaagctacttgggt

SEQ ID NO: 467121 - DNA, 25 bp, Rattus norvegicus
ggtctggaacactagctacttgggt

SEQ ID NO: 467122 - DNA, 25 bp, Rattus norvegicus
ggtctggaactcaaaaatccacccg

SEQ ID NO: 467123 - DNA, 25 bp, Rattus norvegicus
ggtctggaactctaaaatccacccg

SEQ ID NO: 467124 - DNA, 25 bp, Rattus norvegicus
ggtctggaacttctcttcagtgcac

SEQ ID NO: 467125 - DNA, 25 bp, Rattus norvegicus
ggtctggaacttgtcttcagtgcac

SEQ ID NO: 467126 - DNA, 25 bp, Rattus norvegicus
ggtctggaagtcctccgaagacttt

SEQ ID NO: 467127 - DNA, 25 bp, Rattus norvegicus
ggtctggaagtcgtccgaagacttt

SEQ ID NO: 467128 - DNA, 25 bp, Rattus norvegicus
ggtctggacacccttactatagcca

SEQ ID NO: 467129 - DNA, 25 bp, Rattus norvegicus
ggtctggacaccgttactatagcca

SEQ ID NO: 467130 - DNA, 25 bp, Rattus norvegicus
ggtctggatgaaatttattccttca

SEQ ID NO: 467131 - DNA, 25 bp, Rattus norvegicus
ggtctggatgaattttattccttca

SEQ ID NO: 467132 - DNA, 25 bp, Rattus norvegicus
ggtctggcagtcacttttgtgtcag

SEQ ID NO: 467133 - DNA, 25 bp, Rattus norvegicus
ggtctggcagtctcttttgtgtcag

SEQ ID NO: 467134 - DNA, 25 bp, Rattus norvegicus
ggtctggcttcaatttggcatccaa

SEQ ID NO: 467135 - DNA, 25 bp, Rattus norvegicus
ggtctggcttcattttggcatccaa

SEQ ID NO: 467136 - DNA, 25 bp, Rattus norvegicus
ggtctggcttgaccatccatgggca

SEQ ID NO: 467137 - DNA, 25 bp, Rattus norvegicus
ggtctggcttgagcatccatgggca

SEQ ID NO: 467138 - DNA, 25 bp, Rattus norvegicus
ggtctgggaccactcttcagtataa

SEQ ID NO: 467139 - DNA, 25 bp, Rattus norvegicus
ggtctgggaccagtcttcagtataa

SEQ ID NO: 467140 - DNA, 25 bp, Rattus norvegicus
ggtctgggagacatcatcttctaca

SEQ ID NO: 467141 - DNA, 25 bp, Rattus norvegicus
ggtctgggagacttcatcttctaca

SEQ ID NO: 467142 - DNA, 25 bp, Rattus norvegicus
ggtctgggattaagccctgactgct

SEQ ID NO: 467143 - DNA, 25 bp, Rattus norvegicus
ggtctgggattatgccctgactgct

SEQ ID NO: 467144 - DNA, 25 bp, Rattus norvegicus
ggtctgggcattactgccttaagga

SEQ ID NO: 467145 - DNA, 25 bp, Rattus norvegicus
ggtctgggcatttctgccttaagga

SEQ ID NO: 467146 - DNA, 25 bp, Rattus norvegicus
ggtctgggctacacgtcggacgaaa

SEQ ID NO: 467147 - DNA, 25 bp, Rattus norvegicus
ggtctgggctactcgtcggacgaaa

SEQ ID NO: 467148 - DNA, 25 bp, Rattus norvegicus
ggtctggtacctcagatctgagatt

SEQ ID NO: 467149 - DNA, 25 bp, Rattus norvegicus
ggtctggtacctgagatctgagatt

SEQ ID NO: 467150 - DNA, 25 bp, Rattus norvegicus
ggtctggtatccctgataggatttt

SEQ ID NO: 467151 - DNA, 25 bp, Rattus norvegicus
ggtctggtatccgtgataggatttt

SEQ ID NO: 467152 - DNA, 25 bp, Rattus norvegicus
ggtctggtatttcccatcatttagt

SEQ ID NO: 467153 - DNA, 25 bp, Rattus norvegicus
ggtctggtatttgccatcatttagt

SEQ ID NO: 467154 - DNA, 25 bp, Rattus norvegicus
ggtctggtcaggcttctgctacttc

SEQ ID NO: 467155 - DNA, 25 bp, Rattus norvegicus
ggtctggtcagggttctgctacttc

SEQ ID NO: 467156 - DNA, 25 bp, Rattus norvegicus
ggtctggtcctgatccacggagaag

SEQ ID NO: 467157 - DNA, 25 bp, Rattus norvegicus
ggtctggtcctgttccacggagaag

SEQ ID NO: 467158 - DNA, 25 bp, Rattus norvegicus
ggtctggtcgccaaaagctttcgaa

SEQ ID NO: 467159 - DNA, 25 bp, Rattus norvegicus
ggtctggtcgcctaaagctttcgaa

SEQ ID NO: 467160 - DNA, 25 bp, Rattus norvegicus
ggtctggtctaaatcttccttttat

SEQ ID NO: 467161 - DNA, 25 bp, Rattus norvegicus
ggtctggtctaattcttccttttat

SEQ ID NO: 467162 - DNA, 25 bp, Rattus norvegicus
ggtctggtctttagatcagctaccc

SEQ ID NO: 467163 - DNA, 25 bp, Rattus norvegicus
ggtctggtcttttgatcagctaccc

SEQ ID NO: 467164 - DNA, 25 bp, Rattus norvegicus
ggtctggtgactagccgagcttcac

SEQ ID NO: 467165 - DNA, 25 bp, Rattus norvegicus
ggtctggtgacttgccgagcttcac

SEQ ID NO: 467166 - DNA, 25 bp, Rattus norvegicus
ggtctggtgccccagatctgacact

SEQ ID NO: 467167 - DNA, 25 bp, Rattus norvegicus
ggtctggtgcccgagatctgacact

SEQ ID NO: 467168 - DNA, 25 bp, Rattus norvegicus
ggtctgtaaactaagggcttccttg

SEQ ID NO: 467169 - DNA, 25 bp, Rattus norvegicus
ggtctgtaaacttagggcttccttg

SEQ ID NO: 467170 - DNA, 25 bp, Rattus norvegicus
ggtctgtaagctccatcagccctgt

SEQ ID NO: 467171 - DNA, 25 bp, Rattus norvegicus
ggtctgtaagctgcatcagccctgt

SEQ ID NO: 467172 - DNA, 25 bp, Rattus norvegicus
ggtctgtacatcctgtcctgcatgt

SEQ ID NO: 467173 - DNA, 25 bp, Rattus norvegicus
ggtctgtacatcgtgtcctgcatgt

SEQ ID NO: 467174 - DNA, 25 bp, Rattus norvegicus
ggtctgtacatgaaatagtggtctt

SEQ ID NO: 467175 - DNA, 25 bp, Rattus norvegicus
ggtctgtacatgtaatagtggtctt

SEQ ID NO: 467176 - DNA, 25 bp, Rattus norvegicus
ggtctgtaccagagggactttgcca

SEQ ID NO: 467177 - DNA, 25 bp, Rattus norvegicus
ggtctgtaccagtgggactttgcca

SEQ ID NO: 467178 - DNA, 25 bp, Rattus norvegicus
ggtctgtactacagccatcagggct

SEQ ID NO: 467179 - DNA, 25 bp, Rattus norvegicus
ggtctgtactactgccatcagggct

SEQ ID NO: 467180 - DNA, 25 bp, Rattus norvegicus
ggtctgtagcccatttgatcaaact

SEQ ID NO: 467181 - DNA, 25 bp, Rattus norvegicus
ggtctgtagcccttttgatcaaact

SEQ ID NO: 467182 - DNA, 25 bp, Rattus norvegicus
ggtctgtaggccaccagtgtgctca

SEQ ID NO: 467183 - DNA, 25 bp, Rattus norvegicus
ggtctgtaggcctccagtgtgctca

SEQ ID NO: 467184 - DNA, 25 bp, Rattus norvegicus
ggtctgtagtaactggattcttcca

SEQ ID NO: 467185 - DNA, 25 bp, Rattus norvegicus
ggtctgtagtaagtggattcttcca

SEQ ID NO: 467186 - DNA, 25 bp, Rattus norvegicus
ggtctgtatcccagtatgtcaggga

SEQ ID NO: 467187 - DNA, 25 bp, Rattus norvegicus
ggtctgtatccctgtatgtcaggga

SEQ ID NO: 467188 - DNA, 25 bp, Rattus norvegicus
ggtctgtatcctaatagctcctttc

SEQ ID NO: 467189 - DNA, 25 bp, Rattus norvegicus
ggtctgtatccttatagctcctttc

SEQ ID NO: 467190 - DNA, 25 bp, Rattus norvegicus
ggtctgtattgtatgccccaaaata

SEQ ID NO: 467191 - DNA, 25 bp, Rattus norvegicus
ggtctgtattgtttgccccaaaata

SEQ ID NO: 467192 - DNA, 25 bp, Rattus norvegicus
ggtctgtcaaccagtgaatctttaa

SEQ ID NO: 467193 - DNA, 25 bp, Rattus norvegicus
ggtctgtcaacctgtgaatctttaa

SEQ ID NO: 467194 - DNA, 25 bp, Rattus norvegicus
ggtctgtcaagcagattaccactta

SEQ ID NO: 467195 - DNA, 25 bp, Rattus norvegicus
ggtctgtcaagctgattaccactta

SEQ ID NO: 467196 - DNA, 25 bp, Rattus norvegicus
ggtctgtcacatatgtattgaccca

SEQ ID NO: 467197 - DNA, 25 bp, Rattus norvegicus
ggtctgtcacatttgtattgaccca

SEQ ID NO: 467198 - DNA, 25 bp, Rattus norvegicus
ggtctgtcaccgacatcaaagtaag

SEQ ID NO: 467199 - DNA, 25 bp, Rattus norvegicus
ggtctgtcaccgtcatcaaagtaag

SEQ ID NO: 467200 - DNA, 25 bp, Rattus norvegicus
ggtctgtcagcaatactcagcgcaa

SEQ ID NO: 467201 - DNA, 25 bp, Rattus norvegicus
ggtctgtcagcattactcagcgcaa

SEQ ID NO: 467202 - DNA, 25 bp, Rattus norvegicus
ggtctgtccaccatgtttattgaga

SEQ ID NO: 467203 - DNA, 25 bp, Rattus norvegicus
ggtctgtccaccttgtttattgaga

SEQ ID NO: 467204 - DNA, 25 bp, Rattus norvegicus
ggtctgtccatgagtctctctggat

SEQ ID NO: 467205 - DNA, 25 bp, Rattus norvegicus
ggtctgtccatgtgtctctctggat

SEQ ID NO: 467206 - DNA, 25 bp, Rattus norvegicus
ggtctgtcttaacaagctttggcca

SEQ ID NO: 467207 - DNA, 25 bp, Rattus norvegicus
ggtctgtcttaagaagctttggcca

SEQ ID NO: 467208 - DNA, 25 bp, Rattus norvegicus
ggtctgtgaccaacctgtgttaaga

SEQ ID NO: 467209 - DNA, 25 bp, Rattus norvegicus
ggtctgtgaccatcctgtgttaaga

SEQ ID NO: 467210 - DNA, 25 bp, Rattus norvegicus
ggtctgtgactactagagcctttca

SEQ ID NO: 467211 - DNA, 25 bp, Rattus norvegicus
ggtctgtgactagtagagcctttca

SEQ ID NO: 467212 - DNA, 25 bp, Rattus norvegicus
ggtctgtgagaccatacttagaaca

SEQ ID NO: 467213 - DNA, 25 bp, Rattus norvegicus
ggtctgtgagacgatacttagaaca

SEQ ID NO: 467214 - DNA, 25 bp, Rattus norvegicus
ggtctgtgatgccagtctcagttac

SEQ ID NO: 467215 - DNA, 25 bp, Rattus norvegicus
ggtctgtgatgcgagtctcagttac

SEQ ID NO: 467216 - DNA, 25 bp, Rattus norvegicus
ggtctgtggaacactctacacttta

SEQ ID NO: 467217 - DNA, 25 bp, Rattus norvegicus
ggtctgtggaactctctacacttta

SEQ ID NO: 467218 - DNA, 25 bp, Rattus norvegicus
ggtctgtggcagagaaccatttcct

SEQ ID NO: 467219 - DNA, 25 bp, Rattus norvegicus
ggtctgtggcagtgaaccatttcct

SEQ ID NO: 467220 - DNA, 25 bp, Rattus norvegicus
ggtctgtggccacttcacaggcata

SEQ ID NO: 467221 - DNA, 25 bp, Rattus norvegicus
ggtctgtggccagttcacaggcata

SEQ ID NO: 467222 - DNA, 25 bp, Rattus norvegicus
ggtctgtgggacattgtattctgat

SEQ ID NO: 467223 - DNA, 25 bp, Rattus norvegicus
ggtctgtgggactttgtattctgat

SEQ ID NO: 467224 - DNA, 25 bp, Rattus norvegicus
ggtctgtgtctcaactctacggcta

SEQ ID NO: 467225 - DNA, 25 bp, Rattus norvegicus
ggtctgtgtctctactctacggcta

SEQ ID NO: 467226 - DNA, 25 bp, Rattus norvegicus
ggtctgttaaacagcatctggaatt

SEQ ID NO: 467227 - DNA, 25 bp, Rattus norvegicus
ggtctgttaaactgcatctggaatt

SEQ ID NO: 467228 - DNA, 25 bp, Rattus norvegicus
ggtctgttagaaccttgcccatctt

SEQ ID NO: 467229 - DNA, 25 bp, Rattus norvegicus
ggtctgttagaagcttgcccatctt

SEQ ID NO: 467230 - DNA, 25 bp, Rattus norvegicus
ggtctgttctatattaattcgccat

SEQ ID NO: 467231 - DNA, 25 bp, Rattus norvegicus
ggtctgttctattttaattcgccat

SEQ ID NO: 467232 - DNA, 25 bp, Rattus norvegicus
ggtctgttctgtcttatgtaaccca

SEQ ID NO: 467233 - DNA, 25 bp, Rattus norvegicus
ggtctgttctgtgttatgtaaccca

SEQ ID NO: 467234 - DNA, 25 bp, Rattus norvegicus
ggtctgttgatgagccctctacaaa

SEQ ID NO: 467235 - DNA, 25 bp, Rattus norvegicus
ggtctgttgatgtgccctctacaaa

SEQ ID NO: 467236 - DNA, 25 bp, Rattus norvegicus
ggtctgttggttatgaacactcata

SEQ ID NO: 467237 - DNA, 25 bp, Rattus norvegicus
ggtctgttggttttgaacactcata

SEQ ID NO: 467238 - DNA, 25 bp, Rattus norvegicus
ggtctgtttaatcctgcatcaccag

SEQ ID NO: 467239 - DNA, 25 bp, Rattus norvegicus
ggtctgtttaatgctgcatcaccag

SEQ ID NO: 467240 - DNA, 25 bp, Rattus norvegicus
ggtctgtttcttctaagtggtcata

SEQ ID NO: 467241 - DNA, 25 bp, Rattus norvegicus
ggtctgtttcttgtaagtggtcata

SEQ ID NO: 467242 - DNA, 25 bp, Rattus norvegicus
ggtctgtttgcaattgataggtttt

SEQ ID NO: 467243 - DNA, 25 bp, Rattus norvegicus
ggtctgtttgcaatttgggtaattc

SEQ ID NO: 467244 - DNA, 25 bp, Rattus norvegicus
ggtctgtttgcatttgataggtttt

SEQ ID NO: 467245 - DNA, 25 bp, Rattus norvegicus
ggtctgtttgcattttgggtaattc

SEQ ID NO: 467246 - DNA, 25 bp, Rattus norvegicus
ggtctgttttctctaacttttgcta

SEQ ID NO: 467247 - DNA, 25 bp, Rattus norvegicus
ggtctgttttctgtaacttttgcta

SEQ ID NO: 467248 - DNA, 25 bp, Rattus norvegicus
ggtcttaaaacactgttggcggaca

SEQ ID NO: 467249 - DNA, 25 bp, Rattus norvegicus
ggtcttaaaacagtgttggcggaca

SEQ ID NO: 467250 - DNA, 25 bp, Rattus norvegicus
ggtcttaaaacccaactgagtgatt

SEQ ID NO: 467251 - DNA, 25 bp, Rattus norvegicus
ggtcttaaaaccgaactgagtgatt

SEQ ID NO: 467252 - DNA, 25 bp, Rattus norvegicus
ggtcttaaactcacaattctctcgc

SEQ ID NO: 467253 - DNA, 25 bp, Rattus norvegicus
ggtcttaaactctcaattctctcgc

SEQ ID NO: 467254 - DNA, 25 bp, Rattus norvegicus
ggtcttaaattgaagccctgggtga

SEQ ID NO: 467255 - DNA, 25 bp, Rattus norvegicus
ggtcttaaattgtagccctgggtga

SEQ ID NO: 467256 - DNA, 25 bp, Rattus norvegicus
ggtcttaaccttctaattctcctgc

SEQ ID NO: 467257 - DNA, 25 bp, Rattus norvegicus
ggtcttaaccttgtaattctcctgc

SEQ ID NO: 467258 - DNA, 25 bp, Rattus norvegicus
ggtcttaactagagagccatgcctc

SEQ ID NO: 467259 - DNA, 25 bp, Rattus norvegicus
ggtcttaactagtgagccatgcctc

SEQ ID NO: 467260 - DNA, 25 bp, Rattus norvegicus
ggtcttaatcacatcaatgtaaacg

SEQ ID NO: 467261 - DNA, 25 bp, Rattus norvegicus
ggtcttaatcacttcaatgtaaacg

SEQ ID NO: 467262 - DNA, 25 bp, Rattus norvegicus
ggtcttaatcgtcgacacacaccat

SEQ ID NO: 467263 - DNA, 25 bp, Rattus norvegicus
ggtcttaatcgtggacacacaccat

SEQ ID NO: 467264 - DNA, 25 bp, Rattus norvegicus
ggtcttacagctactagtgttacac

SEQ ID NO: 467265 - DNA, 25 bp, Rattus norvegicus
ggtcttacagcttctagtgttacac

SEQ ID NO: 467266 - DNA, 25 bp, Rattus norvegicus
ggtcttacatttattggcccaacaa

SEQ ID NO: 467267 - DNA, 25 bp, Rattus norvegicus
ggtcttacattttttggcccaacaa

SEQ ID NO: 467268 - DNA, 25 bp, Rattus norvegicus
ggtcttaccaaacctgtttgcggat

SEQ ID NO: 467269 - DNA, 25 bp, Rattus norvegicus
ggtcttaccaaagctgtttgcggat

SEQ ID NO: 467270 - DNA, 25 bp, Rattus norvegicus
ggtcttacctttcgaacactctttg

SEQ ID NO: 467271 - DNA, 25 bp, Rattus norvegicus
ggtcttacctttggaacactctttg

SEQ ID NO: 467272 - DNA, 25 bp, Rattus norvegicus
ggtcttagacgtagtttctgctttg

SEQ ID NO: 467273 - DNA, 25 bp, Rattus norvegicus
ggtcttagacgtatacagcgactat

SEQ ID NO: 467274 - DNA, 25 bp, Rattus norvegicus
ggtcttagacgttgtttctgctttg

SEQ ID NO: 467275 - DNA, 25 bp, Rattus norvegicus
ggtcttagacgtttacagcgactat

SEQ ID NO: 467276 - DNA, 25 bp, Rattus norvegicus
ggtcttagccctagaatcttagtgt

SEQ ID NO: 467277 - DNA, 25 bp, Rattus norvegicus
ggtcttagcccttgaatcttagtgt

SEQ ID NO: 467278 - DNA, 25 bp, Rattus norvegicus
ggtcttaggaagcaacccgttgatc

SEQ ID NO: 467279 - DNA, 25 bp, Rattus norvegicus
ggtcttaggaaggaacccgttgatc

SEQ ID NO: 467280 - DNA, 25 bp, Rattus norvegicus
ggtcttatacttaagcccaggctgg

SEQ ID NO: 467281 - DNA, 25 bp, Rattus norvegicus
ggtcttatactttagcccaggctgg

SEQ ID NO: 467282 - DNA, 25 bp, Rattus norvegicus
ggtcttatagtaacctttgggttca

SEQ ID NO: 467283 - DNA, 25 bp, Rattus norvegicus
ggtcttatagtatcctttgggttca

SEQ ID NO: 467284 - DNA, 25 bp, Rattus norvegicus
ggtcttatctaaaacacattgggaa

SEQ ID NO: 467285 - DNA, 25 bp, Rattus norvegicus
ggtcttatctaatacacattgggaa

SEQ ID NO: 467286 - DNA, 25 bp, Rattus norvegicus
ggtcttatgattaatcctcctacat

SEQ ID NO: 467287 - DNA, 25 bp, Rattus norvegicus
ggtcttatgatttatcctcctacat

SEQ ID NO: 467288 - DNA, 25 bp, Rattus norvegicus
ggtcttatttcacctcagggatctg

SEQ ID NO: 467289 - DNA, 25 bp, Rattus norvegicus
ggtcttatttcagctcagggatctg

SEQ ID NO: 467290 - DNA, 25 bp, Rattus norvegicus
ggtcttattttaatgtctcctgtgg

SEQ ID NO: 467291 - DNA, 25 bp, Rattus norvegicus
ggtcttattttattgtctcctgtgg

SEQ ID NO: 467292 - DNA, 25 bp, Rattus norvegicus
ggtcttcaaacccagtagctacaag

SEQ ID NO: 467293 - DNA, 25 bp, Rattus norvegicus
ggtcttcaaaccgagtagctacaag

SEQ ID NO: 467294 - DNA, 25 bp, Rattus norvegicus
ggtcttcaagccagttgcacatgta

SEQ ID NO: 467295 - DNA, 25 bp, Rattus norvegicus
ggtcttcaagcctgttgcacatgta

SEQ ID NO: 467296 - DNA, 25 bp, Rattus norvegicus
ggtcttcacaatccttcaccagtgg

SEQ ID NO: 467297 - DNA, 25 bp, Rattus norvegicus
ggtcttcacaatgcttcaccagtgg

SEQ ID NO: 467298 - DNA, 25 bp, Rattus norvegicus
ggtcttcaccagcttagcgagtgca

SEQ ID NO: 467299 - DNA, 25 bp, Rattus norvegicus
ggtcttcaccaggttagcgagtgca

SEQ ID NO: 467300 - DNA, 25 bp, Rattus norvegicus
ggtcttcacccaatgaattctggag

SEQ ID NO: 467301 - DNA, 25 bp, Rattus norvegicus
ggtcttcacccattgaattctggag

SEQ ID NO: 467302 - DNA, 25 bp, Rattus norvegicus
ggtcttcactaacttctgctggctg

SEQ ID NO: 467303 - DNA, 25 bp, Rattus norvegicus
ggtcttcactaagttctgctggctg

SEQ ID NO: 467304 - DNA, 25 bp, Rattus norvegicus
ggtcttcagaaacaactcaagcctt

SEQ ID NO: 467305 - DNA, 25 bp, Rattus norvegicus
ggtcttcagaaagaactcaagcctt

SEQ ID NO: 467306 - DNA, 25 bp, Rattus norvegicus
ggtcttcagtccacgtctttgtgaa

SEQ ID NO: 467307 - DNA, 25 bp, Rattus norvegicus
ggtcttcagtcctcgtctttgtgaa

SEQ ID NO: 467308 - DNA, 25 bp, Rattus norvegicus
ggtcttcatcatattctacaggttt

SEQ ID NO: 467309 - DNA, 25 bp, Rattus norvegicus
ggtcttcatcattttctacaggttt

SEQ ID NO: 467310 - DNA, 25 bp, Rattus norvegicus
ggtcttcatgtacatcccctaagaa

SEQ ID NO: 467311 - DNA, 25 bp, Rattus norvegicus
ggtcttcatgtagatcccctaagaa

SEQ ID NO: 467312 - DNA, 25 bp, Rattus norvegicus
ggtcttcatgtcctttcttccgctg

SEQ ID NO: 467313 - DNA, 25 bp, Rattus norvegicus
ggtcttcatgtcgtttcttccgctg

SEQ ID NO: 467314 - DNA, 25 bp, Rattus norvegicus
ggtcttcattaccaagatgtctgca

SEQ ID NO: 467315 - DNA, 25 bp, Rattus norvegicus
ggtcttcattaccttgggtcatgca

SEQ ID NO: 467316 - DNA, 25 bp, Rattus norvegicus
ggtcttcattacgaagatgtctgca

SEQ ID NO: 467317 - DNA, 25 bp, Rattus norvegicus
ggtcttcattacgttgggtcatgca

SEQ ID NO: 467318 - DNA, 25 bp, Rattus norvegicus
ggtcttccaagtaaacatcacagtg

SEQ ID NO: 467319 - DNA, 25 bp, Rattus norvegicus
ggtcttccaagttaacatcacagtg

SEQ ID NO: 467320 - DNA, 25 bp, Rattus norvegicus
ggtcttccaattcctgtcattgcta

SEQ ID NO: 467321 - DNA, 25 bp, Rattus norvegicus
ggtcttccaattgctgtcattgcta

SEQ ID NO: 467322 - DNA, 25 bp, Rattus norvegicus
ggtcttccacagagacggatggcat

SEQ ID NO: 467323 - DNA, 25 bp, Rattus norvegicus
ggtcttccacagcaaaggctcccat

SEQ ID NO: 467324 - DNA, 25 bp, Rattus norvegicus
ggtcttccacaggaaaggctcccat

SEQ ID NO: 467325 - DNA, 25 bp, Rattus norvegicus
ggtcttccacagtgacggatggcat

SEQ ID NO: 467326 - DNA, 25 bp, Rattus norvegicus
ggtcttccaggaaccgcaggcaaaa

SEQ ID NO: 467327 - DNA, 25 bp, Rattus norvegicus
ggtcttccaggatccgcaggcaaaa

SEQ ID NO: 467328 - DNA, 25 bp, Rattus norvegicus
ggtcttccagttatattcatttcaa

SEQ ID NO: 467329 - DNA, 25 bp, Rattus norvegicus
ggtcttccagttttattcatttcaa

SEQ ID NO: 467330 - DNA, 25 bp, Rattus norvegicus
ggtcttcccctgaatgattttgatt

SEQ ID NO: 467331 - DNA, 25 bp, Rattus norvegicus
ggtcttcccctgtatgattttgatt

SEQ ID NO: 467332 - DNA, 25 bp, Rattus norvegicus
ggtcttcccttgaggtcagaggtga

SEQ ID NO: 467333 - DNA, 25 bp, Rattus norvegicus
ggtcttcccttgtggtcagaggtga

SEQ ID NO: 467334 - DNA, 25 bp, Rattus norvegicus
ggtcttccctttctggaaggcacta

SEQ ID NO: 467335 - DNA, 25 bp, Rattus norvegicus
ggtcttccctttgtggaaggcacta

SEQ ID NO: 467336 - DNA, 25 bp, Rattus norvegicus
ggtcttccggcacctggatgaagtt

SEQ ID NO: 467337 - DNA, 25 bp, Rattus norvegicus
ggtcttccggcagctggatgaagtt

SEQ ID NO: 467338 - DNA, 25 bp, Rattus norvegicus
ggtcttcctcgtactaacttttgag

SEQ ID NO: 467339 - DNA, 25 bp, Rattus norvegicus
ggtcttcctcgttctaacttttgag

SEQ ID NO: 467340 - DNA, 25 bp, Rattus norvegicus
ggtcttcctggaactagagcaacat

SEQ ID NO: 467341 - DNA, 25 bp, Rattus norvegicus
ggtcttcctggatctagagcaacat

SEQ ID NO: 467342 - DNA, 25 bp, Rattus norvegicus
ggtcttccttatagcgtagcctaaa

SEQ ID NO: 467343 - DNA, 25 bp, Rattus norvegicus
ggtcttccttattgcgtagcctaaa

SEQ ID NO: 467344 - DNA, 25 bp, Rattus norvegicus
ggtcttccttccatccaagagaagc

SEQ ID NO: 467345 - DNA, 25 bp, Rattus norvegicus
ggtcttccttccttccaagagaagc

SEQ ID NO: 467346 - DNA, 25 bp, Rattus norvegicus
ggtcttccttctcttctagaatttt

SEQ ID NO: 467347 - DNA, 25 bp, Rattus norvegicus
ggtcttccttctgttctagaatttt

SEQ ID NO: 467348 - DNA, 25 bp, Rattus norvegicus
ggtcttccttgtaactttacataca

SEQ ID NO: 467349 - DNA, 25 bp, Rattus norvegicus
ggtcttccttgttactttacataca

SEQ ID NO: 467350 - DNA, 25 bp, Rattus norvegicus
ggtcttctacacatttatgaaccag

SEQ ID NO: 467351 - DNA, 25 bp, Rattus norvegicus
ggtcttctacacttttatgaaccag

SEQ ID NO: 467352 - DNA, 25 bp, Rattus norvegicus
ggtcttctcaatagccagagctgat

SEQ ID NO: 467353 - DNA, 25 bp, Rattus norvegicus
ggtcttctcaattgccagagctgat

SEQ ID NO: 467354 - DNA, 25 bp, Rattus norvegicus
ggtcttctccaaagagacattttgt

SEQ ID NO: 467355 - DNA, 25 bp, Rattus norvegicus
ggtcttctccaatgagacattttgt

SEQ ID NO: 467356 - DNA, 25 bp, Rattus norvegicus
ggtcttctccatctctttgtgggac

SEQ ID NO: 467357 - DNA, 25 bp, Rattus norvegicus
ggtcttctccatgtctttgtgggac

SEQ ID NO: 467358 - DNA, 25 bp, Rattus norvegicus
ggtcttctcgccaaggtgaacctga

SEQ ID NO: 467359 - DNA, 25 bp, Rattus norvegicus
ggtcttctcgcctaggtgaacctga

SEQ ID NO: 467360 - DNA, 25 bp, Rattus norvegicus
ggtcttctgagacagcaggctgaca

SEQ ID NO: 467361 - DNA, 25 bp, Rattus norvegicus
ggtcttctgagagagcaggctgaca

SEQ ID NO: 467362 - DNA, 25 bp, Rattus norvegicus
ggtcttctgatcctgtttacaactg

SEQ ID NO: 467363 - DNA, 25 bp, Rattus norvegicus
ggtcttctgatcgtgtttacaactg

SEQ ID NO: 467364 - DNA, 25 bp, Rattus norvegicus
ggtcttctgcccagaggtctttata

SEQ ID NO: 467365 - DNA, 25 bp, Rattus norvegicus
ggtcttctgccctgaggtctttata

SEQ ID NO: 467366 - DNA, 25 bp, Rattus norvegicus
ggtcttctgctgagtgtcaatatgt

SEQ ID NO: 467367 - DNA, 25 bp, Rattus norvegicus
ggtcttctgctgtgtgtcaatatgt

SEQ ID NO: 467368 - DNA, 25 bp, Rattus norvegicus
ggtcttctgtgtcaactcccgagaa

SEQ ID NO: 467369 - DNA, 25 bp, Rattus norvegicus
ggtcttctgtgtgaactcccgagaa

SEQ ID NO: 467370 - DNA, 25 bp, Rattus norvegicus
ggtcttctgttcattgggctatgca

SEQ ID NO: 467371 - DNA, 25 bp, Rattus norvegicus
ggtcttctgttctttgggctatgca

SEQ ID NO: 467372 - DNA, 25 bp, Rattus norvegicus
ggtcttcttcccaaaaaatgatatg

SEQ ID NO: 467373 - DNA, 25 bp, Rattus norvegicus
ggtcttcttcccagtgttaactata

SEQ ID NO: 467374 - DNA, 25 bp, Rattus norvegicus
ggtcttcttccctaaaaatgatatg

SEQ ID NO: 467375 - DNA, 25 bp, Rattus norvegicus
ggtcttcttccctgtgttaactata

SEQ ID NO: 467376 - DNA, 25 bp, Rattus norvegicus
ggtcttctttgtatatagtctcatt

SEQ ID NO: 467377 - DNA, 25 bp, Rattus norvegicus
ggtcttctttgtttatagtctcatt

SEQ ID NO: 467378 - DNA, 25 bp, Rattus norvegicus
ggtcttgaatccatggcatttccca

SEQ ID NO: 467379 - DNA, 25 bp, Rattus norvegicus
ggtcttgaatccttggcatttccca

SEQ ID NO: 467380 - DNA, 25 bp, Rattus norvegicus
ggtcttgaccacaagatgtggcctg

SEQ ID NO: 467381 - DNA, 25 bp, Rattus norvegicus
ggtcttgaccactagatgtggcctg

SEQ ID NO: 467382 - DNA, 25 bp, Rattus norvegicus
ggtcttgaccctattgggattgcat

SEQ ID NO: 467383 - DNA, 25 bp, Rattus norvegicus
ggtcttgacccttttgggattgcat

SEQ ID NO: 467384 - DNA, 25 bp, Rattus norvegicus
ggtcttgcagcaatggcattcgata

SEQ ID NO: 467385 - DNA, 25 bp, Rattus norvegicus
ggtcttgcagcattggcattcgata

SEQ ID NO: 467386 - DNA, 25 bp, Rattus norvegicus
ggtcttgcatcacggctggacacta

SEQ ID NO: 467387 - DNA, 25 bp, Rattus norvegicus
ggtcttgcatcagggctggacacta

SEQ ID NO: 467388 - DNA, 25 bp, Rattus norvegicus
ggtcttgccagaactttgcgaatta

SEQ ID NO: 467389 - DNA, 25 bp, Rattus norvegicus
ggtcttgccagaccctggcctcaga

SEQ ID NO: 467390 - DNA, 25 bp, Rattus norvegicus
ggtcttgccagagcctggcctcaga

SEQ ID NO: 467391 - DNA, 25 bp, Rattus norvegicus
ggtcttgccagatctttgcgaatta

SEQ ID NO: 467392 - DNA, 25 bp, Rattus norvegicus
ggtcttgccatcatgggtgactgtt

SEQ ID NO: 467393 - DNA, 25 bp, Rattus norvegicus
ggtcttgccatcttgggtgactgtt

SEQ ID NO: 467394 - DNA, 25 bp, Rattus norvegicus
ggtcttgcccaaaagaggctggaga

SEQ ID NO: 467395 - DNA, 25 bp, Rattus norvegicus
ggtcttgcccaatagaggctggaga

SEQ ID NO: 467396 - DNA, 25 bp, Rattus norvegicus
ggtcttgcccacaaaaggtactaga

SEQ ID NO: 467397 - DNA, 25 bp, Rattus norvegicus
ggtcttgcccactaaaggtactaga

SEQ ID NO: 467398 - DNA, 25 bp, Rattus norvegicus
ggtcttgccctgcttgagtttctac

SEQ ID NO: 467399 - DNA, 25 bp, Rattus norvegicus
ggtcttgccctggttgagtttctac

SEQ ID NO: 467400 - DNA, 25 bp, Rattus norvegicus
ggtcttgcctctaagtctttacagg

SEQ ID NO: 467401 - DNA, 25 bp, Rattus norvegicus
ggtcttgcctcttagtctttacagg

SEQ ID NO: 467402 - DNA, 25 bp, Rattus norvegicus
ggtcttgctacaacctaacacgttt

SEQ ID NO: 467403 - DNA, 25 bp, Rattus norvegicus
ggtcttgctacatcctaacacgttt

SEQ ID NO: 467404 - DNA, 25 bp, Rattus norvegicus
ggtcttgctaggaagtcctgtctga

SEQ ID NO: 467405 - DNA, 25 bp, Rattus norvegicus
ggtcttgctaggtagtcctgtctga

SEQ ID NO: 467406 - DNA, 25 bp, Rattus norvegicus
ggtcttgctcaaacccagtagttac

SEQ ID NO: 467407 - DNA, 25 bp, Rattus norvegicus
ggtcttgctcaatcccagtagttac

SEQ ID NO: 467408 - DNA, 25 bp, Rattus norvegicus
ggtcttggaaccctggagagccctc

SEQ ID NO: 467409 - DNA, 25 bp, Rattus norvegicus
ggtcttggaaccgtggagagccctc

SEQ ID NO: 467410 - DNA, 25 bp, Rattus norvegicus
ggtcttggcatgaggtcatctagat

SEQ ID NO: 467411 - DNA, 25 bp, Rattus norvegicus
ggtcttggcatgtggtcatctagat

SEQ ID NO: 467412 - DNA, 25 bp, Rattus norvegicus
ggtcttggccaacgtcagcgtgaat

SEQ ID NO: 467413 - DNA, 25 bp, Rattus norvegicus
ggtcttggccaaggtcagcgtgaat

SEQ ID NO: 467414 - DNA, 25 bp, Rattus norvegicus
ggtcttgggtatcaggccatttcat

SEQ ID NO: 467415 - DNA, 25 bp, Rattus norvegicus
ggtcttgggtatgaggccatttcat

SEQ ID NO: 467416 - DNA, 25 bp, Rattus norvegicus
ggtcttgtagtcctgacatcatcag

SEQ ID NO: 467417 - DNA, 25 bp, Rattus norvegicus
ggtcttgtagtcgtgacatcatcag

SEQ ID NO: 467418 - DNA, 25 bp, Rattus norvegicus
ggtcttgtattaccagagcatgtca

SEQ ID NO: 467419 - DNA, 25 bp, Rattus norvegicus
ggtcttgtattagcagagcatgtca

SEQ ID NO: 467420 - DNA, 25 bp, Rattus norvegicus
ggtcttgtcactctgtttgtattta

SEQ ID NO: 467421 - DNA, 25 bp, Rattus norvegicus
ggtcttgtcactgtgtttgtattta

SEQ ID NO: 467422 - DNA, 25 bp, Rattus norvegicus
ggtcttgtcctgcaccgcaggcaga

SEQ ID NO: 467423 - DNA, 25 bp, Rattus norvegicus
ggtcttgtcctggaccgcaggcaga

SEQ ID NO: 467424 - DNA, 25 bp, Rattus norvegicus
ggtcttgtcttgaatgccggtgtag

SEQ ID NO: 467425 - DNA, 25 bp, Rattus norvegicus
ggtcttgtcttgtatgccggtgtag

SEQ ID NO: 467426 - DNA, 25 bp, Rattus norvegicus
ggtcttgtgagaaaatcagtctgct

SEQ ID NO: 467427 - DNA, 25 bp, Rattus norvegicus
ggtcttgtgagataatcagtctgct

SEQ ID NO: 467428 - DNA, 25 bp, Rattus norvegicus
ggtcttgttataccagccttcagat

SEQ ID NO: 467429 - DNA, 25 bp, Rattus norvegicus
ggtcttgttatagcagccttcagat

SEQ ID NO: 467430 - DNA, 25 bp, Rattus norvegicus
ggtcttgttcctaatgctgagagcc

SEQ ID NO: 467431 - DNA, 25 bp, Rattus norvegicus
ggtcttgttccttatgctgagagcc

SEQ ID NO: 467432 - DNA, 25 bp, Rattus norvegicus
ggtcttgttttgatccttggatcga

SEQ ID NO: 467433 - DNA, 25 bp, Rattus norvegicus
ggtcttgttttgttccttggatcga

SEQ ID NO: 467434 - DNA, 25 bp, Rattus norvegicus
ggtctttaatccactatttctttgt

SEQ ID NO: 467435 - DNA, 25 bp, Rattus norvegicus
ggtctttaatcctctatttctttgt

SEQ ID NO: 467436 - DNA, 25 bp, Rattus norvegicus
ggtctttaccctataagcctgttga

SEQ ID NO: 467437 - DNA, 25 bp, Rattus norvegicus
ggtctttaccctttaagcctgttga

SEQ ID NO: 467438 - DNA, 25 bp, Rattus norvegicus
ggtctttagactcgttaacagcaaa

SEQ ID NO: 467439 - DNA, 25 bp, Rattus norvegicus
ggtctttagactggttaacagcaaa

SEQ ID NO: 467440 - DNA, 25 bp, Rattus norvegicus
ggtctttagcctctgttatttttca

SEQ ID NO: 467441 - DNA, 25 bp, Rattus norvegicus
ggtctttagcctgtgttatttttca

SEQ ID NO: 467442 - DNA, 25 bp, Rattus norvegicus
ggtctttagttcaggatccttgtaa

SEQ ID NO: 467443 - DNA, 25 bp, Rattus norvegicus
ggtctttagttctggatccttgtaa

SEQ ID NO: 467444 - DNA, 25 bp, Rattus norvegicus
ggtctttataccactaaggatcgct

SEQ ID NO: 467445 - DNA, 25 bp, Rattus norvegicus
ggtctttatacctctaaggatcgct

SEQ ID NO: 467446 - DNA, 25 bp, Rattus norvegicus
ggtctttatagcattcaccaggaat

SEQ ID NO: 467447 - DNA, 25 bp, Rattus norvegicus
ggtctttatagctttcaccaggaat

SEQ ID NO: 467448 - DNA, 25 bp, Rattus norvegicus
ggtctttcaaagactgctttatcta

SEQ ID NO: 467449 - DNA, 25 bp, Rattus norvegicus
ggtctttcaaagtctgctttatcta

SEQ ID NO: 467450 - DNA, 25 bp, Rattus norvegicus
ggtctttcagttacccttctgttat

SEQ ID NO: 467451 - DNA, 25 bp, Rattus norvegicus
ggtctttcagtttcccttctgttat

SEQ ID NO: 467452 - DNA, 25 bp, Rattus norvegicus
ggtctttccaggaatctgcatttgt

SEQ ID NO: 467453 - DNA, 25 bp, Rattus norvegicus
ggtctttccaggtatctgcatttgt

SEQ ID NO: 467454 - DNA, 25 bp, Rattus norvegicus
ggtctttccctcacattcaaaaaca

SEQ ID NO: 467455 - DNA, 25 bp, Rattus norvegicus
ggtctttccctctcattcaaaaaca

SEQ ID NO: 467456 - DNA, 25 bp, Rattus norvegicus
ggtctttcctagagcttcattttca

SEQ ID NO: 467457 - DNA, 25 bp, Rattus norvegicus
ggtctttcctagtgcttcattttca

SEQ ID NO: 467458 - DNA, 25 bp, Rattus norvegicus
ggtctttcctctaaaggtgccatag

SEQ ID NO: 467459 - DNA, 25 bp, Rattus norvegicus
ggtctttcctctatcactatcaaag

SEQ ID NO: 467460 - DNA, 25 bp, Rattus norvegicus
ggtctttcctcttaaggtgccatag

SEQ ID NO: 467461 - DNA, 25 bp, Rattus norvegicus
ggtctttcctctttcactatcaaag

SEQ ID NO: 467462 - DNA, 25 bp, Rattus norvegicus
ggtctttctaaaactattctgtgta

SEQ ID NO: 467463 - DNA, 25 bp, Rattus norvegicus
ggtctttctaaatctattctgtgta

SEQ ID NO: 467464 - DNA, 25 bp, Rattus norvegicus
ggtctttctcttagtggccaacctt

SEQ ID NO: 467465 - DNA, 25 bp, Rattus norvegicus
ggtctttctctttgtggccaacctt

SEQ ID NO: 467466 - DNA, 25 bp, Rattus norvegicus
ggtctttctgacaggtaggctgaca

SEQ ID NO: 467467 - DNA, 25 bp, Rattus norvegicus
ggtctttctgactggtaggctgaca

SEQ ID NO: 467468 - DNA, 25 bp, Rattus norvegicus
ggtctttctggcaactgttcattca

SEQ ID NO: 467469 - DNA, 25 bp, Rattus norvegicus
ggtctttctggctactgttcattca

SEQ ID NO: 467470 - DNA, 25 bp, Rattus norvegicus
ggtctttcttctagtaattcccact

SEQ ID NO: 467471 - DNA, 25 bp, Rattus norvegicus
ggtctttcttcttgtaattcccact

SEQ ID NO: 467472 - DNA, 25 bp, Rattus norvegicus
ggtctttcttggctcaaacctgtga

SEQ ID NO: 467473 - DNA, 25 bp, Rattus norvegicus
ggtctttcttgggtcaaacctgtga

SEQ ID NO: 467474 - DNA, 25 bp, Rattus norvegicus
ggtctttcttttatggcacatgtca

SEQ ID NO: 467475 - DNA, 25 bp, Rattus norvegicus
ggtctttcttttttggcacatgtca

SEQ ID NO: 467476 - DNA, 25 bp, Rattus norvegicus
ggtctttgacccaggatacaggttt

SEQ ID NO: 467477 - DNA, 25 bp, Rattus norvegicus
ggtctttgacccagggtaagcgtct

SEQ ID NO: 467478 - DNA, 25 bp, Rattus norvegicus
ggtctttgaccctggatacaggttt

SEQ ID NO: 467479 - DNA, 25 bp, Rattus norvegicus
ggtctttgaccctgggtaagcgtct

SEQ ID NO: 467480 - DNA, 25 bp, Rattus norvegicus
ggtctttgcagacgcttgttagagt

SEQ ID NO: 467481 - DNA, 25 bp, Rattus norvegicus
ggtctttgcagaggcttgttagagt

SEQ ID NO: 467482 - DNA, 25 bp, Rattus norvegicus
ggtctttgccaacgttcactgatta

SEQ ID NO: 467483 - DNA, 25 bp, Rattus norvegicus
ggtctttgccaaggttcactgatta

SEQ ID NO: 467484 - DNA, 25 bp, Rattus norvegicus
ggtctttggtaaagctattagcctt

SEQ ID NO: 467485 - DNA, 25 bp, Rattus norvegicus
ggtctttggtaatgctattagcctt

SEQ ID NO: 467486 - DNA, 25 bp, Rattus norvegicus
ggtctttgtgcccagtacagagata

SEQ ID NO: 467487 - DNA, 25 bp, Rattus norvegicus
ggtctttgtgccgagtacagagata

SEQ ID NO: 467488 - DNA, 25 bp, Rattus norvegicus
ggtctttgttcccttctgaagcaca

SEQ ID NO: 467489 - DNA, 25 bp, Rattus norvegicus
ggtctttgttccgttctgaagcaca

SEQ ID NO: 467490 - DNA, 25 bp, Rattus norvegicus
ggtctttgttctctacatttttagc

SEQ ID NO: 467491 - DNA, 25 bp, Rattus norvegicus
ggtctttgttctgtacatttttagc

SEQ ID NO: 467492 - DNA, 25 bp, Rattus norvegicus
ggtctttgttgtatacctgacagtc

SEQ ID NO: 467493 - DNA, 25 bp, Rattus norvegicus
ggtctttgttgtttacctgacagtc

SEQ ID NO: 467494 - DNA, 25 bp, Rattus norvegicus
ggtcttttacctcatctaccaggag

SEQ ID NO: 467495 - DNA, 25 bp, Rattus norvegicus
ggtcttttacctgatctaccaggag

SEQ ID NO: 467496 - DNA, 25 bp, Rattus norvegicus
ggtcttttagccatggtgttagcat

SEQ ID NO: 467497 - DNA, 25 bp, Rattus norvegicus
ggtcttttagccttggtgttagcat

SEQ ID NO: 467498 - DNA, 25 bp, Rattus norvegicus
ggtcttttataacctaaatgtctag

SEQ ID NO: 467499 - DNA, 25 bp, Rattus norvegicus
ggtcttttataagctaaatgtctag

SEQ ID NO: 467500 - DNA, 25 bp, Rattus norvegicus
ggtcttttcaaccatctgacttcta

SEQ ID NO: 467501 - DNA, 25 bp, Rattus norvegicus
ggtcttttcaacgatctgacttcta

SEQ ID NO: 467502 - DNA, 25 bp, Rattus norvegicus
ggtcttttcaatacccaatgtcgta

SEQ ID NO: 467503 - DNA, 25 bp, Rattus norvegicus
ggtcttttcaattcccaatgtcgta

SEQ ID NO: 467504 - DNA, 25 bp, Rattus norvegicus
ggtcttttcttcatgacttatgaga

SEQ ID NO: 467505 - DNA, 25 bp, Rattus norvegicus
ggtcttttcttcttgacttatgaga

SEQ ID NO: 467506 - DNA, 25 bp, Rattus norvegicus
ggtcttttctttaagcttctcatgc

SEQ ID NO: 467507 - DNA, 25 bp, Rattus norvegicus
ggtcttttcttttagcttctcatgc

SEQ ID NO: 467508 - DNA, 25 bp, Rattus norvegicus
ggtcttttgaagacatggccatctt

SEQ ID NO: 467509 - DNA, 25 bp, Rattus norvegicus
ggtcttttgaagtcatggccatctt

SEQ ID NO: 467510 - DNA, 25 bp, Rattus norvegicus
ggtcttttgataacggctccccaaa

SEQ ID NO: 467511 - DNA, 25 bp, Rattus norvegicus
ggtcttttgatatcggctccccaaa

SEQ ID NO: 467512 - DNA, 25 bp, Rattus norvegicus
ggtcttttgtgaacccgacagcaag

SEQ ID NO: 467513 - DNA, 25 bp, Rattus norvegicus
ggtcttttgtgatcccgacagcaag

SEQ ID NO: 467514 - DNA, 25 bp, Rattus norvegicus
ggtctttttagaaagccagtgtcat

SEQ ID NO: 467515 - DNA, 25 bp, Rattus norvegicus
ggtctttttagatagccagtgtcat

SEQ ID NO: 467516 - DNA, 25 bp, Rattus norvegicus
ggtctttttatcaacctggaggacg

SEQ ID NO: 467517 - DNA, 25 bp, Rattus norvegicus
ggtctttttatctacctggaggacg

SEQ ID NO: 467518 - DNA, 25 bp, Rattus norvegicus
ggtctttttgacaaaactgcttttg

SEQ ID NO: 467519 - DNA, 25 bp, Rattus norvegicus
ggtctttttgactaaactgcttttg

SEQ ID NO: 467520 - DNA, 25 bp, Rattus norvegicus
ggtgaaaacaccattcattcttgct

SEQ ID NO: 467521 - DNA, 25 bp, Rattus norvegicus
ggtgaaaacacctttcattcttgct

SEQ ID NO: 467522 - DNA, 25 bp, Rattus norvegicus
ggtgaaaacatgatactcccattaa

SEQ ID NO: 467523 - DNA, 25 bp, Rattus norvegicus
ggtgaaaacatgttactcccattaa

SEQ ID NO: 467524 - DNA, 25 bp, Rattus norvegicus
ggtgaaaaccagctcggcgatacta

SEQ ID NO: 467525 - DNA, 25 bp, Rattus norvegicus
ggtgaaaaccaggtcggcgatacta

SEQ ID NO: 467526 - DNA, 25 bp, Rattus norvegicus
ggtgaaaaccccactgaacttagca

SEQ ID NO: 467527 - DNA, 25 bp, Rattus norvegicus
ggtgaaaacccctctgaacttagca

SEQ ID NO: 467528 - DNA, 25 bp, Rattus norvegicus
ggtgaaaatcttaactttgctgaat

SEQ ID NO: 467529 - DNA, 25 bp, Rattus norvegicus
ggtgaaaatctttactttgctgaat

SEQ ID NO: 467530 - DNA, 25 bp, Rattus norvegicus
ggtgaaaatgtccttcggtcttctc

SEQ ID NO: 467531 - DNA, 25 bp, Rattus norvegicus
ggtgaaaatgtcgttcggtcttctc

SEQ ID NO: 467532 - DNA, 25 bp, Rattus norvegicus
ggtgaaacacatcggcagtcgcctc

SEQ ID NO: 467533 - DNA, 25 bp, Rattus norvegicus
ggtgaaacacatgggcagtcgcctc

SEQ ID NO: 467534 - DNA, 25 bp, Rattus norvegicus
ggtgaaaccttgctcttggtcataa

SEQ ID NO: 467535 - DNA, 25 bp, Rattus norvegicus
ggtgaaaccttggtcttggtcataa

SEQ ID NO: 467536 - DNA, 25 bp, Rattus norvegicus
ggtgaaacgtccagtagggtacatg

SEQ ID NO: 467537 - DNA, 25 bp, Rattus norvegicus
ggtgaaacgtcctgtagggtacatg

SEQ ID NO: 467538 - DNA, 25 bp, Rattus norvegicus
ggtgaaactcaaacaaaccctcatt

SEQ ID NO: 467539 - DNA, 25 bp, Rattus norvegicus
ggtgaaactcaatcaaaccctcatt

SEQ ID NO: 467540 - DNA, 25 bp, Rattus norvegicus
ggtgaaagcaccagaatgccctgta

SEQ ID NO: 467541 - DNA, 25 bp, Rattus norvegicus
ggtgaaagcacctgaatgccctgta

SEQ ID NO: 467542 - DNA, 25 bp, Rattus norvegicus
ggtgaaagccaaaggacccttctta

SEQ ID NO: 467543 - DNA, 25 bp, Rattus norvegicus
ggtgaaagccaatggacccttctta

SEQ ID NO: 467544 - DNA, 25 bp, Rattus norvegicus
ggtgaaagctcacagtaacctgatt

SEQ ID NO: 467545 - DNA, 25 bp, Rattus norvegicus
ggtgaaagctcagagtaacctgatt

SEQ ID NO: 467546 - DNA, 25 bp, Rattus norvegicus
ggtgaaaggaatctaccacttgatt

SEQ ID NO: 467547 - DNA, 25 bp, Rattus norvegicus
ggtgaaaggaatgtaccacttgatt

SEQ ID NO: 467548 - DNA, 25 bp, Rattus norvegicus
ggtgaaagtaaaccccaaatgtatt

SEQ ID NO: 467549 - DNA, 25 bp, Rattus norvegicus
ggtgaaagtaaagcccaaatgtatt

SEQ ID NO: 467550 - DNA, 25 bp, Rattus norvegicus
ggtgaaagtcaacctccttcatcat

SEQ ID NO: 467551 - DNA, 25 bp, Rattus norvegicus
ggtgaaagtcaagctccttcatcat

SEQ ID NO: 467552 - DNA, 25 bp, Rattus norvegicus
ggtgaaatacttagtactttgcaaa

SEQ ID NO: 467553 - DNA, 25 bp, Rattus norvegicus
ggtgaaatactttgtactttgcaaa

SEQ ID NO: 467554 - DNA, 25 bp, Rattus norvegicus
ggtgaaatagcccttagtcctccct

SEQ ID NO: 467555 - DNA, 25 bp, Rattus norvegicus
ggtgaaatagccgttagtcctccct

SEQ ID NO: 467556 - DNA, 25 bp, Rattus norvegicus
ggtgaaatccataacattcccacat

SEQ ID NO: 467557 - DNA, 25 bp, Rattus norvegicus
ggtgaaatccatattctactctaac

SEQ ID NO: 467558 - DNA, 25 bp, Rattus norvegicus
ggtgaaatccattacattcccacat

SEQ ID NO: 467559 - DNA, 25 bp, Rattus norvegicus
ggtgaaatccattttctactctaac

SEQ ID NO: 467560 - DNA, 25 bp, Rattus norvegicus
ggtgaaatctacatttctatttagg

SEQ ID NO: 467561 - DNA, 25 bp, Rattus norvegicus
ggtgaaatctacttttctatttagg

SEQ ID NO: 467562 - DNA, 25 bp, Rattus norvegicus
ggtgaaatgttacctcccgtacaga

SEQ ID NO: 467563 - DNA, 25 bp, Rattus norvegicus
ggtgaaatgttagctcccgtacaga

SEQ ID NO: 467564 - DNA, 25 bp, Rattus norvegicus
ggtgaaattaatctatgcctcatct

SEQ ID NO: 467565 - DNA, 25 bp, Rattus norvegicus
ggtgaaattaatgtatgcctcatct

SEQ ID NO: 467566 - DNA, 25 bp, Rattus norvegicus
ggtgaacaaaggaggagctgctcca

SEQ ID NO: 467567 - DNA, 25 bp, Rattus norvegicus
ggtgaacaaaggtggagctgctcca

SEQ ID NO: 467568 - DNA, 25 bp, Rattus norvegicus
ggtgaacaccaaaagcctgtttatt

SEQ ID NO: 467569 - DNA, 25 bp, Rattus norvegicus
ggtgaacaccaatagcctgtttatt

SEQ ID NO: 467570 - DNA, 25 bp, Rattus norvegicus
ggtgaacaccatacagctctttggg

SEQ ID NO: 467571 - DNA, 25 bp, Rattus norvegicus
ggtgaacaccattcagctctttggg

SEQ ID NO: 467572 - DNA, 25 bp, Rattus norvegicus
ggtgaacagctcagcagggaccttc

SEQ ID NO: 467573 - DNA, 25 bp, Rattus norvegicus
ggtgaacagctctgcagggaccttc

SEQ ID NO: 467574 - DNA, 25 bp, Rattus norvegicus
ggtgaacatcaacaattgcctcctc

SEQ ID NO: 467575 - DNA, 25 bp, Rattus norvegicus
ggtgaacatcaacggcatcatcctc

SEQ ID NO: 467576 - DNA, 25 bp, Rattus norvegicus
ggtgaacatcaagaattgcctcctc

SEQ ID NO: 467577 - DNA, 25 bp, Rattus norvegicus
ggtgaacatcaagggcatcatcctc

SEQ ID NO: 467578 - DNA, 25 bp, Rattus norvegicus
ggtgaacatgggaaactcctgcctc

SEQ ID NO: 467579 - DNA, 25 bp, Rattus norvegicus
ggtgaacatgggtaactcctgcctc

SEQ ID NO: 467580 - DNA, 25 bp, Rattus norvegicus
ggtgaaccacctctgttttagaagt

SEQ ID NO: 467581 - DNA, 25 bp, Rattus norvegicus
ggtgaaccacctgtgttttagaagt

SEQ ID NO: 467582 - DNA, 25 bp, Rattus norvegicus
ggtgaaccagaccatacacagagtt

SEQ ID NO: 467583 - DNA, 25 bp, Rattus norvegicus
ggtgaaccagacgatacacagagtt

SEQ ID NO: 467584 - DNA, 25 bp, Rattus norvegicus
ggtgaacccagacacacggagccat

SEQ ID NO: 467585 - DNA, 25 bp, Rattus norvegicus
ggtgaacccagagacacggagccat

SEQ ID NO: 467586 - DNA, 25 bp, Rattus norvegicus
ggtgaaccctttaatctatagtctt

SEQ ID NO: 467587 - DNA, 25 bp, Rattus norvegicus
ggtgaacccttttatctatagtctt

SEQ ID NO: 467588 - DNA, 25 bp, Rattus norvegicus
ggtgaaccgccaactttcaaagtct

SEQ ID NO: 467589 - DNA, 25 bp, Rattus norvegicus
ggtgaaccgccatctttcaaagtct

SEQ ID NO: 467590 - DNA, 25 bp, Rattus norvegicus
ggtgaacctctgcagcagctggctc

SEQ ID NO: 467591 - DNA, 25 bp, Rattus norvegicus
ggtgaacctctggagcagctggctc

SEQ ID NO: 467592 - DNA, 25 bp, Rattus norvegicus
ggtgaacctgcccagatttatcagt

SEQ ID NO: 467593 - DNA, 25 bp, Rattus norvegicus
ggtgaacctgcccattgtagagcga

SEQ ID NO: 467594 - DNA, 25 bp, Rattus norvegicus
ggtgaacctgccgagatttatcagt

SEQ ID NO: 467595 - DNA, 25 bp, Rattus norvegicus
ggtgaacctgccgattgtagagcga

SEQ ID NO: 467596 - DNA, 25 bp, Rattus norvegicus
ggtgaaccttcaatcttcgaggaga

SEQ ID NO: 467597 - DNA, 25 bp, Rattus norvegicus
ggtgaaccttcattcttcgaggaga

SEQ ID NO: 467598 - DNA, 25 bp, Rattus norvegicus
ggtgaacctttcaaacacagatgtt

SEQ ID NO: 467599 - DNA, 25 bp, Rattus norvegicus
ggtgaacctttctaacacagatgtt

SEQ ID NO: 467600 - DNA, 25 bp, Rattus norvegicus
ggtgaacgctccaaattttttgctt

SEQ ID NO: 467601 - DNA, 25 bp, Rattus norvegicus
ggtgaacgctcctaattttttgctt

SEQ ID NO: 467602 - DNA, 25 bp, Rattus norvegicus
ggtgaactaaagctgccaaatgata

SEQ ID NO: 467603 - DNA, 25 bp, Rattus norvegicus
ggtgaactaaaggtgccaaatgata

SEQ ID NO: 467604 - DNA, 25 bp, Rattus norvegicus
ggtgaactaatcaatcttcgttttg

SEQ ID NO: 467605 - DNA, 25 bp, Rattus norvegicus
ggtgaactaatctatcttcgttttg

SEQ ID NO: 467606 - DNA, 25 bp, Rattus norvegicus
ggtgaactccccagctatttataaa

SEQ ID NO: 467607 - DNA, 25 bp, Rattus norvegicus
ggtgaactcccctgctatttataaa

SEQ ID NO: 467608 - DNA, 25 bp, Rattus norvegicus
ggtgaactccctcccataaaattat

SEQ ID NO: 467609 - DNA, 25 bp, Rattus norvegicus
ggtgaactccctgccataaaattat

SEQ ID NO: 467610 - DNA, 25 bp, Rattus norvegicus
ggtgaactcggacccagcaaccaga

SEQ ID NO: 467611 - DNA, 25 bp, Rattus norvegicus
ggtgaactcggagccagcaaccaga

SEQ ID NO: 467612 - DNA, 25 bp, Rattus norvegicus
ggtgaactctgcaaagccccaaaat

SEQ ID NO: 467613 - DNA, 25 bp, Rattus norvegicus
ggtgaactctgctaagccccaaaat

SEQ ID NO: 467614 - DNA, 25 bp, Rattus norvegicus
ggtgaactcttaaccagatccctgg

SEQ ID NO: 467615 - DNA, 25 bp, Rattus norvegicus
ggtgaactcttatccagatccctgg

SEQ ID NO: 467616 - DNA, 25 bp, Rattus norvegicus
ggtgaactgctaattcaacgcctgc

SEQ ID NO: 467617 - DNA, 25 bp, Rattus norvegicus
ggtgaactgctatttcaacgcctgc

SEQ ID NO: 467618 - DNA, 25 bp, Rattus norvegicus
ggtgaactgtgacgtccccatgact

SEQ ID NO: 467619 - DNA, 25 bp, Rattus norvegicus
ggtgaactgtgaggtccccatgact

SEQ ID NO: 467620 - DNA, 25 bp, Rattus norvegicus
ggtgaactgttccatgtagagctgt

SEQ ID NO: 467621 - DNA, 25 bp, Rattus norvegicus
ggtgaactgttcgatgtagagctgt

SEQ ID NO: 467622 - DNA, 25 bp, Rattus norvegicus
ggtgaacttaacaaccatacttgaa

SEQ ID NO: 467623 - DNA, 25 bp, Rattus norvegicus
ggtgaacttaactaccatacttgaa

SEQ ID NO: 467624 - DNA, 25 bp, Rattus norvegicus
ggtgaacttcaactttatactgtgt

SEQ ID NO: 467625 - DNA, 25 bp, Rattus norvegicus
ggtgaacttcaagtttatactgtgt

SEQ ID NO: 467626 - DNA, 25 bp, Rattus norvegicus
ggtgaacttccaagcaatgctcctt

SEQ ID NO: 467627 - DNA, 25 bp, Rattus norvegicus
ggtgaacttccatgcaatgctcctt

SEQ ID NO: 467628 - DNA, 25 bp, Rattus norvegicus
ggtgaacttgacatcatcccattta

SEQ ID NO: 467629 - DNA, 25 bp, Rattus norvegicus
ggtgaacttgacttcatcccattta

SEQ ID NO: 467630 - DNA, 25 bp, Rattus norvegicus
ggtgaacttggaaacacacatcatt

SEQ ID NO: 467631 - DNA, 25 bp, Rattus norvegicus
ggtgaacttggatacacacatcatt

SEQ ID NO: 467632 - DNA, 25 bp, Rattus norvegicus
ggtgaagaaatcaccactcgtccgt

SEQ ID NO: 467633 - DNA, 25 bp, Rattus norvegicus
ggtgaagaaatctccactcgtccgt

SEQ ID NO: 467634 - DNA, 25 bp, Rattus norvegicus
ggtgaagaacacaacacttcctgtg

SEQ ID NO: 467635 - DNA, 25 bp, Rattus norvegicus
ggtgaagaacactacacttcctgtg

SEQ ID NO: 467636 - DNA, 25 bp, Rattus norvegicus
ggtgaagaagtcatgttcttacaga

SEQ ID NO: 467637 - DNA, 25 bp, Rattus norvegicus
ggtgaagaagtcctcagccctggca

SEQ ID NO: 467638 - DNA, 25 bp, Rattus norvegicus
ggtgaagaagtcgtcagccctggca

SEQ ID NO: 467639 - DNA, 25 bp, Rattus norvegicus
ggtgaagaagtcttgttcttacaga

SEQ ID NO: 467640 - DNA, 25 bp, Rattus norvegicus
ggtgaagacatcaggaatcgcattc

SEQ ID NO: 467641 - DNA, 25 bp, Rattus norvegicus
ggtgaagacatctggaatcgcattc

SEQ ID NO: 467642 - DNA, 25 bp, Rattus norvegicus
ggtgaagatcaaccagtccctttcc

SEQ ID NO: 467643 - DNA, 25 bp, Rattus norvegicus
ggtgaagatcaagcagtccctttcc

SEQ ID NO: 467644 - DNA, 25 bp, Rattus norvegicus
ggtgaagatcccagtgtccatcact

SEQ ID NO: 467645 - DNA, 25 bp, Rattus norvegicus
ggtgaagatccctgtgtccatcact

SEQ ID NO: 467646 - DNA, 25 bp, Rattus norvegicus
ggtgaagatctccttggaatctcaa

SEQ ID NO: 467647 - DNA, 25 bp, Rattus norvegicus
ggtgaagatctcgttggaatctcaa

SEQ ID NO: 467648 - DNA, 25 bp, Rattus norvegicus
ggtgaagatggcacccgttttccgc

SEQ ID NO: 467649 - DNA, 25 bp, Rattus norvegicus
ggtgaagatggctcccgttttccgc

SEQ ID NO: 467650 - DNA, 25 bp, Rattus norvegicus
ggtgaagcacagaatgcctgtatat

SEQ ID NO: 467651 - DNA, 25 bp, Rattus norvegicus
ggtgaagcacagtatgcctgtatat

SEQ ID NO: 467652 - DNA, 25 bp, Rattus norvegicus
ggtgaagcaccaactgagaaccccg

SEQ ID NO: 467653 - DNA, 25 bp, Rattus norvegicus
ggtgaagcaccatctgagaaccccg

SEQ ID NO: 467654 - DNA, 25 bp, Rattus norvegicus
ggtgaagcacgcctgtaatccaagt

SEQ ID NO: 467655 - DNA, 25 bp, Rattus norvegicus
ggtgaagcacgcgtgtaatccaagt

SEQ ID NO: 467656 - DNA, 25 bp, Rattus norvegicus
ggtgaagcaggaacacccagagttc

SEQ ID NO: 467657 - DNA, 25 bp, Rattus norvegicus
ggtgaagcaggatcacccagagttc

SEQ ID NO: 467658 - DNA, 25 bp, Rattus norvegicus
ggtgaagcatcccactatgacagtg

SEQ ID NO: 467659 - DNA, 25 bp, Rattus norvegicus
ggtgaagcatccgactatgacagtg

SEQ ID NO: 467660 - DNA, 25 bp, Rattus norvegicus
ggtgaagcccatattcagtcgggac

SEQ ID NO: 467661 - DNA, 25 bp, Rattus norvegicus
ggtgaagcccattttcagtcgggac

SEQ ID NO: 467662 - DNA, 25 bp, Rattus norvegicus
ggtgaagcgaagctctaaccctcct

SEQ ID NO: 467663 - DNA, 25 bp, Rattus norvegicus
ggtgaagcgaaggtctaaccctcct

SEQ ID NO: 467664 - DNA, 25 bp, Rattus norvegicus
ggtgaagctctaagagggtccccag

SEQ ID NO: 467665 - DNA, 25 bp, Rattus norvegicus
ggtgaagctctatgagggtccccag

SEQ ID NO: 467666 - DNA, 25 bp, Rattus norvegicus
ggtgaagcttgcagacatacagatt

SEQ ID NO: 467667 - DNA, 25 bp, Rattus norvegicus
ggtgaagcttgctgacatacagatt

SEQ ID NO: 467668 - DNA, 25 bp, Rattus norvegicus
ggtgaaggactccaagctcatcctc

SEQ ID NO: 467669 - DNA, 25 bp, Rattus norvegicus
ggtgaaggactcgaagctcatcctc

SEQ ID NO: 467670 - DNA, 25 bp, Rattus norvegicus
ggtgaaggcagacctagcccgaaaa

SEQ ID NO: 467671 - DNA, 25 bp, Rattus norvegicus
ggtgaaggcagagctagcccgaaaa

SEQ ID NO: 467672 - DNA, 25 bp, Rattus norvegicus
ggtgaagtccaacgcgacctctagg

SEQ ID NO: 467673 - DNA, 25 bp, Rattus norvegicus
ggtgaagtccaaggcgacctctagg

SEQ ID NO: 467674 - DNA, 25 bp, Rattus norvegicus
ggtgaagtccccaatggagcctatg

SEQ ID NO: 467675 - DNA, 25 bp, Rattus norvegicus
ggtgaagtcccctatggagcctatg

SEQ ID NO: 467676 - DNA, 25 bp, Rattus norvegicus
ggtgaagtctcacagatacatcctt

SEQ ID NO: 467677 - DNA, 25 bp, Rattus norvegicus
ggtgaagtctcagagatacatcctt

SEQ ID NO: 467678 - DNA, 25 bp, Rattus norvegicus
ggtgaagttattaatccaatttacg

SEQ ID NO: 467679 - DNA, 25 bp, Rattus norvegicus
ggtgaagttatttatccaatttacg

SEQ ID NO: 467680 - DNA, 25 bp, Rattus norvegicus
ggtgaagttcttatcatttgggaag

SEQ ID NO: 467681 - DNA, 25 bp, Rattus norvegicus
ggtgaagttcttttcatttgggaag

SEQ ID NO: 467682 - DNA, 25 bp, Rattus norvegicus
ggtgaagtttcactgccacacagac

SEQ ID NO: 467683 - DNA, 25 bp, Rattus norvegicus
ggtgaagtttcagtgccacacagac

SEQ ID NO: 467684 - DNA, 25 bp, Rattus norvegicus
ggtgaataaaacactttatgcagat

SEQ ID NO: 467685 - DNA, 25 bp, Rattus norvegicus
ggtgaataaaactctttatgcagat

SEQ ID NO: 467686 - DNA, 25 bp, Rattus norvegicus
ggtgaataagctagctgtcctccct

SEQ ID NO: 467687 - DNA, 25 bp, Rattus norvegicus
ggtgaataagcttgctgtcctccct

SEQ ID NO: 467688 - DNA, 25 bp, Rattus norvegicus
ggtgaataatatctctagccctatt

SEQ ID NO: 467689 - DNA, 25 bp, Rattus norvegicus
ggtgaataatatgtctagccctatt

SEQ ID NO: 467690 - DNA, 25 bp, Rattus norvegicus
ggtgaatatttgagacttccagacc

SEQ ID NO: 467691 - DNA, 25 bp, Rattus norvegicus
ggtgaatatttgtgacttccagacc

SEQ ID NO: 467692 - DNA, 25 bp, Rattus norvegicus
ggtgaatcacaacaagcctttaagg

SEQ ID NO: 467693 - DNA, 25 bp, Rattus norvegicus
ggtgaatcacaagaagcctttaagg

SEQ ID NO: 467694 - DNA, 25 bp, Rattus norvegicus
ggtgaatcagacataaggcctatcg

SEQ ID NO: 467695 - DNA, 25 bp, Rattus norvegicus
ggtgaatcagacttaaggcctatcg

SEQ ID NO: 467696 - DNA, 25 bp, Rattus norvegicus
ggtgaatcagtccatctccaggcaa

SEQ ID NO: 467697 - DNA, 25 bp, Rattus norvegicus
ggtgaatcagtcgatctccaggcaa

SEQ ID NO: 467698 - DNA, 25 bp, Rattus norvegicus
ggtgaatcatgtccctctagaacag

SEQ ID NO: 467699 - DNA, 25 bp, Rattus norvegicus
ggtgaatcatgtgcctctagaacag

SEQ ID NO: 467700 - DNA, 25 bp, Rattus norvegicus
ggtgaatcggtaagtcctaattaga

SEQ ID NO: 467701 - DNA, 25 bp, Rattus norvegicus
ggtgaatcggtatgtcctaattaga

SEQ ID NO: 467702 - DNA, 25 bp, Rattus norvegicus
ggtgaatcttttcttgcgtgatcag

SEQ ID NO: 467703 - DNA, 25 bp, Rattus norvegicus
ggtgaatcttttgttgcgtgatcag

SEQ ID NO: 467704 - DNA, 25 bp, Rattus norvegicus
ggtgaatgacatctgcctcttgagt

SEQ ID NO: 467705 - DNA, 25 bp, Rattus norvegicus
ggtgaatgacatgtgcctcttgagt

SEQ ID NO: 467706 - DNA, 25 bp, Rattus norvegicus
ggtgaatgccctcagcgaggacaca

SEQ ID NO: 467707 - DNA, 25 bp, Rattus norvegicus
ggtgaatgccctgagcgaggacaca

SEQ ID NO: 467708 - DNA, 25 bp, Rattus norvegicus
ggtgaatgtggcaggagtctccctc

SEQ ID NO: 467709 - DNA, 25 bp, Rattus norvegicus
ggtgaatgtggctggagtctccctc

SEQ ID NO: 467710 - DNA, 25 bp, Rattus norvegicus
ggtgaatgtggtcccagccccggtg

SEQ ID NO: 467711 - DNA, 25 bp, Rattus norvegicus
ggtgaatgtggtgccagccccggtg

SEQ ID NO: 467712 - DNA, 25 bp, Rattus norvegicus
ggtgaatgtgtaactgcttcccaga

SEQ ID NO: 467713 - DNA, 25 bp, Rattus norvegicus
ggtgaatgtgtatctgcttcccaga

SEQ ID NO: 467714 - DNA, 25 bp, Rattus norvegicus
ggtgaatgttggagaaccccttcgt

SEQ ID NO: 467715 - DNA, 25 bp, Rattus norvegicus
ggtgaatgttggtgaaccccttcgt

SEQ ID NO: 467716 - DNA, 25 bp, Rattus norvegicus
ggtgaattctgtactttcctttact

SEQ ID NO: 467717 - DNA, 25 bp, Rattus norvegicus
ggtgaattctgttctttcctttact

SEQ ID NO: 467718 - DNA, 25 bp, Rattus norvegicus
ggtgaattgcctagagcttgtttaa

SEQ ID NO: 467719 - DNA, 25 bp, Rattus norvegicus
ggtgaattgccttgagcttgtttaa

SEQ ID NO: 467720 - DNA, 25 bp, Rattus norvegicus
ggtgaattggccaagcacgccgttt

SEQ ID NO: 467721 - DNA, 25 bp, Rattus norvegicus
ggtgaattggcctagcacgccgttt

SEQ ID NO: 467722 - DNA, 25 bp, Rattus norvegicus
ggtgaattgggaatactttctttct

SEQ ID NO: 467723 - DNA, 25 bp, Rattus norvegicus
ggtgaattgggattactttctttct

SEQ ID NO: 467724 - DNA, 25 bp, Rattus norvegicus
ggtgaatttatcattgctgctgtgg

SEQ ID NO: 467725 - DNA, 25 bp, Rattus norvegicus
ggtgaatttatctttgctgctgtgg

SEQ ID NO: 467726 - DNA, 25 bp, Rattus norvegicus
ggtgaatttcttcctggcagatctt

SEQ ID NO: 467727 - DNA, 25 bp, Rattus norvegicus
ggtgaatttcttgctggcagatctt

SEQ ID NO: 467728 - DNA, 25 bp, Rattus norvegicus
ggtgacaaagccctgtgcttcaaga

SEQ ID NO: 467729 - DNA, 25 bp, Rattus norvegicus
ggtgacaaagccgtgtgcttcaaga

SEQ ID NO: 467730 - DNA, 25 bp, Rattus norvegicus
ggtgacaaatccatacgtttccgtc

SEQ ID NO: 467731 - DNA, 25 bp, Rattus norvegicus
ggtgacaaatccttacgtttccgtc

SEQ ID NO: 467732 - DNA, 25 bp, Rattus norvegicus
ggtgacaactccaaagcctgataag

SEQ ID NO: 467733 - DNA, 25 bp, Rattus norvegicus
ggtgacaactcctaagcctgataag

SEQ ID NO: 467734 - DNA, 25 bp, Rattus norvegicus
ggtgacaacttgacttcatcatcca

SEQ ID NO: 467735 - DNA, 25 bp, Rattus norvegicus
ggtgacaacttgtcttcatcatcca

SEQ ID NO: 467736 - DNA, 25 bp, Rattus norvegicus
ggtgacaagtcccatagctactttg

SEQ ID NO: 467737 - DNA, 25 bp, Rattus norvegicus
ggtgacaagtccgatagctactttg

SEQ ID NO: 467738 - DNA, 25 bp, Rattus norvegicus
ggtgacaagtgccagccatcttctt

SEQ ID NO: 467739 - DNA, 25 bp, Rattus norvegicus
ggtgacaagtgcgagccatcttctt

SEQ ID NO: 467740 - DNA, 25 bp, Rattus norvegicus
ggtgacaatattactcctgtcgcct

SEQ ID NO: 467741 - DNA, 25 bp, Rattus norvegicus
ggtgacaatatttctcctgtcgcct

SEQ ID NO: 467742 - DNA, 25 bp, Rattus norvegicus
ggtgacaatcctaacccagagccat

SEQ ID NO: 467743 - DNA, 25 bp, Rattus norvegicus
ggtgacaatccttacccagagccat

SEQ ID NO: 467744 - DNA, 25 bp, Rattus norvegicus
ggtgacaatgggagtctggatgaca

SEQ ID NO: 467745 - DNA, 25 bp, Rattus norvegicus
ggtgacaatgggtgtctggatgaca

SEQ ID NO: 467746 - DNA, 25 bp, Rattus norvegicus
ggtgacacaaatctcccagcagaat

SEQ ID NO: 467747 - DNA, 25 bp, Rattus norvegicus
ggtgacacaaatgtcccagcagaat

SEQ ID NO: 467748 - DNA, 25 bp, Rattus norvegicus
ggtgacacaagacctctgactgcat

SEQ ID NO: 467749 - DNA, 25 bp, Rattus norvegicus
ggtgacacaagagctctgactgcat

SEQ ID NO: 467750 - DNA, 25 bp, Rattus norvegicus
ggtgacacaagccttcctttaaatt

SEQ ID NO: 467751 - DNA, 25 bp, Rattus norvegicus
ggtgacacaagcgttcctttaaatt

SEQ ID NO: 467752 - DNA, 25 bp, Rattus norvegicus
ggtgacacaagtattcataggcgat

SEQ ID NO: 467753 - DNA, 25 bp, Rattus norvegicus
ggtgacacaagttttcataggcgat

SEQ ID NO: 467754 - DNA, 25 bp, Rattus norvegicus
ggtgacacacaactgtaatcctaga

SEQ ID NO: 467755 - DNA, 25 bp, Rattus norvegicus
ggtgacacacaagtgtaatcctaga

SEQ ID NO: 467756 - DNA, 25 bp, Rattus norvegicus
ggtgacacactcctgagatttctgc

SEQ ID NO: 467757 - DNA, 25 bp, Rattus norvegicus
ggtgacacactcgtgagatttctgc

SEQ ID NO: 467758 - DNA, 25 bp, Rattus norvegicus
ggtgacacagtgatagccccttcag

SEQ ID NO: 467759 - DNA, 25 bp, Rattus norvegicus
ggtgacacagtgttagccccttcag

SEQ ID NO: 467760 - DNA, 25 bp, Rattus norvegicus
ggtgacacggagcaactcccagaat

SEQ ID NO: 467761 - DNA, 25 bp, Rattus norvegicus
ggtgacacggaggaactcccagaat

SEQ ID NO: 467762 - DNA, 25 bp, Rattus norvegicus
ggtgacacgtcacgcagttgtgcct

SEQ ID NO: 467763 - DNA, 25 bp, Rattus norvegicus
ggtgacacgtcaggcagttgtgcct

SEQ ID NO: 467764 - DNA, 25 bp, Rattus norvegicus
ggtgacactcccagaagaattttgt

SEQ ID NO: 467765 - DNA, 25 bp, Rattus norvegicus
ggtgacactccctgaagaattttgt

SEQ ID NO: 467766 - DNA, 25 bp, Rattus norvegicus
ggtgacactcttacggtgacttttg

SEQ ID NO: 467767 - DNA, 25 bp, Rattus norvegicus
ggtgacactctttcggtgacttttg

SEQ ID NO: 467768 - DNA, 25 bp, Rattus norvegicus
ggtgacactgacagacctccaggaa

SEQ ID NO: 467769 - DNA, 25 bp, Rattus norvegicus
ggtgacactgactgacctccaggaa

SEQ ID NO: 467770 - DNA, 25 bp, Rattus norvegicus
ggtgacactgcaacaagccatctaa

SEQ ID NO: 467771 - DNA, 25 bp, Rattus norvegicus
ggtgacactgcatcaagccatctaa

SEQ ID NO: 467772 - DNA, 25 bp, Rattus norvegicus
ggtgacactgttagattctaactac

SEQ ID NO: 467773 - DNA, 25 bp, Rattus norvegicus
ggtgacactgtttgattctaactac

SEQ ID NO: 467774 - DNA, 25 bp, Rattus norvegicus
ggtgacacttccaaagaatcttttc

SEQ ID NO: 467775 - DNA, 25 bp, Rattus norvegicus
ggtgacacttcctaagaatcttttc

SEQ ID NO: 467776 - DNA, 25 bp, Rattus norvegicus
ggtgacagattgaggcctttcattt

SEQ ID NO: 467777 - DNA, 25 bp, Rattus norvegicus
ggtgacagattgtggcctttcattt

SEQ ID NO: 467778 - DNA, 25 bp, Rattus norvegicus
ggtgacagccacaggtcacggccgc

SEQ ID NO: 467779 - DNA, 25 bp, Rattus norvegicus
ggtgacagccactggtcacggccgc

SEQ ID NO: 467780 - DNA, 25 bp, Rattus norvegicus
ggtgacaggatgcaacattgagaat

SEQ ID NO: 467781 - DNA, 25 bp, Rattus norvegicus
ggtgacaggatggaacattgagaat

SEQ ID NO: 467782 - DNA, 25 bp, Rattus norvegicus
ggtgacagggacaccttcccttcca

SEQ ID NO: 467783 - DNA, 25 bp, Rattus norvegicus
ggtgacagggacagctcaggctctt

SEQ ID NO: 467784 - DNA, 25 bp, Rattus norvegicus
ggtgacagggactccttcccttcca

SEQ ID NO: 467785 - DNA, 25 bp, Rattus norvegicus
ggtgacagggactgctcaggctctt

SEQ ID NO: 467786 - DNA, 25 bp, Rattus norvegicus
ggtgacagtcatcgtgatcttagtt

SEQ ID NO: 467787 - DNA, 25 bp, Rattus norvegicus
ggtgacagtcatggtgatcttagtt

SEQ ID NO: 467788 - DNA, 25 bp, Rattus norvegicus
ggtgacagtgatattactcctaagt

SEQ ID NO: 467789 - DNA, 25 bp, Rattus norvegicus
ggtgacagtgattttactcctaagt

SEQ ID NO: 467790 - DNA, 25 bp, Rattus norvegicus
ggtgacagtgtcatgaggctcagct

SEQ ID NO: 467791 - DNA, 25 bp, Rattus norvegicus
ggtgacagtgtcctttatacgaaca

SEQ ID NO: 467792 - DNA, 25 bp, Rattus norvegicus
ggtgacagtgtcgtttatacgaaca

SEQ ID NO: 467793 - DNA, 25 bp, Rattus norvegicus
ggtgacagtgtcttgaggctcagct

SEQ ID NO: 467794 - DNA, 25 bp, Rattus norvegicus
ggtgacatccaaagagaagctccta

SEQ ID NO: 467795 - DNA, 25 bp, Rattus norvegicus
ggtgacatccaaattgtccttgagt

SEQ ID NO: 467796 - DNA, 25 bp, Rattus norvegicus
ggtgacatccaatgagaagctccta

SEQ ID NO: 467797 - DNA, 25 bp, Rattus norvegicus
ggtgacatccaatttgtccttgagt

SEQ ID NO: 467798 - DNA, 25 bp, Rattus norvegicus
ggtgacatctaccaaagcatcaaaa

SEQ ID NO: 467799 - DNA, 25 bp, Rattus norvegicus
ggtgacatctacgaaagcatcaaaa

SEQ ID NO: 467800 - DNA, 25 bp, Rattus norvegicus
ggtgacatctcaaaggccaggaatt

SEQ ID NO: 467801 - DNA, 25 bp, Rattus norvegicus
ggtgacatctcataggccaggaatt

SEQ ID NO: 467802 - DNA, 25 bp, Rattus norvegicus
ggtgacatgcacctgaatcccagat

SEQ ID NO: 467803 - DNA, 25 bp, Rattus norvegicus
ggtgacatgcacgtgaatcccagat

SEQ ID NO: 467804 - DNA, 25 bp, Rattus norvegicus
ggtgacatgggtacccactcaaaat

SEQ ID NO: 467805 - DNA, 25 bp, Rattus norvegicus
ggtgacatgggttcccactcaaaat

SEQ ID NO: 467806 - DNA, 25 bp, Rattus norvegicus
ggtgacattaggaggcagccttcag

SEQ ID NO: 467807 - DNA, 25 bp, Rattus norvegicus
ggtgacattaggtggcagccttcag

SEQ ID NO: 467808 - DNA, 25 bp, Rattus norvegicus
ggtgacattcaaaagggcctccttt

SEQ ID NO: 467809 - DNA, 25 bp, Rattus norvegicus
ggtgacattcaatagggcctccttt

SEQ ID NO: 467810 - DNA, 25 bp, Rattus norvegicus
ggtgacattctaatcctctagtgag

SEQ ID NO: 467811 - DNA, 25 bp, Rattus norvegicus
ggtgacattctattcctctagtgag

SEQ ID NO: 467812 - DNA, 25 bp, Rattus norvegicus
ggtgacattgcgcacatcttgtact

SEQ ID NO: 467813 - DNA, 25 bp, Rattus norvegicus
ggtgacattgcggacatcttgtact

SEQ ID NO: 467814 - DNA, 25 bp, Rattus norvegicus
ggtgacattgtcagacctcacagaa

SEQ ID NO: 467815 - DNA, 25 bp, Rattus norvegicus
ggtgacattgtctgacctcacagaa

SEQ ID NO: 467816 - DNA, 25 bp, Rattus norvegicus
ggtgaccacaggcagctaattcagg

SEQ ID NO: 467817 - DNA, 25 bp, Rattus norvegicus
ggtgaccacagggagctaattcagg

SEQ ID NO: 467818 - DNA, 25 bp, Rattus norvegicus
ggtgaccaccttaacagtgacctgg

SEQ ID NO: 467819 - DNA, 25 bp, Rattus norvegicus
ggtgaccacctttacagtgacctgg

SEQ ID NO: 467820 - DNA, 25 bp, Rattus norvegicus
ggtgaccagagccttcgttaagtgt

SEQ ID NO: 467821 - DNA, 25 bp, Rattus norvegicus
ggtgaccagagcgttcgttaagtgt

SEQ ID NO: 467822 - DNA, 25 bp, Rattus norvegicus
ggtgaccagataatcaaatccgtga

SEQ ID NO: 467823 - DNA, 25 bp, Rattus norvegicus
ggtgaccagatattcaaatccgtga

SEQ ID NO: 467824 - DNA, 25 bp, Rattus norvegicus
ggtgaccagcagacccaggaacaaa

SEQ ID NO: 467825 - DNA, 25 bp, Rattus norvegicus
ggtgaccagcagtcccaggaacaaa

SEQ ID NO: 467826 - DNA, 25 bp, Rattus norvegicus
ggtgaccataataacgcttactcta

SEQ ID NO: 467827 - DNA, 25 bp, Rattus norvegicus
ggtgaccataattacgcttactcta

SEQ ID NO: 467828 - DNA, 25 bp, Rattus norvegicus
ggtgaccatacaacataccctcaaa

SEQ ID NO: 467829 - DNA, 25 bp, Rattus norvegicus
ggtgaccatacatcataccctcaaa

SEQ ID NO: 467830 - DNA, 25 bp, Rattus norvegicus
ggtgacccatgcagtagctcaaatt

SEQ ID NO: 467831 - DNA, 25 bp, Rattus norvegicus
ggtgacccatgctgtagctcaaatt

SEQ ID NO: 467832 - DNA, 25 bp, Rattus norvegicus
ggtgaccctagaatctgtcagctaa

SEQ ID NO: 467833 - DNA, 25 bp, Rattus norvegicus
ggtgaccctagattctgtcagctaa

SEQ ID NO: 467834 - DNA, 25 bp, Rattus norvegicus
ggtgaccctcgaacattcaaatcaa

SEQ ID NO: 467835 - DNA, 25 bp, Rattus norvegicus
ggtgaccctcgatcattcaaatcaa

SEQ ID NO: 467836 - DNA, 25 bp, Rattus norvegicus
ggtgaccctgacagctggctgtgtc

SEQ ID NO: 467837 - DNA, 25 bp, Rattus norvegicus
ggtgaccctgactgctggctgtgtc

SEQ ID NO: 467838 - DNA, 25 bp, Rattus norvegicus
ggtgaccctgcacaaagacccggtg

SEQ ID NO: 467839 - DNA, 25 bp, Rattus norvegicus
ggtgaccctgcagaaagacccggtg

SEQ ID NO: 467840 - DNA, 25 bp, Rattus norvegicus
ggtgaccctggaagtcatcgataca

SEQ ID NO: 467841 - DNA, 25 bp, Rattus norvegicus
ggtgaccctggatgtcatcgataca

SEQ ID NO: 467842 - DNA, 25 bp, Rattus norvegicus
ggtgacccttgtcttatttccatgt

SEQ ID NO: 467843 - DNA, 25 bp, Rattus norvegicus
ggtgacccttgtgttatttccatgt

SEQ ID NO: 467844 - DNA, 25 bp, Rattus norvegicus
ggtgaccgccttcgtggagtgtgaa

SEQ ID NO: 467845 - DNA, 25 bp, Rattus norvegicus
ggtgaccgccttggtggagtgtgaa

SEQ ID NO: 467846 - DNA, 25 bp, Rattus norvegicus
ggtgaccggtagatttctatgcagt

SEQ ID NO: 467847 - DNA, 25 bp, Rattus norvegicus
ggtgaccggtagttttctatgcagt

SEQ ID NO: 467848 - DNA, 25 bp, Rattus norvegicus
ggtgacctaaacagcagggcctaga

SEQ ID NO: 467849 - DNA, 25 bp, Rattus norvegicus
ggtgacctaaactgcagggcctaga

SEQ ID NO: 467850 - DNA, 25 bp, Rattus norvegicus
ggtgacctactcacgaccagactat

SEQ ID NO: 467851 - DNA, 25 bp, Rattus norvegicus
ggtgacctactctcgaccagactat

SEQ ID NO: 467852 - DNA, 25 bp, Rattus norvegicus
ggtgacctactgcagcctgaggaaa

SEQ ID NO: 467853 - DNA, 25 bp, Rattus norvegicus
ggtgacctactggagcctgaggaaa

SEQ ID NO: 467854 - DNA, 25 bp, Rattus norvegicus
ggtgacctacttactgaagccaggc

SEQ ID NO: 467855 - DNA, 25 bp, Rattus norvegicus
ggtgacctactttctgaagccaggc

SEQ ID NO: 467856 - DNA, 25 bp, Rattus norvegicus
ggtgacctagcacacttcctgaagt

SEQ ID NO: 467857 - DNA, 25 bp, Rattus norvegicus
ggtgacctagcagacttcctgaagt

SEQ ID NO: 467858 - DNA, 25 bp, Rattus norvegicus
ggtgacctatgtcagcctgcaattc

SEQ ID NO: 467859 - DNA, 25 bp, Rattus norvegicus
ggtgacctatgtgagcctgcaattc

SEQ ID NO: 467860 - DNA, 25 bp, Rattus norvegicus
ggtgacctcacacatccttctgtac

SEQ ID NO: 467861 - DNA, 25 bp, Rattus norvegicus
ggtgacctcacagatccttctgtac

SEQ ID NO: 467862 - DNA, 25 bp, Rattus norvegicus
ggtgacctcactacagagcagactt

SEQ ID NO: 467863 - DNA, 25 bp, Rattus norvegicus
ggtgacctcacttcagagcagactt

SEQ ID NO: 467864 - DNA, 25 bp, Rattus norvegicus
ggtgacctcatcacctgggataaga

SEQ ID NO: 467865 - DNA, 25 bp, Rattus norvegicus
ggtgacctcatctcctgggataaga

SEQ ID NO: 467866 - DNA, 25 bp, Rattus norvegicus
ggtgacctcattaggaccttcatac

SEQ ID NO: 467867 - DNA, 25 bp, Rattus norvegicus
ggtgacctcatttggaccttcatac

SEQ ID NO: 467868 - DNA, 25 bp, Rattus norvegicus
ggtgacctccaacatttagccagtg

SEQ ID NO: 467869 - DNA, 25 bp, Rattus norvegicus
ggtgacctccaagatttagccagtg

SEQ ID NO: 467870 - DNA, 25 bp, Rattus norvegicus
ggtgacctcctaagaacatcagctt

SEQ ID NO: 467871 - DNA, 25 bp, Rattus norvegicus
ggtgacctcctatgaacatcagctt

SEQ ID NO: 467872 - DNA, 25 bp, Rattus norvegicus
ggtgacctctcacttgtactgagaa

SEQ ID NO: 467873 - DNA, 25 bp, Rattus norvegicus
ggtgacctctcagttgtactgagaa

SEQ ID NO: 467874 - DNA, 25 bp, Rattus norvegicus
ggtgacctctccacataaagatttg

SEQ ID NO: 467875 - DNA, 25 bp, Rattus norvegicus
ggtgacctctcctcataaagatttg

SEQ ID NO: 467876 - DNA, 25 bp, Rattus norvegicus
ggtgacctgaaccaattcctcagtg

SEQ ID NO: 467877 - DNA, 25 bp, Rattus norvegicus
ggtgacctgaacgaattcctcagtg

SEQ ID NO: 467878 - DNA, 25 bp, Rattus norvegicus
ggtgacctggagaccttgaacactt

SEQ ID NO: 467879 - DNA, 25 bp, Rattus norvegicus
ggtgacctggagtccttgaacactt

SEQ ID NO: 467880 - DNA, 25 bp, Rattus norvegicus
ggtgacctgtagacgagctgatgct

SEQ ID NO: 467881 - DNA, 25 bp, Rattus norvegicus
ggtgacctgtagtcgagctgatgct

SEQ ID NO: 467882 - DNA, 25 bp, Rattus norvegicus
ggtgacctgtctaaatgttgaccta

SEQ ID NO: 467883 - DNA, 25 bp, Rattus norvegicus
ggtgacctgtcttaatgttgaccta

SEQ ID NO: 467884 - DNA, 25 bp, Rattus norvegicus
ggtgacctgtgaatatgcctgaaac

SEQ ID NO: 467885 - DNA, 25 bp, Rattus norvegicus
ggtgacctgtgattatgcctgaaac

SEQ ID NO: 467886 - DNA, 25 bp, Rattus norvegicus
ggtgaccttctgagagacactagtt

SEQ ID NO: 467887 - DNA, 25 bp, Rattus norvegicus
ggtgaccttctgtgagacactagtt

SEQ ID NO: 467888 - DNA, 25 bp, Rattus norvegicus
ggtgacctttatcaagtggcgagtt

SEQ ID NO: 467889 - DNA, 25 bp, Rattus norvegicus
ggtgacctttatgaagtggcgagtt

SEQ ID NO: 467890 - DNA, 25 bp, Rattus norvegicus
ggtgacgacatcctcgatgaccaga

SEQ ID NO: 467891 - DNA, 25 bp, Rattus norvegicus
ggtgacgacatcgtcgatgaccaga

SEQ ID NO: 467892 - DNA, 25 bp, Rattus norvegicus
ggtgacgcagcccttgcactcgatg

SEQ ID NO: 467893 - DNA, 25 bp, Rattus norvegicus
ggtgacgcagccgttgcactcgatg

SEQ ID NO: 467894 - DNA, 25 bp, Rattus norvegicus
ggtgacgcagctcaagtgcccttga

SEQ ID NO: 467895 - DNA, 25 bp, Rattus norvegicus
ggtgacgcagctgaagtgcccttga

SEQ ID NO: 467896 - DNA, 25 bp, Rattus norvegicus
ggtgacgccaaaatgtccttaggaa

SEQ ID NO: 467897 - DNA, 25 bp, Rattus norvegicus
ggtgacgccaaattgtccttaggaa

SEQ ID NO: 467898 - DNA, 25 bp, Rattus norvegicus
ggtgacgccgaacatgtttactaca

SEQ ID NO: 467899 - DNA, 25 bp, Rattus norvegicus
ggtgacgccgaagatgtttactaca

SEQ ID NO: 467900 - DNA, 25 bp, Rattus norvegicus
ggtgacggtcgtatttagccatctg

SEQ ID NO: 467901 - DNA, 25 bp, Rattus norvegicus
ggtgacggtcgtttttagccatctg

SEQ ID NO: 467902 - DNA, 25 bp, Rattus norvegicus
ggtgacgtcagtcaaaagacaacat

SEQ ID NO: 467903 - DNA, 25 bp, Rattus norvegicus
ggtgacgtcagtgaaaagacaacat

SEQ ID NO: 467904 - DNA, 25 bp, Rattus norvegicus
ggtgacgtccacacgtgagagccgt

SEQ ID NO: 467905 - DNA, 25 bp, Rattus norvegicus
ggtgacgtccactcgtgagagccgt

SEQ ID NO: 467906 - DNA, 25 bp, Rattus norvegicus
ggtgacgtccttcctctgaataaag

SEQ ID NO: 467907 - DNA, 25 bp, Rattus norvegicus
ggtgacgtccttgctctgaataaag

SEQ ID NO: 467908 - DNA, 25 bp, Rattus norvegicus
ggtgacgtctgcaagttttgaaact

SEQ ID NO: 467909 - DNA, 25 bp, Rattus norvegicus
ggtgacgtctgctagttttgaaact

SEQ ID NO: 467910 - DNA, 25 bp, Rattus norvegicus
ggtgacgtcttaagccttgcaggaa

SEQ ID NO: 467911 - DNA, 25 bp, Rattus norvegicus
ggtgacgtcttatgccttgcaggaa

SEQ ID NO: 467912 - DNA, 25 bp, Rattus norvegicus
ggtgacgtgattcattcagtatctt

SEQ ID NO: 467913 - DNA, 25 bp, Rattus norvegicus
ggtgacgtgattgattcagtatctt

SEQ ID NO: 467914 - DNA, 25 bp, Rattus norvegicus
ggtgacgtgctactaactttatgtt

SEQ ID NO: 467915 - DNA, 25 bp, Rattus norvegicus
ggtgacgtgctagtaactttatgtt

SEQ ID NO: 467916 - DNA, 25 bp, Rattus norvegicus
ggtgacgtgtacatacttctgttgt

SEQ ID NO: 467917 - DNA, 25 bp, Rattus norvegicus
ggtgacgtgtacttacttctgttgt

SEQ ID NO: 467918 - DNA, 25 bp, Rattus norvegicus
ggtgacgttaagatcccaagttgtt

SEQ ID NO: 467919 - DNA, 25 bp, Rattus norvegicus
ggtgacgttaagttcccaagttgtt

SEQ ID NO: 467920 - DNA, 25 bp, Rattus norvegicus
ggtgacgttggaaccattccacact

SEQ ID NO: 467921 - DNA, 25 bp, Rattus norvegicus
ggtgacgttggatccattccacact

SEQ ID NO: 467922 - DNA, 25 bp, Rattus norvegicus
ggtgactacaaaccgaggccccagt

SEQ ID NO: 467923 - DNA, 25 bp, Rattus norvegicus
ggtgactacaaagcgaggccccagt

SEQ ID NO: 467924 - DNA, 25 bp, Rattus norvegicus
ggtgactaccacatcgatgtctgta

SEQ ID NO: 467925 - DNA, 25 bp, Rattus norvegicus
ggtgactaccacttcgatgtctgta

SEQ ID NO: 467926 - DNA, 25 bp, Rattus norvegicus
ggtgactactgcctggtcctgaagc

SEQ ID NO: 467927 - DNA, 25 bp, Rattus norvegicus
ggtgactactgcgtggtcctgaagc

SEQ ID NO: 467928 - DNA, 25 bp, Rattus norvegicus
ggtgactacttcctgatctaaactg

SEQ ID NO: 467929 - DNA, 25 bp, Rattus norvegicus
ggtgactacttcgtgatctaaactg

SEQ ID NO: 467930 - DNA, 25 bp, Rattus norvegicus
ggtgactatgtcaaactccatctat

SEQ ID NO: 467931 - DNA, 25 bp, Rattus norvegicus
ggtgactatgtctaactccatctat

SEQ ID NO: 467932 - DNA, 25 bp, Rattus norvegicus
ggtgactcaactaagaccttacgtt

SEQ ID NO: 467933 - DNA, 25 bp, Rattus norvegicus
ggtgactcaacttagaccttacgtt

SEQ ID NO: 467934 - DNA, 25 bp, Rattus norvegicus
ggtgactcaccccagagccgatgtt

SEQ ID NO: 467935 - DNA, 25 bp, Rattus norvegicus
ggtgactcacccgagagccgatgtt

SEQ ID NO: 467936 - DNA, 25 bp, Rattus norvegicus
ggtgactcacctccagagtgaaagt

SEQ ID NO: 467937 - DNA, 25 bp, Rattus norvegicus
ggtgactcacctgcagagtgaaagt

SEQ ID NO: 467938 - DNA, 25 bp, Rattus norvegicus
ggtgactcacttcctgcaggcagga

SEQ ID NO: 467939 - DNA, 25 bp, Rattus norvegicus
ggtgactcacttgctgcaggcagga

SEQ ID NO: 467940 - DNA, 25 bp, Rattus norvegicus
ggtgactcagaaagctgtgggttct

SEQ ID NO: 467941 - DNA, 25 bp, Rattus norvegicus
ggtgactcagaacgtcctgttccaa

SEQ ID NO: 467942 - DNA, 25 bp, Rattus norvegicus
ggtgactcagaaggtcctgttccaa

SEQ ID NO: 467943 - DNA, 25 bp, Rattus norvegicus
ggtgactcagaatgctgtgggttct

SEQ ID NO: 467944 - DNA, 25 bp, Rattus norvegicus
ggtgactcatgccaacactcaggaa

SEQ ID NO: 467945 - DNA, 25 bp, Rattus norvegicus
ggtgactcatgcgaacactcaggaa

SEQ ID NO: 467946 - DNA, 25 bp, Rattus norvegicus
ggtgactcctagcagtttggactat

SEQ ID NO: 467947 - DNA, 25 bp, Rattus norvegicus
ggtgactcctaggagtttggactat

SEQ ID NO: 467948 - DNA, 25 bp, Rattus norvegicus
ggtgactcgtacagtgaacacggca

SEQ ID NO: 467949 - DNA, 25 bp, Rattus norvegicus
ggtgactcgtactgtgaacacggca

SEQ ID NO: 467950 - DNA, 25 bp, Rattus norvegicus
ggtgactctcaaactgccaaacatg

SEQ ID NO: 467951 - DNA, 25 bp, Rattus norvegicus
ggtgactctcaatctgccaaacatg

SEQ ID NO: 467952 - DNA, 25 bp, Rattus norvegicus
ggtgactctgaactctgcaaccgaa

SEQ ID NO: 467953 - DNA, 25 bp, Rattus norvegicus
ggtgactctgaagtctgcaaccgaa

SEQ ID NO: 467954 - DNA, 25 bp, Rattus norvegicus
ggtgactctttaatttcaactgtaa

SEQ ID NO: 467955 - DNA, 25 bp, Rattus norvegicus
ggtgactctttattttcaactgtaa

SEQ ID NO: 467956 - DNA, 25 bp, Rattus norvegicus
ggtgactgaactattcaggccacag

SEQ ID NO: 467957 - DNA, 25 bp, Rattus norvegicus
ggtgactgaacttttcaggccacag

SEQ ID NO: 467958 - DNA, 25 bp, Rattus norvegicus
ggtgactgacccaagacaatctgag

SEQ ID NO: 467959 - DNA, 25 bp, Rattus norvegicus
ggtgactgaccctagacaatctgag

SEQ ID NO: 467960 - DNA, 25 bp, Rattus norvegicus
ggtgactgcgacatccatattagta

SEQ ID NO: 467961 - DNA, 25 bp, Rattus norvegicus
ggtgactgcgacttccatattagta

SEQ ID NO: 467962 - DNA, 25 bp, Rattus norvegicus
ggtgactgctatcaaagggtcatat

SEQ ID NO: 467963 - DNA, 25 bp, Rattus norvegicus
ggtgactgctatgaaagggtcatat

SEQ ID NO: 467964 - DNA, 25 bp, Rattus norvegicus
ggtgactggactagtgcatgtgccc

SEQ ID NO: 467965 - DNA, 25 bp, Rattus norvegicus
ggtgactggacttgtgcatgtgccc

SEQ ID NO: 467966 - DNA, 25 bp, Rattus norvegicus
ggtgactgggccagatgtcccaaga

SEQ ID NO: 467967 - DNA, 25 bp, Rattus norvegicus
ggtgactgggcctgatgtcccaaga

SEQ ID NO: 467968 - DNA, 25 bp, Rattus norvegicus
ggtgactgtaagctgggtattttcc

SEQ ID NO: 467969 - DNA, 25 bp, Rattus norvegicus
ggtgactgtaaggtgggtattttcc

SEQ ID NO: 467970 - DNA, 25 bp, Rattus norvegicus
ggtgactgtattactctccatagta

SEQ ID NO: 467971 - DNA, 25 bp, Rattus norvegicus
ggtgactgtatttctctccatagta

SEQ ID NO: 467972 - DNA, 25 bp, Rattus norvegicus
ggtgactgtcccaaaattaactgag

SEQ ID NO: 467973 - DNA, 25 bp, Rattus norvegicus
ggtgactgtccctaaattaactgag

SEQ ID NO: 467974 - DNA, 25 bp, Rattus norvegicus
ggtgactgtgataagccctggctac

SEQ ID NO: 467975 - DNA, 25 bp, Rattus norvegicus
ggtgactgtgattagccctggctac

SEQ ID NO: 467976 - DNA, 25 bp, Rattus norvegicus
ggtgactgtggcactgtggcccaat

SEQ ID NO: 467977 - DNA, 25 bp, Rattus norvegicus
ggtgactgtggctctgtggcccaat

SEQ ID NO: 467978 - DNA, 25 bp, Rattus norvegicus
ggtgactgttgcctgctagtaaagc

SEQ ID NO: 467979 - DNA, 25 bp, Rattus norvegicus
ggtgactgttgcgtgctagtaaagc

SEQ ID NO: 467980 - DNA, 25 bp, Rattus norvegicus
ggtgacttaagtcatggcccagact

SEQ ID NO: 467981 - DNA, 25 bp, Rattus norvegicus
ggtgacttaagtgatggcccagact

SEQ ID NO: 467982 - DNA, 25 bp, Rattus norvegicus
ggtgacttcacaagttattgtagtt

SEQ ID NO: 467983 - DNA, 25 bp, Rattus norvegicus
ggtgacttcacatgttattgtagtt

SEQ ID NO: 467984 - DNA, 25 bp, Rattus norvegicus
ggtgacttcataagatttctgtgca

SEQ ID NO: 467985 - DNA, 25 bp, Rattus norvegicus
ggtgacttcatatgatttctgtgca

SEQ ID NO: 467986 - DNA, 25 bp, Rattus norvegicus
ggtgacttcattcagagccatttgt

SEQ ID NO: 467987 - DNA, 25 bp, Rattus norvegicus
ggtgacttcattgagagccatttgt

SEQ ID NO: 467988 - DNA, 25 bp, Rattus norvegicus
ggtgacttccacctaatgagtacac

SEQ ID NO: 467989 - DNA, 25 bp, Rattus norvegicus
ggtgacttccacgtaatgagtacac

SEQ ID NO: 467990 - DNA, 25 bp, Rattus norvegicus
ggtgacttcgtcagacagcgttaga

SEQ ID NO: 467991 - DNA, 25 bp, Rattus norvegicus
ggtgacttcgtctgacagcgttaga

SEQ ID NO: 467992 - DNA, 25 bp, Rattus norvegicus
ggtgacttctaaataccagttacaa

SEQ ID NO: 467993 - DNA, 25 bp, Rattus norvegicus
ggtgacttctaattaccagttacaa

SEQ ID NO: 467994 - DNA, 25 bp, Rattus norvegicus
ggtgacttctcaccattgaagccat

SEQ ID NO: 467995 - DNA, 25 bp, Rattus norvegicus
ggtgacttctcagcattgaagccat

SEQ ID NO: 467996 - DNA, 25 bp, Rattus norvegicus
ggtgacttctggagacatagtaata

SEQ ID NO: 467997 - DNA, 25 bp, Rattus norvegicus
ggtgacttctggtgacatagtaata

SEQ ID NO: 467998 - DNA, 25 bp, Rattus norvegicus
ggtgacttctgtccctttgtgataa

SEQ ID NO: 467999 - DNA, 25 bp, Rattus norvegicus
ggtgacttctgtgcctttgtgataa

SEQ ID NO: 468000 - DNA, 25 bp, Rattus norvegicus
ggtgacttgcaacattttgtttctg

SEQ ID NO: 468001 - DNA, 25 bp, Rattus norvegicus
ggtgacttgcaagattttgtttctg

SEQ ID NO: 468002 - DNA, 25 bp, Rattus norvegicus
ggtgacttggcgcaggatttcctct

SEQ ID NO: 468003 - DNA, 25 bp, Rattus norvegicus
ggtgacttggcggaggatttcctct

SEQ ID NO: 468004 - DNA, 25 bp, Rattus norvegicus
ggtgactttctacatctgctgtgga

SEQ ID NO: 468005 - DNA, 25 bp, Rattus norvegicus
ggtgactttctagatctgctgtgga

SEQ ID NO: 468006 - DNA, 25 bp, Rattus norvegicus
ggtgagaaaaacatcctgacttgac

SEQ ID NO: 468007 - DNA, 25 bp, Rattus norvegicus
ggtgagaaaaacttcctgacttgac

SEQ ID NO: 468008 - DNA, 25 bp, Rattus norvegicus
ggtgagaacaggaccttccccaggg

SEQ ID NO: 468009 - DNA, 25 bp, Rattus norvegicus
ggtgagaacaggtccttccccaggg

SEQ ID NO: 468010 - DNA, 25 bp, Rattus norvegicus
ggtgagaaccacagcactggaggat

SEQ ID NO: 468011 - DNA, 25 bp, Rattus norvegicus
ggtgagaaccactgcactggaggat

SEQ ID NO: 468012 - DNA, 25 bp, Rattus norvegicus
ggtgagaagaaccttacttccataa

SEQ ID NO: 468013 - DNA, 25 bp, Rattus norvegicus
ggtgagaagaacgttacttccataa

SEQ ID NO: 468014 - DNA, 25 bp, Rattus norvegicus
ggtgagaagccaattgagcgtgcaa

SEQ ID NO: 468015 - DNA, 25 bp, Rattus norvegicus
ggtgagaagccatttgagcgtgcaa

SEQ ID NO: 468016 - DNA, 25 bp, Rattus norvegicus
ggtgagaagctgcagagacggccca

SEQ ID NO: 468017 - DNA, 25 bp, Rattus norvegicus
ggtgagaagctggagagacggccca

SEQ ID NO: 468018 - DNA, 25 bp, Rattus norvegicus
ggtgagacaattccatttccatgcc

SEQ ID NO: 468019 - DNA, 25 bp, Rattus norvegicus
ggtgagacaattgcatttccatgcc

SEQ ID NO: 468020 - DNA, 25 bp, Rattus norvegicus
ggtgagaccagcatacgtgaatagt

SEQ ID NO: 468021 - DNA, 25 bp, Rattus norvegicus
ggtgagaccagcttacgtgaatagt

SEQ ID NO: 468022 - DNA, 25 bp, Rattus norvegicus
ggtgagaccgcaaagcaaggccgta

SEQ ID NO: 468023 - DNA, 25 bp, Rattus norvegicus
ggtgagaccgcatagcaaggccgta

SEQ ID NO: 468024 - DNA, 25 bp, Rattus norvegicus
ggtgagactataccatcttactaca

SEQ ID NO: 468025 - DNA, 25 bp, Rattus norvegicus
ggtgagactatagcatcttactaca

SEQ ID NO: 468026 - DNA, 25 bp, Rattus norvegicus
ggtgagagcaacagttcttggaaca

SEQ ID NO: 468027 - DNA, 25 bp, Rattus norvegicus
ggtgagagcaactgttcttggaaca

SEQ ID NO: 468028 - DNA, 25 bp, Rattus norvegicus
ggtgagagcaagctgattccgcatt

SEQ ID NO: 468029 - DNA, 25 bp, Rattus norvegicus
ggtgagagcaaggtgattccgcatt

SEQ ID NO: 468030 - DNA, 25 bp, Rattus norvegicus
ggtgagagccacacattgctacaat

SEQ ID NO: 468031 - DNA, 25 bp, Rattus norvegicus
ggtgagagccactcattgctacaat

SEQ ID NO: 468032 - DNA, 25 bp, Rattus norvegicus
ggtgagaggcacaccttgacttaaa

SEQ ID NO: 468033 - DNA, 25 bp, Rattus norvegicus
ggtgagaggcactccttgacttaaa

SEQ ID NO: 468034 - DNA, 25 bp, Rattus norvegicus
ggtgagagtccaaatgctgcacttc

SEQ ID NO: 468035 - DNA, 25 bp, Rattus norvegicus
ggtgagagtccatatgctgcacttc

SEQ ID NO: 468036 - DNA, 25 bp, Rattus norvegicus
ggtgagatcactccatcagagcaca

SEQ ID NO: 468037 - DNA, 25 bp, Rattus norvegicus
ggtgagatcactgcatcagagcaca

SEQ ID NO: 468038 - DNA, 25 bp, Rattus norvegicus
ggtgagatttctaccacgtgcccag

SEQ ID NO: 468039 - DNA, 25 bp, Rattus norvegicus
ggtgagatttcttccacgtgcccag

SEQ ID NO: 468040 - DNA, 25 bp, Rattus norvegicus
ggtgagattttaccagcctctgttt

SEQ ID NO: 468041 - DNA, 25 bp, Rattus norvegicus
ggtgagattttagcagcctctgttt

SEQ ID NO: 468042 - DNA, 25 bp, Rattus norvegicus
ggtgagcaccatcttatctgaagga

SEQ ID NO: 468043 - DNA, 25 bp, Rattus norvegicus
ggtgagcaccatgttatctgaagga

SEQ ID NO: 468044 - DNA, 25 bp, Rattus norvegicus
ggtgagcacccaacatagtcacaga

SEQ ID NO: 468045 - DNA, 25 bp, Rattus norvegicus
ggtgagcacccatcatagtcacaga

SEQ ID NO: 468046 - DNA, 25 bp, Rattus norvegicus
ggtgagcactgacaaggctcctcct

SEQ ID NO: 468047 - DNA, 25 bp, Rattus norvegicus
ggtgagcactgagaaggctcctcct

SEQ ID NO: 468048 - DNA, 25 bp, Rattus norvegicus
ggtgagcagcaaacaggctcccagt

SEQ ID NO: 468049 - DNA, 25 bp, Rattus norvegicus
ggtgagcagcaatcaggctcccagt

SEQ ID NO: 468050 - DNA, 25 bp, Rattus norvegicus
ggtgagcaggtgaccacgagcatct

SEQ ID NO: 468051 - DNA, 25 bp, Rattus norvegicus
ggtgagcaggtgactttacccacac

SEQ ID NO: 468052 - DNA, 25 bp, Rattus norvegicus
ggtgagcaggtgtccacgagcatct

SEQ ID NO: 468053 - DNA, 25 bp, Rattus norvegicus
ggtgagcaggtgtctttacccacac

SEQ ID NO: 468054 - DNA, 25 bp, Rattus norvegicus
ggtgagcattctcaggagcgtccat

SEQ ID NO: 468055 - DNA, 25 bp, Rattus norvegicus
ggtgagcattctgaggagcgtccat

SEQ ID NO: 468056 - DNA, 25 bp, Rattus norvegicus
ggtgagcattgcctcaacgtgctgc

SEQ ID NO: 468057 - DNA, 25 bp, Rattus norvegicus
ggtgagcattgcgtcaacgtgctgc

SEQ ID NO: 468058 - DNA, 25 bp, Rattus norvegicus
ggtgagccagtaagttgacattgtt

SEQ ID NO: 468059 - DNA, 25 bp, Rattus norvegicus
ggtgagccagtatgttgacattgtt

SEQ ID NO: 468060 - DNA, 25 bp, Rattus norvegicus
ggtgagcccaccagtgaggattact

SEQ ID NO: 468061 - DNA, 25 bp, Rattus norvegicus
ggtgagcccacctgtgaggattact

SEQ ID NO: 468062 - DNA, 25 bp, Rattus norvegicus
ggtgagccccaacatgcaggaggcc

SEQ ID NO: 468063 - DNA, 25 bp, Rattus norvegicus
ggtgagccccaagatgcaggaggcc

SEQ ID NO: 468064 - DNA, 25 bp, Rattus norvegicus
ggtgagcctatgcacagacaatatt

SEQ ID NO: 468065 - DNA, 25 bp, Rattus norvegicus
ggtgagcctatggacagacaatatt

SEQ ID NO: 468066 - DNA, 25 bp, Rattus norvegicus
ggtgagcgaaggatacttcccggat

SEQ ID NO: 468067 - DNA, 25 bp, Rattus norvegicus
ggtgagcgaaggttacttcccggat

SEQ ID NO: 468068 - DNA, 25 bp, Rattus norvegicus
ggtgagcgcactacctatataggtc

SEQ ID NO: 468069 - DNA, 25 bp, Rattus norvegicus
ggtgagcgcacttcctatataggtc

SEQ ID NO: 468070 - DNA, 25 bp, Rattus norvegicus
ggtgagcgctgcacactgcacatga

SEQ ID NO: 468071 - DNA, 25 bp, Rattus norvegicus
ggtgagcgctgctcactgcacatga

SEQ ID NO: 468072 - DNA, 25 bp, Rattus norvegicus
ggtgagctactaacgtctgcagatt

SEQ ID NO: 468073 - DNA, 25 bp, Rattus norvegicus
ggtgagctactatcgtctgcagatt

SEQ ID NO: 468074 - DNA, 25 bp, Rattus norvegicus
ggtgagctacttcattattgagcca

SEQ ID NO: 468075 - DNA, 25 bp, Rattus norvegicus
ggtgagctacttgattattgagcca

SEQ ID NO: 468076 - DNA, 25 bp, Rattus norvegicus
ggtgagctcactctcattccggatc

SEQ ID NO: 468077 - DNA, 25 bp, Rattus norvegicus
ggtgagctcactgtcattccggatc

SEQ ID NO: 468078 - DNA, 25 bp, Rattus norvegicus
ggtgagctcttgatcttaaatttgg

SEQ ID NO: 468079 - DNA, 25 bp, Rattus norvegicus
ggtgagctcttgttcttaaatttgg

SEQ ID NO: 468080 - DNA, 25 bp, Rattus norvegicus
ggtgagctgaggatacaactttaca

SEQ ID NO: 468081 - DNA, 25 bp, Rattus norvegicus
ggtgagctgaggttacaactttaca

SEQ ID NO: 468082 - DNA, 25 bp, Rattus norvegicus
ggtgagctggtgattgcccgaattc

SEQ ID NO: 468083 - DNA, 25 bp, Rattus norvegicus
ggtgagctggtgtttgcccgaattc

SEQ ID NO: 468084 - DNA, 25 bp, Rattus norvegicus
ggtgagcttatgaccctgccctttg

SEQ ID NO: 468085 - DNA, 25 bp, Rattus norvegicus
ggtgagcttatgtccctgccctttg

SEQ ID NO: 468086 - DNA, 25 bp, Rattus norvegicus
ggtgagctttttccagacatgtgta

SEQ ID NO: 468087 - DNA, 25 bp, Rattus norvegicus
ggtgagctttttgcagacatgtgta

SEQ ID NO: 468088 - DNA, 25 bp, Rattus norvegicus
ggtgaggaactacatttgtctccac

SEQ ID NO: 468089 - DNA, 25 bp, Rattus norvegicus
ggtgaggaactagatttgtctccac

SEQ ID NO: 468090 - DNA, 25 bp, Rattus norvegicus
ggtgaggaccttctgtctcaaacac

SEQ ID NO: 468091 - DNA, 25 bp, Rattus norvegicus
ggtgaggaccttgtgtctcaaacac

SEQ ID NO: 468092 - DNA, 25 bp, Rattus norvegicus
ggtgaggactgtatgtacctctcca

SEQ ID NO: 468093 - DNA, 25 bp, Rattus norvegicus
ggtgaggactgtttgtacctctcca

SEQ ID NO: 468094 - DNA, 25 bp, Rattus norvegicus
ggtgaggagctaagacctcccagag

SEQ ID NO: 468095 - DNA, 25 bp, Rattus norvegicus
ggtgaggagctatgacctcccagag

SEQ ID NO: 468096 - DNA, 25 bp, Rattus norvegicus
ggtgaggagtacagaacctccccac

SEQ ID NO: 468097 - DNA, 25 bp, Rattus norvegicus
ggtgaggagtactgaacctccccac

SEQ ID NO: 468098 - DNA, 25 bp, Rattus norvegicus
ggtgaggagttgaccccggagccca

SEQ ID NO: 468099 - DNA, 25 bp, Rattus norvegicus
ggtgaggagttgtccccggagccca

SEQ ID NO: 468100 - DNA, 25 bp, Rattus norvegicus
ggtgaggcacatctaccactgcata

SEQ ID NO: 468101 - DNA, 25 bp, Rattus norvegicus
ggtgaggcacatgtaccactgcata

SEQ ID NO: 468102 - DNA, 25 bp, Rattus norvegicus
ggtgaggcctgacccaatgccattt

SEQ ID NO: 468103 - DNA, 25 bp, Rattus norvegicus
ggtgaggcctgagccaatgccattt

SEQ ID NO: 468104 - DNA, 25 bp, Rattus norvegicus
ggtgaggctctacgaatacttcctt

SEQ ID NO: 468105 - DNA, 25 bp, Rattus norvegicus
ggtgaggctctaggaatacttcctt

SEQ ID NO: 468106 - DNA, 25 bp, Rattus norvegicus
ggtgagggccctcgcaccactatca

SEQ ID NO: 468107 - DNA, 25 bp, Rattus norvegicus
ggtgagggccctggcaccactatca

SEQ ID NO: 468108 - DNA, 25 bp, Rattus norvegicus
ggtgagggccgcactctgtatgtct

SEQ ID NO: 468109 - DNA, 25 bp, Rattus norvegicus
ggtgagggccgctctctgtatgtct

SEQ ID NO: 468110 - DNA, 25 bp, Rattus norvegicus
ggtgagggtcctaaaacatccaagt

SEQ ID NO: 468111 - DNA, 25 bp, Rattus norvegicus
ggtgagggtccttaaacatccaagt

SEQ ID NO: 468112 - DNA, 25 bp, Rattus norvegicus
ggtgagggttaaagtgctcctgtcc

SEQ ID NO: 468113 - DNA, 25 bp, Rattus norvegicus
ggtgagggttaatgtgctcctgtcc

SEQ ID NO: 468114 - DNA, 25 bp, Rattus norvegicus
ggtgaggtactcatgggatcctaca

SEQ ID NO: 468115 - DNA, 25 bp, Rattus norvegicus
ggtgaggtactcttgggatcctaca

SEQ ID NO: 468116 - DNA, 25 bp, Rattus norvegicus
ggtgaggtcctgctgaacattctga

SEQ ID NO: 468117 - DNA, 25 bp, Rattus norvegicus
ggtgaggtcctggtgaacattctga

SEQ ID NO: 468118 - DNA, 25 bp, Rattus norvegicus
ggtgaggtgaccaatgacttcatca

SEQ ID NO: 468119 - DNA, 25 bp, Rattus norvegicus
ggtgaggtgacctatgacttcatca

SEQ ID NO: 468120 - DNA, 25 bp, Rattus norvegicus
ggtgaggtggtcagcattccagcct

SEQ ID NO: 468121 - DNA, 25 bp, Rattus norvegicus
ggtgaggtggtctgcattccagcct

SEQ ID NO: 468122 - DNA, 25 bp, Rattus norvegicus
ggtgaggttattctgctagaattct

SEQ ID NO: 468123 - DNA, 25 bp, Rattus norvegicus
ggtgaggttattgtgctagaattct

SEQ ID NO: 468124 - DNA, 25 bp, Rattus norvegicus
ggtgaggtttatcctacgactccct

SEQ ID NO: 468125 - DNA, 25 bp, Rattus norvegicus
ggtgaggtttatgctacgactccct

SEQ ID NO: 468126 - DNA, 25 bp, Rattus norvegicus
ggtgagtattatacctaccattacc

SEQ ID NO: 468127 - DNA, 25 bp, Rattus norvegicus
ggtgagtattattcctaccattacc

SEQ ID NO: 468128 - DNA, 25 bp, Rattus norvegicus
ggtgagtcactacttcagagcttta

SEQ ID NO: 468129 - DNA, 25 bp, Rattus norvegicus
ggtgagtcactagttcagagcttta

SEQ ID NO: 468130 - DNA, 25 bp, Rattus norvegicus
ggtgagtcagaccatccttgatgtt

SEQ ID NO: 468131 - DNA, 25 bp, Rattus norvegicus
ggtgagtcagacgatccttgatgtt

SEQ ID NO: 468132 - DNA, 25 bp, Rattus norvegicus
ggtgagtcctcaatgatttctttgc

SEQ ID NO: 468133 - DNA, 25 bp, Rattus norvegicus
ggtgagtcctcattgatttctttgc

SEQ ID NO: 468134 - DNA, 25 bp, Rattus norvegicus
ggtgagtcggacagtgtacacactg

SEQ ID NO: 468135 - DNA, 25 bp, Rattus norvegicus
ggtgagtcggactgtgtacacactg

SEQ ID NO: 468136 - DNA, 25 bp, Rattus norvegicus
ggtgagtctcagattggcctgacta

SEQ ID NO: 468137 - DNA, 25 bp, Rattus norvegicus
ggtgagtctcagtttggcctgacta

SEQ ID NO: 468138 - DNA, 25 bp, Rattus norvegicus
ggtgagtgtgctaatccttagggtc

SEQ ID NO: 468139 - DNA, 25 bp, Rattus norvegicus
ggtgagtgtgcttatccttagggtc

SEQ ID NO: 468140 - DNA, 25 bp, Rattus norvegicus
ggtgagttattaacctcctgtttcc

SEQ ID NO: 468141 - DNA, 25 bp, Rattus norvegicus
ggtgagttattatcctcctgtttcc

SEQ ID NO: 468142 - DNA, 25 bp, Rattus norvegicus
ggtgagttctctagtcaatgtcatt

SEQ ID NO: 468143 - DNA, 25 bp, Rattus norvegicus
ggtgagttctcttgtcaatgtcatt

SEQ ID NO: 468144 - DNA, 25 bp, Rattus norvegicus
ggtgagttcttcaatacctttgtct

SEQ ID NO: 468145 - DNA, 25 bp, Rattus norvegicus
ggtgagttcttctatacctttgtct

SEQ ID NO: 468146 - DNA, 25 bp, Rattus norvegicus
ggtgagttgaaaccacactgtatca

SEQ ID NO: 468147 - DNA, 25 bp, Rattus norvegicus
ggtgagttgaaagcacactgtatca

SEQ ID NO: 468148 - DNA, 25 bp, Rattus norvegicus
ggtgagttgctgaccctgcaggact

SEQ ID NO: 468149 - DNA, 25 bp, Rattus norvegicus
ggtgagttgctgtccctgcaggact

SEQ ID NO: 468150 - DNA, 25 bp, Rattus norvegicus
ggtgagtttgttccccagtttaaat

SEQ ID NO: 468151 - DNA, 25 bp, Rattus norvegicus
ggtgagtttgttgcccagtttaaat

SEQ ID NO: 468152 - DNA, 25 bp, Rattus norvegicus
ggtgagtttttcctgatttgccaga

SEQ ID NO: 468153 - DNA, 25 bp, Rattus norvegicus
ggtgagtttttcgtgatttgccaga

SEQ ID NO: 468154 - DNA, 25 bp, Rattus norvegicus
ggtgataaccagactattctgcgta

SEQ ID NO: 468155 - DNA, 25 bp, Rattus norvegicus
ggtgataaccagtctattctgcgta

SEQ ID NO: 468156 - DNA, 25 bp, Rattus norvegicus
ggtgataactaaaaactgtctcctc

SEQ ID NO: 468157 - DNA, 25 bp, Rattus norvegicus
ggtgataactaataactgtctcctc

SEQ ID NO: 468158 - DNA, 25 bp, Rattus norvegicus
ggtgatacagctcatcattacctat

SEQ ID NO: 468159 - DNA, 25 bp, Rattus norvegicus
ggtgatacagctgatcattacctat

SEQ ID NO: 468160 - DNA, 25 bp, Rattus norvegicus
ggtgatacaggaaggcttttctttc

SEQ ID NO: 468161 - DNA, 25 bp, Rattus norvegicus
ggtgatacaggatggcttttctttc

SEQ ID NO: 468162 - DNA, 25 bp, Rattus norvegicus
ggtgatacattcctttgggaccagt

SEQ ID NO: 468163 - DNA, 25 bp, Rattus norvegicus
ggtgatacattcgtttgggaccagt

SEQ ID NO: 468164 - DNA, 25 bp, Rattus norvegicus
ggtgataccagcactgatatgcaaa

SEQ ID NO: 468165 - DNA, 25 bp, Rattus norvegicus
ggtgataccagctctgatatgcaaa

SEQ ID NO: 468166 - DNA, 25 bp, Rattus norvegicus
ggtgatacccaacaaatatatatct

SEQ ID NO: 468167 - DNA, 25 bp, Rattus norvegicus
ggtgatacccaagaaatatatatct

SEQ ID NO: 468168 - DNA, 25 bp, Rattus norvegicus
ggtgatacctcaaggacattgctcc

SEQ ID NO: 468169 - DNA, 25 bp, Rattus norvegicus
ggtgatacctcatggacattgctcc

SEQ ID NO: 468170 - DNA, 25 bp, Rattus norvegicus
ggtgataccttgatgaatcattgaa

SEQ ID NO: 468171 - DNA, 25 bp, Rattus norvegicus
ggtgataccttgttgaatcattgaa

SEQ ID NO: 468172 - DNA, 25 bp, Rattus norvegicus
ggtgatacgcttacatttccgaatg

SEQ ID NO: 468173 - DNA, 25 bp, Rattus norvegicus
ggtgatacgctttcatttccgaatg

SEQ ID NO: 468174 - DNA, 25 bp, Rattus norvegicus
ggtgatactctgaaagaactcctag

SEQ ID NO: 468175 - DNA, 25 bp, Rattus norvegicus
ggtgatactctgtaagaactcctag

SEQ ID NO: 468176 - DNA, 25 bp, Rattus norvegicus
ggtgatactgcaatagtttcccttt

SEQ ID NO: 468177 - DNA, 25 bp, Rattus norvegicus
ggtgatactgcattagtttcccttt

SEQ ID NO: 468178 - DNA, 25 bp, Rattus norvegicus
ggtgatactgtcagtctccaaacag

SEQ ID NO: 468179 - DNA, 25 bp, Rattus norvegicus
ggtgatactgtctgtctccaaacag

SEQ ID NO: 468180 - DNA, 25 bp, Rattus norvegicus
ggtgatagcaacctttgaccccaag

SEQ ID NO: 468181 - DNA, 25 bp, Rattus norvegicus
ggtgatagcaacgtttgaccccaag

SEQ ID NO: 468182 - DNA, 25 bp, Rattus norvegicus
ggtgatagcatacgcctttaatccc

SEQ ID NO: 468183 - DNA, 25 bp, Rattus norvegicus
ggtgatagcataggcctttaatccc

SEQ ID NO: 468184 - DNA, 25 bp, Rattus norvegicus
ggtgatagcgtgaagagcttttctc

SEQ ID NO: 468185 - DNA, 25 bp, Rattus norvegicus
ggtgatagcgtgtagagcttttctc

SEQ ID NO: 468186 - DNA, 25 bp, Rattus norvegicus
ggtgatagctgtaggctgactgcca

SEQ ID NO: 468187 - DNA, 25 bp, Rattus norvegicus
ggtgatagctgttggctgactgcca

SEQ ID NO: 468188 - DNA, 25 bp, Rattus norvegicus
ggtgatagtgagcaacttcccaaaa

SEQ ID NO: 468189 - DNA, 25 bp, Rattus norvegicus
ggtgatagtgaggaacttcccaaaa

SEQ ID NO: 468190 - DNA, 25 bp, Rattus norvegicus
ggtgatatacctattctgaagagta

SEQ ID NO: 468191 - DNA, 25 bp, Rattus norvegicus
ggtgatataccttttctgaagagta

SEQ ID NO: 468192 - DNA, 25 bp, Rattus norvegicus
ggtgatatcccaaggaacccgccat

SEQ ID NO: 468193 - DNA, 25 bp, Rattus norvegicus
ggtgatatcccatggaacccgccat

SEQ ID NO: 468194 - DNA, 25 bp, Rattus norvegicus
ggtgatatctccagaagttctttgt

SEQ ID NO: 468195 - DNA, 25 bp, Rattus norvegicus
ggtgatatctcctgaagttctttgt

SEQ ID NO: 468196 - DNA, 25 bp, Rattus norvegicus
ggtgatattacaagcctggctctaa

SEQ ID NO: 468197 - DNA, 25 bp, Rattus norvegicus
ggtgatattacatgcctggctctaa

SEQ ID NO: 468198 - DNA, 25 bp, Rattus norvegicus
ggtgatattccaatcaataggcatt

SEQ ID NO: 468199 - DNA, 25 bp, Rattus norvegicus
ggtgatattccattcaataggcatt

SEQ ID NO: 468200 - DNA, 25 bp, Rattus norvegicus
ggtgatattcctatgtccatttttc

SEQ ID NO: 468201 - DNA, 25 bp, Rattus norvegicus
ggtgatattcctttgtccatttttc

SEQ ID NO: 468202 - DNA, 25 bp, Rattus norvegicus
ggtgatcaaaacacgtctttatctt

SEQ ID NO: 468203 - DNA, 25 bp, Rattus norvegicus
ggtgatcaaaactcgtctttatctt

SEQ ID NO: 468204 - DNA, 25 bp, Rattus norvegicus
ggtgatcaaagcaggaccccactgt

SEQ ID NO: 468205 - DNA, 25 bp, Rattus norvegicus
ggtgatcaaagctggaccccactgt

SEQ ID NO: 468206 - DNA, 25 bp, Rattus norvegicus
ggtgatcaaatgaagccgagcagcc

SEQ ID NO: 468207 - DNA, 25 bp, Rattus norvegicus
ggtgatcaaatgtagccgagcagcc

SEQ ID NO: 468208 - DNA, 25 bp, Rattus norvegicus
ggtgatcaacttcctttgttttctt

SEQ ID NO: 468209 - DNA, 25 bp, Rattus norvegicus
ggtgatcaacttgctttgttttctt

SEQ ID NO: 468210 - DNA, 25 bp, Rattus norvegicus
ggtgatcaagatccccatggtagat

SEQ ID NO: 468211 - DNA, 25 bp, Rattus norvegicus
ggtgatcaagatgcccatggtagat

SEQ ID NO: 468212 - DNA, 25 bp, Rattus norvegicus
ggtgatcaagtgacgcaatctcaaa

SEQ ID NO: 468213 - DNA, 25 bp, Rattus norvegicus
ggtgatcaagtgtcgcaatctcaaa

SEQ ID NO: 468214 - DNA, 25 bp, Rattus norvegicus
ggtgatcacatactacgaccggacc

SEQ ID NO: 468215 - DNA, 25 bp, Rattus norvegicus
ggtgatcacatagtacgaccggacc

SEQ ID NO: 468216 - DNA, 25 bp, Rattus norvegicus
ggtgatcaccttaagctcagacgat

SEQ ID NO: 468217 - DNA, 25 bp, Rattus norvegicus
ggtgatcacctttagctcagacgat

SEQ ID NO: 468218 - DNA, 25 bp, Rattus norvegicus
ggtgatcactcactttacacatcta

SEQ ID NO: 468219 - DNA, 25 bp, Rattus norvegicus
ggtgatcactcagtttacacatcta

SEQ ID NO: 468220 - DNA, 25 bp, Rattus norvegicus
ggtgatcactgactacttttcccac

SEQ ID NO: 468221 - DNA, 25 bp, Rattus norvegicus
ggtgatcactgagtacttttcccac

SEQ ID NO: 468222 - DNA, 25 bp, Rattus norvegicus
ggtgatcagccaatcagcactagct

SEQ ID NO: 468223 - DNA, 25 bp, Rattus norvegicus
ggtgatcagccattcagcactagct

SEQ ID NO: 468224 - DNA, 25 bp, Rattus norvegicus
ggtgatcaggcaccttcacacagct

SEQ ID NO: 468225 - DNA, 25 bp, Rattus norvegicus
ggtgatcaggcagcttcacacagct

SEQ ID NO: 468226 - DNA, 25 bp, Rattus norvegicus
ggtgatcatgaaactgttcccacag

SEQ ID NO: 468227 - DNA, 25 bp, Rattus norvegicus
ggtgatcatgaatctgttcccacag

SEQ ID NO: 468228 - DNA, 25 bp, Rattus norvegicus
ggtgatcatgtgacatcaaaagctc

SEQ ID NO: 468229 - DNA, 25 bp, Rattus norvegicus
ggtgatcatgtgcttactgttttta

SEQ ID NO: 468230 - DNA, 25 bp, Rattus norvegicus
ggtgatcatgtggttactgttttta

SEQ ID NO: 468231 - DNA, 25 bp, Rattus norvegicus
ggtgatcatgtgtcatcaaaagctc

SEQ ID NO: 468232 - DNA, 25 bp, Rattus norvegicus
ggtgatcattctaacagcctgtggg

SEQ ID NO: 468233 - DNA, 25 bp, Rattus norvegicus
ggtgatcattcttacagcctgtggg

SEQ ID NO: 468234 - DNA, 25 bp, Rattus norvegicus
ggtgatccacacattgcctatgagt

SEQ ID NO: 468235 - DNA, 25 bp, Rattus norvegicus
ggtgatccacactttgcctatgagt

SEQ ID NO: 468236 - DNA, 25 bp, Rattus norvegicus
ggtgatccagaactcctgaggaccc

SEQ ID NO: 468237 - DNA, 25 bp, Rattus norvegicus
ggtgatccagaagtcctgaggaccc

SEQ ID NO: 468238 - DNA, 25 bp, Rattus norvegicus
ggtgatccatgtatactgaaggctg

SEQ ID NO: 468239 - DNA, 25 bp, Rattus norvegicus
ggtgatccatgtttactgaaggctg

SEQ ID NO: 468240 - DNA, 25 bp, Rattus norvegicus
ggtgatccgacaccattgaaacttc

SEQ ID NO: 468241 - DNA, 25 bp, Rattus norvegicus
ggtgatccgacagcattgaaacttc

SEQ ID NO: 468242 - DNA, 25 bp, Rattus norvegicus
ggtgatcctcagcagaatgctccgt

SEQ ID NO: 468243 - DNA, 25 bp, Rattus norvegicus
ggtgatcctcaggagaatgctccgt

SEQ ID NO: 468244 - DNA, 25 bp, Rattus norvegicus
ggtgatcctccccttgtggagagct

SEQ ID NO: 468245 - DNA, 25 bp, Rattus norvegicus
ggtgatcctcccgttgtggagagct

SEQ ID NO: 468246 - DNA, 25 bp, Rattus norvegicus
ggtgatcctggcctgaatatttttc

SEQ ID NO: 468247 - DNA, 25 bp, Rattus norvegicus
ggtgatcctggcgtgaatatttttc

SEQ ID NO: 468248 - DNA, 25 bp, Rattus norvegicus
ggtgatcctgtccatgtctgtgtct

SEQ ID NO: 468249 - DNA, 25 bp, Rattus norvegicus
ggtgatcctgtcgatgtctgtgtct

SEQ ID NO: 468250 - DNA, 25 bp, Rattus norvegicus
ggtgatcgaagaccagacccttccc

SEQ ID NO: 468251 - DNA, 25 bp, Rattus norvegicus
ggtgatcgaagagcagacccttccc

SEQ ID NO: 468252 - DNA, 25 bp, Rattus norvegicus
ggtgatcgagtgactatctgtgaat

SEQ ID NO: 468253 - DNA, 25 bp, Rattus norvegicus
ggtgatcgagtgtctatctgtgaat

SEQ ID NO: 468254 - DNA, 25 bp, Rattus norvegicus
ggtgatcgccttagaaacgcacata

SEQ ID NO: 468255 - DNA, 25 bp, Rattus norvegicus
ggtgatcgcctttgaaacgcacata

SEQ ID NO: 468256 - DNA, 25 bp, Rattus norvegicus
ggtgatcgttgccaaaactacgtaa

SEQ ID NO: 468257 - DNA, 25 bp, Rattus norvegicus
ggtgatcgttgcgaaaactacgtaa

SEQ ID NO: 468258 - DNA, 25 bp, Rattus norvegicus
ggtgatctatacaggcctcagtgac

SEQ ID NO: 468259 - DNA, 25 bp, Rattus norvegicus
ggtgatctatactggcctcagtgac

SEQ ID NO: 468260 - DNA, 25 bp, Rattus norvegicus
ggtgatctcactccctgtaggttga

SEQ ID NO: 468261 - DNA, 25 bp, Rattus norvegicus
ggtgatctcactcttgaacggtttt

SEQ ID NO: 468262 - DNA, 25 bp, Rattus norvegicus
ggtgatctcactgcctgtaggttga

SEQ ID NO: 468263 - DNA, 25 bp, Rattus norvegicus
ggtgatctcactgttgaacggtttt

SEQ ID NO: 468264 - DNA, 25 bp, Rattus norvegicus
ggtgatctcagaagagagccccaca

SEQ ID NO: 468265 - DNA, 25 bp, Rattus norvegicus
ggtgatctcagatgagagccccaca

SEQ ID NO: 468266 - DNA, 25 bp, Rattus norvegicus
ggtgatctccaacctccagaagaaa

SEQ ID NO: 468267 - DNA, 25 bp, Rattus norvegicus
ggtgatctccaacttacatcattag

SEQ ID NO: 468268 - DNA, 25 bp, Rattus norvegicus
ggtgatctccaagctccagaagaaa

SEQ ID NO: 468269 - DNA, 25 bp, Rattus norvegicus
ggtgatctccaagttacatcattag

SEQ ID NO: 468270 - DNA, 25 bp, Rattus norvegicus
ggtgatctccctctgtaagctggac

SEQ ID NO: 468271 - DNA, 25 bp, Rattus norvegicus
ggtgatctccctgtgtaagctggac

SEQ ID NO: 468272 - DNA, 25 bp, Rattus norvegicus
ggtgatctgtgaccagtaccagaaa

SEQ ID NO: 468273 - DNA, 25 bp, Rattus norvegicus
ggtgatctgtgagcagtaccagaaa

SEQ ID NO: 468274 - DNA, 25 bp, Rattus norvegicus
ggtgatcttcttatcagcttgtcaa

SEQ ID NO: 468275 - DNA, 25 bp, Rattus norvegicus
ggtgatcttcttttcagcttgtcaa

SEQ ID NO: 468276 - DNA, 25 bp, Rattus norvegicus
ggtgatcttggcaaatacagttatt

SEQ ID NO: 468277 - DNA, 25 bp, Rattus norvegicus
ggtgatcttggctaatacagttatt

SEQ ID NO: 468278 - DNA, 25 bp, Rattus norvegicus
ggtgatcttgtgcttttgcttttaa

SEQ ID NO: 468279 - DNA, 25 bp, Rattus norvegicus
ggtgatcttgtggttttgcttttaa

SEQ ID NO: 468280 - DNA, 25 bp, Rattus norvegicus
ggtgatctttgtcaagtctgtgcag

SEQ ID NO: 468281 - DNA, 25 bp, Rattus norvegicus
ggtgatctttgtgaagtctgtgcag

SEQ ID NO: 468282 - DNA, 25 bp, Rattus norvegicus
ggtgatgaaattcctgcccttccac

SEQ ID NO: 468283 - DNA, 25 bp, Rattus norvegicus
ggtgatgaaattgctgcccttccac

SEQ ID NO: 468284 - DNA, 25 bp, Rattus norvegicus
ggtgatgaacttaagcctctattgg

SEQ ID NO: 468285 - DNA, 25 bp, Rattus norvegicus
ggtgatgaactttagcctctattgg

SEQ ID NO: 468286 - DNA, 25 bp, Rattus norvegicus
ggtgatgacccgagatgatgctttt

SEQ ID NO: 468287 - DNA, 25 bp, Rattus norvegicus
ggtgatgacccgtgatgatgctttt

SEQ ID NO: 468288 - DNA, 25 bp, Rattus norvegicus
ggtgatgagcatatcccaggcagcc

SEQ ID NO: 468289 - DNA, 25 bp, Rattus norvegicus
ggtgatgagcatttcccaggcagcc

SEQ ID NO: 468290 - DNA, 25 bp, Rattus norvegicus
ggtgatgatactcctatgtcctgaa

SEQ ID NO: 468291 - DNA, 25 bp, Rattus norvegicus
ggtgatgatactgctatgtcctgaa

SEQ ID NO: 468292 - DNA, 25 bp, Rattus norvegicus
ggtgatgatcacaatggttattaga

SEQ ID NO: 468293 - DNA, 25 bp, Rattus norvegicus
ggtgatgatcactatggttattaga

SEQ ID NO: 468294 - DNA, 25 bp, Rattus norvegicus
ggtgatgatggcactgtagcacagt

SEQ ID NO: 468295 - DNA, 25 bp, Rattus norvegicus
ggtgatgatggctctgtagcacagt

SEQ ID NO: 468296 - DNA, 25 bp, Rattus norvegicus
ggtgatgattaactcgggcctcgcc

SEQ ID NO: 468297 - DNA, 25 bp, Rattus norvegicus
ggtgatgattaagtcgggcctcgcc

SEQ ID NO: 468298 - DNA, 25 bp, Rattus norvegicus
ggtgatgcaattacatccccttggg

SEQ ID NO: 468299 - DNA, 25 bp, Rattus norvegicus
ggtgatgcaatttcatccccttggg

SEQ ID NO: 468300 - DNA, 25 bp, Rattus norvegicus
ggtgatgcacacctaaaatccttgc

SEQ ID NO: 468301 - DNA, 25 bp, Rattus norvegicus
ggtgatgcacacgtaaaatccttgc

SEQ ID NO: 468302 - DNA, 25 bp, Rattus norvegicus
ggtgatgcatagagaggcctgtctc

SEQ ID NO: 468303 - DNA, 25 bp, Rattus norvegicus
ggtgatgcatagtgaggcctgtctc

SEQ ID NO: 468304 - DNA, 25 bp, Rattus norvegicus
ggtgatgccagaatcaacctcccag

SEQ ID NO: 468305 - DNA, 25 bp, Rattus norvegicus
ggtgatgccagattcaacctcccag

SEQ ID NO: 468306 - DNA, 25 bp, Rattus norvegicus
ggtgatgccccaatcagaaggtcta

SEQ ID NO: 468307 - DNA, 25 bp, Rattus norvegicus
ggtgatgccccattcagaaggtcta

SEQ ID NO: 468308 - DNA, 25 bp, Rattus norvegicus
ggtgatgcctaaactctatggtaac

SEQ ID NO: 468309 - DNA, 25 bp, Rattus norvegicus
ggtgatgcctaatctctatggtaac

SEQ ID NO: 468310 - DNA, 25 bp, Rattus norvegicus
ggtgatgcctgacgttccttaatgt

SEQ ID NO: 468311 - DNA, 25 bp, Rattus norvegicus
ggtgatgcctgaggttccttaatgt

SEQ ID NO: 468312 - DNA, 25 bp, Rattus norvegicus
ggtgatgctaatatcaacactgttg

SEQ ID NO: 468313 - DNA, 25 bp, Rattus norvegicus
ggtgatgctaatttcaacactgttg

SEQ ID NO: 468314 - DNA, 25 bp, Rattus norvegicus
ggtgatgcttaccaatacatttcta

SEQ ID NO: 468315 - DNA, 25 bp, Rattus norvegicus
ggtgatgcttacgaatacatttcta

SEQ ID NO: 468316 - DNA, 25 bp, Rattus norvegicus
ggtgatgctttcaagtattctgcac

SEQ ID NO: 468317 - DNA, 25 bp, Rattus norvegicus
ggtgatgctttctagtattctgcac

SEQ ID NO: 468318 - DNA, 25 bp, Rattus norvegicus
ggtgatggagaacccttcccatgcc

SEQ ID NO: 468319 - DNA, 25 bp, Rattus norvegicus
ggtgatggagaagccttcccatgcc

SEQ ID NO: 468320 - DNA, 25 bp, Rattus norvegicus
ggtgatggcccaccagttcagagca

SEQ ID NO: 468321 - DNA, 25 bp, Rattus norvegicus
ggtgatggcccagcagttcagagca

SEQ ID NO: 468322 - DNA, 25 bp, Rattus norvegicus
ggtgatggcctaagttcttggattt

SEQ ID NO: 468323 - DNA, 25 bp, Rattus norvegicus
ggtgatggcctatgttcttggattt

SEQ ID NO: 468324 - DNA, 25 bp, Rattus norvegicus
ggtgatggtgaacaacttccgcccg

SEQ ID NO: 468325 - DNA, 25 bp, Rattus norvegicus
ggtgatggtgaagaacttccgcccg

SEQ ID NO: 468326 - DNA, 25 bp, Rattus norvegicus
ggtgatggttttactttttctaatg

SEQ ID NO: 468327 - DNA, 25 bp, Rattus norvegicus
ggtgatggtttttctttttctaatg

SEQ ID NO: 468328 - DNA, 25 bp, Rattus norvegicus
ggtgatgtaaccacagacacgcccg

SEQ ID NO: 468329 - DNA, 25 bp, Rattus norvegicus
ggtgatgtaacctcagacacgcccg

SEQ ID NO: 468330 - DNA, 25 bp, Rattus norvegicus
ggtgatgtaccccaggtgtgccatc

SEQ ID NO: 468331 - DNA, 25 bp, Rattus norvegicus
ggtgatgtacccgaggtgtgccatc

SEQ ID NO: 468332 - DNA, 25 bp, Rattus norvegicus
ggtgatgtccatccgaatgacctta

SEQ ID NO: 468333 - DNA, 25 bp, Rattus norvegicus
ggtgatgtccatgcgaatgacctta

SEQ ID NO: 468334 - DNA, 25 bp, Rattus norvegicus
ggtgatgtcgcacaacagaccttga

SEQ ID NO: 468335 - DNA, 25 bp, Rattus norvegicus
ggtgatgtcgcagaacagaccttga

SEQ ID NO: 468336 - DNA, 25 bp, Rattus norvegicus
ggtgatgtgaccactgtctatgcag

SEQ ID NO: 468337 - DNA, 25 bp, Rattus norvegicus
ggtgatgtgacctctgtctatgcag

SEQ ID NO: 468338 - DNA, 25 bp, Rattus norvegicus
ggtgatgtgctccttattttcatta

SEQ ID NO: 468339 - DNA, 25 bp, Rattus norvegicus
ggtgatgtgctcgttattttcatta

SEQ ID NO: 468340 - DNA, 25 bp, Rattus norvegicus
ggtgatgtggccacaggactcccgt

SEQ ID NO: 468341 - DNA, 25 bp, Rattus norvegicus
ggtgatgtggcctcaggactcccgt

SEQ ID NO: 468342 - DNA, 25 bp, Rattus norvegicus
ggtgatgttcccatgttttgtttac

SEQ ID NO: 468343 - DNA, 25 bp, Rattus norvegicus
ggtgatgttcccttgttttgtttac

SEQ ID NO: 468344 - DNA, 25 bp, Rattus norvegicus
ggtgatgttcttatacagctggttt

SEQ ID NO: 468345 - DNA, 25 bp, Rattus norvegicus
ggtgatgttcttttacagctggttt

SEQ ID NO: 468346 - DNA, 25 bp, Rattus norvegicus
ggtgatgttgccaaggtacagccat

SEQ ID NO: 468347 - DNA, 25 bp, Rattus norvegicus
ggtgatgttgcctaggtacagccat

SEQ ID NO: 468348 - DNA, 25 bp, Rattus norvegicus
ggtgatgttggtatgatttcccttt

SEQ ID NO: 468349 - DNA, 25 bp, Rattus norvegicus
ggtgatgttggtttgatttcccttt

SEQ ID NO: 468350 - DNA, 25 bp, Rattus norvegicus
ggtgatgtttctactgatagtccag

SEQ ID NO: 468351 - DNA, 25 bp, Rattus norvegicus
ggtgatgtttcttctgatagtccag

SEQ ID NO: 468352 - DNA, 25 bp, Rattus norvegicus
ggtgatgtttgactatctctgtccc

SEQ ID NO: 468353 - DNA, 25 bp, Rattus norvegicus
ggtgatgtttgagtatctctgtccc

SEQ ID NO: 468354 - DNA, 25 bp, Rattus norvegicus
ggtgatgtttgcaactttgcccaga

SEQ ID NO: 468355 - DNA, 25 bp, Rattus norvegicus
ggtgatgtttgctactttgcccaga

SEQ ID NO: 468356 - DNA, 25 bp, Rattus norvegicus
ggtgattaattacccccgcaaggag

SEQ ID NO: 468357 - DNA, 25 bp, Rattus norvegicus
ggtgattaattagccccgcaaggag

SEQ ID NO: 468358 - DNA, 25 bp, Rattus norvegicus
ggtgattacaagcttctgagtatgt

SEQ ID NO: 468359 - DNA, 25 bp, Rattus norvegicus
ggtgattacaaggttctgagtatgt

SEQ ID NO: 468360 - DNA, 25 bp, Rattus norvegicus
ggtgattacctcaacttttatgact

SEQ ID NO: 468361 - DNA, 25 bp, Rattus norvegicus
ggtgattacctctacttttatgact

SEQ ID NO: 468362 - DNA, 25 bp, Rattus norvegicus
ggtgattactgaagcccagcaagct

SEQ ID NO: 468363 - DNA, 25 bp, Rattus norvegicus
ggtgattactgatgcccagcaagct

SEQ ID NO: 468364 - DNA, 25 bp, Rattus norvegicus
ggtgattagtagaggcgactgcccc

SEQ ID NO: 468365 - DNA, 25 bp, Rattus norvegicus
ggtgattagtagtggcgactgcccc

SEQ ID NO: 468366 - DNA, 25 bp, Rattus norvegicus
ggtgattattgaaacgtccatgcga

SEQ ID NO: 468367 - DNA, 25 bp, Rattus norvegicus
ggtgattattgatacgtccatgcga

SEQ ID NO: 468368 - DNA, 25 bp, Rattus norvegicus
ggtgattccactcatggcgactcca

SEQ ID NO: 468369 - DNA, 25 bp, Rattus norvegicus
ggtgattccactgatggcgactcca

SEQ ID NO: 468370 - DNA, 25 bp, Rattus norvegicus
ggtgattccaggattgccaaagcca

SEQ ID NO: 468371 - DNA, 25 bp, Rattus norvegicus
ggtgattccaggtttgccaaagcca

SEQ ID NO: 468372 - DNA, 25 bp, Rattus norvegicus
ggtgattcccaaccgaaccaacaga

SEQ ID NO: 468373 - DNA, 25 bp, Rattus norvegicus
ggtgattcccaagcgaaccaacaga

SEQ ID NO: 468374 - DNA, 25 bp, Rattus norvegicus
ggtgattcccgaaagttgccgagtt

SEQ ID NO: 468375 - DNA, 25 bp, Rattus norvegicus
ggtgattcccgatagttgccgagtt

SEQ ID NO: 468376 - DNA, 25 bp, Rattus norvegicus
ggtgattcgaacaagggcttcccta

SEQ ID NO: 468377 - DNA, 25 bp, Rattus norvegicus
ggtgattcgaactagggcttcccta

SEQ ID NO: 468378 - DNA, 25 bp, Rattus norvegicus
ggtgattcgcagagacggtgccatt

SEQ ID NO: 468379 - DNA, 25 bp, Rattus norvegicus
ggtgattcgcagtgacggtgccatt

SEQ ID NO: 468380 - DNA, 25 bp, Rattus norvegicus
ggtgattctcaaagcaactgtattc

SEQ ID NO: 468381 - DNA, 25 bp, Rattus norvegicus
ggtgattctcaatgcaactgtattc

SEQ ID NO: 468382 - DNA, 25 bp, Rattus norvegicus
ggtgattctcatcggactacctcca

SEQ ID NO: 468383 - DNA, 25 bp, Rattus norvegicus
ggtgattctcatgggactacctcca

SEQ ID NO: 468384 - DNA, 25 bp, Rattus norvegicus
ggtgattctgagacccataaagttg

SEQ ID NO: 468385 - DNA, 25 bp, Rattus norvegicus
ggtgattctgagtcccataaagttg

SEQ ID NO: 468386 - DNA, 25 bp, Rattus norvegicus
ggtgattctgtgaatcaaccttaga

SEQ ID NO: 468387 - DNA, 25 bp, Rattus norvegicus
ggtgattctgtgtatcaaccttaga

SEQ ID NO: 468388 - DNA, 25 bp, Rattus norvegicus
ggtgattgacaaacccagttggatc

SEQ ID NO: 468389 - DNA, 25 bp, Rattus norvegicus
ggtgattgacaatcccagttggatc

SEQ ID NO: 468390 - DNA, 25 bp, Rattus norvegicus
ggtgattgacacctgtagcctaaca

SEQ ID NO: 468391 - DNA, 25 bp, Rattus norvegicus
ggtgattgacacgtgtagcctaaca

SEQ ID NO: 468392 - DNA, 25 bp, Rattus norvegicus
ggtgattgacctatgaagttacatc

SEQ ID NO: 468393 - DNA, 25 bp, Rattus norvegicus
ggtgattgacctttgaagttacatc

SEQ ID NO: 468394 - DNA, 25 bp, Rattus norvegicus
ggtgattgagttacacagcattcat

SEQ ID NO: 468395 - DNA, 25 bp, Rattus norvegicus
ggtgattgagtttcacagcattcat

SEQ ID NO: 468396 - DNA, 25 bp, Rattus norvegicus
ggtgattgctgtacttgactgagat

SEQ ID NO: 468397 - DNA, 25 bp, Rattus norvegicus
ggtgattgctgttcttgactgagat

SEQ ID NO: 468398 - DNA, 25 bp, Rattus norvegicus
ggtgattggccacaacagcaatctg

SEQ ID NO: 468399 - DNA, 25 bp, Rattus norvegicus
ggtgattggccagaacagcaatctg

SEQ ID NO: 468400 - DNA, 25 bp, Rattus norvegicus
ggtgatttaaaaagctgcccataag

SEQ ID NO: 468401 - DNA, 25 bp, Rattus norvegicus
ggtgatttaaaatgctgcccataag

SEQ ID NO: 468402 - DNA, 25 bp, Rattus norvegicus
ggtgatttaaggcacttgctgttct

SEQ ID NO: 468403 - DNA, 25 bp, Rattus norvegicus
ggtgatttaagggacttgctgttct

SEQ ID NO: 468404 - DNA, 25 bp, Rattus norvegicus
ggtgatttactaactcctgtttgtg

SEQ ID NO: 468405 - DNA, 25 bp, Rattus norvegicus
ggtgatttactatctcctgtttgtg

SEQ ID NO: 468406 - DNA, 25 bp, Rattus norvegicus
ggtgatttcaagcttcaatatgcac

SEQ ID NO: 468407 - DNA, 25 bp, Rattus norvegicus
ggtgatttcaaggttcaatatgcac

SEQ ID NO: 468408 - DNA, 25 bp, Rattus norvegicus
ggtgatttccccaatctaagttttg

SEQ ID NO: 468409 - DNA, 25 bp, Rattus norvegicus
ggtgatttcccctatctaagttttg

SEQ ID NO: 468410 - DNA, 25 bp, Rattus norvegicus
ggtgatttcctcataactcaacagt

SEQ ID NO: 468411 - DNA, 25 bp, Rattus norvegicus
ggtgatttcctcttaactcaacagt

SEQ ID NO: 468412 - DNA, 25 bp, Rattus norvegicus
ggtgatttctctattacgtgtacat

SEQ ID NO: 468413 - DNA, 25 bp, Rattus norvegicus
ggtgatttctcttttacgtgtacat

SEQ ID NO: 468414 - DNA, 25 bp, Rattus norvegicus
ggtgatttgaacaacctcgctctgc

SEQ ID NO: 468415 - DNA, 25 bp, Rattus norvegicus
ggtgatttgaactacctcgctctgc

SEQ ID NO: 468416 - DNA, 25 bp, Rattus norvegicus
ggtgatttgctcatttaacggactt

SEQ ID NO: 468417 - DNA, 25 bp, Rattus norvegicus
ggtgatttgctcttttaacggactt

SEQ ID NO: 468418 - DNA, 25 bp, Rattus norvegicus
ggtgatttgtagatcctgactgcct

SEQ ID NO: 468419 - DNA, 25 bp, Rattus norvegicus
ggtgatttgtagttcctgactgcct

SEQ ID NO: 468420 - DNA, 25 bp, Rattus norvegicus
ggtgattttcaccatcctgaagctc

SEQ ID NO: 468421 - DNA, 25 bp, Rattus norvegicus
ggtgattttcacgatcctgaagctc

SEQ ID NO: 468422 - DNA, 25 bp, Rattus norvegicus
ggtgattttgccagtgatgagaagc

SEQ ID NO: 468423 - DNA, 25 bp, Rattus norvegicus
ggtgattttgcctgtgatgagaagc

SEQ ID NO: 468424 - DNA, 25 bp, Rattus norvegicus
ggtgcaaacctgagcagcagatgat

SEQ ID NO: 468425 - DNA, 25 bp, Rattus norvegicus
ggtgcaaacctgtgcagcagatgat

SEQ ID NO: 468426 - DNA, 25 bp, Rattus norvegicus
ggtgcaaactgacctggagacgtct

SEQ ID NO: 468427 - DNA, 25 bp, Rattus norvegicus
ggtgcaaactgagctggagacgtct

SEQ ID NO: 468428 - DNA, 25 bp, Rattus norvegicus
ggtgcaaagcacagctcagcattta

SEQ ID NO: 468429 - DNA, 25 bp, Rattus norvegicus
ggtgcaaagcactgctcagcattta

SEQ ID NO: 468430 - DNA, 25 bp, Rattus norvegicus
ggtgcaaatgacatcctgggttcta

SEQ ID NO: 468431 - DNA, 25 bp, Rattus norvegicus
ggtgcaaatgacttcctgggttcta

SEQ ID NO: 468432 - DNA, 25 bp, Rattus norvegicus
ggtgcaaattgtaatttccagtacg

SEQ ID NO: 468433 - DNA, 25 bp, Rattus norvegicus
ggtgcaaattgttatttccagtacg

SEQ ID NO: 468434 - DNA, 25 bp, Rattus norvegicus
ggtgcaacatgaacgatcctcgaaa

SEQ ID NO: 468435 - DNA, 25 bp, Rattus norvegicus
ggtgcaacatgatcgatcctcgaaa

SEQ ID NO: 468436 - DNA, 25 bp, Rattus norvegicus
ggtgcaacccagatacctggtgaca

SEQ ID NO: 468437 - DNA, 25 bp, Rattus norvegicus
ggtgcaacccagttacctggtgaca

SEQ ID NO: 468438 - DNA, 25 bp, Rattus norvegicus
ggtgcaacccctaggtgcacataaa

SEQ ID NO: 468439 - DNA, 25 bp, Rattus norvegicus
ggtgcaaccccttggtgcacataaa

SEQ ID NO: 468440 - DNA, 25 bp, Rattus norvegicus
ggtgcaactcaaacctcgaaaacaa

SEQ ID NO: 468441 - DNA, 25 bp, Rattus norvegicus
ggtgcaactcaatcctcgaaaacaa

SEQ ID NO: 468442 - DNA, 25 bp, Rattus norvegicus
ggtgcaactgtgatcaaccataatt

SEQ ID NO: 468443 - DNA, 25 bp, Rattus norvegicus
ggtgcaactgtgttcaaccataatt

SEQ ID NO: 468444 - DNA, 25 bp, Rattus norvegicus
ggtgcaacttgcaatcccttttcta

SEQ ID NO: 468445 - DNA, 25 bp, Rattus norvegicus
ggtgcaacttgctatcccttttcta

SEQ ID NO: 468446 - DNA, 25 bp, Rattus norvegicus
ggtgcaagaggccacaaagccactt

SEQ ID NO: 468447 - DNA, 25 bp, Rattus norvegicus
ggtgcaagaggcgacaaagccactt

SEQ ID NO: 468448 - DNA, 25 bp, Rattus norvegicus
ggtgcaagctctaggaagctagaga

SEQ ID NO: 468449 - DNA, 25 bp, Rattus norvegicus
ggtgcaagctcttggaagctagaga

SEQ ID NO: 468450 - DNA, 25 bp, Rattus norvegicus
ggtgcaaggaccacagcaggcatcg

SEQ ID NO: 468451 - DNA, 25 bp, Rattus norvegicus
ggtgcaaggacctcagcaggcatcg

SEQ ID NO: 468452 - DNA, 25 bp, Rattus norvegicus
ggtgcaaggctacttcatgctgtat

SEQ ID NO: 468453 - DNA, 25 bp, Rattus norvegicus
ggtgcaaggctagttcatgctgtat

SEQ ID NO: 468454 - DNA, 25 bp, Rattus norvegicus
ggtgcaaggcttactacagcgtcaa

SEQ ID NO: 468455 - DNA, 25 bp, Rattus norvegicus
ggtgcaaggctttctacagcgtcaa

SEQ ID NO: 468456 - DNA, 25 bp, Rattus norvegicus
ggtgcaatgacaaggtctccacttg

SEQ ID NO: 468457 - DNA, 25 bp, Rattus norvegicus
ggtgcaatgacatggtctccacttg

SEQ ID NO: 468458 - DNA, 25 bp, Rattus norvegicus
ggtgcaatgattatcttgttccttg

SEQ ID NO: 468459 - DNA, 25 bp, Rattus norvegicus
ggtgcaatgattttcttgttccttg

SEQ ID NO: 468460 - DNA, 25 bp, Rattus norvegicus
ggtgcaatgctcaggtaataatctt

SEQ ID NO: 468461 - DNA, 25 bp, Rattus norvegicus
ggtgcaatgctctggtaataatctt

SEQ ID NO: 468462 - DNA, 25 bp, Rattus norvegicus
ggtgcaatgtgaccagccacctcac

SEQ ID NO: 468463 - DNA, 25 bp, Rattus norvegicus
ggtgcaatgtgagcagccacctcac

SEQ ID NO: 468464 - DNA, 25 bp, Rattus norvegicus
ggtgcaattctgatctgctgtcatt

SEQ ID NO: 468465 - DNA, 25 bp, Rattus norvegicus
ggtgcaattctgttctgctgtcatt

SEQ ID NO: 468466 - DNA, 25 bp, Rattus norvegicus
ggtgcaatttatacccttgtcacta

SEQ ID NO: 468467 - DNA, 25 bp, Rattus norvegicus
ggtgcaatttattcccttgtcacta

SEQ ID NO: 468468 - DNA, 25 bp, Rattus norvegicus
ggtgcacaagtaaccagggccgcca

SEQ ID NO: 468469 - DNA, 25 bp, Rattus norvegicus
ggtgcacaagtatccagggccgcca

SEQ ID NO: 468470 - DNA, 25 bp, Rattus norvegicus
ggtgcacaatgcatggcgtttccaa

SEQ ID NO: 468471 - DNA, 25 bp, Rattus norvegicus
ggtgcacaatgcttggcgtttccaa

SEQ ID NO: 468472 - DNA, 25 bp, Rattus norvegicus
ggtgcacacacaaggccatggagaa

SEQ ID NO: 468473 - DNA, 25 bp, Rattus norvegicus
ggtgcacacacatggccatggagaa

SEQ ID NO: 468474 - DNA, 25 bp, Rattus norvegicus
ggtgcacacactcgctggaaggaac

SEQ ID NO: 468475 - DNA, 25 bp, Rattus norvegicus
ggtgcacacactggctggaaggaac

SEQ ID NO: 468476 - DNA, 25 bp, Rattus norvegicus
ggtgcacacagaactgccggtgtac

SEQ ID NO: 468477 - DNA, 25 bp, Rattus norvegicus
ggtgcacacagatctgccggtgtac

SEQ ID NO: 468478 - DNA, 25 bp, Rattus norvegicus
ggtgcacaccttagcgcaatctgat

SEQ ID NO: 468479 - DNA, 25 bp, Rattus norvegicus
ggtgcacacctttgcgcaatctgat

SEQ ID NO: 468480 - DNA, 25 bp, Rattus norvegicus
ggtgcacagcacaaattagttatat

SEQ ID NO: 468481 - DNA, 25 bp, Rattus norvegicus
ggtgcacagcacaatgacttaagga

SEQ ID NO: 468482 - DNA, 25 bp, Rattus norvegicus
ggtgcacagcactaattagttatat

SEQ ID NO: 468483 - DNA, 25 bp, Rattus norvegicus
ggtgcacagcactatgacttaagga

SEQ ID NO: 468484 - DNA, 25 bp, Rattus norvegicus
ggtgcacagctcaatatgatcgatc

SEQ ID NO: 468485 - DNA, 25 bp, Rattus norvegicus
ggtgcacagctctatatgatcgatc

SEQ ID NO: 468486 - DNA, 25 bp, Rattus norvegicus
ggtgcacagttcctttaagcccatt

SEQ ID NO: 468487 - DNA, 25 bp, Rattus norvegicus
ggtgcacagttcgtttaagcccatt

SEQ ID NO: 468488 - DNA, 25 bp, Rattus norvegicus
ggtgcacataggctgcaagtttcat

SEQ ID NO: 468489 - DNA, 25 bp, Rattus norvegicus
ggtgcacatagggtgcaagtttcat

SEQ ID NO: 468490 - DNA, 25 bp, Rattus norvegicus
ggtgcacatcacagcgactgactga

SEQ ID NO: 468491 - DNA, 25 bp, Rattus norvegicus
ggtgcacatcacatctttctgggat

SEQ ID NO: 468492 - DNA, 25 bp, Rattus norvegicus
ggtgcacatcactgcgactgactga

SEQ ID NO: 468493 - DNA, 25 bp, Rattus norvegicus
ggtgcacatcacttctttctgggat

SEQ ID NO: 468494 - DNA, 25 bp, Rattus norvegicus
ggtgcacatgcaaatgtgtaggcaa

SEQ ID NO: 468495 - DNA, 25 bp, Rattus norvegicus
ggtgcacatgcatatgtgtaggcaa

SEQ ID NO: 468496 - DNA, 25 bp, Rattus norvegicus
ggtgcaccagctctccaagatcaga

SEQ ID NO: 468497 - DNA, 25 bp, Rattus norvegicus
ggtgcaccagctgtccaagatcaga

SEQ ID NO: 468498 - DNA, 25 bp, Rattus norvegicus
ggtgcaccagtgaaatcccagttct

SEQ ID NO: 468499 - DNA, 25 bp, Rattus norvegicus
ggtgcaccagtgaaccatgctccac

SEQ ID NO: 468500 - DNA, 25 bp, Rattus norvegicus
ggtgcaccagtgtaatcccagttct

SEQ ID NO: 468501 - DNA, 25 bp, Rattus norvegicus
ggtgcaccagtgtaccatgctccac

SEQ ID NO: 468502 - DNA, 25 bp, Rattus norvegicus
ggtgcaccatctatctgtgaatccc

SEQ ID NO: 468503 - DNA, 25 bp, Rattus norvegicus
ggtgcaccatctttctgtgaatccc

SEQ ID NO: 468504 - DNA, 25 bp, Rattus norvegicus
ggtgcaccatttaaaggaccctcat

SEQ ID NO: 468505 - DNA, 25 bp, Rattus norvegicus
ggtgcaccattttaaggaccctcat

SEQ ID NO: 468506 - DNA, 25 bp, Rattus norvegicus
ggtgcacccaggagacagtgtagat

SEQ ID NO: 468507 - DNA, 25 bp, Rattus norvegicus
ggtgcacccaggtgacagtgtagat

SEQ ID NO: 468508 - DNA, 25 bp, Rattus norvegicus
ggtgcaccctaaaacttcgatcgag

SEQ ID NO: 468509 - DNA, 25 bp, Rattus norvegicus
ggtgcaccctaatacttcgatcgag

SEQ ID NO: 468510 - DNA, 25 bp, Rattus norvegicus
ggtgcaccgtacactttgtagctga

SEQ ID NO: 468511 - DNA, 25 bp, Rattus norvegicus
ggtgcaccgtactctttgtagctga

SEQ ID NO: 468512 - DNA, 25 bp, Rattus norvegicus
ggtgcacctatcctgtagagacttg

SEQ ID NO: 468513 - DNA, 25 bp, Rattus norvegicus
ggtgcacctatcgtgtagagacttg

SEQ ID NO: 468514 - DNA, 25 bp, Rattus norvegicus
ggtgcacgagctacctgtccagcag

SEQ ID NO: 468515 - DNA, 25 bp, Rattus norvegicus
ggtgcacgagcttcctgtccagcag

SEQ ID NO: 468516 - DNA, 25 bp, Rattus norvegicus
ggtgcacgtctgacaatcagcagct

SEQ ID NO: 468517 - DNA, 25 bp, Rattus norvegicus
ggtgcacgtctgtcaatcagcagct

SEQ ID NO: 468518 - DNA, 25 bp, Rattus norvegicus
ggtgcactccatatctgagaacttt

SEQ ID NO: 468519 - DNA, 25 bp, Rattus norvegicus
ggtgcactccatttctgagaacttt

SEQ ID NO: 468520 - DNA, 25 bp, Rattus norvegicus
ggtgcactcctgaaaatccagccct

SEQ ID NO: 468521 - DNA, 25 bp, Rattus norvegicus
ggtgcactcctgtaaatccagccct

SEQ ID NO: 468522 - DNA, 25 bp, Rattus norvegicus
ggtgcactctcacacacttattcaa

SEQ ID NO: 468523 - DNA, 25 bp, Rattus norvegicus
ggtgcactctcagacacttattcaa

SEQ ID NO: 468524 - DNA, 25 bp, Rattus norvegicus
ggtgcactgaacaagtctgggttaa

SEQ ID NO: 468525 - DNA, 25 bp, Rattus norvegicus
ggtgcactgaactagtctgggttaa

SEQ ID NO: 468526 - DNA, 25 bp, Rattus norvegicus
ggtgcactgatcagctagagctgta

SEQ ID NO: 468527 - DNA, 25 bp, Rattus norvegicus
ggtgcactgatctgctagagctgta

SEQ ID NO: 468528 - DNA, 25 bp, Rattus norvegicus
ggtgcactgattagtagggaacatt

SEQ ID NO: 468529 - DNA, 25 bp, Rattus norvegicus
ggtgcactgatttgtagggaacatt

SEQ ID NO: 468530 - DNA, 25 bp, Rattus norvegicus
ggtgcactgtaccttttgacaaaga

SEQ ID NO: 468531 - DNA, 25 bp, Rattus norvegicus
ggtgcactgtacgttttgacaaaga

SEQ ID NO: 468532 - DNA, 25 bp, Rattus norvegicus
ggtgcacttcaaagtttgtacccct

SEQ ID NO: 468533 - DNA, 25 bp, Rattus norvegicus
ggtgcacttcaatgtttgtacccct

SEQ ID NO: 468534 - DNA, 25 bp, Rattus norvegicus
ggtgcacttcctcttaacttcaaaa

SEQ ID NO: 468535 - DNA, 25 bp, Rattus norvegicus
ggtgcacttcctgttaacttcaaaa

SEQ ID NO: 468536 - DNA, 25 bp, Rattus norvegicus
ggtgcacttgaaaccaagggttcaa

SEQ ID NO: 468537 - DNA, 25 bp, Rattus norvegicus
ggtgcacttgaatccaagggttcaa

SEQ ID NO: 468538 - DNA, 25 bp, Rattus norvegicus
ggtgcacttgtgcagacagttgtca

SEQ ID NO: 468539 - DNA, 25 bp, Rattus norvegicus
ggtgcacttgtggagacagttgtca

SEQ ID NO: 468540 - DNA, 25 bp, Rattus norvegicus
ggtgcagaaactacttgtctccctt

SEQ ID NO: 468541 - DNA, 25 bp, Rattus norvegicus
ggtgcagaaacttcttgtctccctt

SEQ ID NO: 468542 - DNA, 25 bp, Rattus norvegicus
ggtgcagaaggcacgacttgcctac

SEQ ID NO: 468543 - DNA, 25 bp, Rattus norvegicus
ggtgcagaaggctcgacttgcctac

SEQ ID NO: 468544 - DNA, 25 bp, Rattus norvegicus
ggtgcagaatgtacagcctccaact

SEQ ID NO: 468545 - DNA, 25 bp, Rattus norvegicus
ggtgcagaatgttcagcctccaact

SEQ ID NO: 468546 - DNA, 25 bp, Rattus norvegicus
ggtgcagacagacgccaccgcgcat

SEQ ID NO: 468547 - DNA, 25 bp, Rattus norvegicus
ggtgcagacagaggccaccgcgcat

SEQ ID NO: 468548 - DNA, 25 bp, Rattus norvegicus
ggtgcagacaggagccagagccaaa

SEQ ID NO: 468549 - DNA, 25 bp, Rattus norvegicus
ggtgcagacaggtgccagagccaaa

SEQ ID NO: 468550 - DNA, 25 bp, Rattus norvegicus
ggtgcagacatcaccatgattgggc

SEQ ID NO: 468551 - DNA, 25 bp, Rattus norvegicus
ggtgcagacatctccatgattgggc

SEQ ID NO: 468552 - DNA, 25 bp, Rattus norvegicus
ggtgcagaccagagtgctctctcca

SEQ ID NO: 468553 - DNA, 25 bp, Rattus norvegicus
ggtgcagaccagtgtgctctctcca

SEQ ID NO: 468554 - DNA, 25 bp, Rattus norvegicus
ggtgcagaccgacgccaacaagtac

SEQ ID NO: 468555 - DNA, 25 bp, Rattus norvegicus
ggtgcagaccgaggccaacaagtac

SEQ ID NO: 468556 - DNA, 25 bp, Rattus norvegicus
ggtgcagacctgctgccacatgatt

SEQ ID NO: 468557 - DNA, 25 bp, Rattus norvegicus
ggtgcagacctggtgccacatgatt

SEQ ID NO: 468558 - DNA, 25 bp, Rattus norvegicus
ggtgcagactctcgagttggcccaa

SEQ ID NO: 468559 - DNA, 25 bp, Rattus norvegicus
ggtgcagactctggagttggcccaa

SEQ ID NO: 468560 - DNA, 25 bp, Rattus norvegicus
ggtgcagagaggatccgctttccca

SEQ ID NO: 468561 - DNA, 25 bp, Rattus norvegicus
ggtgcagagaggttccgctttccca

SEQ ID NO: 468562 - DNA, 25 bp, Rattus norvegicus
ggtgcagagcccacaggacttggaa

SEQ ID NO: 468563 - DNA, 25 bp, Rattus norvegicus
ggtgcagagccctcaggacttggaa

SEQ ID NO: 468564 - DNA, 25 bp, Rattus norvegicus
ggtgcagaggcaccatccccaggtt

SEQ ID NO: 468565 - DNA, 25 bp, Rattus norvegicus
ggtgcagaggcagcatccccaggtt

SEQ ID NO: 468566 - DNA, 25 bp, Rattus norvegicus
ggtgcagagtaccagagcaacccca

SEQ ID NO: 468567 - DNA, 25 bp, Rattus norvegicus
ggtgcagagtacgagagcaacccca

SEQ ID NO: 468568 - DNA, 25 bp, Rattus norvegicus
ggtgcagagtcacccaagtgcctca

SEQ ID NO: 468569 - DNA, 25 bp, Rattus norvegicus
ggtgcagagtcagccaagtgcctca

SEQ ID NO: 468570 - DNA, 25 bp, Rattus norvegicus
ggtgcagatctccttgcagtcaata

SEQ ID NO: 468571 - DNA, 25 bp, Rattus norvegicus
ggtgcagatctcgttgcagtcaata

SEQ ID NO: 468572 - DNA, 25 bp, Rattus norvegicus
ggtgcagatttccttaaattccccg

SEQ ID NO: 468573 - DNA, 25 bp, Rattus norvegicus
ggtgcagatttcgttaaattccccg

SEQ ID NO: 468574 - DNA, 25 bp, Rattus norvegicus
ggtgcagcacagactcttaaaccat

SEQ ID NO: 468575 - DNA, 25 bp, Rattus norvegicus
ggtgcagcacagtctcttaaaccat

SEQ ID NO: 468576 - DNA, 25 bp, Rattus norvegicus
ggtgcagcactcctttgtgcaaaat

SEQ ID NO: 468577 - DNA, 25 bp, Rattus norvegicus
ggtgcagcactcgtttgtgcaaaat

SEQ ID NO: 468578 - DNA, 25 bp, Rattus norvegicus
ggtgcagccattcctggcagactaa

SEQ ID NO: 468579 - DNA, 25 bp, Rattus norvegicus
ggtgcagccattgctggcagactaa

SEQ ID NO: 468580 - DNA, 25 bp, Rattus norvegicus
ggtgcagctgaaccgctccaaaaac

SEQ ID NO: 468581 - DNA, 25 bp, Rattus norvegicus
ggtgcagctgaagcgctccaaaaac

SEQ ID NO: 468582 - DNA, 25 bp, Rattus norvegicus
ggtgcagctgtacctgaactccaat

SEQ ID NO: 468583 - DNA, 25 bp, Rattus norvegicus
ggtgcagctgtagctgaactccaat

SEQ ID NO: 468584 - DNA, 25 bp, Rattus norvegicus
ggtgcagctttgagttttctgagca

SEQ ID NO: 468585 - DNA, 25 bp, Rattus norvegicus
ggtgcagctttgtgttttctgagca

SEQ ID NO: 468586 - DNA, 25 bp, Rattus norvegicus
ggtgcaggaaccacagaccctatgc

SEQ ID NO: 468587 - DNA, 25 bp, Rattus norvegicus
ggtgcaggaacctcagaccctatgc

SEQ ID NO: 468588 - DNA, 25 bp, Rattus norvegicus
ggtgcaggacctaatcgttgtacat

SEQ ID NO: 468589 - DNA, 25 bp, Rattus norvegicus
ggtgcaggaccttatcgttgtacat

SEQ ID NO: 468590 - DNA, 25 bp, Rattus norvegicus
ggtgcaggcaccagtgttccgtgca

SEQ ID NO: 468591 - DNA, 25 bp, Rattus norvegicus
ggtgcaggcacctgtgttccgtgca

SEQ ID NO: 468592 - DNA, 25 bp, Rattus norvegicus
ggtgcaggccagcaagactaaactt

SEQ ID NO: 468593 - DNA, 25 bp, Rattus norvegicus
ggtgcaggccaggaagactaaactt

SEQ ID NO: 468594 - DNA, 25 bp, Rattus norvegicus
ggtgcaggcctaactttggtgccaa

SEQ ID NO: 468595 - DNA, 25 bp, Rattus norvegicus
ggtgcaggcctatctttggtgccaa

SEQ ID NO: 468596 - DNA, 25 bp, Rattus norvegicus
ggtgcaggcttcacttttgtggtga

SEQ ID NO: 468597 - DNA, 25 bp, Rattus norvegicus
ggtgcaggcttctcttttgtggtga

SEQ ID NO: 468598 - DNA, 25 bp, Rattus norvegicus
ggtgcagggtttctattactagtca

SEQ ID NO: 468599 - DNA, 25 bp, Rattus norvegicus
ggtgcagggtttgtattactagtca

SEQ ID NO: 468600 - DNA, 25 bp, Rattus norvegicus
ggtgcaggtaccaaattcgttcctt

SEQ ID NO: 468601 - DNA, 25 bp, Rattus norvegicus
ggtgcaggtacctaattcgttcctt

SEQ ID NO: 468602 - DNA, 25 bp, Rattus norvegicus
ggtgcagtaccaactcggcttgctt

SEQ ID NO: 468603 - DNA, 25 bp, Rattus norvegicus
ggtgcagtaccatctcggcttgctt

SEQ ID NO: 468604 - DNA, 25 bp, Rattus norvegicus
ggtgcagtatctcgtgactatcctt

SEQ ID NO: 468605 - DNA, 25 bp, Rattus norvegicus
ggtgcagtatctggtgactatcctt

SEQ ID NO: 468606 - DNA, 25 bp, Rattus norvegicus
ggtgcagtatgaagtcactccaatt

SEQ ID NO: 468607 - DNA, 25 bp, Rattus norvegicus
ggtgcagtatgatgtcactccaatt

SEQ ID NO: 468608 - DNA, 25 bp, Rattus norvegicus
ggtgcagtattgctactcttatatt

SEQ ID NO: 468609 - DNA, 25 bp, Rattus norvegicus
ggtgcagtattggtactcttatatt

SEQ ID NO: 468610 - DNA, 25 bp, Rattus norvegicus
ggtgcagtcaaacccatagcctctg

SEQ ID NO: 468611 - DNA, 25 bp, Rattus norvegicus
ggtgcagtcaaagccatagcctctg

SEQ ID NO: 468612 - DNA, 25 bp, Rattus norvegicus
ggtgcagtccatcttcaatgttcca

SEQ ID NO: 468613 - DNA, 25 bp, Rattus norvegicus
ggtgcagtccatgttcaatgttcca

SEQ ID NO: 468614 - DNA, 25 bp, Rattus norvegicus
ggtgcagtctcgcacgctaagcgac

SEQ ID NO: 468615 - DNA, 25 bp, Rattus norvegicus
ggtgcagtctcggacgctaagcgac

SEQ ID NO: 468616 - DNA, 25 bp, Rattus norvegicus
ggtgcagtgaatacctcctgaccat

SEQ ID NO: 468617 - DNA, 25 bp, Rattus norvegicus
ggtgcagtgaattcctcctgaccat

SEQ ID NO: 468618 - DNA, 25 bp, Rattus norvegicus
ggtgcagtgactcaagccacaggtt

SEQ ID NO: 468619 - DNA, 25 bp, Rattus norvegicus
ggtgcagtgactgaagccacaggtt

SEQ ID NO: 468620 - DNA, 25 bp, Rattus norvegicus
ggtgcagtgcaaactaagcgaagaa

SEQ ID NO: 468621 - DNA, 25 bp, Rattus norvegicus
ggtgcagtgcaatctaagcgaagaa

SEQ ID NO: 468622 - DNA, 25 bp, Rattus norvegicus
ggtgcagtgctcctatataaagttc

SEQ ID NO: 468623 - DNA, 25 bp, Rattus norvegicus
ggtgcagtgctcgtatataaagttc

SEQ ID NO: 468624 - DNA, 25 bp, Rattus norvegicus
ggtgcagtgtgaatcccgccggctt

SEQ ID NO: 468625 - DNA, 25 bp, Rattus norvegicus
ggtgcagtgtgattcccgccggctt

SEQ ID NO: 468626 - DNA, 25 bp, Rattus norvegicus
ggtgcagttaccctttggcgatccc

SEQ ID NO: 468627 - DNA, 25 bp, Rattus norvegicus
ggtgcagttaccgtttggcgatccc

SEQ ID NO: 468628 - DNA, 25 bp, Rattus norvegicus
ggtgcataatgccttgcagcaaata

SEQ ID NO: 468629 - DNA, 25 bp, Rattus norvegicus
ggtgcataatgcgttgcagcaaata

SEQ ID NO: 468630 - DNA, 25 bp, Rattus norvegicus
ggtgcatagctgagagcctttgaaa

SEQ ID NO: 468631 - DNA, 25 bp, Rattus norvegicus
ggtgcatagctgtgagcctttgaaa

SEQ ID NO: 468632 - DNA, 25 bp, Rattus norvegicus
ggtgcatatattcctattttccatt

SEQ ID NO: 468633 - DNA, 25 bp, Rattus norvegicus
ggtgcatatattgctattttccatt

SEQ ID NO: 468634 - DNA, 25 bp, Rattus norvegicus
ggtgcatatttcagtcatgtctgct

SEQ ID NO: 468635 - DNA, 25 bp, Rattus norvegicus
ggtgcatatttctgtcatgtctgct

SEQ ID NO: 468636 - DNA, 25 bp, Rattus norvegicus
ggtgcatcaatcacggagctattca

SEQ ID NO: 468637 - DNA, 25 bp, Rattus norvegicus
ggtgcatcaatctcggagctattca

SEQ ID NO: 468638 - DNA, 25 bp, Rattus norvegicus
ggtgcatccactccgtctgcgcaat

SEQ ID NO: 468639 - DNA, 25 bp, Rattus norvegicus
ggtgcatccactgcgtctgcgcaat

SEQ ID NO: 468640 - DNA, 25 bp, Rattus norvegicus
ggtgcatcgcagcttcatggacgaa

SEQ ID NO: 468641 - DNA, 25 bp, Rattus norvegicus
ggtgcatcgcaggttcatggacgaa

SEQ ID NO: 468642 - DNA, 25 bp, Rattus norvegicus
ggtgcatctgagaccctgaggagca

SEQ ID NO: 468643 - DNA, 25 bp, Rattus norvegicus
ggtgcatctgagtccctgaggagca

SEQ ID NO: 468644 - DNA, 25 bp, Rattus norvegicus
ggtgcatctgccctctgagttcttt

SEQ ID NO: 468645 - DNA, 25 bp, Rattus norvegicus
ggtgcatctgccgtctgagttcttt

SEQ ID NO: 468646 - DNA, 25 bp, Rattus norvegicus
ggtgcatctgctcatggacttcgga

SEQ ID NO: 468647 - DNA, 25 bp, Rattus norvegicus
ggtgcatctgctctatcaagtctaa

SEQ ID NO: 468648 - DNA, 25 bp, Rattus norvegicus
ggtgcatctgctgatggacttcgga

SEQ ID NO: 468649 - DNA, 25 bp, Rattus norvegicus
ggtgcatctgctgtatcaagtctaa

SEQ ID NO: 468650 - DNA, 25 bp, Rattus norvegicus
ggtgcatctgtaacctgttttactt

SEQ ID NO: 468651 - DNA, 25 bp, Rattus norvegicus
ggtgcatctgtatcctgttttactt

SEQ ID NO: 468652 - DNA, 25 bp, Rattus norvegicus
ggtgcatcttggctgaacggttcat

SEQ ID NO: 468653 - DNA, 25 bp, Rattus norvegicus
ggtgcatcttgggtgaacggttcat

SEQ ID NO: 468654 - DNA, 25 bp, Rattus norvegicus
ggtgcatgaacaagaacgtgtacac

SEQ ID NO: 468655 - DNA, 25 bp, Rattus norvegicus
ggtgcatgaacatgaacgtgtacac

SEQ ID NO: 468656 - DNA, 25 bp, Rattus norvegicus
ggtgcatgaaccacccacgcagaag

SEQ ID NO: 468657 - DNA, 25 bp, Rattus norvegicus
ggtgcatgaacctcccacgcagaag

SEQ ID NO: 468658 - DNA, 25 bp, Rattus norvegicus
ggtgcatgaccaattgtcagctgtc

SEQ ID NO: 468659 - DNA, 25 bp, Rattus norvegicus
ggtgcatgaccatttgtcagctgtc

SEQ ID NO: 468660 - DNA, 25 bp, Rattus norvegicus
ggtgcatgatctcctgtacagtccc

SEQ ID NO: 468661 - DNA, 25 bp, Rattus norvegicus
ggtgcatgatctgctgtacagtccc

SEQ ID NO: 468662 - DNA, 25 bp, Rattus norvegicus
ggtgcatgatgaagaattcacaaag

SEQ ID NO: 468663 - DNA, 25 bp, Rattus norvegicus
ggtgcatgatgatgaattcacaaag

SEQ ID NO: 468664 - DNA, 25 bp, Rattus norvegicus
ggtgcatgcctgaatgttagtcata

SEQ ID NO: 468665 - DNA, 25 bp, Rattus norvegicus
ggtgcatgcctgtatgttagtcata

SEQ ID NO: 468666 - DNA, 25 bp, Rattus norvegicus
ggtgcatggcacataagccactttt

SEQ ID NO: 468667 - DNA, 25 bp, Rattus norvegicus
ggtgcatggcacttaagccactttt

SEQ ID NO: 468668 - DNA, 25 bp, Rattus norvegicus
ggtgcatggcctccgtttccggcca

SEQ ID NO: 468669 - DNA, 25 bp, Rattus norvegicus
ggtgcatggcctgcgtttccggcca

SEQ ID NO: 468670 - DNA, 25 bp, Rattus norvegicus
ggtgcatggctaatcatccaggcaa

SEQ ID NO: 468671 - DNA, 25 bp, Rattus norvegicus
ggtgcatggctattcatccaggcaa

SEQ ID NO: 468672 - DNA, 25 bp, Rattus norvegicus
ggtgcatgggtcagaattcctttcc

SEQ ID NO: 468673 - DNA, 25 bp, Rattus norvegicus
ggtgcatgggtctgaattcctttcc

SEQ ID NO: 468674 - DNA, 25 bp, Rattus norvegicus
ggtgcatggttgcaagatcaccagt

SEQ ID NO: 468675 - DNA, 25 bp, Rattus norvegicus
ggtgcatggttggaagatcaccagt

SEQ ID NO: 468676 - DNA, 25 bp, Rattus norvegicus
ggtgcatgtctaaagtcactcagaa

SEQ ID NO: 468677 - DNA, 25 bp, Rattus norvegicus
ggtgcatgtctaataacacagatat

SEQ ID NO: 468678 - DNA, 25 bp, Rattus norvegicus
ggtgcatgtctatagtcactcagaa

SEQ ID NO: 468679 - DNA, 25 bp, Rattus norvegicus
ggtgcatgtctattaacacagatat

SEQ ID NO: 468680 - DNA, 25 bp, Rattus norvegicus
ggtgcatgtgacagccagtgacatt

SEQ ID NO: 468681 - DNA, 25 bp, Rattus norvegicus
ggtgcatgtgactgccagtgacatt

SEQ ID NO: 468682 - DNA, 25 bp, Rattus norvegicus
ggtgcatgtgtgaaacctcagcatt

SEQ ID NO: 468683 - DNA, 25 bp, Rattus norvegicus
ggtgcatgtgtgtaacctcagcatt

SEQ ID NO: 468684 - DNA, 25 bp, Rattus norvegicus
ggtgcatgttgcagtgaggtccttc

SEQ ID NO: 468685 - DNA, 25 bp, Rattus norvegicus
ggtgcatgttgctgtgaggtccttc

SEQ ID NO: 468686 - DNA, 25 bp, Rattus norvegicus
ggtgcatgtttgagatctttaggac

SEQ ID NO: 468687 - DNA, 25 bp, Rattus norvegicus
ggtgcatgtttgtgatctttaggac

SEQ ID NO: 468688 - DNA, 25 bp, Rattus norvegicus
ggtgcattctttattcttcagtgtc

SEQ ID NO: 468689 - DNA, 25 bp, Rattus norvegicus
ggtgcattcttttttcttcagtgtc

SEQ ID NO: 468690 - DNA, 25 bp, Rattus norvegicus
ggtgcattgtacactagctcagctc

SEQ ID NO: 468691 - DNA, 25 bp, Rattus norvegicus
ggtgcattgtactctagctcagctc

SEQ ID NO: 468692 - DNA, 25 bp, Rattus norvegicus
ggtgcatttttcatgggagaccaat

SEQ ID NO: 468693 - DNA, 25 bp, Rattus norvegicus
ggtgcatttttcttgggagaccaat

SEQ ID NO: 468694 - DNA, 25 bp, Rattus norvegicus
ggtgccaaagctcactgggacgaaa

SEQ ID NO: 468695 - DNA, 25 bp, Rattus norvegicus
ggtgccaaagctgactgggacgaaa

SEQ ID NO: 468696 - DNA, 25 bp, Rattus norvegicus
ggtgccaacataaaattcctcttaa

SEQ ID NO: 468697 - DNA, 25 bp, Rattus norvegicus
ggtgccaacatataattcctcttaa

SEQ ID NO: 468698 - DNA, 25 bp, Rattus norvegicus
ggtgccaaccccaaacgtatcagtt

SEQ ID NO: 468699 - DNA, 25 bp, Rattus norvegicus
ggtgccaacccctaacgtatcagtt

SEQ ID NO: 468700 - DNA, 25 bp, Rattus norvegicus
ggtgccaactgccacactaagtgcc

SEQ ID NO: 468701 - DNA, 25 bp, Rattus norvegicus
ggtgccaactgcgacactaagtgcc

SEQ ID NO: 468702 - DNA, 25 bp, Rattus norvegicus
ggtgccaagacaatgacacggctta

SEQ ID NO: 468703 - DNA, 25 bp, Rattus norvegicus
ggtgccaagacattgacacggctta

SEQ ID NO: 468704 - DNA, 25 bp, Rattus norvegicus
ggtgccaagagccagatcctctttg

SEQ ID NO: 468705 - DNA, 25 bp, Rattus norvegicus
ggtgccaagagcgagatcctctttg

SEQ ID NO: 468706 - DNA, 25 bp, Rattus norvegicus
ggtgccaagctcacaggcggtccag

SEQ ID NO: 468707 - DNA, 25 bp, Rattus norvegicus
ggtgccaagctctcaggcggtccag

SEQ ID NO: 468708 - DNA, 25 bp, Rattus norvegicus
ggtgccaagtgacgccttttctgaa

SEQ ID NO: 468709 - DNA, 25 bp, Rattus norvegicus
ggtgccaagtgaggccttttctgaa

SEQ ID NO: 468710 - DNA, 25 bp, Rattus norvegicus
ggtgccaatgtgaaccacttctgag

SEQ ID NO: 468711 - DNA, 25 bp, Rattus norvegicus
ggtgccaatgtgtaccacttctgag

SEQ ID NO: 468712 - DNA, 25 bp, Rattus norvegicus
ggtgccacacggctgtttagttaca

SEQ ID NO: 468713 - DNA, 25 bp, Rattus norvegicus
ggtgccacacgggtgtttagttaca

SEQ ID NO: 468714 - DNA, 25 bp, Rattus norvegicus
ggtgccacagcacattactagtgtt

SEQ ID NO: 468715 - DNA, 25 bp, Rattus norvegicus
ggtgccacagcagattactagtgtt

SEQ ID NO: 468716 - DNA, 25 bp, Rattus norvegicus
ggtgccacagtgaagccacggatga

SEQ ID NO: 468717 - DNA, 25 bp, Rattus norvegicus
ggtgccacagtgtagccacggatga

SEQ ID NO: 468718 - DNA, 25 bp, Rattus norvegicus
ggtgccacatgaatcatcgcagagt

SEQ ID NO: 468719 - DNA, 25 bp, Rattus norvegicus
ggtgccacatgattcatcgcagagt

SEQ ID NO: 468720 - DNA, 25 bp, Rattus norvegicus
ggtgccaccaacaagcgaacaagtt

SEQ ID NO: 468721 - DNA, 25 bp, Rattus norvegicus
ggtgccaccaactagcgaacaagtt

SEQ ID NO: 468722 - DNA, 25 bp, Rattus norvegicus
ggtgccacccaaagctgcagaaaga

SEQ ID NO: 468723 - DNA, 25 bp, Rattus norvegicus
ggtgccacccaatgctgcagaaaga

SEQ ID NO: 468724 - DNA, 25 bp, Rattus norvegicus
ggtgccactgtactctgataacact

SEQ ID NO: 468725 - DNA, 25 bp, Rattus norvegicus
ggtgccactgtagtctgataacact

SEQ ID NO: 468726 - DNA, 25 bp, Rattus norvegicus
ggtgccactgtgaatcttgtaagag

SEQ ID NO: 468727 - DNA, 25 bp, Rattus norvegicus
ggtgccactgtgtatcttgtaagag

SEQ ID NO: 468728 - DNA, 25 bp, Rattus norvegicus
ggtgccagagaaaatgctctcaatt

SEQ ID NO: 468729 - DNA, 25 bp, Rattus norvegicus
ggtgccagagaatatgctctcaatt

SEQ ID NO: 468730 - DNA, 25 bp, Rattus norvegicus
ggtgccagcaagaaaagcctcgctt

SEQ ID NO: 468731 - DNA, 25 bp, Rattus norvegicus
ggtgccagcaagtaaagcctcgctt

SEQ ID NO: 468732 - DNA, 25 bp, Rattus norvegicus
ggtgccagcattcggttcagcccca

SEQ ID NO: 468733 - DNA, 25 bp, Rattus norvegicus
ggtgccagcattgggttcagcccca

SEQ ID NO: 468734 - DNA, 25 bp, Rattus norvegicus
ggtgccagctgcaggctggtcacct

SEQ ID NO: 468735 - DNA, 25 bp, Rattus norvegicus
ggtgccagctgctggctggtcacct

SEQ ID NO: 468736 - DNA, 25 bp, Rattus norvegicus
ggtgccagctttattgtgactccac

SEQ ID NO: 468737 - DNA, 25 bp, Rattus norvegicus
ggtgccagcttttttgtgactccac

SEQ ID NO: 468738 - DNA, 25 bp, Rattus norvegicus
ggtgccagggccacagcttaagtac

SEQ ID NO: 468739 - DNA, 25 bp, Rattus norvegicus
ggtgccagggcctcagcttaagtac

SEQ ID NO: 468740 - DNA, 25 bp, Rattus norvegicus
ggtgccagtacaaaagtcagcactg

SEQ ID NO: 468741 - DNA, 25 bp, Rattus norvegicus
ggtgccagtacataagtcagcactg

SEQ ID NO: 468742 - DNA, 25 bp, Rattus norvegicus
ggtgccagtgataaatctccccgaa

SEQ ID NO: 468743 - DNA, 25 bp, Rattus norvegicus
ggtgccagtgattaatctccccgaa

SEQ ID NO: 468744 - DNA, 25 bp, Rattus norvegicus
ggtgccatactcataggctaccaga

SEQ ID NO: 468745 - DNA, 25 bp, Rattus norvegicus
ggtgccatactcttaggctaccaga

SEQ ID NO: 468746 - DNA, 25 bp, Rattus norvegicus
ggtgccatacttactctagttttac

SEQ ID NO: 468747 - DNA, 25 bp, Rattus norvegicus
ggtgccatactttctctagttttac

SEQ ID NO: 468748 - DNA, 25 bp, Rattus norvegicus
ggtgccatccaccatgggacaagag

SEQ ID NO: 468749 - DNA, 25 bp, Rattus norvegicus
ggtgccatccacctatggaggacaa

SEQ ID NO: 468750 - DNA, 25 bp, Rattus norvegicus
ggtgccatccacgatgggacaagag

SEQ ID NO: 468751 - DNA, 25 bp, Rattus norvegicus
ggtgccatccacgtatggaggacaa

SEQ ID NO: 468752 - DNA, 25 bp, Rattus norvegicus
ggtgccatgtgtctctgttcccaga

SEQ ID NO: 468753 - DNA, 25 bp, Rattus norvegicus
ggtgccatgtgtgtctgttcccaga

SEQ ID NO: 468754 - DNA, 25 bp, Rattus norvegicus
ggtgccattacgatctgtgggcttc

SEQ ID NO: 468755 - DNA, 25 bp, Rattus norvegicus
ggtgccattacgttctgtgggcttc

SEQ ID NO: 468756 - DNA, 25 bp, Rattus norvegicus
ggtgccattccaagtgtccagataa

SEQ ID NO: 468757 - DNA, 25 bp, Rattus norvegicus
ggtgccattccatgtgtccagataa

SEQ ID NO: 468758 - DNA, 25 bp, Rattus norvegicus
ggtgccattgatcgcccagaactga

SEQ ID NO: 468759 - DNA, 25 bp, Rattus norvegicus
ggtgccattgatggcccagaactga

SEQ ID NO: 468760 - DNA, 25 bp, Rattus norvegicus
ggtgccattgcccatgtgtatattg

SEQ ID NO: 468761 - DNA, 25 bp, Rattus norvegicus
ggtgccattgccgatgtgtatattg

SEQ ID NO: 468762 - DNA, 25 bp, Rattus norvegicus
ggtgccattggcaattactctggag

SEQ ID NO: 468763 - DNA, 25 bp, Rattus norvegicus
ggtgccattggctattactctggag

SEQ ID NO: 468764 - DNA, 25 bp, Rattus norvegicus
ggtgccatttgcagaatcatgtcct

SEQ ID NO: 468765 - DNA, 25 bp, Rattus norvegicus
ggtgccatttgctgaatcatgtcct

SEQ ID NO: 468766 - DNA, 25 bp, Rattus norvegicus
ggtgcccacacaacagatactattg

SEQ ID NO: 468767 - DNA, 25 bp, Rattus norvegicus
ggtgcccacacatcagatactattg

SEQ ID NO: 468768 - DNA, 25 bp, Rattus norvegicus
ggtgcccacacgatggcaaggtttt

SEQ ID NO: 468769 - DNA, 25 bp, Rattus norvegicus
ggtgcccacacgttggcaaggtttt

SEQ ID NO: 468770 - DNA, 25 bp, Rattus norvegicus
ggtgcccaccaaacaacattcaaat

SEQ ID NO: 468771 - DNA, 25 bp, Rattus norvegicus
ggtgcccaccaatcaacattcaaat

SEQ ID NO: 468772 - DNA, 25 bp, Rattus norvegicus
ggtgcccaccacacagtttagtcat

SEQ ID NO: 468773 - DNA, 25 bp, Rattus norvegicus
ggtgcccaccactcagtttagtcat

SEQ ID NO: 468774 - DNA, 25 bp, Rattus norvegicus
ggtgcccaccctcaaagttcaaagt

SEQ ID NO: 468775 - DNA, 25 bp, Rattus norvegicus
ggtgcccaccctgaaagttcaaagt

SEQ ID NO: 468776 - DNA, 25 bp, Rattus norvegicus
ggtgcccacggcagggttcgtcctt

SEQ ID NO: 468777 - DNA, 25 bp, Rattus norvegicus
ggtgcccacggctgggttcgtcctt

SEQ ID NO: 468778 - DNA, 25 bp, Rattus norvegicus
ggtgcccacttgaatagttccctgg

SEQ ID NO: 468779 - DNA, 25 bp, Rattus norvegicus
ggtgcccacttgtatagttccctgg

SEQ ID NO: 468780 - DNA, 25 bp, Rattus norvegicus
ggtgcccagagtccagaacgcccag

SEQ ID NO: 468781 - DNA, 25 bp, Rattus norvegicus
ggtgcccagagtgcagaacgcccag

SEQ ID NO: 468782 - DNA, 25 bp, Rattus norvegicus
ggtgcccagatactgccaagatctt

SEQ ID NO: 468783 - DNA, 25 bp, Rattus norvegicus
ggtgcccagatagtgccaagatctt

SEQ ID NO: 468784 - DNA, 25 bp, Rattus norvegicus
ggtgcccaggacagacttttttact

SEQ ID NO: 468785 - DNA, 25 bp, Rattus norvegicus
ggtgcccaggactgacttttttact

SEQ ID NO: 468786 - DNA, 25 bp, Rattus norvegicus
ggtgcccaggctatggacatttgaa

SEQ ID NO: 468787 - DNA, 25 bp, Rattus norvegicus
ggtgcccaggctttggacatttgaa

SEQ ID NO: 468788 - DNA, 25 bp, Rattus norvegicus
ggtgcccagggcacagaatccttaa

SEQ ID NO: 468789 - DNA, 25 bp, Rattus norvegicus
ggtgcccagggctcagaatccttaa

SEQ ID NO: 468790 - DNA, 25 bp, Rattus norvegicus
ggtgcccattaaaattatctacgga

SEQ ID NO: 468791 - DNA, 25 bp, Rattus norvegicus
ggtgcccattaatattatctacgga

SEQ ID NO: 468792 - DNA, 25 bp, Rattus norvegicus
ggtgcccattgtagtagagcctgcc

SEQ ID NO: 468793 - DNA, 25 bp, Rattus norvegicus
ggtgcccattgttgtagagcctgcc

SEQ ID NO: 468794 - DNA, 25 bp, Rattus norvegicus
ggtgccccaattaattgcccaataa

SEQ ID NO: 468795 - DNA, 25 bp, Rattus norvegicus
ggtgccccaattataagagatggtg

SEQ ID NO: 468796 - DNA, 25 bp, Rattus norvegicus
ggtgccccaatttattgcccaataa

SEQ ID NO: 468797 - DNA, 25 bp, Rattus norvegicus
ggtgccccaattttaagagatggtg

SEQ ID NO: 468798 - DNA, 25 bp, Rattus norvegicus
ggtgccccagaaaaccatggtgact

SEQ ID NO: 468799 - DNA, 25 bp, Rattus norvegicus
ggtgccccagaataccatggtgact

SEQ ID NO: 468800 - DNA, 25 bp, Rattus norvegicus
ggtgccccaggaagaaccagcaaga

SEQ ID NO: 468801 - DNA, 25 bp, Rattus norvegicus
ggtgccccaggatgaaccagcaaga

SEQ ID NO: 468802 - DNA, 25 bp, Rattus norvegicus
ggtgccccgcaaatttgaggcctat

SEQ ID NO: 468803 - DNA, 25 bp, Rattus norvegicus
ggtgccccgcaattttgaggcctat

SEQ ID NO: 468804 - DNA, 25 bp, Rattus norvegicus
ggtgcccctgggaaatagtgttcaa

SEQ ID NO: 468805 - DNA, 25 bp, Rattus norvegicus
ggtgcccctgggtaatagtgttcaa

SEQ ID NO: 468806 - DNA, 25 bp, Rattus norvegicus
ggtgccccttcgacgacaggctgtg

SEQ ID NO: 468807 - DNA, 25 bp, Rattus norvegicus
ggtgccccttcgtcgacaggctgtg

SEQ ID NO: 468808 - DNA, 25 bp, Rattus norvegicus
ggtgcccgactgcaagtacaagctc

SEQ ID NO: 468809 - DNA, 25 bp, Rattus norvegicus
ggtgcccgactggaagtacaagctc

SEQ ID NO: 468810 - DNA, 25 bp, Rattus norvegicus
ggtgccctaggcagcagaagtctcc

SEQ ID NO: 468811 - DNA, 25 bp, Rattus norvegicus
ggtgccctaggctgcagaagtctcc

SEQ ID NO: 468812 - DNA, 25 bp, Rattus norvegicus
ggtgccctcttcatagggtactgca

SEQ ID NO: 468813 - DNA, 25 bp, Rattus norvegicus
ggtgccctcttcttagggtactgca

SEQ ID NO: 468814 - DNA, 25 bp, Rattus norvegicus
ggtgccctctttagaactttacagc

SEQ ID NO: 468815 - DNA, 25 bp, Rattus norvegicus
ggtgccctcttttgaactttacagc

SEQ ID NO: 468816 - DNA, 25 bp, Rattus norvegicus
ggtgccctgcagatatcggatgtca

SEQ ID NO: 468817 - DNA, 25 bp, Rattus norvegicus
ggtgccctgcagttatcggatgtca

SEQ ID NO: 468818 - DNA, 25 bp, Rattus norvegicus
ggtgccctggcactttagattacca

SEQ ID NO: 468819 - DNA, 25 bp, Rattus norvegicus
ggtgccctggcagtttagattacca

SEQ ID NO: 468820 - DNA, 25 bp, Rattus norvegicus
ggtgccctgggtatgattccttacg

SEQ ID NO: 468821 - DNA, 25 bp, Rattus norvegicus
ggtgccctgggtttgattccttacg

SEQ ID NO: 468822 - DNA, 25 bp, Rattus norvegicus
ggtgccctgtatatgcaggctgtat

SEQ ID NO: 468823 - DNA, 25 bp, Rattus norvegicus
ggtgccctgtatttgcaggctgtat

SEQ ID NO: 468824 - DNA, 25 bp, Rattus norvegicus
ggtgccctgtgaccatcaagtacca

SEQ ID NO: 468825 - DNA, 25 bp, Rattus norvegicus
ggtgccctgtgagcatcaagtacca

SEQ ID NO: 468826 - DNA, 25 bp, Rattus norvegicus
ggtgccctgttgacatgacgttatt

SEQ ID NO: 468827 - DNA, 25 bp, Rattus norvegicus
ggtgccctgttgtcatgacgttatt

SEQ ID NO: 468828 - DNA, 25 bp, Rattus norvegicus
ggtgcccttgggacagagtattgct

SEQ ID NO: 468829 - DNA, 25 bp, Rattus norvegicus
ggtgcccttgggtcagagtattgct

SEQ ID NO: 468830 - DNA, 25 bp, Rattus norvegicus
ggtgccgacactctaggtaggctca

SEQ ID NO: 468831 - DNA, 25 bp, Rattus norvegicus
ggtgccgacactgtaggtaggctca

SEQ ID NO: 468832 - DNA, 25 bp, Rattus norvegicus
ggtgccgatgcccttgcttgaactc

SEQ ID NO: 468833 - DNA, 25 bp, Rattus norvegicus
ggtgccgatgccgttgcttgaactc

SEQ ID NO: 468834 - DNA, 25 bp, Rattus norvegicus
ggtgccgattatccattaccgcatg

SEQ ID NO: 468835 - DNA, 25 bp, Rattus norvegicus
ggtgccgattatgcattaccgcatg

SEQ ID NO: 468836 - DNA, 25 bp, Rattus norvegicus
ggtgccgattccaacaaagatgctg

SEQ ID NO: 468837 - DNA, 25 bp, Rattus norvegicus
ggtgccgattcctacaaagatgctg

SEQ ID NO: 468838 - DNA, 25 bp, Rattus norvegicus
ggtgccgctatgcttgctctggcaa

SEQ ID NO: 468839 - DNA, 25 bp, Rattus norvegicus
ggtgccgctatggttgctctggcaa

SEQ ID NO: 468840 - DNA, 25 bp, Rattus norvegicus
ggtgccgctcaccactattgagcaa

SEQ ID NO: 468841 - DNA, 25 bp, Rattus norvegicus
ggtgccgctcacgactattgagcaa

SEQ ID NO: 468842 - DNA, 25 bp, Rattus norvegicus
ggtgccgctcctcagtgagaatgaa

SEQ ID NO: 468843 - DNA, 25 bp, Rattus norvegicus
ggtgccgctcctgagtgagaatgaa

SEQ ID NO: 468844 - DNA, 25 bp, Rattus norvegicus
ggtgccgggcacagcctcggattcc

SEQ ID NO: 468845 - DNA, 25 bp, Rattus norvegicus
ggtgccgggcactgcctcggattcc

SEQ ID NO: 468846 - DNA, 25 bp, Rattus norvegicus
ggtgccgtacatcaatggcaagttt

SEQ ID NO: 468847 - DNA, 25 bp, Rattus norvegicus
ggtgccgtacatgaatggcaagttt

SEQ ID NO: 468848 - DNA, 25 bp, Rattus norvegicus
ggtgccgtcgctcctaggctctgtc

SEQ ID NO: 468849 - DNA, 25 bp, Rattus norvegicus
ggtgccgtcgctgctaggctctgtc

SEQ ID NO: 468850 - DNA, 25 bp, Rattus norvegicus
ggtgccgtgcccattaagaggagaa

SEQ ID NO: 468851 - DNA, 25 bp, Rattus norvegicus
ggtgccgtgccctttaagaggagaa

SEQ ID NO: 468852 - DNA, 25 bp, Rattus norvegicus
ggtgccgtgccgaattggaacaaga

SEQ ID NO: 468853 - DNA, 25 bp, Rattus norvegicus
ggtgccgtgccgtattggaacaaga

SEQ ID NO: 468854 - DNA, 25 bp, Rattus norvegicus
ggtgccgttcacctttaagaatatg

SEQ ID NO: 468855 - DNA, 25 bp, Rattus norvegicus
ggtgccgttcacgtttaagaatatg

SEQ ID NO: 468856 - DNA, 25 bp, Rattus norvegicus
ggtgcctaaaatccagtgccttatg

SEQ ID NO: 468857 - DNA, 25 bp, Rattus norvegicus
ggtgcctaaaatgcagtgccttatg

SEQ ID NO: 468858 - DNA, 25 bp, Rattus norvegicus
ggtgcctaacacaatggtccatttg

SEQ ID NO: 468859 - DNA, 25 bp, Rattus norvegicus
ggtgcctaacactatggtccatttg

SEQ ID NO: 468860 - DNA, 25 bp, Rattus norvegicus
ggtgcctacctgcaaagcctggagc

SEQ ID NO: 468861 - DNA, 25 bp, Rattus norvegicus
ggtgcctacctggaaagcctggagc

SEQ ID NO: 468862 - DNA, 25 bp, Rattus norvegicus
ggtgcctactttcctaacggactac

SEQ ID NO: 468863 - DNA, 25 bp, Rattus norvegicus
ggtgcctactttgctaacggactac

SEQ ID NO: 468864 - DNA, 25 bp, Rattus norvegicus
ggtgcctagaagcagcccaagtgtt

SEQ ID NO: 468865 - DNA, 25 bp, Rattus norvegicus
ggtgcctagaaggagcccaagtgtt

SEQ ID NO: 468866 - DNA, 25 bp, Rattus norvegicus
ggtgcctaggaaagtgtcctctcca

SEQ ID NO: 468867 - DNA, 25 bp, Rattus norvegicus
ggtgcctaggaatgtgtcctctcca

SEQ ID NO: 468868 - DNA, 25 bp, Rattus norvegicus
ggtgcctataggatcttttcaggtg

SEQ ID NO: 468869 - DNA, 25 bp, Rattus norvegicus
ggtgcctataggttcttttcaggtg

SEQ ID NO: 468870 - DNA, 25 bp, Rattus norvegicus
ggtgcctatcatcagcaagccatct

SEQ ID NO: 468871 - DNA, 25 bp, Rattus norvegicus
ggtgcctatcatgagcaagccatct

SEQ ID NO: 468872 - DNA, 25 bp, Rattus norvegicus
ggtgcctatttgacaaaaactgaag

SEQ ID NO: 468873 - DNA, 25 bp, Rattus norvegicus
ggtgcctatttgtcaaaaactgaag

SEQ ID NO: 468874 - DNA, 25 bp, Rattus norvegicus
ggtgcctcactcatgtaatcccagt

SEQ ID NO: 468875 - DNA, 25 bp, Rattus norvegicus
ggtgcctcactcttgtaatcccagt

SEQ ID NO: 468876 - DNA, 25 bp, Rattus norvegicus
ggtgcctcactgataattcttctac

SEQ ID NO: 468877 - DNA, 25 bp, Rattus norvegicus
ggtgcctcactgttaattcttctac

SEQ ID NO: 468878 - DNA, 25 bp, Rattus norvegicus
ggtgcctcacttcgattacatctgt

SEQ ID NO: 468879 - DNA, 25 bp, Rattus norvegicus
ggtgcctcacttggattacatctgt

SEQ ID NO: 468880 - DNA, 25 bp, Rattus norvegicus
ggtgcctccaatccggaagtttaag

SEQ ID NO: 468881 - DNA, 25 bp, Rattus norvegicus
ggtgcctccaatgcggaagtttaag

SEQ ID NO: 468882 - DNA, 25 bp, Rattus norvegicus
ggtgcctccttgctcacagagtcat

SEQ ID NO: 468883 - DNA, 25 bp, Rattus norvegicus
ggtgcctccttggtcacagagtcat

SEQ ID NO: 468884 - DNA, 25 bp, Rattus norvegicus
ggtgcctctagtattggtgtgagat

SEQ ID NO: 468885 - DNA, 25 bp, Rattus norvegicus
ggtgcctctagttttggtgtgagat

SEQ ID NO: 468886 - DNA, 25 bp, Rattus norvegicus
ggtgcctctatgaaactgctttgta

SEQ ID NO: 468887 - DNA, 25 bp, Rattus norvegicus
ggtgcctctatgtaactgctttgta

SEQ ID NO: 468888 - DNA, 25 bp, Rattus norvegicus
ggtgcctctccaatagagtgtgcat

SEQ ID NO: 468889 - DNA, 25 bp, Rattus norvegicus
ggtgcctctccattagagtgtgcat

SEQ ID NO: 468890 - DNA, 25 bp, Rattus norvegicus
ggtgcctctggcattgttgaagctg

SEQ ID NO: 468891 - DNA, 25 bp, Rattus norvegicus
ggtgcctctggctttgttgaagctg

SEQ ID NO: 468892 - DNA, 25 bp, Rattus norvegicus
ggtgcctctgttcattggccagtat

SEQ ID NO: 468893 - DNA, 25 bp, Rattus norvegicus
ggtgcctctgttgattggccagtat

SEQ ID NO: 468894 - DNA, 25 bp, Rattus norvegicus
ggtgcctcttcacggaactttggta

SEQ ID NO: 468895 - DNA, 25 bp, Rattus norvegicus
ggtgcctcttcagggaactttggta

SEQ ID NO: 468896 - DNA, 25 bp, Rattus norvegicus
ggtgcctgatgaagagaccgtcaac

SEQ ID NO: 468897 - DNA, 25 bp, Rattus norvegicus
ggtgcctgatgatgagaccgtcaac

SEQ ID NO: 468898 - DNA, 25 bp, Rattus norvegicus
ggtgcctgccaaagaacttcactga

SEQ ID NO: 468899 - DNA, 25 bp, Rattus norvegicus
ggtgcctgccaaatcagtaacaaag

SEQ ID NO: 468900 - DNA, 25 bp, Rattus norvegicus
ggtgcctgccaatgaacttcactga

SEQ ID NO: 468901 - DNA, 25 bp, Rattus norvegicus
ggtgcctgccaattcagtaacaaag

SEQ ID NO: 468902 - DNA, 25 bp, Rattus norvegicus
ggtgcctgcgtaactctatacagaa

SEQ ID NO: 468903 - DNA, 25 bp, Rattus norvegicus
ggtgcctgcgtatctctatacagaa

SEQ ID NO: 468904 - DNA, 25 bp, Rattus norvegicus
ggtgcctgctcaattctagaagttg

SEQ ID NO: 468905 - DNA, 25 bp, Rattus norvegicus
ggtgcctgctcatttctagaagttg

SEQ ID NO: 468906 - DNA, 25 bp, Rattus norvegicus
ggtgcctgcttactatatacatcgg

SEQ ID NO: 468907 - DNA, 25 bp, Rattus norvegicus
ggtgcctgcttagtatatacatcgg

SEQ ID NO: 468908 - DNA, 25 bp, Rattus norvegicus
ggtgcctgggaaagtgtcagccaca

SEQ ID NO: 468909 - DNA, 25 bp, Rattus norvegicus
ggtgcctgggaatgtgtcagccaca

SEQ ID NO: 468910 - DNA, 25 bp, Rattus norvegicus
ggtgcctgggcaccttcactgataa

SEQ ID NO: 468911 - DNA, 25 bp, Rattus norvegicus
ggtgcctgggcagcttcactgataa

SEQ ID NO: 468912 - DNA, 25 bp, Rattus norvegicus
ggtgcctgggccagaagtctgctct

SEQ ID NO: 468913 - DNA, 25 bp, Rattus norvegicus
ggtgcctgggccataagaaactagc

SEQ ID NO: 468914 - DNA, 25 bp, Rattus norvegicus
ggtgcctgggcctgaagtctgctct

SEQ ID NO: 468915 - DNA, 25 bp, Rattus norvegicus
ggtgcctgggccttaagaaactagc

SEQ ID NO: 468916 - DNA, 25 bp, Rattus norvegicus
ggtgcctgggtcatcagcgagtccc

SEQ ID NO: 468917 - DNA, 25 bp, Rattus norvegicus
ggtgcctgggtcttcagcgagtccc

SEQ ID NO: 468918 - DNA, 25 bp, Rattus norvegicus
ggtgcctgtgccactagcagagatc

SEQ ID NO: 468919 - DNA, 25 bp, Rattus norvegicus
ggtgcctgtgcctctagcagagatc

SEQ ID NO: 468920 - DNA, 25 bp, Rattus norvegicus
ggtgcctgtgtaacctgaaagtaaa

SEQ ID NO: 468921 - DNA, 25 bp, Rattus norvegicus
ggtgcctgtgtatcctgaaagtaaa

SEQ ID NO: 468922 - DNA, 25 bp, Rattus norvegicus
ggtgcctgtgttaagggtccttatt

SEQ ID NO: 468923 - DNA, 25 bp, Rattus norvegicus
ggtgcctgtgttacattgtctggtc

SEQ ID NO: 468924 - DNA, 25 bp, Rattus norvegicus
ggtgcctgtgtttagggtccttatt

SEQ ID NO: 468925 - DNA, 25 bp, Rattus norvegicus
ggtgcctgtgtttcattgtctggtc

SEQ ID NO: 468926 - DNA, 25 bp, Rattus norvegicus
ggtgcctgttaacgaccggatcatt

SEQ ID NO: 468927 - DNA, 25 bp, Rattus norvegicus
ggtgcctgttaaggaccggatcatt

SEQ ID NO: 468928 - DNA, 25 bp, Rattus norvegicus
ggtgccttagccaaacttctagtgc

SEQ ID NO: 468929 - DNA, 25 bp, Rattus norvegicus
ggtgccttagcctaacttctagtgc

SEQ ID NO: 468930 - DNA, 25 bp, Rattus norvegicus
ggtgccttcacgctatattcggaca

SEQ ID NO: 468931 - DNA, 25 bp, Rattus norvegicus
ggtgccttcacggtatattcggaca

SEQ ID NO: 468932 - DNA, 25 bp, Rattus norvegicus
ggtgccttcccaatgacgaagtgca

SEQ ID NO: 468933 - DNA, 25 bp, Rattus norvegicus
ggtgccttcccattgacgaagtgca

SEQ ID NO: 468934 - DNA, 25 bp, Rattus norvegicus
ggtgccttccgaatcatgctggaat

SEQ ID NO: 468935 - DNA, 25 bp, Rattus norvegicus
ggtgccttccgattcatgctggaat

SEQ ID NO: 468936 - DNA, 25 bp, Rattus norvegicus
ggtgccttctataacatcattccag

SEQ ID NO: 468937 - DNA, 25 bp, Rattus norvegicus
ggtgccttctattacatcattccag

SEQ ID NO: 468938 - DNA, 25 bp, Rattus norvegicus
ggtgccttctggatggaaccctttc

SEQ ID NO: 468939 - DNA, 25 bp, Rattus norvegicus
ggtgccttctggttggaaccctttc

SEQ ID NO: 468940 - DNA, 25 bp, Rattus norvegicus
ggtgccttgaaaactatgacctcaa

SEQ ID NO: 468941 - DNA, 25 bp, Rattus norvegicus
ggtgccttgaaatctatgacctcaa

SEQ ID NO: 468942 - DNA, 25 bp, Rattus norvegicus
ggtgccttgccaacttcaggatgaa

SEQ ID NO: 468943 - DNA, 25 bp, Rattus norvegicus
ggtgccttgccatcttcaggatgaa

SEQ ID NO: 468944 - DNA, 25 bp, Rattus norvegicus
ggtgcctttatgaaatatatcccga

SEQ ID NO: 468945 - DNA, 25 bp, Rattus norvegicus
ggtgcctttatgtaatatatcccga

SEQ ID NO: 468946 - DNA, 25 bp, Rattus norvegicus
ggtgcgaactctaggtgtaggtctt

SEQ ID NO: 468947 - DNA, 25 bp, Rattus norvegicus
ggtgcgaactcttggtgtaggtctt

SEQ ID NO: 468948 - DNA, 25 bp, Rattus norvegicus
ggtgcgactgaccttcacagagcag

SEQ ID NO: 468949 - DNA, 25 bp, Rattus norvegicus
ggtgcgactgacgttcacagagcag

SEQ ID NO: 468950 - DNA, 25 bp, Rattus norvegicus
ggtgcgatccatcacagagcagtat

SEQ ID NO: 468951 - DNA, 25 bp, Rattus norvegicus
ggtgcgatccatgacagagcagtat

SEQ ID NO: 468952 - DNA, 25 bp, Rattus norvegicus
ggtgcgcatgagctatctccccagt

SEQ ID NO: 468953 - DNA, 25 bp, Rattus norvegicus
ggtgcgcatgaggtatctccccagt

SEQ ID NO: 468954 - DNA, 25 bp, Rattus norvegicus
ggtgcgccagtcagagtttctcaag

SEQ ID NO: 468955 - DNA, 25 bp, Rattus norvegicus
ggtgcgccagtctgagtttctcaag

SEQ ID NO: 468956 - DNA, 25 bp, Rattus norvegicus
ggtgcgccgacaaagccatctacag

SEQ ID NO: 468957 - DNA, 25 bp, Rattus norvegicus
ggtgcgccgacatagccatctacag

SEQ ID NO: 468958 - DNA, 25 bp, Rattus norvegicus
ggtgcgcgcctcaaaagctggacag

SEQ ID NO: 468959 - DNA, 25 bp, Rattus norvegicus
ggtgcgcgcctctaaagctggacag

SEQ ID NO: 468960 - DNA, 25 bp, Rattus norvegicus
ggtgcgctatgcatacaatctacag

SEQ ID NO: 468961 - DNA, 25 bp, Rattus norvegicus
ggtgcgctatgcttacaatctacag

SEQ ID NO: 468962 - DNA, 25 bp, Rattus norvegicus
ggtgcgctgccaacaattttgtata

SEQ ID NO: 468963 - DNA, 25 bp, Rattus norvegicus
ggtgcgctgccatcaattttgtata

SEQ ID NO: 468964 - DNA, 25 bp, Rattus norvegicus
ggtgcgcttctaatagagttgtggt

SEQ ID NO: 468965 - DNA, 25 bp, Rattus norvegicus
ggtgcgcttctattagagttgtggt

SEQ ID NO: 468966 - DNA, 25 bp, Rattus norvegicus
ggtgcggagggactctctcaaactt

SEQ ID NO: 468967 - DNA, 25 bp, Rattus norvegicus
ggtgcggagggagtctctcaaactt

SEQ ID NO: 468968 - DNA, 25 bp, Rattus norvegicus
ggtgcgggcaagcagcgctggcaga

SEQ ID NO: 468969 - DNA, 25 bp, Rattus norvegicus
ggtgcgggcaaggagcgctggcaga

SEQ ID NO: 468970 - DNA, 25 bp, Rattus norvegicus
ggtgcggtaagaatgaacctgcaaa

SEQ ID NO: 468971 - DNA, 25 bp, Rattus norvegicus
ggtgcggtaagattgaacctgcaaa

SEQ ID NO: 468972 - DNA, 25 bp, Rattus norvegicus
ggtgcggtggccacgaccacctacg

SEQ ID NO: 468973 - DNA, 25 bp, Rattus norvegicus
ggtgcggtggcctcgaccacctacg

SEQ ID NO: 468974 - DNA, 25 bp, Rattus norvegicus
ggtgcggttgagatagctgcctaaa

SEQ ID NO: 468975 - DNA, 25 bp, Rattus norvegicus
ggtgcggttgagttagctgcctaaa

SEQ ID NO: 468976 - DNA, 25 bp, Rattus norvegicus
ggtgcgtcacagacggcggctcctt

SEQ ID NO: 468977 - DNA, 25 bp, Rattus norvegicus
ggtgcgtcacagtcggcggctcctt

SEQ ID NO: 468978 - DNA, 25 bp, Rattus norvegicus
ggtgcgtcctaaagtccatgtgtaa

SEQ ID NO: 468979 - DNA, 25 bp, Rattus norvegicus
ggtgcgtcctaatgtccatgtgtaa

SEQ ID NO: 468980 - DNA, 25 bp, Rattus norvegicus
ggtgcgtctgccaaaactttgaaag

SEQ ID NO: 468981 - DNA, 25 bp, Rattus norvegicus
ggtgcgtctgcctaaactttgaaag

SEQ ID NO: 468982 - DNA, 25 bp, Rattus norvegicus
ggtgcgtctttgatcaggtatcaat

SEQ ID NO: 468983 - DNA, 25 bp, Rattus norvegicus
ggtgcgtctttgttcaggtatcaat

SEQ ID NO: 468984 - DNA, 25 bp, Rattus norvegicus
ggtgcgtgcagcagttctggcacaa

SEQ ID NO: 468985 - DNA, 25 bp, Rattus norvegicus
ggtgcgtgcagctgttctggcacaa

SEQ ID NO: 468986 - DNA, 25 bp, Rattus norvegicus
ggtgcgtgcgctcgtgcgggtgtgc

SEQ ID NO: 468987 - DNA, 25 bp, Rattus norvegicus
ggtgcgtgcgctggtgcgggtgtgc

SEQ ID NO: 468988 - DNA, 25 bp, Rattus norvegicus
ggtgcgtgtgctatactgaagatca

SEQ ID NO: 468989 - DNA, 25 bp, Rattus norvegicus
ggtgcgtgtgctttactgaagatca

SEQ ID NO: 468990 - DNA, 25 bp, Rattus norvegicus
ggtgcgtgtgttagttgaagttttc

SEQ ID NO: 468991 - DNA, 25 bp, Rattus norvegicus
ggtgcgtgtgtttgttgaagttttc

SEQ ID NO: 468992 - DNA, 25 bp, Rattus norvegicus
ggtgcgttcagcactgttcgtaaag

SEQ ID NO: 468993 - DNA, 25 bp, Rattus norvegicus
ggtgcgttcagctctgttcgtaaag

SEQ ID NO: 468994 - DNA, 25 bp, Rattus norvegicus
ggtgcgttctcaagtcctgaagtac

SEQ ID NO: 468995 - DNA, 25 bp, Rattus norvegicus
ggtgcgttctcatgtcctgaagtac

SEQ ID NO: 468996 - DNA, 25 bp, Rattus norvegicus
ggtgctaaaccaagatgctctcagt

SEQ ID NO: 468997 - DNA, 25 bp, Rattus norvegicus
ggtgctaaaccatgatgctctcagt

SEQ ID NO: 468998 - DNA, 25 bp, Rattus norvegicus
ggtgctaaatagactttctttcctc

SEQ ID NO: 468999 - DNA, 25 bp, Rattus norvegicus
ggtgctaaatagtctttctttcctc

SEQ ID NO: 469000 - DNA, 25 bp, Rattus norvegicus
ggtgctaaatgcagtcagcctcttg

SEQ ID NO: 469001 - DNA, 25 bp, Rattus norvegicus
ggtgctaaatgctgtcagcctcttg

SEQ ID NO: 469002 - DNA, 25 bp, Rattus norvegicus
ggtgctaaccagaaggtgactccta

SEQ ID NO: 469003 - DNA, 25 bp, Rattus norvegicus
ggtgctaaccagtaggtgactccta

SEQ ID NO: 469004 - DNA, 25 bp, Rattus norvegicus
ggtgctaagattattgccaatggaa

SEQ ID NO: 469005 - DNA, 25 bp, Rattus norvegicus
ggtgctaagatttttgccaatggaa

SEQ ID NO: 469006 - DNA, 25 bp, Rattus norvegicus
ggtgctaagccaagccaacactgga

SEQ ID NO: 469007 - DNA, 25 bp, Rattus norvegicus
ggtgctaagccatgccaacactgga

SEQ ID NO: 469008 - DNA, 25 bp, Rattus norvegicus
ggtgctaagggactttgtcattcaa

SEQ ID NO: 469009 - DNA, 25 bp, Rattus norvegicus
ggtgctaagggagtttgtcattcaa

SEQ ID NO: 469010 - DNA, 25 bp, Rattus norvegicus
ggtgctaagtccacgaacagacatt

SEQ ID NO: 469011 - DNA, 25 bp, Rattus norvegicus
ggtgctaagtcctcgaacagacatt

SEQ ID NO: 469012 - DNA, 25 bp, Rattus norvegicus
ggtgctaagtttagtatctctttgg

SEQ ID NO: 469013 - DNA, 25 bp, Rattus norvegicus
ggtgctaagttttgtatctctttgg

SEQ ID NO: 469014 - DNA, 25 bp, Rattus norvegicus
ggtgctaatcccctcagactcagat

SEQ ID NO: 469015 - DNA, 25 bp, Rattus norvegicus
ggtgctaatcccgtcagactcagat

SEQ ID NO: 469016 - DNA, 25 bp, Rattus norvegicus
ggtgctacacctcggagccgatgat

SEQ ID NO: 469017 - DNA, 25 bp, Rattus norvegicus
ggtgctacacctgggagccgatgat

SEQ ID NO: 469018 - DNA, 25 bp, Rattus norvegicus
ggtgctacagccagggattcagtca

SEQ ID NO: 469019 - DNA, 25 bp, Rattus norvegicus
ggtgctacagcctgggattcagtca

SEQ ID NO: 469020 - DNA, 25 bp, Rattus norvegicus
ggtgctacaggccaatcgcggcttc

SEQ ID NO: 469021 - DNA, 25 bp, Rattus norvegicus
ggtgctacaggcgaatcgcggcttc

SEQ ID NO: 469022 - DNA, 25 bp, Rattus norvegicus
ggtgctacctgacatgcagaccatt

SEQ ID NO: 469023 - DNA, 25 bp, Rattus norvegicus
ggtgctacctgagatgcagaccatt

SEQ ID NO: 469024 - DNA, 25 bp, Rattus norvegicus
ggtgctaccttaatgcatactttaa

SEQ ID NO: 469025 - DNA, 25 bp, Rattus norvegicus
ggtgctaccttattgcatactttaa

SEQ ID NO: 469026 - DNA, 25 bp, Rattus norvegicus
ggtgctacttatattccaacactga

SEQ ID NO: 469027 - DNA, 25 bp, Rattus norvegicus
ggtgctacttattttccaacactga

SEQ ID NO: 469028 - DNA, 25 bp, Rattus norvegicus
ggtgctagaagcaagctgagcctca

SEQ ID NO: 469029 - DNA, 25 bp, Rattus norvegicus
ggtgctagaagctagctgagcctca

SEQ ID NO: 469030 - DNA, 25 bp, Rattus norvegicus
ggtgctagactcagaagggccaaat

SEQ ID NO: 469031 - DNA, 25 bp, Rattus norvegicus
ggtgctagactctgaagggccaaat

SEQ ID NO: 469032 - DNA, 25 bp, Rattus norvegicus
ggtgctagtaggacctagtatcctc

SEQ ID NO: 469033 - DNA, 25 bp, Rattus norvegicus
ggtgctagtaggtcctagtatcctc

SEQ ID NO: 469034 - DNA, 25 bp, Rattus norvegicus
ggtgctagtgcacgtctttacttag

SEQ ID NO: 469035 - DNA, 25 bp, Rattus norvegicus
ggtgctagtgcaggtctttacttag

SEQ ID NO: 469036 - DNA, 25 bp, Rattus norvegicus
ggtgctatacttagcagtctatgat

SEQ ID NO: 469037 - DNA, 25 bp, Rattus norvegicus
ggtgctatactttgcagtctatgat

SEQ ID NO: 469038 - DNA, 25 bp, Rattus norvegicus
ggtgctatccctaaagaccagcctg

SEQ ID NO: 469039 - DNA, 25 bp, Rattus norvegicus
ggtgctatcccttaagaccagcctg

SEQ ID NO: 469040 - DNA, 25 bp, Rattus norvegicus
ggtgctatccgtactcatcaaaaaa

SEQ ID NO: 469041 - DNA, 25 bp, Rattus norvegicus
ggtgctatccgttctcatcaaaaaa

SEQ ID NO: 469042 - DNA, 25 bp, Rattus norvegicus
ggtgctatgtttctatttccaaata

SEQ ID NO: 469043 - DNA, 25 bp, Rattus norvegicus
ggtgctatgtttgtatttccaaata

SEQ ID NO: 469044 - DNA, 25 bp, Rattus norvegicus
ggtgctattcacaggctttacttgt

SEQ ID NO: 469045 - DNA, 25 bp, Rattus norvegicus
ggtgctattcactggctttacttgt

SEQ ID NO: 469046 - DNA, 25 bp, Rattus norvegicus
ggtgctattccaatgttctttgtac

SEQ ID NO: 469047 - DNA, 25 bp, Rattus norvegicus
ggtgctattccattgttctttgtac

SEQ ID NO: 469048 - DNA, 25 bp, Rattus norvegicus
ggtgctattccgataagtcttgttc

SEQ ID NO: 469049 - DNA, 25 bp, Rattus norvegicus
ggtgctattccgttaagtcttgttc

SEQ ID NO: 469050 - DNA, 25 bp, Rattus norvegicus
ggtgctcaacaccaacagccgatat

SEQ ID NO: 469051 - DNA, 25 bp, Rattus norvegicus
ggtgctcaacacgaacagccgatat

SEQ ID NO: 469052 - DNA, 25 bp, Rattus norvegicus
ggtgctcacagcagagggtcctcag

SEQ ID NO: 469053 - DNA, 25 bp, Rattus norvegicus
ggtgctcacagcagatttttgcagt

SEQ ID NO: 469054 - DNA, 25 bp, Rattus norvegicus
ggtgctcacagctgagggtcctcag

SEQ ID NO: 469055 - DNA, 25 bp, Rattus norvegicus
ggtgctcacagctgatttttgcagt

SEQ ID NO: 469056 - DNA, 25 bp, Rattus norvegicus
ggtgctcactgtagaacccgtcgga

SEQ ID NO: 469057 - DNA, 25 bp, Rattus norvegicus
ggtgctcactgttgaacccgtcgga

SEQ ID NO: 469058 - DNA, 25 bp, Rattus norvegicus
ggtgctcagaccagagtgccattaa

SEQ ID NO: 469059 - DNA, 25 bp, Rattus norvegicus
ggtgctcagacctgagtgccattaa

SEQ ID NO: 469060 - DNA, 25 bp, Rattus norvegicus
ggtgctcagccacagtgctacgaat

SEQ ID NO: 469061 - DNA, 25 bp, Rattus norvegicus
ggtgctcagccagagtgctacgaat

SEQ ID NO: 469062 - DNA, 25 bp, Rattus norvegicus
ggtgctcagcccctgatctgggaaa

SEQ ID NO: 469063 - DNA, 25 bp, Rattus norvegicus
ggtgctcagcccgtgatctgggaaa

SEQ ID NO: 469064 - DNA, 25 bp, Rattus norvegicus
ggtgctcagcctccacaaggacaag

SEQ ID NO: 469065 - DNA, 25 bp, Rattus norvegicus
ggtgctcagcctgcacaaggacaag

SEQ ID NO: 469066 - DNA, 25 bp, Rattus norvegicus
ggtgctcagctaaaaacctgcgaat

SEQ ID NO: 469067 - DNA, 25 bp, Rattus norvegicus
ggtgctcagctataaacctgcgaat

SEQ ID NO: 469068 - DNA, 25 bp, Rattus norvegicus
ggtgctcaggacaggctggtcaact

SEQ ID NO: 469069 - DNA, 25 bp, Rattus norvegicus
ggtgctcaggactggctggtcaact

SEQ ID NO: 469070 - DNA, 25 bp, Rattus norvegicus
ggtgctcatatgagtttgactcttg

SEQ ID NO: 469071 - DNA, 25 bp, Rattus norvegicus
ggtgctcatatgtgtttgactcttg

SEQ ID NO: 469072 - DNA, 25 bp, Rattus norvegicus
ggtgctcatcctctaagattcttca

SEQ ID NO: 469073 - DNA, 25 bp, Rattus norvegicus
ggtgctcatcctgtaagattcttca

SEQ ID NO: 469074 - DNA, 25 bp, Rattus norvegicus
ggtgctcatgtaagggcccaagatt

SEQ ID NO: 469075 - DNA, 25 bp, Rattus norvegicus
ggtgctcatgtatgggcccaagatt

SEQ ID NO: 469076 - DNA, 25 bp, Rattus norvegicus
ggtgctcattgacccaggccttgag

SEQ ID NO: 469077 - DNA, 25 bp, Rattus norvegicus
ggtgctcattgagccaggccttgag

SEQ ID NO: 469078 - DNA, 25 bp, Rattus norvegicus
ggtgctcatttacgaggacccccga

SEQ ID NO: 469079 - DNA, 25 bp, Rattus norvegicus
ggtgctcatttaggaggacccccga

SEQ ID NO: 469080 - DNA, 25 bp, Rattus norvegicus
ggtgctcatttgcatatatcccaag

SEQ ID NO: 469081 - DNA, 25 bp, Rattus norvegicus
ggtgctcatttggatatatcccaag

SEQ ID NO: 469082 - DNA, 25 bp, Rattus norvegicus
ggtgctccaacaccgagagctcgga

SEQ ID NO: 469083 - DNA, 25 bp, Rattus norvegicus
ggtgctccaacactttgattttaat

SEQ ID NO: 469084 - DNA, 25 bp, Rattus norvegicus
ggtgctccaacagcgagagctcgga

SEQ ID NO: 469085 - DNA, 25 bp, Rattus norvegicus
ggtgctccaacagtttgattttaat

SEQ ID NO: 469086 - DNA, 25 bp, Rattus norvegicus
ggtgctcctctgaacgtattattag

SEQ ID NO: 469087 - DNA, 25 bp, Rattus norvegicus
ggtgctcctctgtacgtattattag

SEQ ID NO: 469088 - DNA, 25 bp, Rattus norvegicus
ggtgctcctgagagggatcgataat

SEQ ID NO: 469089 - DNA, 25 bp, Rattus norvegicus
ggtgctcctgagtgggatcgataat

SEQ ID NO: 469090 - DNA, 25 bp, Rattus norvegicus
ggtgctcctgatagggcctgaaata

SEQ ID NO: 469091 - DNA, 25 bp, Rattus norvegicus
ggtgctcctgattgggcctgaaata

SEQ ID NO: 469092 - DNA, 25 bp, Rattus norvegicus
ggtgctccttgaatctgcttccaaa

SEQ ID NO: 469093 - DNA, 25 bp, Rattus norvegicus
ggtgctccttgattctgcttccaaa

SEQ ID NO: 469094 - DNA, 25 bp, Rattus norvegicus
ggtgctccttgcagcagtagaagga

SEQ ID NO: 469095 - DNA, 25 bp, Rattus norvegicus
ggtgctccttgctgcagtagaagga

SEQ ID NO: 469096 - DNA, 25 bp, Rattus norvegicus
ggtgctcctttccatgaacatctgg

SEQ ID NO: 469097 - DNA, 25 bp, Rattus norvegicus
ggtgctcctttcgatgaacatctgg

SEQ ID NO: 469098 - DNA, 25 bp, Rattus norvegicus
ggtgctcctttgaatgcctggatta

SEQ ID NO: 469099 - DNA, 25 bp, Rattus norvegicus
ggtgctcctttgtatgcctggatta

SEQ ID NO: 469100 - DNA, 25 bp, Rattus norvegicus
ggtgctcgcaatatactgcactctg

SEQ ID NO: 469101 - DNA, 25 bp, Rattus norvegicus
ggtgctcgcaatttactgcactctg

SEQ ID NO: 469102 - DNA, 25 bp, Rattus norvegicus
ggtgctctactgaggctccctataa

SEQ ID NO: 469103 - DNA, 25 bp, Rattus norvegicus
ggtgctctactgtggctccctataa

SEQ ID NO: 469104 - DNA, 25 bp, Rattus norvegicus
ggtgctctaggtcctgtgaccatac

SEQ ID NO: 469105 - DNA, 25 bp, Rattus norvegicus
ggtgctctaggtgctgtgaccatac

SEQ ID NO: 469106 - DNA, 25 bp, Rattus norvegicus
ggtgctctcaacattccccaagaaa

SEQ ID NO: 469107 - DNA, 25 bp, Rattus norvegicus
ggtgctctcaactttccccaagaaa

SEQ ID NO: 469108 - DNA, 25 bp, Rattus norvegicus
ggtgctctcagcaaggctaccgtaa

SEQ ID NO: 469109 - DNA, 25 bp, Rattus norvegicus
ggtgctctcagctaggctaccgtaa

SEQ ID NO: 469110 - DNA, 25 bp, Rattus norvegicus
ggtgctctctaaaatgaatgcagtt

SEQ ID NO: 469111 - DNA, 25 bp, Rattus norvegicus
ggtgctctctaatatgaatgcagtt

SEQ ID NO: 469112 - DNA, 25 bp, Rattus norvegicus
ggtgctctgggcagttctgtcttcg

SEQ ID NO: 469113 - DNA, 25 bp, Rattus norvegicus
ggtgctctgggctgttctgtcttcg

SEQ ID NO: 469114 - DNA, 25 bp, Rattus norvegicus
ggtgctcttaaacaagccttggcca

SEQ ID NO: 469115 - DNA, 25 bp, Rattus norvegicus
ggtgctcttaaagaagccttggcca

SEQ ID NO: 469116 - DNA, 25 bp, Rattus norvegicus
ggtgctcttcaaagcaaagacttct

SEQ ID NO: 469117 - DNA, 25 bp, Rattus norvegicus
ggtgctcttcaatgcaaagacttct

SEQ ID NO: 469118 - DNA, 25 bp, Rattus norvegicus
ggtgctcttctgacagtagaggcaa

SEQ ID NO: 469119 - DNA, 25 bp, Rattus norvegicus
ggtgctcttctgtcagtagaggcaa

SEQ ID NO: 469120 - DNA, 25 bp, Rattus norvegicus
ggtgctgaaatcagtttctaactcc

SEQ ID NO: 469121 - DNA, 25 bp, Rattus norvegicus
ggtgctgaaatctgtttctaactcc

SEQ ID NO: 469122 - DNA, 25 bp, Rattus norvegicus
ggtgctgaacctactactggagaga

SEQ ID NO: 469123 - DNA, 25 bp, Rattus norvegicus
ggtgctgaaccttctactggagaga

SEQ ID NO: 469124 - DNA, 25 bp, Rattus norvegicus
ggtgctgaacttcaccagtgcaggt

SEQ ID NO: 469125 - DNA, 25 bp, Rattus norvegicus
ggtgctgaacttgaccagtgcaggt

SEQ ID NO: 469126 - DNA, 25 bp, Rattus norvegicus
ggtgctgaagaaaatccagtgctca

SEQ ID NO: 469127 - DNA, 25 bp, Rattus norvegicus
ggtgctgaagaatatccagtgctca

SEQ ID NO: 469128 - DNA, 25 bp, Rattus norvegicus
ggtgctgaagagaaacccatcccac

SEQ ID NO: 469129 - DNA, 25 bp, Rattus norvegicus
ggtgctgaagagtaacccatcccac

SEQ ID NO: 469130 - DNA, 25 bp, Rattus norvegicus
ggtgctgaagtacttctctcatcaa

SEQ ID NO: 469131 - DNA, 25 bp, Rattus norvegicus
ggtgctgaagtagttctctcatcaa

SEQ ID NO: 469132 - DNA, 25 bp, Rattus norvegicus
ggtgctgaatatctccttgtaggct

SEQ ID NO: 469133 - DNA, 25 bp, Rattus norvegicus
ggtgctgaatatgtccttgtaggct

SEQ ID NO: 469134 - DNA, 25 bp, Rattus norvegicus
ggtgctgacagcataacgagcctta

SEQ ID NO: 469135 - DNA, 25 bp, Rattus norvegicus
ggtgctgacagcttaacgagcctta

SEQ ID NO: 469136 - DNA, 25 bp, Rattus norvegicus
ggtgctgacattcatgccctagatt

SEQ ID NO: 469137 - DNA, 25 bp, Rattus norvegicus
ggtgctgacattgatgccctagatt

SEQ ID NO: 469138 - DNA, 25 bp, Rattus norvegicus
ggtgctgacccgagctgaagacagc

SEQ ID NO: 469139 - DNA, 25 bp, Rattus norvegicus
ggtgctgacccgtgctgaagacagc

SEQ ID NO: 469140 - DNA, 25 bp, Rattus norvegicus
ggtgctgacgtgacctaatcctttt

SEQ ID NO: 469141 - DNA, 25 bp, Rattus norvegicus
ggtgctgacgtgtcctaatcctttt

SEQ ID NO: 469142 - DNA, 25 bp, Rattus norvegicus
ggtgctgagaacagtgtttcccctc

SEQ ID NO: 469143 - DNA, 25 bp, Rattus norvegicus
ggtgctgagaactgtgtttcccctc

SEQ ID NO: 469144 - DNA, 25 bp, Rattus norvegicus
ggtgctgaggtaacgttaggaccct

SEQ ID NO: 469145 - DNA, 25 bp, Rattus norvegicus
ggtgctgaggtatcgttaggaccct

SEQ ID NO: 469146 - DNA, 25 bp, Rattus norvegicus
ggtgctgatatcacatgaccacaat

SEQ ID NO: 469147 - DNA, 25 bp, Rattus norvegicus
ggtgctgatatctcatgaccacaat

SEQ ID NO: 469148 - DNA, 25 bp, Rattus norvegicus
ggtgctgatcccaagtctgaataat

SEQ ID NO: 469149 - DNA, 25 bp, Rattus norvegicus
ggtgctgatccctagtctgaataat

SEQ ID NO: 469150 - DNA, 25 bp, Rattus norvegicus
ggtgctgatgcccaaaactgaagca

SEQ ID NO: 469151 - DNA, 25 bp, Rattus norvegicus
ggtgctgatgccgaaaactgaagca

SEQ ID NO: 469152 - DNA, 25 bp, Rattus norvegicus
ggtgctgattcaaagcctgatatct

SEQ ID NO: 469153 - DNA, 25 bp, Rattus norvegicus
ggtgctgattcatagcctgatatct

SEQ ID NO: 469154 - DNA, 25 bp, Rattus norvegicus
ggtgctgattttaaatgcttctcgt

SEQ ID NO: 469155 - DNA, 25 bp, Rattus norvegicus
ggtgctgatttttaatgcttctcgt

SEQ ID NO: 469156 - DNA, 25 bp, Rattus norvegicus
ggtgctgcaaacaactttggtcttc

SEQ ID NO: 469157 - DNA, 25 bp, Rattus norvegicus
ggtgctgcaaacagtcctgagctca

SEQ ID NO: 469158 - DNA, 25 bp, Rattus norvegicus
ggtgctgcaaactactttggtcttc

SEQ ID NO: 469159 - DNA, 25 bp, Rattus norvegicus
ggtgctgcaaactgtcctgagctca

SEQ ID NO: 469160 - DNA, 25 bp, Rattus norvegicus
ggtgctgcatgccttaattctggac

SEQ ID NO: 469161 - DNA, 25 bp, Rattus norvegicus
ggtgctgcatgcgttaattctggac

SEQ ID NO: 469162 - DNA, 25 bp, Rattus norvegicus
ggtgctgccatacactaggttgttt

SEQ ID NO: 469163 - DNA, 25 bp, Rattus norvegicus
ggtgctgccatacgactgcaacata

SEQ ID NO: 469164 - DNA, 25 bp, Rattus norvegicus
ggtgctgccatagactaggttgttt

SEQ ID NO: 469165 - DNA, 25 bp, Rattus norvegicus
ggtgctgccataggactgcaacata

SEQ ID NO: 469166 - DNA, 25 bp, Rattus norvegicus
ggtgctgcccaacgttcaaggaata

SEQ ID NO: 469167 - DNA, 25 bp, Rattus norvegicus
ggtgctgcccaaggttcaaggaata

SEQ ID NO: 469168 - DNA, 25 bp, Rattus norvegicus
ggtgctgccctgaagattagcaact

SEQ ID NO: 469169 - DNA, 25 bp, Rattus norvegicus
ggtgctgccctgtagattagcaact

SEQ ID NO: 469170 - DNA, 25 bp, Rattus norvegicus
ggtgctgccgagatacatgtgtaaa

SEQ ID NO: 469171 - DNA, 25 bp, Rattus norvegicus
ggtgctgccgagttacatgtgtaaa

SEQ ID NO: 469172 - DNA, 25 bp, Rattus norvegicus
ggtgctgccgtcatgtatgtatgta

SEQ ID NO: 469173 - DNA, 25 bp, Rattus norvegicus
ggtgctgccgtcttgtatgtatgta

SEQ ID NO: 469174 - DNA, 25 bp, Rattus norvegicus
ggtgctgcctaactgattatgtcaa

SEQ ID NO: 469175 - DNA, 25 bp, Rattus norvegicus
ggtgctgcctaagtgattatgtcaa

SEQ ID NO: 469176 - DNA, 25 bp, Rattus norvegicus
ggtgctgccttcctatgggttgaat

SEQ ID NO: 469177 - DNA, 25 bp, Rattus norvegicus
ggtgctgccttcgtatgggttgaat

SEQ ID NO: 469178 - DNA, 25 bp, Rattus norvegicus
ggtgctgcggatctgattatgtaat

SEQ ID NO: 469179 - DNA, 25 bp, Rattus norvegicus
ggtgctgcggatgtgattatgtaat

SEQ ID NO: 469180 - DNA, 25 bp, Rattus norvegicus
ggtgctgcggctctcatagcaagat

SEQ ID NO: 469181 - DNA, 25 bp, Rattus norvegicus
ggtgctgcggctgtcatagcaagat

SEQ ID NO: 469182 - DNA, 25 bp, Rattus norvegicus
ggtgctgctaacacatgtgctgagt

SEQ ID NO: 469183 - DNA, 25 bp, Rattus norvegicus
ggtgctgctaactcatgtgctgagt

SEQ ID NO: 469184 - DNA, 25 bp, Rattus norvegicus
ggtgctgctacgacaagtgtaacac

SEQ ID NO: 469185 - DNA, 25 bp, Rattus norvegicus
ggtgctgctacgtcaagtgtaacac

SEQ ID NO: 469186 - DNA, 25 bp, Rattus norvegicus
ggtgctgctcccaacaaagagatta

SEQ ID NO: 469187 - DNA, 25 bp, Rattus norvegicus
ggtgctgctccctacaaagagatta

SEQ ID NO: 469188 - DNA, 25 bp, Rattus norvegicus
ggtgctgctgagcactgcaatttga

SEQ ID NO: 469189 - DNA, 25 bp, Rattus norvegicus
ggtgctgctgaggactgcaatttga

SEQ ID NO: 469190 - DNA, 25 bp, Rattus norvegicus
ggtgctgctggaaaagccaataaag

SEQ ID NO: 469191 - DNA, 25 bp, Rattus norvegicus
ggtgctgctggataagccaataaag

SEQ ID NO: 469192 - DNA, 25 bp, Rattus norvegicus
ggtgctgcttcaatggttttttaca

SEQ ID NO: 469193 - DNA, 25 bp, Rattus norvegicus
ggtgctgcttcattggttttttaca

SEQ ID NO: 469194 - DNA, 25 bp, Rattus norvegicus
ggtgctgcttccataaataatctta

SEQ ID NO: 469195 - DNA, 25 bp, Rattus norvegicus
ggtgctgcttccttaaataatctta

SEQ ID NO: 469196 - DNA, 25 bp, Rattus norvegicus
ggtgctgcttcgacaagtgccggca

SEQ ID NO: 469197 - DNA, 25 bp, Rattus norvegicus
ggtgctgcttcgtcaagtgccggca

SEQ ID NO: 469198 - DNA, 25 bp, Rattus norvegicus
ggtgctggacagacagttcctatgc

SEQ ID NO: 469199 - DNA, 25 bp, Rattus norvegicus
ggtgctggacagtcagttcctatgc

SEQ ID NO: 469200 - DNA, 25 bp, Rattus norvegicus
ggtgctggacttagagcacttcctg

SEQ ID NO: 469201 - DNA, 25 bp, Rattus norvegicus
ggtgctggactttgagcacttcctg

SEQ ID NO: 469202 - DNA, 25 bp, Rattus norvegicus
ggtgctggagtaagcccactttgtc

SEQ ID NO: 469203 - DNA, 25 bp, Rattus norvegicus
ggtgctggagtatgcccactttgtc

SEQ ID NO: 469204 - DNA, 25 bp, Rattus norvegicus
ggtgctggccatcctgttttaatca

SEQ ID NO: 469205 - DNA, 25 bp, Rattus norvegicus
ggtgctggccatgctgttttaatca

SEQ ID NO: 469206 - DNA, 25 bp, Rattus norvegicus
ggtgctggcggcaggtttacgccgc

SEQ ID NO: 469207 - DNA, 25 bp, Rattus norvegicus
ggtgctggcggctggtttacgccgc

SEQ ID NO: 469208 - DNA, 25 bp, Rattus norvegicus
ggtgctggctttatcagtgtctact

SEQ ID NO: 469209 - DNA, 25 bp, Rattus norvegicus
ggtgctggctttttcagtgtctact

SEQ ID NO: 469210 - DNA, 25 bp, Rattus norvegicus
ggtgctgggactcgaactcacgccc

SEQ ID NO: 469211 - DNA, 25 bp, Rattus norvegicus
ggtgctgggactggaactcacgccc

SEQ ID NO: 469212 - DNA, 25 bp, Rattus norvegicus
ggtgctgggcaccaagtactctgac

SEQ ID NO: 469213 - DNA, 25 bp, Rattus norvegicus
ggtgctgggcacgaagtactctgac

SEQ ID NO: 469214 - DNA, 25 bp, Rattus norvegicus
ggtgctgggtgcacagagccacaca

SEQ ID NO: 469215 - DNA, 25 bp, Rattus norvegicus
ggtgctgggtgctcagagccacaca

SEQ ID NO: 469216 - DNA, 25 bp, Rattus norvegicus
ggtgctgggttcattgttaatttcc

SEQ ID NO: 469217 - DNA, 25 bp, Rattus norvegicus
ggtgctgggttctttgttaatttcc

SEQ ID NO: 469218 - DNA, 25 bp, Rattus norvegicus
ggtgctggtaccacagtcgcggtca

SEQ ID NO: 469219 - DNA, 25 bp, Rattus norvegicus
ggtgctggtacctcagtcgcggtca

SEQ ID NO: 469220 - DNA, 25 bp, Rattus norvegicus
ggtgctgtaccaaagccttatgaca

SEQ ID NO: 469221 - DNA, 25 bp, Rattus norvegicus
ggtgctgtaccatagccttatgaca

SEQ ID NO: 469222 - DNA, 25 bp, Rattus norvegicus
ggtgctgtaggaccccagctcacaa

SEQ ID NO: 469223 - DNA, 25 bp, Rattus norvegicus
ggtgctgtaggagcccagctcacaa

SEQ ID NO: 469224 - DNA, 25 bp, Rattus norvegicus
ggtgctgtataacgatcttctcatc

SEQ ID NO: 469225 - DNA, 25 bp, Rattus norvegicus
ggtgctgtataaggatcttctcatc

SEQ ID NO: 469226 - DNA, 25 bp, Rattus norvegicus
ggtgctgtccacaagactcctgaag

SEQ ID NO: 469227 - DNA, 25 bp, Rattus norvegicus
ggtgctgtccactagactcctgaag

SEQ ID NO: 469228 - DNA, 25 bp, Rattus norvegicus
ggtgctgtccatcttatgagaatcc

SEQ ID NO: 469229 - DNA, 25 bp, Rattus norvegicus
ggtgctgtccatgttatgagaatcc

SEQ ID NO: 469230 - DNA, 25 bp, Rattus norvegicus
ggtgctgtctgcactttagactgct

SEQ ID NO: 469231 - DNA, 25 bp, Rattus norvegicus
ggtgctgtctgctctttagactgct

SEQ ID NO: 469232 - DNA, 25 bp, Rattus norvegicus
ggtgctgtgagcattaactcctgcc

SEQ ID NO: 469233 - DNA, 25 bp, Rattus norvegicus
ggtgctgtgagctttaactcctgcc

SEQ ID NO: 469234 - DNA, 25 bp, Rattus norvegicus
ggtgctgtgagtacctggttcaaaa

SEQ ID NO: 469235 - DNA, 25 bp, Rattus norvegicus
ggtgctgtgagtcatgtttcccata

SEQ ID NO: 469236 - DNA, 25 bp, Rattus norvegicus
ggtgctgtgagtgatgtttcccata

SEQ ID NO: 469237 - DNA, 25 bp, Rattus norvegicus
ggtgctgtgagttcctggttcaaaa

SEQ ID NO: 469238 - DNA, 25 bp, Rattus norvegicus
ggtgctgtgcacagaagtgccccaa

SEQ ID NO: 469239 - DNA, 25 bp, Rattus norvegicus
ggtgctgtgcactgaagtgccccaa

SEQ ID NO: 469240 - DNA, 25 bp, Rattus norvegicus
ggtgctgtgctacctatgaggacac

SEQ ID NO: 469241 - DNA, 25 bp, Rattus norvegicus
ggtgctgtgctagctatgaggacac

SEQ ID NO: 469242 - DNA, 25 bp, Rattus norvegicus
ggtgctgtgtaaacccaagctttta

SEQ ID NO: 469243 - DNA, 25 bp, Rattus norvegicus
ggtgctgtgtaacgcatgacattcc

SEQ ID NO: 469244 - DNA, 25 bp, Rattus norvegicus
ggtgctgtgtaaggcatgacattcc

SEQ ID NO: 469245 - DNA, 25 bp, Rattus norvegicus
ggtgctgtgtaatcccaagctttta

SEQ ID NO: 469246 - DNA, 25 bp, Rattus norvegicus
ggtgctgttagactccagtgttcta

SEQ ID NO: 469247 - DNA, 25 bp, Rattus norvegicus
ggtgctgttagagtccagtgttcta

SEQ ID NO: 469248 - DNA, 25 bp, Rattus norvegicus
ggtgctgttggcaactttatcaaaa

SEQ ID NO: 469249 - DNA, 25 bp, Rattus norvegicus
ggtgctgttggctactttatcaaaa

SEQ ID NO: 469250 - DNA, 25 bp, Rattus norvegicus
ggtgctgttttcagagatctgggaa

SEQ ID NO: 469251 - DNA, 25 bp, Rattus norvegicus
ggtgctgttttctgagatctgggaa

SEQ ID NO: 469252 - DNA, 25 bp, Rattus norvegicus
ggtgctgttttgcagtatgcctgct

SEQ ID NO: 469253 - DNA, 25 bp, Rattus norvegicus
ggtgctgttttggagtatgcctgct

SEQ ID NO: 469254 - DNA, 25 bp, Rattus norvegicus
ggtgcttaacatatgattcttaccc

SEQ ID NO: 469255 - DNA, 25 bp, Rattus norvegicus
ggtgcttaacatttgattcttaccc

SEQ ID NO: 469256 - DNA, 25 bp, Rattus norvegicus
ggtgcttacaagcacagtgctgttt

SEQ ID NO: 469257 - DNA, 25 bp, Rattus norvegicus
ggtgcttacaaggacagtgctgttt

SEQ ID NO: 469258 - DNA, 25 bp, Rattus norvegicus
ggtgcttaccaaccaagaccaggtt

SEQ ID NO: 469259 - DNA, 25 bp, Rattus norvegicus
ggtgcttaccaagcaagaccaggtt

SEQ ID NO: 469260 - DNA, 25 bp, Rattus norvegicus
ggtgcttagagcatttcatgtaacc

SEQ ID NO: 469261 - DNA, 25 bp, Rattus norvegicus
ggtgcttagagcttttcatgtaacc

SEQ ID NO: 469262 - DNA, 25 bp, Rattus norvegicus
ggtgcttagccaccttaagacctta

SEQ ID NO: 469263 - DNA, 25 bp, Rattus norvegicus
ggtgcttagccagcttaagacctta

SEQ ID NO: 469264 - DNA, 25 bp, Rattus norvegicus
ggtgcttcacttcgctgtatttttg

SEQ ID NO: 469265 - DNA, 25 bp, Rattus norvegicus
ggtgcttcacttggctgtatttttg

SEQ ID NO: 469266 - DNA, 25 bp, Rattus norvegicus
ggtgcttcagctataattatactaa

SEQ ID NO: 469267 - DNA, 25 bp, Rattus norvegicus
ggtgcttcagctatggaaatttcac

SEQ ID NO: 469268 - DNA, 25 bp, Rattus norvegicus
ggtgcttcagctttaattatactaa

SEQ ID NO: 469269 - DNA, 25 bp, Rattus norvegicus
ggtgcttcagctttggaaatttcac

SEQ ID NO: 469270 - DNA, 25 bp, Rattus norvegicus
ggtgcttcagtgagacaggtagtct

SEQ ID NO: 469271 - DNA, 25 bp, Rattus norvegicus
ggtgcttcagtgtgacaggtagtct

SEQ ID NO: 469272 - DNA, 25 bp, Rattus norvegicus
ggtgcttcatgtacacacttggtga

SEQ ID NO: 469273 - DNA, 25 bp, Rattus norvegicus
ggtgcttcatgttcacacttggtga

SEQ ID NO: 469274 - DNA, 25 bp, Rattus norvegicus
ggtgcttcctgcagagggcttgaac

SEQ ID NO: 469275 - DNA, 25 bp, Rattus norvegicus
ggtgcttcctgctgagggcttgaac

SEQ ID NO: 469276 - DNA, 25 bp, Rattus norvegicus
ggtgcttccttaaaacctcagataa

SEQ ID NO: 469277 - DNA, 25 bp, Rattus norvegicus
ggtgcttccttataacctcagataa

SEQ ID NO: 469278 - DNA, 25 bp, Rattus norvegicus
ggtgcttctcctagtagggcagcgc

SEQ ID NO: 469279 - DNA, 25 bp, Rattus norvegicus
ggtgcttctccttgtagggcagcgc

SEQ ID NO: 469280 - DNA, 25 bp, Rattus norvegicus
ggtgcttctgaaaactcttcttgac

SEQ ID NO: 469281 - DNA, 25 bp, Rattus norvegicus
ggtgcttctgaatactcttcttgac

SEQ ID NO: 469282 - DNA, 25 bp, Rattus norvegicus
ggtgcttctggcatggaccgagcaa

SEQ ID NO: 469283 - DNA, 25 bp, Rattus norvegicus
ggtgcttctggcttggaccgagcaa

SEQ ID NO: 469284 - DNA, 25 bp, Rattus norvegicus
ggtgcttctgttaaacctgacttaa

SEQ ID NO: 469285 - DNA, 25 bp, Rattus norvegicus
ggtgcttctgtttaacctgacttaa

SEQ ID NO: 469286 - DNA, 25 bp, Rattus norvegicus
ggtgcttgacccattctgataggaa

SEQ ID NO: 469287 - DNA, 25 bp, Rattus norvegicus
ggtgcttgaccctttctgataggaa

SEQ ID NO: 469288 - DNA, 25 bp, Rattus norvegicus
ggtgcttgacctccggcttctaggc

SEQ ID NO: 469289 - DNA, 25 bp, Rattus norvegicus
ggtgcttgacctgcggcttctaggc

SEQ ID NO: 469290 - DNA, 25 bp, Rattus norvegicus
ggtgcttgcagacgacccttggagg

SEQ ID NO: 469291 - DNA, 25 bp, Rattus norvegicus
ggtgcttgcagaggacccttggagg

SEQ ID NO: 469292 - DNA, 25 bp, Rattus norvegicus
ggtgcttgccttcatgaacttccat

SEQ ID NO: 469293 - DNA, 25 bp, Rattus norvegicus
ggtgcttgccttgatgaacttccat

SEQ ID NO: 469294 - DNA, 25 bp, Rattus norvegicus
ggtgcttggactagcaggctctgac

SEQ ID NO: 469295 - DNA, 25 bp, Rattus norvegicus
ggtgcttggacttgcaggctctgac

SEQ ID NO: 469296 - DNA, 25 bp, Rattus norvegicus
ggtgcttgtcttcttctgaacaaag

SEQ ID NO: 469297 - DNA, 25 bp, Rattus norvegicus
ggtgcttgtcttgttctgaacaaag

SEQ ID NO: 469298 - DNA, 25 bp, Rattus norvegicus
ggtgcttgtgcaccatggtgatact

SEQ ID NO: 469299 - DNA, 25 bp, Rattus norvegicus
ggtgcttgtgcagcatggtgatact

SEQ ID NO: 469300 - DNA, 25 bp, Rattus norvegicus
ggtgcttgtgggagaaccctcatag

SEQ ID NO: 469301 - DNA, 25 bp, Rattus norvegicus
ggtgcttgtgggtgaaccctcatag

SEQ ID NO: 469302 - DNA, 25 bp, Rattus norvegicus
ggtgcttgttgaactgagtccccat

SEQ ID NO: 469303 - DNA, 25 bp, Rattus norvegicus
ggtgcttgttgatctgagtccccat

SEQ ID NO: 469304 - DNA, 25 bp, Rattus norvegicus
ggtgcttgtttgaccacagatggga

SEQ ID NO: 469305 - DNA, 25 bp, Rattus norvegicus
ggtgcttgtttgtccacagatggga

SEQ ID NO: 469306 - DNA, 25 bp, Rattus norvegicus
ggtgctttacagactcacttcatgg

SEQ ID NO: 469307 - DNA, 25 bp, Rattus norvegicus
ggtgctttacagtctcacttcatgg

SEQ ID NO: 469308 - DNA, 25 bp, Rattus norvegicus
ggtgctttatcccactgaaaccaaa

SEQ ID NO: 469309 - DNA, 25 bp, Rattus norvegicus
ggtgctttatccgactgaaaccaaa

SEQ ID NO: 469310 - DNA, 25 bp, Rattus norvegicus
ggtgctttccaacctatcgggaact

SEQ ID NO: 469311 - DNA, 25 bp, Rattus norvegicus
ggtgctttccaagctatcgggaact

SEQ ID NO: 469312 - DNA, 25 bp, Rattus norvegicus
ggtgctttccacattttgagactca

SEQ ID NO: 469313 - DNA, 25 bp, Rattus norvegicus
ggtgctttccactttttgagactca

SEQ ID NO: 469314 - DNA, 25 bp, Rattus norvegicus
ggtgctttctccctctctgtctggc

SEQ ID NO: 469315 - DNA, 25 bp, Rattus norvegicus
ggtgctttctccgtctctgtctggc

SEQ ID NO: 469316 - DNA, 25 bp, Rattus norvegicus
ggtgctttcttactgtttgccaaaa

SEQ ID NO: 469317 - DNA, 25 bp, Rattus norvegicus
ggtgctttcttagtgtttgccaaaa

SEQ ID NO: 469318 - DNA, 25 bp, Rattus norvegicus
ggtgctttgaacagcagctcctcac

SEQ ID NO: 469319 - DNA, 25 bp, Rattus norvegicus
ggtgctttgaactgcagctcctcac

SEQ ID NO: 469320 - DNA, 25 bp, Rattus norvegicus
ggtgcttttccactgttcacaattt

SEQ ID NO: 469321 - DNA, 25 bp, Rattus norvegicus
ggtgcttttccagtgttcacaattt

SEQ ID NO: 469322 - DNA, 25 bp, Rattus norvegicus
ggtgcttttctaaactttcaataac

SEQ ID NO: 469323 - DNA, 25 bp, Rattus norvegicus
ggtgcttttctatactttcaataac

SEQ ID NO: 469324 - DNA, 25 bp, Rattus norvegicus
ggtgctttttctatgacacatacta

SEQ ID NO: 469325 - DNA, 25 bp, Rattus norvegicus
ggtgctttttctttgacacatacta

SEQ ID NO: 469326 - DNA, 25 bp, Rattus norvegicus
ggtggaaaatcaccacggtttctgt

SEQ ID NO: 469327 - DNA, 25 bp, Rattus norvegicus
ggtggaaaatcagcacggtttctgt

SEQ ID NO: 469328 - DNA, 25 bp, Rattus norvegicus
ggtggaaacccaaacaatgcttatg

SEQ ID NO: 469329 - DNA, 25 bp, Rattus norvegicus
ggtggaaacccatacaatgcttatg

SEQ ID NO: 469330 - DNA, 25 bp, Rattus norvegicus
ggtggaaacccgcatactatctgca

SEQ ID NO: 469331 - DNA, 25 bp, Rattus norvegicus
ggtggaaacccggatactatctgca

SEQ ID NO: 469332 - DNA, 25 bp, Rattus norvegicus
ggtggaaagcttacgagctgccatg

SEQ ID NO: 469333 - DNA, 25 bp, Rattus norvegicus
ggtggaaagctttcgagctgccatg

SEQ ID NO: 469334 - DNA, 25 bp, Rattus norvegicus
ggtggaaatcctccagcgtgtcata

SEQ ID NO: 469335 - DNA, 25 bp, Rattus norvegicus
ggtggaaatcctgcagcgtgtcata

SEQ ID NO: 469336 - DNA, 25 bp, Rattus norvegicus
ggtggaacaaccacgtgcagcagct

SEQ ID NO: 469337 - DNA, 25 bp, Rattus norvegicus
ggtggaacaacctcgtgcagcagct

SEQ ID NO: 469338 - DNA, 25 bp, Rattus norvegicus
ggtggaacattcaaacatcagcctt

SEQ ID NO: 469339 - DNA, 25 bp, Rattus norvegicus
ggtggaacattctaacatcagcctt

SEQ ID NO: 469340 - DNA, 25 bp, Rattus norvegicus
ggtggaaccatcactatttctcaga

SEQ ID NO: 469341 - DNA, 25 bp, Rattus norvegicus
ggtggaaccatctctatttctcaga

SEQ ID NO: 469342 - DNA, 25 bp, Rattus norvegicus
ggtggaaccctgatggaatttcatt

SEQ ID NO: 469343 - DNA, 25 bp, Rattus norvegicus
ggtggaaccctgttggaatttcatt

SEQ ID NO: 469344 - DNA, 25 bp, Rattus norvegicus
ggtggaaccgacacatttgttaaca

SEQ ID NO: 469345 - DNA, 25 bp, Rattus norvegicus
ggtggaaccgactcatttgttaaca

SEQ ID NO: 469346 - DNA, 25 bp, Rattus norvegicus
ggtggaaccgctaggttaccagtga

SEQ ID NO: 469347 - DNA, 25 bp, Rattus norvegicus
ggtggaaccgcttggttaccagtga

SEQ ID NO: 469348 - DNA, 25 bp, Rattus norvegicus
ggtggaaccgggagcgtaggcgcct

SEQ ID NO: 469349 - DNA, 25 bp, Rattus norvegicus
ggtggaaccgggtgcgtaggcgcct

SEQ ID NO: 469350 - DNA, 25 bp, Rattus norvegicus
ggtggaacctttatgtgggcctcag

SEQ ID NO: 469351 - DNA, 25 bp, Rattus norvegicus
ggtggaacctttttgtgggcctcag

SEQ ID NO: 469352 - DNA, 25 bp, Rattus norvegicus
ggtggaactcagaattccctttgtg

SEQ ID NO: 469353 - DNA, 25 bp, Rattus norvegicus
ggtggaactcagtattccctttgtg

SEQ ID NO: 469354 - DNA, 25 bp, Rattus norvegicus
ggtggaactgccagagtgcactttc

SEQ ID NO: 469355 - DNA, 25 bp, Rattus norvegicus
ggtggaactgcctgagtgcactttc

SEQ ID NO: 469356 - DNA, 25 bp, Rattus norvegicus
ggtggaactttcactgaagctcctt

SEQ ID NO: 469357 - DNA, 25 bp, Rattus norvegicus
ggtggaactttctctgaagctcctt

SEQ ID NO: 469358 - DNA, 25 bp, Rattus norvegicus
ggtggaacttttaccgtgcagctcc

SEQ ID NO: 469359 - DNA, 25 bp, Rattus norvegicus
ggtggaactttttccgtgcagctcc

SEQ ID NO: 469360 - DNA, 25 bp, Rattus norvegicus
ggtggaagacagcatgcctctctcc

SEQ ID NO: 469361 - DNA, 25 bp, Rattus norvegicus
ggtggaagacaggatgcctctctcc

SEQ ID NO: 469362 - DNA, 25 bp, Rattus norvegicus
ggtggaagccatactatgtctctgt

SEQ ID NO: 469363 - DNA, 25 bp, Rattus norvegicus
ggtggaagccattctatgtctctgt

SEQ ID NO: 469364 - DNA, 25 bp, Rattus norvegicus
ggtggaatatccactcagcaagcat

SEQ ID NO: 469365 - DNA, 25 bp, Rattus norvegicus
ggtggaatatcctctcagcaagcat

SEQ ID NO: 469366 - DNA, 25 bp, Rattus norvegicus
ggtggaatcactaagcccaagaact

SEQ ID NO: 469367 - DNA, 25 bp, Rattus norvegicus
ggtggaatcacttagcccaagaact

SEQ ID NO: 469368 - DNA, 25 bp, Rattus norvegicus
ggtggaatccatcaagctcctgatg

SEQ ID NO: 469369 - DNA, 25 bp, Rattus norvegicus
ggtggaatccatgaagctcctgatg

SEQ ID NO: 469370 - DNA, 25 bp, Rattus norvegicus
ggtggaatcgtcaacacagaatttt

SEQ ID NO: 469371 - DNA, 25 bp, Rattus norvegicus
ggtggaatcgtctacacagaatttt

SEQ ID NO: 469372 - DNA, 25 bp, Rattus norvegicus
ggtggaatctgtagaggccagttca

SEQ ID NO: 469373 - DNA, 25 bp, Rattus norvegicus
ggtggaatctgttgaggccagttca

SEQ ID NO: 469374 - DNA, 25 bp, Rattus norvegicus
ggtggaatgccaactctacctgaac

SEQ ID NO: 469375 - DNA, 25 bp, Rattus norvegicus
ggtggaatgccatctctacctgaac

SEQ ID NO: 469376 - DNA, 25 bp, Rattus norvegicus
ggtggaattcggaaccagatgactt

SEQ ID NO: 469377 - DNA, 25 bp, Rattus norvegicus
ggtggaattcggtaccagatgactt

SEQ ID NO: 469378 - DNA, 25 bp, Rattus norvegicus
ggtggaattctcagaggtccaggcc

SEQ ID NO: 469379 - DNA, 25 bp, Rattus norvegicus
ggtggaattctctgaggtccaggcc

SEQ ID NO: 469380 - DNA, 25 bp, Rattus norvegicus
ggtggacaatataatttctatcatg

SEQ ID NO: 469381 - DNA, 25 bp, Rattus norvegicus
ggtggacaatattatttctatcatg

SEQ ID NO: 469382 - DNA, 25 bp, Rattus norvegicus
ggtggacacaatacaaatgttcatc

SEQ ID NO: 469383 - DNA, 25 bp, Rattus norvegicus
ggtggacacaattcaaatgttcatc

SEQ ID NO: 469384 - DNA, 25 bp, Rattus norvegicus
ggtggacacacacctgttgcaggat

SEQ ID NO: 469385 - DNA, 25 bp, Rattus norvegicus
ggtggacacacagctgttgcaggat

SEQ ID NO: 469386 - DNA, 25 bp, Rattus norvegicus
ggtggacacagaccagcagctgatc

SEQ ID NO: 469387 - DNA, 25 bp, Rattus norvegicus
ggtggacacagagcagcagctgatc

SEQ ID NO: 469388 - DNA, 25 bp, Rattus norvegicus
ggtggacaccgccacaggcaataag

SEQ ID NO: 469389 - DNA, 25 bp, Rattus norvegicus
ggtggacaccgcgacaggcaataag

SEQ ID NO: 469390 - DNA, 25 bp, Rattus norvegicus
ggtggacactttaagtttatctcta

SEQ ID NO: 469391 - DNA, 25 bp, Rattus norvegicus
ggtggacactttcccatcaattaag

SEQ ID NO: 469392 - DNA, 25 bp, Rattus norvegicus
ggtggacactttgccatcaattaag

SEQ ID NO: 469393 - DNA, 25 bp, Rattus norvegicus
ggtggacacttttagtttatctcta

SEQ ID NO: 469394 - DNA, 25 bp, Rattus norvegicus
ggtggacagcttcagcttgacccca

SEQ ID NO: 469395 - DNA, 25 bp, Rattus norvegicus
ggtggacagcttgagcttgacccca

SEQ ID NO: 469396 - DNA, 25 bp, Rattus norvegicus
ggtggacagtatcccttacacacag

SEQ ID NO: 469397 - DNA, 25 bp, Rattus norvegicus
ggtggacagtatgccttacacacag

SEQ ID NO: 469398 - DNA, 25 bp, Rattus norvegicus
ggtggacatcaaacggcgcgaccca

SEQ ID NO: 469399 - DNA, 25 bp, Rattus norvegicus
ggtggacatcaatcggcgcgaccca

SEQ ID NO: 469400 - DNA, 25 bp, Rattus norvegicus
ggtggacatccacaacaagcgtttc

SEQ ID NO: 469401 - DNA, 25 bp, Rattus norvegicus
ggtggacatccagaacaagcgtttc

SEQ ID NO: 469402 - DNA, 25 bp, Rattus norvegicus
ggtggacatctgcaacttctatttc

SEQ ID NO: 469403 - DNA, 25 bp, Rattus norvegicus
ggtggacatctggaacttctatttc

SEQ ID NO: 469404 - DNA, 25 bp, Rattus norvegicus
ggtggacatgtcaaaatttgctcaa

SEQ ID NO: 469405 - DNA, 25 bp, Rattus norvegicus
ggtggacatgtctaaatttgctcaa

SEQ ID NO: 469406 - DNA, 25 bp, Rattus norvegicus
ggtggaccatcgaatcatagcctgt

SEQ ID NO: 469407 - DNA, 25 bp, Rattus norvegicus
ggtggaccatcgtatcatagcctgt

SEQ ID NO: 469408 - DNA, 25 bp, Rattus norvegicus
ggtggacccaatcgcgagagctccc

SEQ ID NO: 469409 - DNA, 25 bp, Rattus norvegicus
ggtggacccaatggcgagagctccc

SEQ ID NO: 469410 - DNA, 25 bp, Rattus norvegicus
ggtggacccataaaagctcttagct

SEQ ID NO: 469411 - DNA, 25 bp, Rattus norvegicus
ggtggacccatataagctcttagct

SEQ ID NO: 469412 - DNA, 25 bp, Rattus norvegicus
ggtggaccccttctcaggacagaat

SEQ ID NO: 469413 - DNA, 25 bp, Rattus norvegicus
ggtggaccccttgtcaggacagaat

SEQ ID NO: 469414 - DNA, 25 bp, Rattus norvegicus
ggtggaccctccactgtcatggaaa

SEQ ID NO: 469415 - DNA, 25 bp, Rattus norvegicus
ggtggaccctcctctgtcatggaaa

SEQ ID NO: 469416 - DNA, 25 bp, Rattus norvegicus
ggtggaccgtcgacattcactgtat

SEQ ID NO: 469417 - DNA, 25 bp, Rattus norvegicus
ggtggaccgtcgtcattcactgtat

SEQ ID NO: 469418 - DNA, 25 bp, Rattus norvegicus
ggtggaccttgaatagagttctgcc

SEQ ID NO: 469419 - DNA, 25 bp, Rattus norvegicus
ggtggaccttgattagagttctgcc

SEQ ID NO: 469420 - DNA, 25 bp, Rattus norvegicus
ggtggaccttggcaacatgcagcca

SEQ ID NO: 469421 - DNA, 25 bp, Rattus norvegicus
ggtggaccttgggaacatgcagcca

SEQ ID NO: 469422 - DNA, 25 bp, Rattus norvegicus
ggtggacgaatcatcctgcaggata

SEQ ID NO: 469423 - DNA, 25 bp, Rattus norvegicus
ggtggacgaatcttcctgcaggata

SEQ ID NO: 469424 - DNA, 25 bp, Rattus norvegicus
ggtggacgagcgaccgcatgctaat

SEQ ID NO: 469425 - DNA, 25 bp, Rattus norvegicus
ggtggacgagcgtccgcatgctaat

SEQ ID NO: 469426 - DNA, 25 bp, Rattus norvegicus
ggtggacgcagcacagccatacagt

SEQ ID NO: 469427 - DNA, 25 bp, Rattus norvegicus
ggtggacgcagctcagccatacagt

SEQ ID NO: 469428 - DNA, 25 bp, Rattus norvegicus
ggtggacgtatgaattgttcactct

SEQ ID NO: 469429 - DNA, 25 bp, Rattus norvegicus
ggtggacgtatgtattgttcactct

SEQ ID NO: 469430 - DNA, 25 bp, Rattus norvegicus
ggtggacgtcagacatcatggctct

SEQ ID NO: 469431 - DNA, 25 bp, Rattus norvegicus
ggtggacgtcagtcatcatggctct

SEQ ID NO: 469432 - DNA, 25 bp, Rattus norvegicus
ggtggactacataacaataagcaga

SEQ ID NO: 469433 - DNA, 25 bp, Rattus norvegicus
ggtggactacattacaataagcaga

SEQ ID NO: 469434 - DNA, 25 bp, Rattus norvegicus
ggtggactagagatttattctgaaa

SEQ ID NO: 469435 - DNA, 25 bp, Rattus norvegicus
ggtggactagagttttattctgaaa

SEQ ID NO: 469436 - DNA, 25 bp, Rattus norvegicus
ggtggactaggaagacccagctttc

SEQ ID NO: 469437 - DNA, 25 bp, Rattus norvegicus
ggtggactaggatgacccagctttc

SEQ ID NO: 469438 - DNA, 25 bp, Rattus norvegicus
ggtggactctgcatgtgggtttctc

SEQ ID NO: 469439 - DNA, 25 bp, Rattus norvegicus
ggtggactctgcttgtgggtttctc

SEQ ID NO: 469440 - DNA, 25 bp, Rattus norvegicus
ggtggactctgtcccagccaataca

SEQ ID NO: 469441 - DNA, 25 bp, Rattus norvegicus
ggtggactctgtgccagccaataca

SEQ ID NO: 469442 - DNA, 25 bp, Rattus norvegicus
ggtggactggatatcaccccaggta

SEQ ID NO: 469443 - DNA, 25 bp, Rattus norvegicus
ggtggactggatttcaccccaggta

SEQ ID NO: 469444 - DNA, 25 bp, Rattus norvegicus
ggtggacttaccagtattttccaat

SEQ ID NO: 469445 - DNA, 25 bp, Rattus norvegicus
ggtggacttacctgtattttccaat

SEQ ID NO: 469446 - DNA, 25 bp, Rattus norvegicus
ggtggacttctcaaaccaacagtgg

SEQ ID NO: 469447 - DNA, 25 bp, Rattus norvegicus
ggtggacttctctaaccaacagtgg

SEQ ID NO: 469448 - DNA, 25 bp, Rattus norvegicus
ggtggacttctgcaataagcccatt

SEQ ID NO: 469449 - DNA, 25 bp, Rattus norvegicus
ggtggacttctggaataagcccatt

SEQ ID NO: 469450 - DNA, 25 bp, Rattus norvegicus
ggtggacttgaactcctcagtggaa

SEQ ID NO: 469451 - DNA, 25 bp, Rattus norvegicus
ggtggacttgaagtcctcagtggaa

SEQ ID NO: 469452 - DNA, 25 bp, Rattus norvegicus
ggtggacttgtgaatctgcgacgaa

SEQ ID NO: 469453 - DNA, 25 bp, Rattus norvegicus
ggtggacttgtgtatctgcgacgaa

SEQ ID NO: 469454 - DNA, 25 bp, Rattus norvegicus
ggtggacttttccaacagttgtact

SEQ ID NO: 469455 - DNA, 25 bp, Rattus norvegicus
ggtggacttttcgaacagttgtact

SEQ ID NO: 469456 - DNA, 25 bp, Rattus norvegicus
ggtggacttttgatttcataacatt

SEQ ID NO: 469457 - DNA, 25 bp, Rattus norvegicus
ggtggacttttgttttcataacatt

SEQ ID NO: 469458 - DNA, 25 bp, Rattus norvegicus
ggtggagaactcatttgcacacgag

SEQ ID NO: 469459 - DNA, 25 bp, Rattus norvegicus
ggtggagaactcttttgcacacgag

SEQ ID NO: 469460 - DNA, 25 bp, Rattus norvegicus
ggtggagacccaaggctaaatttgc

SEQ ID NO: 469461 - DNA, 25 bp, Rattus norvegicus
ggtggagacccacatcctgacaaga

SEQ ID NO: 469462 - DNA, 25 bp, Rattus norvegicus
ggtggagacccagatcctgacaaga

SEQ ID NO: 469463 - DNA, 25 bp, Rattus norvegicus
ggtggagacccatggctaaatttgc

SEQ ID NO: 469464 - DNA, 25 bp, Rattus norvegicus
ggtggagactccaggtgtactcacg

SEQ ID NO: 469465 - DNA, 25 bp, Rattus norvegicus
ggtggagactcctggtgtactcacg

SEQ ID NO: 469466 - DNA, 25 bp, Rattus norvegicus
ggtggagactggatcacctcccgta

SEQ ID NO: 469467 - DNA, 25 bp, Rattus norvegicus
ggtggagactggttcacctcccgta

SEQ ID NO: 469468 - DNA, 25 bp, Rattus norvegicus
ggtggagagcttacgctgaactaac

SEQ ID NO: 469469 - DNA, 25 bp, Rattus norvegicus
ggtggagagctttcgctgaactaac

SEQ ID NO: 469470 - DNA, 25 bp, Rattus norvegicus
ggtggagatcgaaaggaccgctttt

SEQ ID NO: 469471 - DNA, 25 bp, Rattus norvegicus
ggtggagatcgataggaccgctttt

SEQ ID NO: 469472 - DNA, 25 bp, Rattus norvegicus
ggtggagatctgcttttgcatcctt

SEQ ID NO: 469473 - DNA, 25 bp, Rattus norvegicus
ggtggagatctggttttgcatcctt

SEQ ID NO: 469474 - DNA, 25 bp, Rattus norvegicus
ggtggagatgaacctcaaagccaag

SEQ ID NO: 469475 - DNA, 25 bp, Rattus norvegicus
ggtggagatgaagctcaaagccaag

SEQ ID NO: 469476 - DNA, 25 bp, Rattus norvegicus
ggtggagcaaaaccctaagtccttg

SEQ ID NO: 469477 - DNA, 25 bp, Rattus norvegicus
ggtggagcaaaagcctaagtccttg

SEQ ID NO: 469478 - DNA, 25 bp, Rattus norvegicus
ggtggagcaacgattccaggaatgt

SEQ ID NO: 469479 - DNA, 25 bp, Rattus norvegicus
ggtggagcaacgtttccaggaatgt

SEQ ID NO: 469480 - DNA, 25 bp, Rattus norvegicus
ggtggagcacccagaaaaagccgtg

SEQ ID NO: 469481 - DNA, 25 bp, Rattus norvegicus
ggtggagcaccctgaaaaagccgtg

SEQ ID NO: 469482 - DNA, 25 bp, Rattus norvegicus
ggtggagccattcctgcgactgtac

SEQ ID NO: 469483 - DNA, 25 bp, Rattus norvegicus
ggtggagccattgctgcgactgtac

SEQ ID NO: 469484 - DNA, 25 bp, Rattus norvegicus
ggtggagcccaacgctaagcctgcc

SEQ ID NO: 469485 - DNA, 25 bp, Rattus norvegicus
ggtggagcccaaggctaagcctgcc

SEQ ID NO: 469486 - DNA, 25 bp, Rattus norvegicus
ggtggagcccagatagctcacatgt

SEQ ID NO: 469487 - DNA, 25 bp, Rattus norvegicus
ggtggagcccagttagctcacatgt

SEQ ID NO: 469488 - DNA, 25 bp, Rattus norvegicus
ggtggagcccggatgctacacagaa

SEQ ID NO: 469489 - DNA, 25 bp, Rattus norvegicus
ggtggagcccggttgctacacagaa

SEQ ID NO: 469490 - DNA, 25 bp, Rattus norvegicus
ggtggagcccttattgccataaaca

SEQ ID NO: 469491 - DNA, 25 bp, Rattus norvegicus
ggtggagccctttttgccataaaca

SEQ ID NO: 469492 - DNA, 25 bp, Rattus norvegicus
ggtggagcctatcagctgaagtcat

SEQ ID NO: 469493 - DNA, 25 bp, Rattus norvegicus
ggtggagcctatgagctgaagtcat

SEQ ID NO: 469494 - DNA, 25 bp, Rattus norvegicus
ggtggagctataaaagccgctgttg

SEQ ID NO: 469495 - DNA, 25 bp, Rattus norvegicus
ggtggagctatataagccgctgttg

SEQ ID NO: 469496 - DNA, 25 bp, Rattus norvegicus
ggtggagctgagcaacacaaatgat

SEQ ID NO: 469497 - DNA, 25 bp, Rattus norvegicus
ggtggagctgaggaacacaaatgat

SEQ ID NO: 469498 - DNA, 25 bp, Rattus norvegicus
ggtggagcttcaatgagccccaggc

SEQ ID NO: 469499 - DNA, 25 bp, Rattus norvegicus
ggtggagcttcactcccagagatga

SEQ ID NO: 469500 - DNA, 25 bp, Rattus norvegicus
ggtggagcttcagtcccagagatga

SEQ ID NO: 469501 - DNA, 25 bp, Rattus norvegicus
ggtggagcttcattgagccccaggc

SEQ ID NO: 469502 - DNA, 25 bp, Rattus norvegicus
ggtggaggacctacgatgcaaatat

SEQ ID NO: 469503 - DNA, 25 bp, Rattus norvegicus
ggtggaggaccttcgatgcaaatat

SEQ ID NO: 469504 - DNA, 25 bp, Rattus norvegicus
ggtggaggcaaacatccgctcgcat

SEQ ID NO: 469505 - DNA, 25 bp, Rattus norvegicus
ggtggaggcaaagatccgctcgcat

SEQ ID NO: 469506 - DNA, 25 bp, Rattus norvegicus
ggtggaggcacgattcagactaaat

SEQ ID NO: 469507 - DNA, 25 bp, Rattus norvegicus
ggtggaggcacgtttcagactaaat

SEQ ID NO: 469508 - DNA, 25 bp, Rattus norvegicus
ggtggaggcattaaaccactcccag

SEQ ID NO: 469509 - DNA, 25 bp, Rattus norvegicus
ggtggaggcattaaccttattcact

SEQ ID NO: 469510 - DNA, 25 bp, Rattus norvegicus
ggtggaggcatttaaccactcccag

SEQ ID NO: 469511 - DNA, 25 bp, Rattus norvegicus
ggtggaggcatttaccttattcact

SEQ ID NO: 469512 - DNA, 25 bp, Rattus norvegicus
ggtggaggccacagctctggaatcc

SEQ ID NO: 469513 - DNA, 25 bp, Rattus norvegicus
ggtggaggccactgctctggaatcc

SEQ ID NO: 469514 - DNA, 25 bp, Rattus norvegicus
ggtggaggcccaagactaagcccag

SEQ ID NO: 469515 - DNA, 25 bp, Rattus norvegicus
ggtggaggcccaccagcagaataaa

SEQ ID NO: 469516 - DNA, 25 bp, Rattus norvegicus
ggtggaggcccagcagcagaataaa

SEQ ID NO: 469517 - DNA, 25 bp, Rattus norvegicus
ggtggaggcccatgactaagcccag

SEQ ID NO: 469518 - DNA, 25 bp, Rattus norvegicus
ggtggaggctcaacctggcagcttc

SEQ ID NO: 469519 - DNA, 25 bp, Rattus norvegicus
ggtggaggctcatcctggcagcttc

SEQ ID NO: 469520 - DNA, 25 bp, Rattus norvegicus
ggtggagtacgccaatgccatttgc

SEQ ID NO: 469521 - DNA, 25 bp, Rattus norvegicus
ggtggagtacgcgaatgccatttgc

SEQ ID NO: 469522 - DNA, 25 bp, Rattus norvegicus
ggtggagtacgtatacagccctgaa

SEQ ID NO: 469523 - DNA, 25 bp, Rattus norvegicus
ggtggagtacgtttacagccctgaa

SEQ ID NO: 469524 - DNA, 25 bp, Rattus norvegicus
ggtggagtcaaactggcccttgtac

SEQ ID NO: 469525 - DNA, 25 bp, Rattus norvegicus
ggtggagtcaaagtggcccttgtac

SEQ ID NO: 469526 - DNA, 25 bp, Rattus norvegicus
ggtggagtccgtagctgtcagtcaa

SEQ ID NO: 469527 - DNA, 25 bp, Rattus norvegicus
ggtggagtccgttgctgtcagtcaa

SEQ ID NO: 469528 - DNA, 25 bp, Rattus norvegicus
ggtggagtgattccaagattacatt

SEQ ID NO: 469529 - DNA, 25 bp, Rattus norvegicus
ggtggagtgattgcaagattacatt

SEQ ID NO: 469530 - DNA, 25 bp, Rattus norvegicus
ggtggagtgcccagctagttaagaa

SEQ ID NO: 469531 - DNA, 25 bp, Rattus norvegicus
ggtggagtgccctgctagttaagaa

SEQ ID NO: 469532 - DNA, 25 bp, Rattus norvegicus
ggtggagttccacaacaagttctat

SEQ ID NO: 469533 - DNA, 25 bp, Rattus norvegicus
ggtggagttccagaacaagttctat

SEQ ID NO: 469534 - DNA, 25 bp, Rattus norvegicus
ggtggagttccgatgtgaccccgac

SEQ ID NO: 469535 - DNA, 25 bp, Rattus norvegicus
ggtggagttccgttgtgaccccgac

SEQ ID NO: 469536 - DNA, 25 bp, Rattus norvegicus
ggtggataacacattgcataggaga

SEQ ID NO: 469537 - DNA, 25 bp, Rattus norvegicus
ggtggataacactttgcataggaga

SEQ ID NO: 469538 - DNA, 25 bp, Rattus norvegicus
ggtggatcaagcaactcatcgcctt

SEQ ID NO: 469539 - DNA, 25 bp, Rattus norvegicus
ggtggatcaagctactcatcgcctt

SEQ ID NO: 469540 - DNA, 25 bp, Rattus norvegicus
ggtggatcagctcagcctctttgaa

SEQ ID NO: 469541 - DNA, 25 bp, Rattus norvegicus
ggtggatcagctgagcctctttgaa

SEQ ID NO: 469542 - DNA, 25 bp, Rattus norvegicus
ggtggatcaggaaggacctcctctg

SEQ ID NO: 469543 - DNA, 25 bp, Rattus norvegicus
ggtggatcaggatggacctcctctg

SEQ ID NO: 469544 - DNA, 25 bp, Rattus norvegicus
ggtggatcaggccacagaccccaac

SEQ ID NO: 469545 - DNA, 25 bp, Rattus norvegicus
ggtggatcaggcgacagaccccaac

SEQ ID NO: 469546 - DNA, 25 bp, Rattus norvegicus
ggtggatcatgcaggcgaggtgctc

SEQ ID NO: 469547 - DNA, 25 bp, Rattus norvegicus
ggtggatcatgctggcgaggtgctc

SEQ ID NO: 469548 - DNA, 25 bp, Rattus norvegicus
ggtggatcctgactccacaggaaat

SEQ ID NO: 469549 - DNA, 25 bp, Rattus norvegicus
ggtggatcctgagtccacaggaaat

SEQ ID NO: 469550 - DNA, 25 bp, Rattus norvegicus
ggtggatctcagctactgcaacagt

SEQ ID NO: 469551 - DNA, 25 bp, Rattus norvegicus
ggtggatctcaggtactgcaacagt

SEQ ID NO: 469552 - DNA, 25 bp, Rattus norvegicus
ggtggatctcgtctctgtgtaacca

SEQ ID NO: 469553 - DNA, 25 bp, Rattus norvegicus
ggtggatctcgtgtctgtgtaacca

SEQ ID NO: 469554 - DNA, 25 bp, Rattus norvegicus
ggtggatctctcagattctagacca

SEQ ID NO: 469555 - DNA, 25 bp, Rattus norvegicus
ggtggatctctctgattctagacca

SEQ ID NO: 469556 - DNA, 25 bp, Rattus norvegicus
ggtggatgacaaccctgactttgat

SEQ ID NO: 469557 - DNA, 25 bp, Rattus norvegicus
ggtggatgacaacttcctatcttat

SEQ ID NO: 469558 - DNA, 25 bp, Rattus norvegicus
ggtggatgacaagcctgactttgat

SEQ ID NO: 469559 - DNA, 25 bp, Rattus norvegicus
ggtggatgacaagttcctatcttat

SEQ ID NO: 469560 - DNA, 25 bp, Rattus norvegicus
ggtggatgattgctgctttttcccc

SEQ ID NO: 469561 - DNA, 25 bp, Rattus norvegicus
ggtggatgattggtgctttttcccc

SEQ ID NO: 469562 - DNA, 25 bp, Rattus norvegicus
ggtggatgcacgcaaaccgctcttt

SEQ ID NO: 469563 - DNA, 25 bp, Rattus norvegicus
ggtggatgcacggaaaccgctcttt

SEQ ID NO: 469564 - DNA, 25 bp, Rattus norvegicus
ggtggatgccaccatgcatggcaat

SEQ ID NO: 469565 - DNA, 25 bp, Rattus norvegicus
ggtggatgccacgatgcatggcaat

SEQ ID NO: 469566 - DNA, 25 bp, Rattus norvegicus
ggtggatgcctccttgtcagaaaca

SEQ ID NO: 469567 - DNA, 25 bp, Rattus norvegicus
ggtggatgcctcgttgtcagaaaca

SEQ ID NO: 469568 - DNA, 25 bp, Rattus norvegicus
ggtggatggatcaatacttttaaca

SEQ ID NO: 469569 - DNA, 25 bp, Rattus norvegicus
ggtggatggatctatacttttaaca

SEQ ID NO: 469570 - DNA, 25 bp, Rattus norvegicus
ggtggatggctgagctaccaagaaa

SEQ ID NO: 469571 - DNA, 25 bp, Rattus norvegicus
ggtggatggctgtgctaccaagaaa

SEQ ID NO: 469572 - DNA, 25 bp, Rattus norvegicus
ggtggatgggaactacactctgtac

SEQ ID NO: 469573 - DNA, 25 bp, Rattus norvegicus
ggtggatgggaagtacactctgtac

SEQ ID NO: 469574 - DNA, 25 bp, Rattus norvegicus
ggtggatggtgaaatcgccccctcg

SEQ ID NO: 469575 - DNA, 25 bp, Rattus norvegicus
ggtggatggtgatatcgccccctcg

SEQ ID NO: 469576 - DNA, 25 bp, Rattus norvegicus
ggtggatggttcagccactgagcac

SEQ ID NO: 469577 - DNA, 25 bp, Rattus norvegicus
ggtggatggttctgccactgagcac

SEQ ID NO: 469578 - DNA, 25 bp, Rattus norvegicus
ggtggatgtattatacgcctttttt

SEQ ID NO: 469579 - DNA, 25 bp, Rattus norvegicus
ggtggatgtattttacgcctttttt

SEQ ID NO: 469580 - DNA, 25 bp, Rattus norvegicus
ggtggattcagccaaagccaggaac

SEQ ID NO: 469581 - DNA, 25 bp, Rattus norvegicus
ggtggattcagcgaaagccaggaac

SEQ ID NO: 469582 - DNA, 25 bp, Rattus norvegicus
ggtggattctctctttccagacaac

SEQ ID NO: 469583 - DNA, 25 bp, Rattus norvegicus
ggtggattctctgtttccagacaac

SEQ ID NO: 469584 - DNA, 25 bp, Rattus norvegicus
ggtggattcttacagcctggcacta

SEQ ID NO: 469585 - DNA, 25 bp, Rattus norvegicus
ggtggattcttagagcctggcacta

SEQ ID NO: 469586 - DNA, 25 bp, Rattus norvegicus
ggtggattcttcacggaaactgcaa

SEQ ID NO: 469587 - DNA, 25 bp, Rattus norvegicus
ggtggattcttctcggaaactgcaa

SEQ ID NO: 469588 - DNA, 25 bp, Rattus norvegicus
ggtggattgattacagtacctacaa

SEQ ID NO: 469589 - DNA, 25 bp, Rattus norvegicus
ggtggattgatttcagtacctacaa

SEQ ID NO: 469590 - DNA, 25 bp, Rattus norvegicus
ggtggattgcccagaagtggcccta

SEQ ID NO: 469591 - DNA, 25 bp, Rattus norvegicus
ggtggattgccctgaagtggcccta

SEQ ID NO: 469592 - DNA, 25 bp, Rattus norvegicus
ggtggatttcccatgcaaactgaat

SEQ ID NO: 469593 - DNA, 25 bp, Rattus norvegicus
ggtggatttcccttgcaaactgaat

SEQ ID NO: 469594 - DNA, 25 bp, Rattus norvegicus
ggtggatttgtaagcaatgcactgc

SEQ ID NO: 469595 - DNA, 25 bp, Rattus norvegicus
ggtggatttgtatgcaatgcactgc

SEQ ID NO: 469596 - DNA, 25 bp, Rattus norvegicus
ggtggcaaactgaggccttgatcca

SEQ ID NO: 469597 - DNA, 25 bp, Rattus norvegicus
ggtggcaaactgtggccttgatcca

SEQ ID NO: 469598 - DNA, 25 bp, Rattus norvegicus
ggtggcaaccacaaatgtgctgttt

SEQ ID NO: 469599 - DNA, 25 bp, Rattus norvegicus
ggtggcaaccactaatgtgctgttt

SEQ ID NO: 469600 - DNA, 25 bp, Rattus norvegicus
ggtggcaacccacttaggtcatctt

SEQ ID NO: 469601 - DNA, 25 bp, Rattus norvegicus
ggtggcaacccagttaggtcatctt

SEQ ID NO: 469602 - DNA, 25 bp, Rattus norvegicus
ggtggcaacctgatttttaatggct

SEQ ID NO: 469603 - DNA, 25 bp, Rattus norvegicus
ggtggcaacctgttttttaatggct

SEQ ID NO: 469604 - DNA, 25 bp, Rattus norvegicus
ggtggcaactgcagcactgaccaga

SEQ ID NO: 469605 - DNA, 25 bp, Rattus norvegicus
ggtggcaactgctgcactgaccaga

SEQ ID NO: 469606 - DNA, 25 bp, Rattus norvegicus
ggtggcaagggacccatctgctact

SEQ ID NO: 469607 - DNA, 25 bp, Rattus norvegicus
ggtggcaagggagccatctgctact

SEQ ID NO: 469608 - DNA, 25 bp, Rattus norvegicus
ggtggcaatgacatcgtgttctttt

SEQ ID NO: 469609 - DNA, 25 bp, Rattus norvegicus
ggtggcaatgacttcgtgttctttt

SEQ ID NO: 469610 - DNA, 25 bp, Rattus norvegicus
ggtggcaatgttatccttgcgagaa

SEQ ID NO: 469611 - DNA, 25 bp, Rattus norvegicus
ggtggcaatgttttccttgcgagaa

SEQ ID NO: 469612 - DNA, 25 bp, Rattus norvegicus
ggtggcaattctacaaccaagcaga

SEQ ID NO: 469613 - DNA, 25 bp, Rattus norvegicus
ggtggcaattcttcaaccaagcaga

SEQ ID NO: 469614 - DNA, 25 bp, Rattus norvegicus
ggtggcacacacatatttcttggga

SEQ ID NO: 469615 - DNA, 25 bp, Rattus norvegicus
ggtggcacacacattgaaccccagt

SEQ ID NO: 469616 - DNA, 25 bp, Rattus norvegicus
ggtggcacacacttatttcttggga

SEQ ID NO: 469617 - DNA, 25 bp, Rattus norvegicus
ggtggcacacactttgaaccccagt

SEQ ID NO: 469618 - DNA, 25 bp, Rattus norvegicus
ggtggcacagaaacaatcccagccc

SEQ ID NO: 469619 - DNA, 25 bp, Rattus norvegicus
ggtggcacagaatcaatcccagccc

SEQ ID NO: 469620 - DNA, 25 bp, Rattus norvegicus
ggtggcacagcaaaagaacccagct

SEQ ID NO: 469621 - DNA, 25 bp, Rattus norvegicus
ggtggcacagcataagaacccagct

SEQ ID NO: 469622 - DNA, 25 bp, Rattus norvegicus
ggtggcacagccatgtccagagcag

SEQ ID NO: 469623 - DNA, 25 bp, Rattus norvegicus
ggtggcacagccttgtccagagcag

SEQ ID NO: 469624 - DNA, 25 bp, Rattus norvegicus
ggtggcacagttattatccaggaca

SEQ ID NO: 469625 - DNA, 25 bp, Rattus norvegicus
ggtggcacagtttttatccaggaca

SEQ ID NO: 469626 - DNA, 25 bp, Rattus norvegicus
ggtggcacatggcacacgtacataa

SEQ ID NO: 469627 - DNA, 25 bp, Rattus norvegicus
ggtggcacatgggacacgtacataa

SEQ ID NO: 469628 - DNA, 25 bp, Rattus norvegicus
ggtggcaccaaacgaagaacctaca

SEQ ID NO: 469629 - DNA, 25 bp, Rattus norvegicus
ggtggcaccaaaggaagaacctaca

SEQ ID NO: 469630 - DNA, 25 bp, Rattus norvegicus
ggtggcaccagactcaatgcggctc

SEQ ID NO: 469631 - DNA, 25 bp, Rattus norvegicus
ggtggcaccagagtcaatgcggctc

SEQ ID NO: 469632 - DNA, 25 bp, Rattus norvegicus
ggtggcaccatcaacgatgtgctga

SEQ ID NO: 469633 - DNA, 25 bp, Rattus norvegicus
ggtggcaccatctacgatgtgctga

SEQ ID NO: 469634 - DNA, 25 bp, Rattus norvegicus
ggtggcacccagactaaggtaccga

SEQ ID NO: 469635 - DNA, 25 bp, Rattus norvegicus
ggtggcacccagtctaaggtaccga

SEQ ID NO: 469636 - DNA, 25 bp, Rattus norvegicus
ggtggcacgcagaattctgaacaac

SEQ ID NO: 469637 - DNA, 25 bp, Rattus norvegicus
ggtggcacgcagtattctgaacaac

SEQ ID NO: 469638 - DNA, 25 bp, Rattus norvegicus
ggtggcacggtgactatcctaggtc

SEQ ID NO: 469639 - DNA, 25 bp, Rattus norvegicus
ggtggcacggtgtctatcctaggtc

SEQ ID NO: 469640 - DNA, 25 bp, Rattus norvegicus
ggtggcactgagatttccatacatt

SEQ ID NO: 469641 - DNA, 25 bp, Rattus norvegicus
ggtggcactgagttttccatacatt

SEQ ID NO: 469642 - DNA, 25 bp, Rattus norvegicus
ggtggcagaactcactctatctgga

SEQ ID NO: 469643 - DNA, 25 bp, Rattus norvegicus
ggtggcagaactgactctatctgga

SEQ ID NO: 469644 - DNA, 25 bp, Rattus norvegicus
ggtggcagaagtcagtcccctgtct

SEQ ID NO: 469645 - DNA, 25 bp, Rattus norvegicus
ggtggcagaagtgagtcccctgtct

SEQ ID NO: 469646 - DNA, 25 bp, Rattus norvegicus
ggtggcagagacagttctcttcact

SEQ ID NO: 469647 - DNA, 25 bp, Rattus norvegicus
ggtggcagagactgttctcttcact

SEQ ID NO: 469648 - DNA, 25 bp, Rattus norvegicus
ggtggcagatgtcgcctcttgtctt

SEQ ID NO: 469649 - DNA, 25 bp, Rattus norvegicus
ggtggcagatgtggcctcttgtctt

SEQ ID NO: 469650 - DNA, 25 bp, Rattus norvegicus
ggtggcagccatactagacatctag

SEQ ID NO: 469651 - DNA, 25 bp, Rattus norvegicus
ggtggcagccattctagacatctag

SEQ ID NO: 469652 - DNA, 25 bp, Rattus norvegicus
ggtggcagcccacactgaaccagag

SEQ ID NO: 469653 - DNA, 25 bp, Rattus norvegicus
ggtggcagcccagactgaaccagag

SEQ ID NO: 469654 - DNA, 25 bp, Rattus norvegicus
ggtggcagctgcactttgggcaacc

SEQ ID NO: 469655 - DNA, 25 bp, Rattus norvegicus
ggtggcagctgctctttgggcaacc

SEQ ID NO: 469656 - DNA, 25 bp, Rattus norvegicus
ggtggcaggcacctttatatcaggt

SEQ ID NO: 469657 - DNA, 25 bp, Rattus norvegicus
ggtggcaggcacgtttatatcaggt

SEQ ID NO: 469658 - DNA, 25 bp, Rattus norvegicus
ggtggcagggccaagctgctacaaa

SEQ ID NO: 469659 - DNA, 25 bp, Rattus norvegicus
ggtggcagggcctagctgctacaaa

SEQ ID NO: 469660 - DNA, 25 bp, Rattus norvegicus
ggtggcagtgtaagcttttagtccc

SEQ ID NO: 469661 - DNA, 25 bp, Rattus norvegicus
ggtggcagtgtatgcttttagtccc

SEQ ID NO: 469662 - DNA, 25 bp, Rattus norvegicus
ggtggcagttccctcttctgtgtag

SEQ ID NO: 469663 - DNA, 25 bp, Rattus norvegicus
ggtggcagttccgtcttctgtgtag

SEQ ID NO: 469664 - DNA, 25 bp, Rattus norvegicus
ggtggcagtttaattctcagatcag

SEQ ID NO: 469665 - DNA, 25 bp, Rattus norvegicus
ggtggcagtttatttctcagatcag

SEQ ID NO: 469666 - DNA, 25 bp, Rattus norvegicus
ggtggcataagcctgctggttcaaa

SEQ ID NO: 469667 - DNA, 25 bp, Rattus norvegicus
ggtggcataagcgtgctggttcaaa

SEQ ID NO: 469668 - DNA, 25 bp, Rattus norvegicus
ggtggcatcaacctgtggagattac

SEQ ID NO: 469669 - DNA, 25 bp, Rattus norvegicus
ggtggcatcaacgtgtggagattac

SEQ ID NO: 469670 - DNA, 25 bp, Rattus norvegicus
ggtggcatcagcaaatcagtacaga

SEQ ID NO: 469671 - DNA, 25 bp, Rattus norvegicus
ggtggcatcagctaatcagtacaga

SEQ ID NO: 469672 - DNA, 25 bp, Rattus norvegicus
ggtggcatcatcatcaatatttctt

SEQ ID NO: 469673 - DNA, 25 bp, Rattus norvegicus
ggtggcatcatcttcaatatttctt

SEQ ID NO: 469674 - DNA, 25 bp, Rattus norvegicus
ggtggcatcatgcaaaagcaagtta

SEQ ID NO: 469675 - DNA, 25 bp, Rattus norvegicus
ggtggcatcatggaaaagcaagtta

SEQ ID NO: 469676 - DNA, 25 bp, Rattus norvegicus
ggtggcatctgtcgcatgctatgaa

SEQ ID NO: 469677 - DNA, 25 bp, Rattus norvegicus
ggtggcatctgtggcatgctatgaa

SEQ ID NO: 469678 - DNA, 25 bp, Rattus norvegicus
ggtggcatgctgacaaaaggctaat

SEQ ID NO: 469679 - DNA, 25 bp, Rattus norvegicus
ggtggcatgctgtcaaaaggctaat

SEQ ID NO: 469680 - DNA, 25 bp, Rattus norvegicus
ggtggcatgtttaaccttctggaaa

SEQ ID NO: 469681 - DNA, 25 bp, Rattus norvegicus
ggtggcatgttttaccttctggaaa

SEQ ID NO: 469682 - DNA, 25 bp, Rattus norvegicus
ggtggcattcacatatactgagaga

SEQ ID NO: 469683 - DNA, 25 bp, Rattus norvegicus
ggtggcattcacttatactgagaga

SEQ ID NO: 469684 - DNA, 25 bp, Rattus norvegicus
ggtggcattttcacctttgccataa

SEQ ID NO: 469685 - DNA, 25 bp, Rattus norvegicus
ggtggcattttccagaatgtccctc

SEQ ID NO: 469686 - DNA, 25 bp, Rattus norvegicus
ggtggcattttcgagaatgtccctc

SEQ ID NO: 469687 - DNA, 25 bp, Rattus norvegicus
ggtggcattttctcctttgccataa

SEQ ID NO: 469688 - DNA, 25 bp, Rattus norvegicus
ggtggccaagcaagggatacatgcc

SEQ ID NO: 469689 - DNA, 25 bp, Rattus norvegicus
ggtggccaagcatgggatacatgcc

SEQ ID NO: 469690 - DNA, 25 bp, Rattus norvegicus
ggtggccaagcgattatactctgtt

SEQ ID NO: 469691 - DNA, 25 bp, Rattus norvegicus
ggtggccaagcgtttatactctgtt

SEQ ID NO: 469692 - DNA, 25 bp, Rattus norvegicus
ggtggccacacactgaagccatgat

SEQ ID NO: 469693 - DNA, 25 bp, Rattus norvegicus
ggtggccacacagtgaagccatgat

SEQ ID NO: 469694 - DNA, 25 bp, Rattus norvegicus
ggtggccacatcatgcctattgaat

SEQ ID NO: 469695 - DNA, 25 bp, Rattus norvegicus
ggtggccacatcttgcctattgaat

SEQ ID NO: 469696 - DNA, 25 bp, Rattus norvegicus
ggtggccactctctattgaagggta

SEQ ID NO: 469697 - DNA, 25 bp, Rattus norvegicus
ggtggccactctgtattgaagggta

SEQ ID NO: 469698 - DNA, 25 bp, Rattus norvegicus
ggtggccacttcattctgataataa

SEQ ID NO: 469699 - DNA, 25 bp, Rattus norvegicus
ggtggccacttctttctgataataa

SEQ ID NO: 469700 - DNA, 25 bp, Rattus norvegicus
ggtggccagaatcctccttaaaggt

SEQ ID NO: 469701 - DNA, 25 bp, Rattus norvegicus
ggtggccagaatgctccttaaaggt

SEQ ID NO: 469702 - DNA, 25 bp, Rattus norvegicus
ggtggccagattaaagttcctccga

SEQ ID NO: 469703 - DNA, 25 bp, Rattus norvegicus
ggtggccagatttaagttcctccga

SEQ ID NO: 469704 - DNA, 25 bp, Rattus norvegicus
ggtggccagccacatgtgtgacata

SEQ ID NO: 469705 - DNA, 25 bp, Rattus norvegicus
ggtggccagccagatgtgtgacata

SEQ ID NO: 469706 - DNA, 25 bp, Rattus norvegicus
ggtggccaggccagaatccttatgt

SEQ ID NO: 469707 - DNA, 25 bp, Rattus norvegicus
ggtggccaggcctgaatccttatgt

SEQ ID NO: 469708 - DNA, 25 bp, Rattus norvegicus
ggtggccagtttaattttgacgagg

SEQ ID NO: 469709 - DNA, 25 bp, Rattus norvegicus
ggtggccagttttattttgacgagg

SEQ ID NO: 469710 - DNA, 25 bp, Rattus norvegicus
ggtggcccaaagctgctccaaagaa

SEQ ID NO: 469711 - DNA, 25 bp, Rattus norvegicus
ggtggcccaaaggtgctccaaagaa

SEQ ID NO: 469712 - DNA, 25 bp, Rattus norvegicus
ggtggcccactcatttgtgaacaac

SEQ ID NO: 469713 - DNA, 25 bp, Rattus norvegicus
ggtggcccactcctcaagtgttaaa

SEQ ID NO: 469714 - DNA, 25 bp, Rattus norvegicus
ggtggcccactcgtcaagtgttaaa

SEQ ID NO: 469715 - DNA, 25 bp, Rattus norvegicus
ggtggcccactcttttgtgaacaac

SEQ ID NO: 469716 - DNA, 25 bp, Rattus norvegicus
ggtggcccacttagtgaatgaataa

SEQ ID NO: 469717 - DNA, 25 bp, Rattus norvegicus
ggtggcccactttgtgaatgaataa

SEQ ID NO: 469718 - DNA, 25 bp, Rattus norvegicus
ggtggcccagagcaggctaaccaca

SEQ ID NO: 469719 - DNA, 25 bp, Rattus norvegicus
ggtggcccagaggaggctaaccaca

SEQ ID NO: 469720 - DNA, 25 bp, Rattus norvegicus
ggtggcccagccaaaaacatgtcct

SEQ ID NO: 469721 - DNA, 25 bp, Rattus norvegicus
ggtggcccagcctaaaacatgtcct

SEQ ID NO: 469722 - DNA, 25 bp, Rattus norvegicus
ggtggcccaggtactgagcagtgaa

SEQ ID NO: 469723 - DNA, 25 bp, Rattus norvegicus
ggtggcccaggttctgagcagtgaa

SEQ ID NO: 469724 - DNA, 25 bp, Rattus norvegicus
ggtggcccattcagagtcgatataa

SEQ ID NO: 469725 - DNA, 25 bp, Rattus norvegicus
ggtggcccattctgagtcgatataa

SEQ ID NO: 469726 - DNA, 25 bp, Rattus norvegicus
ggtggccccatacccaggaatatat

SEQ ID NO: 469727 - DNA, 25 bp, Rattus norvegicus
ggtggccccatagccaggaatatat

SEQ ID NO: 469728 - DNA, 25 bp, Rattus norvegicus
ggtggcccgcgtaggtcacccgagg

SEQ ID NO: 469729 - DNA, 25 bp, Rattus norvegicus
ggtggcccgcgttggtcacccgagg

SEQ ID NO: 469730 - DNA, 25 bp, Rattus norvegicus
ggtggccctaatcttcattgtaatg

SEQ ID NO: 469731 - DNA, 25 bp, Rattus norvegicus
ggtggccctaatgttcattgtaatg

SEQ ID NO: 469732 - DNA, 25 bp, Rattus norvegicus
ggtggccctggaattgctcagagaa

SEQ ID NO: 469733 - DNA, 25 bp, Rattus norvegicus
ggtggccctggatttgctcagagaa

SEQ ID NO: 469734 - DNA, 25 bp, Rattus norvegicus
ggtggccgacatccttcatgaacag

SEQ ID NO: 469735 - DNA, 25 bp, Rattus norvegicus
ggtggccgacatgcttcatgaacag

SEQ ID NO: 469736 - DNA, 25 bp, Rattus norvegicus
ggtggccgaggtcaatgtttattta

SEQ ID NO: 469737 - DNA, 25 bp, Rattus norvegicus
ggtggccgaggtgaatgtttattta

SEQ ID NO: 469738 - DNA, 25 bp, Rattus norvegicus
ggtggcctacaaaacccatcaatga

SEQ ID NO: 469739 - DNA, 25 bp, Rattus norvegicus
ggtggcctacaatacccatcaatga

SEQ ID NO: 469740 - DNA, 25 bp, Rattus norvegicus
ggtggcctacctcttgaagcagcta

SEQ ID NO: 469741 - DNA, 25 bp, Rattus norvegicus
ggtggcctacctgttgaagcagcta

SEQ ID NO: 469742 - DNA, 25 bp, Rattus norvegicus
ggtggcctagaactcccaatgtaga

SEQ ID NO: 469743 - DNA, 25 bp, Rattus norvegicus
ggtggcctagaagtcccaatgtaga

SEQ ID NO: 469744 - DNA, 25 bp, Rattus norvegicus
ggtggcctagatcccagactattat

SEQ ID NO: 469745 - DNA, 25 bp, Rattus norvegicus
ggtggcctagatgccagactattat

SEQ ID NO: 469746 - DNA, 25 bp, Rattus norvegicus
ggtggcctagcaattaagagacttc

SEQ ID NO: 469747 - DNA, 25 bp, Rattus norvegicus
ggtggcctagcatttaagagacttc

SEQ ID NO: 469748 - DNA, 25 bp, Rattus norvegicus
ggtggcctatgccacgtgtcccaga

SEQ ID NO: 469749 - DNA, 25 bp, Rattus norvegicus
ggtggcctatgcgacgtgtcccaga

SEQ ID NO: 469750 - DNA, 25 bp, Rattus norvegicus
ggtggcctcagaccagatattcata

SEQ ID NO: 469751 - DNA, 25 bp, Rattus norvegicus
ggtggcctcagagcagatattcata

SEQ ID NO: 469752 - DNA, 25 bp, Rattus norvegicus
ggtggcctcccacataatgaattat

SEQ ID NO: 469753 - DNA, 25 bp, Rattus norvegicus
ggtggcctcccagataatgaattat

SEQ ID NO: 469754 - DNA, 25 bp, Rattus norvegicus
ggtggcctcgctatttaagaactca

SEQ ID NO: 469755 - DNA, 25 bp, Rattus norvegicus
ggtggcctcgctttttaagaactca

SEQ ID NO: 469756 - DNA, 25 bp, Rattus norvegicus
ggtggcctctccaacagtaacttca

SEQ ID NO: 469757 - DNA, 25 bp, Rattus norvegicus
ggtggcctctcctacagtaacttca

SEQ ID NO: 469758 - DNA, 25 bp, Rattus norvegicus
ggtggcctgctcaagggaacactgc

SEQ ID NO: 469759 - DNA, 25 bp, Rattus norvegicus
ggtggcctgctctagggaacactgc

SEQ ID NO: 469760 - DNA, 25 bp, Rattus norvegicus
ggtggcctgctgacgatacaacaat

SEQ ID NO: 469761 - DNA, 25 bp, Rattus norvegicus
ggtggcctgctgtcgatacaacaat

SEQ ID NO: 469762 - DNA, 25 bp, Rattus norvegicus
ggtggccttcagatcggtcacagaa

SEQ ID NO: 469763 - DNA, 25 bp, Rattus norvegicus
ggtggccttcagattatgtaattat

SEQ ID NO: 469764 - DNA, 25 bp, Rattus norvegicus
ggtggccttcagttcggtcacagaa

SEQ ID NO: 469765 - DNA, 25 bp, Rattus norvegicus
ggtggccttcagtttatgtaattat

SEQ ID NO: 469766 - DNA, 25 bp, Rattus norvegicus
ggtggccttcttaatatatcgtttg

SEQ ID NO: 469767 - DNA, 25 bp, Rattus norvegicus
ggtggccttctttatatatcgtttg

SEQ ID NO: 469768 - DNA, 25 bp, Rattus norvegicus
ggtggccttgccctgtttgaacatt

SEQ ID NO: 469769 - DNA, 25 bp, Rattus norvegicus
ggtggccttgccgtgtttgaacatt

SEQ ID NO: 469770 - DNA, 25 bp, Rattus norvegicus
ggtggcctttagagatggtcatgct

SEQ ID NO: 469771 - DNA, 25 bp, Rattus norvegicus
ggtggcctttagtgatggtcatgct

SEQ ID NO: 469772 - DNA, 25 bp, Rattus norvegicus
ggtggcctttgcagagagacagtca

SEQ ID NO: 469773 - DNA, 25 bp, Rattus norvegicus
ggtggcctttgctgagagacagtca

SEQ ID NO: 469774 - DNA, 25 bp, Rattus norvegicus
ggtggcctttgtcataactattcta

SEQ ID NO: 469775 - DNA, 25 bp, Rattus norvegicus
ggtggcctttgtgataactattcta

SEQ ID NO: 469776 - DNA, 25 bp, Rattus norvegicus
ggtggcctttttaacactctacaga

SEQ ID NO: 469777 - DNA, 25 bp, Rattus norvegicus
ggtggccttttttacactctacaga

SEQ ID NO: 469778 - DNA, 25 bp, Rattus norvegicus
ggtggcgaaaccaagcctcatggac

SEQ ID NO: 469779 - DNA, 25 bp, Rattus norvegicus
ggtggcgaaacctagcctcatggac

SEQ ID NO: 469780 - DNA, 25 bp, Rattus norvegicus
ggtggcgccctgcaggacaaaataa

SEQ ID NO: 469781 - DNA, 25 bp, Rattus norvegicus
ggtggcgccctggaggacaaaataa

SEQ ID NO: 469782 - DNA, 25 bp, Rattus norvegicus
ggtggcgcctcacgttggcacccat

SEQ ID NO: 469783 - DNA, 25 bp, Rattus norvegicus
ggtggcgcctcaggttggcacccat

SEQ ID NO: 469784 - DNA, 25 bp, Rattus norvegicus
ggtggcgcgggcacggaagtgcatg

SEQ ID NO: 469785 - DNA, 25 bp, Rattus norvegicus
ggtggcgcgggctcggaagtgcatg

SEQ ID NO: 469786 - DNA, 25 bp, Rattus norvegicus
ggtggcgctcacctgtaaatttcag

SEQ ID NO: 469787 - DNA, 25 bp, Rattus norvegicus
ggtggcgctcacgtgtaaatttcag

SEQ ID NO: 469788 - DNA, 25 bp, Rattus norvegicus
ggtggcgctctccaacagttaaaag

SEQ ID NO: 469789 - DNA, 25 bp, Rattus norvegicus
ggtggcgctctcgaacagttaaaag

SEQ ID NO: 469790 - DNA, 25 bp, Rattus norvegicus
ggtggcggacacacagctgaagccc

SEQ ID NO: 469791 - DNA, 25 bp, Rattus norvegicus
ggtggcggacactcagctgaagccc

SEQ ID NO: 469792 - DNA, 25 bp, Rattus norvegicus
ggtggcgtgagtcctcagatacatc

SEQ ID NO: 469793 - DNA, 25 bp, Rattus norvegicus
ggtggcgtgagtgctcagatacatc

SEQ ID NO: 469794 - DNA, 25 bp, Rattus norvegicus
ggtggcgttcagagccaggtaccat

SEQ ID NO: 469795 - DNA, 25 bp, Rattus norvegicus
ggtggcgttcagtgccaggtaccat

SEQ ID NO: 469796 - DNA, 25 bp, Rattus norvegicus
ggtggcgtttgtaccagaacgccgc

SEQ ID NO: 469797 - DNA, 25 bp, Rattus norvegicus
ggtggcgtttgttccagaacgccgc

SEQ ID NO: 469798 - DNA, 25 bp, Rattus norvegicus
ggtggctaaccgactgtaagacttg

SEQ ID NO: 469799 - DNA, 25 bp, Rattus norvegicus
ggtggctaaccgtctgtaagacttg

SEQ ID NO: 469800 - DNA, 25 bp, Rattus norvegicus
ggtggctacaataccgaaactcaga

SEQ ID NO: 469801 - DNA, 25 bp, Rattus norvegicus
ggtggctacaattccgaaactcaga

SEQ ID NO: 469802 - DNA, 25 bp, Rattus norvegicus
ggtggctacagaactggatttcatt

SEQ ID NO: 469803 - DNA, 25 bp, Rattus norvegicus
ggtggctacagatctggatttcatt

SEQ ID NO: 469804 - DNA, 25 bp, Rattus norvegicus
ggtggctagcgaccatctgtaaccc

SEQ ID NO: 469805 - DNA, 25 bp, Rattus norvegicus
ggtggctagcgagcatctgtaaccc

SEQ ID NO: 469806 - DNA, 25 bp, Rattus norvegicus
ggtggctaggctacctgaccataaa

SEQ ID NO: 469807 - DNA, 25 bp, Rattus norvegicus
ggtggctaggcttcctgaccataaa

SEQ ID NO: 469808 - DNA, 25 bp, Rattus norvegicus
ggtggctatactcactacacataaa

SEQ ID NO: 469809 - DNA, 25 bp, Rattus norvegicus
ggtggctatactgactacacataaa

SEQ ID NO: 469810 - DNA, 25 bp, Rattus norvegicus
ggtggctatatcctgccttatttag

SEQ ID NO: 469811 - DNA, 25 bp, Rattus norvegicus
ggtggctatatcgtgccttatttag

SEQ ID NO: 469812 - DNA, 25 bp, Rattus norvegicus
ggtggctatggacgcttttacaaca

SEQ ID NO: 469813 - DNA, 25 bp, Rattus norvegicus
ggtggctatggaggcttttacaaca

SEQ ID NO: 469814 - DNA, 25 bp, Rattus norvegicus
ggtggctattaaatcttcagtctgc

SEQ ID NO: 469815 - DNA, 25 bp, Rattus norvegicus
ggtggctattaattcttcagtctgc

SEQ ID NO: 469816 - DNA, 25 bp, Rattus norvegicus
ggtggctattatactaactactctt

SEQ ID NO: 469817 - DNA, 25 bp, Rattus norvegicus
ggtggctattattctaactactctt

SEQ ID NO: 469818 - DNA, 25 bp, Rattus norvegicus
ggtggctcaatgaacttctgcttaa

SEQ ID NO: 469819 - DNA, 25 bp, Rattus norvegicus
ggtggctcaatgcttactgcttttc

SEQ ID NO: 469820 - DNA, 25 bp, Rattus norvegicus
ggtggctcaatggttactgcttttc

SEQ ID NO: 469821 - DNA, 25 bp, Rattus norvegicus
ggtggctcaatgtacttctgcttaa

SEQ ID NO: 469822 - DNA, 25 bp, Rattus norvegicus
ggtggctcagagcacaatctatcat

SEQ ID NO: 469823 - DNA, 25 bp, Rattus norvegicus
ggtggctcagaggacaatctatcat

SEQ ID NO: 469824 - DNA, 25 bp, Rattus norvegicus
ggtggctcagcaacagtgcctgttt

SEQ ID NO: 469825 - DNA, 25 bp, Rattus norvegicus
ggtggctcagcaaggtgaactccaa

SEQ ID NO: 469826 - DNA, 25 bp, Rattus norvegicus
ggtggctcagcatcagtgcctgttt

SEQ ID NO: 469827 - DNA, 25 bp, Rattus norvegicus
ggtggctcagcatggtgaactccaa

SEQ ID NO: 469828 - DNA, 25 bp, Rattus norvegicus
ggtggctcagttcgtgggcggtggg

SEQ ID NO: 469829 - DNA, 25 bp, Rattus norvegicus
ggtggctcagttggtgggcggtggg

SEQ ID NO: 469830 - DNA, 25 bp, Rattus norvegicus
ggtggctcatcaccgtcacagactt

SEQ ID NO: 469831 - DNA, 25 bp, Rattus norvegicus
ggtggctcatcagcgtcacagactt

SEQ ID NO: 469832 - DNA, 25 bp, Rattus norvegicus
ggtggctcatctccttttttctgaa

SEQ ID NO: 469833 - DNA, 25 bp, Rattus norvegicus
ggtggctcatctgcttttttctgaa

SEQ ID NO: 469834 - DNA, 25 bp, Rattus norvegicus
ggtggctcatggagctttcaataaa

SEQ ID NO: 469835 - DNA, 25 bp, Rattus norvegicus
ggtggctcatggtgctttcaataaa

SEQ ID NO: 469836 - DNA, 25 bp, Rattus norvegicus
ggtggctcattcaagctattcttaa

SEQ ID NO: 469837 - DNA, 25 bp, Rattus norvegicus
ggtggctcattctagctattcttaa

SEQ ID NO: 469838 - DNA, 25 bp, Rattus norvegicus
ggtggctccggcagttgctgtggtt

SEQ ID NO: 469839 - DNA, 25 bp, Rattus norvegicus
ggtggctccggctgttgctgtggtt

SEQ ID NO: 469840 - DNA, 25 bp, Rattus norvegicus
ggtggctcctctaaaagatgcatca

SEQ ID NO: 469841 - DNA, 25 bp, Rattus norvegicus
ggtggctcctcttaaagatgcatca

SEQ ID NO: 469842 - DNA, 25 bp, Rattus norvegicus
ggtggctcggcacttcaacctgatc

SEQ ID NO: 469843 - DNA, 25 bp, Rattus norvegicus
ggtggctcggcagttcaacctgatc

SEQ ID NO: 469844 - DNA, 25 bp, Rattus norvegicus
ggtggctctctgagacatcatggcg

SEQ ID NO: 469845 - DNA, 25 bp, Rattus norvegicus
ggtggctctctgtgacatcatggcg

SEQ ID NO: 469846 - DNA, 25 bp, Rattus norvegicus
ggtggctgaaacagcggccgatcat

SEQ ID NO: 469847 - DNA, 25 bp, Rattus norvegicus
ggtggctgaaactgcggccgatcat

SEQ ID NO: 469848 - DNA, 25 bp, Rattus norvegicus
ggtggctgaaatagcacatttttat

SEQ ID NO: 469849 - DNA, 25 bp, Rattus norvegicus
ggtggctgaaattgcacatttttat

SEQ ID NO: 469850 - DNA, 25 bp, Rattus norvegicus
ggtggctgacaactgtctgagacaa

SEQ ID NO: 469851 - DNA, 25 bp, Rattus norvegicus
ggtggctgacaagtgtctgagacaa

SEQ ID NO: 469852 - DNA, 25 bp, Rattus norvegicus
ggtggctgacaccaagtctagcaca

SEQ ID NO: 469853 - DNA, 25 bp, Rattus norvegicus
ggtggctgacacgaagtctagcaca

SEQ ID NO: 469854 - DNA, 25 bp, Rattus norvegicus
ggtggctgactcacctgaccggtaa

SEQ ID NO: 469855 - DNA, 25 bp, Rattus norvegicus
ggtggctgactctcctgaccggtaa

SEQ ID NO: 469856 - DNA, 25 bp, Rattus norvegicus
ggtggctgcaaacgacatcccgctg

SEQ ID NO: 469857 - DNA, 25 bp, Rattus norvegicus
ggtggctgcaaaggacatcccgctg

SEQ ID NO: 469858 - DNA, 25 bp, Rattus norvegicus
ggtggctgcacccatgaatctcaga

SEQ ID NO: 469859 - DNA, 25 bp, Rattus norvegicus
ggtggctgcaccgatgaatctcaga

SEQ ID NO: 469860 - DNA, 25 bp, Rattus norvegicus
ggtggctgccccaaagaaagacaca

SEQ ID NO: 469861 - DNA, 25 bp, Rattus norvegicus
ggtggctgcccctaagaaagacaca

SEQ ID NO: 469862 - DNA, 25 bp, Rattus norvegicus
ggtggctgcgagatctcacaggcat

SEQ ID NO: 469863 - DNA, 25 bp, Rattus norvegicus
ggtggctgcgagttctcacaggcat

SEQ ID NO: 469864 - DNA, 25 bp, Rattus norvegicus
ggtggctgcttcaaagggcagcttt

SEQ ID NO: 469865 - DNA, 25 bp, Rattus norvegicus
ggtggctgcttctaagggcagcttt

SEQ ID NO: 469866 - DNA, 25 bp, Rattus norvegicus
ggtggctggacccatcacgaaagtc

SEQ ID NO: 469867 - DNA, 25 bp, Rattus norvegicus
ggtggctggaccgatcacgaaagtc

SEQ ID NO: 469868 - DNA, 25 bp, Rattus norvegicus
ggtggctggcggattgtaactttat

SEQ ID NO: 469869 - DNA, 25 bp, Rattus norvegicus
ggtggctggcggtttgtaactttat

SEQ ID NO: 469870 - DNA, 25 bp, Rattus norvegicus
ggtggctggtaacactcagaaccct

SEQ ID NO: 469871 - DNA, 25 bp, Rattus norvegicus
ggtggctggtaagactcagaaccct

SEQ ID NO: 469872 - DNA, 25 bp, Rattus norvegicus
ggtggctgtggaactgagcccctct

SEQ ID NO: 469873 - DNA, 25 bp, Rattus norvegicus
ggtggctgtggaagttttctgtata

SEQ ID NO: 469874 - DNA, 25 bp, Rattus norvegicus
ggtggctgtggatctgagcccctct

SEQ ID NO: 469875 - DNA, 25 bp, Rattus norvegicus
ggtggctgtggatgttttctgtata

SEQ ID NO: 469876 - DNA, 25 bp, Rattus norvegicus
ggtggctgtttaccccctggccaaa

SEQ ID NO: 469877 - DNA, 25 bp, Rattus norvegicus
ggtggctgtttagcccctggccaaa

SEQ ID NO: 469878 - DNA, 25 bp, Rattus norvegicus
ggtggcttacggagcactttctaaa

SEQ ID NO: 469879 - DNA, 25 bp, Rattus norvegicus
ggtggcttacggtgcactttctaaa

SEQ ID NO: 469880 - DNA, 25 bp, Rattus norvegicus
ggtggcttactgacttctgtattat

SEQ ID NO: 469881 - DNA, 25 bp, Rattus norvegicus
ggtggcttactgtcttctgtattat

SEQ ID NO: 469882 - DNA, 25 bp, Rattus norvegicus
ggtggcttatctccaagacagtgca

SEQ ID NO: 469883 - DNA, 25 bp, Rattus norvegicus
ggtggcttatctgcaagacagtgca

SEQ ID NO: 469884 - DNA, 25 bp, Rattus norvegicus
ggtggcttcaccattgatgacgtaa

SEQ ID NO: 469885 - DNA, 25 bp, Rattus norvegicus
ggtggcttcacctttgatgacgtaa

SEQ ID NO: 469886 - DNA, 25 bp, Rattus norvegicus
ggtggcttcagaccaagtagatcta

SEQ ID NO: 469887 - DNA, 25 bp, Rattus norvegicus
ggtggcttcagagcaagtagatcta

SEQ ID NO: 469888 - DNA, 25 bp, Rattus norvegicus
ggtggcttcaggactcgctaagaat

SEQ ID NO: 469889 - DNA, 25 bp, Rattus norvegicus
ggtggcttcaggtctcgctaagaat

SEQ ID NO: 469890 - DNA, 25 bp, Rattus norvegicus
ggtggcttcatcaactatgtgcatc

SEQ ID NO: 469891 - DNA, 25 bp, Rattus norvegicus
ggtggcttcatctactatgtgcatc

SEQ ID NO: 469892 - DNA, 25 bp, Rattus norvegicus
ggtggcttccttaagtgtgtcataa

SEQ ID NO: 469893 - DNA, 25 bp, Rattus norvegicus
ggtggcttcctttagtgtgtcataa

SEQ ID NO: 469894 - DNA, 25 bp, Rattus norvegicus
ggtggcttcgctagacttggatgac

SEQ ID NO: 469895 - DNA, 25 bp, Rattus norvegicus
ggtggcttcgcttgacttggatgac

SEQ ID NO: 469896 - DNA, 25 bp, Rattus norvegicus
ggtggcttctacagaacggatttca

SEQ ID NO: 469897 - DNA, 25 bp, Rattus norvegicus
ggtggcttctactgaacggatttca

SEQ ID NO: 469898 - DNA, 25 bp, Rattus norvegicus
ggtggcttgtcaactattcatgtaa

SEQ ID NO: 469899 - DNA, 25 bp, Rattus norvegicus
ggtggcttgtcacctagactgttaa

SEQ ID NO: 469900 - DNA, 25 bp, Rattus norvegicus
ggtggcttgtcagctagactgttaa

SEQ ID NO: 469901 - DNA, 25 bp, Rattus norvegicus
ggtggcttgtcatctattcatgtaa

SEQ ID NO: 469902 - DNA, 25 bp, Rattus norvegicus
ggtggctttactctcaagaccagac

SEQ ID NO: 469903 - DNA, 25 bp, Rattus norvegicus
ggtggctttactgtcaagaccagac

SEQ ID NO: 469904 - DNA, 25 bp, Rattus norvegicus
ggtggctttatcctgagagttgtaa

SEQ ID NO: 469905 - DNA, 25 bp, Rattus norvegicus
ggtggctttatcgtgagagttgtaa

SEQ ID NO: 469906 - DNA, 25 bp, Rattus norvegicus
ggtggctttcagactacctaacaaa

SEQ ID NO: 469907 - DNA, 25 bp, Rattus norvegicus
ggtggctttcagtctacctaacaaa

SEQ ID NO: 469908 - DNA, 25 bp, Rattus norvegicus
ggtggctttctcatagacctcaggg

SEQ ID NO: 469909 - DNA, 25 bp, Rattus norvegicus
ggtggctttctcttagacctcaggg

SEQ ID NO: 469910 - DNA, 25 bp, Rattus norvegicus
ggtggctttgatagacagtttggct

SEQ ID NO: 469911 - DNA, 25 bp, Rattus norvegicus
ggtggctttgattgacagtttggct

SEQ ID NO: 469912 - DNA, 25 bp, Rattus norvegicus
ggtgggaaaagcagctccgagaaca

SEQ ID NO: 469913 - DNA, 25 bp, Rattus norvegicus
ggtgggaaaagctgctccgagaaca

SEQ ID NO: 469914 - DNA, 25 bp, Rattus norvegicus
ggtgggaaagctatgacctcctcag

SEQ ID NO: 469915 - DNA, 25 bp, Rattus norvegicus
ggtgggaaagctttgacctcctcag

SEQ ID NO: 469916 - DNA, 25 bp, Rattus norvegicus
ggtgggaattacattgccgaagttt

SEQ ID NO: 469917 - DNA, 25 bp, Rattus norvegicus
ggtgggaattactttgccgaagttt

SEQ ID NO: 469918 - DNA, 25 bp, Rattus norvegicus
ggtgggacaccaatcgaggtactat

SEQ ID NO: 469919 - DNA, 25 bp, Rattus norvegicus
ggtgggacaccattcgaggtactat

SEQ ID NO: 469920 - DNA, 25 bp, Rattus norvegicus
ggtgggaccaagcagatgccctcat

SEQ ID NO: 469921 - DNA, 25 bp, Rattus norvegicus
ggtgggaccaaggagatgccctcat

SEQ ID NO: 469922 - DNA, 25 bp, Rattus norvegicus
ggtgggaccagaagaaatccatttt

SEQ ID NO: 469923 - DNA, 25 bp, Rattus norvegicus
ggtgggaccagatgaaatccatttt

SEQ ID NO: 469924 - DNA, 25 bp, Rattus norvegicus
ggtgggaccagcatcattgggaaat

SEQ ID NO: 469925 - DNA, 25 bp, Rattus norvegicus
ggtgggaccagcttcattgggaaat

SEQ ID NO: 469926 - DNA, 25 bp, Rattus norvegicus
ggtgggaccttcaagtgccaactgc

SEQ ID NO: 469927 - DNA, 25 bp, Rattus norvegicus
ggtgggaccttctagtgccaactgc

SEQ ID NO: 469928 - DNA, 25 bp, Rattus norvegicus
ggtgggacggcaaagaatgttttct

SEQ ID NO: 469929 - DNA, 25 bp, Rattus norvegicus
ggtgggacggcatagaatgttttct

SEQ ID NO: 469930 - DNA, 25 bp, Rattus norvegicus
ggtgggactggcacatactcaggaa

SEQ ID NO: 469931 - DNA, 25 bp, Rattus norvegicus
ggtgggactggctcatactcaggaa

SEQ ID NO: 469932 - DNA, 25 bp, Rattus norvegicus
ggtgggagggccatctcttcactct

SEQ ID NO: 469933 - DNA, 25 bp, Rattus norvegicus
ggtgggagggccttctcttcactct

SEQ ID NO: 469934 - DNA, 25 bp, Rattus norvegicus
ggtgggatacctccaaaagctatgt

SEQ ID NO: 469935 - DNA, 25 bp, Rattus norvegicus
ggtgggatacctgcaaaagctatgt

SEQ ID NO: 469936 - DNA, 25 bp, Rattus norvegicus
ggtgggatccacacttggattctct

SEQ ID NO: 469937 - DNA, 25 bp, Rattus norvegicus
ggtgggatccaccatatctggcaaa

SEQ ID NO: 469938 - DNA, 25 bp, Rattus norvegicus
ggtgggatccacgatatctggcaaa

SEQ ID NO: 469939 - DNA, 25 bp, Rattus norvegicus
ggtgggatccactcttggattctct

SEQ ID NO: 469940 - DNA, 25 bp, Rattus norvegicus
ggtgggattaacatgctccctgtca

SEQ ID NO: 469941 - DNA, 25 bp, Rattus norvegicus
ggtgggattaacttgctccctgtca

SEQ ID NO: 469942 - DNA, 25 bp, Rattus norvegicus
ggtgggcaaaatattctggtagttt

SEQ ID NO: 469943 - DNA, 25 bp, Rattus norvegicus
ggtgggcaaaattttctggtagttt

SEQ ID NO: 469944 - DNA, 25 bp, Rattus norvegicus
ggtgggcaaaccagaagctttcaag

SEQ ID NO: 469945 - DNA, 25 bp, Rattus norvegicus
ggtgggcaaacctgaagctttcaag

SEQ ID NO: 469946 - DNA, 25 bp, Rattus norvegicus
ggtgggcactccaggtctaaggaca

SEQ ID NO: 469947 - DNA, 25 bp, Rattus norvegicus
ggtgggcactcctggtctaaggaca

SEQ ID NO: 469948 - DNA, 25 bp, Rattus norvegicus
ggtgggcagatgatcatgtatcttt

SEQ ID NO: 469949 - DNA, 25 bp, Rattus norvegicus
ggtgggcagatgttcatgtatcttt

SEQ ID NO: 469950 - DNA, 25 bp, Rattus norvegicus
ggtgggcatgctcgtttcacactgc

SEQ ID NO: 469951 - DNA, 25 bp, Rattus norvegicus
ggtgggcatgctggtttcacactgc

SEQ ID NO: 469952 - DNA, 25 bp, Rattus norvegicus
ggtgggcatgtaaattcaactctct

SEQ ID NO: 469953 - DNA, 25 bp, Rattus norvegicus
ggtgggcatgtatattcaactctct

SEQ ID NO: 469954 - DNA, 25 bp, Rattus norvegicus
ggtgggcattgcaatttaattacta

SEQ ID NO: 469955 - DNA, 25 bp, Rattus norvegicus
ggtgggcattgcagactttatatgt

SEQ ID NO: 469956 - DNA, 25 bp, Rattus norvegicus
ggtgggcattgctatttaattacta

SEQ ID NO: 469957 - DNA, 25 bp, Rattus norvegicus
ggtgggcattgctgactttatatgt

SEQ ID NO: 469958 - DNA, 25 bp, Rattus norvegicus
ggtgggcattttatgttcagcaata

SEQ ID NO: 469959 - DNA, 25 bp, Rattus norvegicus
ggtgggcattttttgttcagcaata

SEQ ID NO: 469960 - DNA, 25 bp, Rattus norvegicus
ggtgggccacagaaaacatccttga

SEQ ID NO: 469961 - DNA, 25 bp, Rattus norvegicus
ggtgggccacagtaaacatccttga

SEQ ID NO: 469962 - DNA, 25 bp, Rattus norvegicus
ggtgggccagagaatcgtgttatat

SEQ ID NO: 469963 - DNA, 25 bp, Rattus norvegicus
ggtgggccagagtatcgtgttatat

SEQ ID NO: 469964 - DNA, 25 bp, Rattus norvegicus
ggtgggccgaacaggattcattatc

SEQ ID NO: 469965 - DNA, 25 bp, Rattus norvegicus
ggtgggccgaactggattcattatc

SEQ ID NO: 469966 - DNA, 25 bp, Rattus norvegicus
ggtgggccgcagacacccacaagca

SEQ ID NO: 469967 - DNA, 25 bp, Rattus norvegicus
ggtgggccgcagtcacccacaagca

SEQ ID NO: 469968 - DNA, 25 bp, Rattus norvegicus
ggtgggcgccgcaagctaagaaaac

SEQ ID NO: 469969 - DNA, 25 bp, Rattus norvegicus
ggtgggcgccgctagctaagaaaac

SEQ ID NO: 469970 - DNA, 25 bp, Rattus norvegicus
ggtgggctatacagtcttcagggtc

SEQ ID NO: 469971 - DNA, 25 bp, Rattus norvegicus
ggtgggctatactgtcttcagggtc

SEQ ID NO: 469972 - DNA, 25 bp, Rattus norvegicus
ggtgggctgctcacttaccccactt

SEQ ID NO: 469973 - DNA, 25 bp, Rattus norvegicus
ggtgggctgctctcttaccccactt

SEQ ID NO: 469974 - DNA, 25 bp, Rattus norvegicus
ggtgggctgggaaactttgtggaat

SEQ ID NO: 469975 - DNA, 25 bp, Rattus norvegicus
ggtgggctgggatactttgtggaat

SEQ ID NO: 469976 - DNA, 25 bp, Rattus norvegicus
ggtgggctgtctcagagaccttaaa

SEQ ID NO: 469977 - DNA, 25 bp, Rattus norvegicus
ggtgggctgtctgagagaccttaaa

SEQ ID NO: 469978 - DNA, 25 bp, Rattus norvegicus
ggtgggcttaaaaccatgcactctg

SEQ ID NO: 469979 - DNA, 25 bp, Rattus norvegicus
ggtgggcttaaatccatgcactctg

SEQ ID NO: 469980 - DNA, 25 bp, Rattus norvegicus
ggtgggcttcccagtgaaataaact

SEQ ID NO: 469981 - DNA, 25 bp, Rattus norvegicus
ggtgggcttccctgtgaaataaact

SEQ ID NO: 469982 - DNA, 25 bp, Rattus norvegicus
ggtgggcttctgactacatttggaa

SEQ ID NO: 469983 - DNA, 25 bp, Rattus norvegicus
ggtgggcttctgtctacatttggaa

SEQ ID NO: 469984 - DNA, 25 bp, Rattus norvegicus
ggtgggctttccatggatgtagcat

SEQ ID NO: 469985 - DNA, 25 bp, Rattus norvegicus
ggtgggctttccttggatgtagcat

SEQ ID NO: 469986 - DNA, 25 bp, Rattus norvegicus
ggtgggtacaagatactgctcagaa

SEQ ID NO: 469987 - DNA, 25 bp, Rattus norvegicus
ggtgggtacaagttactgctcagaa

SEQ ID NO: 469988 - DNA, 25 bp, Rattus norvegicus
ggtgggtagctcacaacttgcttta

SEQ ID NO: 469989 - DNA, 25 bp, Rattus norvegicus
ggtgggtagctctcaacttgcttta

SEQ ID NO: 469990 - DNA, 25 bp, Rattus norvegicus
ggtgggtattgtctagcctctctcc

SEQ ID NO: 469991 - DNA, 25 bp, Rattus norvegicus
ggtgggtattgtgtagcctctctcc

SEQ ID NO: 469992 - DNA, 25 bp, Rattus norvegicus
ggtgggtccctgagaatagtactga

SEQ ID NO: 469993 - DNA, 25 bp, Rattus norvegicus
ggtgggtccctgtgaatagtactga

SEQ ID NO: 469994 - DNA, 25 bp, Rattus norvegicus
ggtgggtctgacactgacagccaaa

SEQ ID NO: 469995 - DNA, 25 bp, Rattus norvegicus
ggtgggtctgactctgacagccaaa

SEQ ID NO: 469996 - DNA, 25 bp, Rattus norvegicus
ggtgggtgacccaggacaaccttgt

SEQ ID NO: 469997 - DNA, 25 bp, Rattus norvegicus
ggtgggtgaccctggacaaccttgt

SEQ ID NO: 469998 - DNA, 25 bp, Rattus norvegicus
ggtgggtgctctaaaggttcctttg

SEQ ID NO: 469999 - DNA, 25 bp, Rattus norvegicus
ggtgggtgctcttaaggttcctttg

SEQ ID NO: 470000 - DNA, 25 bp, Rattus norvegicus
ggtgggtgtgcacccttcccaaagc

SEQ ID NO: 470001 - DNA, 25 bp, Rattus norvegicus
ggtgggtgtgcagccttcccaaagc

SEQ ID NO: 470002 - DNA, 25 bp, Rattus norvegicus
ggtgggttaaacactcttgaccata

SEQ ID NO: 470003 - DNA, 25 bp, Rattus norvegicus
ggtgggttaaactctcttgaccata

SEQ ID NO: 470004 - DNA, 25 bp, Rattus norvegicus
ggtgggttcaagaccaatgtcacta

SEQ ID NO: 470005 - DNA, 25 bp, Rattus norvegicus
ggtgggttcaagtccaatgtcacta

SEQ ID NO: 470006 - DNA, 25 bp, Rattus norvegicus
ggtgggtttctgaggcaatcttata

SEQ ID NO: 470007 - DNA, 25 bp, Rattus norvegicus
ggtgggtttctgtggcaatcttata

SEQ ID NO: 470008 - DNA, 25 bp, Rattus norvegicus
ggtgggttttctagttcacatctcc

SEQ ID NO: 470009 - DNA, 25 bp, Rattus norvegicus
ggtgggttttcttgttcacatctcc

SEQ ID NO: 470010 - DNA, 25 bp, Rattus norvegicus
ggtggtaaaatcattatcatcctaa

SEQ ID NO: 470011 - DNA, 25 bp, Rattus norvegicus
ggtggtaaaatctttatcatcctaa

SEQ ID NO: 470012 - DNA, 25 bp, Rattus norvegicus
ggtggtaaatatcagagtcctctgc

SEQ ID NO: 470013 - DNA, 25 bp, Rattus norvegicus
ggtggtaaatatgagagtcctctgc

SEQ ID NO: 470014 - DNA, 25 bp, Rattus norvegicus
ggtggtaagccactctgctttagat

SEQ ID NO: 470015 - DNA, 25 bp, Rattus norvegicus
ggtggtaagccagtctgctttagat

SEQ ID NO: 470016 - DNA, 25 bp, Rattus norvegicus
ggtggtaagttcaagccatgcacat

SEQ ID NO: 470017 - DNA, 25 bp, Rattus norvegicus
ggtggtaagttctagccatgcacat

SEQ ID NO: 470018 - DNA, 25 bp, Rattus norvegicus
ggtggtacagaaagtgatttagccc

SEQ ID NO: 470019 - DNA, 25 bp, Rattus norvegicus
ggtggtacagaatgtgatttagccc

SEQ ID NO: 470020 - DNA, 25 bp, Rattus norvegicus
ggtggtacccctcacataactaaat

SEQ ID NO: 470021 - DNA, 25 bp, Rattus norvegicus
ggtggtacccctgacataactaaat

SEQ ID NO: 470022 - DNA, 25 bp, Rattus norvegicus
ggtggtacgagaactcttctccagt

SEQ ID NO: 470023 - DNA, 25 bp, Rattus norvegicus
ggtggtacgagatctcttctccagt

SEQ ID NO: 470024 - DNA, 25 bp, Rattus norvegicus
ggtggtactaatccgacactttgta

SEQ ID NO: 470025 - DNA, 25 bp, Rattus norvegicus
ggtggtactaatgcgacactttgta

SEQ ID NO: 470026 - DNA, 25 bp, Rattus norvegicus
ggtggtactgacctgtaatcctaga

SEQ ID NO: 470027 - DNA, 25 bp, Rattus norvegicus
ggtggtactgacgtgtaatcctaga

SEQ ID NO: 470028 - DNA, 25 bp, Rattus norvegicus
ggtggtactgcactggattttctct

SEQ ID NO: 470029 - DNA, 25 bp, Rattus norvegicus
ggtggtactgcagtggattttctct

SEQ ID NO: 470030 - DNA, 25 bp, Rattus norvegicus
ggtggtagacacactgttctttaat

SEQ ID NO: 470031 - DNA, 25 bp, Rattus norvegicus
ggtggtagacactctgttctttaat

SEQ ID NO: 470032 - DNA, 25 bp, Rattus norvegicus
ggtggtagacatagaggttttcctc

SEQ ID NO: 470033 - DNA, 25 bp, Rattus norvegicus
ggtggtagacattgaggttttcctc

SEQ ID NO: 470034 - DNA, 25 bp, Rattus norvegicus
ggtggtagagtactatgccagccaa

SEQ ID NO: 470035 - DNA, 25 bp, Rattus norvegicus
ggtggtagagtagtatgccagccaa

SEQ ID NO: 470036 - DNA, 25 bp, Rattus norvegicus
ggtggtaggtacatttgcttagtga

SEQ ID NO: 470037 - DNA, 25 bp, Rattus norvegicus
ggtggtaggtacttttgcttagtga

SEQ ID NO: 470038 - DNA, 25 bp, Rattus norvegicus
ggtggtagtggacactgccccacac

SEQ ID NO: 470039 - DNA, 25 bp, Rattus norvegicus
ggtggtagtggagactgccccacac

SEQ ID NO: 470040 - DNA, 25 bp, Rattus norvegicus
ggtggtatatcaagcttgccctcct

SEQ ID NO: 470041 - DNA, 25 bp, Rattus norvegicus
ggtggtatatcatgcttgccctcct

SEQ ID NO: 470042 - DNA, 25 bp, Rattus norvegicus
ggtggtatccagaggactttcctac

SEQ ID NO: 470043 - DNA, 25 bp, Rattus norvegicus
ggtggtatccagtggactttcctac

SEQ ID NO: 470044 - DNA, 25 bp, Rattus norvegicus
ggtggtatctctacttagtgttcta

SEQ ID NO: 470045 - DNA, 25 bp, Rattus norvegicus
ggtggtatctcttcttagtgttcta

SEQ ID NO: 470046 - DNA, 25 bp, Rattus norvegicus
ggtggtatcttcagtctatgagccc

SEQ ID NO: 470047 - DNA, 25 bp, Rattus norvegicus
ggtggtatcttctgtctatgagccc

SEQ ID NO: 470048 - DNA, 25 bp, Rattus norvegicus
ggtggtatgcatacatttctcttat

SEQ ID NO: 470049 - DNA, 25 bp, Rattus norvegicus
ggtggtatgcattcatttctcttat

SEQ ID NO: 470050 - DNA, 25 bp, Rattus norvegicus
ggtggtattctgaggccattgtttc

SEQ ID NO: 470051 - DNA, 25 bp, Rattus norvegicus
ggtggtattctgtggccattgtttc

SEQ ID NO: 470052 - DNA, 25 bp, Rattus norvegicus
ggtggtcaaaacagcggctttgagt

SEQ ID NO: 470053 - DNA, 25 bp, Rattus norvegicus
ggtggtcaaaactgcggctttgagt

SEQ ID NO: 470054 - DNA, 25 bp, Rattus norvegicus
ggtggtcaagctcaattccattctt

SEQ ID NO: 470055 - DNA, 25 bp, Rattus norvegicus
ggtggtcaagctgaattccattctt

SEQ ID NO: 470056 - DNA, 25 bp, Rattus norvegicus
ggtggtcaagtcaacggtggcctca

SEQ ID NO: 470057 - DNA, 25 bp, Rattus norvegicus
ggtggtcaagtctacggtggcctca

SEQ ID NO: 470058 - DNA, 25 bp, Rattus norvegicus
ggtggtcaatttacttctgcctttt

SEQ ID NO: 470059 - DNA, 25 bp, Rattus norvegicus
ggtggtcaattttcttctgcctttt

SEQ ID NO: 470060 - DNA, 25 bp, Rattus norvegicus
ggtggtcactatagcccccaccaaa

SEQ ID NO: 470061 - DNA, 25 bp, Rattus norvegicus
ggtggtcactattgcccccaccaaa

SEQ ID NO: 470062 - DNA, 25 bp, Rattus norvegicus
ggtggtcagagaaggaaacctaact

SEQ ID NO: 470063 - DNA, 25 bp, Rattus norvegicus
ggtggtcagagatggaaacctaact

SEQ ID NO: 470064 - DNA, 25 bp, Rattus norvegicus
ggtggtcagccgagactcctctgga

SEQ ID NO: 470065 - DNA, 25 bp, Rattus norvegicus
ggtggtcagccgtgactcctctgga

SEQ ID NO: 470066 - DNA, 25 bp, Rattus norvegicus
ggtggtcagggtaccatccctacct

SEQ ID NO: 470067 - DNA, 25 bp, Rattus norvegicus
ggtggtcagggttccatccctacct

SEQ ID NO: 470068 - DNA, 25 bp, Rattus norvegicus
ggtggtcagtatctccagtgagcat

SEQ ID NO: 470069 - DNA, 25 bp, Rattus norvegicus
ggtggtcagtatgtccagtgagcat

SEQ ID NO: 470070 - DNA, 25 bp, Rattus norvegicus
ggtggtcagtttaataatcctcagt

SEQ ID NO: 470071 - DNA, 25 bp, Rattus norvegicus
ggtggtcagttttataatcctcagt

SEQ ID NO: 470072 - DNA, 25 bp, Rattus norvegicus
ggtggtcatgtcagatccatccatc

SEQ ID NO: 470073 - DNA, 25 bp, Rattus norvegicus
ggtggtcatgtctgatccatccatc

SEQ ID NO: 470074 - DNA, 25 bp, Rattus norvegicus
ggtggtccagataggtcaaatgtgt

SEQ ID NO: 470075 - DNA, 25 bp, Rattus norvegicus
ggtggtccagattggtcaaatgtgt

SEQ ID NO: 470076 - DNA, 25 bp, Rattus norvegicus
ggtggtccagctattctgagaaaac

SEQ ID NO: 470077 - DNA, 25 bp, Rattus norvegicus
ggtggtccagcttttctgagaaaac

SEQ ID NO: 470078 - DNA, 25 bp, Rattus norvegicus
ggtggtccattcacttaaaatttct

SEQ ID NO: 470079 - DNA, 25 bp, Rattus norvegicus
ggtggtccattctcttaaaatttct

SEQ ID NO: 470080 - DNA, 25 bp, Rattus norvegicus
ggtggtcctaataaaatctcatcaa

SEQ ID NO: 470081 - DNA, 25 bp, Rattus norvegicus
ggtggtcctaattaaatctcatcaa

SEQ ID NO: 470082 - DNA, 25 bp, Rattus norvegicus
ggtggtcctatgacagcactcaagc

SEQ ID NO: 470083 - DNA, 25 bp, Rattus norvegicus
ggtggtcctatgtcagcactcaagc

SEQ ID NO: 470084 - DNA, 25 bp, Rattus norvegicus
ggtggtcctcctaaatgttgggatt

SEQ ID NO: 470085 - DNA, 25 bp, Rattus norvegicus
ggtggtcctccttaatgttgggatt

SEQ ID NO: 470086 - DNA, 25 bp, Rattus norvegicus
ggtggtcctgatataaaggattcat

SEQ ID NO: 470087 - DNA, 25 bp, Rattus norvegicus
ggtggtcctgatttaaaggattcat

SEQ ID NO: 470088 - DNA, 25 bp, Rattus norvegicus
ggtggtcctggaactcatgctgtag

SEQ ID NO: 470089 - DNA, 25 bp, Rattus norvegicus
ggtggtcctggaactttttgatgca

SEQ ID NO: 470090 - DNA, 25 bp, Rattus norvegicus
ggtggtcctggatctcatgctgtag

SEQ ID NO: 470091 - DNA, 25 bp, Rattus norvegicus
ggtggtcctggatctttttgatgca

SEQ ID NO: 470092 - DNA, 25 bp, Rattus norvegicus
ggtggtccttctcttaccgaagtca

SEQ ID NO: 470093 - DNA, 25 bp, Rattus norvegicus
ggtggtccttctgttaccgaagtca

SEQ ID NO: 470094 - DNA, 25 bp, Rattus norvegicus
ggtggtctagccatccacagaagat

SEQ ID NO: 470095 - DNA, 25 bp, Rattus norvegicus
ggtggtctagccttccacagaagat

SEQ ID NO: 470096 - DNA, 25 bp, Rattus norvegicus
ggtggtctatatccatccttccagt

SEQ ID NO: 470097 - DNA, 25 bp, Rattus norvegicus
ggtggtctatatgcatccttccagt

SEQ ID NO: 470098 - DNA, 25 bp, Rattus norvegicus
ggtggtctcctaatccttaatttat

SEQ ID NO: 470099 - DNA, 25 bp, Rattus norvegicus
ggtggtctcctattccttaatttat

SEQ ID NO: 470100 - DNA, 25 bp, Rattus norvegicus
ggtggtctgccaccataatcaagat

SEQ ID NO: 470101 - DNA, 25 bp, Rattus norvegicus
ggtggtctgccagcataatcaagat

SEQ ID NO: 470102 - DNA, 25 bp, Rattus norvegicus
ggtggtcttgatctttcaatcccta

SEQ ID NO: 470103 - DNA, 25 bp, Rattus norvegicus
ggtggtcttgatgtttcaatcccta

SEQ ID NO: 470104 - DNA, 25 bp, Rattus norvegicus
ggtggtgaaaaccttgacatttcct

SEQ ID NO: 470105 - DNA, 25 bp, Rattus norvegicus
ggtggtgaaaacgttgacatttcct

SEQ ID NO: 470106 - DNA, 25 bp, Rattus norvegicus
ggtggtgaacataccatctttcatt

SEQ ID NO: 470107 - DNA, 25 bp, Rattus norvegicus
ggtggtgaacattccatctttcatt

SEQ ID NO: 470108 - DNA, 25 bp, Rattus norvegicus
ggtggtgaatagactccggcgctac

SEQ ID NO: 470109 - DNA, 25 bp, Rattus norvegicus
ggtggtgaatagtctccggcgctac

SEQ ID NO: 470110 - DNA, 25 bp, Rattus norvegicus
ggtggtgaccgaaatgctgttctaa

SEQ ID NO: 470111 - DNA, 25 bp, Rattus norvegicus
ggtggtgaccgatatgctgttctaa

SEQ ID NO: 470112 - DNA, 25 bp, Rattus norvegicus
ggtggtgactagacccttcttgcct

SEQ ID NO: 470113 - DNA, 25 bp, Rattus norvegicus
ggtggtgactagtcccttcttgcct

SEQ ID NO: 470114 - DNA, 25 bp, Rattus norvegicus
ggtggtgagcacacaagcttaagtg

SEQ ID NO: 470115 - DNA, 25 bp, Rattus norvegicus
ggtggtgagcactcaagcttaagtg

SEQ ID NO: 470116 - DNA, 25 bp, Rattus norvegicus
ggtggtgatacacagcacctctgga

SEQ ID NO: 470117 - DNA, 25 bp, Rattus norvegicus
ggtggtgatacagagcacctctgga

SEQ ID NO: 470118 - DNA, 25 bp, Rattus norvegicus
ggtggtgatcagacagcctcggaac

SEQ ID NO: 470119 - DNA, 25 bp, Rattus norvegicus
ggtggtgatcagtcagcctcggaac

SEQ ID NO: 470120 - DNA, 25 bp, Rattus norvegicus
ggtggtgcacaaactcttgatagag

SEQ ID NO: 470121 - DNA, 25 bp, Rattus norvegicus
ggtggtgcacaatctcttgatagag

SEQ ID NO: 470122 - DNA, 25 bp, Rattus norvegicus
ggtggtgcttttcatcagggatcct

SEQ ID NO: 470123 - DNA, 25 bp, Rattus norvegicus
ggtggtgcttttgatcagggatcct

SEQ ID NO: 470124 - DNA, 25 bp, Rattus norvegicus
ggtggtggaactcaagcatgctttt

SEQ ID NO: 470125 - DNA, 25 bp, Rattus norvegicus
ggtggtggaactgaagcatgctttt

SEQ ID NO: 470126 - DNA, 25 bp, Rattus norvegicus
ggtggtggactcaacaacgtcgtcg

SEQ ID NO: 470127 - DNA, 25 bp, Rattus norvegicus
ggtggtggactctacaacgtcgtcg

SEQ ID NO: 470128 - DNA, 25 bp, Rattus norvegicus
ggtggtggccaaccccatactggtc

SEQ ID NO: 470129 - DNA, 25 bp, Rattus norvegicus
ggtggtggccaagcccatactggtc

SEQ ID NO: 470130 - DNA, 25 bp, Rattus norvegicus
ggtggtggcgaccaatgtttctata

SEQ ID NO: 470131 - DNA, 25 bp, Rattus norvegicus
ggtggtggcgacgaatgtttctata

SEQ ID NO: 470132 - DNA, 25 bp, Rattus norvegicus
ggtggtggtgacaatatctctgcag

SEQ ID NO: 470133 - DNA, 25 bp, Rattus norvegicus
ggtggtggtgactatatctctgcag

SEQ ID NO: 470134 - DNA, 25 bp, Rattus norvegicus
ggtggtggtttacttgtttgatctt

SEQ ID NO: 470135 - DNA, 25 bp, Rattus norvegicus
ggtggtggtttagttgtttgatctt

SEQ ID NO: 470136 - DNA, 25 bp, Rattus norvegicus
ggtggtgtattactcaggattctct

SEQ ID NO: 470137 - DNA, 25 bp, Rattus norvegicus
ggtggtgtattagtcaggattctct

SEQ ID NO: 470138 - DNA, 25 bp, Rattus norvegicus
ggtggtgtcaccagagtacattctt

SEQ ID NO: 470139 - DNA, 25 bp, Rattus norvegicus
ggtggtgtcacctgagtacattctt

SEQ ID NO: 470140 - DNA, 25 bp, Rattus norvegicus
ggtggtgtcagcaattcaagtttat

SEQ ID NO: 470141 - DNA, 25 bp, Rattus norvegicus
ggtggtgtcagctattcaagtttat

SEQ ID NO: 470142 - DNA, 25 bp, Rattus norvegicus
ggtggtgtcattaagatcaagccct

SEQ ID NO: 470143 - DNA, 25 bp, Rattus norvegicus
ggtggtgtcatttagatcaagccct

SEQ ID NO: 470144 - DNA, 25 bp, Rattus norvegicus
ggtggtgtcccgagagtcacaaaga

SEQ ID NO: 470145 - DNA, 25 bp, Rattus norvegicus
ggtggtgtcccgtgagtcacaaaga

SEQ ID NO: 470146 - DNA, 25 bp, Rattus norvegicus
ggtggtgtcgccatgtctgaaatga

SEQ ID NO: 470147 - DNA, 25 bp, Rattus norvegicus
ggtggtgtcgccttgtctgaaatga

SEQ ID NO: 470148 - DNA, 25 bp, Rattus norvegicus
ggtggtgtctctatatctccagaaa

SEQ ID NO: 470149 - DNA, 25 bp, Rattus norvegicus
ggtggtgtctctttatctccagaaa

SEQ ID NO: 470150 - DNA, 25 bp, Rattus norvegicus
ggtggtgtctttaatcacagccaat

SEQ ID NO: 470151 - DNA, 25 bp, Rattus norvegicus
ggtggtgtcttttatcacagccaat

SEQ ID NO: 470152 - DNA, 25 bp, Rattus norvegicus
ggtggtgtgacaactgggcactcac

SEQ ID NO: 470153 - DNA, 25 bp, Rattus norvegicus
ggtggtgtgacatctgggcactcac

SEQ ID NO: 470154 - DNA, 25 bp, Rattus norvegicus
ggtggtgtgcgccttaacctcagca

SEQ ID NO: 470155 - DNA, 25 bp, Rattus norvegicus
ggtggtgtgcgcgttaacctcagca

SEQ ID NO: 470156 - DNA, 25 bp, Rattus norvegicus
ggtggtgttcttctcccttataatt

SEQ ID NO: 470157 - DNA, 25 bp, Rattus norvegicus
ggtggtgttcttgtcccttataatt

SEQ ID NO: 470158 - DNA, 25 bp, Rattus norvegicus
ggtggtgttggaacacagccgccac

SEQ ID NO: 470159 - DNA, 25 bp, Rattus norvegicus
ggtggtgttggatcacagccgccac

SEQ ID NO: 470160 - DNA, 25 bp, Rattus norvegicus
ggtggttaaagcctgtttctacaat

SEQ ID NO: 470161 - DNA, 25 bp, Rattus norvegicus
ggtggttaaagcgtgtttctacaat

SEQ ID NO: 470162 - DNA, 25 bp, Rattus norvegicus
ggtggttaactacccattggtatct

SEQ ID NO: 470163 - DNA, 25 bp, Rattus norvegicus
ggtggttaactagccattggtatct

SEQ ID NO: 470164 - DNA, 25 bp, Rattus norvegicus
ggtggttaatcacctcttctggata

SEQ ID NO: 470165 - DNA, 25 bp, Rattus norvegicus
ggtggttaatcagctcttctggata

SEQ ID NO: 470166 - DNA, 25 bp, Rattus norvegicus
ggtggttaatgccatccaggtgccc

SEQ ID NO: 470167 - DNA, 25 bp, Rattus norvegicus
ggtggttaatgcgatccaggtgccc

SEQ ID NO: 470168 - DNA, 25 bp, Rattus norvegicus
ggtggttacagcatcagggtcttcc

SEQ ID NO: 470169 - DNA, 25 bp, Rattus norvegicus
ggtggttacagcttcagggtcttcc

SEQ ID NO: 470170 - DNA, 25 bp, Rattus norvegicus
ggtggttaccggagtggcacttcta

SEQ ID NO: 470171 - DNA, 25 bp, Rattus norvegicus
ggtggttaccggtgtggcacttcta

SEQ ID NO: 470172 - DNA, 25 bp, Rattus norvegicus
ggtggttagtttatgccaacatgac

SEQ ID NO: 470173 - DNA, 25 bp, Rattus norvegicus
ggtggttagtttctcctgtgtataa

SEQ ID NO: 470174 - DNA, 25 bp, Rattus norvegicus
ggtggttagtttgtcctgtgtataa

SEQ ID NO: 470175 - DNA, 25 bp, Rattus norvegicus
ggtggttagtttttgccaacatgac

SEQ ID NO: 470176 - DNA, 25 bp, Rattus norvegicus
ggtggttatttaaagcacacttagt

SEQ ID NO: 470177 - DNA, 25 bp, Rattus norvegicus
ggtggttatttatagcacacttagt

SEQ ID NO: 470178 - DNA, 25 bp, Rattus norvegicus
ggtggttcaaatcatctgggctaca

SEQ ID NO: 470179 - DNA, 25 bp, Rattus norvegicus
ggtggttcaaatgatctgggctaca

SEQ ID NO: 470180 - DNA, 25 bp, Rattus norvegicus
ggtggttcatccctgtaatcacagc

SEQ ID NO: 470181 - DNA, 25 bp, Rattus norvegicus
ggtggttcatccgtgtaatcacagc

SEQ ID NO: 470182 - DNA, 25 bp, Rattus norvegicus
ggtggttccagccaaaagcgtcaat

SEQ ID NO: 470183 - DNA, 25 bp, Rattus norvegicus
ggtggttccagcgaaaagcgtcaat

SEQ ID NO: 470184 - DNA, 25 bp, Rattus norvegicus
ggtggttcctatatgcaaggctact

SEQ ID NO: 470185 - DNA, 25 bp, Rattus norvegicus
ggtggttcctatttgcaaggctact

SEQ ID NO: 470186 - DNA, 25 bp, Rattus norvegicus
ggtggttcctttcattagggatcca

SEQ ID NO: 470187 - DNA, 25 bp, Rattus norvegicus
ggtggttcctttgattagggatcca

SEQ ID NO: 470188 - DNA, 25 bp, Rattus norvegicus
ggtggttctcagaaggactggccta

SEQ ID NO: 470189 - DNA, 25 bp, Rattus norvegicus
ggtggttctcagtaggactggccta

SEQ ID NO: 470190 - DNA, 25 bp, Rattus norvegicus
ggtggttctcttcccaaagtggaag

SEQ ID NO: 470191 - DNA, 25 bp, Rattus norvegicus
ggtggttctcttgccaaagtggaag

SEQ ID NO: 470192 - DNA, 25 bp, Rattus norvegicus
ggtggttctgcgactagtgacccaa

SEQ ID NO: 470193 - DNA, 25 bp, Rattus norvegicus
ggtggttctgcgtctagtgacccaa

SEQ ID NO: 470194 - DNA, 25 bp, Rattus norvegicus
ggtggttctggactctctaagacac

SEQ ID NO: 470195 - DNA, 25 bp, Rattus norvegicus
ggtggttctggagtctctaagacac

SEQ ID NO: 470196 - DNA, 25 bp, Rattus norvegicus
ggtggttcttttccacatttagttg

SEQ ID NO: 470197 - DNA, 25 bp, Rattus norvegicus
ggtggttcttttgcacatttagttg

SEQ ID NO: 470198 - DNA, 25 bp, Rattus norvegicus
ggtggttgcaggagctaagccaaac

SEQ ID NO: 470199 - DNA, 25 bp, Rattus norvegicus
ggtggttgcaggtgctaagccaaac

SEQ ID NO: 470200 - DNA, 25 bp, Rattus norvegicus
ggtggttgtcctcggtcccagaaat

SEQ ID NO: 470201 - DNA, 25 bp, Rattus norvegicus
ggtggttgtcctgggtcccagaaat

SEQ ID NO: 470202 - DNA, 25 bp, Rattus norvegicus
ggtggtttacagcacatttcataaa

SEQ ID NO: 470203 - DNA, 25 bp, Rattus norvegicus
ggtggtttacagcagattttatttc

SEQ ID NO: 470204 - DNA, 25 bp, Rattus norvegicus
ggtggtttacaggacatttcataaa

SEQ ID NO: 470205 - DNA, 25 bp, Rattus norvegicus
ggtggtttacaggagattttatttc

SEQ ID NO: 470206 - DNA, 25 bp, Rattus norvegicus
ggtggtttcacaattttatttcaga

SEQ ID NO: 470207 - DNA, 25 bp, Rattus norvegicus
ggtggtttcacatttttatttcaga

SEQ ID NO: 470208 - DNA, 25 bp, Rattus norvegicus
ggtggtttcagtatatgcagacgca

SEQ ID NO: 470209 - DNA, 25 bp, Rattus norvegicus
ggtggtttcagtttatgcagacgca

SEQ ID NO: 470210 - DNA, 25 bp, Rattus norvegicus
ggtggtttccagaatgccctccacg

SEQ ID NO: 470211 - DNA, 25 bp, Rattus norvegicus
ggtggtttccagtatgccctccacg

SEQ ID NO: 470212 - DNA, 25 bp, Rattus norvegicus
ggtggtttctacatgatacgattca

SEQ ID NO: 470213 - DNA, 25 bp, Rattus norvegicus
ggtggtttctacttgatacgattca

SEQ ID NO: 470214 - DNA, 25 bp, Rattus norvegicus
ggtggtttgaagattcctcttcaga

SEQ ID NO: 470215 - DNA, 25 bp, Rattus norvegicus
ggtggtttgaagtttcctcttcaga

SEQ ID NO: 470216 - DNA, 25 bp, Rattus norvegicus
ggtggttttgacattcttcactcaa

SEQ ID NO: 470217 - DNA, 25 bp, Rattus norvegicus
ggtggttttgactttcttcactcaa

SEQ ID NO: 470218 - DNA, 25 bp, Rattus norvegicus
ggtggttttgcactctgctactact

SEQ ID NO: 470219 - DNA, 25 bp, Rattus norvegicus
ggtggttttgcagtctgctactact

SEQ ID NO: 470220 - DNA, 25 bp, Rattus norvegicus
ggtggttttgttcatccatcgtgtc

SEQ ID NO: 470221 - DNA, 25 bp, Rattus norvegicus
ggtggttttgttgatccatcgtgtc

SEQ ID NO: 470222 - DNA, 25 bp, Rattus norvegicus
ggtggttttttacacactccagtca

SEQ ID NO: 470223 - DNA, 25 bp, Rattus norvegicus
ggtggttttttagacactccagtca

SEQ ID NO: 470224 - DNA, 25 bp, Rattus norvegicus
ggtgtaaaagtcaggccaccccttg

SEQ ID NO: 470225 - DNA, 25 bp, Rattus norvegicus
ggtgtaaaagtctggccaccccttg

SEQ ID NO: 470226 - DNA, 25 bp, Rattus norvegicus
ggtgtaaacgagaatcgcattttat

SEQ ID NO: 470227 - DNA, 25 bp, Rattus norvegicus
ggtgtaaacgagtatcgcattttat

SEQ ID NO: 470228 - DNA, 25 bp, Rattus norvegicus
ggtgtaaagggcagagctgccccac

SEQ ID NO: 470229 - DNA, 25 bp, Rattus norvegicus
ggtgtaaagggctgagctgccccac

SEQ ID NO: 470230 - DNA, 25 bp, Rattus norvegicus
ggtgtaaatcttacttccaaactga

SEQ ID NO: 470231 - DNA, 25 bp, Rattus norvegicus
ggtgtaaatctttcttccaaactga

SEQ ID NO: 470232 - DNA, 25 bp, Rattus norvegicus
ggtgtaaccttcatctcgttgatat

SEQ ID NO: 470233 - DNA, 25 bp, Rattus norvegicus
ggtgtaaccttcttctcgttgatat

SEQ ID NO: 470234 - DNA, 25 bp, Rattus norvegicus
ggtgtaacgagacatcccaagtaat

SEQ ID NO: 470235 - DNA, 25 bp, Rattus norvegicus
ggtgtaacgagagatcccaagtaat

SEQ ID NO: 470236 - DNA, 25 bp, Rattus norvegicus
ggtgtaagcattaccaggctgtcaa

SEQ ID NO: 470237 - DNA, 25 bp, Rattus norvegicus
ggtgtaagcatttccaggctgtcaa

SEQ ID NO: 470238 - DNA, 25 bp, Rattus norvegicus
ggtgtaagtcacctctcttttattt

SEQ ID NO: 470239 - DNA, 25 bp, Rattus norvegicus
ggtgtaagtcacgtctcttttattt

SEQ ID NO: 470240 - DNA, 25 bp, Rattus norvegicus
ggtgtaataatgacctctacatcag

SEQ ID NO: 470241 - DNA, 25 bp, Rattus norvegicus
ggtgtaataatgtcctctacatcag

SEQ ID NO: 470242 - DNA, 25 bp, Rattus norvegicus
ggtgtaatgtgaccaactccaacca

SEQ ID NO: 470243 - DNA, 25 bp, Rattus norvegicus
ggtgtaatgtgagcaactccaacca

SEQ ID NO: 470244 - DNA, 25 bp, Rattus norvegicus
ggtgtaattagtatgatgacgtatc

SEQ ID NO: 470245 - DNA, 25 bp, Rattus norvegicus
ggtgtaattagtttgatgacgtatc

SEQ ID NO: 470246 - DNA, 25 bp, Rattus norvegicus
ggtgtacaatctcaccttccacatg

SEQ ID NO: 470247 - DNA, 25 bp, Rattus norvegicus
ggtgtacaatctgaccttccacatg

SEQ ID NO: 470248 - DNA, 25 bp, Rattus norvegicus
ggtgtacagactcatagcccgcatg

SEQ ID NO: 470249 - DNA, 25 bp, Rattus norvegicus
ggtgtacagactgatagcccgcatg

SEQ ID NO: 470250 - DNA, 25 bp, Rattus norvegicus
ggtgtacataagctgtatctcatgc

SEQ ID NO: 470251 - DNA, 25 bp, Rattus norvegicus
ggtgtacataaggtgtatctcatgc

SEQ ID NO: 470252 - DNA, 25 bp, Rattus norvegicus
ggtgtacattgtacgttcttgtgat

SEQ ID NO: 470253 - DNA, 25 bp, Rattus norvegicus
ggtgtacattgttcgttcttgtgat

SEQ ID NO: 470254 - DNA, 25 bp, Rattus norvegicus
ggtgtaccacgtccagggcactgaa

SEQ ID NO: 470255 - DNA, 25 bp, Rattus norvegicus
ggtgtaccacgtgcagggcactgaa

SEQ ID NO: 470256 - DNA, 25 bp, Rattus norvegicus
ggtgtaccagagaatccagcccagc

SEQ ID NO: 470257 - DNA, 25 bp, Rattus norvegicus
ggtgtaccagagtatccagcccagc

SEQ ID NO: 470258 - DNA, 25 bp, Rattus norvegicus
ggtgtaccagccagccagcgaccat

SEQ ID NO: 470259 - DNA, 25 bp, Rattus norvegicus
ggtgtaccagcctgccagcgaccat

SEQ ID NO: 470260 - DNA, 25 bp, Rattus norvegicus
ggtgtaccaggtagtctcaatcctc

SEQ ID NO: 470261 - DNA, 25 bp, Rattus norvegicus
ggtgtaccaggttgtctcaatcctc

SEQ ID NO: 470262 - DNA, 25 bp, Rattus norvegicus
ggtgtaccatctctcattctgagga

SEQ ID NO: 470263 - DNA, 25 bp, Rattus norvegicus
ggtgtaccatctgtcattctgagga

SEQ ID NO: 470264 - DNA, 25 bp, Rattus norvegicus
ggtgtaccatgaatccaacttcctg

SEQ ID NO: 470265 - DNA, 25 bp, Rattus norvegicus
ggtgtaccatgattccaacttcctg

SEQ ID NO: 470266 - DNA, 25 bp, Rattus norvegicus
ggtgtacccaaacgtcacacggtag

SEQ ID NO: 470267 - DNA, 25 bp, Rattus norvegicus
ggtgtacccaaaggtcacacggtag

SEQ ID NO: 470268 - DNA, 25 bp, Rattus norvegicus
ggtgtacccaagctacccagaaaag

SEQ ID NO: 470269 - DNA, 25 bp, Rattus norvegicus
ggtgtacccaaggtacccagaaaag

SEQ ID NO: 470270 - DNA, 25 bp, Rattus norvegicus
ggtgtacccacccacaatatggaga

SEQ ID NO: 470271 - DNA, 25 bp, Rattus norvegicus
ggtgtacccaccgacaatatggaga

SEQ ID NO: 470272 - DNA, 25 bp, Rattus norvegicus
ggtgtaccccaacgttgctgagaac

SEQ ID NO: 470273 - DNA, 25 bp, Rattus norvegicus
ggtgtaccccaaggttgctgagaac

SEQ ID NO: 470274 - DNA, 25 bp, Rattus norvegicus
ggtgtaccgacactttggcaaggcc

SEQ ID NO: 470275 - DNA, 25 bp, Rattus norvegicus
ggtgtaccgacagtttggcaaggcc

SEQ ID NO: 470276 - DNA, 25 bp, Rattus norvegicus
ggtgtaccgcgacatcaagctggaa

SEQ ID NO: 470277 - DNA, 25 bp, Rattus norvegicus
ggtgtaccgcgagatcaagctggaa

SEQ ID NO: 470278 - DNA, 25 bp, Rattus norvegicus
ggtgtacgagaacatccctgcgact

SEQ ID NO: 470279 - DNA, 25 bp, Rattus norvegicus
ggtgtacgagaagatccctgcgact

SEQ ID NO: 470280 - DNA, 25 bp, Rattus norvegicus
ggtgtacgcagacggagtcccacac

SEQ ID NO: 470281 - DNA, 25 bp, Rattus norvegicus
ggtgtacgcagagggagtcccacac

SEQ ID NO: 470282 - DNA, 25 bp, Rattus norvegicus
ggtgtacgctgcacaagggcttgac

SEQ ID NO: 470283 - DNA, 25 bp, Rattus norvegicus
ggtgtacgctgctcaagggcttgac

SEQ ID NO: 470284 - DNA, 25 bp, Rattus norvegicus
ggtgtacggaacactaccttacttg

SEQ ID NO: 470285 - DNA, 25 bp, Rattus norvegicus
ggtgtacggaactctaccttacttg

SEQ ID NO: 470286 - DNA, 25 bp, Rattus norvegicus
ggtgtactacgtcaacaaggacttt

SEQ ID NO: 470287 - DNA, 25 bp, Rattus norvegicus
ggtgtactacgtgaacaaggacttt

SEQ ID NO: 470288 - DNA, 25 bp, Rattus norvegicus
ggtgtactatccacttaaaacgtgt

SEQ ID NO: 470289 - DNA, 25 bp, Rattus norvegicus
ggtgtactatcctcttaaaacgtgt

SEQ ID NO: 470290 - DNA, 25 bp, Rattus norvegicus
ggtgtactcacgagcgcgcacacgt

SEQ ID NO: 470291 - DNA, 25 bp, Rattus norvegicus
ggtgtactcacgtgcgcgcacacgt

SEQ ID NO: 470292 - DNA, 25 bp, Rattus norvegicus
ggtgtactcactcctgttgcaggat

SEQ ID NO: 470293 - DNA, 25 bp, Rattus norvegicus
ggtgtactcactgctgttgcaggat

SEQ ID NO: 470294 - DNA, 25 bp, Rattus norvegicus
ggtgtactccatcgacatgttccac

SEQ ID NO: 470295 - DNA, 25 bp, Rattus norvegicus
ggtgtactccatggacatgttccac

SEQ ID NO: 470296 - DNA, 25 bp, Rattus norvegicus
ggtgtactctagacccggctggaga

SEQ ID NO: 470297 - DNA, 25 bp, Rattus norvegicus
ggtgtactctagtcccggctggaga

SEQ ID NO: 470298 - DNA, 25 bp, Rattus norvegicus
ggtgtactgccccagtggagacaaa

SEQ ID NO: 470299 - DNA, 25 bp, Rattus norvegicus
ggtgtactgcccgagtggagacaaa

SEQ ID NO: 470300 - DNA, 25 bp, Rattus norvegicus
ggtgtactgtggacctaactactaa

SEQ ID NO: 470301 - DNA, 25 bp, Rattus norvegicus
ggtgtactgtggtcctaactactaa

SEQ ID NO: 470302 - DNA, 25 bp, Rattus norvegicus
ggtgtactgttcagatttccatgct

SEQ ID NO: 470303 - DNA, 25 bp, Rattus norvegicus
ggtgtactgttctgatttccatgct

SEQ ID NO: 470304 - DNA, 25 bp, Rattus norvegicus
ggtgtacttatgatactcagcgttt

SEQ ID NO: 470305 - DNA, 25 bp, Rattus norvegicus
ggtgtacttatgttactcagcgttt

SEQ ID NO: 470306 - DNA, 25 bp, Rattus norvegicus
ggtgtacttccaactgtgtgcagag

SEQ ID NO: 470307 - DNA, 25 bp, Rattus norvegicus
ggtgtacttccatctgtgtgcagag

SEQ ID NO: 470308 - DNA, 25 bp, Rattus norvegicus
ggtgtacttgtccaggtaacttagg

SEQ ID NO: 470309 - DNA, 25 bp, Rattus norvegicus
ggtgtacttgtcgaggtaacttagg

SEQ ID NO: 470310 - DNA, 25 bp, Rattus norvegicus
ggtgtagaaaatctccctggaaact

SEQ ID NO: 470311 - DNA, 25 bp, Rattus norvegicus
ggtgtagaaaatgtccctggaaact

SEQ ID NO: 470312 - DNA, 25 bp, Rattus norvegicus
ggtgtagaccacctgatcctagcag

SEQ ID NO: 470313 - DNA, 25 bp, Rattus norvegicus
ggtgtagaccacgtgatcctagcag

SEQ ID NO: 470314 - DNA, 25 bp, Rattus norvegicus
ggtgtagagtgactgccatcaaact

SEQ ID NO: 470315 - DNA, 25 bp, Rattus norvegicus
ggtgtagagtgagtgccatcaaact

SEQ ID NO: 470316 - DNA, 25 bp, Rattus norvegicus
ggtgtagagtttctttccttcacta

SEQ ID NO: 470317 - DNA, 25 bp, Rattus norvegicus
ggtgtagagtttgtttccttcacta

SEQ ID NO: 470318 - DNA, 25 bp, Rattus norvegicus
ggtgtagatcccattagcttgagac

SEQ ID NO: 470319 - DNA, 25 bp, Rattus norvegicus
ggtgtagatccctttagcttgagac

SEQ ID NO: 470320 - DNA, 25 bp, Rattus norvegicus
ggtgtagatcctagaatttccataa

SEQ ID NO: 470321 - DNA, 25 bp, Rattus norvegicus
ggtgtagatccttgaatttccataa

SEQ ID NO: 470322 - DNA, 25 bp, Rattus norvegicus
ggtgtagattgcaaggcccctccag

SEQ ID NO: 470323 - DNA, 25 bp, Rattus norvegicus
ggtgtagattgctaggcccctccag

SEQ ID NO: 470324 - DNA, 25 bp, Rattus norvegicus
ggtgtagcacttagccttggaaatc

SEQ ID NO: 470325 - DNA, 25 bp, Rattus norvegicus
ggtgtagcactttgccttggaaatc

SEQ ID NO: 470326 - DNA, 25 bp, Rattus norvegicus
ggtgtagcagttaaggtcctcttaa

SEQ ID NO: 470327 - DNA, 25 bp, Rattus norvegicus
ggtgtagcagtttaggtcctcttaa

SEQ ID NO: 470328 - DNA, 25 bp, Rattus norvegicus
ggtgtagccaggacttcattagtgt

SEQ ID NO: 470329 - DNA, 25 bp, Rattus norvegicus
ggtgtagccaggtcttcattagtgt

SEQ ID NO: 470330 - DNA, 25 bp, Rattus norvegicus
ggtgtagccccgacataacaaaggt

SEQ ID NO: 470331 - DNA, 25 bp, Rattus norvegicus
ggtgtagccccgtcataacaaaggt

SEQ ID NO: 470332 - DNA, 25 bp, Rattus norvegicus
ggtgtagctcagacctgtttttatt

SEQ ID NO: 470333 - DNA, 25 bp, Rattus norvegicus
ggtgtagctcagtcctgtttttatt

SEQ ID NO: 470334 - DNA, 25 bp, Rattus norvegicus
ggtgtagctgacaaaacctcccatc

SEQ ID NO: 470335 - DNA, 25 bp, Rattus norvegicus
ggtgtagctgactaaacctcccatc

SEQ ID NO: 470336 - DNA, 25 bp, Rattus norvegicus
ggtgtagcttatcaagccccttcac

SEQ ID NO: 470337 - DNA, 25 bp, Rattus norvegicus
ggtgtagcttatgaagccccttcac

SEQ ID NO: 470338 - DNA, 25 bp, Rattus norvegicus
ggtgtaggactacctagcttccact

SEQ ID NO: 470339 - DNA, 25 bp, Rattus norvegicus
ggtgtaggactagctagcttccact

SEQ ID NO: 470340 - DNA, 25 bp, Rattus norvegicus
ggtgtaggcattaaatcccaccact

SEQ ID NO: 470341 - DNA, 25 bp, Rattus norvegicus
ggtgtaggcatttaatcccaccact

SEQ ID NO: 470342 - DNA, 25 bp, Rattus norvegicus
ggtgtagtcaccatcagaagttgga

SEQ ID NO: 470343 - DNA, 25 bp, Rattus norvegicus
ggtgtagtcaccttcagaagttgga

SEQ ID NO: 470344 - DNA, 25 bp, Rattus norvegicus
ggtgtagtcctccttaatttcaact

SEQ ID NO: 470345 - DNA, 25 bp, Rattus norvegicus
ggtgtagtcctcgttaatttcaact

SEQ ID NO: 470346 - DNA, 25 bp, Rattus norvegicus
ggtgtagtgactaccaaagcccaag

SEQ ID NO: 470347 - DNA, 25 bp, Rattus norvegicus
ggtgtagtgacttccaaagcccaag

SEQ ID NO: 470348 - DNA, 25 bp, Rattus norvegicus
ggtgtagtgcctatgccactaactt

SEQ ID NO: 470349 - DNA, 25 bp, Rattus norvegicus
ggtgtagtgcctttgccactaactt

SEQ ID NO: 470350 - DNA, 25 bp, Rattus norvegicus
ggtgtagtggttatcttagcactca

SEQ ID NO: 470351 - DNA, 25 bp, Rattus norvegicus
ggtgtagtggttttcttagcactca

SEQ ID NO: 470352 - DNA, 25 bp, Rattus norvegicus
ggtgtagtgtcgacataggccatca

SEQ ID NO: 470353 - DNA, 25 bp, Rattus norvegicus
ggtgtagtgtcgtcataggccatca

SEQ ID NO: 470354 - DNA, 25 bp, Rattus norvegicus
ggtgtagtttgaacagcctcctcta

SEQ ID NO: 470355 - DNA, 25 bp, Rattus norvegicus
ggtgtagtttgatcagcctcctcta

SEQ ID NO: 470356 - DNA, 25 bp, Rattus norvegicus
ggtgtataggatccccaggtctttc

SEQ ID NO: 470357 - DNA, 25 bp, Rattus norvegicus
ggtgtataggatgcccaggtctttc

SEQ ID NO: 470358 - DNA, 25 bp, Rattus norvegicus
ggtgtatatatcatgaactcacaaa

SEQ ID NO: 470359 - DNA, 25 bp, Rattus norvegicus
ggtgtatatatcttgaactcacaaa

SEQ ID NO: 470360 - DNA, 25 bp, Rattus norvegicus
ggtgtatatctcaaagcttgtgtat

SEQ ID NO: 470361 - DNA, 25 bp, Rattus norvegicus
ggtgtatatctctaagcttgtgtat

SEQ ID NO: 470362 - DNA, 25 bp, Rattus norvegicus
ggtgtatattatcttctggtgcatg

SEQ ID NO: 470363 - DNA, 25 bp, Rattus norvegicus
ggtgtatattatgttctggtgcatg

SEQ ID NO: 470364 - DNA, 25 bp, Rattus norvegicus
ggtgtatcaacacaccctgacattt

SEQ ID NO: 470365 - DNA, 25 bp, Rattus norvegicus
ggtgtatcaacagaccctgacattt

SEQ ID NO: 470366 - DNA, 25 bp, Rattus norvegicus
ggtgtatcaccacagccccggacag

SEQ ID NO: 470367 - DNA, 25 bp, Rattus norvegicus
ggtgtatcaccagagccccggacag

SEQ ID NO: 470368 - DNA, 25 bp, Rattus norvegicus
ggtgtatcactgcttatctgtttat

SEQ ID NO: 470369 - DNA, 25 bp, Rattus norvegicus
ggtgtatcactggttatctgtttat

SEQ ID NO: 470370 - DNA, 25 bp, Rattus norvegicus
ggtgtatcagatcagagtgtaaatg

SEQ ID NO: 470371 - DNA, 25 bp, Rattus norvegicus
ggtgtatcagatgagagtgtaaatg

SEQ ID NO: 470372 - DNA, 25 bp, Rattus norvegicus
ggtgtatcatttcgtcattctggaa

SEQ ID NO: 470373 - DNA, 25 bp, Rattus norvegicus
ggtgtatcatttggtcattctggaa

SEQ ID NO: 470374 - DNA, 25 bp, Rattus norvegicus
ggtgtatccctcaggaagtgagtta

SEQ ID NO: 470375 - DNA, 25 bp, Rattus norvegicus
ggtgtatccctctggaagtgagtta

SEQ ID NO: 470376 - DNA, 25 bp, Rattus norvegicus
ggtgtatcttctagatttaaaggaa

SEQ ID NO: 470377 - DNA, 25 bp, Rattus norvegicus
ggtgtatcttcttgatttaaaggaa

SEQ ID NO: 470378 - DNA, 25 bp, Rattus norvegicus
ggtgtatgcaaaagtccctttaatg

SEQ ID NO: 470379 - DNA, 25 bp, Rattus norvegicus
ggtgtatgcaaatgtccctttaatg

SEQ ID NO: 470380 - DNA, 25 bp, Rattus norvegicus
ggtgtatgcactcaattacctttct

SEQ ID NO: 470381 - DNA, 25 bp, Rattus norvegicus
ggtgtatgcactgaattacctttct

SEQ ID NO: 470382 - DNA, 25 bp, Rattus norvegicus
ggtgtatgccgactgtcttagtgac

SEQ ID NO: 470383 - DNA, 25 bp, Rattus norvegicus
ggtgtatgccgagtgtcttagtgac

SEQ ID NO: 470384 - DNA, 25 bp, Rattus norvegicus
ggtgtatgccgtccgaaatctcact

SEQ ID NO: 470385 - DNA, 25 bp, Rattus norvegicus
ggtgtatgccgtgcgaaatctcact

SEQ ID NO: 470386 - DNA, 25 bp, Rattus norvegicus
ggtgtatggtttaggatggcccatt

SEQ ID NO: 470387 - DNA, 25 bp, Rattus norvegicus
ggtgtatggttttggatggcccatt

SEQ ID NO: 470388 - DNA, 25 bp, Rattus norvegicus
ggtgtattaccacgaatggcccctc

SEQ ID NO: 470389 - DNA, 25 bp, Rattus norvegicus
ggtgtattaccaggaatggcccctc

SEQ ID NO: 470390 - DNA, 25 bp, Rattus norvegicus
ggtgtattcattctcctgtcagagg

SEQ ID NO: 470391 - DNA, 25 bp, Rattus norvegicus
ggtgtattcattgtcctgtcagagg

SEQ ID NO: 470392 - DNA, 25 bp, Rattus norvegicus
ggtgtattcttgaaactagtgtctg

SEQ ID NO: 470393 - DNA, 25 bp, Rattus norvegicus
ggtgtattcttgtaactagtgtctg

SEQ ID NO: 470394 - DNA, 25 bp, Rattus norvegicus
ggtgtattggatacctccagtttct

SEQ ID NO: 470395 - DNA, 25 bp, Rattus norvegicus
ggtgtattggattcctccagtttct

SEQ ID NO: 470396 - DNA, 25 bp, Rattus norvegicus
ggtgtatttacaccgctgctttgac

SEQ ID NO: 470397 - DNA, 25 bp, Rattus norvegicus
ggtgtatttacagcgctgctttgac

SEQ ID NO: 470398 - DNA, 25 bp, Rattus norvegicus
ggtgtatttcctaactcaaacctca

SEQ ID NO: 470399 - DNA, 25 bp, Rattus norvegicus
ggtgtatttccttactcaaacctca

SEQ ID NO: 470400 - DNA, 25 bp, Rattus norvegicus
ggtgtattttaccttatcccagcca

SEQ ID NO: 470401 - DNA, 25 bp, Rattus norvegicus
ggtgtattttacgttatcccagcca

SEQ ID NO: 470402 - DNA, 25 bp, Rattus norvegicus
ggtgtatttttactgctacctgcta

SEQ ID NO: 470403 - DNA, 25 bp, Rattus norvegicus
ggtgtatttttagtgctacctgcta

SEQ ID NO: 470404 - DNA, 25 bp, Rattus norvegicus
ggtgtattttttcctcagatttgat

SEQ ID NO: 470405 - DNA, 25 bp, Rattus norvegicus
ggtgtattttttgctcagatttgat

SEQ ID NO: 470406 - DNA, 25 bp, Rattus norvegicus
ggtgtcaaatatatccccaatcgtg

SEQ ID NO: 470407 - DNA, 25 bp, Rattus norvegicus
ggtgtcaaatatttccccaatcgtg

SEQ ID NO: 470408 - DNA, 25 bp, Rattus norvegicus
ggtgtcaacacccatggcatggttt

SEQ ID NO: 470409 - DNA, 25 bp, Rattus norvegicus
ggtgtcaacaccgatggcatggttt

SEQ ID NO: 470410 - DNA, 25 bp, Rattus norvegicus
ggtgtcaatgtcctggcatcagtat

SEQ ID NO: 470411 - DNA, 25 bp, Rattus norvegicus
ggtgtcaatgtcgtggcatcagtat

SEQ ID NO: 470412 - DNA, 25 bp, Rattus norvegicus
ggtgtcacaaccagctgcactaggt

SEQ ID NO: 470413 - DNA, 25 bp, Rattus norvegicus
ggtgtcacaacctgctgcactaggt

SEQ ID NO: 470414 - DNA, 25 bp, Rattus norvegicus
ggtgtcacacagaattcatggcaca

SEQ ID NO: 470415 - DNA, 25 bp, Rattus norvegicus
ggtgtcacacagtattcatggcaca

SEQ ID NO: 470416 - DNA, 25 bp, Rattus norvegicus
ggtgtcacagttcagtaggttatct

SEQ ID NO: 470417 - DNA, 25 bp, Rattus norvegicus
ggtgtcacagttgagtaggttatct

SEQ ID NO: 470418 - DNA, 25 bp, Rattus norvegicus
ggtgtcaccgttcaaaggccaaaga

SEQ ID NO: 470419 - DNA, 25 bp, Rattus norvegicus
ggtgtcaccgttgaaaggccaaaga

SEQ ID NO: 470420 - DNA, 25 bp, Rattus norvegicus
ggtgtcacctggctgagcttcagca

SEQ ID NO: 470421 - DNA, 25 bp, Rattus norvegicus
ggtgtcacctgggtgagcttcagca

SEQ ID NO: 470422 - DNA, 25 bp, Rattus norvegicus
ggtgtcactctgcaaacctgaacgg

SEQ ID NO: 470423 - DNA, 25 bp, Rattus norvegicus
ggtgtcactctggaaacctgaacgg

SEQ ID NO: 470424 - DNA, 25 bp, Rattus norvegicus
ggtgtcacttgccaatgctgtatat

SEQ ID NO: 470425 - DNA, 25 bp, Rattus norvegicus
ggtgtcacttgcgaatgctgtatat

SEQ ID NO: 470426 - DNA, 25 bp, Rattus norvegicus
ggtgtcagaactctatcagtagcat

SEQ ID NO: 470427 - DNA, 25 bp, Rattus norvegicus
ggtgtcagaactgtatcagtagcat

SEQ ID NO: 470428 - DNA, 25 bp, Rattus norvegicus
ggtgtcagacacagcattggtccaa

SEQ ID NO: 470429 - DNA, 25 bp, Rattus norvegicus
ggtgtcagacactgcattggtccaa

SEQ ID NO: 470430 - DNA, 25 bp, Rattus norvegicus
ggtgtcagaccgaagtgtcccatat

SEQ ID NO: 470431 - DNA, 25 bp, Rattus norvegicus
ggtgtcagaccgtagtgtcccatat

SEQ ID NO: 470432 - DNA, 25 bp, Rattus norvegicus
ggtgtcagagacaattccactcaga

SEQ ID NO: 470433 - DNA, 25 bp, Rattus norvegicus
ggtgtcagagactattccactcaga

SEQ ID NO: 470434 - DNA, 25 bp, Rattus norvegicus
ggtgtcagcctcatgcctgttgatg

SEQ ID NO: 470435 - DNA, 25 bp, Rattus norvegicus
ggtgtcagcctcttgcctgttgatg

SEQ ID NO: 470436 - DNA, 25 bp, Rattus norvegicus
ggtgtcagctctagggcacagactg

SEQ ID NO: 470437 - DNA, 25 bp, Rattus norvegicus
ggtgtcagctcttgggcacagactg

SEQ ID NO: 470438 - DNA, 25 bp, Rattus norvegicus
ggtgtcaggcctagaatcttcattt

SEQ ID NO: 470439 - DNA, 25 bp, Rattus norvegicus
ggtgtcaggccttgaatcttcattt

SEQ ID NO: 470440 - DNA, 25 bp, Rattus norvegicus
ggtgtcagtcttcattcttgtgatt

SEQ ID NO: 470441 - DNA, 25 bp, Rattus norvegicus
ggtgtcagtcttgattcttgtgatt

SEQ ID NO: 470442 - DNA, 25 bp, Rattus norvegicus
ggtgtcagtgtgctaaaaagccaaa

SEQ ID NO: 470443 - DNA, 25 bp, Rattus norvegicus
ggtgtcagtgtggtaaaaagccaaa

SEQ ID NO: 470444 - DNA, 25 bp, Rattus norvegicus
ggtgtcagtttcctgtagttaataa

SEQ ID NO: 470445 - DNA, 25 bp, Rattus norvegicus
ggtgtcagtttcgtgtagttaataa

SEQ ID NO: 470446 - DNA, 25 bp, Rattus norvegicus
ggtgtcatactcatgaattggctct

SEQ ID NO: 470447 - DNA, 25 bp, Rattus norvegicus
ggtgtcatactcttgaattggctct

SEQ ID NO: 470448 - DNA, 25 bp, Rattus norvegicus
ggtgtcataggcacatctgtgcata

SEQ ID NO: 470449 - DNA, 25 bp, Rattus norvegicus
ggtgtcataggctcatctgtgcata

SEQ ID NO: 470450 - DNA, 25 bp, Rattus norvegicus
ggtgtcatataactctactttttct

SEQ ID NO: 470451 - DNA, 25 bp, Rattus norvegicus
ggtgtcatataagtctactttttct

SEQ ID NO: 470452 - DNA, 25 bp, Rattus norvegicus
ggtgtcatcacaaacatactgctgt

SEQ ID NO: 470453 - DNA, 25 bp, Rattus norvegicus
ggtgtcatcacatacatactgctgt

SEQ ID NO: 470454 - DNA, 25 bp, Rattus norvegicus
ggtgtcatcaccacaaccatgacag

SEQ ID NO: 470455 - DNA, 25 bp, Rattus norvegicus
ggtgtcatcacctcaaccatgacag

SEQ ID NO: 470456 - DNA, 25 bp, Rattus norvegicus
ggtgtcatcttcaatcatggcatgt

SEQ ID NO: 470457 - DNA, 25 bp, Rattus norvegicus
ggtgtcatcttctatcatggcatgt

SEQ ID NO: 470458 - DNA, 25 bp, Rattus norvegicus
ggtgtcatgtgtccagaggacccca

SEQ ID NO: 470459 - DNA, 25 bp, Rattus norvegicus
ggtgtcatgtgtgcagaggacccca

SEQ ID NO: 470460 - DNA, 25 bp, Rattus norvegicus
ggtgtcattgtgaaccaggcacaaa

SEQ ID NO: 470461 - DNA, 25 bp, Rattus norvegicus
ggtgtcattgtgtaccaggcacaaa

SEQ ID NO: 470462 - DNA, 25 bp, Rattus norvegicus
ggtgtccaaaacatccttatcatag

SEQ ID NO: 470463 - DNA, 25 bp, Rattus norvegicus
ggtgtccaaaacttccttatcatag

SEQ ID NO: 470464 - DNA, 25 bp, Rattus norvegicus
ggtgtccaaatacatagtaatcctt

SEQ ID NO: 470465 - DNA, 25 bp, Rattus norvegicus
ggtgtccaaatagatagtaatcctt

SEQ ID NO: 470466 - DNA, 25 bp, Rattus norvegicus
ggtgtccacgttaggatcccaaagc

SEQ ID NO: 470467 - DNA, 25 bp, Rattus norvegicus
ggtgtccacgtttggatcccaaagc

SEQ ID NO: 470468 - DNA, 25 bp, Rattus norvegicus
ggtgtccactgcctacatccacaag

SEQ ID NO: 470469 - DNA, 25 bp, Rattus norvegicus
ggtgtccactgcgtacatccacaag

SEQ ID NO: 470470 - DNA, 25 bp, Rattus norvegicus
ggtgtccacttcacgtgctgggtgt

SEQ ID NO: 470471 - DNA, 25 bp, Rattus norvegicus
ggtgtccacttctcgtgctgggtgt

SEQ ID NO: 470472 - DNA, 25 bp, Rattus norvegicus
ggtgtccaggttagatagggctcta

SEQ ID NO: 470473 - DNA, 25 bp, Rattus norvegicus
ggtgtccaggtttgatagggctcta

SEQ ID NO: 470474 - DNA, 25 bp, Rattus norvegicus
ggtgtccagtgaacagaatcccgtc

SEQ ID NO: 470475 - DNA, 25 bp, Rattus norvegicus
ggtgtccagtgatcagaatcccgtc

SEQ ID NO: 470476 - DNA, 25 bp, Rattus norvegicus
ggtgtccataggagattaatgtcaa

SEQ ID NO: 470477 - DNA, 25 bp, Rattus norvegicus
ggtgtccataggtgattaatgtcaa

SEQ ID NO: 470478 - DNA, 25 bp, Rattus norvegicus
ggtgtccatcacagagcttgcccaa

SEQ ID NO: 470479 - DNA, 25 bp, Rattus norvegicus
ggtgtccatcactgagcttgcccaa

SEQ ID NO: 470480 - DNA, 25 bp, Rattus norvegicus
ggtgtccatctacccggatgaatgt

SEQ ID NO: 470481 - DNA, 25 bp, Rattus norvegicus
ggtgtccatctagccggatgaatgt

SEQ ID NO: 470482 - DNA, 25 bp, Rattus norvegicus
ggtgtccattgaattttaacttctg

SEQ ID NO: 470483 - DNA, 25 bp, Rattus norvegicus
ggtgtccattgatttttaacttctg

SEQ ID NO: 470484 - DNA, 25 bp, Rattus norvegicus
ggtgtccattgtatgtccaatccta

SEQ ID NO: 470485 - DNA, 25 bp, Rattus norvegicus
ggtgtccattgtttgtccaatccta

SEQ ID NO: 470486 - DNA, 25 bp, Rattus norvegicus
ggtgtcccaaaaatccgtagtctct

SEQ ID NO: 470487 - DNA, 25 bp, Rattus norvegicus
ggtgtcccaaaattccgtagtctct

SEQ ID NO: 470488 - DNA, 25 bp, Rattus norvegicus
ggtgtcccaaagaagctgtagtatt

SEQ ID NO: 470489 - DNA, 25 bp, Rattus norvegicus
ggtgtcccaaagtagctgtagtatt

SEQ ID NO: 470490 - DNA, 25 bp, Rattus norvegicus
ggtgtccccgtgaatgtattactgc

SEQ ID NO: 470491 - DNA, 25 bp, Rattus norvegicus
ggtgtccccgtgtatgtattactgc

SEQ ID NO: 470492 - DNA, 25 bp, Rattus norvegicus
ggtgtccccttcctggagacaagtg

SEQ ID NO: 470493 - DNA, 25 bp, Rattus norvegicus
ggtgtccccttcgtggagacaagtg

SEQ ID NO: 470494 - DNA, 25 bp, Rattus norvegicus
ggtgtccccttgaggaagatcgaga

SEQ ID NO: 470495 - DNA, 25 bp, Rattus norvegicus
ggtgtccccttgtggaagatcgaga

SEQ ID NO: 470496 - DNA, 25 bp, Rattus norvegicus
ggtgtcccgctcaccacgtgcagag

SEQ ID NO: 470497 - DNA, 25 bp, Rattus norvegicus
ggtgtcccgctctccacgtgcagag

SEQ ID NO: 470498 - DNA, 25 bp, Rattus norvegicus
ggtgtcccgctgacacaggttaaaa

SEQ ID NO: 470499 - DNA, 25 bp, Rattus norvegicus
ggtgtcccgctgtcacaggttaaaa

SEQ ID NO: 470500 - DNA, 25 bp, Rattus norvegicus
ggtgtccctacgcagaactctcagg

SEQ ID NO: 470501 - DNA, 25 bp, Rattus norvegicus
ggtgtccctacggagaactctcagg

SEQ ID NO: 470502 - DNA, 25 bp, Rattus norvegicus
ggtgtccctgacagaccgtagcttg

SEQ ID NO: 470503 - DNA, 25 bp, Rattus norvegicus
ggtgtccctgactgaccgtagcttg

SEQ ID NO: 470504 - DNA, 25 bp, Rattus norvegicus
ggtgtccgtgacaaaatctaatctt

SEQ ID NO: 470505 - DNA, 25 bp, Rattus norvegicus
ggtgtccgtgactaaatctaatctt

SEQ ID NO: 470506 - DNA, 25 bp, Rattus norvegicus
ggtgtccgtttccttagtgaactga

SEQ ID NO: 470507 - DNA, 25 bp, Rattus norvegicus
ggtgtccgtttcgttagtgaactga

SEQ ID NO: 470508 - DNA, 25 bp, Rattus norvegicus
ggtgtcctagagacctcattctcaa

SEQ ID NO: 470509 - DNA, 25 bp, Rattus norvegicus
ggtgtcctagagtcctcattctcaa

SEQ ID NO: 470510 - DNA, 25 bp, Rattus norvegicus
ggtgtcctcaggatcatcaacatta

SEQ ID NO: 470511 - DNA, 25 bp, Rattus norvegicus
ggtgtcctcaggttcatcaacatta

SEQ ID NO: 470512 - DNA, 25 bp, Rattus norvegicus
ggtgtcctccacagaaattgtttgt

SEQ ID NO: 470513 - DNA, 25 bp, Rattus norvegicus
ggtgtcctccactgaaattgtttgt

SEQ ID NO: 470514 - DNA, 25 bp, Rattus norvegicus
ggtgtcctctaacatttggtctgat

SEQ ID NO: 470515 - DNA, 25 bp, Rattus norvegicus
ggtgtcctctaagatttggtctgat

SEQ ID NO: 470516 - DNA, 25 bp, Rattus norvegicus
ggtgtcctctggcttatacataact

SEQ ID NO: 470517 - DNA, 25 bp, Rattus norvegicus
ggtgtcctctgggttatacataact

SEQ ID NO: 470518 - DNA, 25 bp, Rattus norvegicus
ggtgtcctgcagcttgtgccaacga

SEQ ID NO: 470519 - DNA, 25 bp, Rattus norvegicus
ggtgtcctgcaggttgtgccaacga

SEQ ID NO: 470520 - DNA, 25 bp, Rattus norvegicus
ggtgtcctgcgcatttcttacaaag

SEQ ID NO: 470521 - DNA, 25 bp, Rattus norvegicus
ggtgtcctgcgcttttcttacaaag

SEQ ID NO: 470522 - DNA, 25 bp, Rattus norvegicus
ggtgtcctggacagtgttactgatc

SEQ ID NO: 470523 - DNA, 25 bp, Rattus norvegicus
ggtgtcctggactgtgttactgatc

SEQ ID NO: 470524 - DNA, 25 bp, Rattus norvegicus
ggtgtcctggcacacactctgtaga

SEQ ID NO: 470525 - DNA, 25 bp, Rattus norvegicus
ggtgtcctggcagacactctgtaga

SEQ ID NO: 470526 - DNA, 25 bp, Rattus norvegicus
ggtgtcctggttaaatttctgttgc

SEQ ID NO: 470527 - DNA, 25 bp, Rattus norvegicus
ggtgtcctggtttaatttctgttgc

SEQ ID NO: 470528 - DNA, 25 bp, Rattus norvegicus
ggtgtcctgtgaacattgctgtagc

SEQ ID NO: 470529 - DNA, 25 bp, Rattus norvegicus
ggtgtcctgtgaaccaagagccgtg

SEQ ID NO: 470530 - DNA, 25 bp, Rattus norvegicus
ggtgtcctgtgaccctcaataaagc

SEQ ID NO: 470531 - DNA, 25 bp, Rattus norvegicus
ggtgtcctgtgagcctcaataaagc

SEQ ID NO: 470532 - DNA, 25 bp, Rattus norvegicus
ggtgtcctgtgatcattgctgtagc

SEQ ID NO: 470533 - DNA, 25 bp, Rattus norvegicus
ggtgtcctgtgatccaagagccgtg

SEQ ID NO: 470534 - DNA, 25 bp, Rattus norvegicus
ggtgtccttacactgacgcgaagaa

SEQ ID NO: 470535 - DNA, 25 bp, Rattus norvegicus
ggtgtccttacagtgacgcgaagaa

SEQ ID NO: 470536 - DNA, 25 bp, Rattus norvegicus
ggtgtcctttacagactgacctcat

SEQ ID NO: 470537 - DNA, 25 bp, Rattus norvegicus
ggtgtcctttactgactgacctcat

SEQ ID NO: 470538 - DNA, 25 bp, Rattus norvegicus
ggtgtcctttatcactttggtggga

SEQ ID NO: 470539 - DNA, 25 bp, Rattus norvegicus
ggtgtcctttatgactttggtggga

SEQ ID NO: 470540 - DNA, 25 bp, Rattus norvegicus
ggtgtcgcgcctcgccctgttgtct

SEQ ID NO: 470541 - DNA, 25 bp, Rattus norvegicus
ggtgtcgcgcctggccctgttgtct

SEQ ID NO: 470542 - DNA, 25 bp, Rattus norvegicus
ggtgtcgtcagactggtcagtccat

SEQ ID NO: 470543 - DNA, 25 bp, Rattus norvegicus
ggtgtcgtcagagtggtcagtccat

SEQ ID NO: 470544 - DNA, 25 bp, Rattus norvegicus
ggtgtctaagacaccaagcgcccat

SEQ ID NO: 470545 - DNA, 25 bp, Rattus norvegicus
ggtgtctaagactccaagcgcccat

SEQ ID NO: 470546 - DNA, 25 bp, Rattus norvegicus
ggtgtctaaggccaacgcctacaag

SEQ ID NO: 470547 - DNA, 25 bp, Rattus norvegicus
ggtgtctaaggcgaacgcctacaag

SEQ ID NO: 470548 - DNA, 25 bp, Rattus norvegicus
ggtgtctacaatattctgcttcttt

SEQ ID NO: 470549 - DNA, 25 bp, Rattus norvegicus
ggtgtctacaattttctgcttcttt

SEQ ID NO: 470550 - DNA, 25 bp, Rattus norvegicus
ggtgtctacagcatctgctgcggca

SEQ ID NO: 470551 - DNA, 25 bp, Rattus norvegicus
ggtgtctacagcttctgctgcggca

SEQ ID NO: 470552 - DNA, 25 bp, Rattus norvegicus
ggtgtctacgagatattctgttctg

SEQ ID NO: 470553 - DNA, 25 bp, Rattus norvegicus
ggtgtctacgagttattctgttctg

SEQ ID NO: 470554 - DNA, 25 bp, Rattus norvegicus
ggtgtctacgtacaaaacttcaaca

SEQ ID NO: 470555 - DNA, 25 bp, Rattus norvegicus
ggtgtctacgtagaaaacttcaaca

SEQ ID NO: 470556 - DNA, 25 bp, Rattus norvegicus
ggtgtctacgttaagagccctatgc

SEQ ID NO: 470557 - DNA, 25 bp, Rattus norvegicus
ggtgtctacgtttagagccctatgc

SEQ ID NO: 470558 - DNA, 25 bp, Rattus norvegicus
ggtgtctactgacctgagctttaca

SEQ ID NO: 470559 - DNA, 25 bp, Rattus norvegicus
ggtgtctactgagctgagctttaca

SEQ ID NO: 470560 - DNA, 25 bp, Rattus norvegicus
ggtgtctaggaaccccagggactaa

SEQ ID NO: 470561 - DNA, 25 bp, Rattus norvegicus
ggtgtctaggaagcccagggactaa

SEQ ID NO: 470562 - DNA, 25 bp, Rattus norvegicus
ggtgtctatcatcttaaagcgtgca

SEQ ID NO: 470563 - DNA, 25 bp, Rattus norvegicus
ggtgtctatcatgttaaagcgtgca

SEQ ID NO: 470564 - DNA, 25 bp, Rattus norvegicus
ggtgtctcacaacttccaagtaaag

SEQ ID NO: 470565 - DNA, 25 bp, Rattus norvegicus
ggtgtctcacaagttccaagtaaag

SEQ ID NO: 470566 - DNA, 25 bp, Rattus norvegicus
ggtgtctccactattgtgattccaa

SEQ ID NO: 470567 - DNA, 25 bp, Rattus norvegicus
ggtgtctccacttttgtgattccaa

SEQ ID NO: 470568 - DNA, 25 bp, Rattus norvegicus
ggtgtctccatgcaagactcggatt

SEQ ID NO: 470569 - DNA, 25 bp, Rattus norvegicus
ggtgtctccatggaagactcggatt

SEQ ID NO: 470570 - DNA, 25 bp, Rattus norvegicus
ggtgtctcccaacccatgtggaatt

SEQ ID NO: 470571 - DNA, 25 bp, Rattus norvegicus
ggtgtctcccaagccatgtggaatt

SEQ ID NO: 470572 - DNA, 25 bp, Rattus norvegicus
ggtgtctccctcaaggctgacagaa

SEQ ID NO: 470573 - DNA, 25 bp, Rattus norvegicus
ggtgtctccctctaggctgacagaa

SEQ ID NO: 470574 - DNA, 25 bp, Rattus norvegicus
ggtgtctctaatagtaattccccta

SEQ ID NO: 470575 - DNA, 25 bp, Rattus norvegicus
ggtgtctctaattgtaattccccta

SEQ ID NO: 470576 - DNA, 25 bp, Rattus norvegicus
ggtgtctctctgcttttgtgacaaa

SEQ ID NO: 470577 - DNA, 25 bp, Rattus norvegicus
ggtgtctctctggttttgtgacaaa

SEQ ID NO: 470578 - DNA, 25 bp, Rattus norvegicus
ggtgtctctgggaggcttccaaaga

SEQ ID NO: 470579 - DNA, 25 bp, Rattus norvegicus
ggtgtctctgggtggcttccaaaga

SEQ ID NO: 470580 - DNA, 25 bp, Rattus norvegicus
ggtgtctctgtcattttaattcttg

SEQ ID NO: 470581 - DNA, 25 bp, Rattus norvegicus
ggtgtctctgtctttttaattcttg

SEQ ID NO: 470582 - DNA, 25 bp, Rattus norvegicus
ggtgtctgacttcccaggaggaact

SEQ ID NO: 470583 - DNA, 25 bp, Rattus norvegicus
ggtgtctgacttgccaggaggaact

SEQ ID NO: 470584 - DNA, 25 bp, Rattus norvegicus
ggtgtctgcaatagcacaggacccc

SEQ ID NO: 470585 - DNA, 25 bp, Rattus norvegicus
ggtgtctgcaattgcacaggacccc

SEQ ID NO: 470586 - DNA, 25 bp, Rattus norvegicus
ggtgtctggaacctcagcatctggt

SEQ ID NO: 470587 - DNA, 25 bp, Rattus norvegicus
ggtgtctggaacgtcagcatctggt

SEQ ID NO: 470588 - DNA, 25 bp, Rattus norvegicus
ggtgtctgtacaaagttcgtctttg

SEQ ID NO: 470589 - DNA, 25 bp, Rattus norvegicus
ggtgtctgtacatagttcgtctttg

SEQ ID NO: 470590 - DNA, 25 bp, Rattus norvegicus
ggtgtctgtcaccttacagtacagt

SEQ ID NO: 470591 - DNA, 25 bp, Rattus norvegicus
ggtgtctgtcacgttacagtacagt

SEQ ID NO: 470592 - DNA, 25 bp, Rattus norvegicus
ggtgtctgtcagacctttagtgata

SEQ ID NO: 470593 - DNA, 25 bp, Rattus norvegicus
ggtgtctgtcagtcctttagtgata

SEQ ID NO: 470594 - DNA, 25 bp, Rattus norvegicus
ggtgtctgtcccagtgtatatcata

SEQ ID NO: 470595 - DNA, 25 bp, Rattus norvegicus
ggtgtctgtccctgtgtatatcata

SEQ ID NO: 470596 - DNA, 25 bp, Rattus norvegicus
ggtgtctgtgagcatatttctagga

SEQ ID NO: 470597 - DNA, 25 bp, Rattus norvegicus
ggtgtctgtgaggatatttctagga

SEQ ID NO: 470598 - DNA, 25 bp, Rattus norvegicus
ggtgtctgtgcacgaaccagtgaac

SEQ ID NO: 470599 - DNA, 25 bp, Rattus norvegicus
ggtgtctgtgcaggaaccagtgaac

SEQ ID NO: 470600 - DNA, 25 bp, Rattus norvegicus
ggtgtcttagatcaacctgatacaa

SEQ ID NO: 470601 - DNA, 25 bp, Rattus norvegicus
ggtgtcttagatgaacctgatacaa

SEQ ID NO: 470602 - DNA, 25 bp, Rattus norvegicus
ggtgtcttattcctctttccagtac

SEQ ID NO: 470603 - DNA, 25 bp, Rattus norvegicus
ggtgtcttattcgtctttccagtac

SEQ ID NO: 470604 - DNA, 25 bp, Rattus norvegicus
ggtgtcttccaaaatggctaagaac

SEQ ID NO: 470605 - DNA, 25 bp, Rattus norvegicus
ggtgtcttccaatatggctaagaac

SEQ ID NO: 470606 - DNA, 25 bp, Rattus norvegicus
ggtgtcttccagaagattgtcaact

SEQ ID NO: 470607 - DNA, 25 bp, Rattus norvegicus
ggtgtcttccagtagattgtcaact

SEQ ID NO: 470608 - DNA, 25 bp, Rattus norvegicus
ggtgtcttcctacgtaagagctttt

SEQ ID NO: 470609 - DNA, 25 bp, Rattus norvegicus
ggtgtcttcctaggtaagagctttt

SEQ ID NO: 470610 - DNA, 25 bp, Rattus norvegicus
ggtgtcttctccagggaaggccgca

SEQ ID NO: 470611 - DNA, 25 bp, Rattus norvegicus
ggtgtcttctcctgggaaggccgca

SEQ ID NO: 470612 - DNA, 25 bp, Rattus norvegicus
ggtgtcttggcaaggtactgcacaa

SEQ ID NO: 470613 - DNA, 25 bp, Rattus norvegicus
ggtgtcttggcatggtactgcacaa

SEQ ID NO: 470614 - DNA, 25 bp, Rattus norvegicus
ggtgtgaaatctcttggcccagtca

SEQ ID NO: 470615 - DNA, 25 bp, Rattus norvegicus
ggtgtgaaatctgttggcccagtca

SEQ ID NO: 470616 - DNA, 25 bp, Rattus norvegicus
ggtgtgaactcacatccctaactca

SEQ ID NO: 470617 - DNA, 25 bp, Rattus norvegicus
ggtgtgaactcagatccctaactca

SEQ ID NO: 470618 - DNA, 25 bp, Rattus norvegicus
ggtgtgaataacctgaaccgtttat

SEQ ID NO: 470619 - DNA, 25 bp, Rattus norvegicus
ggtgtgaataacgtgaaccgtttat

SEQ ID NO: 470620 - DNA, 25 bp, Rattus norvegicus
ggtgtgacacatctacctttgtaat

SEQ ID NO: 470621 - DNA, 25 bp, Rattus norvegicus
ggtgtgacacatgtacctttgtaat

SEQ ID NO: 470622 - DNA, 25 bp, Rattus norvegicus
ggtgtgacagctatggtgacagcat

SEQ ID NO: 470623 - DNA, 25 bp, Rattus norvegicus
ggtgtgacagctttggtgacagcat

SEQ ID NO: 470624 - DNA, 25 bp, Rattus norvegicus
ggtgtgacgttacctcagcaatggt

SEQ ID NO: 470625 - DNA, 25 bp, Rattus norvegicus
ggtgtgacgttagctcagcaatggt

SEQ ID NO: 470626 - DNA, 25 bp, Rattus norvegicus
ggtgtgactccaatcatgattttct

SEQ ID NO: 470627 - DNA, 25 bp, Rattus norvegicus
ggtgtgactccattcatgattttct

SEQ ID NO: 470628 - DNA, 25 bp, Rattus norvegicus
ggtgtgactcttctaaaacattcat

SEQ ID NO: 470629 - DNA, 25 bp, Rattus norvegicus
ggtgtgactcttgtaaaacattcat

SEQ ID NO: 470630 - DNA, 25 bp, Rattus norvegicus
ggtgtgacttgccaaaacttttctg

SEQ ID NO: 470631 - DNA, 25 bp, Rattus norvegicus
ggtgtgacttgcgaaaacttttctg

SEQ ID NO: 470632 - DNA, 25 bp, Rattus norvegicus
ggtgtgatatctactttctgtgtgg

SEQ ID NO: 470633 - DNA, 25 bp, Rattus norvegicus
ggtgtgatatcttctttctgtgtgg

SEQ ID NO: 470634 - DNA, 25 bp, Rattus norvegicus
ggtgtgatcaggaccttatcttgtc

SEQ ID NO: 470635 - DNA, 25 bp, Rattus norvegicus
ggtgtgatcaggtccttatcttgtc

SEQ ID NO: 470636 - DNA, 25 bp, Rattus norvegicus
ggtgtgatcccaccacaggattatg

SEQ ID NO: 470637 - DNA, 25 bp, Rattus norvegicus
ggtgtgatcccagcacaggattatg

SEQ ID NO: 470638 - DNA, 25 bp, Rattus norvegicus
ggtgtgatctacatcagccactgac

SEQ ID NO: 470639 - DNA, 25 bp, Rattus norvegicus
ggtgtgatctacttcagccactgac

SEQ ID NO: 470640 - DNA, 25 bp, Rattus norvegicus
ggtgtgatctgcaacccagggatgc

SEQ ID NO: 470641 - DNA, 25 bp, Rattus norvegicus
ggtgtgatctgctacccagggatgc

SEQ ID NO: 470642 - DNA, 25 bp, Rattus norvegicus
ggtgtgatgcctacttgtaatgttc

SEQ ID NO: 470643 - DNA, 25 bp, Rattus norvegicus
ggtgtgatgccttcttgtaatgttc

SEQ ID NO: 470644 - DNA, 25 bp, Rattus norvegicus
ggtgtgatgggtatgagtcctctta

SEQ ID NO: 470645 - DNA, 25 bp, Rattus norvegicus
ggtgtgatgggtttgagtcctctta

SEQ ID NO: 470646 - DNA, 25 bp, Rattus norvegicus
ggtgtgatgtacatcgccagcctcg

SEQ ID NO: 470647 - DNA, 25 bp, Rattus norvegicus
ggtgtgatgtacttcgccagcctcg

SEQ ID NO: 470648 - DNA, 25 bp, Rattus norvegicus
ggtgtgatgtgcatttgttactgta

SEQ ID NO: 470649 - DNA, 25 bp, Rattus norvegicus
ggtgtgatgtgcttttgttactgta

SEQ ID NO: 470650 - DNA, 25 bp, Rattus norvegicus
ggtgtgattccaaagtatttctagt

SEQ ID NO: 470651 - DNA, 25 bp, Rattus norvegicus
ggtgtgattccatagtatttctagt

SEQ ID NO: 470652 - DNA, 25 bp, Rattus norvegicus
ggtgtgattcttccatccaaaggat

SEQ ID NO: 470653 - DNA, 25 bp, Rattus norvegicus
ggtgtgattcttgcatccaaaggat

SEQ ID NO: 470654 - DNA, 25 bp, Rattus norvegicus
ggtgtgatttacctttggacagatc

SEQ ID NO: 470655 - DNA, 25 bp, Rattus norvegicus
ggtgtgatttacgtttggacagatc

SEQ ID NO: 470656 - DNA, 25 bp, Rattus norvegicus
ggtgtgatttcactcagcatgctgt

SEQ ID NO: 470657 - DNA, 25 bp, Rattus norvegicus
ggtgtgatttcagtcagcatgctgt

SEQ ID NO: 470658 - DNA, 25 bp, Rattus norvegicus
ggtgtgcaaacaacaggtttctcat

SEQ ID NO: 470659 - DNA, 25 bp, Rattus norvegicus
ggtgtgcaaacatcaggtttctcat

SEQ ID NO: 470660 - DNA, 25 bp, Rattus norvegicus
ggtgtgcaagccatttttatagttc

SEQ ID NO: 470661 - DNA, 25 bp, Rattus norvegicus
ggtgtgcaagccttttttatagttc

SEQ ID NO: 470662 - DNA, 25 bp, Rattus norvegicus
ggtgtgcaccataatgcccagcctt

SEQ ID NO: 470663 - DNA, 25 bp, Rattus norvegicus
ggtgtgcaccattatgcccagcctt

SEQ ID NO: 470664 - DNA, 25 bp, Rattus norvegicus
ggtgtgcacctgaacatgtaagtat

SEQ ID NO: 470665 - DNA, 25 bp, Rattus norvegicus
ggtgtgcacctgtacatgtaagtat

SEQ ID NO: 470666 - DNA, 25 bp, Rattus norvegicus
ggtgtgcactcaacaaactatccct

SEQ ID NO: 470667 - DNA, 25 bp, Rattus norvegicus
ggtgtgcactcatcaaactatccct

SEQ ID NO: 470668 - DNA, 25 bp, Rattus norvegicus
ggtgtgcagaatcgacccccggcct

SEQ ID NO: 470669 - DNA, 25 bp, Rattus norvegicus
ggtgtgcagaatggacccccggcct

SEQ ID NO: 470670 - DNA, 25 bp, Rattus norvegicus
ggtgtgcagcaactcttagaactaa

SEQ ID NO: 470671 - DNA, 25 bp, Rattus norvegicus
ggtgtgcagcaagtcttagaactaa

SEQ ID NO: 470672 - DNA, 25 bp, Rattus norvegicus
ggtgtgcagcttcatatccagtgac

SEQ ID NO: 470673 - DNA, 25 bp, Rattus norvegicus
ggtgtgcagcttgatatccagtgac

SEQ ID NO: 470674 - DNA, 25 bp, Rattus norvegicus
ggtgtgcagtccaggctctggcttc

SEQ ID NO: 470675 - DNA, 25 bp, Rattus norvegicus
ggtgtgcagtcctggctctggcttc

SEQ ID NO: 470676 - DNA, 25 bp, Rattus norvegicus
ggtgtgcagtttaagccaaatcctt

SEQ ID NO: 470677 - DNA, 25 bp, Rattus norvegicus
ggtgtgcagttttagccaaatcctt

SEQ ID NO: 470678 - DNA, 25 bp, Rattus norvegicus
ggtgtgccacgcagtgatccaagca

SEQ ID NO: 470679 - DNA, 25 bp, Rattus norvegicus
ggtgtgccacgctgtgatccaagca

SEQ ID NO: 470680 - DNA, 25 bp, Rattus norvegicus
ggtgtgccatacacagaaacccctg

SEQ ID NO: 470681 - DNA, 25 bp, Rattus norvegicus
ggtgtgccatactcagaaacccctg

SEQ ID NO: 470682 - DNA, 25 bp, Rattus norvegicus
ggtgtgccatttaatgattcttttt

SEQ ID NO: 470683 - DNA, 25 bp, Rattus norvegicus
ggtgtgccattttatgattcttttt

SEQ ID NO: 470684 - DNA, 25 bp, Rattus norvegicus
ggtgtgcccagaatacaactaccac

SEQ ID NO: 470685 - DNA, 25 bp, Rattus norvegicus
ggtgtgcccagattacaactaccac

SEQ ID NO: 470686 - DNA, 25 bp, Rattus norvegicus
ggtgtgccctatacacaaatttgta

SEQ ID NO: 470687 - DNA, 25 bp, Rattus norvegicus
ggtgtgccctattcacaaatttgta

SEQ ID NO: 470688 - DNA, 25 bp, Rattus norvegicus
ggtgtgccgctgagtaataattttt

SEQ ID NO: 470689 - DNA, 25 bp, Rattus norvegicus
ggtgtgccgctgtgtaataattttt

SEQ ID NO: 470690 - DNA, 25 bp, Rattus norvegicus
ggtgtgcctcttaacatcagctttg

SEQ ID NO: 470691 - DNA, 25 bp, Rattus norvegicus
ggtgtgcctctttacatcagctttg

SEQ ID NO: 470692 - DNA, 25 bp, Rattus norvegicus
ggtgtgcctgagagattttattttc

SEQ ID NO: 470693 - DNA, 25 bp, Rattus norvegicus
ggtgtgcctgagtgattttattttc

SEQ ID NO: 470694 - DNA, 25 bp, Rattus norvegicus
ggtgtgcctggcaaatggtattact

SEQ ID NO: 470695 - DNA, 25 bp, Rattus norvegicus
ggtgtgcctggctaatggtattact

SEQ ID NO: 470696 - DNA, 25 bp, Rattus norvegicus
ggtgtgcgcctcactgagaatatat

SEQ ID NO: 470697 - DNA, 25 bp, Rattus norvegicus
ggtgtgcgcctctctgagaatatat

SEQ ID NO: 470698 - DNA, 25 bp, Rattus norvegicus
ggtgtgcgcgcacgcagacctaaac

SEQ ID NO: 470699 - DNA, 25 bp, Rattus norvegicus
ggtgtgcgcgcaggcagacctaaac

SEQ ID NO: 470700 - DNA, 25 bp, Rattus norvegicus
ggtgtgctaactccttatgtatgcg

SEQ ID NO: 470701 - DNA, 25 bp, Rattus norvegicus
ggtgtgctaactgcttatgtatgcg

SEQ ID NO: 470702 - DNA, 25 bp, Rattus norvegicus
ggtgtgctacacagctttttcaaat

SEQ ID NO: 470703 - DNA, 25 bp, Rattus norvegicus
ggtgtgctacactgctttttcaaat

SEQ ID NO: 470704 - DNA, 25 bp, Rattus norvegicus
ggtgtgctatttctactgctcatga

SEQ ID NO: 470705 - DNA, 25 bp, Rattus norvegicus
ggtgtgctatttgtactgctcatga

SEQ ID NO: 470706 - DNA, 25 bp, Rattus norvegicus
ggtgtgctcctgaccctggatgtgc

SEQ ID NO: 470707 - DNA, 25 bp, Rattus norvegicus
ggtgtgctcctgtccctggatgtgc

SEQ ID NO: 470708 - DNA, 25 bp, Rattus norvegicus
ggtgtgcttccgacaacaagtgtga

SEQ ID NO: 470709 - DNA, 25 bp, Rattus norvegicus
ggtgtgcttccgtcaacaagtgtga

SEQ ID NO: 470710 - DNA, 25 bp, Rattus norvegicus
ggtgtgcttcgaactgcttcagaac

SEQ ID NO: 470711 - DNA, 25 bp, Rattus norvegicus
ggtgtgcttcgatctgcttcagaac

SEQ ID NO: 470712 - DNA, 25 bp, Rattus norvegicus
ggtgtgctttctctttaaggtagta

SEQ ID NO: 470713 - DNA, 25 bp, Rattus norvegicus
ggtgtgctttctgtttaaggtagta

SEQ ID NO: 470714 - DNA, 25 bp, Rattus norvegicus
ggtgtgctttggcatttgaagttac

SEQ ID NO: 470715 - DNA, 25 bp, Rattus norvegicus
ggtgtgctttgggatttgaagttac

SEQ ID NO: 470716 - DNA, 25 bp, Rattus norvegicus
ggtgtggacagtcccctgactgcca

SEQ ID NO: 470717 - DNA, 25 bp, Rattus norvegicus
ggtgtggacagtctgaattcagcca

SEQ ID NO: 470718 - DNA, 25 bp, Rattus norvegicus
ggtgtggacagtgccctgactgcca

SEQ ID NO: 470719 - DNA, 25 bp, Rattus norvegicus
ggtgtggacagtgtgaattcagcca

SEQ ID NO: 470720 - DNA, 25 bp, Rattus norvegicus
ggtgtggacattaaggctgctttca

SEQ ID NO: 470721 - DNA, 25 bp, Rattus norvegicus
ggtgtggacatttaggctgctttca

SEQ ID NO: 470722 - DNA, 25 bp, Rattus norvegicus
ggtgtggaggatatctcatcactcc

SEQ ID NO: 470723 - DNA, 25 bp, Rattus norvegicus
ggtgtggaggatttctcatcactcc

SEQ ID NO: 470724 - DNA, 25 bp, Rattus norvegicus
ggtgtggataccattgccattacaa

SEQ ID NO: 470725 - DNA, 25 bp, Rattus norvegicus
ggtgtggatacctttgccattacaa

SEQ ID NO: 470726 - DNA, 25 bp, Rattus norvegicus
ggtgtggatctccaagactggatct

SEQ ID NO: 470727 - DNA, 25 bp, Rattus norvegicus
ggtgtggatctcgaagactggatct

SEQ ID NO: 470728 - DNA, 25 bp, Rattus norvegicus
ggtgtggattttataccatctgtgt

SEQ ID NO: 470729 - DNA, 25 bp, Rattus norvegicus
ggtgtggattttttaccatctgtgt

SEQ ID NO: 470730 - DNA, 25 bp, Rattus norvegicus
ggtgtggcaccaatacccatagagg

SEQ ID NO: 470731 - DNA, 25 bp, Rattus norvegicus
ggtgtggcaccattacccatagagg

SEQ ID NO: 470732 - DNA, 25 bp, Rattus norvegicus
ggtgtggccacaagtccaagtctga

SEQ ID NO: 470733 - DNA, 25 bp, Rattus norvegicus
ggtgtggccacatgtccaagtctga

SEQ ID NO: 470734 - DNA, 25 bp, Rattus norvegicus
ggtgtggcgcctagagacttgttac

SEQ ID NO: 470735 - DNA, 25 bp, Rattus norvegicus
ggtgtggcgccttgagacttgttac

SEQ ID NO: 470736 - DNA, 25 bp, Rattus norvegicus
ggtgtggcgcttatcttaattgtca

SEQ ID NO: 470737 - DNA, 25 bp, Rattus norvegicus
ggtgtggcgcttttcttaattgtca

SEQ ID NO: 470738 - DNA, 25 bp, Rattus norvegicus
ggtgtgggcataagcctggcaccaa

SEQ ID NO: 470739 - DNA, 25 bp, Rattus norvegicus
ggtgtgggcatatgcctggcaccaa

SEQ ID NO: 470740 - DNA, 25 bp, Rattus norvegicus
ggtgtgggcctcagacttggacact

SEQ ID NO: 470741 - DNA, 25 bp, Rattus norvegicus
ggtgtgggcctctgacttggacact

SEQ ID NO: 470742 - DNA, 25 bp, Rattus norvegicus
ggtgtgggccttagagactccgaac

SEQ ID NO: 470743 - DNA, 25 bp, Rattus norvegicus
ggtgtgggcctttgagactccgaac

SEQ ID NO: 470744 - DNA, 25 bp, Rattus norvegicus
ggtgtgggtggtctagtcgccgctc

SEQ ID NO: 470745 - DNA, 25 bp, Rattus norvegicus
ggtgtgggtggtgtagtcgccgctc

SEQ ID NO: 470746 - DNA, 25 bp, Rattus norvegicus
ggtgtggtacagcatcctcaaagac

SEQ ID NO: 470747 - DNA, 25 bp, Rattus norvegicus
ggtgtggtacaggatcctcaaagac

SEQ ID NO: 470748 - DNA, 25 bp, Rattus norvegicus
ggtgtggtactacaagccttattaa

SEQ ID NO: 470749 - DNA, 25 bp, Rattus norvegicus
ggtgtggtactagaagccttattaa

SEQ ID NO: 470750 - DNA, 25 bp, Rattus norvegicus
ggtgtggtagctactgcctttaatc

SEQ ID NO: 470751 - DNA, 25 bp, Rattus norvegicus
ggtgtggtagcttctgcctttaatc

SEQ ID NO: 470752 - DNA, 25 bp, Rattus norvegicus
ggtgtggtccatcttttaactccct

SEQ ID NO: 470753 - DNA, 25 bp, Rattus norvegicus
ggtgtggtccatgttttaactccct

SEQ ID NO: 470754 - DNA, 25 bp, Rattus norvegicus
ggtgtggtccttctgattctagcac

SEQ ID NO: 470755 - DNA, 25 bp, Rattus norvegicus
ggtgtggtccttgtgattctagcac

SEQ ID NO: 470756 - DNA, 25 bp, Rattus norvegicus
ggtgtggtttcaaagttccctctct

SEQ ID NO: 470757 - DNA, 25 bp, Rattus norvegicus
ggtgtggtttcatagttccctctct

SEQ ID NO: 470758 - DNA, 25 bp, Rattus norvegicus
ggtgtgtaaaatatgagctcttcag

SEQ ID NO: 470759 - DNA, 25 bp, Rattus norvegicus
ggtgtgtaaaatttgagctcttcag

SEQ ID NO: 470760 - DNA, 25 bp, Rattus norvegicus
ggtgtgtaaccacgcttacgcagat

SEQ ID NO: 470761 - DNA, 25 bp, Rattus norvegicus
ggtgtgtaaccaggcttacgcagat

SEQ ID NO: 470762 - DNA, 25 bp, Rattus norvegicus
ggtgtgtaatataccacttagtttt

SEQ ID NO: 470763 - DNA, 25 bp, Rattus norvegicus
ggtgtgtaatattccacttagtttt

SEQ ID NO: 470764 - DNA, 25 bp, Rattus norvegicus
ggtgtgtaccacaaaatcaactctg

SEQ ID NO: 470765 - DNA, 25 bp, Rattus norvegicus
ggtgtgtaccactaaatcaactctg

SEQ ID NO: 470766 - DNA, 25 bp, Rattus norvegicus
ggtgtgtacctgattatctgtaact

SEQ ID NO: 470767 - DNA, 25 bp, Rattus norvegicus
ggtgtgtacctgtttatctgtaact

SEQ ID NO: 470768 - DNA, 25 bp, Rattus norvegicus
ggtgtgtagcccatactatttcttt

SEQ ID NO: 470769 - DNA, 25 bp, Rattus norvegicus
ggtgtgtagcccttactatttcttt

SEQ ID NO: 470770 - DNA, 25 bp, Rattus norvegicus
ggtgtgtaggagatcgggaattcga

SEQ ID NO: 470771 - DNA, 25 bp, Rattus norvegicus
ggtgtgtaggagttcgggaattcga

SEQ ID NO: 470772 - DNA, 25 bp, Rattus norvegicus
ggtgtgtcagaactggacccactcc

SEQ ID NO: 470773 - DNA, 25 bp, Rattus norvegicus
ggtgtgtcagaagtggacccactcc

SEQ ID NO: 470774 - DNA, 25 bp, Rattus norvegicus
ggtgtgtccacgaataaacatctag

SEQ ID NO: 470775 - DNA, 25 bp, Rattus norvegicus
ggtgtgtccacgtataaacatctag

SEQ ID NO: 470776 - DNA, 25 bp, Rattus norvegicus
ggtgtgtcttccattggtttacaat

SEQ ID NO: 470777 - DNA, 25 bp, Rattus norvegicus
ggtgtgtcttcctttggtttacaat

SEQ ID NO: 470778 - DNA, 25 bp, Rattus norvegicus
ggtgtgtgaagaagacaactacagt

SEQ ID NO: 470779 - DNA, 25 bp, Rattus norvegicus
ggtgtgtgaagatgacaactacagt

SEQ ID NO: 470780 - DNA, 25 bp, Rattus norvegicus
ggtgtgtgcagaatagtgtctcatc

SEQ ID NO: 470781 - DNA, 25 bp, Rattus norvegicus
ggtgtgtgcagattagtgtctcatc

SEQ ID NO: 470782 - DNA, 25 bp, Rattus norvegicus
ggtgtgtgccagactgacaagcgca

SEQ ID NO: 470783 - DNA, 25 bp, Rattus norvegicus
ggtgtgtgccagtctgacaagcgca

SEQ ID NO: 470784 - DNA, 25 bp, Rattus norvegicus
ggtgtgtgccatcatgctgagcaaa

SEQ ID NO: 470785 - DNA, 25 bp, Rattus norvegicus
ggtgtgtgccatgatgctgagcaaa

SEQ ID NO: 470786 - DNA, 25 bp, Rattus norvegicus
ggtgtgtgcgatacctgagaactcc

SEQ ID NO: 470787 - DNA, 25 bp, Rattus norvegicus
ggtgtgtgcgattcctgagaactcc

SEQ ID NO: 470788 - DNA, 25 bp, Rattus norvegicus
ggtgtgtgggtactttttactcagc

SEQ ID NO: 470789 - DNA, 25 bp, Rattus norvegicus
ggtgtgtgggtagtttttactcagc

SEQ ID NO: 470790 - DNA, 25 bp, Rattus norvegicus
ggtgtgtgtaccctctgtaatcaga

SEQ ID NO: 470791 - DNA, 25 bp, Rattus norvegicus
ggtgtgtgtaccgtctgtaatcaga

SEQ ID NO: 470792 - DNA, 25 bp, Rattus norvegicus
ggtgtgtgtagaactttcccataac

SEQ ID NO: 470793 - DNA, 25 bp, Rattus norvegicus
ggtgtgtgtagatctttcccataac

SEQ ID NO: 470794 - DNA, 25 bp, Rattus norvegicus
ggtgtgtgtatgatcaattcatagc

SEQ ID NO: 470795 - DNA, 25 bp, Rattus norvegicus
ggtgtgtgtatgttcaattcatagc

SEQ ID NO: 470796 - DNA, 25 bp, Rattus norvegicus
ggtgtgtgttaactttgtctggtaa

SEQ ID NO: 470797 - DNA, 25 bp, Rattus norvegicus
ggtgtgtgttaagtttgtctggtaa

SEQ ID NO: 470798 - DNA, 25 bp, Rattus norvegicus
ggtgtgtgttacagattacttctac

SEQ ID NO: 470799 - DNA, 25 bp, Rattus norvegicus
ggtgtgtgttactgattacttctac

SEQ ID NO: 470800 - DNA, 25 bp, Rattus norvegicus
ggtgtgttaacaattccacgacagt

SEQ ID NO: 470801 - DNA, 25 bp, Rattus norvegicus
ggtgtgttaacatttccacgacagt

SEQ ID NO: 470802 - DNA, 25 bp, Rattus norvegicus
ggtgtgttaccacttctgcatatat

SEQ ID NO: 470803 - DNA, 25 bp, Rattus norvegicus
ggtgtgttaccagttctgcatatat

SEQ ID NO: 470804 - DNA, 25 bp, Rattus norvegicus
ggtgtgttactgataaggactgctg

SEQ ID NO: 470805 - DNA, 25 bp, Rattus norvegicus
ggtgtgttactgttaaggactgctg

SEQ ID NO: 470806 - DNA, 25 bp, Rattus norvegicus
ggtgtgttcaacactcagactgttg

SEQ ID NO: 470807 - DNA, 25 bp, Rattus norvegicus
ggtgtgttcaactctcagactgttg

SEQ ID NO: 470808 - DNA, 25 bp, Rattus norvegicus
ggtgtgttcatcagtcttaggtgat

SEQ ID NO: 470809 - DNA, 25 bp, Rattus norvegicus
ggtgtgttcatctgtcttaggtgat

SEQ ID NO: 470810 - DNA, 25 bp, Rattus norvegicus
ggtgtgttcctgagaatctttcctt

SEQ ID NO: 470811 - DNA, 25 bp, Rattus norvegicus
ggtgtgttcctgtgaatctttcctt

SEQ ID NO: 470812 - DNA, 25 bp, Rattus norvegicus
ggtgtgttcgacatccacttataag

SEQ ID NO: 470813 - DNA, 25 bp, Rattus norvegicus
ggtgtgttcgacttccacttataag

SEQ ID NO: 470814 - DNA, 25 bp, Rattus norvegicus
ggtgtgttctatacatagcgctaca

SEQ ID NO: 470815 - DNA, 25 bp, Rattus norvegicus
ggtgtgttctattcatagcgctaca

SEQ ID NO: 470816 - DNA, 25 bp, Rattus norvegicus
ggtgtgttctctcctactctttttt

SEQ ID NO: 470817 - DNA, 25 bp, Rattus norvegicus
ggtgtgttctctgctactctttttt

SEQ ID NO: 470818 - DNA, 25 bp, Rattus norvegicus
ggtgtgttgacaccatccgctgtaa

SEQ ID NO: 470819 - DNA, 25 bp, Rattus norvegicus
ggtgtgttgacagcatccgctgtaa

SEQ ID NO: 470820 - DNA, 25 bp, Rattus norvegicus
ggtgtgttgaccaattggacctcta

SEQ ID NO: 470821 - DNA, 25 bp, Rattus norvegicus
ggtgtgttgacctattggacctcta

SEQ ID NO: 470822 - DNA, 25 bp, Rattus norvegicus
ggtgtgttgttgagttcccagctgc

SEQ ID NO: 470823 - DNA, 25 bp, Rattus norvegicus
ggtgtgttgttgtgttcccagctgc

SEQ ID NO: 470824 - DNA, 25 bp, Rattus norvegicus
ggtgtgtttacaaaagccgtcagca

SEQ ID NO: 470825 - DNA, 25 bp, Rattus norvegicus
ggtgtgtttacataagccgtcagca

SEQ ID NO: 470826 - DNA, 25 bp, Rattus norvegicus
ggtgtgtttactcatccagcccata

SEQ ID NO: 470827 - DNA, 25 bp, Rattus norvegicus
ggtgtgtttactgatccagcccata

SEQ ID NO: 470828 - DNA, 25 bp, Rattus norvegicus
ggtgtgtttcctctctattttatga

SEQ ID NO: 470829 - DNA, 25 bp, Rattus norvegicus
ggtgtgtttcctgtctattttatga

SEQ ID NO: 470830 - DNA, 25 bp, Rattus norvegicus
ggtgtgtttctaatcttacccgaat

SEQ ID NO: 470831 - DNA, 25 bp, Rattus norvegicus
ggtgtgtttctattcttacccgaat

SEQ ID NO: 470832 - DNA, 25 bp, Rattus norvegicus
ggtgtgtttgaccatcggatgaaat

SEQ ID NO: 470833 - DNA, 25 bp, Rattus norvegicus
ggtgtgtttgacgatcggatgaaat

SEQ ID NO: 470834 - DNA, 25 bp, Rattus norvegicus
ggtgtgtttgagacttctccttatc

SEQ ID NO: 470835 - DNA, 25 bp, Rattus norvegicus
ggtgtgtttgagtcttctccttatc

SEQ ID NO: 470836 - DNA, 25 bp, Rattus norvegicus
ggtgttaaccatcacatccggacag

SEQ ID NO: 470837 - DNA, 25 bp, Rattus norvegicus
ggtgttaaccatgacatccggacag

SEQ ID NO: 470838 - DNA, 25 bp, Rattus norvegicus
ggtgttaagtgaactcagccagcat

SEQ ID NO: 470839 - DNA, 25 bp, Rattus norvegicus
ggtgttaagtgatctcagccagcat

SEQ ID NO: 470840 - DNA, 25 bp, Rattus norvegicus
ggtgttaagttccacattccaatgc

SEQ ID NO: 470841 - DNA, 25 bp, Rattus norvegicus
ggtgttaagttcgacattccaatgc

SEQ ID NO: 470842 - DNA, 25 bp, Rattus norvegicus
ggtgttaataccctcagagctgtga

SEQ ID NO: 470843 - DNA, 25 bp, Rattus norvegicus
ggtgttaataccgtcagagctgtga

SEQ ID NO: 470844 - DNA, 25 bp, Rattus norvegicus
ggtgttaatgacctgcaacatggta

SEQ ID NO: 470845 - DNA, 25 bp, Rattus norvegicus
ggtgttaatgacgtgcaacatggta

SEQ ID NO: 470846 - DNA, 25 bp, Rattus norvegicus
ggtgttacaataaccatctagcctc

SEQ ID NO: 470847 - DNA, 25 bp, Rattus norvegicus
ggtgttacaatatccatctagcctc

SEQ ID NO: 470848 - DNA, 25 bp, Rattus norvegicus
ggtgttacagtaaccagctgccagt

SEQ ID NO: 470849 - DNA, 25 bp, Rattus norvegicus
ggtgttacagtatccagctgccagt

SEQ ID NO: 470850 - DNA, 25 bp, Rattus norvegicus
ggtgttacagttatgccttacattg

SEQ ID NO: 470851 - DNA, 25 bp, Rattus norvegicus
ggtgttacagttttgccttacattg

SEQ ID NO: 470852 - DNA, 25 bp, Rattus norvegicus
ggtgttaccaagaacagatctcaat

SEQ ID NO: 470853 - DNA, 25 bp, Rattus norvegicus
ggtgttaccaagtacagatctcaat

SEQ ID NO: 470854 - DNA, 25 bp, Rattus norvegicus
ggtgttaccctgcagacaaaggtta

SEQ ID NO: 470855 - DNA, 25 bp, Rattus norvegicus
ggtgttaccctggagacaaaggtta

SEQ ID NO: 470856 - DNA, 25 bp, Rattus norvegicus
ggtgttactcagagaaccatcttga

SEQ ID NO: 470857 - DNA, 25 bp, Rattus norvegicus
ggtgttactcagtgaaccatcttga

SEQ ID NO: 470858 - DNA, 25 bp, Rattus norvegicus
ggtgttacttacacagtccagaatg

SEQ ID NO: 470859 - DNA, 25 bp, Rattus norvegicus
ggtgttacttactcagtccagaatg

SEQ ID NO: 470860 - DNA, 25 bp, Rattus norvegicus
ggtgttactttgatccaatcttccc

SEQ ID NO: 470861 - DNA, 25 bp, Rattus norvegicus
ggtgttactttgttccaatcttccc

SEQ ID NO: 470862 - DNA, 25 bp, Rattus norvegicus
ggtgttagacacattgccttagttt

SEQ ID NO: 470863 - DNA, 25 bp, Rattus norvegicus
ggtgttagacactttgccttagttt

SEQ ID NO: 470864 - DNA, 25 bp, Rattus norvegicus
ggtgttagctttagtgttactctgt

SEQ ID NO: 470865 - DNA, 25 bp, Rattus norvegicus
ggtgttagcttttgtgttactctgt

SEQ ID NO: 470866 - DNA, 25 bp, Rattus norvegicus
ggtgttatcaccaagctgaatgttt

SEQ ID NO: 470867 - DNA, 25 bp, Rattus norvegicus
ggtgttatcacctagctgaatgttt

SEQ ID NO: 470868 - DNA, 25 bp, Rattus norvegicus
ggtgttatccaccttttcattcgtg

SEQ ID NO: 470869 - DNA, 25 bp, Rattus norvegicus
ggtgttatccacgttttcattcgtg

SEQ ID NO: 470870 - DNA, 25 bp, Rattus norvegicus
ggtgttatgaagacagtctccctcc

SEQ ID NO: 470871 - DNA, 25 bp, Rattus norvegicus
ggtgttatgaagtcagtctccctcc

SEQ ID NO: 470872 - DNA, 25 bp, Rattus norvegicus
ggtgttattccacaggttacaagaa

SEQ ID NO: 470873 - DNA, 25 bp, Rattus norvegicus
ggtgttattccagaggttacaagaa

SEQ ID NO: 470874 - DNA, 25 bp, Rattus norvegicus
ggtgttattctcatgtttgggaaat

SEQ ID NO: 470875 - DNA, 25 bp, Rattus norvegicus
ggtgttattctcttgtttgggaaat

SEQ ID NO: 470876 - DNA, 25 bp, Rattus norvegicus
ggtgttattttaactgctcacttta

SEQ ID NO: 470877 - DNA, 25 bp, Rattus norvegicus
ggtgttattttatctgctcacttta

SEQ ID NO: 470878 - DNA, 25 bp, Rattus norvegicus
ggtgttcaacctctatcatgcccaa

SEQ ID NO: 470879 - DNA, 25 bp, Rattus norvegicus
ggtgttcaacctgtatcatgcccaa

SEQ ID NO: 470880 - DNA, 25 bp, Rattus norvegicus
ggtgttcacaagatccagtcaggaa

SEQ ID NO: 470881 - DNA, 25 bp, Rattus norvegicus
ggtgttcacaagttccagtcaggaa

SEQ ID NO: 470882 - DNA, 25 bp, Rattus norvegicus
ggtgttcaccgtagagaattgctta

SEQ ID NO: 470883 - DNA, 25 bp, Rattus norvegicus
ggtgttcaccgttgagaattgctta

SEQ ID NO: 470884 - DNA, 25 bp, Rattus norvegicus
ggtgttcacctacatcgctagagaa

SEQ ID NO: 470885 - DNA, 25 bp, Rattus norvegicus
ggtgttcacctagatcgctagagaa

SEQ ID NO: 470886 - DNA, 25 bp, Rattus norvegicus
ggtgttcaccttagatattagccat

SEQ ID NO: 470887 - DNA, 25 bp, Rattus norvegicus
ggtgttcacctttgatattagccat

SEQ ID NO: 470888 - DNA, 25 bp, Rattus norvegicus
ggtgttcacggaatcaggcatccat

SEQ ID NO: 470889 - DNA, 25 bp, Rattus norvegicus
ggtgttcacggattcaggcatccat

SEQ ID NO: 470890 - DNA, 25 bp, Rattus norvegicus
ggtgttcagagtaagccatggagct

SEQ ID NO: 470891 - DNA, 25 bp, Rattus norvegicus
ggtgttcagagttagccatggagct

SEQ ID NO: 470892 - DNA, 25 bp, Rattus norvegicus
ggtgttccacaacaagagtctcatc

SEQ ID NO: 470893 - DNA, 25 bp, Rattus norvegicus
ggtgttccacaagaagagtctcatc

SEQ ID NO: 470894 - DNA, 25 bp, Rattus norvegicus
ggtgttccagttacttcttgaagta

SEQ ID NO: 470895 - DNA, 25 bp, Rattus norvegicus
ggtgttccagtttcttcttgaagta

SEQ ID NO: 470896 - DNA, 25 bp, Rattus norvegicus
ggtgttcccctacttctagcatgag

SEQ ID NO: 470897 - DNA, 25 bp, Rattus norvegicus
ggtgttcccctagttctagcatgag

SEQ ID NO: 470898 - DNA, 25 bp, Rattus norvegicus
ggtgttcctcagaacttcagagttg

SEQ ID NO: 470899 - DNA, 25 bp, Rattus norvegicus
ggtgttcctcagtacttcagagttg

SEQ ID NO: 470900 - DNA, 25 bp, Rattus norvegicus
ggtgttcctccaaatgccttcagaa

SEQ ID NO: 470901 - DNA, 25 bp, Rattus norvegicus
ggtgttcctccatatgccttcagaa

SEQ ID NO: 470902 - DNA, 25 bp, Rattus norvegicus
ggtgttcctctaactgggttgtaat

SEQ ID NO: 470903 - DNA, 25 bp, Rattus norvegicus
ggtgttcctctatctgggttgtaat

SEQ ID NO: 470904 - DNA, 25 bp, Rattus norvegicus
ggtgttcctgatccgaatggttcgc

SEQ ID NO: 470905 - DNA, 25 bp, Rattus norvegicus
ggtgttcctgatgcgaatggttcgc

SEQ ID NO: 470906 - DNA, 25 bp, Rattus norvegicus
ggtgttcctggccatttgattctac

SEQ ID NO: 470907 - DNA, 25 bp, Rattus norvegicus
ggtgttcctggcgatttgattctac

SEQ ID NO: 470908 - DNA, 25 bp, Rattus norvegicus
ggtgttcctgtcatagaatagctac

SEQ ID NO: 470909 - DNA, 25 bp, Rattus norvegicus
ggtgttcctgtcttagaatagctac

SEQ ID NO: 470910 - DNA, 25 bp, Rattus norvegicus
ggtgttccttttaacatgcaaagtt

SEQ ID NO: 470911 - DNA, 25 bp, Rattus norvegicus
ggtgttcctttttacatgcaaagtt

SEQ ID NO: 470912 - DNA, 25 bp, Rattus norvegicus
ggtgttcgcgatcagtttacccctc

SEQ ID NO: 470913 - DNA, 25 bp, Rattus norvegicus
ggtgttcgcgatgagtttacccctc

SEQ ID NO: 470914 - DNA, 25 bp, Rattus norvegicus
ggtgttctaatcagtccattgcatg

SEQ ID NO: 470915 - DNA, 25 bp, Rattus norvegicus
ggtgttctaatctgtccattgcatg

SEQ ID NO: 470916 - DNA, 25 bp, Rattus norvegicus
ggtgttctaattatctgtgagcaca

SEQ ID NO: 470917 - DNA, 25 bp, Rattus norvegicus
ggtgttctaattttctgtgagcaca

SEQ ID NO: 470918 - DNA, 25 bp, Rattus norvegicus
ggtgttctagaaccatttgcataca

SEQ ID NO: 470919 - DNA, 25 bp, Rattus norvegicus
ggtgttctagaagcatttgcataca

SEQ ID NO: 470920 - DNA, 25 bp, Rattus norvegicus
ggtgttctcaaaccttttctagtaa

SEQ ID NO: 470921 - DNA, 25 bp, Rattus norvegicus
ggtgttctcaaagcttttctagtaa

SEQ ID NO: 470922 - DNA, 25 bp, Rattus norvegicus
ggtgttctcagacttcggtttccca

SEQ ID NO: 470923 - DNA, 25 bp, Rattus norvegicus
ggtgttctcagagttcggtttccca

SEQ ID NO: 470924 - DNA, 25 bp, Rattus norvegicus
ggtgttctcagtcatcttcatgatg

SEQ ID NO: 470925 - DNA, 25 bp, Rattus norvegicus
ggtgttctcagtgatcttcatgatg

SEQ ID NO: 470926 - DNA, 25 bp, Rattus norvegicus
ggtgttctctacatgatgctgttct

SEQ ID NO: 470927 - DNA, 25 bp, Rattus norvegicus
ggtgttctctacttgatgctgttct

SEQ ID NO: 470928 - DNA, 25 bp, Rattus norvegicus
ggtgttctctgtcaatggaaggaaa

SEQ ID NO: 470929 - DNA, 25 bp, Rattus norvegicus
ggtgttctctgtgaatggaaggaaa

SEQ ID NO: 470930 - DNA, 25 bp, Rattus norvegicus
ggtgttctgacaacatccttaatgt

SEQ ID NO: 470931 - DNA, 25 bp, Rattus norvegicus
ggtgttctgacatcatccttaatgt

SEQ ID NO: 470932 - DNA, 25 bp, Rattus norvegicus
ggtgttctgagaccagttccactgc

SEQ ID NO: 470933 - DNA, 25 bp, Rattus norvegicus
ggtgttctgagagcagttccactgc

SEQ ID NO: 470934 - DNA, 25 bp, Rattus norvegicus
ggtgttctgcttatcaaagtcgctg

SEQ ID NO: 470935 - DNA, 25 bp, Rattus norvegicus
ggtgttctgcttttcaaagtcgctg

SEQ ID NO: 470936 - DNA, 25 bp, Rattus norvegicus
ggtgttctgtgaattcccgtatgac

SEQ ID NO: 470937 - DNA, 25 bp, Rattus norvegicus
ggtgttctgtgatttcccgtatgac

SEQ ID NO: 470938 - DNA, 25 bp, Rattus norvegicus
ggtgttctgtttcaacttgcagctt

SEQ ID NO: 470939 - DNA, 25 bp, Rattus norvegicus
ggtgttctgtttgaacttgcagctt

SEQ ID NO: 470940 - DNA, 25 bp, Rattus norvegicus
ggtgttcttaacatgatcatggtca

SEQ ID NO: 470941 - DNA, 25 bp, Rattus norvegicus
ggtgttcttaacttgatcatggtca

SEQ ID NO: 470942 - DNA, 25 bp, Rattus norvegicus
ggtgttcttcgtcaagtttggctac

SEQ ID NO: 470943 - DNA, 25 bp, Rattus norvegicus
ggtgttcttcgtgaagtttggctac

SEQ ID NO: 470944 - DNA, 25 bp, Rattus norvegicus
ggtgttcttgggaggcgcagtccta

SEQ ID NO: 470945 - DNA, 25 bp, Rattus norvegicus
ggtgttcttgggtggcgcagtccta

SEQ ID NO: 470946 - DNA, 25 bp, Rattus norvegicus
ggtgttctttctacacatttttctt

SEQ ID NO: 470947 - DNA, 25 bp, Rattus norvegicus
ggtgttctttcttcacatttttctt

SEQ ID NO: 470948 - DNA, 25 bp, Rattus norvegicus
ggtgttgaacacagcagccagttac

SEQ ID NO: 470949 - DNA, 25 bp, Rattus norvegicus
ggtgttgaacactgcagccagttac

SEQ ID NO: 470950 - DNA, 25 bp, Rattus norvegicus
ggtgttgaattaacccacaggcatc

SEQ ID NO: 470951 - DNA, 25 bp, Rattus norvegicus
ggtgttgaattatcccacaggcatc

SEQ ID NO: 470952 - DNA, 25 bp, Rattus norvegicus
ggtgttgaccaaaaatcgttctctg

SEQ ID NO: 470953 - DNA, 25 bp, Rattus norvegicus
ggtgttgaccaataatcgttctctg

SEQ ID NO: 470954 - DNA, 25 bp, Rattus norvegicus
ggtgttgaccacacgtatcccagga

SEQ ID NO: 470955 - DNA, 25 bp, Rattus norvegicus
ggtgttgaccactcgtatcccagga

SEQ ID NO: 470956 - DNA, 25 bp, Rattus norvegicus
ggtgttgagccacccatcagaccct

SEQ ID NO: 470957 - DNA, 25 bp, Rattus norvegicus
ggtgttgagccagccatcagaccct

SEQ ID NO: 470958 - DNA, 25 bp, Rattus norvegicus
ggtgttgagtccagtctttctcata

SEQ ID NO: 470959 - DNA, 25 bp, Rattus norvegicus
ggtgttgagtcctgtctttctcata

SEQ ID NO: 470960 - DNA, 25 bp, Rattus norvegicus
ggtgttgataccatgcagtctaata

SEQ ID NO: 470961 - DNA, 25 bp, Rattus norvegicus
ggtgttgataccttgcagtctaata

SEQ ID NO: 470962 - DNA, 25 bp, Rattus norvegicus
ggtgttgatagacaccatggctcat

SEQ ID NO: 470963 - DNA, 25 bp, Rattus norvegicus
ggtgttgatagagaccatggctcat

SEQ ID NO: 470964 - DNA, 25 bp, Rattus norvegicus
ggtgttgcacttatcaaaaatcttg

SEQ ID NO: 470965 - DNA, 25 bp, Rattus norvegicus
ggtgttgcacttttcaaaaatcttg

SEQ ID NO: 470966 - DNA, 25 bp, Rattus norvegicus
ggtgttgcatacctactatgtgtaa

SEQ ID NO: 470967 - DNA, 25 bp, Rattus norvegicus
ggtgttgcatacgtactatgtgtaa

SEQ ID NO: 470968 - DNA, 25 bp, Rattus norvegicus
ggtgttgccgttcctagtagaagtc

SEQ ID NO: 470969 - DNA, 25 bp, Rattus norvegicus
ggtgttgccgttgctagtagaagtc

SEQ ID NO: 470970 - DNA, 25 bp, Rattus norvegicus
ggtgttgcctttactgaactcagac

SEQ ID NO: 470971 - DNA, 25 bp, Rattus norvegicus
ggtgttgcctttcatgaagataagc

SEQ ID NO: 470972 - DNA, 25 bp, Rattus norvegicus
ggtgttgcctttgatgaagataagc

SEQ ID NO: 470973 - DNA, 25 bp, Rattus norvegicus
ggtgttgccttttctgaactcagac

SEQ ID NO: 470974 - DNA, 25 bp, Rattus norvegicus
ggtgttgctggaccttcagagttac

SEQ ID NO: 470975 - DNA, 25 bp, Rattus norvegicus
ggtgttgctggagcttcagagttac

SEQ ID NO: 470976 - DNA, 25 bp, Rattus norvegicus
ggtgttgctgtaatgtgacagcgaa

SEQ ID NO: 470977 - DNA, 25 bp, Rattus norvegicus
ggtgttgctgtattgtgacagcgaa

SEQ ID NO: 470978 - DNA, 25 bp, Rattus norvegicus
ggtgttggaaacattctccggaaca

SEQ ID NO: 470979 - DNA, 25 bp, Rattus norvegicus
ggtgttggaaactttctccggaaca

SEQ ID NO: 470980 - DNA, 25 bp, Rattus norvegicus
ggtgttggacacaaattcccagcat

SEQ ID NO: 470981 - DNA, 25 bp, Rattus norvegicus
ggtgttggacacacccacaggcaga

SEQ ID NO: 470982 - DNA, 25 bp, Rattus norvegicus
ggtgttggacactaattcccagcat

SEQ ID NO: 470983 - DNA, 25 bp, Rattus norvegicus
ggtgttggacactcccacaggcaga

SEQ ID NO: 470984 - DNA, 25 bp, Rattus norvegicus
ggtgttggacttataatcagctgaa

SEQ ID NO: 470985 - DNA, 25 bp, Rattus norvegicus
ggtgttggacttttaatcagctgaa

SEQ ID NO: 470986 - DNA, 25 bp, Rattus norvegicus
ggtgttggcatcaggactgccagtt

SEQ ID NO: 470987 - DNA, 25 bp, Rattus norvegicus
ggtgttggcatctggactgccagtt

SEQ ID NO: 470988 - DNA, 25 bp, Rattus norvegicus
ggtgttggtcccagaagactattca

SEQ ID NO: 470989 - DNA, 25 bp, Rattus norvegicus
ggtgttggtccctgaagactattca

SEQ ID NO: 470990 - DNA, 25 bp, Rattus norvegicus
ggtgttggtcttagttgatttctgt

SEQ ID NO: 470991 - DNA, 25 bp, Rattus norvegicus
ggtgttggtctttgttgatttctgt

SEQ ID NO: 470992 - DNA, 25 bp, Rattus norvegicus
ggtgttgtacagcattcactacagc

SEQ ID NO: 470993 - DNA, 25 bp, Rattus norvegicus
ggtgttgtacaggattcactacagc

SEQ ID NO: 470994 - DNA, 25 bp, Rattus norvegicus
ggtgttgtatttccctcttgtaaat

SEQ ID NO: 470995 - DNA, 25 bp, Rattus norvegicus
ggtgttgtatttgcctcttgtaaat

SEQ ID NO: 470996 - DNA, 25 bp, Rattus norvegicus
ggtgttgtccatcttttacatttag

SEQ ID NO: 470997 - DNA, 25 bp, Rattus norvegicus
ggtgttgtccatgttttacatttag

SEQ ID NO: 470998 - DNA, 25 bp, Rattus norvegicus
ggtgttgtctggaatactttttctc

SEQ ID NO: 470999 - DNA, 25 bp, Rattus norvegicus
ggtgttgtctggtatactttttctc

SEQ ID NO: 471000 - DNA, 25 bp, Rattus norvegicus
ggtgttgtgcgcatttttcctcagt

SEQ ID NO: 471001 - DNA, 25 bp, Rattus norvegicus
ggtgttgtgcgcttttttcctcagt

SEQ ID NO: 471002 - DNA, 25 bp, Rattus norvegicus
ggtgttgttctccttgatcagcatc

SEQ ID NO: 471003 - DNA, 25 bp, Rattus norvegicus
ggtgttgttctcgttgatcagcatc

SEQ ID NO: 471004 - DNA, 25 bp, Rattus norvegicus
ggtgttgttgaaagtcatggcgccc

SEQ ID NO: 471005 - DNA, 25 bp, Rattus norvegicus
ggtgttgttgaatgtcatggcgccc

SEQ ID NO: 471006 - DNA, 25 bp, Rattus norvegicus
ggtgttgttttccacagtttaagct

SEQ ID NO: 471007 - DNA, 25 bp, Rattus norvegicus
ggtgttgttttcgacagtttaagct

SEQ ID NO: 471008 - DNA, 25 bp, Rattus norvegicus
ggtgtttaaggcactgctgttgatt

SEQ ID NO: 471009 - DNA, 25 bp, Rattus norvegicus
ggtgtttaaggctctgctgttgatt

SEQ ID NO: 471010 - DNA, 25 bp, Rattus norvegicus
ggtgtttaccaaccgtgcgggcaat

SEQ ID NO: 471011 - DNA, 25 bp, Rattus norvegicus
ggtgtttaccaagcgtgcgggcaat

SEQ ID NO: 471012 - DNA, 25 bp, Rattus norvegicus
ggtgtttatatccacgaccatgaga

SEQ ID NO: 471013 - DNA, 25 bp, Rattus norvegicus
ggtgtttatatcgacgaccatgaga

SEQ ID NO: 471014 - DNA, 25 bp, Rattus norvegicus
ggtgtttatattactgtcaccataa

SEQ ID NO: 471015 - DNA, 25 bp, Rattus norvegicus
ggtgtttatatttctgtcaccataa

SEQ ID NO: 471016 - DNA, 25 bp, Rattus norvegicus
ggtgtttattctaggttagtcgtca

SEQ ID NO: 471017 - DNA, 25 bp, Rattus norvegicus
ggtgtttattcttggttagtcgtca

SEQ ID NO: 471018 - DNA, 25 bp, Rattus norvegicus
ggtgtttattgcagctccagagcta

SEQ ID NO: 471019 - DNA, 25 bp, Rattus norvegicus
ggtgtttattgctgctccagagcta

SEQ ID NO: 471020 - DNA, 25 bp, Rattus norvegicus
ggtgtttcagagactcctggagtat

SEQ ID NO: 471021 - DNA, 25 bp, Rattus norvegicus
ggtgtttcagagtctcctggagtat

SEQ ID NO: 471022 - DNA, 25 bp, Rattus norvegicus
ggtgtttcagcaaaagtggcattca

SEQ ID NO: 471023 - DNA, 25 bp, Rattus norvegicus
ggtgtttcagcataagtggcattca

SEQ ID NO: 471024 - DNA, 25 bp, Rattus norvegicus
ggtgtttccaacctatttggtcctg

SEQ ID NO: 471025 - DNA, 25 bp, Rattus norvegicus
ggtgtttccaacgtatttggtcctg

SEQ ID NO: 471026 - DNA, 25 bp, Rattus norvegicus
ggtgtttcccatatcaagatttcca

SEQ ID NO: 471027 - DNA, 25 bp, Rattus norvegicus
ggtgtttcccatttcaagatttcca

SEQ ID NO: 471028 - DNA, 25 bp, Rattus norvegicus
ggtgtttccctgaatgaatctccag

SEQ ID NO: 471029 - DNA, 25 bp, Rattus norvegicus
ggtgtttccctgtatgaatctccag

SEQ ID NO: 471030 - DNA, 25 bp, Rattus norvegicus
ggtgtttcctagatctactcagtac

SEQ ID NO: 471031 - DNA, 25 bp, Rattus norvegicus
ggtgtttcctagttctactcagtac

SEQ ID NO: 471032 - DNA, 25 bp, Rattus norvegicus
ggtgtttcctatcaaagcctctcac

SEQ ID NO: 471033 - DNA, 25 bp, Rattus norvegicus
ggtgtttcctatgaaagcctctcac

SEQ ID NO: 471034 - DNA, 25 bp, Rattus norvegicus
ggtgtttcggagacagtgcatccga

SEQ ID NO: 471035 - DNA, 25 bp, Rattus norvegicus
ggtgtttcggagtcagtgcatccga

SEQ ID NO: 471036 - DNA, 25 bp, Rattus norvegicus
ggtgtttctatgaaaacctgtggca

SEQ ID NO: 471037 - DNA, 25 bp, Rattus norvegicus
ggtgtttctatgtaaacctgtggca

SEQ ID NO: 471038 - DNA, 25 bp, Rattus norvegicus
ggtgtttctctgatcgtgttcccaa

SEQ ID NO: 471039 - DNA, 25 bp, Rattus norvegicus
ggtgtttctctgttcgtgttcccaa

SEQ ID NO: 471040 - DNA, 25 bp, Rattus norvegicus
ggtgtttctgtaccaagttttcata

SEQ ID NO: 471041 - DNA, 25 bp, Rattus norvegicus
ggtgtttctgtagcaagttttcata

SEQ ID NO: 471042 - DNA, 25 bp, Rattus norvegicus
ggtgtttctgttcaaatgcatcctc

SEQ ID NO: 471043 - DNA, 25 bp, Rattus norvegicus
ggtgtttctgttgaaatgcatcctc

SEQ ID NO: 471044 - DNA, 25 bp, Rattus norvegicus
ggtgtttgagatacattccacttga

SEQ ID NO: 471045 - DNA, 25 bp, Rattus norvegicus
ggtgtttgagattcattccacttga

SEQ ID NO: 471046 - DNA, 25 bp, Rattus norvegicus
ggtgtttgagcacctgagacagcca

SEQ ID NO: 471047 - DNA, 25 bp, Rattus norvegicus
ggtgtttgagcagctgagacagcca

SEQ ID NO: 471048 - DNA, 25 bp, Rattus norvegicus
ggtgtttgagtaccacaacgtcctg

SEQ ID NO: 471049 - DNA, 25 bp, Rattus norvegicus
ggtgtttgagtagcacaacgtcctg

SEQ ID NO: 471050 - DNA, 25 bp, Rattus norvegicus
ggtgtttgatccatggagctggcat

SEQ ID NO: 471051 - DNA, 25 bp, Rattus norvegicus
ggtgtttgatccttggagctggcat

SEQ ID NO: 471052 - DNA, 25 bp, Rattus norvegicus
ggtgtttgccagacgacatgtgtct

SEQ ID NO: 471053 - DNA, 25 bp, Rattus norvegicus
ggtgtttgccagtcgacatgtgtct

SEQ ID NO: 471054 - DNA, 25 bp, Rattus norvegicus
ggtgtttgcttccatctaggacacc

SEQ ID NO: 471055 - DNA, 25 bp, Rattus norvegicus
ggtgtttgcttcgatctaggacacc

SEQ ID NO: 471056 - DNA, 25 bp, Rattus norvegicus
ggtgtttggcacagtaccatagctg

SEQ ID NO: 471057 - DNA, 25 bp, Rattus norvegicus
ggtgtttggcactgtaccatagctg

SEQ ID NO: 471058 - DNA, 25 bp, Rattus norvegicus
ggtgtttggcctatgggttctcata

SEQ ID NO: 471059 - DNA, 25 bp, Rattus norvegicus
ggtgtttggcctttgggttctcata

SEQ ID NO: 471060 - DNA, 25 bp, Rattus norvegicus
ggtgttttacacatgttactttgct

SEQ ID NO: 471061 - DNA, 25 bp, Rattus norvegicus
ggtgttttacacttgttactttgct

SEQ ID NO: 471062 - DNA, 25 bp, Rattus norvegicus
ggtgttttagccacttggacaataa

SEQ ID NO: 471063 - DNA, 25 bp, Rattus norvegicus
ggtgttttagcctcttggacaataa

SEQ ID NO: 471064 - DNA, 25 bp, Rattus norvegicus
ggtgttttcaccaagaagctgagca

SEQ ID NO: 471065 - DNA, 25 bp, Rattus norvegicus
ggtgttttcacctagaagctgagca

SEQ ID NO: 471066 - DNA, 25 bp, Rattus norvegicus
ggtgttttctccaaataaccatgaa

SEQ ID NO: 471067 - DNA, 25 bp, Rattus norvegicus
ggtgttttctcctaataaccatgaa

SEQ ID NO: 471068 - DNA, 25 bp, Rattus norvegicus
ggtgttttctgaacttgcattgatt

SEQ ID NO: 471069 - DNA, 25 bp, Rattus norvegicus
ggtgttttctgatcttgcattgatt

SEQ ID NO: 471070 - DNA, 25 bp, Rattus norvegicus
ggtgttttcttacgtcagtgcttcc

SEQ ID NO: 471071 - DNA, 25 bp, Rattus norvegicus
ggtgttttcttaggtcagtgcttcc

SEQ ID NO: 471072 - DNA, 25 bp, Rattus norvegicus
ggtgttttcttcaaagggctcagcc

SEQ ID NO: 471073 - DNA, 25 bp, Rattus norvegicus
ggtgttttcttcagccataaggctt

SEQ ID NO: 471074 - DNA, 25 bp, Rattus norvegicus
ggtgttttcttctaagggctcagcc

SEQ ID NO: 471075 - DNA, 25 bp, Rattus norvegicus
ggtgttttcttctgccataaggctt

SEQ ID NO: 471076 - DNA, 25 bp, Rattus norvegicus
ggtgttttcttgaagttgacgtatc

SEQ ID NO: 471077 - DNA, 25 bp, Rattus norvegicus
ggtgttttcttgtagttgacgtatc

SEQ ID NO: 471078 - DNA, 25 bp, Rattus norvegicus
ggtgttttgcatactactgaaccaa

SEQ ID NO: 471079 - DNA, 25 bp, Rattus norvegicus
ggtgttttgcattctactgaaccaa

SEQ ID NO: 471080 - DNA, 25 bp, Rattus norvegicus
ggtgttttggttcaatctgcccagg

SEQ ID NO: 471081 - DNA, 25 bp, Rattus norvegicus
ggtgttttggttgaatctgcccagg

SEQ ID NO: 471082 - DNA, 25 bp, Rattus norvegicus
ggtgtttttacacattgccagacaa

SEQ ID NO: 471083 - DNA, 25 bp, Rattus norvegicus
ggtgtttttacagattgccagacaa

SEQ ID NO: 471084 - DNA, 25 bp, Rattus norvegicus
ggtgtttttcaactgttcattctat

SEQ ID NO: 471085 - DNA, 25 bp, Rattus norvegicus
ggtgtttttcaagtgttcattctat

SEQ ID NO: 471086 - DNA, 25 bp, Rattus norvegicus
ggttaaaacacaaattactattact

SEQ ID NO: 471087 - DNA, 25 bp, Rattus norvegicus
ggttaaaacacacacttcctgctct

SEQ ID NO: 471088 - DNA, 25 bp, Rattus norvegicus
ggttaaaacacagacttcctgctct

SEQ ID NO: 471089 - DNA, 25 bp, Rattus norvegicus
ggttaaaacacatattactattact

SEQ ID NO: 471090 - DNA, 25 bp, Rattus norvegicus
ggttaaaacctgaacggcagctcag

SEQ ID NO: 471091 - DNA, 25 bp, Rattus norvegicus
ggttaaaacctgtacggcagctcag

SEQ ID NO: 471092 - DNA, 25 bp, Rattus norvegicus
ggttaaaagtcacagttcccactga

SEQ ID NO: 471093 - DNA, 25 bp, Rattus norvegicus
ggttaaaagtcagagttcccactga

SEQ ID NO: 471094 - DNA, 25 bp, Rattus norvegicus
ggttaaaagtcccagctctgtgccc

SEQ ID NO: 471095 - DNA, 25 bp, Rattus norvegicus
ggttaaaagtccgagctctgtgccc

SEQ ID NO: 471096 - DNA, 25 bp, Rattus norvegicus
ggttaaaattgacttcaggccccat

SEQ ID NO: 471097 - DNA, 25 bp, Rattus norvegicus
ggttaaaattgagttcaggccccat

SEQ ID NO: 471098 - DNA, 25 bp, Rattus norvegicus
ggttaaaattgtatctcctgagctt

SEQ ID NO: 471099 - DNA, 25 bp, Rattus norvegicus
ggttaaaattgtttctcctgagctt

SEQ ID NO: 471100 - DNA, 25 bp, Rattus norvegicus
ggttaaacacttacagtactcctga

SEQ ID NO: 471101 - DNA, 25 bp, Rattus norvegicus
ggttaaacactttcagtactcctga

SEQ ID NO: 471102 - DNA, 25 bp, Rattus norvegicus
ggttaaagccttaggagcctctggt

SEQ ID NO: 471103 - DNA, 25 bp, Rattus norvegicus
ggttaaagcctttggagcctctggt

SEQ ID NO: 471104 - DNA, 25 bp, Rattus norvegicus
ggttaaagctggcatctggacctaa

SEQ ID NO: 471105 - DNA, 25 bp, Rattus norvegicus
ggttaaagctgggatctggacctaa

SEQ ID NO: 471106 - DNA, 25 bp, Rattus norvegicus
ggttaaaggagcacctgggctaaga

SEQ ID NO: 471107 - DNA, 25 bp, Rattus norvegicus
ggttaaaggagctcctgggctaaga

SEQ ID NO: 471108 - DNA, 25 bp, Rattus norvegicus
ggttaaaggcatctcccgcaatggc

SEQ ID NO: 471109 - DNA, 25 bp, Rattus norvegicus
ggttaaaggcatgtcccgcaatggc

SEQ ID NO: 471110 - DNA, 25 bp, Rattus norvegicus
ggttaaatccccatgctgaatcagg

SEQ ID NO: 471111 - DNA, 25 bp, Rattus norvegicus
ggttaaatccccttgctgaatcagg

SEQ ID NO: 471112 - DNA, 25 bp, Rattus norvegicus
ggttaaattactcccctatccactc

SEQ ID NO: 471113 - DNA, 25 bp, Rattus norvegicus
ggttaaattactgccctatccactc

SEQ ID NO: 471114 - DNA, 25 bp, Rattus norvegicus
ggttaacaaacccattccagccagc

SEQ ID NO: 471115 - DNA, 25 bp, Rattus norvegicus
ggttaacaaaccgattccagccagc

SEQ ID NO: 471116 - DNA, 25 bp, Rattus norvegicus
ggttaacagctgacgtctgaggcag

SEQ ID NO: 471117 - DNA, 25 bp, Rattus norvegicus
ggttaacagctgtcgtctgaggcag

SEQ ID NO: 471118 - DNA, 25 bp, Rattus norvegicus
ggttaacagtcgctggttgacccag

SEQ ID NO: 471119 - DNA, 25 bp, Rattus norvegicus
ggttaacagtcggtggttgacccag

SEQ ID NO: 471120 - DNA, 25 bp, Rattus norvegicus
ggttaaccaccacaaagtctgttag

SEQ ID NO: 471121 - DNA, 25 bp, Rattus norvegicus
ggttaaccaccagaaagtctgttag

SEQ ID NO: 471122 - DNA, 25 bp, Rattus norvegicus
ggttaaccctgaatgcatgtgctat

SEQ ID NO: 471123 - DNA, 25 bp, Rattus norvegicus
ggttaaccctgattgcatgtgctat

SEQ ID NO: 471124 - DNA, 25 bp, Rattus norvegicus
ggttaacctcaaattcagacatcta

SEQ ID NO: 471125 - DNA, 25 bp, Rattus norvegicus
ggttaacctcaatttcagacatcta

SEQ ID NO: 471126 - DNA, 25 bp, Rattus norvegicus
ggttaacctgctatatagacatgac

SEQ ID NO: 471127 - DNA, 25 bp, Rattus norvegicus
ggttaacctgctttatagacatgac

SEQ ID NO: 471128 - DNA, 25 bp, Rattus norvegicus
ggttaacgatgaatcctcactagtc

SEQ ID NO: 471129 - DNA, 25 bp, Rattus norvegicus
ggttaacgatgattcctcactagtc

SEQ ID NO: 471130 - DNA, 25 bp, Rattus norvegicus
ggttaacgttgacatggacattagt

SEQ ID NO: 471131 - DNA, 25 bp, Rattus norvegicus
ggttaacgttgagatggacattagt

SEQ ID NO: 471132 - DNA, 25 bp, Rattus norvegicus
ggttaactaaccctatttccagcat

SEQ ID NO: 471133 - DNA, 25 bp, Rattus norvegicus
ggttaactaacccttgctgacaagc

SEQ ID NO: 471134 - DNA, 25 bp, Rattus norvegicus
ggttaactaaccgtatttccagcat

SEQ ID NO: 471135 - DNA, 25 bp, Rattus norvegicus
ggttaactaaccgttgctgacaagc

SEQ ID NO: 471136 - DNA, 25 bp, Rattus norvegicus
ggttaactacttcattgacagccca

SEQ ID NO: 471137 - DNA, 25 bp, Rattus norvegicus
ggttaactacttgattgacagccca

SEQ ID NO: 471138 - DNA, 25 bp, Rattus norvegicus
ggttaactaggacattgctcagata

SEQ ID NO: 471139 - DNA, 25 bp, Rattus norvegicus
ggttaactaggagattgctcagata

SEQ ID NO: 471140 - DNA, 25 bp, Rattus norvegicus
ggttaactctagcaccctgtgtact

SEQ ID NO: 471141 - DNA, 25 bp, Rattus norvegicus
ggttaactctaggaccctgtgtact

SEQ ID NO: 471142 - DNA, 25 bp, Rattus norvegicus
ggttaactgtacaggccagagccct

SEQ ID NO: 471143 - DNA, 25 bp, Rattus norvegicus
ggttaactgtactggccagagccct

SEQ ID NO: 471144 - DNA, 25 bp, Rattus norvegicus
ggttaacttacaatcatgcgcggta

SEQ ID NO: 471145 - DNA, 25 bp, Rattus norvegicus
ggttaacttacattcatgcgcggta

SEQ ID NO: 471146 - DNA, 25 bp, Rattus norvegicus
ggttaacttgagacttgccttccat

SEQ ID NO: 471147 - DNA, 25 bp, Rattus norvegicus
ggttaacttgagtcttgccttccat

SEQ ID NO: 471148 - DNA, 25 bp, Rattus norvegicus
ggttaagaacatcggttgctcttcc

SEQ ID NO: 471149 - DNA, 25 bp, Rattus norvegicus
ggttaagaacatgggttgctcttcc

SEQ ID NO: 471150 - DNA, 25 bp, Rattus norvegicus
ggttaagaagccctttgccgctcat

SEQ ID NO: 471151 - DNA, 25 bp, Rattus norvegicus
ggttaagaagccgtttgccgctcat

SEQ ID NO: 471152 - DNA, 25 bp, Rattus norvegicus
ggttaagaatcacgccctgctgcca

SEQ ID NO: 471153 - DNA, 25 bp, Rattus norvegicus
ggttaagaatcaggccctgctgcca

SEQ ID NO: 471154 - DNA, 25 bp, Rattus norvegicus
ggttaagacctgctgttcttcatgg

SEQ ID NO: 471155 - DNA, 25 bp, Rattus norvegicus
ggttaagacctggtgttcttcatgg

SEQ ID NO: 471156 - DNA, 25 bp, Rattus norvegicus
ggttaagagcacagcgtcttctgac

SEQ ID NO: 471157 - DNA, 25 bp, Rattus norvegicus
ggttaagagcactgcgtcttctgac

SEQ ID NO: 471158 - DNA, 25 bp, Rattus norvegicus
ggttaagatgctactccagtgtaca

SEQ ID NO: 471159 - DNA, 25 bp, Rattus norvegicus
ggttaagatgcttctccagtgtaca

SEQ ID NO: 471160 - DNA, 25 bp, Rattus norvegicus
ggttaagatggcaagcacaccccaa

SEQ ID NO: 471161 - DNA, 25 bp, Rattus norvegicus
ggttaagatggctagcacaccccaa

SEQ ID NO: 471162 - DNA, 25 bp, Rattus norvegicus
ggttaagcacttagcaagcctggct

SEQ ID NO: 471163 - DNA, 25 bp, Rattus norvegicus
ggttaagcactttgcaagcctggct

SEQ ID NO: 471164 - DNA, 25 bp, Rattus norvegicus
ggttaagccaaccatgttttgcatt

SEQ ID NO: 471165 - DNA, 25 bp, Rattus norvegicus
ggttaagccaacgatgttttgcatt

SEQ ID NO: 471166 - DNA, 25 bp, Rattus norvegicus
ggttaagctgagacctaatcgatag

SEQ ID NO: 471167 - DNA, 25 bp, Rattus norvegicus
ggttaagctgagtcctaatcgatag

SEQ ID NO: 471168 - DNA, 25 bp, Rattus norvegicus
ggttaagtaggtctccagttggcta

SEQ ID NO: 471169 - DNA, 25 bp, Rattus norvegicus
ggttaagtaggtgtccagttggcta

SEQ ID NO: 471170 - DNA, 25 bp, Rattus norvegicus
ggttaagtcctaactctccaccgtg

SEQ ID NO: 471171 - DNA, 25 bp, Rattus norvegicus
ggttaagtcctatctctccaccgtg

SEQ ID NO: 471172 - DNA, 25 bp, Rattus norvegicus
ggttaagtcttgctgacccattgtc

SEQ ID NO: 471173 - DNA, 25 bp, Rattus norvegicus
ggttaagtcttggtgacccattgtc

SEQ ID NO: 471174 - DNA, 25 bp, Rattus norvegicus
ggttaagtgaggaccccttgattga

SEQ ID NO: 471175 - DNA, 25 bp, Rattus norvegicus
ggttaagtgaggtccccttgattga

SEQ ID NO: 471176 - DNA, 25 bp, Rattus norvegicus
ggttaagtggctcaagtcttcctca

SEQ ID NO: 471177 - DNA, 25 bp, Rattus norvegicus
ggttaagtggctgaagtcttcctca

SEQ ID NO: 471178 - DNA, 25 bp, Rattus norvegicus
ggttaatagcaaccgcttccctgta

SEQ ID NO: 471179 - DNA, 25 bp, Rattus norvegicus
ggttaatagcaagcgcttccctgta

SEQ ID NO: 471180 - DNA, 25 bp, Rattus norvegicus
ggttaatagggcctctggacaagtc

SEQ ID NO: 471181 - DNA, 25 bp, Rattus norvegicus
ggttaatagggcgtctggacaagtc

SEQ ID NO: 471182 - DNA, 25 bp, Rattus norvegicus
ggttaatctgtgagcatcccatggg

SEQ ID NO: 471183 - DNA, 25 bp, Rattus norvegicus
ggttaatctgtgtgcatcccatggg

SEQ ID NO: 471184 - DNA, 25 bp, Rattus norvegicus
ggttaatgatgaccacacagtcttt

SEQ ID NO: 471185 - DNA, 25 bp, Rattus norvegicus
ggttaatgatgagcacacagtcttt

SEQ ID NO: 471186 - DNA, 25 bp, Rattus norvegicus
ggttaatggcttagtcactcctctt

SEQ ID NO: 471187 - DNA, 25 bp, Rattus norvegicus
ggttaatggctttgtcactcctctt

SEQ ID NO: 471188 - DNA, 25 bp, Rattus norvegicus
ggttaatttaagcttctgtacacta

SEQ ID NO: 471189 - DNA, 25 bp, Rattus norvegicus
ggttaatttaaggttctgtacacta

SEQ ID NO: 471190 - DNA, 25 bp, Rattus norvegicus
ggttaattttccattccagcagcct

SEQ ID NO: 471191 - DNA, 25 bp, Rattus norvegicus
ggttaattttcctttccagcagcct

SEQ ID NO: 471192 - DNA, 25 bp, Rattus norvegicus
ggttacaagatccatccctagttag

SEQ ID NO: 471193 - DNA, 25 bp, Rattus norvegicus
ggttacaagatcgatccctagttag

SEQ ID NO: 471194 - DNA, 25 bp, Rattus norvegicus
ggttacaagcacatgctattcttga

SEQ ID NO: 471195 - DNA, 25 bp, Rattus norvegicus
ggttacaagcacttgctattcttga

SEQ ID NO: 471196 - DNA, 25 bp, Rattus norvegicus
ggttacaagttgagtgattccactt

SEQ ID NO: 471197 - DNA, 25 bp, Rattus norvegicus
ggttacaagttgtgtgattccactt

SEQ ID NO: 471198 - DNA, 25 bp, Rattus norvegicus
ggttacaatacaaatgcttcccgcc

SEQ ID NO: 471199 - DNA, 25 bp, Rattus norvegicus
ggttacaatacatatgcttcccgcc

SEQ ID NO: 471200 - DNA, 25 bp, Rattus norvegicus
ggttacaatcgaacatttcagggaa

SEQ ID NO: 471201 - DNA, 25 bp, Rattus norvegicus
ggttacaatcgatcatttcagggaa

SEQ ID NO: 471202 - DNA, 25 bp, Rattus norvegicus
ggttacacagcaagattccagttca

SEQ ID NO: 471203 - DNA, 25 bp, Rattus norvegicus
ggttacacagcatgattccagttca

SEQ ID NO: 471204 - DNA, 25 bp, Rattus norvegicus
ggttacacagtgctatgactgactt

SEQ ID NO: 471205 - DNA, 25 bp, Rattus norvegicus
ggttacacagtggtatgactgactt

SEQ ID NO: 471206 - DNA, 25 bp, Rattus norvegicus
ggttacaccaatccactttgacgtg

SEQ ID NO: 471207 - DNA, 25 bp, Rattus norvegicus
ggttacaccaatgcactttgacgtg

SEQ ID NO: 471208 - DNA, 25 bp, Rattus norvegicus
ggttacacggtaatcttcactaggt

SEQ ID NO: 471209 - DNA, 25 bp, Rattus norvegicus
ggttacacggtattcttcactaggt

SEQ ID NO: 471210 - DNA, 25 bp, Rattus norvegicus
ggttacactaacattcattcacaat

SEQ ID NO: 471211 - DNA, 25 bp, Rattus norvegicus
ggttacactaactttcattcacaat

SEQ ID NO: 471212 - DNA, 25 bp, Rattus norvegicus
ggttacactaagatacagagaagct

SEQ ID NO: 471213 - DNA, 25 bp, Rattus norvegicus
ggttacactaagttacagagaagct

SEQ ID NO: 471214 - DNA, 25 bp, Rattus norvegicus
ggttacagacttcggtccggacagc

SEQ ID NO: 471215 - DNA, 25 bp, Rattus norvegicus
ggttacagacttgggtccggacagc

SEQ ID NO: 471216 - DNA, 25 bp, Rattus norvegicus
ggttacagagagaataagcccgtct

SEQ ID NO: 471217 - DNA, 25 bp, Rattus norvegicus
ggttacagagagtataagcccgtct

SEQ ID NO: 471218 - DNA, 25 bp, Rattus norvegicus
ggttacagagtcctttcacatcttc

SEQ ID NO: 471219 - DNA, 25 bp, Rattus norvegicus
ggttacagagtcgtttcacatcttc

SEQ ID NO: 471220 - DNA, 25 bp, Rattus norvegicus
ggttacagatcccacgagaacataa

SEQ ID NO: 471221 - DNA, 25 bp, Rattus norvegicus
ggttacagatccgacgagaacataa

SEQ ID NO: 471222 - DNA, 25 bp, Rattus norvegicus
ggttacagctctaaatccgcatata

SEQ ID NO: 471223 - DNA, 25 bp, Rattus norvegicus
ggttacagctctaggatgtcttcca

SEQ ID NO: 471224 - DNA, 25 bp, Rattus norvegicus
ggttacagctcttaatccgcatata

SEQ ID NO: 471225 - DNA, 25 bp, Rattus norvegicus
ggttacagctcttggatgtcttcca

SEQ ID NO: 471226 - DNA, 25 bp, Rattus norvegicus
ggttacagggttaccatcagcatta

SEQ ID NO: 471227 - DNA, 25 bp, Rattus norvegicus
ggttacagggtttccatcagcatta

SEQ ID NO: 471228 - DNA, 25 bp, Rattus norvegicus
ggttacaggtacacacaagcttgaa

SEQ ID NO: 471229 - DNA, 25 bp, Rattus norvegicus
ggttacaggtactcacaagcttgaa

SEQ ID NO: 471230 - DNA, 25 bp, Rattus norvegicus
ggttacagtaccatggagagcttat

SEQ ID NO: 471231 - DNA, 25 bp, Rattus norvegicus
ggttacagtaccttggagagcttat

SEQ ID NO: 471232 - DNA, 25 bp, Rattus norvegicus
ggttacagtcttcaaagtccaggaa

SEQ ID NO: 471233 - DNA, 25 bp, Rattus norvegicus
ggttacagtcttgaaagtccaggaa

SEQ ID NO: 471234 - DNA, 25 bp, Rattus norvegicus
ggttacatacatatctttgaggctt

SEQ ID NO: 471235 - DNA, 25 bp, Rattus norvegicus
ggttacatacatttctttgaggctt

SEQ ID NO: 471236 - DNA, 25 bp, Rattus norvegicus
ggttacatagaaagtctgaggccag

SEQ ID NO: 471237 - DNA, 25 bp, Rattus norvegicus
ggttacatagaatgtctgaggccag

SEQ ID NO: 471238 - DNA, 25 bp, Rattus norvegicus
ggttacatatttacagccagagtct

SEQ ID NO: 471239 - DNA, 25 bp, Rattus norvegicus
ggttacatattttcagccagagtct

SEQ ID NO: 471240 - DNA, 25 bp, Rattus norvegicus
ggttacatgtgacagcttgctttaa

SEQ ID NO: 471241 - DNA, 25 bp, Rattus norvegicus
ggttacatgtgagagcttgctttaa

SEQ ID NO: 471242 - DNA, 25 bp, Rattus norvegicus
ggttacattggcaggagcattttct

SEQ ID NO: 471243 - DNA, 25 bp, Rattus norvegicus
ggttacattggctggagcattttct

SEQ ID NO: 471244 - DNA, 25 bp, Rattus norvegicus
ggttacattgggaatcctcactgtc

SEQ ID NO: 471245 - DNA, 25 bp, Rattus norvegicus
ggttacattgggtatcctcactgtc

SEQ ID NO: 471246 - DNA, 25 bp, Rattus norvegicus
ggttacattggtcgacttgtaccca

SEQ ID NO: 471247 - DNA, 25 bp, Rattus norvegicus
ggttacattggtggacttgtaccca

SEQ ID NO: 471248 - DNA, 25 bp, Rattus norvegicus
ggttacatttctaggcaaatcacaa

SEQ ID NO: 471249 - DNA, 25 bp, Rattus norvegicus
ggttacatttcttggcaaatcacaa

SEQ ID NO: 471250 - DNA, 25 bp, Rattus norvegicus
ggttacatttgaccccatagtatct

SEQ ID NO: 471251 - DNA, 25 bp, Rattus norvegicus
ggttacatttgagcccatagtatct

SEQ ID NO: 471252 - DNA, 25 bp, Rattus norvegicus
ggttaccaacgtagctttgtagata

SEQ ID NO: 471253 - DNA, 25 bp, Rattus norvegicus
ggttaccaacgttgctttgtagata

SEQ ID NO: 471254 - DNA, 25 bp, Rattus norvegicus
ggttaccacagacctgtttgtttgt

SEQ ID NO: 471255 - DNA, 25 bp, Rattus norvegicus
ggttaccacagagctgtttgtttgt

SEQ ID NO: 471256 - DNA, 25 bp, Rattus norvegicus
ggttaccacagccttccgtgaaggt

SEQ ID NO: 471257 - DNA, 25 bp, Rattus norvegicus
ggttaccacagcgttccgtgaaggt

SEQ ID NO: 471258 - DNA, 25 bp, Rattus norvegicus
ggttaccactgtcccacttaagagt

SEQ ID NO: 471259 - DNA, 25 bp, Rattus norvegicus
ggttaccactgtgccacttaagagt

SEQ ID NO: 471260 - DNA, 25 bp, Rattus norvegicus
ggttaccacttccatgagcgctcct

SEQ ID NO: 471261 - DNA, 25 bp, Rattus norvegicus
ggttaccacttcgatgagcgctcct

SEQ ID NO: 471262 - DNA, 25 bp, Rattus norvegicus
ggttaccagactaacaaatccaaga

SEQ ID NO: 471263 - DNA, 25 bp, Rattus norvegicus
ggttaccagacttacaaatccaaga

SEQ ID NO: 471264 - DNA, 25 bp, Rattus norvegicus
ggttaccagctcacatggcgagtgc

SEQ ID NO: 471265 - DNA, 25 bp, Rattus norvegicus
ggttaccagctctcatggcgagtgc

SEQ ID NO: 471266 - DNA, 25 bp, Rattus norvegicus
ggttaccagtgaccccgaaatcaat

SEQ ID NO: 471267 - DNA, 25 bp, Rattus norvegicus
ggttaccagtgacttcctggaaaat

SEQ ID NO: 471268 - DNA, 25 bp, Rattus norvegicus
ggttaccagtgagcccgaaatcaat

SEQ ID NO: 471269 - DNA, 25 bp, Rattus norvegicus
ggttaccagtgagttcctggaaaat

SEQ ID NO: 471270 - DNA, 25 bp, Rattus norvegicus
ggttaccagtggactccaagatcaa

SEQ ID NO: 471271 - DNA, 25 bp, Rattus norvegicus
ggttaccagtggtctccaagatcaa

SEQ ID NO: 471272 - DNA, 25 bp, Rattus norvegicus
ggttaccatcatcctggccagagga

SEQ ID NO: 471273 - DNA, 25 bp, Rattus norvegicus
ggttaccatcatgctggccagagga

SEQ ID NO: 471274 - DNA, 25 bp, Rattus norvegicus
ggttaccatgcccaaagccagcatt

SEQ ID NO: 471275 - DNA, 25 bp, Rattus norvegicus
ggttaccatgccgaaagccagcatt

SEQ ID NO: 471276 - DNA, 25 bp, Rattus norvegicus
ggttaccattggacttcaggcccca

SEQ ID NO: 471277 - DNA, 25 bp, Rattus norvegicus
ggttaccattggtcttcaggcccca

SEQ ID NO: 471278 - DNA, 25 bp, Rattus norvegicus
ggttacctacaaaggcgagtgccat

SEQ ID NO: 471279 - DNA, 25 bp, Rattus norvegicus
ggttacctacaatggcgagtgccat

SEQ ID NO: 471280 - DNA, 25 bp, Rattus norvegicus
ggttacctcctgagccatgagaaga

SEQ ID NO: 471281 - DNA, 25 bp, Rattus norvegicus
ggttacctcctgtgccatgagaaga

SEQ ID NO: 471282 - DNA, 25 bp, Rattus norvegicus
ggttacctgaaccaccatctaataa

SEQ ID NO: 471283 - DNA, 25 bp, Rattus norvegicus
ggttacctgaacgaccatctaataa

SEQ ID NO: 471284 - DNA, 25 bp, Rattus norvegicus
ggttacctgcataagatcaagctag

SEQ ID NO: 471285 - DNA, 25 bp, Rattus norvegicus
ggttacctgcattagatcaagctag

SEQ ID NO: 471286 - DNA, 25 bp, Rattus norvegicus
ggttacctgtacagatctctgatgc

SEQ ID NO: 471287 - DNA, 25 bp, Rattus norvegicus
ggttacctgtactgatctctgatgc

SEQ ID NO: 471288 - DNA, 25 bp, Rattus norvegicus
ggttaccttcctctgtaagttgctt

SEQ ID NO: 471289 - DNA, 25 bp, Rattus norvegicus
ggttaccttcctgtgtaagttgctt

SEQ ID NO: 471290 - DNA, 25 bp, Rattus norvegicus
ggttaccttgatcagtctcccagaa

SEQ ID NO: 471291 - DNA, 25 bp, Rattus norvegicus
ggttaccttgatgagtctcccagaa

SEQ ID NO: 471292 - DNA, 25 bp, Rattus norvegicus
ggttaccttgccaaatgagtcttgt

SEQ ID NO: 471293 - DNA, 25 bp, Rattus norvegicus
ggttaccttgcctaatgagtcttgt

SEQ ID NO: 471294 - DNA, 25 bp, Rattus norvegicus
ggttacctttgccagtagagtcatt

SEQ ID NO: 471295 - DNA, 25 bp, Rattus norvegicus
ggttacctttgcgagtagagtcatt

SEQ ID NO: 471296 - DNA, 25 bp, Rattus norvegicus
ggttacgaagtcatattctcctgaa

SEQ ID NO: 471297 - DNA, 25 bp, Rattus norvegicus
ggttacgaagtcttattctcctgaa

SEQ ID NO: 471298 - DNA, 25 bp, Rattus norvegicus
ggttacgagcgccttttactaaatg

SEQ ID NO: 471299 - DNA, 25 bp, Rattus norvegicus
ggttacgagcgcgttttactaaatg

SEQ ID NO: 471300 - DNA, 25 bp, Rattus norvegicus
ggttacggaacaagctttgcatatt

SEQ ID NO: 471301 - DNA, 25 bp, Rattus norvegicus
ggttacggaacatgctttgcatatt

SEQ ID NO: 471302 - DNA, 25 bp, Rattus norvegicus
ggttacgtaatactctctcagtcag

SEQ ID NO: 471303 - DNA, 25 bp, Rattus norvegicus
ggttacgtaatagtctctcagtcag

SEQ ID NO: 471304 - DNA, 25 bp, Rattus norvegicus
ggttacgtcagactgtcagctggaa

SEQ ID NO: 471305 - DNA, 25 bp, Rattus norvegicus
ggttacgtcagagtgtcagctggaa

SEQ ID NO: 471306 - DNA, 25 bp, Rattus norvegicus
ggttacgtgctcatatttggaatca

SEQ ID NO: 471307 - DNA, 25 bp, Rattus norvegicus
ggttacgtgctcttatttggaatca

SEQ ID NO: 471308 - DNA, 25 bp, Rattus norvegicus
ggttacgttaccacagactgacagt

SEQ ID NO: 471309 - DNA, 25 bp, Rattus norvegicus
ggttacgttacctcagactgacagt

SEQ ID NO: 471310 - DNA, 25 bp, Rattus norvegicus
ggttacgtttatctccacagtcaaa

SEQ ID NO: 471311 - DNA, 25 bp, Rattus norvegicus
ggttacgtttatgtccacagtcaaa

SEQ ID NO: 471312 - DNA, 25 bp, Rattus norvegicus
ggttactacacacttcaagctttag

SEQ ID NO: 471313 - DNA, 25 bp, Rattus norvegicus
ggttactacacagttcaagctttag

SEQ ID NO: 471314 - DNA, 25 bp, Rattus norvegicus
ggttactacagtcagtctccataca

SEQ ID NO: 471315 - DNA, 25 bp, Rattus norvegicus
ggttactacagtgagtctccataca

SEQ ID NO: 471316 - DNA, 25 bp, Rattus norvegicus
ggttactacgagattgagtctccat

SEQ ID NO: 471317 - DNA, 25 bp, Rattus norvegicus
ggttactacgagtttgagtctccat

SEQ ID NO: 471318 - DNA, 25 bp, Rattus norvegicus
ggttactactacattgtttctggaa

SEQ ID NO: 471319 - DNA, 25 bp, Rattus norvegicus
ggttactactactttgtttctggaa

SEQ ID NO: 471320 - DNA, 25 bp, Rattus norvegicus
ggttactataataattccactgtgg

SEQ ID NO: 471321 - DNA, 25 bp, Rattus norvegicus
ggttactataattattccactgtgg

SEQ ID NO: 471322 - DNA, 25 bp, Rattus norvegicus
ggttactatgagatcaccccaatta

SEQ ID NO: 471323 - DNA, 25 bp, Rattus norvegicus
ggttactatgagttcaccccaatta

SEQ ID NO: 471324 - DNA, 25 bp, Rattus norvegicus
ggttactatgtcactaggtcactaa

SEQ ID NO: 471325 - DNA, 25 bp, Rattus norvegicus
ggttactatgtctctaggtcactaa

SEQ ID NO: 471326 - DNA, 25 bp, Rattus norvegicus
ggttactcatccctttttaagcctg

SEQ ID NO: 471327 - DNA, 25 bp, Rattus norvegicus
ggttactcatccgtttttaagcctg

SEQ ID NO: 471328 - DNA, 25 bp, Rattus norvegicus
ggttactccactcccatgtgactga

SEQ ID NO: 471329 - DNA, 25 bp, Rattus norvegicus
ggttactccactgccatgtgactga

SEQ ID NO: 471330 - DNA, 25 bp, Rattus norvegicus
ggttactcctacagtggcatcatgg

SEQ ID NO: 471331 - DNA, 25 bp, Rattus norvegicus
ggttactcctactgtggcatcatgg

SEQ ID NO: 471332 - DNA, 25 bp, Rattus norvegicus
ggttactctgccacttatttggaga

SEQ ID NO: 471333 - DNA, 25 bp, Rattus norvegicus
ggttactctgcctcttatttggaga

SEQ ID NO: 471334 - DNA, 25 bp, Rattus norvegicus
ggttactctttcatttatctctgtt

SEQ ID NO: 471335 - DNA, 25 bp, Rattus norvegicus
ggttactctttcttttatctctgtt

SEQ ID NO: 471336 - DNA, 25 bp, Rattus norvegicus
ggttactctttgacggccacgcttt

SEQ ID NO: 471337 - DNA, 25 bp, Rattus norvegicus
ggttactctttgtcggccacgcttt

SEQ ID NO: 471338 - DNA, 25 bp, Rattus norvegicus
ggttactgaagcaggccacttggct

SEQ ID NO: 471339 - DNA, 25 bp, Rattus norvegicus
ggttactgaagctggccacttggct

SEQ ID NO: 471340 - DNA, 25 bp, Rattus norvegicus
ggttactgtcaaagcagaccctcaa

SEQ ID NO: 471341 - DNA, 25 bp, Rattus norvegicus
ggttactgtcaatgcagaccctcaa

SEQ ID NO: 471342 - DNA, 25 bp, Rattus norvegicus
ggttactgtcataactcgtgtccgt

SEQ ID NO: 471343 - DNA, 25 bp, Rattus norvegicus
ggttactgtcattactcgtgtccgt

SEQ ID NO: 471344 - DNA, 25 bp, Rattus norvegicus
ggttactgtgcacaatccatcgaca

SEQ ID NO: 471345 - DNA, 25 bp, Rattus norvegicus
ggttactgtgcagaatccatcgaca

SEQ ID NO: 471346 - DNA, 25 bp, Rattus norvegicus
ggttactgttgactcaactgctgag

SEQ ID NO: 471347 - DNA, 25 bp, Rattus norvegicus
ggttactgttgagtcaactgctgag

SEQ ID NO: 471348 - DNA, 25 bp, Rattus norvegicus
ggttacttaattcccctgaaagcag

SEQ ID NO: 471349 - DNA, 25 bp, Rattus norvegicus
ggttacttaattgccctgaaagcag

SEQ ID NO: 471350 - DNA, 25 bp, Rattus norvegicus
ggttacttacatactgtttcttgct

SEQ ID NO: 471351 - DNA, 25 bp, Rattus norvegicus
ggttacttacattctgtttcttgct

SEQ ID NO: 471352 - DNA, 25 bp, Rattus norvegicus
ggttacttcaaccaagttcctgatc

SEQ ID NO: 471353 - DNA, 25 bp, Rattus norvegicus
ggttacttcaacgaagttcctgatc

SEQ ID NO: 471354 - DNA, 25 bp, Rattus norvegicus
ggttacttgcttcgctgagcgatca

SEQ ID NO: 471355 - DNA, 25 bp, Rattus norvegicus
ggttacttgcttggctgagcgatca

SEQ ID NO: 471356 - DNA, 25 bp, Rattus norvegicus
ggttactttataaacatacacgcat

SEQ ID NO: 471357 - DNA, 25 bp, Rattus norvegicus
ggttactttatatacatacacgcat

SEQ ID NO: 471358 - DNA, 25 bp, Rattus norvegicus
ggttactttgtaatggttctcagtc

SEQ ID NO: 471359 - DNA, 25 bp, Rattus norvegicus
ggttactttgtattggttctcagtc

SEQ ID NO: 471360 - DNA, 25 bp, Rattus norvegicus
ggttacttttaaccagtctgttctg

SEQ ID NO: 471361 - DNA, 25 bp, Rattus norvegicus
ggttacttttaagcagtctgttctg

SEQ ID NO: 471362 - DNA, 25 bp, Rattus norvegicus
ggttacttttctcctttgcaaatgt

SEQ ID NO: 471363 - DNA, 25 bp, Rattus norvegicus
ggttacttttctgctttgcaaatgt

SEQ ID NO: 471364 - DNA, 25 bp, Rattus norvegicus
ggttagaaactaatccattcacttt

SEQ ID NO: 471365 - DNA, 25 bp, Rattus norvegicus
ggttagaaactattccattcacttt

SEQ ID NO: 471366 - DNA, 25 bp, Rattus norvegicus
ggttagaacagcatgtgtacgcgcg

SEQ ID NO: 471367 - DNA, 25 bp, Rattus norvegicus
ggttagaacagcttgtgtacgcgcg

SEQ ID NO: 471368 - DNA, 25 bp, Rattus norvegicus
ggttagaacatcaaggtctcccgcc

SEQ ID NO: 471369 - DNA, 25 bp, Rattus norvegicus
ggttagaacatctaggtctcccgcc

SEQ ID NO: 471370 - DNA, 25 bp, Rattus norvegicus
ggttagaacatgatcgtgcccacca

SEQ ID NO: 471371 - DNA, 25 bp, Rattus norvegicus
ggttagaacatgttcgtgcccacca

SEQ ID NO: 471372 - DNA, 25 bp, Rattus norvegicus
ggttagaaccatacaaggtgccttt

SEQ ID NO: 471373 - DNA, 25 bp, Rattus norvegicus
ggttagaaccattcaaggtgccttt

SEQ ID NO: 471374 - DNA, 25 bp, Rattus norvegicus
ggttagaacttgcatatgccccagc

SEQ ID NO: 471375 - DNA, 25 bp, Rattus norvegicus
ggttagaacttggatatgccccagc

SEQ ID NO: 471376 - DNA, 25 bp, Rattus norvegicus
ggttagaagcttccaggtctaggct

SEQ ID NO: 471377 - DNA, 25 bp, Rattus norvegicus
ggttagaagcttgcaggtctaggct

SEQ ID NO: 471378 - DNA, 25 bp, Rattus norvegicus
ggttagaatgtacccctggacctct

SEQ ID NO: 471379 - DNA, 25 bp, Rattus norvegicus
ggttagaatgtagccctggacctct

SEQ ID NO: 471380 - DNA, 25 bp, Rattus norvegicus
ggttagaccaaaaccattgcttttg

SEQ ID NO: 471381 - DNA, 25 bp, Rattus norvegicus
ggttagaccaaatccattgcttttg

SEQ ID NO: 471382 - DNA, 25 bp, Rattus norvegicus
ggttagactcctcataactgaacat

SEQ ID NO: 471383 - DNA, 25 bp, Rattus norvegicus
ggttagactcctgataactgaacat

SEQ ID NO: 471384 - DNA, 25 bp, Rattus norvegicus
ggttagacttgcaaccaacagctct

SEQ ID NO: 471385 - DNA, 25 bp, Rattus norvegicus
ggttagacttgctaccaacagctct

SEQ ID NO: 471386 - DNA, 25 bp, Rattus norvegicus
ggttagagatgaaacctccatacct

SEQ ID NO: 471387 - DNA, 25 bp, Rattus norvegicus
ggttagagatgatacctccatacct

SEQ ID NO: 471388 - DNA, 25 bp, Rattus norvegicus
ggttagagcctcagcctgtgtggcc

SEQ ID NO: 471389 - DNA, 25 bp, Rattus norvegicus
ggttagagcctctgcctgtgtggcc

SEQ ID NO: 471390 - DNA, 25 bp, Rattus norvegicus
ggttagatcaaaccagcacctgcag

SEQ ID NO: 471391 - DNA, 25 bp, Rattus norvegicus
ggttagatcaaagcagcacctgcag

SEQ ID NO: 471392 - DNA, 25 bp, Rattus norvegicus
ggttagatgctaatttccctgacat

SEQ ID NO: 471393 - DNA, 25 bp, Rattus norvegicus
ggttagatgctattttccctgacat

SEQ ID NO: 471394 - DNA, 25 bp, Rattus norvegicus
ggttagattttaatgtctcacagaa

SEQ ID NO: 471395 - DNA, 25 bp, Rattus norvegicus
ggttagattttattgtctcacagaa

SEQ ID NO: 471396 - DNA, 25 bp, Rattus norvegicus
ggttagcaacaaccccggacccgag

SEQ ID NO: 471397 - DNA, 25 bp, Rattus norvegicus
ggttagcaacaagcccggacccgag

SEQ ID NO: 471398 - DNA, 25 bp, Rattus norvegicus
ggttagcacagtacagagcacttaa

SEQ ID NO: 471399 - DNA, 25 bp, Rattus norvegicus
ggttagcacagttcagagcacttaa

SEQ ID NO: 471400 - DNA, 25 bp, Rattus norvegicus
ggttagcacctacaggccacaacta

SEQ ID NO: 471401 - DNA, 25 bp, Rattus norvegicus
ggttagcacctagaggccacaacta

SEQ ID NO: 471402 - DNA, 25 bp, Rattus norvegicus
ggttagcagcctagtccatatacag

SEQ ID NO: 471403 - DNA, 25 bp, Rattus norvegicus
ggttagcagccttgtccatatacag

SEQ ID NO: 471404 - DNA, 25 bp, Rattus norvegicus
ggttagcagtgtatggttctcagca

SEQ ID NO: 471405 - DNA, 25 bp, Rattus norvegicus
ggttagcagtgtttggttctcagca

SEQ ID NO: 471406 - DNA, 25 bp, Rattus norvegicus
ggttagcatcacatcccaccatcat

SEQ ID NO: 471407 - DNA, 25 bp, Rattus norvegicus
ggttagcatcacttcccaccatcat

SEQ ID NO: 471408 - DNA, 25 bp, Rattus norvegicus
ggttagcattcaatgtcaacatgac

SEQ ID NO: 471409 - DNA, 25 bp, Rattus norvegicus
ggttagcattcattgtcaacatgac

SEQ ID NO: 471410 - DNA, 25 bp, Rattus norvegicus
ggttagcattttaatggactctcca

SEQ ID NO: 471411 - DNA, 25 bp, Rattus norvegicus
ggttagcatttttatggactctcca

SEQ ID NO: 471412 - DNA, 25 bp, Rattus norvegicus
ggttagccaggtattttgtgaaagt

SEQ ID NO: 471413 - DNA, 25 bp, Rattus norvegicus
ggttagccaggttttttgtgaaagt

SEQ ID NO: 471414 - DNA, 25 bp, Rattus norvegicus
ggttagcccaagatgagacgagttt

SEQ ID NO: 471415 - DNA, 25 bp, Rattus norvegicus
ggttagcccaagttgagacgagttt

SEQ ID NO: 471416 - DNA, 25 bp, Rattus norvegicus
ggttagcccggtctccagaggacct

SEQ ID NO: 471417 - DNA, 25 bp, Rattus norvegicus
ggttagcccggtgtccagaggacct

SEQ ID NO: 471418 - DNA, 25 bp, Rattus norvegicus
ggttagcctggaacaagactgctta

SEQ ID NO: 471419 - DNA, 25 bp, Rattus norvegicus
ggttagcctggatcaagactgctta

SEQ ID NO: 471420 - DNA, 25 bp, Rattus norvegicus
ggttagccttggattcagacatttg

SEQ ID NO: 471421 - DNA, 25 bp, Rattus norvegicus
ggttagccttggtttcagacatttg

SEQ ID NO: 471422 - DNA, 25 bp, Rattus norvegicus
ggttagcgagcacagttagttatac

SEQ ID NO: 471423 - DNA, 25 bp, Rattus norvegicus
ggttagcgagcagagttagttatac

SEQ ID NO: 471424 - DNA, 25 bp, Rattus norvegicus
ggttagcgtggcatatctgggcttt

SEQ ID NO: 471425 - DNA, 25 bp, Rattus norvegicus
ggttagcgtggcttatctgggcttt

SEQ ID NO: 471426 - DNA, 25 bp, Rattus norvegicus
ggttagctcatgaccatgccagaat

SEQ ID NO: 471427 - DNA, 25 bp, Rattus norvegicus
ggttagctcatgtccatgccagaat

SEQ ID NO: 471428 - DNA, 25 bp, Rattus norvegicus
ggttagctgcctatctaatgctaca

SEQ ID NO: 471429 - DNA, 25 bp, Rattus norvegicus
ggttagctgcctttctaatgctaca

SEQ ID NO: 471430 - DNA, 25 bp, Rattus norvegicus
ggttagcttcttctgttggaactct

SEQ ID NO: 471431 - DNA, 25 bp, Rattus norvegicus
ggttagcttcttgtgttggaactct

SEQ ID NO: 471432 - DNA, 25 bp, Rattus norvegicus
ggttagcttgatcgaatcacccaaa

SEQ ID NO: 471433 - DNA, 25 bp, Rattus norvegicus
ggttagcttgatggaatcacccaaa

SEQ ID NO: 471434 - DNA, 25 bp, Rattus norvegicus
ggttagctttcaacatctacacaac

SEQ ID NO: 471435 - DNA, 25 bp, Rattus norvegicus
ggttagctttcatcatctacacaac

SEQ ID NO: 471436 - DNA, 25 bp, Rattus norvegicus
ggttaggaacctctacaccttcact

SEQ ID NO: 471437 - DNA, 25 bp, Rattus norvegicus
ggttaggaacctgtacaccttcact

SEQ ID NO: 471438 - DNA, 25 bp, Rattus norvegicus
ggttaggcatacacttactggtttt

SEQ ID NO: 471439 - DNA, 25 bp, Rattus norvegicus
ggttaggcatactcttactggtttt

SEQ ID NO: 471440 - DNA, 25 bp, Rattus norvegicus
ggttaggctacaatccaagtggctg

SEQ ID NO: 471441 - DNA, 25 bp, Rattus norvegicus
ggttaggctacattccaagtggctg

SEQ ID NO: 471442 - DNA, 25 bp, Rattus norvegicus
ggttaggctcccaacaaacgaacat

SEQ ID NO: 471443 - DNA, 25 bp, Rattus norvegicus
ggttaggctccctacaaacgaacat

SEQ ID NO: 471444 - DNA, 25 bp, Rattus norvegicus
ggttaggctttcagtttttgtctct

SEQ ID NO: 471445 - DNA, 25 bp, Rattus norvegicus
ggttaggctttctgtttttgtctct

SEQ ID NO: 471446 - DNA, 25 bp, Rattus norvegicus
ggttagggcagacccaagccacact

SEQ ID NO: 471447 - DNA, 25 bp, Rattus norvegicus
ggttagggcagagccaagccacact

SEQ ID NO: 471448 - DNA, 25 bp, Rattus norvegicus
ggttaggtgactcctggtctctcca

SEQ ID NO: 471449 - DNA, 25 bp, Rattus norvegicus
ggttaggtgactgctggtctctcca

SEQ ID NO: 471450 - DNA, 25 bp, Rattus norvegicus
ggttagtaatttcctttgtctgaca

SEQ ID NO: 471451 - DNA, 25 bp, Rattus norvegicus
ggttagtaatttgctttgtctgaca

SEQ ID NO: 471452 - DNA, 25 bp, Rattus norvegicus
ggttagtacacaccagcactgcact

SEQ ID NO: 471453 - DNA, 25 bp, Rattus norvegicus
ggttagtacacagcagcactgcact

SEQ ID NO: 471454 - DNA, 25 bp, Rattus norvegicus
ggttagtacctcaattttactgtag

SEQ ID NO: 471455 - DNA, 25 bp, Rattus norvegicus
ggttagtacctctattttactgtag

SEQ ID NO: 471456 - DNA, 25 bp, Rattus norvegicus
ggttagtacttgcactgacctcggt

SEQ ID NO: 471457 - DNA, 25 bp, Rattus norvegicus
ggttagtacttggactgacctcggt

SEQ ID NO: 471458 - DNA, 25 bp, Rattus norvegicus
ggttagtattttagtcccacacaga

SEQ ID NO: 471459 - DNA, 25 bp, Rattus norvegicus
ggttagtatttttgtcccacacaga

SEQ ID NO: 471460 - DNA, 25 bp, Rattus norvegicus
ggttagtcacagacgcaagagatct

SEQ ID NO: 471461 - DNA, 25 bp, Rattus norvegicus
ggttagtcacagtcgcaagagatct

SEQ ID NO: 471462 - DNA, 25 bp, Rattus norvegicus
ggttagtcttctaagaccgggcgct

SEQ ID NO: 471463 - DNA, 25 bp, Rattus norvegicus
ggttagtcttcttagaccgggcgct

SEQ ID NO: 471464 - DNA, 25 bp, Rattus norvegicus
ggttagtgagaaacttgcctcctat

SEQ ID NO: 471465 - DNA, 25 bp, Rattus norvegicus
ggttagtgagaatcttgcctcctat

SEQ ID NO: 471466 - DNA, 25 bp, Rattus norvegicus
ggttagtgcctaaaacaagcagtga

SEQ ID NO: 471467 - DNA, 25 bp, Rattus norvegicus
ggttagtgcctataacaagcagtga

SEQ ID NO: 471468 - DNA, 25 bp, Rattus norvegicus
ggttagtgcgcaaacggcacacaat

SEQ ID NO: 471469 - DNA, 25 bp, Rattus norvegicus
ggttagtgcgcatacggcacacaat

SEQ ID NO: 471470 - DNA, 25 bp, Rattus norvegicus
ggttagtgctaacctgcaccgtctt

SEQ ID NO: 471471 - DNA, 25 bp, Rattus norvegicus
ggttagtgctaagctgcaccgtctt

SEQ ID NO: 471472 - DNA, 25 bp, Rattus norvegicus
ggttagtggtttccccactgtgaca

SEQ ID NO: 471473 - DNA, 25 bp, Rattus norvegicus
ggttagtggtttgcccactgtgaca

SEQ ID NO: 471474 - DNA, 25 bp, Rattus norvegicus
ggttagtgtgacaatcccactgtct

SEQ ID NO: 471475 - DNA, 25 bp, Rattus norvegicus
ggttagtgtgactatcccactgtct

SEQ ID NO: 471476 - DNA, 25 bp, Rattus norvegicus
ggttagtgtttcagcctccaagggc

SEQ ID NO: 471477 - DNA, 25 bp, Rattus norvegicus
ggttagtgtttctgcctccaagggc

SEQ ID NO: 471478 - DNA, 25 bp, Rattus norvegicus
ggttagtgtttgactctaccaaata

SEQ ID NO: 471479 - DNA, 25 bp, Rattus norvegicus
ggttagtgtttgtctctaccaaata

SEQ ID NO: 471480 - DNA, 25 bp, Rattus norvegicus
ggttagttaataatcatatgcccta

SEQ ID NO: 471481 - DNA, 25 bp, Rattus norvegicus
ggttagttaatattcatatgcccta

SEQ ID NO: 471482 - DNA, 25 bp, Rattus norvegicus
ggttagttgccactgagaagctcat

SEQ ID NO: 471483 - DNA, 25 bp, Rattus norvegicus
ggttagttgccagtgagaagctcat

SEQ ID NO: 471484 - DNA, 25 bp, Rattus norvegicus
ggttagtttgcaaggacctgcctct

SEQ ID NO: 471485 - DNA, 25 bp, Rattus norvegicus
ggttagtttgcatggacctgcctct

SEQ ID NO: 471486 - DNA, 25 bp, Rattus norvegicus
ggttagtttgttcctatgtattgta

SEQ ID NO: 471487 - DNA, 25 bp, Rattus norvegicus
ggttagtttgttgctatgtattgta

SEQ ID NO: 471488 - DNA, 25 bp, Rattus norvegicus
ggttagtttttgataccagctgtaa

SEQ ID NO: 471489 - DNA, 25 bp, Rattus norvegicus
ggttagtttttgttaccagctgtaa

SEQ ID NO: 471490 - DNA, 25 bp, Rattus norvegicus
ggttataactcacatggctgcagcc

SEQ ID NO: 471491 - DNA, 25 bp, Rattus norvegicus
ggttataactcagatggctgcagcc

SEQ ID NO: 471492 - DNA, 25 bp, Rattus norvegicus
ggttataagattacaaactggtaca

SEQ ID NO: 471493 - DNA, 25 bp, Rattus norvegicus
ggttataagatttcaaactggtaca

SEQ ID NO: 471494 - DNA, 25 bp, Rattus norvegicus
ggttataatatacaaagcctctgaa

SEQ ID NO: 471495 - DNA, 25 bp, Rattus norvegicus
ggttataatatagaaagcctctgaa

SEQ ID NO: 471496 - DNA, 25 bp, Rattus norvegicus
ggttatacaaaaagtttgccctttg

SEQ ID NO: 471497 - DNA, 25 bp, Rattus norvegicus
ggttatacaaaatgtttgccctttg

SEQ ID NO: 471498 - DNA, 25 bp, Rattus norvegicus
ggttatacatccctggttttcccat

SEQ ID NO: 471499 - DNA, 25 bp, Rattus norvegicus
ggttatacatccgtggttttcccat

SEQ ID NO: 471500 - DNA, 25 bp, Rattus norvegicus
ggttataccacacagactctgcctg

SEQ ID NO: 471501 - DNA, 25 bp, Rattus norvegicus
ggttataccacagagactctgcctg

SEQ ID NO: 471502 - DNA, 25 bp, Rattus norvegicus
ggttatagtacgcagtctggccctg

SEQ ID NO: 471503 - DNA, 25 bp, Rattus norvegicus
ggttatagtacggagtctggccctg

SEQ ID NO: 471504 - DNA, 25 bp, Rattus norvegicus
ggttatagttctacttttctcagtc

SEQ ID NO: 471505 - DNA, 25 bp, Rattus norvegicus
ggttatagttcttcttttctcagtc

SEQ ID NO: 471506 - DNA, 25 bp, Rattus norvegicus
ggttatatagaaaggccctgcctta

SEQ ID NO: 471507 - DNA, 25 bp, Rattus norvegicus
ggttatatagaatggccctgcctta

SEQ ID NO: 471508 - DNA, 25 bp, Rattus norvegicus
ggttatatcgatagcctgggtacaa

SEQ ID NO: 471509 - DNA, 25 bp, Rattus norvegicus
ggttatatcgattgcctgggtacaa

SEQ ID NO: 471510 - DNA, 25 bp, Rattus norvegicus
ggttatattatgaccagcatccaaa

SEQ ID NO: 471511 - DNA, 25 bp, Rattus norvegicus
ggttatattatgtccagcatccaaa

SEQ ID NO: 471512 - DNA, 25 bp, Rattus norvegicus
ggttatatttccacactaatctgag

SEQ ID NO: 471513 - DNA, 25 bp, Rattus norvegicus
ggttatatttcctcactaatctgag

SEQ ID NO: 471514 - DNA, 25 bp, Rattus norvegicus
ggttatcaaacccagaagtgactta

SEQ ID NO: 471515 - DNA, 25 bp, Rattus norvegicus
ggttatcaaaccgagaagtgactta

SEQ ID NO: 471516 - DNA, 25 bp, Rattus norvegicus
ggttatcaatgtacctagaaatatg

SEQ ID NO: 471517 - DNA, 25 bp, Rattus norvegicus
ggttatcaatgttcctagaaatatg

SEQ ID NO: 471518 - DNA, 25 bp, Rattus norvegicus
ggttatcacagtccaggccggagaa

SEQ ID NO: 471519 - DNA, 25 bp, Rattus norvegicus
ggttatcacagtgcaggccggagaa

SEQ ID NO: 471520 - DNA, 25 bp, Rattus norvegicus
ggttatcatagcacctttcttttaa

SEQ ID NO: 471521 - DNA, 25 bp, Rattus norvegicus
ggttatcatagctcctttcttttaa

SEQ ID NO: 471522 - DNA, 25 bp, Rattus norvegicus
ggttatcattaccaccatttgacaa

SEQ ID NO: 471523 - DNA, 25 bp, Rattus norvegicus
ggttatcattacgaccatttgacaa

SEQ ID NO: 471524 - DNA, 25 bp, Rattus norvegicus
ggttatccaccaacagaacatctaa

SEQ ID NO: 471525 - DNA, 25 bp, Rattus norvegicus
ggttatccaccacccagcggaggaa

SEQ ID NO: 471526 - DNA, 25 bp, Rattus norvegicus
ggttatccaccagccagcggaggaa

SEQ ID NO: 471527 - DNA, 25 bp, Rattus norvegicus
ggttatccaccatcagaacatctaa

SEQ ID NO: 471528 - DNA, 25 bp, Rattus norvegicus
ggttatccgttgcattggccagcca

SEQ ID NO: 471529 - DNA, 25 bp, Rattus norvegicus
ggttatccgttggattggccagcca

SEQ ID NO: 471530 - DNA, 25 bp, Rattus norvegicus
ggttatcctcaacagtttgtctttt

SEQ ID NO: 471531 - DNA, 25 bp, Rattus norvegicus
ggttatcctcaagagtttgtctttt

SEQ ID NO: 471532 - DNA, 25 bp, Rattus norvegicus
ggttatcctctgctaaaatgttgct

SEQ ID NO: 471533 - DNA, 25 bp, Rattus norvegicus
ggttatcctctggtaaaatgttgct

SEQ ID NO: 471534 - DNA, 25 bp, Rattus norvegicus
ggttatcctgggactcattcagtag

SEQ ID NO: 471535 - DNA, 25 bp, Rattus norvegicus
ggttatcctgggtctcattcagtag

SEQ ID NO: 471536 - DNA, 25 bp, Rattus norvegicus
ggttatccttggctatatgacatgt

SEQ ID NO: 471537 - DNA, 25 bp, Rattus norvegicus
ggttatccttgggtatatgacatgt

SEQ ID NO: 471538 - DNA, 25 bp, Rattus norvegicus
ggttatccttgtccaaaagcactgg

SEQ ID NO: 471539 - DNA, 25 bp, Rattus norvegicus
ggttatccttgtgcaaaagcactgg

SEQ ID NO: 471540 - DNA, 25 bp, Rattus norvegicus
ggttatcctttactggcatcagaac

SEQ ID NO: 471541 - DNA, 25 bp, Rattus norvegicus
ggttatcctttagtggcatcagaac

SEQ ID NO: 471542 - DNA, 25 bp, Rattus norvegicus
ggttatctagaccagattatgggct

SEQ ID NO: 471543 - DNA, 25 bp, Rattus norvegicus
ggttatctagacgagattatgggct

SEQ ID NO: 471544 - DNA, 25 bp, Rattus norvegicus
ggttatctcaacaacgaaggctagg

SEQ ID NO: 471545 - DNA, 25 bp, Rattus norvegicus
ggttatctcaactacgaaggctagg

SEQ ID NO: 471546 - DNA, 25 bp, Rattus norvegicus
ggttatctcagcattttctgcagga

SEQ ID NO: 471547 - DNA, 25 bp, Rattus norvegicus
ggttatctcagctttttctgcagga

SEQ ID NO: 471548 - DNA, 25 bp, Rattus norvegicus
ggttatctccagaactgtccatatt

SEQ ID NO: 471549 - DNA, 25 bp, Rattus norvegicus
ggttatctccagtactgtccatatt

SEQ ID NO: 471550 - DNA, 25 bp, Rattus norvegicus
ggttatctccatcgtattactgcta

SEQ ID NO: 471551 - DNA, 25 bp, Rattus norvegicus
ggttatctccatggtattactgcta

SEQ ID NO: 471552 - DNA, 25 bp, Rattus norvegicus
ggttatctctcgaatcattgttttg

SEQ ID NO: 471553 - DNA, 25 bp, Rattus norvegicus
ggttatctctcgtatcattgttttg

SEQ ID NO: 471554 - DNA, 25 bp, Rattus norvegicus
ggttatctctctaccttcaaagatt

SEQ ID NO: 471555 - DNA, 25 bp, Rattus norvegicus
ggttatctctcttccttcaaagatt

SEQ ID NO: 471556 - DNA, 25 bp, Rattus norvegicus
ggttatctctgccacagacagctgc

SEQ ID NO: 471557 - DNA, 25 bp, Rattus norvegicus
ggttatctctgcgacagacagctgc

SEQ ID NO: 471558 - DNA, 25 bp, Rattus norvegicus
ggttatctcttgacaggaggctaca

SEQ ID NO: 471559 - DNA, 25 bp, Rattus norvegicus
ggttatctcttgtcaggaggctaca

SEQ ID NO: 471560 - DNA, 25 bp, Rattus norvegicus
ggttatctgggactcaactatcaac

SEQ ID NO: 471561 - DNA, 25 bp, Rattus norvegicus
ggttatctgggagtcaactatcaac

SEQ ID NO: 471562 - DNA, 25 bp, Rattus norvegicus
ggttatctgtaacgtcacccctagt

SEQ ID NO: 471563 - DNA, 25 bp, Rattus norvegicus
ggttatctgtaaggtcacccctagt

SEQ ID NO: 471564 - DNA, 25 bp, Rattus norvegicus
ggttatctgtacatcctgaggcaaa

SEQ ID NO: 471565 - DNA, 25 bp, Rattus norvegicus
ggttatctgtacttcctgaggcaaa

SEQ ID NO: 471566 - DNA, 25 bp, Rattus norvegicus
ggttatctgtatacgacctgcacaa

SEQ ID NO: 471567 - DNA, 25 bp, Rattus norvegicus
ggttatctgtattcgacctgcacaa

SEQ ID NO: 471568 - DNA, 25 bp, Rattus norvegicus
ggttatcttgacatctgccaaaagc

SEQ ID NO: 471569 - DNA, 25 bp, Rattus norvegicus
ggttatcttgacttctgccaaaagc

SEQ ID NO: 471570 - DNA, 25 bp, Rattus norvegicus
ggttatctttcgatccatcatggct

SEQ ID NO: 471571 - DNA, 25 bp, Rattus norvegicus
ggttatctttcgttccatcatggct

SEQ ID NO: 471572 - DNA, 25 bp, Rattus norvegicus
ggttatgaaagtcgtcttcagtgtc

SEQ ID NO: 471573 - DNA, 25 bp, Rattus norvegicus
ggttatgaaagtggtcttcagtgtc

SEQ ID NO: 471574 - DNA, 25 bp, Rattus norvegicus
ggttatgacaagagtttcatcatct

SEQ ID NO: 471575 - DNA, 25 bp, Rattus norvegicus
ggttatgacaagtgtttcatcatct

SEQ ID NO: 471576 - DNA, 25 bp, Rattus norvegicus
ggttatgagcgcatgttcttgcaga

SEQ ID NO: 471577 - DNA, 25 bp, Rattus norvegicus
ggttatgagcgcttgttcttgcaga

SEQ ID NO: 471578 - DNA, 25 bp, Rattus norvegicus
ggttatgagcttctagttcatctta

SEQ ID NO: 471579 - DNA, 25 bp, Rattus norvegicus
ggttatgagcttgtagttcatctta

SEQ ID NO: 471580 - DNA, 25 bp, Rattus norvegicus
ggttatgagtgacccctattgcaaa

SEQ ID NO: 471581 - DNA, 25 bp, Rattus norvegicus
ggttatgagtgagccctattgcaaa

SEQ ID NO: 471582 - DNA, 25 bp, Rattus norvegicus
ggttatgatgccattagtgctatac

SEQ ID NO: 471583 - DNA, 25 bp, Rattus norvegicus
ggttatgatgcctttagtgctatac

SEQ ID NO: 471584 - DNA, 25 bp, Rattus norvegicus
ggttatgattccatgcttagagttg

SEQ ID NO: 471585 - DNA, 25 bp, Rattus norvegicus
ggttatgattccttgcttagagttg

SEQ ID NO: 471586 - DNA, 25 bp, Rattus norvegicus
ggttatgcacacagacaagactttt

SEQ ID NO: 471587 - DNA, 25 bp, Rattus norvegicus
ggttatgcacactgacaagactttt

SEQ ID NO: 471588 - DNA, 25 bp, Rattus norvegicus
ggttatgcccaaactgtgtagtatt

SEQ ID NO: 471589 - DNA, 25 bp, Rattus norvegicus
ggttatgcccaacagtggtggcaca

SEQ ID NO: 471590 - DNA, 25 bp, Rattus norvegicus
ggttatgcccaagagtggtggcaca

SEQ ID NO: 471591 - DNA, 25 bp, Rattus norvegicus
ggttatgcccaatctgtgtagtatt

SEQ ID NO: 471592 - DNA, 25 bp, Rattus norvegicus
ggttatgccggcactgaggcgcact

SEQ ID NO: 471593 - DNA, 25 bp, Rattus norvegicus
ggttatgccggctctgaggcgcact

SEQ ID NO: 471594 - DNA, 25 bp, Rattus norvegicus
ggttatgcgggaacctgcaagcaaa

SEQ ID NO: 471595 - DNA, 25 bp, Rattus norvegicus
ggttatgcgggatcctgcaagcaaa

SEQ ID NO: 471596 - DNA, 25 bp, Rattus norvegicus
ggttatgcgtatcacccggtatgaa

SEQ ID NO: 471597 - DNA, 25 bp, Rattus norvegicus
ggttatgcgtatgacccggtatgaa

SEQ ID NO: 471598 - DNA, 25 bp, Rattus norvegicus
ggttatgctgcccaacaacactgtc

SEQ ID NO: 471599 - DNA, 25 bp, Rattus norvegicus
ggttatgctgccgaacaacactgtc

SEQ ID NO: 471600 - DNA, 25 bp, Rattus norvegicus
ggttatgctggtctacaaggtgtca

SEQ ID NO: 471601 - DNA, 25 bp, Rattus norvegicus
ggttatgctggtgtacaaggtgtca

SEQ ID NO: 471602 - DNA, 25 bp, Rattus norvegicus
ggttatggaatgaggctacctcaat

SEQ ID NO: 471603 - DNA, 25 bp, Rattus norvegicus
ggttatggaatgtggctacctcaat

SEQ ID NO: 471604 - DNA, 25 bp, Rattus norvegicus
ggttatggggatatgcacaagcagc

SEQ ID NO: 471605 - DNA, 25 bp, Rattus norvegicus
ggttatggggatttgcacaagcagc

SEQ ID NO: 471606 - DNA, 25 bp, Rattus norvegicus
ggttatgggtacctgccacagcccc

SEQ ID NO: 471607 - DNA, 25 bp, Rattus norvegicus
ggttatgggtacgtgccacagcccc

SEQ ID NO: 471608 - DNA, 25 bp, Rattus norvegicus
ggttatgggtgaatccttggcttta

SEQ ID NO: 471609 - DNA, 25 bp, Rattus norvegicus
ggttatgggtgattccttggcttta

SEQ ID NO: 471610 - DNA, 25 bp, Rattus norvegicus
ggttatgtcaatagcagcagccaga

SEQ ID NO: 471611 - DNA, 25 bp, Rattus norvegicus
ggttatgtcaattgcagcagccaga

SEQ ID NO: 471612 - DNA, 25 bp, Rattus norvegicus
ggttatgttgtacagtccttttata

SEQ ID NO: 471613 - DNA, 25 bp, Rattus norvegicus
ggttatgttgtaccaatggctccct

SEQ ID NO: 471614 - DNA, 25 bp, Rattus norvegicus
ggttatgttgtagagtccttttata

SEQ ID NO: 471615 - DNA, 25 bp, Rattus norvegicus
ggttatgttgtagcaatggctccct

SEQ ID NO: 471616 - DNA, 25 bp, Rattus norvegicus
ggttatgttgtcaatttctttctta

SEQ ID NO: 471617 - DNA, 25 bp, Rattus norvegicus
ggttatgttgtctatttctttctta

SEQ ID NO: 471618 - DNA, 25 bp, Rattus norvegicus
ggttattaccacagtcagggctgtt

SEQ ID NO: 471619 - DNA, 25 bp, Rattus norvegicus
ggttattaccactgtcagggctgtt

SEQ ID NO: 471620 - DNA, 25 bp, Rattus norvegicus
ggttattagttccaccatcatttgg

SEQ ID NO: 471621 - DNA, 25 bp, Rattus norvegicus
ggttattagttcgaccatcatttgg

SEQ ID NO: 471622 - DNA, 25 bp, Rattus norvegicus
ggttattatcagctcacttcatttc

SEQ ID NO: 471623 - DNA, 25 bp, Rattus norvegicus
ggttattatcaggtcacttcatttc

SEQ ID NO: 471624 - DNA, 25 bp, Rattus norvegicus
ggttattatggtcttagttatcgaa

SEQ ID NO: 471625 - DNA, 25 bp, Rattus norvegicus
ggttattatggtgttagttatcgaa

SEQ ID NO: 471626 - DNA, 25 bp, Rattus norvegicus
ggttattattctcgagcctcaaata

SEQ ID NO: 471627 - DNA, 25 bp, Rattus norvegicus
ggttattattctcgtccccaaatat

SEQ ID NO: 471628 - DNA, 25 bp, Rattus norvegicus
ggttattattctggagcctcaaata

SEQ ID NO: 471629 - DNA, 25 bp, Rattus norvegicus
ggttattattctggtccccaaatat

SEQ ID NO: 471630 - DNA, 25 bp, Rattus norvegicus
ggttattcattcagactcgtggtcc

SEQ ID NO: 471631 - DNA, 25 bp, Rattus norvegicus
ggttattcattctgactcgtggtcc

SEQ ID NO: 471632 - DNA, 25 bp, Rattus norvegicus
ggttattgaaagatctgctgcatat

SEQ ID NO: 471633 - DNA, 25 bp, Rattus norvegicus
ggttattgaaagttctgctgcatat

SEQ ID NO: 471634 - DNA, 25 bp, Rattus norvegicus
ggttattgaagcatactgcacaagt

SEQ ID NO: 471635 - DNA, 25 bp, Rattus norvegicus
ggttattgaagcttactgcacaagt

SEQ ID NO: 471636 - DNA, 25 bp, Rattus norvegicus
ggttattgatacattgcatcgacat

SEQ ID NO: 471637 - DNA, 25 bp, Rattus norvegicus
ggttattgatactttgcatcgacat

SEQ ID NO: 471638 - DNA, 25 bp, Rattus norvegicus
ggttattgccagcacttcgatccaa

SEQ ID NO: 471639 - DNA, 25 bp, Rattus norvegicus
ggttattgccaggacttcgatccaa

SEQ ID NO: 471640 - DNA, 25 bp, Rattus norvegicus
ggttattggctgacctcagtggcca

SEQ ID NO: 471641 - DNA, 25 bp, Rattus norvegicus
ggttattggctgtcctcagtggcca

SEQ ID NO: 471642 - DNA, 25 bp, Rattus norvegicus
ggttatttaaacaattgtttgcagt

SEQ ID NO: 471643 - DNA, 25 bp, Rattus norvegicus
ggttatttaaactattgtttgcagt

SEQ ID NO: 471644 - DNA, 25 bp, Rattus norvegicus
ggttatttcatcatgtaacattcct

SEQ ID NO: 471645 - DNA, 25 bp, Rattus norvegicus
ggttatttcatcttgtaacattcct

SEQ ID NO: 471646 - DNA, 25 bp, Rattus norvegicus
ggttatttccctcgtcataggccct

SEQ ID NO: 471647 - DNA, 25 bp, Rattus norvegicus
ggttatttccctggtcataggccct

SEQ ID NO: 471648 - DNA, 25 bp, Rattus norvegicus
ggttatttctgaccgacaaacacca

SEQ ID NO: 471649 - DNA, 25 bp, Rattus norvegicus
ggttatttctgagcgacaaacacca

SEQ ID NO: 471650 - DNA, 25 bp, Rattus norvegicus
ggttattttattattcatcaggcga

SEQ ID NO: 471651 - DNA, 25 bp, Rattus norvegicus
ggttattttatttttcatcaggcga

SEQ ID NO: 471652 - DNA, 25 bp, Rattus norvegicus
ggttattttcttcctcatcagagtc

SEQ ID NO: 471653 - DNA, 25 bp, Rattus norvegicus
ggttattttcttgctcatcagagtc

SEQ ID NO: 471654 - DNA, 25 bp, Rattus norvegicus
ggttatttttacacccagcattaag

SEQ ID NO: 471655 - DNA, 25 bp, Rattus norvegicus
ggttatttttactcccagcattaag

SEQ ID NO: 471656 - DNA, 25 bp, Rattus norvegicus
ggttatttttcccagtcatccatga

SEQ ID NO: 471657 - DNA, 25 bp, Rattus norvegicus
ggttatttttccgagtcatccatga

SEQ ID NO: 471658 - DNA, 25 bp, Rattus norvegicus
ggttatttttctaggcatttacact

SEQ ID NO: 471659 - DNA, 25 bp, Rattus norvegicus
ggttatttttctcttgtaccatatg

SEQ ID NO: 471660 - DNA, 25 bp, Rattus norvegicus
ggttatttttctgttgtaccatatg

SEQ ID NO: 471661 - DNA, 25 bp, Rattus norvegicus
ggttatttttcttggcatttacact

SEQ ID NO: 471662 - DNA, 25 bp, Rattus norvegicus
ggttcaaaaaccctgtcagccaatg

SEQ ID NO: 471663 - DNA, 25 bp, Rattus norvegicus
ggttcaaaaaccgtgtcagccaatg

SEQ ID NO: 471664 - DNA, 25 bp, Rattus norvegicus
ggttcaaacatcatccggacatcct

SEQ ID NO: 471665 - DNA, 25 bp, Rattus norvegicus
ggttcaaacatcttccggacatcct

SEQ ID NO: 471666 - DNA, 25 bp, Rattus norvegicus
ggttcaaacattccaaattctccct

SEQ ID NO: 471667 - DNA, 25 bp, Rattus norvegicus
ggttcaaacattgcaaattctccct

SEQ ID NO: 471668 - DNA, 25 bp, Rattus norvegicus
ggttcaaagattacaggccatgcag

SEQ ID NO: 471669 - DNA, 25 bp, Rattus norvegicus
ggttcaaagatttcaggccatgcag

SEQ ID NO: 471670 - DNA, 25 bp, Rattus norvegicus
ggttcaaagtcaaccttggttgcat

SEQ ID NO: 471671 - DNA, 25 bp, Rattus norvegicus
ggttcaaagtcatccttggttgcat

SEQ ID NO: 471672 - DNA, 25 bp, Rattus norvegicus
ggttcaaatccacaatctcacgcat

SEQ ID NO: 471673 - DNA, 25 bp, Rattus norvegicus
ggttcaaatccagaatctcacgcat

SEQ ID NO: 471674 - DNA, 25 bp, Rattus norvegicus
ggttcaaatcttactctgactcagc

SEQ ID NO: 471675 - DNA, 25 bp, Rattus norvegicus
ggttcaaatctttctctgactcagc

SEQ ID NO: 471676 - DNA, 25 bp, Rattus norvegicus
ggttcaacatttattctgacatatg

SEQ ID NO: 471677 - DNA, 25 bp, Rattus norvegicus
ggttcaacattttttctgacatatg

SEQ ID NO: 471678 - DNA, 25 bp, Rattus norvegicus
ggttcaacccaaccgctgtatagta

SEQ ID NO: 471679 - DNA, 25 bp, Rattus norvegicus
ggttcaacccaagcgctgtatagta

SEQ ID NO: 471680 - DNA, 25 bp, Rattus norvegicus
ggttcaaccgccatttggacagagt

SEQ ID NO: 471681 - DNA, 25 bp, Rattus norvegicus
ggttcaaccgccttttggacagagt

SEQ ID NO: 471682 - DNA, 25 bp, Rattus norvegicus
ggttcaacctccagcgataagactt

SEQ ID NO: 471683 - DNA, 25 bp, Rattus norvegicus
ggttcaacctcctgcgataagactt

SEQ ID NO: 471684 - DNA, 25 bp, Rattus norvegicus
ggttcaacgttgatttctcagctct

SEQ ID NO: 471685 - DNA, 25 bp, Rattus norvegicus
ggttcaacgttgttttctcagctct

SEQ ID NO: 471686 - DNA, 25 bp, Rattus norvegicus
ggttcaactcacagcattctctgat

SEQ ID NO: 471687 - DNA, 25 bp, Rattus norvegicus
ggttcaactcactgcattctctgat

SEQ ID NO: 471688 - DNA, 25 bp, Rattus norvegicus
ggttcaactgccagagatgctttca

SEQ ID NO: 471689 - DNA, 25 bp, Rattus norvegicus
ggttcaactgcctgagatgctttca

SEQ ID NO: 471690 - DNA, 25 bp, Rattus norvegicus
ggttcaactggcagttacttgcaac

SEQ ID NO: 471691 - DNA, 25 bp, Rattus norvegicus
ggttcaactggctgttacttgcaac

SEQ ID NO: 471692 - DNA, 25 bp, Rattus norvegicus
ggttcaacttcacactgagacactt

SEQ ID NO: 471693 - DNA, 25 bp, Rattus norvegicus
ggttcaacttcagactgagacactt

SEQ ID NO: 471694 - DNA, 25 bp, Rattus norvegicus
ggttcaagccccaggagacagcagt

SEQ ID NO: 471695 - DNA, 25 bp, Rattus norvegicus
ggttcaagcccctggagacagcagt

SEQ ID NO: 471696 - DNA, 25 bp, Rattus norvegicus
ggttcaagctggaatgtggcttttt

SEQ ID NO: 471697 - DNA, 25 bp, Rattus norvegicus
ggttcaagctggtatgtggcttttt

SEQ ID NO: 471698 - DNA, 25 bp, Rattus norvegicus
ggttcaaggacactttcaccgagaa

SEQ ID NO: 471699 - DNA, 25 bp, Rattus norvegicus
ggttcaaggacagtttcaccgagaa

SEQ ID NO: 471700 - DNA, 25 bp, Rattus norvegicus
ggttcaagtaagagagcgtctcatc

SEQ ID NO: 471701 - DNA, 25 bp, Rattus norvegicus
ggttcaagtaagtgagcgtctcatc

SEQ ID NO: 471702 - DNA, 25 bp, Rattus norvegicus
ggttcaagtctaagcacccacagga

SEQ ID NO: 471703 - DNA, 25 bp, Rattus norvegicus
ggttcaagtctatgcacccacagga

SEQ ID NO: 471704 - DNA, 25 bp, Rattus norvegicus
ggttcaagttgacagcccatagcca

SEQ ID NO: 471705 - DNA, 25 bp, Rattus norvegicus
ggttcaagttgagagcccatagcca

SEQ ID NO: 471706 - DNA, 25 bp, Rattus norvegicus
ggttcaatactgaggctctccaata

SEQ ID NO: 471707 - DNA, 25 bp, Rattus norvegicus
ggttcaatactgtggctctccaata

SEQ ID NO: 471708 - DNA, 25 bp, Rattus norvegicus
ggttcaatccctctcatcacaagga

SEQ ID NO: 471709 - DNA, 25 bp, Rattus norvegicus
ggttcaatccctgtcatcacaagga

SEQ ID NO: 471710 - DNA, 25 bp, Rattus norvegicus
ggttcaatgaggacgcacatctggg

SEQ ID NO: 471711 - DNA, 25 bp, Rattus norvegicus
ggttcaatgaggtcgcacatctggg

SEQ ID NO: 471712 - DNA, 25 bp, Rattus norvegicus
ggttcaatgcctccaatttccatgc

SEQ ID NO: 471713 - DNA, 25 bp, Rattus norvegicus
ggttcaatgcctgcaatttccatgc

SEQ ID NO: 471714 - DNA, 25 bp, Rattus norvegicus
ggttcaattaccaccttaatggcat

SEQ ID NO: 471715 - DNA, 25 bp, Rattus norvegicus
ggttcaattacctccttaatggcat

SEQ ID NO: 471716 - DNA, 25 bp, Rattus norvegicus
ggttcaatttctacaactcacagta

SEQ ID NO: 471717 - DNA, 25 bp, Rattus norvegicus
ggttcaatttcttcaactcacagta

SEQ ID NO: 471718 - DNA, 25 bp, Rattus norvegicus
ggttcaatttgtacctcacagaatc

SEQ ID NO: 471719 - DNA, 25 bp, Rattus norvegicus
ggttcaatttgttcctcacagaatc

SEQ ID NO: 471720 - DNA, 25 bp, Rattus norvegicus
ggttcacaagcaccctgtattcctg

SEQ ID NO: 471721 - DNA, 25 bp, Rattus norvegicus
ggttcacaagcagcctgtattcctg

SEQ ID NO: 471722 - DNA, 25 bp, Rattus norvegicus
ggttcacaatctctaactcagttca

SEQ ID NO: 471723 - DNA, 25 bp, Rattus norvegicus
ggttcacaatctgtaactcagttca

SEQ ID NO: 471724 - DNA, 25 bp, Rattus norvegicus
ggttcacacaatattttccagaaca

SEQ ID NO: 471725 - DNA, 25 bp, Rattus norvegicus
ggttcacacaattttttccagaaca

SEQ ID NO: 471726 - DNA, 25 bp, Rattus norvegicus
ggttcacaccatactgactgctgac

SEQ ID NO: 471727 - DNA, 25 bp, Rattus norvegicus
ggttcacaccattctgactgctgac

SEQ ID NO: 471728 - DNA, 25 bp, Rattus norvegicus
ggttcacagcagcaaacacactgga

SEQ ID NO: 471729 - DNA, 25 bp, Rattus norvegicus
ggttcacagcaggaaacacactgga

SEQ ID NO: 471730 - DNA, 25 bp, Rattus norvegicus
ggttcacagcatcccacagtaaaat

SEQ ID NO: 471731 - DNA, 25 bp, Rattus norvegicus
ggttcacagcatgccacagtaaaat

SEQ ID NO: 471732 - DNA, 25 bp, Rattus norvegicus
ggttcacaggcaaacttgaagccaa

SEQ ID NO: 471733 - DNA, 25 bp, Rattus norvegicus
ggttcacaggcatacttgaagccaa

SEQ ID NO: 471734 - DNA, 25 bp, Rattus norvegicus
ggttcacagtcgcaggagccaaaac

SEQ ID NO: 471735 - DNA, 25 bp, Rattus norvegicus
ggttcacagtcggaggagccaaaac

SEQ ID NO: 471736 - DNA, 25 bp, Rattus norvegicus
ggttcacagtgtcaccctgataaag

SEQ ID NO: 471737 - DNA, 25 bp, Rattus norvegicus
ggttcacagtgtgaccctgataaag

SEQ ID NO: 471738 - DNA, 25 bp, Rattus norvegicus
ggttcacagttaccatctggtgtca

SEQ ID NO: 471739 - DNA, 25 bp, Rattus norvegicus
ggttcacagttagcatctggtgtca

SEQ ID NO: 471740 - DNA, 25 bp, Rattus norvegicus
ggttcacataaacagtccatccaaa

SEQ ID NO: 471741 - DNA, 25 bp, Rattus norvegicus
ggttcacataaagagtccatccaaa

SEQ ID NO: 471742 - DNA, 25 bp, Rattus norvegicus
ggttcacatcatcgtcacattgtct

SEQ ID NO: 471743 - DNA, 25 bp, Rattus norvegicus
ggttcacatcatggtcacattgtct

SEQ ID NO: 471744 - DNA, 25 bp, Rattus norvegicus
ggttcacatgtaactgtgcaggcaa

SEQ ID NO: 471745 - DNA, 25 bp, Rattus norvegicus
ggttcacatgtatctgtgcaggcaa

SEQ ID NO: 471746 - DNA, 25 bp, Rattus norvegicus
ggttcacattcactgcagctgctat

SEQ ID NO: 471747 - DNA, 25 bp, Rattus norvegicus
ggttcacattcagtgcagctgctat

SEQ ID NO: 471748 - DNA, 25 bp, Rattus norvegicus
ggttcaccaaatactcatgtatgtt

SEQ ID NO: 471749 - DNA, 25 bp, Rattus norvegicus
ggttcaccaaattctcatgtatgtt

SEQ ID NO: 471750 - DNA, 25 bp, Rattus norvegicus
ggttcaccactaaggactttgcttc

SEQ ID NO: 471751 - DNA, 25 bp, Rattus norvegicus
ggttcaccactatggactttgcttc

SEQ ID NO: 471752 - DNA, 25 bp, Rattus norvegicus
ggttcaccagtgcaagtgctacagt

SEQ ID NO: 471753 - DNA, 25 bp, Rattus norvegicus
ggttcaccagtgctatttaaacaaa

SEQ ID NO: 471754 - DNA, 25 bp, Rattus norvegicus
ggttcaccagtggaagtgctacagt

SEQ ID NO: 471755 - DNA, 25 bp, Rattus norvegicus
ggttcaccagtggtatttaaacaaa

SEQ ID NO: 471756 - DNA, 25 bp, Rattus norvegicus
ggttcaccatagcaagttctccagt

SEQ ID NO: 471757 - DNA, 25 bp, Rattus norvegicus
ggttcaccataggaagttctccagt

SEQ ID NO: 471758 - DNA, 25 bp, Rattus norvegicus
ggttcaccatcaatttacacgttaa

SEQ ID NO: 471759 - DNA, 25 bp, Rattus norvegicus
ggttcaccatcattttacacgttaa

SEQ ID NO: 471760 - DNA, 25 bp, Rattus norvegicus
ggttcacccacaacagctttaggta

SEQ ID NO: 471761 - DNA, 25 bp, Rattus norvegicus
ggttcacccacatcagctttaggta

SEQ ID NO: 471762 - DNA, 25 bp, Rattus norvegicus
ggttcaccctgactccataaatggc

SEQ ID NO: 471763 - DNA, 25 bp, Rattus norvegicus
ggttcaccctgagtccataaatggc

SEQ ID NO: 471764 - DNA, 25 bp, Rattus norvegicus
ggttcacctaatatgcccagtcaaa

SEQ ID NO: 471765 - DNA, 25 bp, Rattus norvegicus
ggttcacctaatttgcccagtcaaa

SEQ ID NO: 471766 - DNA, 25 bp, Rattus norvegicus
ggttcacctactacagtgttgacca

SEQ ID NO: 471767 - DNA, 25 bp, Rattus norvegicus
ggttcacctacttcagtgttgacca

SEQ ID NO: 471768 - DNA, 25 bp, Rattus norvegicus
ggttcacctcagctcctacatagga

SEQ ID NO: 471769 - DNA, 25 bp, Rattus norvegicus
ggttcacctcaggtcctacatagga

SEQ ID NO: 471770 - DNA, 25 bp, Rattus norvegicus
ggttcaccttaaactgcctttttgt

SEQ ID NO: 471771 - DNA, 25 bp, Rattus norvegicus
ggttcaccttaatctgcctttttgt

SEQ ID NO: 471772 - DNA, 25 bp, Rattus norvegicus
ggttcaccttaccaaagactctatc

SEQ ID NO: 471773 - DNA, 25 bp, Rattus norvegicus
ggttcaccttacgaaagactctatc

SEQ ID NO: 471774 - DNA, 25 bp, Rattus norvegicus
ggttcaccttatcccagaagccatg

SEQ ID NO: 471775 - DNA, 25 bp, Rattus norvegicus
ggttcaccttatgccagaagccatg

SEQ ID NO: 471776 - DNA, 25 bp, Rattus norvegicus
ggttcacctttgctttgcttctgac

SEQ ID NO: 471777 - DNA, 25 bp, Rattus norvegicus
ggttcacctttggtttgcttctgac

SEQ ID NO: 471778 - DNA, 25 bp, Rattus norvegicus
ggttcaccttttaatgcccaagctt

SEQ ID NO: 471779 - DNA, 25 bp, Rattus norvegicus
ggttcacctttttatgcccaagctt

SEQ ID NO: 471780 - DNA, 25 bp, Rattus norvegicus
ggttcacgaaccagcagttttcact

SEQ ID NO: 471781 - DNA, 25 bp, Rattus norvegicus
ggttcacgaacctgcagttttcact

SEQ ID NO: 471782 - DNA, 25 bp, Rattus norvegicus
ggttcacgcagtccggagacctgta

SEQ ID NO: 471783 - DNA, 25 bp, Rattus norvegicus
ggttcacgcagtgcggagacctgta

SEQ ID NO: 471784 - DNA, 25 bp, Rattus norvegicus
ggttcacgttttctttgctatccag

SEQ ID NO: 471785 - DNA, 25 bp, Rattus norvegicus
ggttcacgttttgtttgctatccag

SEQ ID NO: 471786 - DNA, 25 bp, Rattus norvegicus
ggttcactaaatcctatcatctgtt

SEQ ID NO: 471787 - DNA, 25 bp, Rattus norvegicus
ggttcactaaatgctatcatctgtt

SEQ ID NO: 471788 - DNA, 25 bp, Rattus norvegicus
ggttcactcgttactatcctagaag

SEQ ID NO: 471789 - DNA, 25 bp, Rattus norvegicus
ggttcactcgtttctatcctagaag

SEQ ID NO: 471790 - DNA, 25 bp, Rattus norvegicus
ggttcactcttaaagcaacttggat

SEQ ID NO: 471791 - DNA, 25 bp, Rattus norvegicus
ggttcactcttatagcaacttggat

SEQ ID NO: 471792 - DNA, 25 bp, Rattus norvegicus
ggttcactctttatgtgactccact

SEQ ID NO: 471793 - DNA, 25 bp, Rattus norvegicus
ggttcactctttttgtgactccact

SEQ ID NO: 471794 - DNA, 25 bp, Rattus norvegicus
ggttcactgacaattttcttactgg

SEQ ID NO: 471795 - DNA, 25 bp, Rattus norvegicus
ggttcactgacatttttcttactgg

SEQ ID NO: 471796 - DNA, 25 bp, Rattus norvegicus
ggttcactgagtatggtttgcccac

SEQ ID NO: 471797 - DNA, 25 bp, Rattus norvegicus
ggttcactgagtttggtttgcccac

SEQ ID NO: 471798 - DNA, 25 bp, Rattus norvegicus
ggttcactgggacctttctaggtga

SEQ ID NO: 471799 - DNA, 25 bp, Rattus norvegicus
ggttcactgggagctttctaggtga

SEQ ID NO: 471800 - DNA, 25 bp, Rattus norvegicus
ggttcactgtaacatttcacacgcc

SEQ ID NO: 471801 - DNA, 25 bp, Rattus norvegicus
ggttcactgtaagatttcacacgcc

SEQ ID NO: 471802 - DNA, 25 bp, Rattus norvegicus
ggttcactgtccacataacatactt

SEQ ID NO: 471803 - DNA, 25 bp, Rattus norvegicus
ggttcactgtcccatgaaactgctt

SEQ ID NO: 471804 - DNA, 25 bp, Rattus norvegicus
ggttcactgtccgatgaaactgctt

SEQ ID NO: 471805 - DNA, 25 bp, Rattus norvegicus
ggttcactgtcctcataacatactt

SEQ ID NO: 471806 - DNA, 25 bp, Rattus norvegicus
ggttcactgtgaagatgatgatcta

SEQ ID NO: 471807 - DNA, 25 bp, Rattus norvegicus
ggttcactgtgatgatgatgatcta

SEQ ID NO: 471808 - DNA, 25 bp, Rattus norvegicus
ggttcacttattcctaatattgcgg

SEQ ID NO: 471809 - DNA, 25 bp, Rattus norvegicus
ggttcacttattgctaatattgcgg

SEQ ID NO: 471810 - DNA, 25 bp, Rattus norvegicus
ggttcacttcggctatcacccggtc

SEQ ID NO: 471811 - DNA, 25 bp, Rattus norvegicus
ggttcacttcgggtatcacccggtc

SEQ ID NO: 471812 - DNA, 25 bp, Rattus norvegicus
ggttcactttgacatgctgtcccaa

SEQ ID NO: 471813 - DNA, 25 bp, Rattus norvegicus
ggttcactttgagatgctgtcccaa

SEQ ID NO: 471814 - DNA, 25 bp, Rattus norvegicus
ggttcactttggattggtgtaatga

SEQ ID NO: 471815 - DNA, 25 bp, Rattus norvegicus
ggttcactttggtttggtgtaatga

SEQ ID NO: 471816 - DNA, 25 bp, Rattus norvegicus
ggttcagaacggagctggctgggct

SEQ ID NO: 471817 - DNA, 25 bp, Rattus norvegicus
ggttcagaacggtgctggctgggct

SEQ ID NO: 471818 - DNA, 25 bp, Rattus norvegicus
ggttcagaactaaaccttcttacct

SEQ ID NO: 471819 - DNA, 25 bp, Rattus norvegicus
ggttcagaactataccttcttacct

SEQ ID NO: 471820 - DNA, 25 bp, Rattus norvegicus
ggttcagaactcagaactccagctc

SEQ ID NO: 471821 - DNA, 25 bp, Rattus norvegicus
ggttcagaactctgaactccagctc

SEQ ID NO: 471822 - DNA, 25 bp, Rattus norvegicus
ggttcagaactgcacccatgtcggc

SEQ ID NO: 471823 - DNA, 25 bp, Rattus norvegicus
ggttcagaactggacccatgtcggc

SEQ ID NO: 471824 - DNA, 25 bp, Rattus norvegicus
ggttcagaagcccagcgggtcctcc

SEQ ID NO: 471825 - DNA, 25 bp, Rattus norvegicus
ggttcagaagccgagcgggtcctcc

SEQ ID NO: 471826 - DNA, 25 bp, Rattus norvegicus
ggttcagacattctctttttccctc

SEQ ID NO: 471827 - DNA, 25 bp, Rattus norvegicus
ggttcagacattgtctttttccctc

SEQ ID NO: 471828 - DNA, 25 bp, Rattus norvegicus
ggttcagagccaccatccgtggtga

SEQ ID NO: 471829 - DNA, 25 bp, Rattus norvegicus
ggttcagagccagcatccgtggtga

SEQ ID NO: 471830 - DNA, 25 bp, Rattus norvegicus
ggttcagagcctaaccagggaggct

SEQ ID NO: 471831 - DNA, 25 bp, Rattus norvegicus
ggttcagagccttaccagggaggct

SEQ ID NO: 471832 - DNA, 25 bp, Rattus norvegicus
ggttcagagctgatacacggagcta

SEQ ID NO: 471833 - DNA, 25 bp, Rattus norvegicus
ggttcagagctgttacacggagcta

SEQ ID NO: 471834 - DNA, 25 bp, Rattus norvegicus
ggttcagaggccacagcagcatggt

SEQ ID NO: 471835 - DNA, 25 bp, Rattus norvegicus
ggttcagaggcctcagcagcatggt

SEQ ID NO: 471836 - DNA, 25 bp, Rattus norvegicus
ggttcagatcttaccgtctatggat

SEQ ID NO: 471837 - DNA, 25 bp, Rattus norvegicus
ggttcagatctttccgtctatggat

SEQ ID NO: 471838 - DNA, 25 bp, Rattus norvegicus
ggttcagattggaacagacctgact

SEQ ID NO: 471839 - DNA, 25 bp, Rattus norvegicus
ggttcagattggtacagacctgact

SEQ ID NO: 471840 - DNA, 25 bp, Rattus norvegicus
ggttcagcaaagctttccagaatac

SEQ ID NO: 471841 - DNA, 25 bp, Rattus norvegicus
ggttcagcaaaggtttccagaatac

SEQ ID NO: 471842 - DNA, 25 bp, Rattus norvegicus
ggttcagcaaccctgtcatttggag

SEQ ID NO: 471843 - DNA, 25 bp, Rattus norvegicus
ggttcagcaaccgtgtcatttggag

SEQ ID NO: 471844 - DNA, 25 bp, Rattus norvegicus
ggttcagcaatgacaagtccctcca

SEQ ID NO: 471845 - DNA, 25 bp, Rattus norvegicus
ggttcagcaatgtcaagtccctcca

SEQ ID NO: 471846 - DNA, 25 bp, Rattus norvegicus
ggttcagcacccattaagcattcag

SEQ ID NO: 471847 - DNA, 25 bp, Rattus norvegicus
ggttcagcaccctttaagcattcag

SEQ ID NO: 471848 - DNA, 25 bp, Rattus norvegicus
ggttcagcagctcgagcaagcctta

SEQ ID NO: 471849 - DNA, 25 bp, Rattus norvegicus
ggttcagcagctggagcaagcctta

SEQ ID NO: 471850 - DNA, 25 bp, Rattus norvegicus
ggttcagcataccttatagttcgta

SEQ ID NO: 471851 - DNA, 25 bp, Rattus norvegicus
ggttcagcatacgttatagttcgta

SEQ ID NO: 471852 - DNA, 25 bp, Rattus norvegicus
ggttcagcatatcatacggagacaa

SEQ ID NO: 471853 - DNA, 25 bp, Rattus norvegicus
ggttcagcatatgatacggagacaa

SEQ ID NO: 471854 - DNA, 25 bp, Rattus norvegicus
ggttcagccactccatgttcatggg

SEQ ID NO: 471855 - DNA, 25 bp, Rattus norvegicus
ggttcagccactgcatgttcatggg

SEQ ID NO: 471856 - DNA, 25 bp, Rattus norvegicus
ggttcagccagacagttccgtgaga

SEQ ID NO: 471857 - DNA, 25 bp, Rattus norvegicus
ggttcagccagagagttccgtgaga

SEQ ID NO: 471858 - DNA, 25 bp, Rattus norvegicus
ggttcagccagtactccaaataaaa

SEQ ID NO: 471859 - DNA, 25 bp, Rattus norvegicus
ggttcagccagtattcacatgccag

SEQ ID NO: 471860 - DNA, 25 bp, Rattus norvegicus
ggttcagccagttctccaaataaaa

SEQ ID NO: 471861 - DNA, 25 bp, Rattus norvegicus
ggttcagccagttttcacatgccag

SEQ ID NO: 471862 - DNA, 25 bp, Rattus norvegicus
ggttcagcctgaagctcaagacatt

SEQ ID NO: 471863 - DNA, 25 bp, Rattus norvegicus
ggttcagcctgatgctcaagacatt

SEQ ID NO: 471864 - DNA, 25 bp, Rattus norvegicus
ggttcagcgtcaccggaactgcaac

SEQ ID NO: 471865 - DNA, 25 bp, Rattus norvegicus
ggttcagcgtcagcggaactgcaac

SEQ ID NO: 471866 - DNA, 25 bp, Rattus norvegicus
ggttcagctgacagaagcacctccc

SEQ ID NO: 471867 - DNA, 25 bp, Rattus norvegicus
ggttcagctgactgaagcacctccc

SEQ ID NO: 471868 - DNA, 25 bp, Rattus norvegicus
ggttcagctgctacagaaggccatg

SEQ ID NO: 471869 - DNA, 25 bp, Rattus norvegicus
ggttcagctgcttcagaaggccatg

SEQ ID NO: 471870 - DNA, 25 bp, Rattus norvegicus
ggttcaggagcacgattgccaccag

SEQ ID NO: 471871 - DNA, 25 bp, Rattus norvegicus
ggttcaggagcaggattgccaccag

SEQ ID NO: 471872 - DNA, 25 bp, Rattus norvegicus
ggttcaggataactgtattcccatt

SEQ ID NO: 471873 - DNA, 25 bp, Rattus norvegicus
ggttcaggataagtgtattcccatt

SEQ ID NO: 471874 - DNA, 25 bp, Rattus norvegicus
ggttcaggcactagacctctagtca

SEQ ID NO: 471875 - DNA, 25 bp, Rattus norvegicus
ggttcaggcacttgacctctagtca

SEQ ID NO: 471876 - DNA, 25 bp, Rattus norvegicus
ggttcagggacaatccacttgttct

SEQ ID NO: 471877 - DNA, 25 bp, Rattus norvegicus
ggttcagggacattccacttgttct

SEQ ID NO: 471878 - DNA, 25 bp, Rattus norvegicus
ggttcagggcatcctaaactcttga

SEQ ID NO: 471879 - DNA, 25 bp, Rattus norvegicus
ggttcagggcatgctaaactcttga

SEQ ID NO: 471880 - DNA, 25 bp, Rattus norvegicus
ggttcagtaaataacagccgctttt

SEQ ID NO: 471881 - DNA, 25 bp, Rattus norvegicus
ggttcagtaaattacagccgctttt

SEQ ID NO: 471882 - DNA, 25 bp, Rattus norvegicus
ggttcagtacagatcttaggagcac

SEQ ID NO: 471883 - DNA, 25 bp, Rattus norvegicus
ggttcagtacagttcttaggagcac

SEQ ID NO: 471884 - DNA, 25 bp, Rattus norvegicus
ggttcagtacctcaaggcagactct

SEQ ID NO: 471885 - DNA, 25 bp, Rattus norvegicus
ggttcagtacctgaaggcagactct

SEQ ID NO: 471886 - DNA, 25 bp, Rattus norvegicus
ggttcagtcagcaggtcacgctttg

SEQ ID NO: 471887 - DNA, 25 bp, Rattus norvegicus
ggttcagtcagctggtcacgctttg

SEQ ID NO: 471888 - DNA, 25 bp, Rattus norvegicus
ggttcagtgattacgagtccacaca

SEQ ID NO: 471889 - DNA, 25 bp, Rattus norvegicus
ggttcagtgatttcgagtccacaca

SEQ ID NO: 471890 - DNA, 25 bp, Rattus norvegicus
ggttcagtggcaccgacagtgtcct

SEQ ID NO: 471891 - DNA, 25 bp, Rattus norvegicus
ggttcagtggcagcgacagtgtcct

SEQ ID NO: 471892 - DNA, 25 bp, Rattus norvegicus
ggttcagtgttgctcagttttgttt

SEQ ID NO: 471893 - DNA, 25 bp, Rattus norvegicus
ggttcagtgttggtcagttttgttt

SEQ ID NO: 471894 - DNA, 25 bp, Rattus norvegicus
ggttcagttaaaacccatcatgcta

SEQ ID NO: 471895 - DNA, 25 bp, Rattus norvegicus
ggttcagttaaatcccatcatgcta

SEQ ID NO: 471896 - DNA, 25 bp, Rattus norvegicus
ggttcataagtgatgcagcttggct

SEQ ID NO: 471897 - DNA, 25 bp, Rattus norvegicus
ggttcataagtgttgcagcttggct

SEQ ID NO: 471898 - DNA, 25 bp, Rattus norvegicus
ggttcataatggagcctttcatcgc

SEQ ID NO: 471899 - DNA, 25 bp, Rattus norvegicus
ggttcataatggtgcctttcatcgc

SEQ ID NO: 471900 - DNA, 25 bp, Rattus norvegicus
ggttcataattgagggtccctccca

SEQ ID NO: 471901 - DNA, 25 bp, Rattus norvegicus
ggttcataattgtgggtccctccca

SEQ ID NO: 471902 - DNA, 25 bp, Rattus norvegicus
ggttcatacactcaccaatgcttag

SEQ ID NO: 471903 - DNA, 25 bp, Rattus norvegicus
ggttcatacactgaccaatgcttag

SEQ ID NO: 471904 - DNA, 25 bp, Rattus norvegicus
ggttcatagccgagtgtcccttgct

SEQ ID NO: 471905 - DNA, 25 bp, Rattus norvegicus
ggttcatagccgtgtgtcccttgct

SEQ ID NO: 471906 - DNA, 25 bp, Rattus norvegicus
ggttcatatacaagccactcttttc

SEQ ID NO: 471907 - DNA, 25 bp, Rattus norvegicus
ggttcatatacatgccactcttttc

SEQ ID NO: 471908 - DNA, 25 bp, Rattus norvegicus
ggttcatatactcgtccctatggga

SEQ ID NO: 471909 - DNA, 25 bp, Rattus norvegicus
ggttcatatactggtccctatggga

SEQ ID NO: 471910 - DNA, 25 bp, Rattus norvegicus
ggttcatatcaactccagagccgac

SEQ ID NO: 471911 - DNA, 25 bp, Rattus norvegicus
ggttcatatcaagtccagagccgac

SEQ ID NO: 471912 - DNA, 25 bp, Rattus norvegicus
ggttcatatcctactgttctacaaa

SEQ ID NO: 471913 - DNA, 25 bp, Rattus norvegicus
ggttcatatccttctgttctacaaa

SEQ ID NO: 471914 - DNA, 25 bp, Rattus norvegicus
ggttcatatggaccacatcccaaac

SEQ ID NO: 471915 - DNA, 25 bp, Rattus norvegicus
ggttcatatggagcacatcccaaac

SEQ ID NO: 471916 - DNA, 25 bp, Rattus norvegicus
ggttcatcacatactctgtgctgaa

SEQ ID NO: 471917 - DNA, 25 bp, Rattus norvegicus
ggttcatcacattctctgtgctgaa

SEQ ID NO: 471918 - DNA, 25 bp, Rattus norvegicus
ggttcatcactgagcatccttgtat

SEQ ID NO: 471919 - DNA, 25 bp, Rattus norvegicus
ggttcatcactgtgcatccttgtat

SEQ ID NO: 471920 - DNA, 25 bp, Rattus norvegicus
ggttcatcagccaaggtggatctca

SEQ ID NO: 471921 - DNA, 25 bp, Rattus norvegicus
ggttcatcagcctaggtggatctca

SEQ ID NO: 471922 - DNA, 25 bp, Rattus norvegicus
ggttcatcagggaagccaatccttt

SEQ ID NO: 471923 - DNA, 25 bp, Rattus norvegicus
ggttcatcagggtagccaatccttt

SEQ ID NO: 471924 - DNA, 25 bp, Rattus norvegicus
ggttcatcagttacttgtccctgtc

SEQ ID NO: 471925 - DNA, 25 bp, Rattus norvegicus
ggttcatcagttcgtgactttcaat

SEQ ID NO: 471926 - DNA, 25 bp, Rattus norvegicus
ggttcatcagttggtgactttcaat

SEQ ID NO: 471927 - DNA, 25 bp, Rattus norvegicus
ggttcatcagtttcttgtccctgtc

SEQ ID NO: 471928 - DNA, 25 bp, Rattus norvegicus
ggttcatcatatctagcctttaata

SEQ ID NO: 471929 - DNA, 25 bp, Rattus norvegicus
ggttcatcatatgtagcctttaata

SEQ ID NO: 471930 - DNA, 25 bp, Rattus norvegicus
ggttcatccaccaggaactggaatt

SEQ ID NO: 471931 - DNA, 25 bp, Rattus norvegicus
ggttcatccacctggaactggaatt

SEQ ID NO: 471932 - DNA, 25 bp, Rattus norvegicus
ggttcatccactatttgaggttcca

SEQ ID NO: 471933 - DNA, 25 bp, Rattus norvegicus
ggttcatccactttttgaggttcca

SEQ ID NO: 471934 - DNA, 25 bp, Rattus norvegicus
ggttcatcctgccagttggctgcag

SEQ ID NO: 471935 - DNA, 25 bp, Rattus norvegicus
ggttcatcctgcgagttggctgcag

SEQ ID NO: 471936 - DNA, 25 bp, Rattus norvegicus
ggttcatcctggacatatcagcatc

SEQ ID NO: 471937 - DNA, 25 bp, Rattus norvegicus
ggttcatcctggtcatatcagcatc

SEQ ID NO: 471938 - DNA, 25 bp, Rattus norvegicus
ggttcatcgtccatacgttcccctt

SEQ ID NO: 471939 - DNA, 25 bp, Rattus norvegicus
ggttcatcgtccttacgttcccctt

SEQ ID NO: 471940 - DNA, 25 bp, Rattus norvegicus
ggttcatcgtctcccgcatgaagga

SEQ ID NO: 471941 - DNA, 25 bp, Rattus norvegicus
ggttcatcgtctgccgcatgaagga

SEQ ID NO: 471942 - DNA, 25 bp, Rattus norvegicus
ggttcatctatgatcagtgcacaac

SEQ ID NO: 471943 - DNA, 25 bp, Rattus norvegicus
ggttcatctatgcttcaccatgtga

SEQ ID NO: 471944 - DNA, 25 bp, Rattus norvegicus
ggttcatctatggttcaccatgtga

SEQ ID NO: 471945 - DNA, 25 bp, Rattus norvegicus
ggttcatctatgttcagtgcacaac

SEQ ID NO: 471946 - DNA, 25 bp, Rattus norvegicus
ggttcatctgggacaaggttacttc

SEQ ID NO: 471947 - DNA, 25 bp, Rattus norvegicus
ggttcatctgggtcaaggttacttc

SEQ ID NO: 471948 - DNA, 25 bp, Rattus norvegicus
ggttcatgcgccaatactgtttaga

SEQ ID NO: 471949 - DNA, 25 bp, Rattus norvegicus
ggttcatgcgcctatactgtttaga

SEQ ID NO: 471950 - DNA, 25 bp, Rattus norvegicus
ggttcatggttgacttgctgtctca

SEQ ID NO: 471951 - DNA, 25 bp, Rattus norvegicus
ggttcatggttgcagttgtttccta

SEQ ID NO: 471952 - DNA, 25 bp, Rattus norvegicus
ggttcatggttggagttgtttccta

SEQ ID NO: 471953 - DNA, 25 bp, Rattus norvegicus
ggttcatggttgtcttgctgtctca

SEQ ID NO: 471954 - DNA, 25 bp, Rattus norvegicus
ggttcatgtcatcgcgtaaaaataa

SEQ ID NO: 471955 - DNA, 25 bp, Rattus norvegicus
ggttcatgtcatggcgtaaaaataa

SEQ ID NO: 471956 - DNA, 25 bp, Rattus norvegicus
ggttcatgtcggagacctgccagac

SEQ ID NO: 471957 - DNA, 25 bp, Rattus norvegicus
ggttcatgtcggtgacctgccagac

SEQ ID NO: 471958 - DNA, 25 bp, Rattus norvegicus
ggttcatgttgtaccttcacagcag

SEQ ID NO: 471959 - DNA, 25 bp, Rattus norvegicus
ggttcatgttgttccttcacagcag

SEQ ID NO: 471960 - DNA, 25 bp, Rattus norvegicus
ggttcattcgttcttttgtcatttt

SEQ ID NO: 471961 - DNA, 25 bp, Rattus norvegicus
ggttcattcgttgttttgtcatttt

SEQ ID NO: 471962 - DNA, 25 bp, Rattus norvegicus
ggttcattctgaaggaccgtgtccc

SEQ ID NO: 471963 - DNA, 25 bp, Rattus norvegicus
ggttcattctgatggaccgtgtccc

SEQ ID NO: 471964 - DNA, 25 bp, Rattus norvegicus
ggttcattgctaatcctgagcagtt

SEQ ID NO: 471965 - DNA, 25 bp, Rattus norvegicus
ggttcattgctattcctgagcagtt

SEQ ID NO: 471966 - DNA, 25 bp, Rattus norvegicus
ggttcatttaaactgctttcctggg

SEQ ID NO: 471967 - DNA, 25 bp, Rattus norvegicus
ggttcatttaaagtgctttcctggg

SEQ ID NO: 471968 - DNA, 25 bp, Rattus norvegicus
ggttcatttacgcactggaataccg

SEQ ID NO: 471969 - DNA, 25 bp, Rattus norvegicus
ggttcatttacggactggaataccg

SEQ ID NO: 471970 - DNA, 25 bp, Rattus norvegicus
ggttcatttagactgggtttctgtc

SEQ ID NO: 471971 - DNA, 25 bp, Rattus norvegicus
ggttcatttagagtgggtttctgtc

SEQ ID NO: 471972 - DNA, 25 bp, Rattus norvegicus
ggttcatttatgaactcatgcttca

SEQ ID NO: 471973 - DNA, 25 bp, Rattus norvegicus
ggttcatttatgtactcatgcttca

SEQ ID NO: 471974 - DNA, 25 bp, Rattus norvegicus
ggttcatttgaccttagaccttaga

SEQ ID NO: 471975 - DNA, 25 bp, Rattus norvegicus
ggttcatttgacgttagaccttaga

SEQ ID NO: 471976 - DNA, 25 bp, Rattus norvegicus
ggttcatttgctcccgctgggatat

SEQ ID NO: 471977 - DNA, 25 bp, Rattus norvegicus
ggttcatttgctgccgctgggatat

SEQ ID NO: 471978 - DNA, 25 bp, Rattus norvegicus
ggttcatttggtacacaggtctcat

SEQ ID NO: 471979 - DNA, 25 bp, Rattus norvegicus
ggttcatttggtcactttcctgcaa

SEQ ID NO: 471980 - DNA, 25 bp, Rattus norvegicus
ggttcatttggtgactttcctgcaa

SEQ ID NO: 471981 - DNA, 25 bp, Rattus norvegicus
ggttcatttggttcacaggtctcat

SEQ ID NO: 471982 - DNA, 25 bp, Rattus norvegicus
ggttcattttctcgtggcctcatgg

SEQ ID NO: 471983 - DNA, 25 bp, Rattus norvegicus
ggttcattttctggtggcctcatgg

SEQ ID NO: 471984 - DNA, 25 bp, Rattus norvegicus
ggttccaaagtcagtacttctcttg

SEQ ID NO: 471985 - DNA, 25 bp, Rattus norvegicus
ggttccaaagtctgtacttctcttg

SEQ ID NO: 471986 - DNA, 25 bp, Rattus norvegicus
ggttccaaatgcacgtgtaccttga

SEQ ID NO: 471987 - DNA, 25 bp, Rattus norvegicus
ggttccaaatgctcgtgtaccttga

SEQ ID NO: 471988 - DNA, 25 bp, Rattus norvegicus
ggttccaacacgcatagaaggccct

SEQ ID NO: 471989 - DNA, 25 bp, Rattus norvegicus
ggttccaacacggatagaaggccct

SEQ ID NO: 471990 - DNA, 25 bp, Rattus norvegicus
ggttccaacccactttctgagaaag

SEQ ID NO: 471991 - DNA, 25 bp, Rattus norvegicus
ggttccaacccagtttctgagaaag

SEQ ID NO: 471992 - DNA, 25 bp, Rattus norvegicus
ggttccaacttcacagacatcatga

SEQ ID NO: 471993 - DNA, 25 bp, Rattus norvegicus
ggttccaacttctcagacatcatga

SEQ ID NO: 471994 - DNA, 25 bp, Rattus norvegicus
ggttccaagcctctgtgcagagtgc

SEQ ID NO: 471995 - DNA, 25 bp, Rattus norvegicus
ggttccaagcctgtgtgcagagtgc

SEQ ID NO: 471996 - DNA, 25 bp, Rattus norvegicus
ggttccaagtccagtgtgagatgtt

SEQ ID NO: 471997 - DNA, 25 bp, Rattus norvegicus
ggttccaagtcctgtgtgagatgtt

SEQ ID NO: 471998 - DNA, 25 bp, Rattus norvegicus
ggttccaagtggcatcgtgatatta

SEQ ID NO: 471999 - DNA, 25 bp, Rattus norvegicus
ggttccaagtgggatcgtgatatta

SEQ ID NO: 472000 - DNA, 25 bp, Rattus norvegicus
ggttccaatacaagatctttttaga

SEQ ID NO: 472001 - DNA, 25 bp, Rattus norvegicus
ggttccaatacatgatctttttaga

SEQ ID NO: 472002 - DNA, 25 bp, Rattus norvegicus
ggttccaatcctagaaactgtccga

SEQ ID NO: 472003 - DNA, 25 bp, Rattus norvegicus
ggttccaatccttgaaactgtccga

SEQ ID NO: 472004 - DNA, 25 bp, Rattus norvegicus
ggttccaattcccagttctaattga

SEQ ID NO: 472005 - DNA, 25 bp, Rattus norvegicus
ggttccaattcccattacacagtat

SEQ ID NO: 472006 - DNA, 25 bp, Rattus norvegicus
ggttccaattccgagttctaattga

SEQ ID NO: 472007 - DNA, 25 bp, Rattus norvegicus
ggttccaattccgattacacagtat

SEQ ID NO: 472008 - DNA, 25 bp, Rattus norvegicus
ggttccacaaaaccttctgggtttg

SEQ ID NO: 472009 - DNA, 25 bp, Rattus norvegicus
ggttccacaaaagcttctgggtttg

SEQ ID NO: 472010 - DNA, 25 bp, Rattus norvegicus
ggttccacaattcgacgtttcttca

SEQ ID NO: 472011 - DNA, 25 bp, Rattus norvegicus
ggttccacaattggacgtttcttca

SEQ ID NO: 472012 - DNA, 25 bp, Rattus norvegicus
ggttccaccacactgtatccattta

SEQ ID NO: 472013 - DNA, 25 bp, Rattus norvegicus
ggttccaccacagtgtatccattta

SEQ ID NO: 472014 - DNA, 25 bp, Rattus norvegicus
ggttccaccattatctagctgatga

SEQ ID NO: 472015 - DNA, 25 bp, Rattus norvegicus
ggttccaccattttctagctgatga

SEQ ID NO: 472016 - DNA, 25 bp, Rattus norvegicus
ggttccaccccgacatcaggtgaaa

SEQ ID NO: 472017 - DNA, 25 bp, Rattus norvegicus
ggttccaccccgtcatcaggtgaaa

SEQ ID NO: 472018 - DNA, 25 bp, Rattus norvegicus
ggttccacctgacacagttgctgat

SEQ ID NO: 472019 - DNA, 25 bp, Rattus norvegicus
ggttccacctgagacagttgctgat

SEQ ID NO: 472020 - DNA, 25 bp, Rattus norvegicus
ggttccacgtggacacgggtgatca

SEQ ID NO: 472021 - DNA, 25 bp, Rattus norvegicus
ggttccacgtggtcacgggtgatca

SEQ ID NO: 472022 - DNA, 25 bp, Rattus norvegicus
ggttccactcatagaagtttagctt

SEQ ID NO: 472023 - DNA, 25 bp, Rattus norvegicus
ggttccactcattgaagtttagctt

SEQ ID NO: 472024 - DNA, 25 bp, Rattus norvegicus
ggttccactgtcataaaaacggtca

SEQ ID NO: 472025 - DNA, 25 bp, Rattus norvegicus
ggttccactgtcttaaaaacggtca

SEQ ID NO: 472026 - DNA, 25 bp, Rattus norvegicus
ggttccagaaccaggctgggattct

SEQ ID NO: 472027 - DNA, 25 bp, Rattus norvegicus
ggttccagaacctggctgggattct

SEQ ID NO: 472028 - DNA, 25 bp, Rattus norvegicus
ggttccagaagtcttcctcagcaaa

SEQ ID NO: 472029 - DNA, 25 bp, Rattus norvegicus
ggttccagaagtgttcctcagcaaa

SEQ ID NO: 472030 - DNA, 25 bp, Rattus norvegicus
ggttccagaccacctacagacttag

SEQ ID NO: 472031 - DNA, 25 bp, Rattus norvegicus
ggttccagaccagctacagacttag

SEQ ID NO: 472032 - DNA, 25 bp, Rattus norvegicus
ggttccagacgactcggtaaccatt

SEQ ID NO: 472033 - DNA, 25 bp, Rattus norvegicus
ggttccagacgagtcggtaaccatt

SEQ ID NO: 472034 - DNA, 25 bp, Rattus norvegicus
ggttccagaggccaaacatctacta

SEQ ID NO: 472035 - DNA, 25 bp, Rattus norvegicus
ggttccagaggcgaaacatctacta

SEQ ID NO: 472036 - DNA, 25 bp, Rattus norvegicus
ggttccagcaccatgtatacctgta

SEQ ID NO: 472037 - DNA, 25 bp, Rattus norvegicus
ggttccagcaccttgtatacctgta

SEQ ID NO: 472038 - DNA, 25 bp, Rattus norvegicus
ggttccagccacagcaccaagtgaa

SEQ ID NO: 472039 - DNA, 25 bp, Rattus norvegicus
ggttccagccactgcaccaagtgaa

SEQ ID NO: 472040 - DNA, 25 bp, Rattus norvegicus
ggttccagccttcttgtggtttgcc

SEQ ID NO: 472041 - DNA, 25 bp, Rattus norvegicus
ggttccagccttgttgtggtttgcc

SEQ ID NO: 472042 - DNA, 25 bp, Rattus norvegicus
ggttccagcgatatcgaccgagttc

SEQ ID NO: 472043 - DNA, 25 bp, Rattus norvegicus
ggttccagcgatttcgaccgagttc

SEQ ID NO: 472044 - DNA, 25 bp, Rattus norvegicus
ggttccagctcgaccgtggatgtat

SEQ ID NO: 472045 - DNA, 25 bp, Rattus norvegicus
ggttccagctcgtccgtggatgtat

SEQ ID NO: 472046 - DNA, 25 bp, Rattus norvegicus
ggttccaggatcaaaatgccctacc

SEQ ID NO: 472047 - DNA, 25 bp, Rattus norvegicus
ggttccaggatctaaatgccctacc

SEQ ID NO: 472048 - DNA, 25 bp, Rattus norvegicus
ggttccaggcaccagtgacacttaa

SEQ ID NO: 472049 - DNA, 25 bp, Rattus norvegicus
ggttccaggcacgagtgacacttaa

SEQ ID NO: 472050 - DNA, 25 bp, Rattus norvegicus
ggttccagggaacatttggacacct

SEQ ID NO: 472051 - DNA, 25 bp, Rattus norvegicus
ggttccagggaagatttggacacct

SEQ ID NO: 472052 - DNA, 25 bp, Rattus norvegicus
ggttccagggtaaacgtgtgcacac

SEQ ID NO: 472053 - DNA, 25 bp, Rattus norvegicus
ggttccagggtatacgtgtgcacac

SEQ ID NO: 472054 - DNA, 25 bp, Rattus norvegicus
ggttccaggtctagtgagcccagga

SEQ ID NO: 472055 - DNA, 25 bp, Rattus norvegicus
ggttccaggtcttgtgagcccagga

SEQ ID NO: 472056 - DNA, 25 bp, Rattus norvegicus
ggttccaggtgcagggctcagcctt

SEQ ID NO: 472057 - DNA, 25 bp, Rattus norvegicus
ggttccaggtgctgggctcagcctt

SEQ ID NO: 472058 - DNA, 25 bp, Rattus norvegicus
ggttccaggtggaattatatgttca

SEQ ID NO: 472059 - DNA, 25 bp, Rattus norvegicus
ggttccaggtggtattatatgttca

SEQ ID NO: 472060 - DNA, 25 bp, Rattus norvegicus
ggttccagtccaatttcgatatgct

SEQ ID NO: 472061 - DNA, 25 bp, Rattus norvegicus
ggttccagtccattttcgatatgct

SEQ ID NO: 472062 - DNA, 25 bp, Rattus norvegicus
ggttccatagccatcattcttttta

SEQ ID NO: 472063 - DNA, 25 bp, Rattus norvegicus
ggttccatagccttcattcttttta

SEQ ID NO: 472064 - DNA, 25 bp, Rattus norvegicus
ggttccatatccatgcactttgtaa

SEQ ID NO: 472065 - DNA, 25 bp, Rattus norvegicus
ggttccatatccttgcactttgtaa

SEQ ID NO: 472066 - DNA, 25 bp, Rattus norvegicus
ggttccatccacatgcccagaaagg

SEQ ID NO: 472067 - DNA, 25 bp, Rattus norvegicus
ggttccatccacttgcccagaaagg

SEQ ID NO: 472068 - DNA, 25 bp, Rattus norvegicus
ggttccatcgcaccgtgaagattga

SEQ ID NO: 472069 - DNA, 25 bp, Rattus norvegicus
ggttccatcgcagcgtgaagattga

SEQ ID NO: 472070 - DNA, 25 bp, Rattus norvegicus
ggttccatctctacctctgtaaaaa

SEQ ID NO: 472071 - DNA, 25 bp, Rattus norvegicus
ggttccatctcttcctctgtaaaaa

SEQ ID NO: 472072 - DNA, 25 bp, Rattus norvegicus
ggttccatctggattgcccatggta

SEQ ID NO: 472073 - DNA, 25 bp, Rattus norvegicus
ggttccatctggtttgcccatggta

SEQ ID NO: 472074 - DNA, 25 bp, Rattus norvegicus
ggttccatgaccaagatctacggag

SEQ ID NO: 472075 - DNA, 25 bp, Rattus norvegicus
ggttccatgacctagatctacggag

SEQ ID NO: 472076 - DNA, 25 bp, Rattus norvegicus
ggttccatgcacctgaaattcgcga

SEQ ID NO: 472077 - DNA, 25 bp, Rattus norvegicus
ggttccatgcacgtgaaattcgcga

SEQ ID NO: 472078 - DNA, 25 bp, Rattus norvegicus
ggttccatgcagaccatatttattg

SEQ ID NO: 472079 - DNA, 25 bp, Rattus norvegicus
ggttccatgcagtccatatttattg

SEQ ID NO: 472080 - DNA, 25 bp, Rattus norvegicus
ggttccatgcccagtttcaataaga

SEQ ID NO: 472081 - DNA, 25 bp, Rattus norvegicus
ggttccatgccctgtttcaataaga

SEQ ID NO: 472082 - DNA, 25 bp, Rattus norvegicus
ggttccatggagcaacaggaagtaa

SEQ ID NO: 472083 - DNA, 25 bp, Rattus norvegicus
ggttccatggaggaacaggaagtaa

SEQ ID NO: 472084 - DNA, 25 bp, Rattus norvegicus
ggttccattgaaagttgctgataca

SEQ ID NO: 472085 - DNA, 25 bp, Rattus norvegicus
ggttccattgaatgttgctgataca

SEQ ID NO: 472086 - DNA, 25 bp, Rattus norvegicus
ggttccatttgaacagtattgccag

SEQ ID NO: 472087 - DNA, 25 bp, Rattus norvegicus
ggttccatttgatcagtattgccag

SEQ ID NO: 472088 - DNA, 25 bp, Rattus norvegicus
ggttccatttgtatcatctgttgtt

SEQ ID NO: 472089 - DNA, 25 bp, Rattus norvegicus
ggttccatttgtttcatctgttgtt

SEQ ID NO: 472090 - DNA, 25 bp, Rattus norvegicus
ggttcccaagaacagtgtcaaggtt

SEQ ID NO: 472091 - DNA, 25 bp, Rattus norvegicus
ggttcccaagaagagtgtcaaggtt

SEQ ID NO: 472092 - DNA, 25 bp, Rattus norvegicus
ggttcccaagttatggctcagttga

SEQ ID NO: 472093 - DNA, 25 bp, Rattus norvegicus
ggttcccaagttttggctcagttga

SEQ ID NO: 472094 - DNA, 25 bp, Rattus norvegicus
ggttcccaatgaaaaatgccgtctt

SEQ ID NO: 472095 - DNA, 25 bp, Rattus norvegicus
ggttcccaatgataaatgccgtctt

SEQ ID NO: 472096 - DNA, 25 bp, Rattus norvegicus
ggttcccacagacgcttaactgcaa

SEQ ID NO: 472097 - DNA, 25 bp, Rattus norvegicus
ggttcccacagaggcttaactgcaa

SEQ ID NO: 472098 - DNA, 25 bp, Rattus norvegicus
ggttcccacaggaaagcagacagat

SEQ ID NO: 472099 - DNA, 25 bp, Rattus norvegicus
ggttcccacaggtaagcagacagat

SEQ ID NO: 472100 - DNA, 25 bp, Rattus norvegicus
ggttcccacattccctgattggtag

SEQ ID NO: 472101 - DNA, 25 bp, Rattus norvegicus
ggttcccacattgcctgattggtag

SEQ ID NO: 472102 - DNA, 25 bp, Rattus norvegicus
ggttcccaccataggcattaacagt

SEQ ID NO: 472103 - DNA, 25 bp, Rattus norvegicus
ggttcccaccattggcattaacagt

SEQ ID NO: 472104 - DNA, 25 bp, Rattus norvegicus
ggttcccacgaacctgatgtcgctg

SEQ ID NO: 472105 - DNA, 25 bp, Rattus norvegicus
ggttcccacgaagctgatgtcgctg

SEQ ID NO: 472106 - DNA, 25 bp, Rattus norvegicus
ggttcccactccatcagacgaggag

SEQ ID NO: 472107 - DNA, 25 bp, Rattus norvegicus
ggttcccactccttcagacgaggag

SEQ ID NO: 472108 - DNA, 25 bp, Rattus norvegicus
ggttcccagaagatacaaattcgta

SEQ ID NO: 472109 - DNA, 25 bp, Rattus norvegicus
ggttcccagaagttacaaattcgta

SEQ ID NO: 472110 - DNA, 25 bp, Rattus norvegicus
ggttcccagatgagagttccagttt

SEQ ID NO: 472111 - DNA, 25 bp, Rattus norvegicus
ggttcccagatgtgagttccagttt

SEQ ID NO: 472112 - DNA, 25 bp, Rattus norvegicus
ggttcccaggatcaagcccagagat

SEQ ID NO: 472113 - DNA, 25 bp, Rattus norvegicus
ggttcccaggatgaagcccagagat

SEQ ID NO: 472114 - DNA, 25 bp, Rattus norvegicus
ggttcccaggccaagtgaagcctaa

SEQ ID NO: 472115 - DNA, 25 bp, Rattus norvegicus
ggttcccaggcctagtgaagcctaa

SEQ ID NO: 472116 - DNA, 25 bp, Rattus norvegicus
ggttcccagggccaagccggctact

SEQ ID NO: 472117 - DNA, 25 bp, Rattus norvegicus
ggttcccagggcgaagccggctact

SEQ ID NO: 472118 - DNA, 25 bp, Rattus norvegicus
ggttcccagtctcagttgactgtta

SEQ ID NO: 472119 - DNA, 25 bp, Rattus norvegicus
ggttcccagtctgagttgactgtta

SEQ ID NO: 472120 - DNA, 25 bp, Rattus norvegicus
ggttcccatgacaactgagggtgac

SEQ ID NO: 472121 - DNA, 25 bp, Rattus norvegicus
ggttcccatgactactgagggtgac

SEQ ID NO: 472122 - DNA, 25 bp, Rattus norvegicus
ggttcccatgctattgtaatcttac

SEQ ID NO: 472123 - DNA, 25 bp, Rattus norvegicus
ggttcccatgcttttgtaatcttac

SEQ ID NO: 472124 - DNA, 25 bp, Rattus norvegicus
ggttccccacacatgcctatgaggg

SEQ ID NO: 472125 - DNA, 25 bp, Rattus norvegicus
ggttccccacacttgcctatgaggg

SEQ ID NO: 472126 - DNA, 25 bp, Rattus norvegicus
ggttccccactgaacgcagtgcatg

SEQ ID NO: 472127 - DNA, 25 bp, Rattus norvegicus
ggttccccactgtacgcagtgcatg

SEQ ID NO: 472128 - DNA, 25 bp, Rattus norvegicus
ggttccccagaacacagtccaggag

SEQ ID NO: 472129 - DNA, 25 bp, Rattus norvegicus
ggttccccagaagacagtccaggag

SEQ ID NO: 472130 - DNA, 25 bp, Rattus norvegicus
ggttccccagacattcagggtgtca

SEQ ID NO: 472131 - DNA, 25 bp, Rattus norvegicus
ggttccccagactttcagggtgtca

SEQ ID NO: 472132 - DNA, 25 bp, Rattus norvegicus
ggttccccatcaaatcgtttacata

SEQ ID NO: 472133 - DNA, 25 bp, Rattus norvegicus
ggttccccatcatatcgtttacata

SEQ ID NO: 472134 - DNA, 25 bp, Rattus norvegicus
ggttccccatggatttgaaaaccat

SEQ ID NO: 472135 - DNA, 25 bp, Rattus norvegicus
ggttccccatggttttgaaaaccat

SEQ ID NO: 472136 - DNA, 25 bp, Rattus norvegicus
ggttcccctgtgaggcaaagctgaa

SEQ ID NO: 472137 - DNA, 25 bp, Rattus norvegicus
ggttcccctgtgtggcaaagctgaa

SEQ ID NO: 472138 - DNA, 25 bp, Rattus norvegicus
ggttccccttacactaattacactg

SEQ ID NO: 472139 - DNA, 25 bp, Rattus norvegicus
ggttccccttactctaattacactg

SEQ ID NO: 472140 - DNA, 25 bp, Rattus norvegicus
ggttcccctttaattcatgatacaa

SEQ ID NO: 472141 - DNA, 25 bp, Rattus norvegicus
ggttcccctttatttcatgatacaa

SEQ ID NO: 472142 - DNA, 25 bp, Rattus norvegicus
ggttcccgactgaaattggttatag

SEQ ID NO: 472143 - DNA, 25 bp, Rattus norvegicus
ggttcccgactgtaattggttatag

SEQ ID NO: 472144 - DNA, 25 bp, Rattus norvegicus
ggttcccggatgcatttggatgtac

SEQ ID NO: 472145 - DNA, 25 bp, Rattus norvegicus
ggttcccggatggatttggatgtac

SEQ ID NO: 472146 - DNA, 25 bp, Rattus norvegicus
ggttccctaagtaagcagtacagat

SEQ ID NO: 472147 - DNA, 25 bp, Rattus norvegicus
ggttccctaagttagcagtacagat

SEQ ID NO: 472148 - DNA, 25 bp, Rattus norvegicus
ggttccctataacaagacctgagta

SEQ ID NO: 472149 - DNA, 25 bp, Rattus norvegicus
ggttccctataagaagacctgagta

SEQ ID NO: 472150 - DNA, 25 bp, Rattus norvegicus
ggttccctgaacaataactatgata

SEQ ID NO: 472151 - DNA, 25 bp, Rattus norvegicus
ggttccctgaaccaatggctgctca

SEQ ID NO: 472152 - DNA, 25 bp, Rattus norvegicus
ggttccctgaacgaatggctgctca

SEQ ID NO: 472153 - DNA, 25 bp, Rattus norvegicus
ggttccctgaactataactatgata

SEQ ID NO: 472154 - DNA, 25 bp, Rattus norvegicus
ggttccctgaatcgctctgctagaa

SEQ ID NO: 472155 - DNA, 25 bp, Rattus norvegicus
ggttccctgaatggctctgctagaa

SEQ ID NO: 472156 - DNA, 25 bp, Rattus norvegicus
ggttccctggcactttggccttatc

SEQ ID NO: 472157 - DNA, 25 bp, Rattus norvegicus
ggttccctggcagtttggccttatc

SEQ ID NO: 472158 - DNA, 25 bp, Rattus norvegicus
ggttcccttaatcttgttctgaaag

SEQ ID NO: 472159 - DNA, 25 bp, Rattus norvegicus
ggttcccttaatgttgttctgaaag

SEQ ID NO: 472160 - DNA, 25 bp, Rattus norvegicus
ggttcccttcacatgcaggacttaa

SEQ ID NO: 472161 - DNA, 25 bp, Rattus norvegicus
ggttcccttcacatggtgagggcaa

SEQ ID NO: 472162 - DNA, 25 bp, Rattus norvegicus
ggttcccttcacttgcaggacttaa

SEQ ID NO: 472163 - DNA, 25 bp, Rattus norvegicus
ggttcccttcacttggtgagggcaa

SEQ ID NO: 472164 - DNA, 25 bp, Rattus norvegicus
ggttcccttgtcctgacaaattcgg

SEQ ID NO: 472165 - DNA, 25 bp, Rattus norvegicus
ggttcccttgtcgtgacaaattcgg

SEQ ID NO: 472166 - DNA, 25 bp, Rattus norvegicus
ggttccgaacaacccgttgtgatat

SEQ ID NO: 472167 - DNA, 25 bp, Rattus norvegicus
ggttccgaacaagccgttgtgatat

SEQ ID NO: 472168 - DNA, 25 bp, Rattus norvegicus
ggttccgaacccaatacaagcaaag

SEQ ID NO: 472169 - DNA, 25 bp, Rattus norvegicus
ggttccgaaccctatacaagcaaag

SEQ ID NO: 472170 - DNA, 25 bp, Rattus norvegicus
ggttccgatttaatgtggctcttca

SEQ ID NO: 472171 - DNA, 25 bp, Rattus norvegicus
ggttccgatttattgtggctcttca

SEQ ID NO: 472172 - DNA, 25 bp, Rattus norvegicus
ggttccgcgtttcgcagcccattgt

SEQ ID NO: 472173 - DNA, 25 bp, Rattus norvegicus
ggttccgcgtttggcagcccattgt

SEQ ID NO: 472174 - DNA, 25 bp, Rattus norvegicus
ggttccgcttgcaggtttatacact

SEQ ID NO: 472175 - DNA, 25 bp, Rattus norvegicus
ggttccgcttgctggtttatacact

SEQ ID NO: 472176 - DNA, 25 bp, Rattus norvegicus
ggttccgcttttccagacgcaggaa

SEQ ID NO: 472177 - DNA, 25 bp, Rattus norvegicus
ggttccgcttttgcagacgcaggaa

SEQ ID NO: 472178 - DNA, 25 bp, Rattus norvegicus
ggttccgggatcaggatttccattt

SEQ ID NO: 472179 - DNA, 25 bp, Rattus norvegicus
ggttccgggatctggatttccattt

SEQ ID NO: 472180 - DNA, 25 bp, Rattus norvegicus
ggttccgtatttctagtatactgca

SEQ ID NO: 472181 - DNA, 25 bp, Rattus norvegicus
ggttccgtatttgtagtatactgca

SEQ ID NO: 472182 - DNA, 25 bp, Rattus norvegicus
ggttccgtcagcctttctgatgagg

SEQ ID NO: 472183 - DNA, 25 bp, Rattus norvegicus
ggttccgtcagcgtttctgatgagg

SEQ ID NO: 472184 - DNA, 25 bp, Rattus norvegicus
ggttcctaaatacaattcctcctgg

SEQ ID NO: 472185 - DNA, 25 bp, Rattus norvegicus
ggttcctaaatagaattcctcctgg

SEQ ID NO: 472186 - DNA, 25 bp, Rattus norvegicus
ggttcctacagcaggagttccgctt

SEQ ID NO: 472187 - DNA, 25 bp, Rattus norvegicus
ggttcctacagctggagttccgctt

SEQ ID NO: 472188 - DNA, 25 bp, Rattus norvegicus
ggttcctacagtatggcaacgagca

SEQ ID NO: 472189 - DNA, 25 bp, Rattus norvegicus
ggttcctacagtttggcaacgagca

SEQ ID NO: 472190 - DNA, 25 bp, Rattus norvegicus
ggttcctagagaatgtcctcttcct

SEQ ID NO: 472191 - DNA, 25 bp, Rattus norvegicus
ggttcctagagattgtcctcttcct

SEQ ID NO: 472192 - DNA, 25 bp, Rattus norvegicus
ggttcctagcgcaattttactttcg

SEQ ID NO: 472193 - DNA, 25 bp, Rattus norvegicus
ggttcctagcgctattttactttcg

SEQ ID NO: 472194 - DNA, 25 bp, Rattus norvegicus
ggttcctagtcaagcaagatacatt

SEQ ID NO: 472195 - DNA, 25 bp, Rattus norvegicus
ggttcctagtcatgcaagatacatt

SEQ ID NO: 472196 - DNA, 25 bp, Rattus norvegicus
ggttcctataacaacacatgtctgt

SEQ ID NO: 472197 - DNA, 25 bp, Rattus norvegicus
ggttcctataactacacatgtctgt

SEQ ID NO: 472198 - DNA, 25 bp, Rattus norvegicus
ggttcctatagtacaactccaagca

SEQ ID NO: 472199 - DNA, 25 bp, Rattus norvegicus
ggttcctatagttcaactccaagca

SEQ ID NO: 472200 - DNA, 25 bp, Rattus norvegicus
ggttcctatgtgcattagccgatat

SEQ ID NO: 472201 - DNA, 25 bp, Rattus norvegicus
ggttcctatgtggattagccgatat

SEQ ID NO: 472202 - DNA, 25 bp, Rattus norvegicus
ggttcctcacacatcaaggcttgaa

SEQ ID NO: 472203 - DNA, 25 bp, Rattus norvegicus
ggttcctcacacttcaaggcttgaa

SEQ ID NO: 472204 - DNA, 25 bp, Rattus norvegicus
ggttcctcactaagctggtactaaa

SEQ ID NO: 472205 - DNA, 25 bp, Rattus norvegicus
ggttcctcactatgctggtactaaa

SEQ ID NO: 472206 - DNA, 25 bp, Rattus norvegicus
ggttcctcaggacctgttcagggtc

SEQ ID NO: 472207 - DNA, 25 bp, Rattus norvegicus
ggttcctcaggagctgttcagggtc

SEQ ID NO: 472208 - DNA, 25 bp, Rattus norvegicus
ggttcctccaacaaaaacttgcgca

SEQ ID NO: 472209 - DNA, 25 bp, Rattus norvegicus
ggttcctccaactaaaacttgcgca

SEQ ID NO: 472210 - DNA, 25 bp, Rattus norvegicus
ggttcctcccataagcgtggacaag

SEQ ID NO: 472211 - DNA, 25 bp, Rattus norvegicus
ggttcctcccattagcgtggacaag

SEQ ID NO: 472212 - DNA, 25 bp, Rattus norvegicus
ggttcctccgacagtcagggctgaa

SEQ ID NO: 472213 - DNA, 25 bp, Rattus norvegicus
ggttcctccgactgtcagggctgaa

SEQ ID NO: 472214 - DNA, 25 bp, Rattus norvegicus
ggttcctcggagctccgcggcggag

SEQ ID NO: 472215 - DNA, 25 bp, Rattus norvegicus
ggttcctcggaggtccgcggcggag

SEQ ID NO: 472216 - DNA, 25 bp, Rattus norvegicus
ggttcctctctgagtgagttcacag

SEQ ID NO: 472217 - DNA, 25 bp, Rattus norvegicus
ggttcctctctgtgtgagttcacag

SEQ ID NO: 472218 - DNA, 25 bp, Rattus norvegicus
ggttcctctcttacatggacctttt

SEQ ID NO: 472219 - DNA, 25 bp, Rattus norvegicus
ggttcctctctttcatggacctttt

SEQ ID NO: 472220 - DNA, 25 bp, Rattus norvegicus
ggttcctctgaccacatatagtctt

SEQ ID NO: 472221 - DNA, 25 bp, Rattus norvegicus
ggttcctctgacgacatatagtctt

SEQ ID NO: 472222 - DNA, 25 bp, Rattus norvegicus
ggttcctgacctctgttaaatgtga

SEQ ID NO: 472223 - DNA, 25 bp, Rattus norvegicus
ggttcctgacctgtgttaaatgtga

SEQ ID NO: 472224 - DNA, 25 bp, Rattus norvegicus
ggttcctgatgacttctcttcaaat

SEQ ID NO: 472225 - DNA, 25 bp, Rattus norvegicus
ggttcctgatgagttctcttcaaat

SEQ ID NO: 472226 - DNA, 25 bp, Rattus norvegicus
ggttcctgcaacatggtgatcaatt

SEQ ID NO: 472227 - DNA, 25 bp, Rattus norvegicus
ggttcctgcaacttggtgatcaatt

SEQ ID NO: 472228 - DNA, 25 bp, Rattus norvegicus
ggttcctgcataaaccatgcatggc

SEQ ID NO: 472229 - DNA, 25 bp, Rattus norvegicus
ggttcctgcatataccatgcatggc

SEQ ID NO: 472230 - DNA, 25 bp, Rattus norvegicus
ggttcctggagcaatttttgtttct

SEQ ID NO: 472231 - DNA, 25 bp, Rattus norvegicus
ggttcctggagctatttttgtttct

SEQ ID NO: 472232 - DNA, 25 bp, Rattus norvegicus
ggttcctggattcctggtattttat

SEQ ID NO: 472233 - DNA, 25 bp, Rattus norvegicus
ggttcctggattgctggtattttat

SEQ ID NO: 472234 - DNA, 25 bp, Rattus norvegicus
ggttcctgggagaccatcgcctatc

SEQ ID NO: 472235 - DNA, 25 bp, Rattus norvegicus
ggttcctgggagtccatcgcctatc

SEQ ID NO: 472236 - DNA, 25 bp, Rattus norvegicus
ggttcctgggtgacacagttcgtat

SEQ ID NO: 472237 - DNA, 25 bp, Rattus norvegicus
ggttcctgggtgtcacagttcgtat

SEQ ID NO: 472238 - DNA, 25 bp, Rattus norvegicus
ggttcctggtacattgaggccctca

SEQ ID NO: 472239 - DNA, 25 bp, Rattus norvegicus
ggttcctggtactttgaggccctca

SEQ ID NO: 472240 - DNA, 25 bp, Rattus norvegicus
ggttcctggtgacagctacagtgca

SEQ ID NO: 472241 - DNA, 25 bp, Rattus norvegicus
ggttcctggtgagagctacagtgca

SEQ ID NO: 472242 - DNA, 25 bp, Rattus norvegicus
ggttcctggttgagagacctcgagt

SEQ ID NO: 472243 - DNA, 25 bp, Rattus norvegicus
ggttcctggttgtgagacctcgagt

SEQ ID NO: 472244 - DNA, 25 bp, Rattus norvegicus
ggttcctgtacacaatacctcatgt

SEQ ID NO: 472245 - DNA, 25 bp, Rattus norvegicus
ggttcctgtacagaatacctcatgt

SEQ ID NO: 472246 - DNA, 25 bp, Rattus norvegicus
ggttcctgtaggcacagggcatcaa

SEQ ID NO: 472247 - DNA, 25 bp, Rattus norvegicus
ggttcctgtagggacagggcatcaa

SEQ ID NO: 472248 - DNA, 25 bp, Rattus norvegicus
ggttcctgtgaaccggccgagacaa

SEQ ID NO: 472249 - DNA, 25 bp, Rattus norvegicus
ggttcctgtgaagcggccgagacaa

SEQ ID NO: 472250 - DNA, 25 bp, Rattus norvegicus
ggttcctgtgacaccagcatcggaa

SEQ ID NO: 472251 - DNA, 25 bp, Rattus norvegicus
ggttcctgtgactccagcatcggaa

SEQ ID NO: 472252 - DNA, 25 bp, Rattus norvegicus
ggttcctgtttcaaaggctcctgga

SEQ ID NO: 472253 - DNA, 25 bp, Rattus norvegicus
ggttcctgtttctaaggctcctgga

SEQ ID NO: 472254 - DNA, 25 bp, Rattus norvegicus
ggttccttagccctagagaggtgtt

SEQ ID NO: 472255 - DNA, 25 bp, Rattus norvegicus
ggttccttagccgtagagaggtgtt

SEQ ID NO: 472256 - DNA, 25 bp, Rattus norvegicus
ggttccttcacacgctgagcagcca

SEQ ID NO: 472257 - DNA, 25 bp, Rattus norvegicus
ggttccttcacaggctgagcagcca

SEQ ID NO: 472258 - DNA, 25 bp, Rattus norvegicus
ggttccttcagcaggcctaataaat

SEQ ID NO: 472259 - DNA, 25 bp, Rattus norvegicus
ggttccttcagctggcctaataaat

SEQ ID NO: 472260 - DNA, 25 bp, Rattus norvegicus
ggttccttcctgcttgctgtatggg

SEQ ID NO: 472261 - DNA, 25 bp, Rattus norvegicus
ggttccttcctggttgctgtatggg

SEQ ID NO: 472262 - DNA, 25 bp, Rattus norvegicus
ggttccttctacagactttgtgtgt

SEQ ID NO: 472263 - DNA, 25 bp, Rattus norvegicus
ggttccttctactgactttgtgtgt

SEQ ID NO: 472264 - DNA, 25 bp, Rattus norvegicus
ggttccttctatctatctgttcaga

SEQ ID NO: 472265 - DNA, 25 bp, Rattus norvegicus
ggttccttctatctgatggccaagg

SEQ ID NO: 472266 - DNA, 25 bp, Rattus norvegicus
ggttccttctatgtatctgttcaga

SEQ ID NO: 472267 - DNA, 25 bp, Rattus norvegicus
ggttccttctatgtgatggccaagg

SEQ ID NO: 472268 - DNA, 25 bp, Rattus norvegicus
ggttccttctttcgcgcttagtggg

SEQ ID NO: 472269 - DNA, 25 bp, Rattus norvegicus
ggttccttctttggcgcttagtggg

SEQ ID NO: 472270 - DNA, 25 bp, Rattus norvegicus
ggttccttgtatcctttgagactga

SEQ ID NO: 472271 - DNA, 25 bp, Rattus norvegicus
ggttccttgtatgctttgagactga

SEQ ID NO: 472272 - DNA, 25 bp, Rattus norvegicus
ggttcctttgttcctatcatttgca

SEQ ID NO: 472273 - DNA, 25 bp, Rattus norvegicus
ggttcctttgttgctatcatttgca

SEQ ID NO: 472274 - DNA, 25 bp, Rattus norvegicus
ggttcgaaaccgctgttagctttgt

SEQ ID NO: 472275 - DNA, 25 bp, Rattus norvegicus
ggttcgaaaccggtgttagctttgt

SEQ ID NO: 472276 - DNA, 25 bp, Rattus norvegicus
ggttcgaacctacggccctgtgcat

SEQ ID NO: 472277 - DNA, 25 bp, Rattus norvegicus
ggttcgaacctagggccctgtgcat

SEQ ID NO: 472278 - DNA, 25 bp, Rattus norvegicus
ggttcgaatcaacgagctggccgca

SEQ ID NO: 472279 - DNA, 25 bp, Rattus norvegicus
ggttcgaatcaaggagctggccgca

SEQ ID NO: 472280 - DNA, 25 bp, Rattus norvegicus
ggttcgaatcgtatgggcctgcaat

SEQ ID NO: 472281 - DNA, 25 bp, Rattus norvegicus
ggttcgaatcgtttgggcctgcaat

SEQ ID NO: 472282 - DNA, 25 bp, Rattus norvegicus
ggttcgaccttgagtgtgcgtatag

SEQ ID NO: 472283 - DNA, 25 bp, Rattus norvegicus
ggttcgaccttgtgtgtgcgtatag

SEQ ID NO: 472284 - DNA, 25 bp, Rattus norvegicus
ggttcgagacacctatctggacaca

SEQ ID NO: 472285 - DNA, 25 bp, Rattus norvegicus
ggttcgagacacgtatctggacaca

SEQ ID NO: 472286 - DNA, 25 bp, Rattus norvegicus
ggttcgagcagaacccagtttatta

SEQ ID NO: 472287 - DNA, 25 bp, Rattus norvegicus
ggttcgagcagatcccagtttatta

SEQ ID NO: 472288 - DNA, 25 bp, Rattus norvegicus
ggttcgagcccaactttacattgtt

SEQ ID NO: 472289 - DNA, 25 bp, Rattus norvegicus
ggttcgagcccatctttacattgtt

SEQ ID NO: 472290 - DNA, 25 bp, Rattus norvegicus
ggttcgaggtcactgctgcacaaag

SEQ ID NO: 472291 - DNA, 25 bp, Rattus norvegicus
ggttcgaggtcagtgctgcacaaag

SEQ ID NO: 472292 - DNA, 25 bp, Rattus norvegicus
ggttcgattcacaatttggatcagc

SEQ ID NO: 472293 - DNA, 25 bp, Rattus norvegicus
ggttcgattcactatttggatcagc

SEQ ID NO: 472294 - DNA, 25 bp, Rattus norvegicus
ggttcgattccacgcaaggagacac

SEQ ID NO: 472295 - DNA, 25 bp, Rattus norvegicus
ggttcgattccaggcaaggagacac

SEQ ID NO: 472296 - DNA, 25 bp, Rattus norvegicus
ggttcgatttcaacttcggcagtga

SEQ ID NO: 472297 - DNA, 25 bp, Rattus norvegicus
ggttcgatttcatcttcggcagtga

SEQ ID NO: 472298 - DNA, 25 bp, Rattus norvegicus
ggttcgcacatccttattgctcagg

SEQ ID NO: 472299 - DNA, 25 bp, Rattus norvegicus
ggttcgcacatcgttattgctcagg

SEQ ID NO: 472300 - DNA, 25 bp, Rattus norvegicus
ggttcgcagagaccctcatgtggtt

SEQ ID NO: 472301 - DNA, 25 bp, Rattus norvegicus
ggttcgcagagagcctcatgtggtt

SEQ ID NO: 472302 - DNA, 25 bp, Rattus norvegicus
ggttcgcagcagagcgggactatct

SEQ ID NO: 472303 - DNA, 25 bp, Rattus norvegicus
ggttcgcagcagtgcgggactatct

SEQ ID NO: 472304 - DNA, 25 bp, Rattus norvegicus
ggttcgcagtttaccttctcaagat

SEQ ID NO: 472305 - DNA, 25 bp, Rattus norvegicus
ggttcgcagttttccttctcaagat

SEQ ID NO: 472306 - DNA, 25 bp, Rattus norvegicus
ggttcgcccatgaaccatagcaaaa

SEQ ID NO: 472307 - DNA, 25 bp, Rattus norvegicus
ggttcgcccatgtaccatagcaaaa

SEQ ID NO: 472308 - DNA, 25 bp, Rattus norvegicus
ggttcgcttagcactgtagttttca

SEQ ID NO: 472309 - DNA, 25 bp, Rattus norvegicus
ggttcgcttagctctgtagttttca

SEQ ID NO: 472310 - DNA, 25 bp, Rattus norvegicus
ggttcgcttctcagctcacaatcat

SEQ ID NO: 472311 - DNA, 25 bp, Rattus norvegicus
ggttcgcttctctgctcacaatcat

SEQ ID NO: 472312 - DNA, 25 bp, Rattus norvegicus
ggttcggatcctccttgggatatgt

SEQ ID NO: 472313 - DNA, 25 bp, Rattus norvegicus
ggttcggatcctgcttgggatatgt

SEQ ID NO: 472314 - DNA, 25 bp, Rattus norvegicus
ggttcggccaacatgcaaacatgca

SEQ ID NO: 472315 - DNA, 25 bp, Rattus norvegicus
ggttcggccaacttgcaaacatgca

SEQ ID NO: 472316 - DNA, 25 bp, Rattus norvegicus
ggttcggcgggcacgggcaaagtgg

SEQ ID NO: 472317 - DNA, 25 bp, Rattus norvegicus
ggttcggcgggctcgggcaaagtgg

SEQ ID NO: 472318 - DNA, 25 bp, Rattus norvegicus
ggttcgggacttaagctccatgaca

SEQ ID NO: 472319 - DNA, 25 bp, Rattus norvegicus
ggttcgggactttagctccatgaca

SEQ ID NO: 472320 - DNA, 25 bp, Rattus norvegicus
ggttcgtacactccctagaaattat

SEQ ID NO: 472321 - DNA, 25 bp, Rattus norvegicus
ggttcgtacactgcctagaaattat

SEQ ID NO: 472322 - DNA, 25 bp, Rattus norvegicus
ggttcgtagtgtcaatcacccatgt

SEQ ID NO: 472323 - DNA, 25 bp, Rattus norvegicus
ggttcgtagtgtgaatcacccatgt

SEQ ID NO: 472324 - DNA, 25 bp, Rattus norvegicus
ggttcgtcaggaagagcagtcccaa

SEQ ID NO: 472325 - DNA, 25 bp, Rattus norvegicus
ggttcgtcaggatgagcagtcccaa

SEQ ID NO: 472326 - DNA, 25 bp, Rattus norvegicus
ggttcgtccactattacgtcaaata

SEQ ID NO: 472327 - DNA, 25 bp, Rattus norvegicus
ggttcgtccacttttacgtcaaata

SEQ ID NO: 472328 - DNA, 25 bp, Rattus norvegicus
ggttctaaacaaatctacttatctg

SEQ ID NO: 472329 - DNA, 25 bp, Rattus norvegicus
ggttctaaacaattctacttatctg

SEQ ID NO: 472330 - DNA, 25 bp, Rattus norvegicus
ggttctaaagttactgccgttgctt

SEQ ID NO: 472331 - DNA, 25 bp, Rattus norvegicus
ggttctaaagtttctgccgttgctt

SEQ ID NO: 472332 - DNA, 25 bp, Rattus norvegicus
ggttctaagaggaaggtcgcaaaat

SEQ ID NO: 472333 - DNA, 25 bp, Rattus norvegicus
ggttctaagaggtaggtcgcaaaat

SEQ ID NO: 472334 - DNA, 25 bp, Rattus norvegicus
ggttctaagagtcccataaaaatca

SEQ ID NO: 472335 - DNA, 25 bp, Rattus norvegicus
ggttctaagagtgccataaaaatca

SEQ ID NO: 472336 - DNA, 25 bp, Rattus norvegicus
ggttctaagatgaaaggcgctgctc

SEQ ID NO: 472337 - DNA, 25 bp, Rattus norvegicus
ggttctaagatgtaaggcgctgctc

SEQ ID NO: 472338 - DNA, 25 bp, Rattus norvegicus
ggttctaagggtaaaatgcagctct

SEQ ID NO: 472339 - DNA, 25 bp, Rattus norvegicus
ggttctaagggttaaatgcagctct

SEQ ID NO: 472340 - DNA, 25 bp, Rattus norvegicus
ggttctaagtgcctttctattgtag

SEQ ID NO: 472341 - DNA, 25 bp, Rattus norvegicus
ggttctaagtgcgtttctattgtag

SEQ ID NO: 472342 - DNA, 25 bp, Rattus norvegicus
ggttctaagttgagccatgccttcc

SEQ ID NO: 472343 - DNA, 25 bp, Rattus norvegicus
ggttctaagttgtgccatgccttcc

SEQ ID NO: 472344 - DNA, 25 bp, Rattus norvegicus
ggttctaatcaaaggcaagtgcagc

SEQ ID NO: 472345 - DNA, 25 bp, Rattus norvegicus
ggttctaatcaatggcaagtgcagc

SEQ ID NO: 472346 - DNA, 25 bp, Rattus norvegicus
ggttctaatgaactctgtccagatt

SEQ ID NO: 472347 - DNA, 25 bp, Rattus norvegicus
ggttctaatgaagtctgtccagatt

SEQ ID NO: 472348 - DNA, 25 bp, Rattus norvegicus
ggttctaatttcacatttgcaggaa

SEQ ID NO: 472349 - DNA, 25 bp, Rattus norvegicus
ggttctaatttctcatttgcaggaa

SEQ ID NO: 472350 - DNA, 25 bp, Rattus norvegicus
ggttctacagataacagcagcttgt

SEQ ID NO: 472351 - DNA, 25 bp, Rattus norvegicus
ggttctacagattacagcagcttgt

SEQ ID NO: 472352 - DNA, 25 bp, Rattus norvegicus
ggttctactccaatgtgtttgttta

SEQ ID NO: 472353 - DNA, 25 bp, Rattus norvegicus
ggttctactccattgtgtttgttta

SEQ ID NO: 472354 - DNA, 25 bp, Rattus norvegicus
ggttctactgtacagtgtgcactgc

SEQ ID NO: 472355 - DNA, 25 bp, Rattus norvegicus
ggttctactgtagagtgtgcactgc

SEQ ID NO: 472356 - DNA, 25 bp, Rattus norvegicus
ggttctactttgagaggtgctccca

SEQ ID NO: 472357 - DNA, 25 bp, Rattus norvegicus
ggttctactttgtgaggtgctccca

SEQ ID NO: 472358 - DNA, 25 bp, Rattus norvegicus
ggttctagataaagtgtgactcttt

SEQ ID NO: 472359 - DNA, 25 bp, Rattus norvegicus
ggttctagataatgtgtgactcttt

SEQ ID NO: 472360 - DNA, 25 bp, Rattus norvegicus
ggttctagcataccgtgtagttcct

SEQ ID NO: 472361 - DNA, 25 bp, Rattus norvegicus
ggttctagcatagcgtgtagttcct

SEQ ID NO: 472362 - DNA, 25 bp, Rattus norvegicus
ggttctagcgtgaccacgaggcaag

SEQ ID NO: 472363 - DNA, 25 bp, Rattus norvegicus
ggttctagcgtgtccacgaggcaag

SEQ ID NO: 472364 - DNA, 25 bp, Rattus norvegicus
ggttctaggagtatggcagccccag

SEQ ID NO: 472365 - DNA, 25 bp, Rattus norvegicus
ggttctaggagtttggcagccccag

SEQ ID NO: 472366 - DNA, 25 bp, Rattus norvegicus
ggttctagtattctctccagcattc

SEQ ID NO: 472367 - DNA, 25 bp, Rattus norvegicus
ggttctagtattgtctccagcattc

SEQ ID NO: 472368 - DNA, 25 bp, Rattus norvegicus
ggttctagttagctggcatcaacat

SEQ ID NO: 472369 - DNA, 25 bp, Rattus norvegicus
ggttctagttaggtggcatcaacat

SEQ ID NO: 472370 - DNA, 25 bp, Rattus norvegicus
ggttctataccgaggcagggaatca

SEQ ID NO: 472371 - DNA, 25 bp, Rattus norvegicus
ggttctataccgtggcagggaatca

SEQ ID NO: 472372 - DNA, 25 bp, Rattus norvegicus
ggttctatccagcagagtggaccgt

SEQ ID NO: 472373 - DNA, 25 bp, Rattus norvegicus
ggttctatccaggagagtggaccgt

SEQ ID NO: 472374 - DNA, 25 bp, Rattus norvegicus
ggttctatggttaccagtggttcta

SEQ ID NO: 472375 - DNA, 25 bp, Rattus norvegicus
ggttctatggtttccagtggttcta

SEQ ID NO: 472376 - DNA, 25 bp, Rattus norvegicus
ggttctattactcaccatgctaaac

SEQ ID NO: 472377 - DNA, 25 bp, Rattus norvegicus
ggttctattactgaccatgctaaac

SEQ ID NO: 472378 - DNA, 25 bp, Rattus norvegicus
ggttctcaaaaaagaccggtgcttg

SEQ ID NO: 472379 - DNA, 25 bp, Rattus norvegicus
ggttctcaaaaatgaccggtgcttg

SEQ ID NO: 472380 - DNA, 25 bp, Rattus norvegicus
ggttctcaaatcacagacctcgtgt

SEQ ID NO: 472381 - DNA, 25 bp, Rattus norvegicus
ggttctcaaatctcagacctcgtgt

SEQ ID NO: 472382 - DNA, 25 bp, Rattus norvegicus
ggttctcaacctcaacaaattccag

SEQ ID NO: 472383 - DNA, 25 bp, Rattus norvegicus
ggttctcaacctgaacaaattccag

SEQ ID NO: 472384 - DNA, 25 bp, Rattus norvegicus
ggttctcaagatcgcaagtacctgt

SEQ ID NO: 472385 - DNA, 25 bp, Rattus norvegicus
ggttctcaagatggcaagtacctgt

SEQ ID NO: 472386 - DNA, 25 bp, Rattus norvegicus
ggttctcaagctctagagcctcaca

SEQ ID NO: 472387 - DNA, 25 bp, Rattus norvegicus
ggttctcaagctgtagagcctcaca

SEQ ID NO: 472388 - DNA, 25 bp, Rattus norvegicus
ggttctcaaggtagcatttcgcacc

SEQ ID NO: 472389 - DNA, 25 bp, Rattus norvegicus
ggttctcaaggttgcatttcgcacc

SEQ ID NO: 472390 - DNA, 25 bp, Rattus norvegicus
ggttctcaagtgatgtacatactac

SEQ ID NO: 472391 - DNA, 25 bp, Rattus norvegicus
ggttctcaagtgttgtacatactac

SEQ ID NO: 472392 - DNA, 25 bp, Rattus norvegicus
ggttctcacatgaggctatgtaatt

SEQ ID NO: 472393 - DNA, 25 bp, Rattus norvegicus
ggttctcacatgtggctatgtaatt

SEQ ID NO: 472394 - DNA, 25 bp, Rattus norvegicus
ggttctcacccaagttagttttacg

SEQ ID NO: 472395 - DNA, 25 bp, Rattus norvegicus
ggttctcacccatgttagttttacg

SEQ ID NO: 472396 - DNA, 25 bp, Rattus norvegicus
ggttctcacgcacatgccttgactc

SEQ ID NO: 472397 - DNA, 25 bp, Rattus norvegicus
ggttctcacgcagatgccttgactc

SEQ ID NO: 472398 - DNA, 25 bp, Rattus norvegicus
ggttctcacgttataactgcagctg

SEQ ID NO: 472399 - DNA, 25 bp, Rattus norvegicus
ggttctcacgttttaactgcagctg

SEQ ID NO: 472400 - DNA, 25 bp, Rattus norvegicus
ggttctcactctactggaagtagga

SEQ ID NO: 472401 - DNA, 25 bp, Rattus norvegicus
ggttctcactcttctggaagtagga

SEQ ID NO: 472402 - DNA, 25 bp, Rattus norvegicus
ggttctcactttccattcaccatat

SEQ ID NO: 472403 - DNA, 25 bp, Rattus norvegicus
ggttctcactttgcattcaccatat

SEQ ID NO: 472404 - DNA, 25 bp, Rattus norvegicus
ggttctcagaatcctactcgtattt

SEQ ID NO: 472405 - DNA, 25 bp, Rattus norvegicus
ggttctcagaatgctactcgtattt

SEQ ID NO: 472406 - DNA, 25 bp, Rattus norvegicus
ggttctcagcatacaacacattgtt

SEQ ID NO: 472407 - DNA, 25 bp, Rattus norvegicus
ggttctcagcatcgacactattttg

SEQ ID NO: 472408 - DNA, 25 bp, Rattus norvegicus
ggttctcagcatggacactattttg

SEQ ID NO: 472409 - DNA, 25 bp, Rattus norvegicus
ggttctcagcattcaacacattgtt

SEQ ID NO: 472410 - DNA, 25 bp, Rattus norvegicus
ggttctcagcccatgaggtagagac

SEQ ID NO: 472411 - DNA, 25 bp, Rattus norvegicus
ggttctcagcccttgaggtagagac

SEQ ID NO: 472412 - DNA, 25 bp, Rattus norvegicus
ggttctcagctcaccttgtaggtaa

SEQ ID NO: 472413 - DNA, 25 bp, Rattus norvegicus
ggttctcagctctccttgtaggtaa

SEQ ID NO: 472414 - DNA, 25 bp, Rattus norvegicus
ggttctcagtttaagtcgggcagca

SEQ ID NO: 472415 - DNA, 25 bp, Rattus norvegicus
ggttctcagtttatccaaatccatc

SEQ ID NO: 472416 - DNA, 25 bp, Rattus norvegicus
ggttctcagttttagtcgggcagca

SEQ ID NO: 472417 - DNA, 25 bp, Rattus norvegicus
ggttctcagtttttccaaatccatc

SEQ ID NO: 472418 - DNA, 25 bp, Rattus norvegicus
ggttctcatcggatgtgactgtatt

SEQ ID NO: 472419 - DNA, 25 bp, Rattus norvegicus
ggttctcatcggttgtgactgtatt

SEQ ID NO: 472420 - DNA, 25 bp, Rattus norvegicus
ggttctcatgcacgctgacggacat

SEQ ID NO: 472421 - DNA, 25 bp, Rattus norvegicus
ggttctcatgcaggctgacggacat

SEQ ID NO: 472422 - DNA, 25 bp, Rattus norvegicus
ggttctccaaccaggtgttacaagc

SEQ ID NO: 472423 - DNA, 25 bp, Rattus norvegicus
ggttctccaacctggtgttacaagc

SEQ ID NO: 472424 - DNA, 25 bp, Rattus norvegicus
ggttctccactacgaatgtgtccct

SEQ ID NO: 472425 - DNA, 25 bp, Rattus norvegicus
ggttctccactaggaatgtgtccct

SEQ ID NO: 472426 - DNA, 25 bp, Rattus norvegicus
ggttctccagaaaagctgcatttgc

SEQ ID NO: 472427 - DNA, 25 bp, Rattus norvegicus
ggttctccagaatagctgcatttgc

SEQ ID NO: 472428 - DNA, 25 bp, Rattus norvegicus
ggttctccagagcaaagctcccaga

SEQ ID NO: 472429 - DNA, 25 bp, Rattus norvegicus
ggttctccagaggaaagctcccaga

SEQ ID NO: 472430 - DNA, 25 bp, Rattus norvegicus
ggttctccagatctatacaactatt

SEQ ID NO: 472431 - DNA, 25 bp, Rattus norvegicus
ggttctccagatgtatacaactatt

SEQ ID NO: 472432 - DNA, 25 bp, Rattus norvegicus
ggttctccatgacggtgattcgcaa

SEQ ID NO: 472433 - DNA, 25 bp, Rattus norvegicus
ggttctccatgagggtgattcgcaa

SEQ ID NO: 472434 - DNA, 25 bp, Rattus norvegicus
ggttctcccacacgagagcttcata

SEQ ID NO: 472435 - DNA, 25 bp, Rattus norvegicus
ggttctcccacaggagagcttcata

SEQ ID NO: 472436 - DNA, 25 bp, Rattus norvegicus
ggttctccccagatgacaaatactc

SEQ ID NO: 472437 - DNA, 25 bp, Rattus norvegicus
ggttctccccagttgacaaatactc

SEQ ID NO: 472438 - DNA, 25 bp, Rattus norvegicus
ggttctcctaccataaatgagctcc

SEQ ID NO: 472439 - DNA, 25 bp, Rattus norvegicus
ggttctcctaccttaaatgagctcc

SEQ ID NO: 472440 - DNA, 25 bp, Rattus norvegicus
ggttctcctccccatgagaaagggt

SEQ ID NO: 472441 - DNA, 25 bp, Rattus norvegicus
ggttctcctcccgatgagaaagggt

SEQ ID NO: 472442 - DNA, 25 bp, Rattus norvegicus
ggttctcctgtgatgtggctgcagt

SEQ ID NO: 472443 - DNA, 25 bp, Rattus norvegicus
ggttctcctgtgttgtggctgcagt

SEQ ID NO: 472444 - DNA, 25 bp, Rattus norvegicus
ggttctcggatacctagggtcttag

SEQ ID NO: 472445 - DNA, 25 bp, Rattus norvegicus
ggttctcggatagctagggtcttag

SEQ ID NO: 472446 - DNA, 25 bp, Rattus norvegicus
ggttctcgggtccacagtgacctga

SEQ ID NO: 472447 - DNA, 25 bp, Rattus norvegicus
ggttctcgggtcgacagtgacctga

SEQ ID NO: 472448 - DNA, 25 bp, Rattus norvegicus
ggttctcgggttcctccccgatgag

SEQ ID NO: 472449 - DNA, 25 bp, Rattus norvegicus
ggttctcgggttgctccccgatgag

SEQ ID NO: 472450 - DNA, 25 bp, Rattus norvegicus
ggttctcgtatcatcttcagactga

SEQ ID NO: 472451 - DNA, 25 bp, Rattus norvegicus
ggttctcgtatcttcttcagactga

SEQ ID NO: 472452 - DNA, 25 bp, Rattus norvegicus
ggttctctaaacctaagactctctg

SEQ ID NO: 472453 - DNA, 25 bp, Rattus norvegicus
ggttctctaaacgtaagactctctg

SEQ ID NO: 472454 - DNA, 25 bp, Rattus norvegicus
ggttctctaacccagtagtgatcag

SEQ ID NO: 472455 - DNA, 25 bp, Rattus norvegicus
ggttctctaaccgagtagtgatcag

SEQ ID NO: 472456 - DNA, 25 bp, Rattus norvegicus
ggttctctacgccttcctggacgag

SEQ ID NO: 472457 - DNA, 25 bp, Rattus norvegicus
ggttctctacgcgttcctggacgag

SEQ ID NO: 472458 - DNA, 25 bp, Rattus norvegicus
ggttctctatatacggaatgtaact

SEQ ID NO: 472459 - DNA, 25 bp, Rattus norvegicus
ggttctctatattcggaatgtaact

SEQ ID NO: 472460 - DNA, 25 bp, Rattus norvegicus
ggttctctcaagacacttatctgca

SEQ ID NO: 472461 - DNA, 25 bp, Rattus norvegicus
ggttctctcaagtcacttatctgca

SEQ ID NO: 472462 - DNA, 25 bp, Rattus norvegicus
ggttctctcccaagtaagaggctac

SEQ ID NO: 472463 - DNA, 25 bp, Rattus norvegicus
ggttctctcccatgtaagaggctac

SEQ ID NO: 472464 - DNA, 25 bp, Rattus norvegicus
ggttctctctggatgccactggaag

SEQ ID NO: 472465 - DNA, 25 bp, Rattus norvegicus
ggttctctctggttgccactggaag

SEQ ID NO: 472466 - DNA, 25 bp, Rattus norvegicus
ggttctctgaggctccttcgtcctt

SEQ ID NO: 472467 - DNA, 25 bp, Rattus norvegicus
ggttctctgagggtccttcgtcctt

SEQ ID NO: 472468 - DNA, 25 bp, Rattus norvegicus
ggttctctgcagacctaactgaggg

SEQ ID NO: 472469 - DNA, 25 bp, Rattus norvegicus
ggttctctgcagtcctaactgaggg

SEQ ID NO: 472470 - DNA, 25 bp, Rattus norvegicus
ggttctctgctcagtagcagtactg

SEQ ID NO: 472471 - DNA, 25 bp, Rattus norvegicus
ggttctctgctctgtagcagtactg

SEQ ID NO: 472472 - DNA, 25 bp, Rattus norvegicus
ggttctcttagcagacatgggtctt

SEQ ID NO: 472473 - DNA, 25 bp, Rattus norvegicus
ggttctcttagctgacatgggtctt

SEQ ID NO: 472474 - DNA, 25 bp, Rattus norvegicus
ggttctcttcaacggacaaggctgc

SEQ ID NO: 472475 - DNA, 25 bp, Rattus norvegicus
ggttctcttcaagggacaaggctgc

SEQ ID NO: 472476 - DNA, 25 bp, Rattus norvegicus
ggttctcttcagatatttccaaaag

SEQ ID NO: 472477 - DNA, 25 bp, Rattus norvegicus
ggttctcttcagttatttccaaaag

SEQ ID NO: 472478 - DNA, 25 bp, Rattus norvegicus
ggttctctttagaatcgctgccagt

SEQ ID NO: 472479 - DNA, 25 bp, Rattus norvegicus
ggttctctttagtatcgctgccagt

SEQ ID NO: 472480 - DNA, 25 bp, Rattus norvegicus
ggttctctttccactacaatttgga

SEQ ID NO: 472481 - DNA, 25 bp, Rattus norvegicus
ggttctctttcctctacaatttgga

SEQ ID NO: 472482 - DNA, 25 bp, Rattus norvegicus
ggttctctttgtattagctgcttaa

SEQ ID NO: 472483 - DNA, 25 bp, Rattus norvegicus
ggttctctttgttttagctgcttaa

SEQ ID NO: 472484 - DNA, 25 bp, Rattus norvegicus
ggttctctttttcccaaggacactg

SEQ ID NO: 472485 - DNA, 25 bp, Rattus norvegicus
ggttctctttttgccaaggacactg

SEQ ID NO: 472486 - DNA, 25 bp, Rattus norvegicus
ggttctgaaattctgcaacaggtct

SEQ ID NO: 472487 - DNA, 25 bp, Rattus norvegicus
ggttctgaaattgtgcaacaggtct

SEQ ID NO: 472488 - DNA, 25 bp, Rattus norvegicus
ggttctgaaccacggacctacagtc

SEQ ID NO: 472489 - DNA, 25 bp, Rattus norvegicus
ggttctgaaccagggacctacagtc

SEQ ID NO: 472490 - DNA, 25 bp, Rattus norvegicus
ggttctgaactaactgttgctttaa

SEQ ID NO: 472491 - DNA, 25 bp, Rattus norvegicus
ggttctgaactatctgttgctttaa

SEQ ID NO: 472492 - DNA, 25 bp, Rattus norvegicus
ggttctgaagagacctgccttggct

SEQ ID NO: 472493 - DNA, 25 bp, Rattus norvegicus
ggttctgaagagtcctgccttggct

SEQ ID NO: 472494 - DNA, 25 bp, Rattus norvegicus
ggttctgaagccatcttcactgcaa

SEQ ID NO: 472495 - DNA, 25 bp, Rattus norvegicus
ggttctgaagccttcttcactgcaa

SEQ ID NO: 472496 - DNA, 25 bp, Rattus norvegicus
ggttctgaatccaaggtgcccttat

SEQ ID NO: 472497 - DNA, 25 bp, Rattus norvegicus
ggttctgaatcctaggtgcccttat

SEQ ID NO: 472498 - DNA, 25 bp, Rattus norvegicus
ggttctgaccagagccagcctggaa

SEQ ID NO: 472499 - DNA, 25 bp, Rattus norvegicus
ggttctgaccagtgccagcctggaa

SEQ ID NO: 472500 - DNA, 25 bp, Rattus norvegicus
ggttctgaccctcatgcagatgaca

SEQ ID NO: 472501 - DNA, 25 bp, Rattus norvegicus
ggttctgaccctgatgcagatgaca

SEQ ID NO: 472502 - DNA, 25 bp, Rattus norvegicus
ggttctgacggcaccattcggttgt

SEQ ID NO: 472503 - DNA, 25 bp, Rattus norvegicus
ggttctgacggctccattcggttgt

SEQ ID NO: 472504 - DNA, 25 bp, Rattus norvegicus
ggttctgacttcaaatgtcccatcc

SEQ ID NO: 472505 - DNA, 25 bp, Rattus norvegicus
ggttctgacttctaatgtcccatcc

SEQ ID NO: 472506 - DNA, 25 bp, Rattus norvegicus
ggttctgagaccagactagttgtct

SEQ ID NO: 472507 - DNA, 25 bp, Rattus norvegicus
ggttctgagacctgactagttgtct

SEQ ID NO: 472508 - DNA, 25 bp, Rattus norvegicus
ggttctgagcaacaccatttcacca

SEQ ID NO: 472509 - DNA, 25 bp, Rattus norvegicus
ggttctgagcaagaccatttcacca

SEQ ID NO: 472510 - DNA, 25 bp, Rattus norvegicus
ggttctgagctcagctcatggctca

SEQ ID NO: 472511 - DNA, 25 bp, Rattus norvegicus
ggttctgagctctgctcatggctca

SEQ ID NO: 472512 - DNA, 25 bp, Rattus norvegicus
ggttctgaggataaaactggcttct

SEQ ID NO: 472513 - DNA, 25 bp, Rattus norvegicus
ggttctgaggattaaactggcttct

SEQ ID NO: 472514 - DNA, 25 bp, Rattus norvegicus
ggttctgagtctccttgtgaaggca

SEQ ID NO: 472515 - DNA, 25 bp, Rattus norvegicus
ggttctgagtctgcttgtgaaggca

SEQ ID NO: 472516 - DNA, 25 bp, Rattus norvegicus
ggttctgatccaaatacatagtgtg

SEQ ID NO: 472517 - DNA, 25 bp, Rattus norvegicus
ggttctgatccatatacatagtgtg

SEQ ID NO: 472518 - DNA, 25 bp, Rattus norvegicus
ggttctgatgggaatttgcctgcta

SEQ ID NO: 472519 - DNA, 25 bp, Rattus norvegicus
ggttctgatgggtatttgcctgcta

SEQ ID NO: 472520 - DNA, 25 bp, Rattus norvegicus
ggttctgatgtcatttatccagcca

SEQ ID NO: 472521 - DNA, 25 bp, Rattus norvegicus
ggttctgatgtcttttatccagcca

SEQ ID NO: 472522 - DNA, 25 bp, Rattus norvegicus
ggttctgattgacccatgacatgga

SEQ ID NO: 472523 - DNA, 25 bp, Rattus norvegicus
ggttctgattgagccatgacatgga

SEQ ID NO: 472524 - DNA, 25 bp, Rattus norvegicus
ggttctgattgtatgacatctcata

SEQ ID NO: 472525 - DNA, 25 bp, Rattus norvegicus
ggttctgattgtttgacatctcata

SEQ ID NO: 472526 - DNA, 25 bp, Rattus norvegicus
ggttctgcacagctggccaatggac

SEQ ID NO: 472527 - DNA, 25 bp, Rattus norvegicus
ggttctgcacaggtggccaatggac

SEQ ID NO: 472528 - DNA, 25 bp, Rattus norvegicus
ggttctgcactgacgccaataaaaa

SEQ ID NO: 472529 - DNA, 25 bp, Rattus norvegicus
ggttctgcactgtcgccaataaaaa

SEQ ID NO: 472530 - DNA, 25 bp, Rattus norvegicus
ggttctgcagaccaagtacagtgaa

SEQ ID NO: 472531 - DNA, 25 bp, Rattus norvegicus
ggttctgcagacgaagtacagtgaa

SEQ ID NO: 472532 - DNA, 25 bp, Rattus norvegicus
ggttctgcagctatcaatggtgtag

SEQ ID NO: 472533 - DNA, 25 bp, Rattus norvegicus
ggttctgcagctttcaatggtgtag

SEQ ID NO: 472534 - DNA, 25 bp, Rattus norvegicus
ggttctgcagtcactcacaagactt

SEQ ID NO: 472535 - DNA, 25 bp, Rattus norvegicus
ggttctgcagtctctcacaagactt

SEQ ID NO: 472536 - DNA, 25 bp, Rattus norvegicus
ggttctgcatgcctttatactgact

SEQ ID NO: 472537 - DNA, 25 bp, Rattus norvegicus
ggttctgcatgcgtttatactgact

SEQ ID NO: 472538 - DNA, 25 bp, Rattus norvegicus
ggttctgcattgaagaatctgtcat

SEQ ID NO: 472539 - DNA, 25 bp, Rattus norvegicus
ggttctgcattgtagaatctgtcat

SEQ ID NO: 472540 - DNA, 25 bp, Rattus norvegicus
ggttctgccacgagctatttattta

SEQ ID NO: 472541 - DNA, 25 bp, Rattus norvegicus
ggttctgccacgtgctatttattta

SEQ ID NO: 472542 - DNA, 25 bp, Rattus norvegicus
ggttctgccatcagttctgatggga

SEQ ID NO: 472543 - DNA, 25 bp, Rattus norvegicus
ggttctgccatctgttctgatggga

SEQ ID NO: 472544 - DNA, 25 bp, Rattus norvegicus
ggttctgctaggatgctttgccagc

SEQ ID NO: 472545 - DNA, 25 bp, Rattus norvegicus
ggttctgctaggttgctttgccagc

SEQ ID NO: 472546 - DNA, 25 bp, Rattus norvegicus
ggttctgctgtacgcttctagacac

SEQ ID NO: 472547 - DNA, 25 bp, Rattus norvegicus
ggttctgctgtaggcttctagacac

SEQ ID NO: 472548 - DNA, 25 bp, Rattus norvegicus
ggttctgctgttctggtagacatca

SEQ ID NO: 472549 - DNA, 25 bp, Rattus norvegicus
ggttctgctgttgtggtagacatca

SEQ ID NO: 472550 - DNA, 25 bp, Rattus norvegicus
ggttctgctttcatggtgactgaga

SEQ ID NO: 472551 - DNA, 25 bp, Rattus norvegicus
ggttctgctttcttggtgactgaga

SEQ ID NO: 472552 - DNA, 25 bp, Rattus norvegicus
ggttctggacaacggcggtaaatct

SEQ ID NO: 472553 - DNA, 25 bp, Rattus norvegicus
ggttctggacaagggcggtaaatct

SEQ ID NO: 472554 - DNA, 25 bp, Rattus norvegicus
ggttctggactgaatagttgtactt

SEQ ID NO: 472555 - DNA, 25 bp, Rattus norvegicus
ggttctggactgtatagttgtactt

SEQ ID NO: 472556 - DNA, 25 bp, Rattus norvegicus
ggttctggagcgcatacagctgatc

SEQ ID NO: 472557 - DNA, 25 bp, Rattus norvegicus
ggttctggagcggatacagctgatc

SEQ ID NO: 472558 - DNA, 25 bp, Rattus norvegicus
ggttctggccatacctttcactgaa

SEQ ID NO: 472559 - DNA, 25 bp, Rattus norvegicus
ggttctggccattcctttcactgaa

SEQ ID NO: 472560 - DNA, 25 bp, Rattus norvegicus
ggttctgggtatcccgcacgctcac

SEQ ID NO: 472561 - DNA, 25 bp, Rattus norvegicus
ggttctgggtatgccgcacgctcac

SEQ ID NO: 472562 - DNA, 25 bp, Rattus norvegicus
ggttctggtattaaatgagtggccc

SEQ ID NO: 472563 - DNA, 25 bp, Rattus norvegicus
ggttctggtatttaatgagtggccc

SEQ ID NO: 472564 - DNA, 25 bp, Rattus norvegicus
ggttctggtcttcaaacgccatgtc

SEQ ID NO: 472565 - DNA, 25 bp, Rattus norvegicus
ggttctggtcttgaaacgccatgtc

SEQ ID NO: 472566 - DNA, 25 bp, Rattus norvegicus
ggttctggttccacaaaacaggcat

SEQ ID NO: 472567 - DNA, 25 bp, Rattus norvegicus
ggttctggttcctcaaaacaggcat

SEQ ID NO: 472568 - DNA, 25 bp, Rattus norvegicus
ggttctgtaaagatctgcctcttac

SEQ ID NO: 472569 - DNA, 25 bp, Rattus norvegicus
ggttctgtaaagttctgcctcttac

SEQ ID NO: 472570 - DNA, 25 bp, Rattus norvegicus
ggttctgtaatgactttgaagccaa

SEQ ID NO: 472571 - DNA, 25 bp, Rattus norvegicus
ggttctgtaatgtctttgaagccaa

SEQ ID NO: 472572 - DNA, 25 bp, Rattus norvegicus
ggttctgtagctacacagtgtcaca

SEQ ID NO: 472573 - DNA, 25 bp, Rattus norvegicus
ggttctgtagcttcacagtgtcaca

SEQ ID NO: 472574 - DNA, 25 bp, Rattus norvegicus
ggttctgtatgaagcagagctcact

SEQ ID NO: 472575 - DNA, 25 bp, Rattus norvegicus
ggttctgtatgatgcagagctcact

SEQ ID NO: 472576 - DNA, 25 bp, Rattus norvegicus
ggttctgtctatcttaaagtagctg

SEQ ID NO: 472577 - DNA, 25 bp, Rattus norvegicus
ggttctgtctatgttaaagtagctg

SEQ ID NO: 472578 - DNA, 25 bp, Rattus norvegicus
ggttctgtctccagtgagggctcag

SEQ ID NO: 472579 - DNA, 25 bp, Rattus norvegicus
ggttctgtctcctgtgagggctcag

SEQ ID NO: 472580 - DNA, 25 bp, Rattus norvegicus
ggttctgtctctatagaagccactg

SEQ ID NO: 472581 - DNA, 25 bp, Rattus norvegicus
ggttctgtctctttagaagccactg

SEQ ID NO: 472582 - DNA, 25 bp, Rattus norvegicus
ggttctgtcttcattgatagccatc

SEQ ID NO: 472583 - DNA, 25 bp, Rattus norvegicus
ggttctgtcttctttgatagccatc

SEQ ID NO: 472584 - DNA, 25 bp, Rattus norvegicus
ggttctgtgattccccatcatggat

SEQ ID NO: 472585 - DNA, 25 bp, Rattus norvegicus
ggttctgtgattgcccatcatggat

SEQ ID NO: 472586 - DNA, 25 bp, Rattus norvegicus
ggttctgtggataccaagatgctca

SEQ ID NO: 472587 - DNA, 25 bp, Rattus norvegicus
ggttctgtggattccaagatgctca

SEQ ID NO: 472588 - DNA, 25 bp, Rattus norvegicus
ggttctgtgtcaccgactaatgcta

SEQ ID NO: 472589 - DNA, 25 bp, Rattus norvegicus
ggttctgtgtcagcgactaatgcta

SEQ ID NO: 472590 - DNA, 25 bp, Rattus norvegicus
ggttctgttagtatcgtgttcatcc

SEQ ID NO: 472591 - DNA, 25 bp, Rattus norvegicus
ggttctgttagtttcgtgttcatcc

SEQ ID NO: 472592 - DNA, 25 bp, Rattus norvegicus
ggttctgttcctatgacactacgca

SEQ ID NO: 472593 - DNA, 25 bp, Rattus norvegicus
ggttctgttcctttgacactacgca

SEQ ID NO: 472594 - DNA, 25 bp, Rattus norvegicus
ggttctgttgagatgaaggctacat

SEQ ID NO: 472595 - DNA, 25 bp, Rattus norvegicus
ggttctgttgagttgaaggctacat

SEQ ID NO: 472596 - DNA, 25 bp, Rattus norvegicus
ggttctgttgccagagcatgttaat

SEQ ID NO: 472597 - DNA, 25 bp, Rattus norvegicus
ggttctgttgcctgagcatgttaat

SEQ ID NO: 472598 - DNA, 25 bp, Rattus norvegicus
ggttctgttggtatatcagctccag

SEQ ID NO: 472599 - DNA, 25 bp, Rattus norvegicus
ggttctgttggtttatcagctccag

SEQ ID NO: 472600 - DNA, 25 bp, Rattus norvegicus
ggttctgtttccatccattattaca

SEQ ID NO: 472601 - DNA, 25 bp, Rattus norvegicus
ggttctgtttccttccattattaca

SEQ ID NO: 472602 - DNA, 25 bp, Rattus norvegicus
ggttctgttttaattatctgcatat

SEQ ID NO: 472603 - DNA, 25 bp, Rattus norvegicus
ggttctgttttatttatctgcatat

SEQ ID NO: 472604 - DNA, 25 bp, Rattus norvegicus
ggttcttaaaacagatcctccaata

SEQ ID NO: 472605 - DNA, 25 bp, Rattus norvegicus
ggttcttaaaactgatcctccaata

SEQ ID NO: 472606 - DNA, 25 bp, Rattus norvegicus
ggttcttaaactctgctggctgata

SEQ ID NO: 472607 - DNA, 25 bp, Rattus norvegicus
ggttcttaaactgtgctggctgata

SEQ ID NO: 472608 - DNA, 25 bp, Rattus norvegicus
ggttcttaacacaccctgatggtgg

SEQ ID NO: 472609 - DNA, 25 bp, Rattus norvegicus
ggttcttaacactccctgatggtgg

SEQ ID NO: 472610 - DNA, 25 bp, Rattus norvegicus
ggttcttacccacatgacttttcct

SEQ ID NO: 472611 - DNA, 25 bp, Rattus norvegicus
ggttcttacccagatgacttttcct

SEQ ID NO: 472612 - DNA, 25 bp, Rattus norvegicus
ggttcttactatagacccaccatat

SEQ ID NO: 472613 - DNA, 25 bp, Rattus norvegicus
ggttcttactattgacccaccatat

SEQ ID NO: 472614 - DNA, 25 bp, Rattus norvegicus
ggttcttacttcagggccatcaatt

SEQ ID NO: 472615 - DNA, 25 bp, Rattus norvegicus
ggttcttacttctgggccatcaatt

SEQ ID NO: 472616 - DNA, 25 bp, Rattus norvegicus
ggttcttagctgaggttgctaccca

SEQ ID NO: 472617 - DNA, 25 bp, Rattus norvegicus
ggttcttagctgtggttgctaccca

SEQ ID NO: 472618 - DNA, 25 bp, Rattus norvegicus
ggttcttcaaagaggccttcttcgc

SEQ ID NO: 472619 - DNA, 25 bp, Rattus norvegicus
ggttcttcaaagtggccttcttcgc

SEQ ID NO: 472620 - DNA, 25 bp, Rattus norvegicus
ggttcttcaagtctatgccaatcac

SEQ ID NO: 472621 - DNA, 25 bp, Rattus norvegicus
ggttcttcaagtgtatgccaatcac

SEQ ID NO: 472622 - DNA, 25 bp, Rattus norvegicus
ggttcttcacagaaccagagagtaa

SEQ ID NO: 472623 - DNA, 25 bp, Rattus norvegicus
ggttcttcacagtaccagagagtaa

SEQ ID NO: 472624 - DNA, 25 bp, Rattus norvegicus
ggttcttcacttacattgctggctg

SEQ ID NO: 472625 - DNA, 25 bp, Rattus norvegicus
ggttcttcactttcattgctggctg

SEQ ID NO: 472626 - DNA, 25 bp, Rattus norvegicus
ggttcttcatcaagcaggacgacac

SEQ ID NO: 472627 - DNA, 25 bp, Rattus norvegicus
ggttcttcatcatgcaggacgacac

SEQ ID NO: 472628 - DNA, 25 bp, Rattus norvegicus
ggttcttccagcacgaaaactcggt

SEQ ID NO: 472629 - DNA, 25 bp, Rattus norvegicus
ggttcttccagctcgaaaactcggt

SEQ ID NO: 472630 - DNA, 25 bp, Rattus norvegicus
ggttcttccattaggcttttgagga

SEQ ID NO: 472631 - DNA, 25 bp, Rattus norvegicus
ggttcttccatttggcttttgagga

SEQ ID NO: 472632 - DNA, 25 bp, Rattus norvegicus
ggttcttcccagcagaatttagaga

SEQ ID NO: 472633 - DNA, 25 bp, Rattus norvegicus
ggttcttcccaggagaatttagaga

SEQ ID NO: 472634 - DNA, 25 bp, Rattus norvegicus
ggttcttccggtcgaactcagtctg

SEQ ID NO: 472635 - DNA, 25 bp, Rattus norvegicus
ggttcttccggtggaactcagtctg

SEQ ID NO: 472636 - DNA, 25 bp, Rattus norvegicus
ggttcttcctccaaaagattccaca

SEQ ID NO: 472637 - DNA, 25 bp, Rattus norvegicus
ggttcttcctcctaaagattccaca

SEQ ID NO: 472638 - DNA, 25 bp, Rattus norvegicus
ggttcttccttcaagaatcgctcag

SEQ ID NO: 472639 - DNA, 25 bp, Rattus norvegicus
ggttcttccttctagaatcgctcag

SEQ ID NO: 472640 - DNA, 25 bp, Rattus norvegicus
ggttcttctcatacccagtttaaag

SEQ ID NO: 472641 - DNA, 25 bp, Rattus norvegicus
ggttcttctcattcccagtttaaag

SEQ ID NO: 472642 - DNA, 25 bp, Rattus norvegicus
ggttcttctcttactcagaactcag

SEQ ID NO: 472643 - DNA, 25 bp, Rattus norvegicus
ggttcttctctttctcagaactcag

SEQ ID NO: 472644 - DNA, 25 bp, Rattus norvegicus
ggttcttctgatcctgaggtttaaa

SEQ ID NO: 472645 - DNA, 25 bp, Rattus norvegicus
ggttcttctgatgctgaggtttaaa

SEQ ID NO: 472646 - DNA, 25 bp, Rattus norvegicus
ggttcttcttagcacctctgagatc

SEQ ID NO: 472647 - DNA, 25 bp, Rattus norvegicus
ggttcttcttaggacctctgagatc

SEQ ID NO: 472648 - DNA, 25 bp, Rattus norvegicus
ggttcttcttcaactgcattcattt

SEQ ID NO: 472649 - DNA, 25 bp, Rattus norvegicus
ggttcttcttcatctgcattcattt

SEQ ID NO: 472650 - DNA, 25 bp, Rattus norvegicus
ggttcttctttacaaactgcttgaa

SEQ ID NO: 472651 - DNA, 25 bp, Rattus norvegicus
ggttcttctttagaaactgcttgaa

SEQ ID NO: 472652 - DNA, 25 bp, Rattus norvegicus
ggttcttctttgcatttactactcg

SEQ ID NO: 472653 - DNA, 25 bp, Rattus norvegicus
ggttcttctttggatttactactcg

SEQ ID NO: 472654 - DNA, 25 bp, Rattus norvegicus
ggttcttgacaacatgtttcccaat

SEQ ID NO: 472655 - DNA, 25 bp, Rattus norvegicus
ggttcttgacaagatgtttcccaat

SEQ ID NO: 472656 - DNA, 25 bp, Rattus norvegicus
ggttcttgatatattccaaagacac

SEQ ID NO: 472657 - DNA, 25 bp, Rattus norvegicus
ggttcttgatattttccaaagacac

SEQ ID NO: 472658 - DNA, 25 bp, Rattus norvegicus
ggttcttgatttacttcagcgtttt

SEQ ID NO: 472659 - DNA, 25 bp, Rattus norvegicus
ggttcttgattttcttcagcgtttt

SEQ ID NO: 472660 - DNA, 25 bp, Rattus norvegicus
ggttcttgcaaactaagctcaacgt

SEQ ID NO: 472661 - DNA, 25 bp, Rattus norvegicus
ggttcttgcaaagtaagctcaacgt

SEQ ID NO: 472662 - DNA, 25 bp, Rattus norvegicus
ggttcttgcctaaggaactctcctt

SEQ ID NO: 472663 - DNA, 25 bp, Rattus norvegicus
ggttcttgcctatggaactctcctt

SEQ ID NO: 472664 - DNA, 25 bp, Rattus norvegicus
ggttcttgctacatctcagtatcta

SEQ ID NO: 472665 - DNA, 25 bp, Rattus norvegicus
ggttcttgctacttctcagtatcta

SEQ ID NO: 472666 - DNA, 25 bp, Rattus norvegicus
ggttcttgctggcttttgattctgc

SEQ ID NO: 472667 - DNA, 25 bp, Rattus norvegicus
ggttcttgctgggttttgattctgc

SEQ ID NO: 472668 - DNA, 25 bp, Rattus norvegicus
ggttcttgcttgaacaatccctggc

SEQ ID NO: 472669 - DNA, 25 bp, Rattus norvegicus
ggttcttgcttgtacaatccctggc

SEQ ID NO: 472670 - DNA, 25 bp, Rattus norvegicus
ggttcttggacccaggtaccgacat

SEQ ID NO: 472671 - DNA, 25 bp, Rattus norvegicus
ggttcttggaccgaggtaccgacat

SEQ ID NO: 472672 - DNA, 25 bp, Rattus norvegicus
ggttcttggcacacatcagggtata

SEQ ID NO: 472673 - DNA, 25 bp, Rattus norvegicus
ggttcttggcactcatcagggtata

SEQ ID NO: 472674 - DNA, 25 bp, Rattus norvegicus
ggttcttggctaatgtaatgtcctg

SEQ ID NO: 472675 - DNA, 25 bp, Rattus norvegicus
ggttcttggctattgtaatgtcctg

SEQ ID NO: 472676 - DNA, 25 bp, Rattus norvegicus
ggttcttggcttctctggaactcac

SEQ ID NO: 472677 - DNA, 25 bp, Rattus norvegicus
ggttcttggcttgtctggaactcac

SEQ ID NO: 472678 - DNA, 25 bp, Rattus norvegicus
ggttcttggttacctaatcatctta

SEQ ID NO: 472679 - DNA, 25 bp, Rattus norvegicus
ggttcttggttagctaatcatctta

SEQ ID NO: 472680 - DNA, 25 bp, Rattus norvegicus
ggttctttaaacacgctggacggct

SEQ ID NO: 472681 - DNA, 25 bp, Rattus norvegicus
ggttctttaaactcgctggacggct

SEQ ID NO: 472682 - DNA, 25 bp, Rattus norvegicus
ggttctttactcacacatggtcacg

SEQ ID NO: 472683 - DNA, 25 bp, Rattus norvegicus
ggttctttactctcacatggtcacg

SEQ ID NO: 472684 - DNA, 25 bp, Rattus norvegicus
ggttctttagtcatttagcaccaac

SEQ ID NO: 472685 - DNA, 25 bp, Rattus norvegicus
ggttctttagtcttttagcaccaac

SEQ ID NO: 472686 - DNA, 25 bp, Rattus norvegicus
ggttctttatgaactgtactaggtc

SEQ ID NO: 472687 - DNA, 25 bp, Rattus norvegicus
ggttctttatgatctgtactaggtc

SEQ ID NO: 472688 - DNA, 25 bp, Rattus norvegicus
ggttctttcaagagctaccagagca

SEQ ID NO: 472689 - DNA, 25 bp, Rattus norvegicus
ggttctttcaagtgctaccagagca

SEQ ID NO: 472690 - DNA, 25 bp, Rattus norvegicus
ggttctttcagaccagccaggttcc

SEQ ID NO: 472691 - DNA, 25 bp, Rattus norvegicus
ggttctttcagagcagccaggttcc

SEQ ID NO: 472692 - DNA, 25 bp, Rattus norvegicus
ggttctttcagtctagttactttga

SEQ ID NO: 472693 - DNA, 25 bp, Rattus norvegicus
ggttctttcagtgtagttactttga

SEQ ID NO: 472694 - DNA, 25 bp, Rattus norvegicus
ggttctttcatgagacagcgggact

SEQ ID NO: 472695 - DNA, 25 bp, Rattus norvegicus
ggttctttcatgtgacagcgggact

SEQ ID NO: 472696 - DNA, 25 bp, Rattus norvegicus
ggttctttccacagcccaaaggaat

SEQ ID NO: 472697 - DNA, 25 bp, Rattus norvegicus
ggttctttccactgcccaaaggaat

SEQ ID NO: 472698 - DNA, 25 bp, Rattus norvegicus
ggttctttctagaatgttcttccac

SEQ ID NO: 472699 - DNA, 25 bp, Rattus norvegicus
ggttctttctagtatgttcttccac

SEQ ID NO: 472700 - DNA, 25 bp, Rattus norvegicus
ggttctttgaaaatgtcacgctttg

SEQ ID NO: 472701 - DNA, 25 bp, Rattus norvegicus
ggttctttgaaattgtcacgctttg

SEQ ID NO: 472702 - DNA, 25 bp, Rattus norvegicus
ggttctttgcaacctgtgtgacttt

SEQ ID NO: 472703 - DNA, 25 bp, Rattus norvegicus
ggttctttgcaagctgtgtgacttt

SEQ ID NO: 472704 - DNA, 25 bp, Rattus norvegicus
ggttctttgtttccggctcaagctg

SEQ ID NO: 472705 - DNA, 25 bp, Rattus norvegicus
ggttctttgtttgcggctcaagctg

SEQ ID NO: 472706 - DNA, 25 bp, Rattus norvegicus
ggttcttttgaccaacatatccgta

SEQ ID NO: 472707 - DNA, 25 bp, Rattus norvegicus
ggttcttttgacgaacatatccgta

SEQ ID NO: 472708 - DNA, 25 bp, Rattus norvegicus
ggttctttttaaatcccaggcagca

SEQ ID NO: 472709 - DNA, 25 bp, Rattus norvegicus
ggttctttttaattcccaggcagca

SEQ ID NO: 472710 - DNA, 25 bp, Rattus norvegicus
ggttcttttttgagaccagctctca

SEQ ID NO: 472711 - DNA, 25 bp, Rattus norvegicus
ggttcttttttgtgaccagctctca

SEQ ID NO: 472712 - DNA, 25 bp, Rattus norvegicus
ggttgaaaaccaccagtccaggatt

SEQ ID NO: 472713 - DNA, 25 bp, Rattus norvegicus
ggttgaaaaccagcagtccaggatt

SEQ ID NO: 472714 - DNA, 25 bp, Rattus norvegicus
ggttgaaatagtccccatgagcctg

SEQ ID NO: 472715 - DNA, 25 bp, Rattus norvegicus
ggttgaaatagtgcccatgagcctg

SEQ ID NO: 472716 - DNA, 25 bp, Rattus norvegicus
ggttgaaatttcacagcctcagcac

SEQ ID NO: 472717 - DNA, 25 bp, Rattus norvegicus
ggttgaaatttctcagcctcagcac

SEQ ID NO: 472718 - DNA, 25 bp, Rattus norvegicus
ggttgaacaactaatgtgcccaagg

SEQ ID NO: 472719 - DNA, 25 bp, Rattus norvegicus
ggttgaacaacttatgtgcccaagg

SEQ ID NO: 472720 - DNA, 25 bp, Rattus norvegicus
ggttgaacacataccactttctgga

SEQ ID NO: 472721 - DNA, 25 bp, Rattus norvegicus
ggttgaacacattccactttctgga

SEQ ID NO: 472722 - DNA, 25 bp, Rattus norvegicus
ggttgaacccacacatggtgaggat

SEQ ID NO: 472723 - DNA, 25 bp, Rattus norvegicus
ggttgaacccactcatggtgaggat

SEQ ID NO: 472724 - DNA, 25 bp, Rattus norvegicus
ggttgaaccctgagcagtgcatgca

SEQ ID NO: 472725 - DNA, 25 bp, Rattus norvegicus
ggttgaaccctgtgcagtgcatgca

SEQ ID NO: 472726 - DNA, 25 bp, Rattus norvegicus
ggttgaacctgcatgtttgactgta

SEQ ID NO: 472727 - DNA, 25 bp, Rattus norvegicus
ggttgaacctgcttgtttgactgta

SEQ ID NO: 472728 - DNA, 25 bp, Rattus norvegicus
ggttgaaccttgaatgtactgcatt

SEQ ID NO: 472729 - DNA, 25 bp, Rattus norvegicus
ggttgaaccttgtatgtactgcatt

SEQ ID NO: 472730 - DNA, 25 bp, Rattus norvegicus
ggttgaacctttagtgatcttcttt

SEQ ID NO: 472731 - DNA, 25 bp, Rattus norvegicus
ggttgaaccttttgtgatcttcttt

SEQ ID NO: 472732 - DNA, 25 bp, Rattus norvegicus
ggttgaactgtcaggctgaagcaat

SEQ ID NO: 472733 - DNA, 25 bp, Rattus norvegicus
ggttgaactgtctggctgaagcaat

SEQ ID NO: 472734 - DNA, 25 bp, Rattus norvegicus
ggttgaactttgcagttttcctcaa

SEQ ID NO: 472735 - DNA, 25 bp, Rattus norvegicus
ggttgaactttggagttttcctcaa

SEQ ID NO: 472736 - DNA, 25 bp, Rattus norvegicus
ggttgaagccaaccccactgtgtac

SEQ ID NO: 472737 - DNA, 25 bp, Rattus norvegicus
ggttgaagccaagcccactgtgtac

SEQ ID NO: 472738 - DNA, 25 bp, Rattus norvegicus
ggttgaagccgtacaggaccttcct

SEQ ID NO: 472739 - DNA, 25 bp, Rattus norvegicus
ggttgaagccgttcaggaccttcct

SEQ ID NO: 472740 - DNA, 25 bp, Rattus norvegicus
ggttgaatacccatacctcagagct

SEQ ID NO: 472741 - DNA, 25 bp, Rattus norvegicus
ggttgaatacccttacctcagagct

SEQ ID NO: 472742 - DNA, 25 bp, Rattus norvegicus
ggttgaatgtctcccatctttatgt

SEQ ID NO: 472743 - DNA, 25 bp, Rattus norvegicus
ggttgaatgtctgccatctttatgt

SEQ ID NO: 472744 - DNA, 25 bp, Rattus norvegicus
ggttgaattcaccaacagccctgat

SEQ ID NO: 472745 - DNA, 25 bp, Rattus norvegicus
ggttgaattcacgaacagccctgat

SEQ ID NO: 472746 - DNA, 25 bp, Rattus norvegicus
ggttgaattgctatctaagtctcca

SEQ ID NO: 472747 - DNA, 25 bp, Rattus norvegicus
ggttgaattgctttctaagtctcca

SEQ ID NO: 472748 - DNA, 25 bp, Rattus norvegicus
ggttgaatttccatggcctgactaa

SEQ ID NO: 472749 - DNA, 25 bp, Rattus norvegicus
ggttgaatttccttggcctgactaa

SEQ ID NO: 472750 - DNA, 25 bp, Rattus norvegicus
ggttgaatttctatcagtccaggtc

SEQ ID NO: 472751 - DNA, 25 bp, Rattus norvegicus
ggttgaatttctttcagtccaggtc

SEQ ID NO: 472752 - DNA, 25 bp, Rattus norvegicus
ggttgacaaaatatcccgcatcatc

SEQ ID NO: 472753 - DNA, 25 bp, Rattus norvegicus
ggttgacaaaatttcccgcatcatc

SEQ ID NO: 472754 - DNA, 25 bp, Rattus norvegicus
ggttgacaagccactgtttgcttaa

SEQ ID NO: 472755 - DNA, 25 bp, Rattus norvegicus
ggttgacaagcctctgtttgcttaa

SEQ ID NO: 472756 - DNA, 25 bp, Rattus norvegicus
ggttgacacagtagcctttattctt

SEQ ID NO: 472757 - DNA, 25 bp, Rattus norvegicus
ggttgacacagttgcctttattctt

SEQ ID NO: 472758 - DNA, 25 bp, Rattus norvegicus
ggttgacagcatagttgaccccatg

SEQ ID NO: 472759 - DNA, 25 bp, Rattus norvegicus
ggttgacagcattgttgaccccatg

SEQ ID NO: 472760 - DNA, 25 bp, Rattus norvegicus
ggttgacaggaacactcacccaagt

SEQ ID NO: 472761 - DNA, 25 bp, Rattus norvegicus
ggttgacaggaagactcacccaagt

SEQ ID NO: 472762 - DNA, 25 bp, Rattus norvegicus
ggttgacaggagaacaggccgattt

SEQ ID NO: 472763 - DNA, 25 bp, Rattus norvegicus
ggttgacaggagtacaggccgattt

SEQ ID NO: 472764 - DNA, 25 bp, Rattus norvegicus
ggttgacatgatcctacagtgcttt

SEQ ID NO: 472765 - DNA, 25 bp, Rattus norvegicus
ggttgacatgatgctacagtgcttt

SEQ ID NO: 472766 - DNA, 25 bp, Rattus norvegicus
ggttgacattgaattattccacatt

SEQ ID NO: 472767 - DNA, 25 bp, Rattus norvegicus
ggttgacattgatttattccacatt

SEQ ID NO: 472768 - DNA, 25 bp, Rattus norvegicus
ggttgacattgccacacttcacaga

SEQ ID NO: 472769 - DNA, 25 bp, Rattus norvegicus
ggttgacattgcgacacttcacaga

SEQ ID NO: 472770 - DNA, 25 bp, Rattus norvegicus
ggttgaccacatactcgtgctttag

SEQ ID NO: 472771 - DNA, 25 bp, Rattus norvegicus
ggttgaccacattctcgtgctttag

SEQ ID NO: 472772 - DNA, 25 bp, Rattus norvegicus
ggttgaccaggcagtagaccaggat

SEQ ID NO: 472773 - DNA, 25 bp, Rattus norvegicus
ggttgaccaggctgtagaccaggat

SEQ ID NO: 472774 - DNA, 25 bp, Rattus norvegicus
ggttgaccatgacctaacagcaatt

SEQ ID NO: 472775 - DNA, 25 bp, Rattus norvegicus
ggttgaccatgagctaacagcaatt

SEQ ID NO: 472776 - DNA, 25 bp, Rattus norvegicus
ggttgacccagcctatttatactgc

SEQ ID NO: 472777 - DNA, 25 bp, Rattus norvegicus
ggttgacccagcgtatttatactgc

SEQ ID NO: 472778 - DNA, 25 bp, Rattus norvegicus
ggttgaccgcacagtgtaagcagaa

SEQ ID NO: 472779 - DNA, 25 bp, Rattus norvegicus
ggttgaccgcactgtgtaagcagaa

SEQ ID NO: 472780 - DNA, 25 bp, Rattus norvegicus
ggttgacctcaaacacttggcctta

SEQ ID NO: 472781 - DNA, 25 bp, Rattus norvegicus
ggttgacctcaatcacttggcctta

SEQ ID NO: 472782 - DNA, 25 bp, Rattus norvegicus
ggttgacctctgacatctgatgttc

SEQ ID NO: 472783 - DNA, 25 bp, Rattus norvegicus
ggttgacctctgtcatctgatgttc

SEQ ID NO: 472784 - DNA, 25 bp, Rattus norvegicus
ggttgacctggcactcctcaggctt

SEQ ID NO: 472785 - DNA, 25 bp, Rattus norvegicus
ggttgacctggctctcctcaggctt

SEQ ID NO: 472786 - DNA, 25 bp, Rattus norvegicus
ggttgacctgggatctactgtgagt

SEQ ID NO: 472787 - DNA, 25 bp, Rattus norvegicus
ggttgacctgggttctactgtgagt

SEQ ID NO: 472788 - DNA, 25 bp, Rattus norvegicus
ggttgaccttaaccctgggaagact

SEQ ID NO: 472789 - DNA, 25 bp, Rattus norvegicus
ggttgaccttaagcctgggaagact

SEQ ID NO: 472790 - DNA, 25 bp, Rattus norvegicus
ggttgaccttacacatccatgcagt

SEQ ID NO: 472791 - DNA, 25 bp, Rattus norvegicus
ggttgaccttactcatccatgcagt

SEQ ID NO: 472792 - DNA, 25 bp, Rattus norvegicus
ggttgaccttccagagacagggcct

SEQ ID NO: 472793 - DNA, 25 bp, Rattus norvegicus
ggttgaccttcctgagacagggcct

SEQ ID NO: 472794 - DNA, 25 bp, Rattus norvegicus
ggttgaccttcgagagcccgagttt

SEQ ID NO: 472795 - DNA, 25 bp, Rattus norvegicus
ggttgaccttcgtgagcccgagttt

SEQ ID NO: 472796 - DNA, 25 bp, Rattus norvegicus
ggttgacgacctcagatcaatctcc

SEQ ID NO: 472797 - DNA, 25 bp, Rattus norvegicus
ggttgacgacctgagatcaatctcc

SEQ ID NO: 472798 - DNA, 25 bp, Rattus norvegicus
ggttgactaacaccctttatccaat

SEQ ID NO: 472799 - DNA, 25 bp, Rattus norvegicus
ggttgactaacagcctttatccaat

SEQ ID NO: 472800 - DNA, 25 bp, Rattus norvegicus
ggttgactaccgatacatgctgaat

SEQ ID NO: 472801 - DNA, 25 bp, Rattus norvegicus
ggttgactaccgttacatgctgaat

SEQ ID NO: 472802 - DNA, 25 bp, Rattus norvegicus
ggttgactactgcaacaggctttta

SEQ ID NO: 472803 - DNA, 25 bp, Rattus norvegicus
ggttgactactggaacaggctttta

SEQ ID NO: 472804 - DNA, 25 bp, Rattus norvegicus
ggttgactagtcagttatctggcta

SEQ ID NO: 472805 - DNA, 25 bp, Rattus norvegicus
ggttgactagtctgttatctggcta

SEQ ID NO: 472806 - DNA, 25 bp, Rattus norvegicus
ggttgactctatctctaaggctatg

SEQ ID NO: 472807 - DNA, 25 bp, Rattus norvegicus
ggttgactctatgtctaaggctatg

SEQ ID NO: 472808 - DNA, 25 bp, Rattus norvegicus
ggttgactgcatccacattttttaa

SEQ ID NO: 472809 - DNA, 25 bp, Rattus norvegicus
ggttgactgcatgcacattttttaa

SEQ ID NO: 472810 - DNA, 25 bp, Rattus norvegicus
ggttgactgtacaaatgacttccat

SEQ ID NO: 472811 - DNA, 25 bp, Rattus norvegicus
ggttgactgtactaatgacttccat

SEQ ID NO: 472812 - DNA, 25 bp, Rattus norvegicus
ggttgacttgaacacctcattatct

SEQ ID NO: 472813 - DNA, 25 bp, Rattus norvegicus
ggttgacttgaagacctcattatct

SEQ ID NO: 472814 - DNA, 25 bp, Rattus norvegicus
ggttgactttaaatgaacgcatcta

SEQ ID NO: 472815 - DNA, 25 bp, Rattus norvegicus
ggttgactttaattgaacgcatcta

SEQ ID NO: 472816 - DNA, 25 bp, Rattus norvegicus
ggttgactttttccacttctgtata

SEQ ID NO: 472817 - DNA, 25 bp, Rattus norvegicus
ggttgactttttgcacttctgtata

SEQ ID NO: 472818 - DNA, 25 bp, Rattus norvegicus
ggttgagaaacacacttagctctta

SEQ ID NO: 472819 - DNA, 25 bp, Rattus norvegicus
ggttgagaaacagacttagctctta

SEQ ID NO: 472820 - DNA, 25 bp, Rattus norvegicus
ggttgagaacacagattgctctttc

SEQ ID NO: 472821 - DNA, 25 bp, Rattus norvegicus
ggttgagaacactgattgctctttc

SEQ ID NO: 472822 - DNA, 25 bp, Rattus norvegicus
ggttgagaatctccttacctactgc

SEQ ID NO: 472823 - DNA, 25 bp, Rattus norvegicus
ggttgagaatctgcttacctactgc

SEQ ID NO: 472824 - DNA, 25 bp, Rattus norvegicus
ggttgagactctatatttaatgcgt

SEQ ID NO: 472825 - DNA, 25 bp, Rattus norvegicus
ggttgagactctttatttaatgcgt

SEQ ID NO: 472826 - DNA, 25 bp, Rattus norvegicus
ggttgagactgaaccgtgcacttca

SEQ ID NO: 472827 - DNA, 25 bp, Rattus norvegicus
ggttgagactgatccgtgcacttca

SEQ ID NO: 472828 - DNA, 25 bp, Rattus norvegicus
ggttgagagtccagctcacccgcaa

SEQ ID NO: 472829 - DNA, 25 bp, Rattus norvegicus
ggttgagagtcctgctcacccgcaa

SEQ ID NO: 472830 - DNA, 25 bp, Rattus norvegicus
ggttgagatacactcctgtcctgcc

SEQ ID NO: 472831 - DNA, 25 bp, Rattus norvegicus
ggttgagatacagtcctgtcctgcc

SEQ ID NO: 472832 - DNA, 25 bp, Rattus norvegicus
ggttgagcactgaaccagggcactg

SEQ ID NO: 472833 - DNA, 25 bp, Rattus norvegicus
ggttgagcactgtaccagggcactg

SEQ ID NO: 472834 - DNA, 25 bp, Rattus norvegicus
ggttgagcatttctgtctcagcctt

SEQ ID NO: 472835 - DNA, 25 bp, Rattus norvegicus
ggttgagcatttgtgtctcagcctt

SEQ ID NO: 472836 - DNA, 25 bp, Rattus norvegicus
ggttgagcgactccatttggtttcc

SEQ ID NO: 472837 - DNA, 25 bp, Rattus norvegicus
ggttgagcgactgcatttggtttcc

SEQ ID NO: 472838 - DNA, 25 bp, Rattus norvegicus
ggttgagctccacttgaaggtctaa

SEQ ID NO: 472839 - DNA, 25 bp, Rattus norvegicus
ggttgagctccagttgaaggtctaa

SEQ ID NO: 472840 - DNA, 25 bp, Rattus norvegicus
ggttgaggctccattcataccaaaa

SEQ ID NO: 472841 - DNA, 25 bp, Rattus norvegicus
ggttgaggctcctttcataccaaaa

SEQ ID NO: 472842 - DNA, 25 bp, Rattus norvegicus
ggttgaggtaacaaaggatcccaca

SEQ ID NO: 472843 - DNA, 25 bp, Rattus norvegicus
ggttgaggtaactaaggatcccaca

SEQ ID NO: 472844 - DNA, 25 bp, Rattus norvegicus
ggttgaggtctcagaggcactctca

SEQ ID NO: 472845 - DNA, 25 bp, Rattus norvegicus
ggttgaggtctctgaggcactctca

SEQ ID NO: 472846 - DNA, 25 bp, Rattus norvegicus
ggttgaggtcttcccaattcacagt

SEQ ID NO: 472847 - DNA, 25 bp, Rattus norvegicus
ggttgaggtcttgccaattcacagt

SEQ ID NO: 472848 - DNA, 25 bp, Rattus norvegicus
ggttgaggttgcaccaagccaggta

SEQ ID NO: 472849 - DNA, 25 bp, Rattus norvegicus
ggttgaggttgctccaagccaggta

SEQ ID NO: 472850 - DNA, 25 bp, Rattus norvegicus
ggttgagtgacacctgtgagcctct

SEQ ID NO: 472851 - DNA, 25 bp, Rattus norvegicus
ggttgagtgacagctgtgagcctct

SEQ ID NO: 472852 - DNA, 25 bp, Rattus norvegicus
ggttgagttacgacagagttcacat

SEQ ID NO: 472853 - DNA, 25 bp, Rattus norvegicus
ggttgagttacgtcagagttcacat

SEQ ID NO: 472854 - DNA, 25 bp, Rattus norvegicus
ggttgatactccatacagacaaaag

SEQ ID NO: 472855 - DNA, 25 bp, Rattus norvegicus
ggttgatactccttacagacaaaag

SEQ ID NO: 472856 - DNA, 25 bp, Rattus norvegicus
ggttgatcacacaaaactgtcagca

SEQ ID NO: 472857 - DNA, 25 bp, Rattus norvegicus
ggttgatcacactaaactgtcagca

SEQ ID NO: 472858 - DNA, 25 bp, Rattus norvegicus
ggttgatccaacattgactttcttc

SEQ ID NO: 472859 - DNA, 25 bp, Rattus norvegicus
ggttgatccaactttgactttcttc

SEQ ID NO: 472860 - DNA, 25 bp, Rattus norvegicus
ggttgatcgtgaaattccttcctct

SEQ ID NO: 472861 - DNA, 25 bp, Rattus norvegicus
ggttgatcgtgatattccttcctct

SEQ ID NO: 472862 - DNA, 25 bp, Rattus norvegicus
ggttgatctcagagccgtctagtca

SEQ ID NO: 472863 - DNA, 25 bp, Rattus norvegicus
ggttgatctcagtgccgtctagtca

SEQ ID NO: 472864 - DNA, 25 bp, Rattus norvegicus
ggttgatgacatcaccggcgagcct

SEQ ID NO: 472865 - DNA, 25 bp, Rattus norvegicus
ggttgatgacatgaccggcgagcct

SEQ ID NO: 472866 - DNA, 25 bp, Rattus norvegicus
ggttgatgacgccaaagtgtcccca

SEQ ID NO: 472867 - DNA, 25 bp, Rattus norvegicus
ggttgatgacgcgaaagtgtcccca

SEQ ID NO: 472868 - DNA, 25 bp, Rattus norvegicus
ggttgatgagcaagcacagagccat

SEQ ID NO: 472869 - DNA, 25 bp, Rattus norvegicus
ggttgatgagcatgcacagagccat

SEQ ID NO: 472870 - DNA, 25 bp, Rattus norvegicus
ggttgatgccgacctttattaaaca

SEQ ID NO: 472871 - DNA, 25 bp, Rattus norvegicus
ggttgatgccgagctttattaaaca

SEQ ID NO: 472872 - DNA, 25 bp, Rattus norvegicus
ggttgatgctacagtcaatcccggt

SEQ ID NO: 472873 - DNA, 25 bp, Rattus norvegicus
ggttgatgctactgtcaatcccggt

SEQ ID NO: 472874 - DNA, 25 bp, Rattus norvegicus
ggttgatggcggaccgtctccacag

SEQ ID NO: 472875 - DNA, 25 bp, Rattus norvegicus
ggttgatggcggtccgtctccacag

SEQ ID NO: 472876 - DNA, 25 bp, Rattus norvegicus
ggttgatgtaccagagtccttccat

SEQ ID NO: 472877 - DNA, 25 bp, Rattus norvegicus
ggttgatgtacctgagtccttccat

SEQ ID NO: 472878 - DNA, 25 bp, Rattus norvegicus
ggttgatgtcccacatcgtttataa

SEQ ID NO: 472879 - DNA, 25 bp, Rattus norvegicus
ggttgatgtccctcatcgtttataa

SEQ ID NO: 472880 - DNA, 25 bp, Rattus norvegicus
ggttgattagttatgtctgctctgg

SEQ ID NO: 472881 - DNA, 25 bp, Rattus norvegicus
ggttgattagttttgtctgctctgg

SEQ ID NO: 472882 - DNA, 25 bp, Rattus norvegicus
ggttgattcgatccttcccaggttt

SEQ ID NO: 472883 - DNA, 25 bp, Rattus norvegicus
ggttgattcgatgcttcccaggttt

SEQ ID NO: 472884 - DNA, 25 bp, Rattus norvegicus
ggttgattcttgactgctttcgcga

SEQ ID NO: 472885 - DNA, 25 bp, Rattus norvegicus
ggttgattcttgtctgctttcgcga

SEQ ID NO: 472886 - DNA, 25 bp, Rattus norvegicus
ggttgattgttacatcctttagtgg

SEQ ID NO: 472887 - DNA, 25 bp, Rattus norvegicus
ggttgattgttagatcctttagtgg

SEQ ID NO: 472888 - DNA, 25 bp, Rattus norvegicus
ggttgatttactccagtttcacggt

SEQ ID NO: 472889 - DNA, 25 bp, Rattus norvegicus
ggttgatttactgcagtttcacggt

SEQ ID NO: 472890 - DNA, 25 bp, Rattus norvegicus
ggttgatttcatcgagctgctaaga

SEQ ID NO: 472891 - DNA, 25 bp, Rattus norvegicus
ggttgatttcatggagctgctaaga

SEQ ID NO: 472892 - DNA, 25 bp, Rattus norvegicus
ggttgatttcctcttagcagcacta

SEQ ID NO: 472893 - DNA, 25 bp, Rattus norvegicus
ggttgatttcctgttagcagcacta

SEQ ID NO: 472894 - DNA, 25 bp, Rattus norvegicus
ggttgatttggtctcttgccatcga

SEQ ID NO: 472895 - DNA, 25 bp, Rattus norvegicus
ggttgatttggtgtcttgccatcga

SEQ ID NO: 472896 - DNA, 25 bp, Rattus norvegicus
ggttgattttctcagacacttccaa

SEQ ID NO: 472897 - DNA, 25 bp, Rattus norvegicus
ggttgattttctgagacacttccaa

SEQ ID NO: 472898 - DNA, 25 bp, Rattus norvegicus
ggttgcaaaactagattcttcatct

SEQ ID NO: 472899 - DNA, 25 bp, Rattus norvegicus
ggttgcaaaacttgattcttcatct

SEQ ID NO: 472900 - DNA, 25 bp, Rattus norvegicus
ggttgcaaagccattgttctacccg

SEQ ID NO: 472901 - DNA, 25 bp, Rattus norvegicus
ggttgcaaagcctttgttctacccg

SEQ ID NO: 472902 - DNA, 25 bp, Rattus norvegicus
ggttgcaaatcactctctacagatg

SEQ ID NO: 472903 - DNA, 25 bp, Rattus norvegicus
ggttgcaaatcagtctctacagatg

SEQ ID NO: 472904 - DNA, 25 bp, Rattus norvegicus
ggttgcaacaggcaggtcttgtctc

SEQ ID NO: 472905 - DNA, 25 bp, Rattus norvegicus
ggttgcaacagggaggtcttgtctc

SEQ ID NO: 472906 - DNA, 25 bp, Rattus norvegicus
ggttgcaaccagcacatcctggata

SEQ ID NO: 472907 - DNA, 25 bp, Rattus norvegicus
ggttgcaaccaggacatcctggata

SEQ ID NO: 472908 - DNA, 25 bp, Rattus norvegicus
ggttgcacaaacctttggtcttctg

SEQ ID NO: 472909 - DNA, 25 bp, Rattus norvegicus
ggttgcacaaacgtttggtcttctg

SEQ ID NO: 472910 - DNA, 25 bp, Rattus norvegicus
ggttgcagacctagcacccctataa

SEQ ID NO: 472911 - DNA, 25 bp, Rattus norvegicus
ggttgcagaccttgcacccctataa

SEQ ID NO: 472912 - DNA, 25 bp, Rattus norvegicus
ggttgcagaggcacaagtcttcctg

SEQ ID NO: 472913 - DNA, 25 bp, Rattus norvegicus
ggttgcagaggctcaagtcttcctg

SEQ ID NO: 472914 - DNA, 25 bp, Rattus norvegicus
ggttgcataaacaagctcgctttca

SEQ ID NO: 472915 - DNA, 25 bp, Rattus norvegicus
ggttgcataaactagctcgctttca

SEQ ID NO: 472916 - DNA, 25 bp, Rattus norvegicus
ggttgcatataaactttgctctttt

SEQ ID NO: 472917 - DNA, 25 bp, Rattus norvegicus
ggttgcatataatctttgctctttt

SEQ ID NO: 472918 - DNA, 25 bp, Rattus norvegicus
ggttgcatgttcaacaccatacagc

SEQ ID NO: 472919 - DNA, 25 bp, Rattus norvegicus
ggttgcatgttctacaccatacagc

SEQ ID NO: 472920 - DNA, 25 bp, Rattus norvegicus
ggttgcattataagtggaggctcaa

SEQ ID NO: 472921 - DNA, 25 bp, Rattus norvegicus
ggttgcattatatgtggaggctcaa

SEQ ID NO: 472922 - DNA, 25 bp, Rattus norvegicus
ggttgcattcctactttcttacaaa

SEQ ID NO: 472923 - DNA, 25 bp, Rattus norvegicus
ggttgcattccttctttcttacaaa

SEQ ID NO: 472924 - DNA, 25 bp, Rattus norvegicus
ggttgccaaaaaagacgtccacatg

SEQ ID NO: 472925 - DNA, 25 bp, Rattus norvegicus
ggttgccaaaaactgtgtcctttgt

SEQ ID NO: 472926 - DNA, 25 bp, Rattus norvegicus
ggttgccaaaaagtgtgtcctttgt

SEQ ID NO: 472927 - DNA, 25 bp, Rattus norvegicus
ggttgccaaaaatgacgtccacatg

SEQ ID NO: 472928 - DNA, 25 bp, Rattus norvegicus
ggttgccaagccaaactttgtggtt

SEQ ID NO: 472929 - DNA, 25 bp, Rattus norvegicus
ggttgccaagcctaactttgtggtt

SEQ ID NO: 472930 - DNA, 25 bp, Rattus norvegicus
ggttgccaatccaatttgtatctat

SEQ ID NO: 472931 - DNA, 25 bp, Rattus norvegicus
ggttgccaatcctatttgtatctat

SEQ ID NO: 472932 - DNA, 25 bp, Rattus norvegicus
ggttgccacaagactgaacagcgcc

SEQ ID NO: 472933 - DNA, 25 bp, Rattus norvegicus
ggttgccacaagtctgaacagcgcc

SEQ ID NO: 472934 - DNA, 25 bp, Rattus norvegicus
ggttgccacatcactgacagattca

SEQ ID NO: 472935 - DNA, 25 bp, Rattus norvegicus
ggttgccacatctctgacagattca

SEQ ID NO: 472936 - DNA, 25 bp, Rattus norvegicus
ggttgccagaaaaccaatcatcttt

SEQ ID NO: 472937 - DNA, 25 bp, Rattus norvegicus
ggttgccagaaatccaatcatcttt

SEQ ID NO: 472938 - DNA, 25 bp, Rattus norvegicus
ggttgccagatcatgcccatttttt

SEQ ID NO: 472939 - DNA, 25 bp, Rattus norvegicus
ggttgccagatcttgcccatttttt

SEQ ID NO: 472940 - DNA, 25 bp, Rattus norvegicus
ggttgccaggtgagcacttgctttc

SEQ ID NO: 472941 - DNA, 25 bp, Rattus norvegicus
ggttgccaggtgtgcacttgctttc

SEQ ID NO: 472942 - DNA, 25 bp, Rattus norvegicus
ggttgccagtggctatcgacacaac

SEQ ID NO: 472943 - DNA, 25 bp, Rattus norvegicus
ggttgccagtgggtatcgacacaac

SEQ ID NO: 472944 - DNA, 25 bp, Rattus norvegicus
ggttgccatataagtacccgatgtt

SEQ ID NO: 472945 - DNA, 25 bp, Rattus norvegicus
ggttgccatatatgtacccgatgtt

SEQ ID NO: 472946 - DNA, 25 bp, Rattus norvegicus
ggttgccatgctagcctatgaacaa

SEQ ID NO: 472947 - DNA, 25 bp, Rattus norvegicus
ggttgccatgcttgcctatgaacaa

SEQ ID NO: 472948 - DNA, 25 bp, Rattus norvegicus
ggttgccatttgatgcccctgggaa

SEQ ID NO: 472949 - DNA, 25 bp, Rattus norvegicus
ggttgccatttgttgcccctgggaa

SEQ ID NO: 472950 - DNA, 25 bp, Rattus norvegicus
ggttgcccaacaactattgcagcat

SEQ ID NO: 472951 - DNA, 25 bp, Rattus norvegicus
ggttgcccaacatctattgcagcat

SEQ ID NO: 472952 - DNA, 25 bp, Rattus norvegicus
ggttgcccaagtattacacgtaaag

SEQ ID NO: 472953 - DNA, 25 bp, Rattus norvegicus
ggttgcccaagttttacacgtaaag

SEQ ID NO: 472954 - DNA, 25 bp, Rattus norvegicus
ggttgcccaataccagatggttaac

SEQ ID NO: 472955 - DNA, 25 bp, Rattus norvegicus
ggttgcccaatagcagatggttaac

SEQ ID NO: 472956 - DNA, 25 bp, Rattus norvegicus
ggttgcccaattatgtttcttcaat

SEQ ID NO: 472957 - DNA, 25 bp, Rattus norvegicus
ggttgcccaattttgtttcttcaat

SEQ ID NO: 472958 - DNA, 25 bp, Rattus norvegicus
ggttgcccacacaaaggaccaaaag

SEQ ID NO: 472959 - DNA, 25 bp, Rattus norvegicus
ggttgcccacactaaggaccaaaag

SEQ ID NO: 472960 - DNA, 25 bp, Rattus norvegicus
ggttgcccagagatcttggttgttt

SEQ ID NO: 472961 - DNA, 25 bp, Rattus norvegicus
ggttgcccagagttcttggttgttt

SEQ ID NO: 472962 - DNA, 25 bp, Rattus norvegicus
ggttgcccagggaatatttcagcac

SEQ ID NO: 472963 - DNA, 25 bp, Rattus norvegicus
ggttgcccagggtatatttcagcac

SEQ ID NO: 472964 - DNA, 25 bp, Rattus norvegicus
ggttgccctgcaagcagagaagatg

SEQ ID NO: 472965 - DNA, 25 bp, Rattus norvegicus
ggttgccctgcatgcagagaagatg

SEQ ID NO: 472966 - DNA, 25 bp, Rattus norvegicus
ggttgccctggcagagaccccgact

SEQ ID NO: 472967 - DNA, 25 bp, Rattus norvegicus
ggttgccctggctgagaccccgact

SEQ ID NO: 472968 - DNA, 25 bp, Rattus norvegicus
ggttgccctgtaataaagcttgtct

SEQ ID NO: 472969 - DNA, 25 bp, Rattus norvegicus
ggttgccctgtattaaagcttgtct

SEQ ID NO: 472970 - DNA, 25 bp, Rattus norvegicus
ggttgcccttatccttaaagtgcca

SEQ ID NO: 472971 - DNA, 25 bp, Rattus norvegicus
ggttgcccttatgcttaaagtgcca

SEQ ID NO: 472972 - DNA, 25 bp, Rattus norvegicus
ggttgccgaatgaatggtcttcctc

SEQ ID NO: 472973 - DNA, 25 bp, Rattus norvegicus
ggttgccgaatgtatggtcttcctc

SEQ ID NO: 472974 - DNA, 25 bp, Rattus norvegicus
ggttgccgacaaaacagcaaaggat

SEQ ID NO: 472975 - DNA, 25 bp, Rattus norvegicus
ggttgccgacaatacagcaaaggat

SEQ ID NO: 472976 - DNA, 25 bp, Rattus norvegicus
ggttgccggcacatgacaaacacac

SEQ ID NO: 472977 - DNA, 25 bp, Rattus norvegicus
ggttgccggcacttgacaaacacac

SEQ ID NO: 472978 - DNA, 25 bp, Rattus norvegicus
ggttgccgtcggatgttccaattaa

SEQ ID NO: 472979 - DNA, 25 bp, Rattus norvegicus
ggttgccgtcggttgttccaattaa

SEQ ID NO: 472980 - DNA, 25 bp, Rattus norvegicus
ggttgcctacacatctggatggaat

SEQ ID NO: 472981 - DNA, 25 bp, Rattus norvegicus
ggttgcctacacttctggatggaat

SEQ ID NO: 472982 - DNA, 25 bp, Rattus norvegicus
ggttgcctcaaaatgagtgacccac

SEQ ID NO: 472983 - DNA, 25 bp, Rattus norvegicus
ggttgcctcaaattgagtgacccac

SEQ ID NO: 472984 - DNA, 25 bp, Rattus norvegicus
ggttgcctccagcattgtggatatt

SEQ ID NO: 472985 - DNA, 25 bp, Rattus norvegicus
ggttgcctccaggattgtggatatt

SEQ ID NO: 472986 - DNA, 25 bp, Rattus norvegicus
ggttgcctcctgaactaaaacccag

SEQ ID NO: 472987 - DNA, 25 bp, Rattus norvegicus
ggttgcctcctgtactaaaacccag

SEQ ID NO: 472988 - DNA, 25 bp, Rattus norvegicus
ggttgcctcgctatcttatgtgaac

SEQ ID NO: 472989 - DNA, 25 bp, Rattus norvegicus
ggttgcctcgctttcttatgtgaac

SEQ ID NO: 472990 - DNA, 25 bp, Rattus norvegicus
ggttgcctgggcacagattctagct

SEQ ID NO: 472991 - DNA, 25 bp, Rattus norvegicus
ggttgcctgggctcagattctagct

SEQ ID NO: 472992 - DNA, 25 bp, Rattus norvegicus
ggttgcctggttacaccagcatagt

SEQ ID NO: 472993 - DNA, 25 bp, Rattus norvegicus
ggttgcctggtttcaccagcatagt

SEQ ID NO: 472994 - DNA, 25 bp, Rattus norvegicus
ggttgccttaaaacaatgactccat

SEQ ID NO: 472995 - DNA, 25 bp, Rattus norvegicus
ggttgccttaaatcaatgactccat

SEQ ID NO: 472996 - DNA, 25 bp, Rattus norvegicus
ggttgccttagcactgatccatgag

SEQ ID NO: 472997 - DNA, 25 bp, Rattus norvegicus
ggttgccttagctctgatccatgag

SEQ ID NO: 472998 - DNA, 25 bp, Rattus norvegicus
ggttgccttaggattgaccttgcac

SEQ ID NO: 472999 - DNA, 25 bp, Rattus norvegicus
ggttgccttaggtttgaccttgcac

SEQ ID NO: 473000 - DNA, 25 bp, Rattus norvegicus
ggttgccttgagactccattgagac

SEQ ID NO: 473001 - DNA, 25 bp, Rattus norvegicus
ggttgccttgagtctccattgagac

SEQ ID NO: 473002 - DNA, 25 bp, Rattus norvegicus
ggttgccttgtgaacaactttacaa

SEQ ID NO: 473003 - DNA, 25 bp, Rattus norvegicus
ggttgccttgtgtacaactttacaa

SEQ ID NO: 473004 - DNA, 25 bp, Rattus norvegicus
ggttgccttttcactggccaggact

SEQ ID NO: 473005 - DNA, 25 bp, Rattus norvegicus
ggttgccttttctctggccaggact

SEQ ID NO: 473006 - DNA, 25 bp, Rattus norvegicus
ggttgcgagacccacagtattcagt

SEQ ID NO: 473007 - DNA, 25 bp, Rattus norvegicus
ggttgcgagaccgacagtattcagt

SEQ ID NO: 473008 - DNA, 25 bp, Rattus norvegicus
ggttgcgagcgcagcgctatctcat

SEQ ID NO: 473009 - DNA, 25 bp, Rattus norvegicus
ggttgcgagcgctgcgctatctcat

SEQ ID NO: 473010 - DNA, 25 bp, Rattus norvegicus
ggttgcgcagcacctcctgcgatac

SEQ ID NO: 473011 - DNA, 25 bp, Rattus norvegicus
ggttgcgcagcagctcctgcgatac

SEQ ID NO: 473012 - DNA, 25 bp, Rattus norvegicus
ggttgcggtcttcatcttggcgtac

SEQ ID NO: 473013 - DNA, 25 bp, Rattus norvegicus
ggttgcggtcttgatcttggcgtac

SEQ ID NO: 473014 - DNA, 25 bp, Rattus norvegicus
ggttgcggtgagatcgatatttttg

SEQ ID NO: 473015 - DNA, 25 bp, Rattus norvegicus
ggttgcggtgagttcgatatttttg

SEQ ID NO: 473016 - DNA, 25 bp, Rattus norvegicus
ggttgcgtagctcaaatacttgtga

SEQ ID NO: 473017 - DNA, 25 bp, Rattus norvegicus
ggttgcgtagctgaaatacttgtga

SEQ ID NO: 473018 - DNA, 25 bp, Rattus norvegicus
ggttgcgtatgcatttattcctaac

SEQ ID NO: 473019 - DNA, 25 bp, Rattus norvegicus
ggttgcgtatgcttttattcctaac

SEQ ID NO: 473020 - DNA, 25 bp, Rattus norvegicus
ggttgcgtcaccatctttggaatta

SEQ ID NO: 473021 - DNA, 25 bp, Rattus norvegicus
ggttgcgtcaccttctttggaatta

SEQ ID NO: 473022 - DNA, 25 bp, Rattus norvegicus
ggttgcgtttaaagtactacttagt

SEQ ID NO: 473023 - DNA, 25 bp, Rattus norvegicus
ggttgcgtttaatgtactacttagt

SEQ ID NO: 473024 - DNA, 25 bp, Rattus norvegicus
ggttgctaaatacccatggtcctgc

SEQ ID NO: 473025 - DNA, 25 bp, Rattus norvegicus
ggttgctaaatagccatggtcctgc

SEQ ID NO: 473026 - DNA, 25 bp, Rattus norvegicus
ggttgctacagcatctgggtagtaa

SEQ ID NO: 473027 - DNA, 25 bp, Rattus norvegicus
ggttgctacagcttctgggtagtaa

SEQ ID NO: 473028 - DNA, 25 bp, Rattus norvegicus
ggttgctcacaactcaggtatgcat

SEQ ID NO: 473029 - DNA, 25 bp, Rattus norvegicus
ggttgctcacaagtcaggtatgcat

SEQ ID NO: 473030 - DNA, 25 bp, Rattus norvegicus
ggttgctcagctcctaggtcggtct

SEQ ID NO: 473031 - DNA, 25 bp, Rattus norvegicus
ggttgctcagctgctaggtcggtct

SEQ ID NO: 473032 - DNA, 25 bp, Rattus norvegicus
ggttgctcagggatttcagtatact

SEQ ID NO: 473033 - DNA, 25 bp, Rattus norvegicus
ggttgctcagggttttcagtatact

SEQ ID NO: 473034 - DNA, 25 bp, Rattus norvegicus
ggttgctccctgagaatgtcggctg

SEQ ID NO: 473035 - DNA, 25 bp, Rattus norvegicus
ggttgctccctgtgaatgtcggctg

SEQ ID NO: 473036 - DNA, 25 bp, Rattus norvegicus
ggttgctccgcacagccttgttgag

SEQ ID NO: 473037 - DNA, 25 bp, Rattus norvegicus
ggttgctccgcagagccttgttgag

SEQ ID NO: 473038 - DNA, 25 bp, Rattus norvegicus
ggttgctccttgaacagaggctgct

SEQ ID NO: 473039 - DNA, 25 bp, Rattus norvegicus
ggttgctccttgtacagaggctgct

SEQ ID NO: 473040 - DNA, 25 bp, Rattus norvegicus
ggttgctctcttcaggattagcttt

SEQ ID NO: 473041 - DNA, 25 bp, Rattus norvegicus
ggttgctctcttgaggattagcttt

SEQ ID NO: 473042 - DNA, 25 bp, Rattus norvegicus
ggttgctgacatcattggtccacat

SEQ ID NO: 473043 - DNA, 25 bp, Rattus norvegicus
ggttgctgacatgattggtccacat

SEQ ID NO: 473044 - DNA, 25 bp, Rattus norvegicus
ggttgctgcattattccattgagac

SEQ ID NO: 473045 - DNA, 25 bp, Rattus norvegicus
ggttgctgcatttttccattgagac

SEQ ID NO: 473046 - DNA, 25 bp, Rattus norvegicus
ggttgctgctagcttctggaactac

SEQ ID NO: 473047 - DNA, 25 bp, Rattus norvegicus
ggttgctgctaggttctggaactac

SEQ ID NO: 473048 - DNA, 25 bp, Rattus norvegicus
ggttgctggcttaggttaaccaatt

SEQ ID NO: 473049 - DNA, 25 bp, Rattus norvegicus
ggttgctggctttggttaaccaatt

SEQ ID NO: 473050 - DNA, 25 bp, Rattus norvegicus
ggttgctggtgcacgagtgccccta

SEQ ID NO: 473051 - DNA, 25 bp, Rattus norvegicus
ggttgctggtgctcgagtgccccta

SEQ ID NO: 473052 - DNA, 25 bp, Rattus norvegicus
ggttgcttaaacaagtctgtccata

SEQ ID NO: 473053 - DNA, 25 bp, Rattus norvegicus
ggttgcttaaactagtctgtccata

SEQ ID NO: 473054 - DNA, 25 bp, Rattus norvegicus
ggttgcttaaatatccagtaatcct

SEQ ID NO: 473055 - DNA, 25 bp, Rattus norvegicus
ggttgcttaaatccatagcccacca

SEQ ID NO: 473056 - DNA, 25 bp, Rattus norvegicus
ggttgcttaaatgcatagcccacca

SEQ ID NO: 473057 - DNA, 25 bp, Rattus norvegicus
ggttgcttaaatttccagtaatcct

SEQ ID NO: 473058 - DNA, 25 bp, Rattus norvegicus
ggttgcttaacaatttgtgcttcaa

SEQ ID NO: 473059 - DNA, 25 bp, Rattus norvegicus
ggttgcttaacattttgtgcttcaa

SEQ ID NO: 473060 - DNA, 25 bp, Rattus norvegicus
ggttgcttcaaccaagactctatca

SEQ ID NO: 473061 - DNA, 25 bp, Rattus norvegicus
ggttgcttcaacgaagactctatca

SEQ ID NO: 473062 - DNA, 25 bp, Rattus norvegicus
ggttgcttcaccatagaattctctg

SEQ ID NO: 473063 - DNA, 25 bp, Rattus norvegicus
ggttgcttcaccttagaattctctg

SEQ ID NO: 473064 - DNA, 25 bp, Rattus norvegicus
ggttgcttcagacaccagggtgcac

SEQ ID NO: 473065 - DNA, 25 bp, Rattus norvegicus
ggttgcttcagagaccagggtgcac

SEQ ID NO: 473066 - DNA, 25 bp, Rattus norvegicus
ggttgcttcaggagattgatcgcct

SEQ ID NO: 473067 - DNA, 25 bp, Rattus norvegicus
ggttgcttcaggtgattgatcgcct

SEQ ID NO: 473068 - DNA, 25 bp, Rattus norvegicus
ggttgcttcagtctttagtgtccag

SEQ ID NO: 473069 - DNA, 25 bp, Rattus norvegicus
ggttgcttcagtgtttagtgtccag

SEQ ID NO: 473070 - DNA, 25 bp, Rattus norvegicus
ggttgcttctggcttgcaaggttaa

SEQ ID NO: 473071 - DNA, 25 bp, Rattus norvegicus
ggttgcttctgggttgcaaggttaa

SEQ ID NO: 473072 - DNA, 25 bp, Rattus norvegicus
ggttgcttgataaaacagcgcagtt

SEQ ID NO: 473073 - DNA, 25 bp, Rattus norvegicus
ggttgcttgatataacagcgcagtt

SEQ ID NO: 473074 - DNA, 25 bp, Rattus norvegicus
ggttgcttgctcattgattcagtaa

SEQ ID NO: 473075 - DNA, 25 bp, Rattus norvegicus
ggttgcttgctctttgattcagtaa

SEQ ID NO: 473076 - DNA, 25 bp, Rattus norvegicus
ggttgcttgggaaaactgcatccaa

SEQ ID NO: 473077 - DNA, 25 bp, Rattus norvegicus
ggttgcttgggataactgcatccaa

SEQ ID NO: 473078 - DNA, 25 bp, Rattus norvegicus
ggttgctttatccattggtcttcta

SEQ ID NO: 473079 - DNA, 25 bp, Rattus norvegicus
ggttgctttatcgattggtcttcta

SEQ ID NO: 473080 - DNA, 25 bp, Rattus norvegicus
ggttgctttatgatatccttttgtc

SEQ ID NO: 473081 - DNA, 25 bp, Rattus norvegicus
ggttgctttatgttatccttttgtc

SEQ ID NO: 473082 - DNA, 25 bp, Rattus norvegicus
ggttgctttgcaatctctaaaatca

SEQ ID NO: 473083 - DNA, 25 bp, Rattus norvegicus
ggttgctttgcattctctaaaatca

SEQ ID NO: 473084 - DNA, 25 bp, Rattus norvegicus
ggttggaaacaccatcctgagactt

SEQ ID NO: 473085 - DNA, 25 bp, Rattus norvegicus
ggttggaaacacgatcctgagactt

SEQ ID NO: 473086 - DNA, 25 bp, Rattus norvegicus
ggttggaagaacctcatttgtgaga

SEQ ID NO: 473087 - DNA, 25 bp, Rattus norvegicus
ggttggaagaacgtcatttgtgaga

SEQ ID NO: 473088 - DNA, 25 bp, Rattus norvegicus
ggttggaatcttaggtgacatcact

SEQ ID NO: 473089 - DNA, 25 bp, Rattus norvegicus
ggttggaatctttggtgacatcact

SEQ ID NO: 473090 - DNA, 25 bp, Rattus norvegicus
ggttggacaagcagcatactctgca

SEQ ID NO: 473091 - DNA, 25 bp, Rattus norvegicus
ggttggacaagctgcatactctgca

SEQ ID NO: 473092 - DNA, 25 bp, Rattus norvegicus
ggttggacataaccacagtttaagt

SEQ ID NO: 473093 - DNA, 25 bp, Rattus norvegicus
ggttggacataagcacagtttaagt

SEQ ID NO: 473094 - DNA, 25 bp, Rattus norvegicus
ggttggactccacatagcctatcct

SEQ ID NO: 473095 - DNA, 25 bp, Rattus norvegicus
ggttggactccagatagcctatcct

SEQ ID NO: 473096 - DNA, 25 bp, Rattus norvegicus
ggttggagaacactctgtctatcta

SEQ ID NO: 473097 - DNA, 25 bp, Rattus norvegicus
ggttggagaacagtctgtctatcta

SEQ ID NO: 473098 - DNA, 25 bp, Rattus norvegicus
ggttggagagaaaggaaattctcct

SEQ ID NO: 473099 - DNA, 25 bp, Rattus norvegicus
ggttggagagaatggaaattctcct

SEQ ID NO: 473100 - DNA, 25 bp, Rattus norvegicus
ggttggaggtttcacctgcacatca

SEQ ID NO: 473101 - DNA, 25 bp, Rattus norvegicus
ggttggaggtttgacctgcacatca

SEQ ID NO: 473102 - DNA, 25 bp, Rattus norvegicus
ggttggagtggtagcctttcagaat

SEQ ID NO: 473103 - DNA, 25 bp, Rattus norvegicus
ggttggagtggttgcctttcagaat

SEQ ID NO: 473104 - DNA, 25 bp, Rattus norvegicus
ggttggatccgaagaggttccgatt

SEQ ID NO: 473105 - DNA, 25 bp, Rattus norvegicus
ggttggatccgatgaggttccgatt

SEQ ID NO: 473106 - DNA, 25 bp, Rattus norvegicus
ggttggatcctcaagctttcaaaat

SEQ ID NO: 473107 - DNA, 25 bp, Rattus norvegicus
ggttggatcctctagctttcaaaat

SEQ ID NO: 473108 - DNA, 25 bp, Rattus norvegicus
ggttggatcctgaataagacatttg

SEQ ID NO: 473109 - DNA, 25 bp, Rattus norvegicus
ggttggatcctgtataagacatttg

SEQ ID NO: 473110 - DNA, 25 bp, Rattus norvegicus
ggttggattatgactgcaccccaga

SEQ ID NO: 473111 - DNA, 25 bp, Rattus norvegicus
ggttggattatgtctgcaccccaga

SEQ ID NO: 473112 - DNA, 25 bp, Rattus norvegicus
ggttggcaatcacagacattctatg

SEQ ID NO: 473113 - DNA, 25 bp, Rattus norvegicus
ggttggcaatcagagacattctatg

SEQ ID NO: 473114 - DNA, 25 bp, Rattus norvegicus
ggttggcaggtgacccagctttgct

SEQ ID NO: 473115 - DNA, 25 bp, Rattus norvegicus
ggttggcaggtgtcccagctttgct

SEQ ID NO: 473116 - DNA, 25 bp, Rattus norvegicus
ggttggcatatgaaaaccacctggt

SEQ ID NO: 473117 - DNA, 25 bp, Rattus norvegicus
ggttggcatatgtaaaccacctggt

SEQ ID NO: 473118 - DNA, 25 bp, Rattus norvegicus
ggttggccctttcagtggagactaa

SEQ ID NO: 473119 - DNA, 25 bp, Rattus norvegicus
ggttggccctttgagtggagactaa

SEQ ID NO: 473120 - DNA, 25 bp, Rattus norvegicus
ggttggccgtgtaattcagtgttca

SEQ ID NO: 473121 - DNA, 25 bp, Rattus norvegicus
ggttggccgtgttattcagtgttca

SEQ ID NO: 473122 - DNA, 25 bp, Rattus norvegicus
ggttggcctgggatgcagcctcttc

SEQ ID NO: 473123 - DNA, 25 bp, Rattus norvegicus
ggttggcctgggttgcagcctcttc

SEQ ID NO: 473124 - DNA, 25 bp, Rattus norvegicus
ggttggctatttcgcttctcataaa

SEQ ID NO: 473125 - DNA, 25 bp, Rattus norvegicus
ggttggctatttggcttctcataaa

SEQ ID NO: 473126 - DNA, 25 bp, Rattus norvegicus
ggttggctcattattaagcatgctt

SEQ ID NO: 473127 - DNA, 25 bp, Rattus norvegicus
ggttggctcatttttaagcatgctt

SEQ ID NO: 473128 - DNA, 25 bp, Rattus norvegicus
ggttggctccagacagcttgatgac

SEQ ID NO: 473129 - DNA, 25 bp, Rattus norvegicus
ggttggctccagtcagcttgatgac

SEQ ID NO: 473130 - DNA, 25 bp, Rattus norvegicus
ggttggcttttaagggcttgcacat

SEQ ID NO: 473131 - DNA, 25 bp, Rattus norvegicus
ggttggcttttatgggcttgcacat

SEQ ID NO: 473132 - DNA, 25 bp, Rattus norvegicus
ggttgggaggtcaaggtcatcctca

SEQ ID NO: 473133 - DNA, 25 bp, Rattus norvegicus
ggttgggaggtctaggtcatcctca

SEQ ID NO: 473134 - DNA, 25 bp, Rattus norvegicus
ggttgggatttcacatatctagata

SEQ ID NO: 473135 - DNA, 25 bp, Rattus norvegicus
ggttgggatttctcatatctagata

SEQ ID NO: 473136 - DNA, 25 bp, Rattus norvegicus
ggttgggcaccgcatgtacttgact

SEQ ID NO: 473137 - DNA, 25 bp, Rattus norvegicus
ggttgggcaccggatgtacttgact

SEQ ID NO: 473138 - DNA, 25 bp, Rattus norvegicus
ggttgggcatttacttctgtcagaa

SEQ ID NO: 473139 - DNA, 25 bp, Rattus norvegicus
ggttgggcattttcttctgtcagaa

SEQ ID NO: 473140 - DNA, 25 bp, Rattus norvegicus
ggttgggcgatcaagttcccctaat

SEQ ID NO: 473141 - DNA, 25 bp, Rattus norvegicus
ggttgggcgatctagttcccctaat

SEQ ID NO: 473142 - DNA, 25 bp, Rattus norvegicus
ggttgggctggaattctttgtagat

SEQ ID NO: 473143 - DNA, 25 bp, Rattus norvegicus
ggttgggctggatttctttgtagat

SEQ ID NO: 473144 - DNA, 25 bp, Rattus norvegicus
ggttgggcttgaacttcatcctaga

SEQ ID NO: 473145 - DNA, 25 bp, Rattus norvegicus
ggttgggcttgatcttcatcctaga

SEQ ID NO: 473146 - DNA, 25 bp, Rattus norvegicus
ggttgggctttacgacatactgtca

SEQ ID NO: 473147 - DNA, 25 bp, Rattus norvegicus
ggttgggctttaggacatactgtca

SEQ ID NO: 473148 - DNA, 25 bp, Rattus norvegicus
ggttgggtatcactaccctggctac

SEQ ID NO: 473149 - DNA, 25 bp, Rattus norvegicus
ggttgggtatcagtaccctggctac

SEQ ID NO: 473150 - DNA, 25 bp, Rattus norvegicus
ggttgggtggccaccttactgagct

SEQ ID NO: 473151 - DNA, 25 bp, Rattus norvegicus
ggttgggtggcctccttactgagct

SEQ ID NO: 473152 - DNA, 25 bp, Rattus norvegicus
ggttgggttcctcgaaatcacctgg

SEQ ID NO: 473153 - DNA, 25 bp, Rattus norvegicus
ggttgggttcctggaaatcacctgg

SEQ ID NO: 473154 - DNA, 25 bp, Rattus norvegicus
ggttggtaaaatccgcccctaggat

SEQ ID NO: 473155 - DNA, 25 bp, Rattus norvegicus
ggttggtaaaatgcgcccctaggat

SEQ ID NO: 473156 - DNA, 25 bp, Rattus norvegicus
ggttggtaattgaatgacatcctca

SEQ ID NO: 473157 - DNA, 25 bp, Rattus norvegicus
ggttggtaattgaatttcatcctta

SEQ ID NO: 473158 - DNA, 25 bp, Rattus norvegicus
ggttggtaattgtatgacatcctca

SEQ ID NO: 473159 - DNA, 25 bp, Rattus norvegicus
ggttggtaattgtatttcatcctta

SEQ ID NO: 473160 - DNA, 25 bp, Rattus norvegicus
ggttggtcagttaccgtggcacact

SEQ ID NO: 473161 - DNA, 25 bp, Rattus norvegicus
ggttggtcagtttccgtggcacact

SEQ ID NO: 473162 - DNA, 25 bp, Rattus norvegicus
ggttggtcatttactttcagtggtt

SEQ ID NO: 473163 - DNA, 25 bp, Rattus norvegicus
ggttggtcattttctttcagtggtt

SEQ ID NO: 473164 - DNA, 25 bp, Rattus norvegicus
ggttggtctcacagcttgctagaaa

SEQ ID NO: 473165 - DNA, 25 bp, Rattus norvegicus
ggttggtctcactgcttgctagaaa

SEQ ID NO: 473166 - DNA, 25 bp, Rattus norvegicus
ggttggtctgttctttgtcactaac

SEQ ID NO: 473167 - DNA, 25 bp, Rattus norvegicus
ggttggtctgttgtttgtcactaac

SEQ ID NO: 473168 - DNA, 25 bp, Rattus norvegicus
ggttggtgaccacatgtcccctact

SEQ ID NO: 473169 - DNA, 25 bp, Rattus norvegicus
ggttggtgaccagatgtcccctact

SEQ ID NO: 473170 - DNA, 25 bp, Rattus norvegicus
ggttggtgtcaacagcagctagtta

SEQ ID NO: 473171 - DNA, 25 bp, Rattus norvegicus
ggttggtgtcaagagcagctagtta

SEQ ID NO: 473172 - DNA, 25 bp, Rattus norvegicus
ggttggttcaagaagcctgcaaatc

SEQ ID NO: 473173 - DNA, 25 bp, Rattus norvegicus
ggttggttcaagtagcctgcaaatc

SEQ ID NO: 473174 - DNA, 25 bp, Rattus norvegicus
ggttggttctccagtctatgtgggc

SEQ ID NO: 473175 - DNA, 25 bp, Rattus norvegicus
ggttggttctcctgtctatgtgggc

SEQ ID NO: 473176 - DNA, 25 bp, Rattus norvegicus
ggttggttgcataacacgacacaca

SEQ ID NO: 473177 - DNA, 25 bp, Rattus norvegicus
ggttggttgcattacacgacacaca

SEQ ID NO: 473178 - DNA, 25 bp, Rattus norvegicus
ggttggttggtcacatctggaaagc

SEQ ID NO: 473179 - DNA, 25 bp, Rattus norvegicus
ggttggttggtctcatctggaaagc

SEQ ID NO: 473180 - DNA, 25 bp, Rattus norvegicus
ggttggtttaagactttgaatcact

SEQ ID NO: 473181 - DNA, 25 bp, Rattus norvegicus
ggttggtttaagtctttgaatcact

SEQ ID NO: 473182 - DNA, 25 bp, Rattus norvegicus
ggttgtaaaaccacccatgacacac

SEQ ID NO: 473183 - DNA, 25 bp, Rattus norvegicus
ggttgtaaaacctcccatgacacac

SEQ ID NO: 473184 - DNA, 25 bp, Rattus norvegicus
ggttgtaaaggcactgcgcagacat

SEQ ID NO: 473185 - DNA, 25 bp, Rattus norvegicus
ggttgtaaaggctctgcgcagacat

SEQ ID NO: 473186 - DNA, 25 bp, Rattus norvegicus
ggttgtaaatgtaccccagtctgtt

SEQ ID NO: 473187 - DNA, 25 bp, Rattus norvegicus
ggttgtaaatgttccccagtctgtt

SEQ ID NO: 473188 - DNA, 25 bp, Rattus norvegicus
ggttgtaaattcatccaggagctgt

SEQ ID NO: 473189 - DNA, 25 bp, Rattus norvegicus
ggttgtaaattcttccaggagctgt

SEQ ID NO: 473190 - DNA, 25 bp, Rattus norvegicus
ggttgtaaccataatcttctctatt

SEQ ID NO: 473191 - DNA, 25 bp, Rattus norvegicus
ggttgtaaccattatcttctctatt

SEQ ID NO: 473192 - DNA, 25 bp, Rattus norvegicus
ggttgtaacccaccggagagctttc

SEQ ID NO: 473193 - DNA, 25 bp, Rattus norvegicus
ggttgtaacccagcggagagctttc

SEQ ID NO: 473194 - DNA, 25 bp, Rattus norvegicus
ggttgtaagcacattaccttctgag

SEQ ID NO: 473195 - DNA, 25 bp, Rattus norvegicus
ggttgtaagcactttaccttctgag

SEQ ID NO: 473196 - DNA, 25 bp, Rattus norvegicus
ggttgtaagctaactgctctgacca

SEQ ID NO: 473197 - DNA, 25 bp, Rattus norvegicus
ggttgtaagctatctgctctgacca

SEQ ID NO: 473198 - DNA, 25 bp, Rattus norvegicus
ggttgtaagtctagcagccctcgat

SEQ ID NO: 473199 - DNA, 25 bp, Rattus norvegicus
ggttgtaagtcttgcagccctcgat

SEQ ID NO: 473200 - DNA, 25 bp, Rattus norvegicus
ggttgtacaaatacccacatgactg

SEQ ID NO: 473201 - DNA, 25 bp, Rattus norvegicus
ggttgtacaaattcccacatgactg

SEQ ID NO: 473202 - DNA, 25 bp, Rattus norvegicus
ggttgtacagggagccagatagatt

SEQ ID NO: 473203 - DNA, 25 bp, Rattus norvegicus
ggttgtacagggtgccagatagatt

SEQ ID NO: 473204 - DNA, 25 bp, Rattus norvegicus
ggttgtacatacagggatcccgagg

SEQ ID NO: 473205 - DNA, 25 bp, Rattus norvegicus
ggttgtacatactgggatcccgagg

SEQ ID NO: 473206 - DNA, 25 bp, Rattus norvegicus
ggttgtaccatcattatgacctagt

SEQ ID NO: 473207 - DNA, 25 bp, Rattus norvegicus
ggttgtaccatctttatgacctagt

SEQ ID NO: 473208 - DNA, 25 bp, Rattus norvegicus
ggttgtaccttccattctttctgac

SEQ ID NO: 473209 - DNA, 25 bp, Rattus norvegicus
ggttgtaccttcgattctttctgac

SEQ ID NO: 473210 - DNA, 25 bp, Rattus norvegicus
ggttgtactgtcagttaactcatgc

SEQ ID NO: 473211 - DNA, 25 bp, Rattus norvegicus
ggttgtactgtctgttaactcatgc

SEQ ID NO: 473212 - DNA, 25 bp, Rattus norvegicus
ggttgtagccctcccttttgaagct

SEQ ID NO: 473213 - DNA, 25 bp, Rattus norvegicus
ggttgtagccctgccttttgaagct

SEQ ID NO: 473214 - DNA, 25 bp, Rattus norvegicus
ggttgtagctgtcgcccgtgtccac

SEQ ID NO: 473215 - DNA, 25 bp, Rattus norvegicus
ggttgtagctgtggcccgtgtccac

SEQ ID NO: 473216 - DNA, 25 bp, Rattus norvegicus
ggttgtagttaccagcacctcagcc

SEQ ID NO: 473217 - DNA, 25 bp, Rattus norvegicus
ggttgtagttacgagcacctcagcc

SEQ ID NO: 473218 - DNA, 25 bp, Rattus norvegicus
ggttgtagttgtactatcttgtaat

SEQ ID NO: 473219 - DNA, 25 bp, Rattus norvegicus
ggttgtagttgttctatcttgtaat

SEQ ID NO: 473220 - DNA, 25 bp, Rattus norvegicus
ggttgtatacacctgactctgtgtg

SEQ ID NO: 473221 - DNA, 25 bp, Rattus norvegicus
ggttgtatacacgtgactctgtgtg

SEQ ID NO: 473222 - DNA, 25 bp, Rattus norvegicus
ggttgtatcaatcctgagacgacac

SEQ ID NO: 473223 - DNA, 25 bp, Rattus norvegicus
ggttgtatcaatgctgagacgacac

SEQ ID NO: 473224 - DNA, 25 bp, Rattus norvegicus
ggttgtatctctaaaaattggctct

SEQ ID NO: 473225 - DNA, 25 bp, Rattus norvegicus
ggttgtatctcttaaaattggctct

SEQ ID NO: 473226 - DNA, 25 bp, Rattus norvegicus
ggttgtatgtaacacagcccggaat

SEQ ID NO: 473227 - DNA, 25 bp, Rattus norvegicus
ggttgtatgtaagacagcccggaat

SEQ ID NO: 473228 - DNA, 25 bp, Rattus norvegicus
ggttgtattactagatttctgttaa

SEQ ID NO: 473229 - DNA, 25 bp, Rattus norvegicus
ggttgtattacttgatttctgttaa

SEQ ID NO: 473230 - DNA, 25 bp, Rattus norvegicus
ggttgtattcctataaagaatcctg

SEQ ID NO: 473231 - DNA, 25 bp, Rattus norvegicus
ggttgtattcctttaaagaatcctg

SEQ ID NO: 473232 - DNA, 25 bp, Rattus norvegicus
ggttgtattggtctatgcactgtaa

SEQ ID NO: 473233 - DNA, 25 bp, Rattus norvegicus
ggttgtattggtgtatgcactgtaa

SEQ ID NO: 473234 - DNA, 25 bp, Rattus norvegicus
ggttgtcaacaaaggtccagccctt

SEQ ID NO: 473235 - DNA, 25 bp, Rattus norvegicus
ggttgtcaacaatggtccagccctt

SEQ ID NO: 473236 - DNA, 25 bp, Rattus norvegicus
ggttgtcaaggtaactcatcctcag

SEQ ID NO: 473237 - DNA, 25 bp, Rattus norvegicus
ggttgtcaaggttactcatcctcag

SEQ ID NO: 473238 - DNA, 25 bp, Rattus norvegicus
ggttgtcaccaacgtggaatccagg

SEQ ID NO: 473239 - DNA, 25 bp, Rattus norvegicus
ggttgtcaccaaggtggaatccagg

SEQ ID NO: 473240 - DNA, 25 bp, Rattus norvegicus
ggttgtcacccaagcatctgggatt

SEQ ID NO: 473241 - DNA, 25 bp, Rattus norvegicus
ggttgtcacccatgcatctgggatt

SEQ ID NO: 473242 - DNA, 25 bp, Rattus norvegicus
ggttgtcattaaccccaactatgag

SEQ ID NO: 473243 - DNA, 25 bp, Rattus norvegicus
ggttgtcattaagcccaactatgag

SEQ ID NO: 473244 - DNA, 25 bp, Rattus norvegicus
ggttgtccaatcaccacattgtcag

SEQ ID NO: 473245 - DNA, 25 bp, Rattus norvegicus
ggttgtccaatctccacattgtcag

SEQ ID NO: 473246 - DNA, 25 bp, Rattus norvegicus
ggttgtccaccacttgcaacaagag

SEQ ID NO: 473247 - DNA, 25 bp, Rattus norvegicus
ggttgtccaccagttgcaacaagag

SEQ ID NO: 473248 - DNA, 25 bp, Rattus norvegicus
ggttgtccacctccaaactttagaa

SEQ ID NO: 473249 - DNA, 25 bp, Rattus norvegicus
ggttgtccacctgcaaactttagaa

SEQ ID NO: 473250 - DNA, 25 bp, Rattus norvegicus
ggttgtccataaaaactcttccaga

SEQ ID NO: 473251 - DNA, 25 bp, Rattus norvegicus
ggttgtccataataactcttccaga

SEQ ID NO: 473252 - DNA, 25 bp, Rattus norvegicus
ggttgtccatgtacatctagatatt

SEQ ID NO: 473253 - DNA, 25 bp, Rattus norvegicus
ggttgtccatgttcatctagatatt

SEQ ID NO: 473254 - DNA, 25 bp, Rattus norvegicus
ggttgtccccttcggtctcagtgga

SEQ ID NO: 473255 - DNA, 25 bp, Rattus norvegicus
ggttgtccccttgggtctcagtgga

SEQ ID NO: 473256 - DNA, 25 bp, Rattus norvegicus
ggttgtccctgaaaagccgcataat

SEQ ID NO: 473257 - DNA, 25 bp, Rattus norvegicus
ggttgtccctgataagccgcataat

SEQ ID NO: 473258 - DNA, 25 bp, Rattus norvegicus
ggttgtccggtaagttcatgaagtc

SEQ ID NO: 473259 - DNA, 25 bp, Rattus norvegicus
ggttgtccggtatgttcatgaagtc

SEQ ID NO: 473260 - DNA, 25 bp, Rattus norvegicus
ggttgtccgtgcaaaggaacgccta

SEQ ID NO: 473261 - DNA, 25 bp, Rattus norvegicus
ggttgtccgtgctaaggaacgccta

SEQ ID NO: 473262 - DNA, 25 bp, Rattus norvegicus
ggttgtcctactcaaccccgaggag

SEQ ID NO: 473263 - DNA, 25 bp, Rattus norvegicus
ggttgtcctactgaaccccgaggag

SEQ ID NO: 473264 - DNA, 25 bp, Rattus norvegicus
ggttgtccttgaactggctacgcag

SEQ ID NO: 473265 - DNA, 25 bp, Rattus norvegicus
ggttgtccttgatctggctacgcag

SEQ ID NO: 473266 - DNA, 25 bp, Rattus norvegicus
ggttgtcgattgacagaggtttcct

SEQ ID NO: 473267 - DNA, 25 bp, Rattus norvegicus
ggttgtcgattgtcagaggtttcct

SEQ ID NO: 473268 - DNA, 25 bp, Rattus norvegicus
ggttgtcgcggcaccatgcctgcct

SEQ ID NO: 473269 - DNA, 25 bp, Rattus norvegicus
ggttgtcgcggctccatgcctgcct

SEQ ID NO: 473270 - DNA, 25 bp, Rattus norvegicus
ggttgtcgctggcagccgggaggca

SEQ ID NO: 473271 - DNA, 25 bp, Rattus norvegicus
ggttgtcgctgggagccgggaggca

SEQ ID NO: 473272 - DNA, 25 bp, Rattus norvegicus
ggttgtctactcctttgtcttcaaa

SEQ ID NO: 473273 - DNA, 25 bp, Rattus norvegicus
ggttgtctactcgtttgtcttcaaa

SEQ ID NO: 473274 - DNA, 25 bp, Rattus norvegicus
ggttgtctatttccctaacacatgt

SEQ ID NO: 473275 - DNA, 25 bp, Rattus norvegicus
ggttgtctatttgcctaacacatgt

SEQ ID NO: 473276 - DNA, 25 bp, Rattus norvegicus
ggttgtctcatgactttattccagt

SEQ ID NO: 473277 - DNA, 25 bp, Rattus norvegicus
ggttgtctcatgtctttattccagt

SEQ ID NO: 473278 - DNA, 25 bp, Rattus norvegicus
ggttgtctcgcccatgttaatagtc

SEQ ID NO: 473279 - DNA, 25 bp, Rattus norvegicus
ggttgtctcgccgatgttaatagtc

SEQ ID NO: 473280 - DNA, 25 bp, Rattus norvegicus
ggttgtctggcaatacactgttcat

SEQ ID NO: 473281 - DNA, 25 bp, Rattus norvegicus
ggttgtctggcattacactgttcat

SEQ ID NO: 473282 - DNA, 25 bp, Rattus norvegicus
ggttgtcttagaattgtgtgccgat

SEQ ID NO: 473283 - DNA, 25 bp, Rattus norvegicus
ggttgtcttagatttgtgtgccgat

SEQ ID NO: 473284 - DNA, 25 bp, Rattus norvegicus
ggttgtcttcttctagtatgtcttt

SEQ ID NO: 473285 - DNA, 25 bp, Rattus norvegicus
ggttgtcttcttgtagtatgtcttt

SEQ ID NO: 473286 - DNA, 25 bp, Rattus norvegicus
ggttgtcttgtacttgattacttta

SEQ ID NO: 473287 - DNA, 25 bp, Rattus norvegicus
ggttgtcttgtagttgattacttta

SEQ ID NO: 473288 - DNA, 25 bp, Rattus norvegicus
ggttgtgacaggacaccctcatgaa

SEQ ID NO: 473289 - DNA, 25 bp, Rattus norvegicus
ggttgtgacaggtcaccctcatgaa

SEQ ID NO: 473290 - DNA, 25 bp, Rattus norvegicus
ggttgtgactgtcccatgagtaccc

SEQ ID NO: 473291 - DNA, 25 bp, Rattus norvegicus
ggttgtgactgtgccatgagtaccc

SEQ ID NO: 473292 - DNA, 25 bp, Rattus norvegicus
ggttgtgagcatcttctgtaatcaa

SEQ ID NO: 473293 - DNA, 25 bp, Rattus norvegicus
ggttgtgagcatgttctgtaatcaa

SEQ ID NO: 473294 - DNA, 25 bp, Rattus norvegicus
ggttgtgaggttagctttctctgaa

SEQ ID NO: 473295 - DNA, 25 bp, Rattus norvegicus
ggttgtgaggtttgctttctctgaa

SEQ ID NO: 473296 - DNA, 25 bp, Rattus norvegicus
ggttgtgatgataacttggtgccat

SEQ ID NO: 473297 - DNA, 25 bp, Rattus norvegicus
ggttgtgatgattacttggtgccat

SEQ ID NO: 473298 - DNA, 25 bp, Rattus norvegicus
ggttgtgatgtaaacctcctgttta

SEQ ID NO: 473299 - DNA, 25 bp, Rattus norvegicus
ggttgtgatgtatacctcctgttta

SEQ ID NO: 473300 - DNA, 25 bp, Rattus norvegicus
ggttgtgatttcacctttttatctt

SEQ ID NO: 473301 - DNA, 25 bp, Rattus norvegicus
ggttgtgatttctcctttttatctt

SEQ ID NO: 473302 - DNA, 25 bp, Rattus norvegicus
ggttgtgcacaaacattcacacctc

SEQ ID NO: 473303 - DNA, 25 bp, Rattus norvegicus
ggttgtgcacaatcattcacacctc

SEQ ID NO: 473304 - DNA, 25 bp, Rattus norvegicus
ggttgtgcaccacgaggtcatcaat

SEQ ID NO: 473305 - DNA, 25 bp, Rattus norvegicus
ggttgtgcaccaggaggtcatcaat

SEQ ID NO: 473306 - DNA, 25 bp, Rattus norvegicus
ggttgtgcagttatatttcaggtgt

SEQ ID NO: 473307 - DNA, 25 bp, Rattus norvegicus
ggttgtgcagttttatttcaggtgt

SEQ ID NO: 473308 - DNA, 25 bp, Rattus norvegicus
ggttgtgctactacattggagccac

SEQ ID NO: 473309 - DNA, 25 bp, Rattus norvegicus
ggttgtgctacttcattggagccac

SEQ ID NO: 473310 - DNA, 25 bp, Rattus norvegicus
ggttgtggaagcaagcccggacatt

SEQ ID NO: 473311 - DNA, 25 bp, Rattus norvegicus
ggttgtggaagctagcccggacatt

SEQ ID NO: 473312 - DNA, 25 bp, Rattus norvegicus
ggttgtggaatgcacctttaatccc

SEQ ID NO: 473313 - DNA, 25 bp, Rattus norvegicus
ggttgtggaatggacctttaatccc

SEQ ID NO: 473314 - DNA, 25 bp, Rattus norvegicus
ggttgtggacacacatacttcagtg

SEQ ID NO: 473315 - DNA, 25 bp, Rattus norvegicus
ggttgtggacactcatacttcagtg

SEQ ID NO: 473316 - DNA, 25 bp, Rattus norvegicus
ggttgtggagccaaattttactatc

SEQ ID NO: 473317 - DNA, 25 bp, Rattus norvegicus
ggttgtggagcctaattttactatc

SEQ ID NO: 473318 - DNA, 25 bp, Rattus norvegicus
ggttgtggccacagctaagattata

SEQ ID NO: 473319 - DNA, 25 bp, Rattus norvegicus
ggttgtggccactgctaagattata

SEQ ID NO: 473320 - DNA, 25 bp, Rattus norvegicus
ggttgtgggtttacttaccagtcat

SEQ ID NO: 473321 - DNA, 25 bp, Rattus norvegicus
ggttgtgggttttcttaccagtcat

SEQ ID NO: 473322 - DNA, 25 bp, Rattus norvegicus
ggttgtggtcaaatgcagcctatgg

SEQ ID NO: 473323 - DNA, 25 bp, Rattus norvegicus
ggttgtggtcaattgcagcctatgg

SEQ ID NO: 473324 - DNA, 25 bp, Rattus norvegicus
ggttgtggtttgcaactatctacta

SEQ ID NO: 473325 - DNA, 25 bp, Rattus norvegicus
ggttgtggtttggaactatctacta

SEQ ID NO: 473326 - DNA, 25 bp, Rattus norvegicus
ggttgtgtacccattgcaaacgcag

SEQ ID NO: 473327 - DNA, 25 bp, Rattus norvegicus
ggttgtgtaccctttgcaaacgcag

SEQ ID NO: 473328 - DNA, 25 bp, Rattus norvegicus
ggttgtgtatggctagcactactca

SEQ ID NO: 473329 - DNA, 25 bp, Rattus norvegicus
ggttgtgtatgggtagcactactca

SEQ ID NO: 473330 - DNA, 25 bp, Rattus norvegicus
ggttgtgtcataatcatctcttaat

SEQ ID NO: 473331 - DNA, 25 bp, Rattus norvegicus
ggttgtgtcatattcatctcttaat

SEQ ID NO: 473332 - DNA, 25 bp, Rattus norvegicus
ggttgtgtgattacttgcatatgca

SEQ ID NO: 473333 - DNA, 25 bp, Rattus norvegicus
ggttgtgtgatttcttgcatatgca

SEQ ID NO: 473334 - DNA, 25 bp, Rattus norvegicus
ggttgtgtgcccaaaatgtaactca

SEQ ID NO: 473335 - DNA, 25 bp, Rattus norvegicus
ggttgtgtgccctaaatgtaactca

SEQ ID NO: 473336 - DNA, 25 bp, Rattus norvegicus
ggttgtgttcctcggtcctgttcaa

SEQ ID NO: 473337 - DNA, 25 bp, Rattus norvegicus
ggttgtgttcctgggtcctgttcaa

SEQ ID NO: 473338 - DNA, 25 bp, Rattus norvegicus
ggttgtgttgagaagttgatttcat

SEQ ID NO: 473339 - DNA, 25 bp, Rattus norvegicus
ggttgtgttgagtagttgatttcat

SEQ ID NO: 473340 - DNA, 25 bp, Rattus norvegicus
ggttgtgttgttacttccctggaag

SEQ ID NO: 473341 - DNA, 25 bp, Rattus norvegicus
ggttgtgttgtttcttccctggaag

SEQ ID NO: 473342 - DNA, 25 bp, Rattus norvegicus
ggttgttaacttatcagattcatga

SEQ ID NO: 473343 - DNA, 25 bp, Rattus norvegicus
ggttgttaacttttcagattcatga

SEQ ID NO: 473344 - DNA, 25 bp, Rattus norvegicus
ggttgttatcagcagccaatatttt

SEQ ID NO: 473345 - DNA, 25 bp, Rattus norvegicus
ggttgttatcaggagccaatatttt

SEQ ID NO: 473346 - DNA, 25 bp, Rattus norvegicus
ggttgttattctattttgtacagac

SEQ ID NO: 473347 - DNA, 25 bp, Rattus norvegicus
ggttgttattcttttttgtacagac

SEQ ID NO: 473348 - DNA, 25 bp, Rattus norvegicus
ggttgttcacaaagatgcccacggc

SEQ ID NO: 473349 - DNA, 25 bp, Rattus norvegicus
ggttgttcacaatgatgcccacggc

SEQ ID NO: 473350 - DNA, 25 bp, Rattus norvegicus
ggttgttcattcacttctattctgt

SEQ ID NO: 473351 - DNA, 25 bp, Rattus norvegicus
ggttgttcattctcttctattctgt

SEQ ID NO: 473352 - DNA, 25 bp, Rattus norvegicus
ggttgttccagcaaccttcaggaaa

SEQ ID NO: 473353 - DNA, 25 bp, Rattus norvegicus
ggttgttccagctaccttcaggaaa

SEQ ID NO: 473354 - DNA, 25 bp, Rattus norvegicus
ggttgttccctcatccaaacaaatg

SEQ ID NO: 473355 - DNA, 25 bp, Rattus norvegicus
ggttgttccctcttccaaacaaatg

SEQ ID NO: 473356 - DNA, 25 bp, Rattus norvegicus
ggttgttctgttagtatcattctga

SEQ ID NO: 473357 - DNA, 25 bp, Rattus norvegicus
ggttgttctgtttgtatcattctga

SEQ ID NO: 473358 - DNA, 25 bp, Rattus norvegicus
ggttgttcttcccaaaaagctggat

SEQ ID NO: 473359 - DNA, 25 bp, Rattus norvegicus
ggttgttcttccgaaaaagctggat

SEQ ID NO: 473360 - DNA, 25 bp, Rattus norvegicus
ggttgttcttgcagccctcaggagg

SEQ ID NO: 473361 - DNA, 25 bp, Rattus norvegicus
ggttgttcttgctgccctcaggagg

SEQ ID NO: 473362 - DNA, 25 bp, Rattus norvegicus
ggttgttgatttatgttacttcaca

SEQ ID NO: 473363 - DNA, 25 bp, Rattus norvegicus
ggttgttgatttttgttacttcaca

SEQ ID NO: 473364 - DNA, 25 bp, Rattus norvegicus
ggttgttgcacccacttacaagaga

SEQ ID NO: 473365 - DNA, 25 bp, Rattus norvegicus
ggttgttgcaccgacttacaagaga

SEQ ID NO: 473366 - DNA, 25 bp, Rattus norvegicus
ggttgttgccaactatgtacataac

SEQ ID NO: 473367 - DNA, 25 bp, Rattus norvegicus
ggttgttgccaagtatgtacataac

SEQ ID NO: 473368 - DNA, 25 bp, Rattus norvegicus
ggttgttgctgtatttgtgcccaca

SEQ ID NO: 473369 - DNA, 25 bp, Rattus norvegicus
ggttgttgctgtttttgtgcccaca

SEQ ID NO: 473370 - DNA, 25 bp, Rattus norvegicus
ggttgttggtaaaagctcgccctga

SEQ ID NO: 473371 - DNA, 25 bp, Rattus norvegicus
ggttgttggtaatagctcgccctga

SEQ ID NO: 473372 - DNA, 25 bp, Rattus norvegicus
ggttgttgtcccataacataactat

SEQ ID NO: 473373 - DNA, 25 bp, Rattus norvegicus
ggttgttgtcccttaacataactat

SEQ ID NO: 473374 - DNA, 25 bp, Rattus norvegicus
ggttgtttaagacagccggttctct

SEQ ID NO: 473375 - DNA, 25 bp, Rattus norvegicus
ggttgtttaagagagccggttctct

SEQ ID NO: 473376 - DNA, 25 bp, Rattus norvegicus
ggttgtttagagcattccttccctt

SEQ ID NO: 473377 - DNA, 25 bp, Rattus norvegicus
ggttgtttagaggattccttccctt

SEQ ID NO: 473378 - DNA, 25 bp, Rattus norvegicus
ggttgtttatagactccaagacttt

SEQ ID NO: 473379 - DNA, 25 bp, Rattus norvegicus
ggttgtttatagtctccaagacttt

SEQ ID NO: 473380 - DNA, 25 bp, Rattus norvegicus
ggttgtttatgaactgctgtgctgc

SEQ ID NO: 473381 - DNA, 25 bp, Rattus norvegicus
ggttgtttatgatctgctgtgctgc

SEQ ID NO: 473382 - DNA, 25 bp, Rattus norvegicus
ggttgtttccacagtgaggttctta

SEQ ID NO: 473383 - DNA, 25 bp, Rattus norvegicus
ggttgtttccactgtgaggttctta

SEQ ID NO: 473384 - DNA, 25 bp, Rattus norvegicus
ggttgtttgaaccaaatccctgccg

SEQ ID NO: 473385 - DNA, 25 bp, Rattus norvegicus
ggttgtttgaacgaaatccctgccg

SEQ ID NO: 473386 - DNA, 25 bp, Rattus norvegicus
ggttgtttgaagcagtttccttgtg

SEQ ID NO: 473387 - DNA, 25 bp, Rattus norvegicus
ggttgtttgaaggagtttccttgtg

SEQ ID NO: 473388 - DNA, 25 bp, Rattus norvegicus
ggttgtttgagaatccttccttgta

SEQ ID NO: 473389 - DNA, 25 bp, Rattus norvegicus
ggttgtttgagattccttccttgta

SEQ ID NO: 473390 - DNA, 25 bp, Rattus norvegicus
ggttgtttgtgcctacatgatgttt

SEQ ID NO: 473391 - DNA, 25 bp, Rattus norvegicus
ggttgtttgtgcgtacatgatgttt

SEQ ID NO: 473392 - DNA, 25 bp, Rattus norvegicus
ggttgttttgagacacagtctggcc

SEQ ID NO: 473393 - DNA, 25 bp, Rattus norvegicus
ggttgttttgagtcacagtctggcc

SEQ ID NO: 473394 - DNA, 25 bp, Rattus norvegicus
ggttgttttgcaatcttggctgtaa

SEQ ID NO: 473395 - DNA, 25 bp, Rattus norvegicus
ggttgttttgcattcttggctgtaa

SEQ ID NO: 473396 - DNA, 25 bp, Rattus norvegicus
ggtttaaacctgagtagtcaattag

SEQ ID NO: 473397 - DNA, 25 bp, Rattus norvegicus
ggtttaaacctgtgtagtcaattag

SEQ ID NO: 473398 - DNA, 25 bp, Rattus norvegicus
ggtttaaactttcccactgtgatct

SEQ ID NO: 473399 - DNA, 25 bp, Rattus norvegicus
ggtttaaactttgccactgtgatct

SEQ ID NO: 473400 - DNA, 25 bp, Rattus norvegicus
ggtttaaaggcacaaggtcatcatc

SEQ ID NO: 473401 - DNA, 25 bp, Rattus norvegicus
ggtttaaaggcagaaggtcatcatc

SEQ ID NO: 473402 - DNA, 25 bp, Rattus norvegicus
ggtttaaataagcaatcagcctatg

SEQ ID NO: 473403 - DNA, 25 bp, Rattus norvegicus
ggtttaaataaggaatcagcctatg

SEQ ID NO: 473404 - DNA, 25 bp, Rattus norvegicus
ggtttaaatacacgatattccatca

SEQ ID NO: 473405 - DNA, 25 bp, Rattus norvegicus
ggtttaaatacaggatattccatca

SEQ ID NO: 473406 - DNA, 25 bp, Rattus norvegicus
ggtttaacatggacatcttgtagtt

SEQ ID NO: 473407 - DNA, 25 bp, Rattus norvegicus
ggtttaacatggtcatcttgtagtt

SEQ ID NO: 473408 - DNA, 25 bp, Rattus norvegicus
ggtttaaccctaaagctgttgcctg

SEQ ID NO: 473409 - DNA, 25 bp, Rattus norvegicus
ggtttaaccctatagctgttgcctg

SEQ ID NO: 473410 - DNA, 25 bp, Rattus norvegicus
ggtttaaccgaaagcacgagtggca

SEQ ID NO: 473411 - DNA, 25 bp, Rattus norvegicus
ggtttaaccgaatgcacgagtggca

SEQ ID NO: 473412 - DNA, 25 bp, Rattus norvegicus
ggtttaactcgccatgttttactat

SEQ ID NO: 473413 - DNA, 25 bp, Rattus norvegicus
ggtttaactcgcgatgttttactat

SEQ ID NO: 473414 - DNA, 25 bp, Rattus norvegicus
ggtttaagcaaactgccttccattt

SEQ ID NO: 473415 - DNA, 25 bp, Rattus norvegicus
ggtttaagcaaagtgccttccattt

SEQ ID NO: 473416 - DNA, 25 bp, Rattus norvegicus
ggtttaagcaacagcccaaccgtgt

SEQ ID NO: 473417 - DNA, 25 bp, Rattus norvegicus
ggtttaagcaactgcccaaccgtgt

SEQ ID NO: 473418 - DNA, 25 bp, Rattus norvegicus
ggtttaagcacccagctcaggatat

SEQ ID NO: 473419 - DNA, 25 bp, Rattus norvegicus
ggtttaagcaccgagctcaggatat

SEQ ID NO: 473420 - DNA, 25 bp, Rattus norvegicus
ggtttaagccatagcacatccaagt

SEQ ID NO: 473421 - DNA, 25 bp, Rattus norvegicus
ggtttaagccattgcacatccaagt

SEQ ID NO: 473422 - DNA, 25 bp, Rattus norvegicus
ggtttaagtcacaccctgggtgcat

SEQ ID NO: 473423 - DNA, 25 bp, Rattus norvegicus
ggtttaagtcactccctgggtgcat

SEQ ID NO: 473424 - DNA, 25 bp, Rattus norvegicus
ggtttaagtgcactgagccctctag

SEQ ID NO: 473425 - DNA, 25 bp, Rattus norvegicus
ggtttaagtgcagtgagccctctag

SEQ ID NO: 473426 - DNA, 25 bp, Rattus norvegicus
ggtttaataatactatcttgatttt

SEQ ID NO: 473427 - DNA, 25 bp, Rattus norvegicus
ggtttaataatagtatcttgatttt

SEQ ID NO: 473428 - DNA, 25 bp, Rattus norvegicus
ggtttaatagcccatcaattcttag

SEQ ID NO: 473429 - DNA, 25 bp, Rattus norvegicus
ggtttaatagccgatcaattcttag

SEQ ID NO: 473430 - DNA, 25 bp, Rattus norvegicus
ggtttaatatttcgtgggcactgca

SEQ ID NO: 473431 - DNA, 25 bp, Rattus norvegicus
ggtttaatatttggtgggcactgca

SEQ ID NO: 473432 - DNA, 25 bp, Rattus norvegicus
ggtttaatccccagtactgatgaaa

SEQ ID NO: 473433 - DNA, 25 bp, Rattus norvegicus
ggtttaatcccctgtactgatgaaa

SEQ ID NO: 473434 - DNA, 25 bp, Rattus norvegicus
ggtttaatccttacaggaccttgat

SEQ ID NO: 473435 - DNA, 25 bp, Rattus norvegicus
ggtttaatcctttcaggaccttgat

SEQ ID NO: 473436 - DNA, 25 bp, Rattus norvegicus
ggtttaatttccattctttgccttg

SEQ ID NO: 473437 - DNA, 25 bp, Rattus norvegicus
ggtttaatttcctttctttgccttg

SEQ ID NO: 473438 - DNA, 25 bp, Rattus norvegicus
ggtttacaaatcactgcctggatgc

SEQ ID NO: 473439 - DNA, 25 bp, Rattus norvegicus
ggtttacaaatctctgcctggatgc

SEQ ID NO: 473440 - DNA, 25 bp, Rattus norvegicus
ggtttacaagcaacaccgatgcaga

SEQ ID NO: 473441 - DNA, 25 bp, Rattus norvegicus
ggtttacaagcatcaccgatgcaga

SEQ ID NO: 473442 - DNA, 25 bp, Rattus norvegicus
ggtttacacaacaaaagctagtata

SEQ ID NO: 473443 - DNA, 25 bp, Rattus norvegicus
ggtttacacaactaaagctagtata

SEQ ID NO: 473444 - DNA, 25 bp, Rattus norvegicus
ggtttacaccagagtcttgcacagc

SEQ ID NO: 473445 - DNA, 25 bp, Rattus norvegicus
ggtttacaccagtgtcttgcacagc

SEQ ID NO: 473446 - DNA, 25 bp, Rattus norvegicus
ggtttacacgtcaccttgtttgagg

SEQ ID NO: 473447 - DNA, 25 bp, Rattus norvegicus
ggtttacacgtctccttgtttgagg

SEQ ID NO: 473448 - DNA, 25 bp, Rattus norvegicus
ggtttacacgtgagaaccaccacca

SEQ ID NO: 473449 - DNA, 25 bp, Rattus norvegicus
ggtttacacgtgtgaaccaccacca

SEQ ID NO: 473450 - DNA, 25 bp, Rattus norvegicus
ggtttacatggtatgctgtgctcac

SEQ ID NO: 473451 - DNA, 25 bp, Rattus norvegicus
ggtttacatggtttgctgtgctcac

SEQ ID NO: 473452 - DNA, 25 bp, Rattus norvegicus
ggtttaccaaggaactctattctgt

SEQ ID NO: 473453 - DNA, 25 bp, Rattus norvegicus
ggtttaccaaggtactctattctgt

SEQ ID NO: 473454 - DNA, 25 bp, Rattus norvegicus
ggtttacccgacagtggccacaaag

SEQ ID NO: 473455 - DNA, 25 bp, Rattus norvegicus
ggtttacccgactgtggccacaaag

SEQ ID NO: 473456 - DNA, 25 bp, Rattus norvegicus
ggtttacctgttactgtcattctac

SEQ ID NO: 473457 - DNA, 25 bp, Rattus norvegicus
ggtttacctgtttctgtcattctac

SEQ ID NO: 473458 - DNA, 25 bp, Rattus norvegicus
ggtttaccttttcaaagtcagcctg

SEQ ID NO: 473459 - DNA, 25 bp, Rattus norvegicus
ggtttaccttttgaaagtcagcctg

SEQ ID NO: 473460 - DNA, 25 bp, Rattus norvegicus
ggtttacgtcatctgctaaaataat

SEQ ID NO: 473461 - DNA, 25 bp, Rattus norvegicus
ggtttacgtcatgtgctaaaataat

SEQ ID NO: 473462 - DNA, 25 bp, Rattus norvegicus
ggtttactaggaattggctctcaga

SEQ ID NO: 473463 - DNA, 25 bp, Rattus norvegicus
ggtttactaggatttggctctcaga

SEQ ID NO: 473464 - DNA, 25 bp, Rattus norvegicus
ggtttactcctaacaagtgtcagtt

SEQ ID NO: 473465 - DNA, 25 bp, Rattus norvegicus
ggtttactcctatcaagtgtcagtt

SEQ ID NO: 473466 - DNA, 25 bp, Rattus norvegicus
ggtttactctacattttaataccag

SEQ ID NO: 473467 - DNA, 25 bp, Rattus norvegicus
ggtttactctactttttaataccag

SEQ ID NO: 473468 - DNA, 25 bp, Rattus norvegicus
ggtttactcttacttcattaataca

SEQ ID NO: 473469 - DNA, 25 bp, Rattus norvegicus
ggtttactcttagttcattaataca

SEQ ID NO: 473470 - DNA, 25 bp, Rattus norvegicus
ggtttactcttcacataattttgtc

SEQ ID NO: 473471 - DNA, 25 bp, Rattus norvegicus
ggtttactcttctcataattttgtc

SEQ ID NO: 473472 - DNA, 25 bp, Rattus norvegicus
ggtttactgaagaccttctccatat

SEQ ID NO: 473473 - DNA, 25 bp, Rattus norvegicus
ggtttactgaagtccttctccatat

SEQ ID NO: 473474 - DNA, 25 bp, Rattus norvegicus
ggtttactgagtacttatgggctac

SEQ ID NO: 473475 - DNA, 25 bp, Rattus norvegicus
ggtttactgagttcttatgggctac

SEQ ID NO: 473476 - DNA, 25 bp, Rattus norvegicus
ggtttactgctgacattgtccatgc

SEQ ID NO: 473477 - DNA, 25 bp, Rattus norvegicus
ggtttactgctgtcattgtccatgc

SEQ ID NO: 473478 - DNA, 25 bp, Rattus norvegicus
ggtttactgtccaaaacgctgcgct

SEQ ID NO: 473479 - DNA, 25 bp, Rattus norvegicus
ggtttactgtcctaaacgctgcgct

SEQ ID NO: 473480 - DNA, 25 bp, Rattus norvegicus
ggtttactgttaatgctagccctga

SEQ ID NO: 473481 - DNA, 25 bp, Rattus norvegicus
ggtttactgttattgctagccctga

SEQ ID NO: 473482 - DNA, 25 bp, Rattus norvegicus
ggtttacttctcacaatgactagac

SEQ ID NO: 473483 - DNA, 25 bp, Rattus norvegicus
ggtttacttctctcaatgactagac

SEQ ID NO: 473484 - DNA, 25 bp, Rattus norvegicus
ggtttagacctcatcatttaaaatg

SEQ ID NO: 473485 - DNA, 25 bp, Rattus norvegicus
ggtttagacctcttcatttaaaatg

SEQ ID NO: 473486 - DNA, 25 bp, Rattus norvegicus
ggtttagacgtaagcagtccatctt

SEQ ID NO: 473487 - DNA, 25 bp, Rattus norvegicus
ggtttagacgtatgcagtccatctt

SEQ ID NO: 473488 - DNA, 25 bp, Rattus norvegicus
ggtttagagaacactggcttctgta

SEQ ID NO: 473489 - DNA, 25 bp, Rattus norvegicus
ggtttagagaactctggcttctgta

SEQ ID NO: 473490 - DNA, 25 bp, Rattus norvegicus
ggtttagatctgcaactcatccaat

SEQ ID NO: 473491 - DNA, 25 bp, Rattus norvegicus
ggtttagatctggaactcatccaat

SEQ ID NO: 473492 - DNA, 25 bp, Rattus norvegicus
ggtttagattacaccctaccttgtg

SEQ ID NO: 473493 - DNA, 25 bp, Rattus norvegicus
ggtttagattactccctaccttgtg

SEQ ID NO: 473494 - DNA, 25 bp, Rattus norvegicus
ggtttagcctgtagtcatcatggtg

SEQ ID NO: 473495 - DNA, 25 bp, Rattus norvegicus
ggtttagcctgttgtcatcatggtg

SEQ ID NO: 473496 - DNA, 25 bp, Rattus norvegicus
ggtttagcgctgatgactgactgac

SEQ ID NO: 473497 - DNA, 25 bp, Rattus norvegicus
ggtttagcgctgttgactgactgac

SEQ ID NO: 473498 - DNA, 25 bp, Rattus norvegicus
ggtttaggctatcttctcgtgagac

SEQ ID NO: 473499 - DNA, 25 bp, Rattus norvegicus
ggtttaggctatgttctcgtgagac

SEQ ID NO: 473500 - DNA, 25 bp, Rattus norvegicus
ggtttagtccatagttgttcatcct

SEQ ID NO: 473501 - DNA, 25 bp, Rattus norvegicus
ggtttagtccattgttgttcatcct

SEQ ID NO: 473502 - DNA, 25 bp, Rattus norvegicus
ggtttagtctaaacacatgtgcatg

SEQ ID NO: 473503 - DNA, 25 bp, Rattus norvegicus
ggtttagtctaatcacatgtgcatg

SEQ ID NO: 473504 - DNA, 25 bp, Rattus norvegicus
ggtttagtcttgcttccgctgtaaa

SEQ ID NO: 473505 - DNA, 25 bp, Rattus norvegicus
ggtttagtcttggttccgctgtaaa

SEQ ID NO: 473506 - DNA, 25 bp, Rattus norvegicus
ggtttagtgacacactaggcctcaa

SEQ ID NO: 473507 - DNA, 25 bp, Rattus norvegicus
ggtttagtgacagactaggcctcaa

SEQ ID NO: 473508 - DNA, 25 bp, Rattus norvegicus
ggtttagtgtatcccagctgattca

SEQ ID NO: 473509 - DNA, 25 bp, Rattus norvegicus
ggtttagtgtatgccagctgattca

SEQ ID NO: 473510 - DNA, 25 bp, Rattus norvegicus
ggtttagttcaaattcgtcggccat

SEQ ID NO: 473511 - DNA, 25 bp, Rattus norvegicus
ggtttagttcaatttcgtcggccat

SEQ ID NO: 473512 - DNA, 25 bp, Rattus norvegicus
ggtttagttttccaatctggactgt

SEQ ID NO: 473513 - DNA, 25 bp, Rattus norvegicus
ggtttagttttcgaatctggactgt

SEQ ID NO: 473514 - DNA, 25 bp, Rattus norvegicus
ggtttataaacccaagcactagcac

SEQ ID NO: 473515 - DNA, 25 bp, Rattus norvegicus
ggtttataaaccgaagcactagcac

SEQ ID NO: 473516 - DNA, 25 bp, Rattus norvegicus
ggtttataaagtccgttgtcagcat

SEQ ID NO: 473517 - DNA, 25 bp, Rattus norvegicus
ggtttataaagtgcgttgtcagcat

SEQ ID NO: 473518 - DNA, 25 bp, Rattus norvegicus
ggtttataatttcattgctctcaag

SEQ ID NO: 473519 - DNA, 25 bp, Rattus norvegicus
ggtttataatttgattgctctcaag

SEQ ID NO: 473520 - DNA, 25 bp, Rattus norvegicus
ggtttatactgcaaagtctcgcttc

SEQ ID NO: 473521 - DNA, 25 bp, Rattus norvegicus
ggtttatactgctaagtctcgcttc

SEQ ID NO: 473522 - DNA, 25 bp, Rattus norvegicus
ggtttatcaaatccggctcatgttc

SEQ ID NO: 473523 - DNA, 25 bp, Rattus norvegicus
ggtttatcaaatgcggctcatgttc

SEQ ID NO: 473524 - DNA, 25 bp, Rattus norvegicus
ggtttatcactaagcaccctgctga

SEQ ID NO: 473525 - DNA, 25 bp, Rattus norvegicus
ggtttatcactatgcaccctgctga

SEQ ID NO: 473526 - DNA, 25 bp, Rattus norvegicus
ggtttatcatctactatgaaagcct

SEQ ID NO: 473527 - DNA, 25 bp, Rattus norvegicus
ggtttatcatcttctatgaaagcct

SEQ ID NO: 473528 - DNA, 25 bp, Rattus norvegicus
ggtttatcctatcatcacatagtac

SEQ ID NO: 473529 - DNA, 25 bp, Rattus norvegicus
ggtttatcctatgatcacatagtac

SEQ ID NO: 473530 - DNA, 25 bp, Rattus norvegicus
ggtttatctaaaagcttctctactg

SEQ ID NO: 473531 - DNA, 25 bp, Rattus norvegicus
ggtttatctaaatgcttctctactg

SEQ ID NO: 473532 - DNA, 25 bp, Rattus norvegicus
ggtttatctacgaggcaaatgctga

SEQ ID NO: 473533 - DNA, 25 bp, Rattus norvegicus
ggtttatctacgtggcaaatgctga

SEQ ID NO: 473534 - DNA, 25 bp, Rattus norvegicus
ggtttatctgacaacacctggctaa

SEQ ID NO: 473535 - DNA, 25 bp, Rattus norvegicus
ggtttatctgactacacctggctaa

SEQ ID NO: 473536 - DNA, 25 bp, Rattus norvegicus
ggtttatctttcattaagccccatg

SEQ ID NO: 473537 - DNA, 25 bp, Rattus norvegicus
ggtttatctttcctgctctcatatc

SEQ ID NO: 473538 - DNA, 25 bp, Rattus norvegicus
ggtttatctttcgtgctctcatatc

SEQ ID NO: 473539 - DNA, 25 bp, Rattus norvegicus
ggtttatctttctttaagccccatg

SEQ ID NO: 473540 - DNA, 25 bp, Rattus norvegicus
ggtttatgaggtcccttctatccaa

SEQ ID NO: 473541 - DNA, 25 bp, Rattus norvegicus
ggtttatgaggtgccttctatccaa

SEQ ID NO: 473542 - DNA, 25 bp, Rattus norvegicus
ggtttatgcagaactccagatcttg

SEQ ID NO: 473543 - DNA, 25 bp, Rattus norvegicus
ggtttatgcagatctccagatcttg

SEQ ID NO: 473544 - DNA, 25 bp, Rattus norvegicus
ggtttatgcagtactagggctctaa

SEQ ID NO: 473545 - DNA, 25 bp, Rattus norvegicus
ggtttatgcagttctagggctctaa

SEQ ID NO: 473546 - DNA, 25 bp, Rattus norvegicus
ggtttatgcccgagcccctgtgaaa

SEQ ID NO: 473547 - DNA, 25 bp, Rattus norvegicus
ggtttatgcccgtgcccctgtgaaa

SEQ ID NO: 473548 - DNA, 25 bp, Rattus norvegicus
ggtttatggtggacctgcagtctca

SEQ ID NO: 473549 - DNA, 25 bp, Rattus norvegicus
ggtttatggtggtcctgcagtctca

SEQ ID NO: 473550 - DNA, 25 bp, Rattus norvegicus
ggtttatgtcttattgaggccttac

SEQ ID NO: 473551 - DNA, 25 bp, Rattus norvegicus
ggtttatgtctttttgaggccttac

SEQ ID NO: 473552 - DNA, 25 bp, Rattus norvegicus
ggtttattaactccttatgcctatt

SEQ ID NO: 473553 - DNA, 25 bp, Rattus norvegicus
ggtttattaactgcttatgcctatt

SEQ ID NO: 473554 - DNA, 25 bp, Rattus norvegicus
ggtttattccagagcgattccatac

SEQ ID NO: 473555 - DNA, 25 bp, Rattus norvegicus
ggtttattccagtgcgattccatac

SEQ ID NO: 473556 - DNA, 25 bp, Rattus norvegicus
ggtttattcctcaggcttggataac

SEQ ID NO: 473557 - DNA, 25 bp, Rattus norvegicus
ggtttattcctctggcttggataac

SEQ ID NO: 473558 - DNA, 25 bp, Rattus norvegicus
ggtttattctctacctcaccaggat

SEQ ID NO: 473559 - DNA, 25 bp, Rattus norvegicus
ggtttattctcttcctcaccaggat

SEQ ID NO: 473560 - DNA, 25 bp, Rattus norvegicus
ggtttattgctacccagatatgatt

SEQ ID NO: 473561 - DNA, 25 bp, Rattus norvegicus
ggtttattgctagccagatatgatt

SEQ ID NO: 473562 - DNA, 25 bp, Rattus norvegicus
ggtttatttaagacacttgcatggc

SEQ ID NO: 473563 - DNA, 25 bp, Rattus norvegicus
ggtttatttaagtcacttgcatggc

SEQ ID NO: 473564 - DNA, 25 bp, Rattus norvegicus
ggtttatttcgcattcatcttactc

SEQ ID NO: 473565 - DNA, 25 bp, Rattus norvegicus
ggtttatttcgctttcatcttactc

SEQ ID NO: 473566 - DNA, 25 bp, Rattus norvegicus
ggtttatttgcaagctacagagcca

SEQ ID NO: 473567 - DNA, 25 bp, Rattus norvegicus
ggtttatttgcatgctacagagcca

SEQ ID NO: 473568 - DNA, 25 bp, Rattus norvegicus
ggtttatttggaacactttcagact

SEQ ID NO: 473569 - DNA, 25 bp, Rattus norvegicus
ggtttatttggatcactttcagact

SEQ ID NO: 473570 - DNA, 25 bp, Rattus norvegicus
ggtttattttctctcaactctgcct

SEQ ID NO: 473571 - DNA, 25 bp, Rattus norvegicus
ggtttattttctgtcaactctgcct

SEQ ID NO: 473572 - DNA, 25 bp, Rattus norvegicus
ggtttcaaaacaatcctaggagctg

SEQ ID NO: 473573 - DNA, 25 bp, Rattus norvegicus
ggtttcaaaacattcctaggagctg

SEQ ID NO: 473574 - DNA, 25 bp, Rattus norvegicus
ggtttcaaaaggctttccctctgag

SEQ ID NO: 473575 - DNA, 25 bp, Rattus norvegicus
ggtttcaaaagggtttccctctgag

SEQ ID NO: 473576 - DNA, 25 bp, Rattus norvegicus
ggtttcaaatgactgcgcactgcat

SEQ ID NO: 473577 - DNA, 25 bp, Rattus norvegicus
ggtttcaaatgagtgcgcactgcat

SEQ ID NO: 473578 - DNA, 25 bp, Rattus norvegicus
ggtttcaactctcatatattcctgg

SEQ ID NO: 473579 - DNA, 25 bp, Rattus norvegicus
ggtttcaactctgatatattcctgg

SEQ ID NO: 473580 - DNA, 25 bp, Rattus norvegicus
ggtttcaacttgagtctttttcaca

SEQ ID NO: 473581 - DNA, 25 bp, Rattus norvegicus
ggtttcaacttgtgtctttttcaca

SEQ ID NO: 473582 - DNA, 25 bp, Rattus norvegicus
ggtttcacaaatcggcttcagcggt

SEQ ID NO: 473583 - DNA, 25 bp, Rattus norvegicus
ggtttcacaaatgggcttcagcggt

SEQ ID NO: 473584 - DNA, 25 bp, Rattus norvegicus
ggtttcacagctctctataacttaa

SEQ ID NO: 473585 - DNA, 25 bp, Rattus norvegicus
ggtttcacagctgtctataacttaa

SEQ ID NO: 473586 - DNA, 25 bp, Rattus norvegicus
ggtttcacaggaaagcccagcagaa

SEQ ID NO: 473587 - DNA, 25 bp, Rattus norvegicus
ggtttcacaggatagcccagcagaa

SEQ ID NO: 473588 - DNA, 25 bp, Rattus norvegicus
ggtttcacctgcaattgtcgtcgcc

SEQ ID NO: 473589 - DNA, 25 bp, Rattus norvegicus
ggtttcacctgctattgtcgtcgcc

SEQ ID NO: 473590 - DNA, 25 bp, Rattus norvegicus
ggtttcacgctcatcaactggagat

SEQ ID NO: 473591 - DNA, 25 bp, Rattus norvegicus
ggtttcacgctcttcaactggagat

SEQ ID NO: 473592 - DNA, 25 bp, Rattus norvegicus
ggtttcactaaaatgcccaagctgg

SEQ ID NO: 473593 - DNA, 25 bp, Rattus norvegicus
ggtttcactaaattgcccaagctgg

SEQ ID NO: 473594 - DNA, 25 bp, Rattus norvegicus
ggtttcactatactggagctggctc

SEQ ID NO: 473595 - DNA, 25 bp, Rattus norvegicus
ggtttcactatagtggagctggctc

SEQ ID NO: 473596 - DNA, 25 bp, Rattus norvegicus
ggtttcactcggctaatgtcaagtt

SEQ ID NO: 473597 - DNA, 25 bp, Rattus norvegicus
ggtttcactcgggtaatgtcaagtt

SEQ ID NO: 473598 - DNA, 25 bp, Rattus norvegicus
ggtttcactttacttccatagaact

SEQ ID NO: 473599 - DNA, 25 bp, Rattus norvegicus
ggtttcactttagttccatagaact

SEQ ID NO: 473600 - DNA, 25 bp, Rattus norvegicus
ggtttcagatgaacactggccacca

SEQ ID NO: 473601 - DNA, 25 bp, Rattus norvegicus
ggtttcagatgatcactggccacca

SEQ ID NO: 473602 - DNA, 25 bp, Rattus norvegicus
ggtttcagcaaacaccaaagatatg

SEQ ID NO: 473603 - DNA, 25 bp, Rattus norvegicus
ggtttcagcaaagaccaaagatatg

SEQ ID NO: 473604 - DNA, 25 bp, Rattus norvegicus
ggtttcagcatgacaggagatttct

SEQ ID NO: 473605 - DNA, 25 bp, Rattus norvegicus
ggtttcagcatgtcaggagatttct

SEQ ID NO: 473606 - DNA, 25 bp, Rattus norvegicus
ggtttcagctggcatgatacgtgtt

SEQ ID NO: 473607 - DNA, 25 bp, Rattus norvegicus
ggtttcagctgggatgatacgtgtt

SEQ ID NO: 473608 - DNA, 25 bp, Rattus norvegicus
ggtttcagcttcacaccttagtgat

SEQ ID NO: 473609 - DNA, 25 bp, Rattus norvegicus
ggtttcagcttctcaccttagtgat

SEQ ID NO: 473610 - DNA, 25 bp, Rattus norvegicus
ggtttcagcttgacctatactttta

SEQ ID NO: 473611 - DNA, 25 bp, Rattus norvegicus
ggtttcagcttgtcctatactttta

SEQ ID NO: 473612 - DNA, 25 bp, Rattus norvegicus
ggtttcaggcacaatctttttaaat

SEQ ID NO: 473613 - DNA, 25 bp, Rattus norvegicus
ggtttcaggcactatctttttaaat

SEQ ID NO: 473614 - DNA, 25 bp, Rattus norvegicus
ggtttcagtctgagcggcgtccacc

SEQ ID NO: 473615 - DNA, 25 bp, Rattus norvegicus
ggtttcagtctgtgcggcgtccacc

SEQ ID NO: 473616 - DNA, 25 bp, Rattus norvegicus
ggtttcagtcttacctaacagcgag

SEQ ID NO: 473617 - DNA, 25 bp, Rattus norvegicus
ggtttcagtctttcctaacagcgag

SEQ ID NO: 473618 - DNA, 25 bp, Rattus norvegicus
ggtttcagttcacaatgctttcatt

SEQ ID NO: 473619 - DNA, 25 bp, Rattus norvegicus
ggtttcagttcagaatgctttcatt

SEQ ID NO: 473620 - DNA, 25 bp, Rattus norvegicus
ggtttcagtttaaagaacggacaat

SEQ ID NO: 473621 - DNA, 25 bp, Rattus norvegicus
ggtttcagtttatagaacggacaat

SEQ ID NO: 473622 - DNA, 25 bp, Rattus norvegicus
ggtttcataaatctgtccatttgtg

SEQ ID NO: 473623 - DNA, 25 bp, Rattus norvegicus
ggtttcataaatgtgtccatttgtg

SEQ ID NO: 473624 - DNA, 25 bp, Rattus norvegicus
ggtttcatccctaaaatatgctgtg

SEQ ID NO: 473625 - DNA, 25 bp, Rattus norvegicus
ggtttcatccctctcgggtccaaat

SEQ ID NO: 473626 - DNA, 25 bp, Rattus norvegicus
ggtttcatccctgtcgggtccaaat

SEQ ID NO: 473627 - DNA, 25 bp, Rattus norvegicus
ggtttcatcccttaaatatgctgtg

SEQ ID NO: 473628 - DNA, 25 bp, Rattus norvegicus
ggtttcatcgaccttaacagtggga

SEQ ID NO: 473629 - DNA, 25 bp, Rattus norvegicus
ggtttcatcgacgttaacagtggga

SEQ ID NO: 473630 - DNA, 25 bp, Rattus norvegicus
ggtttcatctgccttatttatatta

SEQ ID NO: 473631 - DNA, 25 bp, Rattus norvegicus
ggtttcatctgcgttatttatatta

SEQ ID NO: 473632 - DNA, 25 bp, Rattus norvegicus
ggtttcatggctctgaagagacgcc

SEQ ID NO: 473633 - DNA, 25 bp, Rattus norvegicus
ggtttcatggctgtgaagagacgcc

SEQ ID NO: 473634 - DNA, 25 bp, Rattus norvegicus
ggtttcattaggctcagtgtcattc

SEQ ID NO: 473635 - DNA, 25 bp, Rattus norvegicus
ggtttcattagggtcagtgtcattc

SEQ ID NO: 473636 - DNA, 25 bp, Rattus norvegicus
ggtttcatttctagttcagcgatat

SEQ ID NO: 473637 - DNA, 25 bp, Rattus norvegicus
ggtttcatttcttgttcagcgatat

SEQ ID NO: 473638 - DNA, 25 bp, Rattus norvegicus
ggtttcatttggaccttactcatcc

SEQ ID NO: 473639 - DNA, 25 bp, Rattus norvegicus
ggtttcatttggtccttactcatcc

SEQ ID NO: 473640 - DNA, 25 bp, Rattus norvegicus
ggtttcattttgattcctgtatatc

SEQ ID NO: 473641 - DNA, 25 bp, Rattus norvegicus
ggtttcattttgtttcctgtatatc

SEQ ID NO: 473642 - DNA, 25 bp, Rattus norvegicus
ggtttcatttttccattcactatac

SEQ ID NO: 473643 - DNA, 25 bp, Rattus norvegicus
ggtttcatttttgcattcactatac

SEQ ID NO: 473644 - DNA, 25 bp, Rattus norvegicus
ggtttccaactcatagcactgtttg

SEQ ID NO: 473645 - DNA, 25 bp, Rattus norvegicus
ggtttccaactcttagcactgtttg

SEQ ID NO: 473646 - DNA, 25 bp, Rattus norvegicus
ggtttccaagggagactgctcacat

SEQ ID NO: 473647 - DNA, 25 bp, Rattus norvegicus
ggtttccaagggtgactgctcacat

SEQ ID NO: 473648 - DNA, 25 bp, Rattus norvegicus
ggtttccaagttcactcagacgaag

SEQ ID NO: 473649 - DNA, 25 bp, Rattus norvegicus
ggtttccaagttgactcagacgaag

SEQ ID NO: 473650 - DNA, 25 bp, Rattus norvegicus
ggtttccacaccaagaggaccagag

SEQ ID NO: 473651 - DNA, 25 bp, Rattus norvegicus
ggtttccacaccacggatttcagtg

SEQ ID NO: 473652 - DNA, 25 bp, Rattus norvegicus
ggtttccacacctagaggaccagag

SEQ ID NO: 473653 - DNA, 25 bp, Rattus norvegicus
ggtttccacacctcggatttcagtg

SEQ ID NO: 473654 - DNA, 25 bp, Rattus norvegicus
ggtttccacatcagaggtagttatc

SEQ ID NO: 473655 - DNA, 25 bp, Rattus norvegicus
ggtttccacatctgaggtagttatc

SEQ ID NO: 473656 - DNA, 25 bp, Rattus norvegicus
ggtttccacgctcagaggtccggat

SEQ ID NO: 473657 - DNA, 25 bp, Rattus norvegicus
ggtttccacgctgagaggtccggat

SEQ ID NO: 473658 - DNA, 25 bp, Rattus norvegicus
ggtttccagaaaagccatccaaggg

SEQ ID NO: 473659 - DNA, 25 bp, Rattus norvegicus
ggtttccagaaacctgaggcaaggt

SEQ ID NO: 473660 - DNA, 25 bp, Rattus norvegicus
ggtttccagaaagctgaggcaaggt

SEQ ID NO: 473661 - DNA, 25 bp, Rattus norvegicus
ggtttccagaaatgccatccaaggg

SEQ ID NO: 473662 - DNA, 25 bp, Rattus norvegicus
ggtttccagaatacttcaagttcca

SEQ ID NO: 473663 - DNA, 25 bp, Rattus norvegicus
ggtttccagaattcttcaagttcca

SEQ ID NO: 473664 - DNA, 25 bp, Rattus norvegicus
ggtttccagacaagatgcctacgtg

SEQ ID NO: 473665 - DNA, 25 bp, Rattus norvegicus
ggtttccagacatgatgcctacgtg

SEQ ID NO: 473666 - DNA, 25 bp, Rattus norvegicus
ggtttccagggcatcagggtcatgt

SEQ ID NO: 473667 - DNA, 25 bp, Rattus norvegicus
ggtttccagggcttcagggtcatgt

SEQ ID NO: 473668 - DNA, 25 bp, Rattus norvegicus
ggtttccagtatacataagctcctt

SEQ ID NO: 473669 - DNA, 25 bp, Rattus norvegicus
ggtttccagtatatttaactgtctg

SEQ ID NO: 473670 - DNA, 25 bp, Rattus norvegicus
ggtttccagtattcataagctcctt

SEQ ID NO: 473671 - DNA, 25 bp, Rattus norvegicus
ggtttccagtatttttaactgtctg

SEQ ID NO: 473672 - DNA, 25 bp, Rattus norvegicus
ggtttccatgcccagtgtctgccta

SEQ ID NO: 473673 - DNA, 25 bp, Rattus norvegicus
ggtttccatgccgagtgtctgccta

SEQ ID NO: 473674 - DNA, 25 bp, Rattus norvegicus
ggtttccatggtcctattactcaca

SEQ ID NO: 473675 - DNA, 25 bp, Rattus norvegicus
ggtttccatggtgctattactcaca

SEQ ID NO: 473676 - DNA, 25 bp, Rattus norvegicus
ggtttccattcactgattattcgag

SEQ ID NO: 473677 - DNA, 25 bp, Rattus norvegicus
ggtttccattcagtgattattcgag

SEQ ID NO: 473678 - DNA, 25 bp, Rattus norvegicus
ggtttccatttgataagcagccatt

SEQ ID NO: 473679 - DNA, 25 bp, Rattus norvegicus
ggtttccatttgttaagcagccatt

SEQ ID NO: 473680 - DNA, 25 bp, Rattus norvegicus
ggtttcccaaaccactccttatgat

SEQ ID NO: 473681 - DNA, 25 bp, Rattus norvegicus
ggtttcccaaacgactccttatgat

SEQ ID NO: 473682 - DNA, 25 bp, Rattus norvegicus
ggtttcccaattagcataactcata

SEQ ID NO: 473683 - DNA, 25 bp, Rattus norvegicus
ggtttcccaatttgcataactcata

SEQ ID NO: 473684 - DNA, 25 bp, Rattus norvegicus
ggtttcccactcacttgaacttgtg

SEQ ID NO: 473685 - DNA, 25 bp, Rattus norvegicus
ggtttcccactctcttgaacttgtg

SEQ ID NO: 473686 - DNA, 25 bp, Rattus norvegicus
ggtttcccagatctgtatttcagtg

SEQ ID NO: 473687 - DNA, 25 bp, Rattus norvegicus
ggtttcccagatgtgtatttcagtg

SEQ ID NO: 473688 - DNA, 25 bp, Rattus norvegicus
ggtttcccagctagaggtagagtga

SEQ ID NO: 473689 - DNA, 25 bp, Rattus norvegicus
ggtttcccagcttgaggtagagtga

SEQ ID NO: 473690 - DNA, 25 bp, Rattus norvegicus
ggtttcccatcaacaggcttttgag

SEQ ID NO: 473691 - DNA, 25 bp, Rattus norvegicus
ggtttcccatcatcaggcttttgag

SEQ ID NO: 473692 - DNA, 25 bp, Rattus norvegicus
ggtttccccaggaccatgttatata

SEQ ID NO: 473693 - DNA, 25 bp, Rattus norvegicus
ggtttccccaggtccatgttatata

SEQ ID NO: 473694 - DNA, 25 bp, Rattus norvegicus
ggtttccccgcaagttgcattgtat

SEQ ID NO: 473695 - DNA, 25 bp, Rattus norvegicus
ggtttccccgcatgttgcattgtat

SEQ ID NO: 473696 - DNA, 25 bp, Rattus norvegicus
ggtttcccctatctacacttggtag

SEQ ID NO: 473697 - DNA, 25 bp, Rattus norvegicus
ggtttcccctatgtacacttggtag

SEQ ID NO: 473698 - DNA, 25 bp, Rattus norvegicus
ggtttccctagaagactactgttgt

SEQ ID NO: 473699 - DNA, 25 bp, Rattus norvegicus
ggtttccctagatgactactgttgt

SEQ ID NO: 473700 - DNA, 25 bp, Rattus norvegicus
ggtttccctcctcggctgggattga

SEQ ID NO: 473701 - DNA, 25 bp, Rattus norvegicus
ggtttccctcctgggctgggattga

SEQ ID NO: 473702 - DNA, 25 bp, Rattus norvegicus
ggtttccctgagctggtaatagact

SEQ ID NO: 473703 - DNA, 25 bp, Rattus norvegicus
ggtttccctgaggtggtaatagact

SEQ ID NO: 473704 - DNA, 25 bp, Rattus norvegicus
ggtttcccttgacacaatacagtta

SEQ ID NO: 473705 - DNA, 25 bp, Rattus norvegicus
ggtttcccttgagacaatacagtta

SEQ ID NO: 473706 - DNA, 25 bp, Rattus norvegicus
ggtttccgctgtctttatgtatggt

SEQ ID NO: 473707 - DNA, 25 bp, Rattus norvegicus
ggtttccgctgtgtttatgtatggt

SEQ ID NO: 473708 - DNA, 25 bp, Rattus norvegicus
ggtttccggtgcagttaacttcatc

SEQ ID NO: 473709 - DNA, 25 bp, Rattus norvegicus
ggtttccggtgctgttaacttcatc

SEQ ID NO: 473710 - DNA, 25 bp, Rattus norvegicus
ggtttccgttatctgtctaccacta

SEQ ID NO: 473711 - DNA, 25 bp, Rattus norvegicus
ggtttccgttatgtgtctaccacta

SEQ ID NO: 473712 - DNA, 25 bp, Rattus norvegicus
ggtttcctcagccttaatgacctgg

SEQ ID NO: 473713 - DNA, 25 bp, Rattus norvegicus
ggtttcctcagcgttaatgacctgg

SEQ ID NO: 473714 - DNA, 25 bp, Rattus norvegicus
ggtttcctcaggacagcgtgggcct

SEQ ID NO: 473715 - DNA, 25 bp, Rattus norvegicus
ggtttcctcaggtcagcgtgggcct

SEQ ID NO: 473716 - DNA, 25 bp, Rattus norvegicus
ggtttcctcttcacagcatgatctg

SEQ ID NO: 473717 - DNA, 25 bp, Rattus norvegicus
ggtttcctcttctcagcatgatctg

SEQ ID NO: 473718 - DNA, 25 bp, Rattus norvegicus
ggtttcctgatgaacagcctcagat

SEQ ID NO: 473719 - DNA, 25 bp, Rattus norvegicus
ggtttcctgatgtacagcctcagat

SEQ ID NO: 473720 - DNA, 25 bp, Rattus norvegicus
ggtttcctgctcataggagacacct

SEQ ID NO: 473721 - DNA, 25 bp, Rattus norvegicus
ggtttcctgctcttaggagacacct

SEQ ID NO: 473722 - DNA, 25 bp, Rattus norvegicus
ggtttcctggataagcaagctcgct

SEQ ID NO: 473723 - DNA, 25 bp, Rattus norvegicus
ggtttcctggattagcaagctcgct

SEQ ID NO: 473724 - DNA, 25 bp, Rattus norvegicus
ggtttcctgggtacatttgggcaca

SEQ ID NO: 473725 - DNA, 25 bp, Rattus norvegicus
ggtttcctgggttcatttgggcaca

SEQ ID NO: 473726 - DNA, 25 bp, Rattus norvegicus
ggtttccttcggagaaagactggag

SEQ ID NO: 473727 - DNA, 25 bp, Rattus norvegicus
ggtttccttcggtgaaagactggag

SEQ ID NO: 473728 - DNA, 25 bp, Rattus norvegicus
ggtttccttggcatctactgagtaa

SEQ ID NO: 473729 - DNA, 25 bp, Rattus norvegicus
ggtttccttggcttctactgagtaa

SEQ ID NO: 473730 - DNA, 25 bp, Rattus norvegicus
ggtttcctttaaacatgctggccag

SEQ ID NO: 473731 - DNA, 25 bp, Rattus norvegicus
ggtttcctttaatcatgctggccag

SEQ ID NO: 473732 - DNA, 25 bp, Rattus norvegicus
ggtttcgaaagaaccagaagctctg

SEQ ID NO: 473733 - DNA, 25 bp, Rattus norvegicus
ggtttcgaaagatccagaagctctg

SEQ ID NO: 473734 - DNA, 25 bp, Rattus norvegicus
ggtttcgatctgacgctatgactac

SEQ ID NO: 473735 - DNA, 25 bp, Rattus norvegicus
ggtttcgatctgtcgctatgactac

SEQ ID NO: 473736 - DNA, 25 bp, Rattus norvegicus
ggtttcgccagccacaaagcaactg

SEQ ID NO: 473737 - DNA, 25 bp, Rattus norvegicus
ggtttcgccagcgacaaagcaactg

SEQ ID NO: 473738 - DNA, 25 bp, Rattus norvegicus
ggtttcgccatacactatgcagact

SEQ ID NO: 473739 - DNA, 25 bp, Rattus norvegicus
ggtttcgccatagactatgcagact

SEQ ID NO: 473740 - DNA, 25 bp, Rattus norvegicus
ggtttcgcttgtatgatcttggatt

SEQ ID NO: 473741 - DNA, 25 bp, Rattus norvegicus
ggtttcgcttgtttgatcttggatt

SEQ ID NO: 473742 - DNA, 25 bp, Rattus norvegicus
ggtttcggcaggacccggcagctca

SEQ ID NO: 473743 - DNA, 25 bp, Rattus norvegicus
ggtttcggcaggtcccggcagctca

SEQ ID NO: 473744 - DNA, 25 bp, Rattus norvegicus
ggtttcggtgaaaagccttcaacat

SEQ ID NO: 473745 - DNA, 25 bp, Rattus norvegicus
ggtttcggtgaatagccttcaacat

SEQ ID NO: 473746 - DNA, 25 bp, Rattus norvegicus
ggtttcgtacttctgtgtgccctat

SEQ ID NO: 473747 - DNA, 25 bp, Rattus norvegicus
ggtttcgtacttgtgtgtgccctat

SEQ ID NO: 473748 - DNA, 25 bp, Rattus norvegicus
ggtttcgtagacacaaaactgctga

SEQ ID NO: 473749 - DNA, 25 bp, Rattus norvegicus
ggtttcgtagactcaaaactgctga

SEQ ID NO: 473750 - DNA, 25 bp, Rattus norvegicus
ggtttcgtctgtactcttgtttggg

SEQ ID NO: 473751 - DNA, 25 bp, Rattus norvegicus
ggtttcgtctgttctcttgtttggg

SEQ ID NO: 473752 - DNA, 25 bp, Rattus norvegicus
ggtttctaacttagtaacttgctct

SEQ ID NO: 473753 - DNA, 25 bp, Rattus norvegicus
ggtttctaactttgtaacttgctct

SEQ ID NO: 473754 - DNA, 25 bp, Rattus norvegicus
ggtttctacgttagatcctatctca

SEQ ID NO: 473755 - DNA, 25 bp, Rattus norvegicus
ggtttctacgtttgatcctatctca

SEQ ID NO: 473756 - DNA, 25 bp, Rattus norvegicus
ggtttctagccaaacaagtcaggtt

SEQ ID NO: 473757 - DNA, 25 bp, Rattus norvegicus
ggtttctagccatacaagtcaggtt

SEQ ID NO: 473758 - DNA, 25 bp, Rattus norvegicus
ggtttctagtatctggaggagcccc

SEQ ID NO: 473759 - DNA, 25 bp, Rattus norvegicus
ggtttctagtatgtggaggagcccc

SEQ ID NO: 473760 - DNA, 25 bp, Rattus norvegicus
ggtttctataagagaccctgaggtc

SEQ ID NO: 473761 - DNA, 25 bp, Rattus norvegicus
ggtttctataagtgaccctgaggtc

SEQ ID NO: 473762 - DNA, 25 bp, Rattus norvegicus
ggtttctatgccactactgagacac

SEQ ID NO: 473763 - DNA, 25 bp, Rattus norvegicus
ggtttctatgcctctactgagacac

SEQ ID NO: 473764 - DNA, 25 bp, Rattus norvegicus
ggtttctatggtacctcacatttta

SEQ ID NO: 473765 - DNA, 25 bp, Rattus norvegicus
ggtttctatggttcctcacatttta

SEQ ID NO: 473766 - DNA, 25 bp, Rattus norvegicus
ggtttctattacatcaccttccaag

SEQ ID NO: 473767 - DNA, 25 bp, Rattus norvegicus
ggtttctattacttcaccttccaag

SEQ ID NO: 473768 - DNA, 25 bp, Rattus norvegicus
ggtttctattccaaaagagagccaa

SEQ ID NO: 473769 - DNA, 25 bp, Rattus norvegicus
ggtttctattcctaaagagagccaa

SEQ ID NO: 473770 - DNA, 25 bp, Rattus norvegicus
ggtttctattctaacaactcgtggt

SEQ ID NO: 473771 - DNA, 25 bp, Rattus norvegicus
ggtttctattcttacaactcgtggt

SEQ ID NO: 473772 - DNA, 25 bp, Rattus norvegicus
ggtttctattttaatgacacacacg

SEQ ID NO: 473773 - DNA, 25 bp, Rattus norvegicus
ggtttctatttttatgacacacacg

SEQ ID NO: 473774 - DNA, 25 bp, Rattus norvegicus
ggtttctcaacgacttctgctttca

SEQ ID NO: 473775 - DNA, 25 bp, Rattus norvegicus
ggtttctcaacgtcttctgctttca

SEQ ID NO: 473776 - DNA, 25 bp, Rattus norvegicus
ggtttctcaatccatgggacatatg

SEQ ID NO: 473777 - DNA, 25 bp, Rattus norvegicus
ggtttctcaatcgatgggacatatg

SEQ ID NO: 473778 - DNA, 25 bp, Rattus norvegicus
ggtttctcaatgcacctcagatagg

SEQ ID NO: 473779 - DNA, 25 bp, Rattus norvegicus
ggtttctcaatggacctcagatagg

SEQ ID NO: 473780 - DNA, 25 bp, Rattus norvegicus
ggtttctcagccacggatttagtag

SEQ ID NO: 473781 - DNA, 25 bp, Rattus norvegicus
ggtttctcagcctcggatttagtag

SEQ ID NO: 473782 - DNA, 25 bp, Rattus norvegicus
ggtttctcatacctgcaaatgctaa

SEQ ID NO: 473783 - DNA, 25 bp, Rattus norvegicus
ggtttctcatacgtgcaaatgctaa

SEQ ID NO: 473784 - DNA, 25 bp, Rattus norvegicus
ggtttctcatcaatgcagccatgtc

SEQ ID NO: 473785 - DNA, 25 bp, Rattus norvegicus
ggtttctcatcattgcagccatgtc

SEQ ID NO: 473786 - DNA, 25 bp, Rattus norvegicus
ggtttctcattaaagggcaggcctg

SEQ ID NO: 473787 - DNA, 25 bp, Rattus norvegicus
ggtttctcattatagggcaggcctg

SEQ ID NO: 473788 - DNA, 25 bp, Rattus norvegicus
ggtttctccatgaattcctcaaaag

SEQ ID NO: 473789 - DNA, 25 bp, Rattus norvegicus
ggtttctccatgtattcctcaaaag

SEQ ID NO: 473790 - DNA, 25 bp, Rattus norvegicus
ggtttctcccatccacggcataaat

SEQ ID NO: 473791 - DNA, 25 bp, Rattus norvegicus
ggtttctcccatcccaagtctgtag

SEQ ID NO: 473792 - DNA, 25 bp, Rattus norvegicus
ggtttctcccatgcacggcataaat

SEQ ID NO: 473793 - DNA, 25 bp, Rattus norvegicus
ggtttctcccatgccaagtctgtag

SEQ ID NO: 473794 - DNA, 25 bp, Rattus norvegicus
ggtttctcctggacctctgatggac

SEQ ID NO: 473795 - DNA, 25 bp, Rattus norvegicus
ggtttctcctggtcctctgatggac

SEQ ID NO: 473796 - DNA, 25 bp, Rattus norvegicus
ggtttctccttgaacacagcagtgt

SEQ ID NO: 473797 - DNA, 25 bp, Rattus norvegicus
ggtttctccttgtacacagcagtgt

SEQ ID NO: 473798 - DNA, 25 bp, Rattus norvegicus
ggtttctcgatactaccatcttctc

SEQ ID NO: 473799 - DNA, 25 bp, Rattus norvegicus
ggtttctcgatagtaccatcttctc

SEQ ID NO: 473800 - DNA, 25 bp, Rattus norvegicus
ggtttctctgataccaagcgcaagt

SEQ ID NO: 473801 - DNA, 25 bp, Rattus norvegicus
ggtttctctgattccaagcgcaagt

SEQ ID NO: 473802 - DNA, 25 bp, Rattus norvegicus
ggtttctctggcaaaagatcacatc

SEQ ID NO: 473803 - DNA, 25 bp, Rattus norvegicus
ggtttctctggctaaagatcacatc

SEQ ID NO: 473804 - DNA, 25 bp, Rattus norvegicus
ggtttctgacagagtttgctcttta

SEQ ID NO: 473805 - DNA, 25 bp, Rattus norvegicus
ggtttctgacagtgtttgctcttta

SEQ ID NO: 473806 - DNA, 25 bp, Rattus norvegicus
ggtttctgacgcatgcacatgcgca

SEQ ID NO: 473807 - DNA, 25 bp, Rattus norvegicus
ggtttctgacgcttgcacatgcgca

SEQ ID NO: 473808 - DNA, 25 bp, Rattus norvegicus
ggtttctgatacaattctccgtaag

SEQ ID NO: 473809 - DNA, 25 bp, Rattus norvegicus
ggtttctgatactattctccgtaag

SEQ ID NO: 473810 - DNA, 25 bp, Rattus norvegicus
ggtttctgatggaactgcatatcta

SEQ ID NO: 473811 - DNA, 25 bp, Rattus norvegicus
ggtttctgatggtactgcatatcta

SEQ ID NO: 473812 - DNA, 25 bp, Rattus norvegicus
ggtttctggttgcatattttcttca

SEQ ID NO: 473813 - DNA, 25 bp, Rattus norvegicus
ggtttctggttggatattttcttca

SEQ ID NO: 473814 - DNA, 25 bp, Rattus norvegicus
ggtttctgtcccaacaattgtgtaa

SEQ ID NO: 473815 - DNA, 25 bp, Rattus norvegicus
ggtttctgtcccacaacaacatagg

SEQ ID NO: 473816 - DNA, 25 bp, Rattus norvegicus
ggtttctgtccctacaattgtgtaa

SEQ ID NO: 473817 - DNA, 25 bp, Rattus norvegicus
ggtttctgtccctcaacaacatagg

SEQ ID NO: 473818 - DNA, 25 bp, Rattus norvegicus
ggtttctgtgagactgcagaccaat

SEQ ID NO: 473819 - DNA, 25 bp, Rattus norvegicus
ggtttctgtgagtctgcagaccaat

SEQ ID NO: 473820 - DNA, 25 bp, Rattus norvegicus
ggtttctgtgcaacatgtgctcaac

SEQ ID NO: 473821 - DNA, 25 bp, Rattus norvegicus
ggtttctgtgcacccgttctgagtg

SEQ ID NO: 473822 - DNA, 25 bp, Rattus norvegicus
ggtttctgtgcagccgttctgagtg

SEQ ID NO: 473823 - DNA, 25 bp, Rattus norvegicus
ggtttctgtgcatcatgtgctcaac

SEQ ID NO: 473824 - DNA, 25 bp, Rattus norvegicus
ggtttctgtgcgagtcaaggccaca

SEQ ID NO: 473825 - DNA, 25 bp, Rattus norvegicus
ggtttctgtgcgtgtcaaggccaca

SEQ ID NO: 473826 - DNA, 25 bp, Rattus norvegicus
ggtttctgtgtgagcccgacccagt

SEQ ID NO: 473827 - DNA, 25 bp, Rattus norvegicus
ggtttctgtgtgtgcccgacccagt

SEQ ID NO: 473828 - DNA, 25 bp, Rattus norvegicus
ggtttctgtttcagggctgacacta

SEQ ID NO: 473829 - DNA, 25 bp, Rattus norvegicus
ggtttctgtttctgggctgacacta

SEQ ID NO: 473830 - DNA, 25 bp, Rattus norvegicus
ggtttcttaaccatcaaagatgtgg

SEQ ID NO: 473831 - DNA, 25 bp, Rattus norvegicus
ggtttcttaaccttcaaagatgtgg

SEQ ID NO: 473832 - DNA, 25 bp, Rattus norvegicus
ggtttcttaatcagaacaccagctc

SEQ ID NO: 473833 - DNA, 25 bp, Rattus norvegicus
ggtttcttaatctgaacaccagctc

SEQ ID NO: 473834 - DNA, 25 bp, Rattus norvegicus
ggtttcttacaacatgcctctgaat

SEQ ID NO: 473835 - DNA, 25 bp, Rattus norvegicus
ggtttcttacaagatgcctctgaat

SEQ ID NO: 473836 - DNA, 25 bp, Rattus norvegicus
ggtttcttaggaattgttcactttg

SEQ ID NO: 473837 - DNA, 25 bp, Rattus norvegicus
ggtttcttaggatttgttcactttg

SEQ ID NO: 473838 - DNA, 25 bp, Rattus norvegicus
ggtttcttcagaatgtgtgtgtcat

SEQ ID NO: 473839 - DNA, 25 bp, Rattus norvegicus
ggtttcttcagattgtgtgtgtcat

SEQ ID NO: 473840 - DNA, 25 bp, Rattus norvegicus
ggtttcttccttctctgaatcggac

SEQ ID NO: 473841 - DNA, 25 bp, Rattus norvegicus
ggtttcttccttgtctgaatcggac

SEQ ID NO: 473842 - DNA, 25 bp, Rattus norvegicus
ggtttcttcgtcacatttattgttc

SEQ ID NO: 473843 - DNA, 25 bp, Rattus norvegicus
ggtttcttcgtctcatttattgttc

SEQ ID NO: 473844 - DNA, 25 bp, Rattus norvegicus
ggtttcttctcaaatctagtccccg

SEQ ID NO: 473845 - DNA, 25 bp, Rattus norvegicus
ggtttcttctcatatctagtccccg

SEQ ID NO: 473846 - DNA, 25 bp, Rattus norvegicus
ggtttcttgagccttttgttcaatg

SEQ ID NO: 473847 - DNA, 25 bp, Rattus norvegicus
ggtttcttgagcgttttgttcaatg

SEQ ID NO: 473848 - DNA, 25 bp, Rattus norvegicus
ggtttcttgcatattaactatctca

SEQ ID NO: 473849 - DNA, 25 bp, Rattus norvegicus
ggtttcttgcattttaactatctca

SEQ ID NO: 473850 - DNA, 25 bp, Rattus norvegicus
ggtttcttgcctatctaagctgccc

SEQ ID NO: 473851 - DNA, 25 bp, Rattus norvegicus
ggtttcttgcctttctaagctgccc

SEQ ID NO: 473852 - DNA, 25 bp, Rattus norvegicus
ggtttcttgtccaggtgttaacact

SEQ ID NO: 473853 - DNA, 25 bp, Rattus norvegicus
ggtttcttgtcctggtgttaacact

SEQ ID NO: 473854 - DNA, 25 bp, Rattus norvegicus
ggtttctttgtaccttcacacgatg

SEQ ID NO: 473855 - DNA, 25 bp, Rattus norvegicus
ggtttctttgtagcttcacacgatg

SEQ ID NO: 473856 - DNA, 25 bp, Rattus norvegicus
ggtttctttgtcaccagtatgccaa

SEQ ID NO: 473857 - DNA, 25 bp, Rattus norvegicus
ggtttctttgtctccagtatgccaa

SEQ ID NO: 473858 - DNA, 25 bp, Rattus norvegicus
ggtttcttttctccgtgtagccctg

SEQ ID NO: 473859 - DNA, 25 bp, Rattus norvegicus
ggtttcttttctgcgtgtagccctg

SEQ ID NO: 473860 - DNA, 25 bp, Rattus norvegicus
ggtttgaaactgcatactcgatttt

SEQ ID NO: 473861 - DNA, 25 bp, Rattus norvegicus
ggtttgaaactggatactcgatttt

SEQ ID NO: 473862 - DNA, 25 bp, Rattus norvegicus
ggtttgaacacaaagctaggctgaa

SEQ ID NO: 473863 - DNA, 25 bp, Rattus norvegicus
ggtttgaacacatagctaggctgaa

SEQ ID NO: 473864 - DNA, 25 bp, Rattus norvegicus
ggtttgaacactacctctagattga

SEQ ID NO: 473865 - DNA, 25 bp, Rattus norvegicus
ggtttgaacacttcctctagattga

SEQ ID NO: 473866 - DNA, 25 bp, Rattus norvegicus
ggtttgaacctgaatgatcttatct

SEQ ID NO: 473867 - DNA, 25 bp, Rattus norvegicus
ggtttgaacctgtatgatcttatct

SEQ ID NO: 473868 - DNA, 25 bp, Rattus norvegicus
ggtttgaaccttcagtacctccctg

SEQ ID NO: 473869 - DNA, 25 bp, Rattus norvegicus
ggtttgaaccttgagtacctccctg

SEQ ID NO: 473870 - DNA, 25 bp, Rattus norvegicus
ggtttgaactacctcaagacacgtt

SEQ ID NO: 473871 - DNA, 25 bp, Rattus norvegicus
ggtttgaactacgtcaagacacgtt

SEQ ID NO: 473872 - DNA, 25 bp, Rattus norvegicus
ggtttgaactgcatacatacatgtc

SEQ ID NO: 473873 - DNA, 25 bp, Rattus norvegicus
ggtttgaactgcttacatacatgtc

SEQ ID NO: 473874 - DNA, 25 bp, Rattus norvegicus
ggtttgaacttacctgtgtgctcac

SEQ ID NO: 473875 - DNA, 25 bp, Rattus norvegicus
ggtttgaacttagctgtgtgctcac

SEQ ID NO: 473876 - DNA, 25 bp, Rattus norvegicus
ggtttgaacttcaagtcctgtgcaa

SEQ ID NO: 473877 - DNA, 25 bp, Rattus norvegicus
ggtttgaacttctagtcctgtgcaa

SEQ ID NO: 473878 - DNA, 25 bp, Rattus norvegicus
ggtttgaagccgctgacctgtgctc

SEQ ID NO: 473879 - DNA, 25 bp, Rattus norvegicus
ggtttgaagccggtgacctgtgctc

SEQ ID NO: 473880 - DNA, 25 bp, Rattus norvegicus
ggtttgaagtacaacagccctcctc

SEQ ID NO: 473881 - DNA, 25 bp, Rattus norvegicus
ggtttgaagtactacagccctcctc

SEQ ID NO: 473882 - DNA, 25 bp, Rattus norvegicus
ggtttgaataggactggcacccata

SEQ ID NO: 473883 - DNA, 25 bp, Rattus norvegicus
ggtttgaataggtctggcacccata

SEQ ID NO: 473884 - DNA, 25 bp, Rattus norvegicus
ggtttgaatgagaattgctccccat

SEQ ID NO: 473885 - DNA, 25 bp, Rattus norvegicus
ggtttgaatgagtattgctccccat

SEQ ID NO: 473886 - DNA, 25 bp, Rattus norvegicus
ggtttgaatttaaagcctcttgcat

SEQ ID NO: 473887 - DNA, 25 bp, Rattus norvegicus
ggtttgaatttatagcctcttgcat

SEQ ID NO: 473888 - DNA, 25 bp, Rattus norvegicus
ggtttgacaacacctacagcttcat

SEQ ID NO: 473889 - DNA, 25 bp, Rattus norvegicus
ggtttgacaacagctacagcttcat

SEQ ID NO: 473890 - DNA, 25 bp, Rattus norvegicus
ggtttgacaagaatgacctcagcat

SEQ ID NO: 473891 - DNA, 25 bp, Rattus norvegicus
ggtttgacaagattgacctcagcat

SEQ ID NO: 473892 - DNA, 25 bp, Rattus norvegicus
ggtttgacactgaattttcacattg

SEQ ID NO: 473893 - DNA, 25 bp, Rattus norvegicus
ggtttgacactgtattttcacattg

SEQ ID NO: 473894 - DNA, 25 bp, Rattus norvegicus
ggtttgacagtgctcagttccccgc

SEQ ID NO: 473895 - DNA, 25 bp, Rattus norvegicus
ggtttgacagtggtcagttccccgc

SEQ ID NO: 473896 - DNA, 25 bp, Rattus norvegicus
ggtttgaccgtaagcagtgccgaga

SEQ ID NO: 473897 - DNA, 25 bp, Rattus norvegicus
ggtttgaccgtatgcagtgccgaga

SEQ ID NO: 473898 - DNA, 25 bp, Rattus norvegicus
ggtttgacctgtcactgaatctcca

SEQ ID NO: 473899 - DNA, 25 bp, Rattus norvegicus
ggtttgacctgtgactgaatctcca

SEQ ID NO: 473900 - DNA, 25 bp, Rattus norvegicus
ggtttgacgtgccatcaggtgtttt

SEQ ID NO: 473901 - DNA, 25 bp, Rattus norvegicus
ggtttgacgtgcgatcaggtgtttt

SEQ ID NO: 473902 - DNA, 25 bp, Rattus norvegicus
ggtttgacgttgcacatccagggat

SEQ ID NO: 473903 - DNA, 25 bp, Rattus norvegicus
ggtttgacgttggacatccagggat

SEQ ID NO: 473904 - DNA, 25 bp, Rattus norvegicus
ggtttgactattagccaatgccctg

SEQ ID NO: 473905 - DNA, 25 bp, Rattus norvegicus
ggtttgactatttgccaatgccctg

SEQ ID NO: 473906 - DNA, 25 bp, Rattus norvegicus
ggtttgagaagtcagccccagtccc

SEQ ID NO: 473907 - DNA, 25 bp, Rattus norvegicus
ggtttgagaagtgagccccagtccc

SEQ ID NO: 473908 - DNA, 25 bp, Rattus norvegicus
ggtttgagacccacactctggaaga

SEQ ID NO: 473909 - DNA, 25 bp, Rattus norvegicus
ggtttgagaccctcactctggaaga

SEQ ID NO: 473910 - DNA, 25 bp, Rattus norvegicus
ggtttgagcacacagcattccttaa

SEQ ID NO: 473911 - DNA, 25 bp, Rattus norvegicus
ggtttgagcacagagcattccttaa

SEQ ID NO: 473912 - DNA, 25 bp, Rattus norvegicus
ggtttgaggcctaacatgttctaga

SEQ ID NO: 473913 - DNA, 25 bp, Rattus norvegicus
ggtttgaggccttacatgttctaga

SEQ ID NO: 473914 - DNA, 25 bp, Rattus norvegicus
ggtttgatacacactccattcgatg

SEQ ID NO: 473915 - DNA, 25 bp, Rattus norvegicus
ggtttgatacactctccattcgatg

SEQ ID NO: 473916 - DNA, 25 bp, Rattus norvegicus
ggtttgatataacctgtcggttcac

SEQ ID NO: 473917 - DNA, 25 bp, Rattus norvegicus
ggtttgatataagctgtcggttcac

SEQ ID NO: 473918 - DNA, 25 bp, Rattus norvegicus
ggtttgatccaaatcctattacagt

SEQ ID NO: 473919 - DNA, 25 bp, Rattus norvegicus
ggtttgatccaattcctattacagt

SEQ ID NO: 473920 - DNA, 25 bp, Rattus norvegicus
ggtttgatgaacctgtcccagacct

SEQ ID NO: 473921 - DNA, 25 bp, Rattus norvegicus
ggtttgatgaacgtgtcccagacct

SEQ ID NO: 473922 - DNA, 25 bp, Rattus norvegicus
ggtttgatgaccagcttgttgttaa

SEQ ID NO: 473923 - DNA, 25 bp, Rattus norvegicus
ggtttgatgacctgcttgttgttaa

SEQ ID NO: 473924 - DNA, 25 bp, Rattus norvegicus
ggtttgatgatgcgctcagtgccat

SEQ ID NO: 473925 - DNA, 25 bp, Rattus norvegicus
ggtttgatgatgggctcagtgccat

SEQ ID NO: 473926 - DNA, 25 bp, Rattus norvegicus
ggtttgatgttcagcattgcgaaga

SEQ ID NO: 473927 - DNA, 25 bp, Rattus norvegicus
ggtttgatgttctgcattgcgaaga

SEQ ID NO: 473928 - DNA, 25 bp, Rattus norvegicus
ggtttgattcctaacgccacataaa

SEQ ID NO: 473929 - DNA, 25 bp, Rattus norvegicus
ggtttgattccttacgccacataaa

SEQ ID NO: 473930 - DNA, 25 bp, Rattus norvegicus
ggtttgattcttatttctcctaatg

SEQ ID NO: 473931 - DNA, 25 bp, Rattus norvegicus
ggtttgattcttttttctcctaatg

SEQ ID NO: 473932 - DNA, 25 bp, Rattus norvegicus
ggtttgattttcatcctcatgtatt

SEQ ID NO: 473933 - DNA, 25 bp, Rattus norvegicus
ggtttgattttcatcctggatggat

SEQ ID NO: 473934 - DNA, 25 bp, Rattus norvegicus
ggtttgattttcttcctcatgtatt

SEQ ID NO: 473935 - DNA, 25 bp, Rattus norvegicus
ggtttgattttcttcctggatggat

SEQ ID NO: 473936 - DNA, 25 bp, Rattus norvegicus
ggtttgcaaagtcaatggcctgact

SEQ ID NO: 473937 - DNA, 25 bp, Rattus norvegicus
ggtttgcaaagtgaatggcctgact

SEQ ID NO: 473938 - DNA, 25 bp, Rattus norvegicus
ggtttgcaacatcctaatgcccata

SEQ ID NO: 473939 - DNA, 25 bp, Rattus norvegicus
ggtttgcaacatgctaatgcccata

SEQ ID NO: 473940 - DNA, 25 bp, Rattus norvegicus
ggtttgcaacccatgatggtggcat

SEQ ID NO: 473941 - DNA, 25 bp, Rattus norvegicus
ggtttgcaacccttgatggtggcat

SEQ ID NO: 473942 - DNA, 25 bp, Rattus norvegicus
ggtttgcacactctcttgagaaaaa

SEQ ID NO: 473943 - DNA, 25 bp, Rattus norvegicus
ggtttgcacactgtcttgagaaaaa

SEQ ID NO: 473944 - DNA, 25 bp, Rattus norvegicus
ggtttgcagacacgccaggagacat

SEQ ID NO: 473945 - DNA, 25 bp, Rattus norvegicus
ggtttgcagacaggccaggagacat

SEQ ID NO: 473946 - DNA, 25 bp, Rattus norvegicus
ggtttgcagataccggatcacttct

SEQ ID NO: 473947 - DNA, 25 bp, Rattus norvegicus
ggtttgcagatagcggatcacttct

SEQ ID NO: 473948 - DNA, 25 bp, Rattus norvegicus
ggtttgcagcatccagattccttca

SEQ ID NO: 473949 - DNA, 25 bp, Rattus norvegicus
ggtttgcagcatgcagattccttca

SEQ ID NO: 473950 - DNA, 25 bp, Rattus norvegicus
ggtttgcagctcacagttcttggtt

SEQ ID NO: 473951 - DNA, 25 bp, Rattus norvegicus
ggtttgcagctctcagttcttggtt

SEQ ID NO: 473952 - DNA, 25 bp, Rattus norvegicus
ggtttgcaggaaactccgaccttgt

SEQ ID NO: 473953 - DNA, 25 bp, Rattus norvegicus
ggtttgcaggaatctccgaccttgt

SEQ ID NO: 473954 - DNA, 25 bp, Rattus norvegicus
ggtttgcatcttaggtgtgacttaa

SEQ ID NO: 473955 - DNA, 25 bp, Rattus norvegicus
ggtttgcatctttggtgtgacttaa

SEQ ID NO: 473956 - DNA, 25 bp, Rattus norvegicus
ggtttgcatgtacccagttgacact

SEQ ID NO: 473957 - DNA, 25 bp, Rattus norvegicus
ggtttgcatgtagccagttgacact

SEQ ID NO: 473958 - DNA, 25 bp, Rattus norvegicus
ggtttgcattctcccattggctaaa

SEQ ID NO: 473959 - DNA, 25 bp, Rattus norvegicus
ggtttgcattctgccattggctaaa

SEQ ID NO: 473960 - DNA, 25 bp, Rattus norvegicus
ggtttgccaaagacaattctgaact

SEQ ID NO: 473961 - DNA, 25 bp, Rattus norvegicus
ggtttgccaaagtcaattctgaact

SEQ ID NO: 473962 - DNA, 25 bp, Rattus norvegicus
ggtttgccaagacccctaaggagcg

SEQ ID NO: 473963 - DNA, 25 bp, Rattus norvegicus
ggtttgccaagagccctaaggagcg

SEQ ID NO: 473964 - DNA, 25 bp, Rattus norvegicus
ggtttgccagttaaacatcagctag

SEQ ID NO: 473965 - DNA, 25 bp, Rattus norvegicus
ggtttgccagtttaacatcagctag

SEQ ID NO: 473966 - DNA, 25 bp, Rattus norvegicus
ggtttgccattacagtgttcattca

SEQ ID NO: 473967 - DNA, 25 bp, Rattus norvegicus
ggtttgccattagagtgttcattca

SEQ ID NO: 473968 - DNA, 25 bp, Rattus norvegicus
ggtttgccctaacatatctgtattt

SEQ ID NO: 473969 - DNA, 25 bp, Rattus norvegicus
ggtttgccctaagatatctgtattt

SEQ ID NO: 473970 - DNA, 25 bp, Rattus norvegicus
ggtttgcctgacactgatataaggg

SEQ ID NO: 473971 - DNA, 25 bp, Rattus norvegicus
ggtttgcctgactctgatataaggg

SEQ ID NO: 473972 - DNA, 25 bp, Rattus norvegicus
ggtttgcctgagctttgaacagtca

SEQ ID NO: 473973 - DNA, 25 bp, Rattus norvegicus
ggtttgcctgaggtttgaacagtca

SEQ ID NO: 473974 - DNA, 25 bp, Rattus norvegicus
ggtttgcgattcctgtaaatgtgac

SEQ ID NO: 473975 - DNA, 25 bp, Rattus norvegicus
ggtttgcgattcgtgtaaatgtgac

SEQ ID NO: 473976 - DNA, 25 bp, Rattus norvegicus
ggtttgcgcagtcttgttgacaact

SEQ ID NO: 473977 - DNA, 25 bp, Rattus norvegicus
ggtttgcgcagtgttgttgacaact

SEQ ID NO: 473978 - DNA, 25 bp, Rattus norvegicus
ggtttgcgtaccacagttagccagg

SEQ ID NO: 473979 - DNA, 25 bp, Rattus norvegicus
ggtttgcgtacctcagttagccagg

SEQ ID NO: 473980 - DNA, 25 bp, Rattus norvegicus
ggtttgctacagagagctcagatca

SEQ ID NO: 473981 - DNA, 25 bp, Rattus norvegicus
ggtttgctacagtgagctcagatca

SEQ ID NO: 473982 - DNA, 25 bp, Rattus norvegicus
ggtttgctatatagctagtgctgtt

SEQ ID NO: 473983 - DNA, 25 bp, Rattus norvegicus
ggtttgctatattgctagtgctgtt

SEQ ID NO: 473984 - DNA, 25 bp, Rattus norvegicus
ggtttgctcatccatcagatccaga

SEQ ID NO: 473985 - DNA, 25 bp, Rattus norvegicus
ggtttgctcatcgatcagatccaga

SEQ ID NO: 473986 - DNA, 25 bp, Rattus norvegicus
ggtttgctgccgatgttattttatt

SEQ ID NO: 473987 - DNA, 25 bp, Rattus norvegicus
ggtttgctgccgttgttattttatt

SEQ ID NO: 473988 - DNA, 25 bp, Rattus norvegicus
ggtttgctgtccatagaatgttcga

SEQ ID NO: 473989 - DNA, 25 bp, Rattus norvegicus
ggtttgctgtccttagaatgttcga

SEQ ID NO: 473990 - DNA, 25 bp, Rattus norvegicus
ggtttgcttcaaactgttagtactt

SEQ ID NO: 473991 - DNA, 25 bp, Rattus norvegicus
ggtttgcttcaaagtctccaggact

SEQ ID NO: 473992 - DNA, 25 bp, Rattus norvegicus
ggtttgcttcaatctgttagtactt

SEQ ID NO: 473993 - DNA, 25 bp, Rattus norvegicus
ggtttgcttcaatgtctccaggact

SEQ ID NO: 473994 - DNA, 25 bp, Rattus norvegicus
ggtttggaaacacatcttgcttttt

SEQ ID NO: 473995 - DNA, 25 bp, Rattus norvegicus
ggtttggaaacagatcttgcttttt

SEQ ID NO: 473996 - DNA, 25 bp, Rattus norvegicus
ggtttggacaatcagctaggctgaa

SEQ ID NO: 473997 - DNA, 25 bp, Rattus norvegicus
ggtttggacaatgagctaggctgaa

SEQ ID NO: 473998 - DNA, 25 bp, Rattus norvegicus
ggtttggatatcacgcacaggcagt

SEQ ID NO: 473999 - DNA, 25 bp, Rattus norvegicus
ggtttggatatctcgcacaggcagt

SEQ ID NO: 474000 - DNA, 25 bp, Rattus norvegicus
ggtttggatctaacactgggcacta

SEQ ID NO: 474001 - DNA, 25 bp, Rattus norvegicus
ggtttggatctatcactgggcacta

SEQ ID NO: 474002 - DNA, 25 bp, Rattus norvegicus
ggtttggcaaagcaacacacaactt

SEQ ID NO: 474003 - DNA, 25 bp, Rattus norvegicus
ggtttggcaaaggaacacacaactt

SEQ ID NO: 474004 - DNA, 25 bp, Rattus norvegicus
ggtttggcaccaccgaatccatgat

SEQ ID NO: 474005 - DNA, 25 bp, Rattus norvegicus
ggtttggcaccagcgaatccatgat

SEQ ID NO: 474006 - DNA, 25 bp, Rattus norvegicus
ggtttggcataacctactgttgtaa

SEQ ID NO: 474007 - DNA, 25 bp, Rattus norvegicus
ggtttggcataagctactgttgtaa

SEQ ID NO: 474008 - DNA, 25 bp, Rattus norvegicus
ggtttggccatgacgccttttggga

SEQ ID NO: 474009 - DNA, 25 bp, Rattus norvegicus
ggtttggccatgtcgccttttggga

SEQ ID NO: 474010 - DNA, 25 bp, Rattus norvegicus
ggtttggccctgcaattgaccgatt

SEQ ID NO: 474011 - DNA, 25 bp, Rattus norvegicus
ggtttggccctggaattgaccgatt

SEQ ID NO: 474012 - DNA, 25 bp, Rattus norvegicus
ggtttgggagacactggcagttaca

SEQ ID NO: 474013 - DNA, 25 bp, Rattus norvegicus
ggtttgggagactctggcagttaca

SEQ ID NO: 474014 - DNA, 25 bp, Rattus norvegicus
ggtttgggatagatgtacacaggat

SEQ ID NO: 474015 - DNA, 25 bp, Rattus norvegicus
ggtttgggatagttgtacacaggat

SEQ ID NO: 474016 - DNA, 25 bp, Rattus norvegicus
ggtttggtcccactagacggcaaca

SEQ ID NO: 474017 - DNA, 25 bp, Rattus norvegicus
ggtttggtcccagtagacggcaaca

SEQ ID NO: 474018 - DNA, 25 bp, Rattus norvegicus
ggtttggtgattccttctctggaaa

SEQ ID NO: 474019 - DNA, 25 bp, Rattus norvegicus
ggtttggtgattgcttctctggaaa

SEQ ID NO: 474020 - DNA, 25 bp, Rattus norvegicus
ggtttggttttaatgcagttctcat

SEQ ID NO: 474021 - DNA, 25 bp, Rattus norvegicus
ggtttggttttattgcagttctcat

SEQ ID NO: 474022 - DNA, 25 bp, Rattus norvegicus
ggtttggttttgattcctcagagca

SEQ ID NO: 474023 - DNA, 25 bp, Rattus norvegicus
ggtttggttttgtttcctcagagca

SEQ ID NO: 474024 - DNA, 25 bp, Rattus norvegicus
ggtttgtaaataaaccaatcagtac

SEQ ID NO: 474025 - DNA, 25 bp, Rattus norvegicus
ggtttgtaaatataccaatcagtac

SEQ ID NO: 474026 - DNA, 25 bp, Rattus norvegicus
ggtttgtacacaacttcatagttgc

SEQ ID NO: 474027 - DNA, 25 bp, Rattus norvegicus
ggtttgtacacatcttcatagttgc

SEQ ID NO: 474028 - DNA, 25 bp, Rattus norvegicus
ggtttgtacagaagcatgccacagt

SEQ ID NO: 474029 - DNA, 25 bp, Rattus norvegicus
ggtttgtacagatgcatgccacagt

SEQ ID NO: 474030 - DNA, 25 bp, Rattus norvegicus
ggtttgtaccttctatttatatcaa

SEQ ID NO: 474031 - DNA, 25 bp, Rattus norvegicus
ggtttgtaccttgtatttatatcaa

SEQ ID NO: 474032 - DNA, 25 bp, Rattus norvegicus
ggtttgtagtcaccgaatcctctct

SEQ ID NO: 474033 - DNA, 25 bp, Rattus norvegicus
ggtttgtagtcagcgaatcctctct

SEQ ID NO: 474034 - DNA, 25 bp, Rattus norvegicus
ggtttgtattttcactttcttggat

SEQ ID NO: 474035 - DNA, 25 bp, Rattus norvegicus
ggtttgtattttgactttcttggat

SEQ ID NO: 474036 - DNA, 25 bp, Rattus norvegicus
ggtttgtcaccaagccaaagttcat

SEQ ID NO: 474037 - DNA, 25 bp, Rattus norvegicus
ggtttgtcaccatgccaaagttcat

SEQ ID NO: 474038 - DNA, 25 bp, Rattus norvegicus
ggtttgtcacctcgtatatgacatt

SEQ ID NO: 474039 - DNA, 25 bp, Rattus norvegicus
ggtttgtcacctggtatatgacatt

SEQ ID NO: 474040 - DNA, 25 bp, Rattus norvegicus
ggtttgtcagaaaacatgttcatga

SEQ ID NO: 474041 - DNA, 25 bp, Rattus norvegicus
ggtttgtcagaatacatgttcatga

SEQ ID NO: 474042 - DNA, 25 bp, Rattus norvegicus
ggtttgtcagcaacggatcccggga

SEQ ID NO: 474043 - DNA, 25 bp, Rattus norvegicus
ggtttgtcagcatcggatcccggga

SEQ ID NO: 474044 - DNA, 25 bp, Rattus norvegicus
ggtttgtccgagactgcatgcagca

SEQ ID NO: 474045 - DNA, 25 bp, Rattus norvegicus
ggtttgtccgagtctgcatgcagca

SEQ ID NO: 474046 - DNA, 25 bp, Rattus norvegicus
ggtttgtctcaaactgactcagcag

SEQ ID NO: 474047 - DNA, 25 bp, Rattus norvegicus
ggtttgtctcaatctgactcagcag

SEQ ID NO: 474048 - DNA, 25 bp, Rattus norvegicus
ggtttgtctggaactgtcattctca

SEQ ID NO: 474049 - DNA, 25 bp, Rattus norvegicus
ggtttgtctggatctgtcattctca

SEQ ID NO: 474050 - DNA, 25 bp, Rattus norvegicus
ggtttgtggcaaatggtcctcagca

SEQ ID NO: 474051 - DNA, 25 bp, Rattus norvegicus
ggtttgtggcaattggtcctcagca

SEQ ID NO: 474052 - DNA, 25 bp, Rattus norvegicus
ggtttgtgtaaacgacccatagcaa

SEQ ID NO: 474053 - DNA, 25 bp, Rattus norvegicus
ggtttgtgtaaaggacccatagcaa

SEQ ID NO: 474054 - DNA, 25 bp, Rattus norvegicus
ggtttgtgtgccatccatatagtag

SEQ ID NO: 474055 - DNA, 25 bp, Rattus norvegicus
ggtttgtgtgccttccatatagtag

SEQ ID NO: 474056 - DNA, 25 bp, Rattus norvegicus
ggtttgtgtttcagtatctgtctaa

SEQ ID NO: 474057 - DNA, 25 bp, Rattus norvegicus
ggtttgtgtttctgtatctgtctaa

SEQ ID NO: 474058 - DNA, 25 bp, Rattus norvegicus
ggtttgttcacaccccgagagagga

SEQ ID NO: 474059 - DNA, 25 bp, Rattus norvegicus
ggtttgttcacagcccgagagagga

SEQ ID NO: 474060 - DNA, 25 bp, Rattus norvegicus
ggtttgttcaggatgctgcaagctc

SEQ ID NO: 474061 - DNA, 25 bp, Rattus norvegicus
ggtttgttcaggttgctgcaagctc

SEQ ID NO: 474062 - DNA, 25 bp, Rattus norvegicus
ggtttgttcctacacttgtttgctc

SEQ ID NO: 474063 - DNA, 25 bp, Rattus norvegicus
ggtttgttcctagacttgtttgctc

SEQ ID NO: 474064 - DNA, 25 bp, Rattus norvegicus
ggtttgttctcgatttatgttcttg

SEQ ID NO: 474065 - DNA, 25 bp, Rattus norvegicus
ggtttgttctcgttttatgttcttg

SEQ ID NO: 474066 - DNA, 25 bp, Rattus norvegicus
ggtttgttctgaattctgtactata

SEQ ID NO: 474067 - DNA, 25 bp, Rattus norvegicus
ggtttgttctgatttctgtactata

SEQ ID NO: 474068 - DNA, 25 bp, Rattus norvegicus
ggtttgttcttcaaggtgtagcttt

SEQ ID NO: 474069 - DNA, 25 bp, Rattus norvegicus
ggtttgttcttctaggtgtagcttt

SEQ ID NO: 474070 - DNA, 25 bp, Rattus norvegicus
ggtttgttgtgccagatatttccat

SEQ ID NO: 474071 - DNA, 25 bp, Rattus norvegicus
ggtttgttgtgcgagatatttccat

SEQ ID NO: 474072 - DNA, 25 bp, Rattus norvegicus
ggtttgttgttgcacaagcgcctcc

SEQ ID NO: 474073 - DNA, 25 bp, Rattus norvegicus
ggtttgttgttggacaagcgcctcc

SEQ ID NO: 474074 - DNA, 25 bp, Rattus norvegicus
ggtttgtttaacataactgcattgt

SEQ ID NO: 474075 - DNA, 25 bp, Rattus norvegicus
ggtttgtttaacttaactgcattgt

SEQ ID NO: 474076 - DNA, 25 bp, Rattus norvegicus
ggtttgtttactaggattggctcca

SEQ ID NO: 474077 - DNA, 25 bp, Rattus norvegicus
ggtttgtttacttggattggctcca

SEQ ID NO: 474078 - DNA, 25 bp, Rattus norvegicus
ggtttgtttgcccactggattacat

SEQ ID NO: 474079 - DNA, 25 bp, Rattus norvegicus
ggtttgtttgccgactggattacat

SEQ ID NO: 474080 - DNA, 25 bp, Rattus norvegicus
ggtttgttttccaagtcattcttct

SEQ ID NO: 474081 - DNA, 25 bp, Rattus norvegicus
ggtttgttttcctagtcattcttct

SEQ ID NO: 474082 - DNA, 25 bp, Rattus norvegicus
ggttttaaaatcattcagaggcagt

SEQ ID NO: 474083 - DNA, 25 bp, Rattus norvegicus
ggttttaaaatctttcagaggcagt

SEQ ID NO: 474084 - DNA, 25 bp, Rattus norvegicus
ggttttaacacaccctgtttccagc

SEQ ID NO: 474085 - DNA, 25 bp, Rattus norvegicus
ggttttaacacagcctgtttccagc

SEQ ID NO: 474086 - DNA, 25 bp, Rattus norvegicus
ggttttaacagtatcccggatgcct

SEQ ID NO: 474087 - DNA, 25 bp, Rattus norvegicus
ggttttaacagtttcccggatgcct

SEQ ID NO: 474088 - DNA, 25 bp, Rattus norvegicus
ggttttaaccgcaacctgcagagtc

SEQ ID NO: 474089 - DNA, 25 bp, Rattus norvegicus
ggttttaaccgctacctgcagagtc

SEQ ID NO: 474090 - DNA, 25 bp, Rattus norvegicus
ggttttaactctaagccatggtgtt

SEQ ID NO: 474091 - DNA, 25 bp, Rattus norvegicus
ggttttaactcttagccatggtgtt

SEQ ID NO: 474092 - DNA, 25 bp, Rattus norvegicus
ggttttaagatcagagccctgtcct

SEQ ID NO: 474093 - DNA, 25 bp, Rattus norvegicus
ggttttaagatctgagccctgtcct

SEQ ID NO: 474094 - DNA, 25 bp, Rattus norvegicus
ggttttaagcaaccatcccagggat

SEQ ID NO: 474095 - DNA, 25 bp, Rattus norvegicus
ggttttaagcaagcatcccagggat

SEQ ID NO: 474096 - DNA, 25 bp, Rattus norvegicus
ggttttaatattctgccagggatgg

SEQ ID NO: 474097 - DNA, 25 bp, Rattus norvegicus
ggttttaatattgtgccagggatgg

SEQ ID NO: 474098 - DNA, 25 bp, Rattus norvegicus
ggttttaatcctacacctcaacaca

SEQ ID NO: 474099 - DNA, 25 bp, Rattus norvegicus
ggttttaatccttcacctcaacaca

SEQ ID NO: 474100 - DNA, 25 bp, Rattus norvegicus
ggttttaattccagcccataagtca

SEQ ID NO: 474101 - DNA, 25 bp, Rattus norvegicus
ggttttaattcctgcccataagtca

SEQ ID NO: 474102 - DNA, 25 bp, Rattus norvegicus
ggttttaatttcacaatcatttctg

SEQ ID NO: 474103 - DNA, 25 bp, Rattus norvegicus
ggttttaatttctcaatcatttctg

SEQ ID NO: 474104 - DNA, 25 bp, Rattus norvegicus
ggttttaccaccctcacactgaagg

SEQ ID NO: 474105 - DNA, 25 bp, Rattus norvegicus
ggttttaccaccgtcacactgaagg

SEQ ID NO: 474106 - DNA, 25 bp, Rattus norvegicus
ggttttactataaactgtgcttctc

SEQ ID NO: 474107 - DNA, 25 bp, Rattus norvegicus
ggttttactatatactgtgcttctc

SEQ ID NO: 474108 - DNA, 25 bp, Rattus norvegicus
ggttttactttgagcctattccacg

SEQ ID NO: 474109 - DNA, 25 bp, Rattus norvegicus
ggttttactttgtgcctattccacg

SEQ ID NO: 474110 - DNA, 25 bp, Rattus norvegicus
ggttttagatagatgctggtgccca

SEQ ID NO: 474111 - DNA, 25 bp, Rattus norvegicus
ggttttagatagttgctggtgccca

SEQ ID NO: 474112 - DNA, 25 bp, Rattus norvegicus
ggttttagcctgaaccagaactgta

SEQ ID NO: 474113 - DNA, 25 bp, Rattus norvegicus
ggttttagcctgtaccagaactgta

SEQ ID NO: 474114 - DNA, 25 bp, Rattus norvegicus
ggttttataaaccacatgagcctat

SEQ ID NO: 474115 - DNA, 25 bp, Rattus norvegicus
ggttttataaacgacatgagcctat

SEQ ID NO: 474116 - DNA, 25 bp, Rattus norvegicus
ggttttatacacaccagttccccag

SEQ ID NO: 474117 - DNA, 25 bp, Rattus norvegicus
ggttttatacactccagttccccag

SEQ ID NO: 474118 - DNA, 25 bp, Rattus norvegicus
ggttttatatctctatcttttcatc

SEQ ID NO: 474119 - DNA, 25 bp, Rattus norvegicus
ggttttatatctgtatcttttcatc

SEQ ID NO: 474120 - DNA, 25 bp, Rattus norvegicus
ggttttatcattaccgattgttcca

SEQ ID NO: 474121 - DNA, 25 bp, Rattus norvegicus
ggttttatcatttccgattgttcca

SEQ ID NO: 474122 - DNA, 25 bp, Rattus norvegicus
ggttttatgatcaaatggcccagca

SEQ ID NO: 474123 - DNA, 25 bp, Rattus norvegicus
ggttttatgatctaatggcccagca

SEQ ID NO: 474124 - DNA, 25 bp, Rattus norvegicus
ggttttatgttaacattcatgccac

SEQ ID NO: 474125 - DNA, 25 bp, Rattus norvegicus
ggttttatgttatcattcatgccac

SEQ ID NO: 474126 - DNA, 25 bp, Rattus norvegicus
ggttttattgcccaagctcagaact

SEQ ID NO: 474127 - DNA, 25 bp, Rattus norvegicus
ggttttattgccgaagctcagaact

SEQ ID NO: 474128 - DNA, 25 bp, Rattus norvegicus
ggttttatttgtagcatactttgac

SEQ ID NO: 474129 - DNA, 25 bp, Rattus norvegicus
ggttttatttgttgcatactttgac

SEQ ID NO: 474130 - DNA, 25 bp, Rattus norvegicus
ggttttcaaaacactgggcacagat

SEQ ID NO: 474131 - DNA, 25 bp, Rattus norvegicus
ggttttcaaaactctgggcacagat

SEQ ID NO: 474132 - DNA, 25 bp, Rattus norvegicus
ggttttcaactcactttggttcagg

SEQ ID NO: 474133 - DNA, 25 bp, Rattus norvegicus
ggttttcaactctctttggttcagg

SEQ ID NO: 474134 - DNA, 25 bp, Rattus norvegicus
ggttttcaagacaccatgtccacca

SEQ ID NO: 474135 - DNA, 25 bp, Rattus norvegicus
ggttttcaagactccatgtccacca

SEQ ID NO: 474136 - DNA, 25 bp, Rattus norvegicus
ggttttcaatatccacgagctgggt

SEQ ID NO: 474137 - DNA, 25 bp, Rattus norvegicus
ggttttcaatatgcacgagctgggt

SEQ ID NO: 474138 - DNA, 25 bp, Rattus norvegicus
ggttttcacagcaacttgaagttct

SEQ ID NO: 474139 - DNA, 25 bp, Rattus norvegicus
ggttttcacagccttatctaagaca

SEQ ID NO: 474140 - DNA, 25 bp, Rattus norvegicus
ggttttcacagcgttatctaagaca

SEQ ID NO: 474141 - DNA, 25 bp, Rattus norvegicus
ggttttcacagctacttgaagttct

SEQ ID NO: 474142 - DNA, 25 bp, Rattus norvegicus
ggttttcacatgatcattctccaca

SEQ ID NO: 474143 - DNA, 25 bp, Rattus norvegicus
ggttttcacatgttcattctccaca

SEQ ID NO: 474144 - DNA, 25 bp, Rattus norvegicus
ggttttcaccctcaaactcacatgg

SEQ ID NO: 474145 - DNA, 25 bp, Rattus norvegicus
ggttttcaccctgaaactcacatgg

SEQ ID NO: 474146 - DNA, 25 bp, Rattus norvegicus
ggttttcactaactcattcattcat

SEQ ID NO: 474147 - DNA, 25 bp, Rattus norvegicus
ggttttcactaagtcattcattcat

SEQ ID NO: 474148 - DNA, 25 bp, Rattus norvegicus
ggttttcactggcatcggccggcca

SEQ ID NO: 474149 - DNA, 25 bp, Rattus norvegicus
ggttttcactggctaccaagagatg

SEQ ID NO: 474150 - DNA, 25 bp, Rattus norvegicus
ggttttcactgggatcggccggcca

SEQ ID NO: 474151 - DNA, 25 bp, Rattus norvegicus
ggttttcactgggtaccaagagatg

SEQ ID NO: 474152 - DNA, 25 bp, Rattus norvegicus
ggttttcagccaaagatgttctgga

SEQ ID NO: 474153 - DNA, 25 bp, Rattus norvegicus
ggttttcagccatagatgttctgga

SEQ ID NO: 474154 - DNA, 25 bp, Rattus norvegicus
ggttttcagctactccagtaactga

SEQ ID NO: 474155 - DNA, 25 bp, Rattus norvegicus
ggttttcagctagtccagtaactga

SEQ ID NO: 474156 - DNA, 25 bp, Rattus norvegicus
ggttttcagggtaacttctctgtct

SEQ ID NO: 474157 - DNA, 25 bp, Rattus norvegicus
ggttttcagggttacttctctgtct

SEQ ID NO: 474158 - DNA, 25 bp, Rattus norvegicus
ggttttcagtctatccatctctttc

SEQ ID NO: 474159 - DNA, 25 bp, Rattus norvegicus
ggttttcagtctttccatctctttc

SEQ ID NO: 474160 - DNA, 25 bp, Rattus norvegicus
ggttttcagttactgtttgcctcta

SEQ ID NO: 474161 - DNA, 25 bp, Rattus norvegicus
ggttttcagttagtgtttgcctcta

SEQ ID NO: 474162 - DNA, 25 bp, Rattus norvegicus
ggttttcatcctcgtgtgcatttta

SEQ ID NO: 474163 - DNA, 25 bp, Rattus norvegicus
ggttttcatcctggtgtgcatttta

SEQ ID NO: 474164 - DNA, 25 bp, Rattus norvegicus
ggttttcattgcaagcagcaggtat

SEQ ID NO: 474165 - DNA, 25 bp, Rattus norvegicus
ggttttcattgctagcagcaggtat

SEQ ID NO: 474166 - DNA, 25 bp, Rattus norvegicus
ggttttccagaccaagatccaggag

SEQ ID NO: 474167 - DNA, 25 bp, Rattus norvegicus
ggttttccagacgaagatccaggag

SEQ ID NO: 474168 - DNA, 25 bp, Rattus norvegicus
ggttttcccaaacacaaggcagctt

SEQ ID NO: 474169 - DNA, 25 bp, Rattus norvegicus
ggttttcccaaagacaaggcagctt

SEQ ID NO: 474170 - DNA, 25 bp, Rattus norvegicus
ggttttcccaagagtgctttcgcaa

SEQ ID NO: 474171 - DNA, 25 bp, Rattus norvegicus
ggttttcccaagtgtgctttcgcaa

SEQ ID NO: 474172 - DNA, 25 bp, Rattus norvegicus
ggttttccgaaaatctctgtatcta

SEQ ID NO: 474173 - DNA, 25 bp, Rattus norvegicus
ggttttccgaaattctctgtatcta

SEQ ID NO: 474174 - DNA, 25 bp, Rattus norvegicus
ggttttccggcaactgcaatagctc

SEQ ID NO: 474175 - DNA, 25 bp, Rattus norvegicus
ggttttccggcatctgcaatagctc

SEQ ID NO: 474176 - DNA, 25 bp, Rattus norvegicus
ggttttcctagcaacgtctgggact

SEQ ID NO: 474177 - DNA, 25 bp, Rattus norvegicus
ggttttcctagctacgtctgggact

SEQ ID NO: 474178 - DNA, 25 bp, Rattus norvegicus
ggttttcctcacatgggaagcaaaa

SEQ ID NO: 474179 - DNA, 25 bp, Rattus norvegicus
ggttttcctcacttgggaagcaaaa

SEQ ID NO: 474180 - DNA, 25 bp, Rattus norvegicus
ggttttcctgaaagtgtctgggcaa

SEQ ID NO: 474181 - DNA, 25 bp, Rattus norvegicus
ggttttcctgaaatgagtcctcctg

SEQ ID NO: 474182 - DNA, 25 bp, Rattus norvegicus
ggttttcctgaatgtgtctgggcaa

SEQ ID NO: 474183 - DNA, 25 bp, Rattus norvegicus
ggttttcctgaattgagtcctcctg

SEQ ID NO: 474184 - DNA, 25 bp, Rattus norvegicus
ggttttcctgtcactcctcgagaga

SEQ ID NO: 474185 - DNA, 25 bp, Rattus norvegicus
ggttttcctgtctctcctcgagaga

SEQ ID NO: 474186 - DNA, 25 bp, Rattus norvegicus
ggttttccttgccaaatatgggaga

SEQ ID NO: 474187 - DNA, 25 bp, Rattus norvegicus
ggttttccttgcgaaatatgggaga

SEQ ID NO: 474188 - DNA, 25 bp, Rattus norvegicus
ggttttccttggagtggaaccatca

SEQ ID NO: 474189 - DNA, 25 bp, Rattus norvegicus
ggttttccttggtgtggaaccatca

SEQ ID NO: 474190 - DNA, 25 bp, Rattus norvegicus
ggttttcctttaactgacaagccat

SEQ ID NO: 474191 - DNA, 25 bp, Rattus norvegicus
ggttttcctttatctgacaagccat

SEQ ID NO: 474192 - DNA, 25 bp, Rattus norvegicus
ggttttcgagatactggccacagta

SEQ ID NO: 474193 - DNA, 25 bp, Rattus norvegicus
ggttttcgagattctggccacagta

SEQ ID NO: 474194 - DNA, 25 bp, Rattus norvegicus
ggttttctaacaagcattctactcc

SEQ ID NO: 474195 - DNA, 25 bp, Rattus norvegicus
ggttttctaacatgcattctactcc

SEQ ID NO: 474196 - DNA, 25 bp, Rattus norvegicus
ggttttctaaccattgtcttgttct

SEQ ID NO: 474197 - DNA, 25 bp, Rattus norvegicus
ggttttctaacctttgtcttgttct

SEQ ID NO: 474198 - DNA, 25 bp, Rattus norvegicus
ggttttctagtcaattgggcgacgt

SEQ ID NO: 474199 - DNA, 25 bp, Rattus norvegicus
ggttttctagtctattgggcgacgt

SEQ ID NO: 474200 - DNA, 25 bp, Rattus norvegicus
ggttttctagttcttcaatctgctg

SEQ ID NO: 474201 - DNA, 25 bp, Rattus norvegicus
ggttttctagttgttcaatctgctg

SEQ ID NO: 474202 - DNA, 25 bp, Rattus norvegicus
ggttttctcacgcatagccagggca

SEQ ID NO: 474203 - DNA, 25 bp, Rattus norvegicus
ggttttctcacggatagccagggca

SEQ ID NO: 474204 - DNA, 25 bp, Rattus norvegicus
ggttttctcattcatctttgtggtg

SEQ ID NO: 474205 - DNA, 25 bp, Rattus norvegicus
ggttttctcattgatctttgtggtg

SEQ ID NO: 474206 - DNA, 25 bp, Rattus norvegicus
ggttttctctctctccaaatataaa

SEQ ID NO: 474207 - DNA, 25 bp, Rattus norvegicus
ggttttctctctcttaaagctaaag

SEQ ID NO: 474208 - DNA, 25 bp, Rattus norvegicus
ggttttctctctgtccaaatataaa

SEQ ID NO: 474209 - DNA, 25 bp, Rattus norvegicus
ggttttctctctgttaaagctaaag

SEQ ID NO: 474210 - DNA, 25 bp, Rattus norvegicus
ggttttctctttacatttatggcta

SEQ ID NO: 474211 - DNA, 25 bp, Rattus norvegicus
ggttttctcttttcatttatggcta

SEQ ID NO: 474212 - DNA, 25 bp, Rattus norvegicus
ggttttctgaaactgacactccgaa

SEQ ID NO: 474213 - DNA, 25 bp, Rattus norvegicus
ggttttctgaaagtgacactccgaa

SEQ ID NO: 474214 - DNA, 25 bp, Rattus norvegicus
ggttttctgagcctccctatgtagc

SEQ ID NO: 474215 - DNA, 25 bp, Rattus norvegicus
ggttttctgagcgtccctatgtagc

SEQ ID NO: 474216 - DNA, 25 bp, Rattus norvegicus
ggttttctgcttcggacctggaaat

SEQ ID NO: 474217 - DNA, 25 bp, Rattus norvegicus
ggttttctgcttgggacctggaaat

SEQ ID NO: 474218 - DNA, 25 bp, Rattus norvegicus
ggttttctggtaatggattcacaca

SEQ ID NO: 474219 - DNA, 25 bp, Rattus norvegicus
ggttttctggtattggattcacaca

SEQ ID NO: 474220 - DNA, 25 bp, Rattus norvegicus
ggttttctgttgctcattattatgt

SEQ ID NO: 474221 - DNA, 25 bp, Rattus norvegicus
ggttttctgttggtcattattatgt

SEQ ID NO: 474222 - DNA, 25 bp, Rattus norvegicus
ggttttcttattcaattactccatc

SEQ ID NO: 474223 - DNA, 25 bp, Rattus norvegicus
ggttttcttattgaattactccatc

SEQ ID NO: 474224 - DNA, 25 bp, Rattus norvegicus
ggttttcttcagctgaatgtttagt

SEQ ID NO: 474225 - DNA, 25 bp, Rattus norvegicus
ggttttcttcaggtgaatgtttagt

SEQ ID NO: 474226 - DNA, 25 bp, Rattus norvegicus
ggttttcttcctcaagagaccaatg

SEQ ID NO: 474227 - DNA, 25 bp, Rattus norvegicus
ggttttcttcctgaagagaccaatg

SEQ ID NO: 474228 - DNA, 25 bp, Rattus norvegicus
ggttttcttgcccaaacacacaact

SEQ ID NO: 474229 - DNA, 25 bp, Rattus norvegicus
ggttttcttgccgaaacacacaact

SEQ ID NO: 474230 - DNA, 25 bp, Rattus norvegicus
ggttttcttgtgatgggagcagcct

SEQ ID NO: 474231 - DNA, 25 bp, Rattus norvegicus
ggttttcttgtgttgggagcagcct

SEQ ID NO: 474232 - DNA, 25 bp, Rattus norvegicus
ggttttctttcacatgggacttcac

SEQ ID NO: 474233 - DNA, 25 bp, Rattus norvegicus
ggttttctttcagatgggacttcac

SEQ ID NO: 474234 - DNA, 25 bp, Rattus norvegicus
ggttttgaaactacactgctgccca

SEQ ID NO: 474235 - DNA, 25 bp, Rattus norvegicus
ggttttgaaacttcactgctgccca

SEQ ID NO: 474236 - DNA, 25 bp, Rattus norvegicus
ggttttgaactcaagggcactcagc

SEQ ID NO: 474237 - DNA, 25 bp, Rattus norvegicus
ggttttgaactctagggcactcagc

SEQ ID NO: 474238 - DNA, 25 bp, Rattus norvegicus
ggttttgaagtcactgcagcagcct

SEQ ID NO: 474239 - DNA, 25 bp, Rattus norvegicus
ggttttgaagtctctgcagcagcct

SEQ ID NO: 474240 - DNA, 25 bp, Rattus norvegicus
ggttttgaatggctgatgctgccat

SEQ ID NO: 474241 - DNA, 25 bp, Rattus norvegicus
ggttttgaatgggtgatgctgccat

SEQ ID NO: 474242 - DNA, 25 bp, Rattus norvegicus
ggttttgaattcatgttctcccatt

SEQ ID NO: 474243 - DNA, 25 bp, Rattus norvegicus
ggttttgaattcttgttctcccatt

SEQ ID NO: 474244 - DNA, 25 bp, Rattus norvegicus
ggttttgaccagaccattaacttga

SEQ ID NO: 474245 - DNA, 25 bp, Rattus norvegicus
ggttttgaccagtccattaacttga

SEQ ID NO: 474246 - DNA, 25 bp, Rattus norvegicus
ggttttgactacatgttctgtatcc

SEQ ID NO: 474247 - DNA, 25 bp, Rattus norvegicus
ggttttgactacttgttctgtatcc

SEQ ID NO: 474248 - DNA, 25 bp, Rattus norvegicus
ggttttgagcgaccactactgaaca

SEQ ID NO: 474249 - DNA, 25 bp, Rattus norvegicus
ggttttgagcgagcactactgaaca

SEQ ID NO: 474250 - DNA, 25 bp, Rattus norvegicus
ggttttgatagcagatctgaatact

SEQ ID NO: 474251 - DNA, 25 bp, Rattus norvegicus
ggttttgatagctgatctgaatact

SEQ ID NO: 474252 - DNA, 25 bp, Rattus norvegicus
ggttttgatagtcactgttttagca

SEQ ID NO: 474253 - DNA, 25 bp, Rattus norvegicus
ggttttgatagtgactgttttagca

SEQ ID NO: 474254 - DNA, 25 bp, Rattus norvegicus
ggttttgatggcagtcatgcctata

SEQ ID NO: 474255 - DNA, 25 bp, Rattus norvegicus
ggttttgatggctgtcatgcctata

SEQ ID NO: 474256 - DNA, 25 bp, Rattus norvegicus
ggttttgatgtacccaagacttaag

SEQ ID NO: 474257 - DNA, 25 bp, Rattus norvegicus
ggttttgatgtagccaagacttaag

SEQ ID NO: 474258 - DNA, 25 bp, Rattus norvegicus
ggttttgattctaagagccacacgt

SEQ ID NO: 474259 - DNA, 25 bp, Rattus norvegicus
ggttttgattcttagagccacacgt

SEQ ID NO: 474260 - DNA, 25 bp, Rattus norvegicus
ggttttgatttgacactaggcctgt

SEQ ID NO: 474261 - DNA, 25 bp, Rattus norvegicus
ggttttgatttgtcactaggcctgt

SEQ ID NO: 474262 - DNA, 25 bp, Rattus norvegicus
ggttttgattttcacagctgagcaa

SEQ ID NO: 474263 - DNA, 25 bp, Rattus norvegicus
ggttttgattttgacagctgagcaa

SEQ ID NO: 474264 - DNA, 25 bp, Rattus norvegicus
ggttttgcaacaacactgctgtgat

SEQ ID NO: 474265 - DNA, 25 bp, Rattus norvegicus
ggttttgcaacacaacgtgcttggg

SEQ ID NO: 474266 - DNA, 25 bp, Rattus norvegicus
ggttttgcaacagaacgtgcttggg

SEQ ID NO: 474267 - DNA, 25 bp, Rattus norvegicus
ggttttgcaacatcactgctgtgat

SEQ ID NO: 474268 - DNA, 25 bp, Rattus norvegicus
ggttttgcaaccagagacagaagca

SEQ ID NO: 474269 - DNA, 25 bp, Rattus norvegicus
ggttttgcaacctgagacagaagca

SEQ ID NO: 474270 - DNA, 25 bp, Rattus norvegicus
ggttttgcacctagaagatccctct

SEQ ID NO: 474271 - DNA, 25 bp, Rattus norvegicus
ggttttgcaccttgaagatccctct

SEQ ID NO: 474272 - DNA, 25 bp, Rattus norvegicus
ggttttgcatagaaaggagcctatt

SEQ ID NO: 474273 - DNA, 25 bp, Rattus norvegicus
ggttttgcatagtaaggagcctatt

SEQ ID NO: 474274 - DNA, 25 bp, Rattus norvegicus
ggttttgcatgtctcatcgatggta

SEQ ID NO: 474275 - DNA, 25 bp, Rattus norvegicus
ggttttgcatgtgtcatcgatggta

SEQ ID NO: 474276 - DNA, 25 bp, Rattus norvegicus
ggttttgcattaattccatctcccc

SEQ ID NO: 474277 - DNA, 25 bp, Rattus norvegicus
ggttttgcattatttccatctcccc

SEQ ID NO: 474278 - DNA, 25 bp, Rattus norvegicus
ggttttgccacactgtagaacgtat

SEQ ID NO: 474279 - DNA, 25 bp, Rattus norvegicus
ggttttgccacagtgtagaacgtat

SEQ ID NO: 474280 - DNA, 25 bp, Rattus norvegicus
ggttttgccaggcactggaacctaa

SEQ ID NO: 474281 - DNA, 25 bp, Rattus norvegicus
ggttttgccaggctttggtctaagt

SEQ ID NO: 474282 - DNA, 25 bp, Rattus norvegicus
ggttttgccagggactggaacctaa

SEQ ID NO: 474283 - DNA, 25 bp, Rattus norvegicus
ggttttgccagggtttggtctaagt

SEQ ID NO: 474284 - DNA, 25 bp, Rattus norvegicus
ggttttgcccaaacatcacaattga

SEQ ID NO: 474285 - DNA, 25 bp, Rattus norvegicus
ggttttgcccaatcatcacaattga

SEQ ID NO: 474286 - DNA, 25 bp, Rattus norvegicus
ggttttgccgtcaaagaatgtcttg

SEQ ID NO: 474287 - DNA, 25 bp, Rattus norvegicus
ggttttgccgtctaagaatgtcttg

SEQ ID NO: 474288 - DNA, 25 bp, Rattus norvegicus
ggttttgctaccataccaggagaat

SEQ ID NO: 474289 - DNA, 25 bp, Rattus norvegicus
ggttttgctaccttaccaggagaat

SEQ ID NO: 474290 - DNA, 25 bp, Rattus norvegicus
ggttttgctcacattgatttttgtt

SEQ ID NO: 474291 - DNA, 25 bp, Rattus norvegicus
ggttttgctcactttgatttttgtt

SEQ ID NO: 474292 - DNA, 25 bp, Rattus norvegicus
ggttttgctctgattcttgccaaaa

SEQ ID NO: 474293 - DNA, 25 bp, Rattus norvegicus
ggttttgctctgtttcttgccaaaa

SEQ ID NO: 474294 - DNA, 25 bp, Rattus norvegicus
ggttttggttagattcacagtgcac

SEQ ID NO: 474295 - DNA, 25 bp, Rattus norvegicus
ggttttggttagtttcacagtgcac

SEQ ID NO: 474296 - DNA, 25 bp, Rattus norvegicus
ggttttgtaatcagaagcgtgccta

SEQ ID NO: 474297 - DNA, 25 bp, Rattus norvegicus
ggttttgtaatctgaagcgtgccta

SEQ ID NO: 474298 - DNA, 25 bp, Rattus norvegicus
ggttttgtagcaagtctgaccctaa

SEQ ID NO: 474299 - DNA, 25 bp, Rattus norvegicus
ggttttgtagcatgtctgaccctaa

SEQ ID NO: 474300 - DNA, 25 bp, Rattus norvegicus
ggttttgtatctaggctaccttaga

SEQ ID NO: 474301 - DNA, 25 bp, Rattus norvegicus
ggttttgtatcttggctaccttaga

SEQ ID NO: 474302 - DNA, 25 bp, Rattus norvegicus
ggttttgtccaaagagcctatgagt

SEQ ID NO: 474303 - DNA, 25 bp, Rattus norvegicus
ggttttgtccaatgagcctatgagt

SEQ ID NO: 474304 - DNA, 25 bp, Rattus norvegicus
ggttttgtccccataactgcaatag

SEQ ID NO: 474305 - DNA, 25 bp, Rattus norvegicus
ggttttgtccccatttttgcattgg

SEQ ID NO: 474306 - DNA, 25 bp, Rattus norvegicus
ggttttgtccccttaactgcaatag

SEQ ID NO: 474307 - DNA, 25 bp, Rattus norvegicus
ggttttgtccccttttttgcattgg

SEQ ID NO: 474308 - DNA, 25 bp, Rattus norvegicus
ggttttgtgcctaaacagactctag

SEQ ID NO: 474309 - DNA, 25 bp, Rattus norvegicus
ggttttgtgccttaacagactctag

SEQ ID NO: 474310 - DNA, 25 bp, Rattus norvegicus
ggttttgtgcggaactcacctgcca

SEQ ID NO: 474311 - DNA, 25 bp, Rattus norvegicus
ggttttgtgcggtactcacctgcca

SEQ ID NO: 474312 - DNA, 25 bp, Rattus norvegicus
ggttttgtgcttctttcaatattgg

SEQ ID NO: 474313 - DNA, 25 bp, Rattus norvegicus
ggttttgtgcttgtttcaatattgg

SEQ ID NO: 474314 - DNA, 25 bp, Rattus norvegicus
ggttttgtgtgcatgtcttttatat

SEQ ID NO: 474315 - DNA, 25 bp, Rattus norvegicus
ggttttgtgtgcttgtcttttatat

SEQ ID NO: 474316 - DNA, 25 bp, Rattus norvegicus
ggttttgtgttcagatcattgcttc

SEQ ID NO: 474317 - DNA, 25 bp, Rattus norvegicus
ggttttgtgttctgatcattgcttc

SEQ ID NO: 474318 - DNA, 25 bp, Rattus norvegicus
ggttttgttacaataagttgactat

SEQ ID NO: 474319 - DNA, 25 bp, Rattus norvegicus
ggttttgttacaattccacacacct

SEQ ID NO: 474320 - DNA, 25 bp, Rattus norvegicus
ggttttgttacattaagttgactat

SEQ ID NO: 474321 - DNA, 25 bp, Rattus norvegicus
ggttttgttacatttccacacacct

SEQ ID NO: 474322 - DNA, 25 bp, Rattus norvegicus
ggttttgttactccatctagtatac

SEQ ID NO: 474323 - DNA, 25 bp, Rattus norvegicus
ggttttgttactgcatctagtatac

SEQ ID NO: 474324 - DNA, 25 bp, Rattus norvegicus
ggttttgttcctcggcacaggacgt

SEQ ID NO: 474325 - DNA, 25 bp, Rattus norvegicus
ggttttgttcctgggcacaggacgt

SEQ ID NO: 474326 - DNA, 25 bp, Rattus norvegicus
ggttttgttctcctatattgtctac

SEQ ID NO: 474327 - DNA, 25 bp, Rattus norvegicus
ggttttgttctcgtatattgtctac

SEQ ID NO: 474328 - DNA, 25 bp, Rattus norvegicus
ggttttgttgtaattgttggcacat

SEQ ID NO: 474329 - DNA, 25 bp, Rattus norvegicus
ggttttgttgtatttgttggcacat

SEQ ID NO: 474330 - DNA, 25 bp, Rattus norvegicus
ggttttgttgttcggtctcttatat

SEQ ID NO: 474331 - DNA, 25 bp, Rattus norvegicus
ggttttgttgttgggtctcttatat

SEQ ID NO: 474332 - DNA, 25 bp, Rattus norvegicus
ggttttgtttctagaagcactggca

SEQ ID NO: 474333 - DNA, 25 bp, Rattus norvegicus
ggttttgtttcttgaagcactggca

SEQ ID NO: 474334 - DNA, 25 bp, Rattus norvegicus
ggttttgtttgcaatcttaattttg

SEQ ID NO: 474335 - DNA, 25 bp, Rattus norvegicus
ggttttgtttgctatcttaattttg

SEQ ID NO: 474336 - DNA, 25 bp, Rattus norvegicus
ggttttgttttgctacgagtccaca

SEQ ID NO: 474337 - DNA, 25 bp, Rattus norvegicus
ggttttgttttggtacgagtccaca

SEQ ID NO: 474338 - DNA, 25 bp, Rattus norvegicus
ggtttttaactgaggcttcaccgct

SEQ ID NO: 474339 - DNA, 25 bp, Rattus norvegicus
ggtttttaactgtggcttcaccgct

SEQ ID NO: 474340 - DNA, 25 bp, Rattus norvegicus
ggtttttacattcaagttcgtcata

SEQ ID NO: 474341 - DNA, 25 bp, Rattus norvegicus
ggtttttacattgaagttcgtcata

SEQ ID NO: 474342 - DNA, 25 bp, Rattus norvegicus
ggtttttatcatccacattctttga

SEQ ID NO: 474343 - DNA, 25 bp, Rattus norvegicus
ggtttttatcatgcacattctttga

SEQ ID NO: 474344 - DNA, 25 bp, Rattus norvegicus
ggtttttatgagctggcccttaact

SEQ ID NO: 474345 - DNA, 25 bp, Rattus norvegicus
ggtttttatgaggtggcccttaact

SEQ ID NO: 474346 - DNA, 25 bp, Rattus norvegicus
ggtttttatgctctgttacctgtaa

SEQ ID NO: 474347 - DNA, 25 bp, Rattus norvegicus
ggtttttatgctgtgttacctgtaa

SEQ ID NO: 474348 - DNA, 25 bp, Rattus norvegicus
ggtttttatggaccaatgccccagt

SEQ ID NO: 474349 - DNA, 25 bp, Rattus norvegicus
ggtttttatggagcaatgccccagt

SEQ ID NO: 474350 - DNA, 25 bp, Rattus norvegicus
ggtttttcagaccttcaagctgcaa

SEQ ID NO: 474351 - DNA, 25 bp, Rattus norvegicus
ggtttttcagacgttcaagctgcaa

SEQ ID NO: 474352 - DNA, 25 bp, Rattus norvegicus
ggtttttcatccacagtgatggcat

SEQ ID NO: 474353 - DNA, 25 bp, Rattus norvegicus
ggtttttcatcctcagtgatggcat

SEQ ID NO: 474354 - DNA, 25 bp, Rattus norvegicus
ggtttttcatttcgtgcactaactg

SEQ ID NO: 474355 - DNA, 25 bp, Rattus norvegicus
ggtttttcatttggtgcactaactg

SEQ ID NO: 474356 - DNA, 25 bp, Rattus norvegicus
ggtttttccagtagattggcagcta

SEQ ID NO: 474357 - DNA, 25 bp, Rattus norvegicus
ggtttttccagttgattggcagcta

SEQ ID NO: 474358 - DNA, 25 bp, Rattus norvegicus
ggtttttcccagcttgccaaacaat

SEQ ID NO: 474359 - DNA, 25 bp, Rattus norvegicus
ggtttttcccaggttgccaaacaat

SEQ ID NO: 474360 - DNA, 25 bp, Rattus norvegicus
ggtttttcctgaagatgctggtgca

SEQ ID NO: 474361 - DNA, 25 bp, Rattus norvegicus
ggtttttcctgatgatgctggtgca

SEQ ID NO: 474362 - DNA, 25 bp, Rattus norvegicus
ggtttttccttcaattggttgcatc

SEQ ID NO: 474363 - DNA, 25 bp, Rattus norvegicus
ggtttttccttctattggttgcatc

SEQ ID NO: 474364 - DNA, 25 bp, Rattus norvegicus
ggtttttcgagtctacaccagcaat

SEQ ID NO: 474365 - DNA, 25 bp, Rattus norvegicus
ggtttttcgagtgtacaccagcaat

SEQ ID NO: 474366 - DNA, 25 bp, Rattus norvegicus
ggtttttctactcaatccagggtat

SEQ ID NO: 474367 - DNA, 25 bp, Rattus norvegicus
ggtttttctactgaatccagggtat

SEQ ID NO: 474368 - DNA, 25 bp, Rattus norvegicus
ggtttttctagtccctgtggagtta

SEQ ID NO: 474369 - DNA, 25 bp, Rattus norvegicus
ggtttttctagtgcctgtggagtta

SEQ ID NO: 474370 - DNA, 25 bp, Rattus norvegicus
ggtttttctatcatgttatctgcaa

SEQ ID NO: 474371 - DNA, 25 bp, Rattus norvegicus
ggtttttctatcttgttatctgcaa

SEQ ID NO: 474372 - DNA, 25 bp, Rattus norvegicus
ggtttttcttagagccctgagcaaa

SEQ ID NO: 474373 - DNA, 25 bp, Rattus norvegicus
ggtttttcttagtgccctgagcaaa

SEQ ID NO: 474374 - DNA, 25 bp, Rattus norvegicus
ggtttttcttcaagcaaatgccttt

SEQ ID NO: 474375 - DNA, 25 bp, Rattus norvegicus
ggtttttcttcatgcaaatgccttt

SEQ ID NO: 474376 - DNA, 25 bp, Rattus norvegicus
ggtttttcttgaagtcttgttctct

SEQ ID NO: 474377 - DNA, 25 bp, Rattus norvegicus
ggtttttcttgatgtcttgttctct

SEQ ID NO: 474378 - DNA, 25 bp, Rattus norvegicus
ggtttttctttcacagatgacttta

SEQ ID NO: 474379 - DNA, 25 bp, Rattus norvegicus
ggtttttctttctcagatgacttta

SEQ ID NO: 474380 - DNA, 25 bp, Rattus norvegicus
ggtttttgcctgatgtagtcatttc

SEQ ID NO: 474381 - DNA, 25 bp, Rattus norvegicus
ggtttttgcctgttgtagtcatttc

SEQ ID NO: 474382 - DNA, 25 bp, Rattus norvegicus
ggtttttggagtaccgaactcacag

SEQ ID NO: 474383 - DNA, 25 bp, Rattus norvegicus
ggtttttggagttccgaactcacag

SEQ ID NO: 474384 - DNA, 25 bp, Rattus norvegicus
ggtttttgtagaagccccatctgtt

SEQ ID NO: 474385 - DNA, 25 bp, Rattus norvegicus
ggtttttgtagatgccccatctgtt

SEQ ID NO: 474386 - DNA, 25 bp, Rattus norvegicus
ggtttttgtttgaggtcctgctact

SEQ ID NO: 474387 - DNA, 25 bp, Rattus norvegicus
ggtttttgtttgtggtcctgctact

SEQ ID NO: 474388 - DNA, 25 bp, Rattus norvegicus
ggttttttagctatccctatgttgg

SEQ ID NO: 474389 - DNA, 25 bp, Rattus norvegicus
ggttttttagctttccctatgttgg

SEQ ID NO: 474390 - DNA, 25 bp, Rattus norvegicus
ggttttttccagacatagcacccac

SEQ ID NO: 474391 - DNA, 25 bp, Rattus norvegicus
ggttttttccagtcatagcacccac

SEQ ID NO: 474392 - DNA, 25 bp, Rattus norvegicus
ggttttttgaagaccagcgccctct

SEQ ID NO: 474393 - DNA, 25 bp, Rattus norvegicus
ggttttttgaagtccagcgccctct

SEQ ID NO: 474394 - DNA, 25 bp, Rattus norvegicus
ggttttttgagcaccagctaactgt

SEQ ID NO: 474395 - DNA, 25 bp, Rattus norvegicus
ggttttttgagctccagctaactgt

SEQ ID NO: 474396 - DNA, 25 bp, Rattus norvegicus
ggttttttgatgatggccccgaaga

SEQ ID NO: 474397 - DNA, 25 bp, Rattus norvegicus
ggttttttgatgttggccccgaaga

SEQ ID NO: 474398 - DNA, 25 bp, Rattus norvegicus
gtaaaaacagtcctcttgggattgg

SEQ ID NO: 474399 - DNA, 25 bp, Rattus norvegicus
gtaaaaacagtcgtcttgggattgg

SEQ ID NO: 474400 - DNA, 25 bp, Rattus norvegicus
gtaaaaaccacacagcagcttccta

SEQ ID NO: 474401 - DNA, 25 bp, Rattus norvegicus
gtaaaaaccacagagcagcttccta

SEQ ID NO: 474402 - DNA, 25 bp, Rattus norvegicus
gtaaaaaccgccagggcgccagtgt

SEQ ID NO: 474403 - DNA, 25 bp, Rattus norvegicus
gtaaaaaccgcctgggcgccagtgt

SEQ ID NO: 474404 - DNA, 25 bp, Rattus norvegicus
gtaaaaacctgtattgctttgcatt

SEQ ID NO: 474405 - DNA, 25 bp, Rattus norvegicus
gtaaaaacctgttttgctttgcatt

SEQ ID NO: 474406 - DNA, 25 bp, Rattus norvegicus
gtaaaaactgctcatctgaccaaga

SEQ ID NO: 474407 - DNA, 25 bp, Rattus norvegicus
gtaaaaactgctgatctgaccaaga

SEQ ID NO: 474408 - DNA, 25 bp, Rattus norvegicus
gtaaaaactggcagctgctggatta

SEQ ID NO: 474409 - DNA, 25 bp, Rattus norvegicus
gtaaaaactggctgctgctggatta

SEQ ID NO: 474410 - DNA, 25 bp, Rattus norvegicus
gtaaaaagcctacgctcaagacttg

SEQ ID NO: 474411 - DNA, 25 bp, Rattus norvegicus
gtaaaaagcctaggctcaagacttg

SEQ ID NO: 474412 - DNA, 25 bp, Rattus norvegicus
gtaaaaaggtcacagggcctcagct

SEQ ID NO: 474413 - DNA, 25 bp, Rattus norvegicus
gtaaaaaggtcagagggcctcagct

SEQ ID NO: 474414 - DNA, 25 bp, Rattus norvegicus
gtaaaaagtgcccaagttccaaatg

SEQ ID NO: 474415 - DNA, 25 bp, Rattus norvegicus
gtaaaaagtgccgaagttccaaatg

SEQ ID NO: 474416 - DNA, 25 bp, Rattus norvegicus
gtaaaaatacctacctagcctggct

SEQ ID NO: 474417 - DNA, 25 bp, Rattus norvegicus
gtaaaaataccttcctagcctggct

SEQ ID NO: 474418 - DNA, 25 bp, Rattus norvegicus
gtaaaaatctgtcggctctcaaagc

SEQ ID NO: 474419 - DNA, 25 bp, Rattus norvegicus
gtaaaaatctgtgggctctcaaagc

SEQ ID NO: 474420 - DNA, 25 bp, Rattus norvegicus
gtaaaaatgactatattctccaaag

SEQ ID NO: 474421 - DNA, 25 bp, Rattus norvegicus
gtaaaaatgactttattctccaaag

SEQ ID NO: 474422 - DNA, 25 bp, Rattus norvegicus
gtaaaaatggcgacagctcctgaaa

SEQ ID NO: 474423 - DNA, 25 bp, Rattus norvegicus
gtaaaaatggcgtcagctcctgaaa

SEQ ID NO: 474424 - DNA, 25 bp, Rattus norvegicus
gtaaaaatggtaatgatttctgccc

SEQ ID NO: 474425 - DNA, 25 bp, Rattus norvegicus
gtaaaaatggtattgatttctgccc

SEQ ID NO: 474426 - DNA, 25 bp, Rattus norvegicus
gtaaaaatttcaagtcagccccaaa

SEQ ID NO: 474427 - DNA, 25 bp, Rattus norvegicus
gtaaaaatttcatgtcagccccaaa

SEQ ID NO: 474428 - DNA, 25 bp, Rattus norvegicus
gtaaaacaatttccctgtgtagaaa

SEQ ID NO: 474429 - DNA, 25 bp, Rattus norvegicus
gtaaaacaatttgcctgtgtagaaa

SEQ ID NO: 474430 - DNA, 25 bp, Rattus norvegicus
gtaaaacacacaatagggaatgcat

SEQ ID NO: 474431 - DNA, 25 bp, Rattus norvegicus
gtaaaacacacattagggaatgcat

SEQ ID NO: 474432 - DNA, 25 bp, Rattus norvegicus
gtaaaacacttgactagatcgcagt

SEQ ID NO: 474433 - DNA, 25 bp, Rattus norvegicus
gtaaaacacttgtctagatcgcagt

SEQ ID NO: 474434 - DNA, 25 bp, Rattus norvegicus
gtaaaacagccacccagctttttcc

SEQ ID NO: 474435 - DNA, 25 bp, Rattus norvegicus
gtaaaacagccagccagctttttcc

SEQ ID NO: 474436 - DNA, 25 bp, Rattus norvegicus
gtaaaacagctcacttctttcctgg

SEQ ID NO: 474437 - DNA, 25 bp, Rattus norvegicus
gtaaaacagctctcttctttcctgg

SEQ ID NO: 474438 - DNA, 25 bp, Rattus norvegicus
gtaaaacagctgacctcgttcctct

SEQ ID NO: 474439 - DNA, 25 bp, Rattus norvegicus
gtaaaacagctgtcctcgttcctct

SEQ ID NO: 474440 - DNA, 25 bp, Rattus norvegicus
gtaaaacatcgtatcaccctgacgc

SEQ ID NO: 474441 - DNA, 25 bp, Rattus norvegicus
gtaaaacatcgtttcaccctgacgc

SEQ ID NO: 474442 - DNA, 25 bp, Rattus norvegicus
gtaaaacattttacgttcttcagag

SEQ ID NO: 474443 - DNA, 25 bp, Rattus norvegicus
gtaaaacatttttcgttcttcagag

SEQ ID NO: 474444 - DNA, 25 bp, Rattus norvegicus
gtaaaaccaagaactgccctgtgtt

SEQ ID NO: 474445 - DNA, 25 bp, Rattus norvegicus
gtaaaaccaagatctgccctgtgtt

SEQ ID NO: 474446 - DNA, 25 bp, Rattus norvegicus
gtaaaaccacagagagtccccgtgc

SEQ ID NO: 474447 - DNA, 25 bp, Rattus norvegicus
gtaaaaccacagtgagtccccgtgc

SEQ ID NO: 474448 - DNA, 25 bp, Rattus norvegicus
gtaaaaccaccaccaatctaggcag

SEQ ID NO: 474449 - DNA, 25 bp, Rattus norvegicus
gtaaaaccaccagcaatctaggcag

SEQ ID NO: 474450 - DNA, 25 bp, Rattus norvegicus
gtaaaacccagactgcaggcagaga

SEQ ID NO: 474451 - DNA, 25 bp, Rattus norvegicus
gtaaaacccagagtgcaggcagaga

SEQ ID NO: 474452 - DNA, 25 bp, Rattus norvegicus
gtaaaaccctgcacagttgatattt

SEQ ID NO: 474453 - DNA, 25 bp, Rattus norvegicus
gtaaaaccctgctcagttgatattt

SEQ ID NO: 474454 - DNA, 25 bp, Rattus norvegicus
gtaaaacctatcacttgctgttctt

SEQ ID NO: 474455 - DNA, 25 bp, Rattus norvegicus
gtaaaacctatctcttgctgttctt

SEQ ID NO: 474456 - DNA, 25 bp, Rattus norvegicus
gtaaaacctcttcagaccaagcatt

SEQ ID NO: 474457 - DNA, 25 bp, Rattus norvegicus
gtaaaacctcttgagaccaagcatt

SEQ ID NO: 474458 - DNA, 25 bp, Rattus norvegicus
gtaaaacctgtcaatacctccagtt

SEQ ID NO: 474459 - DNA, 25 bp, Rattus norvegicus
gtaaaacctgtctatacctccagtt

SEQ ID NO: 474460 - DNA, 25 bp, Rattus norvegicus
gtaaaaccttagcacttagcacaat

SEQ ID NO: 474461 - DNA, 25 bp, Rattus norvegicus
gtaaaaccttaggacttagcacaat

SEQ ID NO: 474462 - DNA, 25 bp, Rattus norvegicus
gtaaaaccttgcacttgccggtgat

SEQ ID NO: 474463 - DNA, 25 bp, Rattus norvegicus
gtaaaaccttgctcttgccggtgat

SEQ ID NO: 474464 - DNA, 25 bp, Rattus norvegicus
gtaaaacgccttagagagccacttt

SEQ ID NO: 474465 - DNA, 25 bp, Rattus norvegicus
gtaaaacgcctttgagagccacttt

SEQ ID NO: 474466 - DNA, 25 bp, Rattus norvegicus
gtaaaacgctttctaaagttcacat

SEQ ID NO: 474467 - DNA, 25 bp, Rattus norvegicus
gtaaaacgctttgtaaagttcacat

SEQ ID NO: 474468 - DNA, 25 bp, Rattus norvegicus
gtaaaacgtgagatactggcatcca

SEQ ID NO: 474469 - DNA, 25 bp, Rattus norvegicus
gtaaaacgtgagttactggcatcca

SEQ ID NO: 474470 - DNA, 25 bp, Rattus norvegicus
gtaaaactcaaaagtcgtgtgtctc

SEQ ID NO: 474471 - DNA, 25 bp, Rattus norvegicus
gtaaaactcaaatgtcgtgtgtctc

SEQ ID NO: 474472 - DNA, 25 bp, Rattus norvegicus
gtaaaactcctcctcaattaatctg

SEQ ID NO: 474473 - DNA, 25 bp, Rattus norvegicus
gtaaaactcctcgtcaattaatctg

SEQ ID NO: 474474 - DNA, 25 bp, Rattus norvegicus
gtaaaactcgtgatcaagtctgtgt

SEQ ID NO: 474475 - DNA, 25 bp, Rattus norvegicus
gtaaaactcgtgttcaagtctgtgt

SEQ ID NO: 474476 - DNA, 25 bp, Rattus norvegicus
gtaaaactgcaacttgtaagcctca

SEQ ID NO: 474477 - DNA, 25 bp, Rattus norvegicus
gtaaaactgcaagttgtaagcctca

SEQ ID NO: 474478 - DNA, 25 bp, Rattus norvegicus
gtaaaactgtctctttgaactattg

SEQ ID NO: 474479 - DNA, 25 bp, Rattus norvegicus
gtaaaactgtctgtttgaactattg

SEQ ID NO: 474480 - DNA, 25 bp, Rattus norvegicus
gtaaaacttagtcccagtcctggtg

SEQ ID NO: 474481 - DNA, 25 bp, Rattus norvegicus
gtaaaacttagtgccagtcctggtg

SEQ ID NO: 474482 - DNA, 25 bp, Rattus norvegicus
gtaaaagaagcactacttgggaggt

SEQ ID NO: 474483 - DNA, 25 bp, Rattus norvegicus
gtaaaagaagcagtacttgggaggt

SEQ ID NO: 474484 - DNA, 25 bp, Rattus norvegicus
gtaaaagaagccagcatcgttctga

SEQ ID NO: 474485 - DNA, 25 bp, Rattus norvegicus
gtaaaagaagcctgcatcgttctga

SEQ ID NO: 474486 - DNA, 25 bp, Rattus norvegicus
gtaaaagacctaacttcagctggaa

SEQ ID NO: 474487 - DNA, 25 bp, Rattus norvegicus
gtaaaagacctatcttcagctggaa

SEQ ID NO: 474488 - DNA, 25 bp, Rattus norvegicus
gtaaaagccaccagtgtttcctctg

SEQ ID NO: 474489 - DNA, 25 bp, Rattus norvegicus
gtaaaagccacctgtgtttcctctg

SEQ ID NO: 474490 - DNA, 25 bp, Rattus norvegicus
gtaaaagctgcacaacgcccgctgg

SEQ ID NO: 474491 - DNA, 25 bp, Rattus norvegicus
gtaaaagctgcagaacgcccgctgg

SEQ ID NO: 474492 - DNA, 25 bp, Rattus norvegicus
gtaaaagctggcagcccaagaccaa

SEQ ID NO: 474493 - DNA, 25 bp, Rattus norvegicus
gtaaaagctggctgcccaagaccaa

SEQ ID NO: 474494 - DNA, 25 bp, Rattus norvegicus
gtaaaagcttccattcctgcaacac

SEQ ID NO: 474495 - DNA, 25 bp, Rattus norvegicus
gtaaaagcttcctttcctgcaacac

SEQ ID NO: 474496 - DNA, 25 bp, Rattus norvegicus
gtaaaaggaatgctagcctcaaacc

SEQ ID NO: 474497 - DNA, 25 bp, Rattus norvegicus
gtaaaaggaatggtagcctcaaacc

SEQ ID NO: 474498 - DNA, 25 bp, Rattus norvegicus
gtaaaaggcctgcaacctgcctgtc

SEQ ID NO: 474499 - DNA, 25 bp, Rattus norvegicus
gtaaaaggcctggaacctgcctgtc

SEQ ID NO: 474500 - DNA, 25 bp, Rattus norvegicus
gtaaaaggctccacaggcactgact

SEQ ID NO: 474501 - DNA, 25 bp, Rattus norvegicus
gtaaaaggctcctcaggcactgact

SEQ ID NO: 474502 - DNA, 25 bp, Rattus norvegicus
gtaaaaggctggaatctcatctctc

SEQ ID NO: 474503 - DNA, 25 bp, Rattus norvegicus
gtaaaaggctggtatctcatctctc

SEQ ID NO: 474504 - DNA, 25 bp, Rattus norvegicus
gtaaaagtacccatactctgacagt

SEQ ID NO: 474505 - DNA, 25 bp, Rattus norvegicus
gtaaaagtacccttactctgacagt

SEQ ID NO: 474506 - DNA, 25 bp, Rattus norvegicus
gtaaaagtcctacctgtggcacttg

SEQ ID NO: 474507 - DNA, 25 bp, Rattus norvegicus
gtaaaagtcctagctgtggcacttg

SEQ ID NO: 474508 - DNA, 25 bp, Rattus norvegicus
gtaaaagtccttatcttgcaagaat

SEQ ID NO: 474509 - DNA, 25 bp, Rattus norvegicus
gtaaaagtccttttcttgcaagaat

SEQ ID NO: 474510 - DNA, 25 bp, Rattus norvegicus
gtaaaagtgtctaatctgtacagat

SEQ ID NO: 474511 - DNA, 25 bp, Rattus norvegicus
gtaaaagtgtcttatctgtacagat

SEQ ID NO: 474512 - DNA, 25 bp, Rattus norvegicus
gtaaaagttactagccagccagtct

SEQ ID NO: 474513 - DNA, 25 bp, Rattus norvegicus
gtaaaagttacttgccagccagtct

SEQ ID NO: 474514 - DNA, 25 bp, Rattus norvegicus
gtaaaagttcccatagctctccaag

SEQ ID NO: 474515 - DNA, 25 bp, Rattus norvegicus
gtaaaagttcccatgtctagtacat

SEQ ID NO: 474516 - DNA, 25 bp, Rattus norvegicus
gtaaaagttcccttagctctccaag

SEQ ID NO: 474517 - DNA, 25 bp, Rattus norvegicus
gtaaaagttcccttgtctagtacat

SEQ ID NO: 474518 - DNA, 25 bp, Rattus norvegicus
gtaaaagttcgcaccctgaatgtgg

SEQ ID NO: 474519 - DNA, 25 bp, Rattus norvegicus
gtaaaagttcgctccctgaatgtgg

SEQ ID NO: 474520 - DNA, 25 bp, Rattus norvegicus
gtaaaataccctatgcacaaggagg

SEQ ID NO: 474521 - DNA, 25 bp, Rattus norvegicus
gtaaaataccctttgcacaaggagg

SEQ ID NO: 474522 - DNA, 25 bp, Rattus norvegicus
gtaaaataccttcttgctctgcatg

SEQ ID NO: 474523 - DNA, 25 bp, Rattus norvegicus
gtaaaataccttgttgctctgcatg

SEQ ID NO: 474524 - DNA, 25 bp, Rattus norvegicus
gtaaaatactgtacatgcactgctg

SEQ ID NO: 474525 - DNA, 25 bp, Rattus norvegicus
gtaaaatactgttcatgcactgctg

SEQ ID NO: 474526 - DNA, 25 bp, Rattus norvegicus
gtaaaatagacaaccttccgttatt

SEQ ID NO: 474527 - DNA, 25 bp, Rattus norvegicus
gtaaaatagacatccttccgttatt

SEQ ID NO: 474528 - DNA, 25 bp, Rattus norvegicus
gtaaaatattttagcaccgttgtga

SEQ ID NO: 474529 - DNA, 25 bp, Rattus norvegicus
gtaaaatatttttgcaccgttgtga

SEQ ID NO: 474530 - DNA, 25 bp, Rattus norvegicus
gtaaaatcaccaacaaacggctatg

SEQ ID NO: 474531 - DNA, 25 bp, Rattus norvegicus
gtaaaatcaccatcaaacggctatg

SEQ ID NO: 474532 - DNA, 25 bp, Rattus norvegicus
gtaaaatcagctagcttcccacttc

SEQ ID NO: 474533 - DNA, 25 bp, Rattus norvegicus
gtaaaatcagcttgcttcccacttc

SEQ ID NO: 474534 - DNA, 25 bp, Rattus norvegicus
gtaaaatccatacacactgcactga

SEQ ID NO: 474535 - DNA, 25 bp, Rattus norvegicus
gtaaaatccatagacactgcactga

SEQ ID NO: 474536 - DNA, 25 bp, Rattus norvegicus
gtaaaatccgcaaggctgccgcctg

SEQ ID NO: 474537 - DNA, 25 bp, Rattus norvegicus
gtaaaatccgcatggctgccgcctg

SEQ ID NO: 474538 - DNA, 25 bp, Rattus norvegicus
gtaaaatccttaaccgtgtctgaga

SEQ ID NO: 474539 - DNA, 25 bp, Rattus norvegicus
gtaaaatccttatccgtgtctgaga

SEQ ID NO: 474540 - DNA, 25 bp, Rattus norvegicus
gtaaaatcgcagctgtaggccgata

SEQ ID NO: 474541 - DNA, 25 bp, Rattus norvegicus
gtaaaatcgcaggtgtaggccgata

SEQ ID NO: 474542 - DNA, 25 bp, Rattus norvegicus
gtaaaatctagtcgtgagtctggaa

SEQ ID NO: 474543 - DNA, 25 bp, Rattus norvegicus
gtaaaatctagtggtgagtctggaa

SEQ ID NO: 474544 - DNA, 25 bp, Rattus norvegicus
gtaaaatcttgtacagtgctgtcct

SEQ ID NO: 474545 - DNA, 25 bp, Rattus norvegicus
gtaaaatcttgttcagtgctgtcct

SEQ ID NO: 474546 - DNA, 25 bp, Rattus norvegicus
gtaaaatcttttacagcatgtgtta

SEQ ID NO: 474547 - DNA, 25 bp, Rattus norvegicus
gtaaaatctttttcagcatgtgtta

SEQ ID NO: 474548 - DNA, 25 bp, Rattus norvegicus
gtaaaatgaaccctcagtcggcctt

SEQ ID NO: 474549 - DNA, 25 bp, Rattus norvegicus
gtaaaatgaaccgtcagtcggcctt

SEQ ID NO: 474550 - DNA, 25 bp, Rattus norvegicus
gtaaaatgtatccagccaccatgta

SEQ ID NO: 474551 - DNA, 25 bp, Rattus norvegicus
gtaaaatgtatcgagccaccatgta

SEQ ID NO: 474552 - DNA, 25 bp, Rattus norvegicus
gtaaaatgtcacaacccctaatcac

SEQ ID NO: 474553 - DNA, 25 bp, Rattus norvegicus
gtaaaatgtcactacccctaatcac

SEQ ID NO: 474554 - DNA, 25 bp, Rattus norvegicus
gtaaaattcttgcatgccaccagtc

SEQ ID NO: 474555 - DNA, 25 bp, Rattus norvegicus
gtaaaattcttggatgccaccagtc

SEQ ID NO: 474556 - DNA, 25 bp, Rattus norvegicus
gtaaaattgtacattgcctgccctg

SEQ ID NO: 474557 - DNA, 25 bp, Rattus norvegicus
gtaaaattgtactttgcctgccctg

SEQ ID NO: 474558 - DNA, 25 bp, Rattus norvegicus
gtaaaatttcaaccaccaggtccga

SEQ ID NO: 474559 - DNA, 25 bp, Rattus norvegicus
gtaaaatttcaagcaccaggtccga

SEQ ID NO: 474560 - DNA, 25 bp, Rattus norvegicus
gtaaacaaactcagtgtcccgtggc

SEQ ID NO: 474561 - DNA, 25 bp, Rattus norvegicus
gtaaacaaactctgtgtcccgtggc

SEQ ID NO: 474562 - DNA, 25 bp, Rattus norvegicus
gtaaacaaaggcatcttctgtgtgc

SEQ ID NO: 474563 - DNA, 25 bp, Rattus norvegicus
gtaaacaaaggcttcttctgtgtgc

SEQ ID NO: 474564 - DNA, 25 bp, Rattus norvegicus
gtaaacaaatgacccagccttccgc

SEQ ID NO: 474565 - DNA, 25 bp, Rattus norvegicus
gtaaacaaatgagccagccttccgc

SEQ ID NO: 474566 - DNA, 25 bp, Rattus norvegicus
gtaaacaactacatctgggacattc

SEQ ID NO: 474567 - DNA, 25 bp, Rattus norvegicus
gtaaacaactacttctgggacattc

SEQ ID NO: 474568 - DNA, 25 bp, Rattus norvegicus
gtaaacaacttcatgctatagcagg

SEQ ID NO: 474569 - DNA, 25 bp, Rattus norvegicus
gtaaacaacttcttgctatagcagg

SEQ ID NO: 474570 - DNA, 25 bp, Rattus norvegicus
gtaaacaagggtagcagcctctgca

SEQ ID NO: 474571 - DNA, 25 bp, Rattus norvegicus
gtaaacaagggttgcagcctctgca

SEQ ID NO: 474572 - DNA, 25 bp, Rattus norvegicus
gtaaacacactcatattctccaata

SEQ ID NO: 474573 - DNA, 25 bp, Rattus norvegicus
gtaaacacactcttattctccaata

SEQ ID NO: 474574 - DNA, 25 bp, Rattus norvegicus
gtaaacacatcaagttcctggctcc

SEQ ID NO: 474575 - DNA, 25 bp, Rattus norvegicus
gtaaacacatcatgttcctggctcc

SEQ ID NO: 474576 - DNA, 25 bp, Rattus norvegicus
gtaaacaccctaaagccagacattt

SEQ ID NO: 474577 - DNA, 25 bp, Rattus norvegicus
gtaaacaccctatagccagacattt

SEQ ID NO: 474578 - DNA, 25 bp, Rattus norvegicus
gtaaacacctgtacccagatcaatt

SEQ ID NO: 474579 - DNA, 25 bp, Rattus norvegicus
gtaaacacctgttcccagatcaatt

SEQ ID NO: 474580 - DNA, 25 bp, Rattus norvegicus
gtaaacacgtgtcctggtggccttt

SEQ ID NO: 474581 - DNA, 25 bp, Rattus norvegicus
gtaaacacgtgtgctggtggccttt

SEQ ID NO: 474582 - DNA, 25 bp, Rattus norvegicus
gtaaacactcacctggcaaaaatgt

SEQ ID NO: 474583 - DNA, 25 bp, Rattus norvegicus
gtaaacactcacgtggcaaaaatgt

SEQ ID NO: 474584 - DNA, 25 bp, Rattus norvegicus
gtaaacactgctactcgaatggagt

SEQ ID NO: 474585 - DNA, 25 bp, Rattus norvegicus
gtaaacactgctccaacgaagtctg

SEQ ID NO: 474586 - DNA, 25 bp, Rattus norvegicus
gtaaacactgctgcaacgaagtctg

SEQ ID NO: 474587 - DNA, 25 bp, Rattus norvegicus
gtaaacactgcttctcgaatggagt

SEQ ID NO: 474588 - DNA, 25 bp, Rattus norvegicus
gtaaacacttatatctgatagccag

SEQ ID NO: 474589 - DNA, 25 bp, Rattus norvegicus
gtaaacacttatttctgatagccag

SEQ ID NO: 474590 - DNA, 25 bp, Rattus norvegicus
gtaaacacttctcggctgagtcaat

SEQ ID NO: 474591 - DNA, 25 bp, Rattus norvegicus
gtaaacacttctgggctgagtcaat

SEQ ID NO: 474592 - DNA, 25 bp, Rattus norvegicus
gtaaacagaacacacctatggcatc

SEQ ID NO: 474593 - DNA, 25 bp, Rattus norvegicus
gtaaacagaacagacctatggcatc

SEQ ID NO: 474594 - DNA, 25 bp, Rattus norvegicus
gtaaacagcaacataaagtccataa

SEQ ID NO: 474595 - DNA, 25 bp, Rattus norvegicus
gtaaacagcaacttaaagtccataa

SEQ ID NO: 474596 - DNA, 25 bp, Rattus norvegicus
gtaaacagccatcccaaagggccgc

SEQ ID NO: 474597 - DNA, 25 bp, Rattus norvegicus
gtaaacagccatgccaaagggccgc

SEQ ID NO: 474598 - DNA, 25 bp, Rattus norvegicus
gtaaacagcgtaatgtcaacataat

SEQ ID NO: 474599 - DNA, 25 bp, Rattus norvegicus
gtaaacagcgtattgtcaacataat

SEQ ID NO: 474600 - DNA, 25 bp, Rattus norvegicus
gtaaacagctggcttttgtttccag

SEQ ID NO: 474601 - DNA, 25 bp, Rattus norvegicus
gtaaacagctgggttttgtttccag

SEQ ID NO: 474602 - DNA, 25 bp, Rattus norvegicus
gtaaacaggactccggtacagtgct

SEQ ID NO: 474603 - DNA, 25 bp, Rattus norvegicus
gtaaacaggactgcggtacagtgct

SEQ ID NO: 474604 - DNA, 25 bp, Rattus norvegicus
gtaaacagggtcagccaggagtctg

SEQ ID NO: 474605 - DNA, 25 bp, Rattus norvegicus
gtaaacagggtctgccaggagtctg

SEQ ID NO: 474606 - DNA, 25 bp, Rattus norvegicus
gtaaacagtaacacagcggccagta

SEQ ID NO: 474607 - DNA, 25 bp, Rattus norvegicus
gtaaacagtaactcagcggccagta

SEQ ID NO: 474608 - DNA, 25 bp, Rattus norvegicus
gtaaacataaccaaagccacaatgg

SEQ ID NO: 474609 - DNA, 25 bp, Rattus norvegicus
gtaaacataacctaagccacaatgg

SEQ ID NO: 474610 - DNA, 25 bp, Rattus norvegicus
gtaaacatagtgctttgaccctgag

SEQ ID NO: 474611 - DNA, 25 bp, Rattus norvegicus
gtaaacatagtggtttgaccctgag

SEQ ID NO: 474612 - DNA, 25 bp, Rattus norvegicus
gtaaacatctctctccttacacgaa

SEQ ID NO: 474613 - DNA, 25 bp, Rattus norvegicus
gtaaacatctctgtccttacacgaa

SEQ ID NO: 474614 - DNA, 25 bp, Rattus norvegicus
gtaaacatcttcactatcaccttct

SEQ ID NO: 474615 - DNA, 25 bp, Rattus norvegicus
gtaaacatcttctctatcaccttct

SEQ ID NO: 474616 - DNA, 25 bp, Rattus norvegicus
gtaaacatgatgcacaccgttctat

SEQ ID NO: 474617 - DNA, 25 bp, Rattus norvegicus
gtaaacatgatggacaccgttctat

SEQ ID NO: 474618 - DNA, 25 bp, Rattus norvegicus
gtaaacatgcgcaaactgctgcctc

SEQ ID NO: 474619 - DNA, 25 bp, Rattus norvegicus
gtaaacatgcgctaactgctgcctc

SEQ ID NO: 474620 - DNA, 25 bp, Rattus norvegicus
gtaaacatggcaaacctgtcccaat

SEQ ID NO: 474621 - DNA, 25 bp, Rattus norvegicus
gtaaacatggcatacctgtcccaat

SEQ ID NO: 474622 - DNA, 25 bp, Rattus norvegicus
gtaaaccaacagaccttgcttgttt

SEQ ID NO: 474623 - DNA, 25 bp, Rattus norvegicus
gtaaaccaacagtccttgcttgttt

SEQ ID NO: 474624 - DNA, 25 bp, Rattus norvegicus
gtaaaccaagttaatgccacacgtg

SEQ ID NO: 474625 - DNA, 25 bp, Rattus norvegicus
gtaaaccaagtttatgccacacgtg

SEQ ID NO: 474626 - DNA, 25 bp, Rattus norvegicus
gtaaaccaatgtcatgcttctggaa

SEQ ID NO: 474627 - DNA, 25 bp, Rattus norvegicus
gtaaaccaatgtgatgcttctggaa

SEQ ID NO: 474628 - DNA, 25 bp, Rattus norvegicus
gtaaaccactgccttagggaccatc

SEQ ID NO: 474629 - DNA, 25 bp, Rattus norvegicus
gtaaaccactgcgttagggaccatc

SEQ ID NO: 474630 - DNA, 25 bp, Rattus norvegicus
gtaaaccagataacatgaaagaaat

SEQ ID NO: 474631 - DNA, 25 bp, Rattus norvegicus
gtaaaccagatatcatgaaagaaat

SEQ ID NO: 474632 - DNA, 25 bp, Rattus norvegicus
gtaaaccagccaaggagactctcga

SEQ ID NO: 474633 - DNA, 25 bp, Rattus norvegicus
gtaaaccagccatggagactctcga

SEQ ID NO: 474634 - DNA, 25 bp, Rattus norvegicus
gtaaaccaggccagccggtgtctgc

SEQ ID NO: 474635 - DNA, 25 bp, Rattus norvegicus
gtaaaccaggcctgccggtgtctgc

SEQ ID NO: 474636 - DNA, 25 bp, Rattus norvegicus
gtaaaccatagactgttcagtcctc

SEQ ID NO: 474637 - DNA, 25 bp, Rattus norvegicus
gtaaaccatagagtgttcagtcctc

SEQ ID NO: 474638 - DNA, 25 bp, Rattus norvegicus
gtaaaccatcttctatccttttgtg

SEQ ID NO: 474639 - DNA, 25 bp, Rattus norvegicus
gtaaaccatcttgtatccttttgtg

SEQ ID NO: 474640 - DNA, 25 bp, Rattus norvegicus
gtaaaccatgggaacaacagacttc

SEQ ID NO: 474641 - DNA, 25 bp, Rattus norvegicus
gtaaaccatgggtacaacagacttc

SEQ ID NO: 474642 - DNA, 25 bp, Rattus norvegicus
gtaaacccaaacacaaggctaagag

SEQ ID NO: 474643 - DNA, 25 bp, Rattus norvegicus
gtaaacccaaactcaaggctaagag

SEQ ID NO: 474644 - DNA, 25 bp, Rattus norvegicus
gtaaacccaagtctgtgtgagcccc

SEQ ID NO: 474645 - DNA, 25 bp, Rattus norvegicus
gtaaacccaagtgtgtgtgagcccc

SEQ ID NO: 474646 - DNA, 25 bp, Rattus norvegicus
gtaaacccaatacaacatacacagg

SEQ ID NO: 474647 - DNA, 25 bp, Rattus norvegicus
gtaaacccaatagaacatacacagg

SEQ ID NO: 474648 - DNA, 25 bp, Rattus norvegicus
gtaaacccacagatcagagagcatg

SEQ ID NO: 474649 - DNA, 25 bp, Rattus norvegicus
gtaaacccacagcagagtccatttg

SEQ ID NO: 474650 - DNA, 25 bp, Rattus norvegicus
gtaaacccacaggagagtccatttg

SEQ ID NO: 474651 - DNA, 25 bp, Rattus norvegicus
gtaaacccacagttcagagagcatg

SEQ ID NO: 474652 - DNA, 25 bp, Rattus norvegicus
gtaaacccacttcgcacaggccggg

SEQ ID NO: 474653 - DNA, 25 bp, Rattus norvegicus
gtaaacccacttggcacaggccggg

SEQ ID NO: 474654 - DNA, 25 bp, Rattus norvegicus
gtaaaccccacaacataggacagag

SEQ ID NO: 474655 - DNA, 25 bp, Rattus norvegicus
gtaaaccccacatcataggacagag

SEQ ID NO: 474656 - DNA, 25 bp, Rattus norvegicus
gtaaacccctaaacctgtaacagca

SEQ ID NO: 474657 - DNA, 25 bp, Rattus norvegicus
gtaaacccctaatcctgtaacagca

SEQ ID NO: 474658 - DNA, 25 bp, Rattus norvegicus
gtaaacccgagaaacattcacctgg

SEQ ID NO: 474659 - DNA, 25 bp, Rattus norvegicus
gtaaacccgagatacattcacctgg

SEQ ID NO: 474660 - DNA, 25 bp, Rattus norvegicus
gtaaaccctgtcagcaaaactgtat

SEQ ID NO: 474661 - DNA, 25 bp, Rattus norvegicus
gtaaaccctgtcctctagatgtcta

SEQ ID NO: 474662 - DNA, 25 bp, Rattus norvegicus
gtaaaccctgtcgtctagatgtcta

SEQ ID NO: 474663 - DNA, 25 bp, Rattus norvegicus
gtaaaccctgtctgcaaaactgtat

SEQ ID NO: 474664 - DNA, 25 bp, Rattus norvegicus
gtaaacccttttcatcatttgctga

SEQ ID NO: 474665 - DNA, 25 bp, Rattus norvegicus
gtaaacccttttgatcatttgctga

SEQ ID NO: 474666 - DNA, 25 bp, Rattus norvegicus
gtaaaccgagacagcaagcctcctg

SEQ ID NO: 474667 - DNA, 25 bp, Rattus norvegicus
gtaaaccgagactgcaagcctcctg

SEQ ID NO: 474668 - DNA, 25 bp, Rattus norvegicus
gtaaaccgcgtgaacagtgactggt

SEQ ID NO: 474669 - DNA, 25 bp, Rattus norvegicus
gtaaaccgcgtgtacagtgactggt

SEQ ID NO: 474670 - DNA, 25 bp, Rattus norvegicus
gtaaacctacaacactgcttttctt

SEQ ID NO: 474671 - DNA, 25 bp, Rattus norvegicus
gtaaacctacaagactgcttttctt

SEQ ID NO: 474672 - DNA, 25 bp, Rattus norvegicus
gtaaacctactgcaggtggcccctg

SEQ ID NO: 474673 - DNA, 25 bp, Rattus norvegicus
gtaaacctactggaggtggcccctg

SEQ ID NO: 474674 - DNA, 25 bp, Rattus norvegicus
gtaaacctagaccttgtagacaagt

SEQ ID NO: 474675 - DNA, 25 bp, Rattus norvegicus
gtaaacctagacgttgtagacaagt

SEQ ID NO: 474676 - DNA, 25 bp, Rattus norvegicus
gtaaacctatctagcctattgtgtg

SEQ ID NO: 474677 - DNA, 25 bp, Rattus norvegicus
gtaaacctatcttgcctattgtgtg

SEQ ID NO: 474678 - DNA, 25 bp, Rattus norvegicus
gtaaacctcagcaacactgttcaga

SEQ ID NO: 474679 - DNA, 25 bp, Rattus norvegicus
gtaaacctcagctacactgttcaga

SEQ ID NO: 474680 - DNA, 25 bp, Rattus norvegicus
gtaaacctccaaactcccaaaatga

SEQ ID NO: 474681 - DNA, 25 bp, Rattus norvegicus
gtaaacctccaatctcccaaaatga

SEQ ID NO: 474682 - DNA, 25 bp, Rattus norvegicus
gtaaacctccctcccagaagagcag

SEQ ID NO: 474683 - DNA, 25 bp, Rattus norvegicus
gtaaacctccctgccagaagagcag

SEQ ID NO: 474684 - DNA, 25 bp, Rattus norvegicus
gtaaacctgctgagagctgggtgca

SEQ ID NO: 474685 - DNA, 25 bp, Rattus norvegicus
gtaaacctgctgtgagctgggtgca

SEQ ID NO: 474686 - DNA, 25 bp, Rattus norvegicus
gtaaacctgtgaatgggccccaaga

SEQ ID NO: 474687 - DNA, 25 bp, Rattus norvegicus
gtaaacctgtgattgggccccaaga

SEQ ID NO: 474688 - DNA, 25 bp, Rattus norvegicus
gtaaaccttaaaaactggcagcagt

SEQ ID NO: 474689 - DNA, 25 bp, Rattus norvegicus
gtaaaccttaaatactggcagcagt

SEQ ID NO: 474690 - DNA, 25 bp, Rattus norvegicus
gtaaaccttggcactgttgtctgag

SEQ ID NO: 474691 - DNA, 25 bp, Rattus norvegicus
gtaaaccttggccttgaccatgaga

SEQ ID NO: 474692 - DNA, 25 bp, Rattus norvegicus
gtaaaccttggcgttgaccatgaga

SEQ ID NO: 474693 - DNA, 25 bp, Rattus norvegicus
gtaaaccttggctctgttgtctgag

SEQ ID NO: 474694 - DNA, 25 bp, Rattus norvegicus
gtaaacgaaatgacttccttggcat

SEQ ID NO: 474695 - DNA, 25 bp, Rattus norvegicus
gtaaacgaaatgtcttccttggcat

SEQ ID NO: 474696 - DNA, 25 bp, Rattus norvegicus
gtaaacgaagctaccagttctggga

SEQ ID NO: 474697 - DNA, 25 bp, Rattus norvegicus
gtaaacgaagcttccagttctggga

SEQ ID NO: 474698 - DNA, 25 bp, Rattus norvegicus
gtaaacgacgatagctttcatgagc

SEQ ID NO: 474699 - DNA, 25 bp, Rattus norvegicus
gtaaacgacgattgctttcatgagc

SEQ ID NO: 474700 - DNA, 25 bp, Rattus norvegicus
gtaaacgagctcaagtcatgtggat

SEQ ID NO: 474701 - DNA, 25 bp, Rattus norvegicus
gtaaacgagctctagtcatgtggat

SEQ ID NO: 474702 - DNA, 25 bp, Rattus norvegicus
gtaaacgcccttactatgggtcaga

SEQ ID NO: 474703 - DNA, 25 bp, Rattus norvegicus
gtaaacgccctttctatgggtcaga

SEQ ID NO: 474704 - DNA, 25 bp, Rattus norvegicus
gtaaacgtcccaagttcatccagta

SEQ ID NO: 474705 - DNA, 25 bp, Rattus norvegicus
gtaaacgtcccatgttcatccagta

SEQ ID NO: 474706 - DNA, 25 bp, Rattus norvegicus
gtaaacgtgcaacacactcgtgcga

SEQ ID NO: 474707 - DNA, 25 bp, Rattus norvegicus
gtaaacgtgcaagacactcgtgcga

SEQ ID NO: 474708 - DNA, 25 bp, Rattus norvegicus
gtaaacgttctgaatcacctgtaaa

SEQ ID NO: 474709 - DNA, 25 bp, Rattus norvegicus
gtaaacgttctgtatcacctgtaaa

SEQ ID NO: 474710 - DNA, 25 bp, Rattus norvegicus
gtaaacgttgtcatcagaagccctg

SEQ ID NO: 474711 - DNA, 25 bp, Rattus norvegicus
gtaaacgttgtcttcagaagccctg

SEQ ID NO: 474712 - DNA, 25 bp, Rattus norvegicus
gtaaactaattaacatgtccactaa

SEQ ID NO: 474713 - DNA, 25 bp, Rattus norvegicus
gtaaactaattatcatgtccactaa

SEQ ID NO: 474714 - DNA, 25 bp, Rattus norvegicus
gtaaactacaaacctcctgtgtctt

SEQ ID NO: 474715 - DNA, 25 bp, Rattus norvegicus
gtaaactacaaagctcctgtgtctt

SEQ ID NO: 474716 - DNA, 25 bp, Rattus norvegicus
gtaaactacaggactgcctaaggaa

SEQ ID NO: 474717 - DNA, 25 bp, Rattus norvegicus
gtaaactacaggtctgcctaaggaa

SEQ ID NO: 474718 - DNA, 25 bp, Rattus norvegicus
gtaaactaccatacctgccaagagg

SEQ ID NO: 474719 - DNA, 25 bp, Rattus norvegicus
gtaaactaccattcctgccaagagg

SEQ ID NO: 474720 - DNA, 25 bp, Rattus norvegicus
gtaaactaccttcctcccatgagta

SEQ ID NO: 474721 - DNA, 25 bp, Rattus norvegicus
gtaaactaccttgctcccatgagta

SEQ ID NO: 474722 - DNA, 25 bp, Rattus norvegicus
gtaaactacttgagctcttgtggaa

SEQ ID NO: 474723 - DNA, 25 bp, Rattus norvegicus
gtaaactacttgtgctcttgtggaa

SEQ ID NO: 474724 - DNA, 25 bp, Rattus norvegicus
gtaaactagctgaaaggatttccca

SEQ ID NO: 474725 - DNA, 25 bp, Rattus norvegicus
gtaaactagctgtaaggatttccca

SEQ ID NO: 474726 - DNA, 25 bp, Rattus norvegicus
gtaaactatatcacacccgtgttat

SEQ ID NO: 474727 - DNA, 25 bp, Rattus norvegicus
gtaaactatatctcacccgtgttat

SEQ ID NO: 474728 - DNA, 25 bp, Rattus norvegicus
gtaaactatattccttggccttcaa

SEQ ID NO: 474729 - DNA, 25 bp, Rattus norvegicus
gtaaactatattcctttattctcga

SEQ ID NO: 474730 - DNA, 25 bp, Rattus norvegicus
gtaaactatattgcttggccttcaa

SEQ ID NO: 474731 - DNA, 25 bp, Rattus norvegicus
gtaaactatattgctttattctcga

SEQ ID NO: 474732 - DNA, 25 bp, Rattus norvegicus
gtaaactattaacacagcaaacatg

SEQ ID NO: 474733 - DNA, 25 bp, Rattus norvegicus
gtaaactattaagacagcaaacatg

SEQ ID NO: 474734 - DNA, 25 bp, Rattus norvegicus
gtaaactcactgaaattgttcactt

SEQ ID NO: 474735 - DNA, 25 bp, Rattus norvegicus
gtaaactcactgtaattgttcactt

SEQ ID NO: 474736 - DNA, 25 bp, Rattus norvegicus
gtaaactcatccattcaactggcac

SEQ ID NO: 474737 - DNA, 25 bp, Rattus norvegicus
gtaaactcatcctttcaactggcac

SEQ ID NO: 474738 - DNA, 25 bp, Rattus norvegicus
gtaaactcatctcggttgctttctc

SEQ ID NO: 474739 - DNA, 25 bp, Rattus norvegicus
gtaaactcatctgggttgctttctc

SEQ ID NO: 474740 - DNA, 25 bp, Rattus norvegicus
gtaaactcattgcacaaactggaat

SEQ ID NO: 474741 - DNA, 25 bp, Rattus norvegicus
gtaaactcattggacaaactggaat

SEQ ID NO: 474742 - DNA, 25 bp, Rattus norvegicus
gtaaactccaggagttgctcttaac

SEQ ID NO: 474743 - DNA, 25 bp, Rattus norvegicus
gtaaactccaggtgttgctcttaac

SEQ ID NO: 474744 - DNA, 25 bp, Rattus norvegicus
gtaaactccatcattgttatgtgac

SEQ ID NO: 474745 - DNA, 25 bp, Rattus norvegicus
gtaaactccatctttgttatgtgac

SEQ ID NO: 474746 - DNA, 25 bp, Rattus norvegicus
gtaaactcctgaatccaatccatgc

SEQ ID NO: 474747 - DNA, 25 bp, Rattus norvegicus
gtaaactcctgattccaatccatgc

SEQ ID NO: 474748 - DNA, 25 bp, Rattus norvegicus
gtaaactcgttcaaaactgcttatt

SEQ ID NO: 474749 - DNA, 25 bp, Rattus norvegicus
gtaaactcgttctaaactgcttatt

SEQ ID NO: 474750 - DNA, 25 bp, Rattus norvegicus
gtaaactctctcaagatgggccggg

SEQ ID NO: 474751 - DNA, 25 bp, Rattus norvegicus
gtaaactctctctagatgggccggg

SEQ ID NO: 474752 - DNA, 25 bp, Rattus norvegicus
gtaaactcttcaaagtaaccatgac

SEQ ID NO: 474753 - DNA, 25 bp, Rattus norvegicus
gtaaactcttcatagtaaccatgac

SEQ ID NO: 474754 - DNA, 25 bp, Rattus norvegicus
gtaaactgaggcagctgggtgccct

SEQ ID NO: 474755 - DNA, 25 bp, Rattus norvegicus
gtaaactgaggctgctgggtgccct

SEQ ID NO: 474756 - DNA, 25 bp, Rattus norvegicus
gtaaactgatggatatctcacttca

SEQ ID NO: 474757 - DNA, 25 bp, Rattus norvegicus
gtaaactgatggttatctcacttca

SEQ ID NO: 474758 - DNA, 25 bp, Rattus norvegicus
gtaaactgcaaaaatgtgtctgtgt

SEQ ID NO: 474759 - DNA, 25 bp, Rattus norvegicus
gtaaactgcaaatatgtgtctgtgt

SEQ ID NO: 474760 - DNA, 25 bp, Rattus norvegicus
gtaaactgcatcatcatactagcaa

SEQ ID NO: 474761 - DNA, 25 bp, Rattus norvegicus
gtaaactgcatcttcatactagcaa

SEQ ID NO: 474762 - DNA, 25 bp, Rattus norvegicus
gtaaactgctatacaactgtctttg

SEQ ID NO: 474763 - DNA, 25 bp, Rattus norvegicus
gtaaactgctattcaactgtctttg

SEQ ID NO: 474764 - DNA, 25 bp, Rattus norvegicus
gtaaactggactacctggaacacca

SEQ ID NO: 474765 - DNA, 25 bp, Rattus norvegicus
gtaaactggacttcctggaacacca

SEQ ID NO: 474766 - DNA, 25 bp, Rattus norvegicus
gtaaactgtaccatcattccagtaa

SEQ ID NO: 474767 - DNA, 25 bp, Rattus norvegicus
gtaaactgtaccatttgtgacttca

SEQ ID NO: 474768 - DNA, 25 bp, Rattus norvegicus
gtaaactgtaccttcattccagtaa

SEQ ID NO: 474769 - DNA, 25 bp, Rattus norvegicus
gtaaactgtaccttttgtgacttca

SEQ ID NO: 474770 - DNA, 25 bp, Rattus norvegicus
gtaaactgtctcaacattcttcggt

SEQ ID NO: 474771 - DNA, 25 bp, Rattus norvegicus
gtaaactgtctctacattcttcggt

SEQ ID NO: 474772 - DNA, 25 bp, Rattus norvegicus
gtaaactgtgaacggttctcaaggt

SEQ ID NO: 474773 - DNA, 25 bp, Rattus norvegicus
gtaaactgtgaagggttctcaaggt

SEQ ID NO: 474774 - DNA, 25 bp, Rattus norvegicus
gtaaactgtgccagcagtctcatta

SEQ ID NO: 474775 - DNA, 25 bp, Rattus norvegicus
gtaaactgtgcctgcagtctcatta

SEQ ID NO: 474776 - DNA, 25 bp, Rattus norvegicus
gtaaactgtgtcctttgggtgaact

SEQ ID NO: 474777 - DNA, 25 bp, Rattus norvegicus
gtaaactgtgtcgtttgggtgaact

SEQ ID NO: 474778 - DNA, 25 bp, Rattus norvegicus
gtaaacttccagatcacttctgggt

SEQ ID NO: 474779 - DNA, 25 bp, Rattus norvegicus
gtaaacttccagttcacttctgggt

SEQ ID NO: 474780 - DNA, 25 bp, Rattus norvegicus
gtaaacttctagctcaccttgcaga

SEQ ID NO: 474781 - DNA, 25 bp, Rattus norvegicus
gtaaacttctaggtcaccttgcaga

SEQ ID NO: 474782 - DNA, 25 bp, Rattus norvegicus
gtaaacttctggcttgcaggccatt

SEQ ID NO: 474783 - DNA, 25 bp, Rattus norvegicus
gtaaacttctgggttgcaggccatt

SEQ ID NO: 474784 - DNA, 25 bp, Rattus norvegicus
gtaaacttcttgatcctgggcaaag

SEQ ID NO: 474785 - DNA, 25 bp, Rattus norvegicus
gtaaacttcttgttcctgggcaaag

SEQ ID NO: 474786 - DNA, 25 bp, Rattus norvegicus
gtaaacttgcaaatgctatctttgc

SEQ ID NO: 474787 - DNA, 25 bp, Rattus norvegicus
gtaaacttgcaattgctatctttgc

SEQ ID NO: 474788 - DNA, 25 bp, Rattus norvegicus
gtaaacttggcccacagaagctcac

SEQ ID NO: 474789 - DNA, 25 bp, Rattus norvegicus
gtaaacttggccgacagaagctcac

SEQ ID NO: 474790 - DNA, 25 bp, Rattus norvegicus
gtaaacttgtcaatatttgcatttc

SEQ ID NO: 474791 - DNA, 25 bp, Rattus norvegicus
gtaaacttgtcattatttgcatttc

SEQ ID NO: 474792 - DNA, 25 bp, Rattus norvegicus
gtaaactttgcccaagcgaccagca

SEQ ID NO: 474793 - DNA, 25 bp, Rattus norvegicus
gtaaactttgccgaagcgaccagca

SEQ ID NO: 474794 - DNA, 25 bp, Rattus norvegicus
gtaaagaaaatgaatcccagcctaa

SEQ ID NO: 474795 - DNA, 25 bp, Rattus norvegicus
gtaaagaaaatgtatcccagcctaa

SEQ ID NO: 474796 - DNA, 25 bp, Rattus norvegicus
gtaaagaacatgaatccctcctcgt

SEQ ID NO: 474797 - DNA, 25 bp, Rattus norvegicus
gtaaagaacatgtatccctcctcgt

SEQ ID NO: 474798 - DNA, 25 bp, Rattus norvegicus
gtaaagaacccacgtgatccgattt

SEQ ID NO: 474799 - DNA, 25 bp, Rattus norvegicus
gtaaagaacccaggtgatccgattt

SEQ ID NO: 474800 - DNA, 25 bp, Rattus norvegicus
gtaaagaacggcctgaatttcatgt

SEQ ID NO: 474801 - DNA, 25 bp, Rattus norvegicus
gtaaagaacggcgtgaatttcatgt

SEQ ID NO: 474802 - DNA, 25 bp, Rattus norvegicus
gtaaagaagtgacccagaccctgtg

SEQ ID NO: 474803 - DNA, 25 bp, Rattus norvegicus
gtaaagaagtgagccagaccctgtg

SEQ ID NO: 474804 - DNA, 25 bp, Rattus norvegicus
gtaaagaagtttcgctcctgcccac

SEQ ID NO: 474805 - DNA, 25 bp, Rattus norvegicus
gtaaagaagtttggctcctgcccac

SEQ ID NO: 474806 - DNA, 25 bp, Rattus norvegicus
gtaaagaatcgcctggactaccata

SEQ ID NO: 474807 - DNA, 25 bp, Rattus norvegicus
gtaaagaatcgcgtggactaccata

SEQ ID NO: 474808 - DNA, 25 bp, Rattus norvegicus
gtaaagacacggaatccgcaagtgt

SEQ ID NO: 474809 - DNA, 25 bp, Rattus norvegicus
gtaaagacacggtatccgcaagtgt

SEQ ID NO: 474810 - DNA, 25 bp, Rattus norvegicus
gtaaagacagaccttggcccgcatt

SEQ ID NO: 474811 - DNA, 25 bp, Rattus norvegicus
gtaaagacagacgttggcccgcatt

SEQ ID NO: 474812 - DNA, 25 bp, Rattus norvegicus
gtaaagacagatattcctccacact

SEQ ID NO: 474813 - DNA, 25 bp, Rattus norvegicus
gtaaagacagattttcctccacact

SEQ ID NO: 474814 - DNA, 25 bp, Rattus norvegicus
gtaaagacagcgcacagcagtgatg

SEQ ID NO: 474815 - DNA, 25 bp, Rattus norvegicus
gtaaagacagcggacagcagtgatg

SEQ ID NO: 474816 - DNA, 25 bp, Rattus norvegicus
gtaaagaccagacttcctttgctcc

SEQ ID NO: 474817 - DNA, 25 bp, Rattus norvegicus
gtaaagaccagagttcctttgctcc

SEQ ID NO: 474818 - DNA, 25 bp, Rattus norvegicus
gtaaagacccggatttagcccagct

SEQ ID NO: 474819 - DNA, 25 bp, Rattus norvegicus
gtaaagacccggttttagcccagct

SEQ ID NO: 474820 - DNA, 25 bp, Rattus norvegicus
gtaaagacctacactggcatgattt

SEQ ID NO: 474821 - DNA, 25 bp, Rattus norvegicus
gtaaagacctactctggcatgattt

SEQ ID NO: 474822 - DNA, 25 bp, Rattus norvegicus
gtaaagacgactctgggccaggcat

SEQ ID NO: 474823 - DNA, 25 bp, Rattus norvegicus
gtaaagacgactgtgggccaggcat

SEQ ID NO: 474824 - DNA, 25 bp, Rattus norvegicus
gtaaagacgtttagccattatttga

SEQ ID NO: 474825 - DNA, 25 bp, Rattus norvegicus
gtaaagacgttttgccattatttga

SEQ ID NO: 474826 - DNA, 25 bp, Rattus norvegicus
gtaaagactgttagctgccttccaa

SEQ ID NO: 474827 - DNA, 25 bp, Rattus norvegicus
gtaaagactgtttgctgccttccaa

SEQ ID NO: 474828 - DNA, 25 bp, Rattus norvegicus
gtaaagacttttctgcatgatcctc

SEQ ID NO: 474829 - DNA, 25 bp, Rattus norvegicus
gtaaagacttttgtgcatgatcctc

SEQ ID NO: 474830 - DNA, 25 bp, Rattus norvegicus
gtaaagagacgacccgctgactcac

SEQ ID NO: 474831 - DNA, 25 bp, Rattus norvegicus
gtaaagagacgagccgctgactcac

SEQ ID NO: 474832 - DNA, 25 bp, Rattus norvegicus
gtaaagagcagtcaccatggtattt

SEQ ID NO: 474833 - DNA, 25 bp, Rattus norvegicus
gtaaagagcagtgaccatggtattt

SEQ ID NO: 474834 - DNA, 25 bp, Rattus norvegicus
gtaaagagccctctggttcattgcc

SEQ ID NO: 474835 - DNA, 25 bp, Rattus norvegicus
gtaaagagccctgtggttcattgcc

SEQ ID NO: 474836 - DNA, 25 bp, Rattus norvegicus
gtaaagaggctcagcacatcgtccc

SEQ ID NO: 474837 - DNA, 25 bp, Rattus norvegicus
gtaaagaggctctgcacatcgtccc

SEQ ID NO: 474838 - DNA, 25 bp, Rattus norvegicus
gtaaagagtctgacttctgggctgg

SEQ ID NO: 474839 - DNA, 25 bp, Rattus norvegicus
gtaaagagtctgtcttctgggctgg

SEQ ID NO: 474840 - DNA, 25 bp, Rattus norvegicus
gtaaagatcacgctgcgccaggcat

SEQ ID NO: 474841 - DNA, 25 bp, Rattus norvegicus
gtaaagatcacggtgcgccaggcat

SEQ ID NO: 474842 - DNA, 25 bp, Rattus norvegicus
gtaaagatggcaccctcccatgtgc

SEQ ID NO: 474843 - DNA, 25 bp, Rattus norvegicus
gtaaagatggcagcctcccatgtgc

SEQ ID NO: 474844 - DNA, 25 bp, Rattus norvegicus
gtaaagatggccacttgattccaaa

SEQ ID NO: 474845 - DNA, 25 bp, Rattus norvegicus
gtaaagatggcctcttgattccaaa

SEQ ID NO: 474846 - DNA, 25 bp, Rattus norvegicus
gtaaagatgtttaggcctctgctcc

SEQ ID NO: 474847 - DNA, 25 bp, Rattus norvegicus
gtaaagatgttttggcctctgctcc

SEQ ID NO: 474848 - DNA, 25 bp, Rattus norvegicus
gtaaagattctgattcttctcctat

SEQ ID NO: 474849 - DNA, 25 bp, Rattus norvegicus
gtaaagattctgtttcttctcctat

SEQ ID NO: 474850 - DNA, 25 bp, Rattus norvegicus
gtaaagcaaactattttgtgccttg

SEQ ID NO: 474851 - DNA, 25 bp, Rattus norvegicus
gtaaagcaaacttttttgtgccttg

SEQ ID NO: 474852 - DNA, 25 bp, Rattus norvegicus
gtaaagcactgtaacttctcaagtt

SEQ ID NO: 474853 - DNA, 25 bp, Rattus norvegicus
gtaaagcactgttacttctcaagtt

SEQ ID NO: 474854 - DNA, 25 bp, Rattus norvegicus
gtaaagcacttgcattaaatatgtt

SEQ ID NO: 474855 - DNA, 25 bp, Rattus norvegicus
gtaaagcacttggattaaatatgtt

SEQ ID NO: 474856 - DNA, 25 bp, Rattus norvegicus
gtaaagcagcatcagttgttctcat

SEQ ID NO: 474857 - DNA, 25 bp, Rattus norvegicus
gtaaagcagcatgagttgttctcat

SEQ ID NO: 474858 - DNA, 25 bp, Rattus norvegicus
gtaaagcagttcctaaggccaggtt

SEQ ID NO: 474859 - DNA, 25 bp, Rattus norvegicus
gtaaagcagttcgtaaggccaggtt

SEQ ID NO: 474860 - DNA, 25 bp, Rattus norvegicus
gtaaagcatcagatagcacacagta

SEQ ID NO: 474861 - DNA, 25 bp, Rattus norvegicus
gtaaagcatcagttagcacacagta

SEQ ID NO: 474862 - DNA, 25 bp, Rattus norvegicus
gtaaagcatcccagtgacctgttaa

SEQ ID NO: 474863 - DNA, 25 bp, Rattus norvegicus
gtaaagcatccctgtgacctgttaa

SEQ ID NO: 474864 - DNA, 25 bp, Rattus norvegicus
gtaaagcatcttcagcatcacgaac

SEQ ID NO: 474865 - DNA, 25 bp, Rattus norvegicus
gtaaagcatcttgagcatcacgaac

SEQ ID NO: 474866 - DNA, 25 bp, Rattus norvegicus
gtaaagcatgttaccaatctggttc

SEQ ID NO: 474867 - DNA, 25 bp, Rattus norvegicus
gtaaagcatgtttccaatctggttc

SEQ ID NO: 474868 - DNA, 25 bp, Rattus norvegicus
gtaaagcattacctccactatggaa

SEQ ID NO: 474869 - DNA, 25 bp, Rattus norvegicus
gtaaagcattacgtccactatggaa

SEQ ID NO: 474870 - DNA, 25 bp, Rattus norvegicus
gtaaagccactgaactgagacctgt

SEQ ID NO: 474871 - DNA, 25 bp, Rattus norvegicus
gtaaagccactgtactgagacctgt

SEQ ID NO: 474872 - DNA, 25 bp, Rattus norvegicus
gtaaagccatttaaccaggactcag

SEQ ID NO: 474873 - DNA, 25 bp, Rattus norvegicus
gtaaagccattttaccaggactcag

SEQ ID NO: 474874 - DNA, 25 bp, Rattus norvegicus
gtaaagcccacactaatctgcacaa

SEQ ID NO: 474875 - DNA, 25 bp, Rattus norvegicus
gtaaagcccacagtaatctgcacaa

SEQ ID NO: 474876 - DNA, 25 bp, Rattus norvegicus
gtaaagcccctaaggttctaatcag

SEQ ID NO: 474877 - DNA, 25 bp, Rattus norvegicus
gtaaagcccctatggttctaatcag

SEQ ID NO: 474878 - DNA, 25 bp, Rattus norvegicus
gtaaagcccttactgacccataggt

SEQ ID NO: 474879 - DNA, 25 bp, Rattus norvegicus
gtaaagcccttagtgacccataggt

SEQ ID NO: 474880 - DNA, 25 bp, Rattus norvegicus
gtaaagcctgtaacatttgccatgt

SEQ ID NO: 474881 - DNA, 25 bp, Rattus norvegicus
gtaaagcctgtatcatttgccatgt

SEQ ID NO: 474882 - DNA, 25 bp, Rattus norvegicus
gtaaagcgctctccttcctgttttt

SEQ ID NO: 474883 - DNA, 25 bp, Rattus norvegicus
gtaaagcgctctgcttcctgttttt

SEQ ID NO: 474884 - DNA, 25 bp, Rattus norvegicus
gtaaagctagccacatgtttcctgt

SEQ ID NO: 474885 - DNA, 25 bp, Rattus norvegicus
gtaaagctagcctcatgtttcctgt

SEQ ID NO: 474886 - DNA, 25 bp, Rattus norvegicus
gtaaagctcacaaatgcactcactc

SEQ ID NO: 474887 - DNA, 25 bp, Rattus norvegicus
gtaaagctcacatatgcactcactc

SEQ ID NO: 474888 - DNA, 25 bp, Rattus norvegicus
gtaaagctccaaaatccagtctcaa

SEQ ID NO: 474889 - DNA, 25 bp, Rattus norvegicus
gtaaagctccaatatccagtctcaa

SEQ ID NO: 474890 - DNA, 25 bp, Rattus norvegicus
gtaaagctccgtcctacagcagtgt

SEQ ID NO: 474891 - DNA, 25 bp, Rattus norvegicus
gtaaagctccgtgctacagcagtgt

SEQ ID NO: 474892 - DNA, 25 bp, Rattus norvegicus
gtaaagctctctcaaatcgtgacct

SEQ ID NO: 474893 - DNA, 25 bp, Rattus norvegicus
gtaaagctctctgaaatcgtgacct

SEQ ID NO: 474894 - DNA, 25 bp, Rattus norvegicus
gtaaagctctggatctcacactgta

SEQ ID NO: 474895 - DNA, 25 bp, Rattus norvegicus
gtaaagctctggttctcacactgta

SEQ ID NO: 474896 - DNA, 25 bp, Rattus norvegicus
gtaaagctcttgaactttgattaag

SEQ ID NO: 474897 - DNA, 25 bp, Rattus norvegicus
gtaaagctcttgtactttgattaag

SEQ ID NO: 474898 - DNA, 25 bp, Rattus norvegicus
gtaaagctgaggctccaggaattcc

SEQ ID NO: 474899 - DNA, 25 bp, Rattus norvegicus
gtaaagctgagggtccaggaattcc

SEQ ID NO: 474900 - DNA, 25 bp, Rattus norvegicus
gtaaagctgctcatctagccatggt

SEQ ID NO: 474901 - DNA, 25 bp, Rattus norvegicus
gtaaagctgctcttctagccatggt

SEQ ID NO: 474902 - DNA, 25 bp, Rattus norvegicus
gtaaagctgctgacttctaagtctg

SEQ ID NO: 474903 - DNA, 25 bp, Rattus norvegicus
gtaaagctgctgtcttctaagtctg

SEQ ID NO: 474904 - DNA, 25 bp, Rattus norvegicus
gtaaagcttcacagactcctcaaat

SEQ ID NO: 474905 - DNA, 25 bp, Rattus norvegicus
gtaaagcttcactgactcctcaaat

SEQ ID NO: 474906 - DNA, 25 bp, Rattus norvegicus
gtaaagctttatcaggaccatgtct

SEQ ID NO: 474907 - DNA, 25 bp, Rattus norvegicus
gtaaagctttatgaggaccatgtct

SEQ ID NO: 474908 - DNA, 25 bp, Rattus norvegicus
gtaaaggaaacacctctcagaaacg

SEQ ID NO: 474909 - DNA, 25 bp, Rattus norvegicus
gtaaaggaaacagctctcagaaacg

SEQ ID NO: 474910 - DNA, 25 bp, Rattus norvegicus
gtaaaggaacttatggtttcaccat

SEQ ID NO: 474911 - DNA, 25 bp, Rattus norvegicus
gtaaaggaacttttggtttcaccat

SEQ ID NO: 474912 - DNA, 25 bp, Rattus norvegicus
gtaaaggaccatatttgccttcccg

SEQ ID NO: 474913 - DNA, 25 bp, Rattus norvegicus
gtaaaggaccatttttgccttcccg

SEQ ID NO: 474914 - DNA, 25 bp, Rattus norvegicus
gtaaaggactctctctgtacagtat

SEQ ID NO: 474915 - DNA, 25 bp, Rattus norvegicus
gtaaaggactctgtctgtacagtat

SEQ ID NO: 474916 - DNA, 25 bp, Rattus norvegicus
gtaaaggagattacctgtcatagta

SEQ ID NO: 474917 - DNA, 25 bp, Rattus norvegicus
gtaaaggagatttcctgtcatagta

SEQ ID NO: 474918 - DNA, 25 bp, Rattus norvegicus
gtaaaggcagcccaggaatccaatg

SEQ ID NO: 474919 - DNA, 25 bp, Rattus norvegicus
gtaaaggcagccgaggaatccaatg

SEQ ID NO: 474920 - DNA, 25 bp, Rattus norvegicus
gtaaaggcagcgattcccaaacctc

SEQ ID NO: 474921 - DNA, 25 bp, Rattus norvegicus
gtaaaggcagcgtttcccaaacctc

SEQ ID NO: 474922 - DNA, 25 bp, Rattus norvegicus
gtaaaggcattcacaaagtatcatt

SEQ ID NO: 474923 - DNA, 25 bp, Rattus norvegicus
gtaaaggcattctcaaagtatcatt

SEQ ID NO: 474924 - DNA, 25 bp, Rattus norvegicus
gtaaaggccaaccaagtcttcgaga

SEQ ID NO: 474925 - DNA, 25 bp, Rattus norvegicus
gtaaaggccaacgaagtcttcgaga

SEQ ID NO: 474926 - DNA, 25 bp, Rattus norvegicus
gtaaaggccactaccaaggatgcat

SEQ ID NO: 474927 - DNA, 25 bp, Rattus norvegicus
gtaaaggccacttccaaggatgcat

SEQ ID NO: 474928 - DNA, 25 bp, Rattus norvegicus
gtaaaggccatgctagggtgacatt

SEQ ID NO: 474929 - DNA, 25 bp, Rattus norvegicus
gtaaaggccatggtagggtgacatt

SEQ ID NO: 474930 - DNA, 25 bp, Rattus norvegicus
gtaaaggcccacactaaaatgtcta

SEQ ID NO: 474931 - DNA, 25 bp, Rattus norvegicus
gtaaaggcccactctaaaatgtcta

SEQ ID NO: 474932 - DNA, 25 bp, Rattus norvegicus
gtaaaggcctctccataaggacttt

SEQ ID NO: 474933 - DNA, 25 bp, Rattus norvegicus
gtaaaggcctctgcataaggacttt

SEQ ID NO: 474934 - DNA, 25 bp, Rattus norvegicus
gtaaaggcctttagcttctttgtgg

SEQ ID NO: 474935 - DNA, 25 bp, Rattus norvegicus
gtaaaggccttttgcttctttgtgg

SEQ ID NO: 474936 - DNA, 25 bp, Rattus norvegicus
gtaaaggcggacacctactgtgcat

SEQ ID NO: 474937 - DNA, 25 bp, Rattus norvegicus
gtaaaggcggactcctactgtgcat

SEQ ID NO: 474938 - DNA, 25 bp, Rattus norvegicus
gtaaaggcgtgaatagccccttcgc

SEQ ID NO: 474939 - DNA, 25 bp, Rattus norvegicus
gtaaaggcgtgattagccccttcgc

SEQ ID NO: 474940 - DNA, 25 bp, Rattus norvegicus
gtaaaggctagtctgaaccagtcta

SEQ ID NO: 474941 - DNA, 25 bp, Rattus norvegicus
gtaaaggctagtgtgaaccagtcta

SEQ ID NO: 474942 - DNA, 25 bp, Rattus norvegicus
gtaaaggctcccaataagtcactgc

SEQ ID NO: 474943 - DNA, 25 bp, Rattus norvegicus
gtaaaggctccctataagtcactgc

SEQ ID NO: 474944 - DNA, 25 bp, Rattus norvegicus
gtaaaggctgtactcttaacttgga

SEQ ID NO: 474945 - DNA, 25 bp, Rattus norvegicus
gtaaaggctgtagtcttaacttgga

SEQ ID NO: 474946 - DNA, 25 bp, Rattus norvegicus
gtaaagggactgctgtcacgtcttc

SEQ ID NO: 474947 - DNA, 25 bp, Rattus norvegicus
gtaaagggactggtgtcacgtcttc

SEQ ID NO: 474948 - DNA, 25 bp, Rattus norvegicus
gtaaagggcatacccggccaggcct

SEQ ID NO: 474949 - DNA, 25 bp, Rattus norvegicus
gtaaagggcatagccggccaggcct

SEQ ID NO: 474950 - DNA, 25 bp, Rattus norvegicus
gtaaagggtacaagactgttgtaat

SEQ ID NO: 474951 - DNA, 25 bp, Rattus norvegicus
gtaaagggtacatgactgttgtaat

SEQ ID NO: 474952 - DNA, 25 bp, Rattus norvegicus
gtaaaggtacctcccgccaaagctg

SEQ ID NO: 474953 - DNA, 25 bp, Rattus norvegicus
gtaaaggtacctgccgccaaagctg

SEQ ID NO: 474954 - DNA, 25 bp, Rattus norvegicus
gtaaaggtcaccaaagcctccattt

SEQ ID NO: 474955 - DNA, 25 bp, Rattus norvegicus
gtaaaggtcacctaagcctccattt

SEQ ID NO: 474956 - DNA, 25 bp, Rattus norvegicus
gtaaaggtcctgctccatgaaccag

SEQ ID NO: 474957 - DNA, 25 bp, Rattus norvegicus
gtaaaggtcctggtccatgaaccag

SEQ ID NO: 474958 - DNA, 25 bp, Rattus norvegicus
gtaaaggtctacagcatccctggga

SEQ ID NO: 474959 - DNA, 25 bp, Rattus norvegicus
gtaaaggtctactgcatccctggga

SEQ ID NO: 474960 - DNA, 25 bp, Rattus norvegicus
gtaaaggtctttacagccaatcaaa

SEQ ID NO: 474961 - DNA, 25 bp, Rattus norvegicus
gtaaaggtcttttcagccaatcaaa

SEQ ID NO: 474962 - DNA, 25 bp, Rattus norvegicus
gtaaaggtgcatacatctgctgtta

SEQ ID NO: 474963 - DNA, 25 bp, Rattus norvegicus
gtaaaggtgcattcatctgctgtta

SEQ ID NO: 474964 - DNA, 25 bp, Rattus norvegicus
gtaaaggtgcggaccccaaatctgt

SEQ ID NO: 474965 - DNA, 25 bp, Rattus norvegicus
gtaaaggtgcggtccccaaatctgt

SEQ ID NO: 474966 - DNA, 25 bp, Rattus norvegicus
gtaaaggttggtctgctccaaagcc

SEQ ID NO: 474967 - DNA, 25 bp, Rattus norvegicus
gtaaaggttggtgtgctccaaagcc

SEQ ID NO: 474968 - DNA, 25 bp, Rattus norvegicus
gtaaaggtttacactgaagcttagt

SEQ ID NO: 474969 - DNA, 25 bp, Rattus norvegicus
gtaaaggtttactctgaagcttagt

SEQ ID NO: 474970 - DNA, 25 bp, Rattus norvegicus
gtaaaggttttgatatcgcccaaca

SEQ ID NO: 474971 - DNA, 25 bp, Rattus norvegicus
gtaaaggttttgttatcgcccaaca

SEQ ID NO: 474972 - DNA, 25 bp, Rattus norvegicus
gtaaagtaccgcctcagtcttcaag

SEQ ID NO: 474973 - DNA, 25 bp, Rattus norvegicus
gtaaagtaccgcgtcagtcttcaag

SEQ ID NO: 474974 - DNA, 25 bp, Rattus norvegicus
gtaaagtacttcagtctccagctac

SEQ ID NO: 474975 - DNA, 25 bp, Rattus norvegicus
gtaaagtacttctgtctccagctac

SEQ ID NO: 474976 - DNA, 25 bp, Rattus norvegicus
gtaaagtcccacaccaaaaagcaca

SEQ ID NO: 474977 - DNA, 25 bp, Rattus norvegicus
gtaaagtcccactccaaaaagcaca

SEQ ID NO: 474978 - DNA, 25 bp, Rattus norvegicus
gtaaagtcctgaaatcctaagcata

SEQ ID NO: 474979 - DNA, 25 bp, Rattus norvegicus
gtaaagtcctgatatcctaagcata

SEQ ID NO: 474980 - DNA, 25 bp, Rattus norvegicus
gtaaagtcgcagaccttacagacgc

SEQ ID NO: 474981 - DNA, 25 bp, Rattus norvegicus
gtaaagtcgcagtccttacagacgc

SEQ ID NO: 474982 - DNA, 25 bp, Rattus norvegicus
gtaaagtcggctacacaactcacat

SEQ ID NO: 474983 - DNA, 25 bp, Rattus norvegicus
gtaaagtcggcttcacaactcacat

SEQ ID NO: 474984 - DNA, 25 bp, Rattus norvegicus
gtaaagtgagatccccttcgcactc

SEQ ID NO: 474985 - DNA, 25 bp, Rattus norvegicus
gtaaagtgagatgcccttcgcactc

SEQ ID NO: 474986 - DNA, 25 bp, Rattus norvegicus
gtaaagtgccttactgctctaacag

SEQ ID NO: 474987 - DNA, 25 bp, Rattus norvegicus
gtaaagtgcctttctgctctaacag

SEQ ID NO: 474988 - DNA, 25 bp, Rattus norvegicus
gtaaagtgctttcacctctcggttc

SEQ ID NO: 474989 - DNA, 25 bp, Rattus norvegicus
gtaaagtgctttgacctctcggttc

SEQ ID NO: 474990 - DNA, 25 bp, Rattus norvegicus
gtaaagtggcacatgccttcatccc

SEQ ID NO: 474991 - DNA, 25 bp, Rattus norvegicus
gtaaagtggcacttgccttcatccc

SEQ ID NO: 474992 - DNA, 25 bp, Rattus norvegicus
gtaaagttattaatccagagagtat

SEQ ID NO: 474993 - DNA, 25 bp, Rattus norvegicus
gtaaagttattattccagagagtat

SEQ ID NO: 474994 - DNA, 25 bp, Rattus norvegicus
gtaaagttcatcctggtgttgagct

SEQ ID NO: 474995 - DNA, 25 bp, Rattus norvegicus
gtaaagttcatcgtggtgttgagct

SEQ ID NO: 474996 - DNA, 25 bp, Rattus norvegicus
gtaaagttctgcaccaatgtcttat

SEQ ID NO: 474997 - DNA, 25 bp, Rattus norvegicus
gtaaagttctgctccaatgtcttat

SEQ ID NO: 474998 - DNA, 25 bp, Rattus norvegicus
gtaaagttgtttaccactgtggtgt

SEQ ID NO: 474999 - DNA, 25 bp, Rattus norvegicus
gtaaagttgttttccactgtggtgt

SEQ ID NO: 475000 - DNA, 25 bp, Rattus norvegicus
gtaaataaacccagagccctcacta

SEQ ID NO: 475001 - DNA, 25 bp, Rattus norvegicus
gtaaataaaccctgagccctcacta

SEQ ID NO: 475002 - DNA, 25 bp, Rattus norvegicus
gtaaataaagatattctcagtggtc

SEQ ID NO: 475003 - DNA, 25 bp, Rattus norvegicus
gtaaataaagattttctcagtggtc

SEQ ID NO: 475004 - DNA, 25 bp, Rattus norvegicus
gtaaataacggcagccttctcgcat

SEQ ID NO: 475005 - DNA, 25 bp, Rattus norvegicus
gtaaataacggctgccttctcgcat

SEQ ID NO: 475006 - DNA, 25 bp, Rattus norvegicus
gtaaataatcgccattctcctgtct

SEQ ID NO: 475007 - DNA, 25 bp, Rattus norvegicus
gtaaataatcgcgattctcctgtct

SEQ ID NO: 475008 - DNA, 25 bp, Rattus norvegicus
gtaaatacacccacgtactggacgc

SEQ ID NO: 475009 - DNA, 25 bp, Rattus norvegicus
gtaaatacaccctcgtactggacgc

SEQ ID NO: 475010 - DNA, 25 bp, Rattus norvegicus
gtaaatacactcatcctgaccaatg

SEQ ID NO: 475011 - DNA, 25 bp, Rattus norvegicus
gtaaatacactcatctcctggctgg

SEQ ID NO: 475012 - DNA, 25 bp, Rattus norvegicus
gtaaatacactcttcctgaccaatg

SEQ ID NO: 475013 - DNA, 25 bp, Rattus norvegicus
gtaaatacactcttctcctggctgg

SEQ ID NO: 475014 - DNA, 25 bp, Rattus norvegicus
gtaaatacagtgacttagggctttg

SEQ ID NO: 475015 - DNA, 25 bp, Rattus norvegicus
gtaaatacagtgtcttagggctttg

SEQ ID NO: 475016 - DNA, 25 bp, Rattus norvegicus
gtaaataccacaaaacctgctccag

SEQ ID NO: 475017 - DNA, 25 bp, Rattus norvegicus
gtaaataccacataacctgctccag

SEQ ID NO: 475018 - DNA, 25 bp, Rattus norvegicus
gtaaataccgtacataacagcaatc

SEQ ID NO: 475019 - DNA, 25 bp, Rattus norvegicus
gtaaataccgtagataacagcaatc

SEQ ID NO: 475020 - DNA, 25 bp, Rattus norvegicus
gtaaatacctgaaatgctgggaaat

SEQ ID NO: 475021 - DNA, 25 bp, Rattus norvegicus
gtaaatacctgatatgctgggaaat

SEQ ID NO: 475022 - DNA, 25 bp, Rattus norvegicus
gtaaataccttgaagaagcgttctg

SEQ ID NO: 475023 - DNA, 25 bp, Rattus norvegicus
gtaaataccttgcttgacctccgtt

SEQ ID NO: 475024 - DNA, 25 bp, Rattus norvegicus
gtaaataccttggttgacctccgtt

SEQ ID NO: 475025 - DNA, 25 bp, Rattus norvegicus
gtaaataccttgtagaagcgttctg

SEQ ID NO: 475026 - DNA, 25 bp, Rattus norvegicus
gtaaatacctttatgagtgcagtta

SEQ ID NO: 475027 - DNA, 25 bp, Rattus norvegicus
gtaaatacctttttgagtgcagtta

SEQ ID NO: 475028 - DNA, 25 bp, Rattus norvegicus
gtaaatacgtatatcctgatgtgat

SEQ ID NO: 475029 - DNA, 25 bp, Rattus norvegicus
gtaaatacgtatttcctgatgtgat

SEQ ID NO: 475030 - DNA, 25 bp, Rattus norvegicus
gtaaatacgtgtcaaaatctggagt

SEQ ID NO: 475031 - DNA, 25 bp, Rattus norvegicus
gtaaatacgtgtgaaaatctggagt

SEQ ID NO: 475032 - DNA, 25 bp, Rattus norvegicus
gtaaatactaccatctcagctcttc

SEQ ID NO: 475033 - DNA, 25 bp, Rattus norvegicus
gtaaatactaccttctcagctcttc

SEQ ID NO: 475034 - DNA, 25 bp, Rattus norvegicus
gtaaatactccccatactagctttt

SEQ ID NO: 475035 - DNA, 25 bp, Rattus norvegicus
gtaaatactcccgatactagctttt

SEQ ID NO: 475036 - DNA, 25 bp, Rattus norvegicus
gtaaatactcctaccatagctgatt

SEQ ID NO: 475037 - DNA, 25 bp, Rattus norvegicus
gtaaatactccttccatagctgatt

SEQ ID NO: 475038 - DNA, 25 bp, Rattus norvegicus
gtaaatactctgaaaccttcttgtt

SEQ ID NO: 475039 - DNA, 25 bp, Rattus norvegicus
gtaaatactctgtaaccttcttgtt

SEQ ID NO: 475040 - DNA, 25 bp, Rattus norvegicus
gtaaatactgggacgtgccaccgcc

SEQ ID NO: 475041 - DNA, 25 bp, Rattus norvegicus
gtaaatactgggtcgtgccaccgcc

SEQ ID NO: 475042 - DNA, 25 bp, Rattus norvegicus
gtaaatacttctctgcatttcaaaa

SEQ ID NO: 475043 - DNA, 25 bp, Rattus norvegicus
gtaaatacttctgtgcatttcaaaa

SEQ ID NO: 475044 - DNA, 25 bp, Rattus norvegicus
gtaaatacttgcacttgggacctaa

SEQ ID NO: 475045 - DNA, 25 bp, Rattus norvegicus
gtaaatacttgctcttgggacctaa

SEQ ID NO: 475046 - DNA, 25 bp, Rattus norvegicus
gtaaatagcctgatgcacatccgaa

SEQ ID NO: 475047 - DNA, 25 bp, Rattus norvegicus
gtaaatagcctgttgcacatccgaa

SEQ ID NO: 475048 - DNA, 25 bp, Rattus norvegicus
gtaaataggctccaggttcctttgt

SEQ ID NO: 475049 - DNA, 25 bp, Rattus norvegicus
gtaaataggctcgaggttcctttgt

SEQ ID NO: 475050 - DNA, 25 bp, Rattus norvegicus
gtaaatatcccaatcatcttctcta

SEQ ID NO: 475051 - DNA, 25 bp, Rattus norvegicus
gtaaatatcccattcatcttctcta

SEQ ID NO: 475052 - DNA, 25 bp, Rattus norvegicus
gtaaatatggctacttcctgaatga

SEQ ID NO: 475053 - DNA, 25 bp, Rattus norvegicus
gtaaatatggcttcttcctgaatga

SEQ ID NO: 475054 - DNA, 25 bp, Rattus norvegicus
gtaaatatgtacagactcttgtatg

SEQ ID NO: 475055 - DNA, 25 bp, Rattus norvegicus
gtaaatatgtactgactcttgtatg

SEQ ID NO: 475056 - DNA, 25 bp, Rattus norvegicus
gtaaatatgtctactacctcctggg

SEQ ID NO: 475057 - DNA, 25 bp, Rattus norvegicus
gtaaatatgtcttctacctcctggg

SEQ ID NO: 475058 - DNA, 25 bp, Rattus norvegicus
gtaaatatgtgcatcccttcactga

SEQ ID NO: 475059 - DNA, 25 bp, Rattus norvegicus
gtaaatatgtgcttcccttcactga

SEQ ID NO: 475060 - DNA, 25 bp, Rattus norvegicus
gtaaatatgtttcccctagttgaat

SEQ ID NO: 475061 - DNA, 25 bp, Rattus norvegicus
gtaaatatgtttgccctagttgaat

SEQ ID NO: 475062 - DNA, 25 bp, Rattus norvegicus
gtaaatattccaaagcaggctgcct

SEQ ID NO: 475063 - DNA, 25 bp, Rattus norvegicus
gtaaatattccatagcaggctgcct

SEQ ID NO: 475064 - DNA, 25 bp, Rattus norvegicus
gtaaatattcccaagcagctgttag

SEQ ID NO: 475065 - DNA, 25 bp, Rattus norvegicus
gtaaatattccctagcagctgttag

SEQ ID NO: 475066 - DNA, 25 bp, Rattus norvegicus
gtaaatattcttcgccacgttctac

SEQ ID NO: 475067 - DNA, 25 bp, Rattus norvegicus
gtaaatattcttggccacgttctac

SEQ ID NO: 475068 - DNA, 25 bp, Rattus norvegicus
gtaaatatttctcccactgacttgt

SEQ ID NO: 475069 - DNA, 25 bp, Rattus norvegicus
gtaaatatttctgccactgacttgt

SEQ ID NO: 475070 - DNA, 25 bp, Rattus norvegicus
gtaaatatttgacatgcctctctaa

SEQ ID NO: 475071 - DNA, 25 bp, Rattus norvegicus
gtaaatatttgagatgcctctctaa

SEQ ID NO: 475072 - DNA, 25 bp, Rattus norvegicus
gtaaatcaaggccaacaggtctata

SEQ ID NO: 475073 - DNA, 25 bp, Rattus norvegicus
gtaaatcaaggcgaacaggtctata

SEQ ID NO: 475074 - DNA, 25 bp, Rattus norvegicus
gtaaatcacagtcagctccggatgt

SEQ ID NO: 475075 - DNA, 25 bp, Rattus norvegicus
gtaaatcacagtgagctccggatgt

SEQ ID NO: 475076 - DNA, 25 bp, Rattus norvegicus
gtaaatcaccatagctctcagagtc

SEQ ID NO: 475077 - DNA, 25 bp, Rattus norvegicus
gtaaatcaccattgctctcagagtc

SEQ ID NO: 475078 - DNA, 25 bp, Rattus norvegicus
gtaaatcaccggatcactatccatt

SEQ ID NO: 475079 - DNA, 25 bp, Rattus norvegicus
gtaaatcaccggttcactatccatt

SEQ ID NO: 475080 - DNA, 25 bp, Rattus norvegicus
gtaaatcaccttacttgaatagcaa

SEQ ID NO: 475081 - DNA, 25 bp, Rattus norvegicus
gtaaatcacctttcttgaatagcaa

SEQ ID NO: 475082 - DNA, 25 bp, Rattus norvegicus
gtaaatcagtgactttcgccattgt

SEQ ID NO: 475083 - DNA, 25 bp, Rattus norvegicus
gtaaatcagtgagtttcgccattgt

SEQ ID NO: 475084 - DNA, 25 bp, Rattus norvegicus
gtaaatcatattcatcatgcactgt

SEQ ID NO: 475085 - DNA, 25 bp, Rattus norvegicus
gtaaatcatattgatcatgcactgt

SEQ ID NO: 475086 - DNA, 25 bp, Rattus norvegicus
gtaaatcatcctaatatatgtctaa

SEQ ID NO: 475087 - DNA, 25 bp, Rattus norvegicus
gtaaatcatccttatatatgtctaa

SEQ ID NO: 475088 - DNA, 25 bp, Rattus norvegicus
gtaaatcatggccaatctaccttcc

SEQ ID NO: 475089 - DNA, 25 bp, Rattus norvegicus
gtaaatcatggcgaatctaccttcc

SEQ ID NO: 475090 - DNA, 25 bp, Rattus norvegicus
gtaaatccaacaccaccgggcgagg

SEQ ID NO: 475091 - DNA, 25 bp, Rattus norvegicus
gtaaatccaacagcaccgggcgagg

SEQ ID NO: 475092 - DNA, 25 bp, Rattus norvegicus
gtaaatccacccaatgagagagaga

SEQ ID NO: 475093 - DNA, 25 bp, Rattus norvegicus
gtaaatccaccctatgagagagaga

SEQ ID NO: 475094 - DNA, 25 bp, Rattus norvegicus
gtaaatccagtaacaatcagctttg

SEQ ID NO: 475095 - DNA, 25 bp, Rattus norvegicus
gtaaatccagtatcaatcagctttg

SEQ ID NO: 475096 - DNA, 25 bp, Rattus norvegicus
gtaaatccatttcctgcatgttctc

SEQ ID NO: 475097 - DNA, 25 bp, Rattus norvegicus
gtaaatccatttgctgcatgttctc

SEQ ID NO: 475098 - DNA, 25 bp, Rattus norvegicus
gtaaatcccaatcactttgcctcac

SEQ ID NO: 475099 - DNA, 25 bp, Rattus norvegicus
gtaaatcccaatgactttgcctcac

SEQ ID NO: 475100 - DNA, 25 bp, Rattus norvegicus
gtaaatcccagtctttcgtgaatta

SEQ ID NO: 475101 - DNA, 25 bp, Rattus norvegicus
gtaaatcccagtgtttcgtgaatta

SEQ ID NO: 475102 - DNA, 25 bp, Rattus norvegicus
gtaaatcctaaacaaggcaccacaa

SEQ ID NO: 475103 - DNA, 25 bp, Rattus norvegicus
gtaaatcctaaagaaggcaccacaa

SEQ ID NO: 475104 - DNA, 25 bp, Rattus norvegicus
gtaaatcctcaaagttttgatccat

SEQ ID NO: 475105 - DNA, 25 bp, Rattus norvegicus
gtaaatcctcaatgttttgatccat

SEQ ID NO: 475106 - DNA, 25 bp, Rattus norvegicus
gtaaatcctgaacacgagccaatcc

SEQ ID NO: 475107 - DNA, 25 bp, Rattus norvegicus
gtaaatcctgaagacgagccaatcc

SEQ ID NO: 475108 - DNA, 25 bp, Rattus norvegicus
gtaaatccttacaccttcgcagaac

SEQ ID NO: 475109 - DNA, 25 bp, Rattus norvegicus
gtaaatccttactccttcgcagaac

SEQ ID NO: 475110 - DNA, 25 bp, Rattus norvegicus
gtaaatccttctcggaaacctgcct

SEQ ID NO: 475111 - DNA, 25 bp, Rattus norvegicus
gtaaatccttctgggaaacctgcct

SEQ ID NO: 475112 - DNA, 25 bp, Rattus norvegicus
gtaaatcgcgtcatcaggtgttttt

SEQ ID NO: 475113 - DNA, 25 bp, Rattus norvegicus
gtaaatcgcgtcttcaggtgttttt

SEQ ID NO: 475114 - DNA, 25 bp, Rattus norvegicus
gtaaatctcggtcgcatctgtaatt

SEQ ID NO: 475115 - DNA, 25 bp, Rattus norvegicus
gtaaatctcggtggcatctgtaatt

SEQ ID NO: 475116 - DNA, 25 bp, Rattus norvegicus
gtaaatctctttctcctggaaaaga

SEQ ID NO: 475117 - DNA, 25 bp, Rattus norvegicus
gtaaatctctttgtcctggaaaaga

SEQ ID NO: 475118 - DNA, 25 bp, Rattus norvegicus
gtaaatctgagtcagagtcagctca

SEQ ID NO: 475119 - DNA, 25 bp, Rattus norvegicus
gtaaatctgagtgagagtcagctca

SEQ ID NO: 475120 - DNA, 25 bp, Rattus norvegicus
gtaaatctgatccaattcttccatg

SEQ ID NO: 475121 - DNA, 25 bp, Rattus norvegicus
gtaaatctgatcgaattcttccatg

SEQ ID NO: 475122 - DNA, 25 bp, Rattus norvegicus
gtaaatctgtctcatactttttcta

SEQ ID NO: 475123 - DNA, 25 bp, Rattus norvegicus
gtaaatctgtctgatactttttcta

SEQ ID NO: 475124 - DNA, 25 bp, Rattus norvegicus
gtaaatcttaaccttctgcctagga

SEQ ID NO: 475125 - DNA, 25 bp, Rattus norvegicus
gtaaatcttaacgttctgcctagga

SEQ ID NO: 475126 - DNA, 25 bp, Rattus norvegicus
gtaaatcttcctactggctgtggta

SEQ ID NO: 475127 - DNA, 25 bp, Rattus norvegicus
gtaaatcttccttctggctgtggta

SEQ ID NO: 475128 - DNA, 25 bp, Rattus norvegicus
gtaaatcttgtccacacagtcagcc

SEQ ID NO: 475129 - DNA, 25 bp, Rattus norvegicus
gtaaatcttgtcgacacagtcagcc

SEQ ID NO: 475130 - DNA, 25 bp, Rattus norvegicus
gtaaatctttgcacagggatctaga

SEQ ID NO: 475131 - DNA, 25 bp, Rattus norvegicus
gtaaatctttgctcagggatctaga

SEQ ID NO: 475132 - DNA, 25 bp, Rattus norvegicus
gtaaatgaaattagagacacactca

SEQ ID NO: 475133 - DNA, 25 bp, Rattus norvegicus
gtaaatgaaatttgagacacactca

SEQ ID NO: 475134 - DNA, 25 bp, Rattus norvegicus
gtaaatgaacagacgcagatagagc

SEQ ID NO: 475135 - DNA, 25 bp, Rattus norvegicus
gtaaatgaacagtcgcagatagagc

SEQ ID NO: 475136 - DNA, 25 bp, Rattus norvegicus
gtaaatgacagactgccagagcccc

SEQ ID NO: 475137 - DNA, 25 bp, Rattus norvegicus
gtaaatgacagagtgccagagcccc

SEQ ID NO: 475138 - DNA, 25 bp, Rattus norvegicus
gtaaatgaccctcaccgaatggaca

SEQ ID NO: 475139 - DNA, 25 bp, Rattus norvegicus
gtaaatgaccctgaccgaatggaca

SEQ ID NO: 475140 - DNA, 25 bp, Rattus norvegicus
gtaaatgactttctcagttcttatc

SEQ ID NO: 475141 - DNA, 25 bp, Rattus norvegicus
gtaaatgactttgtcagttcttatc

SEQ ID NO: 475142 - DNA, 25 bp, Rattus norvegicus
gtaaatgagcatcttccccacagtt

SEQ ID NO: 475143 - DNA, 25 bp, Rattus norvegicus
gtaaatgagcatgttccccacagtt

SEQ ID NO: 475144 - DNA, 25 bp, Rattus norvegicus
gtaaatgagcttcaccttgtgcaaa

SEQ ID NO: 475145 - DNA, 25 bp, Rattus norvegicus
gtaaatgagcttgaccttgtgcaaa

SEQ ID NO: 475146 - DNA, 25 bp, Rattus norvegicus
gtaaatgatcttcttctgatacaca

SEQ ID NO: 475147 - DNA, 25 bp, Rattus norvegicus
gtaaatgatcttgttctgatacaca

SEQ ID NO: 475148 - DNA, 25 bp, Rattus norvegicus
gtaaatgatgaaaacatacctggtg

SEQ ID NO: 475149 - DNA, 25 bp, Rattus norvegicus
gtaaatgatgaatacatacctggtg

SEQ ID NO: 475150 - DNA, 25 bp, Rattus norvegicus
gtaaatgatgtgaacagataactct

SEQ ID NO: 475151 - DNA, 25 bp, Rattus norvegicus
gtaaatgatgtgtacagataactct

SEQ ID NO: 475152 - DNA, 25 bp, Rattus norvegicus
gtaaatgatgttctgcatgctctca

SEQ ID NO: 475153 - DNA, 25 bp, Rattus norvegicus
gtaaatgatgttgtgcatgctctca

SEQ ID NO: 475154 - DNA, 25 bp, Rattus norvegicus
gtaaatgcagttacatccagtccca

SEQ ID NO: 475155 - DNA, 25 bp, Rattus norvegicus
gtaaatgcagtttcatccagtccca

SEQ ID NO: 475156 - DNA, 25 bp, Rattus norvegicus
gtaaatgcatcaacagccaggctag

SEQ ID NO: 475157 - DNA, 25 bp, Rattus norvegicus
gtaaatgcatcatcagccaggctag

SEQ ID NO: 475158 - DNA, 25 bp, Rattus norvegicus
gtaaatgcatctccccttggtatgt

SEQ ID NO: 475159 - DNA, 25 bp, Rattus norvegicus
gtaaatgcatctgcccttggtatgt

SEQ ID NO: 475160 - DNA, 25 bp, Rattus norvegicus
gtaaatgccaaactacagacttgat

SEQ ID NO: 475161 - DNA, 25 bp, Rattus norvegicus
gtaaatgccaaagtacagacttgat

SEQ ID NO: 475162 - DNA, 25 bp, Rattus norvegicus
gtaaatgccagtccagttagtgttg

SEQ ID NO: 475163 - DNA, 25 bp, Rattus norvegicus
gtaaatgccagtgcagttagtgttg

SEQ ID NO: 475164 - DNA, 25 bp, Rattus norvegicus
gtaaatgccctgagtgtgaccttcc

SEQ ID NO: 475165 - DNA, 25 bp, Rattus norvegicus
gtaaatgccctgtgtgtgaccttcc

SEQ ID NO: 475166 - DNA, 25 bp, Rattus norvegicus
gtaaatgcctcactccttttaatgc

SEQ ID NO: 475167 - DNA, 25 bp, Rattus norvegicus
gtaaatgcctcagtccttttaatgc

SEQ ID NO: 475168 - DNA, 25 bp, Rattus norvegicus
gtaaatgctactacattggtaataa

SEQ ID NO: 475169 - DNA, 25 bp, Rattus norvegicus
gtaaatgctacttcattggtaataa

SEQ ID NO: 475170 - DNA, 25 bp, Rattus norvegicus
gtaaatgctcaacaaacctcactgg

SEQ ID NO: 475171 - DNA, 25 bp, Rattus norvegicus
gtaaatgctcaagaaacctcactgg

SEQ ID NO: 475172 - DNA, 25 bp, Rattus norvegicus
gtaaatgctctcaaggatgctgtcc

SEQ ID NO: 475173 - DNA, 25 bp, Rattus norvegicus
gtaaatgctctctaggatgctgtcc

SEQ ID NO: 475174 - DNA, 25 bp, Rattus norvegicus
gtaaatgctgtcactggaaggactt

SEQ ID NO: 475175 - DNA, 25 bp, Rattus norvegicus
gtaaatgctgtctctggaaggactt

SEQ ID NO: 475176 - DNA, 25 bp, Rattus norvegicus
gtaaatggaaagagcagggaactct

SEQ ID NO: 475177 - DNA, 25 bp, Rattus norvegicus
gtaaatggaaagtgcagggaactct

SEQ ID NO: 475178 - DNA, 25 bp, Rattus norvegicus
gtaaatggacagaagccacctaaaa

SEQ ID NO: 475179 - DNA, 25 bp, Rattus norvegicus
gtaaatggacagtagccacctaaaa

SEQ ID NO: 475180 - DNA, 25 bp, Rattus norvegicus
gtaaatggacataggtgtaaccctt

SEQ ID NO: 475181 - DNA, 25 bp, Rattus norvegicus
gtaaatggacattggtgtaaccctt

SEQ ID NO: 475182 - DNA, 25 bp, Rattus norvegicus
gtaaatggatccctagataccctag

SEQ ID NO: 475183 - DNA, 25 bp, Rattus norvegicus
gtaaatggatccgtagataccctag

SEQ ID NO: 475184 - DNA, 25 bp, Rattus norvegicus
gtaaatggcattcttaccgccggaa

SEQ ID NO: 475185 - DNA, 25 bp, Rattus norvegicus
gtaaatggcattgttaccgccggaa

SEQ ID NO: 475186 - DNA, 25 bp, Rattus norvegicus
gtaaatgggtcacatcaggttcagt

SEQ ID NO: 475187 - DNA, 25 bp, Rattus norvegicus
gtaaatgggtcagatcaggttcagt

SEQ ID NO: 475188 - DNA, 25 bp, Rattus norvegicus
gtaaatgggtttacagcattcactg

SEQ ID NO: 475189 - DNA, 25 bp, Rattus norvegicus
gtaaatgggttttcagcattcactg

SEQ ID NO: 475190 - DNA, 25 bp, Rattus norvegicus
gtaaatggtacgcactcttcaaata

SEQ ID NO: 475191 - DNA, 25 bp, Rattus norvegicus
gtaaatggtacggactcttcaaata

SEQ ID NO: 475192 - DNA, 25 bp, Rattus norvegicus
gtaaatggtcatcctttgtctcctt

SEQ ID NO: 475193 - DNA, 25 bp, Rattus norvegicus
gtaaatggtcatgctttgtctcctt

SEQ ID NO: 475194 - DNA, 25 bp, Rattus norvegicus
gtaaatggtcttagtattcttccaa

SEQ ID NO: 475195 - DNA, 25 bp, Rattus norvegicus
gtaaatggtctttgtattcttccaa

SEQ ID NO: 475196 - DNA, 25 bp, Rattus norvegicus
gtaaatggtttactacagctgtttt

SEQ ID NO: 475197 - DNA, 25 bp, Rattus norvegicus
gtaaatggtttagtacagctgtttt

SEQ ID NO: 475198 - DNA, 25 bp, Rattus norvegicus
gtaaatgtacccagaaagtctgatt

SEQ ID NO: 475199 - DNA, 25 bp, Rattus norvegicus
gtaaatgtaccctgaaagtctgatt

SEQ ID NO: 475200 - DNA, 25 bp, Rattus norvegicus
gtaaatgtcagcatcttcaccaagt

SEQ ID NO: 475201 - DNA, 25 bp, Rattus norvegicus
gtaaatgtcagccaagccctggaat

SEQ ID NO: 475202 - DNA, 25 bp, Rattus norvegicus
gtaaatgtcagcgaagccctggaat

SEQ ID NO: 475203 - DNA, 25 bp, Rattus norvegicus
gtaaatgtcagcttcttcaccaagt

SEQ ID NO: 475204 - DNA, 25 bp, Rattus norvegicus
gtaaatgtcctacattctcacgctc

SEQ ID NO: 475205 - DNA, 25 bp, Rattus norvegicus
gtaaatgtcctagattctcacgctc

SEQ ID NO: 475206 - DNA, 25 bp, Rattus norvegicus
gtaaatgtctacctgatctaagccc

SEQ ID NO: 475207 - DNA, 25 bp, Rattus norvegicus
gtaaatgtctacgtgatctaagccc

SEQ ID NO: 475208 - DNA, 25 bp, Rattus norvegicus
gtaaatgtctttaaatttctccaga

SEQ ID NO: 475209 - DNA, 25 bp, Rattus norvegicus
gtaaatgtcttttaatttctccaga

SEQ ID NO: 475210 - DNA, 25 bp, Rattus norvegicus
gtaaatgtgcatagagaccgctaca

SEQ ID NO: 475211 - DNA, 25 bp, Rattus norvegicus
gtaaatgtgcattgagaccgctaca

SEQ ID NO: 475212 - DNA, 25 bp, Rattus norvegicus
gtaaatgtgcttagttgctttaaat

SEQ ID NO: 475213 - DNA, 25 bp, Rattus norvegicus
gtaaatgtgctttgttgctttaaat

SEQ ID NO: 475214 - DNA, 25 bp, Rattus norvegicus
gtaaatgtggccatttgtctttgta

SEQ ID NO: 475215 - DNA, 25 bp, Rattus norvegicus
gtaaatgtggccttttgtctttgta

SEQ ID NO: 475216 - DNA, 25 bp, Rattus norvegicus
gtaaatgtggtgagccctgttttaa

SEQ ID NO: 475217 - DNA, 25 bp, Rattus norvegicus
gtaaatgtggtgtgccctgttttaa

SEQ ID NO: 475218 - DNA, 25 bp, Rattus norvegicus
gtaaatgtgtacatggtcctttcct

SEQ ID NO: 475219 - DNA, 25 bp, Rattus norvegicus
gtaaatgtgtacttggtcctttcct

SEQ ID NO: 475220 - DNA, 25 bp, Rattus norvegicus
gtaaatgttctaccaatttgctgta

SEQ ID NO: 475221 - DNA, 25 bp, Rattus norvegicus
gtaaatgttctagcaatttgctgta

SEQ ID NO: 475222 - DNA, 25 bp, Rattus norvegicus
gtaaatgttgaacccagctggcctg

SEQ ID NO: 475223 - DNA, 25 bp, Rattus norvegicus
gtaaatgttgaagccagctggcctg

SEQ ID NO: 475224 - DNA, 25 bp, Rattus norvegicus
gtaaatgtttctcccttcagctcta

SEQ ID NO: 475225 - DNA, 25 bp, Rattus norvegicus
gtaaatgtttctgccttcagctcta

SEQ ID NO: 475226 - DNA, 25 bp, Rattus norvegicus
gtaaatgttttgaagctgccagcag

SEQ ID NO: 475227 - DNA, 25 bp, Rattus norvegicus
gtaaatgttttgtagctgccagcag

SEQ ID NO: 475228 - DNA, 25 bp, Rattus norvegicus
gtaaattacaatccacacgtccgtt

SEQ ID NO: 475229 - DNA, 25 bp, Rattus norvegicus
gtaaattacaatgcacacgtccgtt

SEQ ID NO: 475230 - DNA, 25 bp, Rattus norvegicus
gtaaattatatgaggacatccaact

SEQ ID NO: 475231 - DNA, 25 bp, Rattus norvegicus
gtaaattatatgtggacatccaact

SEQ ID NO: 475232 - DNA, 25 bp, Rattus norvegicus
gtaaattatgctaccaaccttgtat

SEQ ID NO: 475233 - DNA, 25 bp, Rattus norvegicus
gtaaattatgcttccaaccttgtat

SEQ ID NO: 475234 - DNA, 25 bp, Rattus norvegicus
gtaaattcacatatcttctgagaga

SEQ ID NO: 475235 - DNA, 25 bp, Rattus norvegicus
gtaaattcacatttcttctgagaga

SEQ ID NO: 475236 - DNA, 25 bp, Rattus norvegicus
gtaaattcactgctactttgccaaa

SEQ ID NO: 475237 - DNA, 25 bp, Rattus norvegicus
gtaaattcactggtactttgccaaa

SEQ ID NO: 475238 - DNA, 25 bp, Rattus norvegicus
gtaaattcaggcaccattcgcaagg

SEQ ID NO: 475239 - DNA, 25 bp, Rattus norvegicus
gtaaattcaggctccattcgcaagg

SEQ ID NO: 475240 - DNA, 25 bp, Rattus norvegicus
gtaaattccacaatcttagctcctt

SEQ ID NO: 475241 - DNA, 25 bp, Rattus norvegicus
gtaaattccacattcttagctcctt

SEQ ID NO: 475242 - DNA, 25 bp, Rattus norvegicus
gtaaattccagtatctcttcaagac

SEQ ID NO: 475243 - DNA, 25 bp, Rattus norvegicus
gtaaattccagtttctcttcaagac

SEQ ID NO: 475244 - DNA, 25 bp, Rattus norvegicus
gtaaattccattaaagcctcagcat

SEQ ID NO: 475245 - DNA, 25 bp, Rattus norvegicus
gtaaattccatttaagcctcagcat

SEQ ID NO: 475246 - DNA, 25 bp, Rattus norvegicus
gtaaattccctgactctatttcaat

SEQ ID NO: 475247 - DNA, 25 bp, Rattus norvegicus
gtaaattccctgagaccgtggattt

SEQ ID NO: 475248 - DNA, 25 bp, Rattus norvegicus
gtaaattccctgtctctatttcaat

SEQ ID NO: 475249 - DNA, 25 bp, Rattus norvegicus
gtaaattccctgtgaccgtggattt

SEQ ID NO: 475250 - DNA, 25 bp, Rattus norvegicus
gtaaattcctcaccacatacaggca

SEQ ID NO: 475251 - DNA, 25 bp, Rattus norvegicus
gtaaattcctcagcacatacaggca

SEQ ID NO: 475252 - DNA, 25 bp, Rattus norvegicus
gtaaattctcagcaactgaccgaca

SEQ ID NO: 475253 - DNA, 25 bp, Rattus norvegicus
gtaaattctcaggaactgaccgaca

SEQ ID NO: 475254 - DNA, 25 bp, Rattus norvegicus
gtaaattctctaagacgaaccacag

SEQ ID NO: 475255 - DNA, 25 bp, Rattus norvegicus
gtaaattctctaatattctccataa

SEQ ID NO: 475256 - DNA, 25 bp, Rattus norvegicus
gtaaattctctatgacgaaccacag

SEQ ID NO: 475257 - DNA, 25 bp, Rattus norvegicus
gtaaattctctattattctccataa

SEQ ID NO: 475258 - DNA, 25 bp, Rattus norvegicus
gtaaattctgccaccagtgatttga

SEQ ID NO: 475259 - DNA, 25 bp, Rattus norvegicus
gtaaattctgcctccagtgatttga

SEQ ID NO: 475260 - DNA, 25 bp, Rattus norvegicus
gtaaattgcaatctggatgtccctg

SEQ ID NO: 475261 - DNA, 25 bp, Rattus norvegicus
gtaaattgcaatgtggatgtccctg

SEQ ID NO: 475262 - DNA, 25 bp, Rattus norvegicus
gtaaattgccctcactgatgccagc

SEQ ID NO: 475263 - DNA, 25 bp, Rattus norvegicus
gtaaattgccctgactgatgccagc

SEQ ID NO: 475264 - DNA, 25 bp, Rattus norvegicus
gtaaattgtcatccccaatgtagac

SEQ ID NO: 475265 - DNA, 25 bp, Rattus norvegicus
gtaaattgtcatgcccaatgtagac

SEQ ID NO: 475266 - DNA, 25 bp, Rattus norvegicus
gtaaattgttccctgaagccgcgct

SEQ ID NO: 475267 - DNA, 25 bp, Rattus norvegicus
gtaaattgttccgtgaagccgcgct

SEQ ID NO: 475268 - DNA, 25 bp, Rattus norvegicus
gtaaatttagttagcagttcctggt

SEQ ID NO: 475269 - DNA, 25 bp, Rattus norvegicus
gtaaatttagtttgcagttcctggt

SEQ ID NO: 475270 - DNA, 25 bp, Rattus norvegicus
gtaaatttcgtgagtgccctaacca

SEQ ID NO: 475271 - DNA, 25 bp, Rattus norvegicus
gtaaatttcgtgtgtgccctaacca

SEQ ID NO: 475272 - DNA, 25 bp, Rattus norvegicus
gtaaatttgactacctggagcggct

SEQ ID NO: 475273 - DNA, 25 bp, Rattus norvegicus
gtaaatttgacttcctggagcggct

SEQ ID NO: 475274 - DNA, 25 bp, Rattus norvegicus
gtaaatttgtgtatcattctttcta

SEQ ID NO: 475275 - DNA, 25 bp, Rattus norvegicus
gtaaatttgtgtttcattctttcta

SEQ ID NO: 475276 - DNA, 25 bp, Rattus norvegicus
gtaaattttcaacccttagctgagg

SEQ ID NO: 475277 - DNA, 25 bp, Rattus norvegicus
gtaaattttcaagccttagctgagg

SEQ ID NO: 475278 - DNA, 25 bp, Rattus norvegicus
gtaaattttcagacccctcatgtta

SEQ ID NO: 475279 - DNA, 25 bp, Rattus norvegicus
gtaaattttcagtcccctcatgtta

SEQ ID NO: 475280 - DNA, 25 bp, Rattus norvegicus
gtaaattttcttactctcttctcct

SEQ ID NO: 475281 - DNA, 25 bp, Rattus norvegicus
gtaaattttctttctctcttctcct

SEQ ID NO: 475282 - DNA, 25 bp, Rattus norvegicus
gtaaattttgatatcgaagagtatt

SEQ ID NO: 475283 - DNA, 25 bp, Rattus norvegicus
gtaaattttgatttcgaagagtatt

SEQ ID NO: 475284 - DNA, 25 bp, Rattus norvegicus
gtaaatttttgcacctgtcttctgt

SEQ ID NO: 475285 - DNA, 25 bp, Rattus norvegicus
gtaaatttttgctcctgtcttctgt

SEQ ID NO: 475286 - DNA, 25 bp, Rattus norvegicus
gtaacaaaagctcatctcctctagt

SEQ ID NO: 475287 - DNA, 25 bp, Rattus norvegicus
gtaacaaaagctgatctcctctagt

SEQ ID NO: 475288 - DNA, 25 bp, Rattus norvegicus
gtaacaaaataacctgctgccacct

SEQ ID NO: 475289 - DNA, 25 bp, Rattus norvegicus
gtaacaaaataagctgctgccacct

SEQ ID NO: 475290 - DNA, 25 bp, Rattus norvegicus
gtaacaaaccttaagccgtgggatg

SEQ ID NO: 475291 - DNA, 25 bp, Rattus norvegicus
gtaacaaacctttagccgtgggatg

SEQ ID NO: 475292 - DNA, 25 bp, Rattus norvegicus
gtaacaaagctgacgaagctcccct

SEQ ID NO: 475293 - DNA, 25 bp, Rattus norvegicus
gtaacaaagctgtcgaagctcccct

SEQ ID NO: 475294 - DNA, 25 bp, Rattus norvegicus
gtaacaaaggccacacaggtcatcc

SEQ ID NO: 475295 - DNA, 25 bp, Rattus norvegicus
gtaacaaaggcctcacaggtcatcc

SEQ ID NO: 475296 - DNA, 25 bp, Rattus norvegicus
gtaacaaatactaccagagaacggg

SEQ ID NO: 475297 - DNA, 25 bp, Rattus norvegicus
gtaacaaatacttccagagaacggg

SEQ ID NO: 475298 - DNA, 25 bp, Rattus norvegicus
gtaacaacaactacccacagcagag

SEQ ID NO: 475299 - DNA, 25 bp, Rattus norvegicus
gtaacaacaacttcccacagcagag

SEQ ID NO: 475300 - DNA, 25 bp, Rattus norvegicus
gtaacaacatcaacacactcttcag

SEQ ID NO: 475301 - DNA, 25 bp, Rattus norvegicus
gtaacaacatcatcacactcttcag

SEQ ID NO: 475302 - DNA, 25 bp, Rattus norvegicus
gtaacaactggcctcatcacttctg

SEQ ID NO: 475303 - DNA, 25 bp, Rattus norvegicus
gtaacaactggcgtcatcacttctg

SEQ ID NO: 475304 - DNA, 25 bp, Rattus norvegicus
gtaacaacttaaacatctctatgat

SEQ ID NO: 475305 - DNA, 25 bp, Rattus norvegicus
gtaacaacttaatcatctctatgat

SEQ ID NO: 475306 - DNA, 25 bp, Rattus norvegicus
gtaacaacttctcttagtccagtgt

SEQ ID NO: 475307 - DNA, 25 bp, Rattus norvegicus
gtaacaacttctgttagtccagtgt

SEQ ID NO: 475308 - DNA, 25 bp, Rattus norvegicus
gtaacaagacttcgagctctcagat

SEQ ID NO: 475309 - DNA, 25 bp, Rattus norvegicus
gtaacaagacttggagctctcagat

SEQ ID NO: 475310 - DNA, 25 bp, Rattus norvegicus
gtaacaagggcacctgtggctcagc

SEQ ID NO: 475311 - DNA, 25 bp, Rattus norvegicus
gtaacaagggcagctgtggctcagc

SEQ ID NO: 475312 - DNA, 25 bp, Rattus norvegicus
gtaacaagtcacaacctggtggcga

SEQ ID NO: 475313 - DNA, 25 bp, Rattus norvegicus
gtaacaagtcactacctggtggcga

SEQ ID NO: 475314 - DNA, 25 bp, Rattus norvegicus
gtaacaagttccaagatggccagag

SEQ ID NO: 475315 - DNA, 25 bp, Rattus norvegicus
gtaacaagttcctagatggccagag

SEQ ID NO: 475316 - DNA, 25 bp, Rattus norvegicus
gtaacaatacacatcattcctgcaa

SEQ ID NO: 475317 - DNA, 25 bp, Rattus norvegicus
gtaacaatacacttcattcctgcaa

SEQ ID NO: 475318 - DNA, 25 bp, Rattus norvegicus
gtaacaatatccagtctccacaaac

SEQ ID NO: 475319 - DNA, 25 bp, Rattus norvegicus
gtaacaatatcctgtctccacaaac

SEQ ID NO: 475320 - DNA, 25 bp, Rattus norvegicus
gtaacaatcaggacaatcccaggaa

SEQ ID NO: 475321 - DNA, 25 bp, Rattus norvegicus
gtaacaatcaggtcaatcccaggaa

SEQ ID NO: 475322 - DNA, 25 bp, Rattus norvegicus
gtaacaatctaaagccactggtcca

SEQ ID NO: 475323 - DNA, 25 bp, Rattus norvegicus
gtaacaatctaatgccactggtcca

SEQ ID NO: 475324 - DNA, 25 bp, Rattus norvegicus
gtaacaatgtaccacagggctgtca

SEQ ID NO: 475325 - DNA, 25 bp, Rattus norvegicus
gtaacaatgtacgacagggctgtca

SEQ ID NO: 475326 - DNA, 25 bp, Rattus norvegicus
gtaacaattacaccaagagacagaa

SEQ ID NO: 475327 - DNA, 25 bp, Rattus norvegicus
gtaacaattacagcaagagacagaa

SEQ ID NO: 475328 - DNA, 25 bp, Rattus norvegicus
gtaacaattctcattctctgcttaa

SEQ ID NO: 475329 - DNA, 25 bp, Rattus norvegicus
gtaacaattctctttctctgcttaa

SEQ ID NO: 475330 - DNA, 25 bp, Rattus norvegicus
gtaacaattcttcggactctgagtg

SEQ ID NO: 475331 - DNA, 25 bp, Rattus norvegicus
gtaacaattcttgggactctgagtg

SEQ ID NO: 475332 - DNA, 25 bp, Rattus norvegicus
gtaacacaatgcactggtaaccaag

SEQ ID NO: 475333 - DNA, 25 bp, Rattus norvegicus
gtaacacaatgctctggtaaccaag

SEQ ID NO: 475334 - DNA, 25 bp, Rattus norvegicus
gtaacacacaaaagtacagcaccac

SEQ ID NO: 475335 - DNA, 25 bp, Rattus norvegicus
gtaacacacaaatgtacagcaccac

SEQ ID NO: 475336 - DNA, 25 bp, Rattus norvegicus
gtaacacacaccaagctttttccta

SEQ ID NO: 475337 - DNA, 25 bp, Rattus norvegicus
gtaacacacacctagctttttccta

SEQ ID NO: 475338 - DNA, 25 bp, Rattus norvegicus
gtaacacacttaaggagcagcgcat

SEQ ID NO: 475339 - DNA, 25 bp, Rattus norvegicus
gtaacacacttatggagcagcgcat

SEQ ID NO: 475340 - DNA, 25 bp, Rattus norvegicus
gtaacacagaaactgcacgctaagt

SEQ ID NO: 475341 - DNA, 25 bp, Rattus norvegicus
gtaacacagaaagtgcacgctaagt

SEQ ID NO: 475342 - DNA, 25 bp, Rattus norvegicus
gtaacacagaccagacagtgctctc

SEQ ID NO: 475343 - DNA, 25 bp, Rattus norvegicus
gtaacacagacctgacagtgctctc

SEQ ID NO: 475344 - DNA, 25 bp, Rattus norvegicus
gtaacacagattaccctgatttttg

SEQ ID NO: 475345 - DNA, 25 bp, Rattus norvegicus
gtaacacagatttccctgatttttg

SEQ ID NO: 475346 - DNA, 25 bp, Rattus norvegicus
gtaacacagcccaaatgacctgagt

SEQ ID NO: 475347 - DNA, 25 bp, Rattus norvegicus
gtaacacagccctaatgacctgagt

SEQ ID NO: 475348 - DNA, 25 bp, Rattus norvegicus
gtaacacagctgacaattgtccgcc

SEQ ID NO: 475349 - DNA, 25 bp, Rattus norvegicus
gtaacacagctgtcaattgtccgcc

SEQ ID NO: 475350 - DNA, 25 bp, Rattus norvegicus
gtaacacagttccatgcccagtgaa

SEQ ID NO: 475351 - DNA, 25 bp, Rattus norvegicus
gtaacacagttcgatgcccagtgaa

SEQ ID NO: 475352 - DNA, 25 bp, Rattus norvegicus
gtaacacatgctcactttaccttcc

SEQ ID NO: 475353 - DNA, 25 bp, Rattus norvegicus
gtaacacatgctgactttaccttcc

SEQ ID NO: 475354 - DNA, 25 bp, Rattus norvegicus
gtaacacatttgaataaacttctta

SEQ ID NO: 475355 - DNA, 25 bp, Rattus norvegicus
gtaacacatttgtataaacttctta

SEQ ID NO: 475356 - DNA, 25 bp, Rattus norvegicus
gtaacacattttagaatcgtcccca

SEQ ID NO: 475357 - DNA, 25 bp, Rattus norvegicus
gtaacacatttttgaatcgtcccca

SEQ ID NO: 475358 - DNA, 25 bp, Rattus norvegicus
gtaacaccagcaccgtcaagtgcca

SEQ ID NO: 475359 - DNA, 25 bp, Rattus norvegicus
gtaacaccagcagcgtcaagtgcca

SEQ ID NO: 475360 - DNA, 25 bp, Rattus norvegicus
gtaacaccatctaatgtcccagtca

SEQ ID NO: 475361 - DNA, 25 bp, Rattus norvegicus
gtaacaccatcttatgtcccagtca

SEQ ID NO: 475362 - DNA, 25 bp, Rattus norvegicus
gtaacaccccatcaccaaacttgag

SEQ ID NO: 475363 - DNA, 25 bp, Rattus norvegicus
gtaacaccccatgaccaaacttgag

SEQ ID NO: 475364 - DNA, 25 bp, Rattus norvegicus
gtaacacccgaaaccatagacggta

SEQ ID NO: 475365 - DNA, 25 bp, Rattus norvegicus
gtaacacccgaatccatagacggta

SEQ ID NO: 475366 - DNA, 25 bp, Rattus norvegicus
gtaacaccctaacttcagaattcca

SEQ ID NO: 475367 - DNA, 25 bp, Rattus norvegicus
gtaacaccctaagttcagaattcca

SEQ ID NO: 475368 - DNA, 25 bp, Rattus norvegicus
gtaacacccttgacggtagcagctg

SEQ ID NO: 475369 - DNA, 25 bp, Rattus norvegicus
gtaacacccttgtcggtagcagctg

SEQ ID NO: 475370 - DNA, 25 bp, Rattus norvegicus
gtaacaccgctcaggttctaatgta

SEQ ID NO: 475371 - DNA, 25 bp, Rattus norvegicus
gtaacaccgctctggttctaatgta

SEQ ID NO: 475372 - DNA, 25 bp, Rattus norvegicus
gtaacacgagagcacaaagcagcat

SEQ ID NO: 475373 - DNA, 25 bp, Rattus norvegicus
gtaacacgagaggacaaagcagcat

SEQ ID NO: 475374 - DNA, 25 bp, Rattus norvegicus
gtaacacgctgcctgccaaagtagt

SEQ ID NO: 475375 - DNA, 25 bp, Rattus norvegicus
gtaacacgctgcgtgccaaagtagt

SEQ ID NO: 475376 - DNA, 25 bp, Rattus norvegicus
gtaacacgtaccatcctgttgtaat

SEQ ID NO: 475377 - DNA, 25 bp, Rattus norvegicus
gtaacacgtaccttcctgttgtaat

SEQ ID NO: 475378 - DNA, 25 bp, Rattus norvegicus
gtaacacgtcacagtactgattata

SEQ ID NO: 475379 - DNA, 25 bp, Rattus norvegicus
gtaacacgtcactgtactgattata

SEQ ID NO: 475380 - DNA, 25 bp, Rattus norvegicus
gtaacactactaatgaccctgaagc

SEQ ID NO: 475381 - DNA, 25 bp, Rattus norvegicus
gtaacactactattgaccctgaagc

SEQ ID NO: 475382 - DNA, 25 bp, Rattus norvegicus
gtaacactagtcaccaaacacatag

SEQ ID NO: 475383 - DNA, 25 bp, Rattus norvegicus
gtaacactagtctccaaacacatag

SEQ ID NO: 475384 - DNA, 25 bp, Rattus norvegicus
gtaacactcaagacactacagagcc

SEQ ID NO: 475385 - DNA, 25 bp, Rattus norvegicus
gtaacactcaagtcactacagagcc

SEQ ID NO: 475386 - DNA, 25 bp, Rattus norvegicus
gtaacactcatcaatccacaatgga

SEQ ID NO: 475387 - DNA, 25 bp, Rattus norvegicus
gtaacactcatctatccacaatgga

SEQ ID NO: 475388 - DNA, 25 bp, Rattus norvegicus
gtaacactctcacatttcctaaagg

SEQ ID NO: 475389 - DNA, 25 bp, Rattus norvegicus
gtaacactctcagatttcctaaagg

SEQ ID NO: 475390 - DNA, 25 bp, Rattus norvegicus
gtaacactgaatatctgtatgcctt

SEQ ID NO: 475391 - DNA, 25 bp, Rattus norvegicus
gtaacactgaatttctgtatgcctt

SEQ ID NO: 475392 - DNA, 25 bp, Rattus norvegicus
gtaacactgccaatttctctttgta

SEQ ID NO: 475393 - DNA, 25 bp, Rattus norvegicus
gtaacactgccattttctctttgta

SEQ ID NO: 475394 - DNA, 25 bp, Rattus norvegicus
gtaacactgctacacaagctctgtg

SEQ ID NO: 475395 - DNA, 25 bp, Rattus norvegicus
gtaacactgctagacaagctctgtg

SEQ ID NO: 475396 - DNA, 25 bp, Rattus norvegicus
gtaacactgcttctcatgaagcctg

SEQ ID NO: 475397 - DNA, 25 bp, Rattus norvegicus
gtaacactgcttgtcatgaagcctg

SEQ ID NO: 475398 - DNA, 25 bp, Rattus norvegicus
gtaacactggagaggaaccacctaa

SEQ ID NO: 475399 - DNA, 25 bp, Rattus norvegicus
gtaacactggagtggaaccacctaa

SEQ ID NO: 475400 - DNA, 25 bp, Rattus norvegicus
gtaacactggtccattaggctgagc

SEQ ID NO: 475401 - DNA, 25 bp, Rattus norvegicus
gtaacactggtcgattaggctgagc

SEQ ID NO: 475402 - DNA, 25 bp, Rattus norvegicus
gtaacacttacccaaccacgtgtgg

SEQ ID NO: 475403 - DNA, 25 bp, Rattus norvegicus
gtaacacttaccgaaccacgtgtgg

SEQ ID NO: 475404 - DNA, 25 bp, Rattus norvegicus
gtaacacttggaattaagcctcagt

SEQ ID NO: 475405 - DNA, 25 bp, Rattus norvegicus
gtaacacttggacagcacttggatt

SEQ ID NO: 475406 - DNA, 25 bp, Rattus norvegicus
gtaacacttggagagcacttggatt

SEQ ID NO: 475407 - DNA, 25 bp, Rattus norvegicus
gtaacacttggatttaagcctcagt

SEQ ID NO: 475408 - DNA, 25 bp, Rattus norvegicus
gtaacactttcactaaggctggaga

SEQ ID NO: 475409 - DNA, 25 bp, Rattus norvegicus
gtaacactttcagtaaggctggaga

SEQ ID NO: 475410 - DNA, 25 bp, Rattus norvegicus
gtaacactttttctactgcacatgt

SEQ ID NO: 475411 - DNA, 25 bp, Rattus norvegicus
gtaacactttttgtactgcacatgt

SEQ ID NO: 475412 - DNA, 25 bp, Rattus norvegicus
gtaacagaaagcctttgttcctggg

SEQ ID NO: 475413 - DNA, 25 bp, Rattus norvegicus
gtaacagaaagcgtttgttcctggg

SEQ ID NO: 475414 - DNA, 25 bp, Rattus norvegicus
gtaacagaacctctctggaagcaga

SEQ ID NO: 475415 - DNA, 25 bp, Rattus norvegicus
gtaacagaacctgtctggaagcaga

SEQ ID NO: 475416 - DNA, 25 bp, Rattus norvegicus
gtaacagaacgtccccaagggtcag

SEQ ID NO: 475417 - DNA, 25 bp, Rattus norvegicus
gtaacagaacgtgcccaagggtcag

SEQ ID NO: 475418 - DNA, 25 bp, Rattus norvegicus
gtaacagaatgcaagcggccctgag

SEQ ID NO: 475419 - DNA, 25 bp, Rattus norvegicus
gtaacagaatgctagcggccctgag

SEQ ID NO: 475420 - DNA, 25 bp, Rattus norvegicus
gtaacagaattcaccactttgcagt

SEQ ID NO: 475421 - DNA, 25 bp, Rattus norvegicus
gtaacagaattctccactttgcagt

SEQ ID NO: 475422 - DNA, 25 bp, Rattus norvegicus
gtaacagacatcagacggcatccat

SEQ ID NO: 475423 - DNA, 25 bp, Rattus norvegicus
gtaacagacatctgacggcatccat

SEQ ID NO: 475424 - DNA, 25 bp, Rattus norvegicus
gtaacagaccttcacttatttaaat

SEQ ID NO: 475425 - DNA, 25 bp, Rattus norvegicus
gtaacagaccttgacttatttaaat

SEQ ID NO: 475426 - DNA, 25 bp, Rattus norvegicus
gtaacagactaaacaggccgcagat

SEQ ID NO: 475427 - DNA, 25 bp, Rattus norvegicus
gtaacagactaatcaggccgcagat

SEQ ID NO: 475428 - DNA, 25 bp, Rattus norvegicus
gtaacagagaagaggcaaaccagcc

SEQ ID NO: 475429 - DNA, 25 bp, Rattus norvegicus
gtaacagagaagtggcaaaccagcc

SEQ ID NO: 475430 - DNA, 25 bp, Rattus norvegicus
gtaacagaggacatcgggcccaaat

SEQ ID NO: 475431 - DNA, 25 bp, Rattus norvegicus
gtaacagaggacttcgggcccaaat

SEQ ID NO: 475432 - DNA, 25 bp, Rattus norvegicus
gtaacagaggccatgtaccagacca

SEQ ID NO: 475433 - DNA, 25 bp, Rattus norvegicus
gtaacagaggccttgtaccagacca

SEQ ID NO: 475434 - DNA, 25 bp, Rattus norvegicus
gtaacagatcaaacaccggcgctaa

SEQ ID NO: 475435 - DNA, 25 bp, Rattus norvegicus
gtaacagatcaatcaccggcgctaa

SEQ ID NO: 475436 - DNA, 25 bp, Rattus norvegicus
gtaacagatcagagtccacgtgcca

SEQ ID NO: 475437 - DNA, 25 bp, Rattus norvegicus
gtaacagatcagtgtccacgtgcca

SEQ ID NO: 475438 - DNA, 25 bp, Rattus norvegicus
gtaacagatcctatcacttagcaat

SEQ ID NO: 475439 - DNA, 25 bp, Rattus norvegicus
gtaacagatcctttcacttagcaat

SEQ ID NO: 475440 - DNA, 25 bp, Rattus norvegicus
gtaacagatgctattttgaacactt

SEQ ID NO: 475441 - DNA, 25 bp, Rattus norvegicus
gtaacagatgcttttttgaacactt

SEQ ID NO: 475442 - DNA, 25 bp, Rattus norvegicus
gtaacagcaagtcaagacctatttt

SEQ ID NO: 475443 - DNA, 25 bp, Rattus norvegicus
gtaacagcaagtgaagacctatttt

SEQ ID NO: 475444 - DNA, 25 bp, Rattus norvegicus
gtaacagcaattacgcttgcaaaaa

SEQ ID NO: 475445 - DNA, 25 bp, Rattus norvegicus
gtaacagcaatttcgcttgcaaaaa

SEQ ID NO: 475446 - DNA, 25 bp, Rattus norvegicus
gtaacagcagacaacttcactttca

SEQ ID NO: 475447 - DNA, 25 bp, Rattus norvegicus
gtaacagcagactacttcactttca

SEQ ID NO: 475448 - DNA, 25 bp, Rattus norvegicus
gtaacagcagccattctcaaatcat

SEQ ID NO: 475449 - DNA, 25 bp, Rattus norvegicus
gtaacagcagcctttctcaaatcat

SEQ ID NO: 475450 - DNA, 25 bp, Rattus norvegicus
gtaacagcaggtaaactcaaacgct

SEQ ID NO: 475451 - DNA, 25 bp, Rattus norvegicus
gtaacagcaggtactactcctagaa

SEQ ID NO: 475452 - DNA, 25 bp, Rattus norvegicus
gtaacagcaggttaactcaaacgct

SEQ ID NO: 475453 - DNA, 25 bp, Rattus norvegicus
gtaacagcaggttctactcctagaa

SEQ ID NO: 475454 - DNA, 25 bp, Rattus norvegicus
gtaacagcatttctaccctgacctg

SEQ ID NO: 475455 - DNA, 25 bp, Rattus norvegicus
gtaacagcatttgtaccctgacctg

SEQ ID NO: 475456 - DNA, 25 bp, Rattus norvegicus
gtaacagcctctcgatttcacagga

SEQ ID NO: 475457 - DNA, 25 bp, Rattus norvegicus
gtaacagcctctggatttcacagga

SEQ ID NO: 475458 - DNA, 25 bp, Rattus norvegicus
gtaacagcgccaatggaggaccact

SEQ ID NO: 475459 - DNA, 25 bp, Rattus norvegicus
gtaacagcgccattggaggaccact

SEQ ID NO: 475460 - DNA, 25 bp, Rattus norvegicus
gtaacagctataaaatctctttcca

SEQ ID NO: 475461 - DNA, 25 bp, Rattus norvegicus
gtaacagctatataatctctttcca

SEQ ID NO: 475462 - DNA, 25 bp, Rattus norvegicus
gtaacagctcagaaccaagtgtcaa

SEQ ID NO: 475463 - DNA, 25 bp, Rattus norvegicus
gtaacagctcagtaccaagtgtcaa

SEQ ID NO: 475464 - DNA, 25 bp, Rattus norvegicus
gtaacagctctgatgtttcaaaaga

SEQ ID NO: 475465 - DNA, 25 bp, Rattus norvegicus
gtaacagctctgttgtttcaaaaga

SEQ ID NO: 475466 - DNA, 25 bp, Rattus norvegicus
gtaacagctggactcccaagtacaa

SEQ ID NO: 475467 - DNA, 25 bp, Rattus norvegicus
gtaacagctggagtcccaagtacaa

SEQ ID NO: 475468 - DNA, 25 bp, Rattus norvegicus
gtaacagctgttcctcaggtcaact

SEQ ID NO: 475469 - DNA, 25 bp, Rattus norvegicus
gtaacagctgttgctcaggtcaact

SEQ ID NO: 475470 - DNA, 25 bp, Rattus norvegicus
gtaacagcttccatacaactgcgct

SEQ ID NO: 475471 - DNA, 25 bp, Rattus norvegicus
gtaacagcttccttacaactgcgct

SEQ ID NO: 475472 - DNA, 25 bp, Rattus norvegicus
gtaacaggaagcaccttgacctctc

SEQ ID NO: 475473 - DNA, 25 bp, Rattus norvegicus
gtaacaggaagctccttgacctctc

SEQ ID NO: 475474 - DNA, 25 bp, Rattus norvegicus
gtaacaggatgtattcagtttcagt

SEQ ID NO: 475475 - DNA, 25 bp, Rattus norvegicus
gtaacaggatgttttcagtttcagt

SEQ ID NO: 475476 - DNA, 25 bp, Rattus norvegicus
gtaacaggattccagcctcgttgac

SEQ ID NO: 475477 - DNA, 25 bp, Rattus norvegicus
gtaacaggattcgagcctcgttgac

SEQ ID NO: 475478 - DNA, 25 bp, Rattus norvegicus
gtaacaggcaccacaggatttccgt

SEQ ID NO: 475479 - DNA, 25 bp, Rattus norvegicus
gtaacaggcaccattgactgctttt

SEQ ID NO: 475480 - DNA, 25 bp, Rattus norvegicus
gtaacaggcacctcaggatttccgt

SEQ ID NO: 475481 - DNA, 25 bp, Rattus norvegicus
gtaacaggcacctttgactgctttt

SEQ ID NO: 475482 - DNA, 25 bp, Rattus norvegicus
gtaacaggcattagtaacacttgta

SEQ ID NO: 475483 - DNA, 25 bp, Rattus norvegicus
gtaacaggcatttgtaacacttgta

SEQ ID NO: 475484 - DNA, 25 bp, Rattus norvegicus
gtaacaggctgacccgggtagacat

SEQ ID NO: 475485 - DNA, 25 bp, Rattus norvegicus
gtaacaggctgagccgggtagacat

SEQ ID NO: 475486 - DNA, 25 bp, Rattus norvegicus
gtaacagggaaactagctcttttat

SEQ ID NO: 475487 - DNA, 25 bp, Rattus norvegicus
gtaacagggaaagtagctcttttat

SEQ ID NO: 475488 - DNA, 25 bp, Rattus norvegicus
gtaacagggctgaccagaactcatc

SEQ ID NO: 475489 - DNA, 25 bp, Rattus norvegicus
gtaacagggctgtccagaactcatc

SEQ ID NO: 475490 - DNA, 25 bp, Rattus norvegicus
gtaacaggtaccatcttagaagcag

SEQ ID NO: 475491 - DNA, 25 bp, Rattus norvegicus
gtaacaggtaccttcttagaagcag

SEQ ID NO: 475492 - DNA, 25 bp, Rattus norvegicus
gtaacaggtcttatctaaactctag

SEQ ID NO: 475493 - DNA, 25 bp, Rattus norvegicus
gtaacaggtcttttctaaactctag

SEQ ID NO: 475494 - DNA, 25 bp, Rattus norvegicus
gtaacaggtgaaaggagactctttt

SEQ ID NO: 475495 - DNA, 25 bp, Rattus norvegicus
gtaacaggtgaatggagactctttt

SEQ ID NO: 475496 - DNA, 25 bp, Rattus norvegicus
gtaacaggtgccatgactcgctgag

SEQ ID NO: 475497 - DNA, 25 bp, Rattus norvegicus
gtaacaggtgccttgactcgctgag

SEQ ID NO: 475498 - DNA, 25 bp, Rattus norvegicus
gtaacaggtgttcttattaccacct

SEQ ID NO: 475499 - DNA, 25 bp, Rattus norvegicus
gtaacaggtgttgttattaccacct

SEQ ID NO: 475500 - DNA, 25 bp, Rattus norvegicus
gtaacagtacccagagtgacacatg

SEQ ID NO: 475501 - DNA, 25 bp, Rattus norvegicus
gtaacagtaccctgagtgacacatg

SEQ ID NO: 475502 - DNA, 25 bp, Rattus norvegicus
gtaacagtagcacctctggtgcctg

SEQ ID NO: 475503 - DNA, 25 bp, Rattus norvegicus
gtaacagtagcagctctggtgcctg

SEQ ID NO: 475504 - DNA, 25 bp, Rattus norvegicus
gtaacagtcaacaagcagctccttg

SEQ ID NO: 475505 - DNA, 25 bp, Rattus norvegicus
gtaacagtcaactagcagctccttg

SEQ ID NO: 475506 - DNA, 25 bp, Rattus norvegicus
gtaacagtccacatcaagaaccgag

SEQ ID NO: 475507 - DNA, 25 bp, Rattus norvegicus
gtaacagtccacttcaagaaccgag

SEQ ID NO: 475508 - DNA, 25 bp, Rattus norvegicus
gtaacagtctccctgttgtagaaat

SEQ ID NO: 475509 - DNA, 25 bp, Rattus norvegicus
gtaacagtctccgtgttgtagaaat

SEQ ID NO: 475510 - DNA, 25 bp, Rattus norvegicus
gtaacagtgaccctgtcttaagtat

SEQ ID NO: 475511 - DNA, 25 bp, Rattus norvegicus
gtaacagtgaccgtgtcttaagtat

SEQ ID NO: 475512 - DNA, 25 bp, Rattus norvegicus
gtaacagtgactacaaagcctttag

SEQ ID NO: 475513 - DNA, 25 bp, Rattus norvegicus
gtaacagtgacttcaaagcctttag

SEQ ID NO: 475514 - DNA, 25 bp, Rattus norvegicus
gtaacagttctcacgtgtcgacaca

SEQ ID NO: 475515 - DNA, 25 bp, Rattus norvegicus
gtaacagttctctcgtgtcgacaca

SEQ ID NO: 475516 - DNA, 25 bp, Rattus norvegicus
gtaacagttggcagtcacatctctg

SEQ ID NO: 475517 - DNA, 25 bp, Rattus norvegicus
gtaacagttggctgtcacatctctg

SEQ ID NO: 475518 - DNA, 25 bp, Rattus norvegicus
gtaacagttttaagagcccacggca

SEQ ID NO: 475519 - DNA, 25 bp, Rattus norvegicus
gtaacagttttatgagcccacggca

SEQ ID NO: 475520 - DNA, 25 bp, Rattus norvegicus
gtaacataactcaacatccttaatt

SEQ ID NO: 475521 - DNA, 25 bp, Rattus norvegicus
gtaacataactctacatccttaatt

SEQ ID NO: 475522 - DNA, 25 bp, Rattus norvegicus
gtaacataactgacaacccttgaag

SEQ ID NO: 475523 - DNA, 25 bp, Rattus norvegicus
gtaacataactgcttcttggagctt

SEQ ID NO: 475524 - DNA, 25 bp, Rattus norvegicus
gtaacataactggttcttggagctt

SEQ ID NO: 475525 - DNA, 25 bp, Rattus norvegicus
gtaacataactgtcaacccttgaag

SEQ ID NO: 475526 - DNA, 25 bp, Rattus norvegicus
gtaacataatgtattcttggccttt

SEQ ID NO: 475527 - DNA, 25 bp, Rattus norvegicus
gtaacataatgttttcttggccttt

SEQ ID NO: 475528 - DNA, 25 bp, Rattus norvegicus
gtaacatacggtccagctaacgatg

SEQ ID NO: 475529 - DNA, 25 bp, Rattus norvegicus
gtaacatacggtgcagctaacgatg

SEQ ID NO: 475530 - DNA, 25 bp, Rattus norvegicus
gtaacatactgtcaatcctcgtttg

SEQ ID NO: 475531 - DNA, 25 bp, Rattus norvegicus
gtaacatactgtgaatcctcgtttg

SEQ ID NO: 475532 - DNA, 25 bp, Rattus norvegicus
gtaacatagtttcagtcattccata

SEQ ID NO: 475533 - DNA, 25 bp, Rattus norvegicus
gtaacatagtttgagtcattccata

SEQ ID NO: 475534 - DNA, 25 bp, Rattus norvegicus
gtaacatatcctacatgactatttt

SEQ ID NO: 475535 - DNA, 25 bp, Rattus norvegicus
gtaacatatccttcatgactatttt

SEQ ID NO: 475536 - DNA, 25 bp, Rattus norvegicus
gtaacatcagagaccgttcttccag

SEQ ID NO: 475537 - DNA, 25 bp, Rattus norvegicus
gtaacatcagagtccgttcttccag

SEQ ID NO: 475538 - DNA, 25 bp, Rattus norvegicus
gtaacatcatgcatagggcttgggt

SEQ ID NO: 475539 - DNA, 25 bp, Rattus norvegicus
gtaacatcatgcttagggcttgggt

SEQ ID NO: 475540 - DNA, 25 bp, Rattus norvegicus
gtaacatccactagccacaattgat

SEQ ID NO: 475541 - DNA, 25 bp, Rattus norvegicus
gtaacatccacttgccacaattgat

SEQ ID NO: 475542 - DNA, 25 bp, Rattus norvegicus
gtaacatcctcactgttggcatgtg

SEQ ID NO: 475543 - DNA, 25 bp, Rattus norvegicus
gtaacatcctcagtgttggcatgtg

SEQ ID NO: 475544 - DNA, 25 bp, Rattus norvegicus
gtaacatcctccagtttgacagggt

SEQ ID NO: 475545 - DNA, 25 bp, Rattus norvegicus
gtaacatcctcctgtttgacagggt

SEQ ID NO: 475546 - DNA, 25 bp, Rattus norvegicus
gtaacatcctgaattacagcttcgg

SEQ ID NO: 475547 - DNA, 25 bp, Rattus norvegicus
gtaacatcctgatttacagcttcgg

SEQ ID NO: 475548 - DNA, 25 bp, Rattus norvegicus
gtaacatgctgaactcgtgaggtct

SEQ ID NO: 475549 - DNA, 25 bp, Rattus norvegicus
gtaacatgctgatctcgtgaggtct

SEQ ID NO: 475550 - DNA, 25 bp, Rattus norvegicus
gtaacatggacaagccatacagcac

SEQ ID NO: 475551 - DNA, 25 bp, Rattus norvegicus
gtaacatggacatgccatacagcac

SEQ ID NO: 475552 - DNA, 25 bp, Rattus norvegicus
gtaacatggaggcttcctctaccct

SEQ ID NO: 475553 - DNA, 25 bp, Rattus norvegicus
gtaacatggagggttcctctaccct

SEQ ID NO: 475554 - DNA, 25 bp, Rattus norvegicus
gtaacatggccacggtttgtccaca

SEQ ID NO: 475555 - DNA, 25 bp, Rattus norvegicus
gtaacatggccagggtttgtccaca

SEQ ID NO: 475556 - DNA, 25 bp, Rattus norvegicus
gtaacatggctacacgcacactaaa

SEQ ID NO: 475557 - DNA, 25 bp, Rattus norvegicus
gtaacatggctagacgcacactaaa

SEQ ID NO: 475558 - DNA, 25 bp, Rattus norvegicus
gtaacatgggagaatttgatccaac

SEQ ID NO: 475559 - DNA, 25 bp, Rattus norvegicus
gtaacatgggagtatttgatccaac

SEQ ID NO: 475560 - DNA, 25 bp, Rattus norvegicus
gtaacatggtttatatcgtgtccgt

SEQ ID NO: 475561 - DNA, 25 bp, Rattus norvegicus
gtaacatggtttttatcgtgtccgt

SEQ ID NO: 475562 - DNA, 25 bp, Rattus norvegicus
gtaacatgtgctcagtttgccgggc

SEQ ID NO: 475563 - DNA, 25 bp, Rattus norvegicus
gtaacatgtgctgagtttgccgggc

SEQ ID NO: 475564 - DNA, 25 bp, Rattus norvegicus
gtaacatgtgtactcagtccccaag

SEQ ID NO: 475565 - DNA, 25 bp, Rattus norvegicus
gtaacatgtgtagtcagtccccaag

SEQ ID NO: 475566 - DNA, 25 bp, Rattus norvegicus
gtaacattaagcagtctcttgtaga

SEQ ID NO: 475567 - DNA, 25 bp, Rattus norvegicus
gtaacattaagctgtctcttgtaga

SEQ ID NO: 475568 - DNA, 25 bp, Rattus norvegicus
gtaacattatgcatcatatcagaat

SEQ ID NO: 475569 - DNA, 25 bp, Rattus norvegicus
gtaacattatgcttcatatcagaat

SEQ ID NO: 475570 - DNA, 25 bp, Rattus norvegicus
gtaacattcagacagcaattaataa

SEQ ID NO: 475571 - DNA, 25 bp, Rattus norvegicus
gtaacattcagactggcagtgagct

SEQ ID NO: 475572 - DNA, 25 bp, Rattus norvegicus
gtaacattcagagagcaattaataa

SEQ ID NO: 475573 - DNA, 25 bp, Rattus norvegicus
gtaacattcagagtggcagtgagct

SEQ ID NO: 475574 - DNA, 25 bp, Rattus norvegicus
gtaacattccaacatagcttccaaa

SEQ ID NO: 475575 - DNA, 25 bp, Rattus norvegicus
gtaacattccaagatagcttccaaa

SEQ ID NO: 475576 - DNA, 25 bp, Rattus norvegicus
gtaacattcctaattttctggaaag

SEQ ID NO: 475577 - DNA, 25 bp, Rattus norvegicus
gtaacattcctatttttctggaaag

SEQ ID NO: 475578 - DNA, 25 bp, Rattus norvegicus
gtaacattcttcaagtttccctctc

SEQ ID NO: 475579 - DNA, 25 bp, Rattus norvegicus
gtaacattcttctagtttccctctc

SEQ ID NO: 475580 - DNA, 25 bp, Rattus norvegicus
gtaacattgtgtcaacagttgcaga

SEQ ID NO: 475581 - DNA, 25 bp, Rattus norvegicus
gtaacattgtgtgaacagttgcaga

SEQ ID NO: 475582 - DNA, 25 bp, Rattus norvegicus
gtaacatttattatagcttgcatat

SEQ ID NO: 475583 - DNA, 25 bp, Rattus norvegicus
gtaacatttattttagcttgcatat

SEQ ID NO: 475584 - DNA, 25 bp, Rattus norvegicus
gtaacatttgataccctgaggtgaa

SEQ ID NO: 475585 - DNA, 25 bp, Rattus norvegicus
gtaacatttgatcgcctgcagtgta

SEQ ID NO: 475586 - DNA, 25 bp, Rattus norvegicus
gtaacatttgatggcctgcagtgta

SEQ ID NO: 475587 - DNA, 25 bp, Rattus norvegicus
gtaacatttgattccctgaggtgaa

SEQ ID NO: 475588 - DNA, 25 bp, Rattus norvegicus
gtaacatttgcacaatctcctcctt

SEQ ID NO: 475589 - DNA, 25 bp, Rattus norvegicus
gtaacatttgcagaatctcctcctt

SEQ ID NO: 475590 - DNA, 25 bp, Rattus norvegicus
gtaacattttgacagcacaggccta

SEQ ID NO: 475591 - DNA, 25 bp, Rattus norvegicus
gtaacattttgagagcacaggccta

SEQ ID NO: 475592 - DNA, 25 bp, Rattus norvegicus
gtaaccaacacgcacatttaccgtt

SEQ ID NO: 475593 - DNA, 25 bp, Rattus norvegicus
gtaaccaacacggacatttaccgtt

SEQ ID NO: 475594 - DNA, 25 bp, Rattus norvegicus
gtaaccaacccaaaattgcattttg

SEQ ID NO: 475595 - DNA, 25 bp, Rattus norvegicus
gtaaccaacccataattgcattttg

SEQ ID NO: 475596 - DNA, 25 bp, Rattus norvegicus
gtaaccaactctccattgaatatca

SEQ ID NO: 475597 - DNA, 25 bp, Rattus norvegicus
gtaaccaactctgcattgaatatca

SEQ ID NO: 475598 - DNA, 25 bp, Rattus norvegicus
gtaaccaagcgacgctttcctaaga

SEQ ID NO: 475599 - DNA, 25 bp, Rattus norvegicus
gtaaccaagcgaggctttcctaaga

SEQ ID NO: 475600 - DNA, 25 bp, Rattus norvegicus
gtaaccaagttccttaggtctgcag

SEQ ID NO: 475601 - DNA, 25 bp, Rattus norvegicus
gtaaccaagttcgttaggtctgcag

SEQ ID NO: 475602 - DNA, 25 bp, Rattus norvegicus
gtaaccaatctgagcatcggtgtag

SEQ ID NO: 475603 - DNA, 25 bp, Rattus norvegicus
gtaaccaatctgtgcatcggtgtag

SEQ ID NO: 475604 - DNA, 25 bp, Rattus norvegicus
gtaaccaattaacacaacctgcata

SEQ ID NO: 475605 - DNA, 25 bp, Rattus norvegicus
gtaaccaattaagacaacctgcata

SEQ ID NO: 475606 - DNA, 25 bp, Rattus norvegicus
gtaaccacaacaatcccagtatggg

SEQ ID NO: 475607 - DNA, 25 bp, Rattus norvegicus
gtaaccacaacattcccagtatggg

SEQ ID NO: 475608 - DNA, 25 bp, Rattus norvegicus
gtaaccacatagcaagagctctagg

SEQ ID NO: 475609 - DNA, 25 bp, Rattus norvegicus
gtaaccacataggaagagctctagg

SEQ ID NO: 475610 - DNA, 25 bp, Rattus norvegicus
gtaaccaccatgctgtcataaatag

SEQ ID NO: 475611 - DNA, 25 bp, Rattus norvegicus
gtaaccaccatggtgtcataaatag

SEQ ID NO: 475612 - DNA, 25 bp, Rattus norvegicus
gtaaccacctggactaagttgagaa

SEQ ID NO: 475613 - DNA, 25 bp, Rattus norvegicus
gtaaccacctggtctaagttgagaa

SEQ ID NO: 475614 - DNA, 25 bp, Rattus norvegicus
gtaaccactagcaagttccttgtct

SEQ ID NO: 475615 - DNA, 25 bp, Rattus norvegicus
gtaaccactagctagttccttgtct

SEQ ID NO: 475616 - DNA, 25 bp, Rattus norvegicus
gtaaccactagtatgtgcccatatg

SEQ ID NO: 475617 - DNA, 25 bp, Rattus norvegicus
gtaaccactagtttgtgcccatatg

SEQ ID NO: 475618 - DNA, 25 bp, Rattus norvegicus
gtaaccactgatagattaattcctg

SEQ ID NO: 475619 - DNA, 25 bp, Rattus norvegicus
gtaaccactgattgattaattcctg

SEQ ID NO: 475620 - DNA, 25 bp, Rattus norvegicus
gtaaccactgcgacaggtgtttctc

SEQ ID NO: 475621 - DNA, 25 bp, Rattus norvegicus
gtaaccactgcgtcaggtgtttctc

SEQ ID NO: 475622 - DNA, 25 bp, Rattus norvegicus
gtaaccactgtcataatggcaagat

SEQ ID NO: 475623 - DNA, 25 bp, Rattus norvegicus
gtaaccactgtcttaatggcaagat

SEQ ID NO: 475624 - DNA, 25 bp, Rattus norvegicus
gtaaccactgtgatttatctactgt

SEQ ID NO: 475625 - DNA, 25 bp, Rattus norvegicus
gtaaccactgtgttttatctactgt

SEQ ID NO: 475626 - DNA, 25 bp, Rattus norvegicus
gtaaccactttaccaatttggagat

SEQ ID NO: 475627 - DNA, 25 bp, Rattus norvegicus
gtaaccactttagcaatttggagat

SEQ ID NO: 475628 - DNA, 25 bp, Rattus norvegicus
gtaaccagagttactccaagctaag

SEQ ID NO: 475629 - DNA, 25 bp, Rattus norvegicus
gtaaccagagttatgaggtccacat

SEQ ID NO: 475630 - DNA, 25 bp, Rattus norvegicus
gtaaccagagtttctccaagctaag

SEQ ID NO: 475631 - DNA, 25 bp, Rattus norvegicus
gtaaccagagttttgaggtccacat

SEQ ID NO: 475632 - DNA, 25 bp, Rattus norvegicus
gtaaccagatctcaaagtcaacagt

SEQ ID NO: 475633 - DNA, 25 bp, Rattus norvegicus
gtaaccagatctgaaagtcaacagt

SEQ ID NO: 475634 - DNA, 25 bp, Rattus norvegicus
gtaaccagatgaagtgctcctcgaa

SEQ ID NO: 475635 - DNA, 25 bp, Rattus norvegicus
gtaaccagatgatgtgctcctcgaa

SEQ ID NO: 475636 - DNA, 25 bp, Rattus norvegicus
gtaaccagcagaagctctgtcttca

SEQ ID NO: 475637 - DNA, 25 bp, Rattus norvegicus
gtaaccagcagatgctctgtcttca

SEQ ID NO: 475638 - DNA, 25 bp, Rattus norvegicus
gtaaccaggaatcggtgccagtact

SEQ ID NO: 475639 - DNA, 25 bp, Rattus norvegicus
gtaaccaggaatgggtgccagtact

SEQ ID NO: 475640 - DNA, 25 bp, Rattus norvegicus
gtaaccaggcccattctgaataact

SEQ ID NO: 475641 - DNA, 25 bp, Rattus norvegicus
gtaaccaggccctttctgaataact

SEQ ID NO: 475642 - DNA, 25 bp, Rattus norvegicus
gtaaccagggacagaggccaccaga

SEQ ID NO: 475643 - DNA, 25 bp, Rattus norvegicus
gtaaccagggactgaggccaccaga

SEQ ID NO: 475644 - DNA, 25 bp, Rattus norvegicus
gtaaccagggagatcgtcatccgag

SEQ ID NO: 475645 - DNA, 25 bp, Rattus norvegicus
gtaaccagggagttcgtcatccgag

SEQ ID NO: 475646 - DNA, 25 bp, Rattus norvegicus
gtaaccagtgatctcctggagaaga

SEQ ID NO: 475647 - DNA, 25 bp, Rattus norvegicus
gtaaccagtgatgtcctggagaaga

SEQ ID NO: 475648 - DNA, 25 bp, Rattus norvegicus
gtaaccagttgtcattcattgcaag

SEQ ID NO: 475649 - DNA, 25 bp, Rattus norvegicus
gtaaccagttgtgattcattgcaag

SEQ ID NO: 475650 - DNA, 25 bp, Rattus norvegicus
gtaaccatacatccctacacaagtt

SEQ ID NO: 475651 - DNA, 25 bp, Rattus norvegicus
gtaaccatacatgcctacacaagtt

SEQ ID NO: 475652 - DNA, 25 bp, Rattus norvegicus
gtaaccataccgatcaaattcccag

SEQ ID NO: 475653 - DNA, 25 bp, Rattus norvegicus
gtaaccataccgttcaaattcccag

SEQ ID NO: 475654 - DNA, 25 bp, Rattus norvegicus
gtaaccatagccagcttagcttggg

SEQ ID NO: 475655 - DNA, 25 bp, Rattus norvegicus
gtaaccatagcctgcttagcttggg

SEQ ID NO: 475656 - DNA, 25 bp, Rattus norvegicus
gtaaccatatctctggttcccatta

SEQ ID NO: 475657 - DNA, 25 bp, Rattus norvegicus
gtaaccatatctgtggttcccatta

SEQ ID NO: 475658 - DNA, 25 bp, Rattus norvegicus
gtaaccatcagacagcaattcctaa

SEQ ID NO: 475659 - DNA, 25 bp, Rattus norvegicus
gtaaccatcagagagcaattcctaa

SEQ ID NO: 475660 - DNA, 25 bp, Rattus norvegicus
gtaaccatcagcaacatttctgtga

SEQ ID NO: 475661 - DNA, 25 bp, Rattus norvegicus
gtaaccatcagctacatttctgtga

SEQ ID NO: 475662 - DNA, 25 bp, Rattus norvegicus
gtaaccatctctctcatccaaataa

SEQ ID NO: 475663 - DNA, 25 bp, Rattus norvegicus
gtaaccatctctgtcatccaaataa

SEQ ID NO: 475664 - DNA, 25 bp, Rattus norvegicus
gtaaccatgacaacctaggtgttat

SEQ ID NO: 475665 - DNA, 25 bp, Rattus norvegicus
gtaaccatgacatcctaggtgttat

SEQ ID NO: 475666 - DNA, 25 bp, Rattus norvegicus
gtaaccatgctcatgcagcaggcag

SEQ ID NO: 475667 - DNA, 25 bp, Rattus norvegicus
gtaaccatgctcttgcagcaggcag

SEQ ID NO: 475668 - DNA, 25 bp, Rattus norvegicus
gtaaccatggctatcagagattctt

SEQ ID NO: 475669 - DNA, 25 bp, Rattus norvegicus
gtaaccatggctttcagagattctt

SEQ ID NO: 475670 - DNA, 25 bp, Rattus norvegicus
gtaaccatgtggatgaacaactgat

SEQ ID NO: 475671 - DNA, 25 bp, Rattus norvegicus
gtaaccatgtggttgaacaactgat

SEQ ID NO: 475672 - DNA, 25 bp, Rattus norvegicus
gtaaccatttctatccagaggacct

SEQ ID NO: 475673 - DNA, 25 bp, Rattus norvegicus
gtaaccatttctctcttacatcgga

SEQ ID NO: 475674 - DNA, 25 bp, Rattus norvegicus
gtaaccatttctgtcttacatcgga

SEQ ID NO: 475675 - DNA, 25 bp, Rattus norvegicus
gtaaccatttctttccagaggacct

SEQ ID NO: 475676 - DNA, 25 bp, Rattus norvegicus
gtaaccattttcaatttgtgcaaac

SEQ ID NO: 475677 - DNA, 25 bp, Rattus norvegicus
gtaaccattttctatttgtgcaaac

SEQ ID NO: 475678 - DNA, 25 bp, Rattus norvegicus
gtaacccaatgcacatggaatggaa

SEQ ID NO: 475679 - DNA, 25 bp, Rattus norvegicus
gtaacccaatgctcatggaatggaa

SEQ ID NO: 475680 - DNA, 25 bp, Rattus norvegicus
gtaacccacaaaatgaatctgactg

SEQ ID NO: 475681 - DNA, 25 bp, Rattus norvegicus
gtaacccacaaattgaatctgactg

SEQ ID NO: 475682 - DNA, 25 bp, Rattus norvegicus
gtaacccacactccagtgaagctat

SEQ ID NO: 475683 - DNA, 25 bp, Rattus norvegicus
gtaacccacactgcagtgaagctat

SEQ ID NO: 475684 - DNA, 25 bp, Rattus norvegicus
gtaacccacgagatccaaatgctgc

SEQ ID NO: 475685 - DNA, 25 bp, Rattus norvegicus
gtaacccacgagttccaaatgctgc

SEQ ID NO: 475686 - DNA, 25 bp, Rattus norvegicus
gtaacccagcctatatttagtgcag

SEQ ID NO: 475687 - DNA, 25 bp, Rattus norvegicus
gtaacccagcctttatttagtgcag

SEQ ID NO: 475688 - DNA, 25 bp, Rattus norvegicus
gtaacccaggaacgcgttcactgac

SEQ ID NO: 475689 - DNA, 25 bp, Rattus norvegicus
gtaacccaggaaggcgttcactgac

SEQ ID NO: 475690 - DNA, 25 bp, Rattus norvegicus
gtaacccaggcacccgcagaggaag

SEQ ID NO: 475691 - DNA, 25 bp, Rattus norvegicus
gtaacccaggcagccgcagaggaag

SEQ ID NO: 475692 - DNA, 25 bp, Rattus norvegicus
gtaacccagtacagaacctattcgt

SEQ ID NO: 475693 - DNA, 25 bp, Rattus norvegicus
gtaacccagtactgaacctattcgt

SEQ ID NO: 475694 - DNA, 25 bp, Rattus norvegicus
gtaacccagtgaactctacgtcatc

SEQ ID NO: 475695 - DNA, 25 bp, Rattus norvegicus
gtaacccagtgatctctacgtcatc

SEQ ID NO: 475696 - DNA, 25 bp, Rattus norvegicus
gtaacccatgtccagctgtagtctt

SEQ ID NO: 475697 - DNA, 25 bp, Rattus norvegicus
gtaacccatgtcgagctgtagtctt

SEQ ID NO: 475698 - DNA, 25 bp, Rattus norvegicus
gtaaccccatccatggagcacagag

SEQ ID NO: 475699 - DNA, 25 bp, Rattus norvegicus
gtaaccccatccttggagcacagag

SEQ ID NO: 475700 - DNA, 25 bp, Rattus norvegicus
gtaacccccaggagaaggcccatgg

SEQ ID NO: 475701 - DNA, 25 bp, Rattus norvegicus
gtaacccccaggtgaaggcccatgg

SEQ ID NO: 475702 - DNA, 25 bp, Rattus norvegicus
gtaaccccgactctactgaaactca

SEQ ID NO: 475703 - DNA, 25 bp, Rattus norvegicus
gtaaccccgactgtactgaaactca

SEQ ID NO: 475704 - DNA, 25 bp, Rattus norvegicus
gtaaccccgtgtctgtttccgcagg

SEQ ID NO: 475705 - DNA, 25 bp, Rattus norvegicus
gtaaccccgtgtgtgtttccgcagg

SEQ ID NO: 475706 - DNA, 25 bp, Rattus norvegicus
gtaaccccttatatcctgaacacag

SEQ ID NO: 475707 - DNA, 25 bp, Rattus norvegicus
gtaaccccttatttcctgaacacag

SEQ ID NO: 475708 - DNA, 25 bp, Rattus norvegicus
gtaaccccttcaatggagtggctta

SEQ ID NO: 475709 - DNA, 25 bp, Rattus norvegicus
gtaaccccttcattggagtggctta

SEQ ID NO: 475710 - DNA, 25 bp, Rattus norvegicus
gtaacccgaatacaacagacttgat

SEQ ID NO: 475711 - DNA, 25 bp, Rattus norvegicus
gtaacccgaatagaacagacttgat

SEQ ID NO: 475712 - DNA, 25 bp, Rattus norvegicus
gtaacccgatcaagtggctcaggac

SEQ ID NO: 475713 - DNA, 25 bp, Rattus norvegicus
gtaacccgatcatgtggctcaggac

SEQ ID NO: 475714 - DNA, 25 bp, Rattus norvegicus
gtaacccgattaatgtgcaaccctt

SEQ ID NO: 475715 - DNA, 25 bp, Rattus norvegicus
gtaacccgattattgtgcaaccctt

SEQ ID NO: 475716 - DNA, 25 bp, Rattus norvegicus
gtaaccctactgctaagtgctgtgt

SEQ ID NO: 475717 - DNA, 25 bp, Rattus norvegicus
gtaaccctactggtaagtgctgtgt

SEQ ID NO: 475718 - DNA, 25 bp, Rattus norvegicus
gtaaccctaggaacgaaccagtgag

SEQ ID NO: 475719 - DNA, 25 bp, Rattus norvegicus
gtaaccctaggatcgaaccagtgag

SEQ ID NO: 475720 - DNA, 25 bp, Rattus norvegicus
gtaaccctgcctcgatggatttcat

SEQ ID NO: 475721 - DNA, 25 bp, Rattus norvegicus
gtaaccctgcctggatggatttcat

SEQ ID NO: 475722 - DNA, 25 bp, Rattus norvegicus
gtaacccttgcgaatcagattgcag

SEQ ID NO: 475723 - DNA, 25 bp, Rattus norvegicus
gtaacccttgcgtatcagattgcag

SEQ ID NO: 475724 - DNA, 25 bp, Rattus norvegicus
gtaaccctttcgattgaactgcctg

SEQ ID NO: 475725 - DNA, 25 bp, Rattus norvegicus
gtaaccctttcgtttgaactgcctg

SEQ ID NO: 475726 - DNA, 25 bp, Rattus norvegicus
gtaaccgaatacagggtccttctgg

SEQ ID NO: 475727 - DNA, 25 bp, Rattus norvegicus
gtaaccgaatactgggtccttctgg

SEQ ID NO: 475728 - DNA, 25 bp, Rattus norvegicus
gtaaccgattcgagtgctgcacagg

SEQ ID NO: 475729 - DNA, 25 bp, Rattus norvegicus
gtaaccgattcgtgtgctgcacagg

SEQ ID NO: 475730 - DNA, 25 bp, Rattus norvegicus
gtaaccgcccttcaaatggcatgag

SEQ ID NO: 475731 - DNA, 25 bp, Rattus norvegicus
gtaaccgcccttgaaatggcatgag

SEQ ID NO: 475732 - DNA, 25 bp, Rattus norvegicus
gtaaccgccgtcctgaactgaccga

SEQ ID NO: 475733 - DNA, 25 bp, Rattus norvegicus
gtaaccgccgtcgtgaactgaccga

SEQ ID NO: 475734 - DNA, 25 bp, Rattus norvegicus
gtaaccgctagaagactgcagatca

SEQ ID NO: 475735 - DNA, 25 bp, Rattus norvegicus
gtaaccgctagatgactgcagatca

SEQ ID NO: 475736 - DNA, 25 bp, Rattus norvegicus
gtaaccggaacaactcatatgggac

SEQ ID NO: 475737 - DNA, 25 bp, Rattus norvegicus
gtaaccggaacatctcatatgggac

SEQ ID NO: 475738 - DNA, 25 bp, Rattus norvegicus
gtaaccggcaatatttcttatgtgt

SEQ ID NO: 475739 - DNA, 25 bp, Rattus norvegicus
gtaaccggcaatttttcttatgtgt

SEQ ID NO: 475740 - DNA, 25 bp, Rattus norvegicus
gtaaccgggacaccctagccagaac

SEQ ID NO: 475741 - DNA, 25 bp, Rattus norvegicus
gtaaccgggacagcctagccagaac

SEQ ID NO: 475742 - DNA, 25 bp, Rattus norvegicus
gtaaccgggctcctagagtgtcaga

SEQ ID NO: 475743 - DNA, 25 bp, Rattus norvegicus
gtaaccgggctcgtagagtgtcaga

SEQ ID NO: 475744 - DNA, 25 bp, Rattus norvegicus
gtaaccgtatcaagttccagcaaaa

SEQ ID NO: 475745 - DNA, 25 bp, Rattus norvegicus
gtaaccgtatcatgttccagcaaaa

SEQ ID NO: 475746 - DNA, 25 bp, Rattus norvegicus
gtaaccgtgagcaccagccgaagaa

SEQ ID NO: 475747 - DNA, 25 bp, Rattus norvegicus
gtaaccgtgagctccagccgaagaa

SEQ ID NO: 475748 - DNA, 25 bp, Rattus norvegicus
gtaaccgtgtgtaccaagcacagat

SEQ ID NO: 475749 - DNA, 25 bp, Rattus norvegicus
gtaaccgtgtgttccaagcacagat

SEQ ID NO: 475750 - DNA, 25 bp, Rattus norvegicus
gtaaccgttgagctattctactcca

SEQ ID NO: 475751 - DNA, 25 bp, Rattus norvegicus
gtaaccgttgaggtattctactcca

SEQ ID NO: 475752 - DNA, 25 bp, Rattus norvegicus
gtaacctaaaacatcccagctcgaa

SEQ ID NO: 475753 - DNA, 25 bp, Rattus norvegicus
gtaacctaaaacttcccagctcgaa

SEQ ID NO: 475754 - DNA, 25 bp, Rattus norvegicus
gtaacctacaccaccagaaaaagca

SEQ ID NO: 475755 - DNA, 25 bp, Rattus norvegicus
gtaacctacacctccagaaaaagca

SEQ ID NO: 475756 - DNA, 25 bp, Rattus norvegicus
gtaacctacaggagctgctgagcct

SEQ ID NO: 475757 - DNA, 25 bp, Rattus norvegicus
gtaacctacaggtgctgctgagcct

SEQ ID NO: 475758 - DNA, 25 bp, Rattus norvegicus
gtaacctatatcctaatatggtcat

SEQ ID NO: 475759 - DNA, 25 bp, Rattus norvegicus
gtaacctatatcgtaatatggtcat

SEQ ID NO: 475760 - DNA, 25 bp, Rattus norvegicus
gtaacctatggaagtgattgatgcg

SEQ ID NO: 475761 - DNA, 25 bp, Rattus norvegicus
gtaacctatggatgtgattgatgcg

SEQ ID NO: 475762 - DNA, 25 bp, Rattus norvegicus
gtaacctatggtatatttgcttcca

SEQ ID NO: 475763 - DNA, 25 bp, Rattus norvegicus
gtaacctatggtttatttgcttcca

SEQ ID NO: 475764 - DNA, 25 bp, Rattus norvegicus
gtaacctcaattctgagtcccaggg

SEQ ID NO: 475765 - DNA, 25 bp, Rattus norvegicus
gtaacctcaattgtgagtcccaggg

SEQ ID NO: 475766 - DNA, 25 bp, Rattus norvegicus
gtaacctcagctatacatgctctaa

SEQ ID NO: 475767 - DNA, 25 bp, Rattus norvegicus
gtaacctcagctttacatgctctaa

SEQ ID NO: 475768 - DNA, 25 bp, Rattus norvegicus
gtaacctcattacaacgccagtttg

SEQ ID NO: 475769 - DNA, 25 bp, Rattus norvegicus
gtaacctcattagaacgccagtttg

SEQ ID NO: 475770 - DNA, 25 bp, Rattus norvegicus
gtaacctcgcggacaaggcaccgtc

SEQ ID NO: 475771 - DNA, 25 bp, Rattus norvegicus
gtaacctcgcggtcaaggcaccgtc

SEQ ID NO: 475772 - DNA, 25 bp, Rattus norvegicus
gtaacctcggccactgggacagagt

SEQ ID NO: 475773 - DNA, 25 bp, Rattus norvegicus
gtaacctcggcctctgggacagagt

SEQ ID NO: 475774 - DNA, 25 bp, Rattus norvegicus
gtaacctcgtgtatccagtacacta

SEQ ID NO: 475775 - DNA, 25 bp, Rattus norvegicus
gtaacctcgtgtttccagtacacta

SEQ ID NO: 475776 - DNA, 25 bp, Rattus norvegicus
gtaacctctaggagatgcccggaat

SEQ ID NO: 475777 - DNA, 25 bp, Rattus norvegicus
gtaacctctaggtgatgcccggaat

SEQ ID NO: 475778 - DNA, 25 bp, Rattus norvegicus
gtaacctctcatcaaaagctttgtg

SEQ ID NO: 475779 - DNA, 25 bp, Rattus norvegicus
gtaacctctcatgaaaagctttgtg

SEQ ID NO: 475780 - DNA, 25 bp, Rattus norvegicus
gtaacctgaaaccacatggactggg

SEQ ID NO: 475781 - DNA, 25 bp, Rattus norvegicus
gtaacctgaaacgacatggactggg

SEQ ID NO: 475782 - DNA, 25 bp, Rattus norvegicus
gtaacctgaaagaccatgcattatc

SEQ ID NO: 475783 - DNA, 25 bp, Rattus norvegicus
gtaacctgaaagtccatgcattatc

SEQ ID NO: 475784 - DNA, 25 bp, Rattus norvegicus
gtaacctgaagtctactttgactgt

SEQ ID NO: 475785 - DNA, 25 bp, Rattus norvegicus
gtaacctgaagtgtactttgactgt

SEQ ID NO: 475786 - DNA, 25 bp, Rattus norvegicus
gtaacctgaatgagtgtcctgggca

SEQ ID NO: 475787 - DNA, 25 bp, Rattus norvegicus
gtaacctgaatgtgtgtcctgggca

SEQ ID NO: 475788 - DNA, 25 bp, Rattus norvegicus
gtaacctgagtcatggaccctggta

SEQ ID NO: 475789 - DNA, 25 bp, Rattus norvegicus
gtaacctgagtcttggaccctggta

SEQ ID NO: 475790 - DNA, 25 bp, Rattus norvegicus
gtaacctgattacttctgtgttcct

SEQ ID NO: 475791 - DNA, 25 bp, Rattus norvegicus
gtaacctgattagttctgtgttcct

SEQ ID NO: 475792 - DNA, 25 bp, Rattus norvegicus
gtaacctgcagcaaggataggacat

SEQ ID NO: 475793 - DNA, 25 bp, Rattus norvegicus
gtaacctgcagctaggataggacat

SEQ ID NO: 475794 - DNA, 25 bp, Rattus norvegicus
gtaacctgcataacttttgtcattg

SEQ ID NO: 475795 - DNA, 25 bp, Rattus norvegicus
gtaacctgcatatcttttgtcattg

SEQ ID NO: 475796 - DNA, 25 bp, Rattus norvegicus
gtaacctgccatattgtaagcctgc

SEQ ID NO: 475797 - DNA, 25 bp, Rattus norvegicus
gtaacctgccattttgtaagcctgc

SEQ ID NO: 475798 - DNA, 25 bp, Rattus norvegicus
gtaacctgccttatcatgttgcttc

SEQ ID NO: 475799 - DNA, 25 bp, Rattus norvegicus
gtaacctgccttttcatgttgcttc

SEQ ID NO: 475800 - DNA, 25 bp, Rattus norvegicus
gtaacctgctgcacatttgtggtct

SEQ ID NO: 475801 - DNA, 25 bp, Rattus norvegicus
gtaacctgctgcagcacaagtgtgt

SEQ ID NO: 475802 - DNA, 25 bp, Rattus norvegicus
gtaacctgctgctcatttgtggtct

SEQ ID NO: 475803 - DNA, 25 bp, Rattus norvegicus
gtaacctgctgctgcacaagtgtgt

SEQ ID NO: 475804 - DNA, 25 bp, Rattus norvegicus
gtaacctgcttacatctggacttca

SEQ ID NO: 475805 - DNA, 25 bp, Rattus norvegicus
gtaacctgcttagatctggacttca

SEQ ID NO: 475806 - DNA, 25 bp, Rattus norvegicus
gtaacctgcttcatcaaataacaat

SEQ ID NO: 475807 - DNA, 25 bp, Rattus norvegicus
gtaacctgcttcttcaaataacaat

SEQ ID NO: 475808 - DNA, 25 bp, Rattus norvegicus
gtaacctggtcactcacagatccaa

SEQ ID NO: 475809 - DNA, 25 bp, Rattus norvegicus
gtaacctggtcagtcacagatccaa

SEQ ID NO: 475810 - DNA, 25 bp, Rattus norvegicus
gtaacctgtaagcatttcaaccctg

SEQ ID NO: 475811 - DNA, 25 bp, Rattus norvegicus
gtaacctgtaaggatttcaaccctg

SEQ ID NO: 475812 - DNA, 25 bp, Rattus norvegicus
gtaacctgtctcattttagcatgca

SEQ ID NO: 475813 - DNA, 25 bp, Rattus norvegicus
gtaacctgtctctttttagcatgca

SEQ ID NO: 475814 - DNA, 25 bp, Rattus norvegicus
gtaaccttacagactagcgcagtct

SEQ ID NO: 475815 - DNA, 25 bp, Rattus norvegicus
gtaaccttacagtctagcgcagtct

SEQ ID NO: 475816 - DNA, 25 bp, Rattus norvegicus
gtaaccttcagacacggacacatga

SEQ ID NO: 475817 - DNA, 25 bp, Rattus norvegicus
gtaaccttcagagacggacacatga

SEQ ID NO: 475818 - DNA, 25 bp, Rattus norvegicus
gtaaccttccgcaagatttttagag

SEQ ID NO: 475819 - DNA, 25 bp, Rattus norvegicus
gtaaccttccgctagatttttagag

SEQ ID NO: 475820 - DNA, 25 bp, Rattus norvegicus
gtaaccttgaaaacagcctgggcca

SEQ ID NO: 475821 - DNA, 25 bp, Rattus norvegicus
gtaaccttgaaatcagcctgggcca

SEQ ID NO: 475822 - DNA, 25 bp, Rattus norvegicus
gtaaccttgctcctctgggaatggc

SEQ ID NO: 475823 - DNA, 25 bp, Rattus norvegicus
gtaaccttgctcgtctgggaatggc

SEQ ID NO: 475824 - DNA, 25 bp, Rattus norvegicus
gtaaccttgctgaatggcagccctg

SEQ ID NO: 475825 - DNA, 25 bp, Rattus norvegicus
gtaaccttgctgtatggcagccctg

SEQ ID NO: 475826 - DNA, 25 bp, Rattus norvegicus
gtaaccttggatatatgcttgctca

SEQ ID NO: 475827 - DNA, 25 bp, Rattus norvegicus
gtaaccttggatttatgcttgctca

SEQ ID NO: 475828 - DNA, 25 bp, Rattus norvegicus
gtaaccttggctaaagttttgctca

SEQ ID NO: 475829 - DNA, 25 bp, Rattus norvegicus
gtaaccttggcttaagttttgctca

SEQ ID NO: 475830 - DNA, 25 bp, Rattus norvegicus
gtaaccttggtcactaacttctgtg

SEQ ID NO: 475831 - DNA, 25 bp, Rattus norvegicus
gtaaccttggtctctaacttctgtg

SEQ ID NO: 475832 - DNA, 25 bp, Rattus norvegicus
gtaaccttgtgtagttttctcttgt

SEQ ID NO: 475833 - DNA, 25 bp, Rattus norvegicus
gtaaccttgtgttgttttctcttgt

SEQ ID NO: 475834 - DNA, 25 bp, Rattus norvegicus
gtaacctttctaaattgagcctatg

SEQ ID NO: 475835 - DNA, 25 bp, Rattus norvegicus
gtaacctttctatattgagcctatg

SEQ ID NO: 475836 - DNA, 25 bp, Rattus norvegicus
gtaacctttggcatctgtgttcctg

SEQ ID NO: 475837 - DNA, 25 bp, Rattus norvegicus
gtaacctttggcttctgtgttcctg

SEQ ID NO: 475838 - DNA, 25 bp, Rattus norvegicus
gtaaccttttgacctgattggccgg

SEQ ID NO: 475839 - DNA, 25 bp, Rattus norvegicus
gtaaccttttgagctgattggccgg

SEQ ID NO: 475840 - DNA, 25 bp, Rattus norvegicus
gtaacgaaccgtcatgtataacaat

SEQ ID NO: 475841 - DNA, 25 bp, Rattus norvegicus
gtaacgaaccgtgatgtataacaat

SEQ ID NO: 475842 - DNA, 25 bp, Rattus norvegicus
gtaacgaactctactactatgatat

SEQ ID NO: 475843 - DNA, 25 bp, Rattus norvegicus
gtaacgaactcttctactatgatat

SEQ ID NO: 475844 - DNA, 25 bp, Rattus norvegicus
gtaacgacagaccttctacgccgtg

SEQ ID NO: 475845 - DNA, 25 bp, Rattus norvegicus
gtaacgacagacgttctacgccgtg

SEQ ID NO: 475846 - DNA, 25 bp, Rattus norvegicus
gtaacgacaggtatcattgcactgt

SEQ ID NO: 475847 - DNA, 25 bp, Rattus norvegicus
gtaacgacaggtttcattgcactgt

SEQ ID NO: 475848 - DNA, 25 bp, Rattus norvegicus
gtaacgacttgcattatctggtgcc

SEQ ID NO: 475849 - DNA, 25 bp, Rattus norvegicus
gtaacgacttgctttatctggtgcc

SEQ ID NO: 475850 - DNA, 25 bp, Rattus norvegicus
gtaacgagctctcggaactggcatc

SEQ ID NO: 475851 - DNA, 25 bp, Rattus norvegicus
gtaacgagctctgggaactggcatc

SEQ ID NO: 475852 - DNA, 25 bp, Rattus norvegicus
gtaacgatgcttcctaagcctggca

SEQ ID NO: 475853 - DNA, 25 bp, Rattus norvegicus
gtaacgatgcttgctaagcctggca

SEQ ID NO: 475854 - DNA, 25 bp, Rattus norvegicus
gtaacgccacctcctacatttaaat

SEQ ID NO: 475855 - DNA, 25 bp, Rattus norvegicus
gtaacgccacctgctacatttaaat

SEQ ID NO: 475856 - DNA, 25 bp, Rattus norvegicus
gtaacgcctgcccaattgacagaag

SEQ ID NO: 475857 - DNA, 25 bp, Rattus norvegicus
gtaacgcctgccgaattgacagaag

SEQ ID NO: 475858 - DNA, 25 bp, Rattus norvegicus
gtaacggaatgaaggcagggattaa

SEQ ID NO: 475859 - DNA, 25 bp, Rattus norvegicus
gtaacggaatgatggcagggattaa

SEQ ID NO: 475860 - DNA, 25 bp, Rattus norvegicus
gtaacggacccgagagtggcagcaa

SEQ ID NO: 475861 - DNA, 25 bp, Rattus norvegicus
gtaacggacccgtgagtggcagcaa

SEQ ID NO: 475862 - DNA, 25 bp, Rattus norvegicus
gtaacggagcgtatttctcagtaca

SEQ ID NO: 475863 - DNA, 25 bp, Rattus norvegicus
gtaacggagcgtttttctcagtaca

SEQ ID NO: 475864 - DNA, 25 bp, Rattus norvegicus
gtaacggagtcaacctgcgaagagt

SEQ ID NO: 475865 - DNA, 25 bp, Rattus norvegicus
gtaacggagtcatcctgcgaagagt

SEQ ID NO: 475866 - DNA, 25 bp, Rattus norvegicus
gtaacggatccccagtcattagtcc

SEQ ID NO: 475867 - DNA, 25 bp, Rattus norvegicus
gtaacggatcccgagtcattagtcc

SEQ ID NO: 475868 - DNA, 25 bp, Rattus norvegicus
gtaacggcagagatcctctttccat

SEQ ID NO: 475869 - DNA, 25 bp, Rattus norvegicus
gtaacggcagagttcctctttccat

SEQ ID NO: 475870 - DNA, 25 bp, Rattus norvegicus
gtaacggctaaccaggcttgcattg

SEQ ID NO: 475871 - DNA, 25 bp, Rattus norvegicus
gtaacggctaacgaggcttgcattg

SEQ ID NO: 475872 - DNA, 25 bp, Rattus norvegicus
gtaacgggtgtgacatttccaacgg

SEQ ID NO: 475873 - DNA, 25 bp, Rattus norvegicus
gtaacgggtgtgtcatttccaacgg

SEQ ID NO: 475874 - DNA, 25 bp, Rattus norvegicus
gtaacggtgaaaagctcctcaaaca

SEQ ID NO: 475875 - DNA, 25 bp, Rattus norvegicus
gtaacggtgaaatgctcctcaaaca

SEQ ID NO: 475876 - DNA, 25 bp, Rattus norvegicus
gtaacggtgggtactgtgtcaatca

SEQ ID NO: 475877 - DNA, 25 bp, Rattus norvegicus
gtaacggtgggttctgtgtcaatca

SEQ ID NO: 475878 - DNA, 25 bp, Rattus norvegicus
gtaacggttctgaggctgcatcttc

SEQ ID NO: 475879 - DNA, 25 bp, Rattus norvegicus
gtaacggttctgtggctgcatcttc

SEQ ID NO: 475880 - DNA, 25 bp, Rattus norvegicus
gtaacggtttacaatatccatatat

SEQ ID NO: 475881 - DNA, 25 bp, Rattus norvegicus
gtaacggtttactatatccatatat

SEQ ID NO: 475882 - DNA, 25 bp, Rattus norvegicus
gtaacgtgattcattgtgctatgct

SEQ ID NO: 475883 - DNA, 25 bp, Rattus norvegicus
gtaacgtgattctttgtgctatgct

SEQ ID NO: 475884 - DNA, 25 bp, Rattus norvegicus
gtaacgtgtactctgagctgtcctc

SEQ ID NO: 475885 - DNA, 25 bp, Rattus norvegicus
gtaacgtgtactgtgagctgtcctc

SEQ ID NO: 475886 - DNA, 25 bp, Rattus norvegicus
gtaacgtgtgttaggaactctgctg

SEQ ID NO: 475887 - DNA, 25 bp, Rattus norvegicus
gtaacgtgtgtttggaactctgctg

SEQ ID NO: 475888 - DNA, 25 bp, Rattus norvegicus
gtaacgttcagcagccgaatctttc

SEQ ID NO: 475889 - DNA, 25 bp, Rattus norvegicus
gtaacgttcagctgccgaatctttc

SEQ ID NO: 475890 - DNA, 25 bp, Rattus norvegicus
gtaacgttgtacagaagggcgacaa

SEQ ID NO: 475891 - DNA, 25 bp, Rattus norvegicus
gtaacgttgtactgaagggcgacaa

SEQ ID NO: 475892 - DNA, 25 bp, Rattus norvegicus
gtaacgttttatcaacactagtgaa

SEQ ID NO: 475893 - DNA, 25 bp, Rattus norvegicus
gtaacgttttatgaacactagtgaa

SEQ ID NO: 475894 - DNA, 25 bp, Rattus norvegicus
gtaactaactatattgctccaaaga

SEQ ID NO: 475895 - DNA, 25 bp, Rattus norvegicus
gtaactaactattttgctccaaaga

SEQ ID NO: 475896 - DNA, 25 bp, Rattus norvegicus
gtaactaagagcactgggccttcca

SEQ ID NO: 475897 - DNA, 25 bp, Rattus norvegicus
gtaactaagagctctgggccttcca

SEQ ID NO: 475898 - DNA, 25 bp, Rattus norvegicus
gtaactaagccaccagatctccaag

SEQ ID NO: 475899 - DNA, 25 bp, Rattus norvegicus
gtaactaagccagcagatctccaag

SEQ ID NO: 475900 - DNA, 25 bp, Rattus norvegicus
gtaactaaggtcactgctgccactc

SEQ ID NO: 475901 - DNA, 25 bp, Rattus norvegicus
gtaactaaggtctctgctgccactc

SEQ ID NO: 475902 - DNA, 25 bp, Rattus norvegicus
gtaactaatgtaacctctttccaga

SEQ ID NO: 475903 - DNA, 25 bp, Rattus norvegicus
gtaactaatgtatcctctttccaga

SEQ ID NO: 475904 - DNA, 25 bp, Rattus norvegicus
gtaactacacgtattggagtctcat

SEQ ID NO: 475905 - DNA, 25 bp, Rattus norvegicus
gtaactacacgttttggagtctcat

SEQ ID NO: 475906 - DNA, 25 bp, Rattus norvegicus
gtaactacccagaccacttgagaat

SEQ ID NO: 475907 - DNA, 25 bp, Rattus norvegicus
gtaactacccagctttgctcaagtg

SEQ ID NO: 475908 - DNA, 25 bp, Rattus norvegicus
gtaactacccaggtttgctcaagtg

SEQ ID NO: 475909 - DNA, 25 bp, Rattus norvegicus
gtaactacccagtccacttgagaat

SEQ ID NO: 475910 - DNA, 25 bp, Rattus norvegicus
gtaactaccctgatctagtcaccgt

SEQ ID NO: 475911 - DNA, 25 bp, Rattus norvegicus
gtaactaccctgttctagtcaccgt

SEQ ID NO: 475912 - DNA, 25 bp, Rattus norvegicus
gtaactaccttgctttctactcagt

SEQ ID NO: 475913 - DNA, 25 bp, Rattus norvegicus
gtaactaccttggtttctactcagt

SEQ ID NO: 475914 - DNA, 25 bp, Rattus norvegicus
gtaactacgatgaagacggcgcttg

SEQ ID NO: 475915 - DNA, 25 bp, Rattus norvegicus
gtaactacgatgtagacggcgcttg

SEQ ID NO: 475916 - DNA, 25 bp, Rattus norvegicus
gtaactactattattgcatacttga

SEQ ID NO: 475917 - DNA, 25 bp, Rattus norvegicus
gtaactactatttttgcatacttga

SEQ ID NO: 475918 - DNA, 25 bp, Rattus norvegicus
gtaactactctcatgactatgtcat

SEQ ID NO: 475919 - DNA, 25 bp, Rattus norvegicus
gtaactactctcttgactatgtcat

SEQ ID NO: 475920 - DNA, 25 bp, Rattus norvegicus
gtaactacttgtctcaacctaacgg

SEQ ID NO: 475921 - DNA, 25 bp, Rattus norvegicus
gtaactacttgtgtcaacctaacgg

SEQ ID NO: 475922 - DNA, 25 bp, Rattus norvegicus
gtaactagagggatccatttcatct

SEQ ID NO: 475923 - DNA, 25 bp, Rattus norvegicus
gtaactagagggttccatttcatct

SEQ ID NO: 475924 - DNA, 25 bp, Rattus norvegicus
gtaactagctgtctggaattgttca

SEQ ID NO: 475925 - DNA, 25 bp, Rattus norvegicus
gtaactagctgtgtggaattgttca

SEQ ID NO: 475926 - DNA, 25 bp, Rattus norvegicus
gtaactagctttaggaacacattta

SEQ ID NO: 475927 - DNA, 25 bp, Rattus norvegicus
gtaactagcttttggaacacattta

SEQ ID NO: 475928 - DNA, 25 bp, Rattus norvegicus
gtaactagttttatgagcctgtcat

SEQ ID NO: 475929 - DNA, 25 bp, Rattus norvegicus
gtaactagttttttgagcctgtcat

SEQ ID NO: 475930 - DNA, 25 bp, Rattus norvegicus
gtaactataactcatttccttgctt

SEQ ID NO: 475931 - DNA, 25 bp, Rattus norvegicus
gtaactataactgatttccttgctt

SEQ ID NO: 475932 - DNA, 25 bp, Rattus norvegicus
gtaactatatgaaccgtaactaatt

SEQ ID NO: 475933 - DNA, 25 bp, Rattus norvegicus
gtaactatatgatccgtaactaatt

SEQ ID NO: 475934 - DNA, 25 bp, Rattus norvegicus
gtaactatcatgcttagggaccctt

SEQ ID NO: 475935 - DNA, 25 bp, Rattus norvegicus
gtaactatcatggttagggaccctt

SEQ ID NO: 475936 - DNA, 25 bp, Rattus norvegicus
gtaactatgaacattgctgttggca

SEQ ID NO: 475937 - DNA, 25 bp, Rattus norvegicus
gtaactatgaactttgctgttggca

SEQ ID NO: 475938 - DNA, 25 bp, Rattus norvegicus
gtaactatggccatggcagactccc

SEQ ID NO: 475939 - DNA, 25 bp, Rattus norvegicus
gtaactatggccttggcagactccc

SEQ ID NO: 475940 - DNA, 25 bp, Rattus norvegicus
gtaactattacaactctctgacttt

SEQ ID NO: 475941 - DNA, 25 bp, Rattus norvegicus
gtaactattacatctctctgacttt

SEQ ID NO: 475942 - DNA, 25 bp, Rattus norvegicus
gtaactattctgagttgtataaagg

SEQ ID NO: 475943 - DNA, 25 bp, Rattus norvegicus
gtaactattctgtgttgtataaagg

SEQ ID NO: 475944 - DNA, 25 bp, Rattus norvegicus
gtaactattgatatcctgcgactct

SEQ ID NO: 475945 - DNA, 25 bp, Rattus norvegicus
gtaactattgatttcctgcgactct

SEQ ID NO: 475946 - DNA, 25 bp, Rattus norvegicus
gtaactattttgactaaccctcctg

SEQ ID NO: 475947 - DNA, 25 bp, Rattus norvegicus
gtaactattttgcaatgatgcacat

SEQ ID NO: 475948 - DNA, 25 bp, Rattus norvegicus
gtaactattttggaatgatgcacat

SEQ ID NO: 475949 - DNA, 25 bp, Rattus norvegicus
gtaactattttgtctaaccctcctg

SEQ ID NO: 475950 - DNA, 25 bp, Rattus norvegicus
gtaactcaaataactggtgcttctg

SEQ ID NO: 475951 - DNA, 25 bp, Rattus norvegicus
gtaactcaaatatctggtgcttctg

SEQ ID NO: 475952 - DNA, 25 bp, Rattus norvegicus
gtaactcaagagaaatggatgctgt

SEQ ID NO: 475953 - DNA, 25 bp, Rattus norvegicus
gtaactcaagagtaatggatgctgt

SEQ ID NO: 475954 - DNA, 25 bp, Rattus norvegicus
gtaactcaagcgagcctcaaaaaga

SEQ ID NO: 475955 - DNA, 25 bp, Rattus norvegicus
gtaactcaagcgtgcctcaaaaaga

SEQ ID NO: 475956 - DNA, 25 bp, Rattus norvegicus
gtaactcacggcctttgtgcaaaat

SEQ ID NO: 475957 - DNA, 25 bp, Rattus norvegicus
gtaactcacggcgtttgtgcaaaat

SEQ ID NO: 475958 - DNA, 25 bp, Rattus norvegicus
gtaactcactctattaagtatccct

SEQ ID NO: 475959 - DNA, 25 bp, Rattus norvegicus
gtaactcactctctaatttcagcgt

SEQ ID NO: 475960 - DNA, 25 bp, Rattus norvegicus
gtaactcactctgtaatttcagcgt

SEQ ID NO: 475961 - DNA, 25 bp, Rattus norvegicus
gtaactcactcttttaagtatccct

SEQ ID NO: 475962 - DNA, 25 bp, Rattus norvegicus
gtaactcactgtacagatgcccagc

SEQ ID NO: 475963 - DNA, 25 bp, Rattus norvegicus
gtaactcactgttcagatgcccagc

SEQ ID NO: 475964 - DNA, 25 bp, Rattus norvegicus
gtaactcagaatcgcaagtgggctt

SEQ ID NO: 475965 - DNA, 25 bp, Rattus norvegicus
gtaactcagaatggcaagtgggctt

SEQ ID NO: 475966 - DNA, 25 bp, Rattus norvegicus
gtaactcagtcaccatttggaacat

SEQ ID NO: 475967 - DNA, 25 bp, Rattus norvegicus
gtaactcagtcagcatttggaacat

SEQ ID NO: 475968 - DNA, 25 bp, Rattus norvegicus
gtaactcatgtcatagcaccttcta

SEQ ID NO: 475969 - DNA, 25 bp, Rattus norvegicus
gtaactcatgtcttagcaccttcta

SEQ ID NO: 475970 - DNA, 25 bp, Rattus norvegicus
gtaactcattacatctgggcactat

SEQ ID NO: 475971 - DNA, 25 bp, Rattus norvegicus
gtaactcattacttctgggcactat

SEQ ID NO: 475972 - DNA, 25 bp, Rattus norvegicus
gtaactcatttcattgttcctgttt

SEQ ID NO: 475973 - DNA, 25 bp, Rattus norvegicus
gtaactcatttctttgttcctgttt

SEQ ID NO: 475974 - DNA, 25 bp, Rattus norvegicus
gtaactccacggcagaggtttcctt

SEQ ID NO: 475975 - DNA, 25 bp, Rattus norvegicus
gtaactccacgggagaggtttcctt

SEQ ID NO: 475976 - DNA, 25 bp, Rattus norvegicus
gtaactccagaaacccttagcgtat

SEQ ID NO: 475977 - DNA, 25 bp, Rattus norvegicus
gtaactccagaatcccttagcgtat

SEQ ID NO: 475978 - DNA, 25 bp, Rattus norvegicus
gtaactccagctcttcgtgaacttt

SEQ ID NO: 475979 - DNA, 25 bp, Rattus norvegicus
gtaactccagctgttcgtgaacttt

SEQ ID NO: 475980 - DNA, 25 bp, Rattus norvegicus
gtaactccaggacacagccagactc

SEQ ID NO: 475981 - DNA, 25 bp, Rattus norvegicus
gtaactccaggagacagccagactc

SEQ ID NO: 475982 - DNA, 25 bp, Rattus norvegicus
gtaactccatctctgaagtacctga

SEQ ID NO: 475983 - DNA, 25 bp, Rattus norvegicus
gtaactccatctgtgaagtacctga

SEQ ID NO: 475984 - DNA, 25 bp, Rattus norvegicus
gtaactcccagaatcttgtacctgt

SEQ ID NO: 475985 - DNA, 25 bp, Rattus norvegicus
gtaactcccagattcttgtacctgt

SEQ ID NO: 475986 - DNA, 25 bp, Rattus norvegicus
gtaactcccagtctgttgtatcata

SEQ ID NO: 475987 - DNA, 25 bp, Rattus norvegicus
gtaactcccagtgtgttgtatcata

SEQ ID NO: 475988 - DNA, 25 bp, Rattus norvegicus
gtaactcccattatatgtaacattt

SEQ ID NO: 475989 - DNA, 25 bp, Rattus norvegicus
gtaactcccattttatgtaacattt

SEQ ID NO: 475990 - DNA, 25 bp, Rattus norvegicus
gtaactcccttcatccatgctctga

SEQ ID NO: 475991 - DNA, 25 bp, Rattus norvegicus
gtaactcccttcttccatgctctga

SEQ ID NO: 475992 - DNA, 25 bp, Rattus norvegicus
gtaactcccttgactcaatccaagt

SEQ ID NO: 475993 - DNA, 25 bp, Rattus norvegicus
gtaactcccttgtctcaatccaagt

SEQ ID NO: 475994 - DNA, 25 bp, Rattus norvegicus
gtaactcctgctcagtcatgatggg

SEQ ID NO: 475995 - DNA, 25 bp, Rattus norvegicus
gtaactcctgctgagtcatgatggg

SEQ ID NO: 475996 - DNA, 25 bp, Rattus norvegicus
gtaactcctggacctaacgtagaag

SEQ ID NO: 475997 - DNA, 25 bp, Rattus norvegicus
gtaactcctggagctaacgtagaag

SEQ ID NO: 475998 - DNA, 25 bp, Rattus norvegicus
gtaactccttgactgacacactaat

SEQ ID NO: 475999 - DNA, 25 bp, Rattus norvegicus
gtaactccttgagtgacacactaat

SEQ ID NO: 476000 - DNA, 25 bp, Rattus norvegicus
gtaactcctttcatccgaggagagt

SEQ ID NO: 476001 - DNA, 25 bp, Rattus norvegicus
gtaactcctttcttccgaggagagt

SEQ ID NO: 476002 - DNA, 25 bp, Rattus norvegicus
gtaactcgatatatatgccgggttt

SEQ ID NO: 476003 - DNA, 25 bp, Rattus norvegicus
gtaactcgatatttatgccgggttt

SEQ ID NO: 476004 - DNA, 25 bp, Rattus norvegicus
gtaactcgggcccatggaaacagtg

SEQ ID NO: 476005 - DNA, 25 bp, Rattus norvegicus
gtaactcgggccgatggaaacagtg

SEQ ID NO: 476006 - DNA, 25 bp, Rattus norvegicus
gtaactcgggttctcatgtataatc

SEQ ID NO: 476007 - DNA, 25 bp, Rattus norvegicus
gtaactcgggttgtcatgtataatc

SEQ ID NO: 476008 - DNA, 25 bp, Rattus norvegicus
gtaactcgttttcgttgacttctga

SEQ ID NO: 476009 - DNA, 25 bp, Rattus norvegicus
gtaactcgttttggttgacttctga

SEQ ID NO: 476010 - DNA, 25 bp, Rattus norvegicus
gtaactctaaatatatcccttgcat

SEQ ID NO: 476011 - DNA, 25 bp, Rattus norvegicus
gtaactctaaatttatcccttgcat

SEQ ID NO: 476012 - DNA, 25 bp, Rattus norvegicus
gtaactctacaacttcatagcggaa

SEQ ID NO: 476013 - DNA, 25 bp, Rattus norvegicus
gtaactctacaagttcatagcggaa

SEQ ID NO: 476014 - DNA, 25 bp, Rattus norvegicus
gtaactctagtaatcctctgagaaa

SEQ ID NO: 476015 - DNA, 25 bp, Rattus norvegicus
gtaactctagtattcctctgagaaa

SEQ ID NO: 476016 - DNA, 25 bp, Rattus norvegicus
gtaactctgaaaaccacgtgtcatt

SEQ ID NO: 476017 - DNA, 25 bp, Rattus norvegicus
gtaactctgaaatccacgtgtcatt

SEQ ID NO: 476018 - DNA, 25 bp, Rattus norvegicus
gtaactctgaagaatctgctttggg

SEQ ID NO: 476019 - DNA, 25 bp, Rattus norvegicus
gtaactctgaagtatctgctttggg

SEQ ID NO: 476020 - DNA, 25 bp, Rattus norvegicus
gtaactctgaccagggtaccctgga

SEQ ID NO: 476021 - DNA, 25 bp, Rattus norvegicus
gtaactctgacctgggtaccctgga

SEQ ID NO: 476022 - DNA, 25 bp, Rattus norvegicus
gtaactctgcaccaggctctggctg

SEQ ID NO: 476023 - DNA, 25 bp, Rattus norvegicus
gtaactctgcacgaggctctggctg

SEQ ID NO: 476024 - DNA, 25 bp, Rattus norvegicus
gtaactctgctgaagacccattcat

SEQ ID NO: 476025 - DNA, 25 bp, Rattus norvegicus
gtaactctgctgtagacccattcat

SEQ ID NO: 476026 - DNA, 25 bp, Rattus norvegicus
gtaactctgggcaagaacgacaatt

SEQ ID NO: 476027 - DNA, 25 bp, Rattus norvegicus
gtaactctgggctagaacgacaatt

SEQ ID NO: 476028 - DNA, 25 bp, Rattus norvegicus
gtaactctggttatcatccatctct

SEQ ID NO: 476029 - DNA, 25 bp, Rattus norvegicus
gtaactctggttttcatccatctct

SEQ ID NO: 476030 - DNA, 25 bp, Rattus norvegicus
gtaactctgtcaagataggtgcttt

SEQ ID NO: 476031 - DNA, 25 bp, Rattus norvegicus
gtaactctgtcatgataggtgcttt

SEQ ID NO: 476032 - DNA, 25 bp, Rattus norvegicus
gtaactcttacgaggtgttcgtgaa

SEQ ID NO: 476033 - DNA, 25 bp, Rattus norvegicus
gtaactcttacgtggtgttcgtgaa

SEQ ID NO: 476034 - DNA, 25 bp, Rattus norvegicus
gtaactcttagcatttaccagccag

SEQ ID NO: 476035 - DNA, 25 bp, Rattus norvegicus
gtaactcttagcttttaccagccag

SEQ ID NO: 476036 - DNA, 25 bp, Rattus norvegicus
gtaactcttgggaacttgagcagat

SEQ ID NO: 476037 - DNA, 25 bp, Rattus norvegicus
gtaactcttgggtacttgagcagat

SEQ ID NO: 476038 - DNA, 25 bp, Rattus norvegicus
gtaactcttgtgaagattgtctcta

SEQ ID NO: 476039 - DNA, 25 bp, Rattus norvegicus
gtaactcttgtgtagattgtctcta

SEQ ID NO: 476040 - DNA, 25 bp, Rattus norvegicus
gtaactgaaaccattctttccagct

SEQ ID NO: 476041 - DNA, 25 bp, Rattus norvegicus
gtaactgaaacctttctttccagct

SEQ ID NO: 476042 - DNA, 25 bp, Rattus norvegicus
gtaactgaaatgaaccagatctata

SEQ ID NO: 476043 - DNA, 25 bp, Rattus norvegicus
gtaactgaaatgtaccagatctata

SEQ ID NO: 476044 - DNA, 25 bp, Rattus norvegicus
gtaactgaagctacccttgtagtct

SEQ ID NO: 476045 - DNA, 25 bp, Rattus norvegicus
gtaactgaagcttcccttgtagtct

SEQ ID NO: 476046 - DNA, 25 bp, Rattus norvegicus
gtaactgacactctttacctcttca

SEQ ID NO: 476047 - DNA, 25 bp, Rattus norvegicus
gtaactgacactgtttacctcttca

SEQ ID NO: 476048 - DNA, 25 bp, Rattus norvegicus
gtaactgaccaacctctgagattgt

SEQ ID NO: 476049 - DNA, 25 bp, Rattus norvegicus
gtaactgaccaagctctgagattgt

SEQ ID NO: 476050 - DNA, 25 bp, Rattus norvegicus
gtaactgaccttctttatactagct

SEQ ID NO: 476051 - DNA, 25 bp, Rattus norvegicus
gtaactgaccttgtttatactagct

SEQ ID NO: 476052 - DNA, 25 bp, Rattus norvegicus
gtaactgagctgatgaatccctaaa

SEQ ID NO: 476053 - DNA, 25 bp, Rattus norvegicus
gtaactgagctgttgaatccctaaa

SEQ ID NO: 476054 - DNA, 25 bp, Rattus norvegicus
gtaactgagttcacctagactgtca

SEQ ID NO: 476055 - DNA, 25 bp, Rattus norvegicus
gtaactgagttctcctagactgtca

SEQ ID NO: 476056 - DNA, 25 bp, Rattus norvegicus
gtaactgagttgagtgttctttgca

SEQ ID NO: 476057 - DNA, 25 bp, Rattus norvegicus
gtaactgagttgtgtgttctttgca

SEQ ID NO: 476058 - DNA, 25 bp, Rattus norvegicus
gtaactgatagcaacattctgaggt

SEQ ID NO: 476059 - DNA, 25 bp, Rattus norvegicus
gtaactgatagctacattctgaggt

SEQ ID NO: 476060 - DNA, 25 bp, Rattus norvegicus
gtaactgatctgatttcactcattt

SEQ ID NO: 476061 - DNA, 25 bp, Rattus norvegicus
gtaactgatctgttttcactcattt

SEQ ID NO: 476062 - DNA, 25 bp, Rattus norvegicus
gtaactgatggcatgtttgtcttta

SEQ ID NO: 476063 - DNA, 25 bp, Rattus norvegicus
gtaactgatggcttgtttgtcttta

SEQ ID NO: 476064 - DNA, 25 bp, Rattus norvegicus
gtaactgcatgtattaggacctatc

SEQ ID NO: 476065 - DNA, 25 bp, Rattus norvegicus
gtaactgcatgttttaggacctatc

SEQ ID NO: 476066 - DNA, 25 bp, Rattus norvegicus
gtaactgccataatgaattcccact

SEQ ID NO: 476067 - DNA, 25 bp, Rattus norvegicus
gtaactgccatattgaattcccact

SEQ ID NO: 476068 - DNA, 25 bp, Rattus norvegicus
gtaactgcccagctctgtgtataag

SEQ ID NO: 476069 - DNA, 25 bp, Rattus norvegicus
gtaactgcccaggtctgtgtataag

SEQ ID NO: 476070 - DNA, 25 bp, Rattus norvegicus
gtaactgccccacctatatcattag

SEQ ID NO: 476071 - DNA, 25 bp, Rattus norvegicus
gtaactgccccagctatatcattag

SEQ ID NO: 476072 - DNA, 25 bp, Rattus norvegicus
gtaactgctcccacctcaaggttgt

SEQ ID NO: 476073 - DNA, 25 bp, Rattus norvegicus
gtaactgctccctcctcaaggttgt

SEQ ID NO: 476074 - DNA, 25 bp, Rattus norvegicus
gtaactgctcgtctctgtagtctga

SEQ ID NO: 476075 - DNA, 25 bp, Rattus norvegicus
gtaactgctcgtgtctgtagtctga

SEQ ID NO: 476076 - DNA, 25 bp, Rattus norvegicus
gtaactgctctaaactgaaacgggc

SEQ ID NO: 476077 - DNA, 25 bp, Rattus norvegicus
gtaactgctctatactgaaacgggc

SEQ ID NO: 476078 - DNA, 25 bp, Rattus norvegicus
gtaactgctcttaaattgtctggcc

SEQ ID NO: 476079 - DNA, 25 bp, Rattus norvegicus
gtaactgctctttaattgtctggcc

SEQ ID NO: 476080 - DNA, 25 bp, Rattus norvegicus
gtaactgcttccagagtgacggatc

SEQ ID NO: 476081 - DNA, 25 bp, Rattus norvegicus
gtaactgcttcctgagtgacggatc

SEQ ID NO: 476082 - DNA, 25 bp, Rattus norvegicus
gtaactgcttttccatgagctacag

SEQ ID NO: 476083 - DNA, 25 bp, Rattus norvegicus
gtaactgcttttgcatgagctacag

SEQ ID NO: 476084 - DNA, 25 bp, Rattus norvegicus
gtaactggaattactcattagatct

SEQ ID NO: 476085 - DNA, 25 bp, Rattus norvegicus
gtaactggaatttctcattagatct

SEQ ID NO: 476086 - DNA, 25 bp, Rattus norvegicus
gtaactggacatacagccaggactt

SEQ ID NO: 476087 - DNA, 25 bp, Rattus norvegicus
gtaactggacattcagccaggactt

SEQ ID NO: 476088 - DNA, 25 bp, Rattus norvegicus
gtaactggacttaccttggttggat

SEQ ID NO: 476089 - DNA, 25 bp, Rattus norvegicus
gtaactggactttccttggttggat

SEQ ID NO: 476090 - DNA, 25 bp, Rattus norvegicus
gtaactggccagatctgcttggaga

SEQ ID NO: 476091 - DNA, 25 bp, Rattus norvegicus
gtaactggccagttctgcttggaga

SEQ ID NO: 476092 - DNA, 25 bp, Rattus norvegicus
gtaactggcctgcaggatgtctttc

SEQ ID NO: 476093 - DNA, 25 bp, Rattus norvegicus
gtaactggcctggaggatgtctttc

SEQ ID NO: 476094 - DNA, 25 bp, Rattus norvegicus
gtaactgggaaaccgccccctcttg

SEQ ID NO: 476095 - DNA, 25 bp, Rattus norvegicus
gtaactgggaaagcgccccctcttg

SEQ ID NO: 476096 - DNA, 25 bp, Rattus norvegicus
gtaactggtcagatttccacgagga

SEQ ID NO: 476097 - DNA, 25 bp, Rattus norvegicus
gtaactggtcagttttccacgagga

SEQ ID NO: 476098 - DNA, 25 bp, Rattus norvegicus
gtaactggtcatctacctccagcat

SEQ ID NO: 476099 - DNA, 25 bp, Rattus norvegicus
gtaactggtcatgtacctccagcat

SEQ ID NO: 476100 - DNA, 25 bp, Rattus norvegicus
gtaactggtctgagttgcggctgta

SEQ ID NO: 476101 - DNA, 25 bp, Rattus norvegicus
gtaactggtctgtgttgcggctgta

SEQ ID NO: 476102 - DNA, 25 bp, Rattus norvegicus
gtaactggtggtagactgtatttca

SEQ ID NO: 476103 - DNA, 25 bp, Rattus norvegicus
gtaactggtggttgactgtatttca

SEQ ID NO: 476104 - DNA, 25 bp, Rattus norvegicus
gtaactggttctaccttcgaaacat

SEQ ID NO: 476105 - DNA, 25 bp, Rattus norvegicus
gtaactggttcttccttcgaaacat

SEQ ID NO: 476106 - DNA, 25 bp, Rattus norvegicus
gtaactgtacttcccaagagtctga

SEQ ID NO: 476107 - DNA, 25 bp, Rattus norvegicus
gtaactgtacttgccaagagtctga

SEQ ID NO: 476108 - DNA, 25 bp, Rattus norvegicus
gtaactgtaggcctgaaccccagcc

SEQ ID NO: 476109 - DNA, 25 bp, Rattus norvegicus
gtaactgtaggcgtgaaccccagcc

SEQ ID NO: 476110 - DNA, 25 bp, Rattus norvegicus
gtaactgtagtactactagggcctt

SEQ ID NO: 476111 - DNA, 25 bp, Rattus norvegicus
gtaactgtagtagtactagggcctt

SEQ ID NO: 476112 - DNA, 25 bp, Rattus norvegicus
gtaactgtcacaaccttccggaggg

SEQ ID NO: 476113 - DNA, 25 bp, Rattus norvegicus
gtaactgtcacatccttccggaggg

SEQ ID NO: 476114 - DNA, 25 bp, Rattus norvegicus
gtaactgtctacatgcatttagcat

SEQ ID NO: 476115 - DNA, 25 bp, Rattus norvegicus
gtaactgtctacttgcatttagcat

SEQ ID NO: 476116 - DNA, 25 bp, Rattus norvegicus
gtaactgtggatcgcttctggtttt

SEQ ID NO: 476117 - DNA, 25 bp, Rattus norvegicus
gtaactgtggatggcttctggtttt

SEQ ID NO: 476118 - DNA, 25 bp, Rattus norvegicus
gtaactgtggccaagagtccggctc

SEQ ID NO: 476119 - DNA, 25 bp, Rattus norvegicus
gtaactgtggcctagagtccggctc

SEQ ID NO: 476120 - DNA, 25 bp, Rattus norvegicus
gtaactgtggttacccggttcattg

SEQ ID NO: 476121 - DNA, 25 bp, Rattus norvegicus
gtaactgtggtttcccggttcattg

SEQ ID NO: 476122 - DNA, 25 bp, Rattus norvegicus
gtaactgtgttaactgtatctgaat

SEQ ID NO: 476123 - DNA, 25 bp, Rattus norvegicus
gtaactgtgttacttgccaatcatt

SEQ ID NO: 476124 - DNA, 25 bp, Rattus norvegicus
gtaactgtgttagttgccaatcatt

SEQ ID NO: 476125 - DNA, 25 bp, Rattus norvegicus
gtaactgtgttatctgtatctgaat

SEQ ID NO: 476126 - DNA, 25 bp, Rattus norvegicus
gtaactgtgtttactttgtctgatt

SEQ ID NO: 476127 - DNA, 25 bp, Rattus norvegicus
gtaactgtgttttctttgtctgatt

SEQ ID NO: 476128 - DNA, 25 bp, Rattus norvegicus
gtaactgttcttcttcaaaccctga

SEQ ID NO: 476129 - DNA, 25 bp, Rattus norvegicus
gtaactgttcttgttcaaaccctga

SEQ ID NO: 476130 - DNA, 25 bp, Rattus norvegicus
gtaactgttgggactcaggcaacca

SEQ ID NO: 476131 - DNA, 25 bp, Rattus norvegicus
gtaactgttgggtctcaggcaacca

SEQ ID NO: 476132 - DNA, 25 bp, Rattus norvegicus
gtaactgttgtacggcattgggaaa

SEQ ID NO: 476133 - DNA, 25 bp, Rattus norvegicus
gtaactgttgtagggcattgggaaa

SEQ ID NO: 476134 - DNA, 25 bp, Rattus norvegicus
gtaactgtttcaccattcggcattt

SEQ ID NO: 476135 - DNA, 25 bp, Rattus norvegicus
gtaactgtttcagcattcggcattt

SEQ ID NO: 476136 - DNA, 25 bp, Rattus norvegicus
gtaactgttttgctgtgatcatgat

SEQ ID NO: 476137 - DNA, 25 bp, Rattus norvegicus
gtaactgttttggtgtgatcatgat

SEQ ID NO: 476138 - DNA, 25 bp, Rattus norvegicus
gtaacttaagagctgcgggcacacg

SEQ ID NO: 476139 - DNA, 25 bp, Rattus norvegicus
gtaacttaagaggtgcgggcacacg

SEQ ID NO: 476140 - DNA, 25 bp, Rattus norvegicus
gtaacttacaatatttaatgcctga

SEQ ID NO: 476141 - DNA, 25 bp, Rattus norvegicus
gtaacttacaatttttaatgcctga

SEQ ID NO: 476142 - DNA, 25 bp, Rattus norvegicus
gtaacttacttgatgaggtaccaca

SEQ ID NO: 476143 - DNA, 25 bp, Rattus norvegicus
gtaacttacttgttgaggtaccaca

SEQ ID NO: 476144 - DNA, 25 bp, Rattus norvegicus
gtaacttagagtccgatttattcag

SEQ ID NO: 476145 - DNA, 25 bp, Rattus norvegicus
gtaacttagagtgcgatttattcag

SEQ ID NO: 476146 - DNA, 25 bp, Rattus norvegicus
gtaacttagccacagaaccagcaga

SEQ ID NO: 476147 - DNA, 25 bp, Rattus norvegicus
gtaacttagccagagaaccagcaga

SEQ ID NO: 476148 - DNA, 25 bp, Rattus norvegicus
gtaacttaggttatcatgactcaaa

SEQ ID NO: 476149 - DNA, 25 bp, Rattus norvegicus
gtaacttaggttttcatgactcaaa

SEQ ID NO: 476150 - DNA, 25 bp, Rattus norvegicus
gtaacttatactaaccctcagcaac

SEQ ID NO: 476151 - DNA, 25 bp, Rattus norvegicus
gtaacttatacttaccctcagcaac

SEQ ID NO: 476152 - DNA, 25 bp, Rattus norvegicus
gtaacttatattaccattttcctct

SEQ ID NO: 476153 - DNA, 25 bp, Rattus norvegicus
gtaacttatatttccattttcctct

SEQ ID NO: 476154 - DNA, 25 bp, Rattus norvegicus
gtaacttcacagagcatcacagcat

SEQ ID NO: 476155 - DNA, 25 bp, Rattus norvegicus
gtaacttcacagtgcatcacagcat

SEQ ID NO: 476156 - DNA, 25 bp, Rattus norvegicus
gtaacttcaccaaagaccgacgagc

SEQ ID NO: 476157 - DNA, 25 bp, Rattus norvegicus
gtaacttcaccatagaccgacgagc

SEQ ID NO: 476158 - DNA, 25 bp, Rattus norvegicus
gtaacttcaggtatttgactcaatt

SEQ ID NO: 476159 - DNA, 25 bp, Rattus norvegicus
gtaacttcaggtttttgactcaatt

SEQ ID NO: 476160 - DNA, 25 bp, Rattus norvegicus
gtaacttcagttccccgggatgtgg

SEQ ID NO: 476161 - DNA, 25 bp, Rattus norvegicus
gtaacttcagttgcccgggatgtgg

SEQ ID NO: 476162 - DNA, 25 bp, Rattus norvegicus
gtaacttcataaacttttctcctgg

SEQ ID NO: 476163 - DNA, 25 bp, Rattus norvegicus
gtaacttcataatcttttctcctgg

SEQ ID NO: 476164 - DNA, 25 bp, Rattus norvegicus
gtaacttcatcactatcctgtgtat

SEQ ID NO: 476165 - DNA, 25 bp, Rattus norvegicus
gtaacttcatcagtatcctgtgtat

SEQ ID NO: 476166 - DNA, 25 bp, Rattus norvegicus
gtaacttcatggaagctggctgtgc

SEQ ID NO: 476167 - DNA, 25 bp, Rattus norvegicus
gtaacttcatggtagctggctgtgc

SEQ ID NO: 476168 - DNA, 25 bp, Rattus norvegicus
gtaacttccacaaaacatttgatct

SEQ ID NO: 476169 - DNA, 25 bp, Rattus norvegicus
gtaacttccacataacatttgatct

SEQ ID NO: 476170 - DNA, 25 bp, Rattus norvegicus
gtaacttcccttagtgattcctgat

SEQ ID NO: 476171 - DNA, 25 bp, Rattus norvegicus
gtaacttccctttgtgattcctgat

SEQ ID NO: 476172 - DNA, 25 bp, Rattus norvegicus
gtaacttccgttcagatttctgaga

SEQ ID NO: 476173 - DNA, 25 bp, Rattus norvegicus
gtaacttccgttgagatttctgaga

SEQ ID NO: 476174 - DNA, 25 bp, Rattus norvegicus
gtaacttcctgtcagtaaacaactt

SEQ ID NO: 476175 - DNA, 25 bp, Rattus norvegicus
gtaacttcctgtgagtaaacaactt

SEQ ID NO: 476176 - DNA, 25 bp, Rattus norvegicus
gtaacttcgatgatggtccaggtgt

SEQ ID NO: 476177 - DNA, 25 bp, Rattus norvegicus
gtaacttcgatgttggtccaggtgt

SEQ ID NO: 476178 - DNA, 25 bp, Rattus norvegicus
gtaacttcgctgctcagtagatctg

SEQ ID NO: 476179 - DNA, 25 bp, Rattus norvegicus
gtaacttcgctggtcagtagatctg

SEQ ID NO: 476180 - DNA, 25 bp, Rattus norvegicus
gtaacttctgcaagtgagacctcat

SEQ ID NO: 476181 - DNA, 25 bp, Rattus norvegicus
gtaacttctgcatgtgagacctcat

SEQ ID NO: 476182 - DNA, 25 bp, Rattus norvegicus
gtaacttcttgactgtggtagactt

SEQ ID NO: 476183 - DNA, 25 bp, Rattus norvegicus
gtaacttcttgagtgtggtagactt

SEQ ID NO: 476184 - DNA, 25 bp, Rattus norvegicus
gtaacttgaggtcagatccatcttc

SEQ ID NO: 476185 - DNA, 25 bp, Rattus norvegicus
gtaacttgaggtgagatccatcttc

SEQ ID NO: 476186 - DNA, 25 bp, Rattus norvegicus
gtaacttgatgtacagtgttcttat

SEQ ID NO: 476187 - DNA, 25 bp, Rattus norvegicus
gtaacttgatgttcagtgttcttat

SEQ ID NO: 476188 - DNA, 25 bp, Rattus norvegicus
gtaacttgcaagcacactgttttgt

SEQ ID NO: 476189 - DNA, 25 bp, Rattus norvegicus
gtaacttgcaaggacactgttttgt

SEQ ID NO: 476190 - DNA, 25 bp, Rattus norvegicus
gtaacttgccgtagttgctgtccaa

SEQ ID NO: 476191 - DNA, 25 bp, Rattus norvegicus
gtaacttgccgttgttgctgtccaa

SEQ ID NO: 476192 - DNA, 25 bp, Rattus norvegicus
gtaacttgggctccagtctgtaatc

SEQ ID NO: 476193 - DNA, 25 bp, Rattus norvegicus
gtaacttgggctgcagtctgtaatc

SEQ ID NO: 476194 - DNA, 25 bp, Rattus norvegicus
gtaacttggtatccgcgaaacctgt

SEQ ID NO: 476195 - DNA, 25 bp, Rattus norvegicus
gtaacttggtatgcgcgaaacctgt

SEQ ID NO: 476196 - DNA, 25 bp, Rattus norvegicus
gtaacttggtgacagctcactcccc

SEQ ID NO: 476197 - DNA, 25 bp, Rattus norvegicus
gtaacttggtgagagctcactcccc

SEQ ID NO: 476198 - DNA, 25 bp, Rattus norvegicus
gtaacttgtacaaccgaagagcatt

SEQ ID NO: 476199 - DNA, 25 bp, Rattus norvegicus
gtaacttgtacatccgaagagcatt

SEQ ID NO: 476200 - DNA, 25 bp, Rattus norvegicus
gtaacttgtgtcattcatctgaacc

SEQ ID NO: 476201 - DNA, 25 bp, Rattus norvegicus
gtaacttgtgtctttcatctgaacc

SEQ ID NO: 476202 - DNA, 25 bp, Rattus norvegicus
gtaactttacagactgttgccacaa

SEQ ID NO: 476203 - DNA, 25 bp, Rattus norvegicus
gtaactttacagtctgttgccacaa

SEQ ID NO: 476204 - DNA, 25 bp, Rattus norvegicus
gtaactttacatcttcatcaccttc

SEQ ID NO: 476205 - DNA, 25 bp, Rattus norvegicus
gtaactttacatgttcatcaccttc

SEQ ID NO: 476206 - DNA, 25 bp, Rattus norvegicus
gtaactttagccctcaggaagtgga

SEQ ID NO: 476207 - DNA, 25 bp, Rattus norvegicus
gtaactttagccgtcaggaagtgga

SEQ ID NO: 476208 - DNA, 25 bp, Rattus norvegicus
gtaactttatctcactgtatcattt

SEQ ID NO: 476209 - DNA, 25 bp, Rattus norvegicus
gtaactttatctgactgtatcattt

SEQ ID NO: 476210 - DNA, 25 bp, Rattus norvegicus
gtaactttatgccagatttcagatt

SEQ ID NO: 476211 - DNA, 25 bp, Rattus norvegicus
gtaactttatgcgagatttcagatt

SEQ ID NO: 476212 - DNA, 25 bp, Rattus norvegicus
gtaactttattcctaccagacaact

SEQ ID NO: 476213 - DNA, 25 bp, Rattus norvegicus
gtaactttattcgtaccagacaact

SEQ ID NO: 476214 - DNA, 25 bp, Rattus norvegicus
gtaactttccaaacctggacaagga

SEQ ID NO: 476215 - DNA, 25 bp, Rattus norvegicus
gtaactttccaatcctggacaagga

SEQ ID NO: 476216 - DNA, 25 bp, Rattus norvegicus
gtaactttccttctactcaattggg

SEQ ID NO: 476217 - DNA, 25 bp, Rattus norvegicus
gtaactttccttgtactcaattggg

SEQ ID NO: 476218 - DNA, 25 bp, Rattus norvegicus
gtaactttcgaaatcagtctcatgc

SEQ ID NO: 476219 - DNA, 25 bp, Rattus norvegicus
gtaactttcgaattcagtctcatgc

SEQ ID NO: 476220 - DNA, 25 bp, Rattus norvegicus
gtaactttcgtcctgaatccttcaa

SEQ ID NO: 476221 - DNA, 25 bp, Rattus norvegicus
gtaactttcgtcgtgaatccttcaa

SEQ ID NO: 476222 - DNA, 25 bp, Rattus norvegicus
gtaactttcttacctcctcaggtat

SEQ ID NO: 476223 - DNA, 25 bp, Rattus norvegicus
gtaactttcttagctcctcaggtat

SEQ ID NO: 476224 - DNA, 25 bp, Rattus norvegicus
gtaactttgaaaatcgtctgtctgg

SEQ ID NO: 476225 - DNA, 25 bp, Rattus norvegicus
gtaactttgaaattcgtctgtctgg

SEQ ID NO: 476226 - DNA, 25 bp, Rattus norvegicus
gtaactttgacaccgttgattatgg

SEQ ID NO: 476227 - DNA, 25 bp, Rattus norvegicus
gtaactttgacagcgttgattatgg

SEQ ID NO: 476228 - DNA, 25 bp, Rattus norvegicus
gtaactttgagtaactgtggccact

SEQ ID NO: 476229 - DNA, 25 bp, Rattus norvegicus
gtaactttgagttactgtggccact

SEQ ID NO: 476230 - DNA, 25 bp, Rattus norvegicus
gtaactttgcccattttctgcatga

SEQ ID NO: 476231 - DNA, 25 bp, Rattus norvegicus
gtaactttgccctttttctgcatga

SEQ ID NO: 476232 - DNA, 25 bp, Rattus norvegicus
gtaactttgctccaagtcccaataa

SEQ ID NO: 476233 - DNA, 25 bp, Rattus norvegicus
gtaactttgctcgaagtcccaataa

SEQ ID NO: 476234 - DNA, 25 bp, Rattus norvegicus
gtaacttttacactgcctttgccac

SEQ ID NO: 476235 - DNA, 25 bp, Rattus norvegicus
gtaacttttacagtgcctttgccac

SEQ ID NO: 476236 - DNA, 25 bp, Rattus norvegicus
gtaacttttctgacaggactgcagt

SEQ ID NO: 476237 - DNA, 25 bp, Rattus norvegicus
gtaacttttctgtcaggactgcagt

SEQ ID NO: 476238 - DNA, 25 bp, Rattus norvegicus
gtaacttttgaaaccagtgcccatc

SEQ ID NO: 476239 - DNA, 25 bp, Rattus norvegicus
gtaacttttgaacccgtgcctaaga

SEQ ID NO: 476240 - DNA, 25 bp, Rattus norvegicus
gtaacttttgaagccgtgcctaaga

SEQ ID NO: 476241 - DNA, 25 bp, Rattus norvegicus
gtaacttttgaatccagtgcccatc

SEQ ID NO: 476242 - DNA, 25 bp, Rattus norvegicus
gtaacttttggcaaccatgtttcct

SEQ ID NO: 476243 - DNA, 25 bp, Rattus norvegicus
gtaacttttggctaccatgtttcct

SEQ ID NO: 476244 - DNA, 25 bp, Rattus norvegicus
gtaacttttggtagcgaatgtcttt

SEQ ID NO: 476245 - DNA, 25 bp, Rattus norvegicus
gtaacttttggttgcgaatgtcttt

SEQ ID NO: 476246 - DNA, 25 bp, Rattus norvegicus
gtaacttttgtaatcacttgcaatg

SEQ ID NO: 476247 - DNA, 25 bp, Rattus norvegicus
gtaacttttgtattcacttgcaatg

SEQ ID NO: 476248 - DNA, 25 bp, Rattus norvegicus
gtaactttttacagcgccactaagt

SEQ ID NO: 476249 - DNA, 25 bp, Rattus norvegicus
gtaactttttactgcgccactaagt

SEQ ID NO: 476250 - DNA, 25 bp, Rattus norvegicus
gtaactttttcaactgcttagtgat

SEQ ID NO: 476251 - DNA, 25 bp, Rattus norvegicus
gtaactttttcaagatttcagacca

SEQ ID NO: 476252 - DNA, 25 bp, Rattus norvegicus
gtaactttttcatctgcttagtgat

SEQ ID NO: 476253 - DNA, 25 bp, Rattus norvegicus
gtaactttttcatgatttcagacca

SEQ ID NO: 476254 - DNA, 25 bp, Rattus norvegicus
gtaagaaaagaaagtgacctcactg

SEQ ID NO: 476255 - DNA, 25 bp, Rattus norvegicus
gtaagaaaagaatgtgacctcactg

SEQ ID NO: 476256 - DNA, 25 bp, Rattus norvegicus
gtaagaaaccacatacctaagaagg

SEQ ID NO: 476257 - DNA, 25 bp, Rattus norvegicus
gtaagaaaccacttacctaagaagg

SEQ ID NO: 476258 - DNA, 25 bp, Rattus norvegicus
gtaagaaacgacctctccatcattg

SEQ ID NO: 476259 - DNA, 25 bp, Rattus norvegicus
gtaagaaacgacgtctccatcattg

SEQ ID NO: 476260 - DNA, 25 bp, Rattus norvegicus
gtaagaaactgaagcctgcgccatt

SEQ ID NO: 476261 - DNA, 25 bp, Rattus norvegicus
gtaagaaactgatgcctgcgccatt

SEQ ID NO: 476262 - DNA, 25 bp, Rattus norvegicus
gtaagaaaggccagcggacccacac

SEQ ID NO: 476263 - DNA, 25 bp, Rattus norvegicus
gtaagaaaggcctgcggacccacac

SEQ ID NO: 476264 - DNA, 25 bp, Rattus norvegicus
gtaagaaattgcatgctctctccct

SEQ ID NO: 476265 - DNA, 25 bp, Rattus norvegicus
gtaagaaattgcttgctctctccct

SEQ ID NO: 476266 - DNA, 25 bp, Rattus norvegicus
gtaagaacatccaacacttcagctc

SEQ ID NO: 476267 - DNA, 25 bp, Rattus norvegicus
gtaagaacatcctacacttcagctc

SEQ ID NO: 476268 - DNA, 25 bp, Rattus norvegicus
gtaagaacctgaagccatttccaaa

SEQ ID NO: 476269 - DNA, 25 bp, Rattus norvegicus
gtaagaacctgatgccatttccaaa

SEQ ID NO: 476270 - DNA, 25 bp, Rattus norvegicus
gtaagaacgtcccagcatgagagag

SEQ ID NO: 476271 - DNA, 25 bp, Rattus norvegicus
gtaagaacgtccgagcatgagagag

SEQ ID NO: 476272 - DNA, 25 bp, Rattus norvegicus
gtaagaactcccaggactgcgagat

SEQ ID NO: 476273 - DNA, 25 bp, Rattus norvegicus
gtaagaactccctggactgcgagat

SEQ ID NO: 476274 - DNA, 25 bp, Rattus norvegicus
gtaagaagacatataactccgtaaa

SEQ ID NO: 476275 - DNA, 25 bp, Rattus norvegicus
gtaagaagacatttaactccgtaaa

SEQ ID NO: 476276 - DNA, 25 bp, Rattus norvegicus
gtaagaagaccaccaccagatgcag

SEQ ID NO: 476277 - DNA, 25 bp, Rattus norvegicus
gtaagaagaccagcaccagatgcag

SEQ ID NO: 476278 - DNA, 25 bp, Rattus norvegicus
gtaagaagcataacgcacctcgcct

SEQ ID NO: 476279 - DNA, 25 bp, Rattus norvegicus
gtaagaagcatatcgcacctcgcct

SEQ ID NO: 476280 - DNA, 25 bp, Rattus norvegicus
gtaagaagccagatcctcgctattg

SEQ ID NO: 476281 - DNA, 25 bp, Rattus norvegicus
gtaagaagccagttcctcgctattg

SEQ ID NO: 476282 - DNA, 25 bp, Rattus norvegicus
gtaagaagcccgagaccaaagccac

SEQ ID NO: 476283 - DNA, 25 bp, Rattus norvegicus
gtaagaagcccgtgaccaaagccac

SEQ ID NO: 476284 - DNA, 25 bp, Rattus norvegicus
gtaagaagccctcttagctccaaac

SEQ ID NO: 476285 - DNA, 25 bp, Rattus norvegicus
gtaagaagccctgttagctccaaac

SEQ ID NO: 476286 - DNA, 25 bp, Rattus norvegicus
gtaagaagcgcaccctcgatgccgt

SEQ ID NO: 476287 - DNA, 25 bp, Rattus norvegicus
gtaagaagcgcagcctcgatgccgt

SEQ ID NO: 476288 - DNA, 25 bp, Rattus norvegicus
gtaagaagctagacccactgttggg

SEQ ID NO: 476289 - DNA, 25 bp, Rattus norvegicus
gtaagaagctagtcccactgttggg

SEQ ID NO: 476290 - DNA, 25 bp, Rattus norvegicus
gtaagaagggttacatcttcccgct

SEQ ID NO: 476291 - DNA, 25 bp, Rattus norvegicus
gtaagaagggtttcatcttcccgct

SEQ ID NO: 476292 - DNA, 25 bp, Rattus norvegicus
gtaagaaggtcaaccctcacttcac

SEQ ID NO: 476293 - DNA, 25 bp, Rattus norvegicus
gtaagaaggtcatccctcacttcac

SEQ ID NO: 476294 - DNA, 25 bp, Rattus norvegicus
gtaagaatccttagttagcaatcaa

SEQ ID NO: 476295 - DNA, 25 bp, Rattus norvegicus
gtaagaatcctttgttagcaatcaa

SEQ ID NO: 476296 - DNA, 25 bp, Rattus norvegicus
gtaagaatgatgaacgcccctcttt

SEQ ID NO: 476297 - DNA, 25 bp, Rattus norvegicus
gtaagaatgatgtacgcccctcttt

SEQ ID NO: 476298 - DNA, 25 bp, Rattus norvegicus
gtaagaatggcgaagctgtcctctc

SEQ ID NO: 476299 - DNA, 25 bp, Rattus norvegicus
gtaagaatggcgtagctgtcctctc

SEQ ID NO: 476300 - DNA, 25 bp, Rattus norvegicus
gtaagaattctccttggtcatctgg

SEQ ID NO: 476301 - DNA, 25 bp, Rattus norvegicus
gtaagaattctcgttggtcatctgg

SEQ ID NO: 476302 - DNA, 25 bp, Rattus norvegicus
gtaagaattgggatcctaggatcta

SEQ ID NO: 476303 - DNA, 25 bp, Rattus norvegicus
gtaagaattgggttcctaggatcta

SEQ ID NO: 476304 - DNA, 25 bp, Rattus norvegicus
gtaagacacacacgaactcagggcc

SEQ ID NO: 476305 - DNA, 25 bp, Rattus norvegicus
gtaagacacacaggaactcagggcc

SEQ ID NO: 476306 - DNA, 25 bp, Rattus norvegicus
gtaagacacaccctgcctgtatact

SEQ ID NO: 476307 - DNA, 25 bp, Rattus norvegicus
gtaagacacaccgtgcctgtatact

SEQ ID NO: 476308 - DNA, 25 bp, Rattus norvegicus
gtaagacaccagatgttcgctggta

SEQ ID NO: 476309 - DNA, 25 bp, Rattus norvegicus
gtaagacaccagttgttcgctggta

SEQ ID NO: 476310 - DNA, 25 bp, Rattus norvegicus
gtaagacaccctccttaggtcagag

SEQ ID NO: 476311 - DNA, 25 bp, Rattus norvegicus
gtaagacaccctgcttaggtcagag

SEQ ID NO: 476312 - DNA, 25 bp, Rattus norvegicus
gtaagacaccgactctaagaacaga

SEQ ID NO: 476313 - DNA, 25 bp, Rattus norvegicus
gtaagacaccgagtctaagaacaga

SEQ ID NO: 476314 - DNA, 25 bp, Rattus norvegicus
gtaagacagagaccgtcgcctgctt

SEQ ID NO: 476315 - DNA, 25 bp, Rattus norvegicus
gtaagacagagagcgtcgcctgctt

SEQ ID NO: 476316 - DNA, 25 bp, Rattus norvegicus
gtaagacagcccatgttttcaattt

SEQ ID NO: 476317 - DNA, 25 bp, Rattus norvegicus
gtaagacagcccttgttttcaattt

SEQ ID NO: 476318 - DNA, 25 bp, Rattus norvegicus
gtaagacatgatatgttgtgattta

SEQ ID NO: 476319 - DNA, 25 bp, Rattus norvegicus
gtaagacatgatttgttgtgattta

SEQ ID NO: 476320 - DNA, 25 bp, Rattus norvegicus
gtaagacatgctcgaggctgccaaa

SEQ ID NO: 476321 - DNA, 25 bp, Rattus norvegicus
gtaagacatgctggaggctgccaaa

SEQ ID NO: 476322 - DNA, 25 bp, Rattus norvegicus
gtaagacattggatctattccagct

SEQ ID NO: 476323 - DNA, 25 bp, Rattus norvegicus
gtaagacattggttctattccagct

SEQ ID NO: 476324 - DNA, 25 bp, Rattus norvegicus
gtaagacattttcctaactagtgat

SEQ ID NO: 476325 - DNA, 25 bp, Rattus norvegicus
gtaagacattttgctaactagtgat

SEQ ID NO: 476326 - DNA, 25 bp, Rattus norvegicus
gtaagaccacttcctttgtccttgt

SEQ ID NO: 476327 - DNA, 25 bp, Rattus norvegicus
gtaagaccacttgctttgtccttgt

SEQ ID NO: 476328 - DNA, 25 bp, Rattus norvegicus
gtaagaccagccacagttaatgggt

SEQ ID NO: 476329 - DNA, 25 bp, Rattus norvegicus
gtaagaccagcctcagttaatgggt

SEQ ID NO: 476330 - DNA, 25 bp, Rattus norvegicus
gtaagaccatctctactggacacct

SEQ ID NO: 476331 - DNA, 25 bp, Rattus norvegicus
gtaagaccatctgtactggacacct

SEQ ID NO: 476332 - DNA, 25 bp, Rattus norvegicus
gtaagaccatgtatccaggagcaca

SEQ ID NO: 476333 - DNA, 25 bp, Rattus norvegicus
gtaagaccatgtttccaggagcaca

SEQ ID NO: 476334 - DNA, 25 bp, Rattus norvegicus
gtaagaccctgtcacaacaaaattg

SEQ ID NO: 476335 - DNA, 25 bp, Rattus norvegicus
gtaagaccctgtgacaacaaaattg

SEQ ID NO: 476336 - DNA, 25 bp, Rattus norvegicus
gtaagaccttgtagagcccagaact

SEQ ID NO: 476337 - DNA, 25 bp, Rattus norvegicus
gtaagaccttgttgagcccagaact

SEQ ID NO: 476338 - DNA, 25 bp, Rattus norvegicus
gtaagacggcatcaagtggttagtt

SEQ ID NO: 476339 - DNA, 25 bp, Rattus norvegicus
gtaagacggcatgaagtggttagtt

SEQ ID NO: 476340 - DNA, 25 bp, Rattus norvegicus
gtaagacgtacaacccaagaaccag

SEQ ID NO: 476341 - DNA, 25 bp, Rattus norvegicus
gtaagacgtacatcccaagaaccag

SEQ ID NO: 476342 - DNA, 25 bp, Rattus norvegicus
gtaagacgtcgacctctaagtaagt

SEQ ID NO: 476343 - DNA, 25 bp, Rattus norvegicus
gtaagacgtcgagctctaagtaagt

SEQ ID NO: 476344 - DNA, 25 bp, Rattus norvegicus
gtaagactaaaactcacgtgcacga

SEQ ID NO: 476345 - DNA, 25 bp, Rattus norvegicus
gtaagactaaaagtcacgtgcacga

SEQ ID NO: 476346 - DNA, 25 bp, Rattus norvegicus
gtaagactacttcgtatggctgcca

SEQ ID NO: 476347 - DNA, 25 bp, Rattus norvegicus
gtaagactacttggtatggctgcca

SEQ ID NO: 476348 - DNA, 25 bp, Rattus norvegicus
gtaagactatgcacaccaccatttg

SEQ ID NO: 476349 - DNA, 25 bp, Rattus norvegicus
gtaagactatgctcaccaccatttg

SEQ ID NO: 476350 - DNA, 25 bp, Rattus norvegicus
gtaagactcaaaaactggatgtata

SEQ ID NO: 476351 - DNA, 25 bp, Rattus norvegicus
gtaagactcaaatactggatgtata

SEQ ID NO: 476352 - DNA, 25 bp, Rattus norvegicus
gtaagactcctcaacttgctttaaa

SEQ ID NO: 476353 - DNA, 25 bp, Rattus norvegicus
gtaagactcctctacttgctttaaa

SEQ ID NO: 476354 - DNA, 25 bp, Rattus norvegicus
gtaagactcttgaacctttatgtta

SEQ ID NO: 476355 - DNA, 25 bp, Rattus norvegicus
gtaagactcttgctgtatcgtgaca

SEQ ID NO: 476356 - DNA, 25 bp, Rattus norvegicus
gtaagactcttgcttcagattctga

SEQ ID NO: 476357 - DNA, 25 bp, Rattus norvegicus
gtaagactcttggtgtatcgtgaca

SEQ ID NO: 476358 - DNA, 25 bp, Rattus norvegicus
gtaagactcttggttcagattctga

SEQ ID NO: 476359 - DNA, 25 bp, Rattus norvegicus
gtaagactcttgtacctttatgtta

SEQ ID NO: 476360 - DNA, 25 bp, Rattus norvegicus
gtaagactgactacactgctcataa

SEQ ID NO: 476361 - DNA, 25 bp, Rattus norvegicus
gtaagactgacttcactgctcataa

SEQ ID NO: 476362 - DNA, 25 bp, Rattus norvegicus
gtaagactgcctcactctgtaaaat

SEQ ID NO: 476363 - DNA, 25 bp, Rattus norvegicus
gtaagactgcctgactctgtaaaat

SEQ ID NO: 476364 - DNA, 25 bp, Rattus norvegicus
gtaagactgtccctgtgactgctgc

SEQ ID NO: 476365 - DNA, 25 bp, Rattus norvegicus
gtaagactgtccgtgtgactgctgc

SEQ ID NO: 476366 - DNA, 25 bp, Rattus norvegicus
gtaagactgtggaccccaatatccc

SEQ ID NO: 476367 - DNA, 25 bp, Rattus norvegicus
gtaagactgtggtccccaatatccc

SEQ ID NO: 476368 - DNA, 25 bp, Rattus norvegicus
gtaagacttcagacaaccttgagac

SEQ ID NO: 476369 - DNA, 25 bp, Rattus norvegicus
gtaagacttcagtcaaccttgagac

SEQ ID NO: 476370 - DNA, 25 bp, Rattus norvegicus
gtaagactttccatgtgatctataa

SEQ ID NO: 476371 - DNA, 25 bp, Rattus norvegicus
gtaagactttccttgtgatctataa

SEQ ID NO: 476372 - DNA, 25 bp, Rattus norvegicus
gtaagactttgtatctaaggcaaca

SEQ ID NO: 476373 - DNA, 25 bp, Rattus norvegicus
gtaagactttgtttctaaggcaaca

SEQ ID NO: 476374 - DNA, 25 bp, Rattus norvegicus
gtaagagaactccagtgttgctatg

SEQ ID NO: 476375 - DNA, 25 bp, Rattus norvegicus
gtaagagaactcgagtgttgctatg

SEQ ID NO: 476376 - DNA, 25 bp, Rattus norvegicus
gtaagagaacttacccttcattcat

SEQ ID NO: 476377 - DNA, 25 bp, Rattus norvegicus
gtaagagaactttcccttcattcat

SEQ ID NO: 476378 - DNA, 25 bp, Rattus norvegicus
gtaagagaagtgacttgtctcagac

SEQ ID NO: 476379 - DNA, 25 bp, Rattus norvegicus
gtaagagaagtgtcttgtctcagac

SEQ ID NO: 476380 - DNA, 25 bp, Rattus norvegicus
gtaagagacagtcccgtgcagtctt

SEQ ID NO: 476381 - DNA, 25 bp, Rattus norvegicus
gtaagagacagtgccgtgcagtctt

SEQ ID NO: 476382 - DNA, 25 bp, Rattus norvegicus
gtaagagagttcctgatcacctgaa

SEQ ID NO: 476383 - DNA, 25 bp, Rattus norvegicus
gtaagagagttcgtgatcacctgaa

SEQ ID NO: 476384 - DNA, 25 bp, Rattus norvegicus
gtaagagatcacagacgcgcacccg

SEQ ID NO: 476385 - DNA, 25 bp, Rattus norvegicus
gtaagagatcactgacgcgcacccg

SEQ ID NO: 476386 - DNA, 25 bp, Rattus norvegicus
gtaagagcagtgatacatctgacct

SEQ ID NO: 476387 - DNA, 25 bp, Rattus norvegicus
gtaagagcagtgttacatctgacct

SEQ ID NO: 476388 - DNA, 25 bp, Rattus norvegicus
gtaagagcccaacagaattttggac

SEQ ID NO: 476389 - DNA, 25 bp, Rattus norvegicus
gtaagagcccaagagaattttggac

SEQ ID NO: 476390 - DNA, 25 bp, Rattus norvegicus
gtaagagctatcaataccaccaccc

SEQ ID NO: 476391 - DNA, 25 bp, Rattus norvegicus
gtaagagctatctataccaccaccc

SEQ ID NO: 476392 - DNA, 25 bp, Rattus norvegicus
gtaagagctggacgtccatcccact

SEQ ID NO: 476393 - DNA, 25 bp, Rattus norvegicus
gtaagagctggaggtccatcccact

SEQ ID NO: 476394 - DNA, 25 bp, Rattus norvegicus
gtaagagctttgaccagcgagacct

SEQ ID NO: 476395 - DNA, 25 bp, Rattus norvegicus
gtaagagctttgtccagcgagacct

SEQ ID NO: 476396 - DNA, 25 bp, Rattus norvegicus
gtaagaggaccactctctcagcttg

SEQ ID NO: 476397 - DNA, 25 bp, Rattus norvegicus
gtaagaggaccagtctctcagcttg

SEQ ID NO: 476398 - DNA, 25 bp, Rattus norvegicus
gtaagaggcttcatgcgtagcatga

SEQ ID NO: 476399 - DNA, 25 bp, Rattus norvegicus
gtaagaggcttcttgcgtagcatga

SEQ ID NO: 476400 - DNA, 25 bp, Rattus norvegicus
gtaagaggtaagctctcggtgccct

SEQ ID NO: 476401 - DNA, 25 bp, Rattus norvegicus
gtaagaggtaaggtctcggtgccct

SEQ ID NO: 476402 - DNA, 25 bp, Rattus norvegicus
gtaagaggttgccttgagtctccat

SEQ ID NO: 476403 - DNA, 25 bp, Rattus norvegicus
gtaagaggttgcgttgagtctccat

SEQ ID NO: 476404 - DNA, 25 bp, Rattus norvegicus
gtaagagtgatccaggactgctcct

SEQ ID NO: 476405 - DNA, 25 bp, Rattus norvegicus
gtaagagtgatcgaggactgctcct

SEQ ID NO: 476406 - DNA, 25 bp, Rattus norvegicus
gtaagagtgattatttccaggatat

SEQ ID NO: 476407 - DNA, 25 bp, Rattus norvegicus
gtaagagtgattttttccaggatat

SEQ ID NO: 476408 - DNA, 25 bp, Rattus norvegicus
gtaagagtgcacagctgtggactgt

SEQ ID NO: 476409 - DNA, 25 bp, Rattus norvegicus
gtaagagtgcactgctgtggactgt

SEQ ID NO: 476410 - DNA, 25 bp, Rattus norvegicus
gtaagagtggatcctgctcccagtg

SEQ ID NO: 476411 - DNA, 25 bp, Rattus norvegicus
gtaagagtggatgctgctcccagtg

SEQ ID NO: 476412 - DNA, 25 bp, Rattus norvegicus
gtaagagttcggcaaacgctagcta

SEQ ID NO: 476413 - DNA, 25 bp, Rattus norvegicus
gtaagagttcgggaaacgctagcta

SEQ ID NO: 476414 - DNA, 25 bp, Rattus norvegicus
gtaagagttgacatgagacctgaca

SEQ ID NO: 476415 - DNA, 25 bp, Rattus norvegicus
gtaagagttgacttgagacctgaca

SEQ ID NO: 476416 - DNA, 25 bp, Rattus norvegicus
gtaagatacacgcttccagacggaa

SEQ ID NO: 476417 - DNA, 25 bp, Rattus norvegicus
gtaagatacacggttccagacggaa

SEQ ID NO: 476418 - DNA, 25 bp, Rattus norvegicus
gtaagatacttgctctggttcacat

SEQ ID NO: 476419 - DNA, 25 bp, Rattus norvegicus
gtaagatacttggtctggttcacat

SEQ ID NO: 476420 - DNA, 25 bp, Rattus norvegicus
gtaagatatcacaagcattttcccc

SEQ ID NO: 476421 - DNA, 25 bp, Rattus norvegicus
gtaagatatcactagcattttcccc

SEQ ID NO: 476422 - DNA, 25 bp, Rattus norvegicus
gtaagatatttcctgacacatgcaa

SEQ ID NO: 476423 - DNA, 25 bp, Rattus norvegicus
gtaagatatttcgtgacacatgcaa

SEQ ID NO: 476424 - DNA, 25 bp, Rattus norvegicus
gtaagatcaaaactctccgctcgcc

SEQ ID NO: 476425 - DNA, 25 bp, Rattus norvegicus
gtaagatcaaaagtctccgctcgcc

SEQ ID NO: 476426 - DNA, 25 bp, Rattus norvegicus
gtaagatcaaggctcccggttttgc

SEQ ID NO: 476427 - DNA, 25 bp, Rattus norvegicus
gtaagatcaagggtcccggttttgc

SEQ ID NO: 476428 - DNA, 25 bp, Rattus norvegicus
gtaagatccagcagcgcaggcagga

SEQ ID NO: 476429 - DNA, 25 bp, Rattus norvegicus
gtaagatccagctgcgcaggcagga

SEQ ID NO: 476430 - DNA, 25 bp, Rattus norvegicus
gtaagatcgcccaggagaagaaacc

SEQ ID NO: 476431 - DNA, 25 bp, Rattus norvegicus
gtaagatcgccctggagaagaaacc

SEQ ID NO: 476432 - DNA, 25 bp, Rattus norvegicus
gtaagatcggacacattggccacca

SEQ ID NO: 476433 - DNA, 25 bp, Rattus norvegicus
gtaagatcggactcattggccacca

SEQ ID NO: 476434 - DNA, 25 bp, Rattus norvegicus
gtaagatctgacacagtacctcaga

SEQ ID NO: 476435 - DNA, 25 bp, Rattus norvegicus
gtaagatctgactcagtacctcaga

SEQ ID NO: 476436 - DNA, 25 bp, Rattus norvegicus
gtaagatctgccacttgttgaacat

SEQ ID NO: 476437 - DNA, 25 bp, Rattus norvegicus
gtaagatctgcctcttgttgaacat

SEQ ID NO: 476438 - DNA, 25 bp, Rattus norvegicus
gtaagatctgtaatccaagtggcat

SEQ ID NO: 476439 - DNA, 25 bp, Rattus norvegicus
gtaagatctgtattccaagtggcat

SEQ ID NO: 476440 - DNA, 25 bp, Rattus norvegicus
gtaagatctgtcattgcctgggcgt

SEQ ID NO: 476441 - DNA, 25 bp, Rattus norvegicus
gtaagatctgtctttgcctgggcgt

SEQ ID NO: 476442 - DNA, 25 bp, Rattus norvegicus
gtaagatcttttcagccaccaaact

SEQ ID NO: 476443 - DNA, 25 bp, Rattus norvegicus
gtaagatcttttgagccaccaaact

SEQ ID NO: 476444 - DNA, 25 bp, Rattus norvegicus
gtaagatggactcctactactcaaa

SEQ ID NO: 476445 - DNA, 25 bp, Rattus norvegicus
gtaagatggactctactcacacctg

SEQ ID NO: 476446 - DNA, 25 bp, Rattus norvegicus
gtaagatggactgctactactcaaa

SEQ ID NO: 476447 - DNA, 25 bp, Rattus norvegicus
gtaagatggactgtactcacacctg

SEQ ID NO: 476448 - DNA, 25 bp, Rattus norvegicus
gtaagatggctgaactacttgttgc

SEQ ID NO: 476449 - DNA, 25 bp, Rattus norvegicus
gtaagatggctgtactacttgttgc

SEQ ID NO: 476450 - DNA, 25 bp, Rattus norvegicus
gtaagatggtttagggcattcccag

SEQ ID NO: 476451 - DNA, 25 bp, Rattus norvegicus
gtaagatggtttagtgcttctttca

SEQ ID NO: 476452 - DNA, 25 bp, Rattus norvegicus
gtaagatggttttgggcattcccag

SEQ ID NO: 476453 - DNA, 25 bp, Rattus norvegicus
gtaagatggttttgtgcttctttca

SEQ ID NO: 476454 - DNA, 25 bp, Rattus norvegicus
gtaagatgtatcctgcaccaaaatg

SEQ ID NO: 476455 - DNA, 25 bp, Rattus norvegicus
gtaagatgtatcgtgcaccaaaatg

SEQ ID NO: 476456 - DNA, 25 bp, Rattus norvegicus
gtaagatgttcaccaagtccctcct

SEQ ID NO: 476457 - DNA, 25 bp, Rattus norvegicus
gtaagatgttcagcaagtccctcct

SEQ ID NO: 476458 - DNA, 25 bp, Rattus norvegicus
gtaagattacgacctgcaacctgca

SEQ ID NO: 476459 - DNA, 25 bp, Rattus norvegicus
gtaagattacgagctgcaacctgca

SEQ ID NO: 476460 - DNA, 25 bp, Rattus norvegicus
gtaagattcactccaggccgacgaa

SEQ ID NO: 476461 - DNA, 25 bp, Rattus norvegicus
gtaagattcactgcaggccgacgaa

SEQ ID NO: 476462 - DNA, 25 bp, Rattus norvegicus
gtaagatttccaccggttctgcagt

SEQ ID NO: 476463 - DNA, 25 bp, Rattus norvegicus
gtaagatttccagcggttctgcagt

SEQ ID NO: 476464 - DNA, 25 bp, Rattus norvegicus
gtaagatttgagcatcctccctggg

SEQ ID NO: 476465 - DNA, 25 bp, Rattus norvegicus
gtaagatttgaggatcctccctggg

SEQ ID NO: 476466 - DNA, 25 bp, Rattus norvegicus
gtaagcaaaatgaagactcccaaag

SEQ ID NO: 476467 - DNA, 25 bp, Rattus norvegicus
gtaagcaaaatgtagactcccaaag

SEQ ID NO: 476468 - DNA, 25 bp, Rattus norvegicus
gtaagcaaatctcacttttcaccga

SEQ ID NO: 476469 - DNA, 25 bp, Rattus norvegicus
gtaagcaaatctgacttttcaccga

SEQ ID NO: 476470 - DNA, 25 bp, Rattus norvegicus
gtaagcaaccgcattcatccatgtg

SEQ ID NO: 476471 - DNA, 25 bp, Rattus norvegicus
gtaagcaaccgctttcatccatgtg

SEQ ID NO: 476472 - DNA, 25 bp, Rattus norvegicus
gtaagcaagcacactcttgttcaaa

SEQ ID NO: 476473 - DNA, 25 bp, Rattus norvegicus
gtaagcaagcactctcttgttcaaa

SEQ ID NO: 476474 - DNA, 25 bp, Rattus norvegicus
gtaagcaagctcctctagcaatact

SEQ ID NO: 476475 - DNA, 25 bp, Rattus norvegicus
gtaagcaagctcgtctagcaatact

SEQ ID NO: 476476 - DNA, 25 bp, Rattus norvegicus
gtaagcaagtcgagcgccaggtcct

SEQ ID NO: 476477 - DNA, 25 bp, Rattus norvegicus
gtaagcaagtcgtgcgccaggtcct

SEQ ID NO: 476478 - DNA, 25 bp, Rattus norvegicus
gtaagcaataacatttcctgtgtct

SEQ ID NO: 476479 - DNA, 25 bp, Rattus norvegicus
gtaagcaataacttttcctgtgtct

SEQ ID NO: 476480 - DNA, 25 bp, Rattus norvegicus
gtaagcaatcacattattaaccact

SEQ ID NO: 476481 - DNA, 25 bp, Rattus norvegicus
gtaagcaatcactttattaaccact

SEQ ID NO: 476482 - DNA, 25 bp, Rattus norvegicus
gtaagcaatgctcccagggacttca

SEQ ID NO: 476483 - DNA, 25 bp, Rattus norvegicus
gtaagcaatgctgccagggacttca

SEQ ID NO: 476484 - DNA, 25 bp, Rattus norvegicus
gtaagcacaacaccccaaaggactt

SEQ ID NO: 476485 - DNA, 25 bp, Rattus norvegicus
gtaagcacaacagcccaaaggactt

SEQ ID NO: 476486 - DNA, 25 bp, Rattus norvegicus
gtaagcacacgaacttctgagcgcc

SEQ ID NO: 476487 - DNA, 25 bp, Rattus norvegicus
gtaagcacacgatcttctgagcgcc

SEQ ID NO: 476488 - DNA, 25 bp, Rattus norvegicus
gtaagcacagcactgcttcaagctc

SEQ ID NO: 476489 - DNA, 25 bp, Rattus norvegicus
gtaagcacagcagtgcttcaagctc

SEQ ID NO: 476490 - DNA, 25 bp, Rattus norvegicus
gtaagcacagctaactgcagccagg

SEQ ID NO: 476491 - DNA, 25 bp, Rattus norvegicus
gtaagcacagcttactgcagccagg

SEQ ID NO: 476492 - DNA, 25 bp, Rattus norvegicus
gtaagcacatctagtctcacagact

SEQ ID NO: 476493 - DNA, 25 bp, Rattus norvegicus
gtaagcacatcttgtctcacagact

SEQ ID NO: 476494 - DNA, 25 bp, Rattus norvegicus
gtaagcacatgtcctgtagacattt

SEQ ID NO: 476495 - DNA, 25 bp, Rattus norvegicus
gtaagcacatgtgctgtagacattt

SEQ ID NO: 476496 - DNA, 25 bp, Rattus norvegicus
gtaagcacccgacaattcatagtag

SEQ ID NO: 476497 - DNA, 25 bp, Rattus norvegicus
gtaagcacccgagaattcatagtag

SEQ ID NO: 476498 - DNA, 25 bp, Rattus norvegicus
gtaagcacccgccaaagagacagta

SEQ ID NO: 476499 - DNA, 25 bp, Rattus norvegicus
gtaagcacccgcgaaagagacagta

SEQ ID NO: 476500 - DNA, 25 bp, Rattus norvegicus
gtaagcacggacagtactcttcacg

SEQ ID NO: 476501 - DNA, 25 bp, Rattus norvegicus
gtaagcacggactgtactcttcacg

SEQ ID NO: 476502 - DNA, 25 bp, Rattus norvegicus
gtaagcactaacaatggtcaccaaa

SEQ ID NO: 476503 - DNA, 25 bp, Rattus norvegicus
gtaagcactaactatggtcaccaaa

SEQ ID NO: 476504 - DNA, 25 bp, Rattus norvegicus
gtaagcactcatctactgccatcat

SEQ ID NO: 476505 - DNA, 25 bp, Rattus norvegicus
gtaagcactcatgtactgccatcat

SEQ ID NO: 476506 - DNA, 25 bp, Rattus norvegicus
gtaagcactggaaaaccgatcttct

SEQ ID NO: 476507 - DNA, 25 bp, Rattus norvegicus
gtaagcactggataaccgatcttct

SEQ ID NO: 476508 - DNA, 25 bp, Rattus norvegicus
gtaagcacttacatggtagcctttg

SEQ ID NO: 476509 - DNA, 25 bp, Rattus norvegicus
gtaagcacttacttggtagcctttg

SEQ ID NO: 476510 - DNA, 25 bp, Rattus norvegicus
gtaagcacttcaccggaaccccatt

SEQ ID NO: 476511 - DNA, 25 bp, Rattus norvegicus
gtaagcacttcagcggaaccccatt

SEQ ID NO: 476512 - DNA, 25 bp, Rattus norvegicus
gtaagcactttaccgctatggcaca

SEQ ID NO: 476513 - DNA, 25 bp, Rattus norvegicus
gtaagcactttagcgctatggcaca

SEQ ID NO: 476514 - DNA, 25 bp, Rattus norvegicus
gtaagcagagcccatgtgcctattc

SEQ ID NO: 476515 - DNA, 25 bp, Rattus norvegicus
gtaagcagagccgatgtgcctattc

SEQ ID NO: 476516 - DNA, 25 bp, Rattus norvegicus
gtaagcagagttcctggcctccaaa

SEQ ID NO: 476517 - DNA, 25 bp, Rattus norvegicus
gtaagcagagttgctggcctccaaa

SEQ ID NO: 476518 - DNA, 25 bp, Rattus norvegicus
gtaagcagatctacctcttcaagag

SEQ ID NO: 476519 - DNA, 25 bp, Rattus norvegicus
gtaagcagatcttcctcttcaagag

SEQ ID NO: 476520 - DNA, 25 bp, Rattus norvegicus
gtaagcagcttgagatcattgtaat

SEQ ID NO: 476521 - DNA, 25 bp, Rattus norvegicus
gtaagcagcttgtgatcattgtaat

SEQ ID NO: 476522 - DNA, 25 bp, Rattus norvegicus
gtaagcagtcctaaaaaccatccag

SEQ ID NO: 476523 - DNA, 25 bp, Rattus norvegicus
gtaagcagtccttaaaaccatccag

SEQ ID NO: 476524 - DNA, 25 bp, Rattus norvegicus
gtaagcatgcccaaatattccacag

SEQ ID NO: 476525 - DNA, 25 bp, Rattus norvegicus
gtaagcatgccctaatattccacag

SEQ ID NO: 476526 - DNA, 25 bp, Rattus norvegicus
gtaagcatgtaacccattcttttga

SEQ ID NO: 476527 - DNA, 25 bp, Rattus norvegicus
gtaagcatgtaagccattcttttga

SEQ ID NO: 476528 - DNA, 25 bp, Rattus norvegicus
gtaagcatgtagaactgccccaaaa

SEQ ID NO: 476529 - DNA, 25 bp, Rattus norvegicus
gtaagcatgtagctctcccctaatt

SEQ ID NO: 476530 - DNA, 25 bp, Rattus norvegicus
gtaagcatgtaggtctcccctaatt

SEQ ID NO: 476531 - DNA, 25 bp, Rattus norvegicus
gtaagcatgtagtactgccccaaaa

SEQ ID NO: 476532 - DNA, 25 bp, Rattus norvegicus
gtaagcattcatatatcatctcaaa

SEQ ID NO: 476533 - DNA, 25 bp, Rattus norvegicus
gtaagcattcatttatcatctcaaa

SEQ ID NO: 476534 - DNA, 25 bp, Rattus norvegicus
gtaagcattctgctcgcaatgtttt

SEQ ID NO: 476535 - DNA, 25 bp, Rattus norvegicus
gtaagcattctggtcgcaatgtttt

SEQ ID NO: 476536 - DNA, 25 bp, Rattus norvegicus
gtaagccaaggaatcacacacataa

SEQ ID NO: 476537 - DNA, 25 bp, Rattus norvegicus
gtaagccaaggattcacacacataa

SEQ ID NO: 476538 - DNA, 25 bp, Rattus norvegicus
gtaagccaatctaataagcctcctt

SEQ ID NO: 476539 - DNA, 25 bp, Rattus norvegicus
gtaagccaatcttataagcctcctt

SEQ ID NO: 476540 - DNA, 25 bp, Rattus norvegicus
gtaagccaccacaaaggacatccgt

SEQ ID NO: 476541 - DNA, 25 bp, Rattus norvegicus
gtaagccaccactaaggacatccgt

SEQ ID NO: 476542 - DNA, 25 bp, Rattus norvegicus
gtaagccagaagaatcagcattatt

SEQ ID NO: 476543 - DNA, 25 bp, Rattus norvegicus
gtaagccagaagtatcagcattatt

SEQ ID NO: 476544 - DNA, 25 bp, Rattus norvegicus
gtaagccagaggacagaggtcaccg

SEQ ID NO: 476545 - DNA, 25 bp, Rattus norvegicus
gtaagccagaggtcagaggtcaccg

SEQ ID NO: 476546 - DNA, 25 bp, Rattus norvegicus
gtaagccagcacagcaagagcctag

SEQ ID NO: 476547 - DNA, 25 bp, Rattus norvegicus
gtaagccagcactgcaagagcctag

SEQ ID NO: 476548 - DNA, 25 bp, Rattus norvegicus
gtaagccagcgcacttggattttgt

SEQ ID NO: 476549 - DNA, 25 bp, Rattus norvegicus
gtaagccagcgctcttggattttgt

SEQ ID NO: 476550 - DNA, 25 bp, Rattus norvegicus
gtaagccaggaaattgggctctcta

SEQ ID NO: 476551 - DNA, 25 bp, Rattus norvegicus
gtaagccaggaatttgggctctcta

SEQ ID NO: 476552 - DNA, 25 bp, Rattus norvegicus
gtaagccaggcacgaatatcacatg

SEQ ID NO: 476553 - DNA, 25 bp, Rattus norvegicus
gtaagccaggcaggaatatcacatg

SEQ ID NO: 476554 - DNA, 25 bp, Rattus norvegicus
gtaagccataaccttatcttctatt

SEQ ID NO: 476555 - DNA, 25 bp, Rattus norvegicus
gtaagccataacgttatcttctatt

SEQ ID NO: 476556 - DNA, 25 bp, Rattus norvegicus
gtaagccatctcactgatagccatt

SEQ ID NO: 476557 - DNA, 25 bp, Rattus norvegicus
gtaagccatctctctgatagccatt

SEQ ID NO: 476558 - DNA, 25 bp, Rattus norvegicus
gtaagccatggtacatgtatctaca

SEQ ID NO: 476559 - DNA, 25 bp, Rattus norvegicus
gtaagccatggttcatgtatctaca

SEQ ID NO: 476560 - DNA, 25 bp, Rattus norvegicus
gtaagccatttccagactgctctga

SEQ ID NO: 476561 - DNA, 25 bp, Rattus norvegicus
gtaagccatttcgagactgctctga

SEQ ID NO: 476562 - DNA, 25 bp, Rattus norvegicus
gtaagccctaggatccatatttgtt

SEQ ID NO: 476563 - DNA, 25 bp, Rattus norvegicus
gtaagccctaggttccatatttgtt

SEQ ID NO: 476564 - DNA, 25 bp, Rattus norvegicus
gtaagccctataaactgggacctgg

SEQ ID NO: 476565 - DNA, 25 bp, Rattus norvegicus
gtaagccctatatactgggacctgg

SEQ ID NO: 476566 - DNA, 25 bp, Rattus norvegicus
gtaagcccttacagatgctaacccc

SEQ ID NO: 476567 - DNA, 25 bp, Rattus norvegicus
gtaagcccttactgatgctaacccc

SEQ ID NO: 476568 - DNA, 25 bp, Rattus norvegicus
gtaagcccttggacatttctcgtgg

SEQ ID NO: 476569 - DNA, 25 bp, Rattus norvegicus
gtaagcccttggtcatttctcgtgg

SEQ ID NO: 476570 - DNA, 25 bp, Rattus norvegicus
gtaagccctttaactgggtcaagga

SEQ ID NO: 476571 - DNA, 25 bp, Rattus norvegicus
gtaagccctttatctgggtcaagga

SEQ ID NO: 476572 - DNA, 25 bp, Rattus norvegicus
gtaagccgcttgcaagacgcagctg

SEQ ID NO: 476573 - DNA, 25 bp, Rattus norvegicus
gtaagccgcttggaagacgcagctg

SEQ ID NO: 476574 - DNA, 25 bp, Rattus norvegicus
gtaagccggaacacttgtgagtaag

SEQ ID NO: 476575 - DNA, 25 bp, Rattus norvegicus
gtaagccggaactcttgtgagtaag

SEQ ID NO: 476576 - DNA, 25 bp, Rattus norvegicus
gtaagccgtaacctcttggtggact

SEQ ID NO: 476577 - DNA, 25 bp, Rattus norvegicus
gtaagccgtaacgtcttggtggact

SEQ ID NO: 476578 - DNA, 25 bp, Rattus norvegicus
gtaagccgtcagacacatgcacagt

SEQ ID NO: 476579 - DNA, 25 bp, Rattus norvegicus
gtaagccgtcagtcacatgcacagt

SEQ ID NO: 476580 - DNA, 25 bp, Rattus norvegicus
gtaagcctaaagaccagcctgtaga

SEQ ID NO: 476581 - DNA, 25 bp, Rattus norvegicus
gtaagcctaaagtccagcctgtaga

SEQ ID NO: 476582 - DNA, 25 bp, Rattus norvegicus
gtaagcctaagaacccaagttcact

SEQ ID NO: 476583 - DNA, 25 bp, Rattus norvegicus
gtaagcctaagatcccaagttcact

SEQ ID NO: 476584 - DNA, 25 bp, Rattus norvegicus
gtaagcctatttcccttatgtgcta

SEQ ID NO: 476585 - DNA, 25 bp, Rattus norvegicus
gtaagcctatttgccttatgtgcta

SEQ ID NO: 476586 - DNA, 25 bp, Rattus norvegicus
gtaagcctcagaacgttgtacaact

SEQ ID NO: 476587 - DNA, 25 bp, Rattus norvegicus
gtaagcctcagatcgttgtacaact

SEQ ID NO: 476588 - DNA, 25 bp, Rattus norvegicus
gtaagcctcagtaatcatggctttc

SEQ ID NO: 476589 - DNA, 25 bp, Rattus norvegicus
gtaagcctcagttatcatggctttc

SEQ ID NO: 476590 - DNA, 25 bp, Rattus norvegicus
gtaagcctcatcacagctttctagt

SEQ ID NO: 476591 - DNA, 25 bp, Rattus norvegicus
gtaagcctcatctcagctttctagt

SEQ ID NO: 476592 - DNA, 25 bp, Rattus norvegicus
gtaagcctctttagcaccttgaaat

SEQ ID NO: 476593 - DNA, 25 bp, Rattus norvegicus
gtaagcctcttttgcaccttgaaat

SEQ ID NO: 476594 - DNA, 25 bp, Rattus norvegicus
gtaagcctgaggatctgcggtctcc

SEQ ID NO: 476595 - DNA, 25 bp, Rattus norvegicus
gtaagcctgaggttctgcggtctcc

SEQ ID NO: 476596 - DNA, 25 bp, Rattus norvegicus
gtaagcctgatactcaacccaggga

SEQ ID NO: 476597 - DNA, 25 bp, Rattus norvegicus
gtaagcctgatagtcaacccaggga

SEQ ID NO: 476598 - DNA, 25 bp, Rattus norvegicus
gtaagcctggttctggcagcaactc

SEQ ID NO: 476599 - DNA, 25 bp, Rattus norvegicus
gtaagcctggttgtggcagcaactc

SEQ ID NO: 476600 - DNA, 25 bp, Rattus norvegicus
gtaagcctgtaaccacatattcatc

SEQ ID NO: 476601 - DNA, 25 bp, Rattus norvegicus
gtaagcctgtaacctcaattctgag

SEQ ID NO: 476602 - DNA, 25 bp, Rattus norvegicus
gtaagcctgtaagcacatattcatc

SEQ ID NO: 476603 - DNA, 25 bp, Rattus norvegicus
gtaagcctgtaagctcaattctgag

SEQ ID NO: 476604 - DNA, 25 bp, Rattus norvegicus
gtaagcctgtcactattgacctgaa

SEQ ID NO: 476605 - DNA, 25 bp, Rattus norvegicus
gtaagcctgtcagtattgacctgaa

SEQ ID NO: 476606 - DNA, 25 bp, Rattus norvegicus
gtaagcctgtgtaatccattcttaa

SEQ ID NO: 476607 - DNA, 25 bp, Rattus norvegicus
gtaagcctgtgttatccattcttaa

SEQ ID NO: 476608 - DNA, 25 bp, Rattus norvegicus
gtaagccttacaccaactctggcga

SEQ ID NO: 476609 - DNA, 25 bp, Rattus norvegicus
gtaagccttacagcaactctggcga

SEQ ID NO: 476610 - DNA, 25 bp, Rattus norvegicus
gtaagccttcagagtagtctttctc

SEQ ID NO: 476611 - DNA, 25 bp, Rattus norvegicus
gtaagccttcagtgtagtctttctc

SEQ ID NO: 476612 - DNA, 25 bp, Rattus norvegicus
gtaagccttcttaactagggcctgg

SEQ ID NO: 476613 - DNA, 25 bp, Rattus norvegicus
gtaagccttctttactagggcctgg

SEQ ID NO: 476614 - DNA, 25 bp, Rattus norvegicus
gtaagcctttatccttgatttgatt

SEQ ID NO: 476615 - DNA, 25 bp, Rattus norvegicus
gtaagcctttatgcttgatttgatt

SEQ ID NO: 476616 - DNA, 25 bp, Rattus norvegicus
gtaagccttttcactgtgcatgatt

SEQ ID NO: 476617 - DNA, 25 bp, Rattus norvegicus
gtaagccttttctctgtgcatgatt

SEQ ID NO: 476618 - DNA, 25 bp, Rattus norvegicus
gtaagcgcaaacaaccacatgcagt

SEQ ID NO: 476619 - DNA, 25 bp, Rattus norvegicus
gtaagcgcaaactaccacatgcagt

SEQ ID NO: 476620 - DNA, 25 bp, Rattus norvegicus
gtaagcgcggtgcagtcacacatcc

SEQ ID NO: 476621 - DNA, 25 bp, Rattus norvegicus
gtaagcgcggtggagtcacacatcc

SEQ ID NO: 476622 - DNA, 25 bp, Rattus norvegicus
gtaagcggaatgcatccgccttttg

SEQ ID NO: 476623 - DNA, 25 bp, Rattus norvegicus
gtaagcggaatggatccgccttttg

SEQ ID NO: 476624 - DNA, 25 bp, Rattus norvegicus
gtaagcgtctgtatcgtacacttgc

SEQ ID NO: 476625 - DNA, 25 bp, Rattus norvegicus
gtaagcgtctgtttcgtacacttgc

SEQ ID NO: 476626 - DNA, 25 bp, Rattus norvegicus
gtaagcgtctttcttcagtgactct

SEQ ID NO: 476627 - DNA, 25 bp, Rattus norvegicus
gtaagcgtctttgttcagtgactct

SEQ ID NO: 476628 - DNA, 25 bp, Rattus norvegicus
gtaagcgtttcacaatcacatactg

SEQ ID NO: 476629 - DNA, 25 bp, Rattus norvegicus
gtaagcgtttcagaatcacatactg

SEQ ID NO: 476630 - DNA, 25 bp, Rattus norvegicus
gtaagcgtttccaaacctgtgtata

SEQ ID NO: 476631 - DNA, 25 bp, Rattus norvegicus
gtaagcgtttcctaacctgtgtata

SEQ ID NO: 476632 - DNA, 25 bp, Rattus norvegicus
gtaagcgtttgtacagactgcattt

SEQ ID NO: 476633 - DNA, 25 bp, Rattus norvegicus
gtaagcgtttgttcagactgcattt

SEQ ID NO: 476634 - DNA, 25 bp, Rattus norvegicus
gtaagctaccatccggtttcacagt

SEQ ID NO: 476635 - DNA, 25 bp, Rattus norvegicus
gtaagctaccatgcggtttcacagt

SEQ ID NO: 476636 - DNA, 25 bp, Rattus norvegicus
gtaagctaccttcggtactcccgag

SEQ ID NO: 476637 - DNA, 25 bp, Rattus norvegicus
gtaagctaccttgggtactcccgag

SEQ ID NO: 476638 - DNA, 25 bp, Rattus norvegicus
gtaagctacggaactggacatcacc

SEQ ID NO: 476639 - DNA, 25 bp, Rattus norvegicus
gtaagctacggatctggacatcacc

SEQ ID NO: 476640 - DNA, 25 bp, Rattus norvegicus
gtaagctagctcaacacatcactat

SEQ ID NO: 476641 - DNA, 25 bp, Rattus norvegicus
gtaagctagctctacacatcactat

SEQ ID NO: 476642 - DNA, 25 bp, Rattus norvegicus
gtaagctagttccagtccagtgatc

SEQ ID NO: 476643 - DNA, 25 bp, Rattus norvegicus
gtaagctagttcgagtccagtgatc

SEQ ID NO: 476644 - DNA, 25 bp, Rattus norvegicus
gtaagctattacagcatcaatggta

SEQ ID NO: 476645 - DNA, 25 bp, Rattus norvegicus
gtaagctattactgcatcaatggta

SEQ ID NO: 476646 - DNA, 25 bp, Rattus norvegicus
gtaagctcactgacctagatcatat

SEQ ID NO: 476647 - DNA, 25 bp, Rattus norvegicus
gtaagctcactgtcctagatcatat

SEQ ID NO: 476648 - DNA, 25 bp, Rattus norvegicus
gtaagctcacttcccaaaattttgt

SEQ ID NO: 476649 - DNA, 25 bp, Rattus norvegicus
gtaagctcacttcggagtaccctac

SEQ ID NO: 476650 - DNA, 25 bp, Rattus norvegicus
gtaagctcacttgccaaaattttgt

SEQ ID NO: 476651 - DNA, 25 bp, Rattus norvegicus
gtaagctcacttgggagtaccctac

SEQ ID NO: 476652 - DNA, 25 bp, Rattus norvegicus
gtaagctcagaactcaagctccacc

SEQ ID NO: 476653 - DNA, 25 bp, Rattus norvegicus
gtaagctcagaagtcaagctccacc

SEQ ID NO: 476654 - DNA, 25 bp, Rattus norvegicus
gtaagctccaatacagccagggaca

SEQ ID NO: 476655 - DNA, 25 bp, Rattus norvegicus
gtaagctccaattcagccagggaca

SEQ ID NO: 476656 - DNA, 25 bp, Rattus norvegicus
gtaagctccaggatctgaccgaaca

SEQ ID NO: 476657 - DNA, 25 bp, Rattus norvegicus
gtaagctccaggttctgaccgaaca

SEQ ID NO: 476658 - DNA, 25 bp, Rattus norvegicus
gtaagctccatcagccctgtcctga

SEQ ID NO: 476659 - DNA, 25 bp, Rattus norvegicus
gtaagctccatctgccctgtcctga

SEQ ID NO: 476660 - DNA, 25 bp, Rattus norvegicus
gtaagctcgaatccgagctcgtacc

SEQ ID NO: 476661 - DNA, 25 bp, Rattus norvegicus
gtaagctcgaatgcgagctcgtacc

SEQ ID NO: 476662 - DNA, 25 bp, Rattus norvegicus
gtaagctcggaacggcatccgcgat

SEQ ID NO: 476663 - DNA, 25 bp, Rattus norvegicus
gtaagctcggaagggcatccgcgat

SEQ ID NO: 476664 - DNA, 25 bp, Rattus norvegicus
gtaagctctgtcaccgagttgtatc

SEQ ID NO: 476665 - DNA, 25 bp, Rattus norvegicus
gtaagctctgtctccgagttgtatc

SEQ ID NO: 476666 - DNA, 25 bp, Rattus norvegicus
gtaagctcttgccttttagctatga

SEQ ID NO: 476667 - DNA, 25 bp, Rattus norvegicus
gtaagctcttgcgttttagctatga

SEQ ID NO: 476668 - DNA, 25 bp, Rattus norvegicus
gtaagctgagatctgacactttgtt

SEQ ID NO: 476669 - DNA, 25 bp, Rattus norvegicus
gtaagctgagatgtgacactttgtt

SEQ ID NO: 476670 - DNA, 25 bp, Rattus norvegicus
gtaagctgagttatccagacaactg

SEQ ID NO: 476671 - DNA, 25 bp, Rattus norvegicus
gtaagctgagttttccagacaactg

SEQ ID NO: 476672 - DNA, 25 bp, Rattus norvegicus
gtaagctgatatacactctctccta

SEQ ID NO: 476673 - DNA, 25 bp, Rattus norvegicus
gtaagctgatattcactctctccta

SEQ ID NO: 476674 - DNA, 25 bp, Rattus norvegicus
gtaagctgcactatattcatctagt

SEQ ID NO: 476675 - DNA, 25 bp, Rattus norvegicus
gtaagctgcactttattcatctagt

SEQ ID NO: 476676 - DNA, 25 bp, Rattus norvegicus
gtaagctgccaacggactcagtcaa

SEQ ID NO: 476677 - DNA, 25 bp, Rattus norvegicus
gtaagctgccaagggactcagtcaa

SEQ ID NO: 476678 - DNA, 25 bp, Rattus norvegicus
gtaagctgccatctgtctgtctgtg

SEQ ID NO: 476679 - DNA, 25 bp, Rattus norvegicus
gtaagctgccatgtgtctgtctgtg

SEQ ID NO: 476680 - DNA, 25 bp, Rattus norvegicus
gtaagctgcttaatgctgagctcat

SEQ ID NO: 476681 - DNA, 25 bp, Rattus norvegicus
gtaagctgcttattgctgagctcat

SEQ ID NO: 476682 - DNA, 25 bp, Rattus norvegicus
gtaagctggaaacactggagaccat

SEQ ID NO: 476683 - DNA, 25 bp, Rattus norvegicus
gtaagctggaaagactggagaccat

SEQ ID NO: 476684 - DNA, 25 bp, Rattus norvegicus
gtaagctggctgagcctgtagagct

SEQ ID NO: 476685 - DNA, 25 bp, Rattus norvegicus
gtaagctggctgtgcctgtagagct

SEQ ID NO: 476686 - DNA, 25 bp, Rattus norvegicus
gtaagctgggttagggtgtctacct

SEQ ID NO: 476687 - DNA, 25 bp, Rattus norvegicus
gtaagctgggtttgggtgtctacct

SEQ ID NO: 476688 - DNA, 25 bp, Rattus norvegicus
gtaagctgtcaactgaccacaggaa

SEQ ID NO: 476689 - DNA, 25 bp, Rattus norvegicus
gtaagctgtcaagtgaccacaggaa

SEQ ID NO: 476690 - DNA, 25 bp, Rattus norvegicus
gtaagctgtggtccccggtattgca

SEQ ID NO: 476691 - DNA, 25 bp, Rattus norvegicus
gtaagctgtggtgcccggtattgca

SEQ ID NO: 476692 - DNA, 25 bp, Rattus norvegicus
gtaagctgttggctttcactgttaa

SEQ ID NO: 476693 - DNA, 25 bp, Rattus norvegicus
gtaagctgttgggtttcactgttaa

SEQ ID NO: 476694 - DNA, 25 bp, Rattus norvegicus
gtaagcttccacacatgcatgacca

SEQ ID NO: 476695 - DNA, 25 bp, Rattus norvegicus
gtaagcttccactcatgcatgacca

SEQ ID NO: 476696 - DNA, 25 bp, Rattus norvegicus
gtaagcttcctcacagtgcaggaca

SEQ ID NO: 476697 - DNA, 25 bp, Rattus norvegicus
gtaagcttcctctcagtgcaggaca

SEQ ID NO: 476698 - DNA, 25 bp, Rattus norvegicus
gtaagcttctctaaataggaaccac

SEQ ID NO: 476699 - DNA, 25 bp, Rattus norvegicus
gtaagcttctcttaataggaaccac

SEQ ID NO: 476700 - DNA, 25 bp, Rattus norvegicus
gtaagcttcttacggcctttgctaa

SEQ ID NO: 476701 - DNA, 25 bp, Rattus norvegicus
gtaagcttcttagggcctttgctaa

SEQ ID NO: 476702 - DNA, 25 bp, Rattus norvegicus
gtaagcttgaggatgatgtttttaa

SEQ ID NO: 476703 - DNA, 25 bp, Rattus norvegicus
gtaagcttgaggttgatgtttttaa

SEQ ID NO: 476704 - DNA, 25 bp, Rattus norvegicus
gtaagcttggccacacttgatacac

SEQ ID NO: 476705 - DNA, 25 bp, Rattus norvegicus
gtaagcttggcctcacttgatacac

SEQ ID NO: 476706 - DNA, 25 bp, Rattus norvegicus
gtaagctttaccaagcacctgagca

SEQ ID NO: 476707 - DNA, 25 bp, Rattus norvegicus
gtaagctttacctagcacctgagca

SEQ ID NO: 476708 - DNA, 25 bp, Rattus norvegicus
gtaagctttcttaactcaaccaaca

SEQ ID NO: 476709 - DNA, 25 bp, Rattus norvegicus
gtaagctttctttactcaaccaaca

SEQ ID NO: 476710 - DNA, 25 bp, Rattus norvegicus
gtaagctttgtgaccacagcacaag

SEQ ID NO: 476711 - DNA, 25 bp, Rattus norvegicus
gtaagctttgtgtccacagcacaag

SEQ ID NO: 476712 - DNA, 25 bp, Rattus norvegicus
gtaaggaaagccacagcctagcaca

SEQ ID NO: 476713 - DNA, 25 bp, Rattus norvegicus
gtaaggaaagcctcagcctagcaca

SEQ ID NO: 476714 - DNA, 25 bp, Rattus norvegicus
gtaaggaacacacagctcacgggta

SEQ ID NO: 476715 - DNA, 25 bp, Rattus norvegicus
gtaaggaacacagagctcacgggta

SEQ ID NO: 476716 - DNA, 25 bp, Rattus norvegicus
gtaaggaagccaagtagctttctgc

SEQ ID NO: 476717 - DNA, 25 bp, Rattus norvegicus
gtaaggaagccatgtagctttctgc

SEQ ID NO: 476718 - DNA, 25 bp, Rattus norvegicus
gtaaggaaggacagttctcaccccg

SEQ ID NO: 476719 - DNA, 25 bp, Rattus norvegicus
gtaaggaaggactgttctcaccccg

SEQ ID NO: 476720 - DNA, 25 bp, Rattus norvegicus
gtaaggaagtggagcctcccacaca

SEQ ID NO: 476721 - DNA, 25 bp, Rattus norvegicus
gtaaggaagtggtgcctcccacaca

SEQ ID NO: 476722 - DNA, 25 bp, Rattus norvegicus
gtaaggaatggtcgtactcagcccc

SEQ ID NO: 476723 - DNA, 25 bp, Rattus norvegicus
gtaaggaatggtggtactcagcccc

SEQ ID NO: 476724 - DNA, 25 bp, Rattus norvegicus
gtaaggacatctacttgactgatat

SEQ ID NO: 476725 - DNA, 25 bp, Rattus norvegicus
gtaaggacatcttcttgactgatat

SEQ ID NO: 476726 - DNA, 25 bp, Rattus norvegicus
gtaaggaccttactacacttgagaa

SEQ ID NO: 476727 - DNA, 25 bp, Rattus norvegicus
gtaaggaccttagtacacttgagaa

SEQ ID NO: 476728 - DNA, 25 bp, Rattus norvegicus
gtaaggactatacgcattatgacaa

SEQ ID NO: 476729 - DNA, 25 bp, Rattus norvegicus
gtaaggactataggcattatgacaa

SEQ ID NO: 476730 - DNA, 25 bp, Rattus norvegicus
gtaaggactgttagcatggtttttt

SEQ ID NO: 476731 - DNA, 25 bp, Rattus norvegicus
gtaaggactgtttgcatggtttttt

SEQ ID NO: 476732 - DNA, 25 bp, Rattus norvegicus
gtaaggagactaaccattcacattt

SEQ ID NO: 476733 - DNA, 25 bp, Rattus norvegicus
gtaaggagactatccattcacattt

SEQ ID NO: 476734 - DNA, 25 bp, Rattus norvegicus
gtaaggagcagacgctgcttcccct

SEQ ID NO: 476735 - DNA, 25 bp, Rattus norvegicus
gtaaggagcagaggctgcttcccct

SEQ ID NO: 476736 - DNA, 25 bp, Rattus norvegicus
gtaaggagcatcctctgcagtccac

SEQ ID NO: 476737 - DNA, 25 bp, Rattus norvegicus
gtaaggagcatcgtctgcagtccac

SEQ ID NO: 476738 - DNA, 25 bp, Rattus norvegicus
gtaaggagccgaattccaccttcta

SEQ ID NO: 476739 - DNA, 25 bp, Rattus norvegicus
gtaaggagccgatttccaccttcta

SEQ ID NO: 476740 - DNA, 25 bp, Rattus norvegicus
gtaaggaggcctcaatctccagagc

SEQ ID NO: 476741 - DNA, 25 bp, Rattus norvegicus
gtaaggaggcctgaatctccagagc

SEQ ID NO: 476742 - DNA, 25 bp, Rattus norvegicus
gtaaggataagtagcccgtttctct

SEQ ID NO: 476743 - DNA, 25 bp, Rattus norvegicus
gtaaggataagttgcccgtttctct

SEQ ID NO: 476744 - DNA, 25 bp, Rattus norvegicus
gtaaggatattcaccagtctccacg

SEQ ID NO: 476745 - DNA, 25 bp, Rattus norvegicus
gtaaggatattctccagtctccacg

SEQ ID NO: 476746 - DNA, 25 bp, Rattus norvegicus
gtaaggatccttaccactatggact

SEQ ID NO: 476747 - DNA, 25 bp, Rattus norvegicus
gtaaggatccttcaactctccacat

SEQ ID NO: 476748 - DNA, 25 bp, Rattus norvegicus
gtaaggatccttgaactctccacat

SEQ ID NO: 476749 - DNA, 25 bp, Rattus norvegicus
gtaaggatcctttccactatggact

SEQ ID NO: 476750 - DNA, 25 bp, Rattus norvegicus
gtaaggatcgatctgctgtccgtta

SEQ ID NO: 476751 - DNA, 25 bp, Rattus norvegicus
gtaaggatcgatgtgctgtccgtta

SEQ ID NO: 476752 - DNA, 25 bp, Rattus norvegicus
gtaaggatcggactagtggtaatca

SEQ ID NO: 476753 - DNA, 25 bp, Rattus norvegicus
gtaaggatcggagtagtggtaatca

SEQ ID NO: 476754 - DNA, 25 bp, Rattus norvegicus
gtaaggattccaatggccactagga

SEQ ID NO: 476755 - DNA, 25 bp, Rattus norvegicus
gtaaggattccattggccactagga

SEQ ID NO: 476756 - DNA, 25 bp, Rattus norvegicus
gtaaggatttccattcgcgtcttat

SEQ ID NO: 476757 - DNA, 25 bp, Rattus norvegicus
gtaaggatttcctttcgcgtcttat

SEQ ID NO: 476758 - DNA, 25 bp, Rattus norvegicus
gtaaggcaaggcattcttgacagaa

SEQ ID NO: 476759 - DNA, 25 bp, Rattus norvegicus
gtaaggcaaggctttcttgacagaa

SEQ ID NO: 476760 - DNA, 25 bp, Rattus norvegicus
gtaaggcaccagctccaggaacaga

SEQ ID NO: 476761 - DNA, 25 bp, Rattus norvegicus
gtaaggcaccaggtccaggaacaga

SEQ ID NO: 476762 - DNA, 25 bp, Rattus norvegicus
gtaaggcactagctttgatcacaca

SEQ ID NO: 476763 - DNA, 25 bp, Rattus norvegicus
gtaaggcactaggtttgatcacaca

SEQ ID NO: 476764 - DNA, 25 bp, Rattus norvegicus
gtaaggcactgccactagtgataaa

SEQ ID NO: 476765 - DNA, 25 bp, Rattus norvegicus
gtaaggcactgcgactagtgataaa

SEQ ID NO: 476766 - DNA, 25 bp, Rattus norvegicus
gtaaggcaggcccattcctgtgttt

SEQ ID NO: 476767 - DNA, 25 bp, Rattus norvegicus
gtaaggcaggccgattcctgtgttt

SEQ ID NO: 476768 - DNA, 25 bp, Rattus norvegicus
gtaaggcataacactgtattatacc

SEQ ID NO: 476769 - DNA, 25 bp, Rattus norvegicus
gtaaggcataactctgtattatacc

SEQ ID NO: 476770 - DNA, 25 bp, Rattus norvegicus
gtaaggcatcctctcacaagcaatg

SEQ ID NO: 476771 - DNA, 25 bp, Rattus norvegicus
gtaaggcatcctgtcacaagcaatg

SEQ ID NO: 476772 - DNA, 25 bp, Rattus norvegicus
gtaaggcatgccagaagcccaaaca

SEQ ID NO: 476773 - DNA, 25 bp, Rattus norvegicus
gtaaggcatgcctgaagcccaaaca

SEQ ID NO: 476774 - DNA, 25 bp, Rattus norvegicus
gtaaggcattcaagtttggcatcta

SEQ ID NO: 476775 - DNA, 25 bp, Rattus norvegicus
gtaaggcattcatgtttggcatcta

SEQ ID NO: 476776 - DNA, 25 bp, Rattus norvegicus
gtaaggccacatacattaagctgag

SEQ ID NO: 476777 - DNA, 25 bp, Rattus norvegicus
gtaaggccacattcattaagctgag

SEQ ID NO: 476778 - DNA, 25 bp, Rattus norvegicus
gtaaggccagcaccatatgtcatca

SEQ ID NO: 476779 - DNA, 25 bp, Rattus norvegicus
gtaaggccagcagcatatgtcatca

SEQ ID NO: 476780 - DNA, 25 bp, Rattus norvegicus
gtaaggccaggacgtgcaaacatca

SEQ ID NO: 476781 - DNA, 25 bp, Rattus norvegicus
gtaaggccaggaggtgcaaacatca

SEQ ID NO: 476782 - DNA, 25 bp, Rattus norvegicus
gtaaggcctcctccccgtgaggtca

SEQ ID NO: 476783 - DNA, 25 bp, Rattus norvegicus
gtaaggcctcctgcccgtgaggtca

SEQ ID NO: 476784 - DNA, 25 bp, Rattus norvegicus
gtaaggccttgtatgtgagaacgtt

SEQ ID NO: 476785 - DNA, 25 bp, Rattus norvegicus
gtaaggccttgtttgtgagaacgtt

SEQ ID NO: 476786 - DNA, 25 bp, Rattus norvegicus
gtaaggcgaagtctgcctctgctca

SEQ ID NO: 476787 - DNA, 25 bp, Rattus norvegicus
gtaaggcgaagtgtgcctctgctca

SEQ ID NO: 476788 - DNA, 25 bp, Rattus norvegicus
gtaaggcggcatcattacgctacac

SEQ ID NO: 476789 - DNA, 25 bp, Rattus norvegicus
gtaaggcggcatgattacgctacac

SEQ ID NO: 476790 - DNA, 25 bp, Rattus norvegicus
gtaaggcggttgaactgcagctcca

SEQ ID NO: 476791 - DNA, 25 bp, Rattus norvegicus
gtaaggcggttgtactgcagctcca

SEQ ID NO: 476792 - DNA, 25 bp, Rattus norvegicus
gtaaggctcaccacatatgtctctt

SEQ ID NO: 476793 - DNA, 25 bp, Rattus norvegicus
gtaaggctcacctcatatgtctctt

SEQ ID NO: 476794 - DNA, 25 bp, Rattus norvegicus
gtaaggctcctgaaatggcatccca

SEQ ID NO: 476795 - DNA, 25 bp, Rattus norvegicus
gtaaggctcctgtaatggcatccca

SEQ ID NO: 476796 - DNA, 25 bp, Rattus norvegicus
gtaaggctctcacaacaggctggac

SEQ ID NO: 476797 - DNA, 25 bp, Rattus norvegicus
gtaaggctctcagaacaggctggac

SEQ ID NO: 476798 - DNA, 25 bp, Rattus norvegicus
gtaaggctgtgcagactggccagaa

SEQ ID NO: 476799 - DNA, 25 bp, Rattus norvegicus
gtaaggctgtgctgactggccagaa

SEQ ID NO: 476800 - DNA, 25 bp, Rattus norvegicus
gtaaggctgttgaatttggaccatg

SEQ ID NO: 476801 - DNA, 25 bp, Rattus norvegicus
gtaaggctgttgtatttggaccatg

SEQ ID NO: 476802 - DNA, 25 bp, Rattus norvegicus
gtaaggcttaccacacagagtcact

SEQ ID NO: 476803 - DNA, 25 bp, Rattus norvegicus
gtaaggcttacctcacagagtcact

SEQ ID NO: 476804 - DNA, 25 bp, Rattus norvegicus
gtaaggcttatactacattaaaggt

SEQ ID NO: 476805 - DNA, 25 bp, Rattus norvegicus
gtaaggcttatagtacattaaaggt

SEQ ID NO: 476806 - DNA, 25 bp, Rattus norvegicus
gtaaggcttcagacaatcgaagacc

SEQ ID NO: 476807 - DNA, 25 bp, Rattus norvegicus
gtaaggcttcagtcaatcgaagacc

SEQ ID NO: 476808 - DNA, 25 bp, Rattus norvegicus
gtaaggcttcctaggagaaaggcat

SEQ ID NO: 476809 - DNA, 25 bp, Rattus norvegicus
gtaaggcttccttggagaaaggcat

SEQ ID NO: 476810 - DNA, 25 bp, Rattus norvegicus
gtaaggcttctacatgtttatacgt

SEQ ID NO: 476811 - DNA, 25 bp, Rattus norvegicus
gtaaggcttctagatgtttatacgt

SEQ ID NO: 476812 - DNA, 25 bp, Rattus norvegicus
gtaaggctttctaccaaacgacgtg

SEQ ID NO: 476813 - DNA, 25 bp, Rattus norvegicus
gtaaggctttcttccaaacgacgtg

SEQ ID NO: 476814 - DNA, 25 bp, Rattus norvegicus
gtaagggaacacatcttcaacatga

SEQ ID NO: 476815 - DNA, 25 bp, Rattus norvegicus
gtaagggaacacttcttcaacatga

SEQ ID NO: 476816 - DNA, 25 bp, Rattus norvegicus
gtaagggaacagacttgccaccctg

SEQ ID NO: 476817 - DNA, 25 bp, Rattus norvegicus
gtaagggaacagtcttgccaccctg

SEQ ID NO: 476818 - DNA, 25 bp, Rattus norvegicus
gtaagggaagttcgctgcactctcc

SEQ ID NO: 476819 - DNA, 25 bp, Rattus norvegicus
gtaagggaagttggctgcactctcc

SEQ ID NO: 476820 - DNA, 25 bp, Rattus norvegicus
gtaagggagaatacgcatgtctgcg

SEQ ID NO: 476821 - DNA, 25 bp, Rattus norvegicus
gtaagggagaattcgcatgtctgcg

SEQ ID NO: 476822 - DNA, 25 bp, Rattus norvegicus
gtaagggcctacagctggatctttc

SEQ ID NO: 476823 - DNA, 25 bp, Rattus norvegicus
gtaagggcctactgctggatctttc

SEQ ID NO: 476824 - DNA, 25 bp, Rattus norvegicus
gtaagggcttgactggtctgcacca

SEQ ID NO: 476825 - DNA, 25 bp, Rattus norvegicus
gtaagggcttgagtggtctgcacca

SEQ ID NO: 476826 - DNA, 25 bp, Rattus norvegicus
gtaagggtccatatgtacctcaaca

SEQ ID NO: 476827 - DNA, 25 bp, Rattus norvegicus
gtaagggtccatttgtacctcaaca

SEQ ID NO: 476828 - DNA, 25 bp, Rattus norvegicus
gtaagggtcctgaagcaagcaagaa

SEQ ID NO: 476829 - DNA, 25 bp, Rattus norvegicus
gtaagggtcctgtagcaagcaagaa

SEQ ID NO: 476830 - DNA, 25 bp, Rattus norvegicus
gtaagggtcgcaacccacaaactgg

SEQ ID NO: 476831 - DNA, 25 bp, Rattus norvegicus
gtaagggtcgcatcccacaaactgg

SEQ ID NO: 476832 - DNA, 25 bp, Rattus norvegicus
gtaagggttccaagcccacgagagc

SEQ ID NO: 476833 - DNA, 25 bp, Rattus norvegicus
gtaagggttccatgcccacgagagc

SEQ ID NO: 476834 - DNA, 25 bp, Rattus norvegicus
gtaaggtaccctcatactgtataat

SEQ ID NO: 476835 - DNA, 25 bp, Rattus norvegicus
gtaaggtaccctgatactgtataat

SEQ ID NO: 476836 - DNA, 25 bp, Rattus norvegicus
gtaaggtagagcaggtctgagaccc

SEQ ID NO: 476837 - DNA, 25 bp, Rattus norvegicus
gtaaggtagagctggtctgagaccc

SEQ ID NO: 476838 - DNA, 25 bp, Rattus norvegicus
gtaaggtagcctccaagaagtatga

SEQ ID NO: 476839 - DNA, 25 bp, Rattus norvegicus
gtaaggtagcctgcaagaagtatga

SEQ ID NO: 476840 - DNA, 25 bp, Rattus norvegicus
gtaaggtagtccaccaacgcaagtt

SEQ ID NO: 476841 - DNA, 25 bp, Rattus norvegicus
gtaaggtagtcctccaacgcaagtt

SEQ ID NO: 476842 - DNA, 25 bp, Rattus norvegicus
gtaaggtatttcacagtttttgcaa

SEQ ID NO: 476843 - DNA, 25 bp, Rattus norvegicus
gtaaggtatttctcagtttttgcaa

SEQ ID NO: 476844 - DNA, 25 bp, Rattus norvegicus
gtaaggtcactccaagataagggat

SEQ ID NO: 476845 - DNA, 25 bp, Rattus norvegicus
gtaaggtcactcgaagataagggat

SEQ ID NO: 476846 - DNA, 25 bp, Rattus norvegicus
gtaaggtcagtcaacgctacagaga

SEQ ID NO: 476847 - DNA, 25 bp, Rattus norvegicus
gtaaggtcagtctacgctacagaga

SEQ ID NO: 476848 - DNA, 25 bp, Rattus norvegicus
gtaaggtccccgcttttcccatgag

SEQ ID NO: 476849 - DNA, 25 bp, Rattus norvegicus
gtaaggtccccggttttcccatgag

SEQ ID NO: 476850 - DNA, 25 bp, Rattus norvegicus
gtaaggtctgacattctactctacc

SEQ ID NO: 476851 - DNA, 25 bp, Rattus norvegicus
gtaaggtctgactttctactctacc

SEQ ID NO: 476852 - DNA, 25 bp, Rattus norvegicus
gtaaggtctgcacggaacaatcaat

SEQ ID NO: 476853 - DNA, 25 bp, Rattus norvegicus
gtaaggtctgcagggaacaatcaat

SEQ ID NO: 476854 - DNA, 25 bp, Rattus norvegicus
gtaaggtgccacaagatctttttgc

SEQ ID NO: 476855 - DNA, 25 bp, Rattus norvegicus
gtaaggtgccactagatctttttgc

SEQ ID NO: 476856 - DNA, 25 bp, Rattus norvegicus
gtaaggtgctgtagtctttttcaca

SEQ ID NO: 476857 - DNA, 25 bp, Rattus norvegicus
gtaaggtgctgttgtctttttcaca

SEQ ID NO: 476858 - DNA, 25 bp, Rattus norvegicus
gtaaggtgtatgacagccagggcct

SEQ ID NO: 476859 - DNA, 25 bp, Rattus norvegicus
gtaaggtgtatgtcagccagggcct

SEQ ID NO: 476860 - DNA, 25 bp, Rattus norvegicus
gtaaggtgtccaactgtgcccttct

SEQ ID NO: 476861 - DNA, 25 bp, Rattus norvegicus
gtaaggtgtccatctgtgcccttct

SEQ ID NO: 476862 - DNA, 25 bp, Rattus norvegicus
gtaaggttaatacacgaatatcaat

SEQ ID NO: 476863 - DNA, 25 bp, Rattus norvegicus
gtaaggttaatagacgaatatcaat

SEQ ID NO: 476864 - DNA, 25 bp, Rattus norvegicus
gtaaggttacctctctcaaaggcca

SEQ ID NO: 476865 - DNA, 25 bp, Rattus norvegicus
gtaaggttacctgtctcaaaggcca

SEQ ID NO: 476866 - DNA, 25 bp, Rattus norvegicus
gtaaggttagacaaatgcaatggtt

SEQ ID NO: 476867 - DNA, 25 bp, Rattus norvegicus
gtaaggttagactaatgcaatggtt

SEQ ID NO: 476868 - DNA, 25 bp, Rattus norvegicus
gtaaggttccagatgcagagccagt

SEQ ID NO: 476869 - DNA, 25 bp, Rattus norvegicus
gtaaggttccagttgcagagccagt

SEQ ID NO: 476870 - DNA, 25 bp, Rattus norvegicus
gtaaggttgaccacggtgctatgtg

SEQ ID NO: 476871 - DNA, 25 bp, Rattus norvegicus
gtaaggttgacctcggtgctatgtg

SEQ ID NO: 476872 - DNA, 25 bp, Rattus norvegicus
gtaaggttggcacctgcacacactc

SEQ ID NO: 476873 - DNA, 25 bp, Rattus norvegicus
gtaaggttggcagctgcacacactc

SEQ ID NO: 476874 - DNA, 25 bp, Rattus norvegicus
gtaaggttgtgactccgtcctagtt

SEQ ID NO: 476875 - DNA, 25 bp, Rattus norvegicus
gtaaggttgtgagtccgtcctagtt

SEQ ID NO: 476876 - DNA, 25 bp, Rattus norvegicus
gtaagtaacacaagtatgaagctgg

SEQ ID NO: 476877 - DNA, 25 bp, Rattus norvegicus
gtaagtaacacatgtatgaagctgg

SEQ ID NO: 476878 - DNA, 25 bp, Rattus norvegicus
gtaagtaacattaccatgcctctct

SEQ ID NO: 476879 - DNA, 25 bp, Rattus norvegicus
gtaagtaacatttccatgcctctct

SEQ ID NO: 476880 - DNA, 25 bp, Rattus norvegicus
gtaagtaaccataaccttatcttgt

SEQ ID NO: 476881 - DNA, 25 bp, Rattus norvegicus
gtaagtaaccattaccttatcttgt

SEQ ID NO: 476882 - DNA, 25 bp, Rattus norvegicus
gtaagtaattcacctctttgtcaga

SEQ ID NO: 476883 - DNA, 25 bp, Rattus norvegicus
gtaagtaattcagctctttgtcaga

SEQ ID NO: 476884 - DNA, 25 bp, Rattus norvegicus
gtaagtacacctcggaacagctgca

SEQ ID NO: 476885 - DNA, 25 bp, Rattus norvegicus
gtaagtacacctgggaacagctgca

SEQ ID NO: 476886 - DNA, 25 bp, Rattus norvegicus
gtaagtacactaaagttcactatta

SEQ ID NO: 476887 - DNA, 25 bp, Rattus norvegicus
gtaagtacactatagttcactatta

SEQ ID NO: 476888 - DNA, 25 bp, Rattus norvegicus
gtaagtacacttctgctgggcaaat

SEQ ID NO: 476889 - DNA, 25 bp, Rattus norvegicus
gtaagtacacttgtgctgggcaaat

SEQ ID NO: 476890 - DNA, 25 bp, Rattus norvegicus
gtaagtacagaaactccctgagatg

SEQ ID NO: 476891 - DNA, 25 bp, Rattus norvegicus
gtaagtacagaatctccctgagatg

SEQ ID NO: 476892 - DNA, 25 bp, Rattus norvegicus
gtaagtacccatcgtggctgtccag

SEQ ID NO: 476893 - DNA, 25 bp, Rattus norvegicus
gtaagtacccatggtggctgtccag

SEQ ID NO: 476894 - DNA, 25 bp, Rattus norvegicus
gtaagtactcagaactccttcctga

SEQ ID NO: 476895 - DNA, 25 bp, Rattus norvegicus
gtaagtactcagtactccttcctga

SEQ ID NO: 476896 - DNA, 25 bp, Rattus norvegicus
gtaagtagagctaccactgctcagg

SEQ ID NO: 476897 - DNA, 25 bp, Rattus norvegicus
gtaagtagagcttccactgctcagg

SEQ ID NO: 476898 - DNA, 25 bp, Rattus norvegicus
gtaagtagcaaaccatatcctgatg

SEQ ID NO: 476899 - DNA, 25 bp, Rattus norvegicus
gtaagtagcaaagcatatcctgatg

SEQ ID NO: 476900 - DNA, 25 bp, Rattus norvegicus
gtaagtagtccgaggctagcagtct

SEQ ID NO: 476901 - DNA, 25 bp, Rattus norvegicus
gtaagtagtccgtggctagcagtct

SEQ ID NO: 476902 - DNA, 25 bp, Rattus norvegicus
gtaagtagtgtcatggtagccccag

SEQ ID NO: 476903 - DNA, 25 bp, Rattus norvegicus
gtaagtagtgtcttggtagccccag

SEQ ID NO: 476904 - DNA, 25 bp, Rattus norvegicus
gtaagtatgggcaaaggacctaata

SEQ ID NO: 476905 - DNA, 25 bp, Rattus norvegicus
gtaagtatgggctaaggacctaata

SEQ ID NO: 476906 - DNA, 25 bp, Rattus norvegicus
gtaagtcaatccctggactcagaaa

SEQ ID NO: 476907 - DNA, 25 bp, Rattus norvegicus
gtaagtcaatccgtggactcagaaa

SEQ ID NO: 476908 - DNA, 25 bp, Rattus norvegicus
gtaagtcacacacgagcgtatttta

SEQ ID NO: 476909 - DNA, 25 bp, Rattus norvegicus
gtaagtcacacaggagcgtatttta

SEQ ID NO: 476910 - DNA, 25 bp, Rattus norvegicus
gtaagtcaccagcatgaccctgtct

SEQ ID NO: 476911 - DNA, 25 bp, Rattus norvegicus
gtaagtcaccaggatgaccctgtct

SEQ ID NO: 476912 - DNA, 25 bp, Rattus norvegicus
gtaagtcaccctagaggcacacagc

SEQ ID NO: 476913 - DNA, 25 bp, Rattus norvegicus
gtaagtcacccttgaggcacacagc

SEQ ID NO: 476914 - DNA, 25 bp, Rattus norvegicus
gtaagtcaggacatgcccgacatct

SEQ ID NO: 476915 - DNA, 25 bp, Rattus norvegicus
gtaagtcaggacttgcccgacatct

SEQ ID NO: 476916 - DNA, 25 bp, Rattus norvegicus
gtaagtcaggatcctcaactagtag

SEQ ID NO: 476917 - DNA, 25 bp, Rattus norvegicus
gtaagtcaggatgctcaactagtag

SEQ ID NO: 476918 - DNA, 25 bp, Rattus norvegicus
gtaagtcagggtacaatgcaagtca

SEQ ID NO: 476919 - DNA, 25 bp, Rattus norvegicus
gtaagtcagggttcaatgcaagtca

SEQ ID NO: 476920 - DNA, 25 bp, Rattus norvegicus
gtaagtcaggttaggccttagtctc

SEQ ID NO: 476921 - DNA, 25 bp, Rattus norvegicus
gtaagtcaggtttggccttagtctc

SEQ ID NO: 476922 - DNA, 25 bp, Rattus norvegicus
gtaagtcagtctaagggccgaagca

SEQ ID NO: 476923 - DNA, 25 bp, Rattus norvegicus
gtaagtcagtcttagggccgaagca

SEQ ID NO: 476924 - DNA, 25 bp, Rattus norvegicus
gtaagtcagttcagcacacagtcat

SEQ ID NO: 476925 - DNA, 25 bp, Rattus norvegicus
gtaagtcagttctgcacacagtcat

SEQ ID NO: 476926 - DNA, 25 bp, Rattus norvegicus
gtaagtcatggcaggacaagctttt

SEQ ID NO: 476927 - DNA, 25 bp, Rattus norvegicus
gtaagtcatggctggacaagctttt

SEQ ID NO: 476928 - DNA, 25 bp, Rattus norvegicus
gtaagtcatgtaaattcttcctaat

SEQ ID NO: 476929 - DNA, 25 bp, Rattus norvegicus
gtaagtcatgtatattcttcctaat

SEQ ID NO: 476930 - DNA, 25 bp, Rattus norvegicus
gtaagtcatgttacacggctgcctc

SEQ ID NO: 476931 - DNA, 25 bp, Rattus norvegicus
gtaagtcatgtttcacggctgcctc

SEQ ID NO: 476932 - DNA, 25 bp, Rattus norvegicus
gtaagtcatttacctctctgtgcct

SEQ ID NO: 476933 - DNA, 25 bp, Rattus norvegicus
gtaagtcatttagctctctgtgcct

SEQ ID NO: 476934 - DNA, 25 bp, Rattus norvegicus
gtaagtcatttcactcgagctgttt

SEQ ID NO: 476935 - DNA, 25 bp, Rattus norvegicus
gtaagtcatttctctcgagctgttt

SEQ ID NO: 476936 - DNA, 25 bp, Rattus norvegicus
gtaagtccagagacgagaatcctca

SEQ ID NO: 476937 - DNA, 25 bp, Rattus norvegicus
gtaagtccagagtcgagaatcctca

SEQ ID NO: 476938 - DNA, 25 bp, Rattus norvegicus
gtaagtcccctgcttaaatgtccct

SEQ ID NO: 476939 - DNA, 25 bp, Rattus norvegicus
gtaagtcccctggttaaatgtccct

SEQ ID NO: 476940 - DNA, 25 bp, Rattus norvegicus
gtaagtccccttagtactcaaagct

SEQ ID NO: 476941 - DNA, 25 bp, Rattus norvegicus
gtaagtcccctttgtactcaaagct

SEQ ID NO: 476942 - DNA, 25 bp, Rattus norvegicus
gtaagtcccggtaccagcgatttcg

SEQ ID NO: 476943 - DNA, 25 bp, Rattus norvegicus
gtaagtcccggttccagcgatttcg

SEQ ID NO: 476944 - DNA, 25 bp, Rattus norvegicus
gtaagtccgataacatctttctgat

SEQ ID NO: 476945 - DNA, 25 bp, Rattus norvegicus
gtaagtccgatatcatctttctgat

SEQ ID NO: 476946 - DNA, 25 bp, Rattus norvegicus
gtaagtccgtctcgtctgggctcat

SEQ ID NO: 476947 - DNA, 25 bp, Rattus norvegicus
gtaagtccgtctggtctgggctcat

SEQ ID NO: 476948 - DNA, 25 bp, Rattus norvegicus
gtaagtcgaaccatctgtggagatc

SEQ ID NO: 476949 - DNA, 25 bp, Rattus norvegicus
gtaagtcgaaccttctgtggagatc

SEQ ID NO: 476950 - DNA, 25 bp, Rattus norvegicus
gtaagtcgccgtcgttgagcagaaa

SEQ ID NO: 476951 - DNA, 25 bp, Rattus norvegicus
gtaagtcgccgtggttgagcagaaa

SEQ ID NO: 476952 - DNA, 25 bp, Rattus norvegicus
gtaagtcgccttcctaacgtgacag

SEQ ID NO: 476953 - DNA, 25 bp, Rattus norvegicus
gtaagtcgccttgctaacgtgacag

SEQ ID NO: 476954 - DNA, 25 bp, Rattus norvegicus
gtaagtcgggccattatctctttca

SEQ ID NO: 476955 - DNA, 25 bp, Rattus norvegicus
gtaagtcgggcctttatctctttca

SEQ ID NO: 476956 - DNA, 25 bp, Rattus norvegicus
gtaagtcgtcgtcaatcagtttgct

SEQ ID NO: 476957 - DNA, 25 bp, Rattus norvegicus
gtaagtcgtcgtgaatcagtttgct

SEQ ID NO: 476958 - DNA, 25 bp, Rattus norvegicus
gtaagtctaataacatcatctgcac

SEQ ID NO: 476959 - DNA, 25 bp, Rattus norvegicus
gtaagtctaatatcatcatctgcac

SEQ ID NO: 476960 - DNA, 25 bp, Rattus norvegicus
gtaagtctacttagcctttgagaaa

SEQ ID NO: 476961 - DNA, 25 bp, Rattus norvegicus
gtaagtctactttgcctttgagaaa

SEQ ID NO: 476962 - DNA, 25 bp, Rattus norvegicus
gtaagtctcttcagggcagtttaac

SEQ ID NO: 476963 - DNA, 25 bp, Rattus norvegicus
gtaagtctcttctgggcagtttaac

SEQ ID NO: 476964 - DNA, 25 bp, Rattus norvegicus
gtaagtctgaaaagatgtttcatca

SEQ ID NO: 476965 - DNA, 25 bp, Rattus norvegicus
gtaagtctgaaatgatgtttcatca

SEQ ID NO: 476966 - DNA, 25 bp, Rattus norvegicus
gtaagtctgcccaggaggaaccgaa

SEQ ID NO: 476967 - DNA, 25 bp, Rattus norvegicus
gtaagtctgccctggaggaaccgaa

SEQ ID NO: 476968 - DNA, 25 bp, Rattus norvegicus
gtaagtctggccattctataggaat

SEQ ID NO: 476969 - DNA, 25 bp, Rattus norvegicus
gtaagtctggcctttctataggaat

SEQ ID NO: 476970 - DNA, 25 bp, Rattus norvegicus
gtaagtcttccgagctttgtctata

SEQ ID NO: 476971 - DNA, 25 bp, Rattus norvegicus
gtaagtcttccgtgctttgtctata

SEQ ID NO: 476972 - DNA, 25 bp, Rattus norvegicus
gtaagtcttgcaatacagttgtaag

SEQ ID NO: 476973 - DNA, 25 bp, Rattus norvegicus
gtaagtcttgcattacagttgtaag

SEQ ID NO: 476974 - DNA, 25 bp, Rattus norvegicus
gtaagtcttgtcagtaccaatgtaa

SEQ ID NO: 476975 - DNA, 25 bp, Rattus norvegicus
gtaagtcttgtctgtaccaatgtaa

SEQ ID NO: 476976 - DNA, 25 bp, Rattus norvegicus
gtaagtcttttgaccacttctcaat

SEQ ID NO: 476977 - DNA, 25 bp, Rattus norvegicus
gtaagtcttttgtccacttctcaat

SEQ ID NO: 476978 - DNA, 25 bp, Rattus norvegicus
gtaagtgactagaacgccatccgtg

SEQ ID NO: 476979 - DNA, 25 bp, Rattus norvegicus
gtaagtgactagtacgccatccgtg

SEQ ID NO: 476980 - DNA, 25 bp, Rattus norvegicus
gtaagtgagcacatgcctagtctgt

SEQ ID NO: 476981 - DNA, 25 bp, Rattus norvegicus
gtaagtgagcacttgcctagtctgt

SEQ ID NO: 476982 - DNA, 25 bp, Rattus norvegicus
gtaagtgatcttaatccatgcacaa

SEQ ID NO: 476983 - DNA, 25 bp, Rattus norvegicus
gtaagtgatctttatccatgcacaa

SEQ ID NO: 476984 - DNA, 25 bp, Rattus norvegicus
gtaagtgcacgtaagtcagattatt

SEQ ID NO: 476985 - DNA, 25 bp, Rattus norvegicus
gtaagtgcacgttagtcagattatt

SEQ ID NO: 476986 - DNA, 25 bp, Rattus norvegicus
gtaagtgcattcacttcccgtatgt

SEQ ID NO: 476987 - DNA, 25 bp, Rattus norvegicus
gtaagtgcattctcttcccgtatgt

SEQ ID NO: 476988 - DNA, 25 bp, Rattus norvegicus
gtaagtgccaaaccttaccagctgg

SEQ ID NO: 476989 - DNA, 25 bp, Rattus norvegicus
gtaagtgccaaactagaactcctat

SEQ ID NO: 476990 - DNA, 25 bp, Rattus norvegicus
gtaagtgccaaagcttaccagctgg

SEQ ID NO: 476991 - DNA, 25 bp, Rattus norvegicus
gtaagtgccaaagtagaactcctat

SEQ ID NO: 476992 - DNA, 25 bp, Rattus norvegicus
gtaagtgcccttactcatgttaagt

SEQ ID NO: 476993 - DNA, 25 bp, Rattus norvegicus
gtaagtgccctttctcatgttaagt

SEQ ID NO: 476994 - DNA, 25 bp, Rattus norvegicus
gtaagtgccttcagtgtccttgtac

SEQ ID NO: 476995 - DNA, 25 bp, Rattus norvegicus
gtaagtgccttctgtgtccttgtac

SEQ ID NO: 476996 - DNA, 25 bp, Rattus norvegicus
gtaagtgctaagaacctgttactaa

SEQ ID NO: 476997 - DNA, 25 bp, Rattus norvegicus
gtaagtgctaagtacctgttactaa

SEQ ID NO: 476998 - DNA, 25 bp, Rattus norvegicus
gtaagtgctcacatacctggttaag

SEQ ID NO: 476999 - DNA, 25 bp, Rattus norvegicus
gtaagtgctcacttacctggttaag

SEQ ID NO: 477000 - DNA, 25 bp, Rattus norvegicus
gtaagtgctccaacatattctactg

SEQ ID NO: 477001 - DNA, 25 bp, Rattus norvegicus
gtaagtgctccatcatattctactg

SEQ ID NO: 477002 - DNA, 25 bp, Rattus norvegicus
gtaagtgcttctaccagagtactcc

SEQ ID NO: 477003 - DNA, 25 bp, Rattus norvegicus
gtaagtgcttcttccagagtactcc

SEQ ID NO: 477004 - DNA, 25 bp, Rattus norvegicus
gtaagtgctttaacaggctgcctga

SEQ ID NO: 477005 - DNA, 25 bp, Rattus norvegicus
gtaagtgctttatcaggctgcctga

SEQ ID NO: 477006 - DNA, 25 bp, Rattus norvegicus
gtaagtggccctcctttaacatgaa

SEQ ID NO: 477007 - DNA, 25 bp, Rattus norvegicus
gtaagtggccctgctttaacatgaa

SEQ ID NO: 477008 - DNA, 25 bp, Rattus norvegicus
gtaagtggccttatcattgtaacat

SEQ ID NO: 477009 - DNA, 25 bp, Rattus norvegicus
gtaagtggccttttcattgtaacat

SEQ ID NO: 477010 - DNA, 25 bp, Rattus norvegicus
gtaagtgggctcattcggttccgag

SEQ ID NO: 477011 - DNA, 25 bp, Rattus norvegicus
gtaagtgggctctttcggttccgag

SEQ ID NO: 477012 - DNA, 25 bp, Rattus norvegicus
gtaagtggtgtaacaattgttccta

SEQ ID NO: 477013 - DNA, 25 bp, Rattus norvegicus
gtaagtggtgtatcaattgttccta

SEQ ID NO: 477014 - DNA, 25 bp, Rattus norvegicus
gtaagtggttacaagcatcagttat

SEQ ID NO: 477015 - DNA, 25 bp, Rattus norvegicus
gtaagtggttactagcatcagttat

SEQ ID NO: 477016 - DNA, 25 bp, Rattus norvegicus
gtaagtggttttcagacatatctag

SEQ ID NO: 477017 - DNA, 25 bp, Rattus norvegicus
gtaagtggttttgagacatatctag

SEQ ID NO: 477018 - DNA, 25 bp, Rattus norvegicus
gtaagtgtccatagactccttttgt

SEQ ID NO: 477019 - DNA, 25 bp, Rattus norvegicus
gtaagtgtccattgactccttttgt

SEQ ID NO: 477020 - DNA, 25 bp, Rattus norvegicus
gtaagtgtcctcctattttaaatct

SEQ ID NO: 477021 - DNA, 25 bp, Rattus norvegicus
gtaagtgtcctcgtattttaaatct

SEQ ID NO: 477022 - DNA, 25 bp, Rattus norvegicus
gtaagtgtctgtccgttttcattca

SEQ ID NO: 477023 - DNA, 25 bp, Rattus norvegicus
gtaagtgtctgtgcgttttcattca

SEQ ID NO: 477024 - DNA, 25 bp, Rattus norvegicus
gtaagtgtctttctcatataatcat

SEQ ID NO: 477025 - DNA, 25 bp, Rattus norvegicus
gtaagtgtctttgtcatataatcat

SEQ ID NO: 477026 - DNA, 25 bp, Rattus norvegicus
gtaagtgtgcccaaatcttcagtgc

SEQ ID NO: 477027 - DNA, 25 bp, Rattus norvegicus
gtaagtgtgccctaatcttcagtgc

SEQ ID NO: 477028 - DNA, 25 bp, Rattus norvegicus
gtaagtgtgcttcactccacagcag

SEQ ID NO: 477029 - DNA, 25 bp, Rattus norvegicus
gtaagtgtgcttgactccacagcag

SEQ ID NO: 477030 - DNA, 25 bp, Rattus norvegicus
gtaagtgtggagcactgatcaccca

SEQ ID NO: 477031 - DNA, 25 bp, Rattus norvegicus
gtaagtgtggaggactgatcaccca

SEQ ID NO: 477032 - DNA, 25 bp, Rattus norvegicus
gtaagtgtggccaaactgatgtttc

SEQ ID NO: 477033 - DNA, 25 bp, Rattus norvegicus
gtaagtgtggcctaactgatgtttc

SEQ ID NO: 477034 - DNA, 25 bp, Rattus norvegicus
gtaagtgtgtctatcttggttggag

SEQ ID NO: 477035 - DNA, 25 bp, Rattus norvegicus
gtaagtgtgtctttcttggttggag

SEQ ID NO: 477036 - DNA, 25 bp, Rattus norvegicus
gtaagtgtgtttccttcctgtgacc

SEQ ID NO: 477037 - DNA, 25 bp, Rattus norvegicus
gtaagtgtgtttgcttcctgtgacc

SEQ ID NO: 477038 - DNA, 25 bp, Rattus norvegicus
gtaagtgttggcaatgtcaatctga

SEQ ID NO: 477039 - DNA, 25 bp, Rattus norvegicus
gtaagtgttggctatgtcaatctga

SEQ ID NO: 477040 - DNA, 25 bp, Rattus norvegicus
gtaagttacaaacgctgctgtcagc

SEQ ID NO: 477041 - DNA, 25 bp, Rattus norvegicus
gtaagttacaaaggctgctgtcagc

SEQ ID NO: 477042 - DNA, 25 bp, Rattus norvegicus
gtaagttactggaacattgcactgt

SEQ ID NO: 477043 - DNA, 25 bp, Rattus norvegicus
gtaagttactggtacattgcactgt

SEQ ID NO: 477044 - DNA, 25 bp, Rattus norvegicus
gtaagttagcttatcaaacactgtt

SEQ ID NO: 477045 - DNA, 25 bp, Rattus norvegicus
gtaagttagcttttcaaacactgtt

SEQ ID NO: 477046 - DNA, 25 bp, Rattus norvegicus
gtaagttatcacattccgatacaaa

SEQ ID NO: 477047 - DNA, 25 bp, Rattus norvegicus
gtaagttatcactttccgatacaaa

SEQ ID NO: 477048 - DNA, 25 bp, Rattus norvegicus
gtaagttattttcctctcattgttt

SEQ ID NO: 477049 - DNA, 25 bp, Rattus norvegicus
gtaagttattttgctctcattgttt

SEQ ID NO: 477050 - DNA, 25 bp, Rattus norvegicus
gtaagttcacatccaagctccacac

SEQ ID NO: 477051 - DNA, 25 bp, Rattus norvegicus
gtaagttcacatgcaagctccacac

SEQ ID NO: 477052 - DNA, 25 bp, Rattus norvegicus
gtaagttcactgaacatgtatgtgt

SEQ ID NO: 477053 - DNA, 25 bp, Rattus norvegicus
gtaagttcactgtacatgtatgtgt

SEQ ID NO: 477054 - DNA, 25 bp, Rattus norvegicus
gtaagttcagccaatctgacggcca

SEQ ID NO: 477055 - DNA, 25 bp, Rattus norvegicus
gtaagttcagcctatctgacggcca

SEQ ID NO: 477056 - DNA, 25 bp, Rattus norvegicus
gtaagttcatagacagcccttctca

SEQ ID NO: 477057 - DNA, 25 bp, Rattus norvegicus
gtaagttcatagtcagcccttctca

SEQ ID NO: 477058 - DNA, 25 bp, Rattus norvegicus
gtaagttccggaatgcacacagaga

SEQ ID NO: 477059 - DNA, 25 bp, Rattus norvegicus
gtaagttccggattgcacacagaga

SEQ ID NO: 477060 - DNA, 25 bp, Rattus norvegicus
gtaagttcctttattgcgtgtgcat

SEQ ID NO: 477061 - DNA, 25 bp, Rattus norvegicus
gtaagttccttttttgcgtgtgcat

SEQ ID NO: 477062 - DNA, 25 bp, Rattus norvegicus
gtaagttctgaccatcctttctgaa

SEQ ID NO: 477063 - DNA, 25 bp, Rattus norvegicus
gtaagttctgacgatcctttctgaa

SEQ ID NO: 477064 - DNA, 25 bp, Rattus norvegicus
gtaagttcttacagttgtagctagt

SEQ ID NO: 477065 - DNA, 25 bp, Rattus norvegicus
gtaagttcttactgttgtagctagt

SEQ ID NO: 477066 - DNA, 25 bp, Rattus norvegicus
gtaagttcttgtctgcaactggagt

SEQ ID NO: 477067 - DNA, 25 bp, Rattus norvegicus
gtaagttcttgtgtgcaactggagt

SEQ ID NO: 477068 - DNA, 25 bp, Rattus norvegicus
gtaagttgccaaatgatgctacact

SEQ ID NO: 477069 - DNA, 25 bp, Rattus norvegicus
gtaagttgccaattgatgctacact

SEQ ID NO: 477070 - DNA, 25 bp, Rattus norvegicus
gtaagttgctgtctcctcggagttg

SEQ ID NO: 477071 - DNA, 25 bp, Rattus norvegicus
gtaagttgctgtgtcctcggagttg

SEQ ID NO: 477072 - DNA, 25 bp, Rattus norvegicus
gtaagttgctttacccagagcttag

SEQ ID NO: 477073 - DNA, 25 bp, Rattus norvegicus
gtaagttgcttttcccagagcttag

SEQ ID NO: 477074 - DNA, 25 bp, Rattus norvegicus
gtaagttggatgaattgtgcacaga

SEQ ID NO: 477075 - DNA, 25 bp, Rattus norvegicus
gtaagttggatgtattgtgcacaga

SEQ ID NO: 477076 - DNA, 25 bp, Rattus norvegicus
gtaagtttaccgattgacctggaag

SEQ ID NO: 477077 - DNA, 25 bp, Rattus norvegicus
gtaagtttaccgtttgacctggaag

SEQ ID NO: 477078 - DNA, 25 bp, Rattus norvegicus
gtaagtttagttactctgtctgtcc

SEQ ID NO: 477079 - DNA, 25 bp, Rattus norvegicus
gtaagtttagtttctctgtctgtcc

SEQ ID NO: 477080 - DNA, 25 bp, Rattus norvegicus
gtaagtttatatcgcccttcttgga

SEQ ID NO: 477081 - DNA, 25 bp, Rattus norvegicus
gtaagtttatatggcccttcttgga

SEQ ID NO: 477082 - DNA, 25 bp, Rattus norvegicus
gtaagtttcactatctgaggtattg

SEQ ID NO: 477083 - DNA, 25 bp, Rattus norvegicus
gtaagtttcactttctgaggtattg

SEQ ID NO: 477084 - DNA, 25 bp, Rattus norvegicus
gtaagtttcgttcctcagtgagtga

SEQ ID NO: 477085 - DNA, 25 bp, Rattus norvegicus
gtaagtttcgttgctcagtgagtga

SEQ ID NO: 477086 - DNA, 25 bp, Rattus norvegicus
gtaagtttcttaacctgaatgcaag

SEQ ID NO: 477087 - DNA, 25 bp, Rattus norvegicus
gtaagtttcttatcctgaatgcaag

SEQ ID NO: 477088 - DNA, 25 bp, Rattus norvegicus
gtaagtttgcttaagaaggcctctc

SEQ ID NO: 477089 - DNA, 25 bp, Rattus norvegicus
gtaagtttgctttagaaggcctctc

SEQ ID NO: 477090 - DNA, 25 bp, Rattus norvegicus
gtaagttttaggctaactgaggcta

SEQ ID NO: 477091 - DNA, 25 bp, Rattus norvegicus
gtaagttttagggtaactgaggcta

SEQ ID NO: 477092 - DNA, 25 bp, Rattus norvegicus
gtaagttttcccatttgtgacatca

SEQ ID NO: 477093 - DNA, 25 bp, Rattus norvegicus
gtaagttttcccttttgtgacatca

SEQ ID NO: 477094 - DNA, 25 bp, Rattus norvegicus
gtaagttttcctatcatgtgttgta

SEQ ID NO: 477095 - DNA, 25 bp, Rattus norvegicus
gtaagttttcctttcatgtgttgta

SEQ ID NO: 477096 - DNA, 25 bp, Rattus norvegicus
gtaagtttttgcactcgtgcaacca

SEQ ID NO: 477097 - DNA, 25 bp, Rattus norvegicus
gtaagtttttgctctcgtgcaacca

SEQ ID NO: 477098 - DNA, 25 bp, Rattus norvegicus
gtaataaaaaccagtcctagccatg

SEQ ID NO: 477099 - DNA, 25 bp, Rattus norvegicus
gtaataaaaacctgtcctagccatg

SEQ ID NO: 477100 - DNA, 25 bp, Rattus norvegicus
gtaataaaacccaggcatggcatct

SEQ ID NO: 477101 - DNA, 25 bp, Rattus norvegicus
gtaataaaaccctggcatggcatct

SEQ ID NO: 477102 - DNA, 25 bp, Rattus norvegicus
gtaataaactctccctgtcttctac

SEQ ID NO: 477103 - DNA, 25 bp, Rattus norvegicus
gtaataaactctgcctgtcttctac

SEQ ID NO: 477104 - DNA, 25 bp, Rattus norvegicus
gtaataaactgaatactacagtcat

SEQ ID NO: 477105 - DNA, 25 bp, Rattus norvegicus
gtaataaactgattactacagtcat

SEQ ID NO: 477106 - DNA, 25 bp, Rattus norvegicus
gtaataaaggacacgccagccctgt

SEQ ID NO: 477107 - DNA, 25 bp, Rattus norvegicus
gtaataaaggactcgccagccctgt

SEQ ID NO: 477108 - DNA, 25 bp, Rattus norvegicus
gtaataaagtgcaccgcgtcggttc

SEQ ID NO: 477109 - DNA, 25 bp, Rattus norvegicus
gtaataaagtgctccgcgtcggttc

SEQ ID NO: 477110 - DNA, 25 bp, Rattus norvegicus
gtaataaatcacacgactagctctt

SEQ ID NO: 477111 - DNA, 25 bp, Rattus norvegicus
gtaataaatcactcgactagctctt

SEQ ID NO: 477112 - DNA, 25 bp, Rattus norvegicus
gtaataaatctcatcaagggcaagt

SEQ ID NO: 477113 - DNA, 25 bp, Rattus norvegicus
gtaataaatctcttcaagggcaagt

SEQ ID NO: 477114 - DNA, 25 bp, Rattus norvegicus
gtaataacccaccagagaacacact

SEQ ID NO: 477115 - DNA, 25 bp, Rattus norvegicus
gtaataacccacgagagaacacact

SEQ ID NO: 477116 - DNA, 25 bp, Rattus norvegicus
gtaataaccccacttctttgtaatg

SEQ ID NO: 477117 - DNA, 25 bp, Rattus norvegicus
gtaataaccccagttctttgtaatg

SEQ ID NO: 477118 - DNA, 25 bp, Rattus norvegicus
gtaataacctttagctgatgccctc

SEQ ID NO: 477119 - DNA, 25 bp, Rattus norvegicus
gtaataaccttttgctgatgccctc

SEQ ID NO: 477120 - DNA, 25 bp, Rattus norvegicus
gtaataactgagcacatctgccctt

SEQ ID NO: 477121 - DNA, 25 bp, Rattus norvegicus
gtaataactgaggacatctgccctt

SEQ ID NO: 477122 - DNA, 25 bp, Rattus norvegicus
gtaataaggcggacaggctcagctg

SEQ ID NO: 477123 - DNA, 25 bp, Rattus norvegicus
gtaataaggcggtcaggctcagctg

SEQ ID NO: 477124 - DNA, 25 bp, Rattus norvegicus
gtaataatctcacttttatatgaat

SEQ ID NO: 477125 - DNA, 25 bp, Rattus norvegicus
gtaataatctcagttttatatgaat

SEQ ID NO: 477126 - DNA, 25 bp, Rattus norvegicus
gtaataatctcgaactccatccgtt

SEQ ID NO: 477127 - DNA, 25 bp, Rattus norvegicus
gtaataatctcgtactccatccgtt

SEQ ID NO: 477128 - DNA, 25 bp, Rattus norvegicus
gtaataatgtcgacctacctcacag

SEQ ID NO: 477129 - DNA, 25 bp, Rattus norvegicus
gtaataatgtcgtcctacctcacag

SEQ ID NO: 477130 - DNA, 25 bp, Rattus norvegicus
gtaatacacgtaatgacttcagtag

SEQ ID NO: 477131 - DNA, 25 bp, Rattus norvegicus
gtaatacacgtattgacttcagtag

SEQ ID NO: 477132 - DNA, 25 bp, Rattus norvegicus
gtaatacagcagatccagagacact

SEQ ID NO: 477133 - DNA, 25 bp, Rattus norvegicus
gtaatacagcagttccagagacact

SEQ ID NO: 477134 - DNA, 25 bp, Rattus norvegicus
gtaataccacctcttgggagtctga

SEQ ID NO: 477135 - DNA, 25 bp, Rattus norvegicus
gtaataccacctgttgggagtctga

SEQ ID NO: 477136 - DNA, 25 bp, Rattus norvegicus
gtaataccacgtaatgcaatgcata

SEQ ID NO: 477137 - DNA, 25 bp, Rattus norvegicus
gtaataccacgttatgcaatgcata

SEQ ID NO: 477138 - DNA, 25 bp, Rattus norvegicus
gtaataccagctattgctcagaaat

SEQ ID NO: 477139 - DNA, 25 bp, Rattus norvegicus
gtaataccagcttttgctcagaaat

SEQ ID NO: 477140 - DNA, 25 bp, Rattus norvegicus
gtaataccatttacattggccttga

SEQ ID NO: 477141 - DNA, 25 bp, Rattus norvegicus
gtaataccattttcattggccttga

SEQ ID NO: 477142 - DNA, 25 bp, Rattus norvegicus
gtaatacctgcacccatgtgtcgag

SEQ ID NO: 477143 - DNA, 25 bp, Rattus norvegicus
gtaatacctgcagccatgtgtcgag

SEQ ID NO: 477144 - DNA, 25 bp, Rattus norvegicus
gtaatacgctgcaacatttttggag

SEQ ID NO: 477145 - DNA, 25 bp, Rattus norvegicus
gtaatacgctgctacatttttggag

SEQ ID NO: 477146 - DNA, 25 bp, Rattus norvegicus
gtaatacggtggactcttctatgag

SEQ ID NO: 477147 - DNA, 25 bp, Rattus norvegicus
gtaatacggtggtctcttctatgag

SEQ ID NO: 477148 - DNA, 25 bp, Rattus norvegicus
gtaatactaccaagaggccctgtgg

SEQ ID NO: 477149 - DNA, 25 bp, Rattus norvegicus
gtaatactaccatgaggccctgtgg

SEQ ID NO: 477150 - DNA, 25 bp, Rattus norvegicus
gtaatactccacagtgtaacctgca

SEQ ID NO: 477151 - DNA, 25 bp, Rattus norvegicus
gtaatactccactgtgtaacctgca

SEQ ID NO: 477152 - DNA, 25 bp, Rattus norvegicus
gtaatacttctcaacatcagacaat

SEQ ID NO: 477153 - DNA, 25 bp, Rattus norvegicus
gtaatacttctctacatcagacaat

SEQ ID NO: 477154 - DNA, 25 bp, Rattus norvegicus
gtaatacttgccagccgcttagcac

SEQ ID NO: 477155 - DNA, 25 bp, Rattus norvegicus
gtaatacttgcctgccgcttagcac

SEQ ID NO: 477156 - DNA, 25 bp, Rattus norvegicus
gtaatactttctaatgtgacatttc

SEQ ID NO: 477157 - DNA, 25 bp, Rattus norvegicus
gtaatactttcttatgtgacatttc

SEQ ID NO: 477158 - DNA, 25 bp, Rattus norvegicus
gtaatacttttcaagtagtagctca

SEQ ID NO: 477159 - DNA, 25 bp, Rattus norvegicus
gtaatacttttcacgttgctgtaac

SEQ ID NO: 477160 - DNA, 25 bp, Rattus norvegicus
gtaatacttttctagtagtagctca

SEQ ID NO: 477161 - DNA, 25 bp, Rattus norvegicus
gtaatacttttctcgttgctgtaac

SEQ ID NO: 477162 - DNA, 25 bp, Rattus norvegicus
gtaatagatgtaccctagtgttcct

SEQ ID NO: 477163 - DNA, 25 bp, Rattus norvegicus
gtaatagatgtagcctagtgttcct

SEQ ID NO: 477164 - DNA, 25 bp, Rattus norvegicus
gtaatagcaaggctttctccgtgca

SEQ ID NO: 477165 - DNA, 25 bp, Rattus norvegicus
gtaatagcaagggtttctccgtgca

SEQ ID NO: 477166 - DNA, 25 bp, Rattus norvegicus
gtaatagcacatccctttagagcag

SEQ ID NO: 477167 - DNA, 25 bp, Rattus norvegicus
gtaatagcacatgcctttagagcag

SEQ ID NO: 477168 - DNA, 25 bp, Rattus norvegicus
gtaatagcaccgcaagcccagaaat

SEQ ID NO: 477169 - DNA, 25 bp, Rattus norvegicus
gtaatagcaccggaagcccagaaat

SEQ ID NO: 477170 - DNA, 25 bp, Rattus norvegicus
gtaatagcactgatggtttccgttt

SEQ ID NO: 477171 - DNA, 25 bp, Rattus norvegicus
gtaatagcactgttggtttccgttt

SEQ ID NO: 477172 - DNA, 25 bp, Rattus norvegicus
gtaatagccacaaaacattgccact

SEQ ID NO: 477173 - DNA, 25 bp, Rattus norvegicus
gtaatagccacataacattgccact

SEQ ID NO: 477174 - DNA, 25 bp, Rattus norvegicus
gtaatagccgttagagtctctgatg

SEQ ID NO: 477175 - DNA, 25 bp, Rattus norvegicus
gtaatagccgtttgagtctctgatg

SEQ ID NO: 477176 - DNA, 25 bp, Rattus norvegicus
gtaatagcctaccatttcgaaccat

SEQ ID NO: 477177 - DNA, 25 bp, Rattus norvegicus
gtaatagcctacgatttcgaaccat

SEQ ID NO: 477178 - DNA, 25 bp, Rattus norvegicus
gtaatagctgaccaggctgtacaca

SEQ ID NO: 477179 - DNA, 25 bp, Rattus norvegicus
gtaatagctgacgaggctgtacaca

SEQ ID NO: 477180 - DNA, 25 bp, Rattus norvegicus
gtaatagctggtcgctcctgaacac

SEQ ID NO: 477181 - DNA, 25 bp, Rattus norvegicus
gtaatagctggtggctcctgaacac

SEQ ID NO: 477182 - DNA, 25 bp, Rattus norvegicus
gtaatagctgtcatcagcacccagt

SEQ ID NO: 477183 - DNA, 25 bp, Rattus norvegicus
gtaatagctgtcttcagcacccagt

SEQ ID NO: 477184 - DNA, 25 bp, Rattus norvegicus
gtaatagcttggctctgttcacttt

SEQ ID NO: 477185 - DNA, 25 bp, Rattus norvegicus
gtaatagcttgggtctgttcacttt

SEQ ID NO: 477186 - DNA, 25 bp, Rattus norvegicus
gtaataggccctacttttgaagagc

SEQ ID NO: 477187 - DNA, 25 bp, Rattus norvegicus
gtaataggcccttcttttgaagagc

SEQ ID NO: 477188 - DNA, 25 bp, Rattus norvegicus
gtaataggtggtctccttattgtca

SEQ ID NO: 477189 - DNA, 25 bp, Rattus norvegicus
gtaataggtggtgtccttattgtca

SEQ ID NO: 477190 - DNA, 25 bp, Rattus norvegicus
gtaatagtacccagtgtgcttccat

SEQ ID NO: 477191 - DNA, 25 bp, Rattus norvegicus
gtaatagtaccctgtgtgcttccat

SEQ ID NO: 477192 - DNA, 25 bp, Rattus norvegicus
gtaatagtctaaatcaccagcctga

SEQ ID NO: 477193 - DNA, 25 bp, Rattus norvegicus
gtaatagtctaattcaccagcctga

SEQ ID NO: 477194 - DNA, 25 bp, Rattus norvegicus
gtaatagtgtcccaagaacttttat

SEQ ID NO: 477195 - DNA, 25 bp, Rattus norvegicus
gtaatagtgtccgaagaacttttat

SEQ ID NO: 477196 - DNA, 25 bp, Rattus norvegicus
gtaatatacattcaacaccgatcct

SEQ ID NO: 477197 - DNA, 25 bp, Rattus norvegicus
gtaatatacattgaacaccgatcct

SEQ ID NO: 477198 - DNA, 25 bp, Rattus norvegicus
gtaatataccatagtctcacttagg

SEQ ID NO: 477199 - DNA, 25 bp, Rattus norvegicus
gtaatataccattgtctcacttagg

SEQ ID NO: 477200 - DNA, 25 bp, Rattus norvegicus
gtaatatactaccaagccctgcatg

SEQ ID NO: 477201 - DNA, 25 bp, Rattus norvegicus
gtaatatactacgaagccctgcatg

SEQ ID NO: 477202 - DNA, 25 bp, Rattus norvegicus
gtaatatatcctctggttcccaaag

SEQ ID NO: 477203 - DNA, 25 bp, Rattus norvegicus
gtaatatatcctgtggttcccaaag

SEQ ID NO: 477204 - DNA, 25 bp, Rattus norvegicus
gtaatatcacatcacctggtgctgt

SEQ ID NO: 477205 - DNA, 25 bp, Rattus norvegicus
gtaatatcacatgacctggtgctgt

SEQ ID NO: 477206 - DNA, 25 bp, Rattus norvegicus
gtaatatcagcaccagaccaaccca

SEQ ID NO: 477207 - DNA, 25 bp, Rattus norvegicus
gtaatatcagcagcagaccaaccca

SEQ ID NO: 477208 - DNA, 25 bp, Rattus norvegicus
gtaatatccagaagaccagatgtct

SEQ ID NO: 477209 - DNA, 25 bp, Rattus norvegicus
gtaatatccagatgaccagatgtct

SEQ ID NO: 477210 - DNA, 25 bp, Rattus norvegicus
gtaatatccattccaacgtctgtaa

SEQ ID NO: 477211 - DNA, 25 bp, Rattus norvegicus
gtaatatccattgcaacgtctgtaa

SEQ ID NO: 477212 - DNA, 25 bp, Rattus norvegicus
gtaatatctacaagccctactggtt

SEQ ID NO: 477213 - DNA, 25 bp, Rattus norvegicus
gtaatatctacatgccctactggtt

SEQ ID NO: 477214 - DNA, 25 bp, Rattus norvegicus
gtaatatctgtcctggcttgtggct

SEQ ID NO: 477215 - DNA, 25 bp, Rattus norvegicus
gtaatatctgtcgtggcttgtggct

SEQ ID NO: 477216 - DNA, 25 bp, Rattus norvegicus
gtaatatgcgacacgctgtccgaga

SEQ ID NO: 477217 - DNA, 25 bp, Rattus norvegicus
gtaatatgcgactcgctgtccgaga

SEQ ID NO: 477218 - DNA, 25 bp, Rattus norvegicus
gtaatatgtggtagcctccttaata

SEQ ID NO: 477219 - DNA, 25 bp, Rattus norvegicus
gtaatatgtggttgcctccttaata

SEQ ID NO: 477220 - DNA, 25 bp, Rattus norvegicus
gtaatattatccacacctccagttt

SEQ ID NO: 477221 - DNA, 25 bp, Rattus norvegicus
gtaatattatcctcacctccagttt

SEQ ID NO: 477222 - DNA, 25 bp, Rattus norvegicus
gtaatattcatacctccaactcacc

SEQ ID NO: 477223 - DNA, 25 bp, Rattus norvegicus
gtaatattcatagctccaactcacc

SEQ ID NO: 477224 - DNA, 25 bp, Rattus norvegicus
gtaatattgccaacaatgcagtgat

SEQ ID NO: 477225 - DNA, 25 bp, Rattus norvegicus
gtaatattgccatcaatgcagtgat

SEQ ID NO: 477226 - DNA, 25 bp, Rattus norvegicus
gtaatattgctccatgactactaca

SEQ ID NO: 477227 - DNA, 25 bp, Rattus norvegicus
gtaatattgctcgatgactactaca

SEQ ID NO: 477228 - DNA, 25 bp, Rattus norvegicus
gtaatattggacacctgcaacagga

SEQ ID NO: 477229 - DNA, 25 bp, Rattus norvegicus
gtaatattggactcctgcaacagga

SEQ ID NO: 477230 - DNA, 25 bp, Rattus norvegicus
gtaatattgtccatagccaagcctg

SEQ ID NO: 477231 - DNA, 25 bp, Rattus norvegicus
gtaatattgtccttagccaagcctg

SEQ ID NO: 477232 - DNA, 25 bp, Rattus norvegicus
gtaatattgttactaaagcgtctag

SEQ ID NO: 477233 - DNA, 25 bp, Rattus norvegicus
gtaatattgttagtaaagcgtctag

SEQ ID NO: 477234 - DNA, 25 bp, Rattus norvegicus
gtaatatttaggactgtttcagaaa

SEQ ID NO: 477235 - DNA, 25 bp, Rattus norvegicus
gtaatatttaggtctgtttcagaaa

SEQ ID NO: 477236 - DNA, 25 bp, Rattus norvegicus
gtaatatttatgcacaccatcaaat

SEQ ID NO: 477237 - DNA, 25 bp, Rattus norvegicus
gtaatatttatggacaccatcaaat

SEQ ID NO: 477238 - DNA, 25 bp, Rattus norvegicus
gtaatatttgacaaggcggcccatt

SEQ ID NO: 477239 - DNA, 25 bp, Rattus norvegicus
gtaatatttgactaggcggcccatt

SEQ ID NO: 477240 - DNA, 25 bp, Rattus norvegicus
gtaatcaaaactcccctagtgcttc

SEQ ID NO: 477241 - DNA, 25 bp, Rattus norvegicus
gtaatcaaaactgccctagtgcttc

SEQ ID NO: 477242 - DNA, 25 bp, Rattus norvegicus
gtaatcaaaatcaagtctcacgtgt

SEQ ID NO: 477243 - DNA, 25 bp, Rattus norvegicus
gtaatcaaaatctagtctcacgtgt

SEQ ID NO: 477244 - DNA, 25 bp, Rattus norvegicus
gtaatcaaatacacctgtcgtcaaa

SEQ ID NO: 477245 - DNA, 25 bp, Rattus norvegicus
gtaatcaaatactcctgtcgtcaaa

SEQ ID NO: 477246 - DNA, 25 bp, Rattus norvegicus
gtaatcaacatcacgtttccaacta

SEQ ID NO: 477247 - DNA, 25 bp, Rattus norvegicus
gtaatcaacatctcgtttccaacta

SEQ ID NO: 477248 - DNA, 25 bp, Rattus norvegicus
gtaatcaactcaatgtcacagggtt

SEQ ID NO: 477249 - DNA, 25 bp, Rattus norvegicus
gtaatcaactcattgtcacagggtt

SEQ ID NO: 477250 - DNA, 25 bp, Rattus norvegicus
gtaatcacacctctctgtttttagt

SEQ ID NO: 477251 - DNA, 25 bp, Rattus norvegicus
gtaatcacacctgtctgtttttagt

SEQ ID NO: 477252 - DNA, 25 bp, Rattus norvegicus
gtaatcacagatattacctctcatt

SEQ ID NO: 477253 - DNA, 25 bp, Rattus norvegicus
gtaatcacagattttacctctcatt

SEQ ID NO: 477254 - DNA, 25 bp, Rattus norvegicus
gtaatcacgtccatgacaccaatgc

SEQ ID NO: 477255 - DNA, 25 bp, Rattus norvegicus
gtaatcacgtccttgacaccaatgc

SEQ ID NO: 477256 - DNA, 25 bp, Rattus norvegicus
gtaatcactctcaaggttcccaagc

SEQ ID NO: 477257 - DNA, 25 bp, Rattus norvegicus
gtaatcactctctaggttcccaagc

SEQ ID NO: 477258 - DNA, 25 bp, Rattus norvegicus
gtaatcacttccctggagacactgg

SEQ ID NO: 477259 - DNA, 25 bp, Rattus norvegicus
gtaatcacttccgtggagacactgg

SEQ ID NO: 477260 - DNA, 25 bp, Rattus norvegicus
gtaatcagacctaccacactaggtg

SEQ ID NO: 477261 - DNA, 25 bp, Rattus norvegicus
gtaatcagaccttccacactaggtg

SEQ ID NO: 477262 - DNA, 25 bp, Rattus norvegicus
gtaatcagagaccacatcattgcag

SEQ ID NO: 477263 - DNA, 25 bp, Rattus norvegicus
gtaatcagagacgacatcattgcag

SEQ ID NO: 477264 - DNA, 25 bp, Rattus norvegicus
gtaatcagagcacgcgctgttcagt

SEQ ID NO: 477265 - DNA, 25 bp, Rattus norvegicus
gtaatcagagcaggcgctgttcagt

SEQ ID NO: 477266 - DNA, 25 bp, Rattus norvegicus
gtaatcagcactcgccaacatggga

SEQ ID NO: 477267 - DNA, 25 bp, Rattus norvegicus
gtaatcagcactggccaacatggga

SEQ ID NO: 477268 - DNA, 25 bp, Rattus norvegicus
gtaatcagggtcactgttcacgcat

SEQ ID NO: 477269 - DNA, 25 bp, Rattus norvegicus
gtaatcagggtctctgttcacgcat

SEQ ID NO: 477270 - DNA, 25 bp, Rattus norvegicus
gtaatcaggtcacttgttggtctct

SEQ ID NO: 477271 - DNA, 25 bp, Rattus norvegicus
gtaatcaggtcagttgttggtctct

SEQ ID NO: 477272 - DNA, 25 bp, Rattus norvegicus
gtaatcagtaagacacctctcaaca

SEQ ID NO: 477273 - DNA, 25 bp, Rattus norvegicus
gtaatcagtaagtcacctctcaaca

SEQ ID NO: 477274 - DNA, 25 bp, Rattus norvegicus
gtaatcagtgttctggagggactca

SEQ ID NO: 477275 - DNA, 25 bp, Rattus norvegicus
gtaatcagtgttgtggagggactca

SEQ ID NO: 477276 - DNA, 25 bp, Rattus norvegicus
gtaatcagtttgactttggttcctt

SEQ ID NO: 477277 - DNA, 25 bp, Rattus norvegicus
gtaatcagtttgtctttggttcctt

SEQ ID NO: 477278 - DNA, 25 bp, Rattus norvegicus
gtaatcataggccaggtgtccattt

SEQ ID NO: 477279 - DNA, 25 bp, Rattus norvegicus
gtaatcataggcgaggtgtccattt

SEQ ID NO: 477280 - DNA, 25 bp, Rattus norvegicus
gtaatcatctacattcagcaaggaa

SEQ ID NO: 477281 - DNA, 25 bp, Rattus norvegicus
gtaatcatctactttcagcaaggaa

SEQ ID NO: 477282 - DNA, 25 bp, Rattus norvegicus
gtaatcatgcccaaaacaacttagt

SEQ ID NO: 477283 - DNA, 25 bp, Rattus norvegicus
gtaatcatgccctaaacaacttagt

SEQ ID NO: 477284 - DNA, 25 bp, Rattus norvegicus
gtaatcatgttaccaccgatctatt

SEQ ID NO: 477285 - DNA, 25 bp, Rattus norvegicus
gtaatcatgttagcaccgatctatt

SEQ ID NO: 477286 - DNA, 25 bp, Rattus norvegicus
gtaatcattcgtagccattccattc

SEQ ID NO: 477287 - DNA, 25 bp, Rattus norvegicus
gtaatcattcgttgccattccattc

SEQ ID NO: 477288 - DNA, 25 bp, Rattus norvegicus
gtaatcattggcatccaggctgttg

SEQ ID NO: 477289 - DNA, 25 bp, Rattus norvegicus
gtaatcattggcttccaggctgttg

SEQ ID NO: 477290 - DNA, 25 bp, Rattus norvegicus
gtaatccacatcaaaatcactttct

SEQ ID NO: 477291 - DNA, 25 bp, Rattus norvegicus
gtaatccacatctaaatcactttct

SEQ ID NO: 477292 - DNA, 25 bp, Rattus norvegicus
gtaatccacctcatcagctatgagt

SEQ ID NO: 477293 - DNA, 25 bp, Rattus norvegicus
gtaatccacctcttcagctatgagt

SEQ ID NO: 477294 - DNA, 25 bp, Rattus norvegicus
gtaatccactagacatactcatatg

SEQ ID NO: 477295 - DNA, 25 bp, Rattus norvegicus
gtaatccactagtcatactcatatg

SEQ ID NO: 477296 - DNA, 25 bp, Rattus norvegicus
gtaatccactcaaacctataatccc

SEQ ID NO: 477297 - DNA, 25 bp, Rattus norvegicus
gtaatccactcatacctataatccc

SEQ ID NO: 477298 - DNA, 25 bp, Rattus norvegicus
gtaatccagcggcagactgtaagga

SEQ ID NO: 477299 - DNA, 25 bp, Rattus norvegicus
gtaatccagcgggagactgtaagga

SEQ ID NO: 477300 - DNA, 25 bp, Rattus norvegicus
gtaatccaggttccatctaccatgc

SEQ ID NO: 477301 - DNA, 25 bp, Rattus norvegicus
gtaatccaggttgcatctaccatgc

SEQ ID NO: 477302 - DNA, 25 bp, Rattus norvegicus
gtaatccatgtaccacgtgttgcat

SEQ ID NO: 477303 - DNA, 25 bp, Rattus norvegicus
gtaatccatgtagcacgtgttgcat

SEQ ID NO: 477304 - DNA, 25 bp, Rattus norvegicus
gtaatcccaaccctcaagcagtaga

SEQ ID NO: 477305 - DNA, 25 bp, Rattus norvegicus
gtaatcccaaccgtcaagcagtaga

SEQ ID NO: 477306 - DNA, 25 bp, Rattus norvegicus
gtaatcccaagacgcgtgctaacac

SEQ ID NO: 477307 - DNA, 25 bp, Rattus norvegicus
gtaatcccaagaggcgtgctaacac

SEQ ID NO: 477308 - DNA, 25 bp, Rattus norvegicus
gtaatcccaccacatgtacagtaag

SEQ ID NO: 477309 - DNA, 25 bp, Rattus norvegicus
gtaatcccaccagatgtacagtaag

SEQ ID NO: 477310 - DNA, 25 bp, Rattus norvegicus
gtaatcccacccagtcaaatcaagt

SEQ ID NO: 477311 - DNA, 25 bp, Rattus norvegicus
gtaatcccaccctgtcaaatcaagt

SEQ ID NO: 477312 - DNA, 25 bp, Rattus norvegicus
gtaatcccaggaccgaggaagctga

SEQ ID NO: 477313 - DNA, 25 bp, Rattus norvegicus
gtaatcccaggagcgaggaagctga

SEQ ID NO: 477314 - DNA, 25 bp, Rattus norvegicus
gtaatccctaggcttcaaccctgtt

SEQ ID NO: 477315 - DNA, 25 bp, Rattus norvegicus
gtaatccctagggttcaaccctgtt

SEQ ID NO: 477316 - DNA, 25 bp, Rattus norvegicus
gtaatccctgctccaaatgttttta

SEQ ID NO: 477317 - DNA, 25 bp, Rattus norvegicus
gtaatccctgctgcaaatgttttta

SEQ ID NO: 477318 - DNA, 25 bp, Rattus norvegicus
gtaatcccttatagatactcctgta

SEQ ID NO: 477319 - DNA, 25 bp, Rattus norvegicus
gtaatcccttattgatactcctgta

SEQ ID NO: 477320 - DNA, 25 bp, Rattus norvegicus
gtaatcctaaatactctcgagtaaa

SEQ ID NO: 477321 - DNA, 25 bp, Rattus norvegicus
gtaatcctaaattctctcgagtaaa

SEQ ID NO: 477322 - DNA, 25 bp, Rattus norvegicus
gtaatcctaacactctccagtggag

SEQ ID NO: 477323 - DNA, 25 bp, Rattus norvegicus
gtaatcctaacagtctccagtggag

SEQ ID NO: 477324 - DNA, 25 bp, Rattus norvegicus
gtaatcctaactaggtctcacgcca

SEQ ID NO: 477325 - DNA, 25 bp, Rattus norvegicus
gtaatcctaacttggtctcacgcca

SEQ ID NO: 477326 - DNA, 25 bp, Rattus norvegicus
gtaatcctagcaaaggcgaagctga

SEQ ID NO: 477327 - DNA, 25 bp, Rattus norvegicus
gtaatcctagcaatctaccatttgg

SEQ ID NO: 477328 - DNA, 25 bp, Rattus norvegicus
gtaatcctagcataggcgaagctga

SEQ ID NO: 477329 - DNA, 25 bp, Rattus norvegicus
gtaatcctagcattctaccatttgg

SEQ ID NO: 477330 - DNA, 25 bp, Rattus norvegicus
gtaatcctagccatcggaaagtaga

SEQ ID NO: 477331 - DNA, 25 bp, Rattus norvegicus
gtaatcctagccttcggaaagtaga

SEQ ID NO: 477332 - DNA, 25 bp, Rattus norvegicus
gtaatcctctacagtatgctcacag

SEQ ID NO: 477333 - DNA, 25 bp, Rattus norvegicus
gtaatcctctactgtatgctcacag

SEQ ID NO: 477334 - DNA, 25 bp, Rattus norvegicus
gtaatcctgacacttgatgccatca

SEQ ID NO: 477335 - DNA, 25 bp, Rattus norvegicus
gtaatcctgacagttgatgccatca

SEQ ID NO: 477336 - DNA, 25 bp, Rattus norvegicus
gtaatcctgactcttgatgctttag

SEQ ID NO: 477337 - DNA, 25 bp, Rattus norvegicus
gtaatcctgactgttgatgctttag

SEQ ID NO: 477338 - DNA, 25 bp, Rattus norvegicus
gtaatcctgctaagtgtatgtattg

SEQ ID NO: 477339 - DNA, 25 bp, Rattus norvegicus
gtaatcctgctatgtgtatgtattg

SEQ ID NO: 477340 - DNA, 25 bp, Rattus norvegicus
gtaatcctggtacataagccatgtt

SEQ ID NO: 477341 - DNA, 25 bp, Rattus norvegicus
gtaatcctggtagataagccatgtt

SEQ ID NO: 477342 - DNA, 25 bp, Rattus norvegicus
gtaatcctgtatcagtttcctataa

SEQ ID NO: 477343 - DNA, 25 bp, Rattus norvegicus
gtaatcctgtatgagtttcctataa

SEQ ID NO: 477344 - DNA, 25 bp, Rattus norvegicus
gtaatccttgaaagagacccagttt

SEQ ID NO: 477345 - DNA, 25 bp, Rattus norvegicus
gtaatccttgaatgagacccagttt

SEQ ID NO: 477346 - DNA, 25 bp, Rattus norvegicus
gtaatcctttggctcagacttctcc

SEQ ID NO: 477347 - DNA, 25 bp, Rattus norvegicus
gtaatcctttgggtcagacttctcc

SEQ ID NO: 477348 - DNA, 25 bp, Rattus norvegicus
gtaatccttttcagttatgactgat

SEQ ID NO: 477349 - DNA, 25 bp, Rattus norvegicus
gtaatccttttctgttatgactgat

SEQ ID NO: 477350 - DNA, 25 bp, Rattus norvegicus
gtaatcgaccatcaaggagccgtgt

SEQ ID NO: 477351 - DNA, 25 bp, Rattus norvegicus
gtaatcgaccatgaaggagccgtgt

SEQ ID NO: 477352 - DNA, 25 bp, Rattus norvegicus
gtaatcgacttcctgttccatcaca

SEQ ID NO: 477353 - DNA, 25 bp, Rattus norvegicus
gtaatcgacttcgtgttccatcaca

SEQ ID NO: 477354 - DNA, 25 bp, Rattus norvegicus
gtaatcgcaagcataatagctcctg

SEQ ID NO: 477355 - DNA, 25 bp, Rattus norvegicus
gtaatcgcaagcttaatagctcctg

SEQ ID NO: 477356 - DNA, 25 bp, Rattus norvegicus
gtaatcgccccgaccggtgtggaga

SEQ ID NO: 477357 - DNA, 25 bp, Rattus norvegicus
gtaatcgccccgtccggtgtggaga

SEQ ID NO: 477358 - DNA, 25 bp, Rattus norvegicus
gtaatcgcggccctcataggcgtat

SEQ ID NO: 477359 - DNA, 25 bp, Rattus norvegicus
gtaatcgcggccgtcataggcgtat

SEQ ID NO: 477360 - DNA, 25 bp, Rattus norvegicus
gtaatcgggactctagcacatcttg

SEQ ID NO: 477361 - DNA, 25 bp, Rattus norvegicus
gtaatcgggactgtagcacatcttg

SEQ ID NO: 477362 - DNA, 25 bp, Rattus norvegicus
gtaatcggttagcagctcctgctcc

SEQ ID NO: 477363 - DNA, 25 bp, Rattus norvegicus
gtaatcggttaggagctcctgctcc

SEQ ID NO: 477364 - DNA, 25 bp, Rattus norvegicus
gtaatcggtttcaaggttatgccca

SEQ ID NO: 477365 - DNA, 25 bp, Rattus norvegicus
gtaatcggtttctaggttatgccca

SEQ ID NO: 477366 - DNA, 25 bp, Rattus norvegicus
gtaatcgttgtcatatcatggttat

SEQ ID NO: 477367 - DNA, 25 bp, Rattus norvegicus
gtaatcgttgtcttatcatggttat

SEQ ID NO: 477368 - DNA, 25 bp, Rattus norvegicus
gtaatctaccaccatcaccatgtga

SEQ ID NO: 477369 - DNA, 25 bp, Rattus norvegicus
gtaatctaccacgatcaccatgtga

SEQ ID NO: 477370 - DNA, 25 bp, Rattus norvegicus
gtaatctaggcacggttttcataac

SEQ ID NO: 477371 - DNA, 25 bp, Rattus norvegicus
gtaatctaggcagggttttcataac

SEQ ID NO: 477372 - DNA, 25 bp, Rattus norvegicus
gtaatctcaacactgcaaaggcatg

SEQ ID NO: 477373 - DNA, 25 bp, Rattus norvegicus
gtaatctcaacagtgcaaaggcatg

SEQ ID NO: 477374 - DNA, 25 bp, Rattus norvegicus
gtaatctcaagtcttcttttctgat

SEQ ID NO: 477375 - DNA, 25 bp, Rattus norvegicus
gtaatctcaagtgttcttttctgat

SEQ ID NO: 477376 - DNA, 25 bp, Rattus norvegicus
gtaatctcacaccttgagtcacaat

SEQ ID NO: 477377 - DNA, 25 bp, Rattus norvegicus
gtaatctcacacgttgagtcacaat

SEQ ID NO: 477378 - DNA, 25 bp, Rattus norvegicus
gtaatctcatctacaggttcatgtc

SEQ ID NO: 477379 - DNA, 25 bp, Rattus norvegicus
gtaatctcatcttcaggttcatgtc

SEQ ID NO: 477380 - DNA, 25 bp, Rattus norvegicus
gtaatctccagtccacatgctgagg

SEQ ID NO: 477381 - DNA, 25 bp, Rattus norvegicus
gtaatctccagtcggtcttctacaa

SEQ ID NO: 477382 - DNA, 25 bp, Rattus norvegicus
gtaatctccagtgcacatgctgagg

SEQ ID NO: 477383 - DNA, 25 bp, Rattus norvegicus
gtaatctccagtgggtcttctacaa

SEQ ID NO: 477384 - DNA, 25 bp, Rattus norvegicus
gtaatctcgctcaccagaaaacgtg

SEQ ID NO: 477385 - DNA, 25 bp, Rattus norvegicus
gtaatctcgctctccagaaaacgtg

SEQ ID NO: 477386 - DNA, 25 bp, Rattus norvegicus
gtaatctctcagatttctatagcaa

SEQ ID NO: 477387 - DNA, 25 bp, Rattus norvegicus
gtaatctctcagttttctatagcaa

SEQ ID NO: 477388 - DNA, 25 bp, Rattus norvegicus
gtaatctctcatatttcatctaagc

SEQ ID NO: 477389 - DNA, 25 bp, Rattus norvegicus
gtaatctctcatttttcatctaagc

SEQ ID NO: 477390 - DNA, 25 bp, Rattus norvegicus
gtaatctctccacgcctgaaaactt

SEQ ID NO: 477391 - DNA, 25 bp, Rattus norvegicus
gtaatctctccaggcctgaaaactt

SEQ ID NO: 477392 - DNA, 25 bp, Rattus norvegicus
gtaatctgaagacacctgagctcca

SEQ ID NO: 477393 - DNA, 25 bp, Rattus norvegicus
gtaatctgaagagacctgagctcca

SEQ ID NO: 477394 - DNA, 25 bp, Rattus norvegicus
gtaatctgcagaccccttcagaaca

SEQ ID NO: 477395 - DNA, 25 bp, Rattus norvegicus
gtaatctgcagagcccttcagaaca

SEQ ID NO: 477396 - DNA, 25 bp, Rattus norvegicus
gtaatctgcaggacctcagaggtct

SEQ ID NO: 477397 - DNA, 25 bp, Rattus norvegicus
gtaatctgcaggtcctcagaggtct

SEQ ID NO: 477398 - DNA, 25 bp, Rattus norvegicus
gtaatctgcattcttgttcacttaa

SEQ ID NO: 477399 - DNA, 25 bp, Rattus norvegicus
gtaatctgcattgttgttcacttaa

SEQ ID NO: 477400 - DNA, 25 bp, Rattus norvegicus
gtaatctgtgacatccaaaccagga

SEQ ID NO: 477401 - DNA, 25 bp, Rattus norvegicus
gtaatctgtgacttccaaaccagga

SEQ ID NO: 477402 - DNA, 25 bp, Rattus norvegicus
gtaatctgttttaaagttcctgaat

SEQ ID NO: 477403 - DNA, 25 bp, Rattus norvegicus
gtaatctgtttttaagttcctgaat

SEQ ID NO: 477404 - DNA, 25 bp, Rattus norvegicus
gtaatcttagagaagtcttttgtgc

SEQ ID NO: 477405 - DNA, 25 bp, Rattus norvegicus
gtaatcttagagtagtcttttgtgc

SEQ ID NO: 477406 - DNA, 25 bp, Rattus norvegicus
gtaatcttatctcagctaggcagtg

SEQ ID NO: 477407 - DNA, 25 bp, Rattus norvegicus
gtaatcttatctgagctaggcagtg

SEQ ID NO: 477408 - DNA, 25 bp, Rattus norvegicus
gtaatcttcagtatgcttgttctat

SEQ ID NO: 477409 - DNA, 25 bp, Rattus norvegicus
gtaatcttcagtttgcttgttctat

SEQ ID NO: 477410 - DNA, 25 bp, Rattus norvegicus
gtaatcttcctaaggagacctgcaa

SEQ ID NO: 477411 - DNA, 25 bp, Rattus norvegicus
gtaatcttcctatggagacctgcaa

SEQ ID NO: 477412 - DNA, 25 bp, Rattus norvegicus
gtaatcttcctcatggatgtctcat

SEQ ID NO: 477413 - DNA, 25 bp, Rattus norvegicus
gtaatcttcctcttggatgtctcat

SEQ ID NO: 477414 - DNA, 25 bp, Rattus norvegicus
gtaatcttggcaatcaggagactga

SEQ ID NO: 477415 - DNA, 25 bp, Rattus norvegicus
gtaatcttggcattcaggagactga

SEQ ID NO: 477416 - DNA, 25 bp, Rattus norvegicus
gtaatcttgggacttgggaagacta

SEQ ID NO: 477417 - DNA, 25 bp, Rattus norvegicus
gtaatcttgggagttgggaagacta

SEQ ID NO: 477418 - DNA, 25 bp, Rattus norvegicus
gtaatcttgttcctaatcctgtgta

SEQ ID NO: 477419 - DNA, 25 bp, Rattus norvegicus
gtaatcttgttcgtaatcctgtgta

SEQ ID NO: 477420 - DNA, 25 bp, Rattus norvegicus
gtaatgaaatatccccatcgctgat

SEQ ID NO: 477421 - DNA, 25 bp, Rattus norvegicus
gtaatgaaatatgcccatcgctgat

SEQ ID NO: 477422 - DNA, 25 bp, Rattus norvegicus
gtaatgaactgcaggaggccaaccc

SEQ ID NO: 477423 - DNA, 25 bp, Rattus norvegicus
gtaatgaactgctggaggccaaccc

SEQ ID NO: 477424 - DNA, 25 bp, Rattus norvegicus
gtaatgacagccagcaagcctccag

SEQ ID NO: 477425 - DNA, 25 bp, Rattus norvegicus
gtaatgacagcctgcaagcctccag

SEQ ID NO: 477426 - DNA, 25 bp, Rattus norvegicus
gtaatgaccctaacgtgctaactgc

SEQ ID NO: 477427 - DNA, 25 bp, Rattus norvegicus
gtaatgaccctatcgtgctaactgc

SEQ ID NO: 477428 - DNA, 25 bp, Rattus norvegicus
gtaatgacctccctgataccataca

SEQ ID NO: 477429 - DNA, 25 bp, Rattus norvegicus
gtaatgacctccgtgataccataca

SEQ ID NO: 477430 - DNA, 25 bp, Rattus norvegicus
gtaatgaccttgcttgcttcagaaa

SEQ ID NO: 477431 - DNA, 25 bp, Rattus norvegicus
gtaatgaccttggttgcttcagaaa

SEQ ID NO: 477432 - DNA, 25 bp, Rattus norvegicus
gtaatgacctttcccaaagatgctc

SEQ ID NO: 477433 - DNA, 25 bp, Rattus norvegicus
gtaatgacctttgccaaagatgctc

SEQ ID NO: 477434 - DNA, 25 bp, Rattus norvegicus
gtaatgactagcacctgcaagtccc

SEQ ID NO: 477435 - DNA, 25 bp, Rattus norvegicus
gtaatgactagctcctgcaagtccc

SEQ ID NO: 477436 - DNA, 25 bp, Rattus norvegicus
gtaatgactttgcactgccgtgaaa

SEQ ID NO: 477437 - DNA, 25 bp, Rattus norvegicus
gtaatgactttggactgccgtgaaa

SEQ ID NO: 477438 - DNA, 25 bp, Rattus norvegicus
gtaatgagagctacaaactggacta

SEQ ID NO: 477439 - DNA, 25 bp, Rattus norvegicus
gtaatgagagcttcaaactggacta

SEQ ID NO: 477440 - DNA, 25 bp, Rattus norvegicus
gtaatgagcacacccaggtgcctct

SEQ ID NO: 477441 - DNA, 25 bp, Rattus norvegicus
gtaatgagcacagccaggtgcctct

SEQ ID NO: 477442 - DNA, 25 bp, Rattus norvegicus
gtaatgagcataatcctagcaggca

SEQ ID NO: 477443 - DNA, 25 bp, Rattus norvegicus
gtaatgagcatattcctagcaggca

SEQ ID NO: 477444 - DNA, 25 bp, Rattus norvegicus
gtaatgagccacacttaaggcaaaa

SEQ ID NO: 477445 - DNA, 25 bp, Rattus norvegicus
gtaatgagccactcttaaggcaaaa

SEQ ID NO: 477446 - DNA, 25 bp, Rattus norvegicus
gtaatgagcgttcatagtccttaga

SEQ ID NO: 477447 - DNA, 25 bp, Rattus norvegicus
gtaatgagcgttgatagtccttaga

SEQ ID NO: 477448 - DNA, 25 bp, Rattus norvegicus
gtaatgagtgtgatccagcctgtca

SEQ ID NO: 477449 - DNA, 25 bp, Rattus norvegicus
gtaatgagtgtgttccagcctgtca

SEQ ID NO: 477450 - DNA, 25 bp, Rattus norvegicus
gtaatgatccgaaattctctccctc

SEQ ID NO: 477451 - DNA, 25 bp, Rattus norvegicus
gtaatgatccgatattctctccctc

SEQ ID NO: 477452 - DNA, 25 bp, Rattus norvegicus
gtaatgatcttgcacacggtaggtg

SEQ ID NO: 477453 - DNA, 25 bp, Rattus norvegicus
gtaatgatcttggacacggtaggtg

SEQ ID NO: 477454 - DNA, 25 bp, Rattus norvegicus
gtaatgattcgcctttgagacctca

SEQ ID NO: 477455 - DNA, 25 bp, Rattus norvegicus
gtaatgattcgcgtttgagacctca

SEQ ID NO: 477456 - DNA, 25 bp, Rattus norvegicus
gtaatgattttcaagccagcttgta

SEQ ID NO: 477457 - DNA, 25 bp, Rattus norvegicus
gtaatgattttctagccagcttgta

SEQ ID NO: 477458 - DNA, 25 bp, Rattus norvegicus
gtaatgcaaagcattcgttctgaga

SEQ ID NO: 477459 - DNA, 25 bp, Rattus norvegicus
gtaatgcaaagctttcgttctgaga

SEQ ID NO: 477460 - DNA, 25 bp, Rattus norvegicus
gtaatgcaagacattttcccttcct

SEQ ID NO: 477461 - DNA, 25 bp, Rattus norvegicus
gtaatgcaagactttttcccttcct

SEQ ID NO: 477462 - DNA, 25 bp, Rattus norvegicus
gtaatgcacacgactcagacactag

SEQ ID NO: 477463 - DNA, 25 bp, Rattus norvegicus
gtaatgcacacgtctcagacactag

SEQ ID NO: 477464 - DNA, 25 bp, Rattus norvegicus
gtaatgcacagtaggctccatcggg

SEQ ID NO: 477465 - DNA, 25 bp, Rattus norvegicus
gtaatgcacagttggctccatcggg

SEQ ID NO: 477466 - DNA, 25 bp, Rattus norvegicus
gtaatgcacattactaaacaccgag

SEQ ID NO: 477467 - DNA, 25 bp, Rattus norvegicus
gtaatgcacatttctaaacaccgag

SEQ ID NO: 477468 - DNA, 25 bp, Rattus norvegicus
gtaatgcagatgaccctggtaccct

SEQ ID NO: 477469 - DNA, 25 bp, Rattus norvegicus
gtaatgcagatgtccctggtaccct

SEQ ID NO: 477470 - DNA, 25 bp, Rattus norvegicus
gtaatgcagttacagcaaacactgg

SEQ ID NO: 477471 - DNA, 25 bp, Rattus norvegicus
gtaatgcagttagagcaaacactgg

SEQ ID NO: 477472 - DNA, 25 bp, Rattus norvegicus
gtaatgcatattccagcctcaggag

SEQ ID NO: 477473 - DNA, 25 bp, Rattus norvegicus
gtaatgcatattgcagcctcaggag

SEQ ID NO: 477474 - DNA, 25 bp, Rattus norvegicus
gtaatgcatgcccttacgtgacagc

SEQ ID NO: 477475 - DNA, 25 bp, Rattus norvegicus
gtaatgcatgccgttacgtgacagc

SEQ ID NO: 477476 - DNA, 25 bp, Rattus norvegicus
gtaatgccaaagagtgccccaggat

SEQ ID NO: 477477 - DNA, 25 bp, Rattus norvegicus
gtaatgccaaagtgtgccccaggat

SEQ ID NO: 477478 - DNA, 25 bp, Rattus norvegicus
gtaatgccaacaagacacagcttgt

SEQ ID NO: 477479 - DNA, 25 bp, Rattus norvegicus
gtaatgccaacatgacacagcttgt

SEQ ID NO: 477480 - DNA, 25 bp, Rattus norvegicus
gtaatgccaagaactgacaacgcca

SEQ ID NO: 477481 - DNA, 25 bp, Rattus norvegicus
gtaatgccaagatctgacaacgcca

SEQ ID NO: 477482 - DNA, 25 bp, Rattus norvegicus
gtaatgccaagtacttcagccaaat

SEQ ID NO: 477483 - DNA, 25 bp, Rattus norvegicus
gtaatgccaagttcttcagccaaat

SEQ ID NO: 477484 - DNA, 25 bp, Rattus norvegicus
gtaatgccatagacttttccagaag

SEQ ID NO: 477485 - DNA, 25 bp, Rattus norvegicus
gtaatgccatagtcttttccagaag

SEQ ID NO: 477486 - DNA, 25 bp, Rattus norvegicus
gtaatgccattcattagcatcctta

SEQ ID NO: 477487 - DNA, 25 bp, Rattus norvegicus
gtaatgccattctttagcatcctta

SEQ ID NO: 477488 - DNA, 25 bp, Rattus norvegicus
gtaatgccccatcttgacttggtgg

SEQ ID NO: 477489 - DNA, 25 bp, Rattus norvegicus
gtaatgccccatgttgacttggtgg

SEQ ID NO: 477490 - DNA, 25 bp, Rattus norvegicus
gtaatgccctttcaatgcaactttt

SEQ ID NO: 477491 - DNA, 25 bp, Rattus norvegicus
gtaatgccctttgaatgcaactttt

SEQ ID NO: 477492 - DNA, 25 bp, Rattus norvegicus
gtaatgccttttatgctcaggaggg

SEQ ID NO: 477493 - DNA, 25 bp, Rattus norvegicus
gtaatgccttttttgctcaggaggg

SEQ ID NO: 477494 - DNA, 25 bp, Rattus norvegicus
gtaatgctaccaaaacctcatcaag

SEQ ID NO: 477495 - DNA, 25 bp, Rattus norvegicus
gtaatgctaccataacctcatcaag

SEQ ID NO: 477496 - DNA, 25 bp, Rattus norvegicus
gtaatgctagtcaccgaaaacataa

SEQ ID NO: 477497 - DNA, 25 bp, Rattus norvegicus
gtaatgctagtctccgaaaacataa

SEQ ID NO: 477498 - DNA, 25 bp, Rattus norvegicus
gtaatgctatccacatcttttcagt

SEQ ID NO: 477499 - DNA, 25 bp, Rattus norvegicus
gtaatgctatcctcatcttttcagt

SEQ ID NO: 477500 - DNA, 25 bp, Rattus norvegicus
gtaatgctattacccttgctacttt

SEQ ID NO: 477501 - DNA, 25 bp, Rattus norvegicus
gtaatgctattagccttgctacttt

SEQ ID NO: 477502 - DNA, 25 bp, Rattus norvegicus
gtaatgctcatacttaatttggttt

SEQ ID NO: 477503 - DNA, 25 bp, Rattus norvegicus
gtaatgctcatagttaatttggttt

SEQ ID NO: 477504 - DNA, 25 bp, Rattus norvegicus
gtaatgctctttctactttactgta

SEQ ID NO: 477505 - DNA, 25 bp, Rattus norvegicus
gtaatgctctttgtactttactgta

SEQ ID NO: 477506 - DNA, 25 bp, Rattus norvegicus
gtaatgctgtctatatttgatcttc

SEQ ID NO: 477507 - DNA, 25 bp, Rattus norvegicus
gtaatgctgtctttatttgatcttc

SEQ ID NO: 477508 - DNA, 25 bp, Rattus norvegicus
gtaatgctgttgatacttatcatca

SEQ ID NO: 477509 - DNA, 25 bp, Rattus norvegicus
gtaatgctgttgttacttatcatca

SEQ ID NO: 477510 - DNA, 25 bp, Rattus norvegicus
gtaatgcttagtattctactctgtc

SEQ ID NO: 477511 - DNA, 25 bp, Rattus norvegicus
gtaatgcttagttttctactctgtc

SEQ ID NO: 477512 - DNA, 25 bp, Rattus norvegicus
gtaatgcttctcagttctgtgtaac

SEQ ID NO: 477513 - DNA, 25 bp, Rattus norvegicus
gtaatgcttctctgttctgtgtaac

SEQ ID NO: 477514 - DNA, 25 bp, Rattus norvegicus
gtaatgcttgtgacctcatttcctg

SEQ ID NO: 477515 - DNA, 25 bp, Rattus norvegicus
gtaatgcttgtgtcctcatttcctg

SEQ ID NO: 477516 - DNA, 25 bp, Rattus norvegicus
gtaatggaatagattgctgccaact

SEQ ID NO: 477517 - DNA, 25 bp, Rattus norvegicus
gtaatggaatagtttgctgccaact

SEQ ID NO: 477518 - DNA, 25 bp, Rattus norvegicus
gtaatggactccaaaacactcagga

SEQ ID NO: 477519 - DNA, 25 bp, Rattus norvegicus
gtaatggactcctaaacactcagga

SEQ ID NO: 477520 - DNA, 25 bp, Rattus norvegicus
gtaatggagttgatagcacaccctc

SEQ ID NO: 477521 - DNA, 25 bp, Rattus norvegicus
gtaatggagttgttagcacaccctc

SEQ ID NO: 477522 - DNA, 25 bp, Rattus norvegicus
gtaatggagtttcctcttcacgggc

SEQ ID NO: 477523 - DNA, 25 bp, Rattus norvegicus
gtaatggagtttgctcttcacgggc

SEQ ID NO: 477524 - DNA, 25 bp, Rattus norvegicus
gtaatggatgctagtgagccgccgt

SEQ ID NO: 477525 - DNA, 25 bp, Rattus norvegicus
gtaatggatgcttgtgagccgccgt

SEQ ID NO: 477526 - DNA, 25 bp, Rattus norvegicus
gtaatggcaaaacctatcccggctt

SEQ ID NO: 477527 - DNA, 25 bp, Rattus norvegicus
gtaatggcaaaagctatcccggctt

SEQ ID NO: 477528 - DNA, 25 bp, Rattus norvegicus
gtaatggcaataccacaggccccaa

SEQ ID NO: 477529 - DNA, 25 bp, Rattus norvegicus
gtaatggcaatagcacaggccccaa

SEQ ID NO: 477530 - DNA, 25 bp, Rattus norvegicus
gtaatggcacctaagctttgaagta

SEQ ID NO: 477531 - DNA, 25 bp, Rattus norvegicus
gtaatggcaccttagctttgaagta

SEQ ID NO: 477532 - DNA, 25 bp, Rattus norvegicus
gtaatggcatctaacttctcatata

SEQ ID NO: 477533 - DNA, 25 bp, Rattus norvegicus
gtaatggcatcttacttctcatata

SEQ ID NO: 477534 - DNA, 25 bp, Rattus norvegicus
gtaatggccggtccgtgttcctcca

SEQ ID NO: 477535 - DNA, 25 bp, Rattus norvegicus
gtaatggccggtgcgtgttcctcca

SEQ ID NO: 477536 - DNA, 25 bp, Rattus norvegicus
gtaatggctccaacttatagggaaa

SEQ ID NO: 477537 - DNA, 25 bp, Rattus norvegicus
gtaatggctccatcttatagggaaa

SEQ ID NO: 477538 - DNA, 25 bp, Rattus norvegicus
gtaatggctgacaacagtctgtatc

SEQ ID NO: 477539 - DNA, 25 bp, Rattus norvegicus
gtaatggctgactacagtctgtatc

SEQ ID NO: 477540 - DNA, 25 bp, Rattus norvegicus
gtaatgggcccacatttcagtccag

SEQ ID NO: 477541 - DNA, 25 bp, Rattus norvegicus
gtaatgggcccagatttcagtccag

SEQ ID NO: 477542 - DNA, 25 bp, Rattus norvegicus
gtaatgggcctaactgtacattcaa

SEQ ID NO: 477543 - DNA, 25 bp, Rattus norvegicus
gtaatgggcctatctgtacattcaa

SEQ ID NO: 477544 - DNA, 25 bp, Rattus norvegicus
gtaatgggcgtgaattctcacgtca

SEQ ID NO: 477545 - DNA, 25 bp, Rattus norvegicus
gtaatgggcgtgtattctcacgtca

SEQ ID NO: 477546 - DNA, 25 bp, Rattus norvegicus
gtaatgggtaccaggccaggtttat

SEQ ID NO: 477547 - DNA, 25 bp, Rattus norvegicus
gtaatgggtacctggccaggtttat

SEQ ID NO: 477548 - DNA, 25 bp, Rattus norvegicus
gtaatgggtgcaattgaccgtcccg

SEQ ID NO: 477549 - DNA, 25 bp, Rattus norvegicus
gtaatgggtgcatttgaccgtcccg

SEQ ID NO: 477550 - DNA, 25 bp, Rattus norvegicus
gtaatggtaccaacatacatataaa

SEQ ID NO: 477551 - DNA, 25 bp, Rattus norvegicus
gtaatggtaccatcatacatataaa

SEQ ID NO: 477552 - DNA, 25 bp, Rattus norvegicus
gtaatggtagatccagccgctgtac

SEQ ID NO: 477553 - DNA, 25 bp, Rattus norvegicus
gtaatggtagatgcagccgctgtac

SEQ ID NO: 477554 - DNA, 25 bp, Rattus norvegicus
gtaatggtgcttatcctgggatgga

SEQ ID NO: 477555 - DNA, 25 bp, Rattus norvegicus
gtaatggtgcttttcctgggatgga

SEQ ID NO: 477556 - DNA, 25 bp, Rattus norvegicus
gtaatggtgggaactctgcacctgt

SEQ ID NO: 477557 - DNA, 25 bp, Rattus norvegicus
gtaatggtgggatctctgcacctgt

SEQ ID NO: 477558 - DNA, 25 bp, Rattus norvegicus
gtaatggtgtttaatctcccggaat

SEQ ID NO: 477559 - DNA, 25 bp, Rattus norvegicus
gtaatggtgttttatctcccggaat

SEQ ID NO: 477560 - DNA, 25 bp, Rattus norvegicus
gtaatggttaccaaatgtcactgta

SEQ ID NO: 477561 - DNA, 25 bp, Rattus norvegicus
gtaatggttacctaatgtcactgta

SEQ ID NO: 477562 - DNA, 25 bp, Rattus norvegicus
gtaatggttgccaggcaccagcaac

SEQ ID NO: 477563 - DNA, 25 bp, Rattus norvegicus
gtaatggttgcctggcaccagcaac

SEQ ID NO: 477564 - DNA, 25 bp, Rattus norvegicus
gtaatggttgtcaattgtttcttaa

SEQ ID NO: 477565 - DNA, 25 bp, Rattus norvegicus
gtaatggttgtctattgtttcttaa

SEQ ID NO: 477566 - DNA, 25 bp, Rattus norvegicus
gtaatggtttctactctgtactaat

SEQ ID NO: 477567 - DNA, 25 bp, Rattus norvegicus
gtaatggtttcttctctgtactaat

SEQ ID NO: 477568 - DNA, 25 bp, Rattus norvegicus
gtaatggtttggatcacttatctga

SEQ ID NO: 477569 - DNA, 25 bp, Rattus norvegicus
gtaatggtttggttcacttatctga

SEQ ID NO: 477570 - DNA, 25 bp, Rattus norvegicus
gtaatgtaaccaagtcagtcatctg

SEQ ID NO: 477571 - DNA, 25 bp, Rattus norvegicus
gtaatgtaaccatgtcagtcatctg

SEQ ID NO: 477572 - DNA, 25 bp, Rattus norvegicus
gtaatgtaagtgaatgtccaacact

SEQ ID NO: 477573 - DNA, 25 bp, Rattus norvegicus
gtaatgtaagtgtatgtccaacact

SEQ ID NO: 477574 - DNA, 25 bp, Rattus norvegicus
gtaatgtatagccttagctccatga

SEQ ID NO: 477575 - DNA, 25 bp, Rattus norvegicus
gtaatgtatagcgttagctccatga

SEQ ID NO: 477576 - DNA, 25 bp, Rattus norvegicus
gtaatgtcaacgatatccagccgga

SEQ ID NO: 477577 - DNA, 25 bp, Rattus norvegicus
gtaatgtcaacgttatccagccgga

SEQ ID NO: 477578 - DNA, 25 bp, Rattus norvegicus
gtaatgtcagctccctttacacaag

SEQ ID NO: 477579 - DNA, 25 bp, Rattus norvegicus
gtaatgtcagctgcctttacacaag

SEQ ID NO: 477580 - DNA, 25 bp, Rattus norvegicus
gtaatgtcagtaacagcccctgctg

SEQ ID NO: 477581 - DNA, 25 bp, Rattus norvegicus
gtaatgtcagtatcagcccctgctg

SEQ ID NO: 477582 - DNA, 25 bp, Rattus norvegicus
gtaatgtcgggaccatcagtcagtt

SEQ ID NO: 477583 - DNA, 25 bp, Rattus norvegicus
gtaatgtcgggagcatcagtcagtt

SEQ ID NO: 477584 - DNA, 25 bp, Rattus norvegicus
gtaatgtctgggatgcactcaaagc

SEQ ID NO: 477585 - DNA, 25 bp, Rattus norvegicus
gtaatgtctgggttgcactcaaagc

SEQ ID NO: 477586 - DNA, 25 bp, Rattus norvegicus
gtaatgtgaatacaggctccctggt

SEQ ID NO: 477587 - DNA, 25 bp, Rattus norvegicus
gtaatgtgaatagaggctccctggt

SEQ ID NO: 477588 - DNA, 25 bp, Rattus norvegicus
gtaatgtgacctattcaacccaagt

SEQ ID NO: 477589 - DNA, 25 bp, Rattus norvegicus
gtaatgtgaccttttcaacccaagt

SEQ ID NO: 477590 - DNA, 25 bp, Rattus norvegicus
gtaatgtgcatacgcgagatgactc

SEQ ID NO: 477591 - DNA, 25 bp, Rattus norvegicus
gtaatgtgcataggcgagatgactc

SEQ ID NO: 477592 - DNA, 25 bp, Rattus norvegicus
gtaatgtgctttccatcctgaatca

SEQ ID NO: 477593 - DNA, 25 bp, Rattus norvegicus
gtaatgtgctttctctgttttgtaa

SEQ ID NO: 477594 - DNA, 25 bp, Rattus norvegicus
gtaatgtgctttgcatcctgaatca

SEQ ID NO: 477595 - DNA, 25 bp, Rattus norvegicus
gtaatgtgctttgtctgttttgtaa

SEQ ID NO: 477596 - DNA, 25 bp, Rattus norvegicus
gtaatgtgtgctccaacctcaccag

SEQ ID NO: 477597 - DNA, 25 bp, Rattus norvegicus
gtaatgtgtgctgcaacctcaccag

SEQ ID NO: 477598 - DNA, 25 bp, Rattus norvegicus
gtaatgtgtgttaaccaaggccttc

SEQ ID NO: 477599 - DNA, 25 bp, Rattus norvegicus
gtaatgtgtgtttaccaaggccttc

SEQ ID NO: 477600 - DNA, 25 bp, Rattus norvegicus
gtaatgtgttacaggtgaccagtgc

SEQ ID NO: 477601 - DNA, 25 bp, Rattus norvegicus
gtaatgtgttactggtgaccagtgc

SEQ ID NO: 477602 - DNA, 25 bp, Rattus norvegicus
gtaatgttacaaacaggacccctgt

SEQ ID NO: 477603 - DNA, 25 bp, Rattus norvegicus
gtaatgttacaatcaggacccctgt

SEQ ID NO: 477604 - DNA, 25 bp, Rattus norvegicus
gtaatgttcactcccaagcactcat

SEQ ID NO: 477605 - DNA, 25 bp, Rattus norvegicus
gtaatgttcactgccaagcactcat

SEQ ID NO: 477606 - DNA, 25 bp, Rattus norvegicus
gtaatgttcctcatgacactcttgc

SEQ ID NO: 477607 - DNA, 25 bp, Rattus norvegicus
gtaatgttcctcttgacactcttgc

SEQ ID NO: 477608 - DNA, 25 bp, Rattus norvegicus
gtaatgttgctgatctctagttgga

SEQ ID NO: 477609 - DNA, 25 bp, Rattus norvegicus
gtaatgttgctgttctctagttgga

SEQ ID NO: 477610 - DNA, 25 bp, Rattus norvegicus
gtaatgttgtacatacacttctgta

SEQ ID NO: 477611 - DNA, 25 bp, Rattus norvegicus
gtaatgttgtacttacacttctgta

SEQ ID NO: 477612 - DNA, 25 bp, Rattus norvegicus
gtaatgtttatgagtcctccttttc

SEQ ID NO: 477613 - DNA, 25 bp, Rattus norvegicus
gtaatgtttatgtgtcctccttttc

SEQ ID NO: 477614 - DNA, 25 bp, Rattus norvegicus
gtaatgtttcaacgcatgctggcac

SEQ ID NO: 477615 - DNA, 25 bp, Rattus norvegicus
gtaatgtttcaaggcatgctggcac

SEQ ID NO: 477616 - DNA, 25 bp, Rattus norvegicus
gtaatgtttcagaccatcatccagc

SEQ ID NO: 477617 - DNA, 25 bp, Rattus norvegicus
gtaatgtttcagtccatcatccagc

SEQ ID NO: 477618 - DNA, 25 bp, Rattus norvegicus
gtaatgtttgctaatccatcaatag

SEQ ID NO: 477619 - DNA, 25 bp, Rattus norvegicus
gtaatgtttgcttatccatcaatag

SEQ ID NO: 477620 - DNA, 25 bp, Rattus norvegicus
gtaatgtttgtccaggtgcctcagt

SEQ ID NO: 477621 - DNA, 25 bp, Rattus norvegicus
gtaatgtttgtcgaggtgcctcagt

SEQ ID NO: 477622 - DNA, 25 bp, Rattus norvegicus
gtaatgttttcaagccctgtgaatc

SEQ ID NO: 477623 - DNA, 25 bp, Rattus norvegicus
gtaatgttttcatgccctgtgaatc

SEQ ID NO: 477624 - DNA, 25 bp, Rattus norvegicus
gtaatgttttgtcgcctcaactgaa

SEQ ID NO: 477625 - DNA, 25 bp, Rattus norvegicus
gtaatgttttgtggcctcaactgaa

SEQ ID NO: 477626 - DNA, 25 bp, Rattus norvegicus
gtaattacatgtagggagcaatgcc

SEQ ID NO: 477627 - DNA, 25 bp, Rattus norvegicus
gtaattacatgttgggagcaatgcc

SEQ ID NO: 477628 - DNA, 25 bp, Rattus norvegicus
gtaattacctgtctcatgaacaaag

SEQ ID NO: 477629 - DNA, 25 bp, Rattus norvegicus
gtaattacctgtgtcatgaacaaag

SEQ ID NO: 477630 - DNA, 25 bp, Rattus norvegicus
gtaattacggtgatgggcctaaaca

SEQ ID NO: 477631 - DNA, 25 bp, Rattus norvegicus
gtaattacggtgttgggcctaaaca

SEQ ID NO: 477632 - DNA, 25 bp, Rattus norvegicus
gtaattacttcccaaatgccttcag

SEQ ID NO: 477633 - DNA, 25 bp, Rattus norvegicus
gtaattacttccgaaatgccttcag

SEQ ID NO: 477634 - DNA, 25 bp, Rattus norvegicus
gtaattagagagatcctcctgttga

SEQ ID NO: 477635 - DNA, 25 bp, Rattus norvegicus
gtaattagagagttcctcctgttga

SEQ ID NO: 477636 - DNA, 25 bp, Rattus norvegicus
gtaattagccataatgcccttctgg

SEQ ID NO: 477637 - DNA, 25 bp, Rattus norvegicus
gtaattagccattatgcccttctgg

SEQ ID NO: 477638 - DNA, 25 bp, Rattus norvegicus
gtaattaggactccattccttccat

SEQ ID NO: 477639 - DNA, 25 bp, Rattus norvegicus
gtaattaggactgcattccttccat

SEQ ID NO: 477640 - DNA, 25 bp, Rattus norvegicus
gtaattagttccatattgcttcata

SEQ ID NO: 477641 - DNA, 25 bp, Rattus norvegicus
gtaattagttccttattgcttcata

SEQ ID NO: 477642 - DNA, 25 bp, Rattus norvegicus
gtaattatctctctatccttttgta

SEQ ID NO: 477643 - DNA, 25 bp, Rattus norvegicus
gtaattatctctgtatccttttgta

SEQ ID NO: 477644 - DNA, 25 bp, Rattus norvegicus
gtaattatgattccgagtggcacct

SEQ ID NO: 477645 - DNA, 25 bp, Rattus norvegicus
gtaattatgattgcgagtggcacct

SEQ ID NO: 477646 - DNA, 25 bp, Rattus norvegicus
gtaattatggccacacagcaagata

SEQ ID NO: 477647 - DNA, 25 bp, Rattus norvegicus
gtaattatggcctcacagcaagata

SEQ ID NO: 477648 - DNA, 25 bp, Rattus norvegicus
gtaattatgtacagcttaacccagc

SEQ ID NO: 477649 - DNA, 25 bp, Rattus norvegicus
gtaattatgtactgcttaacccagc

SEQ ID NO: 477650 - DNA, 25 bp, Rattus norvegicus
gtaattattcctagtcgggttatgc

SEQ ID NO: 477651 - DNA, 25 bp, Rattus norvegicus
gtaattattccttgtcgggttatgc

SEQ ID NO: 477652 - DNA, 25 bp, Rattus norvegicus
gtaattattcgcacagctatttcat

SEQ ID NO: 477653 - DNA, 25 bp, Rattus norvegicus
gtaattattcgctcagctatttcat

SEQ ID NO: 477654 - DNA, 25 bp, Rattus norvegicus
gtaattattcttcatccagtacttg

SEQ ID NO: 477655 - DNA, 25 bp, Rattus norvegicus
gtaattattcttgatccagtacttg

SEQ ID NO: 477656 - DNA, 25 bp, Rattus norvegicus
gtaattattggcaggctgtcgctcc

SEQ ID NO: 477657 - DNA, 25 bp, Rattus norvegicus
gtaattattggctggctgtcgctcc

SEQ ID NO: 477658 - DNA, 25 bp, Rattus norvegicus
gtaattatttaacatgcctgttttt

SEQ ID NO: 477659 - DNA, 25 bp, Rattus norvegicus
gtaattatttaagatgcctgttttt

SEQ ID NO: 477660 - DNA, 25 bp, Rattus norvegicus
gtaattcaacgcacgcatttaacag

SEQ ID NO: 477661 - DNA, 25 bp, Rattus norvegicus
gtaattcaacgctcgcatttaacag

SEQ ID NO: 477662 - DNA, 25 bp, Rattus norvegicus
gtaattcaatttctccttgcacagc

SEQ ID NO: 477663 - DNA, 25 bp, Rattus norvegicus
gtaattcaatttgtccttgcacagc

SEQ ID NO: 477664 - DNA, 25 bp, Rattus norvegicus
gtaattcacattctaaacgtcgcca

SEQ ID NO: 477665 - DNA, 25 bp, Rattus norvegicus
gtaattcacattgtaaacgtcgcca

SEQ ID NO: 477666 - DNA, 25 bp, Rattus norvegicus
gtaattcaccgtaatatactttatg

SEQ ID NO: 477667 - DNA, 25 bp, Rattus norvegicus
gtaattcaccgttatatactttatg

SEQ ID NO: 477668 - DNA, 25 bp, Rattus norvegicus
gtaattcagccaagaaacgtgttgc

SEQ ID NO: 477669 - DNA, 25 bp, Rattus norvegicus
gtaattcagccatgaaacgtgttgc

SEQ ID NO: 477670 - DNA, 25 bp, Rattus norvegicus
gtaattcagtttaatgttgaccaaa

SEQ ID NO: 477671 - DNA, 25 bp, Rattus norvegicus
gtaattcagtttatcttcaaaatga

SEQ ID NO: 477672 - DNA, 25 bp, Rattus norvegicus
gtaattcagttttatgttgaccaaa

SEQ ID NO: 477673 - DNA, 25 bp, Rattus norvegicus
gtaattcagtttttcttcaaaatga

SEQ ID NO: 477674 - DNA, 25 bp, Rattus norvegicus
gtaattcattccctcaactgcaggt

SEQ ID NO: 477675 - DNA, 25 bp, Rattus norvegicus
gtaattcattccgtcaactgcaggt

SEQ ID NO: 477676 - DNA, 25 bp, Rattus norvegicus
gtaattcattgcagatcctccagga

SEQ ID NO: 477677 - DNA, 25 bp, Rattus norvegicus
gtaattcattgctgatcctccagga

SEQ ID NO: 477678 - DNA, 25 bp, Rattus norvegicus
gtaattccaagtagtatcacaccag

SEQ ID NO: 477679 - DNA, 25 bp, Rattus norvegicus
gtaattccaagttgtatcacaccag

SEQ ID NO: 477680 - DNA, 25 bp, Rattus norvegicus
gtaattccactcctctaacagatct

SEQ ID NO: 477681 - DNA, 25 bp, Rattus norvegicus
gtaattccactcgtctaacagatct

SEQ ID NO: 477682 - DNA, 25 bp, Rattus norvegicus
gtaattccacttctaagggatccaa

SEQ ID NO: 477683 - DNA, 25 bp, Rattus norvegicus
gtaattccacttgtaagggatccaa

SEQ ID NO: 477684 - DNA, 25 bp, Rattus norvegicus
gtaattccaggtcctgcgcttggca

SEQ ID NO: 477685 - DNA, 25 bp, Rattus norvegicus
gtaattccaggtgctgcgcttggca

SEQ ID NO: 477686 - DNA, 25 bp, Rattus norvegicus
gtaattccatagaccagtggagtga

SEQ ID NO: 477687 - DNA, 25 bp, Rattus norvegicus
gtaattccatagtccagtggagtga

SEQ ID NO: 477688 - DNA, 25 bp, Rattus norvegicus
gtaattccatcaatccatgtctgtg

SEQ ID NO: 477689 - DNA, 25 bp, Rattus norvegicus
gtaattccatcattccatgtctgtg

SEQ ID NO: 477690 - DNA, 25 bp, Rattus norvegicus
gtaattccattccattctattgttt

SEQ ID NO: 477691 - DNA, 25 bp, Rattus norvegicus
gtaattccattcgattctattgttt

SEQ ID NO: 477692 - DNA, 25 bp, Rattus norvegicus
gtaattccatttagattcctttcct

SEQ ID NO: 477693 - DNA, 25 bp, Rattus norvegicus
gtaattccattttgattcctttcct

SEQ ID NO: 477694 - DNA, 25 bp, Rattus norvegicus
gtaattcctacccaggcttcaccgt

SEQ ID NO: 477695 - DNA, 25 bp, Rattus norvegicus
gtaattcctaccgaggcttcaccgt

SEQ ID NO: 477696 - DNA, 25 bp, Rattus norvegicus
gtaattcctctacctcgagttctaa

SEQ ID NO: 477697 - DNA, 25 bp, Rattus norvegicus
gtaattcctctagctcgagttctaa

SEQ ID NO: 477698 - DNA, 25 bp, Rattus norvegicus
gtaattcctgatagtggaccccagt

SEQ ID NO: 477699 - DNA, 25 bp, Rattus norvegicus
gtaattcctgattgtggaccccagt

SEQ ID NO: 477700 - DNA, 25 bp, Rattus norvegicus
gtaattcctgtccactgtaaaactg

SEQ ID NO: 477701 - DNA, 25 bp, Rattus norvegicus
gtaattcctgtcgactgtaaaactg

SEQ ID NO: 477702 - DNA, 25 bp, Rattus norvegicus
gtaattccttcactattctcgtgtc

SEQ ID NO: 477703 - DNA, 25 bp, Rattus norvegicus
gtaattccttcagtattctcgtgtc

SEQ ID NO: 477704 - DNA, 25 bp, Rattus norvegicus
gtaattctacaaactgcatgtgggt

SEQ ID NO: 477705 - DNA, 25 bp, Rattus norvegicus
gtaattctacaatctgcatgtgggt

SEQ ID NO: 477706 - DNA, 25 bp, Rattus norvegicus
gtaattctaggtactaaccgtgcca

SEQ ID NO: 477707 - DNA, 25 bp, Rattus norvegicus
gtaattctaggttctaaccgtgcca

SEQ ID NO: 477708 - DNA, 25 bp, Rattus norvegicus
gtaattctcacaagctcgaaagccc

SEQ ID NO: 477709 - DNA, 25 bp, Rattus norvegicus
gtaattctcacatgctcgaaagccc

SEQ ID NO: 477710 - DNA, 25 bp, Rattus norvegicus
gtaattctcagaattctcaaggcag

SEQ ID NO: 477711 - DNA, 25 bp, Rattus norvegicus
gtaattctcagatttctcaaggcag

SEQ ID NO: 477712 - DNA, 25 bp, Rattus norvegicus
gtaattctcctgaattcccatgtaa

SEQ ID NO: 477713 - DNA, 25 bp, Rattus norvegicus
gtaattctcctgtattcccatgtaa

SEQ ID NO: 477714 - DNA, 25 bp, Rattus norvegicus
gtaattctcgtcagtcacatgatga

SEQ ID NO: 477715 - DNA, 25 bp, Rattus norvegicus
gtaattctcgtctgtcacatgatga

SEQ ID NO: 477716 - DNA, 25 bp, Rattus norvegicus
gtaattctcttgacttgtgaaagtg

SEQ ID NO: 477717 - DNA, 25 bp, Rattus norvegicus
gtaattctcttgtcttgtgaaagtg

SEQ ID NO: 477718 - DNA, 25 bp, Rattus norvegicus
gtaattctgccgaaggctcgatgcc

SEQ ID NO: 477719 - DNA, 25 bp, Rattus norvegicus
gtaattctgccgtaggctcgatgcc

SEQ ID NO: 477720 - DNA, 25 bp, Rattus norvegicus
gtaattctgctaagtgaacgcacat

SEQ ID NO: 477721 - DNA, 25 bp, Rattus norvegicus
gtaattctgctatgtgaacgcacat

SEQ ID NO: 477722 - DNA, 25 bp, Rattus norvegicus
gtaattcttcatcctttatctgata

SEQ ID NO: 477723 - DNA, 25 bp, Rattus norvegicus
gtaattcttcatgctttatctgata

SEQ ID NO: 477724 - DNA, 25 bp, Rattus norvegicus
gtaattctttgcctctcatgatcaa

SEQ ID NO: 477725 - DNA, 25 bp, Rattus norvegicus
gtaattctttgcgtctcatgatcaa

SEQ ID NO: 477726 - DNA, 25 bp, Rattus norvegicus
gtaattgaaactacttggccccaca

SEQ ID NO: 477727 - DNA, 25 bp, Rattus norvegicus
gtaattgaaacttcttggccccaca

SEQ ID NO: 477728 - DNA, 25 bp, Rattus norvegicus
gtaattgattttcccctctgagaag

SEQ ID NO: 477729 - DNA, 25 bp, Rattus norvegicus
gtaattgattttgccctctgagaag

SEQ ID NO: 477730 - DNA, 25 bp, Rattus norvegicus
gtaattgcaccacctggtccagcca

SEQ ID NO: 477731 - DNA, 25 bp, Rattus norvegicus
gtaattgcaccagctggtccagcca

SEQ ID NO: 477732 - DNA, 25 bp, Rattus norvegicus
gtaattgcagctcccagagcacaat

SEQ ID NO: 477733 - DNA, 25 bp, Rattus norvegicus
gtaattgcagctgccagagcacaat

SEQ ID NO: 477734 - DNA, 25 bp, Rattus norvegicus
gtaattgcattccagccagttaata

SEQ ID NO: 477735 - DNA, 25 bp, Rattus norvegicus
gtaattgcattcgagccagttaata

SEQ ID NO: 477736 - DNA, 25 bp, Rattus norvegicus
gtaattgctcagagggctctgcaca

SEQ ID NO: 477737 - DNA, 25 bp, Rattus norvegicus
gtaattgctcagtgggctctgcaca

SEQ ID NO: 477738 - DNA, 25 bp, Rattus norvegicus
gtaattgcttttctccttgtcattg

SEQ ID NO: 477739 - DNA, 25 bp, Rattus norvegicus
gtaattgcttttgtccttgtcattg

SEQ ID NO: 477740 - DNA, 25 bp, Rattus norvegicus
gtaattggaaacctcagtctctgta

SEQ ID NO: 477741 - DNA, 25 bp, Rattus norvegicus
gtaattggaaacgtcagtctctgta

SEQ ID NO: 477742 - DNA, 25 bp, Rattus norvegicus
gtaattggacaacatattctcaaga

SEQ ID NO: 477743 - DNA, 25 bp, Rattus norvegicus
gtaattggacaagatattctcaaga

SEQ ID NO: 477744 - DNA, 25 bp, Rattus norvegicus
gtaattggcatccttcttgtggtca

SEQ ID NO: 477745 - DNA, 25 bp, Rattus norvegicus
gtaattggcatcgttcttgtggtca

SEQ ID NO: 477746 - DNA, 25 bp, Rattus norvegicus
gtaattgggcaacttttttagcact

SEQ ID NO: 477747 - DNA, 25 bp, Rattus norvegicus
gtaattgggcaagttttttagcact

SEQ ID NO: 477748 - DNA, 25 bp, Rattus norvegicus
gtaattgtcattcagatcctcgtat

SEQ ID NO: 477749 - DNA, 25 bp, Rattus norvegicus
gtaattgtcattgagatcctcgtat

SEQ ID NO: 477750 - DNA, 25 bp, Rattus norvegicus
gtaattgtctcaaactattttcatg

SEQ ID NO: 477751 - DNA, 25 bp, Rattus norvegicus
gtaattgtctcatactattttcatg

SEQ ID NO: 477752 - DNA, 25 bp, Rattus norvegicus
gtaattgtcttgattcacggcaaat

SEQ ID NO: 477753 - DNA, 25 bp, Rattus norvegicus
gtaattgtcttgtttcacggcaaat

SEQ ID NO: 477754 - DNA, 25 bp, Rattus norvegicus
gtaattgtgactacatctcctttgc

SEQ ID NO: 477755 - DNA, 25 bp, Rattus norvegicus
gtaattgtgacttcatctcctttgc

SEQ ID NO: 477756 - DNA, 25 bp, Rattus norvegicus
gtaattgtgtacatgactggtcaga

SEQ ID NO: 477757 - DNA, 25 bp, Rattus norvegicus
gtaattgtgtacttgactggtcaga

SEQ ID NO: 477758 - DNA, 25 bp, Rattus norvegicus
gtaattgttaacacctgtagcacag

SEQ ID NO: 477759 - DNA, 25 bp, Rattus norvegicus
gtaattgttaactcctgtagcacag

SEQ ID NO: 477760 - DNA, 25 bp, Rattus norvegicus
gtaattgttagcacatcccttagag

SEQ ID NO: 477761 - DNA, 25 bp, Rattus norvegicus
gtaattgttagctcatcccttagag

SEQ ID NO: 477762 - DNA, 25 bp, Rattus norvegicus
gtaattgtttctatctaactgcaga

SEQ ID NO: 477763 - DNA, 25 bp, Rattus norvegicus
gtaattgtttctttctaactgcaga

SEQ ID NO: 477764 - DNA, 25 bp, Rattus norvegicus
gtaatttaaccaagcccctaagtat

SEQ ID NO: 477765 - DNA, 25 bp, Rattus norvegicus
gtaatttaaccatgcccctaagtat

SEQ ID NO: 477766 - DNA, 25 bp, Rattus norvegicus
gtaatttaaggtctgttcacagctg

SEQ ID NO: 477767 - DNA, 25 bp, Rattus norvegicus
gtaatttaaggtgtgttcacagctg

SEQ ID NO: 477768 - DNA, 25 bp, Rattus norvegicus
gtaatttacttgagcaatgcctcca

SEQ ID NO: 477769 - DNA, 25 bp, Rattus norvegicus
gtaatttacttgtgcaatgcctcca

SEQ ID NO: 477770 - DNA, 25 bp, Rattus norvegicus
gtaatttactttcagattccttgct

SEQ ID NO: 477771 - DNA, 25 bp, Rattus norvegicus
gtaatttactttgagattccttgct

SEQ ID NO: 477772 - DNA, 25 bp, Rattus norvegicus
gtaatttatattcccctgagtcacg

SEQ ID NO: 477773 - DNA, 25 bp, Rattus norvegicus
gtaatttatattctggctctgtcca

SEQ ID NO: 477774 - DNA, 25 bp, Rattus norvegicus
gtaatttatattgccctgagtcacg

SEQ ID NO: 477775 - DNA, 25 bp, Rattus norvegicus
gtaatttatattgtggctctgtcca

SEQ ID NO: 477776 - DNA, 25 bp, Rattus norvegicus
gtaatttatttcattagccagcctt

SEQ ID NO: 477777 - DNA, 25 bp, Rattus norvegicus
gtaatttatttctttagccagcctt

SEQ ID NO: 477778 - DNA, 25 bp, Rattus norvegicus
gtaatttcacaccagctgcagagag

SEQ ID NO: 477779 - DNA, 25 bp, Rattus norvegicus
gtaatttcacacgagctgcagagag

SEQ ID NO: 477780 - DNA, 25 bp, Rattus norvegicus
gtaatttcactcatttgttacatga

SEQ ID NO: 477781 - DNA, 25 bp, Rattus norvegicus
gtaatttcactcttttgttacatga

SEQ ID NO: 477782 - DNA, 25 bp, Rattus norvegicus
gtaatttcattcattattttcgtga

SEQ ID NO: 477783 - DNA, 25 bp, Rattus norvegicus
gtaatttcattctttattttcgtga

SEQ ID NO: 477784 - DNA, 25 bp, Rattus norvegicus
gtaatttccacacggcctacaaatg

SEQ ID NO: 477785 - DNA, 25 bp, Rattus norvegicus
gtaatttccacagggcctacaaatg

SEQ ID NO: 477786 - DNA, 25 bp, Rattus norvegicus
gtaatttccctacttgttatccaag

SEQ ID NO: 477787 - DNA, 25 bp, Rattus norvegicus
gtaatttccctagttgttatccaag

SEQ ID NO: 477788 - DNA, 25 bp, Rattus norvegicus
gtaatttccggcaaggatctcggtg

SEQ ID NO: 477789 - DNA, 25 bp, Rattus norvegicus
gtaatttccggctaggatctcggtg

SEQ ID NO: 477790 - DNA, 25 bp, Rattus norvegicus
gtaatttcgagacggaatcctatta

SEQ ID NO: 477791 - DNA, 25 bp, Rattus norvegicus
gtaatttcgagagggaatcctatta

SEQ ID NO: 477792 - DNA, 25 bp, Rattus norvegicus
gtaatttcggccctgtgcgcttcca

SEQ ID NO: 477793 - DNA, 25 bp, Rattus norvegicus
gtaatttcggccgtgtgcgcttcca

SEQ ID NO: 477794 - DNA, 25 bp, Rattus norvegicus
gtaatttctagaccacttttgcaaa

SEQ ID NO: 477795 - DNA, 25 bp, Rattus norvegicus
gtaatttctagagcacttttgcaaa

SEQ ID NO: 477796 - DNA, 25 bp, Rattus norvegicus
gtaatttctctgagactacttttaa

SEQ ID NO: 477797 - DNA, 25 bp, Rattus norvegicus
gtaatttctctgtgactacttttaa

SEQ ID NO: 477798 - DNA, 25 bp, Rattus norvegicus
gtaatttctggcatcattcctattt

SEQ ID NO: 477799 - DNA, 25 bp, Rattus norvegicus
gtaatttctggcttcattcctattt

SEQ ID NO: 477800 - DNA, 25 bp, Rattus norvegicus
gtaatttcttcactcttcacagtca

SEQ ID NO: 477801 - DNA, 25 bp, Rattus norvegicus
gtaatttcttcagtcttcacagtca

SEQ ID NO: 477802 - DNA, 25 bp, Rattus norvegicus
gtaatttcttctcaggtatgaacca

SEQ ID NO: 477803 - DNA, 25 bp, Rattus norvegicus
gtaatttcttctgaggtatgaacca

SEQ ID NO: 477804 - DNA, 25 bp, Rattus norvegicus
gtaatttctttaatcctttgctgtt

SEQ ID NO: 477805 - DNA, 25 bp, Rattus norvegicus
gtaatttctttattcctttgctgtt

SEQ ID NO: 477806 - DNA, 25 bp, Rattus norvegicus
gtaatttgcagtcagtcgaccttaa

SEQ ID NO: 477807 - DNA, 25 bp, Rattus norvegicus
gtaatttgcagtgagtcgaccttaa

SEQ ID NO: 477808 - DNA, 25 bp, Rattus norvegicus
gtaatttggattcaactcttgcttt

SEQ ID NO: 477809 - DNA, 25 bp, Rattus norvegicus
gtaatttggattgaactcttgcttt

SEQ ID NO: 477810 - DNA, 25 bp, Rattus norvegicus
gtaatttgtctgatcttacaatcca

SEQ ID NO: 477811 - DNA, 25 bp, Rattus norvegicus
gtaatttgtctgttcttacaatcca

SEQ ID NO: 477812 - DNA, 25 bp, Rattus norvegicus
gtaattttccccataagtgcaagtg

SEQ ID NO: 477813 - DNA, 25 bp, Rattus norvegicus
gtaattttccccttaagtgcaagtg

SEQ ID NO: 477814 - DNA, 25 bp, Rattus norvegicus
gtaattttctatctaagcagccaat

SEQ ID NO: 477815 - DNA, 25 bp, Rattus norvegicus
gtaattttctatgtaagcagccaat

SEQ ID NO: 477816 - DNA, 25 bp, Rattus norvegicus
gtaattttctcaaccttctttcagt

SEQ ID NO: 477817 - DNA, 25 bp, Rattus norvegicus
gtaattttctcatccttctttcagt

SEQ ID NO: 477818 - DNA, 25 bp, Rattus norvegicus
gtaattttgagaccctgtccaactg

SEQ ID NO: 477819 - DNA, 25 bp, Rattus norvegicus
gtaattttgagagcctgtccaactg

SEQ ID NO: 477820 - DNA, 25 bp, Rattus norvegicus
gtaattttgttaagatgctatcctt

SEQ ID NO: 477821 - DNA, 25 bp, Rattus norvegicus
gtaattttgttacgctgtttccatt

SEQ ID NO: 477822 - DNA, 25 bp, Rattus norvegicus
gtaattttgttaggctgtttccatt

SEQ ID NO: 477823 - DNA, 25 bp, Rattus norvegicus
gtaattttgttatgatgctatcctt

SEQ ID NO: 477824 - DNA, 25 bp, Rattus norvegicus
gtaatttttgccactgattccaatt

SEQ ID NO: 477825 - DNA, 25 bp, Rattus norvegicus
gtaatttttgcctctgattccaatt

SEQ ID NO: 477826 - DNA, 25 bp, Rattus norvegicus
gtaatttttgtacctcatgactttg

SEQ ID NO: 477827 - DNA, 25 bp, Rattus norvegicus
gtaatttttgtagctcatgactttg

SEQ ID NO: 477828 - DNA, 25 bp, Rattus norvegicus
gtaattttttatctgcactgtatat

SEQ ID NO: 477829 - DNA, 25 bp, Rattus norvegicus
gtaattttttatgtgcactgtatat

SEQ ID NO: 477830 - DNA, 25 bp, Rattus norvegicus
gtacaaaacagaatggccttccacc

SEQ ID NO: 477831 - DNA, 25 bp, Rattus norvegicus
gtacaaaacagattggccttccacc

SEQ ID NO: 477832 - DNA, 25 bp, Rattus norvegicus
gtacaaaacattagcctctaactag

SEQ ID NO: 477833 - DNA, 25 bp, Rattus norvegicus
gtacaaaacatttgcctctaactag

SEQ ID NO: 477834 - DNA, 25 bp, Rattus norvegicus
gtacaaaaccaaccatgacgacaaa

SEQ ID NO: 477835 - DNA, 25 bp, Rattus norvegicus
gtacaaaaccaagcatgacgacaaa

SEQ ID NO: 477836 - DNA, 25 bp, Rattus norvegicus
gtacaaaagagcagactccctcctt

SEQ ID NO: 477837 - DNA, 25 bp, Rattus norvegicus
gtacaaaagagctgactccctcctt

SEQ ID NO: 477838 - DNA, 25 bp, Rattus norvegicus
gtacaaaagccaagtcatgcaacat

SEQ ID NO: 477839 - DNA, 25 bp, Rattus norvegicus
gtacaaaagccatgtcatgcaacat

SEQ ID NO: 477840 - DNA, 25 bp, Rattus norvegicus
gtacaaaaggcccagtctggcatcc

SEQ ID NO: 477841 - DNA, 25 bp, Rattus norvegicus
gtacaaaaggccgagtctggcatcc

SEQ ID NO: 477842 - DNA, 25 bp, Rattus norvegicus
gtacaaaattttctggcaatgcctc

SEQ ID NO: 477843 - DNA, 25 bp, Rattus norvegicus
gtacaaaattttgtggcaatgcctc

SEQ ID NO: 477844 - DNA, 25 bp, Rattus norvegicus
gtacaaacaaccaggcagagcttac

SEQ ID NO: 477845 - DNA, 25 bp, Rattus norvegicus
gtacaaacaacctggcagagcttac

SEQ ID NO: 477846 - DNA, 25 bp, Rattus norvegicus
gtacaaacaataactaccgatggaa

SEQ ID NO: 477847 - DNA, 25 bp, Rattus norvegicus
gtacaaacaatatctaccgatggaa

SEQ ID NO: 477848 - DNA, 25 bp, Rattus norvegicus
gtacaaacagttacttcatttatct

SEQ ID NO: 477849 - DNA, 25 bp, Rattus norvegicus
gtacaaacagtttcttcatttatct

SEQ ID NO: 477850 - DNA, 25 bp, Rattus norvegicus
gtacaaacataccagattcgcacag

SEQ ID NO: 477851 - DNA, 25 bp, Rattus norvegicus
gtacaaacatacgagattcgcacag

SEQ ID NO: 477852 - DNA, 25 bp, Rattus norvegicus
gtacaaaccaggactcttggtgtct

SEQ ID NO: 477853 - DNA, 25 bp, Rattus norvegicus
gtacaaaccaggtctcttggtgtct

SEQ ID NO: 477854 - DNA, 25 bp, Rattus norvegicus
gtacaaacgccacaagagctccaag

SEQ ID NO: 477855 - DNA, 25 bp, Rattus norvegicus
gtacaaacgccagaagagctccaag

SEQ ID NO: 477856 - DNA, 25 bp, Rattus norvegicus
gtacaaacggttcttgctgaccaac

SEQ ID NO: 477857 - DNA, 25 bp, Rattus norvegicus
gtacaaacggttgttgctgaccaac

SEQ ID NO: 477858 - DNA, 25 bp, Rattus norvegicus
gtacaaactcttacagcagcaacag

SEQ ID NO: 477859 - DNA, 25 bp, Rattus norvegicus
gtacaaactctttcagcagcaacag

SEQ ID NO: 477860 - DNA, 25 bp, Rattus norvegicus
gtacaaactgcacacacactatatg

SEQ ID NO: 477861 - DNA, 25 bp, Rattus norvegicus
gtacaaactgcagacacactatatg

SEQ ID NO: 477862 - DNA, 25 bp, Rattus norvegicus
gtacaaactgggaaatcagctgatt

SEQ ID NO: 477863 - DNA, 25 bp, Rattus norvegicus
gtacaaactgggaccttgctctagg

SEQ ID NO: 477864 - DNA, 25 bp, Rattus norvegicus
gtacaaactgggtaatcagctgatt

SEQ ID NO: 477865 - DNA, 25 bp, Rattus norvegicus
gtacaaactgggtccttgctctagg

SEQ ID NO: 477866 - DNA, 25 bp, Rattus norvegicus
gtacaaagacggctgtgaccacatt

SEQ ID NO: 477867 - DNA, 25 bp, Rattus norvegicus
gtacaaagacgggtgtgaccacatt

SEQ ID NO: 477868 - DNA, 25 bp, Rattus norvegicus
gtacaaagatgtcacttccagcaga

SEQ ID NO: 477869 - DNA, 25 bp, Rattus norvegicus
gtacaaagatgtgacttccagcaga

SEQ ID NO: 477870 - DNA, 25 bp, Rattus norvegicus
gtacaaagcagtatgcctgtgcata

SEQ ID NO: 477871 - DNA, 25 bp, Rattus norvegicus
gtacaaagcagtttgcctgtgcata

SEQ ID NO: 477872 - DNA, 25 bp, Rattus norvegicus
gtacaaagctacaggtctgtctccc

SEQ ID NO: 477873 - DNA, 25 bp, Rattus norvegicus
gtacaaagctactggtctgtctccc

SEQ ID NO: 477874 - DNA, 25 bp, Rattus norvegicus
gtacaaagctcactggaaatgaaag

SEQ ID NO: 477875 - DNA, 25 bp, Rattus norvegicus
gtacaaagctcagtggaaatgaaag

SEQ ID NO: 477876 - DNA, 25 bp, Rattus norvegicus
gtacaaagtatcctacaagttgtga

SEQ ID NO: 477877 - DNA, 25 bp, Rattus norvegicus
gtacaaagtatcgtacaagttgtga

SEQ ID NO: 477878 - DNA, 25 bp, Rattus norvegicus
gtacaaagtcttagctcgctttagc

SEQ ID NO: 477879 - DNA, 25 bp, Rattus norvegicus
gtacaaagtctttgctcgctttagc

SEQ ID NO: 477880 - DNA, 25 bp, Rattus norvegicus
gtacaaagtgccagactgttctctt

SEQ ID NO: 477881 - DNA, 25 bp, Rattus norvegicus
gtacaaagtgcctgactgttctctt

SEQ ID NO: 477882 - DNA, 25 bp, Rattus norvegicus
gtacaaagttttcaccagaccttga

SEQ ID NO: 477883 - DNA, 25 bp, Rattus norvegicus
gtacaaagttttgaccagaccttga

SEQ ID NO: 477884 - DNA, 25 bp, Rattus norvegicus
gtacaaatatatctgcaaatgcccc

SEQ ID NO: 477885 - DNA, 25 bp, Rattus norvegicus
gtacaaatatatgtgcaaatgcccc

SEQ ID NO: 477886 - DNA, 25 bp, Rattus norvegicus
gtacaaatatttaatagctccagtt

SEQ ID NO: 477887 - DNA, 25 bp, Rattus norvegicus
gtacaaatattttatagctccagtt

SEQ ID NO: 477888 - DNA, 25 bp, Rattus norvegicus
gtacaaatgggacactatactcaga

SEQ ID NO: 477889 - DNA, 25 bp, Rattus norvegicus
gtacaaatgggagactatactcaga

SEQ ID NO: 477890 - DNA, 25 bp, Rattus norvegicus
gtacaaatgtcacgccatggcttta

SEQ ID NO: 477891 - DNA, 25 bp, Rattus norvegicus
gtacaaatgtcaggccatggcttta

SEQ ID NO: 477892 - DNA, 25 bp, Rattus norvegicus
gtacaaatgttcattcttttatgtt

SEQ ID NO: 477893 - DNA, 25 bp, Rattus norvegicus
gtacaaatgttctttcttttatgtt

SEQ ID NO: 477894 - DNA, 25 bp, Rattus norvegicus
gtacaaattaaaacacagcactgtc

SEQ ID NO: 477895 - DNA, 25 bp, Rattus norvegicus
gtacaaattaaatcacagcactgtc

SEQ ID NO: 477896 - DNA, 25 bp, Rattus norvegicus
gtacaacaaaccacatattcccatt

SEQ ID NO: 477897 - DNA, 25 bp, Rattus norvegicus
gtacaacaaacctcatattcccatt

SEQ ID NO: 477898 - DNA, 25 bp, Rattus norvegicus
gtacaacaaccgagcccaagcgagg

SEQ ID NO: 477899 - DNA, 25 bp, Rattus norvegicus
gtacaacaaccgtgcccaagcgagg

SEQ ID NO: 477900 - DNA, 25 bp, Rattus norvegicus
gtacaacacagacccctagccagag

SEQ ID NO: 477901 - DNA, 25 bp, Rattus norvegicus
gtacaacacagagccctagccagag

SEQ ID NO: 477902 - DNA, 25 bp, Rattus norvegicus
gtacaacactccaaaacatgcctac

SEQ ID NO: 477903 - DNA, 25 bp, Rattus norvegicus
gtacaacactcctaaacatgcctac

SEQ ID NO: 477904 - DNA, 25 bp, Rattus norvegicus
gtacaacagaagactacccaacaga

SEQ ID NO: 477905 - DNA, 25 bp, Rattus norvegicus
gtacaacagaagtctacccaacaga

SEQ ID NO: 477906 - DNA, 25 bp, Rattus norvegicus
gtacaacagaggacaaacccagttt

SEQ ID NO: 477907 - DNA, 25 bp, Rattus norvegicus
gtacaacagaggtcaaacccagttt

SEQ ID NO: 477908 - DNA, 25 bp, Rattus norvegicus
gtacaacagcgtcctgttcggaggt

SEQ ID NO: 477909 - DNA, 25 bp, Rattus norvegicus
gtacaacagcgtgctgttcggaggt

SEQ ID NO: 477910 - DNA, 25 bp, Rattus norvegicus
gtacaacagtatactaggccgccaa

SEQ ID NO: 477911 - DNA, 25 bp, Rattus norvegicus
gtacaacagtattctaggccgccaa

SEQ ID NO: 477912 - DNA, 25 bp, Rattus norvegicus
gtacaacagttactctccatttgct

SEQ ID NO: 477913 - DNA, 25 bp, Rattus norvegicus
gtacaacagttagtctccatttgct

SEQ ID NO: 477914 - DNA, 25 bp, Rattus norvegicus
gtacaacagttgagagaagcaccaa

SEQ ID NO: 477915 - DNA, 25 bp, Rattus norvegicus
gtacaacagttgtgagaagcaccaa

SEQ ID NO: 477916 - DNA, 25 bp, Rattus norvegicus
gtacaacatctaagccaagcacacc

SEQ ID NO: 477917 - DNA, 25 bp, Rattus norvegicus
gtacaacatctatgccaagcacacc

SEQ ID NO: 477918 - DNA, 25 bp, Rattus norvegicus
gtacaacattctccttatatccaca

SEQ ID NO: 477919 - DNA, 25 bp, Rattus norvegicus
gtacaacattctgcttatatccaca

SEQ ID NO: 477920 - DNA, 25 bp, Rattus norvegicus
gtacaacattgtaaatcctggaaat

SEQ ID NO: 477921 - DNA, 25 bp, Rattus norvegicus
gtacaacattgttaatcctggaaat

SEQ ID NO: 477922 - DNA, 25 bp, Rattus norvegicus
gtacaaccagcaagaccaaagcaga

SEQ ID NO: 477923 - DNA, 25 bp, Rattus norvegicus
gtacaaccagcatgaccaaagcaga

SEQ ID NO: 477924 - DNA, 25 bp, Rattus norvegicus
gtacaacccaagaaccagggagcct

SEQ ID NO: 477925 - DNA, 25 bp, Rattus norvegicus
gtacaacccaagtaccagggagcct

SEQ ID NO: 477926 - DNA, 25 bp, Rattus norvegicus
gtacaacccataaaattcacgtcct

SEQ ID NO: 477927 - DNA, 25 bp, Rattus norvegicus
gtacaacccatataattcacgtcct

SEQ ID NO: 477928 - DNA, 25 bp, Rattus norvegicus
gtacaaccgtctctgaccattaaat

SEQ ID NO: 477929 - DNA, 25 bp, Rattus norvegicus
gtacaaccgtctgtgaccattaaat

SEQ ID NO: 477930 - DNA, 25 bp, Rattus norvegicus
gtacaacctaacacactggcaagaa

SEQ ID NO: 477931 - DNA, 25 bp, Rattus norvegicus
gtacaacctaactcactggcaagaa

SEQ ID NO: 477932 - DNA, 25 bp, Rattus norvegicus
gtacaacctctgagcccagtttaaa

SEQ ID NO: 477933 - DNA, 25 bp, Rattus norvegicus
gtacaacctctgtgcccagtttaaa

SEQ ID NO: 477934 - DNA, 25 bp, Rattus norvegicus
gtacaaccttataccggaagtctgg

SEQ ID NO: 477935 - DNA, 25 bp, Rattus norvegicus
gtacaaccttattccggaagtctgg

SEQ ID NO: 477936 - DNA, 25 bp, Rattus norvegicus
gtacaacgcagacgatcacacttag

SEQ ID NO: 477937 - DNA, 25 bp, Rattus norvegicus
gtacaacgcagaggatcacacttag

SEQ ID NO: 477938 - DNA, 25 bp, Rattus norvegicus
gtacaacggcaacaccttcaaccag

SEQ ID NO: 477939 - DNA, 25 bp, Rattus norvegicus
gtacaacggcaagaccttcaaccag

SEQ ID NO: 477940 - DNA, 25 bp, Rattus norvegicus
gtacaacgggacacttcctcttctt

SEQ ID NO: 477941 - DNA, 25 bp, Rattus norvegicus
gtacaacgggactcttcctcttctt

SEQ ID NO: 477942 - DNA, 25 bp, Rattus norvegicus
gtacaactcaccatgtatacactgt

SEQ ID NO: 477943 - DNA, 25 bp, Rattus norvegicus
gtacaactcaccttgtatacactgt

SEQ ID NO: 477944 - DNA, 25 bp, Rattus norvegicus
gtacaactgagtcgtctgactctaa

SEQ ID NO: 477945 - DNA, 25 bp, Rattus norvegicus
gtacaactgagtggtctgactctaa

SEQ ID NO: 477946 - DNA, 25 bp, Rattus norvegicus
gtacaactgtgacaagatgatctgc

SEQ ID NO: 477947 - DNA, 25 bp, Rattus norvegicus
gtacaactgtgagaagatgatctgc

SEQ ID NO: 477948 - DNA, 25 bp, Rattus norvegicus
gtacaactgtgcatctaaacgttca

SEQ ID NO: 477949 - DNA, 25 bp, Rattus norvegicus
gtacaactgtgcttctaaacgttca

SEQ ID NO: 477950 - DNA, 25 bp, Rattus norvegicus
gtacaacttgcaagcttgtgcccat

SEQ ID NO: 477951 - DNA, 25 bp, Rattus norvegicus
gtacaacttgcatgcttgtgcccat

SEQ ID NO: 477952 - DNA, 25 bp, Rattus norvegicus
gtacaacttttacacaccagacagt

SEQ ID NO: 477953 - DNA, 25 bp, Rattus norvegicus
gtacaacttttagacaccagacagt

SEQ ID NO: 477954 - DNA, 25 bp, Rattus norvegicus
gtacaagaacccctggataagctaa

SEQ ID NO: 477955 - DNA, 25 bp, Rattus norvegicus
gtacaagaacccgtggataagctaa

SEQ ID NO: 477956 - DNA, 25 bp, Rattus norvegicus
gtacaagaactcctttctcaagcat

SEQ ID NO: 477957 - DNA, 25 bp, Rattus norvegicus
gtacaagaactcgtttctcaagcat

SEQ ID NO: 477958 - DNA, 25 bp, Rattus norvegicus
gtacaagaagaaccctacctcacag

SEQ ID NO: 477959 - DNA, 25 bp, Rattus norvegicus
gtacaagaagaagcctacctcacag

SEQ ID NO: 477960 - DNA, 25 bp, Rattus norvegicus
gtacaagaagacagatgctccccag

SEQ ID NO: 477961 - DNA, 25 bp, Rattus norvegicus
gtacaagaagactgatgctccccag

SEQ ID NO: 477962 - DNA, 25 bp, Rattus norvegicus
gtacaagacatgctagcttataggg

SEQ ID NO: 477963 - DNA, 25 bp, Rattus norvegicus
gtacaagacatggtagcttataggg

SEQ ID NO: 477964 - DNA, 25 bp, Rattus norvegicus
gtacaagacccaaatcccactgttt

SEQ ID NO: 477965 - DNA, 25 bp, Rattus norvegicus
gtacaagacccatatcccactgttt

SEQ ID NO: 477966 - DNA, 25 bp, Rattus norvegicus
gtacaagacctacaagccacattta

SEQ ID NO: 477967 - DNA, 25 bp, Rattus norvegicus
gtacaagacctagaagccacattta

SEQ ID NO: 477968 - DNA, 25 bp, Rattus norvegicus
gtacaagagcttcggtcacctcaag

SEQ ID NO: 477969 - DNA, 25 bp, Rattus norvegicus
gtacaagagcttgggtcacctcaag

SEQ ID NO: 477970 - DNA, 25 bp, Rattus norvegicus
gtacaagaggctccggagactccct

SEQ ID NO: 477971 - DNA, 25 bp, Rattus norvegicus
gtacaagaggctgcggagactccct

SEQ ID NO: 477972 - DNA, 25 bp, Rattus norvegicus
gtacaagatctacccgggacacggg

SEQ ID NO: 477973 - DNA, 25 bp, Rattus norvegicus
gtacaagatctagccgggacacggg

SEQ ID NO: 477974 - DNA, 25 bp, Rattus norvegicus
gtacaagatctcactatctctctat

SEQ ID NO: 477975 - DNA, 25 bp, Rattus norvegicus
gtacaagatctctctatctctctat

SEQ ID NO: 477976 - DNA, 25 bp, Rattus norvegicus
gtacaagccatgagatttcctgccc

SEQ ID NO: 477977 - DNA, 25 bp, Rattus norvegicus
gtacaagccatgtgatttcctgccc

SEQ ID NO: 477978 - DNA, 25 bp, Rattus norvegicus
gtacaagcgcctcctgctccagtaa

SEQ ID NO: 477979 - DNA, 25 bp, Rattus norvegicus
gtacaagcgcctgctgctccagtaa

SEQ ID NO: 477980 - DNA, 25 bp, Rattus norvegicus
gtacaagcgtctccggacacatgta

SEQ ID NO: 477981 - DNA, 25 bp, Rattus norvegicus
gtacaagcgtctgcggacacatgta

SEQ ID NO: 477982 - DNA, 25 bp, Rattus norvegicus
gtacaaggaaccacaacatccgtcc

SEQ ID NO: 477983 - DNA, 25 bp, Rattus norvegicus
gtacaaggaacctcaacatccgtcc

SEQ ID NO: 477984 - DNA, 25 bp, Rattus norvegicus
gtacaaggagcaaccctgctacatc

SEQ ID NO: 477985 - DNA, 25 bp, Rattus norvegicus
gtacaaggagcatccctgctacatc

SEQ ID NO: 477986 - DNA, 25 bp, Rattus norvegicus
gtacaaggccagctgacacatgcaa

SEQ ID NO: 477987 - DNA, 25 bp, Rattus norvegicus
gtacaaggccaggtgacacatgcaa

SEQ ID NO: 477988 - DNA, 25 bp, Rattus norvegicus
gtacaaggctcaattctttacccag

SEQ ID NO: 477989 - DNA, 25 bp, Rattus norvegicus
gtacaaggctcatttctttacccag

SEQ ID NO: 477990 - DNA, 25 bp, Rattus norvegicus
gtacaaggctgtcttgcctgtcact

SEQ ID NO: 477991 - DNA, 25 bp, Rattus norvegicus
gtacaaggctgtgttgcctgtcact

SEQ ID NO: 477992 - DNA, 25 bp, Rattus norvegicus
gtacaaggtgcacttggacctctgg

SEQ ID NO: 477993 - DNA, 25 bp, Rattus norvegicus
gtacaaggtgcagttggacctctgg

SEQ ID NO: 477994 - DNA, 25 bp, Rattus norvegicus
gtacaaggtggtattgtcctgtatt

SEQ ID NO: 477995 - DNA, 25 bp, Rattus norvegicus
gtacaaggtggttttgtcctgtatt

SEQ ID NO: 477996 - DNA, 25 bp, Rattus norvegicus
gtacaaggttttatggctccatggg

SEQ ID NO: 477997 - DNA, 25 bp, Rattus norvegicus
gtacaaggttttttggctccatggg

SEQ ID NO: 477998 - DNA, 25 bp, Rattus norvegicus
gtacaagtagccctctgggttcaat

SEQ ID NO: 477999 - DNA, 25 bp, Rattus norvegicus
gtacaagtagccgtctgggttcaat

SEQ ID NO: 478000 - DNA, 25 bp, Rattus norvegicus
gtacaagtatccatctgacatctcc

SEQ ID NO: 478001 - DNA, 25 bp, Rattus norvegicus
gtacaagtatccttctgacatctcc

SEQ ID NO: 478002 - DNA, 25 bp, Rattus norvegicus
gtacaagtcctacatacgggcatat

SEQ ID NO: 478003 - DNA, 25 bp, Rattus norvegicus
gtacaagtcctagatacgggcatat

SEQ ID NO: 478004 - DNA, 25 bp, Rattus norvegicus
gtacaagtggacacggccttggtca

SEQ ID NO: 478005 - DNA, 25 bp, Rattus norvegicus
gtacaagtggactcggccttggtca

SEQ ID NO: 478006 - DNA, 25 bp, Rattus norvegicus
gtacaagtgtgtatgcctcttaccc

SEQ ID NO: 478007 - DNA, 25 bp, Rattus norvegicus
gtacaagtgtgtttgcctcttaccc

SEQ ID NO: 478008 - DNA, 25 bp, Rattus norvegicus
gtacaagttcttacgcttggcctta

SEQ ID NO: 478009 - DNA, 25 bp, Rattus norvegicus
gtacaagttctttcgcttggcctta

SEQ ID NO: 478010 - DNA, 25 bp, Rattus norvegicus
gtacaagtttacaaggagagatccc

SEQ ID NO: 478011 - DNA, 25 bp, Rattus norvegicus
gtacaagtttactaggagagatccc

SEQ ID NO: 478012 - DNA, 25 bp, Rattus norvegicus
gtacaataaacaattctccgggcat

SEQ ID NO: 478013 - DNA, 25 bp, Rattus norvegicus
gtacaataaacatttctccgggcat

SEQ ID NO: 478014 - DNA, 25 bp, Rattus norvegicus
gtacaataacttcagctggcacgcg

SEQ ID NO: 478015 - DNA, 25 bp, Rattus norvegicus
gtacaataacttgagctggcacgcg

SEQ ID NO: 478016 - DNA, 25 bp, Rattus norvegicus
gtacaataattaccgactctagttc

SEQ ID NO: 478017 - DNA, 25 bp, Rattus norvegicus
gtacaataattagcgactctagttc

SEQ ID NO: 478018 - DNA, 25 bp, Rattus norvegicus
gtacaatacagaagcctgcacaggg

SEQ ID NO: 478019 - DNA, 25 bp, Rattus norvegicus
gtacaatacagatgcctgcacaggg

SEQ ID NO: 478020 - DNA, 25 bp, Rattus norvegicus
gtacaatagctaaacagagactgct

SEQ ID NO: 478021 - DNA, 25 bp, Rattus norvegicus
gtacaatagctatacagagactgct

SEQ ID NO: 478022 - DNA, 25 bp, Rattus norvegicus
gtacaatagctgacaagccgccaat

SEQ ID NO: 478023 - DNA, 25 bp, Rattus norvegicus
gtacaatagctgtcaagccgccaat

SEQ ID NO: 478024 - DNA, 25 bp, Rattus norvegicus
gtacaatatcctcggccatgttggc

SEQ ID NO: 478025 - DNA, 25 bp, Rattus norvegicus
gtacaatatcctgggccatgttggc

SEQ ID NO: 478026 - DNA, 25 bp, Rattus norvegicus
gtacaatattcacactttgtcattt

SEQ ID NO: 478027 - DNA, 25 bp, Rattus norvegicus
gtacaatattcagactttgtcattt

SEQ ID NO: 478028 - DNA, 25 bp, Rattus norvegicus
gtacaatattttcccgtgaaaggca

SEQ ID NO: 478029 - DNA, 25 bp, Rattus norvegicus
gtacaatattttgccgtgaaaggca

SEQ ID NO: 478030 - DNA, 25 bp, Rattus norvegicus
gtacaatcctgtatcatttatgaaa

SEQ ID NO: 478031 - DNA, 25 bp, Rattus norvegicus
gtacaatcctgtttcatttatgaaa

SEQ ID NO: 478032 - DNA, 25 bp, Rattus norvegicus
gtacaatctgctacacgaccattta

SEQ ID NO: 478033 - DNA, 25 bp, Rattus norvegicus
gtacaatctgcttcacgaccattta

SEQ ID NO: 478034 - DNA, 25 bp, Rattus norvegicus
gtacaatcttccatatcatggcata

SEQ ID NO: 478035 - DNA, 25 bp, Rattus norvegicus
gtacaatcttccttatcatggcata

SEQ ID NO: 478036 - DNA, 25 bp, Rattus norvegicus
gtacaatcttgaactaactgctaat

SEQ ID NO: 478037 - DNA, 25 bp, Rattus norvegicus
gtacaatcttgatctaactgctaat

SEQ ID NO: 478038 - DNA, 25 bp, Rattus norvegicus
gtacaatctttgctctgcacaatcg

SEQ ID NO: 478039 - DNA, 25 bp, Rattus norvegicus
gtacaatctttggtctgcacaatcg

SEQ ID NO: 478040 - DNA, 25 bp, Rattus norvegicus
gtacaatgaagaactccgggcccag

SEQ ID NO: 478041 - DNA, 25 bp, Rattus norvegicus
gtacaatgaagatctccgggcccag

SEQ ID NO: 478042 - DNA, 25 bp, Rattus norvegicus
gtacaatgatttcactcctgcaaaa

SEQ ID NO: 478043 - DNA, 25 bp, Rattus norvegicus
gtacaatgatttgactcctgcaaaa

SEQ ID NO: 478044 - DNA, 25 bp, Rattus norvegicus
gtacaatgtgtacccactgccaagt

SEQ ID NO: 478045 - DNA, 25 bp, Rattus norvegicus
gtacaatgtgtagccactgccaagt

SEQ ID NO: 478046 - DNA, 25 bp, Rattus norvegicus
gtacaatgtgttattctccagtgct

SEQ ID NO: 478047 - DNA, 25 bp, Rattus norvegicus
gtacaatgtgtttttctccagtgct

SEQ ID NO: 478048 - DNA, 25 bp, Rattus norvegicus
gtacaattacaaactgctggtcaaa

SEQ ID NO: 478049 - DNA, 25 bp, Rattus norvegicus
gtacaattacaatctgctggtcaaa

SEQ ID NO: 478050 - DNA, 25 bp, Rattus norvegicus
gtacaattcgtcctgaagctgtgtg

SEQ ID NO: 478051 - DNA, 25 bp, Rattus norvegicus
gtacaattcgtcgtgaagctgtgtg

SEQ ID NO: 478052 - DNA, 25 bp, Rattus norvegicus
gtacaattgactcgttttcctcccg

SEQ ID NO: 478053 - DNA, 25 bp, Rattus norvegicus
gtacaattgactggttttcctcccg

SEQ ID NO: 478054 - DNA, 25 bp, Rattus norvegicus
gtacaattgtgaactttccccttat

SEQ ID NO: 478055 - DNA, 25 bp, Rattus norvegicus
gtacaattgtgatctttccccttat

SEQ ID NO: 478056 - DNA, 25 bp, Rattus norvegicus
gtacaatttgtgctttcatcccagt

SEQ ID NO: 478057 - DNA, 25 bp, Rattus norvegicus
gtacaatttgtggtttcatcccagt

SEQ ID NO: 478058 - DNA, 25 bp, Rattus norvegicus
gtacaattttgaactgcgacttttt

SEQ ID NO: 478059 - DNA, 25 bp, Rattus norvegicus
gtacaattttgatctgcgacttttt

SEQ ID NO: 478060 - DNA, 25 bp, Rattus norvegicus
gtacaattttgtctcctattttatt

SEQ ID NO: 478061 - DNA, 25 bp, Rattus norvegicus
gtacaattttgtgtcctattttatt

SEQ ID NO: 478062 - DNA, 25 bp, Rattus norvegicus
gtacacaaagacaaatggaccctga

SEQ ID NO: 478063 - DNA, 25 bp, Rattus norvegicus
gtacacaaagactaatggaccctga

SEQ ID NO: 478064 - DNA, 25 bp, Rattus norvegicus
gtacacaaagagaaggcagccccac

SEQ ID NO: 478065 - DNA, 25 bp, Rattus norvegicus
gtacacaaagagtaggcagccccac

SEQ ID NO: 478066 - DNA, 25 bp, Rattus norvegicus
gtacacaaaggaagctggaccagac

SEQ ID NO: 478067 - DNA, 25 bp, Rattus norvegicus
gtacacaaaggatgctggaccagac

SEQ ID NO: 478068 - DNA, 25 bp, Rattus norvegicus
gtacacaaatgtatgcccgagctct

SEQ ID NO: 478069 - DNA, 25 bp, Rattus norvegicus
gtacacaaatgtttgcccgagctct

SEQ ID NO: 478070 - DNA, 25 bp, Rattus norvegicus
gtacacaacttgaatctgtcctcgt

SEQ ID NO: 478071 - DNA, 25 bp, Rattus norvegicus
gtacacaacttgtatctgtcctcgt

SEQ ID NO: 478072 - DNA, 25 bp, Rattus norvegicus
gtacacaactttactgaggacagcg

SEQ ID NO: 478073 - DNA, 25 bp, Rattus norvegicus
gtacacaacttttctgaggacagcg

SEQ ID NO: 478074 - DNA, 25 bp, Rattus norvegicus
gtacacaagagaatcccgagaccaa

SEQ ID NO: 478075 - DNA, 25 bp, Rattus norvegicus
gtacacaagagattcccgagaccaa

SEQ ID NO: 478076 - DNA, 25 bp, Rattus norvegicus
gtacacaaggcactacttctgattt

SEQ ID NO: 478077 - DNA, 25 bp, Rattus norvegicus
gtacacaaggcagtacttctgattt

SEQ ID NO: 478078 - DNA, 25 bp, Rattus norvegicus
gtacacaagggtctggctgtgccca

SEQ ID NO: 478079 - DNA, 25 bp, Rattus norvegicus
gtacacaagggtgtggctgtgccca

SEQ ID NO: 478080 - DNA, 25 bp, Rattus norvegicus
gtacacaagtgcaggcttctgagat

SEQ ID NO: 478081 - DNA, 25 bp, Rattus norvegicus
gtacacaagtgctggcttctgagat

SEQ ID NO: 478082 - DNA, 25 bp, Rattus norvegicus
gtacacacaaaccttcaggcttcat

SEQ ID NO: 478083 - DNA, 25 bp, Rattus norvegicus
gtacacacaaacgttcaggcttcat

SEQ ID NO: 478084 - DNA, 25 bp, Rattus norvegicus
gtacacacaaccagccaaacgaaac

SEQ ID NO: 478085 - DNA, 25 bp, Rattus norvegicus
gtacacacaaccatacccaggtgga

SEQ ID NO: 478086 - DNA, 25 bp, Rattus norvegicus
gtacacacaacctgccaaacgaaac

SEQ ID NO: 478087 - DNA, 25 bp, Rattus norvegicus
gtacacacaaccttacccaggtgga

SEQ ID NO: 478088 - DNA, 25 bp, Rattus norvegicus
gtacacacacatctgcattttatca

SEQ ID NO: 478089 - DNA, 25 bp, Rattus norvegicus
gtacacacacatgtgcattttatca

SEQ ID NO: 478090 - DNA, 25 bp, Rattus norvegicus
gtacacacacttctctctgtattgt

SEQ ID NO: 478091 - DNA, 25 bp, Rattus norvegicus
gtacacacacttgtctctgtattgt

SEQ ID NO: 478092 - DNA, 25 bp, Rattus norvegicus
gtacacacagagatgcaaacacgca

SEQ ID NO: 478093 - DNA, 25 bp, Rattus norvegicus
gtacacacagagttgcaaacacgca

SEQ ID NO: 478094 - DNA, 25 bp, Rattus norvegicus
gtacacacagatatcttctggctcc

SEQ ID NO: 478095 - DNA, 25 bp, Rattus norvegicus
gtacacacagatttcttctggctcc

SEQ ID NO: 478096 - DNA, 25 bp, Rattus norvegicus
gtacacacatacactcatagcctct

SEQ ID NO: 478097 - DNA, 25 bp, Rattus norvegicus
gtacacacatactctcatagcctct

SEQ ID NO: 478098 - DNA, 25 bp, Rattus norvegicus
gtacacacatgtagccctaatggcc

SEQ ID NO: 478099 - DNA, 25 bp, Rattus norvegicus
gtacacacatgttgccctaatggcc

SEQ ID NO: 478100 - DNA, 25 bp, Rattus norvegicus
gtacacaccacacttcttgtttgat

SEQ ID NO: 478101 - DNA, 25 bp, Rattus norvegicus
gtacacaccacagttcttgtttgat

SEQ ID NO: 478102 - DNA, 25 bp, Rattus norvegicus
gtacacacccaaccacgcctgagcg

SEQ ID NO: 478103 - DNA, 25 bp, Rattus norvegicus
gtacacacccaagcacgcctgagcg

SEQ ID NO: 478104 - DNA, 25 bp, Rattus norvegicus
gtacacaccctcagtctcaagaatg

SEQ ID NO: 478105 - DNA, 25 bp, Rattus norvegicus
gtacacaccctctgtctcaagaatg

SEQ ID NO: 478106 - DNA, 25 bp, Rattus norvegicus
gtacacacgtttagaagagacccag

SEQ ID NO: 478107 - DNA, 25 bp, Rattus norvegicus
gtacacacgttttgaagagacccag

SEQ ID NO: 478108 - DNA, 25 bp, Rattus norvegicus
gtacacactgtacatatcttcgtat

SEQ ID NO: 478109 - DNA, 25 bp, Rattus norvegicus
gtacacactgtactactgccatgta

SEQ ID NO: 478110 - DNA, 25 bp, Rattus norvegicus
gtacacactgtagatatcttcgtat

SEQ ID NO: 478111 - DNA, 25 bp, Rattus norvegicus
gtacacactgtagtactgccatgta

SEQ ID NO: 478112 - DNA, 25 bp, Rattus norvegicus
gtacacagacatcactgccatgttt

SEQ ID NO: 478113 - DNA, 25 bp, Rattus norvegicus
gtacacagacatgactgccatgttt

SEQ ID NO: 478114 - DNA, 25 bp, Rattus norvegicus
gtacacagagccatcttcaggcaat

SEQ ID NO: 478115 - DNA, 25 bp, Rattus norvegicus
gtacacagagccttcttcaggcaat

SEQ ID NO: 478116 - DNA, 25 bp, Rattus norvegicus
gtacacagcactattcctatacagt

SEQ ID NO: 478117 - DNA, 25 bp, Rattus norvegicus
gtacacagcacttttcctatacagt

SEQ ID NO: 478118 - DNA, 25 bp, Rattus norvegicus
gtacacagcatgacaccttgttggg

SEQ ID NO: 478119 - DNA, 25 bp, Rattus norvegicus
gtacacagcatgtcaccttgttggg

SEQ ID NO: 478120 - DNA, 25 bp, Rattus norvegicus
gtacacagctgacatccaacaccga

SEQ ID NO: 478121 - DNA, 25 bp, Rattus norvegicus
gtacacagctgagatccaacaccga

SEQ ID NO: 478122 - DNA, 25 bp, Rattus norvegicus
gtacacaggatcaaaatctctagta

SEQ ID NO: 478123 - DNA, 25 bp, Rattus norvegicus
gtacacaggatctaaatctctagta

SEQ ID NO: 478124 - DNA, 25 bp, Rattus norvegicus
gtacacagggctagacctgaaatca

SEQ ID NO: 478125 - DNA, 25 bp, Rattus norvegicus
gtacacagggcttgacctgaaatca

SEQ ID NO: 478126 - DNA, 25 bp, Rattus norvegicus
gtacacagtccacttttaggctaca

SEQ ID NO: 478127 - DNA, 25 bp, Rattus norvegicus
gtacacagtccagttttaggctaca

SEQ ID NO: 478128 - DNA, 25 bp, Rattus norvegicus
gtacacagtgctctccatctgtgaa

SEQ ID NO: 478129 - DNA, 25 bp, Rattus norvegicus
gtacacagtgctgtccatctgtgaa

SEQ ID NO: 478130 - DNA, 25 bp, Rattus norvegicus
gtacacagtggaccttgactcagtt

SEQ ID NO: 478131 - DNA, 25 bp, Rattus norvegicus
gtacacagtggagcttgactcagtt

SEQ ID NO: 478132 - DNA, 25 bp, Rattus norvegicus
gtacacagttatcactatggagagt

SEQ ID NO: 478133 - DNA, 25 bp, Rattus norvegicus
gtacacagttatgactatggagagt

SEQ ID NO: 478134 - DNA, 25 bp, Rattus norvegicus
gtacacataaccagtcatagacaca

SEQ ID NO: 478135 - DNA, 25 bp, Rattus norvegicus
gtacacataacctgtcatagacaca

SEQ ID NO: 478136 - DNA, 25 bp, Rattus norvegicus
gtacacatacggagtagctactact

SEQ ID NO: 478137 - DNA, 25 bp, Rattus norvegicus
gtacacatacggtgtagctactact

SEQ ID NO: 478138 - DNA, 25 bp, Rattus norvegicus
gtacacatatgtccctagagccaaa

SEQ ID NO: 478139 - DNA, 25 bp, Rattus norvegicus
gtacacatatgtgcctagagccaaa

SEQ ID NO: 478140 - DNA, 25 bp, Rattus norvegicus
gtacacatcaagcaccaggacggga

SEQ ID NO: 478141 - DNA, 25 bp, Rattus norvegicus
gtacacatcaaggaccaggacggga

SEQ ID NO: 478142 - DNA, 25 bp, Rattus norvegicus
gtacacatcataacagtaacttcat

SEQ ID NO: 478143 - DNA, 25 bp, Rattus norvegicus
gtacacatcatacattcggttgaat

SEQ ID NO: 478144 - DNA, 25 bp, Rattus norvegicus
gtacacatcatagattcggttgaat

SEQ ID NO: 478145 - DNA, 25 bp, Rattus norvegicus
gtacacatcatatcagtaacttcat

SEQ ID NO: 478146 - DNA, 25 bp, Rattus norvegicus
gtacacatccgaatagcgtgaccgc

SEQ ID NO: 478147 - DNA, 25 bp, Rattus norvegicus
gtacacatccgattagcgtgaccgc

SEQ ID NO: 478148 - DNA, 25 bp, Rattus norvegicus
gtacacatcctgaccattgtgggag

SEQ ID NO: 478149 - DNA, 25 bp, Rattus norvegicus
gtacacatcctgtccattgtgggag

SEQ ID NO: 478150 - DNA, 25 bp, Rattus norvegicus
gtacacatcgttctggaatgccatg

SEQ ID NO: 478151 - DNA, 25 bp, Rattus norvegicus
gtacacatcgttgtggaatgccatg

SEQ ID NO: 478152 - DNA, 25 bp, Rattus norvegicus
gtacacatctctagttcagctctta

SEQ ID NO: 478153 - DNA, 25 bp, Rattus norvegicus
gtacacatctcttgttcagctctta

SEQ ID NO: 478154 - DNA, 25 bp, Rattus norvegicus
gtacacatgcaaccttccacatttt

SEQ ID NO: 478155 - DNA, 25 bp, Rattus norvegicus
gtacacatgcaagcttccacatttt

SEQ ID NO: 478156 - DNA, 25 bp, Rattus norvegicus
gtacacatgctgcatcaaaatatat

SEQ ID NO: 478157 - DNA, 25 bp, Rattus norvegicus
gtacacatgctggatcaaaatatat

SEQ ID NO: 478158 - DNA, 25 bp, Rattus norvegicus
gtacacatggaaactcagggaccca

SEQ ID NO: 478159 - DNA, 25 bp, Rattus norvegicus
gtacacatggaatctcagggaccca

SEQ ID NO: 478160 - DNA, 25 bp, Rattus norvegicus
gtacacatgtcactcacttaggatc

SEQ ID NO: 478161 - DNA, 25 bp, Rattus norvegicus
gtacacatgtcagtcacttaggatc

SEQ ID NO: 478162 - DNA, 25 bp, Rattus norvegicus
gtacacattacgattcacaatcagt

SEQ ID NO: 478163 - DNA, 25 bp, Rattus norvegicus
gtacacattacgtttcacaatcagt

SEQ ID NO: 478164 - DNA, 25 bp, Rattus norvegicus
gtacacattcgtacactggtgtccc

SEQ ID NO: 478165 - DNA, 25 bp, Rattus norvegicus
gtacacattcgttcactggtgtccc

SEQ ID NO: 478166 - DNA, 25 bp, Rattus norvegicus
gtacacattgaaccctttaagagct

SEQ ID NO: 478167 - DNA, 25 bp, Rattus norvegicus
gtacacattgaagcctttaagagct

SEQ ID NO: 478168 - DNA, 25 bp, Rattus norvegicus
gtacacattgctagtggctcacagt

SEQ ID NO: 478169 - DNA, 25 bp, Rattus norvegicus
gtacacattgcttgtggctcacagt

SEQ ID NO: 478170 - DNA, 25 bp, Rattus norvegicus
gtacacattgtcactaacttcactc

SEQ ID NO: 478171 - DNA, 25 bp, Rattus norvegicus
gtacacattgtctctaacttcactc

SEQ ID NO: 478172 - DNA, 25 bp, Rattus norvegicus
gtacacatttgccatttgaactctg

SEQ ID NO: 478173 - DNA, 25 bp, Rattus norvegicus
gtacacatttgcgatttgaactctg

SEQ ID NO: 478174 - DNA, 25 bp, Rattus norvegicus
gtacaccaagagctctgtcaaatgt

SEQ ID NO: 478175 - DNA, 25 bp, Rattus norvegicus
gtacaccaagaggtctgtcaaatgt

SEQ ID NO: 478176 - DNA, 25 bp, Rattus norvegicus
gtacaccaatccaaagtcttcagaa

SEQ ID NO: 478177 - DNA, 25 bp, Rattus norvegicus
gtacaccaatcctaagtcttcagaa

SEQ ID NO: 478178 - DNA, 25 bp, Rattus norvegicus
gtacaccactttcttgacggcacgg

SEQ ID NO: 478179 - DNA, 25 bp, Rattus norvegicus
gtacaccactttgttgacggcacgg

SEQ ID NO: 478180 - DNA, 25 bp, Rattus norvegicus
gtacaccagaggaccactgttcaag

SEQ ID NO: 478181 - DNA, 25 bp, Rattus norvegicus
gtacaccagaggtccactgttcaag

SEQ ID NO: 478182 - DNA, 25 bp, Rattus norvegicus
gtacaccaggccaacactgcatcat

SEQ ID NO: 478183 - DNA, 25 bp, Rattus norvegicus
gtacaccaggcctacactgcatcat

SEQ ID NO: 478184 - DNA, 25 bp, Rattus norvegicus
gtacaccatctacatagctcctggg

SEQ ID NO: 478185 - DNA, 25 bp, Rattus norvegicus
gtacaccatctagatagctcctggg

SEQ ID NO: 478186 - DNA, 25 bp, Rattus norvegicus
gtacaccattttaaccagagctttg

SEQ ID NO: 478187 - DNA, 25 bp, Rattus norvegicus
gtacaccatttttaccagagctttg

SEQ ID NO: 478188 - DNA, 25 bp, Rattus norvegicus
gtacacccagagaatacttaccttg

SEQ ID NO: 478189 - DNA, 25 bp, Rattus norvegicus
gtacacccagagtatacttaccttg

SEQ ID NO: 478190 - DNA, 25 bp, Rattus norvegicus
gtacaccctgtacagcagcatacgt

SEQ ID NO: 478191 - DNA, 25 bp, Rattus norvegicus
gtacaccctgtagagcagcatacgt

SEQ ID NO: 478192 - DNA, 25 bp, Rattus norvegicus
gtacaccggcacattgagacataga

SEQ ID NO: 478193 - DNA, 25 bp, Rattus norvegicus
gtacaccggcactttgagacataga

SEQ ID NO: 478194 - DNA, 25 bp, Rattus norvegicus
gtacaccgggagcaactagtttctg

SEQ ID NO: 478195 - DNA, 25 bp, Rattus norvegicus
gtacaccgggaggaactagtttctg

SEQ ID NO: 478196 - DNA, 25 bp, Rattus norvegicus
gtacaccgtgaaacccagtatggta

SEQ ID NO: 478197 - DNA, 25 bp, Rattus norvegicus
gtacaccgtgaatcccagtatggta

SEQ ID NO: 478198 - DNA, 25 bp, Rattus norvegicus
gtacacctaacccagcatcaagacc

SEQ ID NO: 478199 - DNA, 25 bp, Rattus norvegicus
gtacacctaaccgagcatcaagacc

SEQ ID NO: 478200 - DNA, 25 bp, Rattus norvegicus
gtacacctagtgcttccagaacgga

SEQ ID NO: 478201 - DNA, 25 bp, Rattus norvegicus
gtacacctagtggttccagaacgga

SEQ ID NO: 478202 - DNA, 25 bp, Rattus norvegicus
gtacacctataaccccaggttctgt

SEQ ID NO: 478203 - DNA, 25 bp, Rattus norvegicus
gtacacctataagcccaggttctgt

SEQ ID NO: 478204 - DNA, 25 bp, Rattus norvegicus
gtacacctatgaaatgctctttgga

SEQ ID NO: 478205 - DNA, 25 bp, Rattus norvegicus
gtacacctatgatatgctctttgga

SEQ ID NO: 478206 - DNA, 25 bp, Rattus norvegicus
gtacacctcgacacaagatcatcag

SEQ ID NO: 478207 - DNA, 25 bp, Rattus norvegicus
gtacacctcgactcaagatcatcag

SEQ ID NO: 478208 - DNA, 25 bp, Rattus norvegicus
gtacacctctaacacttagttacat

SEQ ID NO: 478209 - DNA, 25 bp, Rattus norvegicus
gtacacctctaagacttagttacat

SEQ ID NO: 478210 - DNA, 25 bp, Rattus norvegicus
gtacacctctctattcatctgtggg

SEQ ID NO: 478211 - DNA, 25 bp, Rattus norvegicus
gtacacctctcttttcatctgtggg

SEQ ID NO: 478212 - DNA, 25 bp, Rattus norvegicus
gtacacctgactaattttaaagcga

SEQ ID NO: 478213 - DNA, 25 bp, Rattus norvegicus
gtacacctgacttattttaaagcga

SEQ ID NO: 478214 - DNA, 25 bp, Rattus norvegicus
gtacacctgataaacagatagctgt

SEQ ID NO: 478215 - DNA, 25 bp, Rattus norvegicus
gtacacctgatatacagatagctgt

SEQ ID NO: 478216 - DNA, 25 bp, Rattus norvegicus
gtacacctgatcaggaatggctatt

SEQ ID NO: 478217 - DNA, 25 bp, Rattus norvegicus
gtacacctgatctggaatggctatt

SEQ ID NO: 478218 - DNA, 25 bp, Rattus norvegicus
gtacacctgcaacgctgtcaacagc

SEQ ID NO: 478219 - DNA, 25 bp, Rattus norvegicus
gtacacctgcaaggctgtcaacagc

SEQ ID NO: 478220 - DNA, 25 bp, Rattus norvegicus
gtacacctgggacatggcaaagcat

SEQ ID NO: 478221 - DNA, 25 bp, Rattus norvegicus
gtacacctgggagatggcaaagcat

SEQ ID NO: 478222 - DNA, 25 bp, Rattus norvegicus
gtacacctgtgacctgctctgctgg

SEQ ID NO: 478223 - DNA, 25 bp, Rattus norvegicus
gtacacctgtgagctgctctgctgg

SEQ ID NO: 478224 - DNA, 25 bp, Rattus norvegicus
gtacacctgtgtatgcgcatgcata

SEQ ID NO: 478225 - DNA, 25 bp, Rattus norvegicus
gtacacctgtgtttgcgcatgcata

SEQ ID NO: 478226 - DNA, 25 bp, Rattus norvegicus
gtacaccttataaaactcatctccg

SEQ ID NO: 478227 - DNA, 25 bp, Rattus norvegicus
gtacaccttataccggaccatgaac

SEQ ID NO: 478228 - DNA, 25 bp, Rattus norvegicus
gtacaccttatagcggaccatgaac

SEQ ID NO: 478229 - DNA, 25 bp, Rattus norvegicus
gtacaccttatataactcatctccg

SEQ ID NO: 478230 - DNA, 25 bp, Rattus norvegicus
gtacaccttccaattttaagtgctt

SEQ ID NO: 478231 - DNA, 25 bp, Rattus norvegicus
gtacaccttccatttttaagtgctt

SEQ ID NO: 478232 - DNA, 25 bp, Rattus norvegicus
gtacaccttgatattcattctccac

SEQ ID NO: 478233 - DNA, 25 bp, Rattus norvegicus
gtacaccttgattttcattctccac

SEQ ID NO: 478234 - DNA, 25 bp, Rattus norvegicus
gtacaccttggacgctacacaaaag

SEQ ID NO: 478235 - DNA, 25 bp, Rattus norvegicus
gtacaccttggaggctacacaaaag

SEQ ID NO: 478236 - DNA, 25 bp, Rattus norvegicus
gtacaccttgtaatgggacactatt

SEQ ID NO: 478237 - DNA, 25 bp, Rattus norvegicus
gtacaccttgtattgggacactatt

SEQ ID NO: 478238 - DNA, 25 bp, Rattus norvegicus
gtacacgaacctccaagttactata

SEQ ID NO: 478239 - DNA, 25 bp, Rattus norvegicus
gtacacgaacctgcaagttactata

SEQ ID NO: 478240 - DNA, 25 bp, Rattus norvegicus
gtacacgaagttcccatcggtctgt

SEQ ID NO: 478241 - DNA, 25 bp, Rattus norvegicus
gtacacgaagttgccatcggtctgt

SEQ ID NO: 478242 - DNA, 25 bp, Rattus norvegicus
gtacacgacacacttgcccagaaga

SEQ ID NO: 478243 - DNA, 25 bp, Rattus norvegicus
gtacacgacacagttgcccagaaga

SEQ ID NO: 478244 - DNA, 25 bp, Rattus norvegicus
gtacacgagactccataaggccttt

SEQ ID NO: 478245 - DNA, 25 bp, Rattus norvegicus
gtacacgagactgcataaggccttt

SEQ ID NO: 478246 - DNA, 25 bp, Rattus norvegicus
gtacacgaggccaagttaccagttt

SEQ ID NO: 478247 - DNA, 25 bp, Rattus norvegicus
gtacacgaggcctagttaccagttt

SEQ ID NO: 478248 - DNA, 25 bp, Rattus norvegicus
gtacacgatccgctgagcatccaaa

SEQ ID NO: 478249 - DNA, 25 bp, Rattus norvegicus
gtacacgatccggtgagcatccaaa

SEQ ID NO: 478250 - DNA, 25 bp, Rattus norvegicus
gtacacgattctattttgtctatga

SEQ ID NO: 478251 - DNA, 25 bp, Rattus norvegicus
gtacacgattcttttttgtctatga

SEQ ID NO: 478252 - DNA, 25 bp, Rattus norvegicus
gtacacgcagctattaggtcagttg

SEQ ID NO: 478253 - DNA, 25 bp, Rattus norvegicus
gtacacgcagcttttaggtcagttg

SEQ ID NO: 478254 - DNA, 25 bp, Rattus norvegicus
gtacacgcggtgcacatgtatccta

SEQ ID NO: 478255 - DNA, 25 bp, Rattus norvegicus
gtacacgcggtggacatgtatccta

SEQ ID NO: 478256 - DNA, 25 bp, Rattus norvegicus
gtacacgcgtatacactctacagtg

SEQ ID NO: 478257 - DNA, 25 bp, Rattus norvegicus
gtacacgcgtattcactctacagtg

SEQ ID NO: 478258 - DNA, 25 bp, Rattus norvegicus
gtacacgctcctaatgatcatccga

SEQ ID NO: 478259 - DNA, 25 bp, Rattus norvegicus
gtacacgctccttatgatcatccga

SEQ ID NO: 478260 - DNA, 25 bp, Rattus norvegicus
gtacacgctgctcccacggtgagat

SEQ ID NO: 478261 - DNA, 25 bp, Rattus norvegicus
gtacacgctgctgccacggtgagat

SEQ ID NO: 478262 - DNA, 25 bp, Rattus norvegicus
gtacacggagtacaccggcacacta

SEQ ID NO: 478263 - DNA, 25 bp, Rattus norvegicus
gtacacggagtagaccggcacacta

SEQ ID NO: 478264 - DNA, 25 bp, Rattus norvegicus
gtacacggtgtgattgatgccagcc

SEQ ID NO: 478265 - DNA, 25 bp, Rattus norvegicus
gtacacggtgtgtttgatgccagcc

SEQ ID NO: 478266 - DNA, 25 bp, Rattus norvegicus
gtacacgtacctccgtttaactgtt

SEQ ID NO: 478267 - DNA, 25 bp, Rattus norvegicus
gtacacgtacctgcgtttaactgtt

SEQ ID NO: 478268 - DNA, 25 bp, Rattus norvegicus
gtacacgtgaagattccgagcatta

SEQ ID NO: 478269 - DNA, 25 bp, Rattus norvegicus
gtacacgtgaagtttccgagcatta

SEQ ID NO: 478270 - DNA, 25 bp, Rattus norvegicus
gtacacgtgaataattgtcttgctt

SEQ ID NO: 478271 - DNA, 25 bp, Rattus norvegicus
gtacacgtgaattattgtcttgctt

SEQ ID NO: 478272 - DNA, 25 bp, Rattus norvegicus
gtacacgtggccatggatgtgctaa

SEQ ID NO: 478273 - DNA, 25 bp, Rattus norvegicus
gtacacgtggccttggatgtgctaa

SEQ ID NO: 478274 - DNA, 25 bp, Rattus norvegicus
gtacacgttccgatgttttgtagaa

SEQ ID NO: 478275 - DNA, 25 bp, Rattus norvegicus
gtacacgttccgttgttttgtagaa

SEQ ID NO: 478276 - DNA, 25 bp, Rattus norvegicus
gtacacgttgctagtatttctgcac

SEQ ID NO: 478277 - DNA, 25 bp, Rattus norvegicus
gtacacgttgcttgtatttctgcac

SEQ ID NO: 478278 - DNA, 25 bp, Rattus norvegicus
gtacactaagtacatgcctcgctca

SEQ ID NO: 478279 - DNA, 25 bp, Rattus norvegicus
gtacactaagtagatgcctcgctca

SEQ ID NO: 478280 - DNA, 25 bp, Rattus norvegicus
gtacactacagcatcttatattttt

SEQ ID NO: 478281 - DNA, 25 bp, Rattus norvegicus
gtacactacagcttcttatattttt

SEQ ID NO: 478282 - DNA, 25 bp, Rattus norvegicus
gtacactagaggcttgctgtccttc

SEQ ID NO: 478283 - DNA, 25 bp, Rattus norvegicus
gtacactagagggttgctgtccttc

SEQ ID NO: 478284 - DNA, 25 bp, Rattus norvegicus
gtacactagatgagcctgacctgct

SEQ ID NO: 478285 - DNA, 25 bp, Rattus norvegicus
gtacactagatgtgcctgacctgct

SEQ ID NO: 478286 - DNA, 25 bp, Rattus norvegicus
gtacactcaagcacacttaaacaga

SEQ ID NO: 478287 - DNA, 25 bp, Rattus norvegicus
gtacactcaagctcacttaaacaga

SEQ ID NO: 478288 - DNA, 25 bp, Rattus norvegicus
gtacactcagccattatgctagatg

SEQ ID NO: 478289 - DNA, 25 bp, Rattus norvegicus
gtacactcagcctttatgctagatg

SEQ ID NO: 478290 - DNA, 25 bp, Rattus norvegicus
gtacactcaggacagaatgtgaccc

SEQ ID NO: 478291 - DNA, 25 bp, Rattus norvegicus
gtacactcaggagagaatgtgaccc

SEQ ID NO: 478292 - DNA, 25 bp, Rattus norvegicus
gtacactcagggaaccaggccctta

SEQ ID NO: 478293 - DNA, 25 bp, Rattus norvegicus
gtacactcagggtaccaggccctta

SEQ ID NO: 478294 - DNA, 25 bp, Rattus norvegicus
gtacactcagtgctgggcttcgtaa

SEQ ID NO: 478295 - DNA, 25 bp, Rattus norvegicus
gtacactcagtggtgggcttcgtaa

SEQ ID NO: 478296 - DNA, 25 bp, Rattus norvegicus
gtacactccctacaaattattttgt

SEQ ID NO: 478297 - DNA, 25 bp, Rattus norvegicus
gtacactccctagaaattattttgt

SEQ ID NO: 478298 - DNA, 25 bp, Rattus norvegicus
gtacactcgggcagaacacccatac

SEQ ID NO: 478299 - DNA, 25 bp, Rattus norvegicus
gtacactcgggctgaacacccatac

SEQ ID NO: 478300 - DNA, 25 bp, Rattus norvegicus
gtacactcgtggaagtcggccagcg

SEQ ID NO: 478301 - DNA, 25 bp, Rattus norvegicus
gtacactcgtggtagtcggccagcg

SEQ ID NO: 478302 - DNA, 25 bp, Rattus norvegicus
gtacactctagcagggtggctaaaa

SEQ ID NO: 478303 - DNA, 25 bp, Rattus norvegicus
gtacactctagctgggtggctaaaa

SEQ ID NO: 478304 - DNA, 25 bp, Rattus norvegicus
gtacactctcctccaattaaattga

SEQ ID NO: 478305 - DNA, 25 bp, Rattus norvegicus
gtacactctcctgcaattaaattga

SEQ ID NO: 478306 - DNA, 25 bp, Rattus norvegicus
gtacactctgtaacctgatctaaag

SEQ ID NO: 478307 - DNA, 25 bp, Rattus norvegicus
gtacactctgtacacggaagatttt

SEQ ID NO: 478308 - DNA, 25 bp, Rattus norvegicus
gtacactctgtagacggaagatttt

SEQ ID NO: 478309 - DNA, 25 bp, Rattus norvegicus
gtacactctgtatcctgatctaaag

SEQ ID NO: 478310 - DNA, 25 bp, Rattus norvegicus
gtacactctgtgatgatgtccggct

SEQ ID NO: 478311 - DNA, 25 bp, Rattus norvegicus
gtacactctgtgttgatgtccggct

SEQ ID NO: 478312 - DNA, 25 bp, Rattus norvegicus
gtacactgaagtagttccctgaggt

SEQ ID NO: 478313 - DNA, 25 bp, Rattus norvegicus
gtacactgaagttgttccctgaggt

SEQ ID NO: 478314 - DNA, 25 bp, Rattus norvegicus
gtacactgacctcacaaagtctgtg

SEQ ID NO: 478315 - DNA, 25 bp, Rattus norvegicus
gtacactgacctgacaaagtctgtg

SEQ ID NO: 478316 - DNA, 25 bp, Rattus norvegicus
gtacactgacgtctcggtgattcca

SEQ ID NO: 478317 - DNA, 25 bp, Rattus norvegicus
gtacactgacgtgtcggtgattcca

SEQ ID NO: 478318 - DNA, 25 bp, Rattus norvegicus
gtacactgatcacgcccaacgacga

SEQ ID NO: 478319 - DNA, 25 bp, Rattus norvegicus
gtacactgatcaggcccaacgacga

SEQ ID NO: 478320 - DNA, 25 bp, Rattus norvegicus
gtacactgcaacaaataagccaagg

SEQ ID NO: 478321 - DNA, 25 bp, Rattus norvegicus
gtacactgcaactaataagccaagg

SEQ ID NO: 478322 - DNA, 25 bp, Rattus norvegicus
gtacactgcaagacaaacgttgatt

SEQ ID NO: 478323 - DNA, 25 bp, Rattus norvegicus
gtacactgcaagtcaaacgttgatt

SEQ ID NO: 478324 - DNA, 25 bp, Rattus norvegicus
gtacactgcagtcttcttgatccgc

SEQ ID NO: 478325 - DNA, 25 bp, Rattus norvegicus
gtacactgcagtgttcttgatccgc

SEQ ID NO: 478326 - DNA, 25 bp, Rattus norvegicus
gtacactgctttaccagggctgtgg

SEQ ID NO: 478327 - DNA, 25 bp, Rattus norvegicus
gtacactgcttttccagggctgtgg

SEQ ID NO: 478328 - DNA, 25 bp, Rattus norvegicus
gtacactggagaagtgtctgccctc

SEQ ID NO: 478329 - DNA, 25 bp, Rattus norvegicus
gtacactggagatgtgtctgccctc

SEQ ID NO: 478330 - DNA, 25 bp, Rattus norvegicus
gtacactggcaaccattcaagctct

SEQ ID NO: 478331 - DNA, 25 bp, Rattus norvegicus
gtacactggcaagcattcaagctct

SEQ ID NO: 478332 - DNA, 25 bp, Rattus norvegicus
gtacactggcacagacaagctccta

SEQ ID NO: 478333 - DNA, 25 bp, Rattus norvegicus
gtacactggcactgacaagctccta

SEQ ID NO: 478334 - DNA, 25 bp, Rattus norvegicus
gtacactgggcaccagaccattgat

SEQ ID NO: 478335 - DNA, 25 bp, Rattus norvegicus
gtacactgggcagcagaccattgat

SEQ ID NO: 478336 - DNA, 25 bp, Rattus norvegicus
gtacactggtacatagcgctgttcg

SEQ ID NO: 478337 - DNA, 25 bp, Rattus norvegicus
gtacactggtacttagcgctgttcg

SEQ ID NO: 478338 - DNA, 25 bp, Rattus norvegicus
gtacactgtccacggaactctgaat

SEQ ID NO: 478339 - DNA, 25 bp, Rattus norvegicus
gtacactgtccagggaactctgaat

SEQ ID NO: 478340 - DNA, 25 bp, Rattus norvegicus
gtacactgtgcccattctcttgatt

SEQ ID NO: 478341 - DNA, 25 bp, Rattus norvegicus
gtacactgtgccgattctcttgatt

SEQ ID NO: 478342 - DNA, 25 bp, Rattus norvegicus
gtacactgtgttcattttgcatgat

SEQ ID NO: 478343 - DNA, 25 bp, Rattus norvegicus
gtacactgtgttgattttgcatgat

SEQ ID NO: 478344 - DNA, 25 bp, Rattus norvegicus
gtacacttaatcaatttctaacgaa

SEQ ID NO: 478345 - DNA, 25 bp, Rattus norvegicus
gtacacttaatctatttctaacgaa

SEQ ID NO: 478346 - DNA, 25 bp, Rattus norvegicus
gtacacttagcaactttcaggccac

SEQ ID NO: 478347 - DNA, 25 bp, Rattus norvegicus
gtacacttagcatctttcaggccac

SEQ ID NO: 478348 - DNA, 25 bp, Rattus norvegicus
gtacacttatgtcttcgctttctac

SEQ ID NO: 478349 - DNA, 25 bp, Rattus norvegicus
gtacacttatgtgttcgctttctac

SEQ ID NO: 478350 - DNA, 25 bp, Rattus norvegicus
gtacacttcatcaactatgatctat

SEQ ID NO: 478351 - DNA, 25 bp, Rattus norvegicus
gtacacttcatctactatgatctat

SEQ ID NO: 478352 - DNA, 25 bp, Rattus norvegicus
gtacacttcgtcctttatgttctgt

SEQ ID NO: 478353 - DNA, 25 bp, Rattus norvegicus
gtacacttcgtcgtttatgttctgt

SEQ ID NO: 478354 - DNA, 25 bp, Rattus norvegicus
gtacacttcttgaccatgttggact

SEQ ID NO: 478355 - DNA, 25 bp, Rattus norvegicus
gtacacttcttgtccatgttggact

SEQ ID NO: 478356 - DNA, 25 bp, Rattus norvegicus
gtacacttgattccagacggccagt

SEQ ID NO: 478357 - DNA, 25 bp, Rattus norvegicus
gtacacttgattgcagacggccagt

SEQ ID NO: 478358 - DNA, 25 bp, Rattus norvegicus
gtacacttgggcattttatacagta

SEQ ID NO: 478359 - DNA, 25 bp, Rattus norvegicus
gtacacttgggctttttatacagta

SEQ ID NO: 478360 - DNA, 25 bp, Rattus norvegicus
gtacacttgtttactcggaactaca

SEQ ID NO: 478361 - DNA, 25 bp, Rattus norvegicus
gtacacttgttttctcggaactaca

SEQ ID NO: 478362 - DNA, 25 bp, Rattus norvegicus
gtacactttgtaccactaacactgt

SEQ ID NO: 478363 - DNA, 25 bp, Rattus norvegicus
gtacactttgtagcactaacactgt

SEQ ID NO: 478364 - DNA, 25 bp, Rattus norvegicus
gtacagaaaggacttcgccaaaggt

SEQ ID NO: 478365 - DNA, 25 bp, Rattus norvegicus
gtacagaaaggagttcgccaaaggt

SEQ ID NO: 478366 - DNA, 25 bp, Rattus norvegicus
gtacagaaccaaatggccgctggat

SEQ ID NO: 478367 - DNA, 25 bp, Rattus norvegicus
gtacagaaccaattggccgctggat

SEQ ID NO: 478368 - DNA, 25 bp, Rattus norvegicus
gtacagaaggagaccaccacagcac

SEQ ID NO: 478369 - DNA, 25 bp, Rattus norvegicus
gtacagaaggagtccaccacagcac

SEQ ID NO: 478370 - DNA, 25 bp, Rattus norvegicus
gtacagaaggctctggacaccctga

SEQ ID NO: 478371 - DNA, 25 bp, Rattus norvegicus
gtacagaaggctgtggacaccctga

SEQ ID NO: 478372 - DNA, 25 bp, Rattus norvegicus
gtacagaagtcaagctcttggccca

SEQ ID NO: 478373 - DNA, 25 bp, Rattus norvegicus
gtacagaagtcatgctcttggccca

SEQ ID NO: 478374 - DNA, 25 bp, Rattus norvegicus
gtacagaatatcacctgtggccgtg

SEQ ID NO: 478375 - DNA, 25 bp, Rattus norvegicus
gtacagaatatctcctgtggccgtg

SEQ ID NO: 478376 - DNA, 25 bp, Rattus norvegicus
gtacagaatcaaagtcactccttta

SEQ ID NO: 478377 - DNA, 25 bp, Rattus norvegicus
gtacagaatcaatgtcactccttta

SEQ ID NO: 478378 - DNA, 25 bp, Rattus norvegicus
gtacagaatctcaaagtcctctttg

SEQ ID NO: 478379 - DNA, 25 bp, Rattus norvegicus
gtacagaatctctaagtcctctttg

SEQ ID NO: 478380 - DNA, 25 bp, Rattus norvegicus
gtacagaatttcctcagccataata

SEQ ID NO: 478381 - DNA, 25 bp, Rattus norvegicus
gtacagaatttcgtcagccataata

SEQ ID NO: 478382 - DNA, 25 bp, Rattus norvegicus
gtacagacactgatctaatgagagg

SEQ ID NO: 478383 - DNA, 25 bp, Rattus norvegicus
gtacagacactgttctaatgagagg

SEQ ID NO: 478384 - DNA, 25 bp, Rattus norvegicus
gtacagacaggaagacagcccacat

SEQ ID NO: 478385 - DNA, 25 bp, Rattus norvegicus
gtacagacaggatgacagcccacat

SEQ ID NO: 478386 - DNA, 25 bp, Rattus norvegicus
gtacagacagtgctggttacctcga

SEQ ID NO: 478387 - DNA, 25 bp, Rattus norvegicus
gtacagacagtggtggttacctcga

SEQ ID NO: 478388 - DNA, 25 bp, Rattus norvegicus
gtacagacatgaaccactgaatagt

SEQ ID NO: 478389 - DNA, 25 bp, Rattus norvegicus
gtacagacatgatccactgaatagt

SEQ ID NO: 478390 - DNA, 25 bp, Rattus norvegicus
gtacagaccacacaccagagcttgc

SEQ ID NO: 478391 - DNA, 25 bp, Rattus norvegicus
gtacagaccacagaccagagcttgc

SEQ ID NO: 478392 - DNA, 25 bp, Rattus norvegicus
gtacagaccttcatacctggagaat

SEQ ID NO: 478393 - DNA, 25 bp, Rattus norvegicus
gtacagaccttcttacctggagaat

SEQ ID NO: 478394 - DNA, 25 bp, Rattus norvegicus
gtacagacgccaaccattagagtaa

SEQ ID NO: 478395 - DNA, 25 bp, Rattus norvegicus
gtacagacgccatccattagagtaa

SEQ ID NO: 478396 - DNA, 25 bp, Rattus norvegicus
gtacagactatgatgagaagtgcca

SEQ ID NO: 478397 - DNA, 25 bp, Rattus norvegicus
gtacagactatgttgagaagtgcca

SEQ ID NO: 478398 - DNA, 25 bp, Rattus norvegicus
gtacagactcatagcccgcatgctg

SEQ ID NO: 478399 - DNA, 25 bp, Rattus norvegicus
gtacagactcattgcccgcatgctg

SEQ ID NO: 478400 - DNA, 25 bp, Rattus norvegicus
gtacagacttgaacttattcctccc

SEQ ID NO: 478401 - DNA, 25 bp, Rattus norvegicus
gtacagacttgatcttattcctccc

SEQ ID NO: 478402 - DNA, 25 bp, Rattus norvegicus
gtacagagacagcatttaaatgttt

SEQ ID NO: 478403 - DNA, 25 bp, Rattus norvegicus
gtacagagacaggatttaaatgttt

SEQ ID NO: 478404 - DNA, 25 bp, Rattus norvegicus
gtacagagacataacctggatcctg

SEQ ID NO: 478405 - DNA, 25 bp, Rattus norvegicus
gtacagagacattacctggatcctg

SEQ ID NO: 478406 - DNA, 25 bp, Rattus norvegicus
gtacagagacgaccttttatttcag

SEQ ID NO: 478407 - DNA, 25 bp, Rattus norvegicus
gtacagagacgagcttttatttcag

SEQ ID NO: 478408 - DNA, 25 bp, Rattus norvegicus
gtacagagccatctgcacagttaca

SEQ ID NO: 478409 - DNA, 25 bp, Rattus norvegicus
gtacagagccatgtgcacagttaca

SEQ ID NO: 478410 - DNA, 25 bp, Rattus norvegicus
gtacagagctgtcaggacttccttc

SEQ ID NO: 478411 - DNA, 25 bp, Rattus norvegicus
gtacagagctgtgaggacttccttc

SEQ ID NO: 478412 - DNA, 25 bp, Rattus norvegicus
gtacagagcttgatccttactaggc

SEQ ID NO: 478413 - DNA, 25 bp, Rattus norvegicus
gtacagagcttgttccttactaggc

SEQ ID NO: 478414 - DNA, 25 bp, Rattus norvegicus
gtacagaggtgaacctcccagtgta

SEQ ID NO: 478415 - DNA, 25 bp, Rattus norvegicus
gtacagaggtgatcctcccagtgta

SEQ ID NO: 478416 - DNA, 25 bp, Rattus norvegicus
gtacagaggtttacactggttctat

SEQ ID NO: 478417 - DNA, 25 bp, Rattus norvegicus
gtacagaggttttcactggttctat

SEQ ID NO: 478418 - DNA, 25 bp, Rattus norvegicus
gtacagagttctagctgtcatagct

SEQ ID NO: 478419 - DNA, 25 bp, Rattus norvegicus
gtacagagttcttgctgtcatagct

SEQ ID NO: 478420 - DNA, 25 bp, Rattus norvegicus
gtacagagttgacatcaggtgttct

SEQ ID NO: 478421 - DNA, 25 bp, Rattus norvegicus
gtacagagttgagatcaggtgttct

SEQ ID NO: 478422 - DNA, 25 bp, Rattus norvegicus
gtacagagttgcagcagtccttctg

SEQ ID NO: 478423 - DNA, 25 bp, Rattus norvegicus
gtacagagttgctgcagtccttctg

SEQ ID NO: 478424 - DNA, 25 bp, Rattus norvegicus
gtacagataacaccttaatggccaa

SEQ ID NO: 478425 - DNA, 25 bp, Rattus norvegicus
gtacagataacagcttaatggccaa

SEQ ID NO: 478426 - DNA, 25 bp, Rattus norvegicus
gtacagatctacagagaggcccaaa

SEQ ID NO: 478427 - DNA, 25 bp, Rattus norvegicus
gtacagatctactgagaggcccaaa

SEQ ID NO: 478428 - DNA, 25 bp, Rattus norvegicus
gtacagatgatcagccttggcgacc

SEQ ID NO: 478429 - DNA, 25 bp, Rattus norvegicus
gtacagatgatctgccttggcgacc

SEQ ID NO: 478430 - DNA, 25 bp, Rattus norvegicus
gtacagatgctcattagagggaatc

SEQ ID NO: 478431 - DNA, 25 bp, Rattus norvegicus
gtacagatgctctttagagggaatc

SEQ ID NO: 478432 - DNA, 25 bp, Rattus norvegicus
gtacagattgtcagggaatagccca

SEQ ID NO: 478433 - DNA, 25 bp, Rattus norvegicus
gtacagattgtctgggaatagccca

SEQ ID NO: 478434 - DNA, 25 bp, Rattus norvegicus
gtacagatttctatgcaggcaaacc

SEQ ID NO: 478435 - DNA, 25 bp, Rattus norvegicus
gtacagatttctttgcaggcaaacc

SEQ ID NO: 478436 - DNA, 25 bp, Rattus norvegicus
gtacagcaaatgcatcctggacctg

SEQ ID NO: 478437 - DNA, 25 bp, Rattus norvegicus
gtacagcaaatggatcctggacctg

SEQ ID NO: 478438 - DNA, 25 bp, Rattus norvegicus
gtacagcaagtacccttaaccggtg

SEQ ID NO: 478439 - DNA, 25 bp, Rattus norvegicus
gtacagcaagtagccttaaccggtg

SEQ ID NO: 478440 - DNA, 25 bp, Rattus norvegicus
gtacagcaatggctggcttcgtaat

SEQ ID NO: 478441 - DNA, 25 bp, Rattus norvegicus
gtacagcaatgggtggcttcgtaat

SEQ ID NO: 478442 - DNA, 25 bp, Rattus norvegicus
gtacagcaccacactggtgtcatgt

SEQ ID NO: 478443 - DNA, 25 bp, Rattus norvegicus
gtacagcaccactctggtgtcatgt

SEQ ID NO: 478444 - DNA, 25 bp, Rattus norvegicus
gtacagcagagaaaagcaccacaaa

SEQ ID NO: 478445 - DNA, 25 bp, Rattus norvegicus
gtacagcagagataagcaccacaaa

SEQ ID NO: 478446 - DNA, 25 bp, Rattus norvegicus
gtacagcatctacgagctcgtggaa

SEQ ID NO: 478447 - DNA, 25 bp, Rattus norvegicus
gtacagcatctaggagctcgtggaa

SEQ ID NO: 478448 - DNA, 25 bp, Rattus norvegicus
gtacagcatgaactctgagcgattt

SEQ ID NO: 478449 - DNA, 25 bp, Rattus norvegicus
gtacagcatgaagtctgagcgattt

SEQ ID NO: 478450 - DNA, 25 bp, Rattus norvegicus
gtacagcatgtgaccacaccaagac

SEQ ID NO: 478451 - DNA, 25 bp, Rattus norvegicus
gtacagcatgtgtccacaccaagac

SEQ ID NO: 478452 - DNA, 25 bp, Rattus norvegicus
gtacagcatttcagaacacagcaca

SEQ ID NO: 478453 - DNA, 25 bp, Rattus norvegicus
gtacagcatttctgaacacagcaca

SEQ ID NO: 478454 - DNA, 25 bp, Rattus norvegicus
gtacagccaaatcgtggtcagcaac

SEQ ID NO: 478455 - DNA, 25 bp, Rattus norvegicus
gtacagccaaatggtggtcagcaac

SEQ ID NO: 478456 - DNA, 25 bp, Rattus norvegicus
gtacagccaattcgtttttcaacaa

SEQ ID NO: 478457 - DNA, 25 bp, Rattus norvegicus
gtacagccaattggtttttcaacaa

SEQ ID NO: 478458 - DNA, 25 bp, Rattus norvegicus
gtacagccactgatggactacacag

SEQ ID NO: 478459 - DNA, 25 bp, Rattus norvegicus
gtacagccactgttggactacacag

SEQ ID NO: 478460 - DNA, 25 bp, Rattus norvegicus
gtacagccagtcaggagaggtttct

SEQ ID NO: 478461 - DNA, 25 bp, Rattus norvegicus
gtacagccagtctggagaggtttct

SEQ ID NO: 478462 - DNA, 25 bp, Rattus norvegicus
gtacagcccataactgtgcaatgga

SEQ ID NO: 478463 - DNA, 25 bp, Rattus norvegicus
gtacagcccatatctgtgcaatgga

SEQ ID NO: 478464 - DNA, 25 bp, Rattus norvegicus
gtacagcccattattcatgtctgaa

SEQ ID NO: 478465 - DNA, 25 bp, Rattus norvegicus
gtacagcccatttttcatgtctgaa

SEQ ID NO: 478466 - DNA, 25 bp, Rattus norvegicus
gtacagccgcatcgggttcacggct

SEQ ID NO: 478467 - DNA, 25 bp, Rattus norvegicus
gtacagccgcatggggttcacggct

SEQ ID NO: 478468 - DNA, 25 bp, Rattus norvegicus
gtacagccggagattggacgacaat

SEQ ID NO: 478469 - DNA, 25 bp, Rattus norvegicus
gtacagccggagtttggacgacaat

SEQ ID NO: 478470 - DNA, 25 bp, Rattus norvegicus
gtacagcctgcactgagacatagat

SEQ ID NO: 478471 - DNA, 25 bp, Rattus norvegicus
gtacagcctgcagtgagacatagat

SEQ ID NO: 478472 - DNA, 25 bp, Rattus norvegicus
gtacagcctgggactttggacagtg

SEQ ID NO: 478473 - DNA, 25 bp, Rattus norvegicus
gtacagcctgggtctttggacagtg

SEQ ID NO: 478474 - DNA, 25 bp, Rattus norvegicus
gtacagccttgactatttcaaccat

SEQ ID NO: 478475 - DNA, 25 bp, Rattus norvegicus
gtacagccttgagtatttcaaccat

SEQ ID NO: 478476 - DNA, 25 bp, Rattus norvegicus
gtacagcctttaaaatgcaccccag

SEQ ID NO: 478477 - DNA, 25 bp, Rattus norvegicus
gtacagcctttataatgcaccccag

SEQ ID NO: 478478 - DNA, 25 bp, Rattus norvegicus
gtacagcgacgcacagcaatggcaa

SEQ ID NO: 478479 - DNA, 25 bp, Rattus norvegicus
gtacagcgacgctcagcaatggcaa

SEQ ID NO: 478480 - DNA, 25 bp, Rattus norvegicus
gtacagcgcctgaagaacttgtata

SEQ ID NO: 478481 - DNA, 25 bp, Rattus norvegicus
gtacagcgcctgtagaacttgtata

SEQ ID NO: 478482 - DNA, 25 bp, Rattus norvegicus
gtacagcgggacagccaccttctac

SEQ ID NO: 478483 - DNA, 25 bp, Rattus norvegicus
gtacagcgggactgccaccttctac

SEQ ID NO: 478484 - DNA, 25 bp, Rattus norvegicus
gtacagcgtcatataggctttgcct

SEQ ID NO: 478485 - DNA, 25 bp, Rattus norvegicus
gtacagcgtcatcctttgggcagta

SEQ ID NO: 478486 - DNA, 25 bp, Rattus norvegicus
gtacagcgtcatgctttgggcagta

SEQ ID NO: 478487 - DNA, 25 bp, Rattus norvegicus
gtacagcgtcatttaggctttgcct

SEQ ID NO: 478488 - DNA, 25 bp, Rattus norvegicus
gtacagctaaagagtggaccccaga

SEQ ID NO: 478489 - DNA, 25 bp, Rattus norvegicus
gtacagctaaagtgtggaccccaga

SEQ ID NO: 478490 - DNA, 25 bp, Rattus norvegicus
gtacagctatacaaacaggccaggg

SEQ ID NO: 478491 - DNA, 25 bp, Rattus norvegicus
gtacagctatacacctgagtctctt

SEQ ID NO: 478492 - DNA, 25 bp, Rattus norvegicus
gtacagctatactaacaggccaggg

SEQ ID NO: 478493 - DNA, 25 bp, Rattus norvegicus
gtacagctatactcctgagtctctt

SEQ ID NO: 478494 - DNA, 25 bp, Rattus norvegicus
gtacagctcctgatcataaattctt

SEQ ID NO: 478495 - DNA, 25 bp, Rattus norvegicus
gtacagctcctgttcataaattctt

SEQ ID NO: 478496 - DNA, 25 bp, Rattus norvegicus
gtacagctccttattgacaatgagg

SEQ ID NO: 478497 - DNA, 25 bp, Rattus norvegicus
gtacagctcctttttgacaatgagg

SEQ ID NO: 478498 - DNA, 25 bp, Rattus norvegicus
gtacagctggctcggacacaagagt

SEQ ID NO: 478499 - DNA, 25 bp, Rattus norvegicus
gtacagctggctgggacacaagagt

SEQ ID NO: 478500 - DNA, 25 bp, Rattus norvegicus
gtacagcttaaaacacggacagtga

SEQ ID NO: 478501 - DNA, 25 bp, Rattus norvegicus
gtacagcttaaatcacggacagtga

SEQ ID NO: 478502 - DNA, 25 bp, Rattus norvegicus
gtacagcttctacaaacaggccacc

SEQ ID NO: 478503 - DNA, 25 bp, Rattus norvegicus
gtacagcttctagaaacaggccacc

SEQ ID NO: 478504 - DNA, 25 bp, Rattus norvegicus
gtacagctttgccatgtgatgacaa

SEQ ID NO: 478505 - DNA, 25 bp, Rattus norvegicus
gtacagctttgcgatgtgatgacaa

SEQ ID NO: 478506 - DNA, 25 bp, Rattus norvegicus
gtacaggaaagcacagttcccctgg

SEQ ID NO: 478507 - DNA, 25 bp, Rattus norvegicus
gtacaggaaagctcagttcccctgg

SEQ ID NO: 478508 - DNA, 25 bp, Rattus norvegicus
gtacaggaagtgagccgccattatc

SEQ ID NO: 478509 - DNA, 25 bp, Rattus norvegicus
gtacaggaagtgtgccgccattatc

SEQ ID NO: 478510 - DNA, 25 bp, Rattus norvegicus
gtacaggacacaaattttcacacca

SEQ ID NO: 478511 - DNA, 25 bp, Rattus norvegicus
gtacaggacacatattttcacacca

SEQ ID NO: 478512 - DNA, 25 bp, Rattus norvegicus
gtacaggaccagaaaccaaacctat

SEQ ID NO: 478513 - DNA, 25 bp, Rattus norvegicus
gtacaggaccagtaaccaaacctat

SEQ ID NO: 478514 - DNA, 25 bp, Rattus norvegicus
gtacaggagaggatcaacagttgct

SEQ ID NO: 478515 - DNA, 25 bp, Rattus norvegicus
gtacaggagaggttcaacagttgct

SEQ ID NO: 478516 - DNA, 25 bp, Rattus norvegicus
gtacaggagtctctgagtctcacag

SEQ ID NO: 478517 - DNA, 25 bp, Rattus norvegicus
gtacaggagtctgtgagtctcacag

SEQ ID NO: 478518 - DNA, 25 bp, Rattus norvegicus
gtacaggataacaccaacgccaggc

SEQ ID NO: 478519 - DNA, 25 bp, Rattus norvegicus
gtacaggataactccaacgccaggc

SEQ ID NO: 478520 - DNA, 25 bp, Rattus norvegicus
gtacaggcaagtactgggcccatga

SEQ ID NO: 478521 - DNA, 25 bp, Rattus norvegicus
gtacaggcaagttctgggcccatga

SEQ ID NO: 478522 - DNA, 25 bp, Rattus norvegicus
gtacaggcacaacacattctttcta

SEQ ID NO: 478523 - DNA, 25 bp, Rattus norvegicus
gtacaggcacaagacattctttcta

SEQ ID NO: 478524 - DNA, 25 bp, Rattus norvegicus
gtacaggcacataaccattcatggt

SEQ ID NO: 478525 - DNA, 25 bp, Rattus norvegicus
gtacaggcacattaccattcatggt

SEQ ID NO: 478526 - DNA, 25 bp, Rattus norvegicus
gtacaggcactaaaacagcattaat

SEQ ID NO: 478527 - DNA, 25 bp, Rattus norvegicus
gtacaggcactataacagcattaat

SEQ ID NO: 478528 - DNA, 25 bp, Rattus norvegicus
gtacaggcagaaacccaggactggc

SEQ ID NO: 478529 - DNA, 25 bp, Rattus norvegicus
gtacaggcagaatcccaggactggc

SEQ ID NO: 478530 - DNA, 25 bp, Rattus norvegicus
gtacaggcagcacattgaagaacta

SEQ ID NO: 478531 - DNA, 25 bp, Rattus norvegicus
gtacaggcagcagattgaagaacta

SEQ ID NO: 478532 - DNA, 25 bp, Rattus norvegicus
gtacaggcataaatcactgcttacc

SEQ ID NO: 478533 - DNA, 25 bp, Rattus norvegicus
gtacaggcataattcactgcttacc

SEQ ID NO: 478534 - DNA, 25 bp, Rattus norvegicus
gtacaggccagtatgaccttggatt

SEQ ID NO: 478535 - DNA, 25 bp, Rattus norvegicus
gtacaggccagtttgaccttggatt

SEQ ID NO: 478536 - DNA, 25 bp, Rattus norvegicus
gtacaggccgatataatggtcagtt

SEQ ID NO: 478537 - DNA, 25 bp, Rattus norvegicus
gtacaggccgatttaatggtcagtt

SEQ ID NO: 478538 - DNA, 25 bp, Rattus norvegicus
gtacaggccttcactttggaagcta

SEQ ID NO: 478539 - DNA, 25 bp, Rattus norvegicus
gtacaggccttctctttggaagcta

SEQ ID NO: 478540 - DNA, 25 bp, Rattus norvegicus
gtacaggcgtgcatcactgtcggac

SEQ ID NO: 478541 - DNA, 25 bp, Rattus norvegicus
gtacaggcgtgcttcactgtcggac

SEQ ID NO: 478542 - DNA, 25 bp, Rattus norvegicus
gtacaggctcatccttacagtggta

SEQ ID NO: 478543 - DNA, 25 bp, Rattus norvegicus
gtacaggctcatgcttacagtggta

SEQ ID NO: 478544 - DNA, 25 bp, Rattus norvegicus
gtacaggctcctcctgttaacagct

SEQ ID NO: 478545 - DNA, 25 bp, Rattus norvegicus
gtacaggctcctgctgttaacagct

SEQ ID NO: 478546 - DNA, 25 bp, Rattus norvegicus
gtacaggctctgattaaccacatgg

SEQ ID NO: 478547 - DNA, 25 bp, Rattus norvegicus
gtacaggctctgtttaaccacatgg

SEQ ID NO: 478548 - DNA, 25 bp, Rattus norvegicus
gtacaggctgttatgtgctttttgt

SEQ ID NO: 478549 - DNA, 25 bp, Rattus norvegicus
gtacaggctgttttgtgctttttgt

SEQ ID NO: 478550 - DNA, 25 bp, Rattus norvegicus
gtacagggaagaacagctttcataa

SEQ ID NO: 478551 - DNA, 25 bp, Rattus norvegicus
gtacagggaagatcagctttcataa

SEQ ID NO: 478552 - DNA, 25 bp, Rattus norvegicus
gtacagggagccacaaagcagagtt

SEQ ID NO: 478553 - DNA, 25 bp, Rattus norvegicus
gtacagggagcctcaaagcagagtt

SEQ ID NO: 478554 - DNA, 25 bp, Rattus norvegicus
gtacagggagctaatggccctacat

SEQ ID NO: 478555 - DNA, 25 bp, Rattus norvegicus
gtacagggagcttatggccctacat

SEQ ID NO: 478556 - DNA, 25 bp, Rattus norvegicus
gtacaggggcttcactcctgtcttg

SEQ ID NO: 478557 - DNA, 25 bp, Rattus norvegicus
gtacaggggcttgactcctgtcttg

SEQ ID NO: 478558 - DNA, 25 bp, Rattus norvegicus
gtacagggtacacttgactatgggt

SEQ ID NO: 478559 - DNA, 25 bp, Rattus norvegicus
gtacagggtacagttgactatgggt

SEQ ID NO: 478560 - DNA, 25 bp, Rattus norvegicus
gtacagggtaggatgctcctgacct

SEQ ID NO: 478561 - DNA, 25 bp, Rattus norvegicus
gtacagggtaggttgctcctgacct

SEQ ID NO: 478562 - DNA, 25 bp, Rattus norvegicus
gtacaggtaaacaagcggacaggaa

SEQ ID NO: 478563 - DNA, 25 bp, Rattus norvegicus
gtacaggtaaactagcggacaggaa

SEQ ID NO: 478564 - DNA, 25 bp, Rattus norvegicus
gtacaggtacatccatatatccaac

SEQ ID NO: 478565 - DNA, 25 bp, Rattus norvegicus
gtacaggtacatgcatatatccaac

SEQ ID NO: 478566 - DNA, 25 bp, Rattus norvegicus
gtacaggtatcacttctcttgtctc

SEQ ID NO: 478567 - DNA, 25 bp, Rattus norvegicus
gtacaggtatcagttctcttgtctc

SEQ ID NO: 478568 - DNA, 25 bp, Rattus norvegicus
gtacaggtatttatgcctgcttgta

SEQ ID NO: 478569 - DNA, 25 bp, Rattus norvegicus
gtacaggtatttttgcctgcttgta

SEQ ID NO: 478570 - DNA, 25 bp, Rattus norvegicus
gtacaggtccatcatcggattcttt

SEQ ID NO: 478571 - DNA, 25 bp, Rattus norvegicus
gtacaggtccatgatcggattcttt

SEQ ID NO: 478572 - DNA, 25 bp, Rattus norvegicus
gtacaggtctaaatctgctcagctg

SEQ ID NO: 478573 - DNA, 25 bp, Rattus norvegicus
gtacaggtctaattctgctcagctg

SEQ ID NO: 478574 - DNA, 25 bp, Rattus norvegicus
gtacaggtctcccaccggaaaactg

SEQ ID NO: 478575 - DNA, 25 bp, Rattus norvegicus
gtacaggtctccgaccggaaaactg

SEQ ID NO: 478576 - DNA, 25 bp, Rattus norvegicus
gtacaggtgctaatttggtgcctta

SEQ ID NO: 478577 - DNA, 25 bp, Rattus norvegicus
gtacaggtgctattttggtgcctta

SEQ ID NO: 478578 - DNA, 25 bp, Rattus norvegicus
gtacaggtgtccatagaaattttca

SEQ ID NO: 478579 - DNA, 25 bp, Rattus norvegicus
gtacaggtgtccttagaaattttca

SEQ ID NO: 478580 - DNA, 25 bp, Rattus norvegicus
gtacaggtgtgtacggcacccggta

SEQ ID NO: 478581 - DNA, 25 bp, Rattus norvegicus
gtacaggtgtgttcggcacccggta

SEQ ID NO: 478582 - DNA, 25 bp, Rattus norvegicus
gtacaggttaaaactgccttaagtg

SEQ ID NO: 478583 - DNA, 25 bp, Rattus norvegicus
gtacaggttaaatctgccttaagtg

SEQ ID NO: 478584 - DNA, 25 bp, Rattus norvegicus
gtacaggtttgactatcctgctcat

SEQ ID NO: 478585 - DNA, 25 bp, Rattus norvegicus
gtacaggtttgagtatcctgctcat

SEQ ID NO: 478586 - DNA, 25 bp, Rattus norvegicus
gtacagtaaagacgcttccaagcat

SEQ ID NO: 478587 - DNA, 25 bp, Rattus norvegicus
gtacagtaaagaggcttccaagcat

SEQ ID NO: 478588 - DNA, 25 bp, Rattus norvegicus
gtacagtaaatgacacagccacatg

SEQ ID NO: 478589 - DNA, 25 bp, Rattus norvegicus
gtacagtaaatgtcacagccacatg

SEQ ID NO: 478590 - DNA, 25 bp, Rattus norvegicus
gtacagtaacatccaagagccctct

SEQ ID NO: 478591 - DNA, 25 bp, Rattus norvegicus
gtacagtaacatgcaagagccctct

SEQ ID NO: 478592 - DNA, 25 bp, Rattus norvegicus
gtacagtaatgacagcatgcccaga

SEQ ID NO: 478593 - DNA, 25 bp, Rattus norvegicus
gtacagtaatgagagcatgcccaga

SEQ ID NO: 478594 - DNA, 25 bp, Rattus norvegicus
gtacagtaccttaatatatacactt

SEQ ID NO: 478595 - DNA, 25 bp, Rattus norvegicus
gtacagtacctttatatatacactt

SEQ ID NO: 478596 - DNA, 25 bp, Rattus norvegicus
gtacagtagaaaaatgatcccaggg

SEQ ID NO: 478597 - DNA, 25 bp, Rattus norvegicus
gtacagtagaaatatgatcccaggg

SEQ ID NO: 478598 - DNA, 25 bp, Rattus norvegicus
gtacagtatatcctagactacccat

SEQ ID NO: 478599 - DNA, 25 bp, Rattus norvegicus
gtacagtatatcgtagactacccat

SEQ ID NO: 478600 - DNA, 25 bp, Rattus norvegicus
gtacagtatctgaagcatgccgttc

SEQ ID NO: 478601 - DNA, 25 bp, Rattus norvegicus
gtacagtatctgtagcatgccgttc

SEQ ID NO: 478602 - DNA, 25 bp, Rattus norvegicus
gtacagtattgcagctcatatgctg

SEQ ID NO: 478603 - DNA, 25 bp, Rattus norvegicus
gtacagtattgctgctcatatgctg

SEQ ID NO: 478604 - DNA, 25 bp, Rattus norvegicus
gtacagtcacccacagagttttgca

SEQ ID NO: 478605 - DNA, 25 bp, Rattus norvegicus
gtacagtcaccctcagagttttgca

SEQ ID NO: 478606 - DNA, 25 bp, Rattus norvegicus
gtacagtcagatcttccttaccagg

SEQ ID NO: 478607 - DNA, 25 bp, Rattus norvegicus
gtacagtcagatgttccttaccagg

SEQ ID NO: 478608 - DNA, 25 bp, Rattus norvegicus
gtacagtcatgaaccgctacaccag

SEQ ID NO: 478609 - DNA, 25 bp, Rattus norvegicus
gtacagtcatgatccgctacaccag

SEQ ID NO: 478610 - DNA, 25 bp, Rattus norvegicus
gtacagtccattatggttcacacaa

SEQ ID NO: 478611 - DNA, 25 bp, Rattus norvegicus
gtacagtccattttggttcacacaa

SEQ ID NO: 478612 - DNA, 25 bp, Rattus norvegicus
gtacagtccttaaaatgccagccct

SEQ ID NO: 478613 - DNA, 25 bp, Rattus norvegicus
gtacagtccttataatgccagccct

SEQ ID NO: 478614 - DNA, 25 bp, Rattus norvegicus
gtacagtctccccaagggatggttc

SEQ ID NO: 478615 - DNA, 25 bp, Rattus norvegicus
gtacagtctcccgaagggatggttc

SEQ ID NO: 478616 - DNA, 25 bp, Rattus norvegicus
gtacagtctgcaaacctttgttggt

SEQ ID NO: 478617 - DNA, 25 bp, Rattus norvegicus
gtacagtctgcatacctttgttggt

SEQ ID NO: 478618 - DNA, 25 bp, Rattus norvegicus
gtacagtgaactaacaaagccttat

SEQ ID NO: 478619 - DNA, 25 bp, Rattus norvegicus
gtacagtgaacttacaaagccttat

SEQ ID NO: 478620 - DNA, 25 bp, Rattus norvegicus
gtacagtgatgacccatatctcagc

SEQ ID NO: 478621 - DNA, 25 bp, Rattus norvegicus
gtacagtgatgagccatatctcagc

SEQ ID NO: 478622 - DNA, 25 bp, Rattus norvegicus
gtacagtgccacagccaaagcaagt

SEQ ID NO: 478623 - DNA, 25 bp, Rattus norvegicus
gtacagtgccactgccaaagcaagt

SEQ ID NO: 478624 - DNA, 25 bp, Rattus norvegicus
gtacagtgcctaagacggatcaata

SEQ ID NO: 478625 - DNA, 25 bp, Rattus norvegicus
gtacagtgcctaattatcatgcggg

SEQ ID NO: 478626 - DNA, 25 bp, Rattus norvegicus
gtacagtgcctatgacggatcaata

SEQ ID NO: 478627 - DNA, 25 bp, Rattus norvegicus
gtacagtgcctatttatcatgcggg

SEQ ID NO: 478628 - DNA, 25 bp, Rattus norvegicus
gtacagtgctatcctgaagcgacca

SEQ ID NO: 478629 - DNA, 25 bp, Rattus norvegicus
gtacagtgctatgctgaagcgacca

SEQ ID NO: 478630 - DNA, 25 bp, Rattus norvegicus
gtacagtgctttacacctgctaaaa

SEQ ID NO: 478631 - DNA, 25 bp, Rattus norvegicus
gtacagtgctttcgctcctgaaaat

SEQ ID NO: 478632 - DNA, 25 bp, Rattus norvegicus
gtacagtgctttggctcctgaaaat

SEQ ID NO: 478633 - DNA, 25 bp, Rattus norvegicus
gtacagtgcttttcacctgctaaaa

SEQ ID NO: 478634 - DNA, 25 bp, Rattus norvegicus
gtacagtggatactagtcttaggac

SEQ ID NO: 478635 - DNA, 25 bp, Rattus norvegicus
gtacagtggatagtagtcttaggac

SEQ ID NO: 478636 - DNA, 25 bp, Rattus norvegicus
gtacagtggtatatcttgcttcagt

SEQ ID NO: 478637 - DNA, 25 bp, Rattus norvegicus
gtacagtggtatttcttgcttcagt

SEQ ID NO: 478638 - DNA, 25 bp, Rattus norvegicus
gtacagtgtacaaaacagtatgaat

SEQ ID NO: 478639 - DNA, 25 bp, Rattus norvegicus
gtacagtgtacataacagtatgaat

SEQ ID NO: 478640 - DNA, 25 bp, Rattus norvegicus
gtacagtgtagccttggtccttaag

SEQ ID NO: 478641 - DNA, 25 bp, Rattus norvegicus
gtacagtgtagcgttggtccttaag

SEQ ID NO: 478642 - DNA, 25 bp, Rattus norvegicus
gtacagtgtgtacatacgtcctgaa

SEQ ID NO: 478643 - DNA, 25 bp, Rattus norvegicus
gtacagtgtgtagatacgtcctgaa

SEQ ID NO: 478644 - DNA, 25 bp, Rattus norvegicus
gtacagtgttagacagcaagcggct

SEQ ID NO: 478645 - DNA, 25 bp, Rattus norvegicus
gtacagtgttagtcagcaagcggct

SEQ ID NO: 478646 - DNA, 25 bp, Rattus norvegicus
gtacagtgttcacagttccatgatt

SEQ ID NO: 478647 - DNA, 25 bp, Rattus norvegicus
gtacagtgttcagagttccatgatt

SEQ ID NO: 478648 - DNA, 25 bp, Rattus norvegicus
gtacagtgtttcaagattgctttgg

SEQ ID NO: 478649 - DNA, 25 bp, Rattus norvegicus
gtacagtgtttctagattgctttgg

SEQ ID NO: 478650 - DNA, 25 bp, Rattus norvegicus
gtacagttaaatctggaggtcctct

SEQ ID NO: 478651 - DNA, 25 bp, Rattus norvegicus
gtacagttaaatgtggaggtcctct

SEQ ID NO: 478652 - DNA, 25 bp, Rattus norvegicus
gtacagttaagcctcagacttctgg

SEQ ID NO: 478653 - DNA, 25 bp, Rattus norvegicus
gtacagttaagcgtcagacttctgg

SEQ ID NO: 478654 - DNA, 25 bp, Rattus norvegicus
gtacagttaatcacctcactgagga

SEQ ID NO: 478655 - DNA, 25 bp, Rattus norvegicus
gtacagttaatctcctcactgagga

SEQ ID NO: 478656 - DNA, 25 bp, Rattus norvegicus
gtacagttacctacttacatagcgg

SEQ ID NO: 478657 - DNA, 25 bp, Rattus norvegicus
gtacagttaccttcttacatagcgg

SEQ ID NO: 478658 - DNA, 25 bp, Rattus norvegicus
gtacagttacttatacatagtcaag

SEQ ID NO: 478659 - DNA, 25 bp, Rattus norvegicus
gtacagttacttcatgttcacccgt

SEQ ID NO: 478660 - DNA, 25 bp, Rattus norvegicus
gtacagttacttgatgttcacccgt

SEQ ID NO: 478661 - DNA, 25 bp, Rattus norvegicus
gtacagttacttttacatagtcaag

SEQ ID NO: 478662 - DNA, 25 bp, Rattus norvegicus
gtacagttagtgcagagcccttcct

SEQ ID NO: 478663 - DNA, 25 bp, Rattus norvegicus
gtacagttagtggagagcccttcct

SEQ ID NO: 478664 - DNA, 25 bp, Rattus norvegicus
gtacagttatgtctccgtccattaa

SEQ ID NO: 478665 - DNA, 25 bp, Rattus norvegicus
gtacagttatgtgtccgtccattaa

SEQ ID NO: 478666 - DNA, 25 bp, Rattus norvegicus
gtacagttcagaaccatgcgccgag

SEQ ID NO: 478667 - DNA, 25 bp, Rattus norvegicus
gtacagttcagatccatgcgccgag

SEQ ID NO: 478668 - DNA, 25 bp, Rattus norvegicus
gtacagttcctcatgaagttgcatc

SEQ ID NO: 478669 - DNA, 25 bp, Rattus norvegicus
gtacagttcctcttgaagttgcatc

SEQ ID NO: 478670 - DNA, 25 bp, Rattus norvegicus
gtacagttcctgctcctgcaggtga

SEQ ID NO: 478671 - DNA, 25 bp, Rattus norvegicus
gtacagttcctggtcctgcaggtga

SEQ ID NO: 478672 - DNA, 25 bp, Rattus norvegicus
gtacagttgactatttgacatagca

SEQ ID NO: 478673 - DNA, 25 bp, Rattus norvegicus
gtacagttgactttttgacatagca

SEQ ID NO: 478674 - DNA, 25 bp, Rattus norvegicus
gtacagtttcatatttgagtttgca

SEQ ID NO: 478675 - DNA, 25 bp, Rattus norvegicus
gtacagtttcatttttgagtttgca

SEQ ID NO: 478676 - DNA, 25 bp, Rattus norvegicus
gtacagtttccacaatctgccagaa

SEQ ID NO: 478677 - DNA, 25 bp, Rattus norvegicus
gtacagtttccagaatctgccagaa

SEQ ID NO: 478678 - DNA, 25 bp, Rattus norvegicus
gtacagtttgttcacgtatgcacac

SEQ ID NO: 478679 - DNA, 25 bp, Rattus norvegicus
gtacagtttgttgacgtatgcacac

SEQ ID NO: 478680 - DNA, 25 bp, Rattus norvegicus
gtacataaatgtcccaacagcttga

SEQ ID NO: 478681 - DNA, 25 bp, Rattus norvegicus
gtacataaatgtgccaacagcttga

SEQ ID NO: 478682 - DNA, 25 bp, Rattus norvegicus
gtacataaccctaattggcacagca

SEQ ID NO: 478683 - DNA, 25 bp, Rattus norvegicus
gtacataacccttattggcacagca

SEQ ID NO: 478684 - DNA, 25 bp, Rattus norvegicus
gtacataactcgatccaggctactt

SEQ ID NO: 478685 - DNA, 25 bp, Rattus norvegicus
gtacataactcgttccaggctactt

SEQ ID NO: 478686 - DNA, 25 bp, Rattus norvegicus
gtacataatgccacggaccatggtg

SEQ ID NO: 478687 - DNA, 25 bp, Rattus norvegicus
gtacataatgcctcggaccatggtg

SEQ ID NO: 478688 - DNA, 25 bp, Rattus norvegicus
gtacataatgtcattcaacaggttt

SEQ ID NO: 478689 - DNA, 25 bp, Rattus norvegicus
gtacataatgtctttcaacaggttt

SEQ ID NO: 478690 - DNA, 25 bp, Rattus norvegicus
gtacatacatacattgctctgtccc

SEQ ID NO: 478691 - DNA, 25 bp, Rattus norvegicus
gtacatacatactttgctctgtccc

SEQ ID NO: 478692 - DNA, 25 bp, Rattus norvegicus
gtacatacatctctcttgatattgc

SEQ ID NO: 478693 - DNA, 25 bp, Rattus norvegicus
gtacatacatctgtcttgatattgc

SEQ ID NO: 478694 - DNA, 25 bp, Rattus norvegicus
gtacataccaatacactctacagga

SEQ ID NO: 478695 - DNA, 25 bp, Rattus norvegicus
gtacataccaattcactctacagga

SEQ ID NO: 478696 - DNA, 25 bp, Rattus norvegicus
gtacatacgcccagtgatggatagc

SEQ ID NO: 478697 - DNA, 25 bp, Rattus norvegicus
gtacatacgccctgtgatggatagc

SEQ ID NO: 478698 - DNA, 25 bp, Rattus norvegicus
gtacatacgtgtatacggagttcat

SEQ ID NO: 478699 - DNA, 25 bp, Rattus norvegicus
gtacatacgtgtttacggagttcat

SEQ ID NO: 478700 - DNA, 25 bp, Rattus norvegicus
gtacatactaaccacctagttgatg

SEQ ID NO: 478701 - DNA, 25 bp, Rattus norvegicus
gtacatactaacgacctagttgatg

SEQ ID NO: 478702 - DNA, 25 bp, Rattus norvegicus
gtacatactaagatccaggacggcc

SEQ ID NO: 478703 - DNA, 25 bp, Rattus norvegicus
gtacatactaagttccaggacggcc

SEQ ID NO: 478704 - DNA, 25 bp, Rattus norvegicus
gtacatactgaaacccagccatgtt

SEQ ID NO: 478705 - DNA, 25 bp, Rattus norvegicus
gtacatactgaatcccagccatgtt

SEQ ID NO: 478706 - DNA, 25 bp, Rattus norvegicus
gtacatactgaccccggaggacgcc

SEQ ID NO: 478707 - DNA, 25 bp, Rattus norvegicus
gtacatactgacgccggaggacgcc

SEQ ID NO: 478708 - DNA, 25 bp, Rattus norvegicus
gtacatactgcaagtccagctggat

SEQ ID NO: 478709 - DNA, 25 bp, Rattus norvegicus
gtacatactgcatgtccagctggat

SEQ ID NO: 478710 - DNA, 25 bp, Rattus norvegicus
gtacatactggcagctttgtgttca

SEQ ID NO: 478711 - DNA, 25 bp, Rattus norvegicus
gtacatactggctgctttgtgttca

SEQ ID NO: 478712 - DNA, 25 bp, Rattus norvegicus
gtacatactgtaccaccctgtgtgg

SEQ ID NO: 478713 - DNA, 25 bp, Rattus norvegicus
gtacatactgtagcaccctgtgtgg

SEQ ID NO: 478714 - DNA, 25 bp, Rattus norvegicus
gtacatacttagcacagcacctgga

SEQ ID NO: 478715 - DNA, 25 bp, Rattus norvegicus
gtacatacttaggacagcacctgga

SEQ ID NO: 478716 - DNA, 25 bp, Rattus norvegicus
gtacatacttggaacaacaaactag

SEQ ID NO: 478717 - DNA, 25 bp, Rattus norvegicus
gtacatacttggtacaacaaactag

SEQ ID NO: 478718 - DNA, 25 bp, Rattus norvegicus
gtacatagccttacttactcttttt

SEQ ID NO: 478719 - DNA, 25 bp, Rattus norvegicus
gtacatagccttctggctggtcttt

SEQ ID NO: 478720 - DNA, 25 bp, Rattus norvegicus
gtacatagccttgtggctggtcttt

SEQ ID NO: 478721 - DNA, 25 bp, Rattus norvegicus
gtacatagcctttcttactcttttt

SEQ ID NO: 478722 - DNA, 25 bp, Rattus norvegicus
gtacatagctgtaaatactcccaac

SEQ ID NO: 478723 - DNA, 25 bp, Rattus norvegicus
gtacatagctgtcactcaagaaggt

SEQ ID NO: 478724 - DNA, 25 bp, Rattus norvegicus
gtacatagctgtgactcaagaaggt

SEQ ID NO: 478725 - DNA, 25 bp, Rattus norvegicus
gtacatagctgttaatactcccaac

SEQ ID NO: 478726 - DNA, 25 bp, Rattus norvegicus
gtacatagctttagttatgctgcaa

SEQ ID NO: 478727 - DNA, 25 bp, Rattus norvegicus
gtacatagcttttgttatgctgcaa

SEQ ID NO: 478728 - DNA, 25 bp, Rattus norvegicus
gtacataggaacactcactcagaaa

SEQ ID NO: 478729 - DNA, 25 bp, Rattus norvegicus
gtacataggaactctcactcagaaa

SEQ ID NO: 478730 - DNA, 25 bp, Rattus norvegicus
gtacatagggttatctagactcggt

SEQ ID NO: 478731 - DNA, 25 bp, Rattus norvegicus
gtacatagggttttctagactcggt

SEQ ID NO: 478732 - DNA, 25 bp, Rattus norvegicus
gtacataggtgtattcttgccggtt

SEQ ID NO: 478733 - DNA, 25 bp, Rattus norvegicus
gtacataggtgttttcttgccggtt

SEQ ID NO: 478734 - DNA, 25 bp, Rattus norvegicus
gtacatagtattattcaagcagaga

SEQ ID NO: 478735 - DNA, 25 bp, Rattus norvegicus
gtacatagtatttttcaagcagaga

SEQ ID NO: 478736 - DNA, 25 bp, Rattus norvegicus
gtacatagtgggactgataccgggt

SEQ ID NO: 478737 - DNA, 25 bp, Rattus norvegicus
gtacatagtgggtctgataccgggt

SEQ ID NO: 478738 - DNA, 25 bp, Rattus norvegicus
gtacatatacatacccagtcaaaat

SEQ ID NO: 478739 - DNA, 25 bp, Rattus norvegicus
gtacatatacattcccagtcaaaat

SEQ ID NO: 478740 - DNA, 25 bp, Rattus norvegicus
gtacatatactcactttctcgattg

SEQ ID NO: 478741 - DNA, 25 bp, Rattus norvegicus
gtacatatactctctttctcgattg

SEQ ID NO: 478742 - DNA, 25 bp, Rattus norvegicus
gtacatatactgaccttgcctgtgg

SEQ ID NO: 478743 - DNA, 25 bp, Rattus norvegicus
gtacatatactgtccttgcctgtgg

SEQ ID NO: 478744 - DNA, 25 bp, Rattus norvegicus
gtacatatcgtgacggtagggctat

SEQ ID NO: 478745 - DNA, 25 bp, Rattus norvegicus
gtacatatcgtgtcggtagggctat

SEQ ID NO: 478746 - DNA, 25 bp, Rattus norvegicus
gtacatatctgcaagtcatctataa

SEQ ID NO: 478747 - DNA, 25 bp, Rattus norvegicus
gtacatatctgctagtcatctataa

SEQ ID NO: 478748 - DNA, 25 bp, Rattus norvegicus
gtacatatgcttccaaatttcaggc

SEQ ID NO: 478749 - DNA, 25 bp, Rattus norvegicus
gtacatatgcttgcaaatttcaggc

SEQ ID NO: 478750 - DNA, 25 bp, Rattus norvegicus
gtacatatggtaccgctctggctgg

SEQ ID NO: 478751 - DNA, 25 bp, Rattus norvegicus
gtacatatggtagcgctctggctgg

SEQ ID NO: 478752 - DNA, 25 bp, Rattus norvegicus
gtacatatgtcccttacaagagcaa

SEQ ID NO: 478753 - DNA, 25 bp, Rattus norvegicus
gtacatatgtccgttacaagagcaa

SEQ ID NO: 478754 - DNA, 25 bp, Rattus norvegicus
gtacatatgtgtatctcctcaaata

SEQ ID NO: 478755 - DNA, 25 bp, Rattus norvegicus
gtacatatgtgtttctcctcaaata

SEQ ID NO: 478756 - DNA, 25 bp, Rattus norvegicus
gtacatattcctctagactctgtcc

SEQ ID NO: 478757 - DNA, 25 bp, Rattus norvegicus
gtacatattcctgtagactctgtcc

SEQ ID NO: 478758 - DNA, 25 bp, Rattus norvegicus
gtacatatttggcttcttctatctc

SEQ ID NO: 478759 - DNA, 25 bp, Rattus norvegicus
gtacatatttgggttcttctatctc

SEQ ID NO: 478760 - DNA, 25 bp, Rattus norvegicus
gtacatattttgcagtggttcacaa

SEQ ID NO: 478761 - DNA, 25 bp, Rattus norvegicus
gtacatattttggagtggttcacaa

SEQ ID NO: 478762 - DNA, 25 bp, Rattus norvegicus
gtacatcaagaccagcaacatcctg

SEQ ID NO: 478763 - DNA, 25 bp, Rattus norvegicus
gtacatcaagacgagcaacatcctg

SEQ ID NO: 478764 - DNA, 25 bp, Rattus norvegicus
gtacatcaagagcaccatgggcaag

SEQ ID NO: 478765 - DNA, 25 bp, Rattus norvegicus
gtacatcaagaggaccatgggcaag

SEQ ID NO: 478766 - DNA, 25 bp, Rattus norvegicus
gtacatcaaggcacattcacttctt

SEQ ID NO: 478767 - DNA, 25 bp, Rattus norvegicus
gtacatcaaggctcattcacttctt

SEQ ID NO: 478768 - DNA, 25 bp, Rattus norvegicus
gtacatcacacacccatttttatat

SEQ ID NO: 478769 - DNA, 25 bp, Rattus norvegicus
gtacatcacacagccatttttatat

SEQ ID NO: 478770 - DNA, 25 bp, Rattus norvegicus
gtacatcacgatcgacgaactcaag

SEQ ID NO: 478771 - DNA, 25 bp, Rattus norvegicus
gtacatcacgatggacgaactcaag

SEQ ID NO: 478772 - DNA, 25 bp, Rattus norvegicus
gtacatcacggaaccctaactgtca

SEQ ID NO: 478773 - DNA, 25 bp, Rattus norvegicus
gtacatcacggatccctaactgtca

SEQ ID NO: 478774 - DNA, 25 bp, Rattus norvegicus
gtacatcatctgatggctggcctgt

SEQ ID NO: 478775 - DNA, 25 bp, Rattus norvegicus
gtacatcatctgttggctggcctgt

SEQ ID NO: 478776 - DNA, 25 bp, Rattus norvegicus
gtacatcatgacagtgccatccaga

SEQ ID NO: 478777 - DNA, 25 bp, Rattus norvegicus
gtacatcatgactgtgccatccaga

SEQ ID NO: 478778 - DNA, 25 bp, Rattus norvegicus
gtacatccacaacttcaccaacggg

SEQ ID NO: 478779 - DNA, 25 bp, Rattus norvegicus
gtacatccacaagttcaccaacggg

SEQ ID NO: 478780 - DNA, 25 bp, Rattus norvegicus
gtacatccacacattgcagactgat

SEQ ID NO: 478781 - DNA, 25 bp, Rattus norvegicus
gtacatccacactttgcagactgat

SEQ ID NO: 478782 - DNA, 25 bp, Rattus norvegicus
gtacatccacttcaccgttttaaga

SEQ ID NO: 478783 - DNA, 25 bp, Rattus norvegicus
gtacatccacttgaccgttttaaga

SEQ ID NO: 478784 - DNA, 25 bp, Rattus norvegicus
gtacatccccagcttgacttaaatg

SEQ ID NO: 478785 - DNA, 25 bp, Rattus norvegicus
gtacatccccaggttgacttaaatg

SEQ ID NO: 478786 - DNA, 25 bp, Rattus norvegicus
gtacatcctcatattgattctgcag

SEQ ID NO: 478787 - DNA, 25 bp, Rattus norvegicus
gtacatcctcattttgattctgcag

SEQ ID NO: 478788 - DNA, 25 bp, Rattus norvegicus
gtacatcctcgtcgaagttctggag

SEQ ID NO: 478789 - DNA, 25 bp, Rattus norvegicus
gtacatcctcgtggaagttctggag

SEQ ID NO: 478790 - DNA, 25 bp, Rattus norvegicus
gtacatcctggaacatctgtgcaga

SEQ ID NO: 478791 - DNA, 25 bp, Rattus norvegicus
gtacatcctggatcatctgtgcaga

SEQ ID NO: 478792 - DNA, 25 bp, Rattus norvegicus
gtacatcgagtacatccgcgtgaag

SEQ ID NO: 478793 - DNA, 25 bp, Rattus norvegicus
gtacatcgagtagatccgcgtgaag

SEQ ID NO: 478794 - DNA, 25 bp, Rattus norvegicus
gtacatcgtcatatctatggcttta

SEQ ID NO: 478795 - DNA, 25 bp, Rattus norvegicus
gtacatcgtcatttctatggcttta

SEQ ID NO: 478796 - DNA, 25 bp, Rattus norvegicus
gtacatctaccaattcaactctcag

SEQ ID NO: 478797 - DNA, 25 bp, Rattus norvegicus
gtacatctaccatttcaactctcag

SEQ ID NO: 478798 - DNA, 25 bp, Rattus norvegicus
gtacatctatggcttcagcttgagc

SEQ ID NO: 478799 - DNA, 25 bp, Rattus norvegicus
gtacatctatgggttcagcttgagc

SEQ ID NO: 478800 - DNA, 25 bp, Rattus norvegicus
gtacatctcagtaatttcggtgcaa

SEQ ID NO: 478801 - DNA, 25 bp, Rattus norvegicus
gtacatctcagttatttcggtgcaa

SEQ ID NO: 478802 - DNA, 25 bp, Rattus norvegicus
gtacatctcattacaatcagccatt

SEQ ID NO: 478803 - DNA, 25 bp, Rattus norvegicus
gtacatctcatttcaatcagccatt

SEQ ID NO: 478804 - DNA, 25 bp, Rattus norvegicus
gtacatctcggaactggaccagcta

SEQ ID NO: 478805 - DNA, 25 bp, Rattus norvegicus
gtacatctcggatctggaccagcta

SEQ ID NO: 478806 - DNA, 25 bp, Rattus norvegicus
gtacatctctgaatatttatctctt

SEQ ID NO: 478807 - DNA, 25 bp, Rattus norvegicus
gtacatctctgattatttatctctt

SEQ ID NO: 478808 - DNA, 25 bp, Rattus norvegicus
gtacatctctgtactcatgaagatc

SEQ ID NO: 478809 - DNA, 25 bp, Rattus norvegicus
gtacatctctgtatatagtcgtaaa

SEQ ID NO: 478810 - DNA, 25 bp, Rattus norvegicus
gtacatctctgttctcatgaagatc

SEQ ID NO: 478811 - DNA, 25 bp, Rattus norvegicus
gtacatctctgtttatagtcgtaaa

SEQ ID NO: 478812 - DNA, 25 bp, Rattus norvegicus
gtacatctgattactacgtggtata

SEQ ID NO: 478813 - DNA, 25 bp, Rattus norvegicus
gtacatctgatttctacgtggtata

SEQ ID NO: 478814 - DNA, 25 bp, Rattus norvegicus
gtacatctgctcaagggaatcggga

SEQ ID NO: 478815 - DNA, 25 bp, Rattus norvegicus
gtacatctgctctagggaatcggga

SEQ ID NO: 478816 - DNA, 25 bp, Rattus norvegicus
gtacatctgtacagtctgcagcatt

SEQ ID NO: 478817 - DNA, 25 bp, Rattus norvegicus
gtacatctgtactgtctgcagcatt

SEQ ID NO: 478818 - DNA, 25 bp, Rattus norvegicus
gtacatctgtgaaaacgcctgtttt

SEQ ID NO: 478819 - DNA, 25 bp, Rattus norvegicus
gtacatctgtgataacgcctgtttt

SEQ ID NO: 478820 - DNA, 25 bp, Rattus norvegicus
gtacatctgtgcatcacgtgtgagt

SEQ ID NO: 478821 - DNA, 25 bp, Rattus norvegicus
gtacatctgtgcttcacgtgtgagt

SEQ ID NO: 478822 - DNA, 25 bp, Rattus norvegicus
gtacatcttaatcgcatttctactg

SEQ ID NO: 478823 - DNA, 25 bp, Rattus norvegicus
gtacatcttaatggcatttctactg

SEQ ID NO: 478824 - DNA, 25 bp, Rattus norvegicus
gtacatcttcatctgatcagccagg

SEQ ID NO: 478825 - DNA, 25 bp, Rattus norvegicus
gtacatcttcatgtgatcagccagg

SEQ ID NO: 478826 - DNA, 25 bp, Rattus norvegicus
gtacatcttgtaacttttgggagaa

SEQ ID NO: 478827 - DNA, 25 bp, Rattus norvegicus
gtacatcttgtatcttttgggagaa

SEQ ID NO: 478828 - DNA, 25 bp, Rattus norvegicus
gtacatctttatcttgaaaagctct

SEQ ID NO: 478829 - DNA, 25 bp, Rattus norvegicus
gtacatctttatgttgaaaagctct

SEQ ID NO: 478830 - DNA, 25 bp, Rattus norvegicus
gtacatctttggcatgacccacagg

SEQ ID NO: 478831 - DNA, 25 bp, Rattus norvegicus
gtacatctttgggatgacccacagg

SEQ ID NO: 478832 - DNA, 25 bp, Rattus norvegicus
gtacatgacgtaatgcctttgcatc

SEQ ID NO: 478833 - DNA, 25 bp, Rattus norvegicus
gtacatgacgtattgcctttgcatc

SEQ ID NO: 478834 - DNA, 25 bp, Rattus norvegicus
gtacatgactccatagctggagagt

SEQ ID NO: 478835 - DNA, 25 bp, Rattus norvegicus
gtacatgactccttagctggagagt

SEQ ID NO: 478836 - DNA, 25 bp, Rattus norvegicus
gtacatgactctcacttctctatat

SEQ ID NO: 478837 - DNA, 25 bp, Rattus norvegicus
gtacatgactctgacttctctatat

SEQ ID NO: 478838 - DNA, 25 bp, Rattus norvegicus
gtacatgaggccaggttcttggtat

SEQ ID NO: 478839 - DNA, 25 bp, Rattus norvegicus
gtacatgaggcctggttcttggtat

SEQ ID NO: 478840 - DNA, 25 bp, Rattus norvegicus
gtacatgatacccagccagagtcag

SEQ ID NO: 478841 - DNA, 25 bp, Rattus norvegicus
gtacatgataccgagccagagtcag

SEQ ID NO: 478842 - DNA, 25 bp, Rattus norvegicus
gtacatgatgcaatggcctgctctt

SEQ ID NO: 478843 - DNA, 25 bp, Rattus norvegicus
gtacatgatgcattggcctgctctt

SEQ ID NO: 478844 - DNA, 25 bp, Rattus norvegicus
gtacatgcaagacccctcagagact

SEQ ID NO: 478845 - DNA, 25 bp, Rattus norvegicus
gtacatgcaagagccctcagagact

SEQ ID NO: 478846 - DNA, 25 bp, Rattus norvegicus
gtacatgcacatctgactcattttt

SEQ ID NO: 478847 - DNA, 25 bp, Rattus norvegicus
gtacatgcacatgtgactcattttt

SEQ ID NO: 478848 - DNA, 25 bp, Rattus norvegicus
gtacatgcatagaaacaacatttgt

SEQ ID NO: 478849 - DNA, 25 bp, Rattus norvegicus
gtacatgcatagtaacaacatttgt

SEQ ID NO: 478850 - DNA, 25 bp, Rattus norvegicus
gtacatgcatgacttttgtcctgtt

SEQ ID NO: 478851 - DNA, 25 bp, Rattus norvegicus
gtacatgcatgagttttgtcctgtt

SEQ ID NO: 478852 - DNA, 25 bp, Rattus norvegicus
gtacatgcattgctcgtgttcgggc

SEQ ID NO: 478853 - DNA, 25 bp, Rattus norvegicus
gtacatgcattggtcgtgttcgggc

SEQ ID NO: 478854 - DNA, 25 bp, Rattus norvegicus
gtacatgcctcgctcaagagtttag

SEQ ID NO: 478855 - DNA, 25 bp, Rattus norvegicus
gtacatgcctcggtcaagagtttag

SEQ ID NO: 478856 - DNA, 25 bp, Rattus norvegicus
gtacatgcctgtaactcaagcacat

SEQ ID NO: 478857 - DNA, 25 bp, Rattus norvegicus
gtacatgcctgttactcaagcacat

SEQ ID NO: 478858 - DNA, 25 bp, Rattus norvegicus
gtacatgcgtacacacattttttag

SEQ ID NO: 478859 - DNA, 25 bp, Rattus norvegicus
gtacatgcgtactcacattttttag

SEQ ID NO: 478860 - DNA, 25 bp, Rattus norvegicus
gtacatgctcttagtaacccagtca

SEQ ID NO: 478861 - DNA, 25 bp, Rattus norvegicus
gtacatgctctttgtaacccagtca

SEQ ID NO: 478862 - DNA, 25 bp, Rattus norvegicus
gtacatgctggtccgctacgaggat

SEQ ID NO: 478863 - DNA, 25 bp, Rattus norvegicus
gtacatgctggtgcgctacgaggat

SEQ ID NO: 478864 - DNA, 25 bp, Rattus norvegicus
gtacatgctgtgctagttattttct

SEQ ID NO: 478865 - DNA, 25 bp, Rattus norvegicus
gtacatgctgtggtagttattttct

SEQ ID NO: 478866 - DNA, 25 bp, Rattus norvegicus
gtacatgcttttaccacgccgcctg

SEQ ID NO: 478867 - DNA, 25 bp, Rattus norvegicus
gtacatgctttttccacgccgcctg

SEQ ID NO: 478868 - DNA, 25 bp, Rattus norvegicus
gtacatggaaacagcgaacgtcgtg

SEQ ID NO: 478869 - DNA, 25 bp, Rattus norvegicus
gtacatggaaactgcgaacgtcgtg

SEQ ID NO: 478870 - DNA, 25 bp, Rattus norvegicus
gtacatggaataagttctactagct

SEQ ID NO: 478871 - DNA, 25 bp, Rattus norvegicus
gtacatggaatatgttctactagct

SEQ ID NO: 478872 - DNA, 25 bp, Rattus norvegicus
gtacatggaccaccttcatcgatat

SEQ ID NO: 478873 - DNA, 25 bp, Rattus norvegicus
gtacatggaccagcttcatcgatat

SEQ ID NO: 478874 - DNA, 25 bp, Rattus norvegicus
gtacatggacgaccagtactggcct

SEQ ID NO: 478875 - DNA, 25 bp, Rattus norvegicus
gtacatggacgagcagtactggcct

SEQ ID NO: 478876 - DNA, 25 bp, Rattus norvegicus
gtacatggacttctagtgttctgaa

SEQ ID NO: 478877 - DNA, 25 bp, Rattus norvegicus
gtacatggacttgtagtgttctgaa

SEQ ID NO: 478878 - DNA, 25 bp, Rattus norvegicus
gtacatggagatcctgctacacaaa

SEQ ID NO: 478879 - DNA, 25 bp, Rattus norvegicus
gtacatggagatgctgctacacaaa

SEQ ID NO: 478880 - DNA, 25 bp, Rattus norvegicus
gtacatggagcacacttacctcatc

SEQ ID NO: 478881 - DNA, 25 bp, Rattus norvegicus
gtacatggagcagacttacctcatc

SEQ ID NO: 478882 - DNA, 25 bp, Rattus norvegicus
gtacatggagtgatcagcaaagacc

SEQ ID NO: 478883 - DNA, 25 bp, Rattus norvegicus
gtacatggagtgttcagcaaagacc

SEQ ID NO: 478884 - DNA, 25 bp, Rattus norvegicus
gtacatggataccagctcttcattt

SEQ ID NO: 478885 - DNA, 25 bp, Rattus norvegicus
gtacatggatacgagctcttcattt

SEQ ID NO: 478886 - DNA, 25 bp, Rattus norvegicus
gtacatggtctgacagtcttggaaa

SEQ ID NO: 478887 - DNA, 25 bp, Rattus norvegicus
gtacatggtctgtcagtcttggaaa

SEQ ID NO: 478888 - DNA, 25 bp, Rattus norvegicus
gtacatggtcttaacgtgggactta

SEQ ID NO: 478889 - DNA, 25 bp, Rattus norvegicus
gtacatggtctttacgtgggactta

SEQ ID NO: 478890 - DNA, 25 bp, Rattus norvegicus
gtacatggtgctcagtgacctcatt

SEQ ID NO: 478891 - DNA, 25 bp, Rattus norvegicus
gtacatggtgctgagtgacctcatt

SEQ ID NO: 478892 - DNA, 25 bp, Rattus norvegicus
gtacatggtggactattccggacta

SEQ ID NO: 478893 - DNA, 25 bp, Rattus norvegicus
gtacatggtggagtattccggacta

SEQ ID NO: 478894 - DNA, 25 bp, Rattus norvegicus
gtacatgtaacactatcactctgga

SEQ ID NO: 478895 - DNA, 25 bp, Rattus norvegicus
gtacatgtaacagtatcactctgga

SEQ ID NO: 478896 - DNA, 25 bp, Rattus norvegicus
gtacatgtacttaaattggcttttg

SEQ ID NO: 478897 - DNA, 25 bp, Rattus norvegicus
gtacatgtactttaattggcttttg

SEQ ID NO: 478898 - DNA, 25 bp, Rattus norvegicus
gtacatgtattccagatacctgtct

SEQ ID NO: 478899 - DNA, 25 bp, Rattus norvegicus
gtacatgtattcgagatacctgtct

SEQ ID NO: 478900 - DNA, 25 bp, Rattus norvegicus
gtacatgtcatcctagaatcagaag

SEQ ID NO: 478901 - DNA, 25 bp, Rattus norvegicus
gtacatgtcatcgtagaatcagaag

SEQ ID NO: 478902 - DNA, 25 bp, Rattus norvegicus
gtacatgtcccaccccacatagatg

SEQ ID NO: 478903 - DNA, 25 bp, Rattus norvegicus
gtacatgtcccagcccacatagatg

SEQ ID NO: 478904 - DNA, 25 bp, Rattus norvegicus
gtacatgtctatcgacctgagtctt

SEQ ID NO: 478905 - DNA, 25 bp, Rattus norvegicus
gtacatgtctatggacctgagtctt

SEQ ID NO: 478906 - DNA, 25 bp, Rattus norvegicus
gtacatgtcttgatttccaactaga

SEQ ID NO: 478907 - DNA, 25 bp, Rattus norvegicus
gtacatgtcttgttttccaactaga

SEQ ID NO: 478908 - DNA, 25 bp, Rattus norvegicus
gtacatgtgcatacaggaacccact

SEQ ID NO: 478909 - DNA, 25 bp, Rattus norvegicus
gtacatgtgcattcaggaacccact

SEQ ID NO: 478910 - DNA, 25 bp, Rattus norvegicus
gtacatgtgctgaatgtatcaccat

SEQ ID NO: 478911 - DNA, 25 bp, Rattus norvegicus
gtacatgtgctgtatgtatcaccat

SEQ ID NO: 478912 - DNA, 25 bp, Rattus norvegicus
gtacatgtgggactacaaatgggtt

SEQ ID NO: 478913 - DNA, 25 bp, Rattus norvegicus
gtacatgtgggagtacaaatgggtt

SEQ ID NO: 478914 - DNA, 25 bp, Rattus norvegicus
gtacatgtgtgtaaacccatctcta

SEQ ID NO: 478915 - DNA, 25 bp, Rattus norvegicus
gtacatgtgtgttaacccatctcta

SEQ ID NO: 478916 - DNA, 25 bp, Rattus norvegicus
gtacatgtgtttctgatcacttact

SEQ ID NO: 478917 - DNA, 25 bp, Rattus norvegicus
gtacatgtgtttgtgatcacttact

SEQ ID NO: 478918 - DNA, 25 bp, Rattus norvegicus
gtacatgttcatccaggccaactgg

SEQ ID NO: 478919 - DNA, 25 bp, Rattus norvegicus
gtacatgttcatcgcggcagtcaac

SEQ ID NO: 478920 - DNA, 25 bp, Rattus norvegicus
gtacatgttcatgcaggccaactgg

SEQ ID NO: 478921 - DNA, 25 bp, Rattus norvegicus
gtacatgttcatggcggcagtcaac

SEQ ID NO: 478922 - DNA, 25 bp, Rattus norvegicus
gtacattacagacatacagttcctt

SEQ ID NO: 478923 - DNA, 25 bp, Rattus norvegicus
gtacattacagagatacagttcctt

SEQ ID NO: 478924 - DNA, 25 bp, Rattus norvegicus
gtacattaggagctggcttctacac

SEQ ID NO: 478925 - DNA, 25 bp, Rattus norvegicus
gtacattaggaggtggcttctacac

SEQ ID NO: 478926 - DNA, 25 bp, Rattus norvegicus
gtacattatttacgccagtcttctg

SEQ ID NO: 478927 - DNA, 25 bp, Rattus norvegicus
gtacattatttaggccagtcttctg

SEQ ID NO: 478928 - DNA, 25 bp, Rattus norvegicus
gtacattcaagaagcttcctgaggt

SEQ ID NO: 478929 - DNA, 25 bp, Rattus norvegicus
gtacattcaagatgcttcctgaggt

SEQ ID NO: 478930 - DNA, 25 bp, Rattus norvegicus
gtacattcatatacagttctcctgg

SEQ ID NO: 478931 - DNA, 25 bp, Rattus norvegicus
gtacattcatattcagttctcctgg

SEQ ID NO: 478932 - DNA, 25 bp, Rattus norvegicus
gtacattcattcacaaaaacccacc

SEQ ID NO: 478933 - DNA, 25 bp, Rattus norvegicus
gtacattcattctcaaaaacccacc

SEQ ID NO: 478934 - DNA, 25 bp, Rattus norvegicus
gtacattcgtatatagtgactggtg

SEQ ID NO: 478935 - DNA, 25 bp, Rattus norvegicus
gtacattcgtatttagtgactggtg

SEQ ID NO: 478936 - DNA, 25 bp, Rattus norvegicus
gtacattctcttagttgactttgat

SEQ ID NO: 478937 - DNA, 25 bp, Rattus norvegicus
gtacattctctttgttgactttgat

SEQ ID NO: 478938 - DNA, 25 bp, Rattus norvegicus
gtacattgcagaagaacaccctaat

SEQ ID NO: 478939 - DNA, 25 bp, Rattus norvegicus
gtacattgcagacttcattccacta

SEQ ID NO: 478940 - DNA, 25 bp, Rattus norvegicus
gtacattgcagagttcattccacta

SEQ ID NO: 478941 - DNA, 25 bp, Rattus norvegicus
gtacattgcagatgaacaccctaat

SEQ ID NO: 478942 - DNA, 25 bp, Rattus norvegicus
gtacattgctgccaaccagacagtg

SEQ ID NO: 478943 - DNA, 25 bp, Rattus norvegicus
gtacattgctgcgaaccagacagtg

SEQ ID NO: 478944 - DNA, 25 bp, Rattus norvegicus
gtacattgtagcacactcgtgatga

SEQ ID NO: 478945 - DNA, 25 bp, Rattus norvegicus
gtacattgtagctcactcgtgatga

SEQ ID NO: 478946 - DNA, 25 bp, Rattus norvegicus
gtacattgtggcaaaaatcctctta

SEQ ID NO: 478947 - DNA, 25 bp, Rattus norvegicus
gtacattgtggctaaaatcctctta

SEQ ID NO: 478948 - DNA, 25 bp, Rattus norvegicus
gtacattgtgtcatgcttctgcaga

SEQ ID NO: 478949 - DNA, 25 bp, Rattus norvegicus
gtacattgtgtcttgcttctgcaga

SEQ ID NO: 478950 - DNA, 25 bp, Rattus norvegicus
gtacattgttcccagtttgatgcat

SEQ ID NO: 478951 - DNA, 25 bp, Rattus norvegicus
gtacattgttccgagtttgatgcat

SEQ ID NO: 478952 - DNA, 25 bp, Rattus norvegicus
gtacatttacctatcccggtctgta

SEQ ID NO: 478953 - DNA, 25 bp, Rattus norvegicus
gtacatttacctcctgactaagtca

SEQ ID NO: 478954 - DNA, 25 bp, Rattus norvegicus
gtacatttacctgctgactaagtca

SEQ ID NO: 478955 - DNA, 25 bp, Rattus norvegicus
gtacatttacctttcccggtctgta

SEQ ID NO: 478956 - DNA, 25 bp, Rattus norvegicus
gtacatttatgtcacccttctggtt

SEQ ID NO: 478957 - DNA, 25 bp, Rattus norvegicus
gtacatttatgtgacccttctggtt

SEQ ID NO: 478958 - DNA, 25 bp, Rattus norvegicus
gtacatttcaacatgcatatgcttg

SEQ ID NO: 478959 - DNA, 25 bp, Rattus norvegicus
gtacatttcaacttgcatatgcttg

SEQ ID NO: 478960 - DNA, 25 bp, Rattus norvegicus
gtacatttcacactctggttctggg

SEQ ID NO: 478961 - DNA, 25 bp, Rattus norvegicus
gtacatttcacagtctggttctggg

SEQ ID NO: 478962 - DNA, 25 bp, Rattus norvegicus
gtacatttcagacatagctttggaa

SEQ ID NO: 478963 - DNA, 25 bp, Rattus norvegicus
gtacatttcagagatagctttggaa

SEQ ID NO: 478964 - DNA, 25 bp, Rattus norvegicus
gtacatttccgtcaatgcctttcca

SEQ ID NO: 478965 - DNA, 25 bp, Rattus norvegicus
gtacatttccgtgaatgcctttcca

SEQ ID NO: 478966 - DNA, 25 bp, Rattus norvegicus
gtacatttcctacaactgaagccag

SEQ ID NO: 478967 - DNA, 25 bp, Rattus norvegicus
gtacatttcctagaactgaagccag

SEQ ID NO: 478968 - DNA, 25 bp, Rattus norvegicus
gtacatttctgcatggttcattcct

SEQ ID NO: 478969 - DNA, 25 bp, Rattus norvegicus
gtacatttctgcttggttcattcct

SEQ ID NO: 478970 - DNA, 25 bp, Rattus norvegicus
gtacatttgtgtactgtgttcatga

SEQ ID NO: 478971 - DNA, 25 bp, Rattus norvegicus
gtacatttgtgttctgtgttcatga

SEQ ID NO: 478972 - DNA, 25 bp, Rattus norvegicus
gtacattttccacctttttgactca

SEQ ID NO: 478973 - DNA, 25 bp, Rattus norvegicus
gtacattttccagctttttgactca

SEQ ID NO: 478974 - DNA, 25 bp, Rattus norvegicus
gtacattttcttatgcaactccatc

SEQ ID NO: 478975 - DNA, 25 bp, Rattus norvegicus
gtacattttcttttgcaactccatc

SEQ ID NO: 478976 - DNA, 25 bp, Rattus norvegicus
gtacattttgaaaccttggtttcca

SEQ ID NO: 478977 - DNA, 25 bp, Rattus norvegicus
gtacattttgaatccttggtttcca

SEQ ID NO: 478978 - DNA, 25 bp, Rattus norvegicus
gtacattttgtaagcgtggacatta

SEQ ID NO: 478979 - DNA, 25 bp, Rattus norvegicus
gtacattttgtatgcgtggacatta

SEQ ID NO: 478980 - DNA, 25 bp, Rattus norvegicus
gtacattttgtgactctagggacaa

SEQ ID NO: 478981 - DNA, 25 bp, Rattus norvegicus
gtacattttgtgtctctagggacaa

SEQ ID NO: 478982 - DNA, 25 bp, Rattus norvegicus
gtacatttttaactctgttcttcta

SEQ ID NO: 478983 - DNA, 25 bp, Rattus norvegicus
gtacatttttaagtctgttcttcta

SEQ ID NO: 478984 - DNA, 25 bp, Rattus norvegicus
gtacatttttctcgctgttggagaa

SEQ ID NO: 478985 - DNA, 25 bp, Rattus norvegicus
gtacatttttctggctgttggagaa

SEQ ID NO: 478986 - DNA, 25 bp, Rattus norvegicus
gtacatttttgcagctctgaacatc

SEQ ID NO: 478987 - DNA, 25 bp, Rattus norvegicus
gtacatttttgctgctctgaacatc

SEQ ID NO: 478988 - DNA, 25 bp, Rattus norvegicus
gtaccaaaatatatatacaccctag

SEQ ID NO: 478989 - DNA, 25 bp, Rattus norvegicus
gtaccaaaatatttatacaccctag

SEQ ID NO: 478990 - DNA, 25 bp, Rattus norvegicus
gtaccaaacccactgtgacgcgtaa

SEQ ID NO: 478991 - DNA, 25 bp, Rattus norvegicus
gtaccaaacccagtgtgacgcgtaa

SEQ ID NO: 478992 - DNA, 25 bp, Rattus norvegicus
gtaccaaacgtaaccaatctgtgca

SEQ ID NO: 478993 - DNA, 25 bp, Rattus norvegicus
gtaccaaacgtatccaatctgtgca

SEQ ID NO: 478994 - DNA, 25 bp, Rattus norvegicus
gtaccaaagtgaaccttcacctcaa

SEQ ID NO: 478995 - DNA, 25 bp, Rattus norvegicus
gtaccaaagtgatccttcacctcaa

SEQ ID NO: 478996 - DNA, 25 bp, Rattus norvegicus
gtaccaaagttaaaccatgctccat

SEQ ID NO: 478997 - DNA, 25 bp, Rattus norvegicus
gtaccaaagttataccatgctccat

SEQ ID NO: 478998 - DNA, 25 bp, Rattus norvegicus
gtaccaaatgttccagaagccgaga

SEQ ID NO: 478999 - DNA, 25 bp, Rattus norvegicus
gtaccaaatgttgcagaagccgaga

SEQ ID NO: 479000 - DNA, 25 bp, Rattus norvegicus
gtaccaacaaagctcatatgtatgt

SEQ ID NO: 479001 - DNA, 25 bp, Rattus norvegicus
gtaccaacaaaggtcatatgtatgt

SEQ ID NO: 479002 - DNA, 25 bp, Rattus norvegicus
gtaccaacaggacgagcaaggacaa

SEQ ID NO: 479003 - DNA, 25 bp, Rattus norvegicus
gtaccaacaggaggagcaaggacaa

SEQ ID NO: 479004 - DNA, 25 bp, Rattus norvegicus
gtaccaacagtacatctccagcatg

SEQ ID NO: 479005 - DNA, 25 bp, Rattus norvegicus
gtaccaacagtagatctccagcatg

SEQ ID NO: 479006 - DNA, 25 bp, Rattus norvegicus
gtaccaacagtgctcttgcggttta

SEQ ID NO: 479007 - DNA, 25 bp, Rattus norvegicus
gtaccaacagtggtcttgcggttta

SEQ ID NO: 479008 - DNA, 25 bp, Rattus norvegicus
gtaccaacatggaagactttcttaa

SEQ ID NO: 479009 - DNA, 25 bp, Rattus norvegicus
gtaccaacatggtagactttcttaa

SEQ ID NO: 479010 - DNA, 25 bp, Rattus norvegicus
gtaccaaccgaccaacatcaattag

SEQ ID NO: 479011 - DNA, 25 bp, Rattus norvegicus
gtaccaaccgacgaacatcaattag

SEQ ID NO: 479012 - DNA, 25 bp, Rattus norvegicus
gtaccaacctcgaattacgtgtgtt

SEQ ID NO: 479013 - DNA, 25 bp, Rattus norvegicus
gtaccaacctcgtattacgtgtgtt

SEQ ID NO: 479014 - DNA, 25 bp, Rattus norvegicus
gtaccaaccttaaagcgcgcgagtt

SEQ ID NO: 479015 - DNA, 25 bp, Rattus norvegicus
gtaccaaccttatagcgcgcgagtt

SEQ ID NO: 479016 - DNA, 25 bp, Rattus norvegicus
gtaccaacggttccttagacagcat

SEQ ID NO: 479017 - DNA, 25 bp, Rattus norvegicus
gtaccaacggttgcttagacagcat

SEQ ID NO: 479018 - DNA, 25 bp, Rattus norvegicus
gtaccaactaagacttcctgggatc

SEQ ID NO: 479019 - DNA, 25 bp, Rattus norvegicus
gtaccaactaagtcttcctgggatc

SEQ ID NO: 479020 - DNA, 25 bp, Rattus norvegicus
gtaccaagagatccacaggaggctt

SEQ ID NO: 479021 - DNA, 25 bp, Rattus norvegicus
gtaccaagagatgcacaggaggctt

SEQ ID NO: 479022 - DNA, 25 bp, Rattus norvegicus
gtaccaagatttctcttctatacaa

SEQ ID NO: 479023 - DNA, 25 bp, Rattus norvegicus
gtaccaagatttgtcttctatacaa

SEQ ID NO: 479024 - DNA, 25 bp, Rattus norvegicus
gtaccaagcactcttatgtggctct

SEQ ID NO: 479025 - DNA, 25 bp, Rattus norvegicus
gtaccaagcactgttatgtggctct

SEQ ID NO: 479026 - DNA, 25 bp, Rattus norvegicus
gtaccaaggaccagctgtgttcgct

SEQ ID NO: 479027 - DNA, 25 bp, Rattus norvegicus
gtaccaaggacctgctgtgttcgct

SEQ ID NO: 479028 - DNA, 25 bp, Rattus norvegicus
gtaccaaggacgcattgcctggaag

SEQ ID NO: 479029 - DNA, 25 bp, Rattus norvegicus
gtaccaaggacggattgcctggaag

SEQ ID NO: 479030 - DNA, 25 bp, Rattus norvegicus
gtaccaagtaccactcacgaagttc

SEQ ID NO: 479031 - DNA, 25 bp, Rattus norvegicus
gtaccaagtacctctcacgaagttc

SEQ ID NO: 479032 - DNA, 25 bp, Rattus norvegicus
gtaccaagtagcctgagatgctcca

SEQ ID NO: 479033 - DNA, 25 bp, Rattus norvegicus
gtaccaagtagcgtgagatgctcca

SEQ ID NO: 479034 - DNA, 25 bp, Rattus norvegicus
gtaccaagtggcaactctcatggtc

SEQ ID NO: 479035 - DNA, 25 bp, Rattus norvegicus
gtaccaagtggctactctcatggtc

SEQ ID NO: 479036 - DNA, 25 bp, Rattus norvegicus
gtaccaagtgtacccagttggcagc

SEQ ID NO: 479037 - DNA, 25 bp, Rattus norvegicus
gtaccaagtgtagccagttggcagc

SEQ ID NO: 479038 - DNA, 25 bp, Rattus norvegicus
gtaccaatacagctaacacagaact

SEQ ID NO: 479039 - DNA, 25 bp, Rattus norvegicus
gtaccaatacaggtaacacagaact

SEQ ID NO: 479040 - DNA, 25 bp, Rattus norvegicus
gtaccaatatcaattccactataag

SEQ ID NO: 479041 - DNA, 25 bp, Rattus norvegicus
gtaccaatatcatttccactataag

SEQ ID NO: 479042 - DNA, 25 bp, Rattus norvegicus
gtaccaatatctacacaagttagga

SEQ ID NO: 479043 - DNA, 25 bp, Rattus norvegicus
gtaccaatatcttcacaagttagga

SEQ ID NO: 479044 - DNA, 25 bp, Rattus norvegicus
gtaccaatccctacatgcagtggaa

SEQ ID NO: 479045 - DNA, 25 bp, Rattus norvegicus
gtaccaatcccttcatgcagtggaa

SEQ ID NO: 479046 - DNA, 25 bp, Rattus norvegicus
gtaccaatctgacctctttgaattt

SEQ ID NO: 479047 - DNA, 25 bp, Rattus norvegicus
gtaccaatctgagctctttgaattt

SEQ ID NO: 479048 - DNA, 25 bp, Rattus norvegicus
gtaccaatgataccgacacttgcca

SEQ ID NO: 479049 - DNA, 25 bp, Rattus norvegicus
gtaccaatgatagcgacacttgcca

SEQ ID NO: 479050 - DNA, 25 bp, Rattus norvegicus
gtaccaatgctaagtattcctatat

SEQ ID NO: 479051 - DNA, 25 bp, Rattus norvegicus
gtaccaatgctatgtattcctatat

SEQ ID NO: 479052 - DNA, 25 bp, Rattus norvegicus
gtaccaatgcttataacaacagaat

SEQ ID NO: 479053 - DNA, 25 bp, Rattus norvegicus
gtaccaatgcttttaacaacagaat

SEQ ID NO: 479054 - DNA, 25 bp, Rattus norvegicus
gtaccaatgggaacacttactgtaa

SEQ ID NO: 479055 - DNA, 25 bp, Rattus norvegicus
gtaccaatgggatcacttactgtaa

SEQ ID NO: 479056 - DNA, 25 bp, Rattus norvegicus
gtaccaatgtccagtctggcattaa

SEQ ID NO: 479057 - DNA, 25 bp, Rattus norvegicus
gtaccaatgtcctgtctggcattaa

SEQ ID NO: 479058 - DNA, 25 bp, Rattus norvegicus
gtaccaatgttcacagacactctga

SEQ ID NO: 479059 - DNA, 25 bp, Rattus norvegicus
gtaccaatgttctcagacactctga

SEQ ID NO: 479060 - DNA, 25 bp, Rattus norvegicus
gtaccaattatgaatcttttgtgaa

SEQ ID NO: 479061 - DNA, 25 bp, Rattus norvegicus
gtaccaattatgtatcttttgtgaa

SEQ ID NO: 479062 - DNA, 25 bp, Rattus norvegicus
gtaccacacgacacttagctgcaag

SEQ ID NO: 479063 - DNA, 25 bp, Rattus norvegicus
gtaccacacgactcttagctgcaag

SEQ ID NO: 479064 - DNA, 25 bp, Rattus norvegicus
gtaccacactacagtttgaaccatg

SEQ ID NO: 479065 - DNA, 25 bp, Rattus norvegicus
gtaccacactactgtttgaaccatg

SEQ ID NO: 479066 - DNA, 25 bp, Rattus norvegicus
gtaccacagagaagacggagtccaa

SEQ ID NO: 479067 - DNA, 25 bp, Rattus norvegicus
gtaccacagagatgacggagtccaa

SEQ ID NO: 479068 - DNA, 25 bp, Rattus norvegicus
gtaccacagagcaactccaaagggt

SEQ ID NO: 479069 - DNA, 25 bp, Rattus norvegicus
gtaccacagagctactccaaagggt

SEQ ID NO: 479070 - DNA, 25 bp, Rattus norvegicus
gtaccacagcttaagaaacccagtt

SEQ ID NO: 479071 - DNA, 25 bp, Rattus norvegicus
gtaccacagctttagaaacccagtt

SEQ ID NO: 479072 - DNA, 25 bp, Rattus norvegicus
gtaccacaggtaccaaatccaacac

SEQ ID NO: 479073 - DNA, 25 bp, Rattus norvegicus
gtaccacaggtagcaaatccaacac

SEQ ID NO: 479074 - DNA, 25 bp, Rattus norvegicus
gtaccacagtccatggattaccaga

SEQ ID NO: 479075 - DNA, 25 bp, Rattus norvegicus
gtaccacagtccttggattaccaga

SEQ ID NO: 479076 - DNA, 25 bp, Rattus norvegicus
gtaccacatgtaatgtaaaggcagt

SEQ ID NO: 479077 - DNA, 25 bp, Rattus norvegicus
gtaccacatgtattgtaaaggcagt

SEQ ID NO: 479078 - DNA, 25 bp, Rattus norvegicus
gtaccaccaggactgaggactctgt

SEQ ID NO: 479079 - DNA, 25 bp, Rattus norvegicus
gtaccaccaggagtgaggactctgt

SEQ ID NO: 479080 - DNA, 25 bp, Rattus norvegicus
gtaccaccagtgaatctgtcttctg

SEQ ID NO: 479081 - DNA, 25 bp, Rattus norvegicus
gtaccaccagtgtatctgtcttctg

SEQ ID NO: 479082 - DNA, 25 bp, Rattus norvegicus
gtaccacccgccagattcagggatt

SEQ ID NO: 479083 - DNA, 25 bp, Rattus norvegicus
gtaccacccgcctgattcagggatt

SEQ ID NO: 479084 - DNA, 25 bp, Rattus norvegicus
gtaccaccgacacagattgtttcca

SEQ ID NO: 479085 - DNA, 25 bp, Rattus norvegicus
gtaccaccgacagagattgtttcca

SEQ ID NO: 479086 - DNA, 25 bp, Rattus norvegicus
gtaccacgctgtcatactgatgtca

SEQ ID NO: 479087 - DNA, 25 bp, Rattus norvegicus
gtaccacgctgtgatactgatgtca

SEQ ID NO: 479088 - DNA, 25 bp, Rattus norvegicus
gtaccacggaacacagttttcatat

SEQ ID NO: 479089 - DNA, 25 bp, Rattus norvegicus
gtaccacggaactcagttttcatat

SEQ ID NO: 479090 - DNA, 25 bp, Rattus norvegicus
gtaccacgtaaaaagctctggcaaa

SEQ ID NO: 479091 - DNA, 25 bp, Rattus norvegicus
gtaccacgtaaatagctctggcaaa

SEQ ID NO: 479092 - DNA, 25 bp, Rattus norvegicus
gtaccacgtttaaatgagcagtctc

SEQ ID NO: 479093 - DNA, 25 bp, Rattus norvegicus
gtaccacgtttatatgagcagtctc

SEQ ID NO: 479094 - DNA, 25 bp, Rattus norvegicus
gtaccactaaacaattttttgcaga

SEQ ID NO: 479095 - DNA, 25 bp, Rattus norvegicus
gtaccactaaactattttttgcaga

SEQ ID NO: 479096 - DNA, 25 bp, Rattus norvegicus
gtaccactatgtcaagctagcacct

SEQ ID NO: 479097 - DNA, 25 bp, Rattus norvegicus
gtaccactatgtgaagctagcacct

SEQ ID NO: 479098 - DNA, 25 bp, Rattus norvegicus
gtaccactctttccaattcacaatg

SEQ ID NO: 479099 - DNA, 25 bp, Rattus norvegicus
gtaccactctttgcaattcacaatg

SEQ ID NO: 479100 - DNA, 25 bp, Rattus norvegicus
gtaccactgatgagagcttacatgc

SEQ ID NO: 479101 - DNA, 25 bp, Rattus norvegicus
gtaccactgatgatgaaccctccga

SEQ ID NO: 479102 - DNA, 25 bp, Rattus norvegicus
gtaccactgatgtgagcttacatgc

SEQ ID NO: 479103 - DNA, 25 bp, Rattus norvegicus
gtaccactgatgttgaaccctccga

SEQ ID NO: 479104 - DNA, 25 bp, Rattus norvegicus
gtaccactgcagcacctcattttaa

SEQ ID NO: 479105 - DNA, 25 bp, Rattus norvegicus
gtaccactgcaggacctcattttaa

SEQ ID NO: 479106 - DNA, 25 bp, Rattus norvegicus
gtaccactggctacgccttgtgtaa

SEQ ID NO: 479107 - DNA, 25 bp, Rattus norvegicus
gtaccactggcttcgccttgtgtaa

SEQ ID NO: 479108 - DNA, 25 bp, Rattus norvegicus
gtaccactggtactttgcagtctca

SEQ ID NO: 479109 - DNA, 25 bp, Rattus norvegicus
gtaccactggtagtttgcagtctca

SEQ ID NO: 479110 - DNA, 25 bp, Rattus norvegicus
gtaccactgtggagtctattgctca

SEQ ID NO: 479111 - DNA, 25 bp, Rattus norvegicus
gtaccactgtggtgtctattgctca

SEQ ID NO: 479112 - DNA, 25 bp, Rattus norvegicus
gtaccacttcctctgttatcagtag

SEQ ID NO: 479113 - DNA, 25 bp, Rattus norvegicus
gtaccacttcctgtgttatcagtag

SEQ ID NO: 479114 - DNA, 25 bp, Rattus norvegicus
gtaccacttcgcagggatggaggac

SEQ ID NO: 479115 - DNA, 25 bp, Rattus norvegicus
gtaccacttcgctgggatggaggac

SEQ ID NO: 479116 - DNA, 25 bp, Rattus norvegicus
gtaccacttgggagttactacatgt

SEQ ID NO: 479117 - DNA, 25 bp, Rattus norvegicus
gtaccacttgggtgttactacatgt

SEQ ID NO: 479118 - DNA, 25 bp, Rattus norvegicus
gtaccagaactactatgcccagtgg

SEQ ID NO: 479119 - DNA, 25 bp, Rattus norvegicus
gtaccagaactagtatgcccagtgg

SEQ ID NO: 479120 - DNA, 25 bp, Rattus norvegicus
gtaccagaagacctctgtgttgttt

SEQ ID NO: 479121 - DNA, 25 bp, Rattus norvegicus
gtaccagaagacgtctgtgttgttt

SEQ ID NO: 479122 - DNA, 25 bp, Rattus norvegicus
gtaccagaattaacattccaatgat

SEQ ID NO: 479123 - DNA, 25 bp, Rattus norvegicus
gtaccagaattatcattccaatgat

SEQ ID NO: 479124 - DNA, 25 bp, Rattus norvegicus
gtaccagagccacctcgtggtgtga

SEQ ID NO: 479125 - DNA, 25 bp, Rattus norvegicus
gtaccagagccagctcgtggtgtga

SEQ ID NO: 479126 - DNA, 25 bp, Rattus norvegicus
gtaccagaggcaagggtttcccctg

SEQ ID NO: 479127 - DNA, 25 bp, Rattus norvegicus
gtaccagaggcatgggtttcccctg

SEQ ID NO: 479128 - DNA, 25 bp, Rattus norvegicus
gtaccagcaagcattgctctttgat

SEQ ID NO: 479129 - DNA, 25 bp, Rattus norvegicus
gtaccagcaagctttgctctttgat

SEQ ID NO: 479130 - DNA, 25 bp, Rattus norvegicus
gtaccagcacaaatactgcttcctt

SEQ ID NO: 479131 - DNA, 25 bp, Rattus norvegicus
gtaccagcacaattactgcttcctt

SEQ ID NO: 479132 - DNA, 25 bp, Rattus norvegicus
gtaccagcagccagacatgagttct

SEQ ID NO: 479133 - DNA, 25 bp, Rattus norvegicus
gtaccagcagccattttggtctcaa

SEQ ID NO: 479134 - DNA, 25 bp, Rattus norvegicus
gtaccagcagcctgacatgagttct

SEQ ID NO: 479135 - DNA, 25 bp, Rattus norvegicus
gtaccagcagcctttttggtctcaa

SEQ ID NO: 479136 - DNA, 25 bp, Rattus norvegicus
gtaccagcagggatgttgtgattta

SEQ ID NO: 479137 - DNA, 25 bp, Rattus norvegicus
gtaccagcagggttgttgtgattta

SEQ ID NO: 479138 - DNA, 25 bp, Rattus norvegicus
gtaccagcgaaaaggacaccatcat

SEQ ID NO: 479139 - DNA, 25 bp, Rattus norvegicus
gtaccagcgaaatggacaccatcat

SEQ ID NO: 479140 - DNA, 25 bp, Rattus norvegicus
gtaccagctcccatgagtcaaacag

SEQ ID NO: 479141 - DNA, 25 bp, Rattus norvegicus
gtaccagctcccttgagtcaaacag

SEQ ID NO: 479142 - DNA, 25 bp, Rattus norvegicus
gtaccagctgacaagactgtcccat

SEQ ID NO: 479143 - DNA, 25 bp, Rattus norvegicus
gtaccagctgactagactgtcccat

SEQ ID NO: 479144 - DNA, 25 bp, Rattus norvegicus
gtaccagctgcactaccaggtggct

SEQ ID NO: 479145 - DNA, 25 bp, Rattus norvegicus
gtaccagctgcagtaccaggtggct

SEQ ID NO: 479146 - DNA, 25 bp, Rattus norvegicus
gtaccagctgtgattctttctgaga

SEQ ID NO: 479147 - DNA, 25 bp, Rattus norvegicus
gtaccagctgtgtttctttctgaga

SEQ ID NO: 479148 - DNA, 25 bp, Rattus norvegicus
gtaccagcttagcagattcagatga

SEQ ID NO: 479149 - DNA, 25 bp, Rattus norvegicus
gtaccagcttaggagattcagatga

SEQ ID NO: 479150 - DNA, 25 bp, Rattus norvegicus
gtaccagcttgccttgatggttaat

SEQ ID NO: 479151 - DNA, 25 bp, Rattus norvegicus
gtaccagcttgcgttgatggttaat

SEQ ID NO: 479152 - DNA, 25 bp, Rattus norvegicus
gtaccagcttggattccacagtatt

SEQ ID NO: 479153 - DNA, 25 bp, Rattus norvegicus
gtaccagcttggtttccacagtatt

SEQ ID NO: 479154 - DNA, 25 bp, Rattus norvegicus
gtaccaggaacaattgtgtctcaga

SEQ ID NO: 479155 - DNA, 25 bp, Rattus norvegicus
gtaccaggaacatttgtgtctcaga

SEQ ID NO: 479156 - DNA, 25 bp, Rattus norvegicus
gtaccaggaatgaccgggctacagt

SEQ ID NO: 479157 - DNA, 25 bp, Rattus norvegicus
gtaccaggaatgtccgggctacagt

SEQ ID NO: 479158 - DNA, 25 bp, Rattus norvegicus
gtaccaggacgaacaatagaagaac

SEQ ID NO: 479159 - DNA, 25 bp, Rattus norvegicus
gtaccaggacgatcaatagaagaac

SEQ ID NO: 479160 - DNA, 25 bp, Rattus norvegicus
gtaccaggacgccaccgcagaagag

SEQ ID NO: 479161 - DNA, 25 bp, Rattus norvegicus
gtaccaggacgcgaccgcagaagag

SEQ ID NO: 479162 - DNA, 25 bp, Rattus norvegicus
gtaccaggaggtcccatgattccaa

SEQ ID NO: 479163 - DNA, 25 bp, Rattus norvegicus
gtaccaggaggtgccatgattccaa

SEQ ID NO: 479164 - DNA, 25 bp, Rattus norvegicus
gtaccaggcaggcacacaacacata

SEQ ID NO: 479165 - DNA, 25 bp, Rattus norvegicus
gtaccaggcagggacacaacacata

SEQ ID NO: 479166 - DNA, 25 bp, Rattus norvegicus
gtaccaggccaacgagaacgatttc

SEQ ID NO: 479167 - DNA, 25 bp, Rattus norvegicus
gtaccaggccaaggagaacgatttc

SEQ ID NO: 479168 - DNA, 25 bp, Rattus norvegicus
gtaccaggccagacaggactacata

SEQ ID NO: 479169 - DNA, 25 bp, Rattus norvegicus
gtaccaggccagtcaggactacata

SEQ ID NO: 479170 - DNA, 25 bp, Rattus norvegicus
gtaccaggcgtcctgcagatggtct

SEQ ID NO: 479171 - DNA, 25 bp, Rattus norvegicus
gtaccaggcgtcgtgcagatggtct

SEQ ID NO: 479172 - DNA, 25 bp, Rattus norvegicus
gtaccaggctgtaacactcaacttg

SEQ ID NO: 479173 - DNA, 25 bp, Rattus norvegicus
gtaccaggctgtcacctgtggagca

SEQ ID NO: 479174 - DNA, 25 bp, Rattus norvegicus
gtaccaggctgtgacctgtggagca

SEQ ID NO: 479175 - DNA, 25 bp, Rattus norvegicus
gtaccaggctgttacactcaacttg

SEQ ID NO: 479176 - DNA, 25 bp, Rattus norvegicus
gtaccaggtatcacttataacacag

SEQ ID NO: 479177 - DNA, 25 bp, Rattus norvegicus
gtaccaggtatctcttataacacag

SEQ ID NO: 479178 - DNA, 25 bp, Rattus norvegicus
gtaccaggtcttatatgtgggtgtt

SEQ ID NO: 479179 - DNA, 25 bp, Rattus norvegicus
gtaccaggtcttttatgtgggtgtt

SEQ ID NO: 479180 - DNA, 25 bp, Rattus norvegicus
gtaccagtaaaacagctgtcctcgt

SEQ ID NO: 479181 - DNA, 25 bp, Rattus norvegicus
gtaccagtaaaagagctgtcctcgt

SEQ ID NO: 479182 - DNA, 25 bp, Rattus norvegicus
gtaccagtaaaccttagtgcagtca

SEQ ID NO: 479183 - DNA, 25 bp, Rattus norvegicus
gtaccagtaaacgttagtgcagtca

SEQ ID NO: 479184 - DNA, 25 bp, Rattus norvegicus
gtaccagtaccacgaagtttgaaca

SEQ ID NO: 479185 - DNA, 25 bp, Rattus norvegicus
gtaccagtaccaggaagtttgaaca

SEQ ID NO: 479186 - DNA, 25 bp, Rattus norvegicus
gtaccagtcactctcttgggtgaga

SEQ ID NO: 479187 - DNA, 25 bp, Rattus norvegicus
gtaccagtcactgtcttgggtgaga

SEQ ID NO: 479188 - DNA, 25 bp, Rattus norvegicus
gtaccagtcagtaattatgtagaac

SEQ ID NO: 479189 - DNA, 25 bp, Rattus norvegicus
gtaccagtcagttattatgtagaac

SEQ ID NO: 479190 - DNA, 25 bp, Rattus norvegicus
gtaccagtcgaaacctcaatgggca

SEQ ID NO: 479191 - DNA, 25 bp, Rattus norvegicus
gtaccagtcgaatcctcaatgggca

SEQ ID NO: 479192 - DNA, 25 bp, Rattus norvegicus
gtaccagtcggtctatgttctatct

SEQ ID NO: 479193 - DNA, 25 bp, Rattus norvegicus
gtaccagtcggtgtatgttctatct

SEQ ID NO: 479194 - DNA, 25 bp, Rattus norvegicus
gtaccagtcttaccagtgcttgaga

SEQ ID NO: 479195 - DNA, 25 bp, Rattus norvegicus
gtaccagtcttagcagtgcttgaga

SEQ ID NO: 479196 - DNA, 25 bp, Rattus norvegicus
gtaccagtgagacgacagcaccatt

SEQ ID NO: 479197 - DNA, 25 bp, Rattus norvegicus
gtaccagtgagaggacagcaccatt

SEQ ID NO: 479198 - DNA, 25 bp, Rattus norvegicus
gtaccagttctgcacaagtgccact

SEQ ID NO: 479199 - DNA, 25 bp, Rattus norvegicus
gtaccagttctggacaagtgccact

SEQ ID NO: 479200 - DNA, 25 bp, Rattus norvegicus
gtaccagttgtcaaagccatttgct

SEQ ID NO: 479201 - DNA, 25 bp, Rattus norvegicus
gtaccagttgtctaagccatttgct

SEQ ID NO: 479202 - DNA, 25 bp, Rattus norvegicus
gtaccagtttgtcttttctttatat

SEQ ID NO: 479203 - DNA, 25 bp, Rattus norvegicus
gtaccagtttgtgttttctttatat

SEQ ID NO: 479204 - DNA, 25 bp, Rattus norvegicus
gtaccagttttgagctaggactaag

SEQ ID NO: 479205 - DNA, 25 bp, Rattus norvegicus
gtaccagttttgtgctaggactaag

SEQ ID NO: 479206 - DNA, 25 bp, Rattus norvegicus
gtaccataaccaacctattgcctat

SEQ ID NO: 479207 - DNA, 25 bp, Rattus norvegicus
gtaccataaccatcctattgcctat

SEQ ID NO: 479208 - DNA, 25 bp, Rattus norvegicus
gtaccatacatacgcgatgcagact

SEQ ID NO: 479209 - DNA, 25 bp, Rattus norvegicus
gtaccatacataggcgatgcagact

SEQ ID NO: 479210 - DNA, 25 bp, Rattus norvegicus
gtaccatagttcattcatctgcgtg

SEQ ID NO: 479211 - DNA, 25 bp, Rattus norvegicus
gtaccatagttctttcatctgcgtg

SEQ ID NO: 479212 - DNA, 25 bp, Rattus norvegicus
gtaccatatcttatgcttgcagtct

SEQ ID NO: 479213 - DNA, 25 bp, Rattus norvegicus
gtaccatatcttttgcttgcagtct

SEQ ID NO: 479214 - DNA, 25 bp, Rattus norvegicus
gtaccatcacctagcaagaacactt

SEQ ID NO: 479215 - DNA, 25 bp, Rattus norvegicus
gtaccatcaccttgcaagaacactt

SEQ ID NO: 479216 - DNA, 25 bp, Rattus norvegicus
gtaccatcagacagttaccttctta

SEQ ID NO: 479217 - DNA, 25 bp, Rattus norvegicus
gtaccatcagactgttaccttctta

SEQ ID NO: 479218 - DNA, 25 bp, Rattus norvegicus
gtaccatcagtaccatagtccctga

SEQ ID NO: 479219 - DNA, 25 bp, Rattus norvegicus
gtaccatcagtagcatagtccctga

SEQ ID NO: 479220 - DNA, 25 bp, Rattus norvegicus
gtaccatcagtgagacttagagtct

SEQ ID NO: 479221 - DNA, 25 bp, Rattus norvegicus
gtaccatcagtgtgacttagagtct

SEQ ID NO: 479222 - DNA, 25 bp, Rattus norvegicus
gtaccatcgggcatgtggaccatgg

SEQ ID NO: 479223 - DNA, 25 bp, Rattus norvegicus
gtaccatcgggcttgtggaccatgg

SEQ ID NO: 479224 - DNA, 25 bp, Rattus norvegicus
gtaccatctgaacccaaatgctgaa

SEQ ID NO: 479225 - DNA, 25 bp, Rattus norvegicus
gtaccatctgaagccaaatgctgaa

SEQ ID NO: 479226 - DNA, 25 bp, Rattus norvegicus
gtaccatctgataactcgcttgcat

SEQ ID NO: 479227 - DNA, 25 bp, Rattus norvegicus
gtaccatctgattactcgcttgcat

SEQ ID NO: 479228 - DNA, 25 bp, Rattus norvegicus
gtaccatctgctatctttgactcat

SEQ ID NO: 479229 - DNA, 25 bp, Rattus norvegicus
gtaccatctgctttctttgactcat

SEQ ID NO: 479230 - DNA, 25 bp, Rattus norvegicus
gtaccatgactgagctttttgaata

SEQ ID NO: 479231 - DNA, 25 bp, Rattus norvegicus
gtaccatgactgtgctttttgaata

SEQ ID NO: 479232 - DNA, 25 bp, Rattus norvegicus
gtaccatgagccatctgtagcaagt

SEQ ID NO: 479233 - DNA, 25 bp, Rattus norvegicus
gtaccatgagccttctgtagcaagt

SEQ ID NO: 479234 - DNA, 25 bp, Rattus norvegicus
gtaccatgatatattccagcatctt

SEQ ID NO: 479235 - DNA, 25 bp, Rattus norvegicus
gtaccatgatattttccagcatctt

SEQ ID NO: 479236 - DNA, 25 bp, Rattus norvegicus
gtaccatgatttcgagtcctgttcc

SEQ ID NO: 479237 - DNA, 25 bp, Rattus norvegicus
gtaccatgatttggagtcctgttcc

SEQ ID NO: 479238 - DNA, 25 bp, Rattus norvegicus
gtaccatgccgtactatctaatgtc

SEQ ID NO: 479239 - DNA, 25 bp, Rattus norvegicus
gtaccatgccgttctatctaatgtc

SEQ ID NO: 479240 - DNA, 25 bp, Rattus norvegicus
gtaccatgcctgagtcattactgaa

SEQ ID NO: 479241 - DNA, 25 bp, Rattus norvegicus
gtaccatgcctgtgtcattactgaa

SEQ ID NO: 479242 - DNA, 25 bp, Rattus norvegicus
gtaccatgcggtcatgagtgaccat

SEQ ID NO: 479243 - DNA, 25 bp, Rattus norvegicus
gtaccatgcggtgatgagtgaccat

SEQ ID NO: 479244 - DNA, 25 bp, Rattus norvegicus
gtaccatgctatatttctttcattg

SEQ ID NO: 479245 - DNA, 25 bp, Rattus norvegicus
gtaccatgctatttttctttcattg

SEQ ID NO: 479246 - DNA, 25 bp, Rattus norvegicus
gtaccatgctccataaaaagtgaag

SEQ ID NO: 479247 - DNA, 25 bp, Rattus norvegicus
gtaccatgctccttaaaaagtgaag

SEQ ID NO: 479248 - DNA, 25 bp, Rattus norvegicus
gtaccatgcttgatcagttcttagt

SEQ ID NO: 479249 - DNA, 25 bp, Rattus norvegicus
gtaccatgcttgttcagttcttagt

SEQ ID NO: 479250 - DNA, 25 bp, Rattus norvegicus
gtaccatggaatcatgcccttgcct

SEQ ID NO: 479251 - DNA, 25 bp, Rattus norvegicus
gtaccatggaatgatgcccttgcct

SEQ ID NO: 479252 - DNA, 25 bp, Rattus norvegicus
gtaccatgtgtaccatttttgaaac

SEQ ID NO: 479253 - DNA, 25 bp, Rattus norvegicus
gtaccatgtgtagcatttttgaaac

SEQ ID NO: 479254 - DNA, 25 bp, Rattus norvegicus
gtaccatgttgactaggaactgcct

SEQ ID NO: 479255 - DNA, 25 bp, Rattus norvegicus
gtaccatgttgagtaggaactgcct

SEQ ID NO: 479256 - DNA, 25 bp, Rattus norvegicus
gtaccattacgtatgctatagcaga

SEQ ID NO: 479257 - DNA, 25 bp, Rattus norvegicus
gtaccattacgtttgctatagcaga

SEQ ID NO: 479258 - DNA, 25 bp, Rattus norvegicus
gtaccattatcaaacaccaaacctg

SEQ ID NO: 479259 - DNA, 25 bp, Rattus norvegicus
gtaccattatcatacaccaaacctg

SEQ ID NO: 479260 - DNA, 25 bp, Rattus norvegicus
gtaccattatgtacttgtgtgtgct

SEQ ID NO: 479261 - DNA, 25 bp, Rattus norvegicus
gtaccattatgttcttgtgtgtgct

SEQ ID NO: 479262 - DNA, 25 bp, Rattus norvegicus
gtaccattcacgctccaggagcaga

SEQ ID NO: 479263 - DNA, 25 bp, Rattus norvegicus
gtaccattcacggtccaggagcaga

SEQ ID NO: 479264 - DNA, 25 bp, Rattus norvegicus
gtaccattccctacagtaagttcat

SEQ ID NO: 479265 - DNA, 25 bp, Rattus norvegicus
gtaccattcccttcagtaagttcat

SEQ ID NO: 479266 - DNA, 25 bp, Rattus norvegicus
gtaccattccttctgggaaccaatg

SEQ ID NO: 479267 - DNA, 25 bp, Rattus norvegicus
gtaccattccttgtgggaaccaatg

SEQ ID NO: 479268 - DNA, 25 bp, Rattus norvegicus
gtaccattgattctatgcttctgat

SEQ ID NO: 479269 - DNA, 25 bp, Rattus norvegicus
gtaccattgattgtatgcttctgat

SEQ ID NO: 479270 - DNA, 25 bp, Rattus norvegicus
gtaccattgggcacagcagctgtca

SEQ ID NO: 479271 - DNA, 25 bp, Rattus norvegicus
gtaccattgggctcagcagctgtca

SEQ ID NO: 479272 - DNA, 25 bp, Rattus norvegicus
gtaccattggttctctgtcctttta

SEQ ID NO: 479273 - DNA, 25 bp, Rattus norvegicus
gtaccattggttgtctgtcctttta

SEQ ID NO: 479274 - DNA, 25 bp, Rattus norvegicus
gtaccattgtaccaaatgcccaagt

SEQ ID NO: 479275 - DNA, 25 bp, Rattus norvegicus
gtaccattgtacgaaatgcccaagt

SEQ ID NO: 479276 - DNA, 25 bp, Rattus norvegicus
gtaccattgtttaatcaggagccca

SEQ ID NO: 479277 - DNA, 25 bp, Rattus norvegicus
gtaccattgttttatcaggagccca

SEQ ID NO: 479278 - DNA, 25 bp, Rattus norvegicus
gtaccatttgtaaacctgaatttat

SEQ ID NO: 479279 - DNA, 25 bp, Rattus norvegicus
gtaccatttgtatacctgaatttat

SEQ ID NO: 479280 - DNA, 25 bp, Rattus norvegicus
gtaccattttgaatgtatgttgcac

SEQ ID NO: 479281 - DNA, 25 bp, Rattus norvegicus
gtaccattttgattgtatgttgcac

SEQ ID NO: 479282 - DNA, 25 bp, Rattus norvegicus
gtacccaaaaagcagtctgccaaag

SEQ ID NO: 479283 - DNA, 25 bp, Rattus norvegicus
gtacccaaaaaggagtctgccaaag

SEQ ID NO: 479284 - DNA, 25 bp, Rattus norvegicus
gtacccaaaactcatctgatgtccg

SEQ ID NO: 479285 - DNA, 25 bp, Rattus norvegicus
gtacccaaaactgatctgatgtccg

SEQ ID NO: 479286 - DNA, 25 bp, Rattus norvegicus
gtacccaaacttatttctctgcttg

SEQ ID NO: 479287 - DNA, 25 bp, Rattus norvegicus
gtacccaaacttttttctctgcttg

SEQ ID NO: 479288 - DNA, 25 bp, Rattus norvegicus
gtacccaaatggatgtttctgtaga

SEQ ID NO: 479289 - DNA, 25 bp, Rattus norvegicus
gtacccaaatggttgtttctgtaga

SEQ ID NO: 479290 - DNA, 25 bp, Rattus norvegicus
gtacccaaattgctgtctgttcttt

SEQ ID NO: 479291 - DNA, 25 bp, Rattus norvegicus
gtacccaaattggtgtctgttcttt

SEQ ID NO: 479292 - DNA, 25 bp, Rattus norvegicus
gtacccaaatttattcctgcttgct

SEQ ID NO: 479293 - DNA, 25 bp, Rattus norvegicus
gtacccaaattttttcctgcttgct

SEQ ID NO: 479294 - DNA, 25 bp, Rattus norvegicus
gtacccaacttcattactcactttg

SEQ ID NO: 479295 - DNA, 25 bp, Rattus norvegicus
gtacccaacttctttactcactttg

SEQ ID NO: 479296 - DNA, 25 bp, Rattus norvegicus
gtacccaagcctcgtgctggatgca

SEQ ID NO: 479297 - DNA, 25 bp, Rattus norvegicus
gtacccaagcctggtgctggatgca

SEQ ID NO: 479298 - DNA, 25 bp, Rattus norvegicus
gtacccaagcgtaagctcatgatca

SEQ ID NO: 479299 - DNA, 25 bp, Rattus norvegicus
gtacccaagcgttagctcatgatca

SEQ ID NO: 479300 - DNA, 25 bp, Rattus norvegicus
gtacccaagcttagcgaccatgcaa

SEQ ID NO: 479301 - DNA, 25 bp, Rattus norvegicus
gtacccaagctttgcgaccatgcaa

SEQ ID NO: 479302 - DNA, 25 bp, Rattus norvegicus
gtacccaatgtaatttagctatttt

SEQ ID NO: 479303 - DNA, 25 bp, Rattus norvegicus
gtacccaatgtattttagctatttt

SEQ ID NO: 479304 - DNA, 25 bp, Rattus norvegicus
gtacccaattcaactatggtggttg

SEQ ID NO: 479305 - DNA, 25 bp, Rattus norvegicus
gtacccaattcatctatggtggttg

SEQ ID NO: 479306 - DNA, 25 bp, Rattus norvegicus
gtacccacaagaagacctcaagcag

SEQ ID NO: 479307 - DNA, 25 bp, Rattus norvegicus
gtacccacaagatgacctcaagcag

SEQ ID NO: 479308 - DNA, 25 bp, Rattus norvegicus
gtacccacaccaatggcccatttaa

SEQ ID NO: 479309 - DNA, 25 bp, Rattus norvegicus
gtacccacaccattggcccatttaa

SEQ ID NO: 479310 - DNA, 25 bp, Rattus norvegicus
gtacccacagcacgctctagttcta

SEQ ID NO: 479311 - DNA, 25 bp, Rattus norvegicus
gtacccacagcaggctctagttcta

SEQ ID NO: 479312 - DNA, 25 bp, Rattus norvegicus
gtacccacaggacctacttcatgaa

SEQ ID NO: 479313 - DNA, 25 bp, Rattus norvegicus
gtacccacaggagctacttcatgaa

SEQ ID NO: 479314 - DNA, 25 bp, Rattus norvegicus
gtacccacatcaaaacatcgtgttg

SEQ ID NO: 479315 - DNA, 25 bp, Rattus norvegicus
gtacccacatcataacatcgtgttg

SEQ ID NO: 479316 - DNA, 25 bp, Rattus norvegicus
gtacccacatctcgagggcgacgtg

SEQ ID NO: 479317 - DNA, 25 bp, Rattus norvegicus
gtacccacatctggagggcgacgtg

SEQ ID NO: 479318 - DNA, 25 bp, Rattus norvegicus
gtacccacattgctaagagcccaag

SEQ ID NO: 479319 - DNA, 25 bp, Rattus norvegicus
gtacccacattggtaagagcccaag

SEQ ID NO: 479320 - DNA, 25 bp, Rattus norvegicus
gtacccaccttaaacactaaggcct

SEQ ID NO: 479321 - DNA, 25 bp, Rattus norvegicus
gtacccaccttatacactaaggcct

SEQ ID NO: 479322 - DNA, 25 bp, Rattus norvegicus
gtacccacggtgcttggatcaacaa

SEQ ID NO: 479323 - DNA, 25 bp, Rattus norvegicus
gtacccacggtggttggatcaacaa

SEQ ID NO: 479324 - DNA, 25 bp, Rattus norvegicus
gtacccagaagaacgatgtgaccca

SEQ ID NO: 479325 - DNA, 25 bp, Rattus norvegicus
gtacccagaagatcgatgtgaccca

SEQ ID NO: 479326 - DNA, 25 bp, Rattus norvegicus
gtacccagaaggagactccaagtat

SEQ ID NO: 479327 - DNA, 25 bp, Rattus norvegicus
gtacccagaaggtgactccaagtat

SEQ ID NO: 479328 - DNA, 25 bp, Rattus norvegicus
gtacccagagacactttccaaagaa

SEQ ID NO: 479329 - DNA, 25 bp, Rattus norvegicus
gtacccagagactctttccaaagaa

SEQ ID NO: 479330 - DNA, 25 bp, Rattus norvegicus
gtacccagaggaccatttcatcgag

SEQ ID NO: 479331 - DNA, 25 bp, Rattus norvegicus
gtacccagaggagcatttcatcgag

SEQ ID NO: 479332 - DNA, 25 bp, Rattus norvegicus
gtacccagagtgatgaactagcaaa

SEQ ID NO: 479333 - DNA, 25 bp, Rattus norvegicus
gtacccagagtgttgaactagcaaa

SEQ ID NO: 479334 - DNA, 25 bp, Rattus norvegicus
gtacccagatggagcctctagtaag

SEQ ID NO: 479335 - DNA, 25 bp, Rattus norvegicus
gtacccagatggtgcctctagtaag

SEQ ID NO: 479336 - DNA, 25 bp, Rattus norvegicus
gtacccagatgtcgtggtggaccca

SEQ ID NO: 479337 - DNA, 25 bp, Rattus norvegicus
gtacccagatgtggtggtggaccca

SEQ ID NO: 479338 - DNA, 25 bp, Rattus norvegicus
gtacccagctagctatggctctgtt

SEQ ID NO: 479339 - DNA, 25 bp, Rattus norvegicus
gtacccagctaggtatggctctgtt

SEQ ID NO: 479340 - DNA, 25 bp, Rattus norvegicus
gtacccaggagaagaacttttgcaa

SEQ ID NO: 479341 - DNA, 25 bp, Rattus norvegicus
gtacccaggagatgaacttttgcaa

SEQ ID NO: 479342 - DNA, 25 bp, Rattus norvegicus
gtacccagtactcattttaggcttt

SEQ ID NO: 479343 - DNA, 25 bp, Rattus norvegicus
gtacccagtactgattttaggcttt

SEQ ID NO: 479344 - DNA, 25 bp, Rattus norvegicus
gtacccagtgtaccgagtgtactga

SEQ ID NO: 479345 - DNA, 25 bp, Rattus norvegicus
gtacccagtgtagcgagtgtactga

SEQ ID NO: 479346 - DNA, 25 bp, Rattus norvegicus
gtacccagttccagacaatggttgg

SEQ ID NO: 479347 - DNA, 25 bp, Rattus norvegicus
gtacccagttcctgacaatggttgg

SEQ ID NO: 479348 - DNA, 25 bp, Rattus norvegicus
gtacccatagaaatgctggctgctc

SEQ ID NO: 479349 - DNA, 25 bp, Rattus norvegicus
gtacccatagaattgctggctgctc

SEQ ID NO: 479350 - DNA, 25 bp, Rattus norvegicus
gtacccatatgcagaggtcagccta

SEQ ID NO: 479351 - DNA, 25 bp, Rattus norvegicus
gtacccatatgctgaggtcagccta

SEQ ID NO: 479352 - DNA, 25 bp, Rattus norvegicus
gtacccatcttcagcctgagcagat

SEQ ID NO: 479353 - DNA, 25 bp, Rattus norvegicus
gtacccatcttctgcctgagcagat

SEQ ID NO: 479354 - DNA, 25 bp, Rattus norvegicus
gtacccatctttctaagaccaagag

SEQ ID NO: 479355 - DNA, 25 bp, Rattus norvegicus
gtacccatctttgtaagaccaagag

SEQ ID NO: 479356 - DNA, 25 bp, Rattus norvegicus
gtacccatgaccaggaaagtgctca

SEQ ID NO: 479357 - DNA, 25 bp, Rattus norvegicus
gtacccatgacctggaaagtgctca

SEQ ID NO: 479358 - DNA, 25 bp, Rattus norvegicus
gtaccccaagcacttttacagtagg

SEQ ID NO: 479359 - DNA, 25 bp, Rattus norvegicus
gtaccccaagcagttttacagtagg

SEQ ID NO: 479360 - DNA, 25 bp, Rattus norvegicus
gtaccccaagtgctcaacaagttag

SEQ ID NO: 479361 - DNA, 25 bp, Rattus norvegicus
gtaccccaagtggtcaacaagttag

SEQ ID NO: 479362 - DNA, 25 bp, Rattus norvegicus
gtaccccacagcagggaccagaaag

SEQ ID NO: 479363 - DNA, 25 bp, Rattus norvegicus
gtaccccacagctgggaccagaaag

SEQ ID NO: 479364 - DNA, 25 bp, Rattus norvegicus
gtaccccactacactaaacacaagg

SEQ ID NO: 479365 - DNA, 25 bp, Rattus norvegicus
gtaccccactactctaaacacaagg

SEQ ID NO: 479366 - DNA, 25 bp, Rattus norvegicus
gtaccccactagaagccagtgtttt

SEQ ID NO: 479367 - DNA, 25 bp, Rattus norvegicus
gtaccccactagtagccagtgtttt

SEQ ID NO: 479368 - DNA, 25 bp, Rattus norvegicus
gtaccccaggaaatgcataaatgct

SEQ ID NO: 479369 - DNA, 25 bp, Rattus norvegicus
gtaccccaggaattgcataaatgct

SEQ ID NO: 479370 - DNA, 25 bp, Rattus norvegicus
gtaccccaggtgaggaagactccca

SEQ ID NO: 479371 - DNA, 25 bp, Rattus norvegicus
gtaccccaggtgtggaagactccca

SEQ ID NO: 479372 - DNA, 25 bp, Rattus norvegicus
gtaccccatcacaaacgtgtcagaa

SEQ ID NO: 479373 - DNA, 25 bp, Rattus norvegicus
gtaccccatcactaacgtgtcagaa

SEQ ID NO: 479374 - DNA, 25 bp, Rattus norvegicus
gtaccccggagcagtctaagcggca

SEQ ID NO: 479375 - DNA, 25 bp, Rattus norvegicus
gtaccccggagctgtctaagcggca

SEQ ID NO: 479376 - DNA, 25 bp, Rattus norvegicus
gtacccctccttatactagtgataa

SEQ ID NO: 479377 - DNA, 25 bp, Rattus norvegicus
gtacccctccttttactagtgataa

SEQ ID NO: 479378 - DNA, 25 bp, Rattus norvegicus
gtacccctgaccattctaaaactgg

SEQ ID NO: 479379 - DNA, 25 bp, Rattus norvegicus
gtacccctgacctttctaaaactgg

SEQ ID NO: 479380 - DNA, 25 bp, Rattus norvegicus
gtacccctgttcattgattcattta

SEQ ID NO: 479381 - DNA, 25 bp, Rattus norvegicus
gtacccctgttctttgattcattta

SEQ ID NO: 479382 - DNA, 25 bp, Rattus norvegicus
gtaccccttggcagagtcacaaagt

SEQ ID NO: 479383 - DNA, 25 bp, Rattus norvegicus
gtaccccttggctgagtcacaaagt

SEQ ID NO: 479384 - DNA, 25 bp, Rattus norvegicus
gtacccctttacagtgtctaaatat

SEQ ID NO: 479385 - DNA, 25 bp, Rattus norvegicus
gtacccctttactgtgtctaaatat

SEQ ID NO: 479386 - DNA, 25 bp, Rattus norvegicus
gtacccctttgacagaatgtccagt

SEQ ID NO: 479387 - DNA, 25 bp, Rattus norvegicus
gtacccctttgactttgtgctatca

SEQ ID NO: 479388 - DNA, 25 bp, Rattus norvegicus
gtacccctttgagagaatgtccagt

SEQ ID NO: 479389 - DNA, 25 bp, Rattus norvegicus
gtacccctttgagtttgtgctatca

SEQ ID NO: 479390 - DNA, 25 bp, Rattus norvegicus
gtacccctttgtcctggtgagagaa

SEQ ID NO: 479391 - DNA, 25 bp, Rattus norvegicus
gtacccctttgtgctggtgagagaa

SEQ ID NO: 479392 - DNA, 25 bp, Rattus norvegicus
gtacccgaatgcaggcccaaggtga

SEQ ID NO: 479393 - DNA, 25 bp, Rattus norvegicus
gtacccgaatgctggcccaaggtga

SEQ ID NO: 479394 - DNA, 25 bp, Rattus norvegicus
gtacccgacagaagagaaccaggct

SEQ ID NO: 479395 - DNA, 25 bp, Rattus norvegicus
gtacccgacagatgagaaccaggct

SEQ ID NO: 479396 - DNA, 25 bp, Rattus norvegicus
gtacccgagcgccaccgtaagatcg

SEQ ID NO: 479397 - DNA, 25 bp, Rattus norvegicus
gtacccgagcgcgaccgtaagatcg

SEQ ID NO: 479398 - DNA, 25 bp, Rattus norvegicus
gtacccgagtctaagcgcttgggag

SEQ ID NO: 479399 - DNA, 25 bp, Rattus norvegicus
gtacccgagtcttagcgcttgggag

SEQ ID NO: 479400 - DNA, 25 bp, Rattus norvegicus
gtacccgatatgctggtcccgaaag

SEQ ID NO: 479401 - DNA, 25 bp, Rattus norvegicus
gtacccgatatggtggtcccgaaag

SEQ ID NO: 479402 - DNA, 25 bp, Rattus norvegicus
gtacccgcgtgtagtggccattttg

SEQ ID NO: 479403 - DNA, 25 bp, Rattus norvegicus
gtacccgcgtgttgtggccattttg

SEQ ID NO: 479404 - DNA, 25 bp, Rattus norvegicus
gtacccgctgtacaggatttccttg

SEQ ID NO: 479405 - DNA, 25 bp, Rattus norvegicus
gtacccgctgtagaggatttccttg

SEQ ID NO: 479406 - DNA, 25 bp, Rattus norvegicus
gtacccggcgatatgtgcgcaagtt

SEQ ID NO: 479407 - DNA, 25 bp, Rattus norvegicus
gtacccggcgatttgtgcgcaagtt

SEQ ID NO: 479408 - DNA, 25 bp, Rattus norvegicus
gtacccggttctagcaaacgccaat

SEQ ID NO: 479409 - DNA, 25 bp, Rattus norvegicus
gtacccggttcttgcaaacgccaat

SEQ ID NO: 479410 - DNA, 25 bp, Rattus norvegicus
gtacccgtggtacagctggcaacag

SEQ ID NO: 479411 - DNA, 25 bp, Rattus norvegicus
gtacccgtggtagagctggcaacag

SEQ ID NO: 479412 - DNA, 25 bp, Rattus norvegicus
gtacccgttgctctgacaggtctga

SEQ ID NO: 479413 - DNA, 25 bp, Rattus norvegicus
gtacccgttgctgtgacaggtctga

SEQ ID NO: 479414 - DNA, 25 bp, Rattus norvegicus
gtacccgtttcacagactcagtagg

SEQ ID NO: 479415 - DNA, 25 bp, Rattus norvegicus
gtacccgtttcagagactcagtagg

SEQ ID NO: 479416 - DNA, 25 bp, Rattus norvegicus
gtaccctagccactgatgtgatgcg

SEQ ID NO: 479417 - DNA, 25 bp, Rattus norvegicus
gtaccctagccagtgatgtgatgcg

SEQ ID NO: 479418 - DNA, 25 bp, Rattus norvegicus
gtaccctaggcactgtgaattgtga

SEQ ID NO: 479419 - DNA, 25 bp, Rattus norvegicus
gtaccctaggcagtgtgaattgtga

SEQ ID NO: 479420 - DNA, 25 bp, Rattus norvegicus
gtaccctagtgtacctatagagtgt

SEQ ID NO: 479421 - DNA, 25 bp, Rattus norvegicus
gtaccctagtgttcctatagagtgt

SEQ ID NO: 479422 - DNA, 25 bp, Rattus norvegicus
gtaccctatgggaggcattgctcac

SEQ ID NO: 479423 - DNA, 25 bp, Rattus norvegicus
gtaccctatgggtggcattgctcac

SEQ ID NO: 479424 - DNA, 25 bp, Rattus norvegicus
gtaccctatggtaactgtgttgctg

SEQ ID NO: 479425 - DNA, 25 bp, Rattus norvegicus
gtaccctatggttactgtgttgctg

SEQ ID NO: 479426 - DNA, 25 bp, Rattus norvegicus
gtaccctccatcatgatcaacgaag

SEQ ID NO: 479427 - DNA, 25 bp, Rattus norvegicus
gtaccctccatcttgatcaacgaag

SEQ ID NO: 479428 - DNA, 25 bp, Rattus norvegicus
gtaccctctcgaattgtatgataat

SEQ ID NO: 479429 - DNA, 25 bp, Rattus norvegicus
gtaccctctcgatttgtatgataat

SEQ ID NO: 479430 - DNA, 25 bp, Rattus norvegicus
gtaccctctgttataatctgttatt

SEQ ID NO: 479431 - DNA, 25 bp, Rattus norvegicus
gtaccctctgttttaatctgttatt

SEQ ID NO: 479432 - DNA, 25 bp, Rattus norvegicus
gtaccctgagcccttgtgtggaact

SEQ ID NO: 479433 - DNA, 25 bp, Rattus norvegicus
gtaccctgagccgttgtgtggaact

SEQ ID NO: 479434 - DNA, 25 bp, Rattus norvegicus
gtaccctgaggaacaattccccatt

SEQ ID NO: 479435 - DNA, 25 bp, Rattus norvegicus
gtaccctgaggatcaattccccatt

SEQ ID NO: 479436 - DNA, 25 bp, Rattus norvegicus
gtaccctgccttagtgttctgattc

SEQ ID NO: 479437 - DNA, 25 bp, Rattus norvegicus
gtaccctgcctttgtgttctgattc

SEQ ID NO: 479438 - DNA, 25 bp, Rattus norvegicus
gtaccctgctacctattcagagagt

SEQ ID NO: 479439 - DNA, 25 bp, Rattus norvegicus
gtaccctgctacgtattcagagagt

SEQ ID NO: 479440 - DNA, 25 bp, Rattus norvegicus
gtaccctgtcgtctcctgtaaataa

SEQ ID NO: 479441 - DNA, 25 bp, Rattus norvegicus
gtaccctgtcgtgtcctgtaaataa

SEQ ID NO: 479442 - DNA, 25 bp, Rattus norvegicus
gtaccctgtggaaacactgacctaa

SEQ ID NO: 479443 - DNA, 25 bp, Rattus norvegicus
gtaccctgtggatacactgacctaa

SEQ ID NO: 479444 - DNA, 25 bp, Rattus norvegicus
gtaccctgtgggaatgtttcatact

SEQ ID NO: 479445 - DNA, 25 bp, Rattus norvegicus
gtaccctgtgggtatgtttcatact

SEQ ID NO: 479446 - DNA, 25 bp, Rattus norvegicus
gtaccctgttcacacaagatcttgg

SEQ ID NO: 479447 - DNA, 25 bp, Rattus norvegicus
gtaccctgttcagacaagatcttgg

SEQ ID NO: 479448 - DNA, 25 bp, Rattus norvegicus
gtacccttacctcccatttaatatt

SEQ ID NO: 479449 - DNA, 25 bp, Rattus norvegicus
gtacccttacctgccatttaatatt

SEQ ID NO: 479450 - DNA, 25 bp, Rattus norvegicus
gtacccttctgcatggaaaatcata

SEQ ID NO: 479451 - DNA, 25 bp, Rattus norvegicus
gtacccttctgcttggaaaatcata

SEQ ID NO: 479452 - DNA, 25 bp, Rattus norvegicus
gtacccttctggaagatctcttctt

SEQ ID NO: 479453 - DNA, 25 bp, Rattus norvegicus
gtacccttctggtagatctcttctt

SEQ ID NO: 479454 - DNA, 25 bp, Rattus norvegicus
gtacccttgaaaattgagcatctct

SEQ ID NO: 479455 - DNA, 25 bp, Rattus norvegicus
gtacccttgaaatttgagcatctct

SEQ ID NO: 479456 - DNA, 25 bp, Rattus norvegicus
gtacccttgctcatcctatgagaag

SEQ ID NO: 479457 - DNA, 25 bp, Rattus norvegicus
gtacccttgctcttcctatgagaag

SEQ ID NO: 479458 - DNA, 25 bp, Rattus norvegicus
gtaccctttaaacactcaatccaga

SEQ ID NO: 479459 - DNA, 25 bp, Rattus norvegicus
gtaccctttaaagactcaatccaga

SEQ ID NO: 479460 - DNA, 25 bp, Rattus norvegicus
gtaccctttaccaatgcacagagaa

SEQ ID NO: 479461 - DNA, 25 bp, Rattus norvegicus
gtaccctttacctatgcacagagaa

SEQ ID NO: 479462 - DNA, 25 bp, Rattus norvegicus
gtacccttttggaagagcagcccat

SEQ ID NO: 479463 - DNA, 25 bp, Rattus norvegicus
gtacccttttggtagagcagcccat

SEQ ID NO: 479464 - DNA, 25 bp, Rattus norvegicus
gtaccgacaatcctgcacatgtgta

SEQ ID NO: 479465 - DNA, 25 bp, Rattus norvegicus
gtaccgacaatcgtgcacatgtgta

SEQ ID NO: 479466 - DNA, 25 bp, Rattus norvegicus
gtaccgacattccaagggacaccag

SEQ ID NO: 479467 - DNA, 25 bp, Rattus norvegicus
gtaccgacattcgaagggacaccag

SEQ ID NO: 479468 - DNA, 25 bp, Rattus norvegicus
gtaccgaggcatccttgacacacat

SEQ ID NO: 479469 - DNA, 25 bp, Rattus norvegicus
gtaccgaggcatgcttgacacacat

SEQ ID NO: 479470 - DNA, 25 bp, Rattus norvegicus
gtaccgatgtgaaagtgttttacca

SEQ ID NO: 479471 - DNA, 25 bp, Rattus norvegicus
gtaccgatgtgatagtgttttacca

SEQ ID NO: 479472 - DNA, 25 bp, Rattus norvegicus
gtaccgcaaacgcaggaagcgcttc

SEQ ID NO: 479473 - DNA, 25 bp, Rattus norvegicus
gtaccgcaaacggaggaagcgcttc

SEQ ID NO: 479474 - DNA, 25 bp, Rattus norvegicus
gtaccgccgcatcctagagcagctg

SEQ ID NO: 479475 - DNA, 25 bp, Rattus norvegicus
gtaccgccgcatgctagagcagctg

SEQ ID NO: 479476 - DNA, 25 bp, Rattus norvegicus
gtaccgcgatttaggttgatgccga

SEQ ID NO: 479477 - DNA, 25 bp, Rattus norvegicus
gtaccgcgattttggttgatgccga

SEQ ID NO: 479478 - DNA, 25 bp, Rattus norvegicus
gtaccgcgtcacactggaaggaagc

SEQ ID NO: 479479 - DNA, 25 bp, Rattus norvegicus
gtaccgcgtcactctggaaggaagc

SEQ ID NO: 479480 - DNA, 25 bp, Rattus norvegicus
gtaccgctgtataactctctcagaa

SEQ ID NO: 479481 - DNA, 25 bp, Rattus norvegicus
gtaccgctgtattactctctcagaa

SEQ ID NO: 479482 - DNA, 25 bp, Rattus norvegicus
gtaccggaaggcctggaataaaatg

SEQ ID NO: 479483 - DNA, 25 bp, Rattus norvegicus
gtaccggaaggcgtggaataaaatg

SEQ ID NO: 479484 - DNA, 25 bp, Rattus norvegicus
gtaccggagagcattcagtgatcta

SEQ ID NO: 479485 - DNA, 25 bp, Rattus norvegicus
gtaccggagagctttcagtgatcta

SEQ ID NO: 479486 - DNA, 25 bp, Rattus norvegicus
gtaccggaggagaacccagcccctg

SEQ ID NO: 479487 - DNA, 25 bp, Rattus norvegicus
gtaccggaggagtacccagcccctg

SEQ ID NO: 479488 - DNA, 25 bp, Rattus norvegicus
gtaccggatgcactcatactatggg

SEQ ID NO: 479489 - DNA, 25 bp, Rattus norvegicus
gtaccggatgcagtcatactatggg

SEQ ID NO: 479490 - DNA, 25 bp, Rattus norvegicus
gtaccggatgctcggagttatcaca

SEQ ID NO: 479491 - DNA, 25 bp, Rattus norvegicus
gtaccggatgctgggagttatcaca

SEQ ID NO: 479492 - DNA, 25 bp, Rattus norvegicus
gtaccggcggatctctattgtctat

SEQ ID NO: 479493 - DNA, 25 bp, Rattus norvegicus
gtaccggcggatgtctattgtctat

SEQ ID NO: 479494 - DNA, 25 bp, Rattus norvegicus
gtaccggctacacgaacacgtgcga

SEQ ID NO: 479495 - DNA, 25 bp, Rattus norvegicus
gtaccggctacaggaacacgtgcga

SEQ ID NO: 479496 - DNA, 25 bp, Rattus norvegicus
gtaccgggcgatccttgtgcctgag

SEQ ID NO: 479497 - DNA, 25 bp, Rattus norvegicus
gtaccgggcgatgcttgtgcctgag

SEQ ID NO: 479498 - DNA, 25 bp, Rattus norvegicus
gtaccggtctgccaagcctgttcat

SEQ ID NO: 479499 - DNA, 25 bp, Rattus norvegicus
gtaccggtctgcgaagcctgttcat

SEQ ID NO: 479500 - DNA, 25 bp, Rattus norvegicus
gtaccggtgtatcgagcccctggat

SEQ ID NO: 479501 - DNA, 25 bp, Rattus norvegicus
gtaccggtgtatggagcccctggat

SEQ ID NO: 479502 - DNA, 25 bp, Rattus norvegicus
gtaccggttacgacaatcacaagtg

SEQ ID NO: 479503 - DNA, 25 bp, Rattus norvegicus
gtaccggttacgtcaatcacaagtg

SEQ ID NO: 479504 - DNA, 25 bp, Rattus norvegicus
gtaccggtttagagacccgtggcag

SEQ ID NO: 479505 - DNA, 25 bp, Rattus norvegicus
gtaccggtttagtgacccgtggcag

SEQ ID NO: 479506 - DNA, 25 bp, Rattus norvegicus
gtaccgtaaagacttgctggcacat

SEQ ID NO: 479507 - DNA, 25 bp, Rattus norvegicus
gtaccgtaaagagttgctggcacat

SEQ ID NO: 479508 - DNA, 25 bp, Rattus norvegicus
gtaccgtatgttagagcccgagtgc

SEQ ID NO: 479509 - DNA, 25 bp, Rattus norvegicus
gtaccgtatgtttgagcccgagtgc

SEQ ID NO: 479510 - DNA, 25 bp, Rattus norvegicus
gtaccgtcaaggaatctcaagtgca

SEQ ID NO: 479511 - DNA, 25 bp, Rattus norvegicus
gtaccgtcaaggtatctcaagtgca

SEQ ID NO: 479512 - DNA, 25 bp, Rattus norvegicus
gtaccgtccagtcttgatggctttt

SEQ ID NO: 479513 - DNA, 25 bp, Rattus norvegicus
gtaccgtccagtgttgatggctttt

SEQ ID NO: 479514 - DNA, 25 bp, Rattus norvegicus
gtaccgtcccttagattatttcagt

SEQ ID NO: 479515 - DNA, 25 bp, Rattus norvegicus
gtaccgtccctttgattatttcagt

SEQ ID NO: 479516 - DNA, 25 bp, Rattus norvegicus
gtaccgtgagccagaagcactgtat

SEQ ID NO: 479517 - DNA, 25 bp, Rattus norvegicus
gtaccgtgagcctgaagcactgtat

SEQ ID NO: 479518 - DNA, 25 bp, Rattus norvegicus
gtaccgtgcatcaagagcttcctga

SEQ ID NO: 479519 - DNA, 25 bp, Rattus norvegicus
gtaccgtgcatctagagcttcctga

SEQ ID NO: 479520 - DNA, 25 bp, Rattus norvegicus
gtaccgtggcttatattgtgctaga

SEQ ID NO: 479521 - DNA, 25 bp, Rattus norvegicus
gtaccgtggcttttattgtgctaga

SEQ ID NO: 479522 - DNA, 25 bp, Rattus norvegicus
gtaccgtgtgtacctagtacccatg

SEQ ID NO: 479523 - DNA, 25 bp, Rattus norvegicus
gtaccgtgtgtagctagtacccatg

SEQ ID NO: 479524 - DNA, 25 bp, Rattus norvegicus
gtaccgttgtctattgtttaggcat

SEQ ID NO: 479525 - DNA, 25 bp, Rattus norvegicus
gtaccgttgtcttttgtttaggcat

SEQ ID NO: 479526 - DNA, 25 bp, Rattus norvegicus
gtaccgtttccccatctgtaagaat

SEQ ID NO: 479527 - DNA, 25 bp, Rattus norvegicus
gtaccgtttcccgatctgtaagaat

SEQ ID NO: 479528 - DNA, 25 bp, Rattus norvegicus
gtaccgttttcacctgttgggagaa

SEQ ID NO: 479529 - DNA, 25 bp, Rattus norvegicus
gtaccgttttcagctgttgggagaa

SEQ ID NO: 479530 - DNA, 25 bp, Rattus norvegicus
gtacctaaaagcctggagacttagc

SEQ ID NO: 479531 - DNA, 25 bp, Rattus norvegicus
gtacctaaaagcgtggagacttagc

SEQ ID NO: 479532 - DNA, 25 bp, Rattus norvegicus
gtacctaacagtatctgcttgtgta

SEQ ID NO: 479533 - DNA, 25 bp, Rattus norvegicus
gtacctaacagtttctgcttgtgta

SEQ ID NO: 479534 - DNA, 25 bp, Rattus norvegicus
gtacctaagcccagtgagatctaat

SEQ ID NO: 479535 - DNA, 25 bp, Rattus norvegicus
gtacctaagccctgtgagatctaat

SEQ ID NO: 479536 - DNA, 25 bp, Rattus norvegicus
gtacctacaaagcagctcacaacgg

SEQ ID NO: 479537 - DNA, 25 bp, Rattus norvegicus
gtacctacaaaggagctcacaacgg

SEQ ID NO: 479538 - DNA, 25 bp, Rattus norvegicus
gtacctacatacctattgaacaaag

SEQ ID NO: 479539 - DNA, 25 bp, Rattus norvegicus
gtacctacatacgtattgaacaaag

SEQ ID NO: 479540 - DNA, 25 bp, Rattus norvegicus
gtacctaccctacatgtgcacttgt

SEQ ID NO: 479541 - DNA, 25 bp, Rattus norvegicus
gtacctaccctagatgtgcacttgt

SEQ ID NO: 479542 - DNA, 25 bp, Rattus norvegicus
gtacctaccgtaattatgctttctt

SEQ ID NO: 479543 - DNA, 25 bp, Rattus norvegicus
gtacctaccgtatttatgctttctt

SEQ ID NO: 479544 - DNA, 25 bp, Rattus norvegicus
gtacctacctggaacaagacttcat

SEQ ID NO: 479545 - DNA, 25 bp, Rattus norvegicus
gtacctacctggtacaagacttcat

SEQ ID NO: 479546 - DNA, 25 bp, Rattus norvegicus
gtacctacggttctttctgagatca

SEQ ID NO: 479547 - DNA, 25 bp, Rattus norvegicus
gtacctacggttgtttctgagatca

SEQ ID NO: 479548 - DNA, 25 bp, Rattus norvegicus
gtacctactcatctgtcttcataag

SEQ ID NO: 479549 - DNA, 25 bp, Rattus norvegicus
gtacctactcatgtgtcttcataag

SEQ ID NO: 479550 - DNA, 25 bp, Rattus norvegicus
gtacctacttctcgaaacagccctg

SEQ ID NO: 479551 - DNA, 25 bp, Rattus norvegicus
gtacctacttctggaaacagccctg

SEQ ID NO: 479552 - DNA, 25 bp, Rattus norvegicus
gtacctagaatcctgtcttgttaga

SEQ ID NO: 479553 - DNA, 25 bp, Rattus norvegicus
gtacctagaatcgtgtcttgttaga

SEQ ID NO: 479554 - DNA, 25 bp, Rattus norvegicus
gtacctagagctatcttatgtctgt

SEQ ID NO: 479555 - DNA, 25 bp, Rattus norvegicus
gtacctagagctttcttatgtctgt

SEQ ID NO: 479556 - DNA, 25 bp, Rattus norvegicus
gtacctagccaaccatgcacatagt

SEQ ID NO: 479557 - DNA, 25 bp, Rattus norvegicus
gtacctagccaagcatgcacatagt

SEQ ID NO: 479558 - DNA, 25 bp, Rattus norvegicus
gtacctagtacccatggagaccaga

SEQ ID NO: 479559 - DNA, 25 bp, Rattus norvegicus
gtacctagtaccgatggagaccaga

SEQ ID NO: 479560 - DNA, 25 bp, Rattus norvegicus
gtacctagtctcatctgtattactt

SEQ ID NO: 479561 - DNA, 25 bp, Rattus norvegicus
gtacctagtctcttctgtattactt

SEQ ID NO: 479562 - DNA, 25 bp, Rattus norvegicus
gtacctagtggaacatgtcctctgc

SEQ ID NO: 479563 - DNA, 25 bp, Rattus norvegicus
gtacctagtggatcatgtcctctgc

SEQ ID NO: 479564 - DNA, 25 bp, Rattus norvegicus
gtacctagtggcattgggcttaaat

SEQ ID NO: 479565 - DNA, 25 bp, Rattus norvegicus
gtacctagtggctttgggcttaaat

SEQ ID NO: 479566 - DNA, 25 bp, Rattus norvegicus
gtacctatacctcttagcactatca

SEQ ID NO: 479567 - DNA, 25 bp, Rattus norvegicus
gtacctatacctgttagcactatca

SEQ ID NO: 479568 - DNA, 25 bp, Rattus norvegicus
gtacctatactgaccctccatgatt

SEQ ID NO: 479569 - DNA, 25 bp, Rattus norvegicus
gtacctatactgtccctccatgatt

SEQ ID NO: 479570 - DNA, 25 bp, Rattus norvegicus
gtacctatcaagaacagagagcaga

SEQ ID NO: 479571 - DNA, 25 bp, Rattus norvegicus
gtacctatcaagtacagagagcaga

SEQ ID NO: 479572 - DNA, 25 bp, Rattus norvegicus
gtacctatgaacaatctacatcaag

SEQ ID NO: 479573 - DNA, 25 bp, Rattus norvegicus
gtacctatgaactatctacatcaag

SEQ ID NO: 479574 - DNA, 25 bp, Rattus norvegicus
gtacctatgactcttgcctgcaaaa

SEQ ID NO: 479575 - DNA, 25 bp, Rattus norvegicus
gtacctatgactgttgcctgcaaaa

SEQ ID NO: 479576 - DNA, 25 bp, Rattus norvegicus
gtacctatgatcacatgctcacttt

SEQ ID NO: 479577 - DNA, 25 bp, Rattus norvegicus
gtacctatgatctcatgctcacttt

SEQ ID NO: 479578 - DNA, 25 bp, Rattus norvegicus
gtacctatgtgacagacattttcga

SEQ ID NO: 479579 - DNA, 25 bp, Rattus norvegicus
gtacctatgtgagagacattttcga

SEQ ID NO: 479580 - DNA, 25 bp, Rattus norvegicus
gtacctatgttcagctacttctcag

SEQ ID NO: 479581 - DNA, 25 bp, Rattus norvegicus
gtacctatgttctgctacttctcag

SEQ ID NO: 479582 - DNA, 25 bp, Rattus norvegicus
gtacctatttaaaacagtgcctctc

SEQ ID NO: 479583 - DNA, 25 bp, Rattus norvegicus
gtacctatttaatacagtgcctctc

SEQ ID NO: 479584 - DNA, 25 bp, Rattus norvegicus
gtacctcaaatcctttgtgggctga

SEQ ID NO: 479585 - DNA, 25 bp, Rattus norvegicus
gtacctcaaatcgtttgtgggctga

SEQ ID NO: 479586 - DNA, 25 bp, Rattus norvegicus
gtacctcaacggcacggacagcttc

SEQ ID NO: 479587 - DNA, 25 bp, Rattus norvegicus
gtacctcaacgggacggacagcttc

SEQ ID NO: 479588 - DNA, 25 bp, Rattus norvegicus
gtacctcaaggcagactcttatgtg

SEQ ID NO: 479589 - DNA, 25 bp, Rattus norvegicus
gtacctcaaggctgactcttatgtg

SEQ ID NO: 479590 - DNA, 25 bp, Rattus norvegicus
gtacctcaagtaaagctgtttctgc

SEQ ID NO: 479591 - DNA, 25 bp, Rattus norvegicus
gtacctcaagtatagctgtttctgc

SEQ ID NO: 479592 - DNA, 25 bp, Rattus norvegicus
gtacctcacacaataatgatgggag

SEQ ID NO: 479593 - DNA, 25 bp, Rattus norvegicus
gtacctcacacattaatgatgggag

SEQ ID NO: 479594 - DNA, 25 bp, Rattus norvegicus
gtacctcagatcaattcatactgct

SEQ ID NO: 479595 - DNA, 25 bp, Rattus norvegicus
gtacctcagatctattcatactgct

SEQ ID NO: 479596 - DNA, 25 bp, Rattus norvegicus
gtacctcagatgatttatcctctca

SEQ ID NO: 479597 - DNA, 25 bp, Rattus norvegicus
gtacctcagatgttttatcctctca

SEQ ID NO: 479598 - DNA, 25 bp, Rattus norvegicus
gtacctcagctaaacgttcacacag

SEQ ID NO: 479599 - DNA, 25 bp, Rattus norvegicus
gtacctcagctatacgttcacacag

SEQ ID NO: 479600 - DNA, 25 bp, Rattus norvegicus
gtacctcagttcattgccagggagc

SEQ ID NO: 479601 - DNA, 25 bp, Rattus norvegicus
gtacctcagttctttgccagggagc

SEQ ID NO: 479602 - DNA, 25 bp, Rattus norvegicus
gtacctcattgcctctttccggaag

SEQ ID NO: 479603 - DNA, 25 bp, Rattus norvegicus
gtacctcattgcgtctttccggaag

SEQ ID NO: 479604 - DNA, 25 bp, Rattus norvegicus
gtacctccagaacaaattgaaatac

SEQ ID NO: 479605 - DNA, 25 bp, Rattus norvegicus
gtacctccagaagaaattgaaatac

SEQ ID NO: 479606 - DNA, 25 bp, Rattus norvegicus
gtacctccagttccatggaaatcta

SEQ ID NO: 479607 - DNA, 25 bp, Rattus norvegicus
gtacctccagttgcatggaaatcta

SEQ ID NO: 479608 - DNA, 25 bp, Rattus norvegicus
gtacctccatggaactctgttggga

SEQ ID NO: 479609 - DNA, 25 bp, Rattus norvegicus
gtacctccatggtactctgttggga

SEQ ID NO: 479610 - DNA, 25 bp, Rattus norvegicus
gtacctcctgatacgttttcatatt

SEQ ID NO: 479611 - DNA, 25 bp, Rattus norvegicus
gtacctcctgattcgttttcatatt

SEQ ID NO: 479612 - DNA, 25 bp, Rattus norvegicus
gtacctcctgtgagcgtttatgtta

SEQ ID NO: 479613 - DNA, 25 bp, Rattus norvegicus
gtacctcctgtgtgcgtttatgtta

SEQ ID NO: 479614 - DNA, 25 bp, Rattus norvegicus
gtacctccttcacagcagaacagct

SEQ ID NO: 479615 - DNA, 25 bp, Rattus norvegicus
gtacctccttcagagcagaacagct

SEQ ID NO: 479616 - DNA, 25 bp, Rattus norvegicus
gtacctcgaatgcattcagctttac

SEQ ID NO: 479617 - DNA, 25 bp, Rattus norvegicus
gtacctcgaatggattcagctttac

SEQ ID NO: 479618 - DNA, 25 bp, Rattus norvegicus
gtacctcgacatagcatcttaattt

SEQ ID NO: 479619 - DNA, 25 bp, Rattus norvegicus
gtacctcgacattgcatcttaattt

SEQ ID NO: 479620 - DNA, 25 bp, Rattus norvegicus
gtacctcgtgccaatttctttggat

SEQ ID NO: 479621 - DNA, 25 bp, Rattus norvegicus
gtacctcgtgcctatttctttggat

SEQ ID NO: 479622 - DNA, 25 bp, Rattus norvegicus
gtacctctagctcagatctgttgcc

SEQ ID NO: 479623 - DNA, 25 bp, Rattus norvegicus
gtacctctagctgagatctgttgcc

SEQ ID NO: 479624 - DNA, 25 bp, Rattus norvegicus
gtacctctaggacctcggaagtgca

SEQ ID NO: 479625 - DNA, 25 bp, Rattus norvegicus
gtacctctaggagctcggaagtgca

SEQ ID NO: 479626 - DNA, 25 bp, Rattus norvegicus
gtacctctgactatggtggttgtta

SEQ ID NO: 479627 - DNA, 25 bp, Rattus norvegicus
gtacctctgactttggtggttgtta

SEQ ID NO: 479628 - DNA, 25 bp, Rattus norvegicus
gtacctctgtatctaaccgttttca

SEQ ID NO: 479629 - DNA, 25 bp, Rattus norvegicus
gtacctctgtatgtaaccgttttca

SEQ ID NO: 479630 - DNA, 25 bp, Rattus norvegicus
gtacctcttcttactgtttaacatg

SEQ ID NO: 479631 - DNA, 25 bp, Rattus norvegicus
gtacctcttctttctgtttaacatg

SEQ ID NO: 479632 - DNA, 25 bp, Rattus norvegicus
gtacctcttgtcaaattcatgatat

SEQ ID NO: 479633 - DNA, 25 bp, Rattus norvegicus
gtacctcttgtctaattcatgatat

SEQ ID NO: 479634 - DNA, 25 bp, Rattus norvegicus
gtacctcttgttaacataatttgca

SEQ ID NO: 479635 - DNA, 25 bp, Rattus norvegicus
gtacctcttgtttacataatttgca

SEQ ID NO: 479636 - DNA, 25 bp, Rattus norvegicus
gtacctgaacacagtactgctctta

SEQ ID NO: 479637 - DNA, 25 bp, Rattus norvegicus
gtacctgaacactgtactgctctta

SEQ ID NO: 479638 - DNA, 25 bp, Rattus norvegicus
gtacctgaacccatgtgtccaaatg

SEQ ID NO: 479639 - DNA, 25 bp, Rattus norvegicus
gtacctgaacccttgtgtccaaatg

SEQ ID NO: 479640 - DNA, 25 bp, Rattus norvegicus
gtacctgaacggccatcagtcgaat

SEQ ID NO: 479641 - DNA, 25 bp, Rattus norvegicus
gtacctgaacgggcatcagtcgaat

SEQ ID NO: 479642 - DNA, 25 bp, Rattus norvegicus
gtacctgaagcgacacaatgccctg

SEQ ID NO: 479643 - DNA, 25 bp, Rattus norvegicus
gtacctgaagcgactctgattaaca

SEQ ID NO: 479644 - DNA, 25 bp, Rattus norvegicus
gtacctgaagcgtcacaatgccctg

SEQ ID NO: 479645 - DNA, 25 bp, Rattus norvegicus
gtacctgaagcgtctctgattaaca

SEQ ID NO: 479646 - DNA, 25 bp, Rattus norvegicus
gtacctgaaggaatgctgccttttt

SEQ ID NO: 479647 - DNA, 25 bp, Rattus norvegicus
gtacctgaaggattgctgccttttt

SEQ ID NO: 479648 - DNA, 25 bp, Rattus norvegicus
gtacctgaatatacattggctctta

SEQ ID NO: 479649 - DNA, 25 bp, Rattus norvegicus
gtacctgaatattcattggctctta

SEQ ID NO: 479650 - DNA, 25 bp, Rattus norvegicus
gtacctgacaagcatctggccacaa

SEQ ID NO: 479651 - DNA, 25 bp, Rattus norvegicus
gtacctgacaaggatctggccacaa

SEQ ID NO: 479652 - DNA, 25 bp, Rattus norvegicus
gtacctgacacgatcactacattga

SEQ ID NO: 479653 - DNA, 25 bp, Rattus norvegicus
gtacctgacacgttcactacattga

SEQ ID NO: 479654 - DNA, 25 bp, Rattus norvegicus
gtacctgacattatttgttacatat

SEQ ID NO: 479655 - DNA, 25 bp, Rattus norvegicus
gtacctgacattttttgttacatat

SEQ ID NO: 479656 - DNA, 25 bp, Rattus norvegicus
gtacctgactcaagctaagcactct

SEQ ID NO: 479657 - DNA, 25 bp, Rattus norvegicus
gtacctgactcatgctaagcactct

SEQ ID NO: 479658 - DNA, 25 bp, Rattus norvegicus
gtacctgacttaatttcctttcaat

SEQ ID NO: 479659 - DNA, 25 bp, Rattus norvegicus
gtacctgacttattttcctttcaat

SEQ ID NO: 479660 - DNA, 25 bp, Rattus norvegicus
gtacctgagactatctggacttgag

SEQ ID NO: 479661 - DNA, 25 bp, Rattus norvegicus
gtacctgagactcaattgctgacgt

SEQ ID NO: 479662 - DNA, 25 bp, Rattus norvegicus
gtacctgagactgaattgctgacgt

SEQ ID NO: 479663 - DNA, 25 bp, Rattus norvegicus
gtacctgagactttctggacttgag

SEQ ID NO: 479664 - DNA, 25 bp, Rattus norvegicus
gtacctgagccgagtttttggaagt

SEQ ID NO: 479665 - DNA, 25 bp, Rattus norvegicus
gtacctgagccgtgtttttggaagt

SEQ ID NO: 479666 - DNA, 25 bp, Rattus norvegicus
gtacctgagcctatccgaggaatat

SEQ ID NO: 479667 - DNA, 25 bp, Rattus norvegicus
gtacctgagcctttccgaggaatat

SEQ ID NO: 479668 - DNA, 25 bp, Rattus norvegicus
gtacctgagctccaagtgaacccca

SEQ ID NO: 479669 - DNA, 25 bp, Rattus norvegicus
gtacctgagctcgaagtgaacccca

SEQ ID NO: 479670 - DNA, 25 bp, Rattus norvegicus
gtacctgagtttacttccagtagta

SEQ ID NO: 479671 - DNA, 25 bp, Rattus norvegicus
gtacctgagttttcttccagtagta

SEQ ID NO: 479672 - DNA, 25 bp, Rattus norvegicus
gtacctgatacccatgaaatatgga

SEQ ID NO: 479673 - DNA, 25 bp, Rattus norvegicus
gtacctgataccgatgaaatatgga

SEQ ID NO: 479674 - DNA, 25 bp, Rattus norvegicus
gtacctgatactatttgaagcataa

SEQ ID NO: 479675 - DNA, 25 bp, Rattus norvegicus
gtacctgatactttttgaagcataa

SEQ ID NO: 479676 - DNA, 25 bp, Rattus norvegicus
gtacctgatgcacctcaacacaatt

SEQ ID NO: 479677 - DNA, 25 bp, Rattus norvegicus
gtacctgatgcagctcaacacaatt

SEQ ID NO: 479678 - DNA, 25 bp, Rattus norvegicus
gtacctgatggtcctccaggtggca

SEQ ID NO: 479679 - DNA, 25 bp, Rattus norvegicus
gtacctgatggtgctccaggtggca

SEQ ID NO: 479680 - DNA, 25 bp, Rattus norvegicus
gtacctgatgttctgatgtttttct

SEQ ID NO: 479681 - DNA, 25 bp, Rattus norvegicus
gtacctgatgttgtgatgtttttct

SEQ ID NO: 479682 - DNA, 25 bp, Rattus norvegicus
gtacctgcaactcaccagtctgagg

SEQ ID NO: 479683 - DNA, 25 bp, Rattus norvegicus
gtacctgcaactgaccagtctgagg

SEQ ID NO: 479684 - DNA, 25 bp, Rattus norvegicus
gtacctgcactgacatcactgtcag

SEQ ID NO: 479685 - DNA, 25 bp, Rattus norvegicus
gtacctgcactgtcatcactgtcag

SEQ ID NO: 479686 - DNA, 25 bp, Rattus norvegicus
gtacctgcagagatggcatatgccg

SEQ ID NO: 479687 - DNA, 25 bp, Rattus norvegicus
gtacctgcagagattttatctaagt

SEQ ID NO: 479688 - DNA, 25 bp, Rattus norvegicus
gtacctgcagagttggcatatgccg

SEQ ID NO: 479689 - DNA, 25 bp, Rattus norvegicus
gtacctgcagagtttttatctaagt

SEQ ID NO: 479690 - DNA, 25 bp, Rattus norvegicus
gtacctgcagcaatgatagcccatg

SEQ ID NO: 479691 - DNA, 25 bp, Rattus norvegicus
gtacctgcagcattgatagcccatg

SEQ ID NO: 479692 - DNA, 25 bp, Rattus norvegicus
gtacctgcaggcctgaattcagagc

SEQ ID NO: 479693 - DNA, 25 bp, Rattus norvegicus
gtacctgcaggcgtgaattcagagc

SEQ ID NO: 479694 - DNA, 25 bp, Rattus norvegicus
gtacctgcagtaccttgctctaaat

SEQ ID NO: 479695 - DNA, 25 bp, Rattus norvegicus
gtacctgcagtagcttgctctaaat

SEQ ID NO: 479696 - DNA, 25 bp, Rattus norvegicus
gtacctgcatctagtaaaccaccac

SEQ ID NO: 479697 - DNA, 25 bp, Rattus norvegicus
gtacctgcatcttgtaaaccaccac

SEQ ID NO: 479698 - DNA, 25 bp, Rattus norvegicus
gtacctgccacccattggatagggt

SEQ ID NO: 479699 - DNA, 25 bp, Rattus norvegicus
gtacctgccaccgattggatagggt

SEQ ID NO: 479700 - DNA, 25 bp, Rattus norvegicus
gtacctgccactctcattggatgac

SEQ ID NO: 479701 - DNA, 25 bp, Rattus norvegicus
gtacctgccactgtcattggatgac

SEQ ID NO: 479702 - DNA, 25 bp, Rattus norvegicus
gtacctgccagaaacaagctgtgag

SEQ ID NO: 479703 - DNA, 25 bp, Rattus norvegicus
gtacctgccagatacaagctgtgag

SEQ ID NO: 479704 - DNA, 25 bp, Rattus norvegicus
gtacctgccgctatgaggctgctaa

SEQ ID NO: 479705 - DNA, 25 bp, Rattus norvegicus
gtacctgccgctttgaggctgctaa

SEQ ID NO: 479706 - DNA, 25 bp, Rattus norvegicus
gtacctgcctgtatttcaaagtgtt

SEQ ID NO: 479707 - DNA, 25 bp, Rattus norvegicus
gtacctgcctgtcctgagtcagtat

SEQ ID NO: 479708 - DNA, 25 bp, Rattus norvegicus
gtacctgcctgtgctgagtcagtat

SEQ ID NO: 479709 - DNA, 25 bp, Rattus norvegicus
gtacctgcctgtttttcaaagtgtt

SEQ ID NO: 479710 - DNA, 25 bp, Rattus norvegicus
gtacctgctcaaaaaagcccatcag

SEQ ID NO: 479711 - DNA, 25 bp, Rattus norvegicus
gtacctgctcaataaagcccatcag

SEQ ID NO: 479712 - DNA, 25 bp, Rattus norvegicus
gtacctgctctaagtgtgaggcctt

SEQ ID NO: 479713 - DNA, 25 bp, Rattus norvegicus
gtacctgctctatgtgtgaggcctt

SEQ ID NO: 479714 - DNA, 25 bp, Rattus norvegicus
gtacctgctgcacttaggctataac

SEQ ID NO: 479715 - DNA, 25 bp, Rattus norvegicus
gtacctgctgcagttaggctataac

SEQ ID NO: 479716 - DNA, 25 bp, Rattus norvegicus
gtacctgcttcgatgcagtcacgag

SEQ ID NO: 479717 - DNA, 25 bp, Rattus norvegicus
gtacctgcttcgttgcagtcacgag

SEQ ID NO: 479718 - DNA, 25 bp, Rattus norvegicus
gtacctgctttaacctgtgtgtcat

SEQ ID NO: 479719 - DNA, 25 bp, Rattus norvegicus
gtacctgctttatcctgtgtgtcat

SEQ ID NO: 479720 - DNA, 25 bp, Rattus norvegicus
gtacctgctttgatctttgtaaact

SEQ ID NO: 479721 - DNA, 25 bp, Rattus norvegicus
gtacctgctttgcttctggagttga

SEQ ID NO: 479722 - DNA, 25 bp, Rattus norvegicus
gtacctgctttggttctggagttga

SEQ ID NO: 479723 - DNA, 25 bp, Rattus norvegicus
gtacctgctttgttctttgtaaact

SEQ ID NO: 479724 - DNA, 25 bp, Rattus norvegicus
gtacctgcttttaagcaacactgga

SEQ ID NO: 479725 - DNA, 25 bp, Rattus norvegicus
gtacctgctttttagcaacactgga

SEQ ID NO: 479726 - DNA, 25 bp, Rattus norvegicus
gtacctggaaaacccactggcaaat

SEQ ID NO: 479727 - DNA, 25 bp, Rattus norvegicus
gtacctggaaaagccactggcaaat

SEQ ID NO: 479728 - DNA, 25 bp, Rattus norvegicus
gtacctggaagactgtatgtcctga

SEQ ID NO: 479729 - DNA, 25 bp, Rattus norvegicus
gtacctggaagagtgtatgtcctga

SEQ ID NO: 479730 - DNA, 25 bp, Rattus norvegicus
gtacctggacgacatcaacctgttg

SEQ ID NO: 479731 - DNA, 25 bp, Rattus norvegicus
gtacctggacgagatcaacctgttg

SEQ ID NO: 479732 - DNA, 25 bp, Rattus norvegicus
gtacctggagagagcaacagccact

SEQ ID NO: 479733 - DNA, 25 bp, Rattus norvegicus
gtacctggagagtgcaacagccact

SEQ ID NO: 479734 - DNA, 25 bp, Rattus norvegicus
gtacctggagatctagttccctgag

SEQ ID NO: 479735 - DNA, 25 bp, Rattus norvegicus
gtacctggagatgtagttccctgag

SEQ ID NO: 479736 - DNA, 25 bp, Rattus norvegicus
gtacctggaggaaccgtggagcact

SEQ ID NO: 479737 - DNA, 25 bp, Rattus norvegicus
gtacctggaggatccgtggagcact

SEQ ID NO: 479738 - DNA, 25 bp, Rattus norvegicus
gtacctggagttagtccacgccaga

SEQ ID NO: 479739 - DNA, 25 bp, Rattus norvegicus
gtacctggagtttgtccacgccaga

SEQ ID NO: 479740 - DNA, 25 bp, Rattus norvegicus
gtacctggatgtatgactctaattt

SEQ ID NO: 479741 - DNA, 25 bp, Rattus norvegicus
gtacctggatgtttgactctaattt

SEQ ID NO: 479742 - DNA, 25 bp, Rattus norvegicus
gtacctggcaatatgtcagcctctt

SEQ ID NO: 479743 - DNA, 25 bp, Rattus norvegicus
gtacctggcaatttgtcagcctctt

SEQ ID NO: 479744 - DNA, 25 bp, Rattus norvegicus
gtacctggcccacatcattgtgatg

SEQ ID NO: 479745 - DNA, 25 bp, Rattus norvegicus
gtacctggcccagatcattgtgatg

SEQ ID NO: 479746 - DNA, 25 bp, Rattus norvegicus
gtacctggcgcacacgtatgtacag

SEQ ID NO: 479747 - DNA, 25 bp, Rattus norvegicus
gtacctggcgcagacgtatgtacag

SEQ ID NO: 479748 - DNA, 25 bp, Rattus norvegicus
gtacctggctcactagcaatttccc

SEQ ID NO: 479749 - DNA, 25 bp, Rattus norvegicus
gtacctggctcagtagcaatttccc

SEQ ID NO: 479750 - DNA, 25 bp, Rattus norvegicus
gtacctgggaaccatgacgactgtt

SEQ ID NO: 479751 - DNA, 25 bp, Rattus norvegicus
gtacctgggaacgatgacgactgtt

SEQ ID NO: 479752 - DNA, 25 bp, Rattus norvegicus
gtacctgggagtatcatctttcatg

SEQ ID NO: 479753 - DNA, 25 bp, Rattus norvegicus
gtacctgggagtttcatctttcatg

SEQ ID NO: 479754 - DNA, 25 bp, Rattus norvegicus
gtacctgggttgagcctgtttgagc

SEQ ID NO: 479755 - DNA, 25 bp, Rattus norvegicus
gtacctgggttgtgcctgtttgagc

SEQ ID NO: 479756 - DNA, 25 bp, Rattus norvegicus
gtacctggtcagagggaagttccat

SEQ ID NO: 479757 - DNA, 25 bp, Rattus norvegicus
gtacctggtcagtgggaagttccat

SEQ ID NO: 479758 - DNA, 25 bp, Rattus norvegicus
gtacctggtgatcagagacgtcttt

SEQ ID NO: 479759 - DNA, 25 bp, Rattus norvegicus
gtacctggtgatgagagacgtcttt

SEQ ID NO: 479760 - DNA, 25 bp, Rattus norvegicus
gtacctggtggcacagcgtgtcatc

SEQ ID NO: 479761 - DNA, 25 bp, Rattus norvegicus
gtacctggtggctcagcgtgtcatc

SEQ ID NO: 479762 - DNA, 25 bp, Rattus norvegicus
gtacctggtttgaagttctggaacg

SEQ ID NO: 479763 - DNA, 25 bp, Rattus norvegicus
gtacctggtttgtagttctggaacg

SEQ ID NO: 479764 - DNA, 25 bp, Rattus norvegicus
gtacctgtaattaggtacctacagt

SEQ ID NO: 479765 - DNA, 25 bp, Rattus norvegicus
gtacctgtaatttggtacctacagt

SEQ ID NO: 479766 - DNA, 25 bp, Rattus norvegicus
gtacctgtaggtaagcagatcccct

SEQ ID NO: 479767 - DNA, 25 bp, Rattus norvegicus
gtacctgtaggttagcagatcccct

SEQ ID NO: 479768 - DNA, 25 bp, Rattus norvegicus
gtacctgtagtcactttatttgcaa

SEQ ID NO: 479769 - DNA, 25 bp, Rattus norvegicus
gtacctgtagtcctctcggacaatg

SEQ ID NO: 479770 - DNA, 25 bp, Rattus norvegicus
gtacctgtagtcgtctcggacaatg

SEQ ID NO: 479771 - DNA, 25 bp, Rattus norvegicus
gtacctgtagtctctttatttgcaa

SEQ ID NO: 479772 - DNA, 25 bp, Rattus norvegicus
gtacctgtatttacaggtgtcccta

SEQ ID NO: 479773 - DNA, 25 bp, Rattus norvegicus
gtacctgtattttcaggtgtcccta

SEQ ID NO: 479774 - DNA, 25 bp, Rattus norvegicus
gtacctgtcccaaatgcttttgtaa

SEQ ID NO: 479775 - DNA, 25 bp, Rattus norvegicus
gtacctgtcccatatgcttttgtaa

SEQ ID NO: 479776 - DNA, 25 bp, Rattus norvegicus
gtacctgtcctacagggtctcgaat

SEQ ID NO: 479777 - DNA, 25 bp, Rattus norvegicus
gtacctgtcctagagggtctcgaat

SEQ ID NO: 479778 - DNA, 25 bp, Rattus norvegicus
gtacctgtcctcctgtgctgtgtga

SEQ ID NO: 479779 - DNA, 25 bp, Rattus norvegicus
gtacctgtcctcgtgtgctgtgtga

SEQ ID NO: 479780 - DNA, 25 bp, Rattus norvegicus
gtacctgtctttaacagagcttgct

SEQ ID NO: 479781 - DNA, 25 bp, Rattus norvegicus
gtacctgtcttttacagagcttgct

SEQ ID NO: 479782 - DNA, 25 bp, Rattus norvegicus
gtacctgtgaatagctgcctgtcat

SEQ ID NO: 479783 - DNA, 25 bp, Rattus norvegicus
gtacctgtgaattgctgcctgtcat

SEQ ID NO: 479784 - DNA, 25 bp, Rattus norvegicus
gtacctgtgaccctgagttggctac

SEQ ID NO: 479785 - DNA, 25 bp, Rattus norvegicus
gtacctgtgaccgtgagttggctac

SEQ ID NO: 479786 - DNA, 25 bp, Rattus norvegicus
gtacctgtgataacacctggagcct

SEQ ID NO: 479787 - DNA, 25 bp, Rattus norvegicus
gtacctgtgatatcacctggagcct

SEQ ID NO: 479788 - DNA, 25 bp, Rattus norvegicus
gtacctgtgcttccttgctttaaaa

SEQ ID NO: 479789 - DNA, 25 bp, Rattus norvegicus
gtacctgtgcttgcttgctttaaaa

SEQ ID NO: 479790 - DNA, 25 bp, Rattus norvegicus
gtacctgtgggcacactgaaggcaa

SEQ ID NO: 479791 - DNA, 25 bp, Rattus norvegicus
gtacctgtgggctcactgaaggcaa

SEQ ID NO: 479792 - DNA, 25 bp, Rattus norvegicus
gtacctgtggtacgcttactcagca

SEQ ID NO: 479793 - DNA, 25 bp, Rattus norvegicus
gtacctgtggtaggcttactcagca

SEQ ID NO: 479794 - DNA, 25 bp, Rattus norvegicus
gtacctgtgtcaactcactttgtaa

SEQ ID NO: 479795 - DNA, 25 bp, Rattus norvegicus
gtacctgtgtcatctcactttgtaa

SEQ ID NO: 479796 - DNA, 25 bp, Rattus norvegicus
gtacctgtgtgtctagacccgaaga

SEQ ID NO: 479797 - DNA, 25 bp, Rattus norvegicus
gtacctgtgtgtgtagacccgaaga

SEQ ID NO: 479798 - DNA, 25 bp, Rattus norvegicus
gtacctgttaggctgaatgtctgct

SEQ ID NO: 479799 - DNA, 25 bp, Rattus norvegicus
gtacctgttagggtgaatgtctgct

SEQ ID NO: 479800 - DNA, 25 bp, Rattus norvegicus
gtacctgttatgatggcagccattt

SEQ ID NO: 479801 - DNA, 25 bp, Rattus norvegicus
gtacctgttatgttggcagccattt

SEQ ID NO: 479802 - DNA, 25 bp, Rattus norvegicus
gtacctgttcacaactagttttctt

SEQ ID NO: 479803 - DNA, 25 bp, Rattus norvegicus
gtacctgttcactactagttttctt

SEQ ID NO: 479804 - DNA, 25 bp, Rattus norvegicus
gtacctgtttccagagccaccagag

SEQ ID NO: 479805 - DNA, 25 bp, Rattus norvegicus
gtacctgtttcctgagccaccagag

SEQ ID NO: 479806 - DNA, 25 bp, Rattus norvegicus
gtaccttactatagggtggccactt

SEQ ID NO: 479807 - DNA, 25 bp, Rattus norvegicus
gtaccttactatccctggtgggcta

SEQ ID NO: 479808 - DNA, 25 bp, Rattus norvegicus
gtaccttactatgcctggtgggcta

SEQ ID NO: 479809 - DNA, 25 bp, Rattus norvegicus
gtaccttactattgggtggccactt

SEQ ID NO: 479810 - DNA, 25 bp, Rattus norvegicus
gtaccttaggctatgcacttgtttt

SEQ ID NO: 479811 - DNA, 25 bp, Rattus norvegicus
gtaccttaggctttgcacttgtttt

SEQ ID NO: 479812 - DNA, 25 bp, Rattus norvegicus
gtaccttagggtatttcacagcctt

SEQ ID NO: 479813 - DNA, 25 bp, Rattus norvegicus
gtaccttagggtttttcacagcctt

SEQ ID NO: 479814 - DNA, 25 bp, Rattus norvegicus
gtaccttaggtaagatgactgaaca

SEQ ID NO: 479815 - DNA, 25 bp, Rattus norvegicus
gtaccttaggtatgatgactgaaca

SEQ ID NO: 479816 - DNA, 25 bp, Rattus norvegicus
gtaccttatagcctccgatgcgatg

SEQ ID NO: 479817 - DNA, 25 bp, Rattus norvegicus
gtaccttatagcgtccgatgcgatg

SEQ ID NO: 479818 - DNA, 25 bp, Rattus norvegicus
gtaccttatgttctttcctttctgc

SEQ ID NO: 479819 - DNA, 25 bp, Rattus norvegicus
gtaccttatgttgtttcctttctgc

SEQ ID NO: 479820 - DNA, 25 bp, Rattus norvegicus
gtaccttcaccacttgagggtctct

SEQ ID NO: 479821 - DNA, 25 bp, Rattus norvegicus
gtaccttcaccagttgagggtctct

SEQ ID NO: 479822 - DNA, 25 bp, Rattus norvegicus
gtaccttcatttagtccagagagca

SEQ ID NO: 479823 - DNA, 25 bp, Rattus norvegicus
gtaccttcattttgtccagagagca

SEQ ID NO: 479824 - DNA, 25 bp, Rattus norvegicus
gtaccttccctgctgtagacaggca

SEQ ID NO: 479825 - DNA, 25 bp, Rattus norvegicus
gtaccttccctggtgtagacaggca

SEQ ID NO: 479826 - DNA, 25 bp, Rattus norvegicus
gtaccttcctggaatcattgtcaaa

SEQ ID NO: 479827 - DNA, 25 bp, Rattus norvegicus
gtaccttcctggtatcattgtcaaa

SEQ ID NO: 479828 - DNA, 25 bp, Rattus norvegicus
gtaccttcgaggcactgtatttaac

SEQ ID NO: 479829 - DNA, 25 bp, Rattus norvegicus
gtaccttcgagggactgtatttaac

SEQ ID NO: 479830 - DNA, 25 bp, Rattus norvegicus
gtaccttctgtaagatgtcaacccc

SEQ ID NO: 479831 - DNA, 25 bp, Rattus norvegicus
gtaccttctgtatgatgtcaacccc

SEQ ID NO: 479832 - DNA, 25 bp, Rattus norvegicus
gtaccttgaaaacatgcccaccacg

SEQ ID NO: 479833 - DNA, 25 bp, Rattus norvegicus
gtaccttgaaaagatgcccaccacg

SEQ ID NO: 479834 - DNA, 25 bp, Rattus norvegicus
gtaccttgaaagcatccacacggga

SEQ ID NO: 479835 - DNA, 25 bp, Rattus norvegicus
gtaccttgaaaggatccacacggga

SEQ ID NO: 479836 - DNA, 25 bp, Rattus norvegicus
gtaccttgaggtcccggttcatagc

SEQ ID NO: 479837 - DNA, 25 bp, Rattus norvegicus
gtaccttgaggtgccggttcatagc

SEQ ID NO: 479838 - DNA, 25 bp, Rattus norvegicus
gtaccttgcaacaaggtgctatgac

SEQ ID NO: 479839 - DNA, 25 bp, Rattus norvegicus
gtaccttgcaactaggtgctatgac

SEQ ID NO: 479840 - DNA, 25 bp, Rattus norvegicus
gtaccttgcgtactctgttattttt

SEQ ID NO: 479841 - DNA, 25 bp, Rattus norvegicus
gtaccttgcgtagtctgttattttt

SEQ ID NO: 479842 - DNA, 25 bp, Rattus norvegicus
gtaccttgtgccactgaatttccaa

SEQ ID NO: 479843 - DNA, 25 bp, Rattus norvegicus
gtaccttgtgcctctgaatttccaa

SEQ ID NO: 479844 - DNA, 25 bp, Rattus norvegicus
gtaccttgttttcatcatttccaca

SEQ ID NO: 479845 - DNA, 25 bp, Rattus norvegicus
gtaccttgttttctagaagagtcaa

SEQ ID NO: 479846 - DNA, 25 bp, Rattus norvegicus
gtaccttgttttgatcatttccaca

SEQ ID NO: 479847 - DNA, 25 bp, Rattus norvegicus
gtaccttgttttgtagaagagtcaa

SEQ ID NO: 479848 - DNA, 25 bp, Rattus norvegicus
gtacctttacacagacccgaaacag

SEQ ID NO: 479849 - DNA, 25 bp, Rattus norvegicus
gtacctttacactgacccgaaacag

SEQ ID NO: 479850 - DNA, 25 bp, Rattus norvegicus
gtacctttatccaccgaatcagcag

SEQ ID NO: 479851 - DNA, 25 bp, Rattus norvegicus
gtacctttatcctccgaatcagcag

SEQ ID NO: 479852 - DNA, 25 bp, Rattus norvegicus
gtacctttatttaccagtatgccta

SEQ ID NO: 479853 - DNA, 25 bp, Rattus norvegicus
gtacctttattttccagtatgccta

SEQ ID NO: 479854 - DNA, 25 bp, Rattus norvegicus
gtacctttccacagtcattgaggca

SEQ ID NO: 479855 - DNA, 25 bp, Rattus norvegicus
gtacctttccactgtcattgaggca

SEQ ID NO: 479856 - DNA, 25 bp, Rattus norvegicus
gtacctttccataacaacatgccac

SEQ ID NO: 479857 - DNA, 25 bp, Rattus norvegicus
gtacctttccattacaacatgccac

SEQ ID NO: 479858 - DNA, 25 bp, Rattus norvegicus
gtacctttgactatgtatgacttgt

SEQ ID NO: 479859 - DNA, 25 bp, Rattus norvegicus
gtacctttgactttgtatgacttgt

SEQ ID NO: 479860 - DNA, 25 bp, Rattus norvegicus
gtacctttgcccctcatgtgattct

SEQ ID NO: 479861 - DNA, 25 bp, Rattus norvegicus
gtacctttgcccgtcatgtgattct

SEQ ID NO: 479862 - DNA, 25 bp, Rattus norvegicus
gtacctttggccatttaaactgctg

SEQ ID NO: 479863 - DNA, 25 bp, Rattus norvegicus
gtacctttggccttttaaactgctg

SEQ ID NO: 479864 - DNA, 25 bp, Rattus norvegicus
gtaccttttaagagtccgtcagtga

SEQ ID NO: 479865 - DNA, 25 bp, Rattus norvegicus
gtaccttttaagtgtccgtcagtga

SEQ ID NO: 479866 - DNA, 25 bp, Rattus norvegicus
gtacctttttgtccacgcattttgt

SEQ ID NO: 479867 - DNA, 25 bp, Rattus norvegicus
gtacctttttgtgcacgcattttgt

SEQ ID NO: 479868 - DNA, 25 bp, Rattus norvegicus
gtacgaagacacacaccagctgcaa

SEQ ID NO: 479869 - DNA, 25 bp, Rattus norvegicus
gtacgaagacactcaccagctgcaa

SEQ ID NO: 479870 - DNA, 25 bp, Rattus norvegicus
gtacgaagctgcacccagtgaggaa

SEQ ID NO: 479871 - DNA, 25 bp, Rattus norvegicus
gtacgaagctgctcccagtgaggaa

SEQ ID NO: 479872 - DNA, 25 bp, Rattus norvegicus
gtacgaagtaaactccatgaccata

SEQ ID NO: 479873 - DNA, 25 bp, Rattus norvegicus
gtacgaagtaaagtccatgaccata

SEQ ID NO: 479874 - DNA, 25 bp, Rattus norvegicus
gtacgaatacacactctggaatccc

SEQ ID NO: 479875 - DNA, 25 bp, Rattus norvegicus
gtacgaatacactctctggaatccc

SEQ ID NO: 479876 - DNA, 25 bp, Rattus norvegicus
gtacgaatgcgacgccaccaatgct

SEQ ID NO: 479877 - DNA, 25 bp, Rattus norvegicus
gtacgaatgcgaggccaccaatgct

SEQ ID NO: 479878 - DNA, 25 bp, Rattus norvegicus
gtacgacaagccattcagtggtgat

SEQ ID NO: 479879 - DNA, 25 bp, Rattus norvegicus
gtacgacaagcctttcagtggtgat

SEQ ID NO: 479880 - DNA, 25 bp, Rattus norvegicus
gtacgacactggcagattctgggca

SEQ ID NO: 479881 - DNA, 25 bp, Rattus norvegicus
gtacgacactgggagattctgggca

SEQ ID NO: 479882 - DNA, 25 bp, Rattus norvegicus
gtacgacattttcagttcacagcat

SEQ ID NO: 479883 - DNA, 25 bp, Rattus norvegicus
gtacgacattttgagttcacagcat

SEQ ID NO: 479884 - DNA, 25 bp, Rattus norvegicus
gtacgacctgccatttactttgtgg

SEQ ID NO: 479885 - DNA, 25 bp, Rattus norvegicus
gtacgacctgccttttactttgtgg

SEQ ID NO: 479886 - DNA, 25 bp, Rattus norvegicus
gtacgacctttactgtcagaaatat

SEQ ID NO: 479887 - DNA, 25 bp, Rattus norvegicus
gtacgacctttagtgtcagaaatat

SEQ ID NO: 479888 - DNA, 25 bp, Rattus norvegicus
gtacgacgagtcctgtgatctttgg

SEQ ID NO: 479889 - DNA, 25 bp, Rattus norvegicus
gtacgacgagtcgtgtgatctttgg

SEQ ID NO: 479890 - DNA, 25 bp, Rattus norvegicus
gtacgactatgtctggtgctctaag

SEQ ID NO: 479891 - DNA, 25 bp, Rattus norvegicus
gtacgactatgtgtggtgctctaag

SEQ ID NO: 479892 - DNA, 25 bp, Rattus norvegicus
gtacgactggtacccgaatcacaac

SEQ ID NO: 479893 - DNA, 25 bp, Rattus norvegicus
gtacgactggtagccgaatcacaac

SEQ ID NO: 479894 - DNA, 25 bp, Rattus norvegicus
gtacgagaccttattattattgctg

SEQ ID NO: 479895 - DNA, 25 bp, Rattus norvegicus
gtacgagacctttttattattgctg

SEQ ID NO: 479896 - DNA, 25 bp, Rattus norvegicus
gtacgagactgtcaccgtttaaccg

SEQ ID NO: 479897 - DNA, 25 bp, Rattus norvegicus
gtacgagactgtgaccgtttaaccg

SEQ ID NO: 479898 - DNA, 25 bp, Rattus norvegicus
gtacgagagcttagcacgactgcat

SEQ ID NO: 479899 - DNA, 25 bp, Rattus norvegicus
gtacgagagctttgcacgactgcat

SEQ ID NO: 479900 - DNA, 25 bp, Rattus norvegicus
gtacgagatcgtcacctatgggaag

SEQ ID NO: 479901 - DNA, 25 bp, Rattus norvegicus
gtacgagatcgtgacctatgggaag

SEQ ID NO: 479902 - DNA, 25 bp, Rattus norvegicus
gtacgagatgccagagcagcacttt

SEQ ID NO: 479903 - DNA, 25 bp, Rattus norvegicus
gtacgagatgcctgagcagcacttt

SEQ ID NO: 479904 - DNA, 25 bp, Rattus norvegicus
gtacgagcaagaatcgtcaccctca

SEQ ID NO: 479905 - DNA, 25 bp, Rattus norvegicus
gtacgagcaagattcgtcaccctca

SEQ ID NO: 479906 - DNA, 25 bp, Rattus norvegicus
gtacgagctggactatggcaaacat

SEQ ID NO: 479907 - DNA, 25 bp, Rattus norvegicus
gtacgagctggagtatggcaaacat

SEQ ID NO: 479908 - DNA, 25 bp, Rattus norvegicus
gtacgagctgttcggacctggctat

SEQ ID NO: 479909 - DNA, 25 bp, Rattus norvegicus
gtacgagctgttgggacctggctat

SEQ ID NO: 479910 - DNA, 25 bp, Rattus norvegicus
gtacgaggaactcctttgggttttg

SEQ ID NO: 479911 - DNA, 25 bp, Rattus norvegicus
gtacgaggaactgctttgggttttg

SEQ ID NO: 479912 - DNA, 25 bp, Rattus norvegicus
gtacgaggagatccgagctttccag

SEQ ID NO: 479913 - DNA, 25 bp, Rattus norvegicus
gtacgaggagatgcgagctttccag

SEQ ID NO: 479914 - DNA, 25 bp, Rattus norvegicus
gtacgaggtgtcatcttaccagcat

SEQ ID NO: 479915 - DNA, 25 bp, Rattus norvegicus
gtacgaggtgtcttcttaccagcat

SEQ ID NO: 479916 - DNA, 25 bp, Rattus norvegicus
gtacgagtcttgcagcccagctgta

SEQ ID NO: 479917 - DNA, 25 bp, Rattus norvegicus
gtacgagtcttggagcccagctgta

SEQ ID NO: 479918 - DNA, 25 bp, Rattus norvegicus
gtacgagtgagcatcataactggaa

SEQ ID NO: 479919 - DNA, 25 bp, Rattus norvegicus
gtacgagtgagcttcataactggaa

SEQ ID NO: 479920 - DNA, 25 bp, Rattus norvegicus
gtacgagttgtcatggatgcgcaga

SEQ ID NO: 479921 - DNA, 25 bp, Rattus norvegicus
gtacgagttgtcttggatgcgcaga

SEQ ID NO: 479922 - DNA, 25 bp, Rattus norvegicus
gtacgatccgtgctgatttctgtgt

SEQ ID NO: 479923 - DNA, 25 bp, Rattus norvegicus
gtacgatccgtggtgatttctgtgt

SEQ ID NO: 479924 - DNA, 25 bp, Rattus norvegicus
gtacgatgttacacactgttgcaat

SEQ ID NO: 479925 - DNA, 25 bp, Rattus norvegicus
gtacgatgttactcactgttgcaat

SEQ ID NO: 479926 - DNA, 25 bp, Rattus norvegicus
gtacgattcgtgctcatctggcaag

SEQ ID NO: 479927 - DNA, 25 bp, Rattus norvegicus
gtacgattcgtggtcatctggcaag

SEQ ID NO: 479928 - DNA, 25 bp, Rattus norvegicus
gtacgatttatactgactctttatt

SEQ ID NO: 479929 - DNA, 25 bp, Rattus norvegicus
gtacgatttatagtgactctttatt

SEQ ID NO: 479930 - DNA, 25 bp, Rattus norvegicus
gtacgatttcaaaaccagcattggt

SEQ ID NO: 479931 - DNA, 25 bp, Rattus norvegicus
gtacgatttcaataccagcattggt

SEQ ID NO: 479932 - DNA, 25 bp, Rattus norvegicus
gtacgcacagagactgacgatccgc

SEQ ID NO: 479933 - DNA, 25 bp, Rattus norvegicus
gtacgcacagagtctgacgatccgc

SEQ ID NO: 479934 - DNA, 25 bp, Rattus norvegicus
gtacgcacagttcttgagttcatta

SEQ ID NO: 479935 - DNA, 25 bp, Rattus norvegicus
gtacgcacagttgttgagttcatta

SEQ ID NO: 479936 - DNA, 25 bp, Rattus norvegicus
gtacgcagaaatccgagtcaagtga

SEQ ID NO: 479937 - DNA, 25 bp, Rattus norvegicus
gtacgcagaaatgcgagtcaagtga

SEQ ID NO: 479938 - DNA, 25 bp, Rattus norvegicus
gtacgcagacacacaatgaccgtgt

SEQ ID NO: 479939 - DNA, 25 bp, Rattus norvegicus
gtacgcagacactcaatgaccgtgt

SEQ ID NO: 479940 - DNA, 25 bp, Rattus norvegicus
gtacgcagccaaattcatcaagaag

SEQ ID NO: 479941 - DNA, 25 bp, Rattus norvegicus
gtacgcagccaatttcatcaagaag

SEQ ID NO: 479942 - DNA, 25 bp, Rattus norvegicus
gtacgcagtctcctcaaggcaagaa

SEQ ID NO: 479943 - DNA, 25 bp, Rattus norvegicus
gtacgcagtctcgtcaaggcaagaa

SEQ ID NO: 479944 - DNA, 25 bp, Rattus norvegicus
gtacgcagtgggagcccagcctaga

SEQ ID NO: 479945 - DNA, 25 bp, Rattus norvegicus
gtacgcagtgggtgcccagcctaga

SEQ ID NO: 479946 - DNA, 25 bp, Rattus norvegicus
gtacgcagttacacccgggtgtgga

SEQ ID NO: 479947 - DNA, 25 bp, Rattus norvegicus
gtacgcagttactcccgggtgtgga

SEQ ID NO: 479948 - DNA, 25 bp, Rattus norvegicus
gtacgcatcgagaatgccgactcta

SEQ ID NO: 479949 - DNA, 25 bp, Rattus norvegicus
gtacgcatcgagtatgccgactcta

SEQ ID NO: 479950 - DNA, 25 bp, Rattus norvegicus
gtacgcatggacatcagtggtcttg

SEQ ID NO: 479951 - DNA, 25 bp, Rattus norvegicus
gtacgcatggacttcagtggtcttg

SEQ ID NO: 479952 - DNA, 25 bp, Rattus norvegicus
gtacgcattccaaactttgcacggt

SEQ ID NO: 479953 - DNA, 25 bp, Rattus norvegicus
gtacgcattccatactttgcacggt

SEQ ID NO: 479954 - DNA, 25 bp, Rattus norvegicus
gtacgccaacaacgtcatgtcaggg

SEQ ID NO: 479955 - DNA, 25 bp, Rattus norvegicus
gtacgccaacaaggtcatgtcaggg

SEQ ID NO: 479956 - DNA, 25 bp, Rattus norvegicus
gtacgccaacatatgcttcaggcat

SEQ ID NO: 479957 - DNA, 25 bp, Rattus norvegicus
gtacgccaacatttgcttcaggcat

SEQ ID NO: 479958 - DNA, 25 bp, Rattus norvegicus
gtacgccaatatcgcctcaaagatt

SEQ ID NO: 479959 - DNA, 25 bp, Rattus norvegicus
gtacgccaatatggcctcaaagatt

SEQ ID NO: 479960 - DNA, 25 bp, Rattus norvegicus
gtacgccacagcaaatctcatttgt

SEQ ID NO: 479961 - DNA, 25 bp, Rattus norvegicus
gtacgccacagctaatctcatttgt

SEQ ID NO: 479962 - DNA, 25 bp, Rattus norvegicus
gtacgccacctacgggcctacgtgt

SEQ ID NO: 479963 - DNA, 25 bp, Rattus norvegicus
gtacgccacctaggggcctacgtgt

SEQ ID NO: 479964 - DNA, 25 bp, Rattus norvegicus
gtacgccagcagagtctcagagtga

SEQ ID NO: 479965 - DNA, 25 bp, Rattus norvegicus
gtacgccagcagtgtctcagagtga

SEQ ID NO: 479966 - DNA, 25 bp, Rattus norvegicus
gtacgccagcgactgtgccatgaag

SEQ ID NO: 479967 - DNA, 25 bp, Rattus norvegicus
gtacgccagcgagtgtgccatgaag

SEQ ID NO: 479968 - DNA, 25 bp, Rattus norvegicus
gtacgccatgagagctttcgcagac

SEQ ID NO: 479969 - DNA, 25 bp, Rattus norvegicus
gtacgccatgagtgctttcgcagac

SEQ ID NO: 479970 - DNA, 25 bp, Rattus norvegicus
gtacgccatgcacagacttccagag

SEQ ID NO: 479971 - DNA, 25 bp, Rattus norvegicus
gtacgccatgcagagacttccagag

SEQ ID NO: 479972 - DNA, 25 bp, Rattus norvegicus
gtacgcctctttacatgaacgctta

SEQ ID NO: 479973 - DNA, 25 bp, Rattus norvegicus
gtacgcctcttttcatgaacgctta

SEQ ID NO: 479974 - DNA, 25 bp, Rattus norvegicus
gtacgcctgctcagaatgcggcaag

SEQ ID NO: 479975 - DNA, 25 bp, Rattus norvegicus
gtacgcctgctctgaatgcggcaag

SEQ ID NO: 479976 - DNA, 25 bp, Rattus norvegicus
gtacgcgaaggacataggcttcatt

SEQ ID NO: 479977 - DNA, 25 bp, Rattus norvegicus
gtacgcgaaggagataggcttcatt

SEQ ID NO: 479978 - DNA, 25 bp, Rattus norvegicus
gtacgcgacaaaccccatgtgaatg

SEQ ID NO: 479979 - DNA, 25 bp, Rattus norvegicus
gtacgcgacaaagcccatgtgaatg

SEQ ID NO: 479980 - DNA, 25 bp, Rattus norvegicus
gtacgcgacaggcatcatcttctct

SEQ ID NO: 479981 - DNA, 25 bp, Rattus norvegicus
gtacgcgacagggatcatcttctct

SEQ ID NO: 479982 - DNA, 25 bp, Rattus norvegicus
gtacgcgaccataatgctgaccgtt

SEQ ID NO: 479983 - DNA, 25 bp, Rattus norvegicus
gtacgcgaccattatgctgaccgtt

SEQ ID NO: 479984 - DNA, 25 bp, Rattus norvegicus
gtacgcgatgtcattgagcttacag

SEQ ID NO: 479985 - DNA, 25 bp, Rattus norvegicus
gtacgcgatgtctttgagcttacag

SEQ ID NO: 479986 - DNA, 25 bp, Rattus norvegicus
gtacgcgccgatacgggactcgcta

SEQ ID NO: 479987 - DNA, 25 bp, Rattus norvegicus
gtacgcgccgattcgggactcgcta

SEQ ID NO: 479988 - DNA, 25 bp, Rattus norvegicus
gtacgctccggactgtttaatccag

SEQ ID NO: 479989 - DNA, 25 bp, Rattus norvegicus
gtacgctccggagtgtttaatccag

SEQ ID NO: 479990 - DNA, 25 bp, Rattus norvegicus
gtacgctcgcacacataaatagatg

SEQ ID NO: 479991 - DNA, 25 bp, Rattus norvegicus
gtacgctcgcactcataaatagatg

SEQ ID NO: 479992 - DNA, 25 bp, Rattus norvegicus
gtacgctctctgcttagtgctgttt

SEQ ID NO: 479993 - DNA, 25 bp, Rattus norvegicus
gtacgctctctggttagtgctgttt

SEQ ID NO: 479994 - DNA, 25 bp, Rattus norvegicus
gtacgctctgcaagtctgtgggacg

SEQ ID NO: 479995 - DNA, 25 bp, Rattus norvegicus
gtacgctctgcatgtctgtgggacg

SEQ ID NO: 479996 - DNA, 25 bp, Rattus norvegicus
gtacgctgaaagctcatcctgtctg

SEQ ID NO: 479997 - DNA, 25 bp, Rattus norvegicus
gtacgctgaaaggtcatcctgtctg

SEQ ID NO: 479998 - DNA, 25 bp, Rattus norvegicus
gtacgctgctgaaaacgcaggcttt

SEQ ID NO: 479999 - DNA, 25 bp, Rattus norvegicus
gtacgctgctgataacgcaggcttt

SEQ ID NO: 480000 - DNA, 25 bp, Rattus norvegicus
gtacgctgctgtactttcgtctgtc

SEQ ID NO: 480001 - DNA, 25 bp, Rattus norvegicus
gtacgctgctgttctttcgtctgtc

SEQ ID NO: 480002 - DNA, 25 bp, Rattus norvegicus
gtacgcttcataatggagcatgttt

SEQ ID NO: 480003 - DNA, 25 bp, Rattus norvegicus
gtacgcttcatattggagcatgttt

SEQ ID NO: 480004 - DNA, 25 bp, Rattus norvegicus
gtacggaagagcatgtcccaccagg

SEQ ID NO: 480005 - DNA, 25 bp, Rattus norvegicus
gtacggaagagcttgtcccaccagg

SEQ ID NO: 480006 - DNA, 25 bp, Rattus norvegicus
gtacggaataagcagtttcgctaac

SEQ ID NO: 480007 - DNA, 25 bp, Rattus norvegicus
gtacggaataaggagtttcgctaac

SEQ ID NO: 480008 - DNA, 25 bp, Rattus norvegicus
gtacggaatgcacttgttctttaca

SEQ ID NO: 480009 - DNA, 25 bp, Rattus norvegicus
gtacggaatgcagttgttctttaca

SEQ ID NO: 480010 - DNA, 25 bp, Rattus norvegicus
gtacggacaagaccagagctcatga

SEQ ID NO: 480011 - DNA, 25 bp, Rattus norvegicus
gtacggacaagagcagagctcatga

SEQ ID NO: 480012 - DNA, 25 bp, Rattus norvegicus
gtacggacacaaacattaggcttct

SEQ ID NO: 480013 - DNA, 25 bp, Rattus norvegicus
gtacggacacaatcattaggcttct

SEQ ID NO: 480014 - DNA, 25 bp, Rattus norvegicus
gtacggacagccatgtggacctgag

SEQ ID NO: 480015 - DNA, 25 bp, Rattus norvegicus
gtacggacagccttgtggacctgag

SEQ ID NO: 480016 - DNA, 25 bp, Rattus norvegicus
gtacggacgtgcacggtgctgttat

SEQ ID NO: 480017 - DNA, 25 bp, Rattus norvegicus
gtacggacgtgctcggtgctgttat

SEQ ID NO: 480018 - DNA, 25 bp, Rattus norvegicus
gtacggactatcactggcgctggga

SEQ ID NO: 480019 - DNA, 25 bp, Rattus norvegicus
gtacggactatctctggcgctggga

SEQ ID NO: 480020 - DNA, 25 bp, Rattus norvegicus
gtacggagcatcaccttggagagcc

SEQ ID NO: 480021 - DNA, 25 bp, Rattus norvegicus
gtacggagcatctccttggagagcc

SEQ ID NO: 480022 - DNA, 25 bp, Rattus norvegicus
gtacggagccccagtctgcagaggc

SEQ ID NO: 480023 - DNA, 25 bp, Rattus norvegicus
gtacggagcccctgtctgcagaggc

SEQ ID NO: 480024 - DNA, 25 bp, Rattus norvegicus
gtacggagctgcacaccaaaattct

SEQ ID NO: 480025 - DNA, 25 bp, Rattus norvegicus
gtacggagctgctcaccaaaattct

SEQ ID NO: 480026 - DNA, 25 bp, Rattus norvegicus
gtacggaggaaaatacaactcccag

SEQ ID NO: 480027 - DNA, 25 bp, Rattus norvegicus
gtacggaggaaattacaactcccag

SEQ ID NO: 480028 - DNA, 25 bp, Rattus norvegicus
gtacggatcgacagtgtcatcccac

SEQ ID NO: 480029 - DNA, 25 bp, Rattus norvegicus
gtacggatcgactgtgtcatcccac

SEQ ID NO: 480030 - DNA, 25 bp, Rattus norvegicus
gtacggatcttacgatccttccaga

SEQ ID NO: 480031 - DNA, 25 bp, Rattus norvegicus
gtacggatcttaggatccttccaga

SEQ ID NO: 480032 - DNA, 25 bp, Rattus norvegicus
gtacggcaataaatgtcccctcaca

SEQ ID NO: 480033 - DNA, 25 bp, Rattus norvegicus
gtacggcaataattgtcccctcaca

SEQ ID NO: 480034 - DNA, 25 bp, Rattus norvegicus
gtacggcacagacaagttaccctaa

SEQ ID NO: 480035 - DNA, 25 bp, Rattus norvegicus
gtacggcacagagaagttaccctaa

SEQ ID NO: 480036 - DNA, 25 bp, Rattus norvegicus
gtacggcacttccattacttttcaa

SEQ ID NO: 480037 - DNA, 25 bp, Rattus norvegicus
gtacggcacttcgattacttttcaa

SEQ ID NO: 480038 - DNA, 25 bp, Rattus norvegicus
gtacggcagcaaaaccaggctacag

SEQ ID NO: 480039 - DNA, 25 bp, Rattus norvegicus
gtacggcagcaataccaggctacag

SEQ ID NO: 480040 - DNA, 25 bp, Rattus norvegicus
gtacggcctgtcataggcacatgca

SEQ ID NO: 480041 - DNA, 25 bp, Rattus norvegicus
gtacggcctgtcttaggcacatgca

SEQ ID NO: 480042 - DNA, 25 bp, Rattus norvegicus
gtacggcgctctccatttgatgcaa

SEQ ID NO: 480043 - DNA, 25 bp, Rattus norvegicus
gtacggcgctctgcatttgatgcaa

SEQ ID NO: 480044 - DNA, 25 bp, Rattus norvegicus
gtacgggacagtctctatgtgctca

SEQ ID NO: 480045 - DNA, 25 bp, Rattus norvegicus
gtacgggacagtgtctatgtgctca

SEQ ID NO: 480046 - DNA, 25 bp, Rattus norvegicus
gtacgggattttctaaggacctcag

SEQ ID NO: 480047 - DNA, 25 bp, Rattus norvegicus
gtacgggattttgtaaggacctcag

SEQ ID NO: 480048 - DNA, 25 bp, Rattus norvegicus
gtacgggcaagcaccaacagactca

SEQ ID NO: 480049 - DNA, 25 bp, Rattus norvegicus
gtacgggcaagctccaacagactca

SEQ ID NO: 480050 - DNA, 25 bp, Rattus norvegicus
gtacgggccacaatccggacgaagg

SEQ ID NO: 480051 - DNA, 25 bp, Rattus norvegicus
gtacgggccacattccggacgaagg

SEQ ID NO: 480052 - DNA, 25 bp, Rattus norvegicus
gtacgggctatgatgtgtcgccagc

SEQ ID NO: 480053 - DNA, 25 bp, Rattus norvegicus
gtacgggctatgttgtgtcgccagc

SEQ ID NO: 480054 - DNA, 25 bp, Rattus norvegicus
gtacgggtcccaagtggcatagtta

SEQ ID NO: 480055 - DNA, 25 bp, Rattus norvegicus
gtacgggtcccatgtggcatagtta

SEQ ID NO: 480056 - DNA, 25 bp, Rattus norvegicus
gtacgggttgtgatgccaaaactat

SEQ ID NO: 480057 - DNA, 25 bp, Rattus norvegicus
gtacgggttgtgttgccaaaactat

SEQ ID NO: 480058 - DNA, 25 bp, Rattus norvegicus
gtacggtaaccaacttcatgctaat

SEQ ID NO: 480059 - DNA, 25 bp, Rattus norvegicus
gtacggtaaccatcttcatgctaat

SEQ ID NO: 480060 - DNA, 25 bp, Rattus norvegicus
gtacggtacaggactctccgataca

SEQ ID NO: 480061 - DNA, 25 bp, Rattus norvegicus
gtacggtacaggtctctccgataca

SEQ ID NO: 480062 - DNA, 25 bp, Rattus norvegicus
gtacggtcagttagcgtaaagaaga

SEQ ID NO: 480063 - DNA, 25 bp, Rattus norvegicus
gtacggtcagtttgcgtaaagaaga

SEQ ID NO: 480064 - DNA, 25 bp, Rattus norvegicus
gtacggtcatcaaggtctccaacat

SEQ ID NO: 480065 - DNA, 25 bp, Rattus norvegicus
gtacggtcatcatggtctccaacat

SEQ ID NO: 480066 - DNA, 25 bp, Rattus norvegicus
gtacggtcccctccagtagatggga

SEQ ID NO: 480067 - DNA, 25 bp, Rattus norvegicus
gtacggtcccctgcagtagatggga

SEQ ID NO: 480068 - DNA, 25 bp, Rattus norvegicus
gtacggtcctttactcgatagacgt

SEQ ID NO: 480069 - DNA, 25 bp, Rattus norvegicus
gtacggtccttttctcgatagacgt

SEQ ID NO: 480070 - DNA, 25 bp, Rattus norvegicus
gtacggtgattgctcatttctgtat

SEQ ID NO: 480071 - DNA, 25 bp, Rattus norvegicus
gtacggtgattggtcatttctgtat

SEQ ID NO: 480072 - DNA, 25 bp, Rattus norvegicus
gtacggtggcatagagtgccagcct

SEQ ID NO: 480073 - DNA, 25 bp, Rattus norvegicus
gtacggtggcatatctacagcctct

SEQ ID NO: 480074 - DNA, 25 bp, Rattus norvegicus
gtacggtggcattgagtgccagcct

SEQ ID NO: 480075 - DNA, 25 bp, Rattus norvegicus
gtacggtggcatttctacagcctct

SEQ ID NO: 480076 - DNA, 25 bp, Rattus norvegicus
gtacggttcaggatccaggaggaca

SEQ ID NO: 480077 - DNA, 25 bp, Rattus norvegicus
gtacggttcaggttccaggaggaca

SEQ ID NO: 480078 - DNA, 25 bp, Rattus norvegicus
gtacggttcagtaggagcacagccc

SEQ ID NO: 480079 - DNA, 25 bp, Rattus norvegicus
gtacggttcagttggagcacagccc

SEQ ID NO: 480080 - DNA, 25 bp, Rattus norvegicus
gtacgtacaagtaatctccatccac

SEQ ID NO: 480081 - DNA, 25 bp, Rattus norvegicus
gtacgtacaagttatctccatccac

SEQ ID NO: 480082 - DNA, 25 bp, Rattus norvegicus
gtacgtactggaactctactgcatc

SEQ ID NO: 480083 - DNA, 25 bp, Rattus norvegicus
gtacgtactggatctctactgcatc

SEQ ID NO: 480084 - DNA, 25 bp, Rattus norvegicus
gtacgtagacacctaggtcctgcag

SEQ ID NO: 480085 - DNA, 25 bp, Rattus norvegicus
gtacgtagacacgtaggtcctgcag

SEQ ID NO: 480086 - DNA, 25 bp, Rattus norvegicus
gtacgtaggtcacagtttgcttctt

SEQ ID NO: 480087 - DNA, 25 bp, Rattus norvegicus
gtacgtaggtcagagtttgcttctt

SEQ ID NO: 480088 - DNA, 25 bp, Rattus norvegicus
gtacgtatcttgatcagtgtcgtca

SEQ ID NO: 480089 - DNA, 25 bp, Rattus norvegicus
gtacgtatcttgttcagtgtcgtca

SEQ ID NO: 480090 - DNA, 25 bp, Rattus norvegicus
gtacgtatgtgtagtcccacagccc

SEQ ID NO: 480091 - DNA, 25 bp, Rattus norvegicus
gtacgtatgtgttgtcccacagccc

SEQ ID NO: 480092 - DNA, 25 bp, Rattus norvegicus
gtacgtattcttctcacgatctctg

SEQ ID NO: 480093 - DNA, 25 bp, Rattus norvegicus
gtacgtattcttgtcacgatctctg

SEQ ID NO: 480094 - DNA, 25 bp, Rattus norvegicus
gtacgtatttccatcaaagccaaag

SEQ ID NO: 480095 - DNA, 25 bp, Rattus norvegicus
gtacgtatttccttcaaagccaaag

SEQ ID NO: 480096 - DNA, 25 bp, Rattus norvegicus
gtacgtcaggttaagttgtccagta

SEQ ID NO: 480097 - DNA, 25 bp, Rattus norvegicus
gtacgtcaggtttagttgtccagta

SEQ ID NO: 480098 - DNA, 25 bp, Rattus norvegicus
gtacgtcagtaaaccactgtgctct

SEQ ID NO: 480099 - DNA, 25 bp, Rattus norvegicus
gtacgtcagtaatccactgtgctct

SEQ ID NO: 480100 - DNA, 25 bp, Rattus norvegicus
gtacgtccaacaacagccagagtgt

SEQ ID NO: 480101 - DNA, 25 bp, Rattus norvegicus
gtacgtccaacatcagccagagtgt

SEQ ID NO: 480102 - DNA, 25 bp, Rattus norvegicus
gtacgtcccaggaaggaaattctgt

SEQ ID NO: 480103 - DNA, 25 bp, Rattus norvegicus
gtacgtcccaggtaggaaattctgt

SEQ ID NO: 480104 - DNA, 25 bp, Rattus norvegicus
gtacgtctacaaagggcagctgcag

SEQ ID NO: 480105 - DNA, 25 bp, Rattus norvegicus
gtacgtctacaatgggcagctgcag

SEQ ID NO: 480106 - DNA, 25 bp, Rattus norvegicus
gtacgtctggtcaaatttcctgtca

SEQ ID NO: 480107 - DNA, 25 bp, Rattus norvegicus
gtacgtctggtctaatttcctgtca

SEQ ID NO: 480108 - DNA, 25 bp, Rattus norvegicus
gtacgtgcacttctaattccggaac

SEQ ID NO: 480109 - DNA, 25 bp, Rattus norvegicus
gtacgtgcacttgtaattccggaac

SEQ ID NO: 480110 - DNA, 25 bp, Rattus norvegicus
gtacgtgccctcattacggaggcat

SEQ ID NO: 480111 - DNA, 25 bp, Rattus norvegicus
gtacgtgccctctttacggaggcat

SEQ ID NO: 480112 - DNA, 25 bp, Rattus norvegicus
gtacgtgccttaaccctagcagtgg

SEQ ID NO: 480113 - DNA, 25 bp, Rattus norvegicus
gtacgtgccttatccctagcagtgg

SEQ ID NO: 480114 - DNA, 25 bp, Rattus norvegicus
gtacgtggcaggcatcaaactccaa

SEQ ID NO: 480115 - DNA, 25 bp, Rattus norvegicus
gtacgtggcagggatcaaactccaa

SEQ ID NO: 480116 - DNA, 25 bp, Rattus norvegicus
gtacgtgtacctcatctatggcatg

SEQ ID NO: 480117 - DNA, 25 bp, Rattus norvegicus
gtacgtgtacctgatctatggcatg

SEQ ID NO: 480118 - DNA, 25 bp, Rattus norvegicus
gtacgtgtagtaattcagttagagc

SEQ ID NO: 480119 - DNA, 25 bp, Rattus norvegicus
gtacgtgtagtatttcagttagagc

SEQ ID NO: 480120 - DNA, 25 bp, Rattus norvegicus
gtacgtgtgactcatatgtggatgt

SEQ ID NO: 480121 - DNA, 25 bp, Rattus norvegicus
gtacgtgtgactgatatgtggatgt

SEQ ID NO: 480122 - DNA, 25 bp, Rattus norvegicus
gtacgtgtgtaaatagtgcgctaac

SEQ ID NO: 480123 - DNA, 25 bp, Rattus norvegicus
gtacgtgtgtaattagtgcgctaac

SEQ ID NO: 480124 - DNA, 25 bp, Rattus norvegicus
gtacgtgttccacaaggcttcacct

SEQ ID NO: 480125 - DNA, 25 bp, Rattus norvegicus
gtacgtgttccagaaggcttcacct

SEQ ID NO: 480126 - DNA, 25 bp, Rattus norvegicus
gtacgtgttctaattcactgatgtt

SEQ ID NO: 480127 - DNA, 25 bp, Rattus norvegicus
gtacgtgttctatttcactgatgtt

SEQ ID NO: 480128 - DNA, 25 bp, Rattus norvegicus
gtacgttcaagaatgattaatctgt

SEQ ID NO: 480129 - DNA, 25 bp, Rattus norvegicus
gtacgttcaagattgattaatctgt

SEQ ID NO: 480130 - DNA, 25 bp, Rattus norvegicus
gtacgttcggttcccaccagcagtg

SEQ ID NO: 480131 - DNA, 25 bp, Rattus norvegicus
gtacgttcggttgccaccagcagtg

SEQ ID NO: 480132 - DNA, 25 bp, Rattus norvegicus
gtacgttgccatcaattagccctgc

SEQ ID NO: 480133 - DNA, 25 bp, Rattus norvegicus
gtacgttgccatgaattagccctgc

SEQ ID NO: 480134 - DNA, 25 bp, Rattus norvegicus
gtacgttgtaatcctctgaggccat

SEQ ID NO: 480135 - DNA, 25 bp, Rattus norvegicus
gtacgttgtaatgctctgaggccat

SEQ ID NO: 480136 - DNA, 25 bp, Rattus norvegicus
gtacgttgtatgatgggaatctttc

SEQ ID NO: 480137 - DNA, 25 bp, Rattus norvegicus
gtacgttgtatgttgggaatctttc

SEQ ID NO: 480138 - DNA, 25 bp, Rattus norvegicus
gtacgttgtattacttgcaacttga

SEQ ID NO: 480139 - DNA, 25 bp, Rattus norvegicus
gtacgttgtatttcttgcaacttga

SEQ ID NO: 480140 - DNA, 25 bp, Rattus norvegicus
gtacgttgtcaacttccacatgcga

SEQ ID NO: 480141 - DNA, 25 bp, Rattus norvegicus
gtacgttgtcaagttccacatgcga

SEQ ID NO: 480142 - DNA, 25 bp, Rattus norvegicus
gtacgtttacagacgcagcactaaa

SEQ ID NO: 480143 - DNA, 25 bp, Rattus norvegicus
gtacgtttacagtcgcagcactaaa

SEQ ID NO: 480144 - DNA, 25 bp, Rattus norvegicus
gtacgttttggaatgttcccagaca

SEQ ID NO: 480145 - DNA, 25 bp, Rattus norvegicus
gtacgttttggattgttcccagaca

SEQ ID NO: 480146 - DNA, 25 bp, Rattus norvegicus
gtactaaaccgacagcccggcttag

SEQ ID NO: 480147 - DNA, 25 bp, Rattus norvegicus
gtactaaaccgagagcccggcttag

SEQ ID NO: 480148 - DNA, 25 bp, Rattus norvegicus
gtactaaagtcaccaagccacaaat

SEQ ID NO: 480149 - DNA, 25 bp, Rattus norvegicus
gtactaaagtcagcaagccacaaat

SEQ ID NO: 480150 - DNA, 25 bp, Rattus norvegicus
gtactaaattctatattccattcta

SEQ ID NO: 480151 - DNA, 25 bp, Rattus norvegicus
gtactaaattctttattccattcta

SEQ ID NO: 480152 - DNA, 25 bp, Rattus norvegicus
gtactaactgcccaagaatcattct

SEQ ID NO: 480153 - DNA, 25 bp, Rattus norvegicus
gtactaactgccgaagaatcattct

SEQ ID NO: 480154 - DNA, 25 bp, Rattus norvegicus
gtactaagacaactgctttggcaat

SEQ ID NO: 480155 - DNA, 25 bp, Rattus norvegicus
gtactaagacaagtgctttggcaat

SEQ ID NO: 480156 - DNA, 25 bp, Rattus norvegicus
gtactaagcaatcttgttctgtctg

SEQ ID NO: 480157 - DNA, 25 bp, Rattus norvegicus
gtactaagcaatgttgttctgtctg

SEQ ID NO: 480158 - DNA, 25 bp, Rattus norvegicus
gtactaagttaaccccttctgctct

SEQ ID NO: 480159 - DNA, 25 bp, Rattus norvegicus
gtactaagttaagcccttctgctct

SEQ ID NO: 480160 - DNA, 25 bp, Rattus norvegicus
gtactaatattgagccatcccacaa

SEQ ID NO: 480161 - DNA, 25 bp, Rattus norvegicus
gtactaatattgtgccatcccacaa

SEQ ID NO: 480162 - DNA, 25 bp, Rattus norvegicus
gtactaatgtaacagcacaagcttt

SEQ ID NO: 480163 - DNA, 25 bp, Rattus norvegicus
gtactaatgtaagagcacaagcttt

SEQ ID NO: 480164 - DNA, 25 bp, Rattus norvegicus
gtactaatgtgtctctaaggaactg

SEQ ID NO: 480165 - DNA, 25 bp, Rattus norvegicus
gtactaatgtgtgtctaaggaactg

SEQ ID NO: 480166 - DNA, 25 bp, Rattus norvegicus
gtactaattgacaacacaggtttaa

SEQ ID NO: 480167 - DNA, 25 bp, Rattus norvegicus
gtactaattgactacacaggtttaa

SEQ ID NO: 480168 - DNA, 25 bp, Rattus norvegicus
gtactacaccgacatggaccccgaa

SEQ ID NO: 480169 - DNA, 25 bp, Rattus norvegicus
gtactacaccgagatggaccccgaa

SEQ ID NO: 480170 - DNA, 25 bp, Rattus norvegicus
gtactacagtccagtttgttccagt

SEQ ID NO: 480171 - DNA, 25 bp, Rattus norvegicus
gtactacagtcctgtttgttccagt

SEQ ID NO: 480172 - DNA, 25 bp, Rattus norvegicus
gtactacatcccagaagtcttctac

SEQ ID NO: 480173 - DNA, 25 bp, Rattus norvegicus
gtactacatccctgaagtcttctac

SEQ ID NO: 480174 - DNA, 25 bp, Rattus norvegicus
gtactacatgagatggtttagccat

SEQ ID NO: 480175 - DNA, 25 bp, Rattus norvegicus
gtactacatgagttggtttagccat

SEQ ID NO: 480176 - DNA, 25 bp, Rattus norvegicus
gtactacatttgatctgggtgccca

SEQ ID NO: 480177 - DNA, 25 bp, Rattus norvegicus
gtactacatttgttctgggtgccca

SEQ ID NO: 480178 - DNA, 25 bp, Rattus norvegicus
gtactaccagaaagaggcaaccttg

SEQ ID NO: 480179 - DNA, 25 bp, Rattus norvegicus
gtactaccagaatgaggcaaccttg

SEQ ID NO: 480180 - DNA, 25 bp, Rattus norvegicus
gtactaccagtcagctaccgcctgt

SEQ ID NO: 480181 - DNA, 25 bp, Rattus norvegicus
gtactaccagtctgctaccgcctgt

SEQ ID NO: 480182 - DNA, 25 bp, Rattus norvegicus
gtactaccccgacgacgacgaggag

SEQ ID NO: 480183 - DNA, 25 bp, Rattus norvegicus
gtactaccccgaggacgacgaggag

SEQ ID NO: 480184 - DNA, 25 bp, Rattus norvegicus
gtactaccctccatgagcacagaga

SEQ ID NO: 480185 - DNA, 25 bp, Rattus norvegicus
gtactaccctccttgagcacagaga

SEQ ID NO: 480186 - DNA, 25 bp, Rattus norvegicus
gtactaccctgacatcattgttctg

SEQ ID NO: 480187 - DNA, 25 bp, Rattus norvegicus
gtactaccctgagatcattgttctg

SEQ ID NO: 480188 - DNA, 25 bp, Rattus norvegicus
gtactaccgggtcgaagctgtgcat

SEQ ID NO: 480189 - DNA, 25 bp, Rattus norvegicus
gtactaccgggtggaagctgtgcat

SEQ ID NO: 480190 - DNA, 25 bp, Rattus norvegicus
gtactacctcccataagttgagaga

SEQ ID NO: 480191 - DNA, 25 bp, Rattus norvegicus
gtactacctcccttaagttgagaga

SEQ ID NO: 480192 - DNA, 25 bp, Rattus norvegicus
gtactaccttacagagtgatgccta

SEQ ID NO: 480193 - DNA, 25 bp, Rattus norvegicus
gtactaccttactgagtgatgccta

SEQ ID NO: 480194 - DNA, 25 bp, Rattus norvegicus
gtactaccttgcaagctgtgagcgc

SEQ ID NO: 480195 - DNA, 25 bp, Rattus norvegicus
gtactaccttgctagctgtgagcgc

SEQ ID NO: 480196 - DNA, 25 bp, Rattus norvegicus
gtactacgagttcgtctagctcctt

SEQ ID NO: 480197 - DNA, 25 bp, Rattus norvegicus
gtactacgagttggtctagctcctt

SEQ ID NO: 480198 - DNA, 25 bp, Rattus norvegicus
gtactacgttcaatgactgtgagtt

SEQ ID NO: 480199 - DNA, 25 bp, Rattus norvegicus
gtactacgttcattgactgtgagtt

SEQ ID NO: 480200 - DNA, 25 bp, Rattus norvegicus
gtactactaggactaccaaaggctc

SEQ ID NO: 480201 - DNA, 25 bp, Rattus norvegicus
gtactactaggagtaccaaaggctc

SEQ ID NO: 480202 - DNA, 25 bp, Rattus norvegicus
gtactactcctgattgcttcatggt

SEQ ID NO: 480203 - DNA, 25 bp, Rattus norvegicus
gtactactcctgtttgcttcatggt

SEQ ID NO: 480204 - DNA, 25 bp, Rattus norvegicus
gtactactcgaactgaagactgtgg

SEQ ID NO: 480205 - DNA, 25 bp, Rattus norvegicus
gtactactcgaagtgaagactgtgg

SEQ ID NO: 480206 - DNA, 25 bp, Rattus norvegicus
gtactactgaagcttaagtctggca

SEQ ID NO: 480207 - DNA, 25 bp, Rattus norvegicus
gtactactgaaggttaagtctggca

SEQ ID NO: 480208 - DNA, 25 bp, Rattus norvegicus
gtactactgatacaagttccaaatc

SEQ ID NO: 480209 - DNA, 25 bp, Rattus norvegicus
gtactactgatagaagttccaaatc

SEQ ID NO: 480210 - DNA, 25 bp, Rattus norvegicus
gtactactggatatctgactggagc

SEQ ID NO: 480211 - DNA, 25 bp, Rattus norvegicus
gtactactggatttctgactggagc

SEQ ID NO: 480212 - DNA, 25 bp, Rattus norvegicus
gtactacttcatccagcaagacact

SEQ ID NO: 480213 - DNA, 25 bp, Rattus norvegicus
gtactacttcatgcagcaagacact

SEQ ID NO: 480214 - DNA, 25 bp, Rattus norvegicus
gtactacttggcagaatttccatat

SEQ ID NO: 480215 - DNA, 25 bp, Rattus norvegicus
gtactacttggctgaatttccatat

SEQ ID NO: 480216 - DNA, 25 bp, Rattus norvegicus
gtactacttggtcccagctactggt

SEQ ID NO: 480217 - DNA, 25 bp, Rattus norvegicus
gtactacttggtgccagctactggt

SEQ ID NO: 480218 - DNA, 25 bp, Rattus norvegicus
gtactactttgaaacataggagttt

SEQ ID NO: 480219 - DNA, 25 bp, Rattus norvegicus
gtactactttgatacataggagttt

SEQ ID NO: 480220 - DNA, 25 bp, Rattus norvegicus
gtactagacccaactctttttcatg

SEQ ID NO: 480221 - DNA, 25 bp, Rattus norvegicus
gtactagacccatctctttttcatg

SEQ ID NO: 480222 - DNA, 25 bp, Rattus norvegicus
gtactagagcatattaaaactggac

SEQ ID NO: 480223 - DNA, 25 bp, Rattus norvegicus
gtactagagcattttaaaactggac

SEQ ID NO: 480224 - DNA, 25 bp, Rattus norvegicus
gtactagcacccactataactgatc

SEQ ID NO: 480225 - DNA, 25 bp, Rattus norvegicus
gtactagcaccctctataactgatc

SEQ ID NO: 480226 - DNA, 25 bp, Rattus norvegicus
gtactagcacttaatgagccaatga

SEQ ID NO: 480227 - DNA, 25 bp, Rattus norvegicus
gtactagcactttatgagccaatga

SEQ ID NO: 480228 - DNA, 25 bp, Rattus norvegicus
gtactagcccaaccatcatcaatga

SEQ ID NO: 480229 - DNA, 25 bp, Rattus norvegicus
gtactagcccaagcatcatcaatga

SEQ ID NO: 480230 - DNA, 25 bp, Rattus norvegicus
gtactagctgcacctgcactttaag

SEQ ID NO: 480231 - DNA, 25 bp, Rattus norvegicus
gtactagctgcagctgcactttaag

SEQ ID NO: 480232 - DNA, 25 bp, Rattus norvegicus
gtactaggaaaactgcaccagcatc

SEQ ID NO: 480233 - DNA, 25 bp, Rattus norvegicus
gtactaggaaaagtgcaccagcatc

SEQ ID NO: 480234 - DNA, 25 bp, Rattus norvegicus
gtactaggacttccccgagatcaga

SEQ ID NO: 480235 - DNA, 25 bp, Rattus norvegicus
gtactaggacttgcccgagatcaga

SEQ ID NO: 480236 - DNA, 25 bp, Rattus norvegicus
gtactaggagtgatcatctgcaaat

SEQ ID NO: 480237 - DNA, 25 bp, Rattus norvegicus
gtactaggagtgttcatctgcaaat

SEQ ID NO: 480238 - DNA, 25 bp, Rattus norvegicus
gtactaggattaaagccaccactcc

SEQ ID NO: 480239 - DNA, 25 bp, Rattus norvegicus
gtactaggattatagccaccactcc

SEQ ID NO: 480240 - DNA, 25 bp, Rattus norvegicus
gtactaggcactcgaattgggttga

SEQ ID NO: 480241 - DNA, 25 bp, Rattus norvegicus
gtactaggcactggaattgggttga

SEQ ID NO: 480242 - DNA, 25 bp, Rattus norvegicus
gtactagggataagccacaccccag

SEQ ID NO: 480243 - DNA, 25 bp, Rattus norvegicus
gtactagggatatgccacaccccag

SEQ ID NO: 480244 - DNA, 25 bp, Rattus norvegicus
gtactagggtctcggtctctttcaa

SEQ ID NO: 480245 - DNA, 25 bp, Rattus norvegicus
gtactagggtctgggtctctttcaa

SEQ ID NO: 480246 - DNA, 25 bp, Rattus norvegicus
gtactaggtttgctagtgcacacct

SEQ ID NO: 480247 - DNA, 25 bp, Rattus norvegicus
gtactaggtttggtagtgcacacct

SEQ ID NO: 480248 - DNA, 25 bp, Rattus norvegicus
gtactagtaaatactgcttaagctt

SEQ ID NO: 480249 - DNA, 25 bp, Rattus norvegicus
gtactagtaaattctgcttaagctt

SEQ ID NO: 480250 - DNA, 25 bp, Rattus norvegicus
gtactagttagtccctgagatctta

SEQ ID NO: 480251 - DNA, 25 bp, Rattus norvegicus
gtactagttagtgcctgagatctta

SEQ ID NO: 480252 - DNA, 25 bp, Rattus norvegicus
gtactataaaagcttttgcctccct

SEQ ID NO: 480253 - DNA, 25 bp, Rattus norvegicus
gtactataaaaggttttgcctccct

SEQ ID NO: 480254 - DNA, 25 bp, Rattus norvegicus
gtactataatcacacgggccgcaca

SEQ ID NO: 480255 - DNA, 25 bp, Rattus norvegicus
gtactataatcagacgggccgcaca

SEQ ID NO: 480256 - DNA, 25 bp, Rattus norvegicus
gtactataccggatggcattttatt

SEQ ID NO: 480257 - DNA, 25 bp, Rattus norvegicus
gtactataccggttggcattttatt

SEQ ID NO: 480258 - DNA, 25 bp, Rattus norvegicus
gtactatatctaagtagccttcaga

SEQ ID NO: 480259 - DNA, 25 bp, Rattus norvegicus
gtactatatctatgtagccttcaga

SEQ ID NO: 480260 - DNA, 25 bp, Rattus norvegicus
gtactatcacacatggttcagcaga

SEQ ID NO: 480261 - DNA, 25 bp, Rattus norvegicus
gtactatcacacttggttcagcaga

SEQ ID NO: 480262 - DNA, 25 bp, Rattus norvegicus
gtactatcataaatgcctagcataa

SEQ ID NO: 480263 - DNA, 25 bp, Rattus norvegicus
gtactatcataattgcctagcataa

SEQ ID NO: 480264 - DNA, 25 bp, Rattus norvegicus
gtactatcctagcacattcttaact

SEQ ID NO: 480265 - DNA, 25 bp, Rattus norvegicus
gtactatcctaggacattcttaact

SEQ ID NO: 480266 - DNA, 25 bp, Rattus norvegicus
gtactatctccaaagaggagtcaac

SEQ ID NO: 480267 - DNA, 25 bp, Rattus norvegicus
gtactatctccatagaggagtcaac

SEQ ID NO: 480268 - DNA, 25 bp, Rattus norvegicus
gtactatctggcagcacaccgagga

SEQ ID NO: 480269 - DNA, 25 bp, Rattus norvegicus
gtactatctggctgcacaccgagga

SEQ ID NO: 480270 - DNA, 25 bp, Rattus norvegicus
gtactatctttgaaacttcctgtga

SEQ ID NO: 480271 - DNA, 25 bp, Rattus norvegicus
gtactatctttgtaacttcctgtga

SEQ ID NO: 480272 - DNA, 25 bp, Rattus norvegicus
gtactatgacttacctttgacagtg

SEQ ID NO: 480273 - DNA, 25 bp, Rattus norvegicus
gtactatgactttcctttgacagtg

SEQ ID NO: 480274 - DNA, 25 bp, Rattus norvegicus
gtactatgccttagtgtaagtctca

SEQ ID NO: 480275 - DNA, 25 bp, Rattus norvegicus
gtactatgcctttgtgtaagtctca

SEQ ID NO: 480276 - DNA, 25 bp, Rattus norvegicus
gtactatgtgtgagtgctccgccct

SEQ ID NO: 480277 - DNA, 25 bp, Rattus norvegicus
gtactatgtgtgtgtgctccgccct

SEQ ID NO: 480278 - DNA, 25 bp, Rattus norvegicus
gtactattaactcccaagctagctc

SEQ ID NO: 480279 - DNA, 25 bp, Rattus norvegicus
gtactattaactgccaagctagctc

SEQ ID NO: 480280 - DNA, 25 bp, Rattus norvegicus
gtactattatcaagttctcactgag

SEQ ID NO: 480281 - DNA, 25 bp, Rattus norvegicus
gtactattatcatgttctcactgag

SEQ ID NO: 480282 - DNA, 25 bp, Rattus norvegicus
gtactattattcctggtctttcgcc

SEQ ID NO: 480283 - DNA, 25 bp, Rattus norvegicus
gtactattattcgtggtctttcgcc

SEQ ID NO: 480284 - DNA, 25 bp, Rattus norvegicus
gtactatttaccagatagctgcatg

SEQ ID NO: 480285 - DNA, 25 bp, Rattus norvegicus
gtactatttaccatccgtgtcctag

SEQ ID NO: 480286 - DNA, 25 bp, Rattus norvegicus
gtactatttacctgatagctgcatg

SEQ ID NO: 480287 - DNA, 25 bp, Rattus norvegicus
gtactatttaccttccgtgtcctag

SEQ ID NO: 480288 - DNA, 25 bp, Rattus norvegicus
gtactatttatgactaacctttgaa

SEQ ID NO: 480289 - DNA, 25 bp, Rattus norvegicus
gtactatttatgtctaacctttgaa

SEQ ID NO: 480290 - DNA, 25 bp, Rattus norvegicus
gtactatttccaaagtccagaatgt

SEQ ID NO: 480291 - DNA, 25 bp, Rattus norvegicus
gtactatttccatagtccagaatgt

SEQ ID NO: 480292 - DNA, 25 bp, Rattus norvegicus
gtactatttgtaatggagaagccct

SEQ ID NO: 480293 - DNA, 25 bp, Rattus norvegicus
gtactatttgtattggagaagccct

SEQ ID NO: 480294 - DNA, 25 bp, Rattus norvegicus
gtactcaattggcattgccttcatg

SEQ ID NO: 480295 - DNA, 25 bp, Rattus norvegicus
gtactcaattgggattgccttcatg

SEQ ID NO: 480296 - DNA, 25 bp, Rattus norvegicus
gtactcacaccgcaccagctgaatg

SEQ ID NO: 480297 - DNA, 25 bp, Rattus norvegicus
gtactcacaccggaccagctgaatg

SEQ ID NO: 480298 - DNA, 25 bp, Rattus norvegicus
gtactcacagctcaacaggactaat

SEQ ID NO: 480299 - DNA, 25 bp, Rattus norvegicus
gtactcacagctgaacaggactaat

SEQ ID NO: 480300 - DNA, 25 bp, Rattus norvegicus
gtactcacccctcggacagaagtaa

SEQ ID NO: 480301 - DNA, 25 bp, Rattus norvegicus
gtactcacccctgggacagaagtaa

SEQ ID NO: 480302 - DNA, 25 bp, Rattus norvegicus
gtactcacccggaagcctaacctga

SEQ ID NO: 480303 - DNA, 25 bp, Rattus norvegicus
gtactcacccggtagcctaacctga

SEQ ID NO: 480304 - DNA, 25 bp, Rattus norvegicus
gtactcactacccactccaaaaggg

SEQ ID NO: 480305 - DNA, 25 bp, Rattus norvegicus
gtactcactaccgactccaaaaggg

SEQ ID NO: 480306 - DNA, 25 bp, Rattus norvegicus
gtactcactccacatctgagagtct

SEQ ID NO: 480307 - DNA, 25 bp, Rattus norvegicus
gtactcactccagatctgagagtct

SEQ ID NO: 480308 - DNA, 25 bp, Rattus norvegicus
gtactcactgagaatgccaaaacta

SEQ ID NO: 480309 - DNA, 25 bp, Rattus norvegicus
gtactcactgagtatgccaaaacta

SEQ ID NO: 480310 - DNA, 25 bp, Rattus norvegicus
gtactcactgctctctagaaattaa

SEQ ID NO: 480311 - DNA, 25 bp, Rattus norvegicus
gtactcactgctgtctagaaattaa

SEQ ID NO: 480312 - DNA, 25 bp, Rattus norvegicus
gtactcacttgtctggagtggtcca

SEQ ID NO: 480313 - DNA, 25 bp, Rattus norvegicus
gtactcacttgtgtggagtggtcca

SEQ ID NO: 480314 - DNA, 25 bp, Rattus norvegicus
gtactcactttcatatcactttcat

SEQ ID NO: 480315 - DNA, 25 bp, Rattus norvegicus
gtactcactttcttatcactttcat

SEQ ID NO: 480316 - DNA, 25 bp, Rattus norvegicus
gtactcagaataattgtgcctatag

SEQ ID NO: 480317 - DNA, 25 bp, Rattus norvegicus
gtactcagaatatttgtgcctatag

SEQ ID NO: 480318 - DNA, 25 bp, Rattus norvegicus
gtactcagcccacgtaacatatttt

SEQ ID NO: 480319 - DNA, 25 bp, Rattus norvegicus
gtactcagcccaggtaacatatttt

SEQ ID NO: 480320 - DNA, 25 bp, Rattus norvegicus
gtactcagccttctaaagaacatct

SEQ ID NO: 480321 - DNA, 25 bp, Rattus norvegicus
gtactcagccttgtaaagaacatct

SEQ ID NO: 480322 - DNA, 25 bp, Rattus norvegicus
gtactcagctctataggcaaccact

SEQ ID NO: 480323 - DNA, 25 bp, Rattus norvegicus
gtactcagctctttaggcaaccact

SEQ ID NO: 480324 - DNA, 25 bp, Rattus norvegicus
gtactcaggagacctgtgcacagca

SEQ ID NO: 480325 - DNA, 25 bp, Rattus norvegicus
gtactcaggagagctgtgcacagca

SEQ ID NO: 480326 - DNA, 25 bp, Rattus norvegicus
gtactcaggatgatgcatgtgctag

SEQ ID NO: 480327 - DNA, 25 bp, Rattus norvegicus
gtactcaggatgttgcatgtgctag

SEQ ID NO: 480328 - DNA, 25 bp, Rattus norvegicus
gtactcaggctccacagacacaggg

SEQ ID NO: 480329 - DNA, 25 bp, Rattus norvegicus
gtactcaggctcgacagacacaggg

SEQ ID NO: 480330 - DNA, 25 bp, Rattus norvegicus
gtactcagggtcaggaaagacctct

SEQ ID NO: 480331 - DNA, 25 bp, Rattus norvegicus
gtactcagggtctggaaagacctct

SEQ ID NO: 480332 - DNA, 25 bp, Rattus norvegicus
gtactcagtacaacatgttttcctg

SEQ ID NO: 480333 - DNA, 25 bp, Rattus norvegicus
gtactcagtacatcatgttttcctg

SEQ ID NO: 480334 - DNA, 25 bp, Rattus norvegicus
gtactcagtgacattttcataccaa

SEQ ID NO: 480335 - DNA, 25 bp, Rattus norvegicus
gtactcagtgactttttcataccaa

SEQ ID NO: 480336 - DNA, 25 bp, Rattus norvegicus
gtactcagttcaaatgcttcattca

SEQ ID NO: 480337 - DNA, 25 bp, Rattus norvegicus
gtactcagttcatatgcttcattca

SEQ ID NO: 480338 - DNA, 25 bp, Rattus norvegicus
gtactcatatgcatacacccatgtg

SEQ ID NO: 480339 - DNA, 25 bp, Rattus norvegicus
gtactcatatgcttacacccatgtg

SEQ ID NO: 480340 - DNA, 25 bp, Rattus norvegicus
gtactcatgcagctgtctacattgg

SEQ ID NO: 480341 - DNA, 25 bp, Rattus norvegicus
gtactcatgcaggtgtctacattgg

SEQ ID NO: 480342 - DNA, 25 bp, Rattus norvegicus
gtactcatgcatcttcttgcagagc

SEQ ID NO: 480343 - DNA, 25 bp, Rattus norvegicus
gtactcatgcatgttcttgcagagc

SEQ ID NO: 480344 - DNA, 25 bp, Rattus norvegicus
gtactcatgctcagtatctgtcaca

SEQ ID NO: 480345 - DNA, 25 bp, Rattus norvegicus
gtactcatgctctgtatctgtcaca

SEQ ID NO: 480346 - DNA, 25 bp, Rattus norvegicus
gtactcattctcagcatactgtgga

SEQ ID NO: 480347 - DNA, 25 bp, Rattus norvegicus
gtactcattctctgcatactgtgga

SEQ ID NO: 480348 - DNA, 25 bp, Rattus norvegicus
gtactcatttcaatatgtgccttgc

SEQ ID NO: 480349 - DNA, 25 bp, Rattus norvegicus
gtactcatttcattatgtgccttgc

SEQ ID NO: 480350 - DNA, 25 bp, Rattus norvegicus
gtactcatttgcatacctttgcatc

SEQ ID NO: 480351 - DNA, 25 bp, Rattus norvegicus
gtactcatttgcttacctttgcatc

SEQ ID NO: 480352 - DNA, 25 bp, Rattus norvegicus
gtactcattttgatctcaagctgca

SEQ ID NO: 480353 - DNA, 25 bp, Rattus norvegicus
gtactcattttgttctcaagctgca

SEQ ID NO: 480354 - DNA, 25 bp, Rattus norvegicus
gtactccaaccccagtggagaaact

SEQ ID NO: 480355 - DNA, 25 bp, Rattus norvegicus
gtactccaacccgagtggagaaact

SEQ ID NO: 480356 - DNA, 25 bp, Rattus norvegicus
gtactccaactactacaggacctgg

SEQ ID NO: 480357 - DNA, 25 bp, Rattus norvegicus
gtactccaactagtacaggacctgg

SEQ ID NO: 480358 - DNA, 25 bp, Rattus norvegicus
gtactccaagagagcgcacgtgcag

SEQ ID NO: 480359 - DNA, 25 bp, Rattus norvegicus
gtactccaagagtgcgcacgtgcag

SEQ ID NO: 480360 - DNA, 25 bp, Rattus norvegicus
gtactccaatcaacaaagcacctgt

SEQ ID NO: 480361 - DNA, 25 bp, Rattus norvegicus
gtactccaatcatcaaagcacctgt

SEQ ID NO: 480362 - DNA, 25 bp, Rattus norvegicus
gtactccagcggcagagtatgttct

SEQ ID NO: 480363 - DNA, 25 bp, Rattus norvegicus
gtactccagcgggagagtatgttct

SEQ ID NO: 480364 - DNA, 25 bp, Rattus norvegicus
gtactccaggcaagggactgtcatt

SEQ ID NO: 480365 - DNA, 25 bp, Rattus norvegicus
gtactccaggcatgggactgtcatt

SEQ ID NO: 480366 - DNA, 25 bp, Rattus norvegicus
gtactccagggactacaggcacagg

SEQ ID NO: 480367 - DNA, 25 bp, Rattus norvegicus
gtactccagggagtacaggcacagg

SEQ ID NO: 480368 - DNA, 25 bp, Rattus norvegicus
gtactccagtagcttagggttattt

SEQ ID NO: 480369 - DNA, 25 bp, Rattus norvegicus
gtactccagtaggttagggttattt

SEQ ID NO: 480370 - DNA, 25 bp, Rattus norvegicus
gtactccataagatgagcaggatag

SEQ ID NO: 480371 - DNA, 25 bp, Rattus norvegicus
gtactccataagttgagcaggatag

SEQ ID NO: 480372 - DNA, 25 bp, Rattus norvegicus
gtactccatatcaagtttcctatgt

SEQ ID NO: 480373 - DNA, 25 bp, Rattus norvegicus
gtactccatatctagtttcctatgt

SEQ ID NO: 480374 - DNA, 25 bp, Rattus norvegicus
gtactccatctaccacagaagtgac

SEQ ID NO: 480375 - DNA, 25 bp, Rattus norvegicus
gtactccatctagcacagaagtgac

SEQ ID NO: 480376 - DNA, 25 bp, Rattus norvegicus
gtactccatgaaaatcctgagccca

SEQ ID NO: 480377 - DNA, 25 bp, Rattus norvegicus
gtactccatgaatatcctgagccca

SEQ ID NO: 480378 - DNA, 25 bp, Rattus norvegicus
gtactccattacatcagggtctaag

SEQ ID NO: 480379 - DNA, 25 bp, Rattus norvegicus
gtactccattacttcagggtctaag

SEQ ID NO: 480380 - DNA, 25 bp, Rattus norvegicus
gtactccatttcctagcagggctag

SEQ ID NO: 480381 - DNA, 25 bp, Rattus norvegicus
gtactccatttcgtagcagggctag

SEQ ID NO: 480382 - DNA, 25 bp, Rattus norvegicus
gtactcccaaagagacaaagcctag

SEQ ID NO: 480383 - DNA, 25 bp, Rattus norvegicus
gtactcccaaagtgacaaagcctag

SEQ ID NO: 480384 - DNA, 25 bp, Rattus norvegicus
gtactcccgtccaggcaacaaatat

SEQ ID NO: 480385 - DNA, 25 bp, Rattus norvegicus
gtactcccgtcctggcaacaaatat

SEQ ID NO: 480386 - DNA, 25 bp, Rattus norvegicus
gtactccctacaagggccaggtgat

SEQ ID NO: 480387 - DNA, 25 bp, Rattus norvegicus
gtactccctacatgggccaggtgat

SEQ ID NO: 480388 - DNA, 25 bp, Rattus norvegicus
gtactccctagcactgagaagcttt

SEQ ID NO: 480389 - DNA, 25 bp, Rattus norvegicus
gtactccctagctctgagaagcttt

SEQ ID NO: 480390 - DNA, 25 bp, Rattus norvegicus
gtactccgacttcgaagagaccaga

SEQ ID NO: 480391 - DNA, 25 bp, Rattus norvegicus
gtactccgacttggaagagaccaga

SEQ ID NO: 480392 - DNA, 25 bp, Rattus norvegicus
gtactccgtgtgagcctcgattcaa

SEQ ID NO: 480393 - DNA, 25 bp, Rattus norvegicus
gtactccgtgtgtgcctcgattcaa

SEQ ID NO: 480394 - DNA, 25 bp, Rattus norvegicus
gtactcctaacaccgtgacgaacct

SEQ ID NO: 480395 - DNA, 25 bp, Rattus norvegicus
gtactcctaacagcgtgacgaacct

SEQ ID NO: 480396 - DNA, 25 bp, Rattus norvegicus
gtactcctaagtctgtgctcatctg

SEQ ID NO: 480397 - DNA, 25 bp, Rattus norvegicus
gtactcctaagtgtgtgctcatctg

SEQ ID NO: 480398 - DNA, 25 bp, Rattus norvegicus
gtactcctactaaaatgactcatat

SEQ ID NO: 480399 - DNA, 25 bp, Rattus norvegicus
gtactcctactataatgactcatat

SEQ ID NO: 480400 - DNA, 25 bp, Rattus norvegicus
gtactcctagtacatggccaacaga

SEQ ID NO: 480401 - DNA, 25 bp, Rattus norvegicus
gtactcctagtagatggccaacaga

SEQ ID NO: 480402 - DNA, 25 bp, Rattus norvegicus
gtactcctatatcggcttctgtatg

SEQ ID NO: 480403 - DNA, 25 bp, Rattus norvegicus
gtactcctatatgggcttctgtatg

SEQ ID NO: 480404 - DNA, 25 bp, Rattus norvegicus
gtactcctatttctttatggtgctg

SEQ ID NO: 480405 - DNA, 25 bp, Rattus norvegicus
gtactcctatttgtttatggtgctg

SEQ ID NO: 480406 - DNA, 25 bp, Rattus norvegicus
gtactcctcggaaatatcatcttga

SEQ ID NO: 480407 - DNA, 25 bp, Rattus norvegicus
gtactcctcggatatatcatcttga

SEQ ID NO: 480408 - DNA, 25 bp, Rattus norvegicus
gtactcctcggtaaaatagcctggc

SEQ ID NO: 480409 - DNA, 25 bp, Rattus norvegicus
gtactcctcggttaaatagcctggc

SEQ ID NO: 480410 - DNA, 25 bp, Rattus norvegicus
gtactcctgcagacccgtgagatgg

SEQ ID NO: 480411 - DNA, 25 bp, Rattus norvegicus
gtactcctgcagtcccgtgagatgg

SEQ ID NO: 480412 - DNA, 25 bp, Rattus norvegicus
gtactcctggctacatcatagctgg

SEQ ID NO: 480413 - DNA, 25 bp, Rattus norvegicus
gtactcctggcttcatcatagctgg

SEQ ID NO: 480414 - DNA, 25 bp, Rattus norvegicus
gtactcctggtaaccactgcaaggg

SEQ ID NO: 480415 - DNA, 25 bp, Rattus norvegicus
gtactcctggtatccactgcaaggg

SEQ ID NO: 480416 - DNA, 25 bp, Rattus norvegicus
gtactcctgtatctgtgctctgatg

SEQ ID NO: 480417 - DNA, 25 bp, Rattus norvegicus
gtactcctgtatgtgtgctctgatg

SEQ ID NO: 480418 - DNA, 25 bp, Rattus norvegicus
gtactcctgttgattcttgtgaaga

SEQ ID NO: 480419 - DNA, 25 bp, Rattus norvegicus
gtactcctgttgtttcttgtgaaga

SEQ ID NO: 480420 - DNA, 25 bp, Rattus norvegicus
gtactccttaaacctcaagtgtgtg

SEQ ID NO: 480421 - DNA, 25 bp, Rattus norvegicus
gtactccttaaagctcaagtgtgtg

SEQ ID NO: 480422 - DNA, 25 bp, Rattus norvegicus
gtactccttgctattacaactgttg

SEQ ID NO: 480423 - DNA, 25 bp, Rattus norvegicus
gtactccttgcttttacaactgttg

SEQ ID NO: 480424 - DNA, 25 bp, Rattus norvegicus
gtactccttggccatctttgagcca

SEQ ID NO: 480425 - DNA, 25 bp, Rattus norvegicus
gtactccttggcgatctttgagcca

SEQ ID NO: 480426 - DNA, 25 bp, Rattus norvegicus
gtactcgagactcatttcttctttt

SEQ ID NO: 480427 - DNA, 25 bp, Rattus norvegicus
gtactcgagactgatttcttctttt

SEQ ID NO: 480428 - DNA, 25 bp, Rattus norvegicus
gtactcgagcacattagcaaactga

SEQ ID NO: 480429 - DNA, 25 bp, Rattus norvegicus
gtactcgagcactttagcaaactga

SEQ ID NO: 480430 - DNA, 25 bp, Rattus norvegicus
gtactcgagtggatttcaatggcat

SEQ ID NO: 480431 - DNA, 25 bp, Rattus norvegicus
gtactcgagtggttttcaatggcat

SEQ ID NO: 480432 - DNA, 25 bp, Rattus norvegicus
gtactcgcggcaactcagaacaggg

SEQ ID NO: 480433 - DNA, 25 bp, Rattus norvegicus
gtactcgcggcatctcagaacaggg

SEQ ID NO: 480434 - DNA, 25 bp, Rattus norvegicus
gtactcgcttggaagtgatgctgta

SEQ ID NO: 480435 - DNA, 25 bp, Rattus norvegicus
gtactcgcttggtagtgatgctgta

SEQ ID NO: 480436 - DNA, 25 bp, Rattus norvegicus
gtactcggcaaaatgtcagggacat

SEQ ID NO: 480437 - DNA, 25 bp, Rattus norvegicus
gtactcggcaaattgtcagggacat

SEQ ID NO: 480438 - DNA, 25 bp, Rattus norvegicus
gtactcggcagcatccacctgcagg

SEQ ID NO: 480439 - DNA, 25 bp, Rattus norvegicus
gtactcggcagcttccacctgcagg

SEQ ID NO: 480440 - DNA, 25 bp, Rattus norvegicus
gtactcggcctcatcttcaagagga

SEQ ID NO: 480441 - DNA, 25 bp, Rattus norvegicus
gtactcggcctcttcttcaagagga

SEQ ID NO: 480442 - DNA, 25 bp, Rattus norvegicus
gtactcggctgaagcctcagggcgt

SEQ ID NO: 480443 - DNA, 25 bp, Rattus norvegicus
gtactcggctgatgcctcagggcgt

SEQ ID NO: 480444 - DNA, 25 bp, Rattus norvegicus
gtactcggctggctgactaggcata

SEQ ID NO: 480445 - DNA, 25 bp, Rattus norvegicus
gtactcggctgggtgactaggcata

SEQ ID NO: 480446 - DNA, 25 bp, Rattus norvegicus
gtactcggtaccatgcaattggtca

SEQ ID NO: 480447 - DNA, 25 bp, Rattus norvegicus
gtactcggtaccttgcaattggtca

SEQ ID NO: 480448 - DNA, 25 bp, Rattus norvegicus
gtactcgtgtttaattgccatgctt

SEQ ID NO: 480449 - DNA, 25 bp, Rattus norvegicus
gtactcgtgttttattgccatgctt

SEQ ID NO: 480450 - DNA, 25 bp, Rattus norvegicus
gtactcgttgacatagctgcacagg

SEQ ID NO: 480451 - DNA, 25 bp, Rattus norvegicus
gtactcgttgacttagctgcacagg

SEQ ID NO: 480452 - DNA, 25 bp, Rattus norvegicus
gtactctaactacacatgacctaat

SEQ ID NO: 480453 - DNA, 25 bp, Rattus norvegicus
gtactctaactagacatgacctaat

SEQ ID NO: 480454 - DNA, 25 bp, Rattus norvegicus
gtactctagctactacaagcctttc

SEQ ID NO: 480455 - DNA, 25 bp, Rattus norvegicus
gtactctagctagtacaagcctttc

SEQ ID NO: 480456 - DNA, 25 bp, Rattus norvegicus
gtactctagtggattaacgcctctc

SEQ ID NO: 480457 - DNA, 25 bp, Rattus norvegicus
gtactctagtggtttaacgcctctc

SEQ ID NO: 480458 - DNA, 25 bp, Rattus norvegicus
gtactctcaactaatttgtgatcct

SEQ ID NO: 480459 - DNA, 25 bp, Rattus norvegicus
gtactctcaacttatttgtgatcct

SEQ ID NO: 480460 - DNA, 25 bp, Rattus norvegicus
gtactctcacacaccatgggctgga

SEQ ID NO: 480461 - DNA, 25 bp, Rattus norvegicus
gtactctcacactccatgggctgga

SEQ ID NO: 480462 - DNA, 25 bp, Rattus norvegicus
gtactctcataaaggcagggactgc

SEQ ID NO: 480463 - DNA, 25 bp, Rattus norvegicus
gtactctcataatggcagggactgc

SEQ ID NO: 480464 - DNA, 25 bp, Rattus norvegicus
gtactctcatgaactgtttcctgtg

SEQ ID NO: 480465 - DNA, 25 bp, Rattus norvegicus
gtactctcatgatctgtttcctgtg

SEQ ID NO: 480466 - DNA, 25 bp, Rattus norvegicus
gtactctccagcaggtgggccaagg

SEQ ID NO: 480467 - DNA, 25 bp, Rattus norvegicus
gtactctccagctggtgggccaagg

SEQ ID NO: 480468 - DNA, 25 bp, Rattus norvegicus
gtactctcgtgaaaaagccttccta

SEQ ID NO: 480469 - DNA, 25 bp, Rattus norvegicus
gtactctcgtgataaagccttccta

SEQ ID NO: 480470 - DNA, 25 bp, Rattus norvegicus
gtactctctaccacagtcatagatt

SEQ ID NO: 480471 - DNA, 25 bp, Rattus norvegicus
gtactctctacctcagtcatagatt

SEQ ID NO: 480472 - DNA, 25 bp, Rattus norvegicus
gtactctgagatacgcaggacccga

SEQ ID NO: 480473 - DNA, 25 bp, Rattus norvegicus
gtactctgagattcgcaggacccga

SEQ ID NO: 480474 - DNA, 25 bp, Rattus norvegicus
gtactctgagtcactgagcatctct

SEQ ID NO: 480475 - DNA, 25 bp, Rattus norvegicus
gtactctgagtctctgagcatctct

SEQ ID NO: 480476 - DNA, 25 bp, Rattus norvegicus
gtactctgagtgcagtgttttgctg

SEQ ID NO: 480477 - DNA, 25 bp, Rattus norvegicus
gtactctgagtggagtgttttgctg

SEQ ID NO: 480478 - DNA, 25 bp, Rattus norvegicus
gtactctgcagcacgtgtattgcaa

SEQ ID NO: 480479 - DNA, 25 bp, Rattus norvegicus
gtactctgcagctcgtgtattgcaa

SEQ ID NO: 480480 - DNA, 25 bp, Rattus norvegicus
gtactctgcagtctgattcggtcta

SEQ ID NO: 480481 - DNA, 25 bp, Rattus norvegicus
gtactctgcagtgtgattcggtcta

SEQ ID NO: 480482 - DNA, 25 bp, Rattus norvegicus
gtactctgccatctgtagcttttca

SEQ ID NO: 480483 - DNA, 25 bp, Rattus norvegicus
gtactctgccatgtgtagcttttca

SEQ ID NO: 480484 - DNA, 25 bp, Rattus norvegicus
gtactctggagtatttctcatgtaa

SEQ ID NO: 480485 - DNA, 25 bp, Rattus norvegicus
gtactctggagtttttctcatgtaa

SEQ ID NO: 480486 - DNA, 25 bp, Rattus norvegicus
gtactctgtcccatgtaagtcgttg

SEQ ID NO: 480487 - DNA, 25 bp, Rattus norvegicus
gtactctgtcccttgtaagtcgttg

SEQ ID NO: 480488 - DNA, 25 bp, Rattus norvegicus
gtactctgtgagcagccttcagatg

SEQ ID NO: 480489 - DNA, 25 bp, Rattus norvegicus
gtactctgtgaggagccttcagatg

SEQ ID NO: 480490 - DNA, 25 bp, Rattus norvegicus
gtactctgtgctcatgtaaccttca

SEQ ID NO: 480491 - DNA, 25 bp, Rattus norvegicus
gtactctgtgctgatgtaaccttca

SEQ ID NO: 480492 - DNA, 25 bp, Rattus norvegicus
gtactctgttttataccaagcctgt

SEQ ID NO: 480493 - DNA, 25 bp, Rattus norvegicus
gtactctgttttttaccaagcctgt

SEQ ID NO: 480494 - DNA, 25 bp, Rattus norvegicus
gtactcttatacacttgacaatatc

SEQ ID NO: 480495 - DNA, 25 bp, Rattus norvegicus
gtactcttatactcttgacaatatc

SEQ ID NO: 480496 - DNA, 25 bp, Rattus norvegicus
gtactcttccctcaaagctcagttt

SEQ ID NO: 480497 - DNA, 25 bp, Rattus norvegicus
gtactcttccctgaaagctcagttt

SEQ ID NO: 480498 - DNA, 25 bp, Rattus norvegicus
gtactcttcctacgcagtcaacagg

SEQ ID NO: 480499 - DNA, 25 bp, Rattus norvegicus
gtactcttcctaggcagtcaacagg

SEQ ID NO: 480500 - DNA, 25 bp, Rattus norvegicus
gtactcttctccaagccattgaaat

SEQ ID NO: 480501 - DNA, 25 bp, Rattus norvegicus
gtactcttctcctagccattgaaat

SEQ ID NO: 480502 - DNA, 25 bp, Rattus norvegicus
gtactctttccaaggagcttccata

SEQ ID NO: 480503 - DNA, 25 bp, Rattus norvegicus
gtactctttccatggagcttccata

SEQ ID NO: 480504 - DNA, 25 bp, Rattus norvegicus
gtactctttggacctggaggctttc

SEQ ID NO: 480505 - DNA, 25 bp, Rattus norvegicus
gtactctttggagctggaggctttc

SEQ ID NO: 480506 - DNA, 25 bp, Rattus norvegicus
gtactctttggcaaactgtctcact

SEQ ID NO: 480507 - DNA, 25 bp, Rattus norvegicus
gtactctttggctaactgtctcact

SEQ ID NO: 480508 - DNA, 25 bp, Rattus norvegicus
gtactgaaccaactgaactgcatct

SEQ ID NO: 480509 - DNA, 25 bp, Rattus norvegicus
gtactgaaccaagtgaactgcatct

SEQ ID NO: 480510 - DNA, 25 bp, Rattus norvegicus
gtactgaactagacagcacgcttcc

SEQ ID NO: 480511 - DNA, 25 bp, Rattus norvegicus
gtactgaactagtcagcacgcttcc

SEQ ID NO: 480512 - DNA, 25 bp, Rattus norvegicus
gtactgaagtgtaacttgaaccggg

SEQ ID NO: 480513 - DNA, 25 bp, Rattus norvegicus
gtactgaagtgttacttgaaccggg

SEQ ID NO: 480514 - DNA, 25 bp, Rattus norvegicus
gtactgaatgttatcacgtggcttc

SEQ ID NO: 480515 - DNA, 25 bp, Rattus norvegicus
gtactgaatgttttcacgtggcttc

SEQ ID NO: 480516 - DNA, 25 bp, Rattus norvegicus
gtactgacatagagctgccttcttt

SEQ ID NO: 480517 - DNA, 25 bp, Rattus norvegicus
gtactgacatagtgctgccttcttt

SEQ ID NO: 480518 - DNA, 25 bp, Rattus norvegicus
gtactgacatcaaccaaatgtggac

SEQ ID NO: 480519 - DNA, 25 bp, Rattus norvegicus
gtactgacatcatccaaatgtggac

SEQ ID NO: 480520 - DNA, 25 bp, Rattus norvegicus
gtactgacatgtctgagcagccggc

SEQ ID NO: 480521 - DNA, 25 bp, Rattus norvegicus
gtactgacatgtgtgagcagccggc

SEQ ID NO: 480522 - DNA, 25 bp, Rattus norvegicus
gtactgaccattaatttggccagaa

SEQ ID NO: 480523 - DNA, 25 bp, Rattus norvegicus
gtactgaccatttatttggccagaa

SEQ ID NO: 480524 - DNA, 25 bp, Rattus norvegicus
gtactgacgggtattccagacatga

SEQ ID NO: 480525 - DNA, 25 bp, Rattus norvegicus
gtactgacgggttttccagacatga

SEQ ID NO: 480526 - DNA, 25 bp, Rattus norvegicus
gtactgactctcatagttacccttt

SEQ ID NO: 480527 - DNA, 25 bp, Rattus norvegicus
gtactgactctcttagttacccttt

SEQ ID NO: 480528 - DNA, 25 bp, Rattus norvegicus
gtactgactgccactgtaacaggtt

SEQ ID NO: 480529 - DNA, 25 bp, Rattus norvegicus
gtactgactgcctctgtaacaggtt

SEQ ID NO: 480530 - DNA, 25 bp, Rattus norvegicus
gtactgactgtaatgttccactgat

SEQ ID NO: 480531 - DNA, 25 bp, Rattus norvegicus
gtactgactgtattgttccactgat

SEQ ID NO: 480532 - DNA, 25 bp, Rattus norvegicus
gtactgactttccatatgcacatat

SEQ ID NO: 480533 - DNA, 25 bp, Rattus norvegicus
gtactgactttcgatatgcacatat

SEQ ID NO: 480534 - DNA, 25 bp, Rattus norvegicus
gtactgagaacgatttttccttggt

SEQ ID NO: 480535 - DNA, 25 bp, Rattus norvegicus
gtactgagaacgttttttccttggt

SEQ ID NO: 480536 - DNA, 25 bp, Rattus norvegicus
gtactgagaactacggcagccatcg

SEQ ID NO: 480537 - DNA, 25 bp, Rattus norvegicus
gtactgagaacttcggcagccatcg

SEQ ID NO: 480538 - DNA, 25 bp, Rattus norvegicus
gtactgagaagcagtgtttgccaat

SEQ ID NO: 480539 - DNA, 25 bp, Rattus norvegicus
gtactgagaagctgtgtttgccaat

SEQ ID NO: 480540 - DNA, 25 bp, Rattus norvegicus
gtactgagacaaattttcattgtta

SEQ ID NO: 480541 - DNA, 25 bp, Rattus norvegicus
gtactgagacaatttttcattgtta

SEQ ID NO: 480542 - DNA, 25 bp, Rattus norvegicus
gtactgagattaaattcaccaccac

SEQ ID NO: 480543 - DNA, 25 bp, Rattus norvegicus
gtactgagattatattcaccaccac

SEQ ID NO: 480544 - DNA, 25 bp, Rattus norvegicus
gtactgagcaagacctgtgcccaga

SEQ ID NO: 480545 - DNA, 25 bp, Rattus norvegicus
gtactgagcaagtcctgtgcccaga

SEQ ID NO: 480546 - DNA, 25 bp, Rattus norvegicus
gtactgagcacaatggagaccttcg

SEQ ID NO: 480547 - DNA, 25 bp, Rattus norvegicus
gtactgagcacattggagaccttcg

SEQ ID NO: 480548 - DNA, 25 bp, Rattus norvegicus
gtactgagcagtcagcttgaatcta

SEQ ID NO: 480549 - DNA, 25 bp, Rattus norvegicus
gtactgagcagtgagcttgaatcta

SEQ ID NO: 480550 - DNA, 25 bp, Rattus norvegicus
gtactgagccttaaactttagacaa

SEQ ID NO: 480551 - DNA, 25 bp, Rattus norvegicus
gtactgagcctttaactttagacaa

SEQ ID NO: 480552 - DNA, 25 bp, Rattus norvegicus
gtactgaggatcaagcccaaggctt

SEQ ID NO: 480553 - DNA, 25 bp, Rattus norvegicus
gtactgaggatctagcccaaggctt

SEQ ID NO: 480554 - DNA, 25 bp, Rattus norvegicus
gtactgaggcagacacaagtccaca

SEQ ID NO: 480555 - DNA, 25 bp, Rattus norvegicus
gtactgaggcagtcacaagtccaca

SEQ ID NO: 480556 - DNA, 25 bp, Rattus norvegicus
gtactgaggcttccaactttgtggt

SEQ ID NO: 480557 - DNA, 25 bp, Rattus norvegicus
gtactgaggcttgcaactttgtggt

SEQ ID NO: 480558 - DNA, 25 bp, Rattus norvegicus
gtactgagtccaaagtttggagtat

SEQ ID NO: 480559 - DNA, 25 bp, Rattus norvegicus
gtactgagtccatagtttggagtat

SEQ ID NO: 480560 - DNA, 25 bp, Rattus norvegicus
gtactgagtgcactgcttagaactg

SEQ ID NO: 480561 - DNA, 25 bp, Rattus norvegicus
gtactgagtgcagtgcttagaactg

SEQ ID NO: 480562 - DNA, 25 bp, Rattus norvegicus
gtactgatactaagcctctgtgact

SEQ ID NO: 480563 - DNA, 25 bp, Rattus norvegicus
gtactgatactatgcctctgtgact

SEQ ID NO: 480564 - DNA, 25 bp, Rattus norvegicus
gtactgataggtagtgttgctagaa

SEQ ID NO: 480565 - DNA, 25 bp, Rattus norvegicus
gtactgataggttgtgttgctagaa

SEQ ID NO: 480566 - DNA, 25 bp, Rattus norvegicus
gtactgatattgctgagagactata

SEQ ID NO: 480567 - DNA, 25 bp, Rattus norvegicus
gtactgatattggtgagagactata

SEQ ID NO: 480568 - DNA, 25 bp, Rattus norvegicus
gtactgattagacgtcattggccaa

SEQ ID NO: 480569 - DNA, 25 bp, Rattus norvegicus
gtactgattagaggtcattggccaa

SEQ ID NO: 480570 - DNA, 25 bp, Rattus norvegicus
gtactgcacagtctgtgggctgcaa

SEQ ID NO: 480571 - DNA, 25 bp, Rattus norvegicus
gtactgcacagtgtgtgggctgcaa

SEQ ID NO: 480572 - DNA, 25 bp, Rattus norvegicus
gtactgcacgagctggagcctagat

SEQ ID NO: 480573 - DNA, 25 bp, Rattus norvegicus
gtactgcacgaggtggagcctagat

SEQ ID NO: 480574 - DNA, 25 bp, Rattus norvegicus
gtactgcatctactttgaccgcaaa

SEQ ID NO: 480575 - DNA, 25 bp, Rattus norvegicus
gtactgcatctagtttgaccgcaaa

SEQ ID NO: 480576 - DNA, 25 bp, Rattus norvegicus
gtactgccagtaatgagaaactcac

SEQ ID NO: 480577 - DNA, 25 bp, Rattus norvegicus
gtactgccagtattgagaaactcac

SEQ ID NO: 480578 - DNA, 25 bp, Rattus norvegicus
gtactgcccaagaccagataagctt

SEQ ID NO: 480579 - DNA, 25 bp, Rattus norvegicus
gtactgcccaagtccagataagctt

SEQ ID NO: 480580 - DNA, 25 bp, Rattus norvegicus
gtactgcctcttagtttactgggta

SEQ ID NO: 480581 - DNA, 25 bp, Rattus norvegicus
gtactgcctctttgtttactgggta

SEQ ID NO: 480582 - DNA, 25 bp, Rattus norvegicus
gtactgcctgctcttgagttggaaa

SEQ ID NO: 480583 - DNA, 25 bp, Rattus norvegicus
gtactgcctgctgttgagttggaaa

SEQ ID NO: 480584 - DNA, 25 bp, Rattus norvegicus
gtactgcgagcaccctgaaaaacgt

SEQ ID NO: 480585 - DNA, 25 bp, Rattus norvegicus
gtactgcgagcagcctgaaaaacgt

SEQ ID NO: 480586 - DNA, 25 bp, Rattus norvegicus
gtactgcgatttctctactggtgaa

SEQ ID NO: 480587 - DNA, 25 bp, Rattus norvegicus
gtactgcgatttgtctactggtgaa

SEQ ID NO: 480588 - DNA, 25 bp, Rattus norvegicus
gtactgcgtgcgctgctatttatta

SEQ ID NO: 480589 - DNA, 25 bp, Rattus norvegicus
gtactgcgtgcggtgctatttatta

SEQ ID NO: 480590 - DNA, 25 bp, Rattus norvegicus
gtactgctcacaaggcatctcgtat

SEQ ID NO: 480591 - DNA, 25 bp, Rattus norvegicus
gtactgctcacatggcatctcgtat

SEQ ID NO: 480592 - DNA, 25 bp, Rattus norvegicus
gtactgctcctaatcattgtaatgt

SEQ ID NO: 480593 - DNA, 25 bp, Rattus norvegicus
gtactgctcctattcattgtaatgt

SEQ ID NO: 480594 - DNA, 25 bp, Rattus norvegicus
gtactgctcgcgcttcagaaggctg

SEQ ID NO: 480595 - DNA, 25 bp, Rattus norvegicus
gtactgctcgcggttcagaaggctg

SEQ ID NO: 480596 - DNA, 25 bp, Rattus norvegicus
gtactgctcggtatgatctcaaaca

SEQ ID NO: 480597 - DNA, 25 bp, Rattus norvegicus
gtactgctcggtttgatctcaaaca

SEQ ID NO: 480598 - DNA, 25 bp, Rattus norvegicus
gtactgctcttacacagtctggtca

SEQ ID NO: 480599 - DNA, 25 bp, Rattus norvegicus
gtactgctcttagacagtctggtca

SEQ ID NO: 480600 - DNA, 25 bp, Rattus norvegicus
gtactgctggatattgagttttgct

SEQ ID NO: 480601 - DNA, 25 bp, Rattus norvegicus
gtactgctggattttgagttttgct

SEQ ID NO: 480602 - DNA, 25 bp, Rattus norvegicus
gtactgctggcccagtagcacagac

SEQ ID NO: 480603 - DNA, 25 bp, Rattus norvegicus
gtactgctggccgagtagcacagac

SEQ ID NO: 480604 - DNA, 25 bp, Rattus norvegicus
gtactgctgggaagtacacgtcctt

SEQ ID NO: 480605 - DNA, 25 bp, Rattus norvegicus
gtactgctgggatgtacacgtcctt

SEQ ID NO: 480606 - DNA, 25 bp, Rattus norvegicus
gtactgctgttacttctaaacccat

SEQ ID NO: 480607 - DNA, 25 bp, Rattus norvegicus
gtactgctgttagttctaaacccat

SEQ ID NO: 480608 - DNA, 25 bp, Rattus norvegicus
gtactgctgttgacacttaccaatt

SEQ ID NO: 480609 - DNA, 25 bp, Rattus norvegicus
gtactgctgttgtcacttaccaatt

SEQ ID NO: 480610 - DNA, 25 bp, Rattus norvegicus
gtactgcttccaaaccttaggaaat

SEQ ID NO: 480611 - DNA, 25 bp, Rattus norvegicus
gtactgcttccataccttaggaaat

SEQ ID NO: 480612 - DNA, 25 bp, Rattus norvegicus
gtactgcttctcagcgatttaagga

SEQ ID NO: 480613 - DNA, 25 bp, Rattus norvegicus
gtactgcttctctgcgatttaagga

SEQ ID NO: 480614 - DNA, 25 bp, Rattus norvegicus
gtactgcttctgattcggtgcaaaa

SEQ ID NO: 480615 - DNA, 25 bp, Rattus norvegicus
gtactgcttctgtttcggtgcaaaa

SEQ ID NO: 480616 - DNA, 25 bp, Rattus norvegicus
gtactgctttaaattaagcccttgt

SEQ ID NO: 480617 - DNA, 25 bp, Rattus norvegicus
gtactgctttaatttaagcccttgt

SEQ ID NO: 480618 - DNA, 25 bp, Rattus norvegicus
gtactgctttcaacagtttttgaag

SEQ ID NO: 480619 - DNA, 25 bp, Rattus norvegicus
gtactgctttcatcagtttttgaag

SEQ ID NO: 480620 - DNA, 25 bp, Rattus norvegicus
gtactggaaaggctgtcactgtcat

SEQ ID NO: 480621 - DNA, 25 bp, Rattus norvegicus
gtactggaaagggtgtcactgtcat

SEQ ID NO: 480622 - DNA, 25 bp, Rattus norvegicus
gtactggaaggcatgaccctgcagc

SEQ ID NO: 480623 - DNA, 25 bp, Rattus norvegicus
gtactggaaggcttgaccctgcagc

SEQ ID NO: 480624 - DNA, 25 bp, Rattus norvegicus
gtactggaccatactgcagcaactg

SEQ ID NO: 480625 - DNA, 25 bp, Rattus norvegicus
gtactggaccattctgcagcaactg

SEQ ID NO: 480626 - DNA, 25 bp, Rattus norvegicus
gtactggagaagcatgcccaccact

SEQ ID NO: 480627 - DNA, 25 bp, Rattus norvegicus
gtactggagaaggatgcccaccact

SEQ ID NO: 480628 - DNA, 25 bp, Rattus norvegicus
gtactggagaccctgctgaagcact

SEQ ID NO: 480629 - DNA, 25 bp, Rattus norvegicus
gtactggagaccgtgctgaagcact

SEQ ID NO: 480630 - DNA, 25 bp, Rattus norvegicus
gtactggagaggaagccccactcag

SEQ ID NO: 480631 - DNA, 25 bp, Rattus norvegicus
gtactggagaggtagccccactcag

SEQ ID NO: 480632 - DNA, 25 bp, Rattus norvegicus
gtactggcacggctagcactttggc

SEQ ID NO: 480633 - DNA, 25 bp, Rattus norvegicus
gtactggcacgggtagcactttggc

SEQ ID NO: 480634 - DNA, 25 bp, Rattus norvegicus
gtactggcagaacatacacccttat

SEQ ID NO: 480635 - DNA, 25 bp, Rattus norvegicus
gtactggcagaagatacacccttat

SEQ ID NO: 480636 - DNA, 25 bp, Rattus norvegicus
gtactggcagcgcatcgaaggatcc

SEQ ID NO: 480637 - DNA, 25 bp, Rattus norvegicus
gtactggcagcggatcgaaggatcc

SEQ ID NO: 480638 - DNA, 25 bp, Rattus norvegicus
gtactggccttcatcgtgtgctgga

SEQ ID NO: 480639 - DNA, 25 bp, Rattus norvegicus
gtactggccttcttcgtgtgctgga

SEQ ID NO: 480640 - DNA, 25 bp, Rattus norvegicus
gtactggcgctgagtggagacccct

SEQ ID NO: 480641 - DNA, 25 bp, Rattus norvegicus
gtactggcgctgtgtggagacccct

SEQ ID NO: 480642 - DNA, 25 bp, Rattus norvegicus
gtactgggaaccaaagccatctcct

SEQ ID NO: 480643 - DNA, 25 bp, Rattus norvegicus
gtactgggaacctaagccatctcct

SEQ ID NO: 480644 - DNA, 25 bp, Rattus norvegicus
gtactgggaagtccccaaggacata

SEQ ID NO: 480645 - DNA, 25 bp, Rattus norvegicus
gtactgggaagtgcccaaggacata

SEQ ID NO: 480646 - DNA, 25 bp, Rattus norvegicus
gtactgggaatccaaccagagtcct

SEQ ID NO: 480647 - DNA, 25 bp, Rattus norvegicus
gtactgggaatcgaaccagagtcct

SEQ ID NO: 480648 - DNA, 25 bp, Rattus norvegicus
gtactgggacagcagtgtttcccct

SEQ ID NO: 480649 - DNA, 25 bp, Rattus norvegicus
gtactgggacaggagtgtttcccct

SEQ ID NO: 480650 - DNA, 25 bp, Rattus norvegicus
gtactgggactaagaatcacatgtg

SEQ ID NO: 480651 - DNA, 25 bp, Rattus norvegicus
gtactgggactatgaatcacatgtg

SEQ ID NO: 480652 - DNA, 25 bp, Rattus norvegicus
gtactgggagcaccatttgccacaa

SEQ ID NO: 480653 - DNA, 25 bp, Rattus norvegicus
gtactgggagcagcatttgccacaa

SEQ ID NO: 480654 - DNA, 25 bp, Rattus norvegicus
gtactgggagtgagtctttgcaata

SEQ ID NO: 480655 - DNA, 25 bp, Rattus norvegicus
gtactgggagtgtgtctttgcaata

SEQ ID NO: 480656 - DNA, 25 bp, Rattus norvegicus
gtactggtaaacacccgataagctg

SEQ ID NO: 480657 - DNA, 25 bp, Rattus norvegicus
gtactggtaaactcccgataagctg

SEQ ID NO: 480658 - DNA, 25 bp, Rattus norvegicus
gtactggtaagtaaagcccctgtat

SEQ ID NO: 480659 - DNA, 25 bp, Rattus norvegicus
gtactggtaagttaagcccctgtat

SEQ ID NO: 480660 - DNA, 25 bp, Rattus norvegicus
gtactggtacatatttgccttctgc

SEQ ID NO: 480661 - DNA, 25 bp, Rattus norvegicus
gtactggtacatttttgccttctgc

SEQ ID NO: 480662 - DNA, 25 bp, Rattus norvegicus
gtactggtagtcacagtcataggta

SEQ ID NO: 480663 - DNA, 25 bp, Rattus norvegicus
gtactggtagtctcagtcataggta

SEQ ID NO: 480664 - DNA, 25 bp, Rattus norvegicus
gtactggtcaacctttgggaacctg

SEQ ID NO: 480665 - DNA, 25 bp, Rattus norvegicus
gtactggtcaacgtttgggaacctg

SEQ ID NO: 480666 - DNA, 25 bp, Rattus norvegicus
gtactggtcagcaccatcagacaaa

SEQ ID NO: 480667 - DNA, 25 bp, Rattus norvegicus
gtactggtcagctccatcagacaaa

SEQ ID NO: 480668 - DNA, 25 bp, Rattus norvegicus
gtactggtctgaagaaacctgccct

SEQ ID NO: 480669 - DNA, 25 bp, Rattus norvegicus
gtactggtctgatgaaacctgccct

SEQ ID NO: 480670 - DNA, 25 bp, Rattus norvegicus
gtactggtgatgagtcttctgttca

SEQ ID NO: 480671 - DNA, 25 bp, Rattus norvegicus
gtactggtgatgtgtcttctgttca

SEQ ID NO: 480672 - DNA, 25 bp, Rattus norvegicus
gtactggtgttcaagcatttctcct

SEQ ID NO: 480673 - DNA, 25 bp, Rattus norvegicus
gtactggtgttctagcatttctcct

SEQ ID NO: 480674 - DNA, 25 bp, Rattus norvegicus
gtactggttctgagttgatggcccc

SEQ ID NO: 480675 - DNA, 25 bp, Rattus norvegicus
gtactggttctgcatatcttctttg

SEQ ID NO: 480676 - DNA, 25 bp, Rattus norvegicus
gtactggttctggatatcttctttg

SEQ ID NO: 480677 - DNA, 25 bp, Rattus norvegicus
gtactggttctgtgttgatggcccc

SEQ ID NO: 480678 - DNA, 25 bp, Rattus norvegicus
gtactgtaactacggcttttcatat

SEQ ID NO: 480679 - DNA, 25 bp, Rattus norvegicus
gtactgtaactagggcttttcatat

SEQ ID NO: 480680 - DNA, 25 bp, Rattus norvegicus
gtactgtaagatcatgcactcacct

SEQ ID NO: 480681 - DNA, 25 bp, Rattus norvegicus
gtactgtaagatgatgcactcacct

SEQ ID NO: 480682 - DNA, 25 bp, Rattus norvegicus
gtactgtaagtacgtctgccttatg

SEQ ID NO: 480683 - DNA, 25 bp, Rattus norvegicus
gtactgtaagtaggtctgccttatg

SEQ ID NO: 480684 - DNA, 25 bp, Rattus norvegicus
gtactgtaatacatctgctggtcct

SEQ ID NO: 480685 - DNA, 25 bp, Rattus norvegicus
gtactgtaatacttctgctggtcct

SEQ ID NO: 480686 - DNA, 25 bp, Rattus norvegicus
gtactgtaatccaacctaagcaggt

SEQ ID NO: 480687 - DNA, 25 bp, Rattus norvegicus
gtactgtaatcctacctaagcaggt

SEQ ID NO: 480688 - DNA, 25 bp, Rattus norvegicus
gtactgtacagtcctcatatactat

SEQ ID NO: 480689 - DNA, 25 bp, Rattus norvegicus
gtactgtacagtgctcatatactat

SEQ ID NO: 480690 - DNA, 25 bp, Rattus norvegicus
gtactgtacatcaattaaagcctta

SEQ ID NO: 480691 - DNA, 25 bp, Rattus norvegicus
gtactgtacatcattttactttaga

SEQ ID NO: 480692 - DNA, 25 bp, Rattus norvegicus
gtactgtacatctattaaagcctta

SEQ ID NO: 480693 - DNA, 25 bp, Rattus norvegicus
gtactgtacatctttttactttaga

SEQ ID NO: 480694 - DNA, 25 bp, Rattus norvegicus
gtactgtacattcactaaggctcct

SEQ ID NO: 480695 - DNA, 25 bp, Rattus norvegicus
gtactgtacattgactaaggctcct

SEQ ID NO: 480696 - DNA, 25 bp, Rattus norvegicus
gtactgtactccagagctgttatgt

SEQ ID NO: 480697 - DNA, 25 bp, Rattus norvegicus
gtactgtactcctgagctgttatgt

SEQ ID NO: 480698 - DNA, 25 bp, Rattus norvegicus
gtactgtactgaagttctatggcac

SEQ ID NO: 480699 - DNA, 25 bp, Rattus norvegicus
gtactgtactgatgttctatggcac

SEQ ID NO: 480700 - DNA, 25 bp, Rattus norvegicus
gtactgtactggctgaaggtctgtt

SEQ ID NO: 480701 - DNA, 25 bp, Rattus norvegicus
gtactgtactgggtgaaggtctgtt

SEQ ID NO: 480702 - DNA, 25 bp, Rattus norvegicus
gtactgtagtacactgtgccagcag

SEQ ID NO: 480703 - DNA, 25 bp, Rattus norvegicus
gtactgtagtactctgtgccagcag

SEQ ID NO: 480704 - DNA, 25 bp, Rattus norvegicus
gtactgtagtctcgtagtgcctcaa

SEQ ID NO: 480705 - DNA, 25 bp, Rattus norvegicus
gtactgtagtctggtagtgcctcaa

SEQ ID NO: 480706 - DNA, 25 bp, Rattus norvegicus
gtactgtatatactttacccaagtg

SEQ ID NO: 480707 - DNA, 25 bp, Rattus norvegicus
gtactgtatatagtttacccaagtg

SEQ ID NO: 480708 - DNA, 25 bp, Rattus norvegicus
gtactgtatccacatgccagccaat

SEQ ID NO: 480709 - DNA, 25 bp, Rattus norvegicus
gtactgtatccagatgccagccaat

SEQ ID NO: 480710 - DNA, 25 bp, Rattus norvegicus
gtactgtatgtactcatgcactttg

SEQ ID NO: 480711 - DNA, 25 bp, Rattus norvegicus
gtactgtatgtagtcatgcactttg

SEQ ID NO: 480712 - DNA, 25 bp, Rattus norvegicus
gtactgtatgttactctactgtatg

SEQ ID NO: 480713 - DNA, 25 bp, Rattus norvegicus
gtactgtatgtttctctactgtatg

SEQ ID NO: 480714 - DNA, 25 bp, Rattus norvegicus
gtactgtattttaccttgcagatat

SEQ ID NO: 480715 - DNA, 25 bp, Rattus norvegicus
gtactgtatttttccttgcagatat

SEQ ID NO: 480716 - DNA, 25 bp, Rattus norvegicus
gtactgtcacttcataaagcatctc

SEQ ID NO: 480717 - DNA, 25 bp, Rattus norvegicus
gtactgtcacttgataaagcatctc

SEQ ID NO: 480718 - DNA, 25 bp, Rattus norvegicus
gtactgtcagcgatttgggtgctcc

SEQ ID NO: 480719 - DNA, 25 bp, Rattus norvegicus
gtactgtcagcgttttgggtgctcc

SEQ ID NO: 480720 - DNA, 25 bp, Rattus norvegicus
gtactgtcatctctcatcagctcag

SEQ ID NO: 480721 - DNA, 25 bp, Rattus norvegicus
gtactgtcatctgtcatcagctcag

SEQ ID NO: 480722 - DNA, 25 bp, Rattus norvegicus
gtactgtccagacgccttgtatgaa

SEQ ID NO: 480723 - DNA, 25 bp, Rattus norvegicus
gtactgtccagaggccttgtatgaa

SEQ ID NO: 480724 - DNA, 25 bp, Rattus norvegicus
gtactgtccctcatttctgaaacat

SEQ ID NO: 480725 - DNA, 25 bp, Rattus norvegicus
gtactgtccctcttttctgaaacat

SEQ ID NO: 480726 - DNA, 25 bp, Rattus norvegicus
gtactgtcccttatacctatggcaa

SEQ ID NO: 480727 - DNA, 25 bp, Rattus norvegicus
gtactgtcccttttacctatggcaa

SEQ ID NO: 480728 - DNA, 25 bp, Rattus norvegicus
gtactgtcgtagctgttttactctg

SEQ ID NO: 480729 - DNA, 25 bp, Rattus norvegicus
gtactgtcgtaggtgttttactctg

SEQ ID NO: 480730 - DNA, 25 bp, Rattus norvegicus
gtactgtctactaaacgtggctgct

SEQ ID NO: 480731 - DNA, 25 bp, Rattus norvegicus
gtactgtctacttaacgtggctgct

SEQ ID NO: 480732 - DNA, 25 bp, Rattus norvegicus
gtactgtcttcacattggtcccaaa

SEQ ID NO: 480733 - DNA, 25 bp, Rattus norvegicus
gtactgtcttcagattggtcccaaa

SEQ ID NO: 480734 - DNA, 25 bp, Rattus norvegicus
gtactgtgaaagaccttctgctgtc

SEQ ID NO: 480735 - DNA, 25 bp, Rattus norvegicus
gtactgtgaaagtccttctgctgtc

SEQ ID NO: 480736 - DNA, 25 bp, Rattus norvegicus
gtactgtggaccattaacatttgtc

SEQ ID NO: 480737 - DNA, 25 bp, Rattus norvegicus
gtactgtggacctttaacatttgtc

SEQ ID NO: 480738 - DNA, 25 bp, Rattus norvegicus
gtactgtggtgccaggaccgccata

SEQ ID NO: 480739 - DNA, 25 bp, Rattus norvegicus
gtactgtggtgcgaggaccgccata

SEQ ID NO: 480740 - DNA, 25 bp, Rattus norvegicus
gtactgtgtaatagtgtaaactgtg

SEQ ID NO: 480741 - DNA, 25 bp, Rattus norvegicus
gtactgtgtaattgtgtaaactgtg

SEQ ID NO: 480742 - DNA, 25 bp, Rattus norvegicus
gtactgtgtactacaagtgtatatg

SEQ ID NO: 480743 - DNA, 25 bp, Rattus norvegicus
gtactgtgtacttcaagtgtatatg

SEQ ID NO: 480744 - DNA, 25 bp, Rattus norvegicus
gtactgtgtgatatgaactttttgt

SEQ ID NO: 480745 - DNA, 25 bp, Rattus norvegicus
gtactgtgtgatttgaactttttgt

SEQ ID NO: 480746 - DNA, 25 bp, Rattus norvegicus
gtactgtgtgtacaaaccattgctt

SEQ ID NO: 480747 - DNA, 25 bp, Rattus norvegicus
gtactgtgtgtagaaaccattgctt

SEQ ID NO: 480748 - DNA, 25 bp, Rattus norvegicus
gtactgtgtgtgaacatctggaagc

SEQ ID NO: 480749 - DNA, 25 bp, Rattus norvegicus
gtactgtgtgtgtacatctggaagc

SEQ ID NO: 480750 - DNA, 25 bp, Rattus norvegicus
gtactgtgtttaatactttcatttt

SEQ ID NO: 480751 - DNA, 25 bp, Rattus norvegicus
gtactgtgtttattactttcatttt

SEQ ID NO: 480752 - DNA, 25 bp, Rattus norvegicus
gtactgttcagcatgacctatagat

SEQ ID NO: 480753 - DNA, 25 bp, Rattus norvegicus
gtactgttcagcttgacctatagat

SEQ ID NO: 480754 - DNA, 25 bp, Rattus norvegicus
gtactgttctatctgatctacacat

SEQ ID NO: 480755 - DNA, 25 bp, Rattus norvegicus
gtactgttctatgtgatctacacat

SEQ ID NO: 480756 - DNA, 25 bp, Rattus norvegicus
gtactgttgcagagcgtagcattag

SEQ ID NO: 480757 - DNA, 25 bp, Rattus norvegicus
gtactgttgcagtgcgtagcattag

SEQ ID NO: 480758 - DNA, 25 bp, Rattus norvegicus
gtactgttgctgagttttgctgatt

SEQ ID NO: 480759 - DNA, 25 bp, Rattus norvegicus
gtactgttgctgtgttttgctgatt

SEQ ID NO: 480760 - DNA, 25 bp, Rattus norvegicus
gtactgttgtaaaatttttggtgtt

SEQ ID NO: 480761 - DNA, 25 bp, Rattus norvegicus
gtactgttgtaatatttttggtgtt

SEQ ID NO: 480762 - DNA, 25 bp, Rattus norvegicus
gtactgtttagtcaaccgagcccga

SEQ ID NO: 480763 - DNA, 25 bp, Rattus norvegicus
gtactgtttagtgaaccgagcccga

SEQ ID NO: 480764 - DNA, 25 bp, Rattus norvegicus
gtactgtttcatagccttcagggca

SEQ ID NO: 480765 - DNA, 25 bp, Rattus norvegicus
gtactgtttcattgccttcagggca

SEQ ID NO: 480766 - DNA, 25 bp, Rattus norvegicus
gtactgtttcgtctcagtggtctaa

SEQ ID NO: 480767 - DNA, 25 bp, Rattus norvegicus
gtactgtttcgtgtcagtggtctaa

SEQ ID NO: 480768 - DNA, 25 bp, Rattus norvegicus
gtactgtttgaaatcccactctgga

SEQ ID NO: 480769 - DNA, 25 bp, Rattus norvegicus
gtactgtttgaattcccactctgga

SEQ ID NO: 480770 - DNA, 25 bp, Rattus norvegicus
gtactgtttgatatacaccctattt

SEQ ID NO: 480771 - DNA, 25 bp, Rattus norvegicus
gtactgtttgatttacaccctattt

SEQ ID NO: 480772 - DNA, 25 bp, Rattus norvegicus
gtactgtttgttagtggatggctcc

SEQ ID NO: 480773 - DNA, 25 bp, Rattus norvegicus
gtactgtttgtttgtggatggctcc

SEQ ID NO: 480774 - DNA, 25 bp, Rattus norvegicus
gtacttaaaaaccttcatgatcatc

SEQ ID NO: 480775 - DNA, 25 bp, Rattus norvegicus
gtacttaaaaacgttcatgatcatc

SEQ ID NO: 480776 - DNA, 25 bp, Rattus norvegicus
gtacttaagattcacactgccaaaa

SEQ ID NO: 480777 - DNA, 25 bp, Rattus norvegicus
gtacttaagattgacactgccaaaa

SEQ ID NO: 480778 - DNA, 25 bp, Rattus norvegicus
gtacttaagcagcagagacccctga

SEQ ID NO: 480779 - DNA, 25 bp, Rattus norvegicus
gtacttaagcaggagagacccctga

SEQ ID NO: 480780 - DNA, 25 bp, Rattus norvegicus
gtacttaagcttagcagtcacaaca

SEQ ID NO: 480781 - DNA, 25 bp, Rattus norvegicus
gtacttaagctttgcagtcacaaca

SEQ ID NO: 480782 - DNA, 25 bp, Rattus norvegicus
gtacttaagttccactacagggact

SEQ ID NO: 480783 - DNA, 25 bp, Rattus norvegicus
gtacttaagttcgactacagggact

SEQ ID NO: 480784 - DNA, 25 bp, Rattus norvegicus
gtacttacagccacattcggacaat

SEQ ID NO: 480785 - DNA, 25 bp, Rattus norvegicus
gtacttacagccatcatcagtcagc

SEQ ID NO: 480786 - DNA, 25 bp, Rattus norvegicus
gtacttacagcctcattcggacaat

SEQ ID NO: 480787 - DNA, 25 bp, Rattus norvegicus
gtacttacagccttcatcagtcagc

SEQ ID NO: 480788 - DNA, 25 bp, Rattus norvegicus
gtacttacagtcacacacagggctt

SEQ ID NO: 480789 - DNA, 25 bp, Rattus norvegicus
gtacttacagtctcacacagggctt

SEQ ID NO: 480790 - DNA, 25 bp, Rattus norvegicus
gtacttaccaagatcagcctgggtg

SEQ ID NO: 480791 - DNA, 25 bp, Rattus norvegicus
gtacttaccaagttcagcctgggtg

SEQ ID NO: 480792 - DNA, 25 bp, Rattus norvegicus
gtacttaccactctagttcctggac

SEQ ID NO: 480793 - DNA, 25 bp, Rattus norvegicus
gtacttaccactgtagttcctggac

SEQ ID NO: 480794 - DNA, 25 bp, Rattus norvegicus
gtacttacctaacgttgctctttgg

SEQ ID NO: 480795 - DNA, 25 bp, Rattus norvegicus
gtacttacctaaggttgctctttgg

SEQ ID NO: 480796 - DNA, 25 bp, Rattus norvegicus
gtacttactaagctgtctgagggtt

SEQ ID NO: 480797 - DNA, 25 bp, Rattus norvegicus
gtacttactaaggtgtctgagggtt

SEQ ID NO: 480798 - DNA, 25 bp, Rattus norvegicus
gtacttactgcgaagttggagtcaa

SEQ ID NO: 480799 - DNA, 25 bp, Rattus norvegicus
gtacttactgcgtagttggagtcaa

SEQ ID NO: 480800 - DNA, 25 bp, Rattus norvegicus
gtacttagagacctggcagtgccct

SEQ ID NO: 480801 - DNA, 25 bp, Rattus norvegicus
gtacttagagacgtggcagtgccct

SEQ ID NO: 480802 - DNA, 25 bp, Rattus norvegicus
gtacttaggcatagtagggtcctga

SEQ ID NO: 480803 - DNA, 25 bp, Rattus norvegicus
gtacttaggcattgtagggtcctga

SEQ ID NO: 480804 - DNA, 25 bp, Rattus norvegicus
gtacttaggcttattctctgagaac

SEQ ID NO: 480805 - DNA, 25 bp, Rattus norvegicus
gtacttaggctttttctctgagaac

SEQ ID NO: 480806 - DNA, 25 bp, Rattus norvegicus
gtacttagggttctgttgagactca

SEQ ID NO: 480807 - DNA, 25 bp, Rattus norvegicus
gtacttagggttgtgttgagactca

SEQ ID NO: 480808 - DNA, 25 bp, Rattus norvegicus
gtacttagtaaaatgcagggtccct

SEQ ID NO: 480809 - DNA, 25 bp, Rattus norvegicus
gtacttagtaaattgcagggtccct

SEQ ID NO: 480810 - DNA, 25 bp, Rattus norvegicus
gtacttagtctaaagtcctctcatc

SEQ ID NO: 480811 - DNA, 25 bp, Rattus norvegicus
gtacttagtctatagtcctctcatc

SEQ ID NO: 480812 - DNA, 25 bp, Rattus norvegicus
gtacttatccaaaagtcagctctta

SEQ ID NO: 480813 - DNA, 25 bp, Rattus norvegicus
gtacttatccaatagtcagctctta

SEQ ID NO: 480814 - DNA, 25 bp, Rattus norvegicus
gtacttatccctagatagcattagg

SEQ ID NO: 480815 - DNA, 25 bp, Rattus norvegicus
gtacttatcccttgatagcattagg

SEQ ID NO: 480816 - DNA, 25 bp, Rattus norvegicus
gtacttatctccaacaggacaccta

SEQ ID NO: 480817 - DNA, 25 bp, Rattus norvegicus
gtacttatctcctacaggacaccta

SEQ ID NO: 480818 - DNA, 25 bp, Rattus norvegicus
gtacttatgcagcacgctttcaaac

SEQ ID NO: 480819 - DNA, 25 bp, Rattus norvegicus
gtacttatgcaggacgctttcaaac

SEQ ID NO: 480820 - DNA, 25 bp, Rattus norvegicus
gtacttatgtggagagagatcctct

SEQ ID NO: 480821 - DNA, 25 bp, Rattus norvegicus
gtacttatgtggtgagagatcctct

SEQ ID NO: 480822 - DNA, 25 bp, Rattus norvegicus
gtacttatttaaatcttcttcacgc

SEQ ID NO: 480823 - DNA, 25 bp, Rattus norvegicus
gtacttatttaattcttcttcacgc

SEQ ID NO: 480824 - DNA, 25 bp, Rattus norvegicus
gtacttatttgcacctattttcaga

SEQ ID NO: 480825 - DNA, 25 bp, Rattus norvegicus
gtacttatttgctcctattttcaga

SEQ ID NO: 480826 - DNA, 25 bp, Rattus norvegicus
gtacttattttcattgctgatgcta

SEQ ID NO: 480827 - DNA, 25 bp, Rattus norvegicus
gtacttattttctttgctgatgcta

SEQ ID NO: 480828 - DNA, 25 bp, Rattus norvegicus
gtacttcaactacacggcgggcaga

SEQ ID NO: 480829 - DNA, 25 bp, Rattus norvegicus
gtacttcaactagacggcgggcaga

SEQ ID NO: 480830 - DNA, 25 bp, Rattus norvegicus
gtacttcaatgtatattactgtggt

SEQ ID NO: 480831 - DNA, 25 bp, Rattus norvegicus
gtacttcaatgtcctcatcaacctg

SEQ ID NO: 480832 - DNA, 25 bp, Rattus norvegicus
gtacttcaatgtgctcatcaacctg

SEQ ID NO: 480833 - DNA, 25 bp, Rattus norvegicus
gtacttcaatgtttattactgtggt

SEQ ID NO: 480834 - DNA, 25 bp, Rattus norvegicus
gtacttcacacactgggacaaaatg

SEQ ID NO: 480835 - DNA, 25 bp, Rattus norvegicus
gtacttcacacagtgggacaaaatg

SEQ ID NO: 480836 - DNA, 25 bp, Rattus norvegicus
gtacttcagaatatatttccaccca

SEQ ID NO: 480837 - DNA, 25 bp, Rattus norvegicus
gtacttcagaatttatttccaccca

SEQ ID NO: 480838 - DNA, 25 bp, Rattus norvegicus
gtacttcagcccattcacaattgaa

SEQ ID NO: 480839 - DNA, 25 bp, Rattus norvegicus
gtacttcagccctttcacaattgaa

SEQ ID NO: 480840 - DNA, 25 bp, Rattus norvegicus
gtacttcagcgactgtaacaagtgt

SEQ ID NO: 480841 - DNA, 25 bp, Rattus norvegicus
gtacttcagcgagtgtaacaagtgt

SEQ ID NO: 480842 - DNA, 25 bp, Rattus norvegicus
gtacttcatggtattttgccatatg

SEQ ID NO: 480843 - DNA, 25 bp, Rattus norvegicus
gtacttcatggttttttgccatatg

SEQ ID NO: 480844 - DNA, 25 bp, Rattus norvegicus
gtacttcattggacctactgtggat

SEQ ID NO: 480845 - DNA, 25 bp, Rattus norvegicus
gtacttcattggtcctactgtggat

SEQ ID NO: 480846 - DNA, 25 bp, Rattus norvegicus
gtacttccagaaccaccagacatag

SEQ ID NO: 480847 - DNA, 25 bp, Rattus norvegicus
gtacttccagaagcaccagacatag

SEQ ID NO: 480848 - DNA, 25 bp, Rattus norvegicus
gtacttccagtacccattttccaaa

SEQ ID NO: 480849 - DNA, 25 bp, Rattus norvegicus
gtacttccagtagccattttccaaa

SEQ ID NO: 480850 - DNA, 25 bp, Rattus norvegicus
gtacttcccacaagactaactcaga

SEQ ID NO: 480851 - DNA, 25 bp, Rattus norvegicus
gtacttcccacatgactaactcaga

SEQ ID NO: 480852 - DNA, 25 bp, Rattus norvegicus
gtacttcccagacctacacatggtg

SEQ ID NO: 480853 - DNA, 25 bp, Rattus norvegicus
gtacttcccagagctacacatggtg

SEQ ID NO: 480854 - DNA, 25 bp, Rattus norvegicus
gtacttcccatactcctttgaaaga

SEQ ID NO: 480855 - DNA, 25 bp, Rattus norvegicus
gtacttcccatagtcctttgaaaga

SEQ ID NO: 480856 - DNA, 25 bp, Rattus norvegicus
gtacttccctagaatgggcaatgcc

SEQ ID NO: 480857 - DNA, 25 bp, Rattus norvegicus
gtacttccctagtatgggcaatgcc

SEQ ID NO: 480858 - DNA, 25 bp, Rattus norvegicus
gtacttccggaacctgtgctcagat

SEQ ID NO: 480859 - DNA, 25 bp, Rattus norvegicus
gtacttccggaagctgtgctcagat

SEQ ID NO: 480860 - DNA, 25 bp, Rattus norvegicus
gtacttccgtcaaagtggtgtgcct

SEQ ID NO: 480861 - DNA, 25 bp, Rattus norvegicus
gtacttccgtcatagtggtgtgcct

SEQ ID NO: 480862 - DNA, 25 bp, Rattus norvegicus
gtacttcctctgagaactgtttgtg

SEQ ID NO: 480863 - DNA, 25 bp, Rattus norvegicus
gtacttcctctgtgaactgtttgtg

SEQ ID NO: 480864 - DNA, 25 bp, Rattus norvegicus
gtacttcctgtcataagcatctttg

SEQ ID NO: 480865 - DNA, 25 bp, Rattus norvegicus
gtacttcctgtcttaagcatctttg

SEQ ID NO: 480866 - DNA, 25 bp, Rattus norvegicus
gtacttcgagatcacgcacaatgtg

SEQ ID NO: 480867 - DNA, 25 bp, Rattus norvegicus
gtacttcgagatgacgcacaatgtg

SEQ ID NO: 480868 - DNA, 25 bp, Rattus norvegicus
gtacttcgcttaccaagtccaagtg

SEQ ID NO: 480869 - DNA, 25 bp, Rattus norvegicus
gtacttcgcttagcaagtccaagtg

SEQ ID NO: 480870 - DNA, 25 bp, Rattus norvegicus
gtacttcgtattcagaggtcacaca

SEQ ID NO: 480871 - DNA, 25 bp, Rattus norvegicus
gtacttcgtattgagaggtcacaca

SEQ ID NO: 480872 - DNA, 25 bp, Rattus norvegicus
gtacttctcccacgaggagtggatg

SEQ ID NO: 480873 - DNA, 25 bp, Rattus norvegicus
gtacttctcccaggaggagtggatg

SEQ ID NO: 480874 - DNA, 25 bp, Rattus norvegicus
gtacttctctgtcgatccggatagc

SEQ ID NO: 480875 - DNA, 25 bp, Rattus norvegicus
gtacttctctgtggatccggatagc

SEQ ID NO: 480876 - DNA, 25 bp, Rattus norvegicus
gtacttctgcaaaattcctctcatt

SEQ ID NO: 480877 - DNA, 25 bp, Rattus norvegicus
gtacttctgcaaacctctatactca

SEQ ID NO: 480878 - DNA, 25 bp, Rattus norvegicus
gtacttctgcaatattcctctcatt

SEQ ID NO: 480879 - DNA, 25 bp, Rattus norvegicus
gtacttctgcaatcctctatactca

SEQ ID NO: 480880 - DNA, 25 bp, Rattus norvegicus
gtacttctgcttcaatgtctccagt

SEQ ID NO: 480881 - DNA, 25 bp, Rattus norvegicus
gtacttctgcttgaatgtctccagt

SEQ ID NO: 480882 - DNA, 25 bp, Rattus norvegicus
gtacttctggaacggcttggctgct

SEQ ID NO: 480883 - DNA, 25 bp, Rattus norvegicus
gtacttctggaagggcttggctgct

SEQ ID NO: 480884 - DNA, 25 bp, Rattus norvegicus
gtacttctggataagcttgcttggc

SEQ ID NO: 480885 - DNA, 25 bp, Rattus norvegicus
gtacttctggattagcttgcttggc

SEQ ID NO: 480886 - DNA, 25 bp, Rattus norvegicus
gtacttctggcgaagtcctattaaa

SEQ ID NO: 480887 - DNA, 25 bp, Rattus norvegicus
gtacttctggcgtagtcctattaaa

SEQ ID NO: 480888 - DNA, 25 bp, Rattus norvegicus
gtacttcttaccatggaacctggat

SEQ ID NO: 480889 - DNA, 25 bp, Rattus norvegicus
gtacttcttaccttggaacctggat

SEQ ID NO: 480890 - DNA, 25 bp, Rattus norvegicus
gtacttcttcccaaaagtctgactt

SEQ ID NO: 480891 - DNA, 25 bp, Rattus norvegicus
gtacttcttccctaaagtctgactt

SEQ ID NO: 480892 - DNA, 25 bp, Rattus norvegicus
gtacttctttgtcgttgtctatggt

SEQ ID NO: 480893 - DNA, 25 bp, Rattus norvegicus
gtacttctttgtggttgtctatggt

SEQ ID NO: 480894 - DNA, 25 bp, Rattus norvegicus
gtacttgaaactcagctgacatcag

SEQ ID NO: 480895 - DNA, 25 bp, Rattus norvegicus
gtacttgaaactgagctgacatcag

SEQ ID NO: 480896 - DNA, 25 bp, Rattus norvegicus
gtacttgacttaactttattgcaat

SEQ ID NO: 480897 - DNA, 25 bp, Rattus norvegicus
gtacttgacttatctttattgcaat

SEQ ID NO: 480898 - DNA, 25 bp, Rattus norvegicus
gtacttgagctgattgtgtaatgca

SEQ ID NO: 480899 - DNA, 25 bp, Rattus norvegicus
gtacttgagctgtttgtgtaatgca

SEQ ID NO: 480900 - DNA, 25 bp, Rattus norvegicus
gtacttgaggtaagtaccatttgta

SEQ ID NO: 480901 - DNA, 25 bp, Rattus norvegicus
gtacttgaggtatgtaccatttgta

SEQ ID NO: 480902 - DNA, 25 bp, Rattus norvegicus
gtacttgagtttatgtgcatatact

SEQ ID NO: 480903 - DNA, 25 bp, Rattus norvegicus
gtacttgagtttttgtgcatatact

SEQ ID NO: 480904 - DNA, 25 bp, Rattus norvegicus
gtacttgataatatcccagaagggt

SEQ ID NO: 480905 - DNA, 25 bp, Rattus norvegicus
gtacttgataatttcccagaagggt

SEQ ID NO: 480906 - DNA, 25 bp, Rattus norvegicus
gtacttgataccatctccatgagca

SEQ ID NO: 480907 - DNA, 25 bp, Rattus norvegicus
gtacttgataccttctccatgagca

SEQ ID NO: 480908 - DNA, 25 bp, Rattus norvegicus
gtacttgatcgcagagaagccgtct

SEQ ID NO: 480909 - DNA, 25 bp, Rattus norvegicus
gtacttgatcgctgagaagccgtct

SEQ ID NO: 480910 - DNA, 25 bp, Rattus norvegicus
gtacttgcaatgacatctggccaaa

SEQ ID NO: 480911 - DNA, 25 bp, Rattus norvegicus
gtacttgcaatgtcatctggccaaa

SEQ ID NO: 480912 - DNA, 25 bp, Rattus norvegicus
gtacttgccaacctttcattgttat

SEQ ID NO: 480913 - DNA, 25 bp, Rattus norvegicus
gtacttgccaacgtttcattgttat

SEQ ID NO: 480914 - DNA, 25 bp, Rattus norvegicus
gtacttgccaagcactttattctat

SEQ ID NO: 480915 - DNA, 25 bp, Rattus norvegicus
gtacttgccaaggactttattctat

SEQ ID NO: 480916 - DNA, 25 bp, Rattus norvegicus
gtacttgccctaactgcgtgggaca

SEQ ID NO: 480917 - DNA, 25 bp, Rattus norvegicus
gtacttgccctatctgcgtgggaca

SEQ ID NO: 480918 - DNA, 25 bp, Rattus norvegicus
gtacttgcctgtaaagacttcatga

SEQ ID NO: 480919 - DNA, 25 bp, Rattus norvegicus
gtacttgcctgttaagacttcatga

SEQ ID NO: 480920 - DNA, 25 bp, Rattus norvegicus
gtacttgctgaaatcatccatttct

SEQ ID NO: 480921 - DNA, 25 bp, Rattus norvegicus
gtacttgctgaattcatccatttct

SEQ ID NO: 480922 - DNA, 25 bp, Rattus norvegicus
gtacttgctgatcatccttctacaa

SEQ ID NO: 480923 - DNA, 25 bp, Rattus norvegicus
gtacttgctgatgatccttctacaa

SEQ ID NO: 480924 - DNA, 25 bp, Rattus norvegicus
gtacttgctgtcactggcggagcca

SEQ ID NO: 480925 - DNA, 25 bp, Rattus norvegicus
gtacttgctgtctctggcggagcca

SEQ ID NO: 480926 - DNA, 25 bp, Rattus norvegicus
gtacttgcttatcttgttcgttttg

SEQ ID NO: 480927 - DNA, 25 bp, Rattus norvegicus
gtacttgcttatgttgttcgttttg

SEQ ID NO: 480928 - DNA, 25 bp, Rattus norvegicus
gtacttgcttctatgaggtcatttt

SEQ ID NO: 480929 - DNA, 25 bp, Rattus norvegicus
gtacttgcttctttgaggtcatttt

SEQ ID NO: 480930 - DNA, 25 bp, Rattus norvegicus
gtacttggcacacgctcgaagctga

SEQ ID NO: 480931 - DNA, 25 bp, Rattus norvegicus
gtacttggcacaggctcgaagctga

SEQ ID NO: 480932 - DNA, 25 bp, Rattus norvegicus
gtacttggcatcctagtgacacagt

SEQ ID NO: 480933 - DNA, 25 bp, Rattus norvegicus
gtacttggcatcgtagtgacacagt

SEQ ID NO: 480934 - DNA, 25 bp, Rattus norvegicus
gtacttggcctcactccaataaagg

SEQ ID NO: 480935 - DNA, 25 bp, Rattus norvegicus
gtacttggcctctctccaataaagg

SEQ ID NO: 480936 - DNA, 25 bp, Rattus norvegicus
gtacttggtaatatcacctcttcgg

SEQ ID NO: 480937 - DNA, 25 bp, Rattus norvegicus
gtacttggtaatttcacctcttcgg

SEQ ID NO: 480938 - DNA, 25 bp, Rattus norvegicus
gtacttggtgtgaggccaggcccaa

SEQ ID NO: 480939 - DNA, 25 bp, Rattus norvegicus
gtacttggtgtgtggccaggcccaa

SEQ ID NO: 480940 - DNA, 25 bp, Rattus norvegicus
gtacttggttctatctaccatggga

SEQ ID NO: 480941 - DNA, 25 bp, Rattus norvegicus
gtacttggttctttctaccatggga

SEQ ID NO: 480942 - DNA, 25 bp, Rattus norvegicus
gtacttggttgtatggttagcctat

SEQ ID NO: 480943 - DNA, 25 bp, Rattus norvegicus
gtacttggttgtttggttagcctat

SEQ ID NO: 480944 - DNA, 25 bp, Rattus norvegicus
gtacttgtacacaggcacgtgcatc

SEQ ID NO: 480945 - DNA, 25 bp, Rattus norvegicus
gtacttgtacactggcacgtgcatc

SEQ ID NO: 480946 - DNA, 25 bp, Rattus norvegicus
gtacttgtactcatgtacactccca

SEQ ID NO: 480947 - DNA, 25 bp, Rattus norvegicus
gtacttgtactcttgtacactccca

SEQ ID NO: 480948 - DNA, 25 bp, Rattus norvegicus
gtacttgtccaacctgtatatatca

SEQ ID NO: 480949 - DNA, 25 bp, Rattus norvegicus
gtacttgtccaagctgtatatatca

SEQ ID NO: 480950 - DNA, 25 bp, Rattus norvegicus
gtacttgtgatcacctgttggtata

SEQ ID NO: 480951 - DNA, 25 bp, Rattus norvegicus
gtacttgtgatctcctgttggtata

SEQ ID NO: 480952 - DNA, 25 bp, Rattus norvegicus
gtacttgtgcctagactagcacctt

SEQ ID NO: 480953 - DNA, 25 bp, Rattus norvegicus
gtacttgtgccttgactagcacctt

SEQ ID NO: 480954 - DNA, 25 bp, Rattus norvegicus
gtacttgtgcgtctgatagggataa

SEQ ID NO: 480955 - DNA, 25 bp, Rattus norvegicus
gtacttgtgcgtgtgatagggataa

SEQ ID NO: 480956 - DNA, 25 bp, Rattus norvegicus
gtacttgtgctaatagtgactacat

SEQ ID NO: 480957 - DNA, 25 bp, Rattus norvegicus
gtacttgtgctattagtgactacat

SEQ ID NO: 480958 - DNA, 25 bp, Rattus norvegicus
gtacttgtggttctcgagcctaagc

SEQ ID NO: 480959 - DNA, 25 bp, Rattus norvegicus
gtacttgtggttgtcgagcctaagc

SEQ ID NO: 480960 - DNA, 25 bp, Rattus norvegicus
gtacttgtgtacctgcatgtatgtg

SEQ ID NO: 480961 - DNA, 25 bp, Rattus norvegicus
gtacttgtgtacgtgcatgtatgtg

SEQ ID NO: 480962 - DNA, 25 bp, Rattus norvegicus
gtacttgtgtagctgattgttcatg

SEQ ID NO: 480963 - DNA, 25 bp, Rattus norvegicus
gtacttgtgtaggtgattgttcatg

SEQ ID NO: 480964 - DNA, 25 bp, Rattus norvegicus
gtacttgttactctgctttgggaaa

SEQ ID NO: 480965 - DNA, 25 bp, Rattus norvegicus
gtacttgttactgtgctttgggaaa

SEQ ID NO: 480966 - DNA, 25 bp, Rattus norvegicus
gtacttgttcagctacaaattcgaa

SEQ ID NO: 480967 - DNA, 25 bp, Rattus norvegicus
gtacttgttcaggtacaaattcgaa

SEQ ID NO: 480968 - DNA, 25 bp, Rattus norvegicus
gtacttgttctacacttactaccca

SEQ ID NO: 480969 - DNA, 25 bp, Rattus norvegicus
gtacttgttctagacttactaccca

SEQ ID NO: 480970 - DNA, 25 bp, Rattus norvegicus
gtacttgttgcacccgacgtcgaag

SEQ ID NO: 480971 - DNA, 25 bp, Rattus norvegicus
gtacttgttgcagccgacgtcgaag

SEQ ID NO: 480972 - DNA, 25 bp, Rattus norvegicus
gtacttgttggaacccacatcgaag

SEQ ID NO: 480973 - DNA, 25 bp, Rattus norvegicus
gtacttgttggatcccacatcgaag

SEQ ID NO: 480974 - DNA, 25 bp, Rattus norvegicus
gtactttaattcagctgtttcatga

SEQ ID NO: 480975 - DNA, 25 bp, Rattus norvegicus
gtactttaattctgctgtttcatga

SEQ ID NO: 480976 - DNA, 25 bp, Rattus norvegicus
gtactttacatcacacttgtgtgtg

SEQ ID NO: 480977 - DNA, 25 bp, Rattus norvegicus
gtactttacatctcacttgtgtgtg

SEQ ID NO: 480978 - DNA, 25 bp, Rattus norvegicus
gtactttaccctagacagcacatgt

SEQ ID NO: 480979 - DNA, 25 bp, Rattus norvegicus
gtactttacccttgacagcacatgt

SEQ ID NO: 480980 - DNA, 25 bp, Rattus norvegicus
gtactttactacactaggattagat

SEQ ID NO: 480981 - DNA, 25 bp, Rattus norvegicus
gtactttactactctaggattagat

SEQ ID NO: 480982 - DNA, 25 bp, Rattus norvegicus
gtactttaggccacctatatccagt

SEQ ID NO: 480983 - DNA, 25 bp, Rattus norvegicus
gtactttaggcctcctatatccagt

SEQ ID NO: 480984 - DNA, 25 bp, Rattus norvegicus
gtactttagtatattcaccatttgt

SEQ ID NO: 480985 - DNA, 25 bp, Rattus norvegicus
gtactttagtattttcaccatttgt

SEQ ID NO: 480986 - DNA, 25 bp, Rattus norvegicus
gtactttattttcttcagcctaatt

SEQ ID NO: 480987 - DNA, 25 bp, Rattus norvegicus
gtactttattttgttcagcctaatt

SEQ ID NO: 480988 - DNA, 25 bp, Rattus norvegicus
gtactttcattgcttgtcctcacag

SEQ ID NO: 480989 - DNA, 25 bp, Rattus norvegicus
gtactttcattggttgtcctcacag

SEQ ID NO: 480990 - DNA, 25 bp, Rattus norvegicus
gtactttcccaacgatgcacaggct

SEQ ID NO: 480991 - DNA, 25 bp, Rattus norvegicus
gtactttcccaaggatgcacaggct

SEQ ID NO: 480992 - DNA, 25 bp, Rattus norvegicus
gtactttctagaacttgtcaagctg

SEQ ID NO: 480993 - DNA, 25 bp, Rattus norvegicus
gtactttctagatcttgtcaagctg

SEQ ID NO: 480994 - DNA, 25 bp, Rattus norvegicus
gtactttctcccattcattaggaat

SEQ ID NO: 480995 - DNA, 25 bp, Rattus norvegicus
gtactttctccctttcattaggaat

SEQ ID NO: 480996 - DNA, 25 bp, Rattus norvegicus
gtactttctgttaatgcacgattgt

SEQ ID NO: 480997 - DNA, 25 bp, Rattus norvegicus
gtactttctgtttatgcacgattgt

SEQ ID NO: 480998 - DNA, 25 bp, Rattus norvegicus
gtactttcttaaagcctttgttgga

SEQ ID NO: 480999 - DNA, 25 bp, Rattus norvegicus
gtactttcttaatgcctttgttgga

SEQ ID NO: 481000 - DNA, 25 bp, Rattus norvegicus
gtactttcttacagcatttctgtgg

SEQ ID NO: 481001 - DNA, 25 bp, Rattus norvegicus
gtactttcttactgcatttctgtgg

SEQ ID NO: 481002 - DNA, 25 bp, Rattus norvegicus
gtactttcttagcacttatgagcct

SEQ ID NO: 481003 - DNA, 25 bp, Rattus norvegicus
gtactttcttaggacttatgagcct

SEQ ID NO: 481004 - DNA, 25 bp, Rattus norvegicus
gtactttcttctcattgtgcagcga

SEQ ID NO: 481005 - DNA, 25 bp, Rattus norvegicus
gtactttcttctgattgtgcagcga

SEQ ID NO: 481006 - DNA, 25 bp, Rattus norvegicus
gtactttgaacactgccatttgctt

SEQ ID NO: 481007 - DNA, 25 bp, Rattus norvegicus
gtactttgaacagtgccatttgctt

SEQ ID NO: 481008 - DNA, 25 bp, Rattus norvegicus
gtactttgactcagaacttgagctt

SEQ ID NO: 481009 - DNA, 25 bp, Rattus norvegicus
gtactttgactctgaacttgagctt

SEQ ID NO: 481010 - DNA, 25 bp, Rattus norvegicus
gtactttgatagatttggtcaccga

SEQ ID NO: 481011 - DNA, 25 bp, Rattus norvegicus
gtactttgatagttttggtcaccga

SEQ ID NO: 481012 - DNA, 25 bp, Rattus norvegicus
gtactttgatcgaattcactcccta

SEQ ID NO: 481013 - DNA, 25 bp, Rattus norvegicus
gtactttgatcgtattcactcccta

SEQ ID NO: 481014 - DNA, 25 bp, Rattus norvegicus
gtactttgcacaacacacaccgaga

SEQ ID NO: 481015 - DNA, 25 bp, Rattus norvegicus
gtactttgcacatcacacaccgaga

SEQ ID NO: 481016 - DNA, 25 bp, Rattus norvegicus
gtactttgcagtcatactagtggtt

SEQ ID NO: 481017 - DNA, 25 bp, Rattus norvegicus
gtactttgcagtgatactagtggtt

SEQ ID NO: 481018 - DNA, 25 bp, Rattus norvegicus
gtactttgcatacgtgtgtgtgcac

SEQ ID NO: 481019 - DNA, 25 bp, Rattus norvegicus
gtactttgcataggtgtgtgtgcac

SEQ ID NO: 481020 - DNA, 25 bp, Rattus norvegicus
gtactttgctgcctctttaagacta

SEQ ID NO: 481021 - DNA, 25 bp, Rattus norvegicus
gtactttgctgcgtctttaagacta

SEQ ID NO: 481022 - DNA, 25 bp, Rattus norvegicus
gtactttgcttgaaaggctggccag

SEQ ID NO: 481023 - DNA, 25 bp, Rattus norvegicus
gtactttgcttgtaaggctggccag

SEQ ID NO: 481024 - DNA, 25 bp, Rattus norvegicus
gtactttggcacatgtactccagta

SEQ ID NO: 481025 - DNA, 25 bp, Rattus norvegicus
gtactttggcacttgtactccagta

SEQ ID NO: 481026 - DNA, 25 bp, Rattus norvegicus
gtactttgtaaaactggttgcttac

SEQ ID NO: 481027 - DNA, 25 bp, Rattus norvegicus
gtactttgtaaatctggttgcttac

SEQ ID NO: 481028 - DNA, 25 bp, Rattus norvegicus
gtactttgtctgacttcactgctgt

SEQ ID NO: 481029 - DNA, 25 bp, Rattus norvegicus
gtactttgtctgtcttcactgctgt

SEQ ID NO: 481030 - DNA, 25 bp, Rattus norvegicus
gtacttttaccgcaggataccaagc

SEQ ID NO: 481031 - DNA, 25 bp, Rattus norvegicus
gtacttttaccggaggataccaagc

SEQ ID NO: 481032 - DNA, 25 bp, Rattus norvegicus
gtacttttactcatgctgatgtttt

SEQ ID NO: 481033 - DNA, 25 bp, Rattus norvegicus
gtacttttactcttgctgatgtttt

SEQ ID NO: 481034 - DNA, 25 bp, Rattus norvegicus
gtacttttacttaggtggctggaga

SEQ ID NO: 481035 - DNA, 25 bp, Rattus norvegicus
gtacttttactttggtggctggaga

SEQ ID NO: 481036 - DNA, 25 bp, Rattus norvegicus
gtacttttataaagctttctcctta

SEQ ID NO: 481037 - DNA, 25 bp, Rattus norvegicus
gtacttttataatgctttctcctta

SEQ ID NO: 481038 - DNA, 25 bp, Rattus norvegicus
gtacttttattgctctgaggcacac

SEQ ID NO: 481039 - DNA, 25 bp, Rattus norvegicus
gtacttttattggtctgaggcacac

SEQ ID NO: 481040 - DNA, 25 bp, Rattus norvegicus
gtacttttcctacggagctgctgga

SEQ ID NO: 481041 - DNA, 25 bp, Rattus norvegicus
gtacttttcctagggagctgctgga

SEQ ID NO: 481042 - DNA, 25 bp, Rattus norvegicus
gtacttttcgccattagcacatgtg

SEQ ID NO: 481043 - DNA, 25 bp, Rattus norvegicus
gtacttttcgcctttagcacatgtg

SEQ ID NO: 481044 - DNA, 25 bp, Rattus norvegicus
gtacttttctatcttttatttccag

SEQ ID NO: 481045 - DNA, 25 bp, Rattus norvegicus
gtacttttctatgttttatttccag

SEQ ID NO: 481046 - DNA, 25 bp, Rattus norvegicus
gtacttttgaatcgttgtccatatc

SEQ ID NO: 481047 - DNA, 25 bp, Rattus norvegicus
gtacttttgaatggttgtccatatc

SEQ ID NO: 481048 - DNA, 25 bp, Rattus norvegicus
gtacttttgcggattctatcagcct

SEQ ID NO: 481049 - DNA, 25 bp, Rattus norvegicus
gtacttttgcggtttctatcagcct

SEQ ID NO: 481050 - DNA, 25 bp, Rattus norvegicus
gtacttttggcgatggaagcgcttt

SEQ ID NO: 481051 - DNA, 25 bp, Rattus norvegicus
gtacttttggcgttggaagcgcttt

SEQ ID NO: 481052 - DNA, 25 bp, Rattus norvegicus
gtacttttggttaccagaacaccat

SEQ ID NO: 481053 - DNA, 25 bp, Rattus norvegicus
gtacttttggtttccagaacaccat

SEQ ID NO: 481054 - DNA, 25 bp, Rattus norvegicus
gtacttttgtccaggcttcaaggct

SEQ ID NO: 481055 - DNA, 25 bp, Rattus norvegicus
gtacttttgtcctggcttcaaggct

SEQ ID NO: 481056 - DNA, 25 bp, Rattus norvegicus
gtacttttgtggataatggaccaat

SEQ ID NO: 481057 - DNA, 25 bp, Rattus norvegicus
gtacttttgtggttaatggaccaat

SEQ ID NO: 481058 - DNA, 25 bp, Rattus norvegicus
gtactttttattccatggtgtgaac

SEQ ID NO: 481059 - DNA, 25 bp, Rattus norvegicus
gtactttttattgcatggtgtgaac

SEQ ID NO: 481060 - DNA, 25 bp, Rattus norvegicus
gtactttttctccttgatgcacaag

SEQ ID NO: 481061 - DNA, 25 bp, Rattus norvegicus
gtactttttctcgttgatgcacaag

SEQ ID NO: 481062 - DNA, 25 bp, Rattus norvegicus
gtactttttctgattcatattggac

SEQ ID NO: 481063 - DNA, 25 bp, Rattus norvegicus
gtactttttctgtttcatattggac

SEQ ID NO: 481064 - DNA, 25 bp, Rattus norvegicus
gtacttttttccagtgtaaatattg

SEQ ID NO: 481065 - DNA, 25 bp, Rattus norvegicus
gtacttttttcctgtgtaaatattg

SEQ ID NO: 481066 - DNA, 25 bp, Rattus norvegicus
gtacttttttgtcccgctgcagata

SEQ ID NO: 481067 - DNA, 25 bp, Rattus norvegicus
gtacttttttgtgccgctgcagata

SEQ ID NO: 481068 - DNA, 25 bp, Rattus norvegicus
gtagaaaagccaagtctccctcgtg

SEQ ID NO: 481069 - DNA, 25 bp, Rattus norvegicus
gtagaaaagccatgtctccctcgtg

SEQ ID NO: 481070 - DNA, 25 bp, Rattus norvegicus
gtagaaaagcggacccatccatatt

SEQ ID NO: 481071 - DNA, 25 bp, Rattus norvegicus
gtagaaaagcggtcccatccatatt

SEQ ID NO: 481072 - DNA, 25 bp, Rattus norvegicus
gtagaaaagctgaccccaggttcca

SEQ ID NO: 481073 - DNA, 25 bp, Rattus norvegicus
gtagaaaagctgtccccaggttcca

SEQ ID NO: 481074 - DNA, 25 bp, Rattus norvegicus
gtagaaaagggcctccatgtgccac

SEQ ID NO: 481075 - DNA, 25 bp, Rattus norvegicus
gtagaaaagggcgtccatgtgccac

SEQ ID NO: 481076 - DNA, 25 bp, Rattus norvegicus
gtagaaacacgtacactgcttctca

SEQ ID NO: 481077 - DNA, 25 bp, Rattus norvegicus
gtagaaacacgttcactgcttctca

SEQ ID NO: 481078 - DNA, 25 bp, Rattus norvegicus
gtagaaacagctcagagttcctctg

SEQ ID NO: 481079 - DNA, 25 bp, Rattus norvegicus
gtagaaacagctgagagttcctctg

SEQ ID NO: 481080 - DNA, 25 bp, Rattus norvegicus
gtagaaacccacagcttccgagcat

SEQ ID NO: 481081 - DNA, 25 bp, Rattus norvegicus
gtagaaacccactgcttccgagcat

SEQ ID NO: 481082 - DNA, 25 bp, Rattus norvegicus
gtagaaaccctcctgtcaaactctc

SEQ ID NO: 481083 - DNA, 25 bp, Rattus norvegicus
gtagaaaccctcgtgtcaaactctc

SEQ ID NO: 481084 - DNA, 25 bp, Rattus norvegicus
gtagaaactctaatttcacccaaag

SEQ ID NO: 481085 - DNA, 25 bp, Rattus norvegicus
gtagaaactctattttcacccaaag

SEQ ID NO: 481086 - DNA, 25 bp, Rattus norvegicus
gtagaaactggtcactgtctccatc

SEQ ID NO: 481087 - DNA, 25 bp, Rattus norvegicus
gtagaaactggtgactgtctccatc

SEQ ID NO: 481088 - DNA, 25 bp, Rattus norvegicus
gtagaaagatacaccttccttccgg

SEQ ID NO: 481089 - DNA, 25 bp, Rattus norvegicus
gtagaaagatactccttccttccgg

SEQ ID NO: 481090 - DNA, 25 bp, Rattus norvegicus
gtagaaagccataccgagtgaacat

SEQ ID NO: 481091 - DNA, 25 bp, Rattus norvegicus
gtagaaagccattccgagtgaacat

SEQ ID NO: 481092 - DNA, 25 bp, Rattus norvegicus
gtagaaagcctactgatcctctcac

SEQ ID NO: 481093 - DNA, 25 bp, Rattus norvegicus
gtagaaagcctagtgatcctctcac

SEQ ID NO: 481094 - DNA, 25 bp, Rattus norvegicus
gtagaaagcgctaatatccctagag

SEQ ID NO: 481095 - DNA, 25 bp, Rattus norvegicus
gtagaaagcgcttatatccctagag

SEQ ID NO: 481096 - DNA, 25 bp, Rattus norvegicus
gtagaaaggacaacacaggaacata

SEQ ID NO: 481097 - DNA, 25 bp, Rattus norvegicus
gtagaaaggacatcacaggaacata

SEQ ID NO: 481098 - DNA, 25 bp, Rattus norvegicus
gtagaaagtgccattaccgtccgag

SEQ ID NO: 481099 - DNA, 25 bp, Rattus norvegicus
gtagaaagtgcctttaccgtccgag

SEQ ID NO: 481100 - DNA, 25 bp, Rattus norvegicus
gtagaaatcatgaggctggcagcaa

SEQ ID NO: 481101 - DNA, 25 bp, Rattus norvegicus
gtagaaatcatgtggctggcagcaa

SEQ ID NO: 481102 - DNA, 25 bp, Rattus norvegicus
gtagaaatccatcacctacacccat

SEQ ID NO: 481103 - DNA, 25 bp, Rattus norvegicus
gtagaaatccatgacctacacccat

SEQ ID NO: 481104 - DNA, 25 bp, Rattus norvegicus
gtagaaatggttaatccatggcatt

SEQ ID NO: 481105 - DNA, 25 bp, Rattus norvegicus
gtagaaatggtttatccatggcatt

SEQ ID NO: 481106 - DNA, 25 bp, Rattus norvegicus
gtagaaattctgcttgctctgcccc

SEQ ID NO: 481107 - DNA, 25 bp, Rattus norvegicus
gtagaaattctggttgctctgcccc

SEQ ID NO: 481108 - DNA, 25 bp, Rattus norvegicus
gtagaacaagcacaactcacagaaa

SEQ ID NO: 481109 - DNA, 25 bp, Rattus norvegicus
gtagaacaagcagaactcacagaaa

SEQ ID NO: 481110 - DNA, 25 bp, Rattus norvegicus
gtagaacacgtcattcttagcatga

SEQ ID NO: 481111 - DNA, 25 bp, Rattus norvegicus
gtagaacacgtctttcttagcatga

SEQ ID NO: 481112 - DNA, 25 bp, Rattus norvegicus
gtagaacaggttcccttggtattgg

SEQ ID NO: 481113 - DNA, 25 bp, Rattus norvegicus
gtagaacaggttgccttggtattgg

SEQ ID NO: 481114 - DNA, 25 bp, Rattus norvegicus
gtagaacatactcagggaatatcat

SEQ ID NO: 481115 - DNA, 25 bp, Rattus norvegicus
gtagaacatactgagggaatatcat

SEQ ID NO: 481116 - DNA, 25 bp, Rattus norvegicus
gtagaacatttcatttggccaactc

SEQ ID NO: 481117 - DNA, 25 bp, Rattus norvegicus
gtagaacatttcttttggccaactc

SEQ ID NO: 481118 - DNA, 25 bp, Rattus norvegicus
gtagaaccagtgaccgttccgagtg

SEQ ID NO: 481119 - DNA, 25 bp, Rattus norvegicus
gtagaaccagtgtccgttccgagtg

SEQ ID NO: 481120 - DNA, 25 bp, Rattus norvegicus
gtagaaccatggctgaccgaaagag

SEQ ID NO: 481121 - DNA, 25 bp, Rattus norvegicus
gtagaaccatgggtgaccgaaagag

SEQ ID NO: 481122 - DNA, 25 bp, Rattus norvegicus
gtagaaccatgtaccctatgacatt

SEQ ID NO: 481123 - DNA, 25 bp, Rattus norvegicus
gtagaaccatgttccctatgacatt

SEQ ID NO: 481124 - DNA, 25 bp, Rattus norvegicus
gtagaacccacaaacatgccacagt

SEQ ID NO: 481125 - DNA, 25 bp, Rattus norvegicus
gtagaacccacatacatgccacagt

SEQ ID NO: 481126 - DNA, 25 bp, Rattus norvegicus
gtagaacctcaacctgtcgttttgg

SEQ ID NO: 481127 - DNA, 25 bp, Rattus norvegicus
gtagaacctcaagctgtcgttttgg

SEQ ID NO: 481128 - DNA, 25 bp, Rattus norvegicus
gtagaacgcatcatccgaagactga

SEQ ID NO: 481129 - DNA, 25 bp, Rattus norvegicus
gtagaacgcatcttccgaagactga

SEQ ID NO: 481130 - DNA, 25 bp, Rattus norvegicus
gtagaactacaacttgtataggctt

SEQ ID NO: 481131 - DNA, 25 bp, Rattus norvegicus
gtagaactacaagttgtataggctt

SEQ ID NO: 481132 - DNA, 25 bp, Rattus norvegicus
gtagaactacttcaggtcagcctag

SEQ ID NO: 481133 - DNA, 25 bp, Rattus norvegicus
gtagaactacttgaggtcagcctag

SEQ ID NO: 481134 - DNA, 25 bp, Rattus norvegicus
gtagaactaggtacactttcaacag

SEQ ID NO: 481135 - DNA, 25 bp, Rattus norvegicus
gtagaactaggttcactttcaacag

SEQ ID NO: 481136 - DNA, 25 bp, Rattus norvegicus
gtagaactatccatcccaaatgagt

SEQ ID NO: 481137 - DNA, 25 bp, Rattus norvegicus
gtagaactatccttcccaaatgagt

SEQ ID NO: 481138 - DNA, 25 bp, Rattus norvegicus
gtagaactatctccatataatgtga

SEQ ID NO: 481139 - DNA, 25 bp, Rattus norvegicus
gtagaactatctgcatataatgtga

SEQ ID NO: 481140 - DNA, 25 bp, Rattus norvegicus
gtagaactcatccaaaacctgtgct

SEQ ID NO: 481141 - DNA, 25 bp, Rattus norvegicus
gtagaactcatccttgtcagcaaag

SEQ ID NO: 481142 - DNA, 25 bp, Rattus norvegicus
gtagaactcatcgaaaacctgtgct

SEQ ID NO: 481143 - DNA, 25 bp, Rattus norvegicus
gtagaactcatcgttgtcagcaaag

SEQ ID NO: 481144 - DNA, 25 bp, Rattus norvegicus
gtagaactcttcagcagcaccatgc

SEQ ID NO: 481145 - DNA, 25 bp, Rattus norvegicus
gtagaactcttctgcagcaccatgc

SEQ ID NO: 481146 - DNA, 25 bp, Rattus norvegicus
gtagaactgactcaacatccaattg

SEQ ID NO: 481147 - DNA, 25 bp, Rattus norvegicus
gtagaactgactgaacatccaattg

SEQ ID NO: 481148 - DNA, 25 bp, Rattus norvegicus
gtagaactgcctagaatgctggaat

SEQ ID NO: 481149 - DNA, 25 bp, Rattus norvegicus
gtagaactgccttgaatgctggaat

SEQ ID NO: 481150 - DNA, 25 bp, Rattus norvegicus
gtagaactgtctccatgcaaagcaa

SEQ ID NO: 481151 - DNA, 25 bp, Rattus norvegicus
gtagaactgtctgcatgcaaagcaa

SEQ ID NO: 481152 - DNA, 25 bp, Rattus norvegicus
gtagaacttccaactggacagataa

SEQ ID NO: 481153 - DNA, 25 bp, Rattus norvegicus
gtagaacttccatctggacagataa

SEQ ID NO: 481154 - DNA, 25 bp, Rattus norvegicus
gtagaacttctaagggtcccaggat

SEQ ID NO: 481155 - DNA, 25 bp, Rattus norvegicus
gtagaacttctatgggtcccaggat

SEQ ID NO: 481156 - DNA, 25 bp, Rattus norvegicus
gtagaacttgtaagtccgcactggt

SEQ ID NO: 481157 - DNA, 25 bp, Rattus norvegicus
gtagaacttgtatgtccgcactggt

SEQ ID NO: 481158 - DNA, 25 bp, Rattus norvegicus
gtagaagaatcccaacaaccgacgt

SEQ ID NO: 481159 - DNA, 25 bp, Rattus norvegicus
gtagaagaatccgaacaaccgacgt

SEQ ID NO: 481160 - DNA, 25 bp, Rattus norvegicus
gtagaagacataaggaaacacagaa

SEQ ID NO: 481161 - DNA, 25 bp, Rattus norvegicus
gtagaagacatatggaaacacagaa

SEQ ID NO: 481162 - DNA, 25 bp, Rattus norvegicus
gtagaagaccacagcttcactgtcg

SEQ ID NO: 481163 - DNA, 25 bp, Rattus norvegicus
gtagaagaccactgcttcactgtcg

SEQ ID NO: 481164 - DNA, 25 bp, Rattus norvegicus
gtagaagacctcagtcaccctgtgg

SEQ ID NO: 481165 - DNA, 25 bp, Rattus norvegicus
gtagaagacctctgtcaccctgtgg

SEQ ID NO: 481166 - DNA, 25 bp, Rattus norvegicus
gtagaagacgacatctccaatcagt

SEQ ID NO: 481167 - DNA, 25 bp, Rattus norvegicus
gtagaagacgacttctccaatcagt

SEQ ID NO: 481168 - DNA, 25 bp, Rattus norvegicus
gtagaagactatagagaggaatcac

SEQ ID NO: 481169 - DNA, 25 bp, Rattus norvegicus
gtagaagactattgagaggaatcac

SEQ ID NO: 481170 - DNA, 25 bp, Rattus norvegicus
gtagaagactggcttctcagcttcc

SEQ ID NO: 481171 - DNA, 25 bp, Rattus norvegicus
gtagaagactgggttctcagcttcc

SEQ ID NO: 481172 - DNA, 25 bp, Rattus norvegicus
gtagaagatacacaggcccaggcgt

SEQ ID NO: 481173 - DNA, 25 bp, Rattus norvegicus
gtagaagatacagaggcccaggcgt

SEQ ID NO: 481174 - DNA, 25 bp, Rattus norvegicus
gtagaagccaggaatcacttcactg

SEQ ID NO: 481175 - DNA, 25 bp, Rattus norvegicus
gtagaagccaggtatcacttcactg

SEQ ID NO: 481176 - DNA, 25 bp, Rattus norvegicus
gtagaagcgtttcagtttggaatca

SEQ ID NO: 481177 - DNA, 25 bp, Rattus norvegicus
gtagaagcgtttgagtttggaatca

SEQ ID NO: 481178 - DNA, 25 bp, Rattus norvegicus
gtagaagctcgtacttgtgcaaaat

SEQ ID NO: 481179 - DNA, 25 bp, Rattus norvegicus
gtagaagctcgttcttgtgcaaaat

SEQ ID NO: 481180 - DNA, 25 bp, Rattus norvegicus
gtagaagcttggctctttccatggg

SEQ ID NO: 481181 - DNA, 25 bp, Rattus norvegicus
gtagaagcttgggtctttccatggg

SEQ ID NO: 481182 - DNA, 25 bp, Rattus norvegicus
gtagaagggatgaccgctccgctgc

SEQ ID NO: 481183 - DNA, 25 bp, Rattus norvegicus
gtagaagggatgtccgctccgctgc

SEQ ID NO: 481184 - DNA, 25 bp, Rattus norvegicus
gtagaaggtctgagatgctgataac

SEQ ID NO: 481185 - DNA, 25 bp, Rattus norvegicus
gtagaaggtctgtgatgctgataac

SEQ ID NO: 481186 - DNA, 25 bp, Rattus norvegicus
gtagaaggttgaatcacccaccaat

SEQ ID NO: 481187 - DNA, 25 bp, Rattus norvegicus
gtagaaggttgattcacccaccaat

SEQ ID NO: 481188 - DNA, 25 bp, Rattus norvegicus
gtagaagtcgacatcttcctggaat

SEQ ID NO: 481189 - DNA, 25 bp, Rattus norvegicus
gtagaagtcgacttcttcctggaat

SEQ ID NO: 481190 - DNA, 25 bp, Rattus norvegicus
gtagaagtgactaagacccgcccgg

SEQ ID NO: 481191 - DNA, 25 bp, Rattus norvegicus
gtagaagtgacttagacccgcccgg

SEQ ID NO: 481192 - DNA, 25 bp, Rattus norvegicus
gtagaagtgcgtacctgttttcacc

SEQ ID NO: 481193 - DNA, 25 bp, Rattus norvegicus
gtagaagtgcgttcctgttttcacc

SEQ ID NO: 481194 - DNA, 25 bp, Rattus norvegicus
gtagaagtgctgctgaccctgcgta

SEQ ID NO: 481195 - DNA, 25 bp, Rattus norvegicus
gtagaagtgctggtgaccctgcgta

SEQ ID NO: 481196 - DNA, 25 bp, Rattus norvegicus
gtagaagtgtctcctccttctcgga

SEQ ID NO: 481197 - DNA, 25 bp, Rattus norvegicus
gtagaagtgtctgctccttctcgga

SEQ ID NO: 481198 - DNA, 25 bp, Rattus norvegicus
gtagaagttgttcctaacatgggaa

SEQ ID NO: 481199 - DNA, 25 bp, Rattus norvegicus
gtagaagttgttgctaacatgggaa

SEQ ID NO: 481200 - DNA, 25 bp, Rattus norvegicus
gtagaagtttaacgctgtcctcaaa

SEQ ID NO: 481201 - DNA, 25 bp, Rattus norvegicus
gtagaagtttaaggctgtcctcaaa

SEQ ID NO: 481202 - DNA, 25 bp, Rattus norvegicus
gtagaatattagatcccagtacaca

SEQ ID NO: 481203 - DNA, 25 bp, Rattus norvegicus
gtagaatattagttcccagtacaca

SEQ ID NO: 481204 - DNA, 25 bp, Rattus norvegicus
gtagaatcagatagtccattccaaa

SEQ ID NO: 481205 - DNA, 25 bp, Rattus norvegicus
gtagaatcagattgtccattccaaa

SEQ ID NO: 481206 - DNA, 25 bp, Rattus norvegicus
gtagaatccgaaccctcgttacact

SEQ ID NO: 481207 - DNA, 25 bp, Rattus norvegicus
gtagaatccgaagcctcgttacact

SEQ ID NO: 481208 - DNA, 25 bp, Rattus norvegicus
gtagaatcctaaactagcacccact

SEQ ID NO: 481209 - DNA, 25 bp, Rattus norvegicus
gtagaatcctaatctagcacccact

SEQ ID NO: 481210 - DNA, 25 bp, Rattus norvegicus
gtagaatccttgacaaccttgctct

SEQ ID NO: 481211 - DNA, 25 bp, Rattus norvegicus
gtagaatccttgtcaaccttgctct

SEQ ID NO: 481212 - DNA, 25 bp, Rattus norvegicus
gtagaatctcttactaatttggaat

SEQ ID NO: 481213 - DNA, 25 bp, Rattus norvegicus
gtagaatctctttctaatttggaat

SEQ ID NO: 481214 - DNA, 25 bp, Rattus norvegicus
gtagaatctgtcattccctggacaa

SEQ ID NO: 481215 - DNA, 25 bp, Rattus norvegicus
gtagaatctgtctttccctggacaa

SEQ ID NO: 481216 - DNA, 25 bp, Rattus norvegicus
gtagaatcttgaattcccgcaaggc

SEQ ID NO: 481217 - DNA, 25 bp, Rattus norvegicus
gtagaatcttgatttcccgcaaggc

SEQ ID NO: 481218 - DNA, 25 bp, Rattus norvegicus
gtagaatgatcgacaagcatgccaa

SEQ ID NO: 481219 - DNA, 25 bp, Rattus norvegicus
gtagaatgatcgtcaagcatgccaa

SEQ ID NO: 481220 - DNA, 25 bp, Rattus norvegicus
gtagaatgatctcctgactggccag

SEQ ID NO: 481221 - DNA, 25 bp, Rattus norvegicus
gtagaatgatctgctgactggccag

SEQ ID NO: 481222 - DNA, 25 bp, Rattus norvegicus
gtagaatggcatctcatcgtgctcc

SEQ ID NO: 481223 - DNA, 25 bp, Rattus norvegicus
gtagaatggcatgtcatcgtgctcc

SEQ ID NO: 481224 - DNA, 25 bp, Rattus norvegicus
gtagaatgggaaacgttttgcctgg

SEQ ID NO: 481225 - DNA, 25 bp, Rattus norvegicus
gtagaatgggaatcgttttgcctgg

SEQ ID NO: 481226 - DNA, 25 bp, Rattus norvegicus
gtagaatgttagcttatgttggaat

SEQ ID NO: 481227 - DNA, 25 bp, Rattus norvegicus
gtagaatgttaggttatgttggaat

SEQ ID NO: 481228 - DNA, 25 bp, Rattus norvegicus
gtagaatgtttcatcctatagggag

SEQ ID NO: 481229 - DNA, 25 bp, Rattus norvegicus
gtagaatgtttcttcctatagggag

SEQ ID NO: 481230 - DNA, 25 bp, Rattus norvegicus
gtagaattacccaacgtgctcaccc

SEQ ID NO: 481231 - DNA, 25 bp, Rattus norvegicus
gtagaattaccctacgtgctcaccc

SEQ ID NO: 481232 - DNA, 25 bp, Rattus norvegicus
gtagaattcacgagagggccaggca

SEQ ID NO: 481233 - DNA, 25 bp, Rattus norvegicus
gtagaattcacgtgagggccaggca

SEQ ID NO: 481234 - DNA, 25 bp, Rattus norvegicus
gtagaatttcacatgaactgctgga

SEQ ID NO: 481235 - DNA, 25 bp, Rattus norvegicus
gtagaatttcacttgaactgctgga

SEQ ID NO: 481236 - DNA, 25 bp, Rattus norvegicus
gtagacaaacacagccttgtcctca

SEQ ID NO: 481237 - DNA, 25 bp, Rattus norvegicus
gtagacaaacactgccttgtcctca

SEQ ID NO: 481238 - DNA, 25 bp, Rattus norvegicus
gtagacaaatcccttgttcttgtga

SEQ ID NO: 481239 - DNA, 25 bp, Rattus norvegicus
gtagacaaatccgttgttcttgtga

SEQ ID NO: 481240 - DNA, 25 bp, Rattus norvegicus
gtagacaaatctcttaacctccctg

SEQ ID NO: 481241 - DNA, 25 bp, Rattus norvegicus
gtagacaaatctgttaacctccctg

SEQ ID NO: 481242 - DNA, 25 bp, Rattus norvegicus
gtagacaacaatagcaggccctgaa

SEQ ID NO: 481243 - DNA, 25 bp, Rattus norvegicus
gtagacaacaattgcaggccctgaa

SEQ ID NO: 481244 - DNA, 25 bp, Rattus norvegicus
gtagacaacctccaactctgaattt

SEQ ID NO: 481245 - DNA, 25 bp, Rattus norvegicus
gtagacaacctcgaactctgaattt

SEQ ID NO: 481246 - DNA, 25 bp, Rattus norvegicus
gtagacaagaataggtgacaccacc

SEQ ID NO: 481247 - DNA, 25 bp, Rattus norvegicus
gtagacaagaattggtgacaccacc

SEQ ID NO: 481248 - DNA, 25 bp, Rattus norvegicus
gtagacaagactcgccttgctgaca

SEQ ID NO: 481249 - DNA, 25 bp, Rattus norvegicus
gtagacaagactggccttgctgaca

SEQ ID NO: 481250 - DNA, 25 bp, Rattus norvegicus
gtagacaagctgcaggccaaagtga

SEQ ID NO: 481251 - DNA, 25 bp, Rattus norvegicus
gtagacaagctggaggccaaagtga

SEQ ID NO: 481252 - DNA, 25 bp, Rattus norvegicus
gtagacaagttcaccaaaaccagta

SEQ ID NO: 481253 - DNA, 25 bp, Rattus norvegicus
gtagacaagttctccaaaaccagta

SEQ ID NO: 481254 - DNA, 25 bp, Rattus norvegicus
gtagacaagttgacccagcctctgg

SEQ ID NO: 481255 - DNA, 25 bp, Rattus norvegicus
gtagacaagttgtcccagcctctgg

SEQ ID NO: 481256 - DNA, 25 bp, Rattus norvegicus
gtagacaataccattctcttgtgta

SEQ ID NO: 481257 - DNA, 25 bp, Rattus norvegicus
gtagacaatacctttctcttgtgta

SEQ ID NO: 481258 - DNA, 25 bp, Rattus norvegicus
gtagacaatgttctcataaggccat

SEQ ID NO: 481259 - DNA, 25 bp, Rattus norvegicus
gtagacaatgttgtcataaggccat

SEQ ID NO: 481260 - DNA, 25 bp, Rattus norvegicus
gtagacacaaccatcctgtagggcg

SEQ ID NO: 481261 - DNA, 25 bp, Rattus norvegicus
gtagacacaaccttcctgtagggcg

SEQ ID NO: 481262 - DNA, 25 bp, Rattus norvegicus
gtagacaccaccatgagtcgatata

SEQ ID NO: 481263 - DNA, 25 bp, Rattus norvegicus
gtagacaccaccttgagtcgatata

SEQ ID NO: 481264 - DNA, 25 bp, Rattus norvegicus
gtagacactaggcaacgtttgtaat

SEQ ID NO: 481265 - DNA, 25 bp, Rattus norvegicus
gtagacactagggaacgtttgtaat

SEQ ID NO: 481266 - DNA, 25 bp, Rattus norvegicus
gtagacactcctctatgccaaggta

SEQ ID NO: 481267 - DNA, 25 bp, Rattus norvegicus
gtagacactcctgtatgccaaggta

SEQ ID NO: 481268 - DNA, 25 bp, Rattus norvegicus
gtagacactgatctcatagctgcga

SEQ ID NO: 481269 - DNA, 25 bp, Rattus norvegicus
gtagacactgatgtcatagctgcga

SEQ ID NO: 481270 - DNA, 25 bp, Rattus norvegicus
gtagacacttgaaaacccctgactg

SEQ ID NO: 481271 - DNA, 25 bp, Rattus norvegicus
gtagacacttgataacccctgactg

SEQ ID NO: 481272 - DNA, 25 bp, Rattus norvegicus
gtagacactttgctggatgtgtgaa

SEQ ID NO: 481273 - DNA, 25 bp, Rattus norvegicus
gtagacactttggtggatgtgtgaa

SEQ ID NO: 481274 - DNA, 25 bp, Rattus norvegicus
gtagacacttttatcgcttactctt

SEQ ID NO: 481275 - DNA, 25 bp, Rattus norvegicus
gtagacacttttttcgcttactctt

SEQ ID NO: 481276 - DNA, 25 bp, Rattus norvegicus
gtagacagacacctgccattgccta

SEQ ID NO: 481277 - DNA, 25 bp, Rattus norvegicus
gtagacagacacgtgccattgccta

SEQ ID NO: 481278 - DNA, 25 bp, Rattus norvegicus
gtagacagaccgctgtcgggcccat

SEQ ID NO: 481279 - DNA, 25 bp, Rattus norvegicus
gtagacagaccggtgtcgggcccat

SEQ ID NO: 481280 - DNA, 25 bp, Rattus norvegicus
gtagacagcaggacgctgccctcat

SEQ ID NO: 481281 - DNA, 25 bp, Rattus norvegicus
gtagacagcaggtcgctgccctcat

SEQ ID NO: 481282 - DNA, 25 bp, Rattus norvegicus
gtagacagtaatcgctcagagagta

SEQ ID NO: 481283 - DNA, 25 bp, Rattus norvegicus
gtagacagtaatggctcagagagta

SEQ ID NO: 481284 - DNA, 25 bp, Rattus norvegicus
gtagacagtggacgctccaattcct

SEQ ID NO: 481285 - DNA, 25 bp, Rattus norvegicus
gtagacagtggaggctccaattcct

SEQ ID NO: 481286 - DNA, 25 bp, Rattus norvegicus
gtagacagtggcagacttccgaaga

SEQ ID NO: 481287 - DNA, 25 bp, Rattus norvegicus
gtagacagtggctgacttccgaaga

SEQ ID NO: 481288 - DNA, 25 bp, Rattus norvegicus
gtagacagttggaataccggccctg

SEQ ID NO: 481289 - DNA, 25 bp, Rattus norvegicus
gtagacagttggtataccggccctg

SEQ ID NO: 481290 - DNA, 25 bp, Rattus norvegicus
gtagacatatccaggccttcagagg

SEQ ID NO: 481291 - DNA, 25 bp, Rattus norvegicus
gtagacatatcctggccttcagagg

SEQ ID NO: 481292 - DNA, 25 bp, Rattus norvegicus
gtagacatcaccagtctctatgaga

SEQ ID NO: 481293 - DNA, 25 bp, Rattus norvegicus
gtagacatcacctgtctctatgaga

SEQ ID NO: 481294 - DNA, 25 bp, Rattus norvegicus
gtagacatcgtcatgcctgaatata

SEQ ID NO: 481295 - DNA, 25 bp, Rattus norvegicus
gtagacatcgtcttgcctgaatata

SEQ ID NO: 481296 - DNA, 25 bp, Rattus norvegicus
gtagacatcttaaaggcctctggat

SEQ ID NO: 481297 - DNA, 25 bp, Rattus norvegicus
gtagacatcttataggcctctggat

SEQ ID NO: 481298 - DNA, 25 bp, Rattus norvegicus
gtagacatgtctaggaacactgata

SEQ ID NO: 481299 - DNA, 25 bp, Rattus norvegicus
gtagacatgtcttggaacactgata

SEQ ID NO: 481300 - DNA, 25 bp, Rattus norvegicus
gtagacattctaatccccaaattaa

SEQ ID NO: 481301 - DNA, 25 bp, Rattus norvegicus
gtagacattctaccaggtggcagga

SEQ ID NO: 481302 - DNA, 25 bp, Rattus norvegicus
gtagacattctagcaggtggcagga

SEQ ID NO: 481303 - DNA, 25 bp, Rattus norvegicus
gtagacattctattccccaaattaa

SEQ ID NO: 481304 - DNA, 25 bp, Rattus norvegicus
gtagacattcttctattactgtgaa

SEQ ID NO: 481305 - DNA, 25 bp, Rattus norvegicus
gtagacattcttgtattactgtgaa

SEQ ID NO: 481306 - DNA, 25 bp, Rattus norvegicus
gtagacattgaccagtgcctcagga

SEQ ID NO: 481307 - DNA, 25 bp, Rattus norvegicus
gtagacattgacgagtgcctcagga

SEQ ID NO: 481308 - DNA, 25 bp, Rattus norvegicus
gtagacattgccctaaagcccagcc

SEQ ID NO: 481309 - DNA, 25 bp, Rattus norvegicus
gtagacattgccgtaaagcccagcc

SEQ ID NO: 481310 - DNA, 25 bp, Rattus norvegicus
gtagacattgtgcacctcaccagat

SEQ ID NO: 481311 - DNA, 25 bp, Rattus norvegicus
gtagacattgtggacctcaccagat

SEQ ID NO: 481312 - DNA, 25 bp, Rattus norvegicus
gtagacatttttcccatgacagagt

SEQ ID NO: 481313 - DNA, 25 bp, Rattus norvegicus
gtagacatttttgccatgacagagt

SEQ ID NO: 481314 - DNA, 25 bp, Rattus norvegicus
gtagaccaagctcgctgtcctcgtg

SEQ ID NO: 481315 - DNA, 25 bp, Rattus norvegicus
gtagaccaagctggctgtcctcgtg

SEQ ID NO: 481316 - DNA, 25 bp, Rattus norvegicus
gtagaccaaggtactgcttatggca

SEQ ID NO: 481317 - DNA, 25 bp, Rattus norvegicus
gtagaccaaggttctgcttatggca

SEQ ID NO: 481318 - DNA, 25 bp, Rattus norvegicus
gtagaccaattccatcttgactgat

SEQ ID NO: 481319 - DNA, 25 bp, Rattus norvegicus
gtagaccaattcgatcttgactgat

SEQ ID NO: 481320 - DNA, 25 bp, Rattus norvegicus
gtagaccacaaacacagggcatttt

SEQ ID NO: 481321 - DNA, 25 bp, Rattus norvegicus
gtagaccacaaagacagggcatttt

SEQ ID NO: 481322 - DNA, 25 bp, Rattus norvegicus
gtagaccacactccttttttagaag

SEQ ID NO: 481323 - DNA, 25 bp, Rattus norvegicus
gtagaccacactgcttttttagaag

SEQ ID NO: 481324 - DNA, 25 bp, Rattus norvegicus
gtagaccacatcacaaaggaaaaga

SEQ ID NO: 481325 - DNA, 25 bp, Rattus norvegicus
gtagaccacatctcaaaggaaaaga

SEQ ID NO: 481326 - DNA, 25 bp, Rattus norvegicus
gtagaccacttgagtgcaggcacct

SEQ ID NO: 481327 - DNA, 25 bp, Rattus norvegicus
gtagaccacttgtgtgcaggcacct

SEQ ID NO: 481328 - DNA, 25 bp, Rattus norvegicus
gtagaccagatgcactatttagaca

SEQ ID NO: 481329 - DNA, 25 bp, Rattus norvegicus
gtagaccagatggactatttagaca

SEQ ID NO: 481330 - DNA, 25 bp, Rattus norvegicus
gtagaccaggctcacctatctagaa

SEQ ID NO: 481331 - DNA, 25 bp, Rattus norvegicus
gtagaccaggctgacctatctagaa

SEQ ID NO: 481332 - DNA, 25 bp, Rattus norvegicus
gtagaccaggtcaagttaaagctcg

SEQ ID NO: 481333 - DNA, 25 bp, Rattus norvegicus
gtagaccaggtctagttaaagctcg

SEQ ID NO: 481334 - DNA, 25 bp, Rattus norvegicus
gtagacccagaaagatctgccccat

SEQ ID NO: 481335 - DNA, 25 bp, Rattus norvegicus
gtagacccagaatgatctgccccat

SEQ ID NO: 481336 - DNA, 25 bp, Rattus norvegicus
gtagacccagcaccatgctactatt

SEQ ID NO: 481337 - DNA, 25 bp, Rattus norvegicus
gtagacccagcagcatgctactatt

SEQ ID NO: 481338 - DNA, 25 bp, Rattus norvegicus
gtagacccagctcaggaatatgccc

SEQ ID NO: 481339 - DNA, 25 bp, Rattus norvegicus
gtagacccagctgaggaatatgccc

SEQ ID NO: 481340 - DNA, 25 bp, Rattus norvegicus
gtagaccccaaaagggacattgtgt

SEQ ID NO: 481341 - DNA, 25 bp, Rattus norvegicus
gtagaccccaaatgggacattgtgt

SEQ ID NO: 481342 - DNA, 25 bp, Rattus norvegicus
gtagaccccaatacgctggaaaaat

SEQ ID NO: 481343 - DNA, 25 bp, Rattus norvegicus
gtagaccccaattcgctggaaaaat

SEQ ID NO: 481344 - DNA, 25 bp, Rattus norvegicus
gtagaccccaccatgtacatatgac

SEQ ID NO: 481345 - DNA, 25 bp, Rattus norvegicus
gtagaccccaccttgtacatatgac

SEQ ID NO: 481346 - DNA, 25 bp, Rattus norvegicus
gtagaccccattcagctggtggttt

SEQ ID NO: 481347 - DNA, 25 bp, Rattus norvegicus
gtagaccccattgagctggtggttt

SEQ ID NO: 481348 - DNA, 25 bp, Rattus norvegicus
gtagaccctgagctatcaagtaatt

SEQ ID NO: 481349 - DNA, 25 bp, Rattus norvegicus
gtagaccctgaggtatcaagtaatt

SEQ ID NO: 481350 - DNA, 25 bp, Rattus norvegicus
gtagaccctgctagtatagcttcag

SEQ ID NO: 481351 - DNA, 25 bp, Rattus norvegicus
gtagaccctgcttgtatagcttcag

SEQ ID NO: 481352 - DNA, 25 bp, Rattus norvegicus
gtagaccgacgtaatcgcgctatac

SEQ ID NO: 481353 - DNA, 25 bp, Rattus norvegicus
gtagaccgacgttatcgcgctatac

SEQ ID NO: 481354 - DNA, 25 bp, Rattus norvegicus
gtagaccgtggcactccaggttcgg

SEQ ID NO: 481355 - DNA, 25 bp, Rattus norvegicus
gtagaccgtggctctccaggttcgg

SEQ ID NO: 481356 - DNA, 25 bp, Rattus norvegicus
gtagacctcaacattgcttacacag

SEQ ID NO: 481357 - DNA, 25 bp, Rattus norvegicus
gtagacctcaactttgcttacacag

SEQ ID NO: 481358 - DNA, 25 bp, Rattus norvegicus
gtagacctccatactgtaattacag

SEQ ID NO: 481359 - DNA, 25 bp, Rattus norvegicus
gtagacctccattctgtaattacag

SEQ ID NO: 481360 - DNA, 25 bp, Rattus norvegicus
gtagacctctgtctaaaggtaccta

SEQ ID NO: 481361 - DNA, 25 bp, Rattus norvegicus
gtagacctctgtgtaaaggtaccta

SEQ ID NO: 481362 - DNA, 25 bp, Rattus norvegicus
gtagacctgggaagctgctggaaaa

SEQ ID NO: 481363 - DNA, 25 bp, Rattus norvegicus
gtagacctgggatgctgctggaaaa

SEQ ID NO: 481364 - DNA, 25 bp, Rattus norvegicus
gtagacctgtcaatgttttatattg

SEQ ID NO: 481365 - DNA, 25 bp, Rattus norvegicus
gtagacctgtcattgttttatattg

SEQ ID NO: 481366 - DNA, 25 bp, Rattus norvegicus
gtagaccttggactcagtactagaa

SEQ ID NO: 481367 - DNA, 25 bp, Rattus norvegicus
gtagaccttggagtcagtactagaa

SEQ ID NO: 481368 - DNA, 25 bp, Rattus norvegicus
gtagaccttgtcaggaattaactaa

SEQ ID NO: 481369 - DNA, 25 bp, Rattus norvegicus
gtagaccttgtctggaattaactaa

SEQ ID NO: 481370 - DNA, 25 bp, Rattus norvegicus
gtagacgccagtcagacaacagtaa

SEQ ID NO: 481371 - DNA, 25 bp, Rattus norvegicus
gtagacgccagtgagacaacagtaa

SEQ ID NO: 481372 - DNA, 25 bp, Rattus norvegicus
gtagacgccctcacaggagaacttg

SEQ ID NO: 481373 - DNA, 25 bp, Rattus norvegicus
gtagacgccctctcaggagaacttg

SEQ ID NO: 481374 - DNA, 25 bp, Rattus norvegicus
gtagacgctcggaatgcactttagt

SEQ ID NO: 481375 - DNA, 25 bp, Rattus norvegicus
gtagacgctcggtatgcactttagt

SEQ ID NO: 481376 - DNA, 25 bp, Rattus norvegicus
gtagacggatctctagcaagcttgt

SEQ ID NO: 481377 - DNA, 25 bp, Rattus norvegicus
gtagacggatctgtagcaagcttgt

SEQ ID NO: 481378 - DNA, 25 bp, Rattus norvegicus
gtagacggccgcacagacagacagt

SEQ ID NO: 481379 - DNA, 25 bp, Rattus norvegicus
gtagacggccgctcagacagacagt

SEQ ID NO: 481380 - DNA, 25 bp, Rattus norvegicus
gtagacggtggcaagcacgtcctta

SEQ ID NO: 481381 - DNA, 25 bp, Rattus norvegicus
gtagacggtggctagcacgtcctta

SEQ ID NO: 481382 - DNA, 25 bp, Rattus norvegicus
gtagacgtagaacaattaggagttt

SEQ ID NO: 481383 - DNA, 25 bp, Rattus norvegicus
gtagacgtagaagaattaggagttt

SEQ ID NO: 481384 - DNA, 25 bp, Rattus norvegicus
gtagacgtttgcactgggcatcaca

SEQ ID NO: 481385 - DNA, 25 bp, Rattus norvegicus
gtagacgtttgctctgggcatcaca

SEQ ID NO: 481386 - DNA, 25 bp, Rattus norvegicus
gtagactaacttaacacagcacatt

SEQ ID NO: 481387 - DNA, 25 bp, Rattus norvegicus
gtagactaactttacacagcacatt

SEQ ID NO: 481388 - DNA, 25 bp, Rattus norvegicus
gtagactactgcatctcaaggcacc

SEQ ID NO: 481389 - DNA, 25 bp, Rattus norvegicus
gtagactactgcttctcaaggcacc

SEQ ID NO: 481390 - DNA, 25 bp, Rattus norvegicus
gtagactagagcacggccacaaatt

SEQ ID NO: 481391 - DNA, 25 bp, Rattus norvegicus
gtagactagagctcggccacaaatt

SEQ ID NO: 481392 - DNA, 25 bp, Rattus norvegicus
gtagactagctcctacctcacaaga

SEQ ID NO: 481393 - DNA, 25 bp, Rattus norvegicus
gtagactagctcgtacctcacaaga

SEQ ID NO: 481394 - DNA, 25 bp, Rattus norvegicus
gtagactaggctacaccagaactat

SEQ ID NO: 481395 - DNA, 25 bp, Rattus norvegicus
gtagactaggcttcaccagaactat

SEQ ID NO: 481396 - DNA, 25 bp, Rattus norvegicus
gtagactagtgaattttgaccttga

SEQ ID NO: 481397 - DNA, 25 bp, Rattus norvegicus
gtagactagtgatttttgaccttga

SEQ ID NO: 481398 - DNA, 25 bp, Rattus norvegicus
gtagactagtttaactgctgataga

SEQ ID NO: 481399 - DNA, 25 bp, Rattus norvegicus
gtagactagttttactgctgataga

SEQ ID NO: 481400 - DNA, 25 bp, Rattus norvegicus
gtagactatgacaggaagtccagaa

SEQ ID NO: 481401 - DNA, 25 bp, Rattus norvegicus
gtagactatgactggaagtccagaa

SEQ ID NO: 481402 - DNA, 25 bp, Rattus norvegicus
gtagactattagagcttttccatat

SEQ ID NO: 481403 - DNA, 25 bp, Rattus norvegicus
gtagactattagtgcttttccatat

SEQ ID NO: 481404 - DNA, 25 bp, Rattus norvegicus
gtagactcattactcctgtctcagg

SEQ ID NO: 481405 - DNA, 25 bp, Rattus norvegicus
gtagactcattagtcctgtctcagg

SEQ ID NO: 481406 - DNA, 25 bp, Rattus norvegicus
gtagactccacactcattttcatta

SEQ ID NO: 481407 - DNA, 25 bp, Rattus norvegicus
gtagactccacagtcattttcatta

SEQ ID NO: 481408 - DNA, 25 bp, Rattus norvegicus
gtagactccagaatcataatagagt

SEQ ID NO: 481409 - DNA, 25 bp, Rattus norvegicus
gtagactccagattcataatagagt

SEQ ID NO: 481410 - DNA, 25 bp, Rattus norvegicus
gtagactcggacattcggactctgg

SEQ ID NO: 481411 - DNA, 25 bp, Rattus norvegicus
gtagactcggactttcggactctgg

SEQ ID NO: 481412 - DNA, 25 bp, Rattus norvegicus
gtagactctaggattttctccaaat

SEQ ID NO: 481413 - DNA, 25 bp, Rattus norvegicus
gtagactctaggtttttctccaaat

SEQ ID NO: 481414 - DNA, 25 bp, Rattus norvegicus
gtagactctgatcacctgattagca

SEQ ID NO: 481415 - DNA, 25 bp, Rattus norvegicus
gtagactctgatgacctgattagca

SEQ ID NO: 481416 - DNA, 25 bp, Rattus norvegicus
gtagactctgcacttgtaatacatt

SEQ ID NO: 481417 - DNA, 25 bp, Rattus norvegicus
gtagactctgcagttgtaatacatt

SEQ ID NO: 481418 - DNA, 25 bp, Rattus norvegicus
gtagactgaatcctggcaactgaga

SEQ ID NO: 481419 - DNA, 25 bp, Rattus norvegicus
gtagactgaatcgtggcaactgaga

SEQ ID NO: 481420 - DNA, 25 bp, Rattus norvegicus
gtagactgataaacttggagcttga

SEQ ID NO: 481421 - DNA, 25 bp, Rattus norvegicus
gtagactgataatcttggagcttga

SEQ ID NO: 481422 - DNA, 25 bp, Rattus norvegicus
gtagactgccaacttacctgtccca

SEQ ID NO: 481423 - DNA, 25 bp, Rattus norvegicus
gtagactgccaagttacctgtccca

SEQ ID NO: 481424 - DNA, 25 bp, Rattus norvegicus
gtagactgcctgagacgcatattct

SEQ ID NO: 481425 - DNA, 25 bp, Rattus norvegicus
gtagactgcctgtgacgcatattct

SEQ ID NO: 481426 - DNA, 25 bp, Rattus norvegicus
gtagactgcgaaattgacttttcca

SEQ ID NO: 481427 - DNA, 25 bp, Rattus norvegicus
gtagactgcgaatttgacttttcca

SEQ ID NO: 481428 - DNA, 25 bp, Rattus norvegicus
gtagactgctgaaatgtgccacata

SEQ ID NO: 481429 - DNA, 25 bp, Rattus norvegicus
gtagactgctgatatgtgccacata

SEQ ID NO: 481430 - DNA, 25 bp, Rattus norvegicus
gtagactgggacacatttatttatc

SEQ ID NO: 481431 - DNA, 25 bp, Rattus norvegicus
gtagactgggactcatttatttatc

SEQ ID NO: 481432 - DNA, 25 bp, Rattus norvegicus
gtagactgtcaccaggaatgcttaa

SEQ ID NO: 481433 - DNA, 25 bp, Rattus norvegicus
gtagactgtcacgaggaatgcttaa

SEQ ID NO: 481434 - DNA, 25 bp, Rattus norvegicus
gtagacttaaccatctgttgagtag

SEQ ID NO: 481435 - DNA, 25 bp, Rattus norvegicus
gtagacttaaccttctgttgagtag

SEQ ID NO: 481436 - DNA, 25 bp, Rattus norvegicus
gtagacttacttagaataaaactag

SEQ ID NO: 481437 - DNA, 25 bp, Rattus norvegicus
gtagacttactttgaataaaactag

SEQ ID NO: 481438 - DNA, 25 bp, Rattus norvegicus
gtagacttagacaggccatttaacc

SEQ ID NO: 481439 - DNA, 25 bp, Rattus norvegicus
gtagacttagactggccatttaacc

SEQ ID NO: 481440 - DNA, 25 bp, Rattus norvegicus
gtagacttcagtaacctgcgcagaa

SEQ ID NO: 481441 - DNA, 25 bp, Rattus norvegicus
gtagacttcagttacctgcgcagaa

SEQ ID NO: 481442 - DNA, 25 bp, Rattus norvegicus
gtagacttcataaacatggctgtat

SEQ ID NO: 481443 - DNA, 25 bp, Rattus norvegicus
gtagacttcatatacatggctgtat

SEQ ID NO: 481444 - DNA, 25 bp, Rattus norvegicus
gtagacttcggtaggcgttcacata

SEQ ID NO: 481445 - DNA, 25 bp, Rattus norvegicus
gtagacttcggttggcgttcacata

SEQ ID NO: 481446 - DNA, 25 bp, Rattus norvegicus
gtagacttcgtccacaatgccaaag

SEQ ID NO: 481447 - DNA, 25 bp, Rattus norvegicus
gtagacttcgtcgacaatgccaaag

SEQ ID NO: 481448 - DNA, 25 bp, Rattus norvegicus
gtagacttgagcagtgttcacataa

SEQ ID NO: 481449 - DNA, 25 bp, Rattus norvegicus
gtagacttgagccaaatcccgtctt

SEQ ID NO: 481450 - DNA, 25 bp, Rattus norvegicus
gtagacttgagcgaaatcccgtctt

SEQ ID NO: 481451 - DNA, 25 bp, Rattus norvegicus
gtagacttgagctgtgttcacataa

SEQ ID NO: 481452 - DNA, 25 bp, Rattus norvegicus
gtagacttggcgactctggagttgt

SEQ ID NO: 481453 - DNA, 25 bp, Rattus norvegicus
gtagacttggcgtctctggagttgt

SEQ ID NO: 481454 - DNA, 25 bp, Rattus norvegicus
gtagacttgtccagatgcaccagag

SEQ ID NO: 481455 - DNA, 25 bp, Rattus norvegicus
gtagacttgtcctgatgcaccagag

SEQ ID NO: 481456 - DNA, 25 bp, Rattus norvegicus
gtagactttctgactccattcacaa

SEQ ID NO: 481457 - DNA, 25 bp, Rattus norvegicus
gtagactttctgtctccattcacaa

SEQ ID NO: 481458 - DNA, 25 bp, Rattus norvegicus
gtagagaaactcacttcagcagctg

SEQ ID NO: 481459 - DNA, 25 bp, Rattus norvegicus
gtagagaaactctcttcagcagctg

SEQ ID NO: 481460 - DNA, 25 bp, Rattus norvegicus
gtagagaacaacagtcaactgtggg

SEQ ID NO: 481461 - DNA, 25 bp, Rattus norvegicus
gtagagaacaactgtcaactgtggg

SEQ ID NO: 481462 - DNA, 25 bp, Rattus norvegicus
gtagagaacctcagaaagatttgtt

SEQ ID NO: 481463 - DNA, 25 bp, Rattus norvegicus
gtagagaacctctgaaagatttgtt

SEQ ID NO: 481464 - DNA, 25 bp, Rattus norvegicus
gtagagaacgctcattcccaatcct

SEQ ID NO: 481465 - DNA, 25 bp, Rattus norvegicus
gtagagaacgctgattcccaatcct

SEQ ID NO: 481466 - DNA, 25 bp, Rattus norvegicus
gtagagaagctaaggactcccctca

SEQ ID NO: 481467 - DNA, 25 bp, Rattus norvegicus
gtagagaagctatggactcccctca

SEQ ID NO: 481468 - DNA, 25 bp, Rattus norvegicus
gtagagaccggtcgcccacagacca

SEQ ID NO: 481469 - DNA, 25 bp, Rattus norvegicus
gtagagaccggtggcccacagacca

SEQ ID NO: 481470 - DNA, 25 bp, Rattus norvegicus
gtagagactggtagcaccccaagat

SEQ ID NO: 481471 - DNA, 25 bp, Rattus norvegicus
gtagagactggttgcaccccaagat

SEQ ID NO: 481472 - DNA, 25 bp, Rattus norvegicus
gtagagactgtcctagaacaaaaca

SEQ ID NO: 481473 - DNA, 25 bp, Rattus norvegicus
gtagagactgtcgtagaacaaaaca

SEQ ID NO: 481474 - DNA, 25 bp, Rattus norvegicus
gtagagacttctaatgggaccctaa

SEQ ID NO: 481475 - DNA, 25 bp, Rattus norvegicus
gtagagacttcttatgggaccctaa

SEQ ID NO: 481476 - DNA, 25 bp, Rattus norvegicus
gtagagagactgcaacacacatatg

SEQ ID NO: 481477 - DNA, 25 bp, Rattus norvegicus
gtagagagactggaacacacatatg

SEQ ID NO: 481478 - DNA, 25 bp, Rattus norvegicus
gtagagagccttcatgtgagtccca

SEQ ID NO: 481479 - DNA, 25 bp, Rattus norvegicus
gtagagagccttgatgtgagtccca

SEQ ID NO: 481480 - DNA, 25 bp, Rattus norvegicus
gtagagagctttattgagaatccaa

SEQ ID NO: 481481 - DNA, 25 bp, Rattus norvegicus
gtagagagcttttttgagaatccaa

SEQ ID NO: 481482 - DNA, 25 bp, Rattus norvegicus
gtagagaggtcgcaggccccggcct

SEQ ID NO: 481483 - DNA, 25 bp, Rattus norvegicus
gtagagaggtcggaggccccggcct

SEQ ID NO: 481484 - DNA, 25 bp, Rattus norvegicus
gtagagaggttgaattggccacatt

SEQ ID NO: 481485 - DNA, 25 bp, Rattus norvegicus
gtagagaggttgtattggccacatt

SEQ ID NO: 481486 - DNA, 25 bp, Rattus norvegicus
gtagagatacctcaggttgtcctca

SEQ ID NO: 481487 - DNA, 25 bp, Rattus norvegicus
gtagagatacctgaggttgtcctca

SEQ ID NO: 481488 - DNA, 25 bp, Rattus norvegicus
gtagagatgactctcagcatggctc

SEQ ID NO: 481489 - DNA, 25 bp, Rattus norvegicus
gtagagatgactgtcagcatggctc

SEQ ID NO: 481490 - DNA, 25 bp, Rattus norvegicus
gtagagatgttgatcaccttgactg

SEQ ID NO: 481491 - DNA, 25 bp, Rattus norvegicus
gtagagatgttgttcaccttgactg

SEQ ID NO: 481492 - DNA, 25 bp, Rattus norvegicus
gtagagattcatatagggtccagtt

SEQ ID NO: 481493 - DNA, 25 bp, Rattus norvegicus
gtagagattcatccggacacatcca

SEQ ID NO: 481494 - DNA, 25 bp, Rattus norvegicus
gtagagattcatgcggacacatcca

SEQ ID NO: 481495 - DNA, 25 bp, Rattus norvegicus
gtagagattcatttagggtccagtt

SEQ ID NO: 481496 - DNA, 25 bp, Rattus norvegicus
gtagagattcgaacctgattcaaag

SEQ ID NO: 481497 - DNA, 25 bp, Rattus norvegicus
gtagagattcgatcctgattcaaag

SEQ ID NO: 481498 - DNA, 25 bp, Rattus norvegicus
gtagagcaagcactgaccaagccgt

SEQ ID NO: 481499 - DNA, 25 bp, Rattus norvegicus
gtagagcaagcagtgaccaagccgt

SEQ ID NO: 481500 - DNA, 25 bp, Rattus norvegicus
gtagagcaccacaggaagtcctggt

SEQ ID NO: 481501 - DNA, 25 bp, Rattus norvegicus
gtagagcaccactggaagtcctggt

SEQ ID NO: 481502 - DNA, 25 bp, Rattus norvegicus
gtagagcacctgactggcataaaca

SEQ ID NO: 481503 - DNA, 25 bp, Rattus norvegicus
gtagagcacctgtctggcataaaca

SEQ ID NO: 481504 - DNA, 25 bp, Rattus norvegicus
gtagagcagattactgtccatcaga

SEQ ID NO: 481505 - DNA, 25 bp, Rattus norvegicus
gtagagcagatttctgtccatcaga

SEQ ID NO: 481506 - DNA, 25 bp, Rattus norvegicus
gtagagcagcagaaccagaaacatg

SEQ ID NO: 481507 - DNA, 25 bp, Rattus norvegicus
gtagagcagcagtaccagaaacatg

SEQ ID NO: 481508 - DNA, 25 bp, Rattus norvegicus
gtagagcagccacctagaggcccag

SEQ ID NO: 481509 - DNA, 25 bp, Rattus norvegicus
gtagagcagccagctagaggcccag

SEQ ID NO: 481510 - DNA, 25 bp, Rattus norvegicus
gtagagcagctccatccttaaagaa

SEQ ID NO: 481511 - DNA, 25 bp, Rattus norvegicus
gtagagcagctcgatccttaaagaa

SEQ ID NO: 481512 - DNA, 25 bp, Rattus norvegicus
gtagagcaggtgaggcctagaccaa

SEQ ID NO: 481513 - DNA, 25 bp, Rattus norvegicus
gtagagcaggtgtggcctagaccaa

SEQ ID NO: 481514 - DNA, 25 bp, Rattus norvegicus
gtagagcatcagcatcatgttttca

SEQ ID NO: 481515 - DNA, 25 bp, Rattus norvegicus
gtagagcatcaggatcatgttttca

SEQ ID NO: 481516 - DNA, 25 bp, Rattus norvegicus
gtagagcatccaactaaccttatcc

SEQ ID NO: 481517 - DNA, 25 bp, Rattus norvegicus
gtagagcatccatctaaccttatcc

SEQ ID NO: 481518 - DNA, 25 bp, Rattus norvegicus
gtagagccactaaatgacaagaaat

SEQ ID NO: 481519 - DNA, 25 bp, Rattus norvegicus
gtagagccactatatgacaagaaat

SEQ ID NO: 481520 - DNA, 25 bp, Rattus norvegicus
gtagagccaggaagtgcatacgtgc

SEQ ID NO: 481521 - DNA, 25 bp, Rattus norvegicus
gtagagccaggatgtgcatacgtgc

SEQ ID NO: 481522 - DNA, 25 bp, Rattus norvegicus
gtagagccagggactcacagtagaa

SEQ ID NO: 481523 - DNA, 25 bp, Rattus norvegicus
gtagagccagggtctcacagtagaa

SEQ ID NO: 481524 - DNA, 25 bp, Rattus norvegicus
gtagagccattccaaagtcctgcat

SEQ ID NO: 481525 - DNA, 25 bp, Rattus norvegicus
gtagagccattcgaaagtcctgcat

SEQ ID NO: 481526 - DNA, 25 bp, Rattus norvegicus
gtagagcccaagacaggtctcggct

SEQ ID NO: 481527 - DNA, 25 bp, Rattus norvegicus
gtagagcccaagtcaggtctcggct

SEQ ID NO: 481528 - DNA, 25 bp, Rattus norvegicus
gtagagccctgaagcatctgcagta

SEQ ID NO: 481529 - DNA, 25 bp, Rattus norvegicus
gtagagccctgatgcatctgcagta

SEQ ID NO: 481530 - DNA, 25 bp, Rattus norvegicus
gtagagcctactatgatgtcctata

SEQ ID NO: 481531 - DNA, 25 bp, Rattus norvegicus
gtagagcctactttgatgtcctata

SEQ ID NO: 481532 - DNA, 25 bp, Rattus norvegicus
gtagagcctgacagctgggcacatc

SEQ ID NO: 481533 - DNA, 25 bp, Rattus norvegicus
gtagagcctgactgctgggcacatc

SEQ ID NO: 481534 - DNA, 25 bp, Rattus norvegicus
gtagagccttaaagcagagaggaac

SEQ ID NO: 481535 - DNA, 25 bp, Rattus norvegicus
gtagagccttaatgcagagaggaac

SEQ ID NO: 481536 - DNA, 25 bp, Rattus norvegicus
gtagagcgacttctcaaaagtgttg

SEQ ID NO: 481537 - DNA, 25 bp, Rattus norvegicus
gtagagcgacttgtcaaaagtgttg

SEQ ID NO: 481538 - DNA, 25 bp, Rattus norvegicus
gtagagcgaggcctcatcctctgtg

SEQ ID NO: 481539 - DNA, 25 bp, Rattus norvegicus
gtagagcgaggcgtcatcctctgtg

SEQ ID NO: 481540 - DNA, 25 bp, Rattus norvegicus
gtagagctacctatagacctttgaa

SEQ ID NO: 481541 - DNA, 25 bp, Rattus norvegicus
gtagagctacctttagacctttgaa

SEQ ID NO: 481542 - DNA, 25 bp, Rattus norvegicus
gtagagctagccaatacaccacact

SEQ ID NO: 481543 - DNA, 25 bp, Rattus norvegicus
gtagagctagcctatacaccacact

SEQ ID NO: 481544 - DNA, 25 bp, Rattus norvegicus
gtagagctaggtctctgtggcaaat

SEQ ID NO: 481545 - DNA, 25 bp, Rattus norvegicus
gtagagctaggtgtctgtggcaaat

SEQ ID NO: 481546 - DNA, 25 bp, Rattus norvegicus
gtagagctcgctcatgctgactggc

SEQ ID NO: 481547 - DNA, 25 bp, Rattus norvegicus
gtagagctcgctgatgctgactggc

SEQ ID NO: 481548 - DNA, 25 bp, Rattus norvegicus
gtagagctcgtactgatgtctcctc

SEQ ID NO: 481549 - DNA, 25 bp, Rattus norvegicus
gtagagctcgtagtgatgtctcctc

SEQ ID NO: 481550 - DNA, 25 bp, Rattus norvegicus
gtagagctctacagtacctgtcctg

SEQ ID NO: 481551 - DNA, 25 bp, Rattus norvegicus
gtagagctctactgtacctgtcctg

SEQ ID NO: 481552 - DNA, 25 bp, Rattus norvegicus
gtagagctctctagactctgcacaa

SEQ ID NO: 481553 - DNA, 25 bp, Rattus norvegicus
gtagagctctcttgactctgcacaa

SEQ ID NO: 481554 - DNA, 25 bp, Rattus norvegicus
gtagagctgcaacagcacctccgga

SEQ ID NO: 481555 - DNA, 25 bp, Rattus norvegicus
gtagagctgcaagagcacctccgga

SEQ ID NO: 481556 - DNA, 25 bp, Rattus norvegicus
gtagagctgtaaaaggtgaccttaa

SEQ ID NO: 481557 - DNA, 25 bp, Rattus norvegicus
gtagagctgtaataggtgaccttaa

SEQ ID NO: 481558 - DNA, 25 bp, Rattus norvegicus
gtagagcttcagaatgtgcctcata

SEQ ID NO: 481559 - DNA, 25 bp, Rattus norvegicus
gtagagcttcagtatgtgcctcata

SEQ ID NO: 481560 - DNA, 25 bp, Rattus norvegicus
gtagagcttcatactgggcagaggc

SEQ ID NO: 481561 - DNA, 25 bp, Rattus norvegicus
gtagagcttcattctgggcagaggc

SEQ ID NO: 481562 - DNA, 25 bp, Rattus norvegicus
gtagagcttctgagtttgcacctca

SEQ ID NO: 481563 - DNA, 25 bp, Rattus norvegicus
gtagagcttctgtgtttgcacctca

SEQ ID NO: 481564 - DNA, 25 bp, Rattus norvegicus
gtagagcttggtccctctcaggttc

SEQ ID NO: 481565 - DNA, 25 bp, Rattus norvegicus
gtagagcttggtgcctctcaggttc

SEQ ID NO: 481566 - DNA, 25 bp, Rattus norvegicus
gtagagcttgtcagtgaccacaacc

SEQ ID NO: 481567 - DNA, 25 bp, Rattus norvegicus
gtagagcttgtctgtgaccacaacc

SEQ ID NO: 481568 - DNA, 25 bp, Rattus norvegicus
gtagaggacaatcacgccccttgat

SEQ ID NO: 481569 - DNA, 25 bp, Rattus norvegicus
gtagaggacaatgacgccccttgat

SEQ ID NO: 481570 - DNA, 25 bp, Rattus norvegicus
gtagaggacctgacttcactggagg

SEQ ID NO: 481571 - DNA, 25 bp, Rattus norvegicus
gtagaggacctgtcttcactggagg

SEQ ID NO: 481572 - DNA, 25 bp, Rattus norvegicus
gtagaggactacagataccccatgt

SEQ ID NO: 481573 - DNA, 25 bp, Rattus norvegicus
gtagaggactactgataccccatgt

SEQ ID NO: 481574 - DNA, 25 bp, Rattus norvegicus
gtagaggactcccaacatggacata

SEQ ID NO: 481575 - DNA, 25 bp, Rattus norvegicus
gtagaggactccgaacatggacata

SEQ ID NO: 481576 - DNA, 25 bp, Rattus norvegicus
gtagaggagctacagagtcgctaca

SEQ ID NO: 481577 - DNA, 25 bp, Rattus norvegicus
gtagaggagctagagagtcgctaca

SEQ ID NO: 481578 - DNA, 25 bp, Rattus norvegicus
gtagaggcaagcacaaaggctggat

SEQ ID NO: 481579 - DNA, 25 bp, Rattus norvegicus
gtagaggcaagctcaaaggctggat

SEQ ID NO: 481580 - DNA, 25 bp, Rattus norvegicus
gtagaggcaggtctcagcaaaaacc

SEQ ID NO: 481581 - DNA, 25 bp, Rattus norvegicus
gtagaggcaggtgtcagcaaaaacc

SEQ ID NO: 481582 - DNA, 25 bp, Rattus norvegicus
gtagaggcccaaacagggaccgacc

SEQ ID NO: 481583 - DNA, 25 bp, Rattus norvegicus
gtagaggcccaatcagggaccgacc

SEQ ID NO: 481584 - DNA, 25 bp, Rattus norvegicus
gtagaggccctgaccactctggagg

SEQ ID NO: 481585 - DNA, 25 bp, Rattus norvegicus
gtagaggccctgtccactctggagg

SEQ ID NO: 481586 - DNA, 25 bp, Rattus norvegicus
gtagaggcccttcatgaggacagtt

SEQ ID NO: 481587 - DNA, 25 bp, Rattus norvegicus
gtagaggcccttgatgaggacagtt

SEQ ID NO: 481588 - DNA, 25 bp, Rattus norvegicus
gtagaggccgagatccaggcatact

SEQ ID NO: 481589 - DNA, 25 bp, Rattus norvegicus
gtagaggccgagttccaggcatact

SEQ ID NO: 481590 - DNA, 25 bp, Rattus norvegicus
gtagaggccggtcttgaacccaact

SEQ ID NO: 481591 - DNA, 25 bp, Rattus norvegicus
gtagaggccggtgttgaacccaact

SEQ ID NO: 481592 - DNA, 25 bp, Rattus norvegicus
gtagaggccgtcatgtacggtcctt

SEQ ID NO: 481593 - DNA, 25 bp, Rattus norvegicus
gtagaggccgtcttgtacggtcctt

SEQ ID NO: 481594 - DNA, 25 bp, Rattus norvegicus
gtagaggcctctatctttcctaaga

SEQ ID NO: 481595 - DNA, 25 bp, Rattus norvegicus
gtagaggcctctttctttcctaaga

SEQ ID NO: 481596 - DNA, 25 bp, Rattus norvegicus
gtagaggcgactaggtcacaccttt

SEQ ID NO: 481597 - DNA, 25 bp, Rattus norvegicus
gtagaggcgacttggtcacaccttt

SEQ ID NO: 481598 - DNA, 25 bp, Rattus norvegicus
gtagaggctctgatttggaattaaa

SEQ ID NO: 481599 - DNA, 25 bp, Rattus norvegicus
gtagaggctctgttttggaattaaa

SEQ ID NO: 481600 - DNA, 25 bp, Rattus norvegicus
gtagaggctttcatacttgatgcat

SEQ ID NO: 481601 - DNA, 25 bp, Rattus norvegicus
gtagaggctttcttacttgatgcat

SEQ ID NO: 481602 - DNA, 25 bp, Rattus norvegicus
gtagaggtcatgcagtttcctcctc

SEQ ID NO: 481603 - DNA, 25 bp, Rattus norvegicus
gtagaggtcatggagtttcctcctc

SEQ ID NO: 481604 - DNA, 25 bp, Rattus norvegicus
gtagaggtcctaagtttgctccact

SEQ ID NO: 481605 - DNA, 25 bp, Rattus norvegicus
gtagaggtcctatgtttgctccact

SEQ ID NO: 481606 - DNA, 25 bp, Rattus norvegicus
gtagaggtctctattacagcaaggt

SEQ ID NO: 481607 - DNA, 25 bp, Rattus norvegicus
gtagaggtctcttttacagcaaggt

SEQ ID NO: 481608 - DNA, 25 bp, Rattus norvegicus
gtagaggtgaaacccatgagtgtta

SEQ ID NO: 481609 - DNA, 25 bp, Rattus norvegicus
gtagaggtgaaagccatgagtgtta

SEQ ID NO: 481610 - DNA, 25 bp, Rattus norvegicus
gtagagtaccacaggaacctctgca

SEQ ID NO: 481611 - DNA, 25 bp, Rattus norvegicus
gtagagtaccactggaacctctgca

SEQ ID NO: 481612 - DNA, 25 bp, Rattus norvegicus
gtagagtactagacgccttttgcct

SEQ ID NO: 481613 - DNA, 25 bp, Rattus norvegicus
gtagagtactagtcgccttttgcct

SEQ ID NO: 481614 - DNA, 25 bp, Rattus norvegicus
gtagagtactgcactccgactacat

SEQ ID NO: 481615 - DNA, 25 bp, Rattus norvegicus
gtagagtactgctctccgactacat

SEQ ID NO: 481616 - DNA, 25 bp, Rattus norvegicus
gtagagtatcaaatgtccctggaaa

SEQ ID NO: 481617 - DNA, 25 bp, Rattus norvegicus
gtagagtatcaattgtccctggaaa

SEQ ID NO: 481618 - DNA, 25 bp, Rattus norvegicus
gtagagtatgataccgagatccgga

SEQ ID NO: 481619 - DNA, 25 bp, Rattus norvegicus
gtagagtatgattccgagatccgga

SEQ ID NO: 481620 - DNA, 25 bp, Rattus norvegicus
gtagagtcctaacttctttggttca

SEQ ID NO: 481621 - DNA, 25 bp, Rattus norvegicus
gtagagtcctaagttctttggttca

SEQ ID NO: 481622 - DNA, 25 bp, Rattus norvegicus
gtagagtcctagagatgcatcttta

SEQ ID NO: 481623 - DNA, 25 bp, Rattus norvegicus
gtagagtcctagtgatgcatcttta

SEQ ID NO: 481624 - DNA, 25 bp, Rattus norvegicus
gtagagtccttgactgactcatgca

SEQ ID NO: 481625 - DNA, 25 bp, Rattus norvegicus
gtagagtccttgtctgactcatgca

SEQ ID NO: 481626 - DNA, 25 bp, Rattus norvegicus
gtagagtcgcatctatgtggccaaa

SEQ ID NO: 481627 - DNA, 25 bp, Rattus norvegicus
gtagagtcgcatgtatgtggccaaa

SEQ ID NO: 481628 - DNA, 25 bp, Rattus norvegicus
gtagagtctgcaaacatttcagtat

SEQ ID NO: 481629 - DNA, 25 bp, Rattus norvegicus
gtagagtctgcatacatttcagtat

SEQ ID NO: 481630 - DNA, 25 bp, Rattus norvegicus
gtagagtctgctcgtgccattgtaa

SEQ ID NO: 481631 - DNA, 25 bp, Rattus norvegicus
gtagagtctgctggtgccattgtaa

SEQ ID NO: 481632 - DNA, 25 bp, Rattus norvegicus
gtagagtgccagagccaccggctga

SEQ ID NO: 481633 - DNA, 25 bp, Rattus norvegicus
gtagagtgccagtgccaccggctga

SEQ ID NO: 481634 - DNA, 25 bp, Rattus norvegicus
gtagagtgcgagctcatcagccttg

SEQ ID NO: 481635 - DNA, 25 bp, Rattus norvegicus
gtagagtgcgaggtcatcagccttg

SEQ ID NO: 481636 - DNA, 25 bp, Rattus norvegicus
gtagagttacaccacacttcacgcc

SEQ ID NO: 481637 - DNA, 25 bp, Rattus norvegicus
gtagagttacacgacacttcacgcc

SEQ ID NO: 481638 - DNA, 25 bp, Rattus norvegicus
gtagagttacgtatcgggctgcaaa

SEQ ID NO: 481639 - DNA, 25 bp, Rattus norvegicus
gtagagttacgtttcgggctgcaaa

SEQ ID NO: 481640 - DNA, 25 bp, Rattus norvegicus
gtagagttcactcaggactgcccct

SEQ ID NO: 481641 - DNA, 25 bp, Rattus norvegicus
gtagagttcactgaggactgcccct

SEQ ID NO: 481642 - DNA, 25 bp, Rattus norvegicus
gtagagttcatacacactagggata

SEQ ID NO: 481643 - DNA, 25 bp, Rattus norvegicus
gtagagttcatagacactagggata

SEQ ID NO: 481644 - DNA, 25 bp, Rattus norvegicus
gtagagttcgttacattatatatac

SEQ ID NO: 481645 - DNA, 25 bp, Rattus norvegicus
gtagagttcgtttcattatatatac

SEQ ID NO: 481646 - DNA, 25 bp, Rattus norvegicus
gtagagttctccctgagggctgaac

SEQ ID NO: 481647 - DNA, 25 bp, Rattus norvegicus
gtagagttctccgtgagggctgaac

SEQ ID NO: 481648 - DNA, 25 bp, Rattus norvegicus
gtagagttgtaaatgcacctcccct

SEQ ID NO: 481649 - DNA, 25 bp, Rattus norvegicus
gtagagttgtaattgcacctcccct

SEQ ID NO: 481650 - DNA, 25 bp, Rattus norvegicus
gtagagtttatcatcctttggctag

SEQ ID NO: 481651 - DNA, 25 bp, Rattus norvegicus
gtagagtttatcttcctttggctag

SEQ ID NO: 481652 - DNA, 25 bp, Rattus norvegicus
gtagagtttgagacgtgctttgttc

SEQ ID NO: 481653 - DNA, 25 bp, Rattus norvegicus
gtagagtttgagtcgtgctttgttc

SEQ ID NO: 481654 - DNA, 25 bp, Rattus norvegicus
gtagagtttgttcttgcttttccat

SEQ ID NO: 481655 - DNA, 25 bp, Rattus norvegicus
gtagagtttgttgttgcttttccat

SEQ ID NO: 481656 - DNA, 25 bp, Rattus norvegicus
gtagataagtcgacttcccaactga

SEQ ID NO: 481657 - DNA, 25 bp, Rattus norvegicus
gtagataagtcgtcttcccaactga

SEQ ID NO: 481658 - DNA, 25 bp, Rattus norvegicus
gtagataatatactgccttccgcct

SEQ ID NO: 481659 - DNA, 25 bp, Rattus norvegicus
gtagataatatagtgccttccgcct

SEQ ID NO: 481660 - DNA, 25 bp, Rattus norvegicus
gtagataatcctacgaaaacagctt

SEQ ID NO: 481661 - DNA, 25 bp, Rattus norvegicus
gtagataatccttcgaaaacagctt

SEQ ID NO: 481662 - DNA, 25 bp, Rattus norvegicus
gtagataatgctatgccctgcacag

SEQ ID NO: 481663 - DNA, 25 bp, Rattus norvegicus
gtagataatgctttgccctgcacag

SEQ ID NO: 481664 - DNA, 25 bp, Rattus norvegicus
gtagatactaaactcagacacttca

SEQ ID NO: 481665 - DNA, 25 bp, Rattus norvegicus
gtagatactaaagtcagacacttca

SEQ ID NO: 481666 - DNA, 25 bp, Rattus norvegicus
gtagatagaaagcaccctgtccctg

SEQ ID NO: 481667 - DNA, 25 bp, Rattus norvegicus
gtagatagaaaggaccctgtccctg

SEQ ID NO: 481668 - DNA, 25 bp, Rattus norvegicus
gtagatagcagtccctggtactctg

SEQ ID NO: 481669 - DNA, 25 bp, Rattus norvegicus
gtagatagcagtgcctggtactctg

SEQ ID NO: 481670 - DNA, 25 bp, Rattus norvegicus
gtagatatccttcactggcaggcgc

SEQ ID NO: 481671 - DNA, 25 bp, Rattus norvegicus
gtagatatccttgactggcaggcgc

SEQ ID NO: 481672 - DNA, 25 bp, Rattus norvegicus
gtagatatgaccaccttgtctgggt

SEQ ID NO: 481673 - DNA, 25 bp, Rattus norvegicus
gtagatatgacctccttgtctgggt

SEQ ID NO: 481674 - DNA, 25 bp, Rattus norvegicus
gtagatattaaacacctctccaggt

SEQ ID NO: 481675 - DNA, 25 bp, Rattus norvegicus
gtagatattaaagacctctccaggt

SEQ ID NO: 481676 - DNA, 25 bp, Rattus norvegicus
gtagatattacacccaggagagcgt

SEQ ID NO: 481677 - DNA, 25 bp, Rattus norvegicus
gtagatattacagccaggagagcgt

SEQ ID NO: 481678 - DNA, 25 bp, Rattus norvegicus
gtagatattcagcaggccactgtgt

SEQ ID NO: 481679 - DNA, 25 bp, Rattus norvegicus
gtagatattcaggaggccactgtgt

SEQ ID NO: 481680 - DNA, 25 bp, Rattus norvegicus
gtagatcaaagcaattttctcatgc

SEQ ID NO: 481681 - DNA, 25 bp, Rattus norvegicus
gtagatcaaagctattttctcatgc

SEQ ID NO: 481682 - DNA, 25 bp, Rattus norvegicus
gtagatcaaataattccccaaggaa

SEQ ID NO: 481683 - DNA, 25 bp, Rattus norvegicus
gtagatcaaatatttccccaaggaa

SEQ ID NO: 481684 - DNA, 25 bp, Rattus norvegicus
gtagatcaccacagcaacttgttcc

SEQ ID NO: 481685 - DNA, 25 bp, Rattus norvegicus
gtagatcaccactgcaacttgttcc

SEQ ID NO: 481686 - DNA, 25 bp, Rattus norvegicus
gtagatcacttcagtgcccaaatgc

SEQ ID NO: 481687 - DNA, 25 bp, Rattus norvegicus
gtagatcacttctgtgcccaaatgc

SEQ ID NO: 481688 - DNA, 25 bp, Rattus norvegicus
gtagatcagttccttagcttgcata

SEQ ID NO: 481689 - DNA, 25 bp, Rattus norvegicus
gtagatcagttcgttagcttgcata

SEQ ID NO: 481690 - DNA, 25 bp, Rattus norvegicus
gtagatccacttaggcttcggcaag

SEQ ID NO: 481691 - DNA, 25 bp, Rattus norvegicus
gtagatccactttggcttcggcaag

SEQ ID NO: 481692 - DNA, 25 bp, Rattus norvegicus
gtagatccatgtatagtctccaggg

SEQ ID NO: 481693 - DNA, 25 bp, Rattus norvegicus
gtagatccatgtttagtctccaggg

SEQ ID NO: 481694 - DNA, 25 bp, Rattus norvegicus
gtagatccccagaggtcctttgatg

SEQ ID NO: 481695 - DNA, 25 bp, Rattus norvegicus
gtagatccccagtggtcctttgatg

SEQ ID NO: 481696 - DNA, 25 bp, Rattus norvegicus
gtagatccgagtctagcctgaccta

SEQ ID NO: 481697 - DNA, 25 bp, Rattus norvegicus
gtagatccgagtgtagcctgaccta

SEQ ID NO: 481698 - DNA, 25 bp, Rattus norvegicus
gtagatcctgacctctctattagat

SEQ ID NO: 481699 - DNA, 25 bp, Rattus norvegicus
gtagatcctgacgtctctattagat

SEQ ID NO: 481700 - DNA, 25 bp, Rattus norvegicus
gtagatcctttcagttgtgttacaa

SEQ ID NO: 481701 - DNA, 25 bp, Rattus norvegicus
gtagatcctttctgttgtgttacaa

SEQ ID NO: 481702 - DNA, 25 bp, Rattus norvegicus
gtagatctaggcctgtggcagccaa

SEQ ID NO: 481703 - DNA, 25 bp, Rattus norvegicus
gtagatctaggcgtgtggcagccaa

SEQ ID NO: 481704 - DNA, 25 bp, Rattus norvegicus
gtagatctcatccttgggtagcttc

SEQ ID NO: 481705 - DNA, 25 bp, Rattus norvegicus
gtagatctcatcgttgggtagcttc

SEQ ID NO: 481706 - DNA, 25 bp, Rattus norvegicus
gtagatctcattcacgtggtttcca

SEQ ID NO: 481707 - DNA, 25 bp, Rattus norvegicus
gtagatctcattgacgtggtttcca

SEQ ID NO: 481708 - DNA, 25 bp, Rattus norvegicus
gtagatctcctcatagggctttaag

SEQ ID NO: 481709 - DNA, 25 bp, Rattus norvegicus
gtagatctcctcttagggctttaag

SEQ ID NO: 481710 - DNA, 25 bp, Rattus norvegicus
gtagatctggctcgcactgaaccca

SEQ ID NO: 481711 - DNA, 25 bp, Rattus norvegicus
gtagatctggctggcactgaaccca

SEQ ID NO: 481712 - DNA, 25 bp, Rattus norvegicus
gtagatctgggaaccttccaagttg

SEQ ID NO: 481713 - DNA, 25 bp, Rattus norvegicus
gtagatctgggatccttccaagttg

SEQ ID NO: 481714 - DNA, 25 bp, Rattus norvegicus
gtagatctgttgactgtctggtttc

SEQ ID NO: 481715 - DNA, 25 bp, Rattus norvegicus
gtagatctgttgtctgtctggtttc

SEQ ID NO: 481716 - DNA, 25 bp, Rattus norvegicus
gtagatcttcatattattgcgttag

SEQ ID NO: 481717 - DNA, 25 bp, Rattus norvegicus
gtagatcttcattttattgcgttag

SEQ ID NO: 481718 - DNA, 25 bp, Rattus norvegicus
gtagatcttgtcagctttgacctca

SEQ ID NO: 481719 - DNA, 25 bp, Rattus norvegicus
gtagatcttgtctgctttgacctca

SEQ ID NO: 481720 - DNA, 25 bp, Rattus norvegicus
gtagatctttacaaccaaaatgggc

SEQ ID NO: 481721 - DNA, 25 bp, Rattus norvegicus
gtagatctttactaccaaaatgggc

SEQ ID NO: 481722 - DNA, 25 bp, Rattus norvegicus
gtagatctttctatttgaggcaaac

SEQ ID NO: 481723 - DNA, 25 bp, Rattus norvegicus
gtagatctttctttttgaggcaaac

SEQ ID NO: 481724 - DNA, 25 bp, Rattus norvegicus
gtagatctttgcactttgtgtcaca

SEQ ID NO: 481725 - DNA, 25 bp, Rattus norvegicus
gtagatctttgccaacattctgttc

SEQ ID NO: 481726 - DNA, 25 bp, Rattus norvegicus
gtagatctttgcgaacattctgttc

SEQ ID NO: 481727 - DNA, 25 bp, Rattus norvegicus
gtagatctttgctctttgtgtcaca

SEQ ID NO: 481728 - DNA, 25 bp, Rattus norvegicus
gtagatcttttaaaccaactgctgg

SEQ ID NO: 481729 - DNA, 25 bp, Rattus norvegicus
gtagatcttttataccaactgctgg

SEQ ID NO: 481730 - DNA, 25 bp, Rattus norvegicus
gtagatgaaaccctctcagacgcca

SEQ ID NO: 481731 - DNA, 25 bp, Rattus norvegicus
gtagatgaaaccgtctcagacgcca

SEQ ID NO: 481732 - DNA, 25 bp, Rattus norvegicus
gtagatgaagttaccgagggtgttt

SEQ ID NO: 481733 - DNA, 25 bp, Rattus norvegicus
gtagatgaagtttccgagggtgttt

SEQ ID NO: 481734 - DNA, 25 bp, Rattus norvegicus
gtagatgagtcacgctgctcttgaa

SEQ ID NO: 481735 - DNA, 25 bp, Rattus norvegicus
gtagatgagtcaggctgctcttgaa

SEQ ID NO: 481736 - DNA, 25 bp, Rattus norvegicus
gtagatgatgatctgcccagcctgt

SEQ ID NO: 481737 - DNA, 25 bp, Rattus norvegicus
gtagatgatgatgtgcccagcctgt

SEQ ID NO: 481738 - DNA, 25 bp, Rattus norvegicus
gtagatgcatgtcacttgaggtaca

SEQ ID NO: 481739 - DNA, 25 bp, Rattus norvegicus
gtagatgcatgtgacttgaggtaca

SEQ ID NO: 481740 - DNA, 25 bp, Rattus norvegicus
gtagatgcattgactccagaatata

SEQ ID NO: 481741 - DNA, 25 bp, Rattus norvegicus
gtagatgcattgtctccagaatata

SEQ ID NO: 481742 - DNA, 25 bp, Rattus norvegicus
gtagatgccaaacgtgcccattaaa

SEQ ID NO: 481743 - DNA, 25 bp, Rattus norvegicus
gtagatgccaaaggtgcccattaaa

SEQ ID NO: 481744 - DNA, 25 bp, Rattus norvegicus
gtagatgccacgagattgactcctc

SEQ ID NO: 481745 - DNA, 25 bp, Rattus norvegicus
gtagatgccacgtgattgactcctc

SEQ ID NO: 481746 - DNA, 25 bp, Rattus norvegicus
gtagatgccattattcatttgttga

SEQ ID NO: 481747 - DNA, 25 bp, Rattus norvegicus
gtagatgccatttttcatttgttga

SEQ ID NO: 481748 - DNA, 25 bp, Rattus norvegicus
gtagatgccgccaaagcctatgagg

SEQ ID NO: 481749 - DNA, 25 bp, Rattus norvegicus
gtagatgccgcctaagcctatgagg

SEQ ID NO: 481750 - DNA, 25 bp, Rattus norvegicus
gtagatgccgtaaaggaccgcccac

SEQ ID NO: 481751 - DNA, 25 bp, Rattus norvegicus
gtagatgccgtataggaccgcccac

SEQ ID NO: 481752 - DNA, 25 bp, Rattus norvegicus
gtagatgccttcactatccagggac

SEQ ID NO: 481753 - DNA, 25 bp, Rattus norvegicus
gtagatgccttctctatccagggac

SEQ ID NO: 481754 - DNA, 25 bp, Rattus norvegicus
gtagatgctacaaacccatgtgcag

SEQ ID NO: 481755 - DNA, 25 bp, Rattus norvegicus
gtagatgctacatacccatgtgcag

SEQ ID NO: 481756 - DNA, 25 bp, Rattus norvegicus
gtagatgctcatattcagtcctttg

SEQ ID NO: 481757 - DNA, 25 bp, Rattus norvegicus
gtagatgctcattttcagtcctttg

SEQ ID NO: 481758 - DNA, 25 bp, Rattus norvegicus
gtagatgctgctattctcagtagag

SEQ ID NO: 481759 - DNA, 25 bp, Rattus norvegicus
gtagatgctgcttttctcagtagag

SEQ ID NO: 481760 - DNA, 25 bp, Rattus norvegicus
gtagatgctttaacttttcagtagc

SEQ ID NO: 481761 - DNA, 25 bp, Rattus norvegicus
gtagatgctttatcttttcagtagc

SEQ ID NO: 481762 - DNA, 25 bp, Rattus norvegicus
gtagatgctttgagccgatctcata

SEQ ID NO: 481763 - DNA, 25 bp, Rattus norvegicus
gtagatgctttgtgccgatctcata

SEQ ID NO: 481764 - DNA, 25 bp, Rattus norvegicus
gtagatggagcgcttgctacccaag

SEQ ID NO: 481765 - DNA, 25 bp, Rattus norvegicus
gtagatggagcggttgctacccaag

SEQ ID NO: 481766 - DNA, 25 bp, Rattus norvegicus
gtagatggcatcacccctcaggaag

SEQ ID NO: 481767 - DNA, 25 bp, Rattus norvegicus
gtagatggcatctcccctcaggaag

SEQ ID NO: 481768 - DNA, 25 bp, Rattus norvegicus
gtagatggcccaacatgctttcaca

SEQ ID NO: 481769 - DNA, 25 bp, Rattus norvegicus
gtagatggcccatcatgctttcaca

SEQ ID NO: 481770 - DNA, 25 bp, Rattus norvegicus
gtagatgggcagagaaccagcacct

SEQ ID NO: 481771 - DNA, 25 bp, Rattus norvegicus
gtagatgggcagtgaaccagcacct

SEQ ID NO: 481772 - DNA, 25 bp, Rattus norvegicus
gtagatgggctcagtcaccttagga

SEQ ID NO: 481773 - DNA, 25 bp, Rattus norvegicus
gtagatgggctctgtcaccttagga

SEQ ID NO: 481774 - DNA, 25 bp, Rattus norvegicus
gtagatggttcactactgctgggta

SEQ ID NO: 481775 - DNA, 25 bp, Rattus norvegicus
gtagatggttcagtactgctgggta

SEQ ID NO: 481776 - DNA, 25 bp, Rattus norvegicus
gtagatggttttcctgtagttccct

SEQ ID NO: 481777 - DNA, 25 bp, Rattus norvegicus
gtagatggttttgctgtagttccct

SEQ ID NO: 481778 - DNA, 25 bp, Rattus norvegicus
gtagatgtacagctggcctgcctga

SEQ ID NO: 481779 - DNA, 25 bp, Rattus norvegicus
gtagatgtacaggtggcctgcctga

SEQ ID NO: 481780 - DNA, 25 bp, Rattus norvegicus
gtagatgtaggcagaatccctggaa

SEQ ID NO: 481781 - DNA, 25 bp, Rattus norvegicus
gtagatgtaggctgaatccctggaa

SEQ ID NO: 481782 - DNA, 25 bp, Rattus norvegicus
gtagatgtatctacacgttgtaaat

SEQ ID NO: 481783 - DNA, 25 bp, Rattus norvegicus
gtagatgtatcttcacgttgtaaat

SEQ ID NO: 481784 - DNA, 25 bp, Rattus norvegicus
gtagatgtcgtcagggtccatgccg

SEQ ID NO: 481785 - DNA, 25 bp, Rattus norvegicus
gtagatgtcgtctgggtccatgccg

SEQ ID NO: 481786 - DNA, 25 bp, Rattus norvegicus
gtagatgtctgtagtactttcttgc

SEQ ID NO: 481787 - DNA, 25 bp, Rattus norvegicus
gtagatgtctgttgtactttcttgc

SEQ ID NO: 481788 - DNA, 25 bp, Rattus norvegicus
gtagatgtgtttccctccaccaaga

SEQ ID NO: 481789 - DNA, 25 bp, Rattus norvegicus
gtagatgtgtttgcctccaccaaga

SEQ ID NO: 481790 - DNA, 25 bp, Rattus norvegicus
gtagatgttaccaggcctttatttc

SEQ ID NO: 481791 - DNA, 25 bp, Rattus norvegicus
gtagatgttacctggcctttatttc

SEQ ID NO: 481792 - DNA, 25 bp, Rattus norvegicus
gtagatgttcacaggattttacaaa

SEQ ID NO: 481793 - DNA, 25 bp, Rattus norvegicus
gtagatgttcactggattttacaaa

SEQ ID NO: 481794 - DNA, 25 bp, Rattus norvegicus
gtagatgttgatccggctgaatccc

SEQ ID NO: 481795 - DNA, 25 bp, Rattus norvegicus
gtagatgttgatgcggctgaatccc

SEQ ID NO: 481796 - DNA, 25 bp, Rattus norvegicus
gtagatgttttacactcgtggtatt

SEQ ID NO: 481797 - DNA, 25 bp, Rattus norvegicus
gtagatgttttagactcgtggtatt

SEQ ID NO: 481798 - DNA, 25 bp, Rattus norvegicus
gtagattaaatcatccccatacgga

SEQ ID NO: 481799 - DNA, 25 bp, Rattus norvegicus
gtagattaaatcttccccatacgga

SEQ ID NO: 481800 - DNA, 25 bp, Rattus norvegicus
gtagattaacatagcctcagtttcc

SEQ ID NO: 481801 - DNA, 25 bp, Rattus norvegicus
gtagattaacattgcctcagtttcc

SEQ ID NO: 481802 - DNA, 25 bp, Rattus norvegicus
gtagattacaatatccctgattcgg

SEQ ID NO: 481803 - DNA, 25 bp, Rattus norvegicus
gtagattacaatttccctgattcgg

SEQ ID NO: 481804 - DNA, 25 bp, Rattus norvegicus
gtagattagcatcttttgcctgcaa

SEQ ID NO: 481805 - DNA, 25 bp, Rattus norvegicus
gtagattagcatgttttgcctgcaa

SEQ ID NO: 481806 - DNA, 25 bp, Rattus norvegicus
gtagattatcagacagtgccacgaa

SEQ ID NO: 481807 - DNA, 25 bp, Rattus norvegicus
gtagattatcagtcagtgccacgaa

SEQ ID NO: 481808 - DNA, 25 bp, Rattus norvegicus
gtagattattcaagcactctgagaa

SEQ ID NO: 481809 - DNA, 25 bp, Rattus norvegicus
gtagattattcatgcactctgagaa

SEQ ID NO: 481810 - DNA, 25 bp, Rattus norvegicus
gtagattattctcctgggcctggac

SEQ ID NO: 481811 - DNA, 25 bp, Rattus norvegicus
gtagattattctgctgggcctggac

SEQ ID NO: 481812 - DNA, 25 bp, Rattus norvegicus
gtagattcaaccaacctaggaccaa

SEQ ID NO: 481813 - DNA, 25 bp, Rattus norvegicus
gtagattcaacctacctaggaccaa

SEQ ID NO: 481814 - DNA, 25 bp, Rattus norvegicus
gtagattccagcattgccatttctt

SEQ ID NO: 481815 - DNA, 25 bp, Rattus norvegicus
gtagattccagctttgccatttctt

SEQ ID NO: 481816 - DNA, 25 bp, Rattus norvegicus
gtagattcccagatggccgcagaaa

SEQ ID NO: 481817 - DNA, 25 bp, Rattus norvegicus
gtagattcccagttggccgcagaaa

SEQ ID NO: 481818 - DNA, 25 bp, Rattus norvegicus
gtagattcccggagggagcctcagc

SEQ ID NO: 481819 - DNA, 25 bp, Rattus norvegicus
gtagattcccggtgggagcctcagc

SEQ ID NO: 481820 - DNA, 25 bp, Rattus norvegicus
gtagattccgagactagcggatgca

SEQ ID NO: 481821 - DNA, 25 bp, Rattus norvegicus
gtagattccgagtctagcggatgca

SEQ ID NO: 481822 - DNA, 25 bp, Rattus norvegicus
gtagattctaggatttgccagtttg

SEQ ID NO: 481823 - DNA, 25 bp, Rattus norvegicus
gtagattctaggttttgccagtttg

SEQ ID NO: 481824 - DNA, 25 bp, Rattus norvegicus
gtagattctcttagctatttcccat

SEQ ID NO: 481825 - DNA, 25 bp, Rattus norvegicus
gtagattctctttgctatttcccat

SEQ ID NO: 481826 - DNA, 25 bp, Rattus norvegicus
gtagattctgaaccacaggcaccca

SEQ ID NO: 481827 - DNA, 25 bp, Rattus norvegicus
gtagattctgaagcacaggcaccca

SEQ ID NO: 481828 - DNA, 25 bp, Rattus norvegicus
gtagattcttctaggcttgctattt

SEQ ID NO: 481829 - DNA, 25 bp, Rattus norvegicus
gtagattcttcttggcttgctattt

SEQ ID NO: 481830 - DNA, 25 bp, Rattus norvegicus
gtagattgaactctgttctctgctt

SEQ ID NO: 481831 - DNA, 25 bp, Rattus norvegicus
gtagattgaactgtgttctctgctt

SEQ ID NO: 481832 - DNA, 25 bp, Rattus norvegicus
gtagattgctgccatgaccaccagt

SEQ ID NO: 481833 - DNA, 25 bp, Rattus norvegicus
gtagattgctgcgatgaccaccagt

SEQ ID NO: 481834 - DNA, 25 bp, Rattus norvegicus
gtagattgtcacatcccttgtgaga

SEQ ID NO: 481835 - DNA, 25 bp, Rattus norvegicus
gtagattgtcacttcccttgtgaga

SEQ ID NO: 481836 - DNA, 25 bp, Rattus norvegicus
gtagattgttatacccttctcaatg

SEQ ID NO: 481837 - DNA, 25 bp, Rattus norvegicus
gtagattgttattcccttctcaatg

SEQ ID NO: 481838 - DNA, 25 bp, Rattus norvegicus
gtagatttatccatgttcgggagtt

SEQ ID NO: 481839 - DNA, 25 bp, Rattus norvegicus
gtagatttatccctagtctttccca

SEQ ID NO: 481840 - DNA, 25 bp, Rattus norvegicus
gtagatttatccgtagtctttccca

SEQ ID NO: 481841 - DNA, 25 bp, Rattus norvegicus
gtagatttatccttgttcgggagtt

SEQ ID NO: 481842 - DNA, 25 bp, Rattus norvegicus
gtagatttcaccatagaaattttgt

SEQ ID NO: 481843 - DNA, 25 bp, Rattus norvegicus
gtagatttcaccttagaaattttgt

SEQ ID NO: 481844 - DNA, 25 bp, Rattus norvegicus
gtagatttcactaacttggttccgt

SEQ ID NO: 481845 - DNA, 25 bp, Rattus norvegicus
gtagatttcacttacttggttccgt

SEQ ID NO: 481846 - DNA, 25 bp, Rattus norvegicus
gtagatttcagccaattctcaatac

SEQ ID NO: 481847 - DNA, 25 bp, Rattus norvegicus
gtagatttcagcgaattctcaatac

SEQ ID NO: 481848 - DNA, 25 bp, Rattus norvegicus
gtagatttccagaggccccattgat

SEQ ID NO: 481849 - DNA, 25 bp, Rattus norvegicus
gtagatttccagtggccccattgat

SEQ ID NO: 481850 - DNA, 25 bp, Rattus norvegicus
gtagatttccttcaaaccacatgag

SEQ ID NO: 481851 - DNA, 25 bp, Rattus norvegicus
gtagatttccttgaaaccacatgag

SEQ ID NO: 481852 - DNA, 25 bp, Rattus norvegicus
gtagatttctgcattgaagtttcca

SEQ ID NO: 481853 - DNA, 25 bp, Rattus norvegicus
gtagatttctgctttgaagtttcca

SEQ ID NO: 481854 - DNA, 25 bp, Rattus norvegicus
gtagatttgtccagccaggactgat

SEQ ID NO: 481855 - DNA, 25 bp, Rattus norvegicus
gtagatttgtcctgccaggactgat

SEQ ID NO: 481856 - DNA, 25 bp, Rattus norvegicus
gtagattttattatcttccatcata

SEQ ID NO: 481857 - DNA, 25 bp, Rattus norvegicus
gtagattttattttcttccatcata

SEQ ID NO: 481858 - DNA, 25 bp, Rattus norvegicus
gtagattttcacacatgtaaagcat

SEQ ID NO: 481859 - DNA, 25 bp, Rattus norvegicus
gtagattttcactcatgtaaagcat

SEQ ID NO: 481860 - DNA, 25 bp, Rattus norvegicus
gtagattttcagcactagaaccatg

SEQ ID NO: 481861 - DNA, 25 bp, Rattus norvegicus
gtagattttcaggactagaaccatg

SEQ ID NO: 481862 - DNA, 25 bp, Rattus norvegicus
gtagattttgtcaccttgccttcaa

SEQ ID NO: 481863 - DNA, 25 bp, Rattus norvegicus
gtagattttgtctccttgccttcaa

SEQ ID NO: 481864 - DNA, 25 bp, Rattus norvegicus
gtagattttgttatcatgcctaatt

SEQ ID NO: 481865 - DNA, 25 bp, Rattus norvegicus
gtagattttgttttcatgcctaatt

SEQ ID NO: 481866 - DNA, 25 bp, Rattus norvegicus
gtagcaaaatatcctttcacctgtg

SEQ ID NO: 481867 - DNA, 25 bp, Rattus norvegicus
gtagcaaaatatgctttcacctgtg

SEQ ID NO: 481868 - DNA, 25 bp, Rattus norvegicus
gtagcaaacaggacgttccaatgat

SEQ ID NO: 481869 - DNA, 25 bp, Rattus norvegicus
gtagcaaacaggtcgttccaatgat

SEQ ID NO: 481870 - DNA, 25 bp, Rattus norvegicus
gtagcaaagacacgcaaaccctcca

SEQ ID NO: 481871 - DNA, 25 bp, Rattus norvegicus
gtagcaaagacaggcaaaccctcca

SEQ ID NO: 481872 - DNA, 25 bp, Rattus norvegicus
gtagcaaagctgcacttacctgttt

SEQ ID NO: 481873 - DNA, 25 bp, Rattus norvegicus
gtagcaaagctggacttacctgttt

SEQ ID NO: 481874 - DNA, 25 bp, Rattus norvegicus
gtagcaaagtgtcacccaggtgcaa

SEQ ID NO: 481875 - DNA, 25 bp, Rattus norvegicus
gtagcaaagtgtgacccaggtgcaa

SEQ ID NO: 481876 - DNA, 25 bp, Rattus norvegicus
gtagcaaatgcactctgtaaattat

SEQ ID NO: 481877 - DNA, 25 bp, Rattus norvegicus
gtagcaaatgcagtctgtaaattat

SEQ ID NO: 481878 - DNA, 25 bp, Rattus norvegicus
gtagcaacaacaaggtcacagaggt

SEQ ID NO: 481879 - DNA, 25 bp, Rattus norvegicus
gtagcaacaacatggtcacagaggt

SEQ ID NO: 481880 - DNA, 25 bp, Rattus norvegicus
gtagcaacaaccactgtctagatcc

SEQ ID NO: 481881 - DNA, 25 bp, Rattus norvegicus
gtagcaacaacctctgtctagatcc

SEQ ID NO: 481882 - DNA, 25 bp, Rattus norvegicus
gtagcaacaattatgagccctagtg

SEQ ID NO: 481883 - DNA, 25 bp, Rattus norvegicus
gtagcaacaattttgagccctagtg

SEQ ID NO: 481884 - DNA, 25 bp, Rattus norvegicus
gtagcaacagaccatgctggcccac

SEQ ID NO: 481885 - DNA, 25 bp, Rattus norvegicus
gtagcaacagacgatgctggcccac

SEQ ID NO: 481886 - DNA, 25 bp, Rattus norvegicus
gtagcaacgtaaagcctgccttcag

SEQ ID NO: 481887 - DNA, 25 bp, Rattus norvegicus
gtagcaacgtaatgcctgccttcag

SEQ ID NO: 481888 - DNA, 25 bp, Rattus norvegicus
gtagcaacgtctcggtttgaacgcc

SEQ ID NO: 481889 - DNA, 25 bp, Rattus norvegicus
gtagcaacgtctgggtttgaacgcc

SEQ ID NO: 481890 - DNA, 25 bp, Rattus norvegicus
gtagcaaggaagcatcacacccaag

SEQ ID NO: 481891 - DNA, 25 bp, Rattus norvegicus
gtagcaaggaaggatcacacccaag

SEQ ID NO: 481892 - DNA, 25 bp, Rattus norvegicus
gtagcaaggagaagctgtttcagct

SEQ ID NO: 481893 - DNA, 25 bp, Rattus norvegicus
gtagcaaggagatgctgtttcagct

SEQ ID NO: 481894 - DNA, 25 bp, Rattus norvegicus
gtagcaaggctaatagcattaccaa

SEQ ID NO: 481895 - DNA, 25 bp, Rattus norvegicus
gtagcaaggctattagcattaccaa

SEQ ID NO: 481896 - DNA, 25 bp, Rattus norvegicus
gtagcaagttccactattgcactga

SEQ ID NO: 481897 - DNA, 25 bp, Rattus norvegicus
gtagcaagttcctctattgcactga

SEQ ID NO: 481898 - DNA, 25 bp, Rattus norvegicus
gtagcaagttgaccctgagtaggaa

SEQ ID NO: 481899 - DNA, 25 bp, Rattus norvegicus
gtagcaagttgacctcggagttcct

SEQ ID NO: 481900 - DNA, 25 bp, Rattus norvegicus
gtagcaagttgagcctgagtaggaa

SEQ ID NO: 481901 - DNA, 25 bp, Rattus norvegicus
gtagcaagttgagctcggagttcct

SEQ ID NO: 481902 - DNA, 25 bp, Rattus norvegicus
gtagcaagttgcctgggaacaaaag

SEQ ID NO: 481903 - DNA, 25 bp, Rattus norvegicus
gtagcaagttgcgtgggaacaaaag

SEQ ID NO: 481904 - DNA, 25 bp, Rattus norvegicus
gtagcaagtttaaaccctcactgtc

SEQ ID NO: 481905 - DNA, 25 bp, Rattus norvegicus
gtagcaagtttataccctcactgtc

SEQ ID NO: 481906 - DNA, 25 bp, Rattus norvegicus
gtagcaataaatctgccatcctttt

SEQ ID NO: 481907 - DNA, 25 bp, Rattus norvegicus
gtagcaataaatgtgccatcctttt

SEQ ID NO: 481908 - DNA, 25 bp, Rattus norvegicus
gtagcaataaccaatccggtcttaa

SEQ ID NO: 481909 - DNA, 25 bp, Rattus norvegicus
gtagcaataacctatccggtcttaa

SEQ ID NO: 481910 - DNA, 25 bp, Rattus norvegicus
gtagcaatacctatatgtgctgagc

SEQ ID NO: 481911 - DNA, 25 bp, Rattus norvegicus
gtagcaatacctttatgtgctgagc

SEQ ID NO: 481912 - DNA, 25 bp, Rattus norvegicus
gtagcaatagacctttggatacatt

SEQ ID NO: 481913 - DNA, 25 bp, Rattus norvegicus
gtagcaatagacgtttggatacatt

SEQ ID NO: 481914 - DNA, 25 bp, Rattus norvegicus
gtagcaatcacgcattaactgaaga

SEQ ID NO: 481915 - DNA, 25 bp, Rattus norvegicus
gtagcaatcacggattaactgaaga

SEQ ID NO: 481916 - DNA, 25 bp, Rattus norvegicus
gtagcaatcagcctcacgaagtgtg

SEQ ID NO: 481917 - DNA, 25 bp, Rattus norvegicus
gtagcaatcagcgtcacgaagtgtg

SEQ ID NO: 481918 - DNA, 25 bp, Rattus norvegicus
gtagcaatcatcacctcttagaaaa

SEQ ID NO: 481919 - DNA, 25 bp, Rattus norvegicus
gtagcaatcatctcctcttagaaaa

SEQ ID NO: 481920 - DNA, 25 bp, Rattus norvegicus
gtagcaatctatctacggttttcaa

SEQ ID NO: 481921 - DNA, 25 bp, Rattus norvegicus
gtagcaatctatgtacggttttcaa

SEQ ID NO: 481922 - DNA, 25 bp, Rattus norvegicus
gtagcaatgaccatcaaacctgcct

SEQ ID NO: 481923 - DNA, 25 bp, Rattus norvegicus
gtagcaatgaccttcaaacctgcct

SEQ ID NO: 481924 - DNA, 25 bp, Rattus norvegicus
gtagcaatgtttacacactttctag

SEQ ID NO: 481925 - DNA, 25 bp, Rattus norvegicus
gtagcaatgttttcacactttctag

SEQ ID NO: 481926 - DNA, 25 bp, Rattus norvegicus
gtagcacaacttagatacactagta

SEQ ID NO: 481927 - DNA, 25 bp, Rattus norvegicus
gtagcacaactttgatacactagta

SEQ ID NO: 481928 - DNA, 25 bp, Rattus norvegicus
gtagcacacaccattcaccctggca

SEQ ID NO: 481929 - DNA, 25 bp, Rattus norvegicus
gtagcacacacctttcaccctggca

SEQ ID NO: 481930 - DNA, 25 bp, Rattus norvegicus
gtagcacacagaagcaactaggata

SEQ ID NO: 481931 - DNA, 25 bp, Rattus norvegicus
gtagcacacagatgcaactaggata

SEQ ID NO: 481932 - DNA, 25 bp, Rattus norvegicus
gtagcacagcacaattttactaatg

SEQ ID NO: 481933 - DNA, 25 bp, Rattus norvegicus
gtagcacagcactattttactaatg

SEQ ID NO: 481934 - DNA, 25 bp, Rattus norvegicus
gtagcacatactattaatccaacac

SEQ ID NO: 481935 - DNA, 25 bp, Rattus norvegicus
gtagcacatacttttaatccaacac

SEQ ID NO: 481936 - DNA, 25 bp, Rattus norvegicus
gtagcacatcagcacttatccaaag

SEQ ID NO: 481937 - DNA, 25 bp, Rattus norvegicus
gtagcacatcaggacttatccaaag

SEQ ID NO: 481938 - DNA, 25 bp, Rattus norvegicus
gtagcacatggtcttagcgtttttt

SEQ ID NO: 481939 - DNA, 25 bp, Rattus norvegicus
gtagcacatggtgttagcgtttttt

SEQ ID NO: 481940 - DNA, 25 bp, Rattus norvegicus
gtagcaccagcacccactctgtggg

SEQ ID NO: 481941 - DNA, 25 bp, Rattus norvegicus
gtagcaccagcagccactctgtggg

SEQ ID NO: 481942 - DNA, 25 bp, Rattus norvegicus
gtagcaccgaccacagcatctgaga

SEQ ID NO: 481943 - DNA, 25 bp, Rattus norvegicus
gtagcaccgacctcagcatctgaga

SEQ ID NO: 481944 - DNA, 25 bp, Rattus norvegicus
gtagcaccgggcacctgatggactt

SEQ ID NO: 481945 - DNA, 25 bp, Rattus norvegicus
gtagcaccgggctcctgatggactt

SEQ ID NO: 481946 - DNA, 25 bp, Rattus norvegicus
gtagcacctcaaattctatgctgaa

SEQ ID NO: 481947 - DNA, 25 bp, Rattus norvegicus
gtagcacctcaatttctatgctgaa

SEQ ID NO: 481948 - DNA, 25 bp, Rattus norvegicus
gtagcaccttagattcagctcccag

SEQ ID NO: 481949 - DNA, 25 bp, Rattus norvegicus
gtagcaccttagtttcagctcccag

SEQ ID NO: 481950 - DNA, 25 bp, Rattus norvegicus
gtagcaccttcaagtccttctttag

SEQ ID NO: 481951 - DNA, 25 bp, Rattus norvegicus
gtagcaccttcatgtccttctttag

SEQ ID NO: 481952 - DNA, 25 bp, Rattus norvegicus
gtagcacggcccctttttattgaag

SEQ ID NO: 481953 - DNA, 25 bp, Rattus norvegicus
gtagcacggcccgtttttattgaag

SEQ ID NO: 481954 - DNA, 25 bp, Rattus norvegicus
gtagcactaagccatgccatgccaa

SEQ ID NO: 481955 - DNA, 25 bp, Rattus norvegicus
gtagcactaagcgatgccatgccaa

SEQ ID NO: 481956 - DNA, 25 bp, Rattus norvegicus
gtagcactcataagtttagccaaaa

SEQ ID NO: 481957 - DNA, 25 bp, Rattus norvegicus
gtagcactcatatgtttagccaaaa

SEQ ID NO: 481958 - DNA, 25 bp, Rattus norvegicus
gtagcactcatcaactgcaactgtg

SEQ ID NO: 481959 - DNA, 25 bp, Rattus norvegicus
gtagcactcatctactgcaactgtg

SEQ ID NO: 481960 - DNA, 25 bp, Rattus norvegicus
gtagcactccagatgtaggtcagaa

SEQ ID NO: 481961 - DNA, 25 bp, Rattus norvegicus
gtagcactccagttgtaggtcagaa

SEQ ID NO: 481962 - DNA, 25 bp, Rattus norvegicus
gtagcactctacctgaggttaggct

SEQ ID NO: 481963 - DNA, 25 bp, Rattus norvegicus
gtagcactctacgtgaggttaggct

SEQ ID NO: 481964 - DNA, 25 bp, Rattus norvegicus
gtagcactcttacattacttttcct

SEQ ID NO: 481965 - DNA, 25 bp, Rattus norvegicus
gtagcactcttagattacttttcct

SEQ ID NO: 481966 - DNA, 25 bp, Rattus norvegicus
gtagcactggagcagcttcgaaagt

SEQ ID NO: 481967 - DNA, 25 bp, Rattus norvegicus
gtagcactggaggagcttcgaaagt

SEQ ID NO: 481968 - DNA, 25 bp, Rattus norvegicus
gtagcactggcaatttacagcgatg

SEQ ID NO: 481969 - DNA, 25 bp, Rattus norvegicus
gtagcactggcattttacagcgatg

SEQ ID NO: 481970 - DNA, 25 bp, Rattus norvegicus
gtagcactggccacatgggactgat

SEQ ID NO: 481971 - DNA, 25 bp, Rattus norvegicus
gtagcactggcctcatgggactgat

SEQ ID NO: 481972 - DNA, 25 bp, Rattus norvegicus
gtagcacttctgagatggtacatcc

SEQ ID NO: 481973 - DNA, 25 bp, Rattus norvegicus
gtagcacttctgtgatggtacatcc

SEQ ID NO: 481974 - DNA, 25 bp, Rattus norvegicus
gtagcactttagatccttggtttca

SEQ ID NO: 481975 - DNA, 25 bp, Rattus norvegicus
gtagcactttagttccttggtttca

SEQ ID NO: 481976 - DNA, 25 bp, Rattus norvegicus
gtagcactttgaaaccatgagacag

SEQ ID NO: 481977 - DNA, 25 bp, Rattus norvegicus
gtagcactttgataccatgagacag

SEQ ID NO: 481978 - DNA, 25 bp, Rattus norvegicus
gtagcagaaactctcagacgtgact

SEQ ID NO: 481979 - DNA, 25 bp, Rattus norvegicus
gtagcagaaactgtcagacgtgact

SEQ ID NO: 481980 - DNA, 25 bp, Rattus norvegicus
gtagcagacagccttgatgaccctt

SEQ ID NO: 481981 - DNA, 25 bp, Rattus norvegicus
gtagcagacagcgttgatgaccctt

SEQ ID NO: 481982 - DNA, 25 bp, Rattus norvegicus
gtagcagacatgaccacagttccag

SEQ ID NO: 481983 - DNA, 25 bp, Rattus norvegicus
gtagcagacatgtccacagttccag

SEQ ID NO: 481984 - DNA, 25 bp, Rattus norvegicus
gtagcagagccaatggccgtgctta

SEQ ID NO: 481985 - DNA, 25 bp, Rattus norvegicus
gtagcagagccattggccgtgctta

SEQ ID NO: 481986 - DNA, 25 bp, Rattus norvegicus
gtagcagagcccagttactgttaga

SEQ ID NO: 481987 - DNA, 25 bp, Rattus norvegicus
gtagcagagccctgttactgttaga

SEQ ID NO: 481988 - DNA, 25 bp, Rattus norvegicus
gtagcagagctaatacctccaagag

SEQ ID NO: 481989 - DNA, 25 bp, Rattus norvegicus
gtagcagagctattacctccaagag

SEQ ID NO: 481990 - DNA, 25 bp, Rattus norvegicus
gtagcagagtccatgactcacttga

SEQ ID NO: 481991 - DNA, 25 bp, Rattus norvegicus
gtagcagagtccttgactcacttga

SEQ ID NO: 481992 - DNA, 25 bp, Rattus norvegicus
gtagcagatgccaataatcccaaaa

SEQ ID NO: 481993 - DNA, 25 bp, Rattus norvegicus
gtagcagatgcctataatcccaaaa

SEQ ID NO: 481994 - DNA, 25 bp, Rattus norvegicus
gtagcagcaaatcatcccaaacaac

SEQ ID NO: 481995 - DNA, 25 bp, Rattus norvegicus
gtagcagcaaatgatcccaaacaac

SEQ ID NO: 481996 - DNA, 25 bp, Rattus norvegicus
gtagcagcaacaaccagttcttaag

SEQ ID NO: 481997 - DNA, 25 bp, Rattus norvegicus
gtagcagcaacatccagttcttaag

SEQ ID NO: 481998 - DNA, 25 bp, Rattus norvegicus
gtagcagcaatcctgtgagaccaca

SEQ ID NO: 481999 - DNA, 25 bp, Rattus norvegicus
gtagcagcaatcgtgtgagaccaca

SEQ ID NO: 482000 - DNA, 25 bp, Rattus norvegicus
gtagcagcactaacagagctcagct

SEQ ID NO: 482001 - DNA, 25 bp, Rattus norvegicus
gtagcagcactatcagagctcagct

SEQ ID NO: 482002 - DNA, 25 bp, Rattus norvegicus
gtagcagcactccatatgcaggtca

SEQ ID NO: 482003 - DNA, 25 bp, Rattus norvegicus
gtagcagcactcgatatgcaggtca

SEQ ID NO: 482004 - DNA, 25 bp, Rattus norvegicus
gtagcagcagtgaacaccaatcctc

SEQ ID NO: 482005 - DNA, 25 bp, Rattus norvegicus
gtagcagcagtgtacaccaatcctc

SEQ ID NO: 482006 - DNA, 25 bp, Rattus norvegicus
gtagcagccaaacaccatgtcagtg

SEQ ID NO: 482007 - DNA, 25 bp, Rattus norvegicus
gtagcagccaaagaccatgtcagtg

SEQ ID NO: 482008 - DNA, 25 bp, Rattus norvegicus
gtagcagccatgcaattacctggaa

SEQ ID NO: 482009 - DNA, 25 bp, Rattus norvegicus
gtagcagccatggaattacctggaa

SEQ ID NO: 482010 - DNA, 25 bp, Rattus norvegicus
gtagcagcccagacgtgccgtgaag

SEQ ID NO: 482011 - DNA, 25 bp, Rattus norvegicus
gtagcagcccagtcgtgccgtgaag

SEQ ID NO: 482012 - DNA, 25 bp, Rattus norvegicus
gtagcagcctccaatatagaaacag

SEQ ID NO: 482013 - DNA, 25 bp, Rattus norvegicus
gtagcagcctcctatatagaaacag

SEQ ID NO: 482014 - DNA, 25 bp, Rattus norvegicus
gtagcagcctctagctctgatgcgg

SEQ ID NO: 482015 - DNA, 25 bp, Rattus norvegicus
gtagcagcctcttgctctgatgcgg

SEQ ID NO: 482016 - DNA, 25 bp, Rattus norvegicus
gtagcagcctggatacaatgaaatt

SEQ ID NO: 482017 - DNA, 25 bp, Rattus norvegicus
gtagcagcctggttacaatgaaatt

SEQ ID NO: 482018 - DNA, 25 bp, Rattus norvegicus
gtagcagcgttacctctgtctagag

SEQ ID NO: 482019 - DNA, 25 bp, Rattus norvegicus
gtagcagcgttagctctgtctagag

SEQ ID NO: 482020 - DNA, 25 bp, Rattus norvegicus
gtagcagctacccaggaccagtatg

SEQ ID NO: 482021 - DNA, 25 bp, Rattus norvegicus
gtagcagctaccgaggaccagtatg

SEQ ID NO: 482022 - DNA, 25 bp, Rattus norvegicus
gtagcagctattccaatgtatcaag

SEQ ID NO: 482023 - DNA, 25 bp, Rattus norvegicus
gtagcagctattgcaatgtatcaag

SEQ ID NO: 482024 - DNA, 25 bp, Rattus norvegicus
gtagcagctctgagacactgtgaca

SEQ ID NO: 482025 - DNA, 25 bp, Rattus norvegicus
gtagcagctctgtgacactgtgaca

SEQ ID NO: 482026 - DNA, 25 bp, Rattus norvegicus
gtagcagctggaactcatccttgat

SEQ ID NO: 482027 - DNA, 25 bp, Rattus norvegicus
gtagcagctggatctcatccttgat

SEQ ID NO: 482028 - DNA, 25 bp, Rattus norvegicus
gtagcagctgtactcaccgcagttc

SEQ ID NO: 482029 - DNA, 25 bp, Rattus norvegicus
gtagcagctgtagtcaccgcagttc

SEQ ID NO: 482030 - DNA, 25 bp, Rattus norvegicus
gtagcagcttaaacccacatctgtg

SEQ ID NO: 482031 - DNA, 25 bp, Rattus norvegicus
gtagcagcttaatcccacatctgtg

SEQ ID NO: 482032 - DNA, 25 bp, Rattus norvegicus
gtagcagcttagactccctgaggct

SEQ ID NO: 482033 - DNA, 25 bp, Rattus norvegicus
gtagcagcttagtctccctgaggct

SEQ ID NO: 482034 - DNA, 25 bp, Rattus norvegicus
gtagcagcttccatgtttattttta

SEQ ID NO: 482035 - DNA, 25 bp, Rattus norvegicus
gtagcagcttccttgtttattttta

SEQ ID NO: 482036 - DNA, 25 bp, Rattus norvegicus
gtagcaggagggaaccatcttcaga

SEQ ID NO: 482037 - DNA, 25 bp, Rattus norvegicus
gtagcaggagggtaccatcttcaga

SEQ ID NO: 482038 - DNA, 25 bp, Rattus norvegicus
gtagcaggagtacccagctcccatt

SEQ ID NO: 482039 - DNA, 25 bp, Rattus norvegicus
gtagcaggagtagccagctcccatt

SEQ ID NO: 482040 - DNA, 25 bp, Rattus norvegicus
gtagcaggcagacttgctccaacag

SEQ ID NO: 482041 - DNA, 25 bp, Rattus norvegicus
gtagcaggcagagttgctccaacag

SEQ ID NO: 482042 - DNA, 25 bp, Rattus norvegicus
gtagcaggccaaccgtgagagttaa

SEQ ID NO: 482043 - DNA, 25 bp, Rattus norvegicus
gtagcaggccaagcgtgagagttaa

SEQ ID NO: 482044 - DNA, 25 bp, Rattus norvegicus
gtagcaggccatatgcaggccattt

SEQ ID NO: 482045 - DNA, 25 bp, Rattus norvegicus
gtagcaggccatttgcaggccattt

SEQ ID NO: 482046 - DNA, 25 bp, Rattus norvegicus
gtagcaggtgtcaccttggcacaga

SEQ ID NO: 482047 - DNA, 25 bp, Rattus norvegicus
gtagcaggtgtctccttggcacaga

SEQ ID NO: 482048 - DNA, 25 bp, Rattus norvegicus
gtagcaggttctatgttcagttgtt

SEQ ID NO: 482049 - DNA, 25 bp, Rattus norvegicus
gtagcaggttctttgttcagttgtt

SEQ ID NO: 482050 - DNA, 25 bp, Rattus norvegicus
gtagcagtaatacgaaagccgcaaa

SEQ ID NO: 482051 - DNA, 25 bp, Rattus norvegicus
gtagcagtaataggaaagccgcaaa

SEQ ID NO: 482052 - DNA, 25 bp, Rattus norvegicus
gtagcagtagctagctttggaattc

SEQ ID NO: 482053 - DNA, 25 bp, Rattus norvegicus
gtagcagtagcttgctttggaattc

SEQ ID NO: 482054 - DNA, 25 bp, Rattus norvegicus
gtagcagtaggtcctctgactctgt

SEQ ID NO: 482055 - DNA, 25 bp, Rattus norvegicus
gtagcagtaggtgctctgactctgt

SEQ ID NO: 482056 - DNA, 25 bp, Rattus norvegicus
gtagcagtccatctaatgtttattc

SEQ ID NO: 482057 - DNA, 25 bp, Rattus norvegicus
gtagcagtccatgtaatgtttattc

SEQ ID NO: 482058 - DNA, 25 bp, Rattus norvegicus
gtagcagtgccacggaagcgctcat

SEQ ID NO: 482059 - DNA, 25 bp, Rattus norvegicus
gtagcagtgccagggaagcgctcat

SEQ ID NO: 482060 - DNA, 25 bp, Rattus norvegicus
gtagcagtggcgcacatctgccgat

SEQ ID NO: 482061 - DNA, 25 bp, Rattus norvegicus
gtagcagtggcggacatctgccgat

SEQ ID NO: 482062 - DNA, 25 bp, Rattus norvegicus
gtagcagtgtgcagacgcatcgctt

SEQ ID NO: 482063 - DNA, 25 bp, Rattus norvegicus
gtagcagtgtgctgacgcatcgctt

SEQ ID NO: 482064 - DNA, 25 bp, Rattus norvegicus
gtagcagttaagatccatccaagta

SEQ ID NO: 482065 - DNA, 25 bp, Rattus norvegicus
gtagcagttaagttccatccaagta

SEQ ID NO: 482066 - DNA, 25 bp, Rattus norvegicus
gtagcagttcttaaatcagcagtat

SEQ ID NO: 482067 - DNA, 25 bp, Rattus norvegicus
gtagcagttctttaatcagcagtat

SEQ ID NO: 482068 - DNA, 25 bp, Rattus norvegicus
gtagcatactctaattctcctgtga

SEQ ID NO: 482069 - DNA, 25 bp, Rattus norvegicus
gtagcatactcttattctcctgtga

SEQ ID NO: 482070 - DNA, 25 bp, Rattus norvegicus
gtagcatagatgatgagctcattat

SEQ ID NO: 482071 - DNA, 25 bp, Rattus norvegicus
gtagcatagatgttgagctcattat

SEQ ID NO: 482072 - DNA, 25 bp, Rattus norvegicus
gtagcatagcagcaacacaccttgt

SEQ ID NO: 482073 - DNA, 25 bp, Rattus norvegicus
gtagcatagcaggaacacaccttgt

SEQ ID NO: 482074 - DNA, 25 bp, Rattus norvegicus
gtagcataggacacacacagttggt

SEQ ID NO: 482075 - DNA, 25 bp, Rattus norvegicus
gtagcataggactcacacagttggt

SEQ ID NO: 482076 - DNA, 25 bp, Rattus norvegicus
gtagcataggttagtgctgccacaa

SEQ ID NO: 482077 - DNA, 25 bp, Rattus norvegicus
gtagcataggtttgtgctgccacaa

SEQ ID NO: 482078 - DNA, 25 bp, Rattus norvegicus
gtagcatatgctctccaacatgttc

SEQ ID NO: 482079 - DNA, 25 bp, Rattus norvegicus
gtagcatatgctgtccaacatgttc

SEQ ID NO: 482080 - DNA, 25 bp, Rattus norvegicus
gtagcatcaatgactgttctgccct

SEQ ID NO: 482081 - DNA, 25 bp, Rattus norvegicus
gtagcatcaatgtctgttctgccct

SEQ ID NO: 482082 - DNA, 25 bp, Rattus norvegicus
gtagcatcagctccaattgctgcct

SEQ ID NO: 482083 - DNA, 25 bp, Rattus norvegicus
gtagcatcagctgcaattgctgcct

SEQ ID NO: 482084 - DNA, 25 bp, Rattus norvegicus
gtagcatcaggaacaatacactgca

SEQ ID NO: 482085 - DNA, 25 bp, Rattus norvegicus
gtagcatcaggatcaatacactgca

SEQ ID NO: 482086 - DNA, 25 bp, Rattus norvegicus
gtagcatcattgagactgctgtgat

SEQ ID NO: 482087 - DNA, 25 bp, Rattus norvegicus
gtagcatcattgtgactgctgtgat

SEQ ID NO: 482088 - DNA, 25 bp, Rattus norvegicus
gtagcatccatgctggctcaggagc

SEQ ID NO: 482089 - DNA, 25 bp, Rattus norvegicus
gtagcatccatggtggctcaggagc

SEQ ID NO: 482090 - DNA, 25 bp, Rattus norvegicus
gtagcatccccacaatgttgccctg

SEQ ID NO: 482091 - DNA, 25 bp, Rattus norvegicus
gtagcatccccagaatgttgccctg

SEQ ID NO: 482092 - DNA, 25 bp, Rattus norvegicus
gtagcatcccctctataaactctga

SEQ ID NO: 482093 - DNA, 25 bp, Rattus norvegicus
gtagcatcccctgtataaactctga

SEQ ID NO: 482094 - DNA, 25 bp, Rattus norvegicus
gtagcatcccttcggatacccacaa

SEQ ID NO: 482095 - DNA, 25 bp, Rattus norvegicus
gtagcatcccttcttatgaactgtg

SEQ ID NO: 482096 - DNA, 25 bp, Rattus norvegicus
gtagcatcccttgggatacccacaa

SEQ ID NO: 482097 - DNA, 25 bp, Rattus norvegicus
gtagcatcccttgttatgaactgtg

SEQ ID NO: 482098 - DNA, 25 bp, Rattus norvegicus
gtagcatcctggaaaggccgacttc

SEQ ID NO: 482099 - DNA, 25 bp, Rattus norvegicus
gtagcatcctggtaaggccgacttc

SEQ ID NO: 482100 - DNA, 25 bp, Rattus norvegicus
gtagcatctaccacaagagtgtctg

SEQ ID NO: 482101 - DNA, 25 bp, Rattus norvegicus
gtagcatctacctcaagagtgtctg

SEQ ID NO: 482102 - DNA, 25 bp, Rattus norvegicus
gtagcatctgctctttgtacagacg

SEQ ID NO: 482103 - DNA, 25 bp, Rattus norvegicus
gtagcatctgctgtttgtacagacg

SEQ ID NO: 482104 - DNA, 25 bp, Rattus norvegicus
gtagcatctgtaactgacctcaagc

SEQ ID NO: 482105 - DNA, 25 bp, Rattus norvegicus
gtagcatctgtatctgacctcaagc

SEQ ID NO: 482106 - DNA, 25 bp, Rattus norvegicus
gtagcatgacccaaaagacactggc

SEQ ID NO: 482107 - DNA, 25 bp, Rattus norvegicus
gtagcatgaccctaaagacactggc

SEQ ID NO: 482108 - DNA, 25 bp, Rattus norvegicus
gtagcatgactactggttccgcttt

SEQ ID NO: 482109 - DNA, 25 bp, Rattus norvegicus
gtagcatgactagtggttccgcttt

SEQ ID NO: 482110 - DNA, 25 bp, Rattus norvegicus
gtagcatgagtcatgggccttgcag

SEQ ID NO: 482111 - DNA, 25 bp, Rattus norvegicus
gtagcatgagtcttgggccttgcag

SEQ ID NO: 482112 - DNA, 25 bp, Rattus norvegicus
gtagcatgattgataccaactgcat

SEQ ID NO: 482113 - DNA, 25 bp, Rattus norvegicus
gtagcatgattgttaccaactgcat

SEQ ID NO: 482114 - DNA, 25 bp, Rattus norvegicus
gtagcatgcactccttgttttgttt

SEQ ID NO: 482115 - DNA, 25 bp, Rattus norvegicus
gtagcatgcactgcttgttttgttt

SEQ ID NO: 482116 - DNA, 25 bp, Rattus norvegicus
gtagcatgcgctctgatcgtttata

SEQ ID NO: 482117 - DNA, 25 bp, Rattus norvegicus
gtagcatgcgctgtgatcgtttata

SEQ ID NO: 482118 - DNA, 25 bp, Rattus norvegicus
gtagcatgcgtccatccagggaaac

SEQ ID NO: 482119 - DNA, 25 bp, Rattus norvegicus
gtagcatgcgtcgatccagggaaac

SEQ ID NO: 482120 - DNA, 25 bp, Rattus norvegicus
gtagcatgctgacttttctgttgaa

SEQ ID NO: 482121 - DNA, 25 bp, Rattus norvegicus
gtagcatgctgagttttctgttgaa

SEQ ID NO: 482122 - DNA, 25 bp, Rattus norvegicus
gtagcatggactactgtgttcaccc

SEQ ID NO: 482123 - DNA, 25 bp, Rattus norvegicus
gtagcatggacttctgtgttcaccc

SEQ ID NO: 482124 - DNA, 25 bp, Rattus norvegicus
gtagcatgtcatcagaattccgagg

SEQ ID NO: 482125 - DNA, 25 bp, Rattus norvegicus
gtagcatgtcatgagaattccgagg

SEQ ID NO: 482126 - DNA, 25 bp, Rattus norvegicus
gtagcatgtctgattttataccgag

SEQ ID NO: 482127 - DNA, 25 bp, Rattus norvegicus
gtagcatgtctgtttttataccgag

SEQ ID NO: 482128 - DNA, 25 bp, Rattus norvegicus
gtagcattaccgatacacagattcg

SEQ ID NO: 482129 - DNA, 25 bp, Rattus norvegicus
gtagcattaccgttacacagattcg

SEQ ID NO: 482130 - DNA, 25 bp, Rattus norvegicus
gtagcattatgaattacacccctat

SEQ ID NO: 482131 - DNA, 25 bp, Rattus norvegicus
gtagcattatgatttacacccctat

SEQ ID NO: 482132 - DNA, 25 bp, Rattus norvegicus
gtagcattcacacctgtttacttgc

SEQ ID NO: 482133 - DNA, 25 bp, Rattus norvegicus
gtagcattcacagctgtttacttgc

SEQ ID NO: 482134 - DNA, 25 bp, Rattus norvegicus
gtagcattcaccatagacacggaag

SEQ ID NO: 482135 - DNA, 25 bp, Rattus norvegicus
gtagcattcaccttagacacggaag

SEQ ID NO: 482136 - DNA, 25 bp, Rattus norvegicus
gtagcattcttacccattagacacc

SEQ ID NO: 482137 - DNA, 25 bp, Rattus norvegicus
gtagcattcttagccattagacacc

SEQ ID NO: 482138 - DNA, 25 bp, Rattus norvegicus
gtagcattgcgtaaggaggtgttta

SEQ ID NO: 482139 - DNA, 25 bp, Rattus norvegicus
gtagcattgcgttaggaggtgttta

SEQ ID NO: 482140 - DNA, 25 bp, Rattus norvegicus
gtagcattgcttaaacattgtgtaa

SEQ ID NO: 482141 - DNA, 25 bp, Rattus norvegicus
gtagcattgctttaacattgtgtaa

SEQ ID NO: 482142 - DNA, 25 bp, Rattus norvegicus
gtagcatttgttacctatcttagaa

SEQ ID NO: 482143 - DNA, 25 bp, Rattus norvegicus
gtagcatttgtttcctatcttagaa

SEQ ID NO: 482144 - DNA, 25 bp, Rattus norvegicus
gtagcattttatactttcaagtgtt

SEQ ID NO: 482145 - DNA, 25 bp, Rattus norvegicus
gtagcattttattctttcaagtgtt

SEQ ID NO: 482146 - DNA, 25 bp, Rattus norvegicus
gtagcattttccctaatcctttggt

SEQ ID NO: 482147 - DNA, 25 bp, Rattus norvegicus
gtagcattttccgtaatcctttggt

SEQ ID NO: 482148 - DNA, 25 bp, Rattus norvegicus
gtagccaaaagccatgttgtttatc

SEQ ID NO: 482149 - DNA, 25 bp, Rattus norvegicus
gtagccaaaagcgatgttgtttatc

SEQ ID NO: 482150 - DNA, 25 bp, Rattus norvegicus
gtagccaaactcatcaacattcatg

SEQ ID NO: 482151 - DNA, 25 bp, Rattus norvegicus
gtagccaaactcttcaacattcatg

SEQ ID NO: 482152 - DNA, 25 bp, Rattus norvegicus
gtagccaaaggaagaggaaaccaca

SEQ ID NO: 482153 - DNA, 25 bp, Rattus norvegicus
gtagccaaaggatgaggaaaccaca

SEQ ID NO: 482154 - DNA, 25 bp, Rattus norvegicus
gtagccaaagtgaaaatcccagcag

SEQ ID NO: 482155 - DNA, 25 bp, Rattus norvegicus
gtagccaaagtgtaaatcccagcag

SEQ ID NO: 482156 - DNA, 25 bp, Rattus norvegicus
gtagccaaatttcgcatttcactgt

SEQ ID NO: 482157 - DNA, 25 bp, Rattus norvegicus
gtagccaaatttggcatttcactgt

SEQ ID NO: 482158 - DNA, 25 bp, Rattus norvegicus
gtagccaacaaacaaagctgccgct

SEQ ID NO: 482159 - DNA, 25 bp, Rattus norvegicus
gtagccaacaaagaaagctgccgct

SEQ ID NO: 482160 - DNA, 25 bp, Rattus norvegicus
gtagccaacatactcacgcttacaa

SEQ ID NO: 482161 - DNA, 25 bp, Rattus norvegicus
gtagccaacatagtcacgcttacaa

SEQ ID NO: 482162 - DNA, 25 bp, Rattus norvegicus
gtagccaagatcagaggtaacccca

SEQ ID NO: 482163 - DNA, 25 bp, Rattus norvegicus
gtagccaagatctgaggtaacccca

SEQ ID NO: 482164 - DNA, 25 bp, Rattus norvegicus
gtagccaagtccctgccctttttag

SEQ ID NO: 482165 - DNA, 25 bp, Rattus norvegicus
gtagccaagtccgtgccctttttag

SEQ ID NO: 482166 - DNA, 25 bp, Rattus norvegicus
gtagccaatagcatgccggaagcat

SEQ ID NO: 482167 - DNA, 25 bp, Rattus norvegicus
gtagccaatagcttgccggaagcat

SEQ ID NO: 482168 - DNA, 25 bp, Rattus norvegicus
gtagccaatgaacatccagtgttga

SEQ ID NO: 482169 - DNA, 25 bp, Rattus norvegicus
gtagccaatgaagatccagtgttga

SEQ ID NO: 482170 - DNA, 25 bp, Rattus norvegicus
gtagccaatgtcaacacctgtctaa

SEQ ID NO: 482171 - DNA, 25 bp, Rattus norvegicus
gtagccaatgtctacacctgtctaa

SEQ ID NO: 482172 - DNA, 25 bp, Rattus norvegicus
gtagccacactacagtcaataggtg

SEQ ID NO: 482173 - DNA, 25 bp, Rattus norvegicus
gtagccacactagagtcaataggtg

SEQ ID NO: 482174 - DNA, 25 bp, Rattus norvegicus
gtagccacagcccacgagaagatag

SEQ ID NO: 482175 - DNA, 25 bp, Rattus norvegicus
gtagccacagccgacgagaagatag

SEQ ID NO: 482176 - DNA, 25 bp, Rattus norvegicus
gtagccacttctaagaacttccttc

SEQ ID NO: 482177 - DNA, 25 bp, Rattus norvegicus
gtagccacttcttagaacttccttc

SEQ ID NO: 482178 - DNA, 25 bp, Rattus norvegicus
gtagccacttgaatctttttcccaa

SEQ ID NO: 482179 - DNA, 25 bp, Rattus norvegicus
gtagccacttgattctttttcccaa

SEQ ID NO: 482180 - DNA, 25 bp, Rattus norvegicus
gtagccagagttcaaccctgactgc

SEQ ID NO: 482181 - DNA, 25 bp, Rattus norvegicus
gtagccagagttgaaccctgactgc

SEQ ID NO: 482182 - DNA, 25 bp, Rattus norvegicus
gtagccagcaaactcagaaacaatt

SEQ ID NO: 482183 - DNA, 25 bp, Rattus norvegicus
gtagccagcaaagtcagaaacaatt

SEQ ID NO: 482184 - DNA, 25 bp, Rattus norvegicus
gtagccagcattaaaactcccgcta

SEQ ID NO: 482185 - DNA, 25 bp, Rattus norvegicus
gtagccagcattacatggtaccact

SEQ ID NO: 482186 - DNA, 25 bp, Rattus norvegicus
gtagccagcatttaaactcccgcta

SEQ ID NO: 482187 - DNA, 25 bp, Rattus norvegicus
gtagccagcatttcatggtaccact

SEQ ID NO: 482188 - DNA, 25 bp, Rattus norvegicus
gtagccagccctccggagtttcaga

SEQ ID NO: 482189 - DNA, 25 bp, Rattus norvegicus
gtagccagccctgcggagtttcaga

SEQ ID NO: 482190 - DNA, 25 bp, Rattus norvegicus
gtagccagcttgagtaagacccctt

SEQ ID NO: 482191 - DNA, 25 bp, Rattus norvegicus
gtagccagcttgatcaggtggaccc

SEQ ID NO: 482192 - DNA, 25 bp, Rattus norvegicus
gtagccagcttgtgtaagacccctt

SEQ ID NO: 482193 - DNA, 25 bp, Rattus norvegicus
gtagccagcttgttcaggtggaccc

SEQ ID NO: 482194 - DNA, 25 bp, Rattus norvegicus
gtagccaggaccaccatccatgaag

SEQ ID NO: 482195 - DNA, 25 bp, Rattus norvegicus
gtagccaggacctccatccatgaag

SEQ ID NO: 482196 - DNA, 25 bp, Rattus norvegicus
gtagccaggcagcttctatgccaaa

SEQ ID NO: 482197 - DNA, 25 bp, Rattus norvegicus
gtagccaggcaggttctatgccaaa

SEQ ID NO: 482198 - DNA, 25 bp, Rattus norvegicus
gtagccaggctacaactcttgaatt

SEQ ID NO: 482199 - DNA, 25 bp, Rattus norvegicus
gtagccaggctagaactcttgaatt

SEQ ID NO: 482200 - DNA, 25 bp, Rattus norvegicus
gtagccagtaagatcactgctgtga

SEQ ID NO: 482201 - DNA, 25 bp, Rattus norvegicus
gtagccagtaagttcactgctgtga

SEQ ID NO: 482202 - DNA, 25 bp, Rattus norvegicus
gtagccagtaccattcatacacaga

SEQ ID NO: 482203 - DNA, 25 bp, Rattus norvegicus
gtagccagtacctttcatacacaga

SEQ ID NO: 482204 - DNA, 25 bp, Rattus norvegicus
gtagccagtcccagacatgatccta

SEQ ID NO: 482205 - DNA, 25 bp, Rattus norvegicus
gtagccagtccctgacatgatccta

SEQ ID NO: 482206 - DNA, 25 bp, Rattus norvegicus
gtagccagtcgcctttattagctta

SEQ ID NO: 482207 - DNA, 25 bp, Rattus norvegicus
gtagccagtcgcgtttattagctta

SEQ ID NO: 482208 - DNA, 25 bp, Rattus norvegicus
gtagccagtggcaccagacccaggg

SEQ ID NO: 482209 - DNA, 25 bp, Rattus norvegicus
gtagccagtggctccagacccaggg

SEQ ID NO: 482210 - DNA, 25 bp, Rattus norvegicus
gtagccagttccattatctgttata

SEQ ID NO: 482211 - DNA, 25 bp, Rattus norvegicus
gtagccagttcctttatctgttata

SEQ ID NO: 482212 - DNA, 25 bp, Rattus norvegicus
gtagccataaccaggtgtctcaacc

SEQ ID NO: 482213 - DNA, 25 bp, Rattus norvegicus
gtagccataacctggtgtctcaacc

SEQ ID NO: 482214 - DNA, 25 bp, Rattus norvegicus
gtagccatagctaggagcaaatcca

SEQ ID NO: 482215 - DNA, 25 bp, Rattus norvegicus
gtagccatagcttggagcaaatcca

SEQ ID NO: 482216 - DNA, 25 bp, Rattus norvegicus
gtagccatcacacatgcctctatat

SEQ ID NO: 482217 - DNA, 25 bp, Rattus norvegicus
gtagccatcacagatgcctctatat

SEQ ID NO: 482218 - DNA, 25 bp, Rattus norvegicus
gtagccatcatacgcacccaggata

SEQ ID NO: 482219 - DNA, 25 bp, Rattus norvegicus
gtagccatcataggcacccaggata

SEQ ID NO: 482220 - DNA, 25 bp, Rattus norvegicus
gtagccatctttctatatgttctat

SEQ ID NO: 482221 - DNA, 25 bp, Rattus norvegicus
gtagccatctttgtatatgttctat

SEQ ID NO: 482222 - DNA, 25 bp, Rattus norvegicus
gtagccatgaaaatctagagcctga

SEQ ID NO: 482223 - DNA, 25 bp, Rattus norvegicus
gtagccatgaaattctagagcctga

SEQ ID NO: 482224 - DNA, 25 bp, Rattus norvegicus
gtagccatgagtacagatccagaat

SEQ ID NO: 482225 - DNA, 25 bp, Rattus norvegicus
gtagccatgagttcagatccagaat

SEQ ID NO: 482226 - DNA, 25 bp, Rattus norvegicus
gtagccatgcatcagaaaccgaaga

SEQ ID NO: 482227 - DNA, 25 bp, Rattus norvegicus
gtagccatgcatgagaaaccgaaga

SEQ ID NO: 482228 - DNA, 25 bp, Rattus norvegicus
gtagccatgcctagaagcacagtgt

SEQ ID NO: 482229 - DNA, 25 bp, Rattus norvegicus
gtagccatgccttgaagcacagtgt

SEQ ID NO: 482230 - DNA, 25 bp, Rattus norvegicus
gtagccatggaactttccaacccag

SEQ ID NO: 482231 - DNA, 25 bp, Rattus norvegicus
gtagccatggaagtttccaacccag

SEQ ID NO: 482232 - DNA, 25 bp, Rattus norvegicus
gtagccatggctacagaggccttat

SEQ ID NO: 482233 - DNA, 25 bp, Rattus norvegicus
gtagccatggctatggaaggcccag

SEQ ID NO: 482234 - DNA, 25 bp, Rattus norvegicus
gtagccatggcttcagaggccttat

SEQ ID NO: 482235 - DNA, 25 bp, Rattus norvegicus
gtagccatggctttggaaggcccag

SEQ ID NO: 482236 - DNA, 25 bp, Rattus norvegicus
gtagccatgtcgaaggagcagtatc

SEQ ID NO: 482237 - DNA, 25 bp, Rattus norvegicus
gtagccatgtcgtaggagcagtatc

SEQ ID NO: 482238 - DNA, 25 bp, Rattus norvegicus
gtagccatgtgtcgtagcctttcca

SEQ ID NO: 482239 - DNA, 25 bp, Rattus norvegicus
gtagccatgtgtggtagcctttcca

SEQ ID NO: 482240 - DNA, 25 bp, Rattus norvegicus
gtagccattctgcagcattacgctc

SEQ ID NO: 482241 - DNA, 25 bp, Rattus norvegicus
gtagccattctggagcattacgctc

SEQ ID NO: 482242 - DNA, 25 bp, Rattus norvegicus
gtagccattgggacactgtattcca

SEQ ID NO: 482243 - DNA, 25 bp, Rattus norvegicus
gtagccattgggtcactgtattcca

SEQ ID NO: 482244 - DNA, 25 bp, Rattus norvegicus
gtagccattgtgactgtgaattcca

SEQ ID NO: 482245 - DNA, 25 bp, Rattus norvegicus
gtagccattgtgtctgtgaattcca

SEQ ID NO: 482246 - DNA, 25 bp, Rattus norvegicus
gtagccatttcactagcacagaaca

SEQ ID NO: 482247 - DNA, 25 bp, Rattus norvegicus
gtagccatttcagtagcacagaaca

SEQ ID NO: 482248 - DNA, 25 bp, Rattus norvegicus
gtagccattttgaagagtttcttca

SEQ ID NO: 482249 - DNA, 25 bp, Rattus norvegicus
gtagccattttgtagagtttcttca

SEQ ID NO: 482250 - DNA, 25 bp, Rattus norvegicus
gtagcccaagctctatttctagaga

SEQ ID NO: 482251 - DNA, 25 bp, Rattus norvegicus
gtagcccaagctgtatttctagaga

SEQ ID NO: 482252 - DNA, 25 bp, Rattus norvegicus
gtagcccaagtacataagcgtgcga

SEQ ID NO: 482253 - DNA, 25 bp, Rattus norvegicus
gtagcccaagtagataagcgtgcga

SEQ ID NO: 482254 - DNA, 25 bp, Rattus norvegicus
gtagcccacactagttgaatactct

SEQ ID NO: 482255 - DNA, 25 bp, Rattus norvegicus
gtagcccacacttgttgaatactct

SEQ ID NO: 482256 - DNA, 25 bp, Rattus norvegicus
gtagcccacattcaccaaagttcat

SEQ ID NO: 482257 - DNA, 25 bp, Rattus norvegicus
gtagcccacattgaccaaagttcat

SEQ ID NO: 482258 - DNA, 25 bp, Rattus norvegicus
gtagcccacgagcatcattgtcatt

SEQ ID NO: 482259 - DNA, 25 bp, Rattus norvegicus
gtagcccacgaggatcattgtcatt

SEQ ID NO: 482260 - DNA, 25 bp, Rattus norvegicus
gtagcccagcagataagattacttt

SEQ ID NO: 482261 - DNA, 25 bp, Rattus norvegicus
gtagcccagcagttaagattacttt

SEQ ID NO: 482262 - DNA, 25 bp, Rattus norvegicus
gtagcccaggagatgcattactcgg

SEQ ID NO: 482263 - DNA, 25 bp, Rattus norvegicus
gtagcccaggagttgcattactcgg

SEQ ID NO: 482264 - DNA, 25 bp, Rattus norvegicus
gtagcccagggtcgtcacaaactaa

SEQ ID NO: 482265 - DNA, 25 bp, Rattus norvegicus
gtagcccagggtggtcacaaactaa

SEQ ID NO: 482266 - DNA, 25 bp, Rattus norvegicus
gtagcccaggttagtgttaagacac

SEQ ID NO: 482267 - DNA, 25 bp, Rattus norvegicus
gtagcccaggtttgtgttaagacac

SEQ ID NO: 482268 - DNA, 25 bp, Rattus norvegicus
gtagcccagtggcacagtgcatgtt

SEQ ID NO: 482269 - DNA, 25 bp, Rattus norvegicus
gtagcccagtgggacagtgcatgtt

SEQ ID NO: 482270 - DNA, 25 bp, Rattus norvegicus
gtagcccatagccacattaggtcag

SEQ ID NO: 482271 - DNA, 25 bp, Rattus norvegicus
gtagcccatagcgacattaggtcag

SEQ ID NO: 482272 - DNA, 25 bp, Rattus norvegicus
gtagcccatgacagcaattccgtta

SEQ ID NO: 482273 - DNA, 25 bp, Rattus norvegicus
gtagcccatgactgcaattccgtta

SEQ ID NO: 482274 - DNA, 25 bp, Rattus norvegicus
gtagcccattggatgttcatatatt

SEQ ID NO: 482275 - DNA, 25 bp, Rattus norvegicus
gtagcccattggttgttcatatatt

SEQ ID NO: 482276 - DNA, 25 bp, Rattus norvegicus
gtagcccatttaatcacaggaatca

SEQ ID NO: 482277 - DNA, 25 bp, Rattus norvegicus
gtagcccatttattcacaggaatca

SEQ ID NO: 482278 - DNA, 25 bp, Rattus norvegicus
gtagcccatttcatagggcaccatg

SEQ ID NO: 482279 - DNA, 25 bp, Rattus norvegicus
gtagcccatttcttagggcaccatg

SEQ ID NO: 482280 - DNA, 25 bp, Rattus norvegicus
gtagccccaaaaaactgatgatgta

SEQ ID NO: 482281 - DNA, 25 bp, Rattus norvegicus
gtagccccaaaatactgatgatgta

SEQ ID NO: 482282 - DNA, 25 bp, Rattus norvegicus
gtagccccaatcagtgcagagtgta

SEQ ID NO: 482283 - DNA, 25 bp, Rattus norvegicus
gtagccccaatctgtgcagagtgta

SEQ ID NO: 482284 - DNA, 25 bp, Rattus norvegicus
gtagccccaggaaagatggaggttt

SEQ ID NO: 482285 - DNA, 25 bp, Rattus norvegicus
gtagccccaggatagatggaggttt

SEQ ID NO: 482286 - DNA, 25 bp, Rattus norvegicus
gtagccccagtgatagtccaagtag

SEQ ID NO: 482287 - DNA, 25 bp, Rattus norvegicus
gtagccccagtgttagtccaagtag

SEQ ID NO: 482288 - DNA, 25 bp, Rattus norvegicus
gtagccccgtagactaaaggaactg

SEQ ID NO: 482289 - DNA, 25 bp, Rattus norvegicus
gtagccccgtagtctaaaggaactg

SEQ ID NO: 482290 - DNA, 25 bp, Rattus norvegicus
gtagcccgcggcctgcggttcttct

SEQ ID NO: 482291 - DNA, 25 bp, Rattus norvegicus
gtagcccgcggcgtgcggttcttct

SEQ ID NO: 482292 - DNA, 25 bp, Rattus norvegicus
gtagcccggctaatcatggaagtat

SEQ ID NO: 482293 - DNA, 25 bp, Rattus norvegicus
gtagcccggctattcatggaagtat

SEQ ID NO: 482294 - DNA, 25 bp, Rattus norvegicus
gtagccctaagtactctgtggttga

SEQ ID NO: 482295 - DNA, 25 bp, Rattus norvegicus
gtagccctaagttctctgtggttga

SEQ ID NO: 482296 - DNA, 25 bp, Rattus norvegicus
gtagccctaggaatagcatctaaca

SEQ ID NO: 482297 - DNA, 25 bp, Rattus norvegicus
gtagccctaggattagcatctaaca

SEQ ID NO: 482298 - DNA, 25 bp, Rattus norvegicus
gtagccctatatatgaagcctctta

SEQ ID NO: 482299 - DNA, 25 bp, Rattus norvegicus
gtagccctatatttgaagcctctta

SEQ ID NO: 482300 - DNA, 25 bp, Rattus norvegicus
gtagccctcagtatcatcttgaaca

SEQ ID NO: 482301 - DNA, 25 bp, Rattus norvegicus
gtagccctcagtttcatcttgaaca

SEQ ID NO: 482302 - DNA, 25 bp, Rattus norvegicus
gtagccctcgaaattgcaacatgta

SEQ ID NO: 482303 - DNA, 25 bp, Rattus norvegicus
gtagccctcgaatttgcaacatgta

SEQ ID NO: 482304 - DNA, 25 bp, Rattus norvegicus
gtagccctcgataccactatgtaga

SEQ ID NO: 482305 - DNA, 25 bp, Rattus norvegicus
gtagccctcgattccactatgtaga

SEQ ID NO: 482306 - DNA, 25 bp, Rattus norvegicus
gtagccctgaggaccgactggaaat

SEQ ID NO: 482307 - DNA, 25 bp, Rattus norvegicus
gtagccctgaggtccgactggaaat

SEQ ID NO: 482308 - DNA, 25 bp, Rattus norvegicus
gtagccctggaaccaattctgtaga

SEQ ID NO: 482309 - DNA, 25 bp, Rattus norvegicus
gtagccctggaagcaattctgtaga

SEQ ID NO: 482310 - DNA, 25 bp, Rattus norvegicus
gtagccctggctctactggaccgca

SEQ ID NO: 482311 - DNA, 25 bp, Rattus norvegicus
gtagccctggctgtactggaccgca

SEQ ID NO: 482312 - DNA, 25 bp, Rattus norvegicus
gtagccctgtggatatttttcacaa

SEQ ID NO: 482313 - DNA, 25 bp, Rattus norvegicus
gtagccctgtggttatttttcacaa

SEQ ID NO: 482314 - DNA, 25 bp, Rattus norvegicus
gtagcccttaaactgcagtgggaag

SEQ ID NO: 482315 - DNA, 25 bp, Rattus norvegicus
gtagcccttaaagtgcagtgggaag

SEQ ID NO: 482316 - DNA, 25 bp, Rattus norvegicus
gtagcccttacccttagtactgacg

SEQ ID NO: 482317 - DNA, 25 bp, Rattus norvegicus
gtagcccttaccgttagtactgacg

SEQ ID NO: 482318 - DNA, 25 bp, Rattus norvegicus
gtagcccttggcctggaaatttcag

SEQ ID NO: 482319 - DNA, 25 bp, Rattus norvegicus
gtagcccttggcgtggaaatttcag

SEQ ID NO: 482320 - DNA, 25 bp, Rattus norvegicus
gtagccctttagcaaaggcctcctg

SEQ ID NO: 482321 - DNA, 25 bp, Rattus norvegicus
gtagccctttaggaaaggcctcctg

SEQ ID NO: 482322 - DNA, 25 bp, Rattus norvegicus
gtagccctttggacttctgggaaga

SEQ ID NO: 482323 - DNA, 25 bp, Rattus norvegicus
gtagccctttggtcttctgggaaga

SEQ ID NO: 482324 - DNA, 25 bp, Rattus norvegicus
gtagccgacgaaactcctgcatgtt

SEQ ID NO: 482325 - DNA, 25 bp, Rattus norvegicus
gtagccgacgaatctcctgcatgtt

SEQ ID NO: 482326 - DNA, 25 bp, Rattus norvegicus
gtagccgagatgatccctcagtgga

SEQ ID NO: 482327 - DNA, 25 bp, Rattus norvegicus
gtagccgagatgttccctcagtgga

SEQ ID NO: 482328 - DNA, 25 bp, Rattus norvegicus
gtagccgcaagtaacagatctgcag

SEQ ID NO: 482329 - DNA, 25 bp, Rattus norvegicus
gtagccgcaagttacagatctgcag

SEQ ID NO: 482330 - DNA, 25 bp, Rattus norvegicus
gtagccgcacttaaagtctcagcag

SEQ ID NO: 482331 - DNA, 25 bp, Rattus norvegicus
gtagccgcactttaagtctcagcag

SEQ ID NO: 482332 - DNA, 25 bp, Rattus norvegicus
gtagccgcctccacagtcggactct

SEQ ID NO: 482333 - DNA, 25 bp, Rattus norvegicus
gtagccgcctcctcagtcggactct

SEQ ID NO: 482334 - DNA, 25 bp, Rattus norvegicus
gtagccgcgtgtaacgtcttatggg

SEQ ID NO: 482335 - DNA, 25 bp, Rattus norvegicus
gtagccgcgtgttacgtcttatggg

SEQ ID NO: 482336 - DNA, 25 bp, Rattus norvegicus
gtagccgctaagcatgatctgcaca

SEQ ID NO: 482337 - DNA, 25 bp, Rattus norvegicus
gtagccgctaaggatgatctgcaca

SEQ ID NO: 482338 - DNA, 25 bp, Rattus norvegicus
gtagccggatctccattctgaggaa

SEQ ID NO: 482339 - DNA, 25 bp, Rattus norvegicus
gtagccggatctgcattctgaggaa

SEQ ID NO: 482340 - DNA, 25 bp, Rattus norvegicus
gtagccggctggatccttcaaggta

SEQ ID NO: 482341 - DNA, 25 bp, Rattus norvegicus
gtagccggctggttccttcaaggta

SEQ ID NO: 482342 - DNA, 25 bp, Rattus norvegicus
gtagccgggagcagtttgcagccat

SEQ ID NO: 482343 - DNA, 25 bp, Rattus norvegicus
gtagccgggagctgtttgcagccat

SEQ ID NO: 482344 - DNA, 25 bp, Rattus norvegicus
gtagccgtcattagaactgttgtga

SEQ ID NO: 482345 - DNA, 25 bp, Rattus norvegicus
gtagccgtcatttgaactgttgtga

SEQ ID NO: 482346 - DNA, 25 bp, Rattus norvegicus
gtagccgtccttcgtgactggttaa

SEQ ID NO: 482347 - DNA, 25 bp, Rattus norvegicus
gtagccgtccttggtgactggttaa

SEQ ID NO: 482348 - DNA, 25 bp, Rattus norvegicus
gtagccgtgttcaccagtgaaagca

SEQ ID NO: 482349 - DNA, 25 bp, Rattus norvegicus
gtagccgtgttctccagtgaaagca

SEQ ID NO: 482350 - DNA, 25 bp, Rattus norvegicus
gtagcctaactgctgttatttctaa

SEQ ID NO: 482351 - DNA, 25 bp, Rattus norvegicus
gtagcctaactggtgttatttctaa

SEQ ID NO: 482352 - DNA, 25 bp, Rattus norvegicus
gtagcctaagctctccagaaacaca

SEQ ID NO: 482353 - DNA, 25 bp, Rattus norvegicus
gtagcctaagctgtccagaaacaca

SEQ ID NO: 482354 - DNA, 25 bp, Rattus norvegicus
gtagcctaatacctggagcctttac

SEQ ID NO: 482355 - DNA, 25 bp, Rattus norvegicus
gtagcctaatacgtggagcctttac

SEQ ID NO: 482356 - DNA, 25 bp, Rattus norvegicus
gtagcctaatctcactagggagatg

SEQ ID NO: 482357 - DNA, 25 bp, Rattus norvegicus
gtagcctaatctgactagggagatg

SEQ ID NO: 482358 - DNA, 25 bp, Rattus norvegicus
gtagcctacaccaacaactcagagt

SEQ ID NO: 482359 - DNA, 25 bp, Rattus norvegicus
gtagcctacacctacaactcagagt

SEQ ID NO: 482360 - DNA, 25 bp, Rattus norvegicus
gtagcctacattagtgttcgcattg

SEQ ID NO: 482361 - DNA, 25 bp, Rattus norvegicus
gtagcctacatttgtgttcgcattg

SEQ ID NO: 482362 - DNA, 25 bp, Rattus norvegicus
gtagcctaccttctagcagctgaca

SEQ ID NO: 482363 - DNA, 25 bp, Rattus norvegicus
gtagcctaccttgtagcagctgaca

SEQ ID NO: 482364 - DNA, 25 bp, Rattus norvegicus
gtagcctactacatatcagagaatt

SEQ ID NO: 482365 - DNA, 25 bp, Rattus norvegicus
gtagcctactacttatcagagaatt

SEQ ID NO: 482366 - DNA, 25 bp, Rattus norvegicus
gtagcctagttaattgagcctggtt

SEQ ID NO: 482367 - DNA, 25 bp, Rattus norvegicus
gtagcctagttatttgagcctggtt

SEQ ID NO: 482368 - DNA, 25 bp, Rattus norvegicus
gtagcctatacaaagctgttcccct

SEQ ID NO: 482369 - DNA, 25 bp, Rattus norvegicus
gtagcctatacacactacaaaggat

SEQ ID NO: 482370 - DNA, 25 bp, Rattus norvegicus
gtagcctatacagactacaaaggat

SEQ ID NO: 482371 - DNA, 25 bp, Rattus norvegicus
gtagcctatacatagctgttcccct

SEQ ID NO: 482372 - DNA, 25 bp, Rattus norvegicus
gtagcctatcagaagcggcgcctgt

SEQ ID NO: 482373 - DNA, 25 bp, Rattus norvegicus
gtagcctatcagtagcggcgcctgt

SEQ ID NO: 482374 - DNA, 25 bp, Rattus norvegicus
gtagcctatcttatgagacccattt

SEQ ID NO: 482375 - DNA, 25 bp, Rattus norvegicus
gtagcctatcttttgagacccattt

SEQ ID NO: 482376 - DNA, 25 bp, Rattus norvegicus
gtagcctcacagatatcaccggtaa

SEQ ID NO: 482377 - DNA, 25 bp, Rattus norvegicus
gtagcctcacagttatcaccggtaa

SEQ ID NO: 482378 - DNA, 25 bp, Rattus norvegicus
gtagcctcagacaagcagtacactc

SEQ ID NO: 482379 - DNA, 25 bp, Rattus norvegicus
gtagcctcagactagcagtacactc

SEQ ID NO: 482380 - DNA, 25 bp, Rattus norvegicus
gtagcctcagatcatgtttgcccat

SEQ ID NO: 482381 - DNA, 25 bp, Rattus norvegicus
gtagcctcagatgatgtttgcccat

SEQ ID NO: 482382 - DNA, 25 bp, Rattus norvegicus
gtagcctccatgattccataactct

SEQ ID NO: 482383 - DNA, 25 bp, Rattus norvegicus
gtagcctccatgtttccataactct

SEQ ID NO: 482384 - DNA, 25 bp, Rattus norvegicus
gtagcctcctacataatgtattata

SEQ ID NO: 482385 - DNA, 25 bp, Rattus norvegicus
gtagcctcctacttaatgtattata

SEQ ID NO: 482386 - DNA, 25 bp, Rattus norvegicus
gtagcctccttcatattggtcacaa

SEQ ID NO: 482387 - DNA, 25 bp, Rattus norvegicus
gtagcctccttcttattggtcacaa

SEQ ID NO: 482388 - DNA, 25 bp, Rattus norvegicus
gtagcctcgcctaaacatttattgt

SEQ ID NO: 482389 - DNA, 25 bp, Rattus norvegicus
gtagcctcgccttaacatttattgt

SEQ ID NO: 482390 - DNA, 25 bp, Rattus norvegicus
gtagcctctgttctatttcattcca

SEQ ID NO: 482391 - DNA, 25 bp, Rattus norvegicus
gtagcctctgttgtatttcattcca

SEQ ID NO: 482392 - DNA, 25 bp, Rattus norvegicus
gtagcctctttcatatgtctctgta

SEQ ID NO: 482393 - DNA, 25 bp, Rattus norvegicus
gtagcctctttcttatgtctctgta

SEQ ID NO: 482394 - DNA, 25 bp, Rattus norvegicus
gtagcctgaagtccgacctgtcaga

SEQ ID NO: 482395 - DNA, 25 bp, Rattus norvegicus
gtagcctgaagtgcgacctgtcaga

SEQ ID NO: 482396 - DNA, 25 bp, Rattus norvegicus
gtagcctgagaacatggtatcttca

SEQ ID NO: 482397 - DNA, 25 bp, Rattus norvegicus
gtagcctgagaagatggtatcttca

SEQ ID NO: 482398 - DNA, 25 bp, Rattus norvegicus
gtagcctgagcaccaacgaatttaa

SEQ ID NO: 482399 - DNA, 25 bp, Rattus norvegicus
gtagcctgagcactctagaggatca

SEQ ID NO: 482400 - DNA, 25 bp, Rattus norvegicus
gtagcctgagcagcaacgaatttaa

SEQ ID NO: 482401 - DNA, 25 bp, Rattus norvegicus
gtagcctgagcagtctagaggatca

SEQ ID NO: 482402 - DNA, 25 bp, Rattus norvegicus
gtagcctgaggtagtttcaaaatta

SEQ ID NO: 482403 - DNA, 25 bp, Rattus norvegicus
gtagcctgaggttgtttcaaaatta

SEQ ID NO: 482404 - DNA, 25 bp, Rattus norvegicus
gtagcctgagtgatctcctgggtac

SEQ ID NO: 482405 - DNA, 25 bp, Rattus norvegicus
gtagcctgagtgttctcctgggtac

SEQ ID NO: 482406 - DNA, 25 bp, Rattus norvegicus
gtagcctgatacatagaaaacctgg

SEQ ID NO: 482407 - DNA, 25 bp, Rattus norvegicus
gtagcctgatacttagaaaacctgg

SEQ ID NO: 482408 - DNA, 25 bp, Rattus norvegicus
gtagcctgctctcagaatgtcttat

SEQ ID NO: 482409 - DNA, 25 bp, Rattus norvegicus
gtagcctgctctgagaatgtcttat

SEQ ID NO: 482410 - DNA, 25 bp, Rattus norvegicus
gtagcctgctgtaattagcttccta

SEQ ID NO: 482411 - DNA, 25 bp, Rattus norvegicus
gtagcctgctgttattagcttccta

SEQ ID NO: 482412 - DNA, 25 bp, Rattus norvegicus
gtagcctgcttcagtatgtcaaaga

SEQ ID NO: 482413 - DNA, 25 bp, Rattus norvegicus
gtagcctgcttctgtatgtcaaaga

SEQ ID NO: 482414 - DNA, 25 bp, Rattus norvegicus
gtagcctggcatctggtaactgctt

SEQ ID NO: 482415 - DNA, 25 bp, Rattus norvegicus
gtagcctggcatgtggtaactgctt

SEQ ID NO: 482416 - DNA, 25 bp, Rattus norvegicus
gtagcctggctaaagccaccacaaa

SEQ ID NO: 482417 - DNA, 25 bp, Rattus norvegicus
gtagcctggctatagccaccacaaa

SEQ ID NO: 482418 - DNA, 25 bp, Rattus norvegicus
gtagcctggtccatggctttttgaa

SEQ ID NO: 482419 - DNA, 25 bp, Rattus norvegicus
gtagcctggtccttggctttttgaa

SEQ ID NO: 482420 - DNA, 25 bp, Rattus norvegicus
gtagcctgtctgattaactgggaag

SEQ ID NO: 482421 - DNA, 25 bp, Rattus norvegicus
gtagcctgtctgtttaactgggaag

SEQ ID NO: 482422 - DNA, 25 bp, Rattus norvegicus
gtagcctgtgttatcgtctagcaat

SEQ ID NO: 482423 - DNA, 25 bp, Rattus norvegicus
gtagcctgtgttttcgtctagcaat

SEQ ID NO: 482424 - DNA, 25 bp, Rattus norvegicus
gtagccttactgcacctgttacaag

SEQ ID NO: 482425 - DNA, 25 bp, Rattus norvegicus
gtagccttactggacctgttacaag

SEQ ID NO: 482426 - DNA, 25 bp, Rattus norvegicus
gtagccttatgtcccttgtagtcta

SEQ ID NO: 482427 - DNA, 25 bp, Rattus norvegicus
gtagccttatgtgccttgtagtcta

SEQ ID NO: 482428 - DNA, 25 bp, Rattus norvegicus
gtagccttcactactcaataaatcg

SEQ ID NO: 482429 - DNA, 25 bp, Rattus norvegicus
gtagccttcacttctcaataaatcg

SEQ ID NO: 482430 - DNA, 25 bp, Rattus norvegicus
gtagccttcctcagaacacacggtg

SEQ ID NO: 482431 - DNA, 25 bp, Rattus norvegicus
gtagccttcctctgaacacacggtg

SEQ ID NO: 482432 - DNA, 25 bp, Rattus norvegicus
gtagccttctccagagctatttgaa

SEQ ID NO: 482433 - DNA, 25 bp, Rattus norvegicus
gtagccttctcctgagctatttgaa

SEQ ID NO: 482434 - DNA, 25 bp, Rattus norvegicus
gtagccttctggagtgtagcaagtt

SEQ ID NO: 482435 - DNA, 25 bp, Rattus norvegicus
gtagccttctggtgtgtagcaagtt

SEQ ID NO: 482436 - DNA, 25 bp, Rattus norvegicus
gtagccttgacacaaatccaaaatc

SEQ ID NO: 482437 - DNA, 25 bp, Rattus norvegicus
gtagccttgacagaaatccaaaatc

SEQ ID NO: 482438 - DNA, 25 bp, Rattus norvegicus
gtagccttgctcagatagctgttga

SEQ ID NO: 482439 - DNA, 25 bp, Rattus norvegicus
gtagccttgctcctcagtcagagga

SEQ ID NO: 482440 - DNA, 25 bp, Rattus norvegicus
gtagccttgctcgtcagtcagagga

SEQ ID NO: 482441 - DNA, 25 bp, Rattus norvegicus
gtagccttgctctgatagctgttga

SEQ ID NO: 482442 - DNA, 25 bp, Rattus norvegicus
gtagccttggctaagtcatttaaca

SEQ ID NO: 482443 - DNA, 25 bp, Rattus norvegicus
gtagccttggcttagtcatttaaca

SEQ ID NO: 482444 - DNA, 25 bp, Rattus norvegicus
gtagccttggtcagtgattcctaga

SEQ ID NO: 482445 - DNA, 25 bp, Rattus norvegicus
gtagccttggtctgtgattcctaga

SEQ ID NO: 482446 - DNA, 25 bp, Rattus norvegicus
gtagccttgtaactggtattctgca

SEQ ID NO: 482447 - DNA, 25 bp, Rattus norvegicus
gtagccttgtaagtggtattctgca

SEQ ID NO: 482448 - DNA, 25 bp, Rattus norvegicus
gtagccttgtttaggcgtcatatta

SEQ ID NO: 482449 - DNA, 25 bp, Rattus norvegicus
gtagccttgttttggcgtcatatta

SEQ ID NO: 482450 - DNA, 25 bp, Rattus norvegicus
gtagcctttacaaccagaaccatca

SEQ ID NO: 482451 - DNA, 25 bp, Rattus norvegicus
gtagcctttacatccagaaccatca

SEQ ID NO: 482452 - DNA, 25 bp, Rattus norvegicus
gtagcgaacggacgcccgcgcaggc

SEQ ID NO: 482453 - DNA, 25 bp, Rattus norvegicus
gtagcgaacggaggcccgcgcaggc

SEQ ID NO: 482454 - DNA, 25 bp, Rattus norvegicus
gtagcgaatacaacactgggcctct

SEQ ID NO: 482455 - DNA, 25 bp, Rattus norvegicus
gtagcgaatacatcactgggcctct

SEQ ID NO: 482456 - DNA, 25 bp, Rattus norvegicus
gtagcgagaaccaggagagccccaa

SEQ ID NO: 482457 - DNA, 25 bp, Rattus norvegicus
gtagcgagaacctggagagccccaa

SEQ ID NO: 482458 - DNA, 25 bp, Rattus norvegicus
gtagcgagacctagcatgatagagt

SEQ ID NO: 482459 - DNA, 25 bp, Rattus norvegicus
gtagcgagaccttgcatgatagagt

SEQ ID NO: 482460 - DNA, 25 bp, Rattus norvegicus
gtagcgagcactccgtgaatcgaaa

SEQ ID NO: 482461 - DNA, 25 bp, Rattus norvegicus
gtagcgagcactgcgtgaatcgaaa

SEQ ID NO: 482462 - DNA, 25 bp, Rattus norvegicus
gtagcgaggtccagaagccctgagt

SEQ ID NO: 482463 - DNA, 25 bp, Rattus norvegicus
gtagcgaggtcctgaagccctgagt

SEQ ID NO: 482464 - DNA, 25 bp, Rattus norvegicus
gtagcgatcaatcttctaggtatca

SEQ ID NO: 482465 - DNA, 25 bp, Rattus norvegicus
gtagcgatcaatgttctaggtatca

SEQ ID NO: 482466 - DNA, 25 bp, Rattus norvegicus
gtagcgattacacatgaaccataga

SEQ ID NO: 482467 - DNA, 25 bp, Rattus norvegicus
gtagcgattacagatgaaccataga

SEQ ID NO: 482468 - DNA, 25 bp, Rattus norvegicus
gtagcgattcgcatgaacaaagcca

SEQ ID NO: 482469 - DNA, 25 bp, Rattus norvegicus
gtagcgattcgcttgaacaaagcca

SEQ ID NO: 482470 - DNA, 25 bp, Rattus norvegicus
gtagcgcagatcactttgtcagcca

SEQ ID NO: 482471 - DNA, 25 bp, Rattus norvegicus
gtagcgcagatctctttgtcagcca

SEQ ID NO: 482472 - DNA, 25 bp, Rattus norvegicus
gtagcgcagctcactggtgactcgg

SEQ ID NO: 482473 - DNA, 25 bp, Rattus norvegicus
gtagcgcagctctctggtgactcgg

SEQ ID NO: 482474 - DNA, 25 bp, Rattus norvegicus
gtagcgccacaaacacaagttgtta

SEQ ID NO: 482475 - DNA, 25 bp, Rattus norvegicus
gtagcgccacaatcacaagttgtta

SEQ ID NO: 482476 - DNA, 25 bp, Rattus norvegicus
gtagcgccagagcttggcaccaaag

SEQ ID NO: 482477 - DNA, 25 bp, Rattus norvegicus
gtagcgccagaggttggcaccaaag

SEQ ID NO: 482478 - DNA, 25 bp, Rattus norvegicus
gtagcgccagtgagctgcggcgcga

SEQ ID NO: 482479 - DNA, 25 bp, Rattus norvegicus
gtagcgccagtgtgctgcggcgcga

SEQ ID NO: 482480 - DNA, 25 bp, Rattus norvegicus
gtagcgcggtgcacctagaagcaga

SEQ ID NO: 482481 - DNA, 25 bp, Rattus norvegicus
gtagcgcggtgctcctagaagcaga

SEQ ID NO: 482482 - DNA, 25 bp, Rattus norvegicus
gtagcgctctaacaggatcctctag

SEQ ID NO: 482483 - DNA, 25 bp, Rattus norvegicus
gtagcgctctaagaggatcctctag

SEQ ID NO: 482484 - DNA, 25 bp, Rattus norvegicus
gtagcgctgtatcggactgtcttgc

SEQ ID NO: 482485 - DNA, 25 bp, Rattus norvegicus
gtagcgctgtatgggactgtcttgc

SEQ ID NO: 482486 - DNA, 25 bp, Rattus norvegicus
gtagcgcttacccagatattcgttt

SEQ ID NO: 482487 - DNA, 25 bp, Rattus norvegicus
gtagcgcttaccgagatattcgttt

SEQ ID NO: 482488 - DNA, 25 bp, Rattus norvegicus
gtagcggaggttacccgtgtcacca

SEQ ID NO: 482489 - DNA, 25 bp, Rattus norvegicus
gtagcggaggtttcccgtgtcacca

SEQ ID NO: 482490 - DNA, 25 bp, Rattus norvegicus
gtagcggatgtgagtttagtcttta

SEQ ID NO: 482491 - DNA, 25 bp, Rattus norvegicus
gtagcggatgtgtgtttagtcttta

SEQ ID NO: 482492 - DNA, 25 bp, Rattus norvegicus
gtagcggccataaaataacccagat

SEQ ID NO: 482493 - DNA, 25 bp, Rattus norvegicus
gtagcggccatataataacccagat

SEQ ID NO: 482494 - DNA, 25 bp, Rattus norvegicus
gtagcggccttgatactctgtgaat

SEQ ID NO: 482495 - DNA, 25 bp, Rattus norvegicus
gtagcggccttgttactctgtgaat

SEQ ID NO: 482496 - DNA, 25 bp, Rattus norvegicus
gtagcggctgcaacgtacacaagaa

SEQ ID NO: 482497 - DNA, 25 bp, Rattus norvegicus
gtagcggctgcatcgtacacaagaa

SEQ ID NO: 482498 - DNA, 25 bp, Rattus norvegicus
gtagcggctgtgagtactgtcccaa

SEQ ID NO: 482499 - DNA, 25 bp, Rattus norvegicus
gtagcggctgtgtgtactgtcccaa

SEQ ID NO: 482500 - DNA, 25 bp, Rattus norvegicus
gtagcgggcaatacctctagagggt

SEQ ID NO: 482501 - DNA, 25 bp, Rattus norvegicus
gtagcgggcaattcctctagagggt

SEQ ID NO: 482502 - DNA, 25 bp, Rattus norvegicus
gtagcggtagggactcagcattgta

SEQ ID NO: 482503 - DNA, 25 bp, Rattus norvegicus
gtagcggtagggtctcagcattgta

SEQ ID NO: 482504 - DNA, 25 bp, Rattus norvegicus
gtagcggtctcaactgtttacacag

SEQ ID NO: 482505 - DNA, 25 bp, Rattus norvegicus
gtagcggtctcatctgtttacacag

SEQ ID NO: 482506 - DNA, 25 bp, Rattus norvegicus
gtagcggttgttacttcgatgcttt

SEQ ID NO: 482507 - DNA, 25 bp, Rattus norvegicus
gtagcggttgtttcttcgatgcttt

SEQ ID NO: 482508 - DNA, 25 bp, Rattus norvegicus
gtagcgtaatgaagccgccttacat

SEQ ID NO: 482509 - DNA, 25 bp, Rattus norvegicus
gtagcgtaatgatgccgccttacat

SEQ ID NO: 482510 - DNA, 25 bp, Rattus norvegicus
gtagcgtagcagcttctgagtcttt

SEQ ID NO: 482511 - DNA, 25 bp, Rattus norvegicus
gtagcgtagcaggttctgagtcttt

SEQ ID NO: 482512 - DNA, 25 bp, Rattus norvegicus
gtagcgtcaagtaaaggccccatga

SEQ ID NO: 482513 - DNA, 25 bp, Rattus norvegicus
gtagcgtcaagttaaggccccatga

SEQ ID NO: 482514 - DNA, 25 bp, Rattus norvegicus
gtagcgtcctaaccgcacagcgggc

SEQ ID NO: 482515 - DNA, 25 bp, Rattus norvegicus
gtagcgtcctaagcgcacagcgggc

SEQ ID NO: 482516 - DNA, 25 bp, Rattus norvegicus
gtagcgtctttcactatactaagcc

SEQ ID NO: 482517 - DNA, 25 bp, Rattus norvegicus
gtagcgtctttctctatactaagcc

SEQ ID NO: 482518 - DNA, 25 bp, Rattus norvegicus
gtagcgtgacttccctttcccttta

SEQ ID NO: 482519 - DNA, 25 bp, Rattus norvegicus
gtagcgtgacttgcctttcccttta

SEQ ID NO: 482520 - DNA, 25 bp, Rattus norvegicus
gtagcgtgcctgcaatctcatcgaa

SEQ ID NO: 482521 - DNA, 25 bp, Rattus norvegicus
gtagcgtgcctggaatctcatcgaa

SEQ ID NO: 482522 - DNA, 25 bp, Rattus norvegicus
gtagcgttctacaaggcatgctggg

SEQ ID NO: 482523 - DNA, 25 bp, Rattus norvegicus
gtagcgttctactaggcatgctggg

SEQ ID NO: 482524 - DNA, 25 bp, Rattus norvegicus
gtagcgtttcctatacactcttaag

SEQ ID NO: 482525 - DNA, 25 bp, Rattus norvegicus
gtagcgtttcctttacactcttaag

SEQ ID NO: 482526 - DNA, 25 bp, Rattus norvegicus
gtagctaaatacaggtgtcctggga

SEQ ID NO: 482527 - DNA, 25 bp, Rattus norvegicus
gtagctaaatactggtgtcctggga

SEQ ID NO: 482528 - DNA, 25 bp, Rattus norvegicus
gtagctaacgacattgcttatgatt

SEQ ID NO: 482529 - DNA, 25 bp, Rattus norvegicus
gtagctaacgactttgcttatgatt

SEQ ID NO: 482530 - DNA, 25 bp, Rattus norvegicus
gtagctaaggaacccgccaatcgat

SEQ ID NO: 482531 - DNA, 25 bp, Rattus norvegicus
gtagctaaggaagccgccaatcgat

SEQ ID NO: 482532 - DNA, 25 bp, Rattus norvegicus
gtagctaataacaacaggcatgtca

SEQ ID NO: 482533 - DNA, 25 bp, Rattus norvegicus
gtagctaataactacaggcatgtca

SEQ ID NO: 482534 - DNA, 25 bp, Rattus norvegicus
gtagctaatctcaggtaccccataa

SEQ ID NO: 482535 - DNA, 25 bp, Rattus norvegicus
gtagctaatctctggtaccccataa

SEQ ID NO: 482536 - DNA, 25 bp, Rattus norvegicus
gtagctaatttcatccttgagggca

SEQ ID NO: 482537 - DNA, 25 bp, Rattus norvegicus
gtagctaatttcttccttgagggca

SEQ ID NO: 482538 - DNA, 25 bp, Rattus norvegicus
gtagctacagaaattcatgttccca

SEQ ID NO: 482539 - DNA, 25 bp, Rattus norvegicus
gtagctacagaatttcatgttccca

SEQ ID NO: 482540 - DNA, 25 bp, Rattus norvegicus
gtagctacatttcacgactgcgagg

SEQ ID NO: 482541 - DNA, 25 bp, Rattus norvegicus
gtagctacatttgacgactgcgagg

SEQ ID NO: 482542 - DNA, 25 bp, Rattus norvegicus
gtagctaccacacccagttcctgga

SEQ ID NO: 482543 - DNA, 25 bp, Rattus norvegicus
gtagctaccacagccagttcctgga

SEQ ID NO: 482544 - DNA, 25 bp, Rattus norvegicus
gtagctaccactcttgagttctcgt

SEQ ID NO: 482545 - DNA, 25 bp, Rattus norvegicus
gtagctaccactgttgagttctcgt

SEQ ID NO: 482546 - DNA, 25 bp, Rattus norvegicus
gtagctacccagaatgcgtgtgatt

SEQ ID NO: 482547 - DNA, 25 bp, Rattus norvegicus
gtagctacccagtatgcgtgtgatt

SEQ ID NO: 482548 - DNA, 25 bp, Rattus norvegicus
gtagctacctttatgtatgtcgtta

SEQ ID NO: 482549 - DNA, 25 bp, Rattus norvegicus
gtagctacctttttgtatgtcgtta

SEQ ID NO: 482550 - DNA, 25 bp, Rattus norvegicus
gtagctactagcatgggccggtcca

SEQ ID NO: 482551 - DNA, 25 bp, Rattus norvegicus
gtagctactagcttgggccggtcca

SEQ ID NO: 482552 - DNA, 25 bp, Rattus norvegicus
gtagctactaggcttcgaggtcact

SEQ ID NO: 482553 - DNA, 25 bp, Rattus norvegicus
gtagctactagggttcgaggtcact

SEQ ID NO: 482554 - DNA, 25 bp, Rattus norvegicus
gtagctactgccagaagtgactttt

SEQ ID NO: 482555 - DNA, 25 bp, Rattus norvegicus
gtagctactgcctgaagtgactttt

SEQ ID NO: 482556 - DNA, 25 bp, Rattus norvegicus
gtagctactgttcctcttgctgatg

SEQ ID NO: 482557 - DNA, 25 bp, Rattus norvegicus
gtagctactgttgctcttgctgatg

SEQ ID NO: 482558 - DNA, 25 bp, Rattus norvegicus
gtagctacttgcaggcatccatggt

SEQ ID NO: 482559 - DNA, 25 bp, Rattus norvegicus
gtagctacttgctggcatccatggt

SEQ ID NO: 482560 - DNA, 25 bp, Rattus norvegicus
gtagctactttgatagttgccttgg

SEQ ID NO: 482561 - DNA, 25 bp, Rattus norvegicus
gtagctactttgttagttgccttgg

SEQ ID NO: 482562 - DNA, 25 bp, Rattus norvegicus
gtagctacttttaccatttcttcag

SEQ ID NO: 482563 - DNA, 25 bp, Rattus norvegicus
gtagctactttttccatttcttcag

SEQ ID NO: 482564 - DNA, 25 bp, Rattus norvegicus
gtagctagaattaccatttctggat

SEQ ID NO: 482565 - DNA, 25 bp, Rattus norvegicus
gtagctagaatttccatttctggat

SEQ ID NO: 482566 - DNA, 25 bp, Rattus norvegicus
gtagctagatggcactgtttagtca

SEQ ID NO: 482567 - DNA, 25 bp, Rattus norvegicus
gtagctagatgggactgtttagtca

SEQ ID NO: 482568 - DNA, 25 bp, Rattus norvegicus
gtagctagcacaacggctgttttcg

SEQ ID NO: 482569 - DNA, 25 bp, Rattus norvegicus
gtagctagcacatcggctgttttcg

SEQ ID NO: 482570 - DNA, 25 bp, Rattus norvegicus
gtagctagctttaatgtcactataa

SEQ ID NO: 482571 - DNA, 25 bp, Rattus norvegicus
gtagctagcttttatgtcactataa

SEQ ID NO: 482572 - DNA, 25 bp, Rattus norvegicus
gtagctaggcctcctaggactgatt

SEQ ID NO: 482573 - DNA, 25 bp, Rattus norvegicus
gtagctaggcctgctaggactgatt

SEQ ID NO: 482574 - DNA, 25 bp, Rattus norvegicus
gtagctatcatgactgccagaaccc

SEQ ID NO: 482575 - DNA, 25 bp, Rattus norvegicus
gtagctatcatgtctgccagaaccc

SEQ ID NO: 482576 - DNA, 25 bp, Rattus norvegicus
gtagctatctacaaacgagactgga

SEQ ID NO: 482577 - DNA, 25 bp, Rattus norvegicus
gtagctatctactaacgagactgga

SEQ ID NO: 482578 - DNA, 25 bp, Rattus norvegicus
gtagctatctagacttcctggaggc

SEQ ID NO: 482579 - DNA, 25 bp, Rattus norvegicus
gtagctatctagtcttcctggaggc

SEQ ID NO: 482580 - DNA, 25 bp, Rattus norvegicus
gtagctatgcgaacatggtgtctat

SEQ ID NO: 482581 - DNA, 25 bp, Rattus norvegicus
gtagctatgcgatcatggtgtctat

SEQ ID NO: 482582 - DNA, 25 bp, Rattus norvegicus
gtagctattatcactgccatgggat

SEQ ID NO: 482583 - DNA, 25 bp, Rattus norvegicus
gtagctattatctctgccatgggat

SEQ ID NO: 482584 - DNA, 25 bp, Rattus norvegicus
gtagctattgctaaactaggcccag

SEQ ID NO: 482585 - DNA, 25 bp, Rattus norvegicus
gtagctattgcttaactaggcccag

SEQ ID NO: 482586 - DNA, 25 bp, Rattus norvegicus
gtagctattgttaaatccatgcact

SEQ ID NO: 482587 - DNA, 25 bp, Rattus norvegicus
gtagctattgtttaatccatgcact

SEQ ID NO: 482588 - DNA, 25 bp, Rattus norvegicus
gtagctatttatattctgccaaagg

SEQ ID NO: 482589 - DNA, 25 bp, Rattus norvegicus
gtagctatttattttctgccaaagg

SEQ ID NO: 482590 - DNA, 25 bp, Rattus norvegicus
gtagctcaataccaattcatttaag

SEQ ID NO: 482591 - DNA, 25 bp, Rattus norvegicus
gtagctcaatacgaattcatttaag

SEQ ID NO: 482592 - DNA, 25 bp, Rattus norvegicus
gtagctcaatagaagactgcttgcc

SEQ ID NO: 482593 - DNA, 25 bp, Rattus norvegicus
gtagctcaatagtagactgcttgcc

SEQ ID NO: 482594 - DNA, 25 bp, Rattus norvegicus
gtagctcacagccagttataggaag

SEQ ID NO: 482595 - DNA, 25 bp, Rattus norvegicus
gtagctcacagcgagttataggaag

SEQ ID NO: 482596 - DNA, 25 bp, Rattus norvegicus
gtagctcacgcaccaggacaagcaa

SEQ ID NO: 482597 - DNA, 25 bp, Rattus norvegicus
gtagctcacgcagcaggacaagcaa

SEQ ID NO: 482598 - DNA, 25 bp, Rattus norvegicus
gtagctcacttcatagcatccgtgt

SEQ ID NO: 482599 - DNA, 25 bp, Rattus norvegicus
gtagctcacttcttagcatccgtgt

SEQ ID NO: 482600 - DNA, 25 bp, Rattus norvegicus
gtagctcagcctctagagaacccaa

SEQ ID NO: 482601 - DNA, 25 bp, Rattus norvegicus
gtagctcagcctgtagagaacccaa

SEQ ID NO: 482602 - DNA, 25 bp, Rattus norvegicus
gtagctcagctaacctggtgagtcg

SEQ ID NO: 482603 - DNA, 25 bp, Rattus norvegicus
gtagctcagctatcctggtgagtcg

SEQ ID NO: 482604 - DNA, 25 bp, Rattus norvegicus
gtagctcaggctaactgtgcagact

SEQ ID NO: 482605 - DNA, 25 bp, Rattus norvegicus
gtagctcaggcttactgtgcagact

SEQ ID NO: 482606 - DNA, 25 bp, Rattus norvegicus
gtagctcagttcacaagaaccagca

SEQ ID NO: 482607 - DNA, 25 bp, Rattus norvegicus
gtagctcagttctcaagaaccagca

SEQ ID NO: 482608 - DNA, 25 bp, Rattus norvegicus
gtagctcatagcactagctgctaat

SEQ ID NO: 482609 - DNA, 25 bp, Rattus norvegicus
gtagctcatagctctagctgctaat

SEQ ID NO: 482610 - DNA, 25 bp, Rattus norvegicus
gtagctcatggacctgtgtctagta

SEQ ID NO: 482611 - DNA, 25 bp, Rattus norvegicus
gtagctcatggagctgtgtctagta

SEQ ID NO: 482612 - DNA, 25 bp, Rattus norvegicus
gtagctcattgtaacagacgccctg

SEQ ID NO: 482613 - DNA, 25 bp, Rattus norvegicus
gtagctcattgttacagacgccctg

SEQ ID NO: 482614 - DNA, 25 bp, Rattus norvegicus
gtagctccaaatcgccaatcaaatg

SEQ ID NO: 482615 - DNA, 25 bp, Rattus norvegicus
gtagctccaaatggccaatcaaatg

SEQ ID NO: 482616 - DNA, 25 bp, Rattus norvegicus
gtagctccagaactttatattgctg

SEQ ID NO: 482617 - DNA, 25 bp, Rattus norvegicus
gtagctccagaagtttatattgctg

SEQ ID NO: 482618 - DNA, 25 bp, Rattus norvegicus
gtagctccagtcaccatacaaagat

SEQ ID NO: 482619 - DNA, 25 bp, Rattus norvegicus
gtagctccagtctccatacaaagat

SEQ ID NO: 482620 - DNA, 25 bp, Rattus norvegicus
gtagctccatagaattcaatgcccc

SEQ ID NO: 482621 - DNA, 25 bp, Rattus norvegicus
gtagctccatagtattcaatgcccc

SEQ ID NO: 482622 - DNA, 25 bp, Rattus norvegicus
gtagctccatctcgtggacgggcat

SEQ ID NO: 482623 - DNA, 25 bp, Rattus norvegicus
gtagctccatctggtggacgggcat

SEQ ID NO: 482624 - DNA, 25 bp, Rattus norvegicus
gtagctccattcactgctataaagg

SEQ ID NO: 482625 - DNA, 25 bp, Rattus norvegicus
gtagctccattctctgctataaagg

SEQ ID NO: 482626 - DNA, 25 bp, Rattus norvegicus
gtagctccccacagtgtttctggag

SEQ ID NO: 482627 - DNA, 25 bp, Rattus norvegicus
gtagctccccactgtgtttctggag

SEQ ID NO: 482628 - DNA, 25 bp, Rattus norvegicus
gtagctcctcagaacagcttgttat

SEQ ID NO: 482629 - DNA, 25 bp, Rattus norvegicus
gtagctcctcagtacagcttgttat

SEQ ID NO: 482630 - DNA, 25 bp, Rattus norvegicus
gtagctcctccaagacaacaaacat

SEQ ID NO: 482631 - DNA, 25 bp, Rattus norvegicus
gtagctcctccatgacaacaaacat

SEQ ID NO: 482632 - DNA, 25 bp, Rattus norvegicus
gtagctcctcttatggttgtcagac

SEQ ID NO: 482633 - DNA, 25 bp, Rattus norvegicus
gtagctcctcttttggttgtcagac

SEQ ID NO: 482634 - DNA, 25 bp, Rattus norvegicus
gtagctcgaacgctcaagatcagtg

SEQ ID NO: 482635 - DNA, 25 bp, Rattus norvegicus
gtagctcgaacggtcaagatcagtg

SEQ ID NO: 482636 - DNA, 25 bp, Rattus norvegicus
gtagctcgcaacagccgcaagatgg

SEQ ID NO: 482637 - DNA, 25 bp, Rattus norvegicus
gtagctcgcaactgccgcaagatgg

SEQ ID NO: 482638 - DNA, 25 bp, Rattus norvegicus
gtagctcgtaccctgtatcaaaagt

SEQ ID NO: 482639 - DNA, 25 bp, Rattus norvegicus
gtagctcgtaccgtgtatcaaaagt

SEQ ID NO: 482640 - DNA, 25 bp, Rattus norvegicus
gtagctctccaaataaatgctcagc

SEQ ID NO: 482641 - DNA, 25 bp, Rattus norvegicus
gtagctctccaattaaatgctcagc

SEQ ID NO: 482642 - DNA, 25 bp, Rattus norvegicus
gtagctctccatacagggaggacaa

SEQ ID NO: 482643 - DNA, 25 bp, Rattus norvegicus
gtagctctccattcagggaggacaa

SEQ ID NO: 482644 - DNA, 25 bp, Rattus norvegicus
gtagctctctgcctaagtgtgcaca

SEQ ID NO: 482645 - DNA, 25 bp, Rattus norvegicus
gtagctctctgcgtaagtgtgcaca

SEQ ID NO: 482646 - DNA, 25 bp, Rattus norvegicus
gtagctctgccacgtatccagaaaa

SEQ ID NO: 482647 - DNA, 25 bp, Rattus norvegicus
gtagctctgccaggtatccagaaaa

SEQ ID NO: 482648 - DNA, 25 bp, Rattus norvegicus
gtagctctggaaaactgacttgccc

SEQ ID NO: 482649 - DNA, 25 bp, Rattus norvegicus
gtagctctggaatactgacttgccc

SEQ ID NO: 482650 - DNA, 25 bp, Rattus norvegicus
gtagctctgggactctactcacaaa

SEQ ID NO: 482651 - DNA, 25 bp, Rattus norvegicus
gtagctctgggagtctactcacaaa

SEQ ID NO: 482652 - DNA, 25 bp, Rattus norvegicus
gtagctctgtatacaccttttctct

SEQ ID NO: 482653 - DNA, 25 bp, Rattus norvegicus
gtagctctgtattcaccttttctct

SEQ ID NO: 482654 - DNA, 25 bp, Rattus norvegicus
gtagctctgttacagaacggccctc

SEQ ID NO: 482655 - DNA, 25 bp, Rattus norvegicus
gtagctctgttagagaacggccctc

SEQ ID NO: 482656 - DNA, 25 bp, Rattus norvegicus
gtagctctttatccctttcctggga

SEQ ID NO: 482657 - DNA, 25 bp, Rattus norvegicus
gtagctctttatgcctttcctggga

SEQ ID NO: 482658 - DNA, 25 bp, Rattus norvegicus
gtagctctttccacacaaaaatcag

SEQ ID NO: 482659 - DNA, 25 bp, Rattus norvegicus
gtagctctttcctcacaaaaatcag

SEQ ID NO: 482660 - DNA, 25 bp, Rattus norvegicus
gtagctctttctacttgtcatcttt

SEQ ID NO: 482661 - DNA, 25 bp, Rattus norvegicus
gtagctctttcttcttgtcatcttt

SEQ ID NO: 482662 - DNA, 25 bp, Rattus norvegicus
gtagctcttttaacacactctttat

SEQ ID NO: 482663 - DNA, 25 bp, Rattus norvegicus
gtagctcttttatcacactctttat

SEQ ID NO: 482664 - DNA, 25 bp, Rattus norvegicus
gtagctcttttgctaattcctggag

SEQ ID NO: 482665 - DNA, 25 bp, Rattus norvegicus
gtagctcttttggtaattcctggag

SEQ ID NO: 482666 - DNA, 25 bp, Rattus norvegicus
gtagctgaaaataattcccaactaa

SEQ ID NO: 482667 - DNA, 25 bp, Rattus norvegicus
gtagctgaaaattattcccaactaa

SEQ ID NO: 482668 - DNA, 25 bp, Rattus norvegicus
gtagctgaaacccacattgttcttc

SEQ ID NO: 482669 - DNA, 25 bp, Rattus norvegicus
gtagctgaaaccgacattgttcttc

SEQ ID NO: 482670 - DNA, 25 bp, Rattus norvegicus
gtagctgaacacatgtacccaggcc

SEQ ID NO: 482671 - DNA, 25 bp, Rattus norvegicus
gtagctgaacacttgtacccaggcc

SEQ ID NO: 482672 - DNA, 25 bp, Rattus norvegicus
gtagctgaagccaaaacgaccttta

SEQ ID NO: 482673 - DNA, 25 bp, Rattus norvegicus
gtagctgaagcctaaacgaccttta

SEQ ID NO: 482674 - DNA, 25 bp, Rattus norvegicus
gtagctgaagctcaacctgaaccaa

SEQ ID NO: 482675 - DNA, 25 bp, Rattus norvegicus
gtagctgaagctgaacctgaaccaa

SEQ ID NO: 482676 - DNA, 25 bp, Rattus norvegicus
gtagctgaattcctttcgcaagttt

SEQ ID NO: 482677 - DNA, 25 bp, Rattus norvegicus
gtagctgaattcgtttcgcaagttt

SEQ ID NO: 482678 - DNA, 25 bp, Rattus norvegicus
gtagctgacagaccgaaccccagga

SEQ ID NO: 482679 - DNA, 25 bp, Rattus norvegicus
gtagctgacagagcgaaccccagga

SEQ ID NO: 482680 - DNA, 25 bp, Rattus norvegicus
gtagctgacagtactgcatctggat

SEQ ID NO: 482681 - DNA, 25 bp, Rattus norvegicus
gtagctgacagttctgcatctggat

SEQ ID NO: 482682 - DNA, 25 bp, Rattus norvegicus
gtagctgactccacaagcactgtat

SEQ ID NO: 482683 - DNA, 25 bp, Rattus norvegicus
gtagctgactcctcaagcactgtat

SEQ ID NO: 482684 - DNA, 25 bp, Rattus norvegicus
gtagctgagacactttgttatttca

SEQ ID NO: 482685 - DNA, 25 bp, Rattus norvegicus
gtagctgagacagtttgttatttca

SEQ ID NO: 482686 - DNA, 25 bp, Rattus norvegicus
gtagctgagctacaaatatgatttg

SEQ ID NO: 482687 - DNA, 25 bp, Rattus norvegicus
gtagctgagctagaaatatgatttg

SEQ ID NO: 482688 - DNA, 25 bp, Rattus norvegicus
gtagctgaggctatcctgcaggaca

SEQ ID NO: 482689 - DNA, 25 bp, Rattus norvegicus
gtagctgaggctttcctgcaggaca

SEQ ID NO: 482690 - DNA, 25 bp, Rattus norvegicus
gtagctgattatcctttgccttgtg

SEQ ID NO: 482691 - DNA, 25 bp, Rattus norvegicus
gtagctgattatgctttgccttgtg

SEQ ID NO: 482692 - DNA, 25 bp, Rattus norvegicus
gtagctgattctcgaagcaacgttc

SEQ ID NO: 482693 - DNA, 25 bp, Rattus norvegicus
gtagctgattctggaagcaacgttc

SEQ ID NO: 482694 - DNA, 25 bp, Rattus norvegicus
gtagctgattttagtctccttgtcc

SEQ ID NO: 482695 - DNA, 25 bp, Rattus norvegicus
gtagctgatttttgtctccttgtcc

SEQ ID NO: 482696 - DNA, 25 bp, Rattus norvegicus
gtagctgcaccgatgtttgaactgt

SEQ ID NO: 482697 - DNA, 25 bp, Rattus norvegicus
gtagctgcaccgttgtttgaactgt

SEQ ID NO: 482698 - DNA, 25 bp, Rattus norvegicus
gtagctgcaggaccgctagccacca

SEQ ID NO: 482699 - DNA, 25 bp, Rattus norvegicus
gtagctgcaggactcttccacccta

SEQ ID NO: 482700 - DNA, 25 bp, Rattus norvegicus
gtagctgcaggagcgctagccacca

SEQ ID NO: 482701 - DNA, 25 bp, Rattus norvegicus
gtagctgcaggagtcttccacccta

SEQ ID NO: 482702 - DNA, 25 bp, Rattus norvegicus
gtagctgcagtgaacgtccaacttc

SEQ ID NO: 482703 - DNA, 25 bp, Rattus norvegicus
gtagctgcagtgtacgtccaacttc

SEQ ID NO: 482704 - DNA, 25 bp, Rattus norvegicus
gtagctgccagtctcacagttgtta

SEQ ID NO: 482705 - DNA, 25 bp, Rattus norvegicus
gtagctgccagtgtcacagttgtta

SEQ ID NO: 482706 - DNA, 25 bp, Rattus norvegicus
gtagctgcccaccagtattaacgat

SEQ ID NO: 482707 - DNA, 25 bp, Rattus norvegicus
gtagctgcccacgagtattaacgat

SEQ ID NO: 482708 - DNA, 25 bp, Rattus norvegicus
gtagctgcccctaaggctgtagggc

SEQ ID NO: 482709 - DNA, 25 bp, Rattus norvegicus
gtagctgccccttaggctgtagggc

SEQ ID NO: 482710 - DNA, 25 bp, Rattus norvegicus
gtagctgcctgaacacgacaccgca

SEQ ID NO: 482711 - DNA, 25 bp, Rattus norvegicus
gtagctgcctgatcacgacaccgca

SEQ ID NO: 482712 - DNA, 25 bp, Rattus norvegicus
gtagctgcctgtatacagttctatc

SEQ ID NO: 482713 - DNA, 25 bp, Rattus norvegicus
gtagctgcctgtttacagttctatc

SEQ ID NO: 482714 - DNA, 25 bp, Rattus norvegicus
gtagctgcgagcctatttgtccagg

SEQ ID NO: 482715 - DNA, 25 bp, Rattus norvegicus
gtagctgcgagcgtatttgtccagg

SEQ ID NO: 482716 - DNA, 25 bp, Rattus norvegicus
gtagctgcggtcagccatctttgtt

SEQ ID NO: 482717 - DNA, 25 bp, Rattus norvegicus
gtagctgcggtctgccatctttgtt

SEQ ID NO: 482718 - DNA, 25 bp, Rattus norvegicus
gtagctgctatcaggtttcctttta

SEQ ID NO: 482719 - DNA, 25 bp, Rattus norvegicus
gtagctgctatctggtttcctttta

SEQ ID NO: 482720 - DNA, 25 bp, Rattus norvegicus
gtagctgctcggaatgttcacctaa

SEQ ID NO: 482721 - DNA, 25 bp, Rattus norvegicus
gtagctgctcggtatgttcacctaa

SEQ ID NO: 482722 - DNA, 25 bp, Rattus norvegicus
gtagctgctgagacccatgtgaaac

SEQ ID NO: 482723 - DNA, 25 bp, Rattus norvegicus
gtagctgctgagtcccatgtgaaac

SEQ ID NO: 482724 - DNA, 25 bp, Rattus norvegicus
gtagctgcttccaggcatccaggag

SEQ ID NO: 482725 - DNA, 25 bp, Rattus norvegicus
gtagctgcttccagggtacatttgt

SEQ ID NO: 482726 - DNA, 25 bp, Rattus norvegicus
gtagctgcttcctggcatccaggag

SEQ ID NO: 482727 - DNA, 25 bp, Rattus norvegicus
gtagctgcttcctgggtacatttgt

SEQ ID NO: 482728 - DNA, 25 bp, Rattus norvegicus
gtagctggacagcatttctcttcag

SEQ ID NO: 482729 - DNA, 25 bp, Rattus norvegicus
gtagctggacaggatttctcttcag

SEQ ID NO: 482730 - DNA, 25 bp, Rattus norvegicus
gtagctggactacaattccctcagt

SEQ ID NO: 482731 - DNA, 25 bp, Rattus norvegicus
gtagctggactacttgatcttcctg

SEQ ID NO: 482732 - DNA, 25 bp, Rattus norvegicus
gtagctggactagaattccctcagt

SEQ ID NO: 482733 - DNA, 25 bp, Rattus norvegicus
gtagctggactagttgatcttcctg

SEQ ID NO: 482734 - DNA, 25 bp, Rattus norvegicus
gtagctggagggatcagcctcattt

SEQ ID NO: 482735 - DNA, 25 bp, Rattus norvegicus
gtagctggagggttcagcctcattt

SEQ ID NO: 482736 - DNA, 25 bp, Rattus norvegicus
gtagctggcaccacacctgtggaga

SEQ ID NO: 482737 - DNA, 25 bp, Rattus norvegicus
gtagctggcacctcacctgtggaga

SEQ ID NO: 482738 - DNA, 25 bp, Rattus norvegicus
gtagctggcttacgccttatgcgca

SEQ ID NO: 482739 - DNA, 25 bp, Rattus norvegicus
gtagctggcttaggccttatgcgca

SEQ ID NO: 482740 - DNA, 25 bp, Rattus norvegicus
gtagctgggttcaaaccttaaacag

SEQ ID NO: 482741 - DNA, 25 bp, Rattus norvegicus
gtagctgggttctaaccttaaacag

SEQ ID NO: 482742 - DNA, 25 bp, Rattus norvegicus
gtagctggtgcacgaatctcatccc

SEQ ID NO: 482743 - DNA, 25 bp, Rattus norvegicus
gtagctggtgcaggaatctcatccc

SEQ ID NO: 482744 - DNA, 25 bp, Rattus norvegicus
gtagctgtactacaagcccaccaag

SEQ ID NO: 482745 - DNA, 25 bp, Rattus norvegicus
gtagctgtactagaagcccaccaag

SEQ ID NO: 482746 - DNA, 25 bp, Rattus norvegicus
gtagctgtagagattgccgacgtag

SEQ ID NO: 482747 - DNA, 25 bp, Rattus norvegicus
gtagctgtagagtttgccgacgtag

SEQ ID NO: 482748 - DNA, 25 bp, Rattus norvegicus
gtagctgtagcaaacggtcccatta

SEQ ID NO: 482749 - DNA, 25 bp, Rattus norvegicus
gtagctgtagcatacggtcccatta

SEQ ID NO: 482750 - DNA, 25 bp, Rattus norvegicus
gtagctgtagttcactgctttcctg

SEQ ID NO: 482751 - DNA, 25 bp, Rattus norvegicus
gtagctgtagttgactgctttcctg

SEQ ID NO: 482752 - DNA, 25 bp, Rattus norvegicus
gtagctgtcaaacatctccggtata

SEQ ID NO: 482753 - DNA, 25 bp, Rattus norvegicus
gtagctgtcaaagatctccggtata

SEQ ID NO: 482754 - DNA, 25 bp, Rattus norvegicus
gtagctgtcagtatgtactcaggta

SEQ ID NO: 482755 - DNA, 25 bp, Rattus norvegicus
gtagctgtcagtttgtactcaggta

SEQ ID NO: 482756 - DNA, 25 bp, Rattus norvegicus
gtagctgtcatacattcctgagttg

SEQ ID NO: 482757 - DNA, 25 bp, Rattus norvegicus
gtagctgtcatagattcctgagttg

SEQ ID NO: 482758 - DNA, 25 bp, Rattus norvegicus
gtagctgtccatacaatgaacctgt

SEQ ID NO: 482759 - DNA, 25 bp, Rattus norvegicus
gtagctgtccatccgctggttcacg

SEQ ID NO: 482760 - DNA, 25 bp, Rattus norvegicus
gtagctgtccatgcgctggttcacg

SEQ ID NO: 482761 - DNA, 25 bp, Rattus norvegicus
gtagctgtccattcaatgaacctgt

SEQ ID NO: 482762 - DNA, 25 bp, Rattus norvegicus
gtagctgtcctccaactcacataga

SEQ ID NO: 482763 - DNA, 25 bp, Rattus norvegicus
gtagctgtcctcgaactcacataga

SEQ ID NO: 482764 - DNA, 25 bp, Rattus norvegicus
gtagctgtctacattggtcacttgc

SEQ ID NO: 482765 - DNA, 25 bp, Rattus norvegicus
gtagctgtctactttggtcacttgc

SEQ ID NO: 482766 - DNA, 25 bp, Rattus norvegicus
gtagctgtctctcttctatagaaat

SEQ ID NO: 482767 - DNA, 25 bp, Rattus norvegicus
gtagctgtctctgttctatagaaat

SEQ ID NO: 482768 - DNA, 25 bp, Rattus norvegicus
gtagctgtctggcttcttgttttcc

SEQ ID NO: 482769 - DNA, 25 bp, Rattus norvegicus
gtagctgtctgggttcttgttttcc

SEQ ID NO: 482770 - DNA, 25 bp, Rattus norvegicus
gtagctgtcttacgcatcataaaat

SEQ ID NO: 482771 - DNA, 25 bp, Rattus norvegicus
gtagctgtcttaggcatcataaaat

SEQ ID NO: 482772 - DNA, 25 bp, Rattus norvegicus
gtagctgtgacaccatggtacgctc

SEQ ID NO: 482773 - DNA, 25 bp, Rattus norvegicus
gtagctgtgacagcatggtacgctc

SEQ ID NO: 482774 - DNA, 25 bp, Rattus norvegicus
gtagctgtgagcaagcacaaaagag

SEQ ID NO: 482775 - DNA, 25 bp, Rattus norvegicus
gtagctgtgagctagcacaaaagag

SEQ ID NO: 482776 - DNA, 25 bp, Rattus norvegicus
gtagctgtgcagattgctgacttgc

SEQ ID NO: 482777 - DNA, 25 bp, Rattus norvegicus
gtagctgtgcagtttgctgacttgc

SEQ ID NO: 482778 - DNA, 25 bp, Rattus norvegicus
gtagctgtgcatatcagagcctcct

SEQ ID NO: 482779 - DNA, 25 bp, Rattus norvegicus
gtagctgtgcatttcagagcctcct

SEQ ID NO: 482780 - DNA, 25 bp, Rattus norvegicus
gtagctgtgctactttgtccactca

SEQ ID NO: 482781 - DNA, 25 bp, Rattus norvegicus
gtagctgtgctagtttgtccactca

SEQ ID NO: 482782 - DNA, 25 bp, Rattus norvegicus
gtagctgtgctgacttagttcagtt

SEQ ID NO: 482783 - DNA, 25 bp, Rattus norvegicus
gtagctgtgctgtcttagttcagtt

SEQ ID NO: 482784 - DNA, 25 bp, Rattus norvegicus
gtagctgtggctattgaccgctgct

SEQ ID NO: 482785 - DNA, 25 bp, Rattus norvegicus
gtagctgtggcttttgaccgctgct

SEQ ID NO: 482786 - DNA, 25 bp, Rattus norvegicus
gtagctgtggtcacgcagagtcctc

SEQ ID NO: 482787 - DNA, 25 bp, Rattus norvegicus
gtagctgtggtctcgcagagtcctc

SEQ ID NO: 482788 - DNA, 25 bp, Rattus norvegicus
gtagctgtgttgctccttcacggga

SEQ ID NO: 482789 - DNA, 25 bp, Rattus norvegicus
gtagctgtgttggtccttcacggga

SEQ ID NO: 482790 - DNA, 25 bp, Rattus norvegicus
gtagctgttcagatgccactaagag

SEQ ID NO: 482791 - DNA, 25 bp, Rattus norvegicus
gtagctgttcagttgccactaagag

SEQ ID NO: 482792 - DNA, 25 bp, Rattus norvegicus
gtagctgttcccctgaacaggttta

SEQ ID NO: 482793 - DNA, 25 bp, Rattus norvegicus
gtagctgttcccgtgaacaggttta

SEQ ID NO: 482794 - DNA, 25 bp, Rattus norvegicus
gtagctgttctgagtagtgttccaa

SEQ ID NO: 482795 - DNA, 25 bp, Rattus norvegicus
gtagctgttctgtgtagtgttccaa

SEQ ID NO: 482796 - DNA, 25 bp, Rattus norvegicus
gtagcttaatcaaaacctcacactg

SEQ ID NO: 482797 - DNA, 25 bp, Rattus norvegicus
gtagcttaatcataacctcacactg

SEQ ID NO: 482798 - DNA, 25 bp, Rattus norvegicus
gtagcttacaacagtctgattccag

SEQ ID NO: 482799 - DNA, 25 bp, Rattus norvegicus
gtagcttacaactgtctgattccag

SEQ ID NO: 482800 - DNA, 25 bp, Rattus norvegicus
gtagcttactcaccatgactgtaga

SEQ ID NO: 482801 - DNA, 25 bp, Rattus norvegicus
gtagcttactcagcatgactgtaga

SEQ ID NO: 482802 - DNA, 25 bp, Rattus norvegicus
gtagcttagatccaccttgacaaag

SEQ ID NO: 482803 - DNA, 25 bp, Rattus norvegicus
gtagcttagatcgaccttgacaaag

SEQ ID NO: 482804 - DNA, 25 bp, Rattus norvegicus
gtagcttatagcagtaacgccttag

SEQ ID NO: 482805 - DNA, 25 bp, Rattus norvegicus
gtagcttatagctgtaacgccttag

SEQ ID NO: 482806 - DNA, 25 bp, Rattus norvegicus
gtagcttatataatttcctcacagg

SEQ ID NO: 482807 - DNA, 25 bp, Rattus norvegicus
gtagcttatatattttcctcacagg

SEQ ID NO: 482808 - DNA, 25 bp, Rattus norvegicus
gtagcttcaaacaggaaatagcgaa

SEQ ID NO: 482809 - DNA, 25 bp, Rattus norvegicus
gtagcttcaaactggaaatagcgaa

SEQ ID NO: 482810 - DNA, 25 bp, Rattus norvegicus
gtagcttcagcgactgcaggaaact

SEQ ID NO: 482811 - DNA, 25 bp, Rattus norvegicus
gtagcttcagcgtctgcaggaaact

SEQ ID NO: 482812 - DNA, 25 bp, Rattus norvegicus
gtagcttcaggcctttgatcccctc

SEQ ID NO: 482813 - DNA, 25 bp, Rattus norvegicus
gtagcttcaggcgtttgatcccctc

SEQ ID NO: 482814 - DNA, 25 bp, Rattus norvegicus
gtagcttccataattctgcttcatc

SEQ ID NO: 482815 - DNA, 25 bp, Rattus norvegicus
gtagcttccatatttctgcttcatc

SEQ ID NO: 482816 - DNA, 25 bp, Rattus norvegicus
gtagcttccggacctgtttcggcaa

SEQ ID NO: 482817 - DNA, 25 bp, Rattus norvegicus
gtagcttccggagctgtttcggcaa

SEQ ID NO: 482818 - DNA, 25 bp, Rattus norvegicus
gtagcttcctctcacttgattttta

SEQ ID NO: 482819 - DNA, 25 bp, Rattus norvegicus
gtagcttcctctgacttgattttta

SEQ ID NO: 482820 - DNA, 25 bp, Rattus norvegicus
gtagcttctcttaaaagtggcactt

SEQ ID NO: 482821 - DNA, 25 bp, Rattus norvegicus
gtagcttctctttaaagtggcactt

SEQ ID NO: 482822 - DNA, 25 bp, Rattus norvegicus
gtagcttctgctctagtaacctttt

SEQ ID NO: 482823 - DNA, 25 bp, Rattus norvegicus
gtagcttctgctgtagtaacctttt

SEQ ID NO: 482824 - DNA, 25 bp, Rattus norvegicus
gtagcttctgtaactgtaatcggtt

SEQ ID NO: 482825 - DNA, 25 bp, Rattus norvegicus
gtagcttctgtatctgtaatcggtt

SEQ ID NO: 482826 - DNA, 25 bp, Rattus norvegicus
gtagcttctgttcatagggtgcttc

SEQ ID NO: 482827 - DNA, 25 bp, Rattus norvegicus
gtagcttctgttgatagggtgcttc

SEQ ID NO: 482828 - DNA, 25 bp, Rattus norvegicus
gtagcttgatccatggatttcctga

SEQ ID NO: 482829 - DNA, 25 bp, Rattus norvegicus
gtagcttgatccttggatttcctga

SEQ ID NO: 482830 - DNA, 25 bp, Rattus norvegicus
gtagcttgccaaagtcagccagtgt

SEQ ID NO: 482831 - DNA, 25 bp, Rattus norvegicus
gtagcttgccaatgtcagccagtgt

SEQ ID NO: 482832 - DNA, 25 bp, Rattus norvegicus
gtagcttgctctcccgaagccgaag

SEQ ID NO: 482833 - DNA, 25 bp, Rattus norvegicus
gtagcttgctctgccgaagccgaag

SEQ ID NO: 482834 - DNA, 25 bp, Rattus norvegicus
gtagcttgtagtcttggattctctt

SEQ ID NO: 482835 - DNA, 25 bp, Rattus norvegicus
gtagcttgtagtgttggattctctt

SEQ ID NO: 482836 - DNA, 25 bp, Rattus norvegicus
gtagcttgtcacattgcattgcaca

SEQ ID NO: 482837 - DNA, 25 bp, Rattus norvegicus
gtagcttgtcactttgcattgcaca

SEQ ID NO: 482838 - DNA, 25 bp, Rattus norvegicus
gtagcttgtctgagagcaaccctgt

SEQ ID NO: 482839 - DNA, 25 bp, Rattus norvegicus
gtagcttgtctgtgagcaaccctgt

SEQ ID NO: 482840 - DNA, 25 bp, Rattus norvegicus
gtagcttgttgcagaacgccgccag

SEQ ID NO: 482841 - DNA, 25 bp, Rattus norvegicus
gtagcttgttgctgaacgccgccag

SEQ ID NO: 482842 - DNA, 25 bp, Rattus norvegicus
gtagcttgttttcctgacagcaaat

SEQ ID NO: 482843 - DNA, 25 bp, Rattus norvegicus
gtagcttgttttgctgacagcaaat

SEQ ID NO: 482844 - DNA, 25 bp, Rattus norvegicus
gtagctttagtcatcgcttgccttg

SEQ ID NO: 482845 - DNA, 25 bp, Rattus norvegicus
gtagctttagtcttcgcttgccttg

SEQ ID NO: 482846 - DNA, 25 bp, Rattus norvegicus
gtagctttagttattcaaggagtag

SEQ ID NO: 482847 - DNA, 25 bp, Rattus norvegicus
gtagctttagtttttcaaggagtag

SEQ ID NO: 482848 - DNA, 25 bp, Rattus norvegicus
gtagctttatttctttctgcacctt

SEQ ID NO: 482849 - DNA, 25 bp, Rattus norvegicus
gtagctttatttgtttctgcacctt

SEQ ID NO: 482850 - DNA, 25 bp, Rattus norvegicus
gtagctttcagaccatacagtattc

SEQ ID NO: 482851 - DNA, 25 bp, Rattus norvegicus
gtagctttcagagcatacagtattc

SEQ ID NO: 482852 - DNA, 25 bp, Rattus norvegicus
gtagctttcagtatagttactggta

SEQ ID NO: 482853 - DNA, 25 bp, Rattus norvegicus
gtagctttcagtttagttactggta

SEQ ID NO: 482854 - DNA, 25 bp, Rattus norvegicus
gtagctttcatacggtttgtgcacc

SEQ ID NO: 482855 - DNA, 25 bp, Rattus norvegicus
gtagctttcatagggtttgtgcacc

SEQ ID NO: 482856 - DNA, 25 bp, Rattus norvegicus
gtagctttcattcatcactgtgata

SEQ ID NO: 482857 - DNA, 25 bp, Rattus norvegicus
gtagctttcattgatcactgtgata

SEQ ID NO: 482858 - DNA, 25 bp, Rattus norvegicus
gtagctttctagctccaggaatctg

SEQ ID NO: 482859 - DNA, 25 bp, Rattus norvegicus
gtagctttctaggtccaggaatctg

SEQ ID NO: 482860 - DNA, 25 bp, Rattus norvegicus
gtagctttctgtcgttctgtaatgc

SEQ ID NO: 482861 - DNA, 25 bp, Rattus norvegicus
gtagctttctgtggttctgtaatgc

SEQ ID NO: 482862 - DNA, 25 bp, Rattus norvegicus
gtagctttgaccaatcctgttaact

SEQ ID NO: 482863 - DNA, 25 bp, Rattus norvegicus
gtagctttgacctatcctgttaact

SEQ ID NO: 482864 - DNA, 25 bp, Rattus norvegicus
gtagctttgctcctaaactagaatt

SEQ ID NO: 482865 - DNA, 25 bp, Rattus norvegicus
gtagctttgctcgtaaactagaatt

SEQ ID NO: 482866 - DNA, 25 bp, Rattus norvegicus
gtagctttggcactcatttctgtgt

SEQ ID NO: 482867 - DNA, 25 bp, Rattus norvegicus
gtagctttggcagtcatttctgtgt

SEQ ID NO: 482868 - DNA, 25 bp, Rattus norvegicus
gtagctttgtggcttcgtgtccaac

SEQ ID NO: 482869 - DNA, 25 bp, Rattus norvegicus
gtagctttgtgggttcgtgtccaac

SEQ ID NO: 482870 - DNA, 25 bp, Rattus norvegicus
gtagctttgtttatcctcaggtgta

SEQ ID NO: 482871 - DNA, 25 bp, Rattus norvegicus
gtagctttgtttttcctcaggtgta

SEQ ID NO: 482872 - DNA, 25 bp, Rattus norvegicus
gtagcttttagaatttgtgtcctat

SEQ ID NO: 482873 - DNA, 25 bp, Rattus norvegicus
gtagcttttagattttgtgtcctat

SEQ ID NO: 482874 - DNA, 25 bp, Rattus norvegicus
gtagcttttcacactgttccttata

SEQ ID NO: 482875 - DNA, 25 bp, Rattus norvegicus
gtagcttttcactctgttccttata

SEQ ID NO: 482876 - DNA, 25 bp, Rattus norvegicus
gtagcttttcccagggctttcagca

SEQ ID NO: 482877 - DNA, 25 bp, Rattus norvegicus
gtagcttttccctgggctttcagca

SEQ ID NO: 482878 - DNA, 25 bp, Rattus norvegicus
gtagcttttgctagccccaagggtt

SEQ ID NO: 482879 - DNA, 25 bp, Rattus norvegicus
gtagcttttgcttgccccaagggtt

SEQ ID NO: 482880 - DNA, 25 bp, Rattus norvegicus
gtaggaaacagccataccctgagtg

SEQ ID NO: 482881 - DNA, 25 bp, Rattus norvegicus
gtaggaaacagcgataccctgagtg

SEQ ID NO: 482882 - DNA, 25 bp, Rattus norvegicus
gtaggaaagacaatcccacaccctg

SEQ ID NO: 482883 - DNA, 25 bp, Rattus norvegicus
gtaggaaagacattcccacaccctg

SEQ ID NO: 482884 - DNA, 25 bp, Rattus norvegicus
gtaggaaatccacgcacctctgtga

SEQ ID NO: 482885 - DNA, 25 bp, Rattus norvegicus
gtaggaaatccaggcacctctgtga

SEQ ID NO: 482886 - DNA, 25 bp, Rattus norvegicus
gtaggaaccattctggcctcccagg

SEQ ID NO: 482887 - DNA, 25 bp, Rattus norvegicus
gtaggaaccattgtggcctcccagg

SEQ ID NO: 482888 - DNA, 25 bp, Rattus norvegicus
gtaggaacggacaccttcagattgt

SEQ ID NO: 482889 - DNA, 25 bp, Rattus norvegicus
gtaggaacggactccttcagattgt

SEQ ID NO: 482890 - DNA, 25 bp, Rattus norvegicus
gtaggaactcggctgatttctagct

SEQ ID NO: 482891 - DNA, 25 bp, Rattus norvegicus
gtaggaactcgggtgatttctagct

SEQ ID NO: 482892 - DNA, 25 bp, Rattus norvegicus
gtaggaacttctaattggacaggac

SEQ ID NO: 482893 - DNA, 25 bp, Rattus norvegicus
gtaggaacttcttattggacaggac

SEQ ID NO: 482894 - DNA, 25 bp, Rattus norvegicus
gtaggaagcacactagctgccacat

SEQ ID NO: 482895 - DNA, 25 bp, Rattus norvegicus
gtaggaagcacagtagctgccacat

SEQ ID NO: 482896 - DNA, 25 bp, Rattus norvegicus
gtaggaagcctacccagtctttgat

SEQ ID NO: 482897 - DNA, 25 bp, Rattus norvegicus
gtaggaagcctagccagtctttgat

SEQ ID NO: 482898 - DNA, 25 bp, Rattus norvegicus
gtaggaagcctgctttccattttgt

SEQ ID NO: 482899 - DNA, 25 bp, Rattus norvegicus
gtaggaagcctggtttccattttgt

SEQ ID NO: 482900 - DNA, 25 bp, Rattus norvegicus
gtaggaagctccatgtttcttttgc

SEQ ID NO: 482901 - DNA, 25 bp, Rattus norvegicus
gtaggaagctccttgtttcttttgc

SEQ ID NO: 482902 - DNA, 25 bp, Rattus norvegicus
gtaggaagctttcttaactgcggag

SEQ ID NO: 482903 - DNA, 25 bp, Rattus norvegicus
gtaggaagctttgttaactgcggag

SEQ ID NO: 482904 - DNA, 25 bp, Rattus norvegicus
gtaggaaggaacactgtagcctgct

SEQ ID NO: 482905 - DNA, 25 bp, Rattus norvegicus
gtaggaaggaactctgtagcctgct

SEQ ID NO: 482906 - DNA, 25 bp, Rattus norvegicus
gtaggaagtcaaacctcatccgcca

SEQ ID NO: 482907 - DNA, 25 bp, Rattus norvegicus
gtaggaagtcaatcctcatccgcca

SEQ ID NO: 482908 - DNA, 25 bp, Rattus norvegicus
gtaggaataccgctcttttgacaaa

SEQ ID NO: 482909 - DNA, 25 bp, Rattus norvegicus
gtaggaataccggtcttttgacaaa

SEQ ID NO: 482910 - DNA, 25 bp, Rattus norvegicus
gtaggaatccttcagtgtgctctct

SEQ ID NO: 482911 - DNA, 25 bp, Rattus norvegicus
gtaggaatccttgagtgtgctctct

SEQ ID NO: 482912 - DNA, 25 bp, Rattus norvegicus
gtaggaatctcacctagggtcactc

SEQ ID NO: 482913 - DNA, 25 bp, Rattus norvegicus
gtaggaatctcagctagggtcactc

SEQ ID NO: 482914 - DNA, 25 bp, Rattus norvegicus
gtaggaatgaccagcaagtgtgact

SEQ ID NO: 482915 - DNA, 25 bp, Rattus norvegicus
gtaggaatgacctgcaagtgtgact

SEQ ID NO: 482916 - DNA, 25 bp, Rattus norvegicus
gtaggaattaacactgaagtggtat

SEQ ID NO: 482917 - DNA, 25 bp, Rattus norvegicus
gtaggaattaactctgaagtggtat

SEQ ID NO: 482918 - DNA, 25 bp, Rattus norvegicus
gtaggaatttcgctctgcacaaaca

SEQ ID NO: 482919 - DNA, 25 bp, Rattus norvegicus
gtaggaatttcggtctgcacaaaca

SEQ ID NO: 482920 - DNA, 25 bp, Rattus norvegicus
gtaggacacaaaagcctgaccccaa

SEQ ID NO: 482921 - DNA, 25 bp, Rattus norvegicus
gtaggacacaaatgcctgaccccaa

SEQ ID NO: 482922 - DNA, 25 bp, Rattus norvegicus
gtaggacacactagaggtaaatgct

SEQ ID NO: 482923 - DNA, 25 bp, Rattus norvegicus
gtaggacacacttgaggtaaatgct

SEQ ID NO: 482924 - DNA, 25 bp, Rattus norvegicus
gtaggacacccaacgccttggcttt

SEQ ID NO: 482925 - DNA, 25 bp, Rattus norvegicus
gtaggacacccatcgccttggcttt

SEQ ID NO: 482926 - DNA, 25 bp, Rattus norvegicus
gtaggacaccttaatgacaacatct

SEQ ID NO: 482927 - DNA, 25 bp, Rattus norvegicus
gtaggacacctttatgacaacatct

SEQ ID NO: 482928 - DNA, 25 bp, Rattus norvegicus
gtaggacactgtacttgctttcact

SEQ ID NO: 482929 - DNA, 25 bp, Rattus norvegicus
gtaggacactgttcttgctttcact

SEQ ID NO: 482930 - DNA, 25 bp, Rattus norvegicus
gtaggacagcacactttcgttcatc

SEQ ID NO: 482931 - DNA, 25 bp, Rattus norvegicus
gtaggacagcacattccacaggttt

SEQ ID NO: 482932 - DNA, 25 bp, Rattus norvegicus
gtaggacagcactctttcgttcatc

SEQ ID NO: 482933 - DNA, 25 bp, Rattus norvegicus
gtaggacagcactttccacaggttt

SEQ ID NO: 482934 - DNA, 25 bp, Rattus norvegicus
gtaggacagctactacagccaaatg

SEQ ID NO: 482935 - DNA, 25 bp, Rattus norvegicus
gtaggacagctagtacagccaaatg

SEQ ID NO: 482936 - DNA, 25 bp, Rattus norvegicus
gtaggacatctacggacaaacaact

SEQ ID NO: 482937 - DNA, 25 bp, Rattus norvegicus
gtaggacatctagggacaaacaact

SEQ ID NO: 482938 - DNA, 25 bp, Rattus norvegicus
gtaggacatggtaatttgcccaaaa

SEQ ID NO: 482939 - DNA, 25 bp, Rattus norvegicus
gtaggacatggttatttgcccaaaa

SEQ ID NO: 482940 - DNA, 25 bp, Rattus norvegicus
gtaggaccactactattaacacaaa

SEQ ID NO: 482941 - DNA, 25 bp, Rattus norvegicus
gtaggaccactagtattaacacaaa

SEQ ID NO: 482942 - DNA, 25 bp, Rattus norvegicus
gtaggaccattgatcatactttcaa

SEQ ID NO: 482943 - DNA, 25 bp, Rattus norvegicus
gtaggaccattgttcatactttcaa

SEQ ID NO: 482944 - DNA, 25 bp, Rattus norvegicus
gtaggacccacaacggagcctgaag

SEQ ID NO: 482945 - DNA, 25 bp, Rattus norvegicus
gtaggacccacatcggagcctgaag

SEQ ID NO: 482946 - DNA, 25 bp, Rattus norvegicus
gtaggaccctgaacaagcaaagcaa

SEQ ID NO: 482947 - DNA, 25 bp, Rattus norvegicus
gtaggaccctgatcaagcaaagcaa

SEQ ID NO: 482948 - DNA, 25 bp, Rattus norvegicus
gtaggaccctggatattggccctct

SEQ ID NO: 482949 - DNA, 25 bp, Rattus norvegicus
gtaggaccctggttattggccctct

SEQ ID NO: 482950 - DNA, 25 bp, Rattus norvegicus
gtaggaccgtatccacaacccagac

SEQ ID NO: 482951 - DNA, 25 bp, Rattus norvegicus
gtaggaccgtatgcacaacccagac

SEQ ID NO: 482952 - DNA, 25 bp, Rattus norvegicus
gtaggacctatgaatctcatcgctg

SEQ ID NO: 482953 - DNA, 25 bp, Rattus norvegicus
gtaggacctatgtatctcatcgctg

SEQ ID NO: 482954 - DNA, 25 bp, Rattus norvegicus
gtaggacctgagatttattgacttt

SEQ ID NO: 482955 - DNA, 25 bp, Rattus norvegicus
gtaggacctgagttttattgacttt

SEQ ID NO: 482956 - DNA, 25 bp, Rattus norvegicus
gtaggacctgcaaaagtgacacgta

SEQ ID NO: 482957 - DNA, 25 bp, Rattus norvegicus
gtaggacctgcataagtgacacgta

SEQ ID NO: 482958 - DNA, 25 bp, Rattus norvegicus
gtaggaccttagatcctttatgaaa

SEQ ID NO: 482959 - DNA, 25 bp, Rattus norvegicus
gtaggaccttagttcctttatgaaa

SEQ ID NO: 482960 - DNA, 25 bp, Rattus norvegicus
gtaggaccttcacctgagaaaactc

SEQ ID NO: 482961 - DNA, 25 bp, Rattus norvegicus
gtaggaccttcagctgagaaaactc

SEQ ID NO: 482962 - DNA, 25 bp, Rattus norvegicus
gtaggaccttgaaattctgaaaaaa

SEQ ID NO: 482963 - DNA, 25 bp, Rattus norvegicus
gtaggaccttgatattctgaaaaaa

SEQ ID NO: 482964 - DNA, 25 bp, Rattus norvegicus
gtaggaccttgtatatagcacacag

SEQ ID NO: 482965 - DNA, 25 bp, Rattus norvegicus
gtaggaccttgtttatagcacacag

SEQ ID NO: 482966 - DNA, 25 bp, Rattus norvegicus
gtaggacggtacaggcccagctctt

SEQ ID NO: 482967 - DNA, 25 bp, Rattus norvegicus
gtaggacggtactggcccagctctt

SEQ ID NO: 482968 - DNA, 25 bp, Rattus norvegicus
gtaggacgtcttcagtcacactgta

SEQ ID NO: 482969 - DNA, 25 bp, Rattus norvegicus
gtaggacgtcttgagtcacactgta

SEQ ID NO: 482970 - DNA, 25 bp, Rattus norvegicus
gtaggactaacccaagggctcactc

SEQ ID NO: 482971 - DNA, 25 bp, Rattus norvegicus
gtaggactaaccgaagggctcactc

SEQ ID NO: 482972 - DNA, 25 bp, Rattus norvegicus
gtaggactattgctctagctcttta

SEQ ID NO: 482973 - DNA, 25 bp, Rattus norvegicus
gtaggactattggtctagctcttta

SEQ ID NO: 482974 - DNA, 25 bp, Rattus norvegicus
gtaggactccctactcattttagca

SEQ ID NO: 482975 - DNA, 25 bp, Rattus norvegicus
gtaggactcccttctcattttagca

SEQ ID NO: 482976 - DNA, 25 bp, Rattus norvegicus
gtaggactgcaccagacaagctgtt

SEQ ID NO: 482977 - DNA, 25 bp, Rattus norvegicus
gtaggactgcacgagacaagctgtt

SEQ ID NO: 482978 - DNA, 25 bp, Rattus norvegicus
gtaggactgcataggtagatccaga

SEQ ID NO: 482979 - DNA, 25 bp, Rattus norvegicus
gtaggactgcattggtagatccaga

SEQ ID NO: 482980 - DNA, 25 bp, Rattus norvegicus
gtaggactggaccatcttatgtgga

SEQ ID NO: 482981 - DNA, 25 bp, Rattus norvegicus
gtaggactggacgatcttatgtgga

SEQ ID NO: 482982 - DNA, 25 bp, Rattus norvegicus
gtaggactggttctgctaggcactc

SEQ ID NO: 482983 - DNA, 25 bp, Rattus norvegicus
gtaggactggttgtgctaggcactc

SEQ ID NO: 482984 - DNA, 25 bp, Rattus norvegicus
gtaggacttacccagtagctctcaa

SEQ ID NO: 482985 - DNA, 25 bp, Rattus norvegicus
gtaggacttaccgagtagctctcaa

SEQ ID NO: 482986 - DNA, 25 bp, Rattus norvegicus
gtaggacttcctatgatgtgccata

SEQ ID NO: 482987 - DNA, 25 bp, Rattus norvegicus
gtaggacttcctttgatgtgccata

SEQ ID NO: 482988 - DNA, 25 bp, Rattus norvegicus
gtaggacttctcagttccttagtca

SEQ ID NO: 482989 - DNA, 25 bp, Rattus norvegicus
gtaggacttctctgttccttagtca

SEQ ID NO: 482990 - DNA, 25 bp, Rattus norvegicus
gtaggacttgaacgtccctgcccaa

SEQ ID NO: 482991 - DNA, 25 bp, Rattus norvegicus
gtaggacttgaaggtccctgcccaa

SEQ ID NO: 482992 - DNA, 25 bp, Rattus norvegicus
gtaggacttgccctgcaaacagtat

SEQ ID NO: 482993 - DNA, 25 bp, Rattus norvegicus
gtaggacttgccgtgcaaacagtat

SEQ ID NO: 482994 - DNA, 25 bp, Rattus norvegicus
gtaggagacgtgacagccaagcgca

SEQ ID NO: 482995 - DNA, 25 bp, Rattus norvegicus
gtaggagacgtgtcagccaagcgca

SEQ ID NO: 482996 - DNA, 25 bp, Rattus norvegicus
gtaggagagcggcttccccagcagg

SEQ ID NO: 482997 - DNA, 25 bp, Rattus norvegicus
gtaggagagcgggttccccagcagg

SEQ ID NO: 482998 - DNA, 25 bp, Rattus norvegicus
gtaggagatctccttgcccatgtag

SEQ ID NO: 482999 - DNA, 25 bp, Rattus norvegicus
gtaggagatctcgttgcccatgtag

SEQ ID NO: 483000 - DNA, 25 bp, Rattus norvegicus
gtaggagcacttcacaggtacctct

SEQ ID NO: 483001 - DNA, 25 bp, Rattus norvegicus
gtaggagcacttcgccagctgctga

SEQ ID NO: 483002 - DNA, 25 bp, Rattus norvegicus
gtaggagcacttgacaggtacctct

SEQ ID NO: 483003 - DNA, 25 bp, Rattus norvegicus
gtaggagcacttggccagctgctga

SEQ ID NO: 483004 - DNA, 25 bp, Rattus norvegicus
gtaggagcagcacaggcctcatctt

SEQ ID NO: 483005 - DNA, 25 bp, Rattus norvegicus
gtaggagcagcagaggcctcatctt

SEQ ID NO: 483006 - DNA, 25 bp, Rattus norvegicus
gtaggagcagccattggccagtcca

SEQ ID NO: 483007 - DNA, 25 bp, Rattus norvegicus
gtaggagcagcctttggccagtcca

SEQ ID NO: 483008 - DNA, 25 bp, Rattus norvegicus
gtaggagcagcgctagggccgcgct

SEQ ID NO: 483009 - DNA, 25 bp, Rattus norvegicus
gtaggagcagcggtagggccgcgct

SEQ ID NO: 483010 - DNA, 25 bp, Rattus norvegicus
gtaggagccagaagttcccagccaa

SEQ ID NO: 483011 - DNA, 25 bp, Rattus norvegicus
gtaggagccagatgttcccagccaa

SEQ ID NO: 483012 - DNA, 25 bp, Rattus norvegicus
gtaggagcccatatttccaaactgt

SEQ ID NO: 483013 - DNA, 25 bp, Rattus norvegicus
gtaggagcccatttttccaaactgt

SEQ ID NO: 483014 - DNA, 25 bp, Rattus norvegicus
gtaggagccctgcaaatttctgacc

SEQ ID NO: 483015 - DNA, 25 bp, Rattus norvegicus
gtaggagccctggaaatttctgacc

SEQ ID NO: 483016 - DNA, 25 bp, Rattus norvegicus
gtaggagctgctcggaaagttcttc

SEQ ID NO: 483017 - DNA, 25 bp, Rattus norvegicus
gtaggagctgctgggaaagttcttc

SEQ ID NO: 483018 - DNA, 25 bp, Rattus norvegicus
gtaggaggacctatctgtatcctgc

SEQ ID NO: 483019 - DNA, 25 bp, Rattus norvegicus
gtaggaggacctttctgtatcctgc

SEQ ID NO: 483020 - DNA, 25 bp, Rattus norvegicus
gtaggaggcactcgaatcctgccct

SEQ ID NO: 483021 - DNA, 25 bp, Rattus norvegicus
gtaggaggcactggaatcctgccct

SEQ ID NO: 483022 - DNA, 25 bp, Rattus norvegicus
gtaggaggccataggtaagcaactg

SEQ ID NO: 483023 - DNA, 25 bp, Rattus norvegicus
gtaggaggccattggtaagcaactg

SEQ ID NO: 483024 - DNA, 25 bp, Rattus norvegicus
gtaggaggctggcacacacccttag

SEQ ID NO: 483025 - DNA, 25 bp, Rattus norvegicus
gtaggaggctgggacacacccttag

SEQ ID NO: 483026 - DNA, 25 bp, Rattus norvegicus
gtaggagggcctacctgaattccca

SEQ ID NO: 483027 - DNA, 25 bp, Rattus norvegicus
gtaggagggcctcacattgaactgt

SEQ ID NO: 483028 - DNA, 25 bp, Rattus norvegicus
gtaggagggcctgacattgaactgt

SEQ ID NO: 483029 - DNA, 25 bp, Rattus norvegicus
gtaggagggccttcctgaattccca

SEQ ID NO: 483030 - DNA, 25 bp, Rattus norvegicus
gtaggagtactcattaggtcgctgt

SEQ ID NO: 483031 - DNA, 25 bp, Rattus norvegicus
gtaggagtactctttaggtcgctgt

SEQ ID NO: 483032 - DNA, 25 bp, Rattus norvegicus
gtaggagtcacactggaggccacat

SEQ ID NO: 483033 - DNA, 25 bp, Rattus norvegicus
gtaggagtcacagtggaggccacat

SEQ ID NO: 483034 - DNA, 25 bp, Rattus norvegicus
gtaggagtcagcatgttctccggtc

SEQ ID NO: 483035 - DNA, 25 bp, Rattus norvegicus
gtaggagtcagcttgttctccggtc

SEQ ID NO: 483036 - DNA, 25 bp, Rattus norvegicus
gtaggagtccttagcatttgtcatg

SEQ ID NO: 483037 - DNA, 25 bp, Rattus norvegicus
gtaggagtcctttgcatttgtcatg

SEQ ID NO: 483038 - DNA, 25 bp, Rattus norvegicus
gtaggagtctttactcagaggctgg

SEQ ID NO: 483039 - DNA, 25 bp, Rattus norvegicus
gtaggagtcttttctcagaggctgg

SEQ ID NO: 483040 - DNA, 25 bp, Rattus norvegicus
gtaggagtgactcacatcctggctc

SEQ ID NO: 483041 - DNA, 25 bp, Rattus norvegicus
gtaggagtgactgacatcctggctc

SEQ ID NO: 483042 - DNA, 25 bp, Rattus norvegicus
gtaggagtgcagctgtgctccatca

SEQ ID NO: 483043 - DNA, 25 bp, Rattus norvegicus
gtaggagtgcaggtgtgctccatca

SEQ ID NO: 483044 - DNA, 25 bp, Rattus norvegicus
gtaggagttactacacacttgtctc

SEQ ID NO: 483045 - DNA, 25 bp, Rattus norvegicus
gtaggagttacttcacacttgtctc

SEQ ID NO: 483046 - DNA, 25 bp, Rattus norvegicus
gtaggagttccgataggccggtcat

SEQ ID NO: 483047 - DNA, 25 bp, Rattus norvegicus
gtaggagttccgttaggccggtcat

SEQ ID NO: 483048 - DNA, 25 bp, Rattus norvegicus
gtaggagttcttcgtttgactgaca

SEQ ID NO: 483049 - DNA, 25 bp, Rattus norvegicus
gtaggagttcttggtttgactgaca

SEQ ID NO: 483050 - DNA, 25 bp, Rattus norvegicus
gtaggagttggaccactttctctgt

SEQ ID NO: 483051 - DNA, 25 bp, Rattus norvegicus
gtaggagttggagcactttctctgt

SEQ ID NO: 483052 - DNA, 25 bp, Rattus norvegicus
gtaggagttggcactcttgtcaccg

SEQ ID NO: 483053 - DNA, 25 bp, Rattus norvegicus
gtaggagttggctctcttgtcaccg

SEQ ID NO: 483054 - DNA, 25 bp, Rattus norvegicus
gtaggataacaccagaccccagcag

SEQ ID NO: 483055 - DNA, 25 bp, Rattus norvegicus
gtaggataacacgagaccccagcag

SEQ ID NO: 483056 - DNA, 25 bp, Rattus norvegicus
gtaggataagatagagacccctctt

SEQ ID NO: 483057 - DNA, 25 bp, Rattus norvegicus
gtaggataagattgagacccctctt

SEQ ID NO: 483058 - DNA, 25 bp, Rattus norvegicus
gtaggatacattctatcggccacct

SEQ ID NO: 483059 - DNA, 25 bp, Rattus norvegicus
gtaggatacattgtatcggccacct

SEQ ID NO: 483060 - DNA, 25 bp, Rattus norvegicus
gtaggatatatcatcctcctgcttg

SEQ ID NO: 483061 - DNA, 25 bp, Rattus norvegicus
gtaggatatatcttcctcctgcttg

SEQ ID NO: 483062 - DNA, 25 bp, Rattus norvegicus
gtaggatatttaactctgacagggt

SEQ ID NO: 483063 - DNA, 25 bp, Rattus norvegicus
gtaggatatttatctctgacagggt

SEQ ID NO: 483064 - DNA, 25 bp, Rattus norvegicus
gtaggatccatcagtggttgttgaa

SEQ ID NO: 483065 - DNA, 25 bp, Rattus norvegicus
gtaggatccatctgtggttgttgaa

SEQ ID NO: 483066 - DNA, 25 bp, Rattus norvegicus
gtaggatctgctattatttcccaaa

SEQ ID NO: 483067 - DNA, 25 bp, Rattus norvegicus
gtaggatctgcttttatttcccaaa

SEQ ID NO: 483068 - DNA, 25 bp, Rattus norvegicus
gtaggatgacccatcttaggatgtt

SEQ ID NO: 483069 - DNA, 25 bp, Rattus norvegicus
gtaggatgacccttcttaggatgtt

SEQ ID NO: 483070 - DNA, 25 bp, Rattus norvegicus
gtaggatgacctattcagacttcag

SEQ ID NO: 483071 - DNA, 25 bp, Rattus norvegicus
gtaggatgaccttttcagacttcag

SEQ ID NO: 483072 - DNA, 25 bp, Rattus norvegicus
gtaggatgccaacatacaagagccc

SEQ ID NO: 483073 - DNA, 25 bp, Rattus norvegicus
gtaggatgccaagatacaagagccc

SEQ ID NO: 483074 - DNA, 25 bp, Rattus norvegicus
gtaggatgccataaagagtctgttt

SEQ ID NO: 483075 - DNA, 25 bp, Rattus norvegicus
gtaggatgccattaagagtctgttt

SEQ ID NO: 483076 - DNA, 25 bp, Rattus norvegicus
gtaggatgcttgcaatcacacttgt

SEQ ID NO: 483077 - DNA, 25 bp, Rattus norvegicus
gtaggatgcttggaatcacacttgt

SEQ ID NO: 483078 - DNA, 25 bp, Rattus norvegicus
gtaggatggtctccagccatcttct

SEQ ID NO: 483079 - DNA, 25 bp, Rattus norvegicus
gtaggatggtctgcagccatcttct

SEQ ID NO: 483080 - DNA, 25 bp, Rattus norvegicus
gtaggatgttctaactcttccttca

SEQ ID NO: 483081 - DNA, 25 bp, Rattus norvegicus
gtaggatgttcttactcttccttca

SEQ ID NO: 483082 - DNA, 25 bp, Rattus norvegicus
gtaggattagcacttcttcagatga

SEQ ID NO: 483083 - DNA, 25 bp, Rattus norvegicus
gtaggattagcagttcttcagatga

SEQ ID NO: 483084 - DNA, 25 bp, Rattus norvegicus
gtaggattagcgaccccagagttac

SEQ ID NO: 483085 - DNA, 25 bp, Rattus norvegicus
gtaggattagcgtccccagagttac

SEQ ID NO: 483086 - DNA, 25 bp, Rattus norvegicus
gtaggattccagattttagcttaat

SEQ ID NO: 483087 - DNA, 25 bp, Rattus norvegicus
gtaggattccagtttttagcttaat

SEQ ID NO: 483088 - DNA, 25 bp, Rattus norvegicus
gtaggattccgtctttcctcggtgg

SEQ ID NO: 483089 - DNA, 25 bp, Rattus norvegicus
gtaggattccgtgtttcctcggtgg

SEQ ID NO: 483090 - DNA, 25 bp, Rattus norvegicus
gtaggattccttctctacctgtgac

SEQ ID NO: 483091 - DNA, 25 bp, Rattus norvegicus
gtaggattccttgtctacctgtgac

SEQ ID NO: 483092 - DNA, 25 bp, Rattus norvegicus
gtaggatttcccaagtgggcattgt

SEQ ID NO: 483093 - DNA, 25 bp, Rattus norvegicus
gtaggatttccctagtgggcattgt

SEQ ID NO: 483094 - DNA, 25 bp, Rattus norvegicus
gtaggatttgctatcttccagaaga

SEQ ID NO: 483095 - DNA, 25 bp, Rattus norvegicus
gtaggatttgctttcttccagaaga

SEQ ID NO: 483096 - DNA, 25 bp, Rattus norvegicus
gtaggatttgttaccatggatccca

SEQ ID NO: 483097 - DNA, 25 bp, Rattus norvegicus
gtaggatttgtttccatggatccca

SEQ ID NO: 483098 - DNA, 25 bp, Rattus norvegicus
gtaggcaaaccgacctgaaaggtca

SEQ ID NO: 483099 - DNA, 25 bp, Rattus norvegicus
gtaggcaaaccgtcctgaaaggtca

SEQ ID NO: 483100 - DNA, 25 bp, Rattus norvegicus
gtaggcaaccaaatttccaaccaga

SEQ ID NO: 483101 - DNA, 25 bp, Rattus norvegicus
gtaggcaaccaattttccaaccaga

SEQ ID NO: 483102 - DNA, 25 bp, Rattus norvegicus
gtaggcaacgtcagaaggctggcaa

SEQ ID NO: 483103 - DNA, 25 bp, Rattus norvegicus
gtaggcaacgtctgaaggctggcaa

SEQ ID NO: 483104 - DNA, 25 bp, Rattus norvegicus
gtaggcaagacaattaccaggctgt

SEQ ID NO: 483105 - DNA, 25 bp, Rattus norvegicus
gtaggcaagacatttaccaggctgt

SEQ ID NO: 483106 - DNA, 25 bp, Rattus norvegicus
gtaggcaatcttacagtgtctgcaa

SEQ ID NO: 483107 - DNA, 25 bp, Rattus norvegicus
gtaggcaatctttcagtgtctgcaa

SEQ ID NO: 483108 - DNA, 25 bp, Rattus norvegicus
gtaggcaatgatcatgtgtcctttt

SEQ ID NO: 483109 - DNA, 25 bp, Rattus norvegicus
gtaggcaatgatgatgtgtcctttt

SEQ ID NO: 483110 - DNA, 25 bp, Rattus norvegicus
gtaggcaatgcactcatacacagat

SEQ ID NO: 483111 - DNA, 25 bp, Rattus norvegicus
gtaggcaatgcagtcatacacagat

SEQ ID NO: 483112 - DNA, 25 bp, Rattus norvegicus
gtaggcaatgtgcagctccctcgcg

SEQ ID NO: 483113 - DNA, 25 bp, Rattus norvegicus
gtaggcaatgtggagctccctcgcg

SEQ ID NO: 483114 - DNA, 25 bp, Rattus norvegicus
gtaggcacaaccaaacatttccagg

SEQ ID NO: 483115 - DNA, 25 bp, Rattus norvegicus
gtaggcacaacctaacatttccagg

SEQ ID NO: 483116 - DNA, 25 bp, Rattus norvegicus
gtaggcacaagcactgtggtgtccg

SEQ ID NO: 483117 - DNA, 25 bp, Rattus norvegicus
gtaggcacaagctctgtggtgtccg

SEQ ID NO: 483118 - DNA, 25 bp, Rattus norvegicus
gtaggcacaccactcagtcttaaat

SEQ ID NO: 483119 - DNA, 25 bp, Rattus norvegicus
gtaggcacaccagtcagtcttaaat

SEQ ID NO: 483120 - DNA, 25 bp, Rattus norvegicus
gtaggcacagtgatatcctcagcgc

SEQ ID NO: 483121 - DNA, 25 bp, Rattus norvegicus
gtaggcacagtgttatcctcagcgc

SEQ ID NO: 483122 - DNA, 25 bp, Rattus norvegicus
gtaggcacattacagcactctgctt

SEQ ID NO: 483123 - DNA, 25 bp, Rattus norvegicus
gtaggcacattagagcactctgctt

SEQ ID NO: 483124 - DNA, 25 bp, Rattus norvegicus
gtaggcacccagatgcactcataga

SEQ ID NO: 483125 - DNA, 25 bp, Rattus norvegicus
gtaggcacccagttgcactcataga

SEQ ID NO: 483126 - DNA, 25 bp, Rattus norvegicus
gtaggcaccttcacagcttgctatg

SEQ ID NO: 483127 - DNA, 25 bp, Rattus norvegicus
gtaggcaccttctcagcttgctatg

SEQ ID NO: 483128 - DNA, 25 bp, Rattus norvegicus
gtaggcactctcagaatactgcttt

SEQ ID NO: 483129 - DNA, 25 bp, Rattus norvegicus
gtaggcactctctgaatactgcttt

SEQ ID NO: 483130 - DNA, 25 bp, Rattus norvegicus
gtaggcactcttcacagttgcttta

SEQ ID NO: 483131 - DNA, 25 bp, Rattus norvegicus
gtaggcactcttgacagttgcttta

SEQ ID NO: 483132 - DNA, 25 bp, Rattus norvegicus
gtaggcactggaacagggcctctga

SEQ ID NO: 483133 - DNA, 25 bp, Rattus norvegicus
gtaggcactggatcagggcctctga

SEQ ID NO: 483134 - DNA, 25 bp, Rattus norvegicus
gtaggcactgtgactgacctgggca

SEQ ID NO: 483135 - DNA, 25 bp, Rattus norvegicus
gtaggcactgtgtctgacctgggca

SEQ ID NO: 483136 - DNA, 25 bp, Rattus norvegicus
gtaggcacttgcaattcagtagaga

SEQ ID NO: 483137 - DNA, 25 bp, Rattus norvegicus
gtaggcacttgctattcagtagaga

SEQ ID NO: 483138 - DNA, 25 bp, Rattus norvegicus
gtaggcagaactcggttcaccactc

SEQ ID NO: 483139 - DNA, 25 bp, Rattus norvegicus
gtaggcagaactgggttcaccactc

SEQ ID NO: 483140 - DNA, 25 bp, Rattus norvegicus
gtaggcagaccaaagcagaccattt

SEQ ID NO: 483141 - DNA, 25 bp, Rattus norvegicus
gtaggcagaccatagcagaccattt

SEQ ID NO: 483142 - DNA, 25 bp, Rattus norvegicus
gtaggcagagacacttgggtccctg

SEQ ID NO: 483143 - DNA, 25 bp, Rattus norvegicus
gtaggcagagactcttgggtccctg

SEQ ID NO: 483144 - DNA, 25 bp, Rattus norvegicus
gtaggcagcagaacctgatcctgag

SEQ ID NO: 483145 - DNA, 25 bp, Rattus norvegicus
gtaggcagcagatcctgatcctgag

SEQ ID NO: 483146 - DNA, 25 bp, Rattus norvegicus
gtaggcagccatcaacaatctattt

SEQ ID NO: 483147 - DNA, 25 bp, Rattus norvegicus
gtaggcagccatgaacaatctattt

SEQ ID NO: 483148 - DNA, 25 bp, Rattus norvegicus
gtaggcagcctaccgtcaggtagat

SEQ ID NO: 483149 - DNA, 25 bp, Rattus norvegicus
gtaggcagcctagcgtcaggtagat

SEQ ID NO: 483150 - DNA, 25 bp, Rattus norvegicus
gtaggcaggaggcatcccagtccac

SEQ ID NO: 483151 - DNA, 25 bp, Rattus norvegicus
gtaggcaggagggatcccagtccac

SEQ ID NO: 483152 - DNA, 25 bp, Rattus norvegicus
gtaggcaggatgatgttcagtagaa

SEQ ID NO: 483153 - DNA, 25 bp, Rattus norvegicus
gtaggcaggatgttgttcagtagaa

SEQ ID NO: 483154 - DNA, 25 bp, Rattus norvegicus
gtaggcagtattccagggcagccaa

SEQ ID NO: 483155 - DNA, 25 bp, Rattus norvegicus
gtaggcagtattgcagggcagccaa

SEQ ID NO: 483156 - DNA, 25 bp, Rattus norvegicus
gtaggcagtcagagtatgcacatgt

SEQ ID NO: 483157 - DNA, 25 bp, Rattus norvegicus
gtaggcagtcagtgtatgcacatgt

SEQ ID NO: 483158 - DNA, 25 bp, Rattus norvegicus
gtaggcagttgcacctgactataag

SEQ ID NO: 483159 - DNA, 25 bp, Rattus norvegicus
gtaggcagttgctcctgactataag

SEQ ID NO: 483160 - DNA, 25 bp, Rattus norvegicus
gtaggcatactgaaatgtctctaaa

SEQ ID NO: 483161 - DNA, 25 bp, Rattus norvegicus
gtaggcatactgtaatgtctctaaa

SEQ ID NO: 483162 - DNA, 25 bp, Rattus norvegicus
gtaggcatatttacccttagtaaag

SEQ ID NO: 483163 - DNA, 25 bp, Rattus norvegicus
gtaggcatattttcccttagtaaag

SEQ ID NO: 483164 - DNA, 25 bp, Rattus norvegicus
gtaggcatcagtaaccaagttggac

SEQ ID NO: 483165 - DNA, 25 bp, Rattus norvegicus
gtaggcatcagttaccaagttggac

SEQ ID NO: 483166 - DNA, 25 bp, Rattus norvegicus
gtaggcatccatcagtgtcagtgtt

SEQ ID NO: 483167 - DNA, 25 bp, Rattus norvegicus
gtaggcatccatgagtgtcagtgtt

SEQ ID NO: 483168 - DNA, 25 bp, Rattus norvegicus
gtaggcatcctgacctgtgatatca

SEQ ID NO: 483169 - DNA, 25 bp, Rattus norvegicus
gtaggcatcctgctggactatgata

SEQ ID NO: 483170 - DNA, 25 bp, Rattus norvegicus
gtaggcatcctggtggactatgata

SEQ ID NO: 483171 - DNA, 25 bp, Rattus norvegicus
gtaggcatcctgtcctgtgatatca

SEQ ID NO: 483172 - DNA, 25 bp, Rattus norvegicus
gtaggcatgataatgtataccttca

SEQ ID NO: 483173 - DNA, 25 bp, Rattus norvegicus
gtaggcatgatattgtataccttca

SEQ ID NO: 483174 - DNA, 25 bp, Rattus norvegicus
gtaggcatggccagcagcgttctta

SEQ ID NO: 483175 - DNA, 25 bp, Rattus norvegicus
gtaggcatggcctgcagcgttctta

SEQ ID NO: 483176 - DNA, 25 bp, Rattus norvegicus
gtaggcatggcgaagctggacccct

SEQ ID NO: 483177 - DNA, 25 bp, Rattus norvegicus
gtaggcatggcgtagctggacccct

SEQ ID NO: 483178 - DNA, 25 bp, Rattus norvegicus
gtaggcattcaaaacatctaactaa

SEQ ID NO: 483179 - DNA, 25 bp, Rattus norvegicus
gtaggcattcaatacatctaactaa

SEQ ID NO: 483180 - DNA, 25 bp, Rattus norvegicus
gtaggcattgccatcattttgtgat

SEQ ID NO: 483181 - DNA, 25 bp, Rattus norvegicus
gtaggcattgccttcattttgtgat

SEQ ID NO: 483182 - DNA, 25 bp, Rattus norvegicus
gtaggcattttcattaatctgactt

SEQ ID NO: 483183 - DNA, 25 bp, Rattus norvegicus
gtaggcattttctttaatctgactt

SEQ ID NO: 483184 - DNA, 25 bp, Rattus norvegicus
gtaggccaaactcaacccttctata

SEQ ID NO: 483185 - DNA, 25 bp, Rattus norvegicus
gtaggccaaactcatgccgagctca

SEQ ID NO: 483186 - DNA, 25 bp, Rattus norvegicus
gtaggccaaactgaacccttctata

SEQ ID NO: 483187 - DNA, 25 bp, Rattus norvegicus
gtaggccaaactgatgccgagctca

SEQ ID NO: 483188 - DNA, 25 bp, Rattus norvegicus
gtaggccaagctatcagagtcaacc

SEQ ID NO: 483189 - DNA, 25 bp, Rattus norvegicus
gtaggccaagctttcagagtcaacc

SEQ ID NO: 483190 - DNA, 25 bp, Rattus norvegicus
gtaggccacagaaagccctgggcaa

SEQ ID NO: 483191 - DNA, 25 bp, Rattus norvegicus
gtaggccacagatagccctgggcaa

SEQ ID NO: 483192 - DNA, 25 bp, Rattus norvegicus
gtaggccactgacatgaagccctct

SEQ ID NO: 483193 - DNA, 25 bp, Rattus norvegicus
gtaggccactgagatgaagccctct

SEQ ID NO: 483194 - DNA, 25 bp, Rattus norvegicus
gtaggccagccacaagcttcgggtt

SEQ ID NO: 483195 - DNA, 25 bp, Rattus norvegicus
gtaggccagccagaagcttcgggtt

SEQ ID NO: 483196 - DNA, 25 bp, Rattus norvegicus
gtaggccatcatccgctcagtgaag

SEQ ID NO: 483197 - DNA, 25 bp, Rattus norvegicus
gtaggccatcatgcgctcagtgaag

SEQ ID NO: 483198 - DNA, 25 bp, Rattus norvegicus
gtaggccatgccaatggttttatat

SEQ ID NO: 483199 - DNA, 25 bp, Rattus norvegicus
gtaggccatgcctatggttttatat

SEQ ID NO: 483200 - DNA, 25 bp, Rattus norvegicus
gtaggccattcgatccaattattga

SEQ ID NO: 483201 - DNA, 25 bp, Rattus norvegicus
gtaggccattcgttccaattattga

SEQ ID NO: 483202 - DNA, 25 bp, Rattus norvegicus
gtaggccatttgacacttcggatca

SEQ ID NO: 483203 - DNA, 25 bp, Rattus norvegicus
gtaggccatttgtcacttcggatca

SEQ ID NO: 483204 - DNA, 25 bp, Rattus norvegicus
gtaggcccaaaaacatgcgctgagg

SEQ ID NO: 483205 - DNA, 25 bp, Rattus norvegicus
gtaggcccaaaatcatgcgctgagg

SEQ ID NO: 483206 - DNA, 25 bp, Rattus norvegicus
gtaggcccactcaacagtgcaggtg

SEQ ID NO: 483207 - DNA, 25 bp, Rattus norvegicus
gtaggcccactctacagtgcaggtg

SEQ ID NO: 483208 - DNA, 25 bp, Rattus norvegicus
gtaggcccacttaactctttatatg

SEQ ID NO: 483209 - DNA, 25 bp, Rattus norvegicus
gtaggcccactttactctttatatg

SEQ ID NO: 483210 - DNA, 25 bp, Rattus norvegicus
gtaggcccaggcacagtggcatctc

SEQ ID NO: 483211 - DNA, 25 bp, Rattus norvegicus
gtaggcccaggctcagtggcatctc

SEQ ID NO: 483212 - DNA, 25 bp, Rattus norvegicus
gtaggcccatacatttgaatacttt

SEQ ID NO: 483213 - DNA, 25 bp, Rattus norvegicus
gtaggcccatacttttgaatacttt

SEQ ID NO: 483214 - DNA, 25 bp, Rattus norvegicus
gtaggccctataccgaacaacacga

SEQ ID NO: 483215 - DNA, 25 bp, Rattus norvegicus
gtaggccctatagcgaacaacacga

SEQ ID NO: 483216 - DNA, 25 bp, Rattus norvegicus
gtaggccctgatacagagctttgcc

SEQ ID NO: 483217 - DNA, 25 bp, Rattus norvegicus
gtaggccctgattcagagctttgcc

SEQ ID NO: 483218 - DNA, 25 bp, Rattus norvegicus
gtaggcccttcacctaacatgtaaa

SEQ ID NO: 483219 - DNA, 25 bp, Rattus norvegicus
gtaggcccttcagctaacatgtaaa

SEQ ID NO: 483220 - DNA, 25 bp, Rattus norvegicus
gtaggccgaagcacactgtgtaaaa

SEQ ID NO: 483221 - DNA, 25 bp, Rattus norvegicus
gtaggccgaagctcactgtgtaaaa

SEQ ID NO: 483222 - DNA, 25 bp, Rattus norvegicus
gtaggccgcctgaatgaccttctgg

SEQ ID NO: 483223 - DNA, 25 bp, Rattus norvegicus
gtaggccgcctgtatgaccttctgg

SEQ ID NO: 483224 - DNA, 25 bp, Rattus norvegicus
gtaggccgtagcaagtagttttaca

SEQ ID NO: 483225 - DNA, 25 bp, Rattus norvegicus
gtaggccgtagctagtagttttaca

SEQ ID NO: 483226 - DNA, 25 bp, Rattus norvegicus
gtaggccgtgacacactagtcattg

SEQ ID NO: 483227 - DNA, 25 bp, Rattus norvegicus
gtaggccgtgactcactagtcattg

SEQ ID NO: 483228 - DNA, 25 bp, Rattus norvegicus
gtaggcctacagctatttcaactaa

SEQ ID NO: 483229 - DNA, 25 bp, Rattus norvegicus
gtaggcctacaggtatttcaactaa

SEQ ID NO: 483230 - DNA, 25 bp, Rattus norvegicus
gtaggcctcactcgcaattggaaca

SEQ ID NO: 483231 - DNA, 25 bp, Rattus norvegicus
gtaggcctcactggcaattggaaca

SEQ ID NO: 483232 - DNA, 25 bp, Rattus norvegicus
gtaggcctccaaatgcagacctcaa

SEQ ID NO: 483233 - DNA, 25 bp, Rattus norvegicus
gtaggcctccaattgcagacctcaa

SEQ ID NO: 483234 - DNA, 25 bp, Rattus norvegicus
gtaggcctcctcagtggtccagtag

SEQ ID NO: 483235 - DNA, 25 bp, Rattus norvegicus
gtaggcctcctctgtggtccagtag

SEQ ID NO: 483236 - DNA, 25 bp, Rattus norvegicus
gtaggcctctagactggaacacagt

SEQ ID NO: 483237 - DNA, 25 bp, Rattus norvegicus
gtaggcctctagtctggaacacagt

SEQ ID NO: 483238 - DNA, 25 bp, Rattus norvegicus
gtaggcctggtgctcatatcagctc

SEQ ID NO: 483239 - DNA, 25 bp, Rattus norvegicus
gtaggcctggtggtcatatcagctc

SEQ ID NO: 483240 - DNA, 25 bp, Rattus norvegicus
gtaggcctgtgactcagtggacatt

SEQ ID NO: 483241 - DNA, 25 bp, Rattus norvegicus
gtaggcctgtgagtcagtggacatt

SEQ ID NO: 483242 - DNA, 25 bp, Rattus norvegicus
gtaggcctgtgcacagaggacacca

SEQ ID NO: 483243 - DNA, 25 bp, Rattus norvegicus
gtaggcctgtgctcagaggacacca

SEQ ID NO: 483244 - DNA, 25 bp, Rattus norvegicus
gtaggcctttctaatagcttagttt

SEQ ID NO: 483245 - DNA, 25 bp, Rattus norvegicus
gtaggcctttcttatagcttagttt

SEQ ID NO: 483246 - DNA, 25 bp, Rattus norvegicus
gtaggcgaagggattgaggtgacac

SEQ ID NO: 483247 - DNA, 25 bp, Rattus norvegicus
gtaggcgaagggtttgaggtgacac

SEQ ID NO: 483248 - DNA, 25 bp, Rattus norvegicus
gtaggcgagcaaacatctgaccaaa

SEQ ID NO: 483249 - DNA, 25 bp, Rattus norvegicus
gtaggcgagcaatcatctgaccaaa

SEQ ID NO: 483250 - DNA, 25 bp, Rattus norvegicus
gtaggcgcctgcagatcgaggactt

SEQ ID NO: 483251 - DNA, 25 bp, Rattus norvegicus
gtaggcgcctgctgatcgaggactt

SEQ ID NO: 483252 - DNA, 25 bp, Rattus norvegicus
gtaggcgctataccctgagctccaa

SEQ ID NO: 483253 - DNA, 25 bp, Rattus norvegicus
gtaggcgctatagcctgagctccaa

SEQ ID NO: 483254 - DNA, 25 bp, Rattus norvegicus
gtaggcgctgaacattccttaattt

SEQ ID NO: 483255 - DNA, 25 bp, Rattus norvegicus
gtaggcgctgaagattccttaattt

SEQ ID NO: 483256 - DNA, 25 bp, Rattus norvegicus
gtaggcgtagacaccagcactttat

SEQ ID NO: 483257 - DNA, 25 bp, Rattus norvegicus
gtaggcgtagactccagcactttat

SEQ ID NO: 483258 - DNA, 25 bp, Rattus norvegicus
gtaggcgtagctccagtccggctct

SEQ ID NO: 483259 - DNA, 25 bp, Rattus norvegicus
gtaggcgtagctgcagtccggctct

SEQ ID NO: 483260 - DNA, 25 bp, Rattus norvegicus
gtaggcgtttacatcacaggttcca

SEQ ID NO: 483261 - DNA, 25 bp, Rattus norvegicus
gtaggcgtttacttcacaggttcca

SEQ ID NO: 483262 - DNA, 25 bp, Rattus norvegicus
gtaggctaacataccggtccctgca

SEQ ID NO: 483263 - DNA, 25 bp, Rattus norvegicus
gtaggctaacattccggtccctgca

SEQ ID NO: 483264 - DNA, 25 bp, Rattus norvegicus
gtaggctaacctctgagtttgaagc

SEQ ID NO: 483265 - DNA, 25 bp, Rattus norvegicus
gtaggctaacctgtgagtttgaagc

SEQ ID NO: 483266 - DNA, 25 bp, Rattus norvegicus
gtaggctaataactacagtcctgtg

SEQ ID NO: 483267 - DNA, 25 bp, Rattus norvegicus
gtaggctaataagtacagtcctgtg

SEQ ID NO: 483268 - DNA, 25 bp, Rattus norvegicus
gtaggctaccttcaatgtatgtatg

SEQ ID NO: 483269 - DNA, 25 bp, Rattus norvegicus
gtaggctaccttgaatgtatgtatg

SEQ ID NO: 483270 - DNA, 25 bp, Rattus norvegicus
gtaggctactggagactgtctttac

SEQ ID NO: 483271 - DNA, 25 bp, Rattus norvegicus
gtaggctactggtgactgtctttac

SEQ ID NO: 483272 - DNA, 25 bp, Rattus norvegicus
gtaggctagcagagagactaaggta

SEQ ID NO: 483273 - DNA, 25 bp, Rattus norvegicus
gtaggctagcagtgagactaaggta

SEQ ID NO: 483274 - DNA, 25 bp, Rattus norvegicus
gtaggctatattacctgccacaacc

SEQ ID NO: 483275 - DNA, 25 bp, Rattus norvegicus
gtaggctatatttcctgccacaacc

SEQ ID NO: 483276 - DNA, 25 bp, Rattus norvegicus
gtaggctatggcattcatcctcagg

SEQ ID NO: 483277 - DNA, 25 bp, Rattus norvegicus
gtaggctatggctttcatcctcagg

SEQ ID NO: 483278 - DNA, 25 bp, Rattus norvegicus
gtaggctattgtagtgataattgat

SEQ ID NO: 483279 - DNA, 25 bp, Rattus norvegicus
gtaggctattgttgtgataattgat

SEQ ID NO: 483280 - DNA, 25 bp, Rattus norvegicus
gtaggctcaactccatgtgcttgaa

SEQ ID NO: 483281 - DNA, 25 bp, Rattus norvegicus
gtaggctcaactgcatgtgcttgaa

SEQ ID NO: 483282 - DNA, 25 bp, Rattus norvegicus
gtaggctcacttcgccggatgaagt

SEQ ID NO: 483283 - DNA, 25 bp, Rattus norvegicus
gtaggctcacttggccggatgaagt

SEQ ID NO: 483284 - DNA, 25 bp, Rattus norvegicus
gtaggctcagcaaatctgtacatat

SEQ ID NO: 483285 - DNA, 25 bp, Rattus norvegicus
gtaggctcagcatatctgtacatat

SEQ ID NO: 483286 - DNA, 25 bp, Rattus norvegicus
gtaggctcagttcccatgttaggaa

SEQ ID NO: 483287 - DNA, 25 bp, Rattus norvegicus
gtaggctcagttgccatgttaggaa

SEQ ID NO: 483288 - DNA, 25 bp, Rattus norvegicus
gtaggctccagactcttgggactta

SEQ ID NO: 483289 - DNA, 25 bp, Rattus norvegicus
gtaggctccagagtcttgggactta

SEQ ID NO: 483290 - DNA, 25 bp, Rattus norvegicus
gtaggctcccaaagtcattaacatg

SEQ ID NO: 483291 - DNA, 25 bp, Rattus norvegicus
gtaggctcccaatgtcattaacatg

SEQ ID NO: 483292 - DNA, 25 bp, Rattus norvegicus
gtaggctcctatcaatatgacccca

SEQ ID NO: 483293 - DNA, 25 bp, Rattus norvegicus
gtaggctcctatgaatatgacccca

SEQ ID NO: 483294 - DNA, 25 bp, Rattus norvegicus
gtaggctcttctaacagcacgtggc

SEQ ID NO: 483295 - DNA, 25 bp, Rattus norvegicus
gtaggctcttcttacagcacgtggc

SEQ ID NO: 483296 - DNA, 25 bp, Rattus norvegicus
gtaggctgaagtctggataccacga

SEQ ID NO: 483297 - DNA, 25 bp, Rattus norvegicus
gtaggctgaagtgtggataccacga

SEQ ID NO: 483298 - DNA, 25 bp, Rattus norvegicus
gtaggctgcagcactttggagataa

SEQ ID NO: 483299 - DNA, 25 bp, Rattus norvegicus
gtaggctgcagcagatgccagcatc

SEQ ID NO: 483300 - DNA, 25 bp, Rattus norvegicus
gtaggctgcagctctttggagataa

SEQ ID NO: 483301 - DNA, 25 bp, Rattus norvegicus
gtaggctgcagctgatgccagcatc

SEQ ID NO: 483302 - DNA, 25 bp, Rattus norvegicus
gtaggctgcattaaaatatgtcaag

SEQ ID NO: 483303 - DNA, 25 bp, Rattus norvegicus
gtaggctgcatttaaatatgtcaag

SEQ ID NO: 483304 - DNA, 25 bp, Rattus norvegicus
gtaggctgggctcgcattctaccct

SEQ ID NO: 483305 - DNA, 25 bp, Rattus norvegicus
gtaggctgggctggcattctaccct

SEQ ID NO: 483306 - DNA, 25 bp, Rattus norvegicus
gtaggctgggtgaatcctaacctgc

SEQ ID NO: 483307 - DNA, 25 bp, Rattus norvegicus
gtaggctgggtgtatcctaacctgc

SEQ ID NO: 483308 - DNA, 25 bp, Rattus norvegicus
gtaggctgtcccatatcctctagtg

SEQ ID NO: 483309 - DNA, 25 bp, Rattus norvegicus
gtaggctgtcccttatcctctagtg

SEQ ID NO: 483310 - DNA, 25 bp, Rattus norvegicus
gtaggcttagccaatggctgataga

SEQ ID NO: 483311 - DNA, 25 bp, Rattus norvegicus
gtaggcttagcctatggctgataga

SEQ ID NO: 483312 - DNA, 25 bp, Rattus norvegicus
gtaggcttcctcatttatgttctct

SEQ ID NO: 483313 - DNA, 25 bp, Rattus norvegicus
gtaggcttcctcttttatgttctct

SEQ ID NO: 483314 - DNA, 25 bp, Rattus norvegicus
gtaggcttctcaccagtgtgcagac

SEQ ID NO: 483315 - DNA, 25 bp, Rattus norvegicus
gtaggcttctcagcagtgtgcagac

SEQ ID NO: 483316 - DNA, 25 bp, Rattus norvegicus
gtaggcttgcttatgctgtataact

SEQ ID NO: 483317 - DNA, 25 bp, Rattus norvegicus
gtaggcttgcttttgctgtataact

SEQ ID NO: 483318 - DNA, 25 bp, Rattus norvegicus
gtaggcttgttaatatgacccggct

SEQ ID NO: 483319 - DNA, 25 bp, Rattus norvegicus
gtaggcttgttattatgacccggct

SEQ ID NO: 483320 - DNA, 25 bp, Rattus norvegicus
gtaggctttcctctttcctcagaga

SEQ ID NO: 483321 - DNA, 25 bp, Rattus norvegicus
gtaggctttcctgtttcctcagaga

SEQ ID NO: 483322 - DNA, 25 bp, Rattus norvegicus
gtaggctttctacgatccccatcaa

SEQ ID NO: 483323 - DNA, 25 bp, Rattus norvegicus
gtaggctttctactctttaagaacg

SEQ ID NO: 483324 - DNA, 25 bp, Rattus norvegicus
gtaggctttctaggatccccatcaa

SEQ ID NO: 483325 - DNA, 25 bp, Rattus norvegicus
gtaggctttctagtctttaagaacg

SEQ ID NO: 483326 - DNA, 25 bp, Rattus norvegicus
gtaggctttcttaccagcgtgaatt

SEQ ID NO: 483327 - DNA, 25 bp, Rattus norvegicus
gtaggctttctttccagcgtgaatt

SEQ ID NO: 483328 - DNA, 25 bp, Rattus norvegicus
gtagggaacgagctcttggacacac

SEQ ID NO: 483329 - DNA, 25 bp, Rattus norvegicus
gtagggaacgaggtcttggacacac

SEQ ID NO: 483330 - DNA, 25 bp, Rattus norvegicus
gtagggaagattcctgactccccga

SEQ ID NO: 483331 - DNA, 25 bp, Rattus norvegicus
gtagggaagattgctgactccccga

SEQ ID NO: 483332 - DNA, 25 bp, Rattus norvegicus
gtagggaatccacaacagactcaag

SEQ ID NO: 483333 - DNA, 25 bp, Rattus norvegicus
gtagggaatccagaacagactcaag

SEQ ID NO: 483334 - DNA, 25 bp, Rattus norvegicus
gtagggaatgtcacctctttgtttc

SEQ ID NO: 483335 - DNA, 25 bp, Rattus norvegicus
gtagggaatgtctcctctttgtttc

SEQ ID NO: 483336 - DNA, 25 bp, Rattus norvegicus
gtagggacaacccaagtcattaagt

SEQ ID NO: 483337 - DNA, 25 bp, Rattus norvegicus
gtagggacaaccgaagtcattaagt

SEQ ID NO: 483338 - DNA, 25 bp, Rattus norvegicus
gtagggaccacaacaaagacagctt

SEQ ID NO: 483339 - DNA, 25 bp, Rattus norvegicus
gtagggaccacatcaaagacagctt

SEQ ID NO: 483340 - DNA, 25 bp, Rattus norvegicus
gtagggaccatccatcaatcgtcac

SEQ ID NO: 483341 - DNA, 25 bp, Rattus norvegicus
gtagggaccatcgatcaatcgtcac

SEQ ID NO: 483342 - DNA, 25 bp, Rattus norvegicus
gtagggacccagaccctattcagat

SEQ ID NO: 483343 - DNA, 25 bp, Rattus norvegicus
gtagggacccagtccctattcagat

SEQ ID NO: 483344 - DNA, 25 bp, Rattus norvegicus
gtagggaccctgacaatgtgctgct

SEQ ID NO: 483345 - DNA, 25 bp, Rattus norvegicus
gtagggaccctgtcaatgtgctgct

SEQ ID NO: 483346 - DNA, 25 bp, Rattus norvegicus
gtagggactgacaatagcacaagat

SEQ ID NO: 483347 - DNA, 25 bp, Rattus norvegicus
gtagggactgactatagcacaagat

SEQ ID NO: 483348 - DNA, 25 bp, Rattus norvegicus
gtagggacttgtcgctgttccataa

SEQ ID NO: 483349 - DNA, 25 bp, Rattus norvegicus
gtagggacttgtggctgttccataa

SEQ ID NO: 483350 - DNA, 25 bp, Rattus norvegicus
gtagggagcaacagcaccccagaaa

SEQ ID NO: 483351 - DNA, 25 bp, Rattus norvegicus
gtagggagcaactgcaccccagaaa

SEQ ID NO: 483352 - DNA, 25 bp, Rattus norvegicus
gtagggagcctgcacctgtttgtaa

SEQ ID NO: 483353 - DNA, 25 bp, Rattus norvegicus
gtagggagcctggacctgtttgtaa

SEQ ID NO: 483354 - DNA, 25 bp, Rattus norvegicus
gtagggaggatccacaattctctgg

SEQ ID NO: 483355 - DNA, 25 bp, Rattus norvegicus
gtagggaggatcgacaattctctgg

SEQ ID NO: 483356 - DNA, 25 bp, Rattus norvegicus
gtagggagtagcactaacctctggg

SEQ ID NO: 483357 - DNA, 25 bp, Rattus norvegicus
gtagggagtagctctaacctctggg

SEQ ID NO: 483358 - DNA, 25 bp, Rattus norvegicus
gtagggagtcacatgactatccaga

SEQ ID NO: 483359 - DNA, 25 bp, Rattus norvegicus
gtagggagtcacttgactatccaga

SEQ ID NO: 483360 - DNA, 25 bp, Rattus norvegicus
gtagggatctggacaccgtgtgctc

SEQ ID NO: 483361 - DNA, 25 bp, Rattus norvegicus
gtagggatctggtcaccgtgtgctc

SEQ ID NO: 483362 - DNA, 25 bp, Rattus norvegicus
gtagggatgcaacaattcctggata

SEQ ID NO: 483363 - DNA, 25 bp, Rattus norvegicus
gtagggatgcaagaattcctggata

SEQ ID NO: 483364 - DNA, 25 bp, Rattus norvegicus
gtagggcaactcatcacaactggtc

SEQ ID NO: 483365 - DNA, 25 bp, Rattus norvegicus
gtagggcaactcttcacaactggtc

SEQ ID NO: 483366 - DNA, 25 bp, Rattus norvegicus
gtagggcaactgatcgcgacatcgc

SEQ ID NO: 483367 - DNA, 25 bp, Rattus norvegicus
gtagggcaactgttcgcgacatcgc

SEQ ID NO: 483368 - DNA, 25 bp, Rattus norvegicus
gtagggcacaatattgagacatttt

SEQ ID NO: 483369 - DNA, 25 bp, Rattus norvegicus
gtagggcacaattttgagacatttt

SEQ ID NO: 483370 - DNA, 25 bp, Rattus norvegicus
gtagggcaccctaaagtggatactc

SEQ ID NO: 483371 - DNA, 25 bp, Rattus norvegicus
gtagggcacccttaagtggatactc

SEQ ID NO: 483372 - DNA, 25 bp, Rattus norvegicus
gtagggcagaatatttcataatttc

SEQ ID NO: 483373 - DNA, 25 bp, Rattus norvegicus
gtagggcagaatttttcataatttc

SEQ ID NO: 483374 - DNA, 25 bp, Rattus norvegicus
gtagggcagacaaagaccggatttt

SEQ ID NO: 483375 - DNA, 25 bp, Rattus norvegicus
gtagggcagacacttttacttacaa

SEQ ID NO: 483376 - DNA, 25 bp, Rattus norvegicus
gtagggcagacagttttacttacaa

SEQ ID NO: 483377 - DNA, 25 bp, Rattus norvegicus
gtagggcagacatagaccggatttt

SEQ ID NO: 483378 - DNA, 25 bp, Rattus norvegicus
gtagggcagaccaggtaacttacct

SEQ ID NO: 483379 - DNA, 25 bp, Rattus norvegicus
gtagggcagacctggtaacttacct

SEQ ID NO: 483380 - DNA, 25 bp, Rattus norvegicus
gtagggcagtcaattcatctctagc

SEQ ID NO: 483381 - DNA, 25 bp, Rattus norvegicus
gtagggcagtcatttcatctctagc

SEQ ID NO: 483382 - DNA, 25 bp, Rattus norvegicus
gtagggcagttacttttctctccaa

SEQ ID NO: 483383 - DNA, 25 bp, Rattus norvegicus
gtagggcagttagttttctctccaa

SEQ ID NO: 483384 - DNA, 25 bp, Rattus norvegicus
gtagggcatacaatcaccaacaagc

SEQ ID NO: 483385 - DNA, 25 bp, Rattus norvegicus
gtagggcatacattcaccaacaagc

SEQ ID NO: 483386 - DNA, 25 bp, Rattus norvegicus
gtagggcataccatggctcaaatgt

SEQ ID NO: 483387 - DNA, 25 bp, Rattus norvegicus
gtagggcataccttggctcaaatgt

SEQ ID NO: 483388 - DNA, 25 bp, Rattus norvegicus
gtagggcatttcaatcctgtgacca

SEQ ID NO: 483389 - DNA, 25 bp, Rattus norvegicus
gtagggcatttctatcctgtgacca

SEQ ID NO: 483390 - DNA, 25 bp, Rattus norvegicus
gtagggccatcccagtcccgagttg

SEQ ID NO: 483391 - DNA, 25 bp, Rattus norvegicus
gtagggccatccgagtcccgagttg

SEQ ID NO: 483392 - DNA, 25 bp, Rattus norvegicus
gtagggcccaacaagagactagact

SEQ ID NO: 483393 - DNA, 25 bp, Rattus norvegicus
gtagggcccaactagagactagact

SEQ ID NO: 483394 - DNA, 25 bp, Rattus norvegicus
gtagggccctgtcagataaaggaca

SEQ ID NO: 483395 - DNA, 25 bp, Rattus norvegicus
gtagggccctgtgagataaaggaca

SEQ ID NO: 483396 - DNA, 25 bp, Rattus norvegicus
gtagggccggtcagcctttagcagt

SEQ ID NO: 483397 - DNA, 25 bp, Rattus norvegicus
gtagggccggtctgcctttagcagt

SEQ ID NO: 483398 - DNA, 25 bp, Rattus norvegicus
gtagggcctctaaggtggctccctt

SEQ ID NO: 483399 - DNA, 25 bp, Rattus norvegicus
gtagggcctctatggtggctccctt

SEQ ID NO: 483400 - DNA, 25 bp, Rattus norvegicus
gtagggcgaagacggaagcgtctat

SEQ ID NO: 483401 - DNA, 25 bp, Rattus norvegicus
gtagggcgaagagggaagcgtctat

SEQ ID NO: 483402 - DNA, 25 bp, Rattus norvegicus
gtagggcgacagaatcatttcaaga

SEQ ID NO: 483403 - DNA, 25 bp, Rattus norvegicus
gtagggcgacagtatcatttcaaga

SEQ ID NO: 483404 - DNA, 25 bp, Rattus norvegicus
gtagggcgctttaactgttatctta

SEQ ID NO: 483405 - DNA, 25 bp, Rattus norvegicus
gtagggcgcttttactgttatctta

SEQ ID NO: 483406 - DNA, 25 bp, Rattus norvegicus
gtagggctaacaagtccattatcat

SEQ ID NO: 483407 - DNA, 25 bp, Rattus norvegicus
gtagggctaacatgtccattatcat

SEQ ID NO: 483408 - DNA, 25 bp, Rattus norvegicus
gtagggctaagcatggtagtttcgc

SEQ ID NO: 483409 - DNA, 25 bp, Rattus norvegicus
gtagggctaagcttggtagtttcgc

SEQ ID NO: 483410 - DNA, 25 bp, Rattus norvegicus
gtagggctacctccatgcttctgat

SEQ ID NO: 483411 - DNA, 25 bp, Rattus norvegicus
gtagggctacctgcatgcttctgat

SEQ ID NO: 483412 - DNA, 25 bp, Rattus norvegicus
gtagggctccaaagagttcaacctt

SEQ ID NO: 483413 - DNA, 25 bp, Rattus norvegicus
gtagggctccaacacctggaccctt

SEQ ID NO: 483414 - DNA, 25 bp, Rattus norvegicus
gtagggctccaagacctggaccctt

SEQ ID NO: 483415 - DNA, 25 bp, Rattus norvegicus
gtagggctccaatgagttcaacctt

SEQ ID NO: 483416 - DNA, 25 bp, Rattus norvegicus
gtagggctccgcacagcagcccaaa

SEQ ID NO: 483417 - DNA, 25 bp, Rattus norvegicus
gtagggctccgctcagcagcccaaa

SEQ ID NO: 483418 - DNA, 25 bp, Rattus norvegicus
gtagggctctgcaaataaatcatgt

SEQ ID NO: 483419 - DNA, 25 bp, Rattus norvegicus
gtagggctctgctaataaatcatgt

SEQ ID NO: 483420 - DNA, 25 bp, Rattus norvegicus
gtagggctgctgatagtggtcactc

SEQ ID NO: 483421 - DNA, 25 bp, Rattus norvegicus
gtagggctgctgttagtggtcactc

SEQ ID NO: 483422 - DNA, 25 bp, Rattus norvegicus
gtagggctggtgatcacagtcccac

SEQ ID NO: 483423 - DNA, 25 bp, Rattus norvegicus
gtagggctggtgttcacagtcccac

SEQ ID NO: 483424 - DNA, 25 bp, Rattus norvegicus
gtagggcttcacctaggccaaacca

SEQ ID NO: 483425 - DNA, 25 bp, Rattus norvegicus
gtagggcttcacgtaggccaaacca

SEQ ID NO: 483426 - DNA, 25 bp, Rattus norvegicus
gtagggcttgtgctttatgaatctc

SEQ ID NO: 483427 - DNA, 25 bp, Rattus norvegicus
gtagggcttgtggtttatgaatctc

SEQ ID NO: 483428 - DNA, 25 bp, Rattus norvegicus
gtagggctttgtaaatgctctttaa

SEQ ID NO: 483429 - DNA, 25 bp, Rattus norvegicus
gtagggctttgttaatgctctttaa

SEQ ID NO: 483430 - DNA, 25 bp, Rattus norvegicus
gtagggtaacagatccttccatcat

SEQ ID NO: 483431 - DNA, 25 bp, Rattus norvegicus
gtagggtaacagttccttccatcat

SEQ ID NO: 483432 - DNA, 25 bp, Rattus norvegicus
gtagggtcactgacacacgtggtgt

SEQ ID NO: 483433 - DNA, 25 bp, Rattus norvegicus
gtagggtcactgtcacacgtggtgt

SEQ ID NO: 483434 - DNA, 25 bp, Rattus norvegicus
gtagggtctgtgaacttcctgcagc

SEQ ID NO: 483435 - DNA, 25 bp, Rattus norvegicus
gtagggtctgtgtacttcctgcagc

SEQ ID NO: 483436 - DNA, 25 bp, Rattus norvegicus
gtagggtcttggagagcaactctca

SEQ ID NO: 483437 - DNA, 25 bp, Rattus norvegicus
gtagggtcttggtgagcaactctca

SEQ ID NO: 483438 - DNA, 25 bp, Rattus norvegicus
gtagggtgaccaaacctaagctgcc

SEQ ID NO: 483439 - DNA, 25 bp, Rattus norvegicus
gtagggtgaccatacctaagctgcc

SEQ ID NO: 483440 - DNA, 25 bp, Rattus norvegicus
gtagggtgccagaaggactccaagt

SEQ ID NO: 483441 - DNA, 25 bp, Rattus norvegicus
gtagggtgccagtaggactccaagt

SEQ ID NO: 483442 - DNA, 25 bp, Rattus norvegicus
gtagggtggctcagtgaccaaagta

SEQ ID NO: 483443 - DNA, 25 bp, Rattus norvegicus
gtagggtggctctgtgaccaaagta

SEQ ID NO: 483444 - DNA, 25 bp, Rattus norvegicus
gtagggtgtcatacacacttcgttt

SEQ ID NO: 483445 - DNA, 25 bp, Rattus norvegicus
gtagggtgtcattcacacttcgttt

SEQ ID NO: 483446 - DNA, 25 bp, Rattus norvegicus
gtagggtgttatatgcacttgtgca

SEQ ID NO: 483447 - DNA, 25 bp, Rattus norvegicus
gtagggtgttatttgcacttgtgca

SEQ ID NO: 483448 - DNA, 25 bp, Rattus norvegicus
gtagggttacatagatctgtgcagt

SEQ ID NO: 483449 - DNA, 25 bp, Rattus norvegicus
gtagggttacattgatctgtgcagt

SEQ ID NO: 483450 - DNA, 25 bp, Rattus norvegicus
gtagggttactacctgcacacttcg

SEQ ID NO: 483451 - DNA, 25 bp, Rattus norvegicus
gtagggttactagctgcacacttcg

SEQ ID NO: 483452 - DNA, 25 bp, Rattus norvegicus
gtagggttagtcattgaccactata

SEQ ID NO: 483453 - DNA, 25 bp, Rattus norvegicus
gtagggttagtctttgaccactata

SEQ ID NO: 483454 - DNA, 25 bp, Rattus norvegicus
gtagggttatggagacctgtgttaa

SEQ ID NO: 483455 - DNA, 25 bp, Rattus norvegicus
gtagggttatggtgacctgtgttaa

SEQ ID NO: 483456 - DNA, 25 bp, Rattus norvegicus
gtagggttggacacagctccctgag

SEQ ID NO: 483457 - DNA, 25 bp, Rattus norvegicus
gtagggttggactcagctccctgag

SEQ ID NO: 483458 - DNA, 25 bp, Rattus norvegicus
gtagggtttatgctccaagacttcc

SEQ ID NO: 483459 - DNA, 25 bp, Rattus norvegicus
gtagggtttatggtccaagacttcc

SEQ ID NO: 483460 - DNA, 25 bp, Rattus norvegicus
gtaggtaaagatccatcctcttccc

SEQ ID NO: 483461 - DNA, 25 bp, Rattus norvegicus
gtaggtaaagatgcatcctcttccc

SEQ ID NO: 483462 - DNA, 25 bp, Rattus norvegicus
gtaggtaacacgaggactctagtat

SEQ ID NO: 483463 - DNA, 25 bp, Rattus norvegicus
gtaggtaacacgtggactctagtat

SEQ ID NO: 483464 - DNA, 25 bp, Rattus norvegicus
gtaggtaataccctggcagctcctt

SEQ ID NO: 483465 - DNA, 25 bp, Rattus norvegicus
gtaggtaataccgtggcagctcctt

SEQ ID NO: 483466 - DNA, 25 bp, Rattus norvegicus
gtaggtaccaggacagcatcaccca

SEQ ID NO: 483467 - DNA, 25 bp, Rattus norvegicus
gtaggtaccaggtcagcatcaccca

SEQ ID NO: 483468 - DNA, 25 bp, Rattus norvegicus
gtaggtacccatcctccagtaaatg

SEQ ID NO: 483469 - DNA, 25 bp, Rattus norvegicus
gtaggtacccatgctccagtaaatg

SEQ ID NO: 483470 - DNA, 25 bp, Rattus norvegicus
gtaggtaccccacgctaacactgag

SEQ ID NO: 483471 - DNA, 25 bp, Rattus norvegicus
gtaggtaccccaggctaacactgag

SEQ ID NO: 483472 - DNA, 25 bp, Rattus norvegicus
gtaggtacctagcaagaccctgtct

SEQ ID NO: 483473 - DNA, 25 bp, Rattus norvegicus
gtaggtacctaggaagaccctgtct

SEQ ID NO: 483474 - DNA, 25 bp, Rattus norvegicus
gtaggtactgagaactgcagcatca

SEQ ID NO: 483475 - DNA, 25 bp, Rattus norvegicus
gtaggtactgagtactgcagcatca

SEQ ID NO: 483476 - DNA, 25 bp, Rattus norvegicus
gtaggtaggacccaacgaccacatt

SEQ ID NO: 483477 - DNA, 25 bp, Rattus norvegicus
gtaggtaggaccgaacgaccacatt

SEQ ID NO: 483478 - DNA, 25 bp, Rattus norvegicus
gtaggtaggcctcaaccataatcta

SEQ ID NO: 483479 - DNA, 25 bp, Rattus norvegicus
gtaggtaggcctgaaccataatcta

SEQ ID NO: 483480 - DNA, 25 bp, Rattus norvegicus
gtaggtatcataccccaactgactc

SEQ ID NO: 483481 - DNA, 25 bp, Rattus norvegicus
gtaggtatcatagcccaactgactc

SEQ ID NO: 483482 - DNA, 25 bp, Rattus norvegicus
gtaggtatgctgagccaggaccaaa

SEQ ID NO: 483483 - DNA, 25 bp, Rattus norvegicus
gtaggtatgctgtgccaggaccaaa

SEQ ID NO: 483484 - DNA, 25 bp, Rattus norvegicus
gtaggtattctacctattctagtca

SEQ ID NO: 483485 - DNA, 25 bp, Rattus norvegicus
gtaggtattctagctattctagtca

SEQ ID NO: 483486 - DNA, 25 bp, Rattus norvegicus
gtaggtattctcaagcagtttcctt

SEQ ID NO: 483487 - DNA, 25 bp, Rattus norvegicus
gtaggtattctcagggttatgctca

SEQ ID NO: 483488 - DNA, 25 bp, Rattus norvegicus
gtaggtattctctagcagtttcctt

SEQ ID NO: 483489 - DNA, 25 bp, Rattus norvegicus
gtaggtattctctgggttatgctca

SEQ ID NO: 483490 - DNA, 25 bp, Rattus norvegicus
gtaggtattgatacggccactgtta

SEQ ID NO: 483491 - DNA, 25 bp, Rattus norvegicus
gtaggtattgattcggccactgtta

SEQ ID NO: 483492 - DNA, 25 bp, Rattus norvegicus
gtaggtcaagagactgcctcagccc

SEQ ID NO: 483493 - DNA, 25 bp, Rattus norvegicus
gtaggtcaagagtctgcctcagccc

SEQ ID NO: 483494 - DNA, 25 bp, Rattus norvegicus
gtaggtcacaagcatcttcgatttc

SEQ ID NO: 483495 - DNA, 25 bp, Rattus norvegicus
gtaggtcacaaggatcttcgatttc

SEQ ID NO: 483496 - DNA, 25 bp, Rattus norvegicus
gtaggtcactgaacagacattgaaa

SEQ ID NO: 483497 - DNA, 25 bp, Rattus norvegicus
gtaggtcactgatcagacattgaaa

SEQ ID NO: 483498 - DNA, 25 bp, Rattus norvegicus
gtaggtcacttcctgcctgtgaaaa

SEQ ID NO: 483499 - DNA, 25 bp, Rattus norvegicus
gtaggtcacttcgtgcctgtgaaaa

SEQ ID NO: 483500 - DNA, 25 bp, Rattus norvegicus
gtaggtcacttgctagaactcaaag

SEQ ID NO: 483501 - DNA, 25 bp, Rattus norvegicus
gtaggtcacttggtagaactcaaag

SEQ ID NO: 483502 - DNA, 25 bp, Rattus norvegicus
gtaggtcagggtcagcctcctgctt

SEQ ID NO: 483503 - DNA, 25 bp, Rattus norvegicus
gtaggtcagggtgagcctcctgctt

SEQ ID NO: 483504 - DNA, 25 bp, Rattus norvegicus
gtaggtcctgatcagcttaacctga

SEQ ID NO: 483505 - DNA, 25 bp, Rattus norvegicus
gtaggtcctgatgagcttaacctga

SEQ ID NO: 483506 - DNA, 25 bp, Rattus norvegicus
gtaggtcctgcaaaatacatgtcca

SEQ ID NO: 483507 - DNA, 25 bp, Rattus norvegicus
gtaggtcctgcataatacatgtcca

SEQ ID NO: 483508 - DNA, 25 bp, Rattus norvegicus
gtaggtcgaaaacatccacgtccag

SEQ ID NO: 483509 - DNA, 25 bp, Rattus norvegicus
gtaggtcgaaaagatccacgtccag

SEQ ID NO: 483510 - DNA, 25 bp, Rattus norvegicus
gtaggtcgtcacctggtgtaccaga

SEQ ID NO: 483511 - DNA, 25 bp, Rattus norvegicus
gtaggtcgtcacgtggtgtaccaga

SEQ ID NO: 483512 - DNA, 25 bp, Rattus norvegicus
gtaggtctcatgacaactctgcaga

SEQ ID NO: 483513 - DNA, 25 bp, Rattus norvegicus
gtaggtctcatgtcaactctgcaga

SEQ ID NO: 483514 - DNA, 25 bp, Rattus norvegicus
gtaggtctcctgagagtgtgctgaa

SEQ ID NO: 483515 - DNA, 25 bp, Rattus norvegicus
gtaggtctcctgtgagtgtgctgaa

SEQ ID NO: 483516 - DNA, 25 bp, Rattus norvegicus
gtaggtctctacatgggccagttgg

SEQ ID NO: 483517 - DNA, 25 bp, Rattus norvegicus
gtaggtctctacttgggccagttgg

SEQ ID NO: 483518 - DNA, 25 bp, Rattus norvegicus
gtaggtctctataaatctgtcacag

SEQ ID NO: 483519 - DNA, 25 bp, Rattus norvegicus
gtaggtctctattaatctgtcacag

SEQ ID NO: 483520 - DNA, 25 bp, Rattus norvegicus
gtaggtctgtcaacccagcaaaggg

SEQ ID NO: 483521 - DNA, 25 bp, Rattus norvegicus
gtaggtctgtcatcccagcaaaggg

SEQ ID NO: 483522 - DNA, 25 bp, Rattus norvegicus
gtaggtcttctgagtgggatcattt

SEQ ID NO: 483523 - DNA, 25 bp, Rattus norvegicus
gtaggtcttctgtgtgggatcattt

SEQ ID NO: 483524 - DNA, 25 bp, Rattus norvegicus
gtaggtcttgatccatccaagccta

SEQ ID NO: 483525 - DNA, 25 bp, Rattus norvegicus
gtaggtcttgatgcatccaagccta

SEQ ID NO: 483526 - DNA, 25 bp, Rattus norvegicus
gtaggtctttaaacatgtgtcagca

SEQ ID NO: 483527 - DNA, 25 bp, Rattus norvegicus
gtaggtctttaatcatgtgtcagca

SEQ ID NO: 483528 - DNA, 25 bp, Rattus norvegicus
gtaggtctttatcccgatttcgcgt

SEQ ID NO: 483529 - DNA, 25 bp, Rattus norvegicus
gtaggtctttatgccgatttcgcgt

SEQ ID NO: 483530 - DNA, 25 bp, Rattus norvegicus
gtaggtgaccatatctaactatcca

SEQ ID NO: 483531 - DNA, 25 bp, Rattus norvegicus
gtaggtgaccatttctaactatcca

SEQ ID NO: 483532 - DNA, 25 bp, Rattus norvegicus
gtaggtgacgttacttgagcttaaa

SEQ ID NO: 483533 - DNA, 25 bp, Rattus norvegicus
gtaggtgacgtttcttgagcttaaa

SEQ ID NO: 483534 - DNA, 25 bp, Rattus norvegicus
gtaggtgagcagaagcttgcctccc

SEQ ID NO: 483535 - DNA, 25 bp, Rattus norvegicus
gtaggtgagcagtagcttgcctccc

SEQ ID NO: 483536 - DNA, 25 bp, Rattus norvegicus
gtaggtgagctaacacagtgtatct

SEQ ID NO: 483537 - DNA, 25 bp, Rattus norvegicus
gtaggtgagctatcacagtgtatct

SEQ ID NO: 483538 - DNA, 25 bp, Rattus norvegicus
gtaggtgccacactaacttctgcaa

SEQ ID NO: 483539 - DNA, 25 bp, Rattus norvegicus
gtaggtgccacagtaacttctgcaa

SEQ ID NO: 483540 - DNA, 25 bp, Rattus norvegicus
gtaggtgcctcaagagccaagcaaa

SEQ ID NO: 483541 - DNA, 25 bp, Rattus norvegicus
gtaggtgcctcatgagccaagcaaa

SEQ ID NO: 483542 - DNA, 25 bp, Rattus norvegicus
gtaggtgccttgaaacttcaatgtt

SEQ ID NO: 483543 - DNA, 25 bp, Rattus norvegicus
gtaggtgccttgtaacttcaatgtt

SEQ ID NO: 483544 - DNA, 25 bp, Rattus norvegicus
gtaggtgcgcccaggccaaacagtg

SEQ ID NO: 483545 - DNA, 25 bp, Rattus norvegicus
gtaggtgcgccctggccaaacagtg

SEQ ID NO: 483546 - DNA, 25 bp, Rattus norvegicus
gtaggtgctaggaacgatacaggtc

SEQ ID NO: 483547 - DNA, 25 bp, Rattus norvegicus
gtaggtgctaggtacgatacaggtc

SEQ ID NO: 483548 - DNA, 25 bp, Rattus norvegicus
gtaggtgcttccatcggtggcatct

SEQ ID NO: 483549 - DNA, 25 bp, Rattus norvegicus
gtaggtgcttccttcggtggcatct

SEQ ID NO: 483550 - DNA, 25 bp, Rattus norvegicus
gtaggtggccctcagttgtattgaa

SEQ ID NO: 483551 - DNA, 25 bp, Rattus norvegicus
gtaggtggccctgagttgtattgaa

SEQ ID NO: 483552 - DNA, 25 bp, Rattus norvegicus
gtaggtggcctgagtttgtctcttc

SEQ ID NO: 483553 - DNA, 25 bp, Rattus norvegicus
gtaggtggcctgtgtttgtctcttc

SEQ ID NO: 483554 - DNA, 25 bp, Rattus norvegicus
gtaggtggccttctttgtgttccat

SEQ ID NO: 483555 - DNA, 25 bp, Rattus norvegicus
gtaggtggccttgtttgtgttccat

SEQ ID NO: 483556 - DNA, 25 bp, Rattus norvegicus
gtaggtggtgacacactcctaacta

SEQ ID NO: 483557 - DNA, 25 bp, Rattus norvegicus
gtaggtggtgactcactcctaacta

SEQ ID NO: 483558 - DNA, 25 bp, Rattus norvegicus
gtaggtggtgcaagtcaacttcccg

SEQ ID NO: 483559 - DNA, 25 bp, Rattus norvegicus
gtaggtggtgcatgtcaacttcccg

SEQ ID NO: 483560 - DNA, 25 bp, Rattus norvegicus
gtaggtgtaaagagatactgtcccc

SEQ ID NO: 483561 - DNA, 25 bp, Rattus norvegicus
gtaggtgtaaagtgatactgtcccc

SEQ ID NO: 483562 - DNA, 25 bp, Rattus norvegicus
gtaggtgtagtcatactcaaagaat

SEQ ID NO: 483563 - DNA, 25 bp, Rattus norvegicus
gtaggtgtagtcttactcaaagaat

SEQ ID NO: 483564 - DNA, 25 bp, Rattus norvegicus
gtaggtgtctgcctttacacagaga

SEQ ID NO: 483565 - DNA, 25 bp, Rattus norvegicus
gtaggtgtctgcgtttacacagaga

SEQ ID NO: 483566 - DNA, 25 bp, Rattus norvegicus
gtaggtgttcacaatgccgggcgcc

SEQ ID NO: 483567 - DNA, 25 bp, Rattus norvegicus
gtaggtgttcactatgccgggcgcc

SEQ ID NO: 483568 - DNA, 25 bp, Rattus norvegicus
gtaggtgttggccttctcatatcaa

SEQ ID NO: 483569 - DNA, 25 bp, Rattus norvegicus
gtaggtgttggcgttctcatatcaa

SEQ ID NO: 483570 - DNA, 25 bp, Rattus norvegicus
gtaggtgtttctcttcatattcatg

SEQ ID NO: 483571 - DNA, 25 bp, Rattus norvegicus
gtaggtgtttctgttcatattcatg

SEQ ID NO: 483572 - DNA, 25 bp, Rattus norvegicus
gtaggttaaactctccttcctatca

SEQ ID NO: 483573 - DNA, 25 bp, Rattus norvegicus
gtaggttaaactgtccttcctatca

SEQ ID NO: 483574 - DNA, 25 bp, Rattus norvegicus
gtaggttaaccaatccttatctcct

SEQ ID NO: 483575 - DNA, 25 bp, Rattus norvegicus
gtaggttaaccattccttatctcct

SEQ ID NO: 483576 - DNA, 25 bp, Rattus norvegicus
gtaggttacacacacctgtgatcgc

SEQ ID NO: 483577 - DNA, 25 bp, Rattus norvegicus
gtaggttacacagacctgtgatcgc

SEQ ID NO: 483578 - DNA, 25 bp, Rattus norvegicus
gtaggttatcatctaaacattctga

SEQ ID NO: 483579 - DNA, 25 bp, Rattus norvegicus
gtaggttatcatgtaaacattctga

SEQ ID NO: 483580 - DNA, 25 bp, Rattus norvegicus
gtaggttatgcaaatgtgtttctca

SEQ ID NO: 483581 - DNA, 25 bp, Rattus norvegicus
gtaggttatgcatatgtgtttctca

SEQ ID NO: 483582 - DNA, 25 bp, Rattus norvegicus
gtaggttattcaagttgtttgcaac

SEQ ID NO: 483583 - DNA, 25 bp, Rattus norvegicus
gtaggttattcatgttgtttgcaac

SEQ ID NO: 483584 - DNA, 25 bp, Rattus norvegicus
gtaggttcactgctaggctctggct

SEQ ID NO: 483585 - DNA, 25 bp, Rattus norvegicus
gtaggttcactggtaggctctggct

SEQ ID NO: 483586 - DNA, 25 bp, Rattus norvegicus
gtaggttcattacgttcaggacagg

SEQ ID NO: 483587 - DNA, 25 bp, Rattus norvegicus
gtaggttcattaggttcaggacagg

SEQ ID NO: 483588 - DNA, 25 bp, Rattus norvegicus
gtaggttccagcaacatgttggatc

SEQ ID NO: 483589 - DNA, 25 bp, Rattus norvegicus
gtaggttccagctacatgttggatc

SEQ ID NO: 483590 - DNA, 25 bp, Rattus norvegicus
gtaggttcccttctcgtgacaaatt

SEQ ID NO: 483591 - DNA, 25 bp, Rattus norvegicus
gtaggttcccttgtcgtgacaaatt

SEQ ID NO: 483592 - DNA, 25 bp, Rattus norvegicus
gtaggttgcaagacctctgtgaaca

SEQ ID NO: 483593 - DNA, 25 bp, Rattus norvegicus
gtaggttgcaagtcctctgtgaaca

SEQ ID NO: 483594 - DNA, 25 bp, Rattus norvegicus
gtaggttgcacacgaactcttactc

SEQ ID NO: 483595 - DNA, 25 bp, Rattus norvegicus
gtaggttgcacaggaactcttactc

SEQ ID NO: 483596 - DNA, 25 bp, Rattus norvegicus
gtaggttgctggcttcatgttgaaa

SEQ ID NO: 483597 - DNA, 25 bp, Rattus norvegicus
gtaggttgctgggttcatgttgaaa

SEQ ID NO: 483598 - DNA, 25 bp, Rattus norvegicus
gtaggttggatcaactcaaggttgt

SEQ ID NO: 483599 - DNA, 25 bp, Rattus norvegicus
gtaggttggatctactcaaggttgt

SEQ ID NO: 483600 - DNA, 25 bp, Rattus norvegicus
gtaggttgtactatgtgccttctta

SEQ ID NO: 483601 - DNA, 25 bp, Rattus norvegicus
gtaggttgtactttgtgccttctta

SEQ ID NO: 483602 - DNA, 25 bp, Rattus norvegicus
gtaggtttagatagtgtccagattg

SEQ ID NO: 483603 - DNA, 25 bp, Rattus norvegicus
gtaggtttagattgtgtccagattg

SEQ ID NO: 483604 - DNA, 25 bp, Rattus norvegicus
gtaggtttcaacaaccaccacactt

SEQ ID NO: 483605 - DNA, 25 bp, Rattus norvegicus
gtaggtttcaactaccaccacactt

SEQ ID NO: 483606 - DNA, 25 bp, Rattus norvegicus
gtaggtttcactctgggcttatccc

SEQ ID NO: 483607 - DNA, 25 bp, Rattus norvegicus
gtaggtttcactgtgggcttatccc

SEQ ID NO: 483608 - DNA, 25 bp, Rattus norvegicus
gtaggtttcatcatgctttttgcat

SEQ ID NO: 483609 - DNA, 25 bp, Rattus norvegicus
gtaggtttcatcttgctttttgcat

SEQ ID NO: 483610 - DNA, 25 bp, Rattus norvegicus
gtaggtttccaaatggctattgcca

SEQ ID NO: 483611 - DNA, 25 bp, Rattus norvegicus
gtaggtttccaattggctattgcca

SEQ ID NO: 483612 - DNA, 25 bp, Rattus norvegicus
gtaggtttccttctagttcactata

SEQ ID NO: 483613 - DNA, 25 bp, Rattus norvegicus
gtaggtttccttgtagttcactata

SEQ ID NO: 483614 - DNA, 25 bp, Rattus norvegicus
gtaggtttgagccttcccagactct

SEQ ID NO: 483615 - DNA, 25 bp, Rattus norvegicus
gtaggtttgagcgttcccagactct

SEQ ID NO: 483616 - DNA, 25 bp, Rattus norvegicus
gtaggtttgctccttgtatccaagg

SEQ ID NO: 483617 - DNA, 25 bp, Rattus norvegicus
gtaggtttgctcgttgtatccaagg

SEQ ID NO: 483618 - DNA, 25 bp, Rattus norvegicus
gtaggttttccactttgattatcat

SEQ ID NO: 483619 - DNA, 25 bp, Rattus norvegicus
gtaggttttccagtttgattatcat

SEQ ID NO: 483620 - DNA, 25 bp, Rattus norvegicus
gtaggttttgaactcccagggatat

SEQ ID NO: 483621 - DNA, 25 bp, Rattus norvegicus
gtaggttttgaagtcccagggatat

SEQ ID NO: 483622 - DNA, 25 bp, Rattus norvegicus
gtaggtttttgcaatgtctcaaggc

SEQ ID NO: 483623 - DNA, 25 bp, Rattus norvegicus
gtaggtttttgctatgtctcaaggc

SEQ ID NO: 483624 - DNA, 25 bp, Rattus norvegicus
gtagtaaaacctcaactgtcaggaa

SEQ ID NO: 483625 - DNA, 25 bp, Rattus norvegicus
gtagtaaaacctgaactgtcaggaa

SEQ ID NO: 483626 - DNA, 25 bp, Rattus norvegicus
gtagtaaaaggcagaaccattgcgt

SEQ ID NO: 483627 - DNA, 25 bp, Rattus norvegicus
gtagtaaaaggctgaaccattgcgt

SEQ ID NO: 483628 - DNA, 25 bp, Rattus norvegicus
gtagtaaacagcctttcgcttgtag

SEQ ID NO: 483629 - DNA, 25 bp, Rattus norvegicus
gtagtaaacagcgtttcgcttgtag

SEQ ID NO: 483630 - DNA, 25 bp, Rattus norvegicus
gtagtaaagcccatgtctagctcat

SEQ ID NO: 483631 - DNA, 25 bp, Rattus norvegicus
gtagtaaagcccttgtctagctcat

SEQ ID NO: 483632 - DNA, 25 bp, Rattus norvegicus
gtagtaaatgcccaggtagtcctca

SEQ ID NO: 483633 - DNA, 25 bp, Rattus norvegicus
gtagtaaatgccgaggtagtcctca

SEQ ID NO: 483634 - DNA, 25 bp, Rattus norvegicus
gtagtaacaactactggccagcgtt

SEQ ID NO: 483635 - DNA, 25 bp, Rattus norvegicus
gtagtaacaacttctggccagcgtt

SEQ ID NO: 483636 - DNA, 25 bp, Rattus norvegicus
gtagtaaccccacatcaattcaaat

SEQ ID NO: 483637 - DNA, 25 bp, Rattus norvegicus
gtagtaaccccagatcaattcaaat

SEQ ID NO: 483638 - DNA, 25 bp, Rattus norvegicus
gtagtaactaccacctagtactgtg

SEQ ID NO: 483639 - DNA, 25 bp, Rattus norvegicus
gtagtaactacctcctagtactgtg

SEQ ID NO: 483640 - DNA, 25 bp, Rattus norvegicus
gtagtaactgacatttcctgtaaga

SEQ ID NO: 483641 - DNA, 25 bp, Rattus norvegicus
gtagtaactgacttttcctgtaaga

SEQ ID NO: 483642 - DNA, 25 bp, Rattus norvegicus
gtagtaactgtcatgtctgtcctgt

SEQ ID NO: 483643 - DNA, 25 bp, Rattus norvegicus
gtagtaactgtcttgtctgtcctgt

SEQ ID NO: 483644 - DNA, 25 bp, Rattus norvegicus
gtagtaagacacacactttttagat

SEQ ID NO: 483645 - DNA, 25 bp, Rattus norvegicus
gtagtaagacactcactttttagat

SEQ ID NO: 483646 - DNA, 25 bp, Rattus norvegicus
gtagtaagtactctagtcctatggg

SEQ ID NO: 483647 - DNA, 25 bp, Rattus norvegicus
gtagtaagtactgtagtcctatggg

SEQ ID NO: 483648 - DNA, 25 bp, Rattus norvegicus
gtagtaagtatgctctatccccatt

SEQ ID NO: 483649 - DNA, 25 bp, Rattus norvegicus
gtagtaagtatggtctatccccatt

SEQ ID NO: 483650 - DNA, 25 bp, Rattus norvegicus
gtagtaatcccacttctttaggctg

SEQ ID NO: 483651 - DNA, 25 bp, Rattus norvegicus
gtagtaatcccagttctttaggctg

SEQ ID NO: 483652 - DNA, 25 bp, Rattus norvegicus
gtagtaatcttgaagcaacctggac

SEQ ID NO: 483653 - DNA, 25 bp, Rattus norvegicus
gtagtaatcttgtagcaacctggac

SEQ ID NO: 483654 - DNA, 25 bp, Rattus norvegicus
gtagtaatgtttagctagcctgact

SEQ ID NO: 483655 - DNA, 25 bp, Rattus norvegicus
gtagtaatgttttgctagcctgact

SEQ ID NO: 483656 - DNA, 25 bp, Rattus norvegicus
gtagtaattactatcttgccacctt

SEQ ID NO: 483657 - DNA, 25 bp, Rattus norvegicus
gtagtaattactttcttgccacctt

SEQ ID NO: 483658 - DNA, 25 bp, Rattus norvegicus
gtagtaatttttccccattatcctg

SEQ ID NO: 483659 - DNA, 25 bp, Rattus norvegicus
gtagtaatttttgcccattatcctg

SEQ ID NO: 483660 - DNA, 25 bp, Rattus norvegicus
gtagtacaatgtcgcactgcccagt

SEQ ID NO: 483661 - DNA, 25 bp, Rattus norvegicus
gtagtacaatgtggcactgcccagt

SEQ ID NO: 483662 - DNA, 25 bp, Rattus norvegicus
gtagtacacatcctaaatcctggca

SEQ ID NO: 483663 - DNA, 25 bp, Rattus norvegicus
gtagtacacatcgtaaatcctggca

SEQ ID NO: 483664 - DNA, 25 bp, Rattus norvegicus
gtagtacacttacaaacacacaggt

SEQ ID NO: 483665 - DNA, 25 bp, Rattus norvegicus
gtagtacacttagaaacacacaggt

SEQ ID NO: 483666 - DNA, 25 bp, Rattus norvegicus
gtagtacagtcacctaacgagcatg

SEQ ID NO: 483667 - DNA, 25 bp, Rattus norvegicus
gtagtacagtcagctaacgagcatg

SEQ ID NO: 483668 - DNA, 25 bp, Rattus norvegicus
gtagtaccccgacagctcaagatgt

SEQ ID NO: 483669 - DNA, 25 bp, Rattus norvegicus
gtagtaccccgagagctcaagatgt

SEQ ID NO: 483670 - DNA, 25 bp, Rattus norvegicus
gtagtacctggaactcgttctttac

SEQ ID NO: 483671 - DNA, 25 bp, Rattus norvegicus
gtagtacctggatctcgttctttac

SEQ ID NO: 483672 - DNA, 25 bp, Rattus norvegicus
gtagtacgctgtcctaataccaaag

SEQ ID NO: 483673 - DNA, 25 bp, Rattus norvegicus
gtagtacgctgtgctaataccaaag

SEQ ID NO: 483674 - DNA, 25 bp, Rattus norvegicus
gtagtacgtgctatccgctctgaca

SEQ ID NO: 483675 - DNA, 25 bp, Rattus norvegicus
gtagtacgtgctttccgctctgaca

SEQ ID NO: 483676 - DNA, 25 bp, Rattus norvegicus
gtagtacttgctcttctggagcttg

SEQ ID NO: 483677 - DNA, 25 bp, Rattus norvegicus
gtagtacttgctgttctggagcttg

SEQ ID NO: 483678 - DNA, 25 bp, Rattus norvegicus
gtagtacttgtaccggcactggcgc

SEQ ID NO: 483679 - DNA, 25 bp, Rattus norvegicus
gtagtacttgtagcggcactggcgc

SEQ ID NO: 483680 - DNA, 25 bp, Rattus norvegicus
gtagtagactttacccctatatttg

SEQ ID NO: 483681 - DNA, 25 bp, Rattus norvegicus
gtagtagacttttcccctatatttg

SEQ ID NO: 483682 - DNA, 25 bp, Rattus norvegicus
gtagtagagacaaaaccacccagag

SEQ ID NO: 483683 - DNA, 25 bp, Rattus norvegicus
gtagtagagacataaccacccagag

SEQ ID NO: 483684 - DNA, 25 bp, Rattus norvegicus
gtagtagagaccatgcgaaacccaa

SEQ ID NO: 483685 - DNA, 25 bp, Rattus norvegicus
gtagtagagaccttgcgaaacccaa

SEQ ID NO: 483686 - DNA, 25 bp, Rattus norvegicus
gtagtagagctacacctgccaggac

SEQ ID NO: 483687 - DNA, 25 bp, Rattus norvegicus
gtagtagagctagacctgccaggac

SEQ ID NO: 483688 - DNA, 25 bp, Rattus norvegicus
gtagtagatcctacagctttaccac

SEQ ID NO: 483689 - DNA, 25 bp, Rattus norvegicus
gtagtagatccttcagctttaccac

SEQ ID NO: 483690 - DNA, 25 bp, Rattus norvegicus
gtagtagcactgattgtctccattc

SEQ ID NO: 483691 - DNA, 25 bp, Rattus norvegicus
gtagtagcactgtttgtctccattc

SEQ ID NO: 483692 - DNA, 25 bp, Rattus norvegicus
gtagtagccaacacgcgcagtatat

SEQ ID NO: 483693 - DNA, 25 bp, Rattus norvegicus
gtagtagccaactcgcgcagtatat

SEQ ID NO: 483694 - DNA, 25 bp, Rattus norvegicus
gtagtagccaccatggcctgggagt

SEQ ID NO: 483695 - DNA, 25 bp, Rattus norvegicus
gtagtagccaccttggcctgggagt

SEQ ID NO: 483696 - DNA, 25 bp, Rattus norvegicus
gtagtagccagcagggtttgaccaa

SEQ ID NO: 483697 - DNA, 25 bp, Rattus norvegicus
gtagtagccagctgggtttgaccaa

SEQ ID NO: 483698 - DNA, 25 bp, Rattus norvegicus
gtagtagcccacaggagttttttca

SEQ ID NO: 483699 - DNA, 25 bp, Rattus norvegicus
gtagtagcccactggagttttttca

SEQ ID NO: 483700 - DNA, 25 bp, Rattus norvegicus
gtagtagccgcgcaagatcctcaga

SEQ ID NO: 483701 - DNA, 25 bp, Rattus norvegicus
gtagtagccgcggaagatcctcaga

SEQ ID NO: 483702 - DNA, 25 bp, Rattus norvegicus
gtagtagcctgtatgcctagaaatg

SEQ ID NO: 483703 - DNA, 25 bp, Rattus norvegicus
gtagtagcctgtttgcctagaaatg

SEQ ID NO: 483704 - DNA, 25 bp, Rattus norvegicus
gtagtagccttgaatttgactttac

SEQ ID NO: 483705 - DNA, 25 bp, Rattus norvegicus
gtagtagccttgtatttgactttac

SEQ ID NO: 483706 - DNA, 25 bp, Rattus norvegicus
gtagtagctaatctcctctagtgtg

SEQ ID NO: 483707 - DNA, 25 bp, Rattus norvegicus
gtagtagctaatgtcctctagtgtg

SEQ ID NO: 483708 - DNA, 25 bp, Rattus norvegicus
gtagtagcttttacctgtctttatg

SEQ ID NO: 483709 - DNA, 25 bp, Rattus norvegicus
gtagtagctttttcctgtctttatg

SEQ ID NO: 483710 - DNA, 25 bp, Rattus norvegicus
gtagtaggtcctccagtttttattt

SEQ ID NO: 483711 - DNA, 25 bp, Rattus norvegicus
gtagtaggtcctgcagtttttattt

SEQ ID NO: 483712 - DNA, 25 bp, Rattus norvegicus
gtagtagtacacatcctaaatcctg

SEQ ID NO: 483713 - DNA, 25 bp, Rattus norvegicus
gtagtagtacacttcctaaatcctg

SEQ ID NO: 483714 - DNA, 25 bp, Rattus norvegicus
gtagtagtacgcaggtggcaccaga

SEQ ID NO: 483715 - DNA, 25 bp, Rattus norvegicus
gtagtagtacgctggtggcaccaga

SEQ ID NO: 483716 - DNA, 25 bp, Rattus norvegicus
gtagtagtattcaatattgctttaa

SEQ ID NO: 483717 - DNA, 25 bp, Rattus norvegicus
gtagtagtattcaggcctcgaagac

SEQ ID NO: 483718 - DNA, 25 bp, Rattus norvegicus
gtagtagtattctatattgctttaa

SEQ ID NO: 483719 - DNA, 25 bp, Rattus norvegicus
gtagtagtattctggcctcgaagac

SEQ ID NO: 483720 - DNA, 25 bp, Rattus norvegicus
gtagtagtggatccagctcctttcc

SEQ ID NO: 483721 - DNA, 25 bp, Rattus norvegicus
gtagtagtggatgcagctcctttcc

SEQ ID NO: 483722 - DNA, 25 bp, Rattus norvegicus
gtagtagtgtctcccacagttccta

SEQ ID NO: 483723 - DNA, 25 bp, Rattus norvegicus
gtagtagtgtctgccacagttccta

SEQ ID NO: 483724 - DNA, 25 bp, Rattus norvegicus
gtagtagttgccacagcccagggag

SEQ ID NO: 483725 - DNA, 25 bp, Rattus norvegicus
gtagtagttgcctcagcccagggag

SEQ ID NO: 483726 - DNA, 25 bp, Rattus norvegicus
gtagtagtttcccaagattcctcgg

SEQ ID NO: 483727 - DNA, 25 bp, Rattus norvegicus
gtagtagtttccgaagattcctcgg

SEQ ID NO: 483728 - DNA, 25 bp, Rattus norvegicus
gtagtatagcccctcgcagtggaga

SEQ ID NO: 483729 - DNA, 25 bp, Rattus norvegicus
gtagtatagcccgtcgcagtggaga

SEQ ID NO: 483730 - DNA, 25 bp, Rattus norvegicus
gtagtatatcttaaacacaatgctt

SEQ ID NO: 483731 - DNA, 25 bp, Rattus norvegicus
gtagtatatctttaacacaatgctt

SEQ ID NO: 483732 - DNA, 25 bp, Rattus norvegicus
gtagtatctccaaacacaagcctag

SEQ ID NO: 483733 - DNA, 25 bp, Rattus norvegicus
gtagtatctccatacacaagcctag

SEQ ID NO: 483734 - DNA, 25 bp, Rattus norvegicus
gtagtatctgaacccaaagccgaga

SEQ ID NO: 483735 - DNA, 25 bp, Rattus norvegicus
gtagtatctgaagccaaagccgaga

SEQ ID NO: 483736 - DNA, 25 bp, Rattus norvegicus
gtagtatctgttcaaagcatatcat

SEQ ID NO: 483737 - DNA, 25 bp, Rattus norvegicus
gtagtatctgttgaaagcatatcat

SEQ ID NO: 483738 - DNA, 25 bp, Rattus norvegicus
gtagtatctttgcatcttctgtgta

SEQ ID NO: 483739 - DNA, 25 bp, Rattus norvegicus
gtagtatctttggatcttctgtgta

SEQ ID NO: 483740 - DNA, 25 bp, Rattus norvegicus
gtagtatgtcatctgttaatagtta

SEQ ID NO: 483741 - DNA, 25 bp, Rattus norvegicus
gtagtatgtcatgtgttaatagtta

SEQ ID NO: 483742 - DNA, 25 bp, Rattus norvegicus
gtagtattaataccttcccagaaat

SEQ ID NO: 483743 - DNA, 25 bp, Rattus norvegicus
gtagtattaatagcttcccagaaat

SEQ ID NO: 483744 - DNA, 25 bp, Rattus norvegicus
gtagtattcaggctaccacctttaa

SEQ ID NO: 483745 - DNA, 25 bp, Rattus norvegicus
gtagtattcagggtaccacctttaa

SEQ ID NO: 483746 - DNA, 25 bp, Rattus norvegicus
gtagtattctatatttactcctaat

SEQ ID NO: 483747 - DNA, 25 bp, Rattus norvegicus
gtagtattctatttttactcctaat

SEQ ID NO: 483748 - DNA, 25 bp, Rattus norvegicus
gtagtattcttaacttgttctatat

SEQ ID NO: 483749 - DNA, 25 bp, Rattus norvegicus
gtagtattcttatcttgttctatat

SEQ ID NO: 483750 - DNA, 25 bp, Rattus norvegicus
gtagtattgatgatgaacatttgat

SEQ ID NO: 483751 - DNA, 25 bp, Rattus norvegicus
gtagtattgatgttgaacatttgat

SEQ ID NO: 483752 - DNA, 25 bp, Rattus norvegicus
gtagtatttatcatctcctgtacaa

SEQ ID NO: 483753 - DNA, 25 bp, Rattus norvegicus
gtagtatttatcttctcctgtacaa

SEQ ID NO: 483754 - DNA, 25 bp, Rattus norvegicus
gtagtatttctcactttgaccaaca

SEQ ID NO: 483755 - DNA, 25 bp, Rattus norvegicus
gtagtatttctctctttgaccaaca

SEQ ID NO: 483756 - DNA, 25 bp, Rattus norvegicus
gtagtatttcttacattgcctcatg

SEQ ID NO: 483757 - DNA, 25 bp, Rattus norvegicus
gtagtatttctttcattgcctcatg

SEQ ID NO: 483758 - DNA, 25 bp, Rattus norvegicus
gtagtatttgtcaccaagctcaaga

SEQ ID NO: 483759 - DNA, 25 bp, Rattus norvegicus
gtagtatttgtctccaagctcaaga

SEQ ID NO: 483760 - DNA, 25 bp, Rattus norvegicus
gtagtattttgaagtctggttctga

SEQ ID NO: 483761 - DNA, 25 bp, Rattus norvegicus
gtagtattttgatgtctggttctga

SEQ ID NO: 483762 - DNA, 25 bp, Rattus norvegicus
gtagtcaaaaagcaccggctggtct

SEQ ID NO: 483763 - DNA, 25 bp, Rattus norvegicus
gtagtcaaaaaggaccggctggtct

SEQ ID NO: 483764 - DNA, 25 bp, Rattus norvegicus
gtagtcaaataaacctagggccgat

SEQ ID NO: 483765 - DNA, 25 bp, Rattus norvegicus
gtagtcaaataatcctagggccgat

SEQ ID NO: 483766 - DNA, 25 bp, Rattus norvegicus
gtagtcaactgcacagggtgcgcaa

SEQ ID NO: 483767 - DNA, 25 bp, Rattus norvegicus
gtagtcaactgctcagggtgcgcaa

SEQ ID NO: 483768 - DNA, 25 bp, Rattus norvegicus
gtagtcaatcacacttgtggcctct

SEQ ID NO: 483769 - DNA, 25 bp, Rattus norvegicus
gtagtcaatcactcttgtggcctct

SEQ ID NO: 483770 - DNA, 25 bp, Rattus norvegicus
gtagtcacaaagcatcctaaatgga

SEQ ID NO: 483771 - DNA, 25 bp, Rattus norvegicus
gtagtcacaaaggatcctaaatgga

SEQ ID NO: 483772 - DNA, 25 bp, Rattus norvegicus
gtagtcacacgcaagttgctggtca

SEQ ID NO: 483773 - DNA, 25 bp, Rattus norvegicus
gtagtcacacgctagttgctggtca

SEQ ID NO: 483774 - DNA, 25 bp, Rattus norvegicus
gtagtcacactcatctatggctcaa

SEQ ID NO: 483775 - DNA, 25 bp, Rattus norvegicus
gtagtcacactcttctatggctcaa

SEQ ID NO: 483776 - DNA, 25 bp, Rattus norvegicus
gtagtcacagagctcatcacaatgt

SEQ ID NO: 483777 - DNA, 25 bp, Rattus norvegicus
gtagtcacagaggtcatcacaatgt

SEQ ID NO: 483778 - DNA, 25 bp, Rattus norvegicus
gtagtcacatgccatactgcaggga

SEQ ID NO: 483779 - DNA, 25 bp, Rattus norvegicus
gtagtcacatgcgatactgcaggga

SEQ ID NO: 483780 - DNA, 25 bp, Rattus norvegicus
gtagtcacctttcgataatttctga

SEQ ID NO: 483781 - DNA, 25 bp, Rattus norvegicus
gtagtcacctttggataatttctga

SEQ ID NO: 483782 - DNA, 25 bp, Rattus norvegicus
gtagtcacggtgcaactatacccca

SEQ ID NO: 483783 - DNA, 25 bp, Rattus norvegicus
gtagtcacggtggaactatacccca

SEQ ID NO: 483784 - DNA, 25 bp, Rattus norvegicus
gtagtcacgtggctttgaccaggca

SEQ ID NO: 483785 - DNA, 25 bp, Rattus norvegicus
gtagtcacgtgggtttgaccaggca

SEQ ID NO: 483786 - DNA, 25 bp, Rattus norvegicus
gtagtcactaaaagcatcctcactc

SEQ ID NO: 483787 - DNA, 25 bp, Rattus norvegicus
gtagtcactaaatgcatcctcactc

SEQ ID NO: 483788 - DNA, 25 bp, Rattus norvegicus
gtagtcactactatatcatgtcttt

SEQ ID NO: 483789 - DNA, 25 bp, Rattus norvegicus
gtagtcactactttatcatgtcttt

SEQ ID NO: 483790 - DNA, 25 bp, Rattus norvegicus
gtagtcactatccaattacccagcc

SEQ ID NO: 483791 - DNA, 25 bp, Rattus norvegicus
gtagtcactatcgaattacccagcc

SEQ ID NO: 483792 - DNA, 25 bp, Rattus norvegicus
gtagtcactctcagatggcagtttt

SEQ ID NO: 483793 - DNA, 25 bp, Rattus norvegicus
gtagtcactctctgatggcagtttt

SEQ ID NO: 483794 - DNA, 25 bp, Rattus norvegicus
gtagtcactgcactggagtatccaa

SEQ ID NO: 483795 - DNA, 25 bp, Rattus norvegicus
gtagtcactgcagtggagtatccaa

SEQ ID NO: 483796 - DNA, 25 bp, Rattus norvegicus
gtagtcactggccatttctctaaat

SEQ ID NO: 483797 - DNA, 25 bp, Rattus norvegicus
gtagtcactggcgatttctctaaat

SEQ ID NO: 483798 - DNA, 25 bp, Rattus norvegicus
gtagtcactttaatcagtaaaccgt

SEQ ID NO: 483799 - DNA, 25 bp, Rattus norvegicus
gtagtcactttattcagtaaaccgt

SEQ ID NO: 483800 - DNA, 25 bp, Rattus norvegicus
gtagtcagacttagtacagctcact

SEQ ID NO: 483801 - DNA, 25 bp, Rattus norvegicus
gtagtcagactttgtacagctcact

SEQ ID NO: 483802 - DNA, 25 bp, Rattus norvegicus
gtagtcagcaccaggatcccagggc

SEQ ID NO: 483803 - DNA, 25 bp, Rattus norvegicus
gtagtcagcacctggatcccagggc

SEQ ID NO: 483804 - DNA, 25 bp, Rattus norvegicus
gtagtcaggaaacgccactgtcccg

SEQ ID NO: 483805 - DNA, 25 bp, Rattus norvegicus
gtagtcaggaaaggccactgtcccg

SEQ ID NO: 483806 - DNA, 25 bp, Rattus norvegicus
gtagtcagggccagtggagcacccc

SEQ ID NO: 483807 - DNA, 25 bp, Rattus norvegicus
gtagtcagggcctgtggagcacccc

SEQ ID NO: 483808 - DNA, 25 bp, Rattus norvegicus
gtagtcagggttatcattcacaaaa

SEQ ID NO: 483809 - DNA, 25 bp, Rattus norvegicus
gtagtcagggttttcattcacaaaa

SEQ ID NO: 483810 - DNA, 25 bp, Rattus norvegicus
gtagtcagtcacacaccaagggcag

SEQ ID NO: 483811 - DNA, 25 bp, Rattus norvegicus
gtagtcagtcaccagtagctgttca

SEQ ID NO: 483812 - DNA, 25 bp, Rattus norvegicus
gtagtcagtcacgagtagctgttca

SEQ ID NO: 483813 - DNA, 25 bp, Rattus norvegicus
gtagtcagtcactcaccaagggcag

SEQ ID NO: 483814 - DNA, 25 bp, Rattus norvegicus
gtagtcagtgcgagtcagggccact

SEQ ID NO: 483815 - DNA, 25 bp, Rattus norvegicus
gtagtcagtgcgtgtcagggccact

SEQ ID NO: 483816 - DNA, 25 bp, Rattus norvegicus
gtagtcagtgtgagttcatcatccg

SEQ ID NO: 483817 - DNA, 25 bp, Rattus norvegicus
gtagtcagtgtgtgttcatcatccg

SEQ ID NO: 483818 - DNA, 25 bp, Rattus norvegicus
gtagtcataaacatattactggtga

SEQ ID NO: 483819 - DNA, 25 bp, Rattus norvegicus
gtagtcataaacttattactggtga

SEQ ID NO: 483820 - DNA, 25 bp, Rattus norvegicus
gtagtcatagaaatggcccagctca

SEQ ID NO: 483821 - DNA, 25 bp, Rattus norvegicus
gtagtcatagaattggcccagctca

SEQ ID NO: 483822 - DNA, 25 bp, Rattus norvegicus
gtagtcatatatctcgaggtttctc

SEQ ID NO: 483823 - DNA, 25 bp, Rattus norvegicus
gtagtcatatatgtcgaggtttctc

SEQ ID NO: 483824 - DNA, 25 bp, Rattus norvegicus
gtagtcatccatagcttttcattgt

SEQ ID NO: 483825 - DNA, 25 bp, Rattus norvegicus
gtagtcatccattgcttttcattgt

SEQ ID NO: 483826 - DNA, 25 bp, Rattus norvegicus
gtagtcatctgcctagctctgggtt

SEQ ID NO: 483827 - DNA, 25 bp, Rattus norvegicus
gtagtcatctgcgtagctctgggtt

SEQ ID NO: 483828 - DNA, 25 bp, Rattus norvegicus
gtagtcattgcccttttctgacctc

SEQ ID NO: 483829 - DNA, 25 bp, Rattus norvegicus
gtagtcattgccgttttctgacctc

SEQ ID NO: 483830 - DNA, 25 bp, Rattus norvegicus
gtagtcattgtaccctttatctccg

SEQ ID NO: 483831 - DNA, 25 bp, Rattus norvegicus
gtagtcattgtagcctttatctccg

SEQ ID NO: 483832 - DNA, 25 bp, Rattus norvegicus
gtagtccaatcacagctactctatt

SEQ ID NO: 483833 - DNA, 25 bp, Rattus norvegicus
gtagtccaatcagagctactctatt

SEQ ID NO: 483834 - DNA, 25 bp, Rattus norvegicus
gtagtccacactaactgtgtctcaa

SEQ ID NO: 483835 - DNA, 25 bp, Rattus norvegicus
gtagtccacacttactgtgtctcaa

SEQ ID NO: 483836 - DNA, 25 bp, Rattus norvegicus
gtagtccagtccagcctcaggttta

SEQ ID NO: 483837 - DNA, 25 bp, Rattus norvegicus
gtagtccagtcctgcctcaggttta

SEQ ID NO: 483838 - DNA, 25 bp, Rattus norvegicus
gtagtccatagaaccgtcagaccgt

SEQ ID NO: 483839 - DNA, 25 bp, Rattus norvegicus
gtagtccatagatccgtcagaccgt

SEQ ID NO: 483840 - DNA, 25 bp, Rattus norvegicus
gtagtccataggaccatcttagcaa

SEQ ID NO: 483841 - DNA, 25 bp, Rattus norvegicus
gtagtccataggtccatcttagcaa

SEQ ID NO: 483842 - DNA, 25 bp, Rattus norvegicus
gtagtccatcaacggtttccaaaca

SEQ ID NO: 483843 - DNA, 25 bp, Rattus norvegicus
gtagtccatcaagggtttccaaaca

SEQ ID NO: 483844 - DNA, 25 bp, Rattus norvegicus
gtagtcccagtacccatgtagctga

SEQ ID NO: 483845 - DNA, 25 bp, Rattus norvegicus
gtagtcccagtagccatgtagctga

SEQ ID NO: 483846 - DNA, 25 bp, Rattus norvegicus
gtagtcccttatagcacacatgcac

SEQ ID NO: 483847 - DNA, 25 bp, Rattus norvegicus
gtagtcccttattgcacacatgcac

SEQ ID NO: 483848 - DNA, 25 bp, Rattus norvegicus
gtagtcccttcaaagctttgttaca

SEQ ID NO: 483849 - DNA, 25 bp, Rattus norvegicus
gtagtcccttcatagctttgttaca

SEQ ID NO: 483850 - DNA, 25 bp, Rattus norvegicus
gtagtcccttggctgttacagttga

SEQ ID NO: 483851 - DNA, 25 bp, Rattus norvegicus
gtagtcccttgggtgttacagttga

SEQ ID NO: 483852 - DNA, 25 bp, Rattus norvegicus
gtagtcctaacaccaggtagtcagt

SEQ ID NO: 483853 - DNA, 25 bp, Rattus norvegicus
gtagtcctaacagcaggtagtcagt

SEQ ID NO: 483854 - DNA, 25 bp, Rattus norvegicus
gtagtcctagcaaagtcgggtgcca

SEQ ID NO: 483855 - DNA, 25 bp, Rattus norvegicus
gtagtcctagcatagtcgggtgcca

SEQ ID NO: 483856 - DNA, 25 bp, Rattus norvegicus
gtagtcctcactcaattcttgcgaa

SEQ ID NO: 483857 - DNA, 25 bp, Rattus norvegicus
gtagtcctcactgaattcttgcgaa

SEQ ID NO: 483858 - DNA, 25 bp, Rattus norvegicus
gtagtcctcagacacatgcgagcac

SEQ ID NO: 483859 - DNA, 25 bp, Rattus norvegicus
gtagtcctcagagacatgcgagcac

SEQ ID NO: 483860 - DNA, 25 bp, Rattus norvegicus
gtagtcctcagccatgtgtgccatg

SEQ ID NO: 483861 - DNA, 25 bp, Rattus norvegicus
gtagtcctcagcgatgtgtgccatg

SEQ ID NO: 483862 - DNA, 25 bp, Rattus norvegicus
gtagtcctggagaagacctttgctg

SEQ ID NO: 483863 - DNA, 25 bp, Rattus norvegicus
gtagtcctggagtagacctttgctg

SEQ ID NO: 483864 - DNA, 25 bp, Rattus norvegicus
gtagtcctgggacctcaaaatcatc

SEQ ID NO: 483865 - DNA, 25 bp, Rattus norvegicus
gtagtcctgggagctcaaaatcatc

SEQ ID NO: 483866 - DNA, 25 bp, Rattus norvegicus
gtagtccttaaaattcacccatgaa

SEQ ID NO: 483867 - DNA, 25 bp, Rattus norvegicus
gtagtccttaaatttcacccatgaa

SEQ ID NO: 483868 - DNA, 25 bp, Rattus norvegicus
gtagtccttatgcaagagttgcact

SEQ ID NO: 483869 - DNA, 25 bp, Rattus norvegicus
gtagtccttatggaagagttgcact

SEQ ID NO: 483870 - DNA, 25 bp, Rattus norvegicus
gtagtcgaggcgctctgacaccgta

SEQ ID NO: 483871 - DNA, 25 bp, Rattus norvegicus
gtagtcgaggcggtctgacaccgta

SEQ ID NO: 483872 - DNA, 25 bp, Rattus norvegicus
gtagtcgcaatcattccaaagcctt

SEQ ID NO: 483873 - DNA, 25 bp, Rattus norvegicus
gtagtcgcaatctttccaaagcctt

SEQ ID NO: 483874 - DNA, 25 bp, Rattus norvegicus
gtagtcgcagttcatacaagggaca

SEQ ID NO: 483875 - DNA, 25 bp, Rattus norvegicus
gtagtcgcagttgatacaagggaca

SEQ ID NO: 483876 - DNA, 25 bp, Rattus norvegicus
gtagtcgcatgtatggacctccata

SEQ ID NO: 483877 - DNA, 25 bp, Rattus norvegicus
gtagtcgcatgtttggacctccata

SEQ ID NO: 483878 - DNA, 25 bp, Rattus norvegicus
gtagtcgcttggaccctgatgaaaa

SEQ ID NO: 483879 - DNA, 25 bp, Rattus norvegicus
gtagtcgcttggtccctgatgaaaa

SEQ ID NO: 483880 - DNA, 25 bp, Rattus norvegicus
gtagtcggcgtccatgttgactgac

SEQ ID NO: 483881 - DNA, 25 bp, Rattus norvegicus
gtagtcggcgtcgatgttgactgac

SEQ ID NO: 483882 - DNA, 25 bp, Rattus norvegicus
gtagtcggctatagtcttggctcac

SEQ ID NO: 483883 - DNA, 25 bp, Rattus norvegicus
gtagtcggctattgtcttggctcac

SEQ ID NO: 483884 - DNA, 25 bp, Rattus norvegicus
gtagtcgtcacacacgcgcagcagc

SEQ ID NO: 483885 - DNA, 25 bp, Rattus norvegicus
gtagtcgtcacagacgcgcagcagc

SEQ ID NO: 483886 - DNA, 25 bp, Rattus norvegicus
gtagtcgtgcttctgattaatctga

SEQ ID NO: 483887 - DNA, 25 bp, Rattus norvegicus
gtagtcgtgcttgtgattaatctga

SEQ ID NO: 483888 - DNA, 25 bp, Rattus norvegicus
gtagtcgttctaatggtgactctca

SEQ ID NO: 483889 - DNA, 25 bp, Rattus norvegicus
gtagtcgttctattggtgactctca

SEQ ID NO: 483890 - DNA, 25 bp, Rattus norvegicus
gtagtcgtttatatgcgctctttat

SEQ ID NO: 483891 - DNA, 25 bp, Rattus norvegicus
gtagtcgtttatttgcgctctttat

SEQ ID NO: 483892 - DNA, 25 bp, Rattus norvegicus
gtagtctaaatgaccatgagcctgg

SEQ ID NO: 483893 - DNA, 25 bp, Rattus norvegicus
gtagtctaaatgtccatgagcctgg

SEQ ID NO: 483894 - DNA, 25 bp, Rattus norvegicus
gtagtctaacatcgcaatggtgtca

SEQ ID NO: 483895 - DNA, 25 bp, Rattus norvegicus
gtagtctaacatggcaatggtgtca

SEQ ID NO: 483896 - DNA, 25 bp, Rattus norvegicus
gtagtctaacccctcaactggacag

SEQ ID NO: 483897 - DNA, 25 bp, Rattus norvegicus
gtagtctaacccgtcaactggacag

SEQ ID NO: 483898 - DNA, 25 bp, Rattus norvegicus
gtagtctaccaacgagtcatgacat

SEQ ID NO: 483899 - DNA, 25 bp, Rattus norvegicus
gtagtctaccaaggagtcatgacat

SEQ ID NO: 483900 - DNA, 25 bp, Rattus norvegicus
gtagtctactatattgctggcacct

SEQ ID NO: 483901 - DNA, 25 bp, Rattus norvegicus
gtagtctactattttgctggcacct

SEQ ID NO: 483902 - DNA, 25 bp, Rattus norvegicus
gtagtctactcgcacagacaccatc

SEQ ID NO: 483903 - DNA, 25 bp, Rattus norvegicus
gtagtctactcggacagacaccatc

SEQ ID NO: 483904 - DNA, 25 bp, Rattus norvegicus
gtagtctaggttagacctcgtccca

SEQ ID NO: 483905 - DNA, 25 bp, Rattus norvegicus
gtagtctaggtttgacctcgtccca

SEQ ID NO: 483906 - DNA, 25 bp, Rattus norvegicus
gtagtctagtgtaatccctggaatt

SEQ ID NO: 483907 - DNA, 25 bp, Rattus norvegicus
gtagtctagtgttatccctggaatt

SEQ ID NO: 483908 - DNA, 25 bp, Rattus norvegicus
gtagtctcagcacttaagagtctgt

SEQ ID NO: 483909 - DNA, 25 bp, Rattus norvegicus
gtagtctcagcagttaagagtctgt

SEQ ID NO: 483910 - DNA, 25 bp, Rattus norvegicus
gtagtctcagtgatcaggaggaatt

SEQ ID NO: 483911 - DNA, 25 bp, Rattus norvegicus
gtagtctcagtgttcaggaggaatt

SEQ ID NO: 483912 - DNA, 25 bp, Rattus norvegicus
gtagtctcatctccatctgtaggaa

SEQ ID NO: 483913 - DNA, 25 bp, Rattus norvegicus
gtagtctcatctgcatctgtaggaa

SEQ ID NO: 483914 - DNA, 25 bp, Rattus norvegicus
gtagtctcatgtagtatgtgtatgc

SEQ ID NO: 483915 - DNA, 25 bp, Rattus norvegicus
gtagtctcatgttgtatgtgtatgc

SEQ ID NO: 483916 - DNA, 25 bp, Rattus norvegicus
gtagtctccagtcagctagcgcaca

SEQ ID NO: 483917 - DNA, 25 bp, Rattus norvegicus
gtagtctccagtgagctagcgcaca

SEQ ID NO: 483918 - DNA, 25 bp, Rattus norvegicus
gtagtctcctccagagctgtaactg

SEQ ID NO: 483919 - DNA, 25 bp, Rattus norvegicus
gtagtctcctcctgagctgtaactg

SEQ ID NO: 483920 - DNA, 25 bp, Rattus norvegicus
gtagtctcgtgtagtctcattttct

SEQ ID NO: 483921 - DNA, 25 bp, Rattus norvegicus
gtagtctcgtgttgtctcattttct

SEQ ID NO: 483922 - DNA, 25 bp, Rattus norvegicus
gtagtctctaagcacatgatgaatg

SEQ ID NO: 483923 - DNA, 25 bp, Rattus norvegicus
gtagtctctaaggacatgatgaatg

SEQ ID NO: 483924 - DNA, 25 bp, Rattus norvegicus
gtagtctctatgacattttccttga

SEQ ID NO: 483925 - DNA, 25 bp, Rattus norvegicus
gtagtctctatgtcattttccttga

SEQ ID NO: 483926 - DNA, 25 bp, Rattus norvegicus
gtagtctctggtacacaattctgca

SEQ ID NO: 483927 - DNA, 25 bp, Rattus norvegicus
gtagtctctggttcacaattctgca

SEQ ID NO: 483928 - DNA, 25 bp, Rattus norvegicus
gtagtctcttaactgctcctgtttt

SEQ ID NO: 483929 - DNA, 25 bp, Rattus norvegicus
gtagtctcttaagtgctcctgtttt

SEQ ID NO: 483930 - DNA, 25 bp, Rattus norvegicus
gtagtctcttcactttgtccataga

SEQ ID NO: 483931 - DNA, 25 bp, Rattus norvegicus
gtagtctcttcagtttgtccataga

SEQ ID NO: 483932 - DNA, 25 bp, Rattus norvegicus
gtagtctcttgtacatactgttcaa

SEQ ID NO: 483933 - DNA, 25 bp, Rattus norvegicus
gtagtctcttgttcatactgttcaa

SEQ ID NO: 483934 - DNA, 25 bp, Rattus norvegicus
gtagtctgaactaagctgagcaaac

SEQ ID NO: 483935 - DNA, 25 bp, Rattus norvegicus
gtagtctgaacttagctgagcaaac

SEQ ID NO: 483936 - DNA, 25 bp, Rattus norvegicus
gtagtctgacttcacctcaaacttg

SEQ ID NO: 483937 - DNA, 25 bp, Rattus norvegicus
gtagtctgacttgacctcaaacttg

SEQ ID NO: 483938 - DNA, 25 bp, Rattus norvegicus
gtagtctgagttaggtctgggcttt

SEQ ID NO: 483939 - DNA, 25 bp, Rattus norvegicus
gtagtctgagtttggtctgggcttt

SEQ ID NO: 483940 - DNA, 25 bp, Rattus norvegicus
gtagtctgatcaacatttgtccttc

SEQ ID NO: 483941 - DNA, 25 bp, Rattus norvegicus
gtagtctgatcatcatttgtccttc

SEQ ID NO: 483942 - DNA, 25 bp, Rattus norvegicus
gtagtctgcaccaaacatcttcatt

SEQ ID NO: 483943 - DNA, 25 bp, Rattus norvegicus
gtagtctgcacctaacatcttcatt

SEQ ID NO: 483944 - DNA, 25 bp, Rattus norvegicus
gtagtctgcagaccagtgtatttca

SEQ ID NO: 483945 - DNA, 25 bp, Rattus norvegicus
gtagtctgcagacttcactatgcat

SEQ ID NO: 483946 - DNA, 25 bp, Rattus norvegicus
gtagtctgcagagcagtgtatttca

SEQ ID NO: 483947 - DNA, 25 bp, Rattus norvegicus
gtagtctgcagagttcactatgcat

SEQ ID NO: 483948 - DNA, 25 bp, Rattus norvegicus
gtagtctggacgaactgcatatcct

SEQ ID NO: 483949 - DNA, 25 bp, Rattus norvegicus
gtagtctggacgtactgcatatcct

SEQ ID NO: 483950 - DNA, 25 bp, Rattus norvegicus
gtagtcttaggtatgcttcccttga

SEQ ID NO: 483951 - DNA, 25 bp, Rattus norvegicus
gtagtcttaggtttgcttcccttga

SEQ ID NO: 483952 - DNA, 25 bp, Rattus norvegicus
gtagtcttcaccatgattggcctag

SEQ ID NO: 483953 - DNA, 25 bp, Rattus norvegicus
gtagtcttcaccttgattggcctag

SEQ ID NO: 483954 - DNA, 25 bp, Rattus norvegicus
gtagtcttcccaacatttaatccaa

SEQ ID NO: 483955 - DNA, 25 bp, Rattus norvegicus
gtagtcttcccatcatttaatccaa

SEQ ID NO: 483956 - DNA, 25 bp, Rattus norvegicus
gtagtcttctgaccaagccttactt

SEQ ID NO: 483957 - DNA, 25 bp, Rattus norvegicus
gtagtcttctgagcaagccttactt

SEQ ID NO: 483958 - DNA, 25 bp, Rattus norvegicus
gtagtcttgatgcaccagaatcagg

SEQ ID NO: 483959 - DNA, 25 bp, Rattus norvegicus
gtagtcttgatggaccagaatcagg

SEQ ID NO: 483960 - DNA, 25 bp, Rattus norvegicus
gtagtcttgctgacatctcaggtaa

SEQ ID NO: 483961 - DNA, 25 bp, Rattus norvegicus
gtagtcttgctgtcatctcaggtaa

SEQ ID NO: 483962 - DNA, 25 bp, Rattus norvegicus
gtagtcttgcttaagtatttcccat

SEQ ID NO: 483963 - DNA, 25 bp, Rattus norvegicus
gtagtcttgctttagtatttcccat

SEQ ID NO: 483964 - DNA, 25 bp, Rattus norvegicus
gtagtcttggccataccgattatta

SEQ ID NO: 483965 - DNA, 25 bp, Rattus norvegicus
gtagtcttggccttaccgattatta

SEQ ID NO: 483966 - DNA, 25 bp, Rattus norvegicus
gtagtcttggtcaactgtgctctga

SEQ ID NO: 483967 - DNA, 25 bp, Rattus norvegicus
gtagtcttggtctactgtgctctga

SEQ ID NO: 483968 - DNA, 25 bp, Rattus norvegicus
gtagtcttggtgagtctccatccag

SEQ ID NO: 483969 - DNA, 25 bp, Rattus norvegicus
gtagtcttggtgtgtctccatccag

SEQ ID NO: 483970 - DNA, 25 bp, Rattus norvegicus
gtagtctttaaaaaccactcaaact

SEQ ID NO: 483971 - DNA, 25 bp, Rattus norvegicus
gtagtctttaaataccactcaaact

SEQ ID NO: 483972 - DNA, 25 bp, Rattus norvegicus
gtagtctttctcctgatttagccaa

SEQ ID NO: 483973 - DNA, 25 bp, Rattus norvegicus
gtagtctttctcgtgatttagccaa

SEQ ID NO: 483974 - DNA, 25 bp, Rattus norvegicus
gtagtctttgctatttctggacagg

SEQ ID NO: 483975 - DNA, 25 bp, Rattus norvegicus
gtagtctttgctttttctggacagg

SEQ ID NO: 483976 - DNA, 25 bp, Rattus norvegicus
gtagtctttggtcagtagctttatt

SEQ ID NO: 483977 - DNA, 25 bp, Rattus norvegicus
gtagtctttggtgagtagctttatt

SEQ ID NO: 483978 - DNA, 25 bp, Rattus norvegicus
gtagtctttgtaaagccccaacaat

SEQ ID NO: 483979 - DNA, 25 bp, Rattus norvegicus
gtagtctttgtatagccccaacaat

SEQ ID NO: 483980 - DNA, 25 bp, Rattus norvegicus
gtagtcttttcaattacttaattca

SEQ ID NO: 483981 - DNA, 25 bp, Rattus norvegicus
gtagtcttttcatttacttaattca

SEQ ID NO: 483982 - DNA, 25 bp, Rattus norvegicus
gtagtctttttcacatgctcctgaa

SEQ ID NO: 483983 - DNA, 25 bp, Rattus norvegicus
gtagtctttttccttcaaatttctg

SEQ ID NO: 483984 - DNA, 25 bp, Rattus norvegicus
gtagtctttttccttttcactgaga

SEQ ID NO: 483985 - DNA, 25 bp, Rattus norvegicus
gtagtctttttcgttcaaatttctg

SEQ ID NO: 483986 - DNA, 25 bp, Rattus norvegicus
gtagtctttttcgttttcactgaga

SEQ ID NO: 483987 - DNA, 25 bp, Rattus norvegicus
gtagtctttttctcatgctcctgaa

SEQ ID NO: 483988 - DNA, 25 bp, Rattus norvegicus
gtagtgaacccaagcctagtgaagt

SEQ ID NO: 483989 - DNA, 25 bp, Rattus norvegicus
gtagtgaacccatgcctagtgaagt

SEQ ID NO: 483990 - DNA, 25 bp, Rattus norvegicus
gtagtgaacctaccccattagaaga

SEQ ID NO: 483991 - DNA, 25 bp, Rattus norvegicus
gtagtgaacctagcccattagaaga

SEQ ID NO: 483992 - DNA, 25 bp, Rattus norvegicus
gtagtgaacgtcaccctgtgggtct

SEQ ID NO: 483993 - DNA, 25 bp, Rattus norvegicus
gtagtgaacgtctccctgtgggtct

SEQ ID NO: 483994 - DNA, 25 bp, Rattus norvegicus
gtagtgaagccacatgctccgttaa

SEQ ID NO: 483995 - DNA, 25 bp, Rattus norvegicus
gtagtgaagccagatgctccgttaa

SEQ ID NO: 483996 - DNA, 25 bp, Rattus norvegicus
gtagtgaatcctagctgcacttgca

SEQ ID NO: 483997 - DNA, 25 bp, Rattus norvegicus
gtagtgaatccttgctgcacttgca

SEQ ID NO: 483998 - DNA, 25 bp, Rattus norvegicus
gtagtgaatgcccagttttgtgttt

SEQ ID NO: 483999 - DNA, 25 bp, Rattus norvegicus
gtagtgaatgccgagttttgtgttt

SEQ ID NO: 484000 - DNA, 25 bp, Rattus norvegicus
gtagtgacatctccataagacttgt

SEQ ID NO: 484001 - DNA, 25 bp, Rattus norvegicus
gtagtgacatctgcataagacttgt

SEQ ID NO: 484002 - DNA, 25 bp, Rattus norvegicus
gtagtgacattgcacacaggtttgt

SEQ ID NO: 484003 - DNA, 25 bp, Rattus norvegicus
gtagtgacattggacacaggtttgt

SEQ ID NO: 484004 - DNA, 25 bp, Rattus norvegicus
gtagtgaccaggcacacataggcaa

SEQ ID NO: 484005 - DNA, 25 bp, Rattus norvegicus
gtagtgaccagggacacataggcaa

SEQ ID NO: 484006 - DNA, 25 bp, Rattus norvegicus
gtagtgacccagatgttttcgtagt

SEQ ID NO: 484007 - DNA, 25 bp, Rattus norvegicus
gtagtgacccagttgttttcgtagt

SEQ ID NO: 484008 - DNA, 25 bp, Rattus norvegicus
gtagtgactcagctcatcacaccat

SEQ ID NO: 484009 - DNA, 25 bp, Rattus norvegicus
gtagtgactcaggtcatcacaccat

SEQ ID NO: 484010 - DNA, 25 bp, Rattus norvegicus
gtagtgacttcaatctgccaataaa

SEQ ID NO: 484011 - DNA, 25 bp, Rattus norvegicus
gtagtgacttcattctgccaataaa

SEQ ID NO: 484012 - DNA, 25 bp, Rattus norvegicus
gtagtgagatatctcccagctcatg

SEQ ID NO: 484013 - DNA, 25 bp, Rattus norvegicus
gtagtgagatatgtcccagctcatg

SEQ ID NO: 484014 - DNA, 25 bp, Rattus norvegicus
gtagtgagcctgacgtgactttcaa

SEQ ID NO: 484015 - DNA, 25 bp, Rattus norvegicus
gtagtgagcctgtcgtgactttcaa

SEQ ID NO: 484016 - DNA, 25 bp, Rattus norvegicus
gtagtgaggtatcccgccatgacga

SEQ ID NO: 484017 - DNA, 25 bp, Rattus norvegicus
gtagtgaggtatgccgccatgacga

SEQ ID NO: 484018 - DNA, 25 bp, Rattus norvegicus
gtagtgagtcacaaaaggttttctt

SEQ ID NO: 484019 - DNA, 25 bp, Rattus norvegicus
gtagtgagtcactaaaggttttctt

SEQ ID NO: 484020 - DNA, 25 bp, Rattus norvegicus
gtagtgatataaataaccagccatt

SEQ ID NO: 484021 - DNA, 25 bp, Rattus norvegicus
gtagtgatataattaaccagccatt

SEQ ID NO: 484022 - DNA, 25 bp, Rattus norvegicus
gtagtgatatgtccctgtagcctga

SEQ ID NO: 484023 - DNA, 25 bp, Rattus norvegicus
gtagtgatatgtgcctgtagcctga

SEQ ID NO: 484024 - DNA, 25 bp, Rattus norvegicus
gtagtgcacatacttcagctggcaa

SEQ ID NO: 484025 - DNA, 25 bp, Rattus norvegicus
gtagtgcacatagttcagctggcaa

SEQ ID NO: 484026 - DNA, 25 bp, Rattus norvegicus
gtagtgcactttaattacccattat

SEQ ID NO: 484027 - DNA, 25 bp, Rattus norvegicus
gtagtgcacttttattacccattat

SEQ ID NO: 484028 - DNA, 25 bp, Rattus norvegicus
gtagtgcagccaagaagacccacct

SEQ ID NO: 484029 - DNA, 25 bp, Rattus norvegicus
gtagtgcagccatgaagacccacct

SEQ ID NO: 484030 - DNA, 25 bp, Rattus norvegicus
gtagtgcatcacagagagccaacat

SEQ ID NO: 484031 - DNA, 25 bp, Rattus norvegicus
gtagtgcatcactgagagccaacat

SEQ ID NO: 484032 - DNA, 25 bp, Rattus norvegicus
gtagtgcatgcaaatctgtaatccc

SEQ ID NO: 484033 - DNA, 25 bp, Rattus norvegicus
gtagtgcatgcatatctgtaatccc

SEQ ID NO: 484034 - DNA, 25 bp, Rattus norvegicus
gtagtgcatgccatcagtctcagca

SEQ ID NO: 484035 - DNA, 25 bp, Rattus norvegicus
gtagtgcatgccttcagtctcagca

SEQ ID NO: 484036 - DNA, 25 bp, Rattus norvegicus
gtagtgcatggcagtttccaggtcc

SEQ ID NO: 484037 - DNA, 25 bp, Rattus norvegicus
gtagtgcatggctgtttccaggtcc

SEQ ID NO: 484038 - DNA, 25 bp, Rattus norvegicus
gtagtgccaacaccttggcttgata

SEQ ID NO: 484039 - DNA, 25 bp, Rattus norvegicus
gtagtgccaacagcttggcttgata

SEQ ID NO: 484040 - DNA, 25 bp, Rattus norvegicus
gtagtgccagttcttggttttctta

SEQ ID NO: 484041 - DNA, 25 bp, Rattus norvegicus
gtagtgccagttgttggttttctta

SEQ ID NO: 484042 - DNA, 25 bp, Rattus norvegicus
gtagtgccatagactgcagcagtga

SEQ ID NO: 484043 - DNA, 25 bp, Rattus norvegicus
gtagtgccatagtctgcagcagtga

SEQ ID NO: 484044 - DNA, 25 bp, Rattus norvegicus
gtagtgcccacccaggctcttaggg

SEQ ID NO: 484045 - DNA, 25 bp, Rattus norvegicus
gtagtgcccaccgaggctcttaggg

SEQ ID NO: 484046 - DNA, 25 bp, Rattus norvegicus
gtagtgcccataccctagtgcagaa

SEQ ID NO: 484047 - DNA, 25 bp, Rattus norvegicus
gtagtgcccatagcctagtgcagaa

SEQ ID NO: 484048 - DNA, 25 bp, Rattus norvegicus
gtagtgcccgagagtctgagcagaa

SEQ ID NO: 484049 - DNA, 25 bp, Rattus norvegicus
gtagtgcccgagtgtctgagcagaa

SEQ ID NO: 484050 - DNA, 25 bp, Rattus norvegicus
gtagtgcccgccattatttgtaata

SEQ ID NO: 484051 - DNA, 25 bp, Rattus norvegicus
gtagtgcccgcctttatttgtaata

SEQ ID NO: 484052 - DNA, 25 bp, Rattus norvegicus
gtagtgccctctctttgcaaaaaca

SEQ ID NO: 484053 - DNA, 25 bp, Rattus norvegicus
gtagtgccctctgtttgcaaaaaca

SEQ ID NO: 484054 - DNA, 25 bp, Rattus norvegicus
gtagtgccgtgaatcaactcctgag

SEQ ID NO: 484055 - DNA, 25 bp, Rattus norvegicus
gtagtgccgtgattcaactcctgag

SEQ ID NO: 484056 - DNA, 25 bp, Rattus norvegicus
gtagtgcctgacctttaccaatagt

SEQ ID NO: 484057 - DNA, 25 bp, Rattus norvegicus
gtagtgcctgacgtttaccaatagt

SEQ ID NO: 484058 - DNA, 25 bp, Rattus norvegicus
gtagtgccttggacctggacaaaaa

SEQ ID NO: 484059 - DNA, 25 bp, Rattus norvegicus
gtagtgccttggtcctggacaaaaa

SEQ ID NO: 484060 - DNA, 25 bp, Rattus norvegicus
gtagtgcggtgtactgatgtaactt

SEQ ID NO: 484061 - DNA, 25 bp, Rattus norvegicus
gtagtgcggtgttctgatgtaactt

SEQ ID NO: 484062 - DNA, 25 bp, Rattus norvegicus
gtagtgctagagattcccaagatca

SEQ ID NO: 484063 - DNA, 25 bp, Rattus norvegicus
gtagtgctagagtttcccaagatca

SEQ ID NO: 484064 - DNA, 25 bp, Rattus norvegicus
gtagtgctagctacgctgcgcgaat

SEQ ID NO: 484065 - DNA, 25 bp, Rattus norvegicus
gtagtgctagcttcgctgcgcgaat

SEQ ID NO: 484066 - DNA, 25 bp, Rattus norvegicus
gtagtgctcacacgctcacagaggg

SEQ ID NO: 484067 - DNA, 25 bp, Rattus norvegicus
gtagtgctcacaggctcacagaggg

SEQ ID NO: 484068 - DNA, 25 bp, Rattus norvegicus
gtagtgctcactaagctttgagtgt

SEQ ID NO: 484069 - DNA, 25 bp, Rattus norvegicus
gtagtgctcacttagctttgagtgt

SEQ ID NO: 484070 - DNA, 25 bp, Rattus norvegicus
gtagtgctcttcaaagccatcatcc

SEQ ID NO: 484071 - DNA, 25 bp, Rattus norvegicus
gtagtgctcttctaagccatcatcc

SEQ ID NO: 484072 - DNA, 25 bp, Rattus norvegicus
gtagtgctcttgatgctcctgtgtc

SEQ ID NO: 484073 - DNA, 25 bp, Rattus norvegicus
gtagtgctcttgttgctcctgtgtc

SEQ ID NO: 484074 - DNA, 25 bp, Rattus norvegicus
gtagtgctgaaaccccggtaggaaa

SEQ ID NO: 484075 - DNA, 25 bp, Rattus norvegicus
gtagtgctgaaagcccggtaggaaa

SEQ ID NO: 484076 - DNA, 25 bp, Rattus norvegicus
gtagtgctgactagtctactgttat

SEQ ID NO: 484077 - DNA, 25 bp, Rattus norvegicus
gtagtgctgacttgtctactgttat

SEQ ID NO: 484078 - DNA, 25 bp, Rattus norvegicus
gtagtgctgatcctgtgcataagaa

SEQ ID NO: 484079 - DNA, 25 bp, Rattus norvegicus
gtagtgctgatcgtgtgcataagaa

SEQ ID NO: 484080 - DNA, 25 bp, Rattus norvegicus
gtagtgctgctgattggaaggttct

SEQ ID NO: 484081 - DNA, 25 bp, Rattus norvegicus
gtagtgctgctgtttggaaggttct

SEQ ID NO: 484082 - DNA, 25 bp, Rattus norvegicus
gtagtgctgtgtctactgtggatac

SEQ ID NO: 484083 - DNA, 25 bp, Rattus norvegicus
gtagtgctgtgtgtactgtggatac

SEQ ID NO: 484084 - DNA, 25 bp, Rattus norvegicus
gtagtgcttaagagccagacccaaa

SEQ ID NO: 484085 - DNA, 25 bp, Rattus norvegicus
gtagtgcttaagtgccagacccaaa

SEQ ID NO: 484086 - DNA, 25 bp, Rattus norvegicus
gtagtgcttcccagagcattcagtc

SEQ ID NO: 484087 - DNA, 25 bp, Rattus norvegicus
gtagtgcttccctgagcattcagtc

SEQ ID NO: 484088 - DNA, 25 bp, Rattus norvegicus
gtagtgcttgttactaaggcttctg

SEQ ID NO: 484089 - DNA, 25 bp, Rattus norvegicus
gtagtgcttgtttctaaggcttctg

SEQ ID NO: 484090 - DNA, 25 bp, Rattus norvegicus
gtagtggaaattctgcaatctgaaa

SEQ ID NO: 484091 - DNA, 25 bp, Rattus norvegicus
gtagtggaaattgtgcaatctgaaa

SEQ ID NO: 484092 - DNA, 25 bp, Rattus norvegicus
gtagtggaacacatgcccagtaagt

SEQ ID NO: 484093 - DNA, 25 bp, Rattus norvegicus
gtagtggaacacttgcccagtaagt

SEQ ID NO: 484094 - DNA, 25 bp, Rattus norvegicus
gtagtggaagcaattcacgccgtgt

SEQ ID NO: 484095 - DNA, 25 bp, Rattus norvegicus
gtagtggaagcatttcacgccgtgt

SEQ ID NO: 484096 - DNA, 25 bp, Rattus norvegicus
gtagtggaattccttttcttgaaag

SEQ ID NO: 484097 - DNA, 25 bp, Rattus norvegicus
gtagtggaattcgttttcttgaaag

SEQ ID NO: 484098 - DNA, 25 bp, Rattus norvegicus
gtagtggacagcattggccaccaag

SEQ ID NO: 484099 - DNA, 25 bp, Rattus norvegicus
gtagtggacagctttggccaccaag

SEQ ID NO: 484100 - DNA, 25 bp, Rattus norvegicus
gtagtggatgatacctctccaacct

SEQ ID NO: 484101 - DNA, 25 bp, Rattus norvegicus
gtagtggatgattcctctccaacct

SEQ ID NO: 484102 - DNA, 25 bp, Rattus norvegicus
gtagtggattatctccaacgttctc

SEQ ID NO: 484103 - DNA, 25 bp, Rattus norvegicus
gtagtggattatgtccaacgttctc

SEQ ID NO: 484104 - DNA, 25 bp, Rattus norvegicus
gtagtggattgccttgtgcgtcttc

SEQ ID NO: 484105 - DNA, 25 bp, Rattus norvegicus
gtagtggattgcgttgtgcgtcttc

SEQ ID NO: 484106 - DNA, 25 bp, Rattus norvegicus
gtagtggcacacagctttgacaatg

SEQ ID NO: 484107 - DNA, 25 bp, Rattus norvegicus
gtagtggcacactgctttgacaatg

SEQ ID NO: 484108 - DNA, 25 bp, Rattus norvegicus
gtagtggcagcaacagcagccttgt

SEQ ID NO: 484109 - DNA, 25 bp, Rattus norvegicus
gtagtggcagcatcagcagccttgt

SEQ ID NO: 484110 - DNA, 25 bp, Rattus norvegicus
gtagtggctctcacacagtcaaaaa

SEQ ID NO: 484111 - DNA, 25 bp, Rattus norvegicus
gtagtggctctctcacagtcaaaaa

SEQ ID NO: 484112 - DNA, 25 bp, Rattus norvegicus
gtagtggctgctccactgatgtgaa

SEQ ID NO: 484113 - DNA, 25 bp, Rattus norvegicus
gtagtggctgctgcactgatgtgaa

SEQ ID NO: 484114 - DNA, 25 bp, Rattus norvegicus
gtagtgggaataaaccttcttaggt

SEQ ID NO: 484115 - DNA, 25 bp, Rattus norvegicus
gtagtgggaatataccttcttaggt

SEQ ID NO: 484116 - DNA, 25 bp, Rattus norvegicus
gtagtggtaatcagttttatctttc

SEQ ID NO: 484117 - DNA, 25 bp, Rattus norvegicus
gtagtggtaatctgttttatctttc

SEQ ID NO: 484118 - DNA, 25 bp, Rattus norvegicus
gtagtggtatgaatgtatgcctgaa

SEQ ID NO: 484119 - DNA, 25 bp, Rattus norvegicus
gtagtggtatgattgtatgcctgaa

SEQ ID NO: 484120 - DNA, 25 bp, Rattus norvegicus
gtagtggtcagcatcatcaacttca

SEQ ID NO: 484121 - DNA, 25 bp, Rattus norvegicus
gtagtggtcagcttcatcaacttca

SEQ ID NO: 484122 - DNA, 25 bp, Rattus norvegicus
gtagtggtgaccaaaccgtacagaa

SEQ ID NO: 484123 - DNA, 25 bp, Rattus norvegicus
gtagtggtgacctaaccgtacagaa

SEQ ID NO: 484124 - DNA, 25 bp, Rattus norvegicus
gtagtggtgctgcataacccgtcgc

SEQ ID NO: 484125 - DNA, 25 bp, Rattus norvegicus
gtagtggtgctggataacccgtcgc

SEQ ID NO: 484126 - DNA, 25 bp, Rattus norvegicus
gtagtggtttgtatctcatccaagc

SEQ ID NO: 484127 - DNA, 25 bp, Rattus norvegicus
gtagtggtttgtttctcatccaagc

SEQ ID NO: 484128 - DNA, 25 bp, Rattus norvegicus
gtagtgtacttcagtactcccagca

SEQ ID NO: 484129 - DNA, 25 bp, Rattus norvegicus
gtagtgtacttctgtactcccagca

SEQ ID NO: 484130 - DNA, 25 bp, Rattus norvegicus
gtagtgtatcgaagactccagtcta

SEQ ID NO: 484131 - DNA, 25 bp, Rattus norvegicus
gtagtgtatcgatgactccagtcta

SEQ ID NO: 484132 - DNA, 25 bp, Rattus norvegicus
gtagtgtatggtcacctcggttcca

SEQ ID NO: 484133 - DNA, 25 bp, Rattus norvegicus
gtagtgtatggtgacctcggttcca

SEQ ID NO: 484134 - DNA, 25 bp, Rattus norvegicus
gtagtgtattcaaggttaccccagt

SEQ ID NO: 484135 - DNA, 25 bp, Rattus norvegicus
gtagtgtattcatggttaccccagt

SEQ ID NO: 484136 - DNA, 25 bp, Rattus norvegicus
gtagtgtcaagcaggcctgagactt

SEQ ID NO: 484137 - DNA, 25 bp, Rattus norvegicus
gtagtgtcaagctggcctgagactt

SEQ ID NO: 484138 - DNA, 25 bp, Rattus norvegicus
gtagtgtcccagcaggcaccagtgt

SEQ ID NO: 484139 - DNA, 25 bp, Rattus norvegicus
gtagtgtcccaggaggcaccagtgt

SEQ ID NO: 484140 - DNA, 25 bp, Rattus norvegicus
gtagtgtccgtcacagagtggagaa

SEQ ID NO: 484141 - DNA, 25 bp, Rattus norvegicus
gtagtgtccgtctcagagtggagaa

SEQ ID NO: 484142 - DNA, 25 bp, Rattus norvegicus
gtagtgtctagaattgcctctgtaa

SEQ ID NO: 484143 - DNA, 25 bp, Rattus norvegicus
gtagtgtctagatttgcctctgtaa

SEQ ID NO: 484144 - DNA, 25 bp, Rattus norvegicus
gtagtgtctcatctaccctaggata

SEQ ID NO: 484145 - DNA, 25 bp, Rattus norvegicus
gtagtgtctcatgtaccctaggata

SEQ ID NO: 484146 - DNA, 25 bp, Rattus norvegicus
gtagtgtctggtatacaactgcatt

SEQ ID NO: 484147 - DNA, 25 bp, Rattus norvegicus
gtagtgtctggtttacaactgcatt

SEQ ID NO: 484148 - DNA, 25 bp, Rattus norvegicus
gtagtgtgatctagtcttacgagac

SEQ ID NO: 484149 - DNA, 25 bp, Rattus norvegicus
gtagtgtgatcttgtcttacgagac

SEQ ID NO: 484150 - DNA, 25 bp, Rattus norvegicus
gtagtgtggaatcggactgccttct

SEQ ID NO: 484151 - DNA, 25 bp, Rattus norvegicus
gtagtgtggaatgggactgccttct

SEQ ID NO: 484152 - DNA, 25 bp, Rattus norvegicus
gtagtgtgtaccacattccacacat

SEQ ID NO: 484153 - DNA, 25 bp, Rattus norvegicus
gtagtgtgtacctcattccacacat

SEQ ID NO: 484154 - DNA, 25 bp, Rattus norvegicus
gtagtgttagataacttattttgat

SEQ ID NO: 484155 - DNA, 25 bp, Rattus norvegicus
gtagtgttagattacttattttgat

SEQ ID NO: 484156 - DNA, 25 bp, Rattus norvegicus
gtagtgttgaagaactccttttctg

SEQ ID NO: 484157 - DNA, 25 bp, Rattus norvegicus
gtagtgttgaagtactccttttctg

SEQ ID NO: 484158 - DNA, 25 bp, Rattus norvegicus
gtagtgttgcatatcaatgtccttt

SEQ ID NO: 484159 - DNA, 25 bp, Rattus norvegicus
gtagtgttgcatttcaatgtccttt

SEQ ID NO: 484160 - DNA, 25 bp, Rattus norvegicus
gtagtgttgggaatgcctcttagca

SEQ ID NO: 484161 - DNA, 25 bp, Rattus norvegicus
gtagtgttgggattgcctcttagca

SEQ ID NO: 484162 - DNA, 25 bp, Rattus norvegicus
gtagtgttgtgtccctgaaattcct

SEQ ID NO: 484163 - DNA, 25 bp, Rattus norvegicus
gtagtgttgtgtgcctgaaattcct

SEQ ID NO: 484164 - DNA, 25 bp, Rattus norvegicus
gtagtgtttgtcaaggtcagtttaa

SEQ ID NO: 484165 - DNA, 25 bp, Rattus norvegicus
gtagtgtttgtctaggtcagtttaa

SEQ ID NO: 484166 - DNA, 25 bp, Rattus norvegicus
gtagtgttttgtatgtcctcttatt

SEQ ID NO: 484167 - DNA, 25 bp, Rattus norvegicus
gtagtgttttgtttgtcctcttatt

SEQ ID NO: 484168 - DNA, 25 bp, Rattus norvegicus
gtagttaactacaaagaagtctgac

SEQ ID NO: 484169 - DNA, 25 bp, Rattus norvegicus
gtagttaactactaagaagtctgac

SEQ ID NO: 484170 - DNA, 25 bp, Rattus norvegicus
gtagttaactgcaattccgtctaag

SEQ ID NO: 484171 - DNA, 25 bp, Rattus norvegicus
gtagttaactgctattccgtctaag

SEQ ID NO: 484172 - DNA, 25 bp, Rattus norvegicus
gtagttaatgacatccctctctgga

SEQ ID NO: 484173 - DNA, 25 bp, Rattus norvegicus
gtagttaatgacttccctctctgga

SEQ ID NO: 484174 - DNA, 25 bp, Rattus norvegicus
gtagttaccaataccatacctcagg

SEQ ID NO: 484175 - DNA, 25 bp, Rattus norvegicus
gtagttaccaattccatacctcagg

SEQ ID NO: 484176 - DNA, 25 bp, Rattus norvegicus
gtagttactacaaaaactccgagtt

SEQ ID NO: 484177 - DNA, 25 bp, Rattus norvegicus
gtagttactacataaactccgagtt

SEQ ID NO: 484178 - DNA, 25 bp, Rattus norvegicus
gtagttactcaaagcaaattctggt

SEQ ID NO: 484179 - DNA, 25 bp, Rattus norvegicus
gtagttactcaatgcaaattctggt

SEQ ID NO: 484180 - DNA, 25 bp, Rattus norvegicus
gtagttactgatatgagcatcttta

SEQ ID NO: 484181 - DNA, 25 bp, Rattus norvegicus
gtagttactgatttgagcatcttta

SEQ ID NO: 484182 - DNA, 25 bp, Rattus norvegicus
gtagttactttccttatacctcttg

SEQ ID NO: 484183 - DNA, 25 bp, Rattus norvegicus
gtagttactttcgttatacctcttg

SEQ ID NO: 484184 - DNA, 25 bp, Rattus norvegicus
gtagttagcattacatttcgcacat

SEQ ID NO: 484185 - DNA, 25 bp, Rattus norvegicus
gtagttagcatttcatttcgcacat

SEQ ID NO: 484186 - DNA, 25 bp, Rattus norvegicus
gtagttagttacacactgctgtttc

SEQ ID NO: 484187 - DNA, 25 bp, Rattus norvegicus
gtagttagttactcactgctgtttc

SEQ ID NO: 484188 - DNA, 25 bp, Rattus norvegicus
gtagttatccatcgagaattctccc

SEQ ID NO: 484189 - DNA, 25 bp, Rattus norvegicus
gtagttatccatggagaattctccc

SEQ ID NO: 484190 - DNA, 25 bp, Rattus norvegicus
gtagttatctttctattttgaccac

SEQ ID NO: 484191 - DNA, 25 bp, Rattus norvegicus
gtagttatctttgtattttgaccac

SEQ ID NO: 484192 - DNA, 25 bp, Rattus norvegicus
gtagttcaacccatctaactctaat

SEQ ID NO: 484193 - DNA, 25 bp, Rattus norvegicus
gtagttcaacccttctaactctaat

SEQ ID NO: 484194 - DNA, 25 bp, Rattus norvegicus
gtagttcacaatccctgtacagttt

SEQ ID NO: 484195 - DNA, 25 bp, Rattus norvegicus
gtagttcacaatgcctgtacagttt

SEQ ID NO: 484196 - DNA, 25 bp, Rattus norvegicus
gtagttcacactcacctcaaaatcc

SEQ ID NO: 484197 - DNA, 25 bp, Rattus norvegicus
gtagttcacactgacctcaaaatcc

SEQ ID NO: 484198 - DNA, 25 bp, Rattus norvegicus
gtagttcacagactgctcgtcttcc

SEQ ID NO: 484199 - DNA, 25 bp, Rattus norvegicus
gtagttcacagagtgctcgtcttcc

SEQ ID NO: 484200 - DNA, 25 bp, Rattus norvegicus
gtagttcacatacagctgcttctgt

SEQ ID NO: 484201 - DNA, 25 bp, Rattus norvegicus
gtagttcacatagagctgcttctgt

SEQ ID NO: 484202 - DNA, 25 bp, Rattus norvegicus
gtagttcagatcaagctatgctgtt

SEQ ID NO: 484203 - DNA, 25 bp, Rattus norvegicus
gtagttcagatctagctatgctgtt

SEQ ID NO: 484204 - DNA, 25 bp, Rattus norvegicus
gtagttcagtctctaactcacgctt

SEQ ID NO: 484205 - DNA, 25 bp, Rattus norvegicus
gtagttcagtctgtaactcacgctt

SEQ ID NO: 484206 - DNA, 25 bp, Rattus norvegicus
gtagttcagttcagttctgactttc

SEQ ID NO: 484207 - DNA, 25 bp, Rattus norvegicus
gtagttcagttctgttctgactttc

SEQ ID NO: 484208 - DNA, 25 bp, Rattus norvegicus
gtagttcatgatcttcagcagcagt

SEQ ID NO: 484209 - DNA, 25 bp, Rattus norvegicus
gtagttcatgatgttcagcagcagt

SEQ ID NO: 484210 - DNA, 25 bp, Rattus norvegicus
gtagttcatttcacatgacctccgt

SEQ ID NO: 484211 - DNA, 25 bp, Rattus norvegicus
gtagttcatttctcatgacctccgt

SEQ ID NO: 484212 - DNA, 25 bp, Rattus norvegicus
gtagttccagtacagatcagacctg

SEQ ID NO: 484213 - DNA, 25 bp, Rattus norvegicus
gtagttccagtagagatcagacctg

SEQ ID NO: 484214 - DNA, 25 bp, Rattus norvegicus
gtagttccatttcttcactcatgta

SEQ ID NO: 484215 - DNA, 25 bp, Rattus norvegicus
gtagttccatttgttcactcatgta

SEQ ID NO: 484216 - DNA, 25 bp, Rattus norvegicus
gtagttccccatctaactgtgtttg

SEQ ID NO: 484217 - DNA, 25 bp, Rattus norvegicus
gtagttccccatgtaactgtgtttg

SEQ ID NO: 484218 - DNA, 25 bp, Rattus norvegicus
gtagttccggacctttgtgcagtat

SEQ ID NO: 484219 - DNA, 25 bp, Rattus norvegicus
gtagttccggacgtttgtgcagtat

SEQ ID NO: 484220 - DNA, 25 bp, Rattus norvegicus
gtagttcctgctcttttgtttctca

SEQ ID NO: 484221 - DNA, 25 bp, Rattus norvegicus
gtagttcctgctgttttgtttctca

SEQ ID NO: 484222 - DNA, 25 bp, Rattus norvegicus
gtagttcgccaactacagacttctg

SEQ ID NO: 484223 - DNA, 25 bp, Rattus norvegicus
gtagttcgccaagtacagacttctg

SEQ ID NO: 484224 - DNA, 25 bp, Rattus norvegicus
gtagttcgtaaccaagcacactgtt

SEQ ID NO: 484225 - DNA, 25 bp, Rattus norvegicus
gtagttcgtaacgaagcacactgtt

SEQ ID NO: 484226 - DNA, 25 bp, Rattus norvegicus
gtagttctccctcaatttcaagttt

SEQ ID NO: 484227 - DNA, 25 bp, Rattus norvegicus
gtagttctccctgaatttcaagttt

SEQ ID NO: 484228 - DNA, 25 bp, Rattus norvegicus
gtagttctgcccaggattggtgtct

SEQ ID NO: 484229 - DNA, 25 bp, Rattus norvegicus
gtagttctgccctggattggtgtct

SEQ ID NO: 484230 - DNA, 25 bp, Rattus norvegicus
gtagttcttaggcaagtttcttcta

SEQ ID NO: 484231 - DNA, 25 bp, Rattus norvegicus
gtagttcttagggaagtttcttcta

SEQ ID NO: 484232 - DNA, 25 bp, Rattus norvegicus
gtagttcttcatactgatgggtcaa

SEQ ID NO: 484233 - DNA, 25 bp, Rattus norvegicus
gtagttcttcattctgatgggtcaa

SEQ ID NO: 484234 - DNA, 25 bp, Rattus norvegicus
gtagttcttgatatcctaaatgtgc

SEQ ID NO: 484235 - DNA, 25 bp, Rattus norvegicus
gtagttcttgatttcctaaatgtgc

SEQ ID NO: 484236 - DNA, 25 bp, Rattus norvegicus
gtagttcttgcaattcctaaagtgg

SEQ ID NO: 484237 - DNA, 25 bp, Rattus norvegicus
gtagttcttgcatttcctaaagtgg

SEQ ID NO: 484238 - DNA, 25 bp, Rattus norvegicus
gtagttcttgttcttactgggacat

SEQ ID NO: 484239 - DNA, 25 bp, Rattus norvegicus
gtagttcttgttgttactgggacat

SEQ ID NO: 484240 - DNA, 25 bp, Rattus norvegicus
gtagttgaacctagagcctcatact

SEQ ID NO: 484241 - DNA, 25 bp, Rattus norvegicus
gtagttgaaccttgagcctcatact

SEQ ID NO: 484242 - DNA, 25 bp, Rattus norvegicus
gtagttgactctaagacccagggtt

SEQ ID NO: 484243 - DNA, 25 bp, Rattus norvegicus
gtagttgactcttagacccagggtt

SEQ ID NO: 484244 - DNA, 25 bp, Rattus norvegicus
gtagttgcacacctataatcattcc

SEQ ID NO: 484245 - DNA, 25 bp, Rattus norvegicus
gtagttgcacacgtataatcattcc

SEQ ID NO: 484246 - DNA, 25 bp, Rattus norvegicus
gtagttgcaggaactcaaaaccaaa

SEQ ID NO: 484247 - DNA, 25 bp, Rattus norvegicus
gtagttgcaggatctcaaaaccaaa

SEQ ID NO: 484248 - DNA, 25 bp, Rattus norvegicus
gtagttgcgtggctgaaaccccttt

SEQ ID NO: 484249 - DNA, 25 bp, Rattus norvegicus
gtagttgcgtgggtgaaaccccttt

SEQ ID NO: 484250 - DNA, 25 bp, Rattus norvegicus
gtagttgctctcacggtagcggcga

SEQ ID NO: 484251 - DNA, 25 bp, Rattus norvegicus
gtagttgctctctcggtagcggcga

SEQ ID NO: 484252 - DNA, 25 bp, Rattus norvegicus
gtagttgctttaagcggctgtaatc

SEQ ID NO: 484253 - DNA, 25 bp, Rattus norvegicus
gtagttgctttatgcggctgtaatc

SEQ ID NO: 484254 - DNA, 25 bp, Rattus norvegicus
gtagttggacgaattccgagctctc

SEQ ID NO: 484255 - DNA, 25 bp, Rattus norvegicus
gtagttggacgatttccgagctctc

SEQ ID NO: 484256 - DNA, 25 bp, Rattus norvegicus
gtagttggatttctcgattctcggt

SEQ ID NO: 484257 - DNA, 25 bp, Rattus norvegicus
gtagttggatttgtcgattctcggt

SEQ ID NO: 484258 - DNA, 25 bp, Rattus norvegicus
gtagttggcaagctccagtaatttc

SEQ ID NO: 484259 - DNA, 25 bp, Rattus norvegicus
gtagttggcaaggtccagtaatttc

SEQ ID NO: 484260 - DNA, 25 bp, Rattus norvegicus
gtagttggtatgaaagcgcctgccc

SEQ ID NO: 484261 - DNA, 25 bp, Rattus norvegicus
gtagttggtatgtaagcgcctgccc

SEQ ID NO: 484262 - DNA, 25 bp, Rattus norvegicus
gtagttggtcaacagtgtgtcacac

SEQ ID NO: 484263 - DNA, 25 bp, Rattus norvegicus
gtagttggtcaagagtgtgtcacac

SEQ ID NO: 484264 - DNA, 25 bp, Rattus norvegicus
gtagttggtctgctgggttccatca

SEQ ID NO: 484265 - DNA, 25 bp, Rattus norvegicus
gtagttggtctggtgggttccatca

SEQ ID NO: 484266 - DNA, 25 bp, Rattus norvegicus
gtagttggttctacttagtcttcct

SEQ ID NO: 484267 - DNA, 25 bp, Rattus norvegicus
gtagttggttcttcttagtcttcct

SEQ ID NO: 484268 - DNA, 25 bp, Rattus norvegicus
gtagttggttgcctaattgcagcac

SEQ ID NO: 484269 - DNA, 25 bp, Rattus norvegicus
gtagttggttgcgtaattgcagcac

SEQ ID NO: 484270 - DNA, 25 bp, Rattus norvegicus
gtagttgtaaccatttctaattcag

SEQ ID NO: 484271 - DNA, 25 bp, Rattus norvegicus
gtagttgtaaccttttctaattcag

SEQ ID NO: 484272 - DNA, 25 bp, Rattus norvegicus
gtagttgtactcatgctttaaattg

SEQ ID NO: 484273 - DNA, 25 bp, Rattus norvegicus
gtagttgtactcttgctttaaattg

SEQ ID NO: 484274 - DNA, 25 bp, Rattus norvegicus
gtagttgtagatccctcagacacac

SEQ ID NO: 484275 - DNA, 25 bp, Rattus norvegicus
gtagttgtagatgcctcagacacac

SEQ ID NO: 484276 - DNA, 25 bp, Rattus norvegicus
gtagttgtagccctcattagaactg

SEQ ID NO: 484277 - DNA, 25 bp, Rattus norvegicus
gtagttgtagccgtcattagaactg

SEQ ID NO: 484278 - DNA, 25 bp, Rattus norvegicus
gtagttgtaggactggtgtccccaa

SEQ ID NO: 484279 - DNA, 25 bp, Rattus norvegicus
gtagttgtaggagtggtgtccccaa

SEQ ID NO: 484280 - DNA, 25 bp, Rattus norvegicus
gtagttgtagttcccaacactgtgt

SEQ ID NO: 484281 - DNA, 25 bp, Rattus norvegicus
gtagttgtagttgccaacactgtgt

SEQ ID NO: 484282 - DNA, 25 bp, Rattus norvegicus
gtagttgtcaaaacttgaaactctt

SEQ ID NO: 484283 - DNA, 25 bp, Rattus norvegicus
gtagttgtcaaatcttgaaactctt

SEQ ID NO: 484284 - DNA, 25 bp, Rattus norvegicus
gtagttgtcctaaagacagcgctcc

SEQ ID NO: 484285 - DNA, 25 bp, Rattus norvegicus
gtagttgtcctatagacagcgctcc

SEQ ID NO: 484286 - DNA, 25 bp, Rattus norvegicus
gtagttgttctgatcttgtcttaac

SEQ ID NO: 484287 - DNA, 25 bp, Rattus norvegicus
gtagttgttctgttcttgtcttaac

SEQ ID NO: 484288 - DNA, 25 bp, Rattus norvegicus
gtagttgtttttcatgccccaaata

SEQ ID NO: 484289 - DNA, 25 bp, Rattus norvegicus
gtagttgtttttgatgccccaaata

SEQ ID NO: 484290 - DNA, 25 bp, Rattus norvegicus
gtagtttaaagacagcggccacagg

SEQ ID NO: 484291 - DNA, 25 bp, Rattus norvegicus
gtagtttaaagagagcggccacagg

SEQ ID NO: 484292 - DNA, 25 bp, Rattus norvegicus
gtagtttaatagatggctcctggag

SEQ ID NO: 484293 - DNA, 25 bp, Rattus norvegicus
gtagtttaatagttggctcctggag

SEQ ID NO: 484294 - DNA, 25 bp, Rattus norvegicus
gtagtttacataacccagatccttg

SEQ ID NO: 484295 - DNA, 25 bp, Rattus norvegicus
gtagtttacatatcccagatccttg

SEQ ID NO: 484296 - DNA, 25 bp, Rattus norvegicus
gtagtttactccaactttgtcagtt

SEQ ID NO: 484297 - DNA, 25 bp, Rattus norvegicus
gtagtttactcctactttgtcagtt

SEQ ID NO: 484298 - DNA, 25 bp, Rattus norvegicus
gtagtttactctccgtttagtacgt

SEQ ID NO: 484299 - DNA, 25 bp, Rattus norvegicus
gtagtttactctgcgtttagtacgt

SEQ ID NO: 484300 - DNA, 25 bp, Rattus norvegicus
gtagtttatctcctacataattgga

SEQ ID NO: 484301 - DNA, 25 bp, Rattus norvegicus
gtagtttatctcgtacataattgga

SEQ ID NO: 484302 - DNA, 25 bp, Rattus norvegicus
gtagtttcaagtagtctaggcacac

SEQ ID NO: 484303 - DNA, 25 bp, Rattus norvegicus
gtagtttcaagttgtctaggcacac

SEQ ID NO: 484304 - DNA, 25 bp, Rattus norvegicus
gtagtttccaaaacaatccctctgt

SEQ ID NO: 484305 - DNA, 25 bp, Rattus norvegicus
gtagtttccaaatcaatccctctgt

SEQ ID NO: 484306 - DNA, 25 bp, Rattus norvegicus
gtagtttccaccattcatggcagaa

SEQ ID NO: 484307 - DNA, 25 bp, Rattus norvegicus
gtagtttccacctttcatggcagaa

SEQ ID NO: 484308 - DNA, 25 bp, Rattus norvegicus
gtagtttcctacagacagtccgttc

SEQ ID NO: 484309 - DNA, 25 bp, Rattus norvegicus
gtagtttcctactgacagtccgttc

SEQ ID NO: 484310 - DNA, 25 bp, Rattus norvegicus
gtagtttcctggcagcttccaagga

SEQ ID NO: 484311 - DNA, 25 bp, Rattus norvegicus
gtagtttcctgggagcttccaagga

SEQ ID NO: 484312 - DNA, 25 bp, Rattus norvegicus
gtagtttctagtaccttcaggacaa

SEQ ID NO: 484313 - DNA, 25 bp, Rattus norvegicus
gtagtttctagttccttcaggacaa

SEQ ID NO: 484314 - DNA, 25 bp, Rattus norvegicus
gtagtttctcatctcctttggagga

SEQ ID NO: 484315 - DNA, 25 bp, Rattus norvegicus
gtagtttctcatgtcctttggagga

SEQ ID NO: 484316 - DNA, 25 bp, Rattus norvegicus
gtagtttgcacactatgactttggt

SEQ ID NO: 484317 - DNA, 25 bp, Rattus norvegicus
gtagtttgcacagtatgactttggt

SEQ ID NO: 484318 - DNA, 25 bp, Rattus norvegicus
gtagtttgcagcattctgggtttta

SEQ ID NO: 484319 - DNA, 25 bp, Rattus norvegicus
gtagtttgcagctttctgggtttta

SEQ ID NO: 484320 - DNA, 25 bp, Rattus norvegicus
gtagtttgcccacagttggtgtttt

SEQ ID NO: 484321 - DNA, 25 bp, Rattus norvegicus
gtagtttgcccagagttggtgtttt

SEQ ID NO: 484322 - DNA, 25 bp, Rattus norvegicus
gtagtttgcctactcccagggttgg

SEQ ID NO: 484323 - DNA, 25 bp, Rattus norvegicus
gtagtttgcctagtcccagggttgg

SEQ ID NO: 484324 - DNA, 25 bp, Rattus norvegicus
gtagtttggcagagttaacagcata

SEQ ID NO: 484325 - DNA, 25 bp, Rattus norvegicus
gtagtttggcagtgttaacagcata

SEQ ID NO: 484326 - DNA, 25 bp, Rattus norvegicus
gtagtttggtacagtgtcacatgcc

SEQ ID NO: 484327 - DNA, 25 bp, Rattus norvegicus
gtagtttggtactgtgtcacatgcc

SEQ ID NO: 484328 - DNA, 25 bp, Rattus norvegicus
gtagtttggtttaccatgaccagaa

SEQ ID NO: 484329 - DNA, 25 bp, Rattus norvegicus
gtagtttggttttccatgaccagaa

SEQ ID NO: 484330 - DNA, 25 bp, Rattus norvegicus
gtagtttgtaaacaattgagccacc

SEQ ID NO: 484331 - DNA, 25 bp, Rattus norvegicus
gtagtttgtaaagaattgagccacc

SEQ ID NO: 484332 - DNA, 25 bp, Rattus norvegicus
gtagttttaatgctgttagttgtca

SEQ ID NO: 484333 - DNA, 25 bp, Rattus norvegicus
gtagttttaatggtgttagttgtca

SEQ ID NO: 484334 - DNA, 25 bp, Rattus norvegicus
gtagttttacatagccacagtgtgt

SEQ ID NO: 484335 - DNA, 25 bp, Rattus norvegicus
gtagttttacattgccacagtgtgt

SEQ ID NO: 484336 - DNA, 25 bp, Rattus norvegicus
gtagttttactaatatacctccatc

SEQ ID NO: 484337 - DNA, 25 bp, Rattus norvegicus
gtagttttactattatacctccatc

SEQ ID NO: 484338 - DNA, 25 bp, Rattus norvegicus
gtagttttatttccccagtgctaaa

SEQ ID NO: 484339 - DNA, 25 bp, Rattus norvegicus
gtagttttatttgcccagtgctaaa

SEQ ID NO: 484340 - DNA, 25 bp, Rattus norvegicus
gtagttttcaccatcgttcattatg

SEQ ID NO: 484341 - DNA, 25 bp, Rattus norvegicus
gtagttttcaccttcgttcattatg

SEQ ID NO: 484342 - DNA, 25 bp, Rattus norvegicus
gtagttttctcaactgtacggtacg

SEQ ID NO: 484343 - DNA, 25 bp, Rattus norvegicus
gtagttttctcatctgtacggtacg

SEQ ID NO: 484344 - DNA, 25 bp, Rattus norvegicus
gtagttttctttactgattgttctt

SEQ ID NO: 484345 - DNA, 25 bp, Rattus norvegicus
gtagttttcttttctgattgttctt

SEQ ID NO: 484346 - DNA, 25 bp, Rattus norvegicus
gtagttttgatgaatcactcccaaa

SEQ ID NO: 484347 - DNA, 25 bp, Rattus norvegicus
gtagttttgatgtatcactcccaaa

SEQ ID NO: 484348 - DNA, 25 bp, Rattus norvegicus
gtagttttgattatgcagccttctg

SEQ ID NO: 484349 - DNA, 25 bp, Rattus norvegicus
gtagttttgattttgcagccttctg

SEQ ID NO: 484350 - DNA, 25 bp, Rattus norvegicus
gtagttttgcagacctagggatcat

SEQ ID NO: 484351 - DNA, 25 bp, Rattus norvegicus
gtagttttgcagattacaagttaag

SEQ ID NO: 484352 - DNA, 25 bp, Rattus norvegicus
gtagttttgcagtcctagggatcat

SEQ ID NO: 484353 - DNA, 25 bp, Rattus norvegicus
gtagttttgcagtttacaagttaag

SEQ ID NO: 484354 - DNA, 25 bp, Rattus norvegicus
gtagtttttcgtcttgagtacaaga

SEQ ID NO: 484355 - DNA, 25 bp, Rattus norvegicus
gtagtttttcgtgttgagtacaaga

SEQ ID NO: 484356 - DNA, 25 bp, Rattus norvegicus
gtagttttttggctattactggtat

SEQ ID NO: 484357 - DNA, 25 bp, Rattus norvegicus
gtagttttttgggtattactggtat

SEQ ID NO: 484358 - DNA, 25 bp, Rattus norvegicus
gtataaaaaccaccatccacctttc

SEQ ID NO: 484359 - DNA, 25 bp, Rattus norvegicus
gtataaaaaccagcatccacctttc

SEQ ID NO: 484360 - DNA, 25 bp, Rattus norvegicus
gtataaaaacttccacaggtcaata

SEQ ID NO: 484361 - DNA, 25 bp, Rattus norvegicus
gtataaaaacttgcacaggtcaata

SEQ ID NO: 484362 - DNA, 25 bp, Rattus norvegicus
gtataaaagtgccaaacctgccctc

SEQ ID NO: 484363 - DNA, 25 bp, Rattus norvegicus
gtataaaagtgcgaaacctgccctc

SEQ ID NO: 484364 - DNA, 25 bp, Rattus norvegicus
gtataaaataacctgccctgctgga

SEQ ID NO: 484365 - DNA, 25 bp, Rattus norvegicus
gtataaaataacgtgccctgctgga

SEQ ID NO: 484366 - DNA, 25 bp, Rattus norvegicus
gtataaaattagcacttgtgagcat

SEQ ID NO: 484367 - DNA, 25 bp, Rattus norvegicus
gtataaaattaggacttgtgagcat

SEQ ID NO: 484368 - DNA, 25 bp, Rattus norvegicus
gtataaacatctagaagccttacaa

SEQ ID NO: 484369 - DNA, 25 bp, Rattus norvegicus
gtataaacatcttgaagccttacaa

SEQ ID NO: 484370 - DNA, 25 bp, Rattus norvegicus
gtataaaccaccaagttgtccatgt

SEQ ID NO: 484371 - DNA, 25 bp, Rattus norvegicus
gtataaaccacctagttgtccatgt

SEQ ID NO: 484372 - DNA, 25 bp, Rattus norvegicus
gtataaaccagacccatgctgccgg

SEQ ID NO: 484373 - DNA, 25 bp, Rattus norvegicus
gtataaaccagagccatgctgccgg

SEQ ID NO: 484374 - DNA, 25 bp, Rattus norvegicus
gtataaaccattattgcatcccatt

SEQ ID NO: 484375 - DNA, 25 bp, Rattus norvegicus
gtataaaccatttttgcatcccatt

SEQ ID NO: 484376 - DNA, 25 bp, Rattus norvegicus
gtataaaccccaagctgagctggtg

SEQ ID NO: 484377 - DNA, 25 bp, Rattus norvegicus
gtataaaccccatgctgagctggtg

SEQ ID NO: 484378 - DNA, 25 bp, Rattus norvegicus
gtataaactatccatgctgcttcct

SEQ ID NO: 484379 - DNA, 25 bp, Rattus norvegicus
gtataaactatcgatgctgcttcct

SEQ ID NO: 484380 - DNA, 25 bp, Rattus norvegicus
gtataaactcaccagaacaatcagc

SEQ ID NO: 484381 - DNA, 25 bp, Rattus norvegicus
gtataaactcacgagaacaatcagc

SEQ ID NO: 484382 - DNA, 25 bp, Rattus norvegicus
gtataaactgctactttgggaagac

SEQ ID NO: 484383 - DNA, 25 bp, Rattus norvegicus
gtataaactgcttctttgggaagac

SEQ ID NO: 484384 - DNA, 25 bp, Rattus norvegicus
gtataaagcaaaccaaccgacctat

SEQ ID NO: 484385 - DNA, 25 bp, Rattus norvegicus
gtataaagcaaagcaaccgacctat

SEQ ID NO: 484386 - DNA, 25 bp, Rattus norvegicus
gtataaatccaaagaacctttagaa

SEQ ID NO: 484387 - DNA, 25 bp, Rattus norvegicus
gtataaatccaatgaacctttagaa

SEQ ID NO: 484388 - DNA, 25 bp, Rattus norvegicus
gtataaatctgtaagtttctctctt

SEQ ID NO: 484389 - DNA, 25 bp, Rattus norvegicus
gtataaatctgttagtttctctctt

SEQ ID NO: 484390 - DNA, 25 bp, Rattus norvegicus
gtataaatgagcattccttccttac

SEQ ID NO: 484391 - DNA, 25 bp, Rattus norvegicus
gtataaatgagctttccttccttac

SEQ ID NO: 484392 - DNA, 25 bp, Rattus norvegicus
gtataaatgttaaatccatgttcga

SEQ ID NO: 484393 - DNA, 25 bp, Rattus norvegicus
gtataaatgttatatccatgttcga

SEQ ID NO: 484394 - DNA, 25 bp, Rattus norvegicus
gtataaattttaagaagcccaggca

SEQ ID NO: 484395 - DNA, 25 bp, Rattus norvegicus
gtataaattttatgaagcccaggca

SEQ ID NO: 484396 - DNA, 25 bp, Rattus norvegicus
gtataacacctactgtatataagtg

SEQ ID NO: 484397 - DNA, 25 bp, Rattus norvegicus
gtataacacctagtgtatataagtg

SEQ ID NO: 484398 - DNA, 25 bp, Rattus norvegicus
gtataacagcatcctgacaggtaga

SEQ ID NO: 484399 - DNA, 25 bp, Rattus norvegicus
gtataacagcatgctgacaggtaga

SEQ ID NO: 484400 - DNA, 25 bp, Rattus norvegicus
gtataacattgcacgtttctgtata

SEQ ID NO: 484401 - DNA, 25 bp, Rattus norvegicus
gtataacattgctcgtttctgtata

SEQ ID NO: 484402 - DNA, 25 bp, Rattus norvegicus
gtataaccatcacacaccagtaact

SEQ ID NO: 484403 - DNA, 25 bp, Rattus norvegicus
gtataaccatcagacaccagtaact

SEQ ID NO: 484404 - DNA, 25 bp, Rattus norvegicus
gtataacctgttatcttcttggagt

SEQ ID NO: 484405 - DNA, 25 bp, Rattus norvegicus
gtataacctgttttcttcttggagt

SEQ ID NO: 484406 - DNA, 25 bp, Rattus norvegicus
gtataaccttccaacttctctaatg

SEQ ID NO: 484407 - DNA, 25 bp, Rattus norvegicus
gtataaccttcctacttctctaatg

SEQ ID NO: 484408 - DNA, 25 bp, Rattus norvegicus
gtataaccttgcaaaggtcccagtg

SEQ ID NO: 484409 - DNA, 25 bp, Rattus norvegicus
gtataaccttgctaaggtcccagtg

SEQ ID NO: 484410 - DNA, 25 bp, Rattus norvegicus
gtataactacttagttcccatccga

SEQ ID NO: 484411 - DNA, 25 bp, Rattus norvegicus
gtataactactttgttcccatccga

SEQ ID NO: 484412 - DNA, 25 bp, Rattus norvegicus
gtataactcgatagtgtgccatttt

SEQ ID NO: 484413 - DNA, 25 bp, Rattus norvegicus
gtataactcgattgtgtgccatttt

SEQ ID NO: 484414 - DNA, 25 bp, Rattus norvegicus
gtataactctaccttttcaaattca

SEQ ID NO: 484415 - DNA, 25 bp, Rattus norvegicus
gtataactctacgttttcaaattca

SEQ ID NO: 484416 - DNA, 25 bp, Rattus norvegicus
gtataactgacgatcatattgtaag

SEQ ID NO: 484417 - DNA, 25 bp, Rattus norvegicus
gtataactgacgttcatattgtaag

SEQ ID NO: 484418 - DNA, 25 bp, Rattus norvegicus
gtataactgcctcacacagcggatt

SEQ ID NO: 484419 - DNA, 25 bp, Rattus norvegicus
gtataactgcctgacacagcggatt

SEQ ID NO: 484420 - DNA, 25 bp, Rattus norvegicus
gtataacttgccaaaatctttattc

SEQ ID NO: 484421 - DNA, 25 bp, Rattus norvegicus
gtataacttgcctaaatctttattc

SEQ ID NO: 484422 - DNA, 25 bp, Rattus norvegicus
gtataactttatatgcactaaactt

SEQ ID NO: 484423 - DNA, 25 bp, Rattus norvegicus
gtataactttatttgcactaaactt

SEQ ID NO: 484424 - DNA, 25 bp, Rattus norvegicus
gtataagaaaatccacatgtgtcca

SEQ ID NO: 484425 - DNA, 25 bp, Rattus norvegicus
gtataagaaaatgcacatgtgtcca

SEQ ID NO: 484426 - DNA, 25 bp, Rattus norvegicus
gtataagaaaccctgcaatctcctg

SEQ ID NO: 484427 - DNA, 25 bp, Rattus norvegicus
gtataagaaaccgtgcaatctcctg

SEQ ID NO: 484428 - DNA, 25 bp, Rattus norvegicus
gtataagatgcaacagggccaactg

SEQ ID NO: 484429 - DNA, 25 bp, Rattus norvegicus
gtataagatgcatcagggccaactg

SEQ ID NO: 484430 - DNA, 25 bp, Rattus norvegicus
gtataagcaccacatttccatgtgg

SEQ ID NO: 484431 - DNA, 25 bp, Rattus norvegicus
gtataagcaccagatttccatgtgg

SEQ ID NO: 484432 - DNA, 25 bp, Rattus norvegicus
gtataagcatggattgcccattcca

SEQ ID NO: 484433 - DNA, 25 bp, Rattus norvegicus
gtataagcatggtttgcccattcca

SEQ ID NO: 484434 - DNA, 25 bp, Rattus norvegicus
gtataagccatcagagaccttgcca

SEQ ID NO: 484435 - DNA, 25 bp, Rattus norvegicus
gtataagccatctgagaccttgcca

SEQ ID NO: 484436 - DNA, 25 bp, Rattus norvegicus
gtataagcctgtctctgctactggg

SEQ ID NO: 484437 - DNA, 25 bp, Rattus norvegicus
gtataagcctgtgtctgctactggg

SEQ ID NO: 484438 - DNA, 25 bp, Rattus norvegicus
gtataagctgatacgacttcgcctc

SEQ ID NO: 484439 - DNA, 25 bp, Rattus norvegicus
gtataagctgattcgacttcgcctc

SEQ ID NO: 484440 - DNA, 25 bp, Rattus norvegicus
gtataaggcttcagctttatcaccc

SEQ ID NO: 484441 - DNA, 25 bp, Rattus norvegicus
gtataaggcttctgctttatcaccc

SEQ ID NO: 484442 - DNA, 25 bp, Rattus norvegicus
gtataagggaatcctcacctctgtg

SEQ ID NO: 484443 - DNA, 25 bp, Rattus norvegicus
gtataagggaatgctcacctctgtg

SEQ ID NO: 484444 - DNA, 25 bp, Rattus norvegicus
gtataaggtctgatctaaagtctga

SEQ ID NO: 484445 - DNA, 25 bp, Rattus norvegicus
gtataaggtctgttctaaagtctga

SEQ ID NO: 484446 - DNA, 25 bp, Rattus norvegicus
gtataatacacacctgggtccacct

SEQ ID NO: 484447 - DNA, 25 bp, Rattus norvegicus
gtataatacacagctgggtccacct

SEQ ID NO: 484448 - DNA, 25 bp, Rattus norvegicus
gtataatagagtcaccctctctcaa

SEQ ID NO: 484449 - DNA, 25 bp, Rattus norvegicus
gtataatagagtgaccctctctcaa

SEQ ID NO: 484450 - DNA, 25 bp, Rattus norvegicus
gtataatcaaatccagccctggtgt

SEQ ID NO: 484451 - DNA, 25 bp, Rattus norvegicus
gtataatcaaatgcagccctggtgt

SEQ ID NO: 484452 - DNA, 25 bp, Rattus norvegicus
gtataatcatttaaacccacgaggc

SEQ ID NO: 484453 - DNA, 25 bp, Rattus norvegicus
gtataatcattttaacccacgaggc

SEQ ID NO: 484454 - DNA, 25 bp, Rattus norvegicus
gtataatccaaacgtcctacctgtc

SEQ ID NO: 484455 - DNA, 25 bp, Rattus norvegicus
gtataatccaaaggtcctacctgtc

SEQ ID NO: 484456 - DNA, 25 bp, Rattus norvegicus
gtataatccacaaccttctcaaaat

SEQ ID NO: 484457 - DNA, 25 bp, Rattus norvegicus
gtataatccacatccttctcaaaat

SEQ ID NO: 484458 - DNA, 25 bp, Rattus norvegicus
gtataatctccaatacccaagtgta

SEQ ID NO: 484459 - DNA, 25 bp, Rattus norvegicus
gtataatctccattacccaagtgta

SEQ ID NO: 484460 - DNA, 25 bp, Rattus norvegicus
gtataatctggaagggctgcctctg

SEQ ID NO: 484461 - DNA, 25 bp, Rattus norvegicus
gtataatctggatgggctgcctctg

SEQ ID NO: 484462 - DNA, 25 bp, Rattus norvegicus
gtataatctggcctgtcaaaatcaa

SEQ ID NO: 484463 - DNA, 25 bp, Rattus norvegicus
gtataatctggcgtgtcaaaatcaa

SEQ ID NO: 484464 - DNA, 25 bp, Rattus norvegicus
gtataatctgtgaccttcttctagt

SEQ ID NO: 484465 - DNA, 25 bp, Rattus norvegicus
gtataatctgtgtccttcttctagt

SEQ ID NO: 484466 - DNA, 25 bp, Rattus norvegicus
gtataatcttgcctggccgttgcac

SEQ ID NO: 484467 - DNA, 25 bp, Rattus norvegicus
gtataatcttgcgtggccgttgcac

SEQ ID NO: 484468 - DNA, 25 bp, Rattus norvegicus
gtataatgaagtccctgatttccct

SEQ ID NO: 484469 - DNA, 25 bp, Rattus norvegicus
gtataatgaagtgcctgatttccct

SEQ ID NO: 484470 - DNA, 25 bp, Rattus norvegicus
gtataatgagaacatcaagcctaag

SEQ ID NO: 484471 - DNA, 25 bp, Rattus norvegicus
gtataatgagaagatcaagcctaag

SEQ ID NO: 484472 - DNA, 25 bp, Rattus norvegicus
gtataatgccaaaccatagctggag

SEQ ID NO: 484473 - DNA, 25 bp, Rattus norvegicus
gtataatgccaatccatagctggag

SEQ ID NO: 484474 - DNA, 25 bp, Rattus norvegicus
gtataatgccatattctgacagaaa

SEQ ID NO: 484475 - DNA, 25 bp, Rattus norvegicus
gtataatgccattttctgacagaaa

SEQ ID NO: 484476 - DNA, 25 bp, Rattus norvegicus
gtataatggctcacactgctgttca

SEQ ID NO: 484477 - DNA, 25 bp, Rattus norvegicus
gtataatggctctcactgctgttca

SEQ ID NO: 484478 - DNA, 25 bp, Rattus norvegicus
gtataatgtaaccaaaccagtcctt

SEQ ID NO: 484479 - DNA, 25 bp, Rattus norvegicus
gtataatgtaacgaaaccagtcctt

SEQ ID NO: 484480 - DNA, 25 bp, Rattus norvegicus
gtataattcagcacttatttggctt

SEQ ID NO: 484481 - DNA, 25 bp, Rattus norvegicus
gtataattcagctcttatttggctt

SEQ ID NO: 484482 - DNA, 25 bp, Rattus norvegicus
gtataattctggattctctcacccc

SEQ ID NO: 484483 - DNA, 25 bp, Rattus norvegicus
gtataattctggtttctctcacccc

SEQ ID NO: 484484 - DNA, 25 bp, Rattus norvegicus
gtataattgccaatcattgtaacta

SEQ ID NO: 484485 - DNA, 25 bp, Rattus norvegicus
gtataattgccattcattgtaacta

SEQ ID NO: 484486 - DNA, 25 bp, Rattus norvegicus
gtataattggaaccttgacacacat

SEQ ID NO: 484487 - DNA, 25 bp, Rattus norvegicus
gtataattggaagcttgacacacat

SEQ ID NO: 484488 - DNA, 25 bp, Rattus norvegicus
gtataattgtgaaagtctctcctgg

SEQ ID NO: 484489 - DNA, 25 bp, Rattus norvegicus
gtataattgtgatagtctctcctgg

SEQ ID NO: 484490 - DNA, 25 bp, Rattus norvegicus
gtataattttaccagctttgccatg

SEQ ID NO: 484491 - DNA, 25 bp, Rattus norvegicus
gtataattttacgagctttgccatg

SEQ ID NO: 484492 - DNA, 25 bp, Rattus norvegicus
gtatacaaagcacccctacccagga

SEQ ID NO: 484493 - DNA, 25 bp, Rattus norvegicus
gtatacaaagcagccctacccagga

SEQ ID NO: 484494 - DNA, 25 bp, Rattus norvegicus
gtatacaaatccacagcagcacatg

SEQ ID NO: 484495 - DNA, 25 bp, Rattus norvegicus
gtatacaaatcctcagcagcacatg

SEQ ID NO: 484496 - DNA, 25 bp, Rattus norvegicus
gtatacaaatggaacatacctcaag

SEQ ID NO: 484497 - DNA, 25 bp, Rattus norvegicus
gtatacaaatggtacatacctcaag

SEQ ID NO: 484498 - DNA, 25 bp, Rattus norvegicus
gtatacaacggcaccatcacattgg

SEQ ID NO: 484499 - DNA, 25 bp, Rattus norvegicus
gtatacaacggctccatcacattgg

SEQ ID NO: 484500 - DNA, 25 bp, Rattus norvegicus
gtatacaactccagttatctggaaa

SEQ ID NO: 484501 - DNA, 25 bp, Rattus norvegicus
gtatacaactcctgttatctggaaa

SEQ ID NO: 484502 - DNA, 25 bp, Rattus norvegicus
gtatacaatacacacttacttcggt

SEQ ID NO: 484503 - DNA, 25 bp, Rattus norvegicus
gtatacaatacagacttacttcggt

SEQ ID NO: 484504 - DNA, 25 bp, Rattus norvegicus
gtatacacacatatacagtgtcttt

SEQ ID NO: 484505 - DNA, 25 bp, Rattus norvegicus
gtatacacacatttacagtgtcttt

SEQ ID NO: 484506 - DNA, 25 bp, Rattus norvegicus
gtatacaccccacacaggaagtagt

SEQ ID NO: 484507 - DNA, 25 bp, Rattus norvegicus
gtatacaccccagacaggaagtagt

SEQ ID NO: 484508 - DNA, 25 bp, Rattus norvegicus
gtatacaccttcacttcttttctaa

SEQ ID NO: 484509 - DNA, 25 bp, Rattus norvegicus
gtatacaccttctcttcttttctaa

SEQ ID NO: 484510 - DNA, 25 bp, Rattus norvegicus
gtatacactaatccataggattcat

SEQ ID NO: 484511 - DNA, 25 bp, Rattus norvegicus
gtatacactaatgcataggattcat

SEQ ID NO: 484512 - DNA, 25 bp, Rattus norvegicus
gtatacactgcacttaatctgcatg

SEQ ID NO: 484513 - DNA, 25 bp, Rattus norvegicus
gtatacactgcagttaatctgcatg

SEQ ID NO: 484514 - DNA, 25 bp, Rattus norvegicus
gtatacactggactctgtgcctcat

SEQ ID NO: 484515 - DNA, 25 bp, Rattus norvegicus
gtatacactggagtctgtgcctcat

SEQ ID NO: 484516 - DNA, 25 bp, Rattus norvegicus
gtatacagacacaagctatgaggac

SEQ ID NO: 484517 - DNA, 25 bp, Rattus norvegicus
gtatacagacactagctatgaggac

SEQ ID NO: 484518 - DNA, 25 bp, Rattus norvegicus
gtatacagcagacacccaaggagaa

SEQ ID NO: 484519 - DNA, 25 bp, Rattus norvegicus
gtatacagcagagacccaaggagaa

SEQ ID NO: 484520 - DNA, 25 bp, Rattus norvegicus
gtatacagccttaccggttcaagaa

SEQ ID NO: 484521 - DNA, 25 bp, Rattus norvegicus
gtatacagcctttccggttcaagaa

SEQ ID NO: 484522 - DNA, 25 bp, Rattus norvegicus
gtatacagctggatgttaccatggt

SEQ ID NO: 484523 - DNA, 25 bp, Rattus norvegicus
gtatacagctggttgttaccatggt

SEQ ID NO: 484524 - DNA, 25 bp, Rattus norvegicus
gtatacaggagtagttctgcccttg

SEQ ID NO: 484525 - DNA, 25 bp, Rattus norvegicus
gtatacaggagttgttctgcccttg

SEQ ID NO: 484526 - DNA, 25 bp, Rattus norvegicus
gtatacagtactattctccaacagc

SEQ ID NO: 484527 - DNA, 25 bp, Rattus norvegicus
gtatacagtacttttctccaacagc

SEQ ID NO: 484528 - DNA, 25 bp, Rattus norvegicus
gtatacagtgaaactgctcccttca

SEQ ID NO: 484529 - DNA, 25 bp, Rattus norvegicus
gtatacagtgaatctgctcccttca

SEQ ID NO: 484530 - DNA, 25 bp, Rattus norvegicus
gtatacagttctatcttttggtgga

SEQ ID NO: 484531 - DNA, 25 bp, Rattus norvegicus
gtatacagttctttcttttggtgga

SEQ ID NO: 484532 - DNA, 25 bp, Rattus norvegicus
gtatacataggcatttccctaccct

SEQ ID NO: 484533 - DNA, 25 bp, Rattus norvegicus
gtatacataggcttttccctaccct

SEQ ID NO: 484534 - DNA, 25 bp, Rattus norvegicus
gtatacatatgtctgtgccccagaa

SEQ ID NO: 484535 - DNA, 25 bp, Rattus norvegicus
gtatacatatgtgtgtgccccagaa

SEQ ID NO: 484536 - DNA, 25 bp, Rattus norvegicus
gtatacatatttatcttgcacgtta

SEQ ID NO: 484537 - DNA, 25 bp, Rattus norvegicus
gtatacatatttttcttgcacgtta

SEQ ID NO: 484538 - DNA, 25 bp, Rattus norvegicus
gtatacatccttagcattttccaga

SEQ ID NO: 484539 - DNA, 25 bp, Rattus norvegicus
gtatacatcctttgcattttccaga

SEQ ID NO: 484540 - DNA, 25 bp, Rattus norvegicus
gtatacatgcagaatgacttgggaa

SEQ ID NO: 484541 - DNA, 25 bp, Rattus norvegicus
gtatacatgcagtatgacttgggaa

SEQ ID NO: 484542 - DNA, 25 bp, Rattus norvegicus
gtataccaaactaaccagctgtgac

SEQ ID NO: 484543 - DNA, 25 bp, Rattus norvegicus
gtataccaaacttaccagctgtgac

SEQ ID NO: 484544 - DNA, 25 bp, Rattus norvegicus
gtataccaatagaaatgcccaccca

SEQ ID NO: 484545 - DNA, 25 bp, Rattus norvegicus
gtataccaatagtaatgcccaccca

SEQ ID NO: 484546 - DNA, 25 bp, Rattus norvegicus
gtataccaggtacttgtccaggcag

SEQ ID NO: 484547 - DNA, 25 bp, Rattus norvegicus
gtataccaggtagttgtccaggcag

SEQ ID NO: 484548 - DNA, 25 bp, Rattus norvegicus
gtataccatcgactagggaccatca

SEQ ID NO: 484549 - DNA, 25 bp, Rattus norvegicus
gtataccatcgagtagggaccatca

SEQ ID NO: 484550 - DNA, 25 bp, Rattus norvegicus
gtataccattttctgcatttgtctt

SEQ ID NO: 484551 - DNA, 25 bp, Rattus norvegicus
gtataccattttgtgcatttgtctt

SEQ ID NO: 484552 - DNA, 25 bp, Rattus norvegicus
gtatacccacttaccaaactggttg

SEQ ID NO: 484553 - DNA, 25 bp, Rattus norvegicus
gtatacccactttccaaactggttg

SEQ ID NO: 484554 - DNA, 25 bp, Rattus norvegicus
gtatacccagaacactgatccacta

SEQ ID NO: 484555 - DNA, 25 bp, Rattus norvegicus
gtatacccagaagactgatccacta

SEQ ID NO: 484556 - DNA, 25 bp, Rattus norvegicus
gtataccccactcactagaaaaact

SEQ ID NO: 484557 - DNA, 25 bp, Rattus norvegicus
gtataccccactgactagaaaaact

SEQ ID NO: 484558 - DNA, 25 bp, Rattus norvegicus
gtataccccttaagatccagatgat

SEQ ID NO: 484559 - DNA, 25 bp, Rattus norvegicus
gtataccccttatgatccagatgat

SEQ ID NO: 484560 - DNA, 25 bp, Rattus norvegicus
gtatacccgataagttggaactgga

SEQ ID NO: 484561 - DNA, 25 bp, Rattus norvegicus
gtatacccgatatgttggaactgga

SEQ ID NO: 484562 - DNA, 25 bp, Rattus norvegicus
gtataccctacgagaaagaaccctg

SEQ ID NO: 484563 - DNA, 25 bp, Rattus norvegicus
gtataccctacgtgaaagaaccctg

SEQ ID NO: 484564 - DNA, 25 bp, Rattus norvegicus
gtataccctgtgatagtgccatggc

SEQ ID NO: 484565 - DNA, 25 bp, Rattus norvegicus
gtataccctgtgttagtgccatggc

SEQ ID NO: 484566 - DNA, 25 bp, Rattus norvegicus
gtatacctaggaacactctcaacag

SEQ ID NO: 484567 - DNA, 25 bp, Rattus norvegicus
gtatacctaggatcactctcaacag

SEQ ID NO: 484568 - DNA, 25 bp, Rattus norvegicus
gtatacctatcaaatccatcacgtt

SEQ ID NO: 484569 - DNA, 25 bp, Rattus norvegicus
gtatacctatcatatccatcacgtt

SEQ ID NO: 484570 - DNA, 25 bp, Rattus norvegicus
gtatacctcaatcctgactactgta

SEQ ID NO: 484571 - DNA, 25 bp, Rattus norvegicus
gtatacctcaatgctgactactgta

SEQ ID NO: 484572 - DNA, 25 bp, Rattus norvegicus
gtatacctccaacccctcttaaata

SEQ ID NO: 484573 - DNA, 25 bp, Rattus norvegicus
gtatacctccaagccctcttaaata

SEQ ID NO: 484574 - DNA, 25 bp, Rattus norvegicus
gtatacctcctcagtcaagtacgac

SEQ ID NO: 484575 - DNA, 25 bp, Rattus norvegicus
gtatacctcctctgtcaagtacgac

SEQ ID NO: 484576 - DNA, 25 bp, Rattus norvegicus
gtatacctggcaagagagcttttct

SEQ ID NO: 484577 - DNA, 25 bp, Rattus norvegicus
gtatacctggcatgagagcttttct

SEQ ID NO: 484578 - DNA, 25 bp, Rattus norvegicus
gtatacctgtaaccattcagcgtta

SEQ ID NO: 484579 - DNA, 25 bp, Rattus norvegicus
gtatacctgtaagcattcagcgtta

SEQ ID NO: 484580 - DNA, 25 bp, Rattus norvegicus
gtatacctgttactgaagcatgctc

SEQ ID NO: 484581 - DNA, 25 bp, Rattus norvegicus
gtatacctgttagtgaagcatgctc

SEQ ID NO: 484582 - DNA, 25 bp, Rattus norvegicus
gtataccttataaaactaacctcag

SEQ ID NO: 484583 - DNA, 25 bp, Rattus norvegicus
gtataccttatataactaacctcag

SEQ ID NO: 484584 - DNA, 25 bp, Rattus norvegicus
gtataccttcaaacctaacagaggc

SEQ ID NO: 484585 - DNA, 25 bp, Rattus norvegicus
gtataccttcaatcctaacagaggc

SEQ ID NO: 484586 - DNA, 25 bp, Rattus norvegicus
gtatacgagcatctggttgcctgcc

SEQ ID NO: 484587 - DNA, 25 bp, Rattus norvegicus
gtatacgagcatgtggttgcctgcc

SEQ ID NO: 484588 - DNA, 25 bp, Rattus norvegicus
gtatacgcaactacaacgcaaaata

SEQ ID NO: 484589 - DNA, 25 bp, Rattus norvegicus
gtatacgcaacttcaacgcaaaata

SEQ ID NO: 484590 - DNA, 25 bp, Rattus norvegicus
gtatacgcgcgcagccggagccgat

SEQ ID NO: 484591 - DNA, 25 bp, Rattus norvegicus
gtatacgcgcgctgccggagccgat

SEQ ID NO: 484592 - DNA, 25 bp, Rattus norvegicus
gtatacggtgtacttctgaccttag

SEQ ID NO: 484593 - DNA, 25 bp, Rattus norvegicus
gtatacggtgtagttctgaccttag

SEQ ID NO: 484594 - DNA, 25 bp, Rattus norvegicus
gtatacggtttcattttgctgcttc

SEQ ID NO: 484595 - DNA, 25 bp, Rattus norvegicus
gtatacggtttctttttgctgcttc

SEQ ID NO: 484596 - DNA, 25 bp, Rattus norvegicus
gtatacgtcaggaatcttgctccaa

SEQ ID NO: 484597 - DNA, 25 bp, Rattus norvegicus
gtatacgtcaggtatcttgctccaa

SEQ ID NO: 484598 - DNA, 25 bp, Rattus norvegicus
gtatacgtctgtagatccattcacc

SEQ ID NO: 484599 - DNA, 25 bp, Rattus norvegicus
gtatacgtctgttgatccattcacc

SEQ ID NO: 484600 - DNA, 25 bp, Rattus norvegicus
gtatacgtggtcacattaccagtct

SEQ ID NO: 484601 - DNA, 25 bp, Rattus norvegicus
gtatacgtggtctcattaccagtct

SEQ ID NO: 484602 - DNA, 25 bp, Rattus norvegicus
gtatacgttgtgcaagctgatttaa

SEQ ID NO: 484603 - DNA, 25 bp, Rattus norvegicus
gtatacgttgtggaagctgatttaa

SEQ ID NO: 484604 - DNA, 25 bp, Rattus norvegicus
gtatactaccaaactattcccttca

SEQ ID NO: 484605 - DNA, 25 bp, Rattus norvegicus
gtatactaccaatctattcccttca

SEQ ID NO: 484606 - DNA, 25 bp, Rattus norvegicus
gtatactagccaaaggcggcttgga

SEQ ID NO: 484607 - DNA, 25 bp, Rattus norvegicus
gtatactagccataggcggcttgga

SEQ ID NO: 484608 - DNA, 25 bp, Rattus norvegicus
gtatactagctcatagcagtctgag

SEQ ID NO: 484609 - DNA, 25 bp, Rattus norvegicus
gtatactagctcttagcagtctgag

SEQ ID NO: 484610 - DNA, 25 bp, Rattus norvegicus
gtatactagcttatgttgtgtaaac

SEQ ID NO: 484611 - DNA, 25 bp, Rattus norvegicus
gtatactagcttttgttgtgtaaac

SEQ ID NO: 484612 - DNA, 25 bp, Rattus norvegicus
gtatactatgttcttctgttgtgct

SEQ ID NO: 484613 - DNA, 25 bp, Rattus norvegicus
gtatactatgttgttctgttgtgct

SEQ ID NO: 484614 - DNA, 25 bp, Rattus norvegicus
gtatactcaaatccaccgctcttgc

SEQ ID NO: 484615 - DNA, 25 bp, Rattus norvegicus
gtatactcaaatgcaccgctcttgc

SEQ ID NO: 484616 - DNA, 25 bp, Rattus norvegicus
gtatactcaacaagattcaacctgg

SEQ ID NO: 484617 - DNA, 25 bp, Rattus norvegicus
gtatactcaacatgattcaacctgg

SEQ ID NO: 484618 - DNA, 25 bp, Rattus norvegicus
gtatactcactgctatgaaaacatg

SEQ ID NO: 484619 - DNA, 25 bp, Rattus norvegicus
gtatactcactggtatgaaaacatg

SEQ ID NO: 484620 - DNA, 25 bp, Rattus norvegicus
gtatactcatagacaagccctgcat

SEQ ID NO: 484621 - DNA, 25 bp, Rattus norvegicus
gtatactcatagtcaagccctgcat

SEQ ID NO: 484622 - DNA, 25 bp, Rattus norvegicus
gtatactccagaccatgggtaccga

SEQ ID NO: 484623 - DNA, 25 bp, Rattus norvegicus
gtatactccagagcatgggtaccga

SEQ ID NO: 484624 - DNA, 25 bp, Rattus norvegicus
gtatactccctcatcctggatgaat

SEQ ID NO: 484625 - DNA, 25 bp, Rattus norvegicus
gtatactccctcttcctggatgaat

SEQ ID NO: 484626 - DNA, 25 bp, Rattus norvegicus
gtatactccttaaccatgctattgc

SEQ ID NO: 484627 - DNA, 25 bp, Rattus norvegicus
gtatactccttactaccaaactgga

SEQ ID NO: 484628 - DNA, 25 bp, Rattus norvegicus
gtatactccttagtaccaaactgga

SEQ ID NO: 484629 - DNA, 25 bp, Rattus norvegicus
gtatactccttatccatgctattgc

SEQ ID NO: 484630 - DNA, 25 bp, Rattus norvegicus
gtatactctactacctcagtttact

SEQ ID NO: 484631 - DNA, 25 bp, Rattus norvegicus
gtatactctacttcctcagtttact

SEQ ID NO: 484632 - DNA, 25 bp, Rattus norvegicus
gtatactgccagatactaaagctgg

SEQ ID NO: 484633 - DNA, 25 bp, Rattus norvegicus
gtatactgccagttactaaagctgg

SEQ ID NO: 484634 - DNA, 25 bp, Rattus norvegicus
gtatactgccttattgtaatcctgt

SEQ ID NO: 484635 - DNA, 25 bp, Rattus norvegicus
gtatactgcctttttgtaatcctgt

SEQ ID NO: 484636 - DNA, 25 bp, Rattus norvegicus
gtatactgcgcacggtttcgtgtac

SEQ ID NO: 484637 - DNA, 25 bp, Rattus norvegicus
gtatactgcgcagggtttcgtgtac

SEQ ID NO: 484638 - DNA, 25 bp, Rattus norvegicus
gtatactgtatcagcagctttctgt

SEQ ID NO: 484639 - DNA, 25 bp, Rattus norvegicus
gtatactgtatctgcagctttctgt

SEQ ID NO: 484640 - DNA, 25 bp, Rattus norvegicus
gtatactgtccgacaaattacccaa

SEQ ID NO: 484641 - DNA, 25 bp, Rattus norvegicus
gtatactgtccgtcaaattacccaa

SEQ ID NO: 484642 - DNA, 25 bp, Rattus norvegicus
gtatactgtcgacttacgaagttaa

SEQ ID NO: 484643 - DNA, 25 bp, Rattus norvegicus
gtatactgtcgagttacgaagttaa

SEQ ID NO: 484644 - DNA, 25 bp, Rattus norvegicus
gtatactgtggacaagccagtcctt

SEQ ID NO: 484645 - DNA, 25 bp, Rattus norvegicus
gtatactgtggagaagccagtcctt

SEQ ID NO: 484646 - DNA, 25 bp, Rattus norvegicus
gtatactgtgttcggactgtactat

SEQ ID NO: 484647 - DNA, 25 bp, Rattus norvegicus
gtatactgtgttgggactgtactat

SEQ ID NO: 484648 - DNA, 25 bp, Rattus norvegicus
gtatactgttggatctagcttccat

SEQ ID NO: 484649 - DNA, 25 bp, Rattus norvegicus
gtatactgttggttctagcttccat

SEQ ID NO: 484650 - DNA, 25 bp, Rattus norvegicus
gtatactgtttcaccaaatgattaa

SEQ ID NO: 484651 - DNA, 25 bp, Rattus norvegicus
gtatactgtttctccaaatgattaa

SEQ ID NO: 484652 - DNA, 25 bp, Rattus norvegicus
gtatacttaactactagtcgcgctc

SEQ ID NO: 484653 - DNA, 25 bp, Rattus norvegicus
gtatacttaacttctagtcgcgctc

SEQ ID NO: 484654 - DNA, 25 bp, Rattus norvegicus
gtatacttcactcatgcttgtctgg

SEQ ID NO: 484655 - DNA, 25 bp, Rattus norvegicus
gtatacttcactgatgcttgtctgg

SEQ ID NO: 484656 - DNA, 25 bp, Rattus norvegicus
gtatacttcattccctacaactcaa

SEQ ID NO: 484657 - DNA, 25 bp, Rattus norvegicus
gtatacttcattgcctacaactcaa

SEQ ID NO: 484658 - DNA, 25 bp, Rattus norvegicus
gtatacttccggaaactgtcagatg

SEQ ID NO: 484659 - DNA, 25 bp, Rattus norvegicus
gtatacttccggtaactgtcagatg

SEQ ID NO: 484660 - DNA, 25 bp, Rattus norvegicus
gtatacttctttattaatgcacaaa

SEQ ID NO: 484661 - DNA, 25 bp, Rattus norvegicus
gtatacttcttttttaatgcacaaa

SEQ ID NO: 484662 - DNA, 25 bp, Rattus norvegicus
gtatacttgtttaattctctccgaa

SEQ ID NO: 484663 - DNA, 25 bp, Rattus norvegicus
gtatacttgttttattctctccgaa

SEQ ID NO: 484664 - DNA, 25 bp, Rattus norvegicus
gtatactttaacaatgatcatgagg

SEQ ID NO: 484665 - DNA, 25 bp, Rattus norvegicus
gtatactttaactatgatcatgagg

SEQ ID NO: 484666 - DNA, 25 bp, Rattus norvegicus
gtatactttattatctgttttctta

SEQ ID NO: 484667 - DNA, 25 bp, Rattus norvegicus
gtatactttattttctgttttctta

SEQ ID NO: 484668 - DNA, 25 bp, Rattus norvegicus
gtatagacagaacctgcacccagcc

SEQ ID NO: 484669 - DNA, 25 bp, Rattus norvegicus
gtatagacagaagctgcacccagcc

SEQ ID NO: 484670 - DNA, 25 bp, Rattus norvegicus
gtatagacagacagcccaacgagat

SEQ ID NO: 484671 - DNA, 25 bp, Rattus norvegicus
gtatagacagactgcccaacgagat

SEQ ID NO: 484672 - DNA, 25 bp, Rattus norvegicus
gtatagacatgtcatctcagcacca

SEQ ID NO: 484673 - DNA, 25 bp, Rattus norvegicus
gtatagacatgtgatctcagcacca

SEQ ID NO: 484674 - DNA, 25 bp, Rattus norvegicus
gtatagacctctactcggccgctgc

SEQ ID NO: 484675 - DNA, 25 bp, Rattus norvegicus
gtatagacctcttctcggccgctgc

SEQ ID NO: 484676 - DNA, 25 bp, Rattus norvegicus
gtatagaccttaccatatccttcag

SEQ ID NO: 484677 - DNA, 25 bp, Rattus norvegicus
gtatagaccttagcatatccttcag

SEQ ID NO: 484678 - DNA, 25 bp, Rattus norvegicus
gtatagactttcactcttgcaaggg

SEQ ID NO: 484679 - DNA, 25 bp, Rattus norvegicus
gtatagactttctctcttgcaaggg

SEQ ID NO: 484680 - DNA, 25 bp, Rattus norvegicus
gtatagagagctcattgtttcttgt

SEQ ID NO: 484681 - DNA, 25 bp, Rattus norvegicus
gtatagagagctgattgtttcttgt

SEQ ID NO: 484682 - DNA, 25 bp, Rattus norvegicus
gtatagagccacaaaccttagtcag

SEQ ID NO: 484683 - DNA, 25 bp, Rattus norvegicus
gtatagagccactaaccttagtcag

SEQ ID NO: 484684 - DNA, 25 bp, Rattus norvegicus
gtatagaggcacactgttcaacaga

SEQ ID NO: 484685 - DNA, 25 bp, Rattus norvegicus
gtatagaggcactctgttcaacaga

SEQ ID NO: 484686 - DNA, 25 bp, Rattus norvegicus
gtatagagtgatcagggtgccaaaa

SEQ ID NO: 484687 - DNA, 25 bp, Rattus norvegicus
gtatagagtgatgagggtgccaaaa

SEQ ID NO: 484688 - DNA, 25 bp, Rattus norvegicus
gtatagataaccactcaagacctgt

SEQ ID NO: 484689 - DNA, 25 bp, Rattus norvegicus
gtatagataacctctcaagacctgt

SEQ ID NO: 484690 - DNA, 25 bp, Rattus norvegicus
gtatagatctgtcccattctgacca

SEQ ID NO: 484691 - DNA, 25 bp, Rattus norvegicus
gtatagatctgtctggctttcttgc

SEQ ID NO: 484692 - DNA, 25 bp, Rattus norvegicus
gtatagatctgtgccattctgacca

SEQ ID NO: 484693 - DNA, 25 bp, Rattus norvegicus
gtatagatctgtgtggctttcttgc

SEQ ID NO: 484694 - DNA, 25 bp, Rattus norvegicus
gtatagatgcacatgcttgagacaa

SEQ ID NO: 484695 - DNA, 25 bp, Rattus norvegicus
gtatagatgcacttgcttgagacaa

SEQ ID NO: 484696 - DNA, 25 bp, Rattus norvegicus
gtatagattgtcacttactgtgtaa

SEQ ID NO: 484697 - DNA, 25 bp, Rattus norvegicus
gtatagattgtctcttactgtgtaa

SEQ ID NO: 484698 - DNA, 25 bp, Rattus norvegicus
gtatagcaaagacccctgccgtagt

SEQ ID NO: 484699 - DNA, 25 bp, Rattus norvegicus
gtatagcaaagagccctgccgtagt

SEQ ID NO: 484700 - DNA, 25 bp, Rattus norvegicus
gtatagcagcacactttatttgtag

SEQ ID NO: 484701 - DNA, 25 bp, Rattus norvegicus
gtatagcagcactctttatttgtag

SEQ ID NO: 484702 - DNA, 25 bp, Rattus norvegicus
gtatagcagtaaacgttcaaaggaa

SEQ ID NO: 484703 - DNA, 25 bp, Rattus norvegicus
gtatagcagtaatcgttcaaaggaa

SEQ ID NO: 484704 - DNA, 25 bp, Rattus norvegicus
gtatagcataggcatcctgtagttt

SEQ ID NO: 484705 - DNA, 25 bp, Rattus norvegicus
gtatagcataggcatgtcaccaaga

SEQ ID NO: 484706 - DNA, 25 bp, Rattus norvegicus
gtatagcatagggatcctgtagttt

SEQ ID NO: 484707 - DNA, 25 bp, Rattus norvegicus
gtatagcatagggatgtcaccaaga

SEQ ID NO: 484708 - DNA, 25 bp, Rattus norvegicus
gtatagccagaaagtccggtcaaaa

SEQ ID NO: 484709 - DNA, 25 bp, Rattus norvegicus
gtatagccagaatgtccggtcaaaa

SEQ ID NO: 484710 - DNA, 25 bp, Rattus norvegicus
gtatagccagcaagaatcagaacct

SEQ ID NO: 484711 - DNA, 25 bp, Rattus norvegicus
gtatagccagcatgaatcagaacct

SEQ ID NO: 484712 - DNA, 25 bp, Rattus norvegicus
gtatagccattccacaaccaagctt

SEQ ID NO: 484713 - DNA, 25 bp, Rattus norvegicus
gtatagccattcgacaaccaagctt

SEQ ID NO: 484714 - DNA, 25 bp, Rattus norvegicus
gtatagcccaacctggaacactgca

SEQ ID NO: 484715 - DNA, 25 bp, Rattus norvegicus
gtatagcccaacgtggaacactgca

SEQ ID NO: 484716 - DNA, 25 bp, Rattus norvegicus
gtatagcccggaacccagtgatcaa

SEQ ID NO: 484717 - DNA, 25 bp, Rattus norvegicus
gtatagcccggatcccagtgatcaa

SEQ ID NO: 484718 - DNA, 25 bp, Rattus norvegicus
gtatagcctgtccatttgtatctga

SEQ ID NO: 484719 - DNA, 25 bp, Rattus norvegicus
gtatagcctgtcgatttgtatctga

SEQ ID NO: 484720 - DNA, 25 bp, Rattus norvegicus
gtatagctttgtacactgatgtttt

SEQ ID NO: 484721 - DNA, 25 bp, Rattus norvegicus
gtatagctttgttcactgatgtttt

SEQ ID NO: 484722 - DNA, 25 bp, Rattus norvegicus
gtataggaatacagccttgaacttc

SEQ ID NO: 484723 - DNA, 25 bp, Rattus norvegicus
gtataggaatactgccttgaacttc

SEQ ID NO: 484724 - DNA, 25 bp, Rattus norvegicus
gtataggacacacggcccgacagaa

SEQ ID NO: 484725 - DNA, 25 bp, Rattus norvegicus
gtataggacacagggcccgacagaa

SEQ ID NO: 484726 - DNA, 25 bp, Rattus norvegicus
gtataggaccgtcatttgtcctttt

SEQ ID NO: 484727 - DNA, 25 bp, Rattus norvegicus
gtataggaccgtgatttgtcctttt

SEQ ID NO: 484728 - DNA, 25 bp, Rattus norvegicus
gtataggcaagaagtgaccagctca

SEQ ID NO: 484729 - DNA, 25 bp, Rattus norvegicus
gtataggcaagatgtgaccagctca

SEQ ID NO: 484730 - DNA, 25 bp, Rattus norvegicus
gtataggcagagcagccctcaggac

SEQ ID NO: 484731 - DNA, 25 bp, Rattus norvegicus
gtataggcagaggagccctcaggac

SEQ ID NO: 484732 - DNA, 25 bp, Rattus norvegicus
gtataggccatcagtacataaaagt

SEQ ID NO: 484733 - DNA, 25 bp, Rattus norvegicus
gtataggccatctgtacataaaagt

SEQ ID NO: 484734 - DNA, 25 bp, Rattus norvegicus
gtataggccgataattccagcactg

SEQ ID NO: 484735 - DNA, 25 bp, Rattus norvegicus
gtataggccgattattccagcactg

SEQ ID NO: 484736 - DNA, 25 bp, Rattus norvegicus
gtataggctatactctttgtttaat

SEQ ID NO: 484737 - DNA, 25 bp, Rattus norvegicus
gtataggctatagtctttgtttaat

SEQ ID NO: 484738 - DNA, 25 bp, Rattus norvegicus
gtataggcttctatattgcaaagtt

SEQ ID NO: 484739 - DNA, 25 bp, Rattus norvegicus
gtataggcttctttattgcaaagtt

SEQ ID NO: 484740 - DNA, 25 bp, Rattus norvegicus
gtataggctttaatgtttattgctg

SEQ ID NO: 484741 - DNA, 25 bp, Rattus norvegicus
gtataggctttattgtttattgctg

SEQ ID NO: 484742 - DNA, 25 bp, Rattus norvegicus
gtatagggaaccagtccaacccctg

SEQ ID NO: 484743 - DNA, 25 bp, Rattus norvegicus
gtatagggaacctgtccaacccctg

SEQ ID NO: 484744 - DNA, 25 bp, Rattus norvegicus
gtatagggacctaatcactgacagg

SEQ ID NO: 484745 - DNA, 25 bp, Rattus norvegicus
gtatagggaccttatcactgacagg

SEQ ID NO: 484746 - DNA, 25 bp, Rattus norvegicus
gtatagggtcaaacaggctgcagca

SEQ ID NO: 484747 - DNA, 25 bp, Rattus norvegicus
gtatagggtcaatcaggctgcagca

SEQ ID NO: 484748 - DNA, 25 bp, Rattus norvegicus
gtatagggttccacaatctgttcat

SEQ ID NO: 484749 - DNA, 25 bp, Rattus norvegicus
gtatagggttcctcaatctgttcat

SEQ ID NO: 484750 - DNA, 25 bp, Rattus norvegicus
gtataggtcacacgacccagctgca

SEQ ID NO: 484751 - DNA, 25 bp, Rattus norvegicus
gtataggtcacaggacccagctgca

SEQ ID NO: 484752 - DNA, 25 bp, Rattus norvegicus
gtataggtcattaccaagttgtgtt

SEQ ID NO: 484753 - DNA, 25 bp, Rattus norvegicus
gtataggtcatttccaagttgtgtt

SEQ ID NO: 484754 - DNA, 25 bp, Rattus norvegicus
gtataggttaccatgccatctctgc

SEQ ID NO: 484755 - DNA, 25 bp, Rattus norvegicus
gtataggttaccttgccatctctgc

SEQ ID NO: 484756 - DNA, 25 bp, Rattus norvegicus
gtatagtacacacatctaactctga

SEQ ID NO: 484757 - DNA, 25 bp, Rattus norvegicus
gtatagtacacagatctaactctga

SEQ ID NO: 484758 - DNA, 25 bp, Rattus norvegicus
gtatagtaccttattctctgctgtg

SEQ ID NO: 484759 - DNA, 25 bp, Rattus norvegicus
gtatagtacctttttctctgctgtg

SEQ ID NO: 484760 - DNA, 25 bp, Rattus norvegicus
gtatagtatatgatctttcctgaaa

SEQ ID NO: 484761 - DNA, 25 bp, Rattus norvegicus
gtatagtatatgttctttcctgaaa

SEQ ID NO: 484762 - DNA, 25 bp, Rattus norvegicus
gtatagtatcatagctgcccttcaa

SEQ ID NO: 484763 - DNA, 25 bp, Rattus norvegicus
gtatagtatcattgctgcccttcaa

SEQ ID NO: 484764 - DNA, 25 bp, Rattus norvegicus
gtatagtattcgcgcacctgaggat

SEQ ID NO: 484765 - DNA, 25 bp, Rattus norvegicus
gtatagtattcgggcacctgaggat

SEQ ID NO: 484766 - DNA, 25 bp, Rattus norvegicus
gtatagtctggtaagtctctttcga

SEQ ID NO: 484767 - DNA, 25 bp, Rattus norvegicus
gtatagtctggttagtctctttcga

SEQ ID NO: 484768 - DNA, 25 bp, Rattus norvegicus
gtatagtgaagaattgactttgagt

SEQ ID NO: 484769 - DNA, 25 bp, Rattus norvegicus
gtatagtgaagatttgactttgagt

SEQ ID NO: 484770 - DNA, 25 bp, Rattus norvegicus
gtatagtgccacagatccgatttta

SEQ ID NO: 484771 - DNA, 25 bp, Rattus norvegicus
gtatagtgccactgatccgatttta

SEQ ID NO: 484772 - DNA, 25 bp, Rattus norvegicus
gtatagtggacgctccatcggctct

SEQ ID NO: 484773 - DNA, 25 bp, Rattus norvegicus
gtatagtggacggtccatcggctct

SEQ ID NO: 484774 - DNA, 25 bp, Rattus norvegicus
gtatagtgttctaaacttgcttttt

SEQ ID NO: 484775 - DNA, 25 bp, Rattus norvegicus
gtatagtgttcttaacttgcttttt

SEQ ID NO: 484776 - DNA, 25 bp, Rattus norvegicus
gtatagttaacacactaccgaatgt

SEQ ID NO: 484777 - DNA, 25 bp, Rattus norvegicus
gtatagttaacagactaccgaatgt

SEQ ID NO: 484778 - DNA, 25 bp, Rattus norvegicus
gtatagttaatgcacccctgtcacc

SEQ ID NO: 484779 - DNA, 25 bp, Rattus norvegicus
gtatagttaatggacccctgtcacc

SEQ ID NO: 484780 - DNA, 25 bp, Rattus norvegicus
gtatagttatgacgcctgattagat

SEQ ID NO: 484781 - DNA, 25 bp, Rattus norvegicus
gtatagttatgaggcctgattagat

SEQ ID NO: 484782 - DNA, 25 bp, Rattus norvegicus
gtatagtttaaaaatgcttctgtgt

SEQ ID NO: 484783 - DNA, 25 bp, Rattus norvegicus
gtatagtttaaatatgcttctgtgt

SEQ ID NO: 484784 - DNA, 25 bp, Rattus norvegicus
gtatagtttattatccttcgggcag

SEQ ID NO: 484785 - DNA, 25 bp, Rattus norvegicus
gtatagtttattttccttcgggcag

SEQ ID NO: 484786 - DNA, 25 bp, Rattus norvegicus
gtatagttttctccgaatgagcgag

SEQ ID NO: 484787 - DNA, 25 bp, Rattus norvegicus
gtatagttttctgcgaatgagcgag

SEQ ID NO: 484788 - DNA, 25 bp, Rattus norvegicus
gtatataagctgatcactctgtaca

SEQ ID NO: 484789 - DNA, 25 bp, Rattus norvegicus
gtatataagctgttcactctgtaca

SEQ ID NO: 484790 - DNA, 25 bp, Rattus norvegicus
gtatataattttactgtgtatgttc

SEQ ID NO: 484791 - DNA, 25 bp, Rattus norvegicus
gtatataatttttctgtgtatgttc

SEQ ID NO: 484792 - DNA, 25 bp, Rattus norvegicus
gtatatacactgctcggaaaacata

SEQ ID NO: 484793 - DNA, 25 bp, Rattus norvegicus
gtatatacactggtcggaaaacata

SEQ ID NO: 484794 - DNA, 25 bp, Rattus norvegicus
gtatataccacaagttacagcctgc

SEQ ID NO: 484795 - DNA, 25 bp, Rattus norvegicus
gtatataccacatgttacagcctgc

SEQ ID NO: 484796 - DNA, 25 bp, Rattus norvegicus
gtatataccagcctttaccaacatc

SEQ ID NO: 484797 - DNA, 25 bp, Rattus norvegicus
gtatataccagcgtttaccaacatc

SEQ ID NO: 484798 - DNA, 25 bp, Rattus norvegicus
gtatatacccttcttaagaccttca

SEQ ID NO: 484799 - DNA, 25 bp, Rattus norvegicus
gtatatacccttgttaagaccttca

SEQ ID NO: 484800 - DNA, 25 bp, Rattus norvegicus
gtatatacctctcattgtagcacat

SEQ ID NO: 484801 - DNA, 25 bp, Rattus norvegicus
gtatatacctctgattgtagcacat

SEQ ID NO: 484802 - DNA, 25 bp, Rattus norvegicus
gtatatacctggaagtctttgcccg

SEQ ID NO: 484803 - DNA, 25 bp, Rattus norvegicus
gtatatacctggcttgtctctgaca

SEQ ID NO: 484804 - DNA, 25 bp, Rattus norvegicus
gtatatacctgggttgtctctgaca

SEQ ID NO: 484805 - DNA, 25 bp, Rattus norvegicus
gtatatacctggtagtctttgcccg

SEQ ID NO: 484806 - DNA, 25 bp, Rattus norvegicus
gtatatactatgcttgtcttcttgt

SEQ ID NO: 484807 - DNA, 25 bp, Rattus norvegicus
gtatatactatggttgtcttcttgt

SEQ ID NO: 484808 - DNA, 25 bp, Rattus norvegicus
gtatatactgttatgtatcctacat

SEQ ID NO: 484809 - DNA, 25 bp, Rattus norvegicus
gtatatactgttttgtatcctacat

SEQ ID NO: 484810 - DNA, 25 bp, Rattus norvegicus
gtatatagaataaactgtcgtggac

SEQ ID NO: 484811 - DNA, 25 bp, Rattus norvegicus
gtatatagaatatactgtcgtggac

SEQ ID NO: 484812 - DNA, 25 bp, Rattus norvegicus
gtatatagagctactctatctgcct

SEQ ID NO: 484813 - DNA, 25 bp, Rattus norvegicus
gtatatagagcttctctatctgcct

SEQ ID NO: 484814 - DNA, 25 bp, Rattus norvegicus
gtatatagcaaccatcactgacaag

SEQ ID NO: 484815 - DNA, 25 bp, Rattus norvegicus
gtatatagcaacgatcactgacaag

SEQ ID NO: 484816 - DNA, 25 bp, Rattus norvegicus
gtatatagcccaagcgaactcggaa

SEQ ID NO: 484817 - DNA, 25 bp, Rattus norvegicus
gtatatagcccatgcgaactcggaa

SEQ ID NO: 484818 - DNA, 25 bp, Rattus norvegicus
gtatatagcgtgatttcagattgta

SEQ ID NO: 484819 - DNA, 25 bp, Rattus norvegicus
gtatatagcgtgttttcagattgta

SEQ ID NO: 484820 - DNA, 25 bp, Rattus norvegicus
gtatatagtttcagagtcctgagac

SEQ ID NO: 484821 - DNA, 25 bp, Rattus norvegicus
gtatatagtttctgagtcctgagac

SEQ ID NO: 484822 - DNA, 25 bp, Rattus norvegicus
gtatatagtttgagtccctgggcct

SEQ ID NO: 484823 - DNA, 25 bp, Rattus norvegicus
gtatatagtttgtgtccctgggcct

SEQ ID NO: 484824 - DNA, 25 bp, Rattus norvegicus
gtatatatactcatctttcctggaa

SEQ ID NO: 484825 - DNA, 25 bp, Rattus norvegicus
gtatatatactcttctttcctggaa

SEQ ID NO: 484826 - DNA, 25 bp, Rattus norvegicus
gtatatatgcttcagcctcactcct

SEQ ID NO: 484827 - DNA, 25 bp, Rattus norvegicus
gtatatatgcttgagcctcactcct

SEQ ID NO: 484828 - DNA, 25 bp, Rattus norvegicus
gtatatatgggcataatcacttaag

SEQ ID NO: 484829 - DNA, 25 bp, Rattus norvegicus
gtatatatgggcttaatcacttaag

SEQ ID NO: 484830 - DNA, 25 bp, Rattus norvegicus
gtatatattcaaaaatgctcccttt

SEQ ID NO: 484831 - DNA, 25 bp, Rattus norvegicus
gtatatattcaataatgctcccttt

SEQ ID NO: 484832 - DNA, 25 bp, Rattus norvegicus
gtatatattcacactctgaccttta

SEQ ID NO: 484833 - DNA, 25 bp, Rattus norvegicus
gtatatattcactctctgaccttta

SEQ ID NO: 484834 - DNA, 25 bp, Rattus norvegicus
gtatatcaactgaataggactggca

SEQ ID NO: 484835 - DNA, 25 bp, Rattus norvegicus
gtatatcaactgtataggactggca

SEQ ID NO: 484836 - DNA, 25 bp, Rattus norvegicus
gtatatcaagacacctatggctgta

SEQ ID NO: 484837 - DNA, 25 bp, Rattus norvegicus
gtatatcaagactcctatggctgta

SEQ ID NO: 484838 - DNA, 25 bp, Rattus norvegicus
gtatatcacactacccttaacaaaa

SEQ ID NO: 484839 - DNA, 25 bp, Rattus norvegicus
gtatatcacacttcccttaacaaaa

SEQ ID NO: 484840 - DNA, 25 bp, Rattus norvegicus
gtatatcatgaaacccacacctttg

SEQ ID NO: 484841 - DNA, 25 bp, Rattus norvegicus
gtatatcatgaatcccacacctttg

SEQ ID NO: 484842 - DNA, 25 bp, Rattus norvegicus
gtatatcatgccaagctctgtgaat

SEQ ID NO: 484843 - DNA, 25 bp, Rattus norvegicus
gtatatcatgcctagctctgtgaat

SEQ ID NO: 484844 - DNA, 25 bp, Rattus norvegicus
gtatatccacgtatgctgactgggt

SEQ ID NO: 484845 - DNA, 25 bp, Rattus norvegicus
gtatatccacgtttgctgactgggt

SEQ ID NO: 484846 - DNA, 25 bp, Rattus norvegicus
gtatatccaggaccgcgtctgccgt

SEQ ID NO: 484847 - DNA, 25 bp, Rattus norvegicus
gtatatccaggagcgcgtctgccgt

SEQ ID NO: 484848 - DNA, 25 bp, Rattus norvegicus
gtatatccaggtaccatgtgtgtgc

SEQ ID NO: 484849 - DNA, 25 bp, Rattus norvegicus
gtatatccaggttccatgtgtgtgc

SEQ ID NO: 484850 - DNA, 25 bp, Rattus norvegicus
gtatatccagtcactttgccagagc

SEQ ID NO: 484851 - DNA, 25 bp, Rattus norvegicus
gtatatccagtctctttgccagagc

SEQ ID NO: 484852 - DNA, 25 bp, Rattus norvegicus
gtatatccatgcaccgccagatgca

SEQ ID NO: 484853 - DNA, 25 bp, Rattus norvegicus
gtatatccatgctccgccagatgca

SEQ ID NO: 484854 - DNA, 25 bp, Rattus norvegicus
gtatatcccaaacggccgggtgctt

SEQ ID NO: 484855 - DNA, 25 bp, Rattus norvegicus
gtatatcccaaagggccgggtgctt

SEQ ID NO: 484856 - DNA, 25 bp, Rattus norvegicus
gtatatcccatgattggaactgagg

SEQ ID NO: 484857 - DNA, 25 bp, Rattus norvegicus
gtatatcccatgtttggaactgagg

SEQ ID NO: 484858 - DNA, 25 bp, Rattus norvegicus
gtatatccctgaaaactacccagac

SEQ ID NO: 484859 - DNA, 25 bp, Rattus norvegicus
gtatatccctgataactacccagac

SEQ ID NO: 484860 - DNA, 25 bp, Rattus norvegicus
gtatatcccttaaaatagtactata

SEQ ID NO: 484861 - DNA, 25 bp, Rattus norvegicus
gtatatcccttataatagtactata

SEQ ID NO: 484862 - DNA, 25 bp, Rattus norvegicus
gtatatcctcacactgtcagaagac

SEQ ID NO: 484863 - DNA, 25 bp, Rattus norvegicus
gtatatcctcactctgtcagaagac

SEQ ID NO: 484864 - DNA, 25 bp, Rattus norvegicus
gtatatcctttgcacaccatgctat

SEQ ID NO: 484865 - DNA, 25 bp, Rattus norvegicus
gtatatcctttggacaccatgctat

SEQ ID NO: 484866 - DNA, 25 bp, Rattus norvegicus
gtatatcgtttaacattttctgttt

SEQ ID NO: 484867 - DNA, 25 bp, Rattus norvegicus
gtatatcgtttatcattttctgttt

SEQ ID NO: 484868 - DNA, 25 bp, Rattus norvegicus
gtatatctaccacagctccagagct

SEQ ID NO: 484869 - DNA, 25 bp, Rattus norvegicus
gtatatctaccagagctccagagct

SEQ ID NO: 484870 - DNA, 25 bp, Rattus norvegicus
gtatatctacctctacaactgtctg

SEQ ID NO: 484871 - DNA, 25 bp, Rattus norvegicus
gtatatctacctgtacaactgtctg

SEQ ID NO: 484872 - DNA, 25 bp, Rattus norvegicus
gtatatctatatctctaagctgttg

SEQ ID NO: 484873 - DNA, 25 bp, Rattus norvegicus
gtatatctatatgtctaagctgttg

SEQ ID NO: 484874 - DNA, 25 bp, Rattus norvegicus
gtatatctggatcagcgtctgtctt

SEQ ID NO: 484875 - DNA, 25 bp, Rattus norvegicus
gtatatctggatgagcgtctgtctt

SEQ ID NO: 484876 - DNA, 25 bp, Rattus norvegicus
gtatatctggtacccacaagtctgg

SEQ ID NO: 484877 - DNA, 25 bp, Rattus norvegicus
gtatatctggtagccacaagtctgg

SEQ ID NO: 484878 - DNA, 25 bp, Rattus norvegicus
gtatatctgtacatatccatgtaga

SEQ ID NO: 484879 - DNA, 25 bp, Rattus norvegicus
gtatatctgtacttatccatgtaga

SEQ ID NO: 484880 - DNA, 25 bp, Rattus norvegicus
gtatatctgttgattgggttgttaa

SEQ ID NO: 484881 - DNA, 25 bp, Rattus norvegicus
gtatatctgttgtttgggttgttaa

SEQ ID NO: 484882 - DNA, 25 bp, Rattus norvegicus
gtatatcttctcacaaaacatcaca

SEQ ID NO: 484883 - DNA, 25 bp, Rattus norvegicus
gtatatcttctctcaaaacatcaca

SEQ ID NO: 484884 - DNA, 25 bp, Rattus norvegicus
gtatatgaagtcagctcactgctcc

SEQ ID NO: 484885 - DNA, 25 bp, Rattus norvegicus
gtatatgaagtctgctcactgctcc

SEQ ID NO: 484886 - DNA, 25 bp, Rattus norvegicus
gtatatgaccccagggcctgagaca

SEQ ID NO: 484887 - DNA, 25 bp, Rattus norvegicus
gtatatgacccctgggcctgagaca

SEQ ID NO: 484888 - DNA, 25 bp, Rattus norvegicus
gtatatgactgaatggagctccaca

SEQ ID NO: 484889 - DNA, 25 bp, Rattus norvegicus
gtatatgactgattggagctccaca

SEQ ID NO: 484890 - DNA, 25 bp, Rattus norvegicus
gtatatgacttcatttttctgaata

SEQ ID NO: 484891 - DNA, 25 bp, Rattus norvegicus
gtatatgacttcttttttctgaata

SEQ ID NO: 484892 - DNA, 25 bp, Rattus norvegicus
gtatatgagtgcactatagctgtct

SEQ ID NO: 484893 - DNA, 25 bp, Rattus norvegicus
gtatatgagtgctctatagctgtct

SEQ ID NO: 484894 - DNA, 25 bp, Rattus norvegicus
gtatatgatgtgcctttaatacgtg

SEQ ID NO: 484895 - DNA, 25 bp, Rattus norvegicus
gtatatgatgtggctttaatacgtg

SEQ ID NO: 484896 - DNA, 25 bp, Rattus norvegicus
gtatatgcagaaagaccctgacccc

SEQ ID NO: 484897 - DNA, 25 bp, Rattus norvegicus
gtatatgcagaatgaccctgacccc

SEQ ID NO: 484898 - DNA, 25 bp, Rattus norvegicus
gtatatgcaggcacttctgtctgcc

SEQ ID NO: 484899 - DNA, 25 bp, Rattus norvegicus
gtatatgcaggctcttctgtctgcc

SEQ ID NO: 484900 - DNA, 25 bp, Rattus norvegicus
gtatatgccacaccccaagtgttaa

SEQ ID NO: 484901 - DNA, 25 bp, Rattus norvegicus
gtatatgccacagcccaagtgttaa

SEQ ID NO: 484902 - DNA, 25 bp, Rattus norvegicus
gtatatgcctcaacactcatgaaga

SEQ ID NO: 484903 - DNA, 25 bp, Rattus norvegicus
gtatatgcctcatcactcatgaaga

SEQ ID NO: 484904 - DNA, 25 bp, Rattus norvegicus
gtatatgcctttcttgaaaccgtta

SEQ ID NO: 484905 - DNA, 25 bp, Rattus norvegicus
gtatatgcctttgttgaaaccgtta

SEQ ID NO: 484906 - DNA, 25 bp, Rattus norvegicus
gtatatgctagtctccacagcggct

SEQ ID NO: 484907 - DNA, 25 bp, Rattus norvegicus
gtatatgctagtgtccacagcggct

SEQ ID NO: 484908 - DNA, 25 bp, Rattus norvegicus
gtatatgctcttccttaaaccctga

SEQ ID NO: 484909 - DNA, 25 bp, Rattus norvegicus
gtatatgctcttgcttaaaccctga

SEQ ID NO: 484910 - DNA, 25 bp, Rattus norvegicus
gtatatgctgagaaagtgctctacc

SEQ ID NO: 484911 - DNA, 25 bp, Rattus norvegicus
gtatatgctgagtaagtgctctacc

SEQ ID NO: 484912 - DNA, 25 bp, Rattus norvegicus
gtatatggccccagaagttctagat

SEQ ID NO: 484913 - DNA, 25 bp, Rattus norvegicus
gtatatggcccctgaagttctagat

SEQ ID NO: 484914 - DNA, 25 bp, Rattus norvegicus
gtatatggcttgaactggaactaca

SEQ ID NO: 484915 - DNA, 25 bp, Rattus norvegicus
gtatatggcttgtactggaactaca

SEQ ID NO: 484916 - DNA, 25 bp, Rattus norvegicus
gtatatgggagacccttgatgttta

SEQ ID NO: 484917 - DNA, 25 bp, Rattus norvegicus
gtatatgggagagccttgatgttta

SEQ ID NO: 484918 - DNA, 25 bp, Rattus norvegicus
gtatatgggcgtctcactaaaataa

SEQ ID NO: 484919 - DNA, 25 bp, Rattus norvegicus
gtatatgggcgtgtcactaaaataa

SEQ ID NO: 484920 - DNA, 25 bp, Rattus norvegicus
gtatatggtgacaccttttccagaa

SEQ ID NO: 484921 - DNA, 25 bp, Rattus norvegicus
gtatatggtgactccttttccagaa

SEQ ID NO: 484922 - DNA, 25 bp, Rattus norvegicus
gtatatgtaaccagtgtgtcccatc

SEQ ID NO: 484923 - DNA, 25 bp, Rattus norvegicus
gtatatgtaacctgtgtgtcccatc

SEQ ID NO: 484924 - DNA, 25 bp, Rattus norvegicus
gtatatgtagtaccttagtctctga

SEQ ID NO: 484925 - DNA, 25 bp, Rattus norvegicus
gtatatgtagtagcttagtctctga

SEQ ID NO: 484926 - DNA, 25 bp, Rattus norvegicus
gtatatgtatggctgcatctataaa

SEQ ID NO: 484927 - DNA, 25 bp, Rattus norvegicus
gtatatgtatgggtgcatctataaa

SEQ ID NO: 484928 - DNA, 25 bp, Rattus norvegicus
gtatatgtccaaattgcatttcatt

SEQ ID NO: 484929 - DNA, 25 bp, Rattus norvegicus
gtatatgtccaatttgcatttcatt

SEQ ID NO: 484930 - DNA, 25 bp, Rattus norvegicus
gtatatgtctttctttcctttggaa

SEQ ID NO: 484931 - DNA, 25 bp, Rattus norvegicus
gtatatgtctttgtttcctttggaa

SEQ ID NO: 484932 - DNA, 25 bp, Rattus norvegicus
gtatatgtgcaaagtcccgtatgtg

SEQ ID NO: 484933 - DNA, 25 bp, Rattus norvegicus
gtatatgtgcaatgtcccgtatgtg

SEQ ID NO: 484934 - DNA, 25 bp, Rattus norvegicus
gtatatgtgggtccagtacctgccg

SEQ ID NO: 484935 - DNA, 25 bp, Rattus norvegicus
gtatatgtgggtgcagtacctgccg

SEQ ID NO: 484936 - DNA, 25 bp, Rattus norvegicus
gtatatgtgtgaaagcctgcttcct

SEQ ID NO: 484937 - DNA, 25 bp, Rattus norvegicus
gtatatgtgtgatagcctgcttcct

SEQ ID NO: 484938 - DNA, 25 bp, Rattus norvegicus
gtatatgttaccagatagacctcag

SEQ ID NO: 484939 - DNA, 25 bp, Rattus norvegicus
gtatatgttacctgatagacctcag

SEQ ID NO: 484940 - DNA, 25 bp, Rattus norvegicus
gtatatgttcatagctggagcacag

SEQ ID NO: 484941 - DNA, 25 bp, Rattus norvegicus
gtatatgttcattgctggagcacag

SEQ ID NO: 484942 - DNA, 25 bp, Rattus norvegicus
gtatatgttctactttctagggaca

SEQ ID NO: 484943 - DNA, 25 bp, Rattus norvegicus
gtatatgttctagtttctagggaca

SEQ ID NO: 484944 - DNA, 25 bp, Rattus norvegicus
gtatatgtttgcactctgaagtctg

SEQ ID NO: 484945 - DNA, 25 bp, Rattus norvegicus
gtatatgtttgctctctgaagtctg

SEQ ID NO: 484946 - DNA, 25 bp, Rattus norvegicus
gtatatgttttccacttttgcgttt

SEQ ID NO: 484947 - DNA, 25 bp, Rattus norvegicus
gtatatgttttcgacttttgcgttt

SEQ ID NO: 484948 - DNA, 25 bp, Rattus norvegicus
gtatatgttttgaacctctgctggc

SEQ ID NO: 484949 - DNA, 25 bp, Rattus norvegicus
gtatatgttttgtacctctgctggc

SEQ ID NO: 484950 - DNA, 25 bp, Rattus norvegicus
gtatattaagggaggcgttgctcag

SEQ ID NO: 484951 - DNA, 25 bp, Rattus norvegicus
gtatattaagggtggcgttgctcag

SEQ ID NO: 484952 - DNA, 25 bp, Rattus norvegicus
gtatattacctgattacttgtacaa

SEQ ID NO: 484953 - DNA, 25 bp, Rattus norvegicus
gtatattacctgtttacttgtacaa

SEQ ID NO: 484954 - DNA, 25 bp, Rattus norvegicus
gtatattactgtatcttgtgtacaa

SEQ ID NO: 484955 - DNA, 25 bp, Rattus norvegicus
gtatattactgtttcttgtgtacaa

SEQ ID NO: 484956 - DNA, 25 bp, Rattus norvegicus
gtatattatgtgcttacctagtgcc

SEQ ID NO: 484957 - DNA, 25 bp, Rattus norvegicus
gtatattatgtggttacctagtgcc

SEQ ID NO: 484958 - DNA, 25 bp, Rattus norvegicus
gtatattcagaacacttgcccctca

SEQ ID NO: 484959 - DNA, 25 bp, Rattus norvegicus
gtatattcagaagacttgcccctca

SEQ ID NO: 484960 - DNA, 25 bp, Rattus norvegicus
gtatattccaacacactgcttaacg

SEQ ID NO: 484961 - DNA, 25 bp, Rattus norvegicus
gtatattccaactcactgcttaacg

SEQ ID NO: 484962 - DNA, 25 bp, Rattus norvegicus
gtatattccaatccggttccatttt

SEQ ID NO: 484963 - DNA, 25 bp, Rattus norvegicus
gtatattccaatgcggttccatttt

SEQ ID NO: 484964 - DNA, 25 bp, Rattus norvegicus
gtatattcctaaaccagcacttcag

SEQ ID NO: 484965 - DNA, 25 bp, Rattus norvegicus
gtatattcctaatccagcacttcag

SEQ ID NO: 484966 - DNA, 25 bp, Rattus norvegicus
gtatattcctacatagctgtccaat

SEQ ID NO: 484967 - DNA, 25 bp, Rattus norvegicus
gtatattcctacttagctgtccaat

SEQ ID NO: 484968 - DNA, 25 bp, Rattus norvegicus
gtatattcctatccagttccatttt

SEQ ID NO: 484969 - DNA, 25 bp, Rattus norvegicus
gtatattcctatgcagttccatttt

SEQ ID NO: 484970 - DNA, 25 bp, Rattus norvegicus
gtatattctctactctgtacacagg

SEQ ID NO: 484971 - DNA, 25 bp, Rattus norvegicus
gtatattctctagtctgtacacagg

SEQ ID NO: 484972 - DNA, 25 bp, Rattus norvegicus
gtatattctctcattaatttagtcc

SEQ ID NO: 484973 - DNA, 25 bp, Rattus norvegicus
gtatattctctctttaatttagtcc

SEQ ID NO: 484974 - DNA, 25 bp, Rattus norvegicus
gtatattctgctcgcggaatcatcc

SEQ ID NO: 484975 - DNA, 25 bp, Rattus norvegicus
gtatattctgctcttatcccaatac

SEQ ID NO: 484976 - DNA, 25 bp, Rattus norvegicus
gtatattctgctggcggaatcatcc

SEQ ID NO: 484977 - DNA, 25 bp, Rattus norvegicus
gtatattctgctgttatcccaatac

SEQ ID NO: 484978 - DNA, 25 bp, Rattus norvegicus
gtatattgccataacccagggagga

SEQ ID NO: 484979 - DNA, 25 bp, Rattus norvegicus
gtatattgccattacccagggagga

SEQ ID NO: 484980 - DNA, 25 bp, Rattus norvegicus
gtatattgccttcatgtttctgtat

SEQ ID NO: 484981 - DNA, 25 bp, Rattus norvegicus
gtatattgccttgatgtttctgtat

SEQ ID NO: 484982 - DNA, 25 bp, Rattus norvegicus
gtatattgcgtgactcatctgtgaa

SEQ ID NO: 484983 - DNA, 25 bp, Rattus norvegicus
gtatattgcgtgtctcatctgtgaa

SEQ ID NO: 484984 - DNA, 25 bp, Rattus norvegicus
gtatattggcatcaactagcctttg

SEQ ID NO: 484985 - DNA, 25 bp, Rattus norvegicus
gtatattggcatgaactagcctttg

SEQ ID NO: 484986 - DNA, 25 bp, Rattus norvegicus
gtatattgtctacaaaccttggcgt

SEQ ID NO: 484987 - DNA, 25 bp, Rattus norvegicus
gtatattgtctagaaaccttggcgt

SEQ ID NO: 484988 - DNA, 25 bp, Rattus norvegicus
gtatatttagtcaagccaaactatt

SEQ ID NO: 484989 - DNA, 25 bp, Rattus norvegicus
gtatatttagtctagccaaactatt

SEQ ID NO: 484990 - DNA, 25 bp, Rattus norvegicus
gtatatttatagctcactccagctg

SEQ ID NO: 484991 - DNA, 25 bp, Rattus norvegicus
gtatatttataggtcactccagctg

SEQ ID NO: 484992 - DNA, 25 bp, Rattus norvegicus
gtatatttcaccatcacctttacag

SEQ ID NO: 484993 - DNA, 25 bp, Rattus norvegicus
gtatatttcaccttcacctttacag

SEQ ID NO: 484994 - DNA, 25 bp, Rattus norvegicus
gtatatttcatgaacggccacttga

SEQ ID NO: 484995 - DNA, 25 bp, Rattus norvegicus
gtatatttcatgtacggccacttga

SEQ ID NO: 484996 - DNA, 25 bp, Rattus norvegicus
gtatatttcattcccaatttgtgtg

SEQ ID NO: 484997 - DNA, 25 bp, Rattus norvegicus
gtatatttcattgccaatttgtgtg

SEQ ID NO: 484998 - DNA, 25 bp, Rattus norvegicus
gtatatttctttctacagagacctt

SEQ ID NO: 484999 - DNA, 25 bp, Rattus norvegicus
gtatatttctttgtacagagacctt

SEQ ID NO: 485000 - DNA, 25 bp, Rattus norvegicus
gtatatttgtgccttgttctgcaag

SEQ ID NO: 485001 - DNA, 25 bp, Rattus norvegicus
gtatatttgtgcgttgttctgcaag

SEQ ID NO: 485002 - DNA, 25 bp, Rattus norvegicus
gtatattttaatacgggtctccctg

SEQ ID NO: 485003 - DNA, 25 bp, Rattus norvegicus
gtatattttaattcgggtctccctg

SEQ ID NO: 485004 - DNA, 25 bp, Rattus norvegicus
gtatattttccaaagcatctctcag

SEQ ID NO: 485005 - DNA, 25 bp, Rattus norvegicus
gtatattttccatagcatctctcag

SEQ ID NO: 485006 - DNA, 25 bp, Rattus norvegicus
gtatattttcttaggtccttcataa

SEQ ID NO: 485007 - DNA, 25 bp, Rattus norvegicus
gtatattttctttggtccttcataa

SEQ ID NO: 485008 - DNA, 25 bp, Rattus norvegicus
gtatattttgggaggaagaagacat

SEQ ID NO: 485009 - DNA, 25 bp, Rattus norvegicus
gtatattttgggtggaagaagacat

SEQ ID NO: 485010 - DNA, 25 bp, Rattus norvegicus
gtatattttgttcttgtcttttcta

SEQ ID NO: 485011 - DNA, 25 bp, Rattus norvegicus
gtatattttgttgttgtcttttcta

SEQ ID NO: 485012 - DNA, 25 bp, Rattus norvegicus
gtatatttttctcttgtcacaaatg

SEQ ID NO: 485013 - DNA, 25 bp, Rattus norvegicus
gtatatttttctgttgtcacaaatg

SEQ ID NO: 485014 - DNA, 25 bp, Rattus norvegicus
gtatatttttgcaaggagccccagc

SEQ ID NO: 485015 - DNA, 25 bp, Rattus norvegicus
gtatatttttgctaggagccccagc

SEQ ID NO: 485016 - DNA, 25 bp, Rattus norvegicus
gtatattttttaagcttggtcagta

SEQ ID NO: 485017 - DNA, 25 bp, Rattus norvegicus
gtatattttttatgcttggtcagta

SEQ ID NO: 485018 - DNA, 25 bp, Rattus norvegicus
gtatcaaactatacttgcattgctt

SEQ ID NO: 485019 - DNA, 25 bp, Rattus norvegicus
gtatcaaactattcttgcattgctt

SEQ ID NO: 485020 - DNA, 25 bp, Rattus norvegicus
gtatcaaatcctacgtgcccaatga

SEQ ID NO: 485021 - DNA, 25 bp, Rattus norvegicus
gtatcaaatccttcgtgcccaatga

SEQ ID NO: 485022 - DNA, 25 bp, Rattus norvegicus
gtatcaaattttcccttcttcccat

SEQ ID NO: 485023 - DNA, 25 bp, Rattus norvegicus
gtatcaaattttgccttcttcccat

SEQ ID NO: 485024 - DNA, 25 bp, Rattus norvegicus
gtatcaacagacaccacatctagca

SEQ ID NO: 485025 - DNA, 25 bp, Rattus norvegicus
gtatcaacagactccacatctagca

SEQ ID NO: 485026 - DNA, 25 bp, Rattus norvegicus
gtatcaacattactcactgtcttct

SEQ ID NO: 485027 - DNA, 25 bp, Rattus norvegicus
gtatcaacattagtcactgtcttct

SEQ ID NO: 485028 - DNA, 25 bp, Rattus norvegicus
gtatcaaccattataaacccatgtg

SEQ ID NO: 485029 - DNA, 25 bp, Rattus norvegicus
gtatcaaccattttaaacccatgtg

SEQ ID NO: 485030 - DNA, 25 bp, Rattus norvegicus
gtatcaaccttaatggagcttctgc

SEQ ID NO: 485031 - DNA, 25 bp, Rattus norvegicus
gtatcaaccttattggagcttctgc

SEQ ID NO: 485032 - DNA, 25 bp, Rattus norvegicus
gtatcaactaatcagtacctctttg

SEQ ID NO: 485033 - DNA, 25 bp, Rattus norvegicus
gtatcaactaatgagtacctctttg

SEQ ID NO: 485034 - DNA, 25 bp, Rattus norvegicus
gtatcaactgcacgagctggaacgt

SEQ ID NO: 485035 - DNA, 25 bp, Rattus norvegicus
gtatcaactgcaggagctggaacgt

SEQ ID NO: 485036 - DNA, 25 bp, Rattus norvegicus
gtatcaacttgtatgcatgactcca

SEQ ID NO: 485037 - DNA, 25 bp, Rattus norvegicus
gtatcaacttgtttgcatgactcca

SEQ ID NO: 485038 - DNA, 25 bp, Rattus norvegicus
gtatcaactttaaggccattctaca

SEQ ID NO: 485039 - DNA, 25 bp, Rattus norvegicus
gtatcaactttatggccattctaca

SEQ ID NO: 485040 - DNA, 25 bp, Rattus norvegicus
gtatcaagagatccactcaccacat

SEQ ID NO: 485041 - DNA, 25 bp, Rattus norvegicus
gtatcaagagatgcactcaccacat

SEQ ID NO: 485042 - DNA, 25 bp, Rattus norvegicus
gtatcaagatccaggtagcaaagac

SEQ ID NO: 485043 - DNA, 25 bp, Rattus norvegicus
gtatcaagatcctggtagcaaagac

SEQ ID NO: 485044 - DNA, 25 bp, Rattus norvegicus
gtatcaaggagtaagcccatgcatg

SEQ ID NO: 485045 - DNA, 25 bp, Rattus norvegicus
gtatcaaggagttagcccatgcatg

SEQ ID NO: 485046 - DNA, 25 bp, Rattus norvegicus
gtatcaaggcttacttccttctgtt

SEQ ID NO: 485047 - DNA, 25 bp, Rattus norvegicus
gtatcaaggctttcttccttctgtt

SEQ ID NO: 485048 - DNA, 25 bp, Rattus norvegicus
gtatcaagtaatcaactggcagtac

SEQ ID NO: 485049 - DNA, 25 bp, Rattus norvegicus
gtatcaagtaatgaactggcagtac

SEQ ID NO: 485050 - DNA, 25 bp, Rattus norvegicus
gtatcaagtatacgcctgtggcaga

SEQ ID NO: 485051 - DNA, 25 bp, Rattus norvegicus
gtatcaagtataggcctgtggcaga

SEQ ID NO: 485052 - DNA, 25 bp, Rattus norvegicus
gtatcaagtcctattgttgccggtg

SEQ ID NO: 485053 - DNA, 25 bp, Rattus norvegicus
gtatcaagtccttttgttgccggtg

SEQ ID NO: 485054 - DNA, 25 bp, Rattus norvegicus
gtatcaagtgcgattcccactgaga

SEQ ID NO: 485055 - DNA, 25 bp, Rattus norvegicus
gtatcaagtgcgtttcccactgaga

SEQ ID NO: 485056 - DNA, 25 bp, Rattus norvegicus
gtatcaataccaacctcacacatga

SEQ ID NO: 485057 - DNA, 25 bp, Rattus norvegicus
gtatcaataccatcctcacacatga

SEQ ID NO: 485058 - DNA, 25 bp, Rattus norvegicus
gtatcaatcaacctaatatctgtat

SEQ ID NO: 485059 - DNA, 25 bp, Rattus norvegicus
gtatcaatcaacgtaatatctgtat

SEQ ID NO: 485060 - DNA, 25 bp, Rattus norvegicus
gtatcaatccacaaacctgacactt

SEQ ID NO: 485061 - DNA, 25 bp, Rattus norvegicus
gtatcaatccactaacctgacactt

SEQ ID NO: 485062 - DNA, 25 bp, Rattus norvegicus
gtatcaatggtcattcaggtagcgg

SEQ ID NO: 485063 - DNA, 25 bp, Rattus norvegicus
gtatcaatggtctttcaggtagcgg

SEQ ID NO: 485064 - DNA, 25 bp, Rattus norvegicus
gtatcaattccaaacatccactaga

SEQ ID NO: 485065 - DNA, 25 bp, Rattus norvegicus
gtatcaattccatacatccactaga

SEQ ID NO: 485066 - DNA, 25 bp, Rattus norvegicus
gtatcaattcccagcaagggttcca

SEQ ID NO: 485067 - DNA, 25 bp, Rattus norvegicus
gtatcaattccctgcaagggttcca

SEQ ID NO: 485068 - DNA, 25 bp, Rattus norvegicus
gtatcaattgacaaactgcctctgt

SEQ ID NO: 485069 - DNA, 25 bp, Rattus norvegicus
gtatcaattgactaactgcctctgt

SEQ ID NO: 485070 - DNA, 25 bp, Rattus norvegicus
gtatcacaacctacggtaactccag

SEQ ID NO: 485071 - DNA, 25 bp, Rattus norvegicus
gtatcacaaccttcggtaactccag

SEQ ID NO: 485072 - DNA, 25 bp, Rattus norvegicus
gtatcacaaggcacaaagttctctg

SEQ ID NO: 485073 - DNA, 25 bp, Rattus norvegicus
gtatcacaaggctcaaagttctctg

SEQ ID NO: 485074 - DNA, 25 bp, Rattus norvegicus
gtatcacaagtcacagagctgttct

SEQ ID NO: 485075 - DNA, 25 bp, Rattus norvegicus
gtatcacaagtctcagagctgttct

SEQ ID NO: 485076 - DNA, 25 bp, Rattus norvegicus
gtatcacaagttaatggtccccgga

SEQ ID NO: 485077 - DNA, 25 bp, Rattus norvegicus
gtatcacaagtttatggtccccgga

SEQ ID NO: 485078 - DNA, 25 bp, Rattus norvegicus
gtatcacacagaagacactcgggat

SEQ ID NO: 485079 - DNA, 25 bp, Rattus norvegicus
gtatcacacagatgacactcgggat

SEQ ID NO: 485080 - DNA, 25 bp, Rattus norvegicus
gtatcacacctgaaactgcttgcta

SEQ ID NO: 485081 - DNA, 25 bp, Rattus norvegicus
gtatcacacctgtaactgcttgcta

SEQ ID NO: 485082 - DNA, 25 bp, Rattus norvegicus
gtatcacacgtgatggctggctgta

SEQ ID NO: 485083 - DNA, 25 bp, Rattus norvegicus
gtatcacacgtgttggctggctgta

SEQ ID NO: 485084 - DNA, 25 bp, Rattus norvegicus
gtatcacactagactcctatgctta

SEQ ID NO: 485085 - DNA, 25 bp, Rattus norvegicus
gtatcacactagtctcctatgctta

SEQ ID NO: 485086 - DNA, 25 bp, Rattus norvegicus
gtatcacagaatctttttgcgacaa

SEQ ID NO: 485087 - DNA, 25 bp, Rattus norvegicus
gtatcacagaatgtttttgcgacaa

SEQ ID NO: 485088 - DNA, 25 bp, Rattus norvegicus
gtatcacagacgatcttgtaaggac

SEQ ID NO: 485089 - DNA, 25 bp, Rattus norvegicus
gtatcacagacgttcttgtaaggac

SEQ ID NO: 485090 - DNA, 25 bp, Rattus norvegicus
gtatcacagatcagtcacaggcaaa

SEQ ID NO: 485091 - DNA, 25 bp, Rattus norvegicus
gtatcacagatctgtcacaggcaaa

SEQ ID NO: 485092 - DNA, 25 bp, Rattus norvegicus
gtatcacatctgacctgaggctgtt

SEQ ID NO: 485093 - DNA, 25 bp, Rattus norvegicus
gtatcacatctgtcctgaggctgtt

SEQ ID NO: 485094 - DNA, 25 bp, Rattus norvegicus
gtatcacatgtaacagtgcccgttt

SEQ ID NO: 485095 - DNA, 25 bp, Rattus norvegicus
gtatcacatgtatcagtgcccgttt

SEQ ID NO: 485096 - DNA, 25 bp, Rattus norvegicus
gtatcacattgtatcctttctcctt

SEQ ID NO: 485097 - DNA, 25 bp, Rattus norvegicus
gtatcacattgtttcctttctcctt

SEQ ID NO: 485098 - DNA, 25 bp, Rattus norvegicus
gtatcaccatagagatcggaatcca

SEQ ID NO: 485099 - DNA, 25 bp, Rattus norvegicus
gtatcaccatagtgatcggaatcca

SEQ ID NO: 485100 - DNA, 25 bp, Rattus norvegicus
gtatcaccatcaatgcagctcatgt

SEQ ID NO: 485101 - DNA, 25 bp, Rattus norvegicus
gtatcaccatcattgcagctcatgt

SEQ ID NO: 485102 - DNA, 25 bp, Rattus norvegicus
gtatcacccgacatgatgctactgg

SEQ ID NO: 485103 - DNA, 25 bp, Rattus norvegicus
gtatcacccgacttgatgctactgg

SEQ ID NO: 485104 - DNA, 25 bp, Rattus norvegicus
gtatcaccttgaatgtgcctactgt

SEQ ID NO: 485105 - DNA, 25 bp, Rattus norvegicus
gtatcaccttgattgtgcctactgt

SEQ ID NO: 485106 - DNA, 25 bp, Rattus norvegicus
gtatcacgctctctctttcatttat

SEQ ID NO: 485107 - DNA, 25 bp, Rattus norvegicus
gtatcacgctctgtctttcatttat

SEQ ID NO: 485108 - DNA, 25 bp, Rattus norvegicus
gtatcacggcagcttacaacaactt

SEQ ID NO: 485109 - DNA, 25 bp, Rattus norvegicus
gtatcacggcaggttacaacaactt

SEQ ID NO: 485110 - DNA, 25 bp, Rattus norvegicus
gtatcacgttacagtctaatgcttt

SEQ ID NO: 485111 - DNA, 25 bp, Rattus norvegicus
gtatcacgttactgtctaatgcttt

SEQ ID NO: 485112 - DNA, 25 bp, Rattus norvegicus
gtatcactaagtccacttatcagag

SEQ ID NO: 485113 - DNA, 25 bp, Rattus norvegicus
gtatcactaagtgcacttatcagag

SEQ ID NO: 485114 - DNA, 25 bp, Rattus norvegicus
gtatcactacgaatgtgctgtctgt

SEQ ID NO: 485115 - DNA, 25 bp, Rattus norvegicus
gtatcactacgattgtgctgtctgt

SEQ ID NO: 485116 - DNA, 25 bp, Rattus norvegicus
gtatcactccctaagcatttatata

SEQ ID NO: 485117 - DNA, 25 bp, Rattus norvegicus
gtatcactccctctctcaaattggg

SEQ ID NO: 485118 - DNA, 25 bp, Rattus norvegicus
gtatcactccctgtctcaaattggg

SEQ ID NO: 485119 - DNA, 25 bp, Rattus norvegicus
gtatcactcccttagcatttatata

SEQ ID NO: 485120 - DNA, 25 bp, Rattus norvegicus
gtatcactcgacaggtgctggtagt

SEQ ID NO: 485121 - DNA, 25 bp, Rattus norvegicus
gtatcactcgactggtgctggtagt

SEQ ID NO: 485122 - DNA, 25 bp, Rattus norvegicus
gtatcactctgcctgactcccaaga

SEQ ID NO: 485123 - DNA, 25 bp, Rattus norvegicus
gtatcactctgcgtgactcccaaga

SEQ ID NO: 485124 - DNA, 25 bp, Rattus norvegicus
gtatcactgactcctatcgctgggt

SEQ ID NO: 485125 - DNA, 25 bp, Rattus norvegicus
gtatcactgactgctatcgctgggt

SEQ ID NO: 485126 - DNA, 25 bp, Rattus norvegicus
gtatcactgagacgagaccgaccta

SEQ ID NO: 485127 - DNA, 25 bp, Rattus norvegicus
gtatcactgagaggagaccgaccta

SEQ ID NO: 485128 - DNA, 25 bp, Rattus norvegicus
gtatcagaaaacagcagcctcccag

SEQ ID NO: 485129 - DNA, 25 bp, Rattus norvegicus
gtatcagaaaacctttgcttttgct

SEQ ID NO: 485130 - DNA, 25 bp, Rattus norvegicus
gtatcagaaaacgtttgcttttgct

SEQ ID NO: 485131 - DNA, 25 bp, Rattus norvegicus
gtatcagaaaactgcagcctcccag

SEQ ID NO: 485132 - DNA, 25 bp, Rattus norvegicus
gtatcagaaacacctacactctcaa

SEQ ID NO: 485133 - DNA, 25 bp, Rattus norvegicus
gtatcagaaacagctacactctcaa

SEQ ID NO: 485134 - DNA, 25 bp, Rattus norvegicus
gtatcagaactgaatttccacatgt

SEQ ID NO: 485135 - DNA, 25 bp, Rattus norvegicus
gtatcagaactgactttccgggtac

SEQ ID NO: 485136 - DNA, 25 bp, Rattus norvegicus
gtatcagaactgtatttccacatgt

SEQ ID NO: 485137 - DNA, 25 bp, Rattus norvegicus
gtatcagaactgtctttccgggtac

SEQ ID NO: 485138 - DNA, 25 bp, Rattus norvegicus
gtatcagacaagctggctgcctgct

SEQ ID NO: 485139 - DNA, 25 bp, Rattus norvegicus
gtatcagacaaggtggctgcctgct

SEQ ID NO: 485140 - DNA, 25 bp, Rattus norvegicus
gtatcagaccatctgaggccgcata

SEQ ID NO: 485141 - DNA, 25 bp, Rattus norvegicus
gtatcagaccatgtgaggccgcata

SEQ ID NO: 485142 - DNA, 25 bp, Rattus norvegicus
gtatcagacctgcttgtcttttttc

SEQ ID NO: 485143 - DNA, 25 bp, Rattus norvegicus
gtatcagacctggttgtcttttttc

SEQ ID NO: 485144 - DNA, 25 bp, Rattus norvegicus
gtatcagaccttattcaaaacacaa

SEQ ID NO: 485145 - DNA, 25 bp, Rattus norvegicus
gtatcagaccttcgaactagagaag

SEQ ID NO: 485146 - DNA, 25 bp, Rattus norvegicus
gtatcagaccttggaactagagaag

SEQ ID NO: 485147 - DNA, 25 bp, Rattus norvegicus
gtatcagacctttttcaaaacacaa

SEQ ID NO: 485148 - DNA, 25 bp, Rattus norvegicus
gtatcagactgtcctgaagctccaa

SEQ ID NO: 485149 - DNA, 25 bp, Rattus norvegicus
gtatcagactgtgctgaagctccaa

SEQ ID NO: 485150 - DNA, 25 bp, Rattus norvegicus
gtatcagagacaagtgggcacccag

SEQ ID NO: 485151 - DNA, 25 bp, Rattus norvegicus
gtatcagagacatgtgggcacccag

SEQ ID NO: 485152 - DNA, 25 bp, Rattus norvegicus
gtatcagatcccacgaaactggaag

SEQ ID NO: 485153 - DNA, 25 bp, Rattus norvegicus
gtatcagatccctcgaaactggaag

SEQ ID NO: 485154 - DNA, 25 bp, Rattus norvegicus
gtatcagatcggcacttttcaaaca

SEQ ID NO: 485155 - DNA, 25 bp, Rattus norvegicus
gtatcagatcgggacttttcaaaca

SEQ ID NO: 485156 - DNA, 25 bp, Rattus norvegicus
gtatcagattggagattgccagcta

SEQ ID NO: 485157 - DNA, 25 bp, Rattus norvegicus
gtatcagattggtgattgccagcta

SEQ ID NO: 485158 - DNA, 25 bp, Rattus norvegicus
gtatcagcacttaaaacaaattcca

SEQ ID NO: 485159 - DNA, 25 bp, Rattus norvegicus
gtatcagcactttaaacaaattcca

SEQ ID NO: 485160 - DNA, 25 bp, Rattus norvegicus
gtatcagcagctcatggacatcaag

SEQ ID NO: 485161 - DNA, 25 bp, Rattus norvegicus
gtatcagcagctgatggacatcaag

SEQ ID NO: 485162 - DNA, 25 bp, Rattus norvegicus
gtatcagcagtaagcccagcagtgg

SEQ ID NO: 485163 - DNA, 25 bp, Rattus norvegicus
gtatcagcagtatgcccagcagtgg

SEQ ID NO: 485164 - DNA, 25 bp, Rattus norvegicus
gtatcagcatgccagttgttcaata

SEQ ID NO: 485165 - DNA, 25 bp, Rattus norvegicus
gtatcagcatgcgagttgttcaata

SEQ ID NO: 485166 - DNA, 25 bp, Rattus norvegicus
gtatcagccatgaggcccaagacag

SEQ ID NO: 485167 - DNA, 25 bp, Rattus norvegicus
gtatcagccatgtggcccaagacag

SEQ ID NO: 485168 - DNA, 25 bp, Rattus norvegicus
gtatcagcccaacgaagcccagttt

SEQ ID NO: 485169 - DNA, 25 bp, Rattus norvegicus
gtatcagcccaaggaagcccagttt

SEQ ID NO: 485170 - DNA, 25 bp, Rattus norvegicus
gtatcagcccacattgtacttaagt

SEQ ID NO: 485171 - DNA, 25 bp, Rattus norvegicus
gtatcagcccactttgtacttaagt

SEQ ID NO: 485172 - DNA, 25 bp, Rattus norvegicus
gtatcagcccggagaaaacctgtga

SEQ ID NO: 485173 - DNA, 25 bp, Rattus norvegicus
gtatcagcccggagaccagacatag

SEQ ID NO: 485174 - DNA, 25 bp, Rattus norvegicus
gtatcagcccggtgaaaacctgtga

SEQ ID NO: 485175 - DNA, 25 bp, Rattus norvegicus
gtatcagcccggtgaccagacatag

SEQ ID NO: 485176 - DNA, 25 bp, Rattus norvegicus
gtatcagctcctaacacatcgagag

SEQ ID NO: 485177 - DNA, 25 bp, Rattus norvegicus
gtatcagctccttacacatcgagag

SEQ ID NO: 485178 - DNA, 25 bp, Rattus norvegicus
gtatcagctgaccttattctgccag

SEQ ID NO: 485179 - DNA, 25 bp, Rattus norvegicus
gtatcagctgacgttattctgccag

SEQ ID NO: 485180 - DNA, 25 bp, Rattus norvegicus
gtatcagctgatagcccaggacaat

SEQ ID NO: 485181 - DNA, 25 bp, Rattus norvegicus
gtatcagctgattgcccaggacaat

SEQ ID NO: 485182 - DNA, 25 bp, Rattus norvegicus
gtatcagctgtccttcatttcttaa

SEQ ID NO: 485183 - DNA, 25 bp, Rattus norvegicus
gtatcagctgtcgttcatttcttaa

SEQ ID NO: 485184 - DNA, 25 bp, Rattus norvegicus
gtatcagctgtgatgggcatgtgaa

SEQ ID NO: 485185 - DNA, 25 bp, Rattus norvegicus
gtatcagctgtgttgggcatgtgaa

SEQ ID NO: 485186 - DNA, 25 bp, Rattus norvegicus
gtatcaggaaagatccttaagcctt

SEQ ID NO: 485187 - DNA, 25 bp, Rattus norvegicus
gtatcaggaaagttccttaagcctt

SEQ ID NO: 485188 - DNA, 25 bp, Rattus norvegicus
gtatcaggatagcagacaacacagg

SEQ ID NO: 485189 - DNA, 25 bp, Rattus norvegicus
gtatcaggataggagacaacacagg

SEQ ID NO: 485190 - DNA, 25 bp, Rattus norvegicus
gtatcaggcaacctaacccttcagg

SEQ ID NO: 485191 - DNA, 25 bp, Rattus norvegicus
gtatcaggcaacgtaacccttcagg

SEQ ID NO: 485192 - DNA, 25 bp, Rattus norvegicus
gtatcaggcacacagcctctttgag

SEQ ID NO: 485193 - DNA, 25 bp, Rattus norvegicus
gtatcaggcacagagcctctttgag

SEQ ID NO: 485194 - DNA, 25 bp, Rattus norvegicus
gtatcaggtcatactttataattaa

SEQ ID NO: 485195 - DNA, 25 bp, Rattus norvegicus
gtatcaggtcattctttataattaa

SEQ ID NO: 485196 - DNA, 25 bp, Rattus norvegicus
gtatcaggtcggagcttttcattct

SEQ ID NO: 485197 - DNA, 25 bp, Rattus norvegicus
gtatcaggtcggtgcttttcattct

SEQ ID NO: 485198 - DNA, 25 bp, Rattus norvegicus
gtatcagtagaaatcacatctctcc

SEQ ID NO: 485199 - DNA, 25 bp, Rattus norvegicus
gtatcagtagaattcacatctctcc

SEQ ID NO: 485200 - DNA, 25 bp, Rattus norvegicus
gtatcagtcacactgtcaggagcaa

SEQ ID NO: 485201 - DNA, 25 bp, Rattus norvegicus
gtatcagtcacagtgtcaggagcaa

SEQ ID NO: 485202 - DNA, 25 bp, Rattus norvegicus
gtatcagtcctacctgttaacggca

SEQ ID NO: 485203 - DNA, 25 bp, Rattus norvegicus
gtatcagtcctagctgttaacggca

SEQ ID NO: 485204 - DNA, 25 bp, Rattus norvegicus
gtatcagtctctaaccaattggaaa

SEQ ID NO: 485205 - DNA, 25 bp, Rattus norvegicus
gtatcagtctcttaccaattggaaa

SEQ ID NO: 485206 - DNA, 25 bp, Rattus norvegicus
gtatcagtggacaattaagtagcaa

SEQ ID NO: 485207 - DNA, 25 bp, Rattus norvegicus
gtatcagtggactattaagtagcaa

SEQ ID NO: 485208 - DNA, 25 bp, Rattus norvegicus
gtatcagtgtgcctgaaccttgcat

SEQ ID NO: 485209 - DNA, 25 bp, Rattus norvegicus
gtatcagtgtgcgtgaaccttgcat

SEQ ID NO: 485210 - DNA, 25 bp, Rattus norvegicus
gtatcagttgtgcacctgacctgcc

SEQ ID NO: 485211 - DNA, 25 bp, Rattus norvegicus
gtatcagttgtggacctgacctgcc

SEQ ID NO: 485212 - DNA, 25 bp, Rattus norvegicus
gtatcatacctgagtctgtcagaga

SEQ ID NO: 485213 - DNA, 25 bp, Rattus norvegicus
gtatcatacctgtgtctgtcagaga

SEQ ID NO: 485214 - DNA, 25 bp, Rattus norvegicus
gtatcatagccgcaagtgcagcccg

SEQ ID NO: 485215 - DNA, 25 bp, Rattus norvegicus
gtatcatagccggaagtgcagcccg

SEQ ID NO: 485216 - DNA, 25 bp, Rattus norvegicus
gtatcatatagcaacagtttctggg

SEQ ID NO: 485217 - DNA, 25 bp, Rattus norvegicus
gtatcatatagctacagtttctggg

SEQ ID NO: 485218 - DNA, 25 bp, Rattus norvegicus
gtatcatatcatctgcgaatagcaa

SEQ ID NO: 485219 - DNA, 25 bp, Rattus norvegicus
gtatcatatcatgtgcgaatagcaa

SEQ ID NO: 485220 - DNA, 25 bp, Rattus norvegicus
gtatcatatgtaactgggacttttg

SEQ ID NO: 485221 - DNA, 25 bp, Rattus norvegicus
gtatcatatgtatctgggacttttg

SEQ ID NO: 485222 - DNA, 25 bp, Rattus norvegicus
gtatcatcaacgaggacccaggcaa

SEQ ID NO: 485223 - DNA, 25 bp, Rattus norvegicus
gtatcatcaacgtggacccaggcaa

SEQ ID NO: 485224 - DNA, 25 bp, Rattus norvegicus
gtatcatcaccaacgagtctcagga

SEQ ID NO: 485225 - DNA, 25 bp, Rattus norvegicus
gtatcatcaccatcgagtctcagga

SEQ ID NO: 485226 - DNA, 25 bp, Rattus norvegicus
gtatcatcatcccaagttagcacag

SEQ ID NO: 485227 - DNA, 25 bp, Rattus norvegicus
gtatcatcatccgaagttagcacag

SEQ ID NO: 485228 - DNA, 25 bp, Rattus norvegicus
gtatcatccgagagacaggtgcccg

SEQ ID NO: 485229 - DNA, 25 bp, Rattus norvegicus
gtatcatccgagtgacaggtgcccg

SEQ ID NO: 485230 - DNA, 25 bp, Rattus norvegicus
gtatcatcctgtatggccagagcat

SEQ ID NO: 485231 - DNA, 25 bp, Rattus norvegicus
gtatcatcctgtttggccagagcat

SEQ ID NO: 485232 - DNA, 25 bp, Rattus norvegicus
gtatcatgaaacagcagtcattgtt

SEQ ID NO: 485233 - DNA, 25 bp, Rattus norvegicus
gtatcatgaaactgcagtcattgtt

SEQ ID NO: 485234 - DNA, 25 bp, Rattus norvegicus
gtatcatgagatcagaaggcgtcta

SEQ ID NO: 485235 - DNA, 25 bp, Rattus norvegicus
gtatcatgagatgagaaggcgtcta

SEQ ID NO: 485236 - DNA, 25 bp, Rattus norvegicus
gtatcatgatctcatgtcccttgcc

SEQ ID NO: 485237 - DNA, 25 bp, Rattus norvegicus
gtatcatgatctgatgtcccttgcc

SEQ ID NO: 485238 - DNA, 25 bp, Rattus norvegicus
gtatcatgctgtacaaaggccttca

SEQ ID NO: 485239 - DNA, 25 bp, Rattus norvegicus
gtatcatgctgttcaaaggccttca

SEQ ID NO: 485240 - DNA, 25 bp, Rattus norvegicus
gtatcatggaccactctatatctcc

SEQ ID NO: 485241 - DNA, 25 bp, Rattus norvegicus
gtatcatggacctctctatatctcc

SEQ ID NO: 485242 - DNA, 25 bp, Rattus norvegicus
gtatcatgtctgattgtgtgtctct

SEQ ID NO: 485243 - DNA, 25 bp, Rattus norvegicus
gtatcatgtctgtttgtgtgtctct

SEQ ID NO: 485244 - DNA, 25 bp, Rattus norvegicus
gtatcatgtcttcattagcaacagg

SEQ ID NO: 485245 - DNA, 25 bp, Rattus norvegicus
gtatcatgtcttgattagcaacagg

SEQ ID NO: 485246 - DNA, 25 bp, Rattus norvegicus
gtatcatgtgaaattttctggtgta

SEQ ID NO: 485247 - DNA, 25 bp, Rattus norvegicus
gtatcatgtgaatttttctggtgta

SEQ ID NO: 485248 - DNA, 25 bp, Rattus norvegicus
gtatcatgttccctgagattctgtg

SEQ ID NO: 485249 - DNA, 25 bp, Rattus norvegicus
gtatcatgttccgtgagattctgtg

SEQ ID NO: 485250 - DNA, 25 bp, Rattus norvegicus
gtatcattagctacctttgtgcaga

SEQ ID NO: 485251 - DNA, 25 bp, Rattus norvegicus
gtatcattagcttcctttgtgcaga

SEQ ID NO: 485252 - DNA, 25 bp, Rattus norvegicus
gtatcattatcaccaccagagacag

SEQ ID NO: 485253 - DNA, 25 bp, Rattus norvegicus
gtatcattatcagcaccagagacag

SEQ ID NO: 485254 - DNA, 25 bp, Rattus norvegicus
gtatcattattaaacccaccaccgg

SEQ ID NO: 485255 - DNA, 25 bp, Rattus norvegicus
gtatcattattatacccaccaccgg

SEQ ID NO: 485256 - DNA, 25 bp, Rattus norvegicus
gtatcattcacacgagggctcccta

SEQ ID NO: 485257 - DNA, 25 bp, Rattus norvegicus
gtatcattcacaggagggctcccta

SEQ ID NO: 485258 - DNA, 25 bp, Rattus norvegicus
gtatcattcgttatatcccacataa

SEQ ID NO: 485259 - DNA, 25 bp, Rattus norvegicus
gtatcattcgttttatcccacataa

SEQ ID NO: 485260 - DNA, 25 bp, Rattus norvegicus
gtatcattgctgctcttgccaagtt

SEQ ID NO: 485261 - DNA, 25 bp, Rattus norvegicus
gtatcattgctggtcttgccaagtt

SEQ ID NO: 485262 - DNA, 25 bp, Rattus norvegicus
gtatcatttcttcttattctttgca

SEQ ID NO: 485263 - DNA, 25 bp, Rattus norvegicus
gtatcatttcttgttattctttgca

SEQ ID NO: 485264 - DNA, 25 bp, Rattus norvegicus
gtatcattttcacaggagcccattc

SEQ ID NO: 485265 - DNA, 25 bp, Rattus norvegicus
gtatcattttcagaggagcccattc

SEQ ID NO: 485266 - DNA, 25 bp, Rattus norvegicus
gtatcattttgtagcatgtactgta

SEQ ID NO: 485267 - DNA, 25 bp, Rattus norvegicus
gtatcattttgttgcatgtactgta

SEQ ID NO: 485268 - DNA, 25 bp, Rattus norvegicus
gtatccaaagggagctccaaggtca

SEQ ID NO: 485269 - DNA, 25 bp, Rattus norvegicus
gtatccaaagggtgctccaaggtca

SEQ ID NO: 485270 - DNA, 25 bp, Rattus norvegicus
gtatccaaatgcaagcacaaattag

SEQ ID NO: 485271 - DNA, 25 bp, Rattus norvegicus
gtatccaaatgctagcacaaattag

SEQ ID NO: 485272 - DNA, 25 bp, Rattus norvegicus
gtatccaacggactccaaacttgtg

SEQ ID NO: 485273 - DNA, 25 bp, Rattus norvegicus
gtatccaacggagtccaaacttgtg

SEQ ID NO: 485274 - DNA, 25 bp, Rattus norvegicus
gtatccaagcacctgaaaactcttg

SEQ ID NO: 485275 - DNA, 25 bp, Rattus norvegicus
gtatccaagcacgtgaaaactcttg

SEQ ID NO: 485276 - DNA, 25 bp, Rattus norvegicus
gtatccaagtctagctcagtccctt

SEQ ID NO: 485277 - DNA, 25 bp, Rattus norvegicus
gtatccaagtcttgctcagtccctt

SEQ ID NO: 485278 - DNA, 25 bp, Rattus norvegicus
gtatccaatattacatgttcagttt

SEQ ID NO: 485279 - DNA, 25 bp, Rattus norvegicus
gtatccaatatttcatgttcagttt

SEQ ID NO: 485280 - DNA, 25 bp, Rattus norvegicus
gtatccaatggacggcgcatcatgc

SEQ ID NO: 485281 - DNA, 25 bp, Rattus norvegicus
gtatccaatggagggcgcatcatgc

SEQ ID NO: 485282 - DNA, 25 bp, Rattus norvegicus
gtatccaattatctttatcagtgca

SEQ ID NO: 485283 - DNA, 25 bp, Rattus norvegicus
gtatccaattatgtttatcagtgca

SEQ ID NO: 485284 - DNA, 25 bp, Rattus norvegicus
gtatccaattgcatcttgatgactt

SEQ ID NO: 485285 - DNA, 25 bp, Rattus norvegicus
gtatccaattgcttcttgatgactt

SEQ ID NO: 485286 - DNA, 25 bp, Rattus norvegicus
gtatccacaaaactccttcttattg

SEQ ID NO: 485287 - DNA, 25 bp, Rattus norvegicus
gtatccacaaaagtccttcttattg

SEQ ID NO: 485288 - DNA, 25 bp, Rattus norvegicus
gtatccacaaccaagaggccgagaa

SEQ ID NO: 485289 - DNA, 25 bp, Rattus norvegicus
gtatccacaacctagaggccgagaa

SEQ ID NO: 485290 - DNA, 25 bp, Rattus norvegicus
gtatccacatcaccaggactgaata

SEQ ID NO: 485291 - DNA, 25 bp, Rattus norvegicus
gtatccacatcagcaggactgaata

SEQ ID NO: 485292 - DNA, 25 bp, Rattus norvegicus
gtatccacctatccttcatttttat

SEQ ID NO: 485293 - DNA, 25 bp, Rattus norvegicus
gtatccacctatgcttcatttttat

SEQ ID NO: 485294 - DNA, 25 bp, Rattus norvegicus
gtatccacctttctctgagcataag

SEQ ID NO: 485295 - DNA, 25 bp, Rattus norvegicus
gtatccacctttgtctgagcataag

SEQ ID NO: 485296 - DNA, 25 bp, Rattus norvegicus
gtatccagaaatatgcccacacgtc

SEQ ID NO: 485297 - DNA, 25 bp, Rattus norvegicus
gtatccagaaatttgcccacacgtc

SEQ ID NO: 485298 - DNA, 25 bp, Rattus norvegicus
gtatccagaatacccctgcaggtcc

SEQ ID NO: 485299 - DNA, 25 bp, Rattus norvegicus
gtatccagaatagccctgcaggtcc

SEQ ID NO: 485300 - DNA, 25 bp, Rattus norvegicus
gtatccagccatattgctgaaggtg

SEQ ID NO: 485301 - DNA, 25 bp, Rattus norvegicus
gtatccagccattttgctgaaggtg

SEQ ID NO: 485302 - DNA, 25 bp, Rattus norvegicus
gtatccagcgataggcggccggttc

SEQ ID NO: 485303 - DNA, 25 bp, Rattus norvegicus
gtatccagcgattggcggccggttc

SEQ ID NO: 485304 - DNA, 25 bp, Rattus norvegicus
gtatccaggagtaccataccagaga

SEQ ID NO: 485305 - DNA, 25 bp, Rattus norvegicus
gtatccaggagttccataccagaga

SEQ ID NO: 485306 - DNA, 25 bp, Rattus norvegicus
gtatccagttacacctataggctaa

SEQ ID NO: 485307 - DNA, 25 bp, Rattus norvegicus
gtatccagttactcctataggctaa

SEQ ID NO: 485308 - DNA, 25 bp, Rattus norvegicus
gtatccatcaaaccgaggctgccac

SEQ ID NO: 485309 - DNA, 25 bp, Rattus norvegicus
gtatccatcaaagcgaggctgccac

SEQ ID NO: 485310 - DNA, 25 bp, Rattus norvegicus
gtatccatccacatctacattgttt

SEQ ID NO: 485311 - DNA, 25 bp, Rattus norvegicus
gtatccatccacttctacattgttt

SEQ ID NO: 485312 - DNA, 25 bp, Rattus norvegicus
gtatccatcgagaacattgtccttt

SEQ ID NO: 485313 - DNA, 25 bp, Rattus norvegicus
gtatccatcgagtacattgtccttt

SEQ ID NO: 485314 - DNA, 25 bp, Rattus norvegicus
gtatccatgaacatcttatttagca

SEQ ID NO: 485315 - DNA, 25 bp, Rattus norvegicus
gtatccatgaacttcttatttagca

SEQ ID NO: 485316 - DNA, 25 bp, Rattus norvegicus
gtatccatgtcaccataagctgtag

SEQ ID NO: 485317 - DNA, 25 bp, Rattus norvegicus
gtatccatgtcagcataagctgtag

SEQ ID NO: 485318 - DNA, 25 bp, Rattus norvegicus
gtatccatgtgactacctgtttaaa

SEQ ID NO: 485319 - DNA, 25 bp, Rattus norvegicus
gtatccatgtgagtacctgtttaaa

SEQ ID NO: 485320 - DNA, 25 bp, Rattus norvegicus
gtatccattctgaagaacacatcat

SEQ ID NO: 485321 - DNA, 25 bp, Rattus norvegicus
gtatccattctgtagaacacatcat

SEQ ID NO: 485322 - DNA, 25 bp, Rattus norvegicus
gtatccatttaccacatccctagaa

SEQ ID NO: 485323 - DNA, 25 bp, Rattus norvegicus
gtatccatttacgacatccctagaa

SEQ ID NO: 485324 - DNA, 25 bp, Rattus norvegicus
gtatccattttaatagttcctagaa

SEQ ID NO: 485325 - DNA, 25 bp, Rattus norvegicus
gtatccattttattagttcctagaa

SEQ ID NO: 485326 - DNA, 25 bp, Rattus norvegicus
gtatcccaaattaaagccagcccag

SEQ ID NO: 485327 - DNA, 25 bp, Rattus norvegicus
gtatcccaaatttaagccagcccag

SEQ ID NO: 485328 - DNA, 25 bp, Rattus norvegicus
gtatcccacagtaagttcacatgca

SEQ ID NO: 485329 - DNA, 25 bp, Rattus norvegicus
gtatcccacagttagttcacatgca

SEQ ID NO: 485330 - DNA, 25 bp, Rattus norvegicus
gtatcccaccataagccatttccaa

SEQ ID NO: 485331 - DNA, 25 bp, Rattus norvegicus
gtatcccaccattagccatttccaa

SEQ ID NO: 485332 - DNA, 25 bp, Rattus norvegicus
gtatcccactgaaacgttctgtgtt

SEQ ID NO: 485333 - DNA, 25 bp, Rattus norvegicus
gtatcccactgatacgttctgtgtt

SEQ ID NO: 485334 - DNA, 25 bp, Rattus norvegicus
gtatcccactttactatgtaaactt

SEQ ID NO: 485335 - DNA, 25 bp, Rattus norvegicus
gtatcccacttttctatgtaaactt

SEQ ID NO: 485336 - DNA, 25 bp, Rattus norvegicus
gtatcccagaaaataggttgtcatt

SEQ ID NO: 485337 - DNA, 25 bp, Rattus norvegicus
gtatcccagaaattaggttgtcatt

SEQ ID NO: 485338 - DNA, 25 bp, Rattus norvegicus
gtatcccaggctacaatatggcggc

SEQ ID NO: 485339 - DNA, 25 bp, Rattus norvegicus
gtatcccaggcttcaatatggcggc

SEQ ID NO: 485340 - DNA, 25 bp, Rattus norvegicus
gtatcccagggtcgactttaggcac

SEQ ID NO: 485341 - DNA, 25 bp, Rattus norvegicus
gtatcccagggtggactttaggcac

SEQ ID NO: 485342 - DNA, 25 bp, Rattus norvegicus
gtatcccagtataggtgctgcaatt

SEQ ID NO: 485343 - DNA, 25 bp, Rattus norvegicus
gtatcccagtattggtgctgcaatt

SEQ ID NO: 485344 - DNA, 25 bp, Rattus norvegicus
gtatcccattcgagttttgttcctg

SEQ ID NO: 485345 - DNA, 25 bp, Rattus norvegicus
gtatcccattcgtgttttgttcctg

SEQ ID NO: 485346 - DNA, 25 bp, Rattus norvegicus
gtatccccaaaaagtatcatggcag

SEQ ID NO: 485347 - DNA, 25 bp, Rattus norvegicus
gtatccccaaaatgtatcatggcag

SEQ ID NO: 485348 - DNA, 25 bp, Rattus norvegicus
gtatccccaattccacttggcgaaa

SEQ ID NO: 485349 - DNA, 25 bp, Rattus norvegicus
gtatccccaattgcacttggcgaaa

SEQ ID NO: 485350 - DNA, 25 bp, Rattus norvegicus
gtatccccagtgattggttcctaca

SEQ ID NO: 485351 - DNA, 25 bp, Rattus norvegicus
gtatccccagtgcttggaacagagc

SEQ ID NO: 485352 - DNA, 25 bp, Rattus norvegicus
gtatccccagtggttggaacagagc

SEQ ID NO: 485353 - DNA, 25 bp, Rattus norvegicus
gtatccccagtgtttggttcctaca

SEQ ID NO: 485354 - DNA, 25 bp, Rattus norvegicus
gtatcccctgggagcctaggttctt

SEQ ID NO: 485355 - DNA, 25 bp, Rattus norvegicus
gtatcccctgggtgcctaggttctt

SEQ ID NO: 485356 - DNA, 25 bp, Rattus norvegicus
gtatccccttgaaggatgagcccaa

SEQ ID NO: 485357 - DNA, 25 bp, Rattus norvegicus
gtatccccttgatggatgagcccaa

SEQ ID NO: 485358 - DNA, 25 bp, Rattus norvegicus
gtatccccttgcagtagtatctggt

SEQ ID NO: 485359 - DNA, 25 bp, Rattus norvegicus
gtatccccttgctgtagtatctggt

SEQ ID NO: 485360 - DNA, 25 bp, Rattus norvegicus
gtatcccgaggtcgccagatttgga

SEQ ID NO: 485361 - DNA, 25 bp, Rattus norvegicus
gtatcccgaggtggccagatttgga

SEQ ID NO: 485362 - DNA, 25 bp, Rattus norvegicus
gtatccctaaatcgactagaactca

SEQ ID NO: 485363 - DNA, 25 bp, Rattus norvegicus
gtatccctaaatggactagaactca

SEQ ID NO: 485364 - DNA, 25 bp, Rattus norvegicus
gtatccctggctatgtggaactaac

SEQ ID NO: 485365 - DNA, 25 bp, Rattus norvegicus
gtatccctggctttgtggaactaac

SEQ ID NO: 485366 - DNA, 25 bp, Rattus norvegicus
gtatccctgtagctgtcaatcttga

SEQ ID NO: 485367 - DNA, 25 bp, Rattus norvegicus
gtatccctgtaggtgtcaatcttga

SEQ ID NO: 485368 - DNA, 25 bp, Rattus norvegicus
gtatcccttactctgttgtctgtta

SEQ ID NO: 485369 - DNA, 25 bp, Rattus norvegicus
gtatcccttactgtgttgtctgtta

SEQ ID NO: 485370 - DNA, 25 bp, Rattus norvegicus
gtatcccttgaaagaccttctagaa

SEQ ID NO: 485371 - DNA, 25 bp, Rattus norvegicus
gtatcccttgaaatgacccttgtga

SEQ ID NO: 485372 - DNA, 25 bp, Rattus norvegicus
gtatcccttgaatgaccttctagaa

SEQ ID NO: 485373 - DNA, 25 bp, Rattus norvegicus
gtatcccttgaattgacccttgtga

SEQ ID NO: 485374 - DNA, 25 bp, Rattus norvegicus
gtatcccttggccaagcttggcata

SEQ ID NO: 485375 - DNA, 25 bp, Rattus norvegicus
gtatcccttggcgaagcttggcata

SEQ ID NO: 485376 - DNA, 25 bp, Rattus norvegicus
gtatcccttgttctttgattaccct

SEQ ID NO: 485377 - DNA, 25 bp, Rattus norvegicus
gtatcccttgttgtttgattaccct

SEQ ID NO: 485378 - DNA, 25 bp, Rattus norvegicus
gtatcccttttaaggcagttcctgc

SEQ ID NO: 485379 - DNA, 25 bp, Rattus norvegicus
gtatcccttttatggcagttcctgc

SEQ ID NO: 485380 - DNA, 25 bp, Rattus norvegicus
gtatccgagacccaaaacatcctaa

SEQ ID NO: 485381 - DNA, 25 bp, Rattus norvegicus
gtatccgagaccgaaaacatcctaa

SEQ ID NO: 485382 - DNA, 25 bp, Rattus norvegicus
gtatccgagatcatcaacaccattg

SEQ ID NO: 485383 - DNA, 25 bp, Rattus norvegicus
gtatccgagatcttcaacaccattg

SEQ ID NO: 485384 - DNA, 25 bp, Rattus norvegicus
gtatccgagcagaaggcggcgcaca

SEQ ID NO: 485385 - DNA, 25 bp, Rattus norvegicus
gtatccgagcagtaggcggcgcaca

SEQ ID NO: 485386 - DNA, 25 bp, Rattus norvegicus
gtatccggaagcagcagatccagtg

SEQ ID NO: 485387 - DNA, 25 bp, Rattus norvegicus
gtatccggaagctgcagatccagtg

SEQ ID NO: 485388 - DNA, 25 bp, Rattus norvegicus
gtatccggcaacatgtagcccttca

SEQ ID NO: 485389 - DNA, 25 bp, Rattus norvegicus
gtatccggcaacttgtagcccttca

SEQ ID NO: 485390 - DNA, 25 bp, Rattus norvegicus
gtatccggcagtattacagagtcaa

SEQ ID NO: 485391 - DNA, 25 bp, Rattus norvegicus
gtatccggcagttttacagagtcaa

SEQ ID NO: 485392 - DNA, 25 bp, Rattus norvegicus
gtatccgtaagtactctgctgtaaa

SEQ ID NO: 485393 - DNA, 25 bp, Rattus norvegicus
gtatccgtaagttctctgctgtaaa

SEQ ID NO: 485394 - DNA, 25 bp, Rattus norvegicus
gtatccgtgacaacagattgctttg

SEQ ID NO: 485395 - DNA, 25 bp, Rattus norvegicus
gtatccgtgacatcagattgctttg

SEQ ID NO: 485396 - DNA, 25 bp, Rattus norvegicus
gtatccgtggatattatgcctcaat

SEQ ID NO: 485397 - DNA, 25 bp, Rattus norvegicus
gtatccgtggattttatgcctcaat

SEQ ID NO: 485398 - DNA, 25 bp, Rattus norvegicus
gtatccgtggtaatagcttcctggt

SEQ ID NO: 485399 - DNA, 25 bp, Rattus norvegicus
gtatccgtggtattagcttcctggt

SEQ ID NO: 485400 - DNA, 25 bp, Rattus norvegicus
gtatccgtgtcaactggactctaag

SEQ ID NO: 485401 - DNA, 25 bp, Rattus norvegicus
gtatccgtgtcatctggactctaag

SEQ ID NO: 485402 - DNA, 25 bp, Rattus norvegicus
gtatccgttaccatggagctggaat

SEQ ID NO: 485403 - DNA, 25 bp, Rattus norvegicus
gtatccgttaccttggagctggaat

SEQ ID NO: 485404 - DNA, 25 bp, Rattus norvegicus
gtatccgtttacagaatgcatcttc

SEQ ID NO: 485405 - DNA, 25 bp, Rattus norvegicus
gtatccgtttactgaatgcatcttc

SEQ ID NO: 485406 - DNA, 25 bp, Rattus norvegicus
gtatccgtttagacaaaaccctgag

SEQ ID NO: 485407 - DNA, 25 bp, Rattus norvegicus
gtatccgtttagtcaaaaccctgag

SEQ ID NO: 485408 - DNA, 25 bp, Rattus norvegicus
gtatccgtttcaaagactcttacag

SEQ ID NO: 485409 - DNA, 25 bp, Rattus norvegicus
gtatccgtttcatagactcttacag

SEQ ID NO: 485410 - DNA, 25 bp, Rattus norvegicus
gtatcctaaagtcacttcaaactgt

SEQ ID NO: 485411 - DNA, 25 bp, Rattus norvegicus
gtatcctaaagtgacttcaaactgt

SEQ ID NO: 485412 - DNA, 25 bp, Rattus norvegicus
gtatcctaaccaagtatcctactga

SEQ ID NO: 485413 - DNA, 25 bp, Rattus norvegicus
gtatcctaaccatgtatcctactga

SEQ ID NO: 485414 - DNA, 25 bp, Rattus norvegicus
gtatcctaacccagggtctcaggaa

SEQ ID NO: 485415 - DNA, 25 bp, Rattus norvegicus
gtatcctaaccctgggtctcaggaa

SEQ ID NO: 485416 - DNA, 25 bp, Rattus norvegicus
gtatcctaacctatccctgatgagg

SEQ ID NO: 485417 - DNA, 25 bp, Rattus norvegicus
gtatcctaacctttccctgatgagg

SEQ ID NO: 485418 - DNA, 25 bp, Rattus norvegicus
gtatcctagggaacagtttgccgta

SEQ ID NO: 485419 - DNA, 25 bp, Rattus norvegicus
gtatcctagggatcagtttgccgta

SEQ ID NO: 485420 - DNA, 25 bp, Rattus norvegicus
gtatcctagggtctgtgtccatcca

SEQ ID NO: 485421 - DNA, 25 bp, Rattus norvegicus
gtatcctagggtgtgtgtccatcca

SEQ ID NO: 485422 - DNA, 25 bp, Rattus norvegicus
gtatcctagttcatgtacatccgaa

SEQ ID NO: 485423 - DNA, 25 bp, Rattus norvegicus
gtatcctagttcttgtacatccgaa

SEQ ID NO: 485424 - DNA, 25 bp, Rattus norvegicus
gtatcctatggtaatgtgtatgtat

SEQ ID NO: 485425 - DNA, 25 bp, Rattus norvegicus
gtatcctatggttatgtgtatgtat

SEQ ID NO: 485426 - DNA, 25 bp, Rattus norvegicus
gtatcctcagaactggactcctggt

SEQ ID NO: 485427 - DNA, 25 bp, Rattus norvegicus
gtatcctcagaagtggactcctggt

SEQ ID NO: 485428 - DNA, 25 bp, Rattus norvegicus
gtatcctcattgatactcacagtgt

SEQ ID NO: 485429 - DNA, 25 bp, Rattus norvegicus
gtatcctcattgttactcacagtgt

SEQ ID NO: 485430 - DNA, 25 bp, Rattus norvegicus
gtatcctcatttcggacaaaagcct

SEQ ID NO: 485431 - DNA, 25 bp, Rattus norvegicus
gtatcctcatttctatgggttgttt

SEQ ID NO: 485432 - DNA, 25 bp, Rattus norvegicus
gtatcctcatttgggacaaaagcct

SEQ ID NO: 485433 - DNA, 25 bp, Rattus norvegicus
gtatcctcatttgtatgggttgttt

SEQ ID NO: 485434 - DNA, 25 bp, Rattus norvegicus
gtatcctcctcaaaacctggtgaag

SEQ ID NO: 485435 - DNA, 25 bp, Rattus norvegicus
gtatcctcctcataacctggtgaag

SEQ ID NO: 485436 - DNA, 25 bp, Rattus norvegicus
gtatcctcctttcttacattatcaa

SEQ ID NO: 485437 - DNA, 25 bp, Rattus norvegicus
gtatcctcctttgttacattatcaa

SEQ ID NO: 485438 - DNA, 25 bp, Rattus norvegicus
gtatcctctgccacttaaacgtaat

SEQ ID NO: 485439 - DNA, 25 bp, Rattus norvegicus
gtatcctctgcctcttaaacgtaat

SEQ ID NO: 485440 - DNA, 25 bp, Rattus norvegicus
gtatcctgaagtacgacaccactgt

SEQ ID NO: 485441 - DNA, 25 bp, Rattus norvegicus
gtatcctgaagttcgacaccactgt

SEQ ID NO: 485442 - DNA, 25 bp, Rattus norvegicus
gtatcctgacagcaacctgatatag

SEQ ID NO: 485443 - DNA, 25 bp, Rattus norvegicus
gtatcctgacaggaacctgatatag

SEQ ID NO: 485444 - DNA, 25 bp, Rattus norvegicus
gtatcctgactgattcaacccagca

SEQ ID NO: 485445 - DNA, 25 bp, Rattus norvegicus
gtatcctgactgtttcaacccagca

SEQ ID NO: 485446 - DNA, 25 bp, Rattus norvegicus
gtatcctgcggaactctcaattaac

SEQ ID NO: 485447 - DNA, 25 bp, Rattus norvegicus
gtatcctgcggatctctcaattaac

SEQ ID NO: 485448 - DNA, 25 bp, Rattus norvegicus
gtatcctggagcattcaatatgacc

SEQ ID NO: 485449 - DNA, 25 bp, Rattus norvegicus
gtatcctggagctttcaatatgacc

SEQ ID NO: 485450 - DNA, 25 bp, Rattus norvegicus
gtatcctggataacgtggttatcag

SEQ ID NO: 485451 - DNA, 25 bp, Rattus norvegicus
gtatcctggatatcgtggttatcag

SEQ ID NO: 485452 - DNA, 25 bp, Rattus norvegicus
gtatcctggatgatctggagtcata

SEQ ID NO: 485453 - DNA, 25 bp, Rattus norvegicus
gtatcctggatgttctggagtcata

SEQ ID NO: 485454 - DNA, 25 bp, Rattus norvegicus
gtatcctgggccaagctacagagat

SEQ ID NO: 485455 - DNA, 25 bp, Rattus norvegicus
gtatcctgggcctagctacagagat

SEQ ID NO: 485456 - DNA, 25 bp, Rattus norvegicus
gtatcctgtataaagtaagacgtag

SEQ ID NO: 485457 - DNA, 25 bp, Rattus norvegicus
gtatcctgtatatagtaagacgtag

SEQ ID NO: 485458 - DNA, 25 bp, Rattus norvegicus
gtatcctgtatcagtgaattgcttt

SEQ ID NO: 485459 - DNA, 25 bp, Rattus norvegicus
gtatcctgtatctgtgaattgcttt

SEQ ID NO: 485460 - DNA, 25 bp, Rattus norvegicus
gtatcctgtcgcagcgcagcaatga

SEQ ID NO: 485461 - DNA, 25 bp, Rattus norvegicus
gtatcctgtcgctgcgcagcaatga

SEQ ID NO: 485462 - DNA, 25 bp, Rattus norvegicus
gtatcctgtgaccagtgcctacaaa

SEQ ID NO: 485463 - DNA, 25 bp, Rattus norvegicus
gtatcctgtgacgagtgcctacaaa

SEQ ID NO: 485464 - DNA, 25 bp, Rattus norvegicus
gtatcctgtggcctacatgcgtctt

SEQ ID NO: 485465 - DNA, 25 bp, Rattus norvegicus
gtatcctgtggcgtacatgcgtctt

SEQ ID NO: 485466 - DNA, 25 bp, Rattus norvegicus
gtatcctgttctctacattaagttt

SEQ ID NO: 485467 - DNA, 25 bp, Rattus norvegicus
gtatcctgttctgtacattaagttt

SEQ ID NO: 485468 - DNA, 25 bp, Rattus norvegicus
gtatcctgttgcaagtacttgtgca

SEQ ID NO: 485469 - DNA, 25 bp, Rattus norvegicus
gtatcctgttgctagtacttgtgca

SEQ ID NO: 485470 - DNA, 25 bp, Rattus norvegicus
gtatccttacaaaagacctcgtatg

SEQ ID NO: 485471 - DNA, 25 bp, Rattus norvegicus
gtatccttacaatagacctcgtatg

SEQ ID NO: 485472 - DNA, 25 bp, Rattus norvegicus
gtatccttattcacaccttgggtac

SEQ ID NO: 485473 - DNA, 25 bp, Rattus norvegicus
gtatccttattctcaccttgggtac

SEQ ID NO: 485474 - DNA, 25 bp, Rattus norvegicus
gtatccttatttctagactcctatt

SEQ ID NO: 485475 - DNA, 25 bp, Rattus norvegicus
gtatccttatttgtagactcctatt

SEQ ID NO: 485476 - DNA, 25 bp, Rattus norvegicus
gtatccttcactagacctgcaatgt

SEQ ID NO: 485477 - DNA, 25 bp, Rattus norvegicus
gtatccttcactccctgtcagggaa

SEQ ID NO: 485478 - DNA, 25 bp, Rattus norvegicus
gtatccttcactgcctgtcagggaa

SEQ ID NO: 485479 - DNA, 25 bp, Rattus norvegicus
gtatccttcacttgacctgcaatgt

SEQ ID NO: 485480 - DNA, 25 bp, Rattus norvegicus
gtatccttgagaaggcttcctctgg

SEQ ID NO: 485481 - DNA, 25 bp, Rattus norvegicus
gtatccttgagatggcttcctctgg

SEQ ID NO: 485482 - DNA, 25 bp, Rattus norvegicus
gtatccttgattactggttgtctca

SEQ ID NO: 485483 - DNA, 25 bp, Rattus norvegicus
gtatccttgatttctggttgtctca

SEQ ID NO: 485484 - DNA, 25 bp, Rattus norvegicus
gtatccttgcagatatgtgacttaa

SEQ ID NO: 485485 - DNA, 25 bp, Rattus norvegicus
gtatccttgcagttatgtgacttaa

SEQ ID NO: 485486 - DNA, 25 bp, Rattus norvegicus
gtatccttggtgattgtggttcata

SEQ ID NO: 485487 - DNA, 25 bp, Rattus norvegicus
gtatccttggtgtttgtggttcata

SEQ ID NO: 485488 - DNA, 25 bp, Rattus norvegicus
gtatccttgtaacttgaagaccact

SEQ ID NO: 485489 - DNA, 25 bp, Rattus norvegicus
gtatccttgtaagttgaagaccact

SEQ ID NO: 485490 - DNA, 25 bp, Rattus norvegicus
gtatccttgtgaacacacagccagt

SEQ ID NO: 485491 - DNA, 25 bp, Rattus norvegicus
gtatccttgtgatcacacagccagt

SEQ ID NO: 485492 - DNA, 25 bp, Rattus norvegicus
gtatcctttactcaatgctgtgaat

SEQ ID NO: 485493 - DNA, 25 bp, Rattus norvegicus
gtatcctttactgaatgctgtgaat

SEQ ID NO: 485494 - DNA, 25 bp, Rattus norvegicus
gtatcctttataatagtgctgccat

SEQ ID NO: 485495 - DNA, 25 bp, Rattus norvegicus
gtatcctttatattagtgctgccat

SEQ ID NO: 485496 - DNA, 25 bp, Rattus norvegicus
gtatcctttctaatttctcacgtaa

SEQ ID NO: 485497 - DNA, 25 bp, Rattus norvegicus
gtatcctttctattttctcacgtaa

SEQ ID NO: 485498 - DNA, 25 bp, Rattus norvegicus
gtatcctttctcaatgtagtggcct

SEQ ID NO: 485499 - DNA, 25 bp, Rattus norvegicus
gtatcctttctctatgtagtggcct

SEQ ID NO: 485500 - DNA, 25 bp, Rattus norvegicus
gtatcctttgggatggtgtgtagcc

SEQ ID NO: 485501 - DNA, 25 bp, Rattus norvegicus
gtatcctttgggttggtgtgtagcc

SEQ ID NO: 485502 - DNA, 25 bp, Rattus norvegicus
gtatcctttggtacaattcctttgt

SEQ ID NO: 485503 - DNA, 25 bp, Rattus norvegicus
gtatcctttggttcaattcctttgt

SEQ ID NO: 485504 - DNA, 25 bp, Rattus norvegicus
gtatccttttaacctgtactagagc

SEQ ID NO: 485505 - DNA, 25 bp, Rattus norvegicus
gtatccttttaagctgtactagagc

SEQ ID NO: 485506 - DNA, 25 bp, Rattus norvegicus
gtatcgacatgtacgccatgggcct

SEQ ID NO: 485507 - DNA, 25 bp, Rattus norvegicus
gtatcgacatgttcgccatgggcct

SEQ ID NO: 485508 - DNA, 25 bp, Rattus norvegicus
gtatcgaccatgagccatatatcta

SEQ ID NO: 485509 - DNA, 25 bp, Rattus norvegicus
gtatcgaccatgtgccatatatcta

SEQ ID NO: 485510 - DNA, 25 bp, Rattus norvegicus
gtatcgacgagccacttagttttaa

SEQ ID NO: 485511 - DNA, 25 bp, Rattus norvegicus
gtatcgacgagcgacttagttttaa

SEQ ID NO: 485512 - DNA, 25 bp, Rattus norvegicus
gtatcgactacgagctttacaaggc

SEQ ID NO: 485513 - DNA, 25 bp, Rattus norvegicus
gtatcgactacgtgctttacaaggc

SEQ ID NO: 485514 - DNA, 25 bp, Rattus norvegicus
gtatcgactttaatggctttgttgt

SEQ ID NO: 485515 - DNA, 25 bp, Rattus norvegicus
gtatcgactttattggctttgttgt

SEQ ID NO: 485516 - DNA, 25 bp, Rattus norvegicus
gtatcgagactaccatcaatgacca

SEQ ID NO: 485517 - DNA, 25 bp, Rattus norvegicus
gtatcgagactagcatcaatgacca

SEQ ID NO: 485518 - DNA, 25 bp, Rattus norvegicus
gtatcgagcataaaggtagcacttg

SEQ ID NO: 485519 - DNA, 25 bp, Rattus norvegicus
gtatcgagcatataggtagcacttg

SEQ ID NO: 485520 - DNA, 25 bp, Rattus norvegicus
gtatcgagctgaatgcaagttggat

SEQ ID NO: 485521 - DNA, 25 bp, Rattus norvegicus
gtatcgagctgattgcaagttggat

SEQ ID NO: 485522 - DNA, 25 bp, Rattus norvegicus
gtatcgaggcctacaagcctctgca

SEQ ID NO: 485523 - DNA, 25 bp, Rattus norvegicus
gtatcgaggccttcaagcctctgca

SEQ ID NO: 485524 - DNA, 25 bp, Rattus norvegicus
gtatcgatacccaggcttacagtta

SEQ ID NO: 485525 - DNA, 25 bp, Rattus norvegicus
gtatcgataccctggcttacagtta

SEQ ID NO: 485526 - DNA, 25 bp, Rattus norvegicus
gtatcgatcctacgtctatcagccc

SEQ ID NO: 485527 - DNA, 25 bp, Rattus norvegicus
gtatcgatcctaggtctatcagccc

SEQ ID NO: 485528 - DNA, 25 bp, Rattus norvegicus
gtatcgatctgtcaatctggttatc

SEQ ID NO: 485529 - DNA, 25 bp, Rattus norvegicus
gtatcgatctgtgaatctggttatc

SEQ ID NO: 485530 - DNA, 25 bp, Rattus norvegicus
gtatcgatgcctattagtttttcca

SEQ ID NO: 485531 - DNA, 25 bp, Rattus norvegicus
gtatcgatgccttttagtttttcca

SEQ ID NO: 485532 - DNA, 25 bp, Rattus norvegicus
gtatcgcacaataccttttgacagt

SEQ ID NO: 485533 - DNA, 25 bp, Rattus norvegicus
gtatcgcacaattccttttgacagt

SEQ ID NO: 485534 - DNA, 25 bp, Rattus norvegicus
gtatcgcacaggaaatcttctcgaa

SEQ ID NO: 485535 - DNA, 25 bp, Rattus norvegicus
gtatcgcacaggtaatcttctcgaa

SEQ ID NO: 485536 - DNA, 25 bp, Rattus norvegicus
gtatcgcagcatccgacacaatgag

SEQ ID NO: 485537 - DNA, 25 bp, Rattus norvegicus
gtatcgcagcatgcgacacaatgag

SEQ ID NO: 485538 - DNA, 25 bp, Rattus norvegicus
gtatcgcccaagcttcgtgtctgac

SEQ ID NO: 485539 - DNA, 25 bp, Rattus norvegicus
gtatcgcccaaggttcgtgtctgac

SEQ ID NO: 485540 - DNA, 25 bp, Rattus norvegicus
gtatcgccctcgcacagagttttgc

SEQ ID NO: 485541 - DNA, 25 bp, Rattus norvegicus
gtatcgccctcggacagagttttgc

SEQ ID NO: 485542 - DNA, 25 bp, Rattus norvegicus
gtatcgccgcaacttcaattaccga

SEQ ID NO: 485543 - DNA, 25 bp, Rattus norvegicus
gtatcgccgcaagttcaattaccga

SEQ ID NO: 485544 - DNA, 25 bp, Rattus norvegicus
gtatcgccgggcaggtgtccataga

SEQ ID NO: 485545 - DNA, 25 bp, Rattus norvegicus
gtatcgccgggctggtgtccataga

SEQ ID NO: 485546 - DNA, 25 bp, Rattus norvegicus
gtatcgctgacaatttgaccatgat

SEQ ID NO: 485547 - DNA, 25 bp, Rattus norvegicus
gtatcgctgacattttgaccatgat

SEQ ID NO: 485548 - DNA, 25 bp, Rattus norvegicus
gtatcgctgatcaacctgaggcaaa

SEQ ID NO: 485549 - DNA, 25 bp, Rattus norvegicus
gtatcgctgatctacctgaggcaaa

SEQ ID NO: 485550 - DNA, 25 bp, Rattus norvegicus
gtatcgcttggcagttaattatata

SEQ ID NO: 485551 - DNA, 25 bp, Rattus norvegicus
gtatcgcttggctgttaattatata

SEQ ID NO: 485552 - DNA, 25 bp, Rattus norvegicus
gtatcggatacactggaagactttc

SEQ ID NO: 485553 - DNA, 25 bp, Rattus norvegicus
gtatcggatacagtggaagactttc

SEQ ID NO: 485554 - DNA, 25 bp, Rattus norvegicus
gtatcggcaaatcaacatggctata

SEQ ID NO: 485555 - DNA, 25 bp, Rattus norvegicus
gtatcggcaaatgaacatggctata

SEQ ID NO: 485556 - DNA, 25 bp, Rattus norvegicus
gtatcgggaactcaaccagggtcct

SEQ ID NO: 485557 - DNA, 25 bp, Rattus norvegicus
gtatcgggaactgaaccagggtcct

SEQ ID NO: 485558 - DNA, 25 bp, Rattus norvegicus
gtatcgggctttatcatgcagtatt

SEQ ID NO: 485559 - DNA, 25 bp, Rattus norvegicus
gtatcgggctttttcatgcagtatt

SEQ ID NO: 485560 - DNA, 25 bp, Rattus norvegicus
gtatcggtgtagaccatgtggcccg

SEQ ID NO: 485561 - DNA, 25 bp, Rattus norvegicus
gtatcggtgtagtccatgtggcccg

SEQ ID NO: 485562 - DNA, 25 bp, Rattus norvegicus
gtatcggttacaacatcttgtgtgt

SEQ ID NO: 485563 - DNA, 25 bp, Rattus norvegicus
gtatcggttacatcatcttgtgtgt

SEQ ID NO: 485564 - DNA, 25 bp, Rattus norvegicus
gtatcgtaagttattggtagcacca

SEQ ID NO: 485565 - DNA, 25 bp, Rattus norvegicus
gtatcgtaagtttttggtagcacca

SEQ ID NO: 485566 - DNA, 25 bp, Rattus norvegicus
gtatcgtcatacatgccaaggcctt

SEQ ID NO: 485567 - DNA, 25 bp, Rattus norvegicus
gtatcgtcatacttgccaaggcctt

SEQ ID NO: 485568 - DNA, 25 bp, Rattus norvegicus
gtatcgtcgatcacagaaacaactt

SEQ ID NO: 485569 - DNA, 25 bp, Rattus norvegicus
gtatcgtcgatctcagaaacaactt

SEQ ID NO: 485570 - DNA, 25 bp, Rattus norvegicus
gtatcgtgcgtacagacagcgtcag

SEQ ID NO: 485571 - DNA, 25 bp, Rattus norvegicus
gtatcgtgcgtagagacagcgtcag

SEQ ID NO: 485572 - DNA, 25 bp, Rattus norvegicus
gtatcgtgctaccaagttgctatga

SEQ ID NO: 485573 - DNA, 25 bp, Rattus norvegicus
gtatcgtgctacgaagttgctatga

SEQ ID NO: 485574 - DNA, 25 bp, Rattus norvegicus
gtatcgtgtaataagtagcttactt

SEQ ID NO: 485575 - DNA, 25 bp, Rattus norvegicus
gtatcgtgtaattagtagcttactt

SEQ ID NO: 485576 - DNA, 25 bp, Rattus norvegicus
gtatcgtgtaccatttgtgaccatc

SEQ ID NO: 485577 - DNA, 25 bp, Rattus norvegicus
gtatcgtgtaccttttgtgaccatc

SEQ ID NO: 485578 - DNA, 25 bp, Rattus norvegicus
gtatcgttcaatacggtgacttcca

SEQ ID NO: 485579 - DNA, 25 bp, Rattus norvegicus
gtatcgttcaattcggtgacttcca

SEQ ID NO: 485580 - DNA, 25 bp, Rattus norvegicus
gtatcgttgtcaaggcagaccccaa

SEQ ID NO: 485581 - DNA, 25 bp, Rattus norvegicus
gtatcgttgtcatggcagaccccaa

SEQ ID NO: 485582 - DNA, 25 bp, Rattus norvegicus
gtatctaaatatatgcttttctccc

SEQ ID NO: 485583 - DNA, 25 bp, Rattus norvegicus
gtatctaaatatttgcttttctccc

SEQ ID NO: 485584 - DNA, 25 bp, Rattus norvegicus
gtatctaaccttcagaacggctttt

SEQ ID NO: 485585 - DNA, 25 bp, Rattus norvegicus
gtatctaaccttgagaacggctttt

SEQ ID NO: 485586 - DNA, 25 bp, Rattus norvegicus
gtatctaatcacagtaatctcccag

SEQ ID NO: 485587 - DNA, 25 bp, Rattus norvegicus
gtatctaatcactgtaatctcccag

SEQ ID NO: 485588 - DNA, 25 bp, Rattus norvegicus
gtatctaatctcagcacctgggagg

SEQ ID NO: 485589 - DNA, 25 bp, Rattus norvegicus
gtatctaatctctgcacctgggagg

SEQ ID NO: 485590 - DNA, 25 bp, Rattus norvegicus
gtatctaattagattccaaggtcag

SEQ ID NO: 485591 - DNA, 25 bp, Rattus norvegicus
gtatctaattagtttccaaggtcag

SEQ ID NO: 485592 - DNA, 25 bp, Rattus norvegicus
gtatctacaattcaacagctactgt

SEQ ID NO: 485593 - DNA, 25 bp, Rattus norvegicus
gtatctacaattgaacagctactgt

SEQ ID NO: 485594 - DNA, 25 bp, Rattus norvegicus
gtatctacgggtcctgcagccatga

SEQ ID NO: 485595 - DNA, 25 bp, Rattus norvegicus
gtatctacgggtgctgcagccatga

SEQ ID NO: 485596 - DNA, 25 bp, Rattus norvegicus
gtatctactgtaagtgcagaccatg

SEQ ID NO: 485597 - DNA, 25 bp, Rattus norvegicus
gtatctactgtatgtgcagaccatg

SEQ ID NO: 485598 - DNA, 25 bp, Rattus norvegicus
gtatctactgtgatcttcgtcagaa

SEQ ID NO: 485599 - DNA, 25 bp, Rattus norvegicus
gtatctactgtgttcttcgtcagaa

SEQ ID NO: 485600 - DNA, 25 bp, Rattus norvegicus
gtatctacttagctcttttttggaa

SEQ ID NO: 485601 - DNA, 25 bp, Rattus norvegicus
gtatctacttaggtcttttttggaa

SEQ ID NO: 485602 - DNA, 25 bp, Rattus norvegicus
gtatctactttcatcattttaactt

SEQ ID NO: 485603 - DNA, 25 bp, Rattus norvegicus
gtatctactttccactctttgtggg

SEQ ID NO: 485604 - DNA, 25 bp, Rattus norvegicus
gtatctactttcgactctttgtggg

SEQ ID NO: 485605 - DNA, 25 bp, Rattus norvegicus
gtatctactttcttcattttaactt

SEQ ID NO: 485606 - DNA, 25 bp, Rattus norvegicus
gtatctagacatccattgacccttg

SEQ ID NO: 485607 - DNA, 25 bp, Rattus norvegicus
gtatctagacatgcattgacccttg

SEQ ID NO: 485608 - DNA, 25 bp, Rattus norvegicus
gtatctatacctcccatgtttctaa

SEQ ID NO: 485609 - DNA, 25 bp, Rattus norvegicus
gtatctatacctgccatgtttctaa

SEQ ID NO: 485610 - DNA, 25 bp, Rattus norvegicus
gtatctatcagaatatccatctcgt

SEQ ID NO: 485611 - DNA, 25 bp, Rattus norvegicus
gtatctatcagattatccatctcgt

SEQ ID NO: 485612 - DNA, 25 bp, Rattus norvegicus
gtatctatctcactgctatgtattt

SEQ ID NO: 485613 - DNA, 25 bp, Rattus norvegicus
gtatctatctcagtgctatgtattt

SEQ ID NO: 485614 - DNA, 25 bp, Rattus norvegicus
gtatctatgacacgctacttctacc

SEQ ID NO: 485615 - DNA, 25 bp, Rattus norvegicus
gtatctatgacaggctacttctacc

SEQ ID NO: 485616 - DNA, 25 bp, Rattus norvegicus
gtatctattttaaactgaatcatta

SEQ ID NO: 485617 - DNA, 25 bp, Rattus norvegicus
gtatctattttatactgaatcatta

SEQ ID NO: 485618 - DNA, 25 bp, Rattus norvegicus
gtatctatttttaattcatctgaaa

SEQ ID NO: 485619 - DNA, 25 bp, Rattus norvegicus
gtatctattttttattcatctgaaa

SEQ ID NO: 485620 - DNA, 25 bp, Rattus norvegicus
gtatctcaagtgacatagcctcttc

SEQ ID NO: 485621 - DNA, 25 bp, Rattus norvegicus
gtatctcaagtgtcatagcctcttc

SEQ ID NO: 485622 - DNA, 25 bp, Rattus norvegicus
gtatctcaatctatttctgacactc

SEQ ID NO: 485623 - DNA, 25 bp, Rattus norvegicus
gtatctcaatctctgattcacagtg

SEQ ID NO: 485624 - DNA, 25 bp, Rattus norvegicus
gtatctcaatctgtgattcacagtg

SEQ ID NO: 485625 - DNA, 25 bp, Rattus norvegicus
gtatctcaatctttttctgacactc

SEQ ID NO: 485626 - DNA, 25 bp, Rattus norvegicus
gtatctcagatacaccaattggcag

SEQ ID NO: 485627 - DNA, 25 bp, Rattus norvegicus
gtatctcagatagaccaattggcag

SEQ ID NO: 485628 - DNA, 25 bp, Rattus norvegicus
gtatctcagccaccgtcatggacgc

SEQ ID NO: 485629 - DNA, 25 bp, Rattus norvegicus
gtatctcagccagcgtcatggacgc

SEQ ID NO: 485630 - DNA, 25 bp, Rattus norvegicus
gtatctcaggcaacacaccatagga

SEQ ID NO: 485631 - DNA, 25 bp, Rattus norvegicus
gtatctcaggcatcacaccatagga

SEQ ID NO: 485632 - DNA, 25 bp, Rattus norvegicus
gtatctcagtgcacaatctccagag

SEQ ID NO: 485633 - DNA, 25 bp, Rattus norvegicus
gtatctcagtgctcaatctccagag

SEQ ID NO: 485634 - DNA, 25 bp, Rattus norvegicus
gtatctcataggattctgacatgca

SEQ ID NO: 485635 - DNA, 25 bp, Rattus norvegicus
gtatctcataggtttctgacatgca

SEQ ID NO: 485636 - DNA, 25 bp, Rattus norvegicus
gtatctcatgaaagtctatgtccat

SEQ ID NO: 485637 - DNA, 25 bp, Rattus norvegicus
gtatctcatgaatgtctatgtccat

SEQ ID NO: 485638 - DNA, 25 bp, Rattus norvegicus
gtatctcatgtgatagttcttattt

SEQ ID NO: 485639 - DNA, 25 bp, Rattus norvegicus
gtatctcatgtgctggtatctttat

SEQ ID NO: 485640 - DNA, 25 bp, Rattus norvegicus
gtatctcatgtggtggtatctttat

SEQ ID NO: 485641 - DNA, 25 bp, Rattus norvegicus
gtatctcatgtgttagttcttattt

SEQ ID NO: 485642 - DNA, 25 bp, Rattus norvegicus
gtatctcattaaaggtattgtactg

SEQ ID NO: 485643 - DNA, 25 bp, Rattus norvegicus
gtatctcattaatggtattgtactg

SEQ ID NO: 485644 - DNA, 25 bp, Rattus norvegicus
gtatctcattatcgctcctacaggg

SEQ ID NO: 485645 - DNA, 25 bp, Rattus norvegicus
gtatctcattatggctcctacaggg

SEQ ID NO: 485646 - DNA, 25 bp, Rattus norvegicus
gtatctcattcaaaactggtgtggg

SEQ ID NO: 485647 - DNA, 25 bp, Rattus norvegicus
gtatctcattcataactggtgtggg

SEQ ID NO: 485648 - DNA, 25 bp, Rattus norvegicus
gtatctccaaacagtggtaacggtt

SEQ ID NO: 485649 - DNA, 25 bp, Rattus norvegicus
gtatctccaaactgtggtaacggtt

SEQ ID NO: 485650 - DNA, 25 bp, Rattus norvegicus
gtatctccaagccagtctgtgtttt

SEQ ID NO: 485651 - DNA, 25 bp, Rattus norvegicus
gtatctccaagcgagtctgtgtttt

SEQ ID NO: 485652 - DNA, 25 bp, Rattus norvegicus
gtatctccagaacaaaagtgctgtg

SEQ ID NO: 485653 - DNA, 25 bp, Rattus norvegicus
gtatctccagaagaaaagtgctgtg

SEQ ID NO: 485654 - DNA, 25 bp, Rattus norvegicus
gtatctccaggaacctttctgtaaa

SEQ ID NO: 485655 - DNA, 25 bp, Rattus norvegicus
gtatctccaggatcctttctgtaaa

SEQ ID NO: 485656 - DNA, 25 bp, Rattus norvegicus
gtatctccaggtaaccaggaaccat

SEQ ID NO: 485657 - DNA, 25 bp, Rattus norvegicus
gtatctccaggttaccaggaaccat

SEQ ID NO: 485658 - DNA, 25 bp, Rattus norvegicus
gtatctccatatcgaggatgctcgc

SEQ ID NO: 485659 - DNA, 25 bp, Rattus norvegicus
gtatctccatatggaggatgctcgc

SEQ ID NO: 485660 - DNA, 25 bp, Rattus norvegicus
gtatctccatcaaccagggcacttg

SEQ ID NO: 485661 - DNA, 25 bp, Rattus norvegicus
gtatctccatcatccagggcacttg

SEQ ID NO: 485662 - DNA, 25 bp, Rattus norvegicus
gtatctccatttagaccatccattt

SEQ ID NO: 485663 - DNA, 25 bp, Rattus norvegicus
gtatctccattttgaccatccattt

SEQ ID NO: 485664 - DNA, 25 bp, Rattus norvegicus
gtatctccccaaacatttccatagg

SEQ ID NO: 485665 - DNA, 25 bp, Rattus norvegicus
gtatctccccaatcatttccatagg

SEQ ID NO: 485666 - DNA, 25 bp, Rattus norvegicus
gtatctcccctaatttttctcttct

SEQ ID NO: 485667 - DNA, 25 bp, Rattus norvegicus
gtatctcccctattttttctcttct

SEQ ID NO: 485668 - DNA, 25 bp, Rattus norvegicus
gtatctccctgcaatttgacttctt

SEQ ID NO: 485669 - DNA, 25 bp, Rattus norvegicus
gtatctccctgctatttgacttctt

SEQ ID NO: 485670 - DNA, 25 bp, Rattus norvegicus
gtatctcccttcagagaacatcctg

SEQ ID NO: 485671 - DNA, 25 bp, Rattus norvegicus
gtatctcccttctgagaacatcctg

SEQ ID NO: 485672 - DNA, 25 bp, Rattus norvegicus
gtatctcctatgcatcaattacaga

SEQ ID NO: 485673 - DNA, 25 bp, Rattus norvegicus
gtatctcctatggatcaattacaga

SEQ ID NO: 485674 - DNA, 25 bp, Rattus norvegicus
gtatctcctcataaaaatcagcaac

SEQ ID NO: 485675 - DNA, 25 bp, Rattus norvegicus
gtatctcctcattaaaatcagcaac

SEQ ID NO: 485676 - DNA, 25 bp, Rattus norvegicus
gtatctcctgagcttaatttgtgaa

SEQ ID NO: 485677 - DNA, 25 bp, Rattus norvegicus
gtatctcctgaggttaatttgtgaa

SEQ ID NO: 485678 - DNA, 25 bp, Rattus norvegicus
gtatctccttccagagcatgaggat

SEQ ID NO: 485679 - DNA, 25 bp, Rattus norvegicus
gtatctccttcctgagcatgaggat

SEQ ID NO: 485680 - DNA, 25 bp, Rattus norvegicus
gtatctcgatccacagacagcaaga

SEQ ID NO: 485681 - DNA, 25 bp, Rattus norvegicus
gtatctcgatcctcagacagcaaga

SEQ ID NO: 485682 - DNA, 25 bp, Rattus norvegicus
gtatctcgcgccaggaggagaaagt

SEQ ID NO: 485683 - DNA, 25 bp, Rattus norvegicus
gtatctcgcgcctggaggagaaagt

SEQ ID NO: 485684 - DNA, 25 bp, Rattus norvegicus
gtatctcgcttcatggtggtgcaac

SEQ ID NO: 485685 - DNA, 25 bp, Rattus norvegicus
gtatctcgcttcttggtggtgcaac

SEQ ID NO: 485686 - DNA, 25 bp, Rattus norvegicus
gtatctcggcttaaccagaaatctt

SEQ ID NO: 485687 - DNA, 25 bp, Rattus norvegicus
gtatctcggctttaccagaaatctt

SEQ ID NO: 485688 - DNA, 25 bp, Rattus norvegicus
gtatctcgggacacagacctttgca

SEQ ID NO: 485689 - DNA, 25 bp, Rattus norvegicus
gtatctcgggactcagacctttgca

SEQ ID NO: 485690 - DNA, 25 bp, Rattus norvegicus
gtatctctaatactacagatccatg

SEQ ID NO: 485691 - DNA, 25 bp, Rattus norvegicus
gtatctctaatagtacagatccatg

SEQ ID NO: 485692 - DNA, 25 bp, Rattus norvegicus
gtatctctcagacccttttttaaat

SEQ ID NO: 485693 - DNA, 25 bp, Rattus norvegicus
gtatctctcagagccttttttaaat

SEQ ID NO: 485694 - DNA, 25 bp, Rattus norvegicus
gtatctctcatgagtgggagcttgt

SEQ ID NO: 485695 - DNA, 25 bp, Rattus norvegicus
gtatctctcatgtgtgggagcttgt

SEQ ID NO: 485696 - DNA, 25 bp, Rattus norvegicus
gtatctctcctgcttaagttggctc

SEQ ID NO: 485697 - DNA, 25 bp, Rattus norvegicus
gtatctctcctggttaagttggctc

SEQ ID NO: 485698 - DNA, 25 bp, Rattus norvegicus
gtatctctccttaatcttggtggtc

SEQ ID NO: 485699 - DNA, 25 bp, Rattus norvegicus
gtatctctcctttatcttggtggtc

SEQ ID NO: 485700 - DNA, 25 bp, Rattus norvegicus
gtatctctctcacttaagcaggcgt

SEQ ID NO: 485701 - DNA, 25 bp, Rattus norvegicus
gtatctctctcagttaagcaggcgt

SEQ ID NO: 485702 - DNA, 25 bp, Rattus norvegicus
gtatctctgaagcagtctaccctag

SEQ ID NO: 485703 - DNA, 25 bp, Rattus norvegicus
gtatctctgaaggagtctaccctag

SEQ ID NO: 485704 - DNA, 25 bp, Rattus norvegicus
gtatctctgggtacctaagaagcaa

SEQ ID NO: 485705 - DNA, 25 bp, Rattus norvegicus
gtatctctgggttcctaagaagcaa

SEQ ID NO: 485706 - DNA, 25 bp, Rattus norvegicus
gtatctcttagtccctagccaagct

SEQ ID NO: 485707 - DNA, 25 bp, Rattus norvegicus
gtatctcttagtgcctagccaagct

SEQ ID NO: 485708 - DNA, 25 bp, Rattus norvegicus
gtatctcttccaaggcacagacaag

SEQ ID NO: 485709 - DNA, 25 bp, Rattus norvegicus
gtatctcttccatggcacagacaag

SEQ ID NO: 485710 - DNA, 25 bp, Rattus norvegicus
gtatctctttctctatatctctatc

SEQ ID NO: 485711 - DNA, 25 bp, Rattus norvegicus
gtatctctttctgtatatctctatc

SEQ ID NO: 485712 - DNA, 25 bp, Rattus norvegicus
gtatctctttgaaggactccaagca

SEQ ID NO: 485713 - DNA, 25 bp, Rattus norvegicus
gtatctctttgatggactccaagca

SEQ ID NO: 485714 - DNA, 25 bp, Rattus norvegicus
gtatctgaaaacactggctagaagc

SEQ ID NO: 485715 - DNA, 25 bp, Rattus norvegicus
gtatctgaaaacatgggtgacaccc

SEQ ID NO: 485716 - DNA, 25 bp, Rattus norvegicus
gtatctgaaaactctggctagaagc

SEQ ID NO: 485717 - DNA, 25 bp, Rattus norvegicus
gtatctgaaaacttgggtgacaccc

SEQ ID NO: 485718 - DNA, 25 bp, Rattus norvegicus
gtatctgaaataccgttctcaccct

SEQ ID NO: 485719 - DNA, 25 bp, Rattus norvegicus
gtatctgaaatagcgttctcaccct

SEQ ID NO: 485720 - DNA, 25 bp, Rattus norvegicus
gtatctgaaatccaagagccatgtg

SEQ ID NO: 485721 - DNA, 25 bp, Rattus norvegicus
gtatctgaaatcgaagagccatgtg

SEQ ID NO: 485722 - DNA, 25 bp, Rattus norvegicus
gtatctgaactaagagccctggatg

SEQ ID NO: 485723 - DNA, 25 bp, Rattus norvegicus
gtatctgaactatgagccctggatg

SEQ ID NO: 485724 - DNA, 25 bp, Rattus norvegicus
gtatctgaactcacattagccttgt

SEQ ID NO: 485725 - DNA, 25 bp, Rattus norvegicus
gtatctgaactctcattagccttgt

SEQ ID NO: 485726 - DNA, 25 bp, Rattus norvegicus
gtatctgaacttagattcccctgaa

SEQ ID NO: 485727 - DNA, 25 bp, Rattus norvegicus
gtatctgaactttgattcccctgaa

SEQ ID NO: 485728 - DNA, 25 bp, Rattus norvegicus
gtatctgaaggacctggtccacctg

SEQ ID NO: 485729 - DNA, 25 bp, Rattus norvegicus
gtatctgaaggagctggtccacctg

SEQ ID NO: 485730 - DNA, 25 bp, Rattus norvegicus
gtatctgaagtaacactggccttga

SEQ ID NO: 485731 - DNA, 25 bp, Rattus norvegicus
gtatctgaagtaacccacagtgcaa

SEQ ID NO: 485732 - DNA, 25 bp, Rattus norvegicus
gtatctgaagtatcactggccttga

SEQ ID NO: 485733 - DNA, 25 bp, Rattus norvegicus
gtatctgaagtatcccacagtgcaa

SEQ ID NO: 485734 - DNA, 25 bp, Rattus norvegicus
gtatctgaattgcatttgtactttt

SEQ ID NO: 485735 - DNA, 25 bp, Rattus norvegicus
gtatctgaattggatttgtactttt

SEQ ID NO: 485736 - DNA, 25 bp, Rattus norvegicus
gtatctgaccggagcctggaggctt

SEQ ID NO: 485737 - DNA, 25 bp, Rattus norvegicus
gtatctgaccggtgcctggaggctt

SEQ ID NO: 485738 - DNA, 25 bp, Rattus norvegicus
gtatctgactacaaacaccatccta

SEQ ID NO: 485739 - DNA, 25 bp, Rattus norvegicus
gtatctgactactaacaccatccta

SEQ ID NO: 485740 - DNA, 25 bp, Rattus norvegicus
gtatctgagaaactaaacatgtatt

SEQ ID NO: 485741 - DNA, 25 bp, Rattus norvegicus
gtatctgagaaagtaaacatgtatt

SEQ ID NO: 485742 - DNA, 25 bp, Rattus norvegicus
gtatctgagggtctcgtgcacgacc

SEQ ID NO: 485743 - DNA, 25 bp, Rattus norvegicus
gtatctgagggtgtcgtgcacgacc

SEQ ID NO: 485744 - DNA, 25 bp, Rattus norvegicus
gtatctgagtttagctttggccgcc

SEQ ID NO: 485745 - DNA, 25 bp, Rattus norvegicus
gtatctgagttttgctttggccgcc

SEQ ID NO: 485746 - DNA, 25 bp, Rattus norvegicus
gtatctgatctgacttatatccaag

SEQ ID NO: 485747 - DNA, 25 bp, Rattus norvegicus
gtatctgatctgtcttatatccaag

SEQ ID NO: 485748 - DNA, 25 bp, Rattus norvegicus
gtatctgatggccattatacaacag

SEQ ID NO: 485749 - DNA, 25 bp, Rattus norvegicus
gtatctgatggcgattatacaacag

SEQ ID NO: 485750 - DNA, 25 bp, Rattus norvegicus
gtatctgcaaaacgcctgctaggaa

SEQ ID NO: 485751 - DNA, 25 bp, Rattus norvegicus
gtatctgcaaaaggcctgctaggaa

SEQ ID NO: 485752 - DNA, 25 bp, Rattus norvegicus
gtatctgcattaaggagccaccgtg

SEQ ID NO: 485753 - DNA, 25 bp, Rattus norvegicus
gtatctgcattatggagccaccgtg

SEQ ID NO: 485754 - DNA, 25 bp, Rattus norvegicus
gtatctgccaaacactgcacgggaa

SEQ ID NO: 485755 - DNA, 25 bp, Rattus norvegicus
gtatctgccaaagactgcacgggaa

SEQ ID NO: 485756 - DNA, 25 bp, Rattus norvegicus
gtatctgccaaccatactatgaaac

SEQ ID NO: 485757 - DNA, 25 bp, Rattus norvegicus
gtatctgccaacgatactatgaaac

SEQ ID NO: 485758 - DNA, 25 bp, Rattus norvegicus
gtatctgccatgaatctggagtaat

SEQ ID NO: 485759 - DNA, 25 bp, Rattus norvegicus
gtatctgccatgtatctggagtaat

SEQ ID NO: 485760 - DNA, 25 bp, Rattus norvegicus
gtatctgccattcactcacattgag

SEQ ID NO: 485761 - DNA, 25 bp, Rattus norvegicus
gtatctgccattgactcacattgag

SEQ ID NO: 485762 - DNA, 25 bp, Rattus norvegicus
gtatctgccctgattctttataaat

SEQ ID NO: 485763 - DNA, 25 bp, Rattus norvegicus
gtatctgccctgtttctttataaat

SEQ ID NO: 485764 - DNA, 25 bp, Rattus norvegicus
gtatctgccttgagttcccttagca

SEQ ID NO: 485765 - DNA, 25 bp, Rattus norvegicus
gtatctgccttgtgttcccttagca

SEQ ID NO: 485766 - DNA, 25 bp, Rattus norvegicus
gtatctgcgaagcactctgcaactc

SEQ ID NO: 485767 - DNA, 25 bp, Rattus norvegicus
gtatctgcgaaggactctgcaactc

SEQ ID NO: 485768 - DNA, 25 bp, Rattus norvegicus
gtatctgctagccttcttttggaat

SEQ ID NO: 485769 - DNA, 25 bp, Rattus norvegicus
gtatctgctagcgttcttttggaat

SEQ ID NO: 485770 - DNA, 25 bp, Rattus norvegicus
gtatctgctagtactataggacttt

SEQ ID NO: 485771 - DNA, 25 bp, Rattus norvegicus
gtatctgctagttctataggacttt

SEQ ID NO: 485772 - DNA, 25 bp, Rattus norvegicus
gtatctgctctccttggctgaagtg

SEQ ID NO: 485773 - DNA, 25 bp, Rattus norvegicus
gtatctgctctcgttggctgaagtg

SEQ ID NO: 485774 - DNA, 25 bp, Rattus norvegicus
gtatctgctgcacggtagtctagct

SEQ ID NO: 485775 - DNA, 25 bp, Rattus norvegicus
gtatctgctgcagggtagtctagct

SEQ ID NO: 485776 - DNA, 25 bp, Rattus norvegicus
gtatctgctgccctttaatgactag

SEQ ID NO: 485777 - DNA, 25 bp, Rattus norvegicus
gtatctgctgccgtttaatgactag

SEQ ID NO: 485778 - DNA, 25 bp, Rattus norvegicus
gtatctgctgctagaactgttgtgc

SEQ ID NO: 485779 - DNA, 25 bp, Rattus norvegicus
gtatctgctgcttgaactgttgtgc

SEQ ID NO: 485780 - DNA, 25 bp, Rattus norvegicus
gtatctgctggcatacagaccagtt

SEQ ID NO: 485781 - DNA, 25 bp, Rattus norvegicus
gtatctgctggcttacagaccagtt

SEQ ID NO: 485782 - DNA, 25 bp, Rattus norvegicus
gtatctgcttaacatctgcgacgtt

SEQ ID NO: 485783 - DNA, 25 bp, Rattus norvegicus
gtatctgcttaagatctgcgacgtt

SEQ ID NO: 485784 - DNA, 25 bp, Rattus norvegicus
gtatctgcttggaactttgatttaa

SEQ ID NO: 485785 - DNA, 25 bp, Rattus norvegicus
gtatctgcttggtactttgatttaa

SEQ ID NO: 485786 - DNA, 25 bp, Rattus norvegicus
gtatctgcttgtcatcttgcctgaa

SEQ ID NO: 485787 - DNA, 25 bp, Rattus norvegicus
gtatctgcttgtgatcttgcctgaa

SEQ ID NO: 485788 - DNA, 25 bp, Rattus norvegicus
gtatctggaaacagaagccctcccg

SEQ ID NO: 485789 - DNA, 25 bp, Rattus norvegicus
gtatctggaaactgaagccctcccg

SEQ ID NO: 485790 - DNA, 25 bp, Rattus norvegicus
gtatctggacccatttgtacttttg

SEQ ID NO: 485791 - DNA, 25 bp, Rattus norvegicus
gtatctggacccttttgtacttttg

SEQ ID NO: 485792 - DNA, 25 bp, Rattus norvegicus
gtatctggagtaatgcagacaccaa

SEQ ID NO: 485793 - DNA, 25 bp, Rattus norvegicus
gtatctggagtattgcagacaccaa

SEQ ID NO: 485794 - DNA, 25 bp, Rattus norvegicus
gtatctgggatacctcgtaatggaa

SEQ ID NO: 485795 - DNA, 25 bp, Rattus norvegicus
gtatctgggatagctcgtaatggaa

SEQ ID NO: 485796 - DNA, 25 bp, Rattus norvegicus
gtatctgggcaaataagcactcttc

SEQ ID NO: 485797 - DNA, 25 bp, Rattus norvegicus
gtatctgggcaattaagcactcttc

SEQ ID NO: 485798 - DNA, 25 bp, Rattus norvegicus
gtatctgggcctacagacaccactt

SEQ ID NO: 485799 - DNA, 25 bp, Rattus norvegicus
gtatctgggccttcagacaccactt

SEQ ID NO: 485800 - DNA, 25 bp, Rattus norvegicus
gtatctggttataggatcactctgg

SEQ ID NO: 485801 - DNA, 25 bp, Rattus norvegicus
gtatctggttattggatcactctgg

SEQ ID NO: 485802 - DNA, 25 bp, Rattus norvegicus
gtatctgtaaatcctatccttaggg

SEQ ID NO: 485803 - DNA, 25 bp, Rattus norvegicus
gtatctgtaaatgctatccttaggg

SEQ ID NO: 485804 - DNA, 25 bp, Rattus norvegicus
gtatctgtaaccacataacttttat

SEQ ID NO: 485805 - DNA, 25 bp, Rattus norvegicus
gtatctgtaacccttgaatccctag

SEQ ID NO: 485806 - DNA, 25 bp, Rattus norvegicus
gtatctgtaaccgttgaatccctag

SEQ ID NO: 485807 - DNA, 25 bp, Rattus norvegicus
gtatctgtaacctcataacttttat

SEQ ID NO: 485808 - DNA, 25 bp, Rattus norvegicus
gtatctgtacatccatgtccacaaa

SEQ ID NO: 485809 - DNA, 25 bp, Rattus norvegicus
gtatctgtacatgcatgtccacaaa

SEQ ID NO: 485810 - DNA, 25 bp, Rattus norvegicus
gtatctgtagaacttcttccaggag

SEQ ID NO: 485811 - DNA, 25 bp, Rattus norvegicus
gtatctgtagaagttcttccaggag

SEQ ID NO: 485812 - DNA, 25 bp, Rattus norvegicus
gtatctgtagtcactcgatgctatg

SEQ ID NO: 485813 - DNA, 25 bp, Rattus norvegicus
gtatctgtagtctctcgatgctatg

SEQ ID NO: 485814 - DNA, 25 bp, Rattus norvegicus
gtatctgtatcgatatcctggtggg

SEQ ID NO: 485815 - DNA, 25 bp, Rattus norvegicus
gtatctgtatcgttatcctggtggg

SEQ ID NO: 485816 - DNA, 25 bp, Rattus norvegicus
gtatctgtatgtctaaccctttgta

SEQ ID NO: 485817 - DNA, 25 bp, Rattus norvegicus
gtatctgtatgtgtaaccctttgta

SEQ ID NO: 485818 - DNA, 25 bp, Rattus norvegicus
gtatctgtcaagatcagagtcctct

SEQ ID NO: 485819 - DNA, 25 bp, Rattus norvegicus
gtatctgtcaagttcagagtcctct

SEQ ID NO: 485820 - DNA, 25 bp, Rattus norvegicus
gtatctgtcagtcctgagacgccaa

SEQ ID NO: 485821 - DNA, 25 bp, Rattus norvegicus
gtatctgtcagtgctgagacgccaa

SEQ ID NO: 485822 - DNA, 25 bp, Rattus norvegicus
gtatctgtcataagcgttcctaagg

SEQ ID NO: 485823 - DNA, 25 bp, Rattus norvegicus
gtatctgtcatatgcgttcctaagg

SEQ ID NO: 485824 - DNA, 25 bp, Rattus norvegicus
gtatctgtcatgcttgtcactgtcc

SEQ ID NO: 485825 - DNA, 25 bp, Rattus norvegicus
gtatctgtcatggttgtcactgtcc

SEQ ID NO: 485826 - DNA, 25 bp, Rattus norvegicus
gtatctgtccagatcatcagttttt

SEQ ID NO: 485827 - DNA, 25 bp, Rattus norvegicus
gtatctgtccagttcatcagttttt

SEQ ID NO: 485828 - DNA, 25 bp, Rattus norvegicus
gtatctgtccccagcatatggagca

SEQ ID NO: 485829 - DNA, 25 bp, Rattus norvegicus
gtatctgtcccctgcatatggagca

SEQ ID NO: 485830 - DNA, 25 bp, Rattus norvegicus
gtatctgtcctaatcagttaaccca

SEQ ID NO: 485831 - DNA, 25 bp, Rattus norvegicus
gtatctgtcctattcagttaaccca

SEQ ID NO: 485832 - DNA, 25 bp, Rattus norvegicus
gtatctgtctgtagtgcttcaaatg

SEQ ID NO: 485833 - DNA, 25 bp, Rattus norvegicus
gtatctgtctgttgtgcttcaaatg

SEQ ID NO: 485834 - DNA, 25 bp, Rattus norvegicus
gtatctgtgagacttcaccatgaat

SEQ ID NO: 485835 - DNA, 25 bp, Rattus norvegicus
gtatctgtgagagttcaccatgaat

SEQ ID NO: 485836 - DNA, 25 bp, Rattus norvegicus
gtatctgtgcatacatgtaccagca

SEQ ID NO: 485837 - DNA, 25 bp, Rattus norvegicus
gtatctgtgcattcatgtaccagca

SEQ ID NO: 485838 - DNA, 25 bp, Rattus norvegicus
gtatctgtgtagacttgctgatgtc

SEQ ID NO: 485839 - DNA, 25 bp, Rattus norvegicus
gtatctgtgtagtcttgctgatgtc

SEQ ID NO: 485840 - DNA, 25 bp, Rattus norvegicus
gtatctgttcacacttaggagccac

SEQ ID NO: 485841 - DNA, 25 bp, Rattus norvegicus
gtatctgttcactcttaggagccac

SEQ ID NO: 485842 - DNA, 25 bp, Rattus norvegicus
gtatctgttctcatgggttcaactc

SEQ ID NO: 485843 - DNA, 25 bp, Rattus norvegicus
gtatctgttctcttgggttcaactc

SEQ ID NO: 485844 - DNA, 25 bp, Rattus norvegicus
gtatctgttcttcatgctcgaccga

SEQ ID NO: 485845 - DNA, 25 bp, Rattus norvegicus
gtatctgttcttgatgctcgaccga

SEQ ID NO: 485846 - DNA, 25 bp, Rattus norvegicus
gtatctgttgcaagtgaccacaatg

SEQ ID NO: 485847 - DNA, 25 bp, Rattus norvegicus
gtatctgttgcatgtgaccacaatg

SEQ ID NO: 485848 - DNA, 25 bp, Rattus norvegicus
gtatctgttggaccactgcagcaaa

SEQ ID NO: 485849 - DNA, 25 bp, Rattus norvegicus
gtatctgttggagcactgcagcaaa

SEQ ID NO: 485850 - DNA, 25 bp, Rattus norvegicus
gtatctgttgtgcttgattgatctc

SEQ ID NO: 485851 - DNA, 25 bp, Rattus norvegicus
gtatctgttgtggttgattgatctc

SEQ ID NO: 485852 - DNA, 25 bp, Rattus norvegicus
gtatctgtttgtccctttcttagac

SEQ ID NO: 485853 - DNA, 25 bp, Rattus norvegicus
gtatctgtttgtgcctttcttagac

SEQ ID NO: 485854 - DNA, 25 bp, Rattus norvegicus
gtatcttaaaagacatcaggctgca

SEQ ID NO: 485855 - DNA, 25 bp, Rattus norvegicus
gtatcttaaaagtcatcaggctgca

SEQ ID NO: 485856 - DNA, 25 bp, Rattus norvegicus
gtatcttaatccagtccatactgcc

SEQ ID NO: 485857 - DNA, 25 bp, Rattus norvegicus
gtatcttaatcctgtccatactgcc

SEQ ID NO: 485858 - DNA, 25 bp, Rattus norvegicus
gtatcttaatctcacctggtttcat

SEQ ID NO: 485859 - DNA, 25 bp, Rattus norvegicus
gtatcttaatctgacctggtttcat

SEQ ID NO: 485860 - DNA, 25 bp, Rattus norvegicus
gtatcttaatgtatttatcccgaca

SEQ ID NO: 485861 - DNA, 25 bp, Rattus norvegicus
gtatcttaatgtttttatcccgaca

SEQ ID NO: 485862 - DNA, 25 bp, Rattus norvegicus
gtatcttaccctcatggacaacttt

SEQ ID NO: 485863 - DNA, 25 bp, Rattus norvegicus
gtatcttaccctgatggacaacttt

SEQ ID NO: 485864 - DNA, 25 bp, Rattus norvegicus
gtatcttaccgacagacaccaccag

SEQ ID NO: 485865 - DNA, 25 bp, Rattus norvegicus
gtatcttaccgagagacaccaccag

SEQ ID NO: 485866 - DNA, 25 bp, Rattus norvegicus
gtatcttactgacaatcatgcacaa

SEQ ID NO: 485867 - DNA, 25 bp, Rattus norvegicus
gtatcttactgagaatcatgcacaa

SEQ ID NO: 485868 - DNA, 25 bp, Rattus norvegicus
gtatcttagagtatacactttgtgt

SEQ ID NO: 485869 - DNA, 25 bp, Rattus norvegicus
gtatcttagagtttacactttgtgt

SEQ ID NO: 485870 - DNA, 25 bp, Rattus norvegicus
gtatcttagctgattgtcgacacta

SEQ ID NO: 485871 - DNA, 25 bp, Rattus norvegicus
gtatcttagctgtttgtcgacacta

SEQ ID NO: 485872 - DNA, 25 bp, Rattus norvegicus
gtatcttaggtcactctctttgagg

SEQ ID NO: 485873 - DNA, 25 bp, Rattus norvegicus
gtatcttaggtctctctctttgagg

SEQ ID NO: 485874 - DNA, 25 bp, Rattus norvegicus
gtatcttagtgtaaccaagcttcca

SEQ ID NO: 485875 - DNA, 25 bp, Rattus norvegicus
gtatcttagtgtcatctaccaccct

SEQ ID NO: 485876 - DNA, 25 bp, Rattus norvegicus
gtatcttagtgtgatctaccaccct

SEQ ID NO: 485877 - DNA, 25 bp, Rattus norvegicus
gtatcttagtgttaccaagcttcca

SEQ ID NO: 485878 - DNA, 25 bp, Rattus norvegicus
gtatcttatcttacccattctttga

SEQ ID NO: 485879 - DNA, 25 bp, Rattus norvegicus
gtatcttatctttcccattctttga

SEQ ID NO: 485880 - DNA, 25 bp, Rattus norvegicus
gtatcttatgcaaagtgattccatg

SEQ ID NO: 485881 - DNA, 25 bp, Rattus norvegicus
gtatcttatgcatagtgattccatg

SEQ ID NO: 485882 - DNA, 25 bp, Rattus norvegicus
gtatcttcacctcggattccagcta

SEQ ID NO: 485883 - DNA, 25 bp, Rattus norvegicus
gtatcttcacctgggattccagcta

SEQ ID NO: 485884 - DNA, 25 bp, Rattus norvegicus
gtatcttcagaaatgggcccttgcg

SEQ ID NO: 485885 - DNA, 25 bp, Rattus norvegicus
gtatcttcagaattgggcccttgcg

SEQ ID NO: 485886 - DNA, 25 bp, Rattus norvegicus
gtatcttcagctcggaattctcttt

SEQ ID NO: 485887 - DNA, 25 bp, Rattus norvegicus
gtatcttcagctgggaattctcttt

SEQ ID NO: 485888 - DNA, 25 bp, Rattus norvegicus
gtatcttcataacaagctggctcac

SEQ ID NO: 485889 - DNA, 25 bp, Rattus norvegicus
gtatcttcataagaagctggctcac

SEQ ID NO: 485890 - DNA, 25 bp, Rattus norvegicus
gtatcttcatgacggttctctgctc

SEQ ID NO: 485891 - DNA, 25 bp, Rattus norvegicus
gtatcttcatgagggttctctgctc

SEQ ID NO: 485892 - DNA, 25 bp, Rattus norvegicus
gtatcttcatggagtcgaggtcaac

SEQ ID NO: 485893 - DNA, 25 bp, Rattus norvegicus
gtatcttcatggtgtcgaggtcaac

SEQ ID NO: 485894 - DNA, 25 bp, Rattus norvegicus
gtatcttccaccagtgcctgaatgg

SEQ ID NO: 485895 - DNA, 25 bp, Rattus norvegicus
gtatcttccacctgtgcctgaatgg

SEQ ID NO: 485896 - DNA, 25 bp, Rattus norvegicus
gtatcttcccttaccactttagata

SEQ ID NO: 485897 - DNA, 25 bp, Rattus norvegicus
gtatcttccctttccactttagata

SEQ ID NO: 485898 - DNA, 25 bp, Rattus norvegicus
gtatcttccgccagctgcctgagag

SEQ ID NO: 485899 - DNA, 25 bp, Rattus norvegicus
gtatcttccgcctgctgcctgagag

SEQ ID NO: 485900 - DNA, 25 bp, Rattus norvegicus
gtatcttcctaccacaaaatccata

SEQ ID NO: 485901 - DNA, 25 bp, Rattus norvegicus
gtatcttcctacgacaaaatccata

SEQ ID NO: 485902 - DNA, 25 bp, Rattus norvegicus
gtatcttcgattcaactgtccaaca

SEQ ID NO: 485903 - DNA, 25 bp, Rattus norvegicus
gtatcttcgattgaactgtccaaca

SEQ ID NO: 485904 - DNA, 25 bp, Rattus norvegicus
gtatcttcgcagagatgtttcgccg

SEQ ID NO: 485905 - DNA, 25 bp, Rattus norvegicus
gtatcttcgcagtgatgtttcgccg

SEQ ID NO: 485906 - DNA, 25 bp, Rattus norvegicus
gtatcttctaagaccactgggacaa

SEQ ID NO: 485907 - DNA, 25 bp, Rattus norvegicus
gtatcttctaagtccactgggacaa

SEQ ID NO: 485908 - DNA, 25 bp, Rattus norvegicus
gtatcttctatcactgccttaaatc

SEQ ID NO: 485909 - DNA, 25 bp, Rattus norvegicus
gtatcttctatctctgccttaaatc

SEQ ID NO: 485910 - DNA, 25 bp, Rattus norvegicus
gtatcttctatgcaattccttttct

SEQ ID NO: 485911 - DNA, 25 bp, Rattus norvegicus
gtatcttctatggaattccttttct

SEQ ID NO: 485912 - DNA, 25 bp, Rattus norvegicus
gtatcttctgcaagggaatcttcca

SEQ ID NO: 485913 - DNA, 25 bp, Rattus norvegicus
gtatcttctgcatgggaatcttcca

SEQ ID NO: 485914 - DNA, 25 bp, Rattus norvegicus
gtatcttgagaacatgaccttgaaa

SEQ ID NO: 485915 - DNA, 25 bp, Rattus norvegicus
gtatcttgagaagatgaccttgaaa

SEQ ID NO: 485916 - DNA, 25 bp, Rattus norvegicus
gtatcttgatatcgatcccagttgg

SEQ ID NO: 485917 - DNA, 25 bp, Rattus norvegicus
gtatcttgatatggatcccagttgg

SEQ ID NO: 485918 - DNA, 25 bp, Rattus norvegicus
gtatcttgctcacgaattagtcggt

SEQ ID NO: 485919 - DNA, 25 bp, Rattus norvegicus
gtatcttgctcaggaattagtcggt

SEQ ID NO: 485920 - DNA, 25 bp, Rattus norvegicus
gtatcttggaacagcgctttcccga

SEQ ID NO: 485921 - DNA, 25 bp, Rattus norvegicus
gtatcttggaactgcgctttcccga

SEQ ID NO: 485922 - DNA, 25 bp, Rattus norvegicus
gtatcttggaatatgttgcctgctt

SEQ ID NO: 485923 - DNA, 25 bp, Rattus norvegicus
gtatcttggaatttgttgcctgctt

SEQ ID NO: 485924 - DNA, 25 bp, Rattus norvegicus
gtatcttggagcctagcacactggc

SEQ ID NO: 485925 - DNA, 25 bp, Rattus norvegicus
gtatcttggagcgtagcacactggc

SEQ ID NO: 485926 - DNA, 25 bp, Rattus norvegicus
gtatcttggcgcagactaccagaaa

SEQ ID NO: 485927 - DNA, 25 bp, Rattus norvegicus
gtatcttggcgctgactaccagaaa

SEQ ID NO: 485928 - DNA, 25 bp, Rattus norvegicus
gtatcttgtacgctgatggaggacc

SEQ ID NO: 485929 - DNA, 25 bp, Rattus norvegicus
gtatcttgtacggtgatggaggacc

SEQ ID NO: 485930 - DNA, 25 bp, Rattus norvegicus
gtatcttgtactattgtttgtgatt

SEQ ID NO: 485931 - DNA, 25 bp, Rattus norvegicus
gtatcttgtacttttgtttgtgatt

SEQ ID NO: 485932 - DNA, 25 bp, Rattus norvegicus
gtatcttgtattctgtatgtttcta

SEQ ID NO: 485933 - DNA, 25 bp, Rattus norvegicus
gtatcttgtattgtgtatgtttcta

SEQ ID NO: 485934 - DNA, 25 bp, Rattus norvegicus
gtatcttgtcccatgacttcagatg

SEQ ID NO: 485935 - DNA, 25 bp, Rattus norvegicus
gtatcttgtcccttgacttcagatg

SEQ ID NO: 485936 - DNA, 25 bp, Rattus norvegicus
gtatcttgtgtcatcaacattggaa

SEQ ID NO: 485937 - DNA, 25 bp, Rattus norvegicus
gtatcttgtgtcttcaacattggaa

SEQ ID NO: 485938 - DNA, 25 bp, Rattus norvegicus
gtatcttgtgtgatttcgttatcat

SEQ ID NO: 485939 - DNA, 25 bp, Rattus norvegicus
gtatcttgtgtgttttcgttatcat

SEQ ID NO: 485940 - DNA, 25 bp, Rattus norvegicus
gtatcttgttatcttaagccccttt

SEQ ID NO: 485941 - DNA, 25 bp, Rattus norvegicus
gtatcttgttatgttaagccccttt

SEQ ID NO: 485942 - DNA, 25 bp, Rattus norvegicus
gtatcttgttctaagttttatgacc

SEQ ID NO: 485943 - DNA, 25 bp, Rattus norvegicus
gtatcttgttcttagttttatgacc

SEQ ID NO: 485944 - DNA, 25 bp, Rattus norvegicus
gtatctttagacagcatcgtgttag

SEQ ID NO: 485945 - DNA, 25 bp, Rattus norvegicus
gtatctttagactgcatcgtgttag

SEQ ID NO: 485946 - DNA, 25 bp, Rattus norvegicus
gtatctttatttccccagtgttcta

SEQ ID NO: 485947 - DNA, 25 bp, Rattus norvegicus
gtatctttatttgcccagtgttcta

SEQ ID NO: 485948 - DNA, 25 bp, Rattus norvegicus
gtatctttcaggaaggagcacacaa

SEQ ID NO: 485949 - DNA, 25 bp, Rattus norvegicus
gtatctttcaggtaggagcacacaa

SEQ ID NO: 485950 - DNA, 25 bp, Rattus norvegicus
gtatctttcctccatgttcactaga

SEQ ID NO: 485951 - DNA, 25 bp, Rattus norvegicus
gtatctttcctcgatgttcactaga

SEQ ID NO: 485952 - DNA, 25 bp, Rattus norvegicus
gtatctttcggacggatctgctgcg

SEQ ID NO: 485953 - DNA, 25 bp, Rattus norvegicus
gtatctttcggagggatctgctgcg

SEQ ID NO: 485954 - DNA, 25 bp, Rattus norvegicus
gtatctttctccacagcgtattgtc

SEQ ID NO: 485955 - DNA, 25 bp, Rattus norvegicus
gtatctttctcctcagcgtattgtc

SEQ ID NO: 485956 - DNA, 25 bp, Rattus norvegicus
gtatctttctgaccaacatgctgag

SEQ ID NO: 485957 - DNA, 25 bp, Rattus norvegicus
gtatctttctgagcaacatgctgag

SEQ ID NO: 485958 - DNA, 25 bp, Rattus norvegicus
gtatctttgaacctttaggaccagt

SEQ ID NO: 485959 - DNA, 25 bp, Rattus norvegicus
gtatctttgaacgtttaggaccagt

SEQ ID NO: 485960 - DNA, 25 bp, Rattus norvegicus
gtatctttgaggctactcctggcag

SEQ ID NO: 485961 - DNA, 25 bp, Rattus norvegicus
gtatctttgagggtactcctggcag

SEQ ID NO: 485962 - DNA, 25 bp, Rattus norvegicus
gtatctttgatcatctctcactgaa

SEQ ID NO: 485963 - DNA, 25 bp, Rattus norvegicus
gtatctttgatcttctctcactgaa

SEQ ID NO: 485964 - DNA, 25 bp, Rattus norvegicus
gtatctttgatgagatgtctgtgtc

SEQ ID NO: 485965 - DNA, 25 bp, Rattus norvegicus
gtatctttgatgtgatgtctgtgtc

SEQ ID NO: 485966 - DNA, 25 bp, Rattus norvegicus
gtatcttttcacagtacatatggca

SEQ ID NO: 485967 - DNA, 25 bp, Rattus norvegicus
gtatcttttcactgtacatatggca

SEQ ID NO: 485968 - DNA, 25 bp, Rattus norvegicus
gtatcttttcagagtgtgtaccaaa

SEQ ID NO: 485969 - DNA, 25 bp, Rattus norvegicus
gtatcttttcagtgtgtgtaccaaa

SEQ ID NO: 485970 - DNA, 25 bp, Rattus norvegicus
gtatcttttcgtatcacgcgagtat

SEQ ID NO: 485971 - DNA, 25 bp, Rattus norvegicus
gtatcttttcgtttcacgcgagtat

SEQ ID NO: 485972 - DNA, 25 bp, Rattus norvegicus
gtatcttttctgaacccgtttgatc

SEQ ID NO: 485973 - DNA, 25 bp, Rattus norvegicus
gtatcttttctgtacccgtttgatc

SEQ ID NO: 485974 - DNA, 25 bp, Rattus norvegicus
gtatcttttgcaagtagcttcctta

SEQ ID NO: 485975 - DNA, 25 bp, Rattus norvegicus
gtatcttttgcatgtagcttcctta

SEQ ID NO: 485976 - DNA, 25 bp, Rattus norvegicus
gtatctttttacctgatgaaatctc

SEQ ID NO: 485977 - DNA, 25 bp, Rattus norvegicus
gtatctttttacgtgatgaaatctc

SEQ ID NO: 485978 - DNA, 25 bp, Rattus norvegicus
gtatctttttagcaacgggatgcac

SEQ ID NO: 485979 - DNA, 25 bp, Rattus norvegicus
gtatctttttaggaacgggatgcac

SEQ ID NO: 485980 - DNA, 25 bp, Rattus norvegicus
gtatctttttcaacctgttcgttgt

SEQ ID NO: 485981 - DNA, 25 bp, Rattus norvegicus
gtatctttttcactccttttgatta

SEQ ID NO: 485982 - DNA, 25 bp, Rattus norvegicus
gtatctttttcagtccttttgatta

SEQ ID NO: 485983 - DNA, 25 bp, Rattus norvegicus
gtatctttttcatcctgttcgttgt

SEQ ID NO: 485984 - DNA, 25 bp, Rattus norvegicus
gtatctttttgacgcatttgtttgg

SEQ ID NO: 485985 - DNA, 25 bp, Rattus norvegicus
gtatctttttgaggcatttgtttgg

SEQ ID NO: 485986 - DNA, 25 bp, Rattus norvegicus
gtatcttttttaatcagttctccta

SEQ ID NO: 485987 - DNA, 25 bp, Rattus norvegicus
gtatcttttttattcagttctccta

SEQ ID NO: 485988 - DNA, 25 bp, Rattus norvegicus
gtatgaaaagctcttcccaccaaag

SEQ ID NO: 485989 - DNA, 25 bp, Rattus norvegicus
gtatgaaaagctgttcccaccaaag

SEQ ID NO: 485990 - DNA, 25 bp, Rattus norvegicus
gtatgaaaatgcatccgttatgtga

SEQ ID NO: 485991 - DNA, 25 bp, Rattus norvegicus
gtatgaaaatgcttccgttatgtga

SEQ ID NO: 485992 - DNA, 25 bp, Rattus norvegicus
gtatgaaatccacggagcccagaaa

SEQ ID NO: 485993 - DNA, 25 bp, Rattus norvegicus
gtatgaaatccagggagcccagaaa

SEQ ID NO: 485994 - DNA, 25 bp, Rattus norvegicus
gtatgaaatctccattcctacctag

SEQ ID NO: 485995 - DNA, 25 bp, Rattus norvegicus
gtatgaaatctcgattcctacctag

SEQ ID NO: 485996 - DNA, 25 bp, Rattus norvegicus
gtatgaaatgtaactcccgcagtag

SEQ ID NO: 485997 - DNA, 25 bp, Rattus norvegicus
gtatgaaatgtatctcccgcagtag

SEQ ID NO: 485998 - DNA, 25 bp, Rattus norvegicus
gtatgaacacatccaggcagcgctg

SEQ ID NO: 485999 - DNA, 25 bp, Rattus norvegicus
gtatgaacacatgcaggcagcgctg

SEQ ID NO: 486000 - DNA, 25 bp, Rattus norvegicus
gtatgaaccaaaatgcaacactcag

SEQ ID NO: 486001 - DNA, 25 bp, Rattus norvegicus
gtatgaaccaaattgcaacactcag

SEQ ID NO: 486002 - DNA, 25 bp, Rattus norvegicus
gtatgaaccactaccatctctggaa

SEQ ID NO: 486003 - DNA, 25 bp, Rattus norvegicus
gtatgaaccacttccatctctggaa

SEQ ID NO: 486004 - DNA, 25 bp, Rattus norvegicus
gtatgaaccagacccggcagacctt

SEQ ID NO: 486005 - DNA, 25 bp, Rattus norvegicus
gtatgaaccagagccggcagacctt

SEQ ID NO: 486006 - DNA, 25 bp, Rattus norvegicus
gtatgaaccaggctgcagacttact

SEQ ID NO: 486007 - DNA, 25 bp, Rattus norvegicus
gtatgaaccagggtgcagacttact

SEQ ID NO: 486008 - DNA, 25 bp, Rattus norvegicus
gtatgaaccagtcgacaagccaaca

SEQ ID NO: 486009 - DNA, 25 bp, Rattus norvegicus
gtatgaaccagtggacaagccaaca

SEQ ID NO: 486010 - DNA, 25 bp, Rattus norvegicus
gtatgaaccgagatctctgaatgag

SEQ ID NO: 486011 - DNA, 25 bp, Rattus norvegicus
gtatgaaccgagttctctgaatgag

SEQ ID NO: 486012 - DNA, 25 bp, Rattus norvegicus
gtatgaacggtcaccatgcaggaac

SEQ ID NO: 486013 - DNA, 25 bp, Rattus norvegicus
gtatgaacggtctccatgcaggaac

SEQ ID NO: 486014 - DNA, 25 bp, Rattus norvegicus
gtatgaactactataaggcaacgaa

SEQ ID NO: 486015 - DNA, 25 bp, Rattus norvegicus
gtatgaactactttaaggcaacgaa

SEQ ID NO: 486016 - DNA, 25 bp, Rattus norvegicus
gtatgaagaagacattttcacaatt

SEQ ID NO: 486017 - DNA, 25 bp, Rattus norvegicus
gtatgaagaagagattttcacaatt

SEQ ID NO: 486018 - DNA, 25 bp, Rattus norvegicus
gtatgaagaagtaacagccactgta

SEQ ID NO: 486019 - DNA, 25 bp, Rattus norvegicus
gtatgaagaagttacagccactgta

SEQ ID NO: 486020 - DNA, 25 bp, Rattus norvegicus
gtatgaagaggtcatggcagttctt

SEQ ID NO: 486021 - DNA, 25 bp, Rattus norvegicus
gtatgaagaggtgatggcagttctt

SEQ ID NO: 486022 - DNA, 25 bp, Rattus norvegicus
gtatgaagccctcataacccagaag

SEQ ID NO: 486023 - DNA, 25 bp, Rattus norvegicus
gtatgaagccctgataacccagaag

SEQ ID NO: 486024 - DNA, 25 bp, Rattus norvegicus
gtatgaagccttctacccagcatca

SEQ ID NO: 486025 - DNA, 25 bp, Rattus norvegicus
gtatgaagccttgtacccagcatca

SEQ ID NO: 486026 - DNA, 25 bp, Rattus norvegicus
gtatgaaggctaactccagcacgat

SEQ ID NO: 486027 - DNA, 25 bp, Rattus norvegicus
gtatgaaggctatctccagcacgat

SEQ ID NO: 486028 - DNA, 25 bp, Rattus norvegicus
gtatgaaggctgctttcctgccgtt

SEQ ID NO: 486029 - DNA, 25 bp, Rattus norvegicus
gtatgaaggctggtttcctgccgtt

SEQ ID NO: 486030 - DNA, 25 bp, Rattus norvegicus
gtatgaagggccagccatcagctgt

SEQ ID NO: 486031 - DNA, 25 bp, Rattus norvegicus
gtatgaagggcctgccatcagctgt

SEQ ID NO: 486032 - DNA, 25 bp, Rattus norvegicus
gtatgaagtcttatcttcctcagtg

SEQ ID NO: 486033 - DNA, 25 bp, Rattus norvegicus
gtatgaagtcttttcttcctcagtg

SEQ ID NO: 486034 - DNA, 25 bp, Rattus norvegicus
gtatgaagtgaccaaccgccttaga

SEQ ID NO: 486035 - DNA, 25 bp, Rattus norvegicus
gtatgaagtgacgaaccgccttaga

SEQ ID NO: 486036 - DNA, 25 bp, Rattus norvegicus
gtatgaagtgtcagcggtccacaat

SEQ ID NO: 486037 - DNA, 25 bp, Rattus norvegicus
gtatgaagtgtctgcggtccacaat

SEQ ID NO: 486038 - DNA, 25 bp, Rattus norvegicus
gtatgaagttgtcttgctgtgctaa

SEQ ID NO: 486039 - DNA, 25 bp, Rattus norvegicus
gtatgaagttgtgttgctgtgctaa

SEQ ID NO: 486040 - DNA, 25 bp, Rattus norvegicus
gtatgaagttttctttgctttccca

SEQ ID NO: 486041 - DNA, 25 bp, Rattus norvegicus
gtatgaagttttgtttgctttccca

SEQ ID NO: 486042 - DNA, 25 bp, Rattus norvegicus
gtatgaatacatactccttatttat

SEQ ID NO: 486043 - DNA, 25 bp, Rattus norvegicus
gtatgaatacattctccttatttat

SEQ ID NO: 486044 - DNA, 25 bp, Rattus norvegicus
gtatgaatacccatatttgctgcaa

SEQ ID NO: 486045 - DNA, 25 bp, Rattus norvegicus
gtatgaatacccttatttgctgcaa

SEQ ID NO: 486046 - DNA, 25 bp, Rattus norvegicus
gtatgaatattaaggcaagcctcta

SEQ ID NO: 486047 - DNA, 25 bp, Rattus norvegicus
gtatgaatattatggcaagcctcta

SEQ ID NO: 486048 - DNA, 25 bp, Rattus norvegicus
gtatgaatcaagacctctaccacag

SEQ ID NO: 486049 - DNA, 25 bp, Rattus norvegicus
gtatgaatcaagtcctctaccacag

SEQ ID NO: 486050 - DNA, 25 bp, Rattus norvegicus
gtatgaatcctgcacggctcaccaa

SEQ ID NO: 486051 - DNA, 25 bp, Rattus norvegicus
gtatgaatcctggacggctcaccaa

SEQ ID NO: 486052 - DNA, 25 bp, Rattus norvegicus
gtatgaatctctccacagaagcctt

SEQ ID NO: 486053 - DNA, 25 bp, Rattus norvegicus
gtatgaatctctgcacagaagcctt

SEQ ID NO: 486054 - DNA, 25 bp, Rattus norvegicus
gtatgacaaggcagtggcttacatt

SEQ ID NO: 486055 - DNA, 25 bp, Rattus norvegicus
gtatgacaaggctgtggcttacatt

SEQ ID NO: 486056 - DNA, 25 bp, Rattus norvegicus
gtatgacacacaccagaacctgcga

SEQ ID NO: 486057 - DNA, 25 bp, Rattus norvegicus
gtatgacacacagcagaacctgcga

SEQ ID NO: 486058 - DNA, 25 bp, Rattus norvegicus
gtatgacacaccctggaccttgtag

SEQ ID NO: 486059 - DNA, 25 bp, Rattus norvegicus
gtatgacacaccgtggaccttgtag

SEQ ID NO: 486060 - DNA, 25 bp, Rattus norvegicus
gtatgacacagtccaacgcttgccc

SEQ ID NO: 486061 - DNA, 25 bp, Rattus norvegicus
gtatgacacagtgcaacgcttgccc

SEQ ID NO: 486062 - DNA, 25 bp, Rattus norvegicus
gtatgacactggacctgacacacgt

SEQ ID NO: 486063 - DNA, 25 bp, Rattus norvegicus
gtatgacactggtcctgacacacgt

SEQ ID NO: 486064 - DNA, 25 bp, Rattus norvegicus
gtatgacagacaacagcacccaaga

SEQ ID NO: 486065 - DNA, 25 bp, Rattus norvegicus
gtatgacagacatcagcacccaaga

SEQ ID NO: 486066 - DNA, 25 bp, Rattus norvegicus
gtatgacagcaaaacactgcactca

SEQ ID NO: 486067 - DNA, 25 bp, Rattus norvegicus
gtatgacagcaatacactgcactca

SEQ ID NO: 486068 - DNA, 25 bp, Rattus norvegicus
gtatgacagccacctggtgccaact

SEQ ID NO: 486069 - DNA, 25 bp, Rattus norvegicus
gtatgacagccagctggtgccaact

SEQ ID NO: 486070 - DNA, 25 bp, Rattus norvegicus
gtatgacagtataatcggcccgcac

SEQ ID NO: 486071 - DNA, 25 bp, Rattus norvegicus
gtatgacagtattatcggcccgcac

SEQ ID NO: 486072 - DNA, 25 bp, Rattus norvegicus
gtatgacatactacttggaggcaaa

SEQ ID NO: 486073 - DNA, 25 bp, Rattus norvegicus
gtatgacatacttcttggaggcaaa

SEQ ID NO: 486074 - DNA, 25 bp, Rattus norvegicus
gtatgacatcacaccaggtgaaact

SEQ ID NO: 486075 - DNA, 25 bp, Rattus norvegicus
gtatgacatcactccaggtgaaact

SEQ ID NO: 486076 - DNA, 25 bp, Rattus norvegicus
gtatgacatcataccacggcaaaga

SEQ ID NO: 486077 - DNA, 25 bp, Rattus norvegicus
gtatgacatcattccacggcaaaga

SEQ ID NO: 486078 - DNA, 25 bp, Rattus norvegicus
gtatgacatgataacttataacttc

SEQ ID NO: 486079 - DNA, 25 bp, Rattus norvegicus
gtatgacatgattacttataacttc

SEQ ID NO: 486080 - DNA, 25 bp, Rattus norvegicus
gtatgacatgggaatctcacattgt

SEQ ID NO: 486081 - DNA, 25 bp, Rattus norvegicus
gtatgacatgggtatctcacattgt

SEQ ID NO: 486082 - DNA, 25 bp, Rattus norvegicus
gtatgacattccacacatgcggtct

SEQ ID NO: 486083 - DNA, 25 bp, Rattus norvegicus
gtatgacattcctcacatgcggtct

SEQ ID NO: 486084 - DNA, 25 bp, Rattus norvegicus
gtatgaccactccaacttacttcac

SEQ ID NO: 486085 - DNA, 25 bp, Rattus norvegicus
gtatgaccactcgaacttacttcac

SEQ ID NO: 486086 - DNA, 25 bp, Rattus norvegicus
gtatgaccacttaaacacactcttc

SEQ ID NO: 486087 - DNA, 25 bp, Rattus norvegicus
gtatgaccactttaacacactcttc

SEQ ID NO: 486088 - DNA, 25 bp, Rattus norvegicus
gtatgaccaggtcctcatggaggat

SEQ ID NO: 486089 - DNA, 25 bp, Rattus norvegicus
gtatgaccaggtgctcatggaggat

SEQ ID NO: 486090 - DNA, 25 bp, Rattus norvegicus
gtatgaccagtacagcctggcccaa

SEQ ID NO: 486091 - DNA, 25 bp, Rattus norvegicus
gtatgaccagtagagcctggcccaa

SEQ ID NO: 486092 - DNA, 25 bp, Rattus norvegicus
gtatgaccatagaagaatttcgagt

SEQ ID NO: 486093 - DNA, 25 bp, Rattus norvegicus
gtatgaccatagtagaatttcgagt

SEQ ID NO: 486094 - DNA, 25 bp, Rattus norvegicus
gtatgaccgggcagcacatttcctg

SEQ ID NO: 486095 - DNA, 25 bp, Rattus norvegicus
gtatgaccgggctgcacatttcctg

SEQ ID NO: 486096 - DNA, 25 bp, Rattus norvegicus
gtatgacctcacattcttatctatt

SEQ ID NO: 486097 - DNA, 25 bp, Rattus norvegicus
gtatgacctcactttcttatctatt

SEQ ID NO: 486098 - DNA, 25 bp, Rattus norvegicus
gtatgacctccccataaatgttaaa

SEQ ID NO: 486099 - DNA, 25 bp, Rattus norvegicus
gtatgacctcccgataaatgttaaa

SEQ ID NO: 486100 - DNA, 25 bp, Rattus norvegicus
gtatgacctgaaaccaatctcttct

SEQ ID NO: 486101 - DNA, 25 bp, Rattus norvegicus
gtatgacctgaatccaatctcttct

SEQ ID NO: 486102 - DNA, 25 bp, Rattus norvegicus
gtatgacctggtagctttaaccaca

SEQ ID NO: 486103 - DNA, 25 bp, Rattus norvegicus
gtatgacctggttgctttaaccaca

SEQ ID NO: 486104 - DNA, 25 bp, Rattus norvegicus
gtatgacgccaccacaaggagggaa

SEQ ID NO: 486105 - DNA, 25 bp, Rattus norvegicus
gtatgacgccacgacaaggagggaa

SEQ ID NO: 486106 - DNA, 25 bp, Rattus norvegicus
gtatgacgcctaattatttcggtct

SEQ ID NO: 486107 - DNA, 25 bp, Rattus norvegicus
gtatgacgcctatttatttcggtct

SEQ ID NO: 486108 - DNA, 25 bp, Rattus norvegicus
gtatgacgggatcaagcggctctat

SEQ ID NO: 486109 - DNA, 25 bp, Rattus norvegicus
gtatgacgggatgaagcggctctat

SEQ ID NO: 486110 - DNA, 25 bp, Rattus norvegicus
gtatgactatcaagccagggtggaa

SEQ ID NO: 486111 - DNA, 25 bp, Rattus norvegicus
gtatgactatcatgccagggtggaa

SEQ ID NO: 486112 - DNA, 25 bp, Rattus norvegicus
gtatgactgcacctggaacaccacc

SEQ ID NO: 486113 - DNA, 25 bp, Rattus norvegicus
gtatgactgcacgtggaacaccacc

SEQ ID NO: 486114 - DNA, 25 bp, Rattus norvegicus
gtatgactgctgatgacacgttaca

SEQ ID NO: 486115 - DNA, 25 bp, Rattus norvegicus
gtatgactgctgttgacacgttaca

SEQ ID NO: 486116 - DNA, 25 bp, Rattus norvegicus
gtatgactggaaatctgcaactgtt

SEQ ID NO: 486117 - DNA, 25 bp, Rattus norvegicus
gtatgactggaattctgcaactgtt

SEQ ID NO: 486118 - DNA, 25 bp, Rattus norvegicus
gtatgactggtgctggatctctaaa

SEQ ID NO: 486119 - DNA, 25 bp, Rattus norvegicus
gtatgactggtggtggatctctaaa

SEQ ID NO: 486120 - DNA, 25 bp, Rattus norvegicus
gtatgactgtgcaatgttatttgat

SEQ ID NO: 486121 - DNA, 25 bp, Rattus norvegicus
gtatgactgtgctatgttatttgat

SEQ ID NO: 486122 - DNA, 25 bp, Rattus norvegicus
gtatgactgtttactcatctgcagg

SEQ ID NO: 486123 - DNA, 25 bp, Rattus norvegicus
gtatgactgttttctcatctgcagg

SEQ ID NO: 486124 - DNA, 25 bp, Rattus norvegicus
gtatgacttaatacccatctgttgg

SEQ ID NO: 486125 - DNA, 25 bp, Rattus norvegicus
gtatgacttaattcccatctgttgg

SEQ ID NO: 486126 - DNA, 25 bp, Rattus norvegicus
gtatgacttcggataaaatgctatt

SEQ ID NO: 486127 - DNA, 25 bp, Rattus norvegicus
gtatgacttcggttaaaatgctatt

SEQ ID NO: 486128 - DNA, 25 bp, Rattus norvegicus
gtatgacttcttaactcaagagaca

SEQ ID NO: 486129 - DNA, 25 bp, Rattus norvegicus
gtatgacttcttccgagtagactca

SEQ ID NO: 486130 - DNA, 25 bp, Rattus norvegicus
gtatgacttcttccttatcatctca

SEQ ID NO: 486131 - DNA, 25 bp, Rattus norvegicus
gtatgacttcttgcgagtagactca

SEQ ID NO: 486132 - DNA, 25 bp, Rattus norvegicus
gtatgacttcttgcttatcatctca

SEQ ID NO: 486133 - DNA, 25 bp, Rattus norvegicus
gtatgacttctttactcaagagaca

SEQ ID NO: 486134 - DNA, 25 bp, Rattus norvegicus
gtatgactttcaacttccagtcctg

SEQ ID NO: 486135 - DNA, 25 bp, Rattus norvegicus
gtatgactttcatcttccagtcctg

SEQ ID NO: 486136 - DNA, 25 bp, Rattus norvegicus
gtatgactttgacaggttctctcgc

SEQ ID NO: 486137 - DNA, 25 bp, Rattus norvegicus
gtatgactttgagaggttctctcgc

SEQ ID NO: 486138 - DNA, 25 bp, Rattus norvegicus
gtatgactttgtccctgtgattcaa

SEQ ID NO: 486139 - DNA, 25 bp, Rattus norvegicus
gtatgactttgtgcctgtgattcaa

SEQ ID NO: 486140 - DNA, 25 bp, Rattus norvegicus
gtatgacttttacctttgcattgaa

SEQ ID NO: 486141 - DNA, 25 bp, Rattus norvegicus
gtatgacttttagctttgcattgaa

SEQ ID NO: 486142 - DNA, 25 bp, Rattus norvegicus
gtatgacttttcagctttgatttaa

SEQ ID NO: 486143 - DNA, 25 bp, Rattus norvegicus
gtatgacttttctgctttgatttaa

SEQ ID NO: 486144 - DNA, 25 bp, Rattus norvegicus
gtatgagaaacaatccaggcgctct

SEQ ID NO: 486145 - DNA, 25 bp, Rattus norvegicus
gtatgagaaacattccaggcgctct

SEQ ID NO: 486146 - DNA, 25 bp, Rattus norvegicus
gtatgagacatgatttcacctgaaa

SEQ ID NO: 486147 - DNA, 25 bp, Rattus norvegicus
gtatgagacatgttttcacctgaaa

SEQ ID NO: 486148 - DNA, 25 bp, Rattus norvegicus
gtatgagactcaatagggtctccaa

SEQ ID NO: 486149 - DNA, 25 bp, Rattus norvegicus
gtatgagactcattagggtctccaa

SEQ ID NO: 486150 - DNA, 25 bp, Rattus norvegicus
gtatgagagtctatgtcgcggcgtc

SEQ ID NO: 486151 - DNA, 25 bp, Rattus norvegicus
gtatgagagtctttgtcgcggcgtc

SEQ ID NO: 486152 - DNA, 25 bp, Rattus norvegicus
gtatgagagtgcaccatagcatttt

SEQ ID NO: 486153 - DNA, 25 bp, Rattus norvegicus
gtatgagagtgctccatagcatttt

SEQ ID NO: 486154 - DNA, 25 bp, Rattus norvegicus
gtatgagatgcacacacacttggtt

SEQ ID NO: 486155 - DNA, 25 bp, Rattus norvegicus
gtatgagatgcagacacacttggtt

SEQ ID NO: 486156 - DNA, 25 bp, Rattus norvegicus
gtatgagcaatacgcctatgacggc

SEQ ID NO: 486157 - DNA, 25 bp, Rattus norvegicus
gtatgagcaataggcctatgacggc

SEQ ID NO: 486158 - DNA, 25 bp, Rattus norvegicus
gtatgagcagcccaaatgtgataac

SEQ ID NO: 486159 - DNA, 25 bp, Rattus norvegicus
gtatgagcagccgaaatgtgataac

SEQ ID NO: 486160 - DNA, 25 bp, Rattus norvegicus
gtatgagcagtgaacccagtataag

SEQ ID NO: 486161 - DNA, 25 bp, Rattus norvegicus
gtatgagcagtgtacccagtataag

SEQ ID NO: 486162 - DNA, 25 bp, Rattus norvegicus
gtatgagcattgagcagccttttcc

SEQ ID NO: 486163 - DNA, 25 bp, Rattus norvegicus
gtatgagcattgtgcagccttttcc

SEQ ID NO: 486164 - DNA, 25 bp, Rattus norvegicus
gtatgagccaccacacatggctgta

SEQ ID NO: 486165 - DNA, 25 bp, Rattus norvegicus
gtatgagccacctcacatggctgta

SEQ ID NO: 486166 - DNA, 25 bp, Rattus norvegicus
gtatgagcccctagatggtttggtt

SEQ ID NO: 486167 - DNA, 25 bp, Rattus norvegicus
gtatgagccccttgatggtttggtt

SEQ ID NO: 486168 - DNA, 25 bp, Rattus norvegicus
gtatgagcctcaagcaattagttgc

SEQ ID NO: 486169 - DNA, 25 bp, Rattus norvegicus
gtatgagcctcatgcaattagttgc

SEQ ID NO: 486170 - DNA, 25 bp, Rattus norvegicus
gtatgagcgctgaccaaaggccgtg

SEQ ID NO: 486171 - DNA, 25 bp, Rattus norvegicus
gtatgagcgctgtccaaaggccgtg

SEQ ID NO: 486172 - DNA, 25 bp, Rattus norvegicus
gtatgagcttcaagccagtcgcgtc

SEQ ID NO: 486173 - DNA, 25 bp, Rattus norvegicus
gtatgagcttcatgccagtcgcgtc

SEQ ID NO: 486174 - DNA, 25 bp, Rattus norvegicus
gtatgagctttaagacctcgtccta

SEQ ID NO: 486175 - DNA, 25 bp, Rattus norvegicus
gtatgagctttatgacctcgtccta

SEQ ID NO: 486176 - DNA, 25 bp, Rattus norvegicus
gtatgaggaagaacacccttagatc

SEQ ID NO: 486177 - DNA, 25 bp, Rattus norvegicus
gtatgaggaagatcacccttagatc

SEQ ID NO: 486178 - DNA, 25 bp, Rattus norvegicus
gtatgaggctaactcctggtagtgt

SEQ ID NO: 486179 - DNA, 25 bp, Rattus norvegicus
gtatgaggctaagtcctggtagtgt

SEQ ID NO: 486180 - DNA, 25 bp, Rattus norvegicus
gtatgaggtacaacctgccctactt

SEQ ID NO: 486181 - DNA, 25 bp, Rattus norvegicus
gtatgaggtacatcctgccctactt

SEQ ID NO: 486182 - DNA, 25 bp, Rattus norvegicus
gtatgagtacagatgtgtccccatt

SEQ ID NO: 486183 - DNA, 25 bp, Rattus norvegicus
gtatgagtacagttgtgtccccatt

SEQ ID NO: 486184 - DNA, 25 bp, Rattus norvegicus
gtatgagtataccaaatgctgttta

SEQ ID NO: 486185 - DNA, 25 bp, Rattus norvegicus
gtatgagtatacgaaatgctgttta

SEQ ID NO: 486186 - DNA, 25 bp, Rattus norvegicus
gtatgagtcagtacaagagcccgtt

SEQ ID NO: 486187 - DNA, 25 bp, Rattus norvegicus
gtatgagtcagttcaagagcccgtt

SEQ ID NO: 486188 - DNA, 25 bp, Rattus norvegicus
gtatgagtgacgatctggtacttct

SEQ ID NO: 486189 - DNA, 25 bp, Rattus norvegicus
gtatgagtgacgttctggtacttct

SEQ ID NO: 486190 - DNA, 25 bp, Rattus norvegicus
gtatgagttacaattctgccttcag

SEQ ID NO: 486191 - DNA, 25 bp, Rattus norvegicus
gtatgagttacatttctgccttcag

SEQ ID NO: 486192 - DNA, 25 bp, Rattus norvegicus
gtatgagttagtctttcttttgtaa

SEQ ID NO: 486193 - DNA, 25 bp, Rattus norvegicus
gtatgagttagtgtttcttttgtaa

SEQ ID NO: 486194 - DNA, 25 bp, Rattus norvegicus
gtatgagtttagctcctgctctgtc

SEQ ID NO: 486195 - DNA, 25 bp, Rattus norvegicus
gtatgagtttaggtcctgctctgtc

SEQ ID NO: 486196 - DNA, 25 bp, Rattus norvegicus
gtatgagttttaagcctgtccacag

SEQ ID NO: 486197 - DNA, 25 bp, Rattus norvegicus
gtatgagttttatgcctgtccacag

SEQ ID NO: 486198 - DNA, 25 bp, Rattus norvegicus
gtatgagttttcctcatctcttcta

SEQ ID NO: 486199 - DNA, 25 bp, Rattus norvegicus
gtatgagttttcgtcatctcttcta

SEQ ID NO: 486200 - DNA, 25 bp, Rattus norvegicus
gtatgataacagcaccaaacccttt

SEQ ID NO: 486201 - DNA, 25 bp, Rattus norvegicus
gtatgataacaggaccaaacccttt

SEQ ID NO: 486202 - DNA, 25 bp, Rattus norvegicus
gtatgataacatatttcctctggac

SEQ ID NO: 486203 - DNA, 25 bp, Rattus norvegicus
gtatgataacatttttcctctggac

SEQ ID NO: 486204 - DNA, 25 bp, Rattus norvegicus
gtatgatacagtagcggcccatgtg

SEQ ID NO: 486205 - DNA, 25 bp, Rattus norvegicus
gtatgatacagttgcggcccatgtg

SEQ ID NO: 486206 - DNA, 25 bp, Rattus norvegicus
gtatgataccaaattcaacttccca

SEQ ID NO: 486207 - DNA, 25 bp, Rattus norvegicus
gtatgataccaatttcaacttccca

SEQ ID NO: 486208 - DNA, 25 bp, Rattus norvegicus
gtatgatagtgaccctgtttccgct

SEQ ID NO: 486209 - DNA, 25 bp, Rattus norvegicus
gtatgatagtgagcctgtttccgct

SEQ ID NO: 486210 - DNA, 25 bp, Rattus norvegicus
gtatgatcactacacggcacacctg

SEQ ID NO: 486211 - DNA, 25 bp, Rattus norvegicus
gtatgatcactagacggcacacctg

SEQ ID NO: 486212 - DNA, 25 bp, Rattus norvegicus
gtatgatcagaaccggaaccttcta

SEQ ID NO: 486213 - DNA, 25 bp, Rattus norvegicus
gtatgatcagaagcggaaccttcta

SEQ ID NO: 486214 - DNA, 25 bp, Rattus norvegicus
gtatgatccccaatggaaaggcaag

SEQ ID NO: 486215 - DNA, 25 bp, Rattus norvegicus
gtatgatccccattggaaaggcaag

SEQ ID NO: 486216 - DNA, 25 bp, Rattus norvegicus
gtatgatcctcacgtagcagtcctt

SEQ ID NO: 486217 - DNA, 25 bp, Rattus norvegicus
gtatgatcctcaggtagcagtcctt

SEQ ID NO: 486218 - DNA, 25 bp, Rattus norvegicus
gtatgatcctttatagatgatgtag

SEQ ID NO: 486219 - DNA, 25 bp, Rattus norvegicus
gtatgatcctttttagatgatgtag

SEQ ID NO: 486220 - DNA, 25 bp, Rattus norvegicus
gtatgatcggcactgatctccccag

SEQ ID NO: 486221 - DNA, 25 bp, Rattus norvegicus
gtatgatcggcagtgatctccccag

SEQ ID NO: 486222 - DNA, 25 bp, Rattus norvegicus
gtatgatctgggaaagcctccttta

SEQ ID NO: 486223 - DNA, 25 bp, Rattus norvegicus
gtatgatctgggtaagcctccttta

SEQ ID NO: 486224 - DNA, 25 bp, Rattus norvegicus
gtatgatgaatacgcccagctagtg

SEQ ID NO: 486225 - DNA, 25 bp, Rattus norvegicus
gtatgatgaataggcccagctagtg

SEQ ID NO: 486226 - DNA, 25 bp, Rattus norvegicus
gtatgatgagttatcttgcttcttc

SEQ ID NO: 486227 - DNA, 25 bp, Rattus norvegicus
gtatgatgagttttcttgcttcttc

SEQ ID NO: 486228 - DNA, 25 bp, Rattus norvegicus
gtatgatgcatgaccctgatgggcc

SEQ ID NO: 486229 - DNA, 25 bp, Rattus norvegicus
gtatgatgcatgtccctgatgggcc

SEQ ID NO: 486230 - DNA, 25 bp, Rattus norvegicus
gtatgatgccatcccatgttgaaca

SEQ ID NO: 486231 - DNA, 25 bp, Rattus norvegicus
gtatgatgccatgccatgttgaaca

SEQ ID NO: 486232 - DNA, 25 bp, Rattus norvegicus
gtatgatgcctaaaaactgtcccgc

SEQ ID NO: 486233 - DNA, 25 bp, Rattus norvegicus
gtatgatgcctataaactgtcccgc

SEQ ID NO: 486234 - DNA, 25 bp, Rattus norvegicus
gtatgatgccttattggcctccgag

SEQ ID NO: 486235 - DNA, 25 bp, Rattus norvegicus
gtatgatgcctttttggcctccgag

SEQ ID NO: 486236 - DNA, 25 bp, Rattus norvegicus
gtatgatgctggcttctaccacacg

SEQ ID NO: 486237 - DNA, 25 bp, Rattus norvegicus
gtatgatgctgggttctaccacacg

SEQ ID NO: 486238 - DNA, 25 bp, Rattus norvegicus
gtatgatggattctgagtctcactt

SEQ ID NO: 486239 - DNA, 25 bp, Rattus norvegicus
gtatgatggattgtgagtctcactt

SEQ ID NO: 486240 - DNA, 25 bp, Rattus norvegicus
gtatgatggctaactggcttttcag

SEQ ID NO: 486241 - DNA, 25 bp, Rattus norvegicus
gtatgatggctatctggcttttcag

SEQ ID NO: 486242 - DNA, 25 bp, Rattus norvegicus
gtatgatgggcaagttagccagcca

SEQ ID NO: 486243 - DNA, 25 bp, Rattus norvegicus
gtatgatgggcatgttagccagcca

SEQ ID NO: 486244 - DNA, 25 bp, Rattus norvegicus
gtatgatggtctcgactggctgtcc

SEQ ID NO: 486245 - DNA, 25 bp, Rattus norvegicus
gtatgatggtctggactggctgtcc

SEQ ID NO: 486246 - DNA, 25 bp, Rattus norvegicus
gtatgatgtctgagcatcaccccgg

SEQ ID NO: 486247 - DNA, 25 bp, Rattus norvegicus
gtatgatgtctgtgcatcaccccgg

SEQ ID NO: 486248 - DNA, 25 bp, Rattus norvegicus
gtatgattcttgacctagagagctt

SEQ ID NO: 486249 - DNA, 25 bp, Rattus norvegicus
gtatgattcttgtcctagagagctt

SEQ ID NO: 486250 - DNA, 25 bp, Rattus norvegicus
gtatgattgaacaccagaggccaac

SEQ ID NO: 486251 - DNA, 25 bp, Rattus norvegicus
gtatgattgaactccagaggccaac

SEQ ID NO: 486252 - DNA, 25 bp, Rattus norvegicus
gtatgatttctcagcactcagtttc

SEQ ID NO: 486253 - DNA, 25 bp, Rattus norvegicus
gtatgatttctctgcactcagtttc

SEQ ID NO: 486254 - DNA, 25 bp, Rattus norvegicus
gtatgatttgctacctataaaattt

SEQ ID NO: 486255 - DNA, 25 bp, Rattus norvegicus
gtatgatttgcttcctataaaattt

SEQ ID NO: 486256 - DNA, 25 bp, Rattus norvegicus
gtatgatttgtaagcccttccacga

SEQ ID NO: 486257 - DNA, 25 bp, Rattus norvegicus
gtatgatttgtatgcccttccacga

SEQ ID NO: 486258 - DNA, 25 bp, Rattus norvegicus
gtatgcaaagtgagcttctgtcctg

SEQ ID NO: 486259 - DNA, 25 bp, Rattus norvegicus
gtatgcaaagtgtgcttctgtcctg

SEQ ID NO: 486260 - DNA, 25 bp, Rattus norvegicus
gtatgcaaatgcaacctgggagaag

SEQ ID NO: 486261 - DNA, 25 bp, Rattus norvegicus
gtatgcaaatgctacctgggagaag

SEQ ID NO: 486262 - DNA, 25 bp, Rattus norvegicus
gtatgcaacgacaagtcttccggct

SEQ ID NO: 486263 - DNA, 25 bp, Rattus norvegicus
gtatgcaacgactagtcttccggct

SEQ ID NO: 486264 - DNA, 25 bp, Rattus norvegicus
gtatgcaagcttccactagacctag

SEQ ID NO: 486265 - DNA, 25 bp, Rattus norvegicus
gtatgcaagcttgcactagacctag

SEQ ID NO: 486266 - DNA, 25 bp, Rattus norvegicus
gtatgcaatctgcattccttcctgt

SEQ ID NO: 486267 - DNA, 25 bp, Rattus norvegicus
gtatgcaatctggattccttcctgt

SEQ ID NO: 486268 - DNA, 25 bp, Rattus norvegicus
gtatgcaatggacgcgtggctctcc

SEQ ID NO: 486269 - DNA, 25 bp, Rattus norvegicus
gtatgcaatggaggcgtggctctcc

SEQ ID NO: 486270 - DNA, 25 bp, Rattus norvegicus
gtatgcacaaccaataggagaccca

SEQ ID NO: 486271 - DNA, 25 bp, Rattus norvegicus
gtatgcacaacctataggagaccca

SEQ ID NO: 486272 - DNA, 25 bp, Rattus norvegicus
gtatgcacactgagtctgttatgca

SEQ ID NO: 486273 - DNA, 25 bp, Rattus norvegicus
gtatgcacactgattttacttttta

SEQ ID NO: 486274 - DNA, 25 bp, Rattus norvegicus
gtatgcacactgtgtctgttatgca

SEQ ID NO: 486275 - DNA, 25 bp, Rattus norvegicus
gtatgcacactgtttttacttttta

SEQ ID NO: 486276 - DNA, 25 bp, Rattus norvegicus
gtatgcacaggacgctgacctctgt

SEQ ID NO: 486277 - DNA, 25 bp, Rattus norvegicus
gtatgcacaggaggctgacctctgt

SEQ ID NO: 486278 - DNA, 25 bp, Rattus norvegicus
gtatgcacataaatcatcacttgga

SEQ ID NO: 486279 - DNA, 25 bp, Rattus norvegicus
gtatgcacataattcatcacttgga

SEQ ID NO: 486280 - DNA, 25 bp, Rattus norvegicus
gtatgcaccaaaaaatgctactcta

SEQ ID NO: 486281 - DNA, 25 bp, Rattus norvegicus
gtatgcaccaaataatgctactcta

SEQ ID NO: 486282 - DNA, 25 bp, Rattus norvegicus
gtatgcaccagaaattgaaagctag

SEQ ID NO: 486283 - DNA, 25 bp, Rattus norvegicus
gtatgcaccagatattgaaagctag

SEQ ID NO: 486284 - DNA, 25 bp, Rattus norvegicus
gtatgcacgcatctatgtctatctg

SEQ ID NO: 486285 - DNA, 25 bp, Rattus norvegicus
gtatgcacgcatgtatgtctatctg

SEQ ID NO: 486286 - DNA, 25 bp, Rattus norvegicus
gtatgcactccgctgtacacaaaaa

SEQ ID NO: 486287 - DNA, 25 bp, Rattus norvegicus
gtatgcactccggtgtacacaaaaa

SEQ ID NO: 486288 - DNA, 25 bp, Rattus norvegicus
gtatgcactcctattgtagcacatg

SEQ ID NO: 486289 - DNA, 25 bp, Rattus norvegicus
gtatgcactccttttgtagcacatg

SEQ ID NO: 486290 - DNA, 25 bp, Rattus norvegicus
gtatgcactgtaatgtgggctagcg

SEQ ID NO: 486291 - DNA, 25 bp, Rattus norvegicus
gtatgcactgtattgtgggctagcg

SEQ ID NO: 486292 - DNA, 25 bp, Rattus norvegicus
gtatgcactttaacaaacacagctg

SEQ ID NO: 486293 - DNA, 25 bp, Rattus norvegicus
gtatgcactttatcaaacacagctg

SEQ ID NO: 486294 - DNA, 25 bp, Rattus norvegicus
gtatgcagaacgaggtgcccatcgg

SEQ ID NO: 486295 - DNA, 25 bp, Rattus norvegicus
gtatgcagaacgtggtgcccatcgg

SEQ ID NO: 486296 - DNA, 25 bp, Rattus norvegicus
gtatgcagagcaaccggctaacaaa

SEQ ID NO: 486297 - DNA, 25 bp, Rattus norvegicus
gtatgcagagcatccggctaacaaa

SEQ ID NO: 486298 - DNA, 25 bp, Rattus norvegicus
gtatgcagagccattaggtcctttg

SEQ ID NO: 486299 - DNA, 25 bp, Rattus norvegicus
gtatgcagagcctttaggtcctttg

SEQ ID NO: 486300 - DNA, 25 bp, Rattus norvegicus
gtatgcagatcgataactccttgtt

SEQ ID NO: 486301 - DNA, 25 bp, Rattus norvegicus
gtatgcagatcgttaactccttgtt

SEQ ID NO: 486302 - DNA, 25 bp, Rattus norvegicus
gtatgcagatgactggtgttattcc

SEQ ID NO: 486303 - DNA, 25 bp, Rattus norvegicus
gtatgcagatgagtggtgttattcc

SEQ ID NO: 486304 - DNA, 25 bp, Rattus norvegicus
gtatgcagccaaaaactcacccagg

SEQ ID NO: 486305 - DNA, 25 bp, Rattus norvegicus
gtatgcagccaataactcacccagg

SEQ ID NO: 486306 - DNA, 25 bp, Rattus norvegicus
gtatgcagctagacgggacaacttc

SEQ ID NO: 486307 - DNA, 25 bp, Rattus norvegicus
gtatgcagctagtcgggacaacttc

SEQ ID NO: 486308 - DNA, 25 bp, Rattus norvegicus
gtatgcagctggcatcctgagcttt

SEQ ID NO: 486309 - DNA, 25 bp, Rattus norvegicus
gtatgcagctgggatcctgagcttt

SEQ ID NO: 486310 - DNA, 25 bp, Rattus norvegicus
gtatgcaggagaccctgtctgtatc

SEQ ID NO: 486311 - DNA, 25 bp, Rattus norvegicus
gtatgcaggagagcctgtctgtatc

SEQ ID NO: 486312 - DNA, 25 bp, Rattus norvegicus
gtatgcagtcaacttcttggccatg

SEQ ID NO: 486313 - DNA, 25 bp, Rattus norvegicus
gtatgcagtcaagttcttggccatg

SEQ ID NO: 486314 - DNA, 25 bp, Rattus norvegicus
gtatgcatacttaattcacgtaaga

SEQ ID NO: 486315 - DNA, 25 bp, Rattus norvegicus
gtatgcatactttattcacgtaaga

SEQ ID NO: 486316 - DNA, 25 bp, Rattus norvegicus
gtatgcatagatacctatgtgtgca

SEQ ID NO: 486317 - DNA, 25 bp, Rattus norvegicus
gtatgcatagattcctatgtgtgca

SEQ ID NO: 486318 - DNA, 25 bp, Rattus norvegicus
gtatgcatatatatcagctcactgt

SEQ ID NO: 486319 - DNA, 25 bp, Rattus norvegicus
gtatgcatatatttcagctcactgt

SEQ ID NO: 486320 - DNA, 25 bp, Rattus norvegicus
gtatgcatcaccatgttacactggg

SEQ ID NO: 486321 - DNA, 25 bp, Rattus norvegicus
gtatgcatcaccttgttacactggg

SEQ ID NO: 486322 - DNA, 25 bp, Rattus norvegicus
gtatgcatgactccacagacaagct

SEQ ID NO: 486323 - DNA, 25 bp, Rattus norvegicus
gtatgcatgactcggtctccaaaat

SEQ ID NO: 486324 - DNA, 25 bp, Rattus norvegicus
gtatgcatgactgcacagacaagct

SEQ ID NO: 486325 - DNA, 25 bp, Rattus norvegicus
gtatgcatgactgggtctccaaaat

SEQ ID NO: 486326 - DNA, 25 bp, Rattus norvegicus
gtatgcatggacactactcatggct

SEQ ID NO: 486327 - DNA, 25 bp, Rattus norvegicus
gtatgcatggactctactcatggct

SEQ ID NO: 486328 - DNA, 25 bp, Rattus norvegicus
gtatgcatgtataacctcctgtggt

SEQ ID NO: 486329 - DNA, 25 bp, Rattus norvegicus
gtatgcatgtattacctcctgtggt

SEQ ID NO: 486330 - DNA, 25 bp, Rattus norvegicus
gtatgcatgtgactgttcttgtcct

SEQ ID NO: 486331 - DNA, 25 bp, Rattus norvegicus
gtatgcatgtgagtgttcttgtcct

SEQ ID NO: 486332 - DNA, 25 bp, Rattus norvegicus
gtatgcattcacagaactccaggta

SEQ ID NO: 486333 - DNA, 25 bp, Rattus norvegicus
gtatgcattcactgaactccaggta

SEQ ID NO: 486334 - DNA, 25 bp, Rattus norvegicus
gtatgcattgacacattggacattt

SEQ ID NO: 486335 - DNA, 25 bp, Rattus norvegicus
gtatgcattgactcattggacattt

SEQ ID NO: 486336 - DNA, 25 bp, Rattus norvegicus
gtatgcattgctcgtttaaggacag

SEQ ID NO: 486337 - DNA, 25 bp, Rattus norvegicus
gtatgcattgctggtttaaggacag

SEQ ID NO: 486338 - DNA, 25 bp, Rattus norvegicus
gtatgccaaaataacaggtttccaa

SEQ ID NO: 486339 - DNA, 25 bp, Rattus norvegicus
gtatgccaaaattacaggtttccaa

SEQ ID NO: 486340 - DNA, 25 bp, Rattus norvegicus
gtatgccaaactctgactccagacc

SEQ ID NO: 486341 - DNA, 25 bp, Rattus norvegicus
gtatgccaaactgtgactccagacc

SEQ ID NO: 486342 - DNA, 25 bp, Rattus norvegicus
gtatgccaagccagacacatgtgac

SEQ ID NO: 486343 - DNA, 25 bp, Rattus norvegicus
gtatgccaagcctgacacatgtgac

SEQ ID NO: 486344 - DNA, 25 bp, Rattus norvegicus
gtatgccaagctcattatgttaacg

SEQ ID NO: 486345 - DNA, 25 bp, Rattus norvegicus
gtatgccaagctgattatgttaacg

SEQ ID NO: 486346 - DNA, 25 bp, Rattus norvegicus
gtatgccaatataccgtcggccata

SEQ ID NO: 486347 - DNA, 25 bp, Rattus norvegicus
gtatgccaatattccgtcggccata

SEQ ID NO: 486348 - DNA, 25 bp, Rattus norvegicus
gtatgccagatacgctcacagggac

SEQ ID NO: 486349 - DNA, 25 bp, Rattus norvegicus
gtatgccagataggctcacagggac

SEQ ID NO: 486350 - DNA, 25 bp, Rattus norvegicus
gtatgccagtccacataggtggaca

SEQ ID NO: 486351 - DNA, 25 bp, Rattus norvegicus
gtatgccagtcctcataggtggaca

SEQ ID NO: 486352 - DNA, 25 bp, Rattus norvegicus
gtatgccataatctgcatgccaaca

SEQ ID NO: 486353 - DNA, 25 bp, Rattus norvegicus
gtatgccataatgtgcatgccaaca

SEQ ID NO: 486354 - DNA, 25 bp, Rattus norvegicus
gtatgccatgtgatgctaccttaaa

SEQ ID NO: 486355 - DNA, 25 bp, Rattus norvegicus
gtatgccatgtgcactatttacaca

SEQ ID NO: 486356 - DNA, 25 bp, Rattus norvegicus
gtatgccatgtggactatttacaca

SEQ ID NO: 486357 - DNA, 25 bp, Rattus norvegicus
gtatgccatgtgttgctaccttaaa

SEQ ID NO: 486358 - DNA, 25 bp, Rattus norvegicus
gtatgccattcacatgtttcctgaa

SEQ ID NO: 486359 - DNA, 25 bp, Rattus norvegicus
gtatgccattcagatgtttcctgaa

SEQ ID NO: 486360 - DNA, 25 bp, Rattus norvegicus
gtatgccattctagcatttcctggg

SEQ ID NO: 486361 - DNA, 25 bp, Rattus norvegicus
gtatgccattcttgcatttcctggg

SEQ ID NO: 486362 - DNA, 25 bp, Rattus norvegicus
gtatgcccacgtaacatcaagctgt

SEQ ID NO: 486363 - DNA, 25 bp, Rattus norvegicus
gtatgcccacgttacatcaagctgt

SEQ ID NO: 486364 - DNA, 25 bp, Rattus norvegicus
gtatgcccagggaaagcggcgttat

SEQ ID NO: 486365 - DNA, 25 bp, Rattus norvegicus
gtatgcccagggtaagcggcgttat

SEQ ID NO: 486366 - DNA, 25 bp, Rattus norvegicus
gtatgcccggcacctggagatgatt

SEQ ID NO: 486367 - DNA, 25 bp, Rattus norvegicus
gtatgcccggcagctggagatgatt

SEQ ID NO: 486368 - DNA, 25 bp, Rattus norvegicus
gtatgcccgtacagctaaagcccaa

SEQ ID NO: 486369 - DNA, 25 bp, Rattus norvegicus
gtatgcccgtactgctaaagcccaa

SEQ ID NO: 486370 - DNA, 25 bp, Rattus norvegicus
gtatgccctcaacactatgatcaaa

SEQ ID NO: 486371 - DNA, 25 bp, Rattus norvegicus
gtatgccctcaagactatgatcaaa

SEQ ID NO: 486372 - DNA, 25 bp, Rattus norvegicus
gtatgcccttcacacttgtgacaag

SEQ ID NO: 486373 - DNA, 25 bp, Rattus norvegicus
gtatgcccttcagacttgtgacaag

SEQ ID NO: 486374 - DNA, 25 bp, Rattus norvegicus
gtatgcccttctccgagttggcagg

SEQ ID NO: 486375 - DNA, 25 bp, Rattus norvegicus
gtatgcccttctgcgagttggcagg

SEQ ID NO: 486376 - DNA, 25 bp, Rattus norvegicus
gtatgccgtcccaagtggagctgag

SEQ ID NO: 486377 - DNA, 25 bp, Rattus norvegicus
gtatgccgtccctagtggagctgag

SEQ ID NO: 486378 - DNA, 25 bp, Rattus norvegicus
gtatgcctaaatctgccttgtccag

SEQ ID NO: 486379 - DNA, 25 bp, Rattus norvegicus
gtatgcctaaatgtgccttgtccag

SEQ ID NO: 486380 - DNA, 25 bp, Rattus norvegicus
gtatgcctaacactacatccatgtt

SEQ ID NO: 486381 - DNA, 25 bp, Rattus norvegicus
gtatgcctaacagtacatccatgtt

SEQ ID NO: 486382 - DNA, 25 bp, Rattus norvegicus
gtatgcctatgactgcccagaagtc

SEQ ID NO: 486383 - DNA, 25 bp, Rattus norvegicus
gtatgcctatgagtgcccagaagtc

SEQ ID NO: 486384 - DNA, 25 bp, Rattus norvegicus
gtatgcctccaaagcccggaaacat

SEQ ID NO: 486385 - DNA, 25 bp, Rattus norvegicus
gtatgcctccaatgcccggaaacat

SEQ ID NO: 486386 - DNA, 25 bp, Rattus norvegicus
gtatgcctcctacagtcaaaaatgt

SEQ ID NO: 486387 - DNA, 25 bp, Rattus norvegicus
gtatgcctcctagagtcaaaaatgt

SEQ ID NO: 486388 - DNA, 25 bp, Rattus norvegicus
gtatgcctgcagagtccattgactt

SEQ ID NO: 486389 - DNA, 25 bp, Rattus norvegicus
gtatgcctgcagtgtccattgactt

SEQ ID NO: 486390 - DNA, 25 bp, Rattus norvegicus
gtatgcctgctgaagtcttatttct

SEQ ID NO: 486391 - DNA, 25 bp, Rattus norvegicus
gtatgcctgctgtagtcttatttct

SEQ ID NO: 486392 - DNA, 25 bp, Rattus norvegicus
gtatgcctggctcattgctgtctgt

SEQ ID NO: 486393 - DNA, 25 bp, Rattus norvegicus
gtatgcctggctgattgctgtctgt

SEQ ID NO: 486394 - DNA, 25 bp, Rattus norvegicus
gtatgcctgtctacttattacccag

SEQ ID NO: 486395 - DNA, 25 bp, Rattus norvegicus
gtatgcctgtcttcttattacccag

SEQ ID NO: 486396 - DNA, 25 bp, Rattus norvegicus
gtatgccttcaaacagtatctttct

SEQ ID NO: 486397 - DNA, 25 bp, Rattus norvegicus
gtatgccttcaatcagtatctttct

SEQ ID NO: 486398 - DNA, 25 bp, Rattus norvegicus
gtatgcctttatcctgtgacacact

SEQ ID NO: 486399 - DNA, 25 bp, Rattus norvegicus
gtatgcctttatgctgtgacacact

SEQ ID NO: 486400 - DNA, 25 bp, Rattus norvegicus
gtatgccttttcaatttggaaccca

SEQ ID NO: 486401 - DNA, 25 bp, Rattus norvegicus
gtatgccttttctatttggaaccca

SEQ ID NO: 486402 - DNA, 25 bp, Rattus norvegicus
gtatgcgactcaaagcaagcgctca

SEQ ID NO: 486403 - DNA, 25 bp, Rattus norvegicus
gtatgcgactcatagcaagcgctca

SEQ ID NO: 486404 - DNA, 25 bp, Rattus norvegicus
gtatgcgagcttacatcggattcct

SEQ ID NO: 486405 - DNA, 25 bp, Rattus norvegicus
gtatgcgagctttcatcggattcct

SEQ ID NO: 486406 - DNA, 25 bp, Rattus norvegicus
gtatgcgagttgcacatcatcttca

SEQ ID NO: 486407 - DNA, 25 bp, Rattus norvegicus
gtatgcgagttggacatcatcttca

SEQ ID NO: 486408 - DNA, 25 bp, Rattus norvegicus
gtatgcgctgcacagatcacacaca

SEQ ID NO: 486409 - DNA, 25 bp, Rattus norvegicus
gtatgcgctgcagagatcacacaca

SEQ ID NO: 486410 - DNA, 25 bp, Rattus norvegicus
gtatgcgctgtaaatgcttatggtt

SEQ ID NO: 486411 - DNA, 25 bp, Rattus norvegicus
gtatgcgctgtatatgcttatggtt

SEQ ID NO: 486412 - DNA, 25 bp, Rattus norvegicus
gtatgcgtaattaaaatccttggta

SEQ ID NO: 486413 - DNA, 25 bp, Rattus norvegicus
gtatgcgtaatttaaatccttggta

SEQ ID NO: 486414 - DNA, 25 bp, Rattus norvegicus
gtatgcgtactaacagtcctcatgc

SEQ ID NO: 486415 - DNA, 25 bp, Rattus norvegicus
gtatgcgtactatcagtcctcatgc

SEQ ID NO: 486416 - DNA, 25 bp, Rattus norvegicus
gtatgcgtacttagctgttacaagt

SEQ ID NO: 486417 - DNA, 25 bp, Rattus norvegicus
gtatgcgtactttgctgttacaagt

SEQ ID NO: 486418 - DNA, 25 bp, Rattus norvegicus
gtatgcgtagctcaccaggcagtcc

SEQ ID NO: 486419 - DNA, 25 bp, Rattus norvegicus
gtatgcgtagctgaccaggcagtcc

SEQ ID NO: 486420 - DNA, 25 bp, Rattus norvegicus
gtatgcgttgagaattaacctccat

SEQ ID NO: 486421 - DNA, 25 bp, Rattus norvegicus
gtatgcgttgagtattaacctccat

SEQ ID NO: 486422 - DNA, 25 bp, Rattus norvegicus
gtatgcgttgtacctaactctgatg

SEQ ID NO: 486423 - DNA, 25 bp, Rattus norvegicus
gtatgcgttgtagctaactctgatg

SEQ ID NO: 486424 - DNA, 25 bp, Rattus norvegicus
gtatgctaacaaagtcctctctggg

SEQ ID NO: 486425 - DNA, 25 bp, Rattus norvegicus
gtatgctaacaatgtcctctctggg

SEQ ID NO: 486426 - DNA, 25 bp, Rattus norvegicus
gtatgctaagcaacccagagatcca

SEQ ID NO: 486427 - DNA, 25 bp, Rattus norvegicus
gtatgctaagcatcccagagatcca

SEQ ID NO: 486428 - DNA, 25 bp, Rattus norvegicus
gtatgctacagaatccactcttgtt

SEQ ID NO: 486429 - DNA, 25 bp, Rattus norvegicus
gtatgctacagattccactcttgtt

SEQ ID NO: 486430 - DNA, 25 bp, Rattus norvegicus
gtatgctaccataggcttctaccaa

SEQ ID NO: 486431 - DNA, 25 bp, Rattus norvegicus
gtatgctaccattggcttctaccaa

SEQ ID NO: 486432 - DNA, 25 bp, Rattus norvegicus
gtatgctacctgaccttaaacaagt

SEQ ID NO: 486433 - DNA, 25 bp, Rattus norvegicus
gtatgctacctgtccttaaacaagt

SEQ ID NO: 486434 - DNA, 25 bp, Rattus norvegicus
gtatgctaccttatagctctactcg

SEQ ID NO: 486435 - DNA, 25 bp, Rattus norvegicus
gtatgctaccttttagctctactcg

SEQ ID NO: 486436 - DNA, 25 bp, Rattus norvegicus
gtatgctaggtcagtactctcccaa

SEQ ID NO: 486437 - DNA, 25 bp, Rattus norvegicus
gtatgctaggtctgtactctcccaa

SEQ ID NO: 486438 - DNA, 25 bp, Rattus norvegicus
gtatgctatagaataacgtcactaa

SEQ ID NO: 486439 - DNA, 25 bp, Rattus norvegicus
gtatgctatagattaacgtcactaa

SEQ ID NO: 486440 - DNA, 25 bp, Rattus norvegicus
gtatgctcaatgacacagcgcttgc

SEQ ID NO: 486441 - DNA, 25 bp, Rattus norvegicus
gtatgctcaatgtcacagcgcttgc

SEQ ID NO: 486442 - DNA, 25 bp, Rattus norvegicus
gtatgctcacccctagaatgtgtac

SEQ ID NO: 486443 - DNA, 25 bp, Rattus norvegicus
gtatgctcacccgtagaatgtgtac

SEQ ID NO: 486444 - DNA, 25 bp, Rattus norvegicus
gtatgctcactacaaagctgcctga

SEQ ID NO: 486445 - DNA, 25 bp, Rattus norvegicus
gtatgctcactagaaagctgcctga

SEQ ID NO: 486446 - DNA, 25 bp, Rattus norvegicus
gtatgctcagctccatgtttatttt

SEQ ID NO: 486447 - DNA, 25 bp, Rattus norvegicus
gtatgctcagctgcatgtttatttt

SEQ ID NO: 486448 - DNA, 25 bp, Rattus norvegicus
gtatgctccagaaacaaccagacta

SEQ ID NO: 486449 - DNA, 25 bp, Rattus norvegicus
gtatgctccagatacaaccagacta

SEQ ID NO: 486450 - DNA, 25 bp, Rattus norvegicus
gtatgctccatgacttgacctggac

SEQ ID NO: 486451 - DNA, 25 bp, Rattus norvegicus
gtatgctccatgtcttgacctggac

SEQ ID NO: 486452 - DNA, 25 bp, Rattus norvegicus
gtatgctcctttcatgggtcacatc

SEQ ID NO: 486453 - DNA, 25 bp, Rattus norvegicus
gtatgctcctttgatgggtcacatc

SEQ ID NO: 486454 - DNA, 25 bp, Rattus norvegicus
gtatgctctcatcccagtagtgcga

SEQ ID NO: 486455 - DNA, 25 bp, Rattus norvegicus
gtatgctctcatgccagtagtgcga

SEQ ID NO: 486456 - DNA, 25 bp, Rattus norvegicus
gtatgctctcttaatggtgccaaac

SEQ ID NO: 486457 - DNA, 25 bp, Rattus norvegicus
gtatgctctctttatggtgccaaac

SEQ ID NO: 486458 - DNA, 25 bp, Rattus norvegicus
gtatgctctgcgctatctggcaacg

SEQ ID NO: 486459 - DNA, 25 bp, Rattus norvegicus
gtatgctctgcggtatctggcaacg

SEQ ID NO: 486460 - DNA, 25 bp, Rattus norvegicus
gtatgctctgctacaaaatgacttg

SEQ ID NO: 486461 - DNA, 25 bp, Rattus norvegicus
gtatgctctgcttcaaaatgacttg

SEQ ID NO: 486462 - DNA, 25 bp, Rattus norvegicus
gtatgctctgttatgtgacttgaaa

SEQ ID NO: 486463 - DNA, 25 bp, Rattus norvegicus
gtatgctctgttttgtgacttgaaa

SEQ ID NO: 486464 - DNA, 25 bp, Rattus norvegicus
gtatgctcttagaggtggcctggaa

SEQ ID NO: 486465 - DNA, 25 bp, Rattus norvegicus
gtatgctcttagtggtggcctggaa

SEQ ID NO: 486466 - DNA, 25 bp, Rattus norvegicus
gtatgctgacaaccctctgtgtata

SEQ ID NO: 486467 - DNA, 25 bp, Rattus norvegicus
gtatgctgacaagcctctgtgtata

SEQ ID NO: 486468 - DNA, 25 bp, Rattus norvegicus
gtatgctgacacaaaggctctgcct

SEQ ID NO: 486469 - DNA, 25 bp, Rattus norvegicus
gtatgctgacactaaggctctgcct

SEQ ID NO: 486470 - DNA, 25 bp, Rattus norvegicus
gtatgctgacagctgttcaccagca

SEQ ID NO: 486471 - DNA, 25 bp, Rattus norvegicus
gtatgctgacaggtgttcaccagca

SEQ ID NO: 486472 - DNA, 25 bp, Rattus norvegicus
gtatgctgataaatctagaccaaag

SEQ ID NO: 486473 - DNA, 25 bp, Rattus norvegicus
gtatgctgataattctagaccaaag

SEQ ID NO: 486474 - DNA, 25 bp, Rattus norvegicus
gtatgctgcactcggtttctctttt

SEQ ID NO: 486475 - DNA, 25 bp, Rattus norvegicus
gtatgctgcactgggtttctctttt

SEQ ID NO: 486476 - DNA, 25 bp, Rattus norvegicus
gtatgctgcagaaagtcttgtccct

SEQ ID NO: 486477 - DNA, 25 bp, Rattus norvegicus
gtatgctgcagatagtcttgtccct

SEQ ID NO: 486478 - DNA, 25 bp, Rattus norvegicus
gtatgctgctcactgcatgttttag

SEQ ID NO: 486479 - DNA, 25 bp, Rattus norvegicus
gtatgctgctcagtgcatgttttag

SEQ ID NO: 486480 - DNA, 25 bp, Rattus norvegicus
gtatgctgggatacaccaacccaaa

SEQ ID NO: 486481 - DNA, 25 bp, Rattus norvegicus
gtatgctgggattcaccaacccaaa

SEQ ID NO: 486482 - DNA, 25 bp, Rattus norvegicus
gtatgctgtaccacaaaccatctgt

SEQ ID NO: 486483 - DNA, 25 bp, Rattus norvegicus
gtatgctgtacctcaaaccatctgt

SEQ ID NO: 486484 - DNA, 25 bp, Rattus norvegicus
gtatgctgtcacactgcaaacacat

SEQ ID NO: 486485 - DNA, 25 bp, Rattus norvegicus
gtatgctgtcactctgcaaacacat

SEQ ID NO: 486486 - DNA, 25 bp, Rattus norvegicus
gtatgctgtggcatcttttttaagg

SEQ ID NO: 486487 - DNA, 25 bp, Rattus norvegicus
gtatgctgtggcttcttttttaagg

SEQ ID NO: 486488 - DNA, 25 bp, Rattus norvegicus
gtatgcttaccaagggagtgcctgc

SEQ ID NO: 486489 - DNA, 25 bp, Rattus norvegicus
gtatgcttaccatgggagtgcctgc

SEQ ID NO: 486490 - DNA, 25 bp, Rattus norvegicus
gtatgcttagacatgtaatgcttta

SEQ ID NO: 486491 - DNA, 25 bp, Rattus norvegicus
gtatgcttagacttgtaatgcttta

SEQ ID NO: 486492 - DNA, 25 bp, Rattus norvegicus
gtatgcttagtgatggttgttttga

SEQ ID NO: 486493 - DNA, 25 bp, Rattus norvegicus
gtatgcttagtgttggttgttttga

SEQ ID NO: 486494 - DNA, 25 bp, Rattus norvegicus
gtatgcttcaagaccatttctggtg

SEQ ID NO: 486495 - DNA, 25 bp, Rattus norvegicus
gtatgcttcaagtccatttctggtg

SEQ ID NO: 486496 - DNA, 25 bp, Rattus norvegicus
gtatgcttccagcagaacgtctctt

SEQ ID NO: 486497 - DNA, 25 bp, Rattus norvegicus
gtatgcttccaggagaacgtctctt

SEQ ID NO: 486498 - DNA, 25 bp, Rattus norvegicus
gtatgcttctacagggtcaacttaa

SEQ ID NO: 486499 - DNA, 25 bp, Rattus norvegicus
gtatgcttctactgggtcaacttaa

SEQ ID NO: 486500 - DNA, 25 bp, Rattus norvegicus
gtatgcttctcccaaagtcagctac

SEQ ID NO: 486501 - DNA, 25 bp, Rattus norvegicus
gtatgcttctccgaaagtcagctac

SEQ ID NO: 486502 - DNA, 25 bp, Rattus norvegicus
gtatgcttctgtatcagagccagct

SEQ ID NO: 486503 - DNA, 25 bp, Rattus norvegicus
gtatgcttctgtttcagagccagct

SEQ ID NO: 486504 - DNA, 25 bp, Rattus norvegicus
gtatgcttgaatcatggaaatctaa

SEQ ID NO: 486505 - DNA, 25 bp, Rattus norvegicus
gtatgcttgaatgatggaaatctaa

SEQ ID NO: 486506 - DNA, 25 bp, Rattus norvegicus
gtatgcttgcatcgtgccaggtgcc

SEQ ID NO: 486507 - DNA, 25 bp, Rattus norvegicus
gtatgcttgcatggtgccaggtgcc

SEQ ID NO: 486508 - DNA, 25 bp, Rattus norvegicus
gtatgcttgcttaagaaaccgtata

SEQ ID NO: 486509 - DNA, 25 bp, Rattus norvegicus
gtatgcttgctttagaaaccgtata

SEQ ID NO: 486510 - DNA, 25 bp, Rattus norvegicus
gtatgctttccgagcactttagcaa

SEQ ID NO: 486511 - DNA, 25 bp, Rattus norvegicus
gtatgctttccgtgcactttagcaa

SEQ ID NO: 486512 - DNA, 25 bp, Rattus norvegicus
gtatgctttcttcttgttggcccat

SEQ ID NO: 486513 - DNA, 25 bp, Rattus norvegicus
gtatgctttcttgttgttggcccat

SEQ ID NO: 486514 - DNA, 25 bp, Rattus norvegicus
gtatgctttttgactgtatcctttt

SEQ ID NO: 486515 - DNA, 25 bp, Rattus norvegicus
gtatgctttttgtctgtatcctttt

SEQ ID NO: 486516 - DNA, 25 bp, Rattus norvegicus
gtatgcttttttcggcctgcgcttc

SEQ ID NO: 486517 - DNA, 25 bp, Rattus norvegicus
gtatgcttttttgggcctgcgcttc

SEQ ID NO: 486518 - DNA, 25 bp, Rattus norvegicus
gtatggaactggatactaccctccc

SEQ ID NO: 486519 - DNA, 25 bp, Rattus norvegicus
gtatggaactggttactaccctccc

SEQ ID NO: 486520 - DNA, 25 bp, Rattus norvegicus
gtatggaagtcacttagctagaccc

SEQ ID NO: 486521 - DNA, 25 bp, Rattus norvegicus
gtatggaagtcagttagctagaccc

SEQ ID NO: 486522 - DNA, 25 bp, Rattus norvegicus
gtatggaatcttaacactctcggat

SEQ ID NO: 486523 - DNA, 25 bp, Rattus norvegicus
gtatggaatctttacactctcggat

SEQ ID NO: 486524 - DNA, 25 bp, Rattus norvegicus
gtatggacactgcaccgggctgatc

SEQ ID NO: 486525 - DNA, 25 bp, Rattus norvegicus
gtatggacactggaccgggctgatc

SEQ ID NO: 486526 - DNA, 25 bp, Rattus norvegicus
gtatggacagacacagaccagctcc

SEQ ID NO: 486527 - DNA, 25 bp, Rattus norvegicus
gtatggacagactcagaccagctcc

SEQ ID NO: 486528 - DNA, 25 bp, Rattus norvegicus
gtatggaccagtacctgcagcactg

SEQ ID NO: 486529 - DNA, 25 bp, Rattus norvegicus
gtatggaccagttcctgcagcactg

SEQ ID NO: 486530 - DNA, 25 bp, Rattus norvegicus
gtatggacgtttccacacaggattg

SEQ ID NO: 486531 - DNA, 25 bp, Rattus norvegicus
gtatggacgtttgcacacaggattg

SEQ ID NO: 486532 - DNA, 25 bp, Rattus norvegicus
gtatggactatcagtttggtgcccc

SEQ ID NO: 486533 - DNA, 25 bp, Rattus norvegicus
gtatggactatctgtttggtgcccc

SEQ ID NO: 486534 - DNA, 25 bp, Rattus norvegicus
gtatggactttgagcagctacatca

SEQ ID NO: 486535 - DNA, 25 bp, Rattus norvegicus
gtatggactttgtgcagctacatca

SEQ ID NO: 486536 - DNA, 25 bp, Rattus norvegicus
gtatggagcgaacacatgcatgtag

SEQ ID NO: 486537 - DNA, 25 bp, Rattus norvegicus
gtatggagcgaagacatgcatgtag

SEQ ID NO: 486538 - DNA, 25 bp, Rattus norvegicus
gtatggagtattaccgtgccctcaa

SEQ ID NO: 486539 - DNA, 25 bp, Rattus norvegicus
gtatggagtatttccgtgccctcaa

SEQ ID NO: 486540 - DNA, 25 bp, Rattus norvegicus
gtatggagtttaacactttatcagt

SEQ ID NO: 486541 - DNA, 25 bp, Rattus norvegicus
gtatggagtttatcactttatcagt

SEQ ID NO: 486542 - DNA, 25 bp, Rattus norvegicus
gtatggatggatattctggttttgt

SEQ ID NO: 486543 - DNA, 25 bp, Rattus norvegicus
gtatggatggattttctggttttgt

SEQ ID NO: 486544 - DNA, 25 bp, Rattus norvegicus
gtatggatttggaaccccaacacca

SEQ ID NO: 486545 - DNA, 25 bp, Rattus norvegicus
gtatggatttggtaccccaacacca

SEQ ID NO: 486546 - DNA, 25 bp, Rattus norvegicus
gtatggcaacaccagatctatcggt

SEQ ID NO: 486547 - DNA, 25 bp, Rattus norvegicus
gtatggcaacacgagatctatcggt

SEQ ID NO: 486548 - DNA, 25 bp, Rattus norvegicus
gtatggcaaccaacaggatcgatcc

SEQ ID NO: 486549 - DNA, 25 bp, Rattus norvegicus
gtatggcaaccatcaggatcgatcc

SEQ ID NO: 486550 - DNA, 25 bp, Rattus norvegicus
gtatggcacttccttcttaatcaat

SEQ ID NO: 486551 - DNA, 25 bp, Rattus norvegicus
gtatggcacttcgttcttaatcaat

SEQ ID NO: 486552 - DNA, 25 bp, Rattus norvegicus
gtatggcatagtccctacatttaaa

SEQ ID NO: 486553 - DNA, 25 bp, Rattus norvegicus
gtatggcatagtctagagctctgaa

SEQ ID NO: 486554 - DNA, 25 bp, Rattus norvegicus
gtatggcatagtgcctacatttaaa

SEQ ID NO: 486555 - DNA, 25 bp, Rattus norvegicus
gtatggcatagtgtagagctctgaa

SEQ ID NO: 486556 - DNA, 25 bp, Rattus norvegicus
gtatggcatgctcctagtcttggtg

SEQ ID NO: 486557 - DNA, 25 bp, Rattus norvegicus
gtatggcatgctgctagtcttggtg

SEQ ID NO: 486558 - DNA, 25 bp, Rattus norvegicus
gtatggcatggcacagaccccagtg

SEQ ID NO: 486559 - DNA, 25 bp, Rattus norvegicus
gtatggcatggctcagaccccagtg

SEQ ID NO: 486560 - DNA, 25 bp, Rattus norvegicus
gtatggcattcccattgttttggcc

SEQ ID NO: 486561 - DNA, 25 bp, Rattus norvegicus
gtatggcattccgattgttttggcc

SEQ ID NO: 486562 - DNA, 25 bp, Rattus norvegicus
gtatggccaagtaccttgtacactc

SEQ ID NO: 486563 - DNA, 25 bp, Rattus norvegicus
gtatggccaagttccttgtacactc

SEQ ID NO: 486564 - DNA, 25 bp, Rattus norvegicus
gtatggccacacaagagcttacaga

SEQ ID NO: 486565 - DNA, 25 bp, Rattus norvegicus
gtatggccacactagagcttacaga

SEQ ID NO: 486566 - DNA, 25 bp, Rattus norvegicus
gtatggcccgacatcaggtctgagc

SEQ ID NO: 486567 - DNA, 25 bp, Rattus norvegicus
gtatggcccgacttcaggtctgagc

SEQ ID NO: 486568 - DNA, 25 bp, Rattus norvegicus
gtatggccctctagttgccagagtg

SEQ ID NO: 486569 - DNA, 25 bp, Rattus norvegicus
gtatggccctcttgttgccagagtg

SEQ ID NO: 486570 - DNA, 25 bp, Rattus norvegicus
gtatggcggccaagaacacctggat

SEQ ID NO: 486571 - DNA, 25 bp, Rattus norvegicus
gtatggcggccatgaacacctggat

SEQ ID NO: 486572 - DNA, 25 bp, Rattus norvegicus
gtatggcgtgataactctggtcggc

SEQ ID NO: 486573 - DNA, 25 bp, Rattus norvegicus
gtatggcgtgattactctggtcggc

SEQ ID NO: 486574 - DNA, 25 bp, Rattus norvegicus
gtatggcgtgttagtgagtatgtct

SEQ ID NO: 486575 - DNA, 25 bp, Rattus norvegicus
gtatggcgtgtttgtgagtatgtct

SEQ ID NO: 486576 - DNA, 25 bp, Rattus norvegicus
gtatggcgttcacattcccgggtga

SEQ ID NO: 486577 - DNA, 25 bp, Rattus norvegicus
gtatggcgttcagattcccgggtga

SEQ ID NO: 486578 - DNA, 25 bp, Rattus norvegicus
gtatggctaaacagcggcagcttct

SEQ ID NO: 486579 - DNA, 25 bp, Rattus norvegicus
gtatggctaaactgcggcagcttct

SEQ ID NO: 486580 - DNA, 25 bp, Rattus norvegicus
gtatggctcaaacactcttctgaag

SEQ ID NO: 486581 - DNA, 25 bp, Rattus norvegicus
gtatggctcaaagactcttctgaag

SEQ ID NO: 486582 - DNA, 25 bp, Rattus norvegicus
gtatggctccatatgcattaattta

SEQ ID NO: 486583 - DNA, 25 bp, Rattus norvegicus
gtatggctccatttgcattaattta

SEQ ID NO: 486584 - DNA, 25 bp, Rattus norvegicus
gtatggctcccaacttttaaatcca

SEQ ID NO: 486585 - DNA, 25 bp, Rattus norvegicus
gtatggctcccatcttttaaatcca

SEQ ID NO: 486586 - DNA, 25 bp, Rattus norvegicus
gtatggctgccaaacttttccttag

SEQ ID NO: 486587 - DNA, 25 bp, Rattus norvegicus
gtatggctgccaacctgtgaaggag

SEQ ID NO: 486588 - DNA, 25 bp, Rattus norvegicus
gtatggctgccaagaatccatccct

SEQ ID NO: 486589 - DNA, 25 bp, Rattus norvegicus
gtatggctgccatacttttccttag

SEQ ID NO: 486590 - DNA, 25 bp, Rattus norvegicus
gtatggctgccatcctgtgaaggag

SEQ ID NO: 486591 - DNA, 25 bp, Rattus norvegicus
gtatggctgccatgaatccatccct

SEQ ID NO: 486592 - DNA, 25 bp, Rattus norvegicus
gtatggctgcttccactagaccaga

SEQ ID NO: 486593 - DNA, 25 bp, Rattus norvegicus
gtatggctgcttgcactagaccaga

SEQ ID NO: 486594 - DNA, 25 bp, Rattus norvegicus
gtatggctgttgagggaaactgcat

SEQ ID NO: 486595 - DNA, 25 bp, Rattus norvegicus
gtatggctgttgtgggaaactgcat

SEQ ID NO: 486596 - DNA, 25 bp, Rattus norvegicus
gtatggcttattatgcattcttcat

SEQ ID NO: 486597 - DNA, 25 bp, Rattus norvegicus
gtatggcttattttgcattcttcat

SEQ ID NO: 486598 - DNA, 25 bp, Rattus norvegicus
gtatggcttgtcaggaaacttctgt

SEQ ID NO: 486599 - DNA, 25 bp, Rattus norvegicus
gtatggcttgtctggaaacttctgt

SEQ ID NO: 486600 - DNA, 25 bp, Rattus norvegicus
gtatggctttctagaagcccagcag

SEQ ID NO: 486601 - DNA, 25 bp, Rattus norvegicus
gtatggctttctatctgatgttgtc

SEQ ID NO: 486602 - DNA, 25 bp, Rattus norvegicus
gtatggctttcttgaagcccagcag

SEQ ID NO: 486603 - DNA, 25 bp, Rattus norvegicus
gtatggctttctttctgatgttgtc

SEQ ID NO: 486604 - DNA, 25 bp, Rattus norvegicus
gtatgggacacacttgggtgacatc

SEQ ID NO: 486605 - DNA, 25 bp, Rattus norvegicus
gtatgggacacagttgggtgacatc

SEQ ID NO: 486606 - DNA, 25 bp, Rattus norvegicus
gtatgggacatcaataacttagaaa

SEQ ID NO: 486607 - DNA, 25 bp, Rattus norvegicus
gtatgggacatctataacttagaaa

SEQ ID NO: 486608 - DNA, 25 bp, Rattus norvegicus
gtatgggagtccagagtccaacctc

SEQ ID NO: 486609 - DNA, 25 bp, Rattus norvegicus
gtatgggagtcctgagtccaacctc

SEQ ID NO: 486610 - DNA, 25 bp, Rattus norvegicus
gtatgggcacctccattgcaataga

SEQ ID NO: 486611 - DNA, 25 bp, Rattus norvegicus
gtatgggcacctgcattgcaataga

SEQ ID NO: 486612 - DNA, 25 bp, Rattus norvegicus
gtatgggccagcaataggcaactca

SEQ ID NO: 486613 - DNA, 25 bp, Rattus norvegicus
gtatgggccagctataggcaactca

SEQ ID NO: 486614 - DNA, 25 bp, Rattus norvegicus
gtatgggcctccaattccagcagaa

SEQ ID NO: 486615 - DNA, 25 bp, Rattus norvegicus
gtatgggcctcctattccagcagaa

SEQ ID NO: 486616 - DNA, 25 bp, Rattus norvegicus
gtatgggcggacattatgttttata

SEQ ID NO: 486617 - DNA, 25 bp, Rattus norvegicus
gtatgggcggactttatgttttata

SEQ ID NO: 486618 - DNA, 25 bp, Rattus norvegicus
gtatgggctccaaccagaaagtcca

SEQ ID NO: 486619 - DNA, 25 bp, Rattus norvegicus
gtatgggctccatccagaaagtcca

SEQ ID NO: 486620 - DNA, 25 bp, Rattus norvegicus
gtatgggctgaccaagctaccgact

SEQ ID NO: 486621 - DNA, 25 bp, Rattus norvegicus
gtatgggctgacgaagctaccgact

SEQ ID NO: 486622 - DNA, 25 bp, Rattus norvegicus
gtatgggctgcaatacagacagaca

SEQ ID NO: 486623 - DNA, 25 bp, Rattus norvegicus
gtatgggctgcattacagacagaca

SEQ ID NO: 486624 - DNA, 25 bp, Rattus norvegicus
gtatgggctgtaatgtctccaggaa

SEQ ID NO: 486625 - DNA, 25 bp, Rattus norvegicus
gtatgggctgtattgtctccaggaa

SEQ ID NO: 486626 - DNA, 25 bp, Rattus norvegicus
gtatgggcttccagttaaggctaaa

SEQ ID NO: 486627 - DNA, 25 bp, Rattus norvegicus
gtatgggcttcctgttaaggctaaa

SEQ ID NO: 486628 - DNA, 25 bp, Rattus norvegicus
gtatgggtccgcaagtggctcagca

SEQ ID NO: 486629 - DNA, 25 bp, Rattus norvegicus
gtatgggtccgctagtggctcagca

SEQ ID NO: 486630 - DNA, 25 bp, Rattus norvegicus
gtatgggtctgaagttcccttgaat

SEQ ID NO: 486631 - DNA, 25 bp, Rattus norvegicus
gtatgggtctgatgttcccttgaat

SEQ ID NO: 486632 - DNA, 25 bp, Rattus norvegicus
gtatgggtctttctgatactaccac

SEQ ID NO: 486633 - DNA, 25 bp, Rattus norvegicus
gtatgggtctttgtgatactaccac

SEQ ID NO: 486634 - DNA, 25 bp, Rattus norvegicus
gtatgggtgcccagtggcattttta

SEQ ID NO: 486635 - DNA, 25 bp, Rattus norvegicus
gtatgggtgccctgtggcattttta

SEQ ID NO: 486636 - DNA, 25 bp, Rattus norvegicus
gtatgggtgtcacgccatccactag

SEQ ID NO: 486637 - DNA, 25 bp, Rattus norvegicus
gtatgggtgtcaggccatccactag

SEQ ID NO: 486638 - DNA, 25 bp, Rattus norvegicus
gtatggtaaaagattgtcctcctgt

SEQ ID NO: 486639 - DNA, 25 bp, Rattus norvegicus
gtatggtaaaagtttgtcctcctgt

SEQ ID NO: 486640 - DNA, 25 bp, Rattus norvegicus
gtatggtaaatgattcacgccgtca

SEQ ID NO: 486641 - DNA, 25 bp, Rattus norvegicus
gtatggtaaatgtttcacgccgtca

SEQ ID NO: 486642 - DNA, 25 bp, Rattus norvegicus
gtatggtacctactccggtggagac

SEQ ID NO: 486643 - DNA, 25 bp, Rattus norvegicus
gtatggtacctagtccggtggagac

SEQ ID NO: 486644 - DNA, 25 bp, Rattus norvegicus
gtatggtacgtacatttttattgaa

SEQ ID NO: 486645 - DNA, 25 bp, Rattus norvegicus
gtatggtacgtagatttttattgaa

SEQ ID NO: 486646 - DNA, 25 bp, Rattus norvegicus
gtatggtagatccaccctgacttaa

SEQ ID NO: 486647 - DNA, 25 bp, Rattus norvegicus
gtatggtagatcgaccctgacttaa

SEQ ID NO: 486648 - DNA, 25 bp, Rattus norvegicus
gtatggtagccaaagctttcccagc

SEQ ID NO: 486649 - DNA, 25 bp, Rattus norvegicus
gtatggtagccatagctttcccagc

SEQ ID NO: 486650 - DNA, 25 bp, Rattus norvegicus
gtatggtcactcatttacctagaat

SEQ ID NO: 486651 - DNA, 25 bp, Rattus norvegicus
gtatggtcactcttttacctagaat

SEQ ID NO: 486652 - DNA, 25 bp, Rattus norvegicus
gtatggtcagtccagatgggcattc

SEQ ID NO: 486653 - DNA, 25 bp, Rattus norvegicus
gtatggtcagtcgagatgggcattc

SEQ ID NO: 486654 - DNA, 25 bp, Rattus norvegicus
gtatggtcatagatttccgctggcc

SEQ ID NO: 486655 - DNA, 25 bp, Rattus norvegicus
gtatggtcatagttttccgctggcc

SEQ ID NO: 486656 - DNA, 25 bp, Rattus norvegicus
gtatggtccccaaagagtcatatgt

SEQ ID NO: 486657 - DNA, 25 bp, Rattus norvegicus
gtatggtccccatagagtcatatgt

SEQ ID NO: 486658 - DNA, 25 bp, Rattus norvegicus
gtatggtctcgcagtgtgctttctc

SEQ ID NO: 486659 - DNA, 25 bp, Rattus norvegicus
gtatggtctcgctgtgtgctttctc

SEQ ID NO: 486660 - DNA, 25 bp, Rattus norvegicus
gtatggtgaacactggctctcagcc

SEQ ID NO: 486661 - DNA, 25 bp, Rattus norvegicus
gtatggtgaacagtggctctcagcc

SEQ ID NO: 486662 - DNA, 25 bp, Rattus norvegicus
gtatggtgacatatctcttcgccag

SEQ ID NO: 486663 - DNA, 25 bp, Rattus norvegicus
gtatggtgacatttctcttcgccag

SEQ ID NO: 486664 - DNA, 25 bp, Rattus norvegicus
gtatggtgacctctatttttcttta

SEQ ID NO: 486665 - DNA, 25 bp, Rattus norvegicus
gtatggtgacctgtatttttcttta

SEQ ID NO: 486666 - DNA, 25 bp, Rattus norvegicus
gtatggtgactgcaggtgctaactt

SEQ ID NO: 486667 - DNA, 25 bp, Rattus norvegicus
gtatggtgactggaggtgctaactt

SEQ ID NO: 486668 - DNA, 25 bp, Rattus norvegicus
gtatggtgagtaacagtgagcaaat

SEQ ID NO: 486669 - DNA, 25 bp, Rattus norvegicus
gtatggtgagtatcagtgagcaaat

SEQ ID NO: 486670 - DNA, 25 bp, Rattus norvegicus
gtatggtgcttcatgatgttggttc

SEQ ID NO: 486671 - DNA, 25 bp, Rattus norvegicus
gtatggtgcttcttgatgttggttc

SEQ ID NO: 486672 - DNA, 25 bp, Rattus norvegicus
gtatggtgtcttaagatcagatgtg

SEQ ID NO: 486673 - DNA, 25 bp, Rattus norvegicus
gtatggtgtctttagatcagatgtg

SEQ ID NO: 486674 - DNA, 25 bp, Rattus norvegicus
gtatggtgttctagtttccctatcc

SEQ ID NO: 486675 - DNA, 25 bp, Rattus norvegicus
gtatggtgttcttgtttccctatcc

SEQ ID NO: 486676 - DNA, 25 bp, Rattus norvegicus
gtatggtgtttgattctgtgactcc

SEQ ID NO: 486677 - DNA, 25 bp, Rattus norvegicus
gtatggtgtttgtttctgtgactcc

SEQ ID NO: 486678 - DNA, 25 bp, Rattus norvegicus
gtatggttaacccttcgtgacatgg

SEQ ID NO: 486679 - DNA, 25 bp, Rattus norvegicus
gtatggttaaccgttcgtgacatgg

SEQ ID NO: 486680 - DNA, 25 bp, Rattus norvegicus
gtatggttactaatgcagcgggtgt

SEQ ID NO: 486681 - DNA, 25 bp, Rattus norvegicus
gtatggttactattgcagcgggtgt

SEQ ID NO: 486682 - DNA, 25 bp, Rattus norvegicus
gtatggtttaaacctcagtctgtta

SEQ ID NO: 486683 - DNA, 25 bp, Rattus norvegicus
gtatggtttaaagctcagtctgtta

SEQ ID NO: 486684 - DNA, 25 bp, Rattus norvegicus
gtatggtttactaggtgattgcaaa

SEQ ID NO: 486685 - DNA, 25 bp, Rattus norvegicus
gtatggtttacttggtgattgcaaa

SEQ ID NO: 486686 - DNA, 25 bp, Rattus norvegicus
gtatggtttcaaaatatagctcagg

SEQ ID NO: 486687 - DNA, 25 bp, Rattus norvegicus
gtatggtttcaatatatagctcagg

SEQ ID NO: 486688 - DNA, 25 bp, Rattus norvegicus
gtatggtttttgcaagcatcctgtg

SEQ ID NO: 486689 - DNA, 25 bp, Rattus norvegicus
gtatggtttttggaagcatcctgtg

SEQ ID NO: 486690 - DNA, 25 bp, Rattus norvegicus
gtatgtaacaggatcccataccctg

SEQ ID NO: 486691 - DNA, 25 bp, Rattus norvegicus
gtatgtaacaggttcccataccctg

SEQ ID NO: 486692 - DNA, 25 bp, Rattus norvegicus
gtatgtaagctaccaatccgactct

SEQ ID NO: 486693 - DNA, 25 bp, Rattus norvegicus
gtatgtaagctagcaatccgactct

SEQ ID NO: 486694 - DNA, 25 bp, Rattus norvegicus
gtatgtaagtatctgtcatggccac

SEQ ID NO: 486695 - DNA, 25 bp, Rattus norvegicus
gtatgtaagtatgtgtcatggccac

SEQ ID NO: 486696 - DNA, 25 bp, Rattus norvegicus
gtatgtaagtgcaggcagggcctta

SEQ ID NO: 486697 - DNA, 25 bp, Rattus norvegicus
gtatgtaagtgctggcagggcctta

SEQ ID NO: 486698 - DNA, 25 bp, Rattus norvegicus
gtatgtaatgctcaaccacttgtag

SEQ ID NO: 486699 - DNA, 25 bp, Rattus norvegicus
gtatgtaatgctgaaccacttgtag

SEQ ID NO: 486700 - DNA, 25 bp, Rattus norvegicus
gtatgtaattgccaccactaaactg

SEQ ID NO: 486701 - DNA, 25 bp, Rattus norvegicus
gtatgtaattgcgaccactaaactg

SEQ ID NO: 486702 - DNA, 25 bp, Rattus norvegicus
gtatgtacacttaagtttccagaac

SEQ ID NO: 486703 - DNA, 25 bp, Rattus norvegicus
gtatgtacactttagtttccagaac

SEQ ID NO: 486704 - DNA, 25 bp, Rattus norvegicus
gtatgtacagcaatgtctcctcagt

SEQ ID NO: 486705 - DNA, 25 bp, Rattus norvegicus
gtatgtacagcattgtctcctcagt

SEQ ID NO: 486706 - DNA, 25 bp, Rattus norvegicus
gtatgtacaggacccagaagccaaa

SEQ ID NO: 486707 - DNA, 25 bp, Rattus norvegicus
gtatgtacaggagccagaagccaaa

SEQ ID NO: 486708 - DNA, 25 bp, Rattus norvegicus
gtatgtacagttagctacagccaag

SEQ ID NO: 486709 - DNA, 25 bp, Rattus norvegicus
gtatgtacagtttgctacagccaag

SEQ ID NO: 486710 - DNA, 25 bp, Rattus norvegicus
gtatgtacatgtcttgttttccaac

SEQ ID NO: 486711 - DNA, 25 bp, Rattus norvegicus
gtatgtacatgtgttgttttccaac

SEQ ID NO: 486712 - DNA, 25 bp, Rattus norvegicus
gtatgtaccagtcaaaggagaccac

SEQ ID NO: 486713 - DNA, 25 bp, Rattus norvegicus
gtatgtaccagtgaaaggagaccac

SEQ ID NO: 486714 - DNA, 25 bp, Rattus norvegicus
gtatgtaccattagtatacctgaat

SEQ ID NO: 486715 - DNA, 25 bp, Rattus norvegicus
gtatgtaccatttgtatacctgaat

SEQ ID NO: 486716 - DNA, 25 bp, Rattus norvegicus
gtatgtacctttattgcttctcgag

SEQ ID NO: 486717 - DNA, 25 bp, Rattus norvegicus
gtatgtaccttttttgcttctcgag

SEQ ID NO: 486718 - DNA, 25 bp, Rattus norvegicus
gtatgtactaaacccagacccgtgt

SEQ ID NO: 486719 - DNA, 25 bp, Rattus norvegicus
gtatgtactaaagccagacccgtgt

SEQ ID NO: 486720 - DNA, 25 bp, Rattus norvegicus
gtatgtactcataaccaccagcaaa

SEQ ID NO: 486721 - DNA, 25 bp, Rattus norvegicus
gtatgtactcattaccaccagcaaa

SEQ ID NO: 486722 - DNA, 25 bp, Rattus norvegicus
gtatgtactgcacatgctagcgaca

SEQ ID NO: 486723 - DNA, 25 bp, Rattus norvegicus
gtatgtactgcagatgctagcgaca

SEQ ID NO: 486724 - DNA, 25 bp, Rattus norvegicus
gtatgtactgtaattcctgtctgaa

SEQ ID NO: 486725 - DNA, 25 bp, Rattus norvegicus
gtatgtactgtatttcctgtctgaa

SEQ ID NO: 486726 - DNA, 25 bp, Rattus norvegicus
gtatgtacttacctagcaaatctca

SEQ ID NO: 486727 - DNA, 25 bp, Rattus norvegicus
gtatgtacttacgtagcaaatctca

SEQ ID NO: 486728 - DNA, 25 bp, Rattus norvegicus
gtatgtacttgaaagcctagcactt

SEQ ID NO: 486729 - DNA, 25 bp, Rattus norvegicus
gtatgtacttgatagcctagcactt

SEQ ID NO: 486730 - DNA, 25 bp, Rattus norvegicus
gtatgtactttaaggcattttcttc

SEQ ID NO: 486731 - DNA, 25 bp, Rattus norvegicus
gtatgtactttatggcattttcttc

SEQ ID NO: 486732 - DNA, 25 bp, Rattus norvegicus
gtatgtagctcacaagctggcttat

SEQ ID NO: 486733 - DNA, 25 bp, Rattus norvegicus
gtatgtagctcactccttattctga

SEQ ID NO: 486734 - DNA, 25 bp, Rattus norvegicus
gtatgtagctcagaagctggcttat

SEQ ID NO: 486735 - DNA, 25 bp, Rattus norvegicus
gtatgtagctcagtccttattctga

SEQ ID NO: 486736 - DNA, 25 bp, Rattus norvegicus
gtatgtagctctacccagaaagcat

SEQ ID NO: 486737 - DNA, 25 bp, Rattus norvegicus
gtatgtagctcttcccagaaagcat

SEQ ID NO: 486738 - DNA, 25 bp, Rattus norvegicus
gtatgtagtctcataggcactgtaa

SEQ ID NO: 486739 - DNA, 25 bp, Rattus norvegicus
gtatgtagtctcttaggcactgtaa

SEQ ID NO: 486740 - DNA, 25 bp, Rattus norvegicus
gtatgtagtgaaatggccccagtcc

SEQ ID NO: 486741 - DNA, 25 bp, Rattus norvegicus
gtatgtagtgaattggccccagtcc

SEQ ID NO: 486742 - DNA, 25 bp, Rattus norvegicus
gtatgtagtgtcaaatttctgccaa

SEQ ID NO: 486743 - DNA, 25 bp, Rattus norvegicus
gtatgtagtgtctaatttctgccaa

SEQ ID NO: 486744 - DNA, 25 bp, Rattus norvegicus
gtatgtatactcattaagactgcct

SEQ ID NO: 486745 - DNA, 25 bp, Rattus norvegicus
gtatgtatactctttaagactgcct

SEQ ID NO: 486746 - DNA, 25 bp, Rattus norvegicus
gtatgtatatatatggctctgcctt

SEQ ID NO: 486747 - DNA, 25 bp, Rattus norvegicus
gtatgtatatatttggctctgcctt

SEQ ID NO: 486748 - DNA, 25 bp, Rattus norvegicus
gtatgtatcatgaacaaccaattgg

SEQ ID NO: 486749 - DNA, 25 bp, Rattus norvegicus
gtatgtatcatgtacaaccaattgg

SEQ ID NO: 486750 - DNA, 25 bp, Rattus norvegicus
gtatgtatctatctaccacagcaca

SEQ ID NO: 486751 - DNA, 25 bp, Rattus norvegicus
gtatgtatctatgtaccacagcaca

SEQ ID NO: 486752 - DNA, 25 bp, Rattus norvegicus
gtatgtatctctatccatgctggca

SEQ ID NO: 486753 - DNA, 25 bp, Rattus norvegicus
gtatgtatctctctatctgtatctt

SEQ ID NO: 486754 - DNA, 25 bp, Rattus norvegicus
gtatgtatctctgtatctgtatctt

SEQ ID NO: 486755 - DNA, 25 bp, Rattus norvegicus
gtatgtatctctttccatgctggca

SEQ ID NO: 486756 - DNA, 25 bp, Rattus norvegicus
gtatgtatgcatcgtctctggccta

SEQ ID NO: 486757 - DNA, 25 bp, Rattus norvegicus
gtatgtatgcatggtctctggccta

SEQ ID NO: 486758 - DNA, 25 bp, Rattus norvegicus
gtatgtatgtacatctagaccacag

SEQ ID NO: 486759 - DNA, 25 bp, Rattus norvegicus
gtatgtatgtacttctagaccacag

SEQ ID NO: 486760 - DNA, 25 bp, Rattus norvegicus
gtatgtatgttgaaagcggatctat

SEQ ID NO: 486761 - DNA, 25 bp, Rattus norvegicus
gtatgtatgttgtaagcggatctat

SEQ ID NO: 486762 - DNA, 25 bp, Rattus norvegicus
gtatgtattacacgctttcaccatt

SEQ ID NO: 486763 - DNA, 25 bp, Rattus norvegicus
gtatgtattacaggctttcaccatt

SEQ ID NO: 486764 - DNA, 25 bp, Rattus norvegicus
gtatgtattattaggactttggatt

SEQ ID NO: 486765 - DNA, 25 bp, Rattus norvegicus
gtatgtattatttggactttggatt

SEQ ID NO: 486766 - DNA, 25 bp, Rattus norvegicus
gtatgtattctccaacatgtgtgat

SEQ ID NO: 486767 - DNA, 25 bp, Rattus norvegicus
gtatgtattctcgaacatgtgtgat

SEQ ID NO: 486768 - DNA, 25 bp, Rattus norvegicus
gtatgtatttcaccactgacccctg

SEQ ID NO: 486769 - DNA, 25 bp, Rattus norvegicus
gtatgtatttcagcactgacccctg

SEQ ID NO: 486770 - DNA, 25 bp, Rattus norvegicus
gtatgtattttaactgcatgtgcag

SEQ ID NO: 486771 - DNA, 25 bp, Rattus norvegicus
gtatgtattttatctgcatgtgcag

SEQ ID NO: 486772 - DNA, 25 bp, Rattus norvegicus
gtatgtattttcaccatgtgcccaa

SEQ ID NO: 486773 - DNA, 25 bp, Rattus norvegicus
gtatgtattttctccatgtgcccaa

SEQ ID NO: 486774 - DNA, 25 bp, Rattus norvegicus
gtatgtcaaacaccacgggcagtca

SEQ ID NO: 486775 - DNA, 25 bp, Rattus norvegicus
gtatgtcaaacagcacgggcagtca

SEQ ID NO: 486776 - DNA, 25 bp, Rattus norvegicus
gtatgtcaaggcattcccactataa

SEQ ID NO: 486777 - DNA, 25 bp, Rattus norvegicus
gtatgtcaaggctttcccactataa

SEQ ID NO: 486778 - DNA, 25 bp, Rattus norvegicus
gtatgtcaatagcacaagcctctaa

SEQ ID NO: 486779 - DNA, 25 bp, Rattus norvegicus
gtatgtcaataggacaagcctctaa

SEQ ID NO: 486780 - DNA, 25 bp, Rattus norvegicus
gtatgtcacctaatttttcttcaat

SEQ ID NO: 486781 - DNA, 25 bp, Rattus norvegicus
gtatgtcacctattttttcttcaat

SEQ ID NO: 486782 - DNA, 25 bp, Rattus norvegicus
gtatgtcactggcttatattgttag

SEQ ID NO: 486783 - DNA, 25 bp, Rattus norvegicus
gtatgtcactgggttatattgttag

SEQ ID NO: 486784 - DNA, 25 bp, Rattus norvegicus
gtatgtcagaatctgatgccacttt

SEQ ID NO: 486785 - DNA, 25 bp, Rattus norvegicus
gtatgtcagaatgtgatgccacttt

SEQ ID NO: 486786 - DNA, 25 bp, Rattus norvegicus
gtatgtcagacaccattcttttcta

SEQ ID NO: 486787 - DNA, 25 bp, Rattus norvegicus
gtatgtcagacagcattcttttcta

SEQ ID NO: 486788 - DNA, 25 bp, Rattus norvegicus
gtatgtcagctgacgccatgctgaa

SEQ ID NO: 486789 - DNA, 25 bp, Rattus norvegicus
gtatgtcagctgtcgccatgctgaa

SEQ ID NO: 486790 - DNA, 25 bp, Rattus norvegicus
gtatgtcagggacgcatcactccac

SEQ ID NO: 486791 - DNA, 25 bp, Rattus norvegicus
gtatgtcagggaggcatcactccac

SEQ ID NO: 486792 - DNA, 25 bp, Rattus norvegicus
gtatgtcaggttagctcagtgtaat

SEQ ID NO: 486793 - DNA, 25 bp, Rattus norvegicus
gtatgtcaggtttgctcagtgtaat

SEQ ID NO: 486794 - DNA, 25 bp, Rattus norvegicus
gtatgtcagttgaactaccctagtt

SEQ ID NO: 486795 - DNA, 25 bp, Rattus norvegicus
gtatgtcagttgtactaccctagtt

SEQ ID NO: 486796 - DNA, 25 bp, Rattus norvegicus
gtatgtcagtttacattgtcccagg

SEQ ID NO: 486797 - DNA, 25 bp, Rattus norvegicus
gtatgtcagttttcattgtcccagg

SEQ ID NO: 486798 - DNA, 25 bp, Rattus norvegicus
gtatgtcatcctagtgtaactgcct

SEQ ID NO: 486799 - DNA, 25 bp, Rattus norvegicus
gtatgtcatccttgtgtaactgcct

SEQ ID NO: 486800 - DNA, 25 bp, Rattus norvegicus
gtatgtcatggacctgtctgtacct

SEQ ID NO: 486801 - DNA, 25 bp, Rattus norvegicus
gtatgtcatggagctgtctgtacct

SEQ ID NO: 486802 - DNA, 25 bp, Rattus norvegicus
gtatgtcattccctggcttgaagta

SEQ ID NO: 486803 - DNA, 25 bp, Rattus norvegicus
gtatgtcattccgtggcttgaagta

SEQ ID NO: 486804 - DNA, 25 bp, Rattus norvegicus
gtatgtcattgtctacgacctttga

SEQ ID NO: 486805 - DNA, 25 bp, Rattus norvegicus
gtatgtcattgtgtacgacctttga

SEQ ID NO: 486806 - DNA, 25 bp, Rattus norvegicus
gtatgtccaatacatgagtctttct

SEQ ID NO: 486807 - DNA, 25 bp, Rattus norvegicus
gtatgtccaatagatgagtctttct

SEQ ID NO: 486808 - DNA, 25 bp, Rattus norvegicus
gtatgtccaggcatcaagtaacttg

SEQ ID NO: 486809 - DNA, 25 bp, Rattus norvegicus
gtatgtccaggcttcaagtaacttg

SEQ ID NO: 486810 - DNA, 25 bp, Rattus norvegicus
gtatgtccatggcagcgtgtgtctc

SEQ ID NO: 486811 - DNA, 25 bp, Rattus norvegicus
gtatgtccatgggagcgtgtgtctc

SEQ ID NO: 486812 - DNA, 25 bp, Rattus norvegicus
gtatgtcccagcacatgtagaccag

SEQ ID NO: 486813 - DNA, 25 bp, Rattus norvegicus
gtatgtcccagctcatgtagaccag

SEQ ID NO: 486814 - DNA, 25 bp, Rattus norvegicus
gtatgtccctatcaaatgctgtaca

SEQ ID NO: 486815 - DNA, 25 bp, Rattus norvegicus
gtatgtccctatgaaatgctgtaca

SEQ ID NO: 486816 - DNA, 25 bp, Rattus norvegicus
gtatgtcctatgcagtttcatcctc

SEQ ID NO: 486817 - DNA, 25 bp, Rattus norvegicus
gtatgtcctatggagtttcatcctc

SEQ ID NO: 486818 - DNA, 25 bp, Rattus norvegicus
gtatgtcctggtacttcaatttgaa

SEQ ID NO: 486819 - DNA, 25 bp, Rattus norvegicus
gtatgtcctggttcttcaatttgaa

SEQ ID NO: 486820 - DNA, 25 bp, Rattus norvegicus
gtatgtcctttgaagcaggctcagg

SEQ ID NO: 486821 - DNA, 25 bp, Rattus norvegicus
gtatgtcctttgtagcaggctcagg

SEQ ID NO: 486822 - DNA, 25 bp, Rattus norvegicus
gtatgtcgactgaaatcactgttga

SEQ ID NO: 486823 - DNA, 25 bp, Rattus norvegicus
gtatgtcgactgtaatcactgttga

SEQ ID NO: 486824 - DNA, 25 bp, Rattus norvegicus
gtatgtcgcactcttgatttcaatg

SEQ ID NO: 486825 - DNA, 25 bp, Rattus norvegicus
gtatgtcgcactgttgatttcaatg

SEQ ID NO: 486826 - DNA, 25 bp, Rattus norvegicus
gtatgtcggactagatgtcctcttg

SEQ ID NO: 486827 - DNA, 25 bp, Rattus norvegicus
gtatgtcggacttgatgtcctcttg

SEQ ID NO: 486828 - DNA, 25 bp, Rattus norvegicus
gtatgtcgttccattgttctttaca

SEQ ID NO: 486829 - DNA, 25 bp, Rattus norvegicus
gtatgtcgttcctttgttctttaca

SEQ ID NO: 486830 - DNA, 25 bp, Rattus norvegicus
gtatgtctacaaagtcgccagggcc

SEQ ID NO: 486831 - DNA, 25 bp, Rattus norvegicus
gtatgtctacaatgtcgccagggcc

SEQ ID NO: 486832 - DNA, 25 bp, Rattus norvegicus
gtatgtctactgcactcagctcaac

SEQ ID NO: 486833 - DNA, 25 bp, Rattus norvegicus
gtatgtctactggactcagctcaac

SEQ ID NO: 486834 - DNA, 25 bp, Rattus norvegicus
gtatgtctatgtacctcttgcatgc

SEQ ID NO: 486835 - DNA, 25 bp, Rattus norvegicus
gtatgtctatgttcctcttgcatgc

SEQ ID NO: 486836 - DNA, 25 bp, Rattus norvegicus
gtatgtctatttcacctcttgcttc

SEQ ID NO: 486837 - DNA, 25 bp, Rattus norvegicus
gtatgtctatttgacctcttgcttc

SEQ ID NO: 486838 - DNA, 25 bp, Rattus norvegicus
gtatgtctcaacagtatgttgggac

SEQ ID NO: 486839 - DNA, 25 bp, Rattus norvegicus
gtatgtctcaactgtatgttgggac

SEQ ID NO: 486840 - DNA, 25 bp, Rattus norvegicus
gtatgtctcactagaaattgctttg

SEQ ID NO: 486841 - DNA, 25 bp, Rattus norvegicus
gtatgtctcacttgaaattgctttg

SEQ ID NO: 486842 - DNA, 25 bp, Rattus norvegicus
gtatgtctcataactagtaattggc

SEQ ID NO: 486843 - DNA, 25 bp, Rattus norvegicus
gtatgtctcatactgtttttcaaag

SEQ ID NO: 486844 - DNA, 25 bp, Rattus norvegicus
gtatgtctcatagtgtttttcaaag

SEQ ID NO: 486845 - DNA, 25 bp, Rattus norvegicus
gtatgtctcatatctagtaattggc

SEQ ID NO: 486846 - DNA, 25 bp, Rattus norvegicus
gtatgtctcattctatctcgtgtgc

SEQ ID NO: 486847 - DNA, 25 bp, Rattus norvegicus
gtatgtctcattgtatctcgtgtgc

SEQ ID NO: 486848 - DNA, 25 bp, Rattus norvegicus
gtatgtctctctacactgtggtgca

SEQ ID NO: 486849 - DNA, 25 bp, Rattus norvegicus
gtatgtctctcttcactgtggtgca

SEQ ID NO: 486850 - DNA, 25 bp, Rattus norvegicus
gtatgtctgaagactaccctgtatt

SEQ ID NO: 486851 - DNA, 25 bp, Rattus norvegicus
gtatgtctgaagtctaccctgtatt

SEQ ID NO: 486852 - DNA, 25 bp, Rattus norvegicus
gtatgtctgcttaagcctggttcaa

SEQ ID NO: 486853 - DNA, 25 bp, Rattus norvegicus
gtatgtctgctttagcctggttcaa

SEQ ID NO: 486854 - DNA, 25 bp, Rattus norvegicus
gtatgtctgttcatggctgactgaa

SEQ ID NO: 486855 - DNA, 25 bp, Rattus norvegicus
gtatgtctgttcttggctgactgaa

SEQ ID NO: 486856 - DNA, 25 bp, Rattus norvegicus
gtatgtctgttgaagctctgatttt

SEQ ID NO: 486857 - DNA, 25 bp, Rattus norvegicus
gtatgtctgttgtagctctgatttt

SEQ ID NO: 486858 - DNA, 25 bp, Rattus norvegicus
gtatgtcttctaaaacgtggatgtt

SEQ ID NO: 486859 - DNA, 25 bp, Rattus norvegicus
gtatgtcttctataacgtggatgtt

SEQ ID NO: 486860 - DNA, 25 bp, Rattus norvegicus
gtatgtcttctgctttgtgttcttt

SEQ ID NO: 486861 - DNA, 25 bp, Rattus norvegicus
gtatgtcttctggtttgtgttcttt

SEQ ID NO: 486862 - DNA, 25 bp, Rattus norvegicus
gtatgtcttgatatgctgcctgtat

SEQ ID NO: 486863 - DNA, 25 bp, Rattus norvegicus
gtatgtcttgatttgctgcctgtat

SEQ ID NO: 486864 - DNA, 25 bp, Rattus norvegicus
gtatgtcttgctaatttactctgag

SEQ ID NO: 486865 - DNA, 25 bp, Rattus norvegicus
gtatgtcttgcttatttactctgag

SEQ ID NO: 486866 - DNA, 25 bp, Rattus norvegicus
gtatgtgaacacctatggccggatc

SEQ ID NO: 486867 - DNA, 25 bp, Rattus norvegicus
gtatgtgaacacctctctaagagac

SEQ ID NO: 486868 - DNA, 25 bp, Rattus norvegicus
gtatgtgaacacgtatggccggatc

SEQ ID NO: 486869 - DNA, 25 bp, Rattus norvegicus
gtatgtgaacacgtctctaagagac

SEQ ID NO: 486870 - DNA, 25 bp, Rattus norvegicus
gtatgtgaagtgctaggctagtatt

SEQ ID NO: 486871 - DNA, 25 bp, Rattus norvegicus
gtatgtgaagtggtaggctagtatt

SEQ ID NO: 486872 - DNA, 25 bp, Rattus norvegicus
gtatgtgacaacctttacctgacta

SEQ ID NO: 486873 - DNA, 25 bp, Rattus norvegicus
gtatgtgacaacgtttacctgacta

SEQ ID NO: 486874 - DNA, 25 bp, Rattus norvegicus
gtatgtgacaccagaaccctgattt

SEQ ID NO: 486875 - DNA, 25 bp, Rattus norvegicus
gtatgtgacacctgaaccctgattt

SEQ ID NO: 486876 - DNA, 25 bp, Rattus norvegicus
gtatgtgaccatactagtagccttg

SEQ ID NO: 486877 - DNA, 25 bp, Rattus norvegicus
gtatgtgaccattctagtagccttg

SEQ ID NO: 486878 - DNA, 25 bp, Rattus norvegicus
gtatgtgatctaaagttgctctgtg

SEQ ID NO: 486879 - DNA, 25 bp, Rattus norvegicus
gtatgtgatctatagttgctctgtg

SEQ ID NO: 486880 - DNA, 25 bp, Rattus norvegicus
gtatgtgcaccaagtatatgctggt

SEQ ID NO: 486881 - DNA, 25 bp, Rattus norvegicus
gtatgtgcaccaatacattaattca

SEQ ID NO: 486882 - DNA, 25 bp, Rattus norvegicus
gtatgtgcaccatgtatatgctggt

SEQ ID NO: 486883 - DNA, 25 bp, Rattus norvegicus
gtatgtgcaccattacattaattca

SEQ ID NO: 486884 - DNA, 25 bp, Rattus norvegicus
gtatgtgcaggaactagtctgggat

SEQ ID NO: 486885 - DNA, 25 bp, Rattus norvegicus
gtatgtgcaggatctagtctgggat

SEQ ID NO: 486886 - DNA, 25 bp, Rattus norvegicus
gtatgtgcccctaagaataacaagt

SEQ ID NO: 486887 - DNA, 25 bp, Rattus norvegicus
gtatgtgccccttagaataacaagt

SEQ ID NO: 486888 - DNA, 25 bp, Rattus norvegicus
gtatgtgccctcagtgctggagaaa

SEQ ID NO: 486889 - DNA, 25 bp, Rattus norvegicus
gtatgtgccctctgtgctggagaaa

SEQ ID NO: 486890 - DNA, 25 bp, Rattus norvegicus
gtatgtgcctgaaaggtacccttaa

SEQ ID NO: 486891 - DNA, 25 bp, Rattus norvegicus
gtatgtgcctgataggtacccttaa

SEQ ID NO: 486892 - DNA, 25 bp, Rattus norvegicus
gtatgtgcctttctttcagctttct

SEQ ID NO: 486893 - DNA, 25 bp, Rattus norvegicus
gtatgtgcctttgtttcagctttct

SEQ ID NO: 486894 - DNA, 25 bp, Rattus norvegicus
gtatgtgctcccaaatctacttccg

SEQ ID NO: 486895 - DNA, 25 bp, Rattus norvegicus
gtatgtgctccctaatctacttccg

SEQ ID NO: 486896 - DNA, 25 bp, Rattus norvegicus
gtatgtgctgcaaagccttcaggcc

SEQ ID NO: 486897 - DNA, 25 bp, Rattus norvegicus
gtatgtgctgcaatccaggccaatg

SEQ ID NO: 486898 - DNA, 25 bp, Rattus norvegicus
gtatgtgctgcatagccttcaggcc

SEQ ID NO: 486899 - DNA, 25 bp, Rattus norvegicus
gtatgtgctgcattccaggccaatg

SEQ ID NO: 486900 - DNA, 25 bp, Rattus norvegicus
gtatgtgctgctatgattgtgtaaa

SEQ ID NO: 486901 - DNA, 25 bp, Rattus norvegicus
gtatgtgctgctttgattgtgtaaa

SEQ ID NO: 486902 - DNA, 25 bp, Rattus norvegicus
gtatgtgcttggaactgaacccaga

SEQ ID NO: 486903 - DNA, 25 bp, Rattus norvegicus
gtatgtgcttggtactgaacccaga

SEQ ID NO: 486904 - DNA, 25 bp, Rattus norvegicus
gtatgtgcttgtcctctttaagatt

SEQ ID NO: 486905 - DNA, 25 bp, Rattus norvegicus
gtatgtgcttgtgctctttaagatt

SEQ ID NO: 486906 - DNA, 25 bp, Rattus norvegicus
gtatgtggccagacagcatctgtca

SEQ ID NO: 486907 - DNA, 25 bp, Rattus norvegicus
gtatgtggccagtcagcatctgtca

SEQ ID NO: 486908 - DNA, 25 bp, Rattus norvegicus
gtatgtggcgatactgtgcctgcag

SEQ ID NO: 486909 - DNA, 25 bp, Rattus norvegicus
gtatgtggcgattctgtgcctgcag

SEQ ID NO: 486910 - DNA, 25 bp, Rattus norvegicus
gtatgtggcgttcaggcatttccca

SEQ ID NO: 486911 - DNA, 25 bp, Rattus norvegicus
gtatgtggcgttgaggcatttccca

SEQ ID NO: 486912 - DNA, 25 bp, Rattus norvegicus
gtatgtgtaaatatttgctgcagca

SEQ ID NO: 486913 - DNA, 25 bp, Rattus norvegicus
gtatgtgtaaatttttgctgcagca

SEQ ID NO: 486914 - DNA, 25 bp, Rattus norvegicus
gtatgtgtactgaatctgcttctcc

SEQ ID NO: 486915 - DNA, 25 bp, Rattus norvegicus
gtatgtgtactgctttctgttttgt

SEQ ID NO: 486916 - DNA, 25 bp, Rattus norvegicus
gtatgtgtactggtttctgttttgt

SEQ ID NO: 486917 - DNA, 25 bp, Rattus norvegicus
gtatgtgtactgtatctgcttctcc

SEQ ID NO: 486918 - DNA, 25 bp, Rattus norvegicus
gtatgtgtatttccttcctacttta

SEQ ID NO: 486919 - DNA, 25 bp, Rattus norvegicus
gtatgtgtatttgcttcctacttta

SEQ ID NO: 486920 - DNA, 25 bp, Rattus norvegicus
gtatgtgtcacaatctgctaagaaa

SEQ ID NO: 486921 - DNA, 25 bp, Rattus norvegicus
gtatgtgtcacattctgctaagaaa

SEQ ID NO: 486922 - DNA, 25 bp, Rattus norvegicus
gtatgtgtcccgctaccatgtaaag

SEQ ID NO: 486923 - DNA, 25 bp, Rattus norvegicus
gtatgtgtcccggtaccatgtaaag

SEQ ID NO: 486924 - DNA, 25 bp, Rattus norvegicus
gtatgtgtccttcttcatcttcaga

SEQ ID NO: 486925 - DNA, 25 bp, Rattus norvegicus
gtatgtgtccttgttcatcttcaga

SEQ ID NO: 486926 - DNA, 25 bp, Rattus norvegicus
gtatgtgtctacagagttttcgaaa

SEQ ID NO: 486927 - DNA, 25 bp, Rattus norvegicus
gtatgtgtctactgagttttcgaaa

SEQ ID NO: 486928 - DNA, 25 bp, Rattus norvegicus
gtatgtgtctatcagggtgtacctg

SEQ ID NO: 486929 - DNA, 25 bp, Rattus norvegicus
gtatgtgtctatgagggtgtacctg

SEQ ID NO: 486930 - DNA, 25 bp, Rattus norvegicus
gtatgtgtctgaactgctacctgtg

SEQ ID NO: 486931 - DNA, 25 bp, Rattus norvegicus
gtatgtgtctgatctgctacctgtg

SEQ ID NO: 486932 - DNA, 25 bp, Rattus norvegicus
gtatgtgtctgccattctaagtaca

SEQ ID NO: 486933 - DNA, 25 bp, Rattus norvegicus
gtatgtgtctgcgattctaagtaca

SEQ ID NO: 486934 - DNA, 25 bp, Rattus norvegicus
gtatgtgtcttaaatacccacccac

SEQ ID NO: 486935 - DNA, 25 bp, Rattus norvegicus
gtatgtgtcttatatacccacccac

SEQ ID NO: 486936 - DNA, 25 bp, Rattus norvegicus
gtatgtgtgaccaatgtcctcatgt

SEQ ID NO: 486937 - DNA, 25 bp, Rattus norvegicus
gtatgtgtgacctatgtcctcatgt

SEQ ID NO: 486938 - DNA, 25 bp, Rattus norvegicus
gtatgtgttgttcgacctgttattt

SEQ ID NO: 486939 - DNA, 25 bp, Rattus norvegicus
gtatgtgttgttggacctgttattt

SEQ ID NO: 486940 - DNA, 25 bp, Rattus norvegicus
gtatgtgtttcaagtgccttgtctt

SEQ ID NO: 486941 - DNA, 25 bp, Rattus norvegicus
gtatgtgtttcatgtgccttgtctt

SEQ ID NO: 486942 - DNA, 25 bp, Rattus norvegicus
gtatgtgtttccatttatctctatg

SEQ ID NO: 486943 - DNA, 25 bp, Rattus norvegicus
gtatgtgtttccttttatctctatg

SEQ ID NO: 486944 - DNA, 25 bp, Rattus norvegicus
gtatgtgttttgcagttcttggaat

SEQ ID NO: 486945 - DNA, 25 bp, Rattus norvegicus
gtatgtgttttggagttcttggaat

SEQ ID NO: 486946 - DNA, 25 bp, Rattus norvegicus
gtatgttaccatacagctgacatgt

SEQ ID NO: 486947 - DNA, 25 bp, Rattus norvegicus
gtatgttaccattcagctgacatgt

SEQ ID NO: 486948 - DNA, 25 bp, Rattus norvegicus
gtatgttaccgtccggatcaaacaa

SEQ ID NO: 486949 - DNA, 25 bp, Rattus norvegicus
gtatgttaccgtgcggatcaaacaa

SEQ ID NO: 486950 - DNA, 25 bp, Rattus norvegicus
gtatgttatcttatatatctcctga

SEQ ID NO: 486951 - DNA, 25 bp, Rattus norvegicus
gtatgttatcttttatatctcctga

SEQ ID NO: 486952 - DNA, 25 bp, Rattus norvegicus
gtatgttattaccaaaggcttaagg

SEQ ID NO: 486953 - DNA, 25 bp, Rattus norvegicus
gtatgttattacgaaaggcttaagg

SEQ ID NO: 486954 - DNA, 25 bp, Rattus norvegicus
gtatgttattctatggcttccctcc

SEQ ID NO: 486955 - DNA, 25 bp, Rattus norvegicus
gtatgttattctttggcttccctcc

SEQ ID NO: 486956 - DNA, 25 bp, Rattus norvegicus
gtatgttcaaacaggcctcggtgct

SEQ ID NO: 486957 - DNA, 25 bp, Rattus norvegicus
gtatgttcaaactggcctcggtgct

SEQ ID NO: 486958 - DNA, 25 bp, Rattus norvegicus
gtatgttcaattatccccgtggaat

SEQ ID NO: 486959 - DNA, 25 bp, Rattus norvegicus
gtatgttcaattttccccgtggaat

SEQ ID NO: 486960 - DNA, 25 bp, Rattus norvegicus
gtatgttcacatatgagcctagaga

SEQ ID NO: 486961 - DNA, 25 bp, Rattus norvegicus
gtatgttcacatttgagcctagaga

SEQ ID NO: 486962 - DNA, 25 bp, Rattus norvegicus
gtatgttcagatcgacgtaactcac

SEQ ID NO: 486963 - DNA, 25 bp, Rattus norvegicus
gtatgttcagatggacgtaactcac

SEQ ID NO: 486964 - DNA, 25 bp, Rattus norvegicus
gtatgttcaggtctaaacgctcggg

SEQ ID NO: 486965 - DNA, 25 bp, Rattus norvegicus
gtatgttcaggtgtaaacgctcggg

SEQ ID NO: 486966 - DNA, 25 bp, Rattus norvegicus
gtatgttcatacactgcagtcagct

SEQ ID NO: 486967 - DNA, 25 bp, Rattus norvegicus
gtatgttcatactctgcagtcagct

SEQ ID NO: 486968 - DNA, 25 bp, Rattus norvegicus
gtatgttccagacgtgtcaccagaa

SEQ ID NO: 486969 - DNA, 25 bp, Rattus norvegicus
gtatgttccagaggtgtcaccagaa

SEQ ID NO: 486970 - DNA, 25 bp, Rattus norvegicus
gtatgttctacacacgctctggcat

SEQ ID NO: 486971 - DNA, 25 bp, Rattus norvegicus
gtatgttctacagacgctctggcat

SEQ ID NO: 486972 - DNA, 25 bp, Rattus norvegicus
gtatgttctcagcagctgttaccag

SEQ ID NO: 486973 - DNA, 25 bp, Rattus norvegicus
gtatgttctcaggagctgttaccag

SEQ ID NO: 486974 - DNA, 25 bp, Rattus norvegicus
gtatgttctctgattttaactgtca

SEQ ID NO: 486975 - DNA, 25 bp, Rattus norvegicus
gtatgttctctgtttttaactgtca

SEQ ID NO: 486976 - DNA, 25 bp, Rattus norvegicus
gtatgttgaatacctggcctgggaa

SEQ ID NO: 486977 - DNA, 25 bp, Rattus norvegicus
gtatgttgaatagctggcctgggaa

SEQ ID NO: 486978 - DNA, 25 bp, Rattus norvegicus
gtatgttgcagtattgggtcctatt

SEQ ID NO: 486979 - DNA, 25 bp, Rattus norvegicus
gtatgttgcagttttgggtcctatt

SEQ ID NO: 486980 - DNA, 25 bp, Rattus norvegicus
gtatgttgctttcctcacagagtat

SEQ ID NO: 486981 - DNA, 25 bp, Rattus norvegicus
gtatgttgctttgctcacagagtat

SEQ ID NO: 486982 - DNA, 25 bp, Rattus norvegicus
gtatgttggctactgcatagacaaa

SEQ ID NO: 486983 - DNA, 25 bp, Rattus norvegicus
gtatgttggctagtgcatagacaaa

SEQ ID NO: 486984 - DNA, 25 bp, Rattus norvegicus
gtatgttgtcaacttccaggctgcc

SEQ ID NO: 486985 - DNA, 25 bp, Rattus norvegicus
gtatgttgtcaagttccaggctgcc

SEQ ID NO: 486986 - DNA, 25 bp, Rattus norvegicus
gtatgttgtcatctgcagtgtaaat

SEQ ID NO: 486987 - DNA, 25 bp, Rattus norvegicus
gtatgttgtcatgtgcagtgtaaat

SEQ ID NO: 486988 - DNA, 25 bp, Rattus norvegicus
gtatgttgttctcatttaattcccc

SEQ ID NO: 486989 - DNA, 25 bp, Rattus norvegicus
gtatgttgttctgatttaattcccc

SEQ ID NO: 486990 - DNA, 25 bp, Rattus norvegicus
gtatgtttattcctcaagcgggcga

SEQ ID NO: 486991 - DNA, 25 bp, Rattus norvegicus
gtatgtttattcgtcaagcgggcga

SEQ ID NO: 486992 - DNA, 25 bp, Rattus norvegicus
gtatgtttctctcgcttatactgag

SEQ ID NO: 486993 - DNA, 25 bp, Rattus norvegicus
gtatgtttctctggcttatactgag

SEQ ID NO: 486994 - DNA, 25 bp, Rattus norvegicus
gtatgtttcttaaacaatgtttcag

SEQ ID NO: 486995 - DNA, 25 bp, Rattus norvegicus
gtatgtttcttacctgtgtatacag

SEQ ID NO: 486996 - DNA, 25 bp, Rattus norvegicus
gtatgtttcttagctgtgtatacag

SEQ ID NO: 486997 - DNA, 25 bp, Rattus norvegicus
gtatgtttcttatacaatgtttcag

SEQ ID NO: 486998 - DNA, 25 bp, Rattus norvegicus
gtatgtttctttatcttatctggtt

SEQ ID NO: 486999 - DNA, 25 bp, Rattus norvegicus
gtatgtttctttttcttatctggtt

SEQ ID NO: 487000 - DNA, 25 bp, Rattus norvegicus
gtatgtttgaaaaccttgtggcctg

SEQ ID NO: 487001 - DNA, 25 bp, Rattus norvegicus
gtatgtttgaaatccttgtggcctg

SEQ ID NO: 487002 - DNA, 25 bp, Rattus norvegicus
gtatgtttgcatcactactgtagtt

SEQ ID NO: 487003 - DNA, 25 bp, Rattus norvegicus
gtatgtttgcatgactactgtagtt

SEQ ID NO: 487004 - DNA, 25 bp, Rattus norvegicus
gtatgtttgcccagagtaacctgat

SEQ ID NO: 487005 - DNA, 25 bp, Rattus norvegicus
gtatgtttgccctgagtaacctgat

SEQ ID NO: 487006 - DNA, 25 bp, Rattus norvegicus
gtatgtttggccacgagtatagtca

SEQ ID NO: 487007 - DNA, 25 bp, Rattus norvegicus
gtatgtttggcctcgagtatagtca

SEQ ID NO: 487008 - DNA, 25 bp, Rattus norvegicus
gtatgtttgtaaccagcattgtgat

SEQ ID NO: 487009 - DNA, 25 bp, Rattus norvegicus
gtatgtttgtaagcagcattgtgat

SEQ ID NO: 487010 - DNA, 25 bp, Rattus norvegicus
gtatgtttgtttcgtcagtgttttc

SEQ ID NO: 487011 - DNA, 25 bp, Rattus norvegicus
gtatgtttgtttggtcagtgttttc

SEQ ID NO: 487012 - DNA, 25 bp, Rattus norvegicus
gtatgttttatgaactccttagaaa

SEQ ID NO: 487013 - DNA, 25 bp, Rattus norvegicus
gtatgttttatgtactccttagaaa

SEQ ID NO: 487014 - DNA, 25 bp, Rattus norvegicus
gtatgttttgtcagctttcatcagc

SEQ ID NO: 487015 - DNA, 25 bp, Rattus norvegicus
gtatgttttgtctgctttcatcagc

SEQ ID NO: 487016 - DNA, 25 bp, Rattus norvegicus
gtattaaacactcgtccaactattt

SEQ ID NO: 487017 - DNA, 25 bp, Rattus norvegicus
gtattaaacactggtccaactattt

SEQ ID NO: 487018 - DNA, 25 bp, Rattus norvegicus
gtattaaacccaactccttacttga

SEQ ID NO: 487019 - DNA, 25 bp, Rattus norvegicus
gtattaaacccatctccttacttga

SEQ ID NO: 487020 - DNA, 25 bp, Rattus norvegicus
gtattaaagctgaatccttatgtat

SEQ ID NO: 487021 - DNA, 25 bp, Rattus norvegicus
gtattaaagctgtatccttatgtat

SEQ ID NO: 487022 - DNA, 25 bp, Rattus norvegicus
gtattaaataccattggccgccgct

SEQ ID NO: 487023 - DNA, 25 bp, Rattus norvegicus
gtattaaatacctttggccgccgct

SEQ ID NO: 487024 - DNA, 25 bp, Rattus norvegicus
gtattaacacggaggcctgcctggc

SEQ ID NO: 487025 - DNA, 25 bp, Rattus norvegicus
gtattaacacggtggcctgcctggc

SEQ ID NO: 487026 - DNA, 25 bp, Rattus norvegicus
gtattaacatccatttcacccgtag

SEQ ID NO: 487027 - DNA, 25 bp, Rattus norvegicus
gtattaacatccttttcacccgtag

SEQ ID NO: 487028 - DNA, 25 bp, Rattus norvegicus
gtattaaccattactcaaccagtcc

SEQ ID NO: 487029 - DNA, 25 bp, Rattus norvegicus
gtattaaccatttctcaaccagtcc

SEQ ID NO: 487030 - DNA, 25 bp, Rattus norvegicus
gtattaaccttactgagcagcctca

SEQ ID NO: 487031 - DNA, 25 bp, Rattus norvegicus
gtattaaccttagtgagcagcctca

SEQ ID NO: 487032 - DNA, 25 bp, Rattus norvegicus
gtattaacgttgcaatgtacttcaa

SEQ ID NO: 487033 - DNA, 25 bp, Rattus norvegicus
gtattaacgttggaatgtacttcaa

SEQ ID NO: 487034 - DNA, 25 bp, Rattus norvegicus
gtattaactctcagaatgtcacttt

SEQ ID NO: 487035 - DNA, 25 bp, Rattus norvegicus
gtattaactctctgaatgtcacttt

SEQ ID NO: 487036 - DNA, 25 bp, Rattus norvegicus
gtattaactgctccttttcttctta

SEQ ID NO: 487037 - DNA, 25 bp, Rattus norvegicus
gtattaactgctgcttttcttctta

SEQ ID NO: 487038 - DNA, 25 bp, Rattus norvegicus
gtattaacttctcgagcaagacctt

SEQ ID NO: 487039 - DNA, 25 bp, Rattus norvegicus
gtattaacttctggagcaagacctt

SEQ ID NO: 487040 - DNA, 25 bp, Rattus norvegicus
gtattaacttttactgcttctctgc

SEQ ID NO: 487041 - DNA, 25 bp, Rattus norvegicus
gtattaactttttctgcttctctgc

SEQ ID NO: 487042 - DNA, 25 bp, Rattus norvegicus
gtattaagactcaagcggctcacgt

SEQ ID NO: 487043 - DNA, 25 bp, Rattus norvegicus
gtattaagactctagcggctcacgt

SEQ ID NO: 487044 - DNA, 25 bp, Rattus norvegicus
gtattaagctcactcaaagtctcag

SEQ ID NO: 487045 - DNA, 25 bp, Rattus norvegicus
gtattaagctcagtcaaagtctcag

SEQ ID NO: 487046 - DNA, 25 bp, Rattus norvegicus
gtattaaggtttacagctcctgtag

SEQ ID NO: 487047 - DNA, 25 bp, Rattus norvegicus
gtattaaggttttcagctcctgtag

SEQ ID NO: 487048 - DNA, 25 bp, Rattus norvegicus
gtattaagtcagcattgtgtggtct

SEQ ID NO: 487049 - DNA, 25 bp, Rattus norvegicus
gtattaagtcaggattgtgtggtct

SEQ ID NO: 487050 - DNA, 25 bp, Rattus norvegicus
gtattaataaggacaaagcttttgg

SEQ ID NO: 487051 - DNA, 25 bp, Rattus norvegicus
gtattaataaggtcaaagcttttgg

SEQ ID NO: 487052 - DNA, 25 bp, Rattus norvegicus
gtattaatcagtagctgttgctttt

SEQ ID NO: 487053 - DNA, 25 bp, Rattus norvegicus
gtattaatcagttgctgttgctttt

SEQ ID NO: 487054 - DNA, 25 bp, Rattus norvegicus
gtattaatccctatgtcgcttacca

SEQ ID NO: 487055 - DNA, 25 bp, Rattus norvegicus
gtattaatccctttgtcgcttacca

SEQ ID NO: 487056 - DNA, 25 bp, Rattus norvegicus
gtattacaagctataagtcctccta

SEQ ID NO: 487057 - DNA, 25 bp, Rattus norvegicus
gtattacaagctttaagtcctccta

SEQ ID NO: 487058 - DNA, 25 bp, Rattus norvegicus
gtattacaagggagtaccaccacca

SEQ ID NO: 487059 - DNA, 25 bp, Rattus norvegicus
gtattacaagggtgtaccaccacca

SEQ ID NO: 487060 - DNA, 25 bp, Rattus norvegicus
gtattacaccttatgcagacacatc

SEQ ID NO: 487061 - DNA, 25 bp, Rattus norvegicus
gtattacaccttttgcagacacatc

SEQ ID NO: 487062 - DNA, 25 bp, Rattus norvegicus
gtattacactctcaaccttaccaat

SEQ ID NO: 487063 - DNA, 25 bp, Rattus norvegicus
gtattacactctgaaccttaccaat

SEQ ID NO: 487064 - DNA, 25 bp, Rattus norvegicus
gtattacagagccaacaccctgtct

SEQ ID NO: 487065 - DNA, 25 bp, Rattus norvegicus
gtattacagagcgaacaccctgtct

SEQ ID NO: 487066 - DNA, 25 bp, Rattus norvegicus
gtattacagatgaacccaccctatg

SEQ ID NO: 487067 - DNA, 25 bp, Rattus norvegicus
gtattacagatgtacccaccctatg

SEQ ID NO: 487068 - DNA, 25 bp, Rattus norvegicus
gtattacattaccaaaagtgcctct

SEQ ID NO: 487069 - DNA, 25 bp, Rattus norvegicus
gtattacattacgaaaagtgcctct

SEQ ID NO: 487070 - DNA, 25 bp, Rattus norvegicus
gtattaccagcaatagtgagtttaa

SEQ ID NO: 487071 - DNA, 25 bp, Rattus norvegicus
gtattaccagcattagtgagtttaa

SEQ ID NO: 487072 - DNA, 25 bp, Rattus norvegicus
gtattaccatgtctcctcttaggaa

SEQ ID NO: 487073 - DNA, 25 bp, Rattus norvegicus
gtattaccatgtgtcctcttaggaa

SEQ ID NO: 487074 - DNA, 25 bp, Rattus norvegicus
gtattaccatttaactgagtctcag

SEQ ID NO: 487075 - DNA, 25 bp, Rattus norvegicus
gtattaccattttactgagtctcag

SEQ ID NO: 487076 - DNA, 25 bp, Rattus norvegicus
gtattacccctgcacgataggaatt

SEQ ID NO: 487077 - DNA, 25 bp, Rattus norvegicus
gtattacccctggacgataggaatt

SEQ ID NO: 487078 - DNA, 25 bp, Rattus norvegicus
gtattaccctacagaagacgtgcct

SEQ ID NO: 487079 - DNA, 25 bp, Rattus norvegicus
gtattaccctactgaagacgtgcct

SEQ ID NO: 487080 - DNA, 25 bp, Rattus norvegicus
gtattaccgggacctggacgctatg

SEQ ID NO: 487081 - DNA, 25 bp, Rattus norvegicus
gtattaccgggagctggacgctatg

SEQ ID NO: 487082 - DNA, 25 bp, Rattus norvegicus
gtattacgtcttacctatgccaagc

SEQ ID NO: 487083 - DNA, 25 bp, Rattus norvegicus
gtattacgtctttcctatgccaagc

SEQ ID NO: 487084 - DNA, 25 bp, Rattus norvegicus
gtattactatagactgaaggcattt

SEQ ID NO: 487085 - DNA, 25 bp, Rattus norvegicus
gtattactatagtctgaaggcattt

SEQ ID NO: 487086 - DNA, 25 bp, Rattus norvegicus
gtattactcagactcacccaagcct

SEQ ID NO: 487087 - DNA, 25 bp, Rattus norvegicus
gtattactcagagtcacccaagcct

SEQ ID NO: 487088 - DNA, 25 bp, Rattus norvegicus
gtattactcatacctgatgtccagg

SEQ ID NO: 487089 - DNA, 25 bp, Rattus norvegicus
gtattactcatagctgatgtccagg

SEQ ID NO: 487090 - DNA, 25 bp, Rattus norvegicus
gtattactccaactgattttccctg

SEQ ID NO: 487091 - DNA, 25 bp, Rattus norvegicus
gtattactccaagtgattttccctg

SEQ ID NO: 487092 - DNA, 25 bp, Rattus norvegicus
gtattactccatattaatcctctaa

SEQ ID NO: 487093 - DNA, 25 bp, Rattus norvegicus
gtattactccattttaatcctctaa

SEQ ID NO: 487094 - DNA, 25 bp, Rattus norvegicus
gtattactctgcaacacttagcctt

SEQ ID NO: 487095 - DNA, 25 bp, Rattus norvegicus
gtattactctgctacacttagcctt

SEQ ID NO: 487096 - DNA, 25 bp, Rattus norvegicus
gtattactgcttcaacgactctctg

SEQ ID NO: 487097 - DNA, 25 bp, Rattus norvegicus
gtattactgcttgaacgactctctg

SEQ ID NO: 487098 - DNA, 25 bp, Rattus norvegicus
gtattactgtggcagcctttccatc

SEQ ID NO: 487099 - DNA, 25 bp, Rattus norvegicus
gtattactgtgggagcctttccatc

SEQ ID NO: 487100 - DNA, 25 bp, Rattus norvegicus
gtattactgtttcatggctgaacca

SEQ ID NO: 487101 - DNA, 25 bp, Rattus norvegicus
gtattactgtttgatggctgaacca

SEQ ID NO: 487102 - DNA, 25 bp, Rattus norvegicus
gtattacttgatccctctttacaga

SEQ ID NO: 487103 - DNA, 25 bp, Rattus norvegicus
gtattacttgatgcctctttacaga

SEQ ID NO: 487104 - DNA, 25 bp, Rattus norvegicus
gtattacttggcaccaggattcagc

SEQ ID NO: 487105 - DNA, 25 bp, Rattus norvegicus
gtattacttggctccaggattcagc

SEQ ID NO: 487106 - DNA, 25 bp, Rattus norvegicus
gtattacttgtaacgcaattcaggg

SEQ ID NO: 487107 - DNA, 25 bp, Rattus norvegicus
gtattacttgtatcgcaattcaggg

SEQ ID NO: 487108 - DNA, 25 bp, Rattus norvegicus
gtattagaaaagacctctctgtgtg

SEQ ID NO: 487109 - DNA, 25 bp, Rattus norvegicus
gtattagaaaagtcctctctgtgtg

SEQ ID NO: 487110 - DNA, 25 bp, Rattus norvegicus
gtattagaccatagttcccaaccat

SEQ ID NO: 487111 - DNA, 25 bp, Rattus norvegicus
gtattagaccattgttcccaaccat

SEQ ID NO: 487112 - DNA, 25 bp, Rattus norvegicus
gtattagagcttcaggtccagcttc

SEQ ID NO: 487113 - DNA, 25 bp, Rattus norvegicus
gtattagagcttgaggtccagcttc

SEQ ID NO: 487114 - DNA, 25 bp, Rattus norvegicus
gtattagaggttaagggcccctgat

SEQ ID NO: 487115 - DNA, 25 bp, Rattus norvegicus
gtattagaggtttagggcccctgat

SEQ ID NO: 487116 - DNA, 25 bp, Rattus norvegicus
gtattagatatgacaccacaccctg

SEQ ID NO: 487117 - DNA, 25 bp, Rattus norvegicus
gtattagatatgtcaccacaccctg

SEQ ID NO: 487118 - DNA, 25 bp, Rattus norvegicus
gtattagcaggtcgaagcatcttct

SEQ ID NO: 487119 - DNA, 25 bp, Rattus norvegicus
gtattagcaggtggaagcatcttct

SEQ ID NO: 487120 - DNA, 25 bp, Rattus norvegicus
gtattagcctttactttagctctgt

SEQ ID NO: 487121 - DNA, 25 bp, Rattus norvegicus
gtattagccttttctttagctctgt

SEQ ID NO: 487122 - DNA, 25 bp, Rattus norvegicus
gtattagctaacacctaactgagat

SEQ ID NO: 487123 - DNA, 25 bp, Rattus norvegicus
gtattagctaactcctaactgagat

SEQ ID NO: 487124 - DNA, 25 bp, Rattus norvegicus
gtattagctgccaatttcagacact

SEQ ID NO: 487125 - DNA, 25 bp, Rattus norvegicus
gtattagctgcctatttcagacact

SEQ ID NO: 487126 - DNA, 25 bp, Rattus norvegicus
gtattagctttacttcacatgtgag

SEQ ID NO: 487127 - DNA, 25 bp, Rattus norvegicus
gtattagctttagttcacatgtgag

SEQ ID NO: 487128 - DNA, 25 bp, Rattus norvegicus
gtattagctttcagacattttcttg

SEQ ID NO: 487129 - DNA, 25 bp, Rattus norvegicus
gtattagctttctgacattttcttg

SEQ ID NO: 487130 - DNA, 25 bp, Rattus norvegicus
gtattagggttcacactttggacac

SEQ ID NO: 487131 - DNA, 25 bp, Rattus norvegicus
gtattagggttctcactttggacac

SEQ ID NO: 487132 - DNA, 25 bp, Rattus norvegicus
gtattaggtgtgattcacttcgaag

SEQ ID NO: 487133 - DNA, 25 bp, Rattus norvegicus
gtattaggtgtgtttcacttcgaag

SEQ ID NO: 487134 - DNA, 25 bp, Rattus norvegicus
gtattagtcactactgacagccata

SEQ ID NO: 487135 - DNA, 25 bp, Rattus norvegicus
gtattagtcacttctgacagccata

SEQ ID NO: 487136 - DNA, 25 bp, Rattus norvegicus
gtattagtgtgtctgccaagctgga

SEQ ID NO: 487137 - DNA, 25 bp, Rattus norvegicus
gtattagtgtgtgtgccaagctgga

SEQ ID NO: 487138 - DNA, 25 bp, Rattus norvegicus
gtattagtgtttctgttgacgcttt

SEQ ID NO: 487139 - DNA, 25 bp, Rattus norvegicus
gtattagtgtttgtgttgacgcttt

SEQ ID NO: 487140 - DNA, 25 bp, Rattus norvegicus
gtattataaacaccggagccacttt

SEQ ID NO: 487141 - DNA, 25 bp, Rattus norvegicus
gtattataaacagcggagccacttt

SEQ ID NO: 487142 - DNA, 25 bp, Rattus norvegicus
gtattataaccgaagccttccagtt

SEQ ID NO: 487143 - DNA, 25 bp, Rattus norvegicus
gtattataaccgtagccttccagtt

SEQ ID NO: 487144 - DNA, 25 bp, Rattus norvegicus
gtattataccagcttggccgggact

SEQ ID NO: 487145 - DNA, 25 bp, Rattus norvegicus
gtattataccaggttggccgggact

SEQ ID NO: 487146 - DNA, 25 bp, Rattus norvegicus
gtattatatatacatgctgctaggt

SEQ ID NO: 487147 - DNA, 25 bp, Rattus norvegicus
gtattatatatagatgctgctaggt

SEQ ID NO: 487148 - DNA, 25 bp, Rattus norvegicus
gtattatccttaccagttctttccg

SEQ ID NO: 487149 - DNA, 25 bp, Rattus norvegicus
gtattatccttagcagttctttccg

SEQ ID NO: 487150 - DNA, 25 bp, Rattus norvegicus
gtattatctcttacttcttgtggtg

SEQ ID NO: 487151 - DNA, 25 bp, Rattus norvegicus
gtattatctcttagtctagcgatgt

SEQ ID NO: 487152 - DNA, 25 bp, Rattus norvegicus
gtattatctctttcttcttgtggtg

SEQ ID NO: 487153 - DNA, 25 bp, Rattus norvegicus
gtattatctctttgtctagcgatgt

SEQ ID NO: 487154 - DNA, 25 bp, Rattus norvegicus
gtattatcttctcaccccatttaaa

SEQ ID NO: 487155 - DNA, 25 bp, Rattus norvegicus
gtattatcttctgaccccatttaaa

SEQ ID NO: 487156 - DNA, 25 bp, Rattus norvegicus
gtattatgcattcttgtcaatttga

SEQ ID NO: 487157 - DNA, 25 bp, Rattus norvegicus
gtattatgcattgttgtcaatttga

SEQ ID NO: 487158 - DNA, 25 bp, Rattus norvegicus
gtattatgtaccatttcctggtcca

SEQ ID NO: 487159 - DNA, 25 bp, Rattus norvegicus
gtattatgtaccttttcctggtcca

SEQ ID NO: 487160 - DNA, 25 bp, Rattus norvegicus
gtattatgtagtcggcagtttatat

SEQ ID NO: 487161 - DNA, 25 bp, Rattus norvegicus
gtattatgtagtgggcagtttatat

SEQ ID NO: 487162 - DNA, 25 bp, Rattus norvegicus
gtattatgtctgatctcaagattcg

SEQ ID NO: 487163 - DNA, 25 bp, Rattus norvegicus
gtattatgtctgttctcaagattcg

SEQ ID NO: 487164 - DNA, 25 bp, Rattus norvegicus
gtattatgttgccatcatagtgtat

SEQ ID NO: 487165 - DNA, 25 bp, Rattus norvegicus
gtattatgttgcgatcatagtgtat

SEQ ID NO: 487166 - DNA, 25 bp, Rattus norvegicus
gtattatgttgtactcagacacctt

SEQ ID NO: 487167 - DNA, 25 bp, Rattus norvegicus
gtattatgttgttctcagacacctt

SEQ ID NO: 487168 - DNA, 25 bp, Rattus norvegicus
gtattattaaagctccatgccaaca

SEQ ID NO: 487169 - DNA, 25 bp, Rattus norvegicus
gtattattaaaggtccatgccaaca

SEQ ID NO: 487170 - DNA, 25 bp, Rattus norvegicus
gtattattaatcaacaggcatcatt

SEQ ID NO: 487171 - DNA, 25 bp, Rattus norvegicus
gtattattaatctacaggcatcatt

SEQ ID NO: 487172 - DNA, 25 bp, Rattus norvegicus
gtattattcaggaatagtggtccat

SEQ ID NO: 487173 - DNA, 25 bp, Rattus norvegicus
gtattattcaggtatagtggtccat

SEQ ID NO: 487174 - DNA, 25 bp, Rattus norvegicus
gtattattctttctgatattgccca

SEQ ID NO: 487175 - DNA, 25 bp, Rattus norvegicus
gtattattctttgtgatattgccca

SEQ ID NO: 487176 - DNA, 25 bp, Rattus norvegicus
gtattattgttgattcagactttaa

SEQ ID NO: 487177 - DNA, 25 bp, Rattus norvegicus
gtattattgttgtttcagactttaa

SEQ ID NO: 487178 - DNA, 25 bp, Rattus norvegicus
gtattattgtttctccagatgctgg

SEQ ID NO: 487179 - DNA, 25 bp, Rattus norvegicus
gtattattgtttgtccagatgctgg

SEQ ID NO: 487180 - DNA, 25 bp, Rattus norvegicus
gtattattttccctgatgccttatg

SEQ ID NO: 487181 - DNA, 25 bp, Rattus norvegicus
gtattattttccgtgatgccttatg

SEQ ID NO: 487182 - DNA, 25 bp, Rattus norvegicus
gtattatttttcactgtcccactta

SEQ ID NO: 487183 - DNA, 25 bp, Rattus norvegicus
gtattatttttctctgtcccactta

SEQ ID NO: 487184 - DNA, 25 bp, Rattus norvegicus
gtattcaaaaggacatttccacatc

SEQ ID NO: 487185 - DNA, 25 bp, Rattus norvegicus
gtattcaaaaggtcatttccacatc

SEQ ID NO: 487186 - DNA, 25 bp, Rattus norvegicus
gtattcaacaccagtagctttttct

SEQ ID NO: 487187 - DNA, 25 bp, Rattus norvegicus
gtattcaacacctgtagctttttct

SEQ ID NO: 487188 - DNA, 25 bp, Rattus norvegicus
gtattcaaccgtaagtgctaccacc

SEQ ID NO: 487189 - DNA, 25 bp, Rattus norvegicus
gtattcaaccgttagtgctaccacc

SEQ ID NO: 487190 - DNA, 25 bp, Rattus norvegicus
gtattcaaggacactccagggcata

SEQ ID NO: 487191 - DNA, 25 bp, Rattus norvegicus
gtattcaaggactctccagggcata

SEQ ID NO: 487192 - DNA, 25 bp, Rattus norvegicus
gtattcaaggttctcagctttgtga

SEQ ID NO: 487193 - DNA, 25 bp, Rattus norvegicus
gtattcaaggttgtcagctttgtga

SEQ ID NO: 487194 - DNA, 25 bp, Rattus norvegicus
gtattcaatagtacctggagggcag

SEQ ID NO: 487195 - DNA, 25 bp, Rattus norvegicus
gtattcaatagttcctggagggcag

SEQ ID NO: 487196 - DNA, 25 bp, Rattus norvegicus
gtattcaatcaactaggtacaactg

SEQ ID NO: 487197 - DNA, 25 bp, Rattus norvegicus
gtattcaatcaagtaggtacaactg

SEQ ID NO: 487198 - DNA, 25 bp, Rattus norvegicus
gtattcaatttcatgcacttatata

SEQ ID NO: 487199 - DNA, 25 bp, Rattus norvegicus
gtattcaatttcttgcacttatata

SEQ ID NO: 487200 - DNA, 25 bp, Rattus norvegicus
gtattcacaaagagatactccgagt

SEQ ID NO: 487201 - DNA, 25 bp, Rattus norvegicus
gtattcacaaagtgatactccgagt

SEQ ID NO: 487202 - DNA, 25 bp, Rattus norvegicus
gtattcacacatcacatcagcccgt

SEQ ID NO: 487203 - DNA, 25 bp, Rattus norvegicus
gtattcacacatgacatcagcccgt

SEQ ID NO: 487204 - DNA, 25 bp, Rattus norvegicus
gtattcacaccacggctgtgctaga

SEQ ID NO: 487205 - DNA, 25 bp, Rattus norvegicus
gtattcacaccagggctgtgctaga

SEQ ID NO: 487206 - DNA, 25 bp, Rattus norvegicus
gtattcacactcctcttcatggtta

SEQ ID NO: 487207 - DNA, 25 bp, Rattus norvegicus
gtattcacactcgtcttcatggtta

SEQ ID NO: 487208 - DNA, 25 bp, Rattus norvegicus
gtattcacataccatcaatgcatat

SEQ ID NO: 487209 - DNA, 25 bp, Rattus norvegicus
gtattcacatacgatcaatgcatat

SEQ ID NO: 487210 - DNA, 25 bp, Rattus norvegicus
gtattcacatctcctctcatgagat

SEQ ID NO: 487211 - DNA, 25 bp, Rattus norvegicus
gtattcacatctgctctcatgagat

SEQ ID NO: 487212 - DNA, 25 bp, Rattus norvegicus
gtattcacatggattcagcctgaca

SEQ ID NO: 487213 - DNA, 25 bp, Rattus norvegicus
gtattcacatggtttcagcctgaca

SEQ ID NO: 487214 - DNA, 25 bp, Rattus norvegicus
gtattcacccctagggagacttcag

SEQ ID NO: 487215 - DNA, 25 bp, Rattus norvegicus
gtattcaccccttgggagacttcag

SEQ ID NO: 487216 - DNA, 25 bp, Rattus norvegicus
gtattcacgctccacctttgaaaaa

SEQ ID NO: 487217 - DNA, 25 bp, Rattus norvegicus
gtattcacgctcgacctttgaaaaa

SEQ ID NO: 487218 - DNA, 25 bp, Rattus norvegicus
gtattcactcaaagatccagggctc

SEQ ID NO: 487219 - DNA, 25 bp, Rattus norvegicus
gtattcactcaatgatccagggctc

SEQ ID NO: 487220 - DNA, 25 bp, Rattus norvegicus
gtattcactcagaattgctgctcca

SEQ ID NO: 487221 - DNA, 25 bp, Rattus norvegicus
gtattcactcagtattgctgctcca

SEQ ID NO: 487222 - DNA, 25 bp, Rattus norvegicus
gtattcactccacaattactttgta

SEQ ID NO: 487223 - DNA, 25 bp, Rattus norvegicus
gtattcactccagaattactttgta

SEQ ID NO: 487224 - DNA, 25 bp, Rattus norvegicus
gtattcacttaaattctgtatctgg

SEQ ID NO: 487225 - DNA, 25 bp, Rattus norvegicus
gtattcacttaatttctgtatctgg

SEQ ID NO: 487226 - DNA, 25 bp, Rattus norvegicus
gtattcacttctctagtcaggccat

SEQ ID NO: 487227 - DNA, 25 bp, Rattus norvegicus
gtattcacttctgtagtcaggccat

SEQ ID NO: 487228 - DNA, 25 bp, Rattus norvegicus
gtattcacttgtagatttggtaact

SEQ ID NO: 487229 - DNA, 25 bp, Rattus norvegicus
gtattcacttgttgatttggtaact

SEQ ID NO: 487230 - DNA, 25 bp, Rattus norvegicus
gtattcagacttagatcactacata

SEQ ID NO: 487231 - DNA, 25 bp, Rattus norvegicus
gtattcagactttgatcactacata

SEQ ID NO: 487232 - DNA, 25 bp, Rattus norvegicus
gtattcagcaacagggatctcttga

SEQ ID NO: 487233 - DNA, 25 bp, Rattus norvegicus
gtattcagcaactgggatctcttga

SEQ ID NO: 487234 - DNA, 25 bp, Rattus norvegicus
gtattcagcaatccccgatagcttc

SEQ ID NO: 487235 - DNA, 25 bp, Rattus norvegicus
gtattcagcaatgcccgatagcttc

SEQ ID NO: 487236 - DNA, 25 bp, Rattus norvegicus
gtattcaggcctcgaagacctagga

SEQ ID NO: 487237 - DNA, 25 bp, Rattus norvegicus
gtattcaggcctggaagacctagga

SEQ ID NO: 487238 - DNA, 25 bp, Rattus norvegicus
gtattcaggctgcttttgctgcctt

SEQ ID NO: 487239 - DNA, 25 bp, Rattus norvegicus
gtattcaggctggttttgctgcctt

SEQ ID NO: 487240 - DNA, 25 bp, Rattus norvegicus
gtattcaggtttcctgtggacatca

SEQ ID NO: 487241 - DNA, 25 bp, Rattus norvegicus
gtattcaggtttgctgtggacatca

SEQ ID NO: 487242 - DNA, 25 bp, Rattus norvegicus
gtattcagttggcagattcttcaca

SEQ ID NO: 487243 - DNA, 25 bp, Rattus norvegicus
gtattcagttgggagattcttcaca

SEQ ID NO: 487244 - DNA, 25 bp, Rattus norvegicus
gtattcatacagcttctagcactca

SEQ ID NO: 487245 - DNA, 25 bp, Rattus norvegicus
gtattcatacaggttctagcactca

SEQ ID NO: 487246 - DNA, 25 bp, Rattus norvegicus
gtattcatagaacttcacatgagtt

SEQ ID NO: 487247 - DNA, 25 bp, Rattus norvegicus
gtattcatagaagttcacatgagtt

SEQ ID NO: 487248 - DNA, 25 bp, Rattus norvegicus
gtattcatagagaatgttccgcatg

SEQ ID NO: 487249 - DNA, 25 bp, Rattus norvegicus
gtattcatagagtatgttccgcatg

SEQ ID NO: 487250 - DNA, 25 bp, Rattus norvegicus
gtattcatagctagttctcgtggta

SEQ ID NO: 487251 - DNA, 25 bp, Rattus norvegicus
gtattcatagcttgttctcgtggta

SEQ ID NO: 487252 - DNA, 25 bp, Rattus norvegicus
gtattcatctcaacttccctttgaa

SEQ ID NO: 487253 - DNA, 25 bp, Rattus norvegicus
gtattcatctcatcttccctttgaa

SEQ ID NO: 487254 - DNA, 25 bp, Rattus norvegicus
gtattcatgcagaacaagtccttgt

SEQ ID NO: 487255 - DNA, 25 bp, Rattus norvegicus
gtattcatgcagtacaagtccttgt

SEQ ID NO: 487256 - DNA, 25 bp, Rattus norvegicus
gtattcatgtccaggctctcagaag

SEQ ID NO: 487257 - DNA, 25 bp, Rattus norvegicus
gtattcatgtcctggctctcagaag

SEQ ID NO: 487258 - DNA, 25 bp, Rattus norvegicus
gtattcattacacacccgagttagc

SEQ ID NO: 487259 - DNA, 25 bp, Rattus norvegicus
gtattcattacagacccgagttagc

SEQ ID NO: 487260 - DNA, 25 bp, Rattus norvegicus
gtattcattatgaattatgccggcg

SEQ ID NO: 487261 - DNA, 25 bp, Rattus norvegicus
gtattcattatgtattatgccggcg

SEQ ID NO: 487262 - DNA, 25 bp, Rattus norvegicus
gtattcattgggatactcctattat

SEQ ID NO: 487263 - DNA, 25 bp, Rattus norvegicus
gtattcattgggttactcctattat

SEQ ID NO: 487264 - DNA, 25 bp, Rattus norvegicus
gtattccaacagcaggctctgcatc

SEQ ID NO: 487265 - DNA, 25 bp, Rattus norvegicus
gtattccaacaggaggctctgcatc

SEQ ID NO: 487266 - DNA, 25 bp, Rattus norvegicus
gtattccaatgtcgtgttccttgaa

SEQ ID NO: 487267 - DNA, 25 bp, Rattus norvegicus
gtattccaatgtggtgttccttgaa

SEQ ID NO: 487268 - DNA, 25 bp, Rattus norvegicus
gtattccacatgacagtcgtgccgt

SEQ ID NO: 487269 - DNA, 25 bp, Rattus norvegicus
gtattccacatgtcagtcgtgccgt

SEQ ID NO: 487270 - DNA, 25 bp, Rattus norvegicus
gtattccaggagagccttaccaaag

SEQ ID NO: 487271 - DNA, 25 bp, Rattus norvegicus
gtattccaggagtgccttaccaaag

SEQ ID NO: 487272 - DNA, 25 bp, Rattus norvegicus
gtattccaggttcctagtgcatcat

SEQ ID NO: 487273 - DNA, 25 bp, Rattus norvegicus
gtattccaggttgctagtgcatcat

SEQ ID NO: 487274 - DNA, 25 bp, Rattus norvegicus
gtattccatcggctggcatttgtaa

SEQ ID NO: 487275 - DNA, 25 bp, Rattus norvegicus
gtattccatcgggtggcatttgtaa

SEQ ID NO: 487276 - DNA, 25 bp, Rattus norvegicus
gtattccatgatagttatccaccag

SEQ ID NO: 487277 - DNA, 25 bp, Rattus norvegicus
gtattccatgattgttatccaccag

SEQ ID NO: 487278 - DNA, 25 bp, Rattus norvegicus
gtattcccaagacgtcttctgagca

SEQ ID NO: 487279 - DNA, 25 bp, Rattus norvegicus
gtattcccaagaggtcttctgagca

SEQ ID NO: 487280 - DNA, 25 bp, Rattus norvegicus
gtattcccaatcactgtcagttgca

SEQ ID NO: 487281 - DNA, 25 bp, Rattus norvegicus
gtattcccaatctctgtcagttgca

SEQ ID NO: 487282 - DNA, 25 bp, Rattus norvegicus
gtattcccagcacagatgacttttt

SEQ ID NO: 487283 - DNA, 25 bp, Rattus norvegicus
gtattcccagcactagaatcctagt

SEQ ID NO: 487284 - DNA, 25 bp, Rattus norvegicus
gtattcccagcagagatgacttttt

SEQ ID NO: 487285 - DNA, 25 bp, Rattus norvegicus
gtattcccagcagtagaatcctagt

SEQ ID NO: 487286 - DNA, 25 bp, Rattus norvegicus
gtattcccaggccagagattctgga

SEQ ID NO: 487287 - DNA, 25 bp, Rattus norvegicus
gtattcccaggcgagagattctgga

SEQ ID NO: 487288 - DNA, 25 bp, Rattus norvegicus
gtattcccctgtacttgtcaaagct

SEQ ID NO: 487289 - DNA, 25 bp, Rattus norvegicus
gtattcccctgttcttgtcaaagct

SEQ ID NO: 487290 - DNA, 25 bp, Rattus norvegicus
gtattccctacgattagtgtctgca

SEQ ID NO: 487291 - DNA, 25 bp, Rattus norvegicus
gtattccctacgtttagtgtctgca

SEQ ID NO: 487292 - DNA, 25 bp, Rattus norvegicus
gtattccctatgcttctactaagta

SEQ ID NO: 487293 - DNA, 25 bp, Rattus norvegicus
gtattccctatggttctactaagta

SEQ ID NO: 487294 - DNA, 25 bp, Rattus norvegicus
gtattccctcagaagtggctctgag

SEQ ID NO: 487295 - DNA, 25 bp, Rattus norvegicus
gtattccctcagtagtggctctgag

SEQ ID NO: 487296 - DNA, 25 bp, Rattus norvegicus
gtattccctgacagtacttctagca

SEQ ID NO: 487297 - DNA, 25 bp, Rattus norvegicus
gtattccctgactgtacttctagca

SEQ ID NO: 487298 - DNA, 25 bp, Rattus norvegicus
gtattccgacacatatatggcttca

SEQ ID NO: 487299 - DNA, 25 bp, Rattus norvegicus
gtattccgacacttatatggcttca

SEQ ID NO: 487300 - DNA, 25 bp, Rattus norvegicus
gtattccggactagtcactgacttc

SEQ ID NO: 487301 - DNA, 25 bp, Rattus norvegicus
gtattccggacttgtcactgacttc

SEQ ID NO: 487302 - DNA, 25 bp, Rattus norvegicus
gtattcctaagtacttgctctctct

SEQ ID NO: 487303 - DNA, 25 bp, Rattus norvegicus
gtattcctaagttcttgctctctct

SEQ ID NO: 487304 - DNA, 25 bp, Rattus norvegicus
gtattcctaattacccatcttgtga

SEQ ID NO: 487305 - DNA, 25 bp, Rattus norvegicus
gtattcctaatttcccatcttgtga

SEQ ID NO: 487306 - DNA, 25 bp, Rattus norvegicus
gtattcctaggtaccagttgccttt

SEQ ID NO: 487307 - DNA, 25 bp, Rattus norvegicus
gtattcctaggttccagttgccttt

SEQ ID NO: 487308 - DNA, 25 bp, Rattus norvegicus
gtattcctccatataagtctgactg

SEQ ID NO: 487309 - DNA, 25 bp, Rattus norvegicus
gtattcctccatttaagtctgactg

SEQ ID NO: 487310 - DNA, 25 bp, Rattus norvegicus
gtattcctctatcgctaaacgttcc

SEQ ID NO: 487311 - DNA, 25 bp, Rattus norvegicus
gtattcctctatggctaaacgttcc

SEQ ID NO: 487312 - DNA, 25 bp, Rattus norvegicus
gtattcctctgaaatggcacacatt

SEQ ID NO: 487313 - DNA, 25 bp, Rattus norvegicus
gtattcctctgatatggcacacatt

SEQ ID NO: 487314 - DNA, 25 bp, Rattus norvegicus
gtattcctggagcttgtaactgact

SEQ ID NO: 487315 - DNA, 25 bp, Rattus norvegicus
gtattcctggaggttgtaactgact

SEQ ID NO: 487316 - DNA, 25 bp, Rattus norvegicus
gtattcctggttatatcagtggagc

SEQ ID NO: 487317 - DNA, 25 bp, Rattus norvegicus
gtattcctggttttatcagtggagc

SEQ ID NO: 487318 - DNA, 25 bp, Rattus norvegicus
gtattcctgtatagctgggttctgt

SEQ ID NO: 487319 - DNA, 25 bp, Rattus norvegicus
gtattcctgtattgctgggttctgt

SEQ ID NO: 487320 - DNA, 25 bp, Rattus norvegicus
gtattcctgtgacctagggcagaga

SEQ ID NO: 487321 - DNA, 25 bp, Rattus norvegicus
gtattcctgtgagctagggcagaga

SEQ ID NO: 487322 - DNA, 25 bp, Rattus norvegicus
gtattccttataccccaggtctgga

SEQ ID NO: 487323 - DNA, 25 bp, Rattus norvegicus
gtattccttatagcccaggtctgga

SEQ ID NO: 487324 - DNA, 25 bp, Rattus norvegicus
gtattccttatcattgggccatgcc

SEQ ID NO: 487325 - DNA, 25 bp, Rattus norvegicus
gtattccttatctttgggccatgcc

SEQ ID NO: 487326 - DNA, 25 bp, Rattus norvegicus
gtattccttattatggccagttctt

SEQ ID NO: 487327 - DNA, 25 bp, Rattus norvegicus
gtattccttattttggccagttctt

SEQ ID NO: 487328 - DNA, 25 bp, Rattus norvegicus
gtattcgaaaggcaagggtcccaca

SEQ ID NO: 487329 - DNA, 25 bp, Rattus norvegicus
gtattcgaaagggaagggtcccaca

SEQ ID NO: 487330 - DNA, 25 bp, Rattus norvegicus
gtattcgaggccatacacagtgctc

SEQ ID NO: 487331 - DNA, 25 bp, Rattus norvegicus
gtattcgaggccttacacagtgctc

SEQ ID NO: 487332 - DNA, 25 bp, Rattus norvegicus
gtattcgagttacttttctctcttt

SEQ ID NO: 487333 - DNA, 25 bp, Rattus norvegicus
gtattcgagttagttttctctcttt

SEQ ID NO: 487334 - DNA, 25 bp, Rattus norvegicus
gtattcgatttgagactgttagtag

SEQ ID NO: 487335 - DNA, 25 bp, Rattus norvegicus
gtattcgatttgtgactgttagtag

SEQ ID NO: 487336 - DNA, 25 bp, Rattus norvegicus
gtattcgctataccgcagtaccata

SEQ ID NO: 487337 - DNA, 25 bp, Rattus norvegicus
gtattcgctatagcgcagtaccata

SEQ ID NO: 487338 - DNA, 25 bp, Rattus norvegicus
gtattcggtcacacattcccaggga

SEQ ID NO: 487339 - DNA, 25 bp, Rattus norvegicus
gtattcggtcactcattcccaggga

SEQ ID NO: 487340 - DNA, 25 bp, Rattus norvegicus
gtattcgtcatgaagtcaccaggct

SEQ ID NO: 487341 - DNA, 25 bp, Rattus norvegicus
gtattcgtcatgtagtcaccaggct

SEQ ID NO: 487342 - DNA, 25 bp, Rattus norvegicus
gtattcgtcgcactataaagcttca

SEQ ID NO: 487343 - DNA, 25 bp, Rattus norvegicus
gtattcgtcgcagtataaagcttca

SEQ ID NO: 487344 - DNA, 25 bp, Rattus norvegicus
gtattcgtcttcaagaaatgcccct

SEQ ID NO: 487345 - DNA, 25 bp, Rattus norvegicus
gtattcgtcttctagaaatgcccct

SEQ ID NO: 487346 - DNA, 25 bp, Rattus norvegicus
gtattcgtgattattgtgctattaa

SEQ ID NO: 487347 - DNA, 25 bp, Rattus norvegicus
gtattcgtgatttttgtgctattaa

SEQ ID NO: 487348 - DNA, 25 bp, Rattus norvegicus
gtattcgttgttcttttcgtgtcaa

SEQ ID NO: 487349 - DNA, 25 bp, Rattus norvegicus
gtattcgttgttgttttcgtgtcaa

SEQ ID NO: 487350 - DNA, 25 bp, Rattus norvegicus
gtattctaaaggctgtgtggctata

SEQ ID NO: 487351 - DNA, 25 bp, Rattus norvegicus
gtattctaaagggtgtgtggctata

SEQ ID NO: 487352 - DNA, 25 bp, Rattus norvegicus
gtattctaacacaatagatttcatt

SEQ ID NO: 487353 - DNA, 25 bp, Rattus norvegicus
gtattctaacactatagatttcatt

SEQ ID NO: 487354 - DNA, 25 bp, Rattus norvegicus
gtattctaattaaacctggacgcgg

SEQ ID NO: 487355 - DNA, 25 bp, Rattus norvegicus
gtattctaattatacctggacgcgg

SEQ ID NO: 487356 - DNA, 25 bp, Rattus norvegicus
gtattctagcagatcctttctggaa

SEQ ID NO: 487357 - DNA, 25 bp, Rattus norvegicus
gtattctagcagttcctttctggaa

SEQ ID NO: 487358 - DNA, 25 bp, Rattus norvegicus
gtattctagcttaggcggtacatat

SEQ ID NO: 487359 - DNA, 25 bp, Rattus norvegicus
gtattctagctttggcggtacatat

SEQ ID NO: 487360 - DNA, 25 bp, Rattus norvegicus
gtattctagtctctcatagctgcta

SEQ ID NO: 487361 - DNA, 25 bp, Rattus norvegicus
gtattctagtctgtcatagctgcta

SEQ ID NO: 487362 - DNA, 25 bp, Rattus norvegicus
gtattctataagctctatctcatgg

SEQ ID NO: 487363 - DNA, 25 bp, Rattus norvegicus
gtattctataaggtctatctcatgg

SEQ ID NO: 487364 - DNA, 25 bp, Rattus norvegicus
gtattctatcagatctgccactgtg

SEQ ID NO: 487365 - DNA, 25 bp, Rattus norvegicus
gtattctatcagttctgccactgtg

SEQ ID NO: 487366 - DNA, 25 bp, Rattus norvegicus
gtattctattggatccaggctggaa

SEQ ID NO: 487367 - DNA, 25 bp, Rattus norvegicus
gtattctattggttccaggctggaa

SEQ ID NO: 487368 - DNA, 25 bp, Rattus norvegicus
gtattctcacccatgggacagattt

SEQ ID NO: 487369 - DNA, 25 bp, Rattus norvegicus
gtattctcacccttgggacagattt

SEQ ID NO: 487370 - DNA, 25 bp, Rattus norvegicus
gtattctcacttaattagttttcta

SEQ ID NO: 487371 - DNA, 25 bp, Rattus norvegicus
gtattctcactttattagttttcta

SEQ ID NO: 487372 - DNA, 25 bp, Rattus norvegicus
gtattctcagtacggttggccagga

SEQ ID NO: 487373 - DNA, 25 bp, Rattus norvegicus
gtattctcagtagggttggccagga

SEQ ID NO: 487374 - DNA, 25 bp, Rattus norvegicus
gtattctccaatcacctctttttac

SEQ ID NO: 487375 - DNA, 25 bp, Rattus norvegicus
gtattctccaatgacctctttttac

SEQ ID NO: 487376 - DNA, 25 bp, Rattus norvegicus
gtattctccagaaaggtcacctcag

SEQ ID NO: 487377 - DNA, 25 bp, Rattus norvegicus
gtattctccagataggtcacctcag

SEQ ID NO: 487378 - DNA, 25 bp, Rattus norvegicus
gtattctccctcatttgtgcacagt

SEQ ID NO: 487379 - DNA, 25 bp, Rattus norvegicus
gtattctccctcttttgtgcacagt

SEQ ID NO: 487380 - DNA, 25 bp, Rattus norvegicus
gtattctctcaactgtgttccttag

SEQ ID NO: 487381 - DNA, 25 bp, Rattus norvegicus
gtattctctcaagtgtgttccttag

SEQ ID NO: 487382 - DNA, 25 bp, Rattus norvegicus
gtattctctcagctctacggaagga

SEQ ID NO: 487383 - DNA, 25 bp, Rattus norvegicus
gtattctctcaggtctacggaagga

SEQ ID NO: 487384 - DNA, 25 bp, Rattus norvegicus
gtattctctctgagacttttccatt

SEQ ID NO: 487385 - DNA, 25 bp, Rattus norvegicus
gtattctctctgtgacttttccatt

SEQ ID NO: 487386 - DNA, 25 bp, Rattus norvegicus
gtattctctgctcgccggaatgagg

SEQ ID NO: 487387 - DNA, 25 bp, Rattus norvegicus
gtattctctgctggccggaatgagg

SEQ ID NO: 487388 - DNA, 25 bp, Rattus norvegicus
gtattctctgtgctaaactgtccgt

SEQ ID NO: 487389 - DNA, 25 bp, Rattus norvegicus
gtattctctgtggtaaactgtccgt

SEQ ID NO: 487390 - DNA, 25 bp, Rattus norvegicus
gtattctcttcaataaactcttggt

SEQ ID NO: 487391 - DNA, 25 bp, Rattus norvegicus
gtattctcttcattaaactcttggt

SEQ ID NO: 487392 - DNA, 25 bp, Rattus norvegicus
gtattctctttccagtcacatttgg

SEQ ID NO: 487393 - DNA, 25 bp, Rattus norvegicus
gtattctctttcgagtcacatttgg

SEQ ID NO: 487394 - DNA, 25 bp, Rattus norvegicus
gtattctgaaatccctgaaactgac

SEQ ID NO: 487395 - DNA, 25 bp, Rattus norvegicus
gtattctgaaatgcctgaaactgac

SEQ ID NO: 487396 - DNA, 25 bp, Rattus norvegicus
gtattctgaactcccgcgttttgaa

SEQ ID NO: 487397 - DNA, 25 bp, Rattus norvegicus
gtattctgaactgccgcgttttgaa

SEQ ID NO: 487398 - DNA, 25 bp, Rattus norvegicus
gtattctgactgctgtatttgtacc

SEQ ID NO: 487399 - DNA, 25 bp, Rattus norvegicus
gtattctgactggtgtatttgtacc

SEQ ID NO: 487400 - DNA, 25 bp, Rattus norvegicus
gtattctgaggtactaactccatca

SEQ ID NO: 487401 - DNA, 25 bp, Rattus norvegicus
gtattctgaggttctaactccatca

SEQ ID NO: 487402 - DNA, 25 bp, Rattus norvegicus
gtattctgatagcatctcattgatt

SEQ ID NO: 487403 - DNA, 25 bp, Rattus norvegicus
gtattctgataggatctcattgatt

SEQ ID NO: 487404 - DNA, 25 bp, Rattus norvegicus
gtattctgatctctgtatgacctcc

SEQ ID NO: 487405 - DNA, 25 bp, Rattus norvegicus
gtattctgatctgtgtatgacctcc

SEQ ID NO: 487406 - DNA, 25 bp, Rattus norvegicus
gtattctgcacacctttagtattgt

SEQ ID NO: 487407 - DNA, 25 bp, Rattus norvegicus
gtattctgcacagctttagtattgt

SEQ ID NO: 487408 - DNA, 25 bp, Rattus norvegicus
gtattctgcaccattttacaaatta

SEQ ID NO: 487409 - DNA, 25 bp, Rattus norvegicus
gtattctgcacctttttacaaatta

SEQ ID NO: 487410 - DNA, 25 bp, Rattus norvegicus
gtattctgcctaatatagcttggaa

SEQ ID NO: 487411 - DNA, 25 bp, Rattus norvegicus
gtattctgcctattatagcttggaa

SEQ ID NO: 487412 - DNA, 25 bp, Rattus norvegicus
gtattctgcttcagcttgaaccaca

SEQ ID NO: 487413 - DNA, 25 bp, Rattus norvegicus
gtattctgcttctgcttgaaccaca

SEQ ID NO: 487414 - DNA, 25 bp, Rattus norvegicus
gtattctgggaaatcgctcgacgct

SEQ ID NO: 487415 - DNA, 25 bp, Rattus norvegicus
gtattctgggaattcgctcgacgct

SEQ ID NO: 487416 - DNA, 25 bp, Rattus norvegicus
gtattctggtaactcttttctggaa

SEQ ID NO: 487417 - DNA, 25 bp, Rattus norvegicus
gtattctggtaagtcttttctggaa

SEQ ID NO: 487418 - DNA, 25 bp, Rattus norvegicus
gtattctggtttaatcctgaccctg

SEQ ID NO: 487419 - DNA, 25 bp, Rattus norvegicus
gtattctggttttatcctgaccctg

SEQ ID NO: 487420 - DNA, 25 bp, Rattus norvegicus
gtattctgtaagctcattcacgcta

SEQ ID NO: 487421 - DNA, 25 bp, Rattus norvegicus
gtattctgtaaggtcattcacgcta

SEQ ID NO: 487422 - DNA, 25 bp, Rattus norvegicus
gtattctgtacactcttggttcatg

SEQ ID NO: 487423 - DNA, 25 bp, Rattus norvegicus
gtattctgtacagtcttggttcatg

SEQ ID NO: 487424 - DNA, 25 bp, Rattus norvegicus
gtattctgtaccatactgcagctct

SEQ ID NO: 487425 - DNA, 25 bp, Rattus norvegicus
gtattctgtaccttactgcagctct

SEQ ID NO: 487426 - DNA, 25 bp, Rattus norvegicus
gtattctgtatgaatgcatggcatg

SEQ ID NO: 487427 - DNA, 25 bp, Rattus norvegicus
gtattctgtatgtatgcatggcatg

SEQ ID NO: 487428 - DNA, 25 bp, Rattus norvegicus
gtattctgtcagatcttcgtgtctt

SEQ ID NO: 487429 - DNA, 25 bp, Rattus norvegicus
gtattctgtcagttcttcgtgtctt

SEQ ID NO: 487430 - DNA, 25 bp, Rattus norvegicus
gtattctgtgccaatagtttcccag

SEQ ID NO: 487431 - DNA, 25 bp, Rattus norvegicus
gtattctgtgcctatagtttcccag

SEQ ID NO: 487432 - DNA, 25 bp, Rattus norvegicus
gtattctgtgtcattagtggcattt

SEQ ID NO: 487433 - DNA, 25 bp, Rattus norvegicus
gtattctgtgtctttagtggcattt

SEQ ID NO: 487434 - DNA, 25 bp, Rattus norvegicus
gtattctgtgtgaattctaaaaatg

SEQ ID NO: 487435 - DNA, 25 bp, Rattus norvegicus
gtattctgtgtgtattctaaaaatg

SEQ ID NO: 487436 - DNA, 25 bp, Rattus norvegicus
gtattctgttctaagacatccatga

SEQ ID NO: 487437 - DNA, 25 bp, Rattus norvegicus
gtattctgttcttagacatccatga

SEQ ID NO: 487438 - DNA, 25 bp, Rattus norvegicus
gtattctgttttagtacctactcat

SEQ ID NO: 487439 - DNA, 25 bp, Rattus norvegicus
gtattctgtttttgtacctactcat

SEQ ID NO: 487440 - DNA, 25 bp, Rattus norvegicus
gtattcttacatcccagtttcatgc

SEQ ID NO: 487441 - DNA, 25 bp, Rattus norvegicus
gtattcttacatctggcttctagac

SEQ ID NO: 487442 - DNA, 25 bp, Rattus norvegicus
gtattcttacatgccagtttcatgc

SEQ ID NO: 487443 - DNA, 25 bp, Rattus norvegicus
gtattcttacatgtggcttctagac

SEQ ID NO: 487444 - DNA, 25 bp, Rattus norvegicus
gtattcttatgcacttcgtttctct

SEQ ID NO: 487445 - DNA, 25 bp, Rattus norvegicus
gtattcttatgctcttcgtttctct

SEQ ID NO: 487446 - DNA, 25 bp, Rattus norvegicus
gtattcttcccacgagatcttttcg

SEQ ID NO: 487447 - DNA, 25 bp, Rattus norvegicus
gtattcttcccaggagatcttttcg

SEQ ID NO: 487448 - DNA, 25 bp, Rattus norvegicus
gtattcttcgtcaatttcaatccat

SEQ ID NO: 487449 - DNA, 25 bp, Rattus norvegicus
gtattcttcgtctatttcaatccat

SEQ ID NO: 487450 - DNA, 25 bp, Rattus norvegicus
gtattcttctggctgatctttttaa

SEQ ID NO: 487451 - DNA, 25 bp, Rattus norvegicus
gtattcttctgggtgatctttttaa

SEQ ID NO: 487452 - DNA, 25 bp, Rattus norvegicus
gtattcttgccgcttctgtgtaaat

SEQ ID NO: 487453 - DNA, 25 bp, Rattus norvegicus
gtattcttgccggttctgtgtaaat

SEQ ID NO: 487454 - DNA, 25 bp, Rattus norvegicus
gtattcttgtatctcagttttgtga

SEQ ID NO: 487455 - DNA, 25 bp, Rattus norvegicus
gtattcttgtatgtcagttttgtga

SEQ ID NO: 487456 - DNA, 25 bp, Rattus norvegicus
gtattctttacacaagtcctcaact

SEQ ID NO: 487457 - DNA, 25 bp, Rattus norvegicus
gtattctttacagaagtcctcaact

SEQ ID NO: 487458 - DNA, 25 bp, Rattus norvegicus
gtattctttaccagtgggtggagaa

SEQ ID NO: 487459 - DNA, 25 bp, Rattus norvegicus
gtattctttacctgtgggtggagaa

SEQ ID NO: 487460 - DNA, 25 bp, Rattus norvegicus
gtattctttagaacactcatggtgt

SEQ ID NO: 487461 - DNA, 25 bp, Rattus norvegicus
gtattctttagatcactcatggtgt

SEQ ID NO: 487462 - DNA, 25 bp, Rattus norvegicus
gtattctttcatagcatcactggac

SEQ ID NO: 487463 - DNA, 25 bp, Rattus norvegicus
gtattctttcattgcatcactggac

SEQ ID NO: 487464 - DNA, 25 bp, Rattus norvegicus
gtattctttctcagaccagtatcct

SEQ ID NO: 487465 - DNA, 25 bp, Rattus norvegicus
gtattctttctctgaccagtatcct

SEQ ID NO: 487466 - DNA, 25 bp, Rattus norvegicus
gtattctttgttctcatgcaagagg

SEQ ID NO: 487467 - DNA, 25 bp, Rattus norvegicus
gtattctttgttgtcatgcaagagg

SEQ ID NO: 487468 - DNA, 25 bp, Rattus norvegicus
gtattcttttcaactgcttttacga

SEQ ID NO: 487469 - DNA, 25 bp, Rattus norvegicus
gtattcttttcatctgcttttacga

SEQ ID NO: 487470 - DNA, 25 bp, Rattus norvegicus
gtattcttttccagatcactatgca

SEQ ID NO: 487471 - DNA, 25 bp, Rattus norvegicus
gtattcttttcctgatcactatgca

SEQ ID NO: 487472 - DNA, 25 bp, Rattus norvegicus
gtattgaaaactactactacatttg

SEQ ID NO: 487473 - DNA, 25 bp, Rattus norvegicus
gtattgaaaacttctactacatttg

SEQ ID NO: 487474 - DNA, 25 bp, Rattus norvegicus
gtattgaaacctcgtggctctttat

SEQ ID NO: 487475 - DNA, 25 bp, Rattus norvegicus
gtattgaaacctggtggctctttat

SEQ ID NO: 487476 - DNA, 25 bp, Rattus norvegicus
gtattgaatactcagcccctgtggg

SEQ ID NO: 487477 - DNA, 25 bp, Rattus norvegicus
gtattgaatactgagcccctgtggg

SEQ ID NO: 487478 - DNA, 25 bp, Rattus norvegicus
gtattgaattgccacaaaagttgaa

SEQ ID NO: 487479 - DNA, 25 bp, Rattus norvegicus
gtattgaattgcgacaaaagttgaa

SEQ ID NO: 487480 - DNA, 25 bp, Rattus norvegicus
gtattgacacacagcatagccacga

SEQ ID NO: 487481 - DNA, 25 bp, Rattus norvegicus
gtattgacacactgcatagccacga

SEQ ID NO: 487482 - DNA, 25 bp, Rattus norvegicus
gtattgacactgaggtctcttacat

SEQ ID NO: 487483 - DNA, 25 bp, Rattus norvegicus
gtattgacactgtggtctcttacat

SEQ ID NO: 487484 - DNA, 25 bp, Rattus norvegicus
gtattgacagacagtatccaaacta

SEQ ID NO: 487485 - DNA, 25 bp, Rattus norvegicus
gtattgacagactgtatccaaacta

SEQ ID NO: 487486 - DNA, 25 bp, Rattus norvegicus
gtattgacaggccacggtttccaaa

SEQ ID NO: 487487 - DNA, 25 bp, Rattus norvegicus
gtattgacaggcgacggtttccaaa

SEQ ID NO: 487488 - DNA, 25 bp, Rattus norvegicus
gtattgacataaactctagctgcac

SEQ ID NO: 487489 - DNA, 25 bp, Rattus norvegicus
gtattgacataatctctagctgcac

SEQ ID NO: 487490 - DNA, 25 bp, Rattus norvegicus
gtattgacatttagacagaagctaa

SEQ ID NO: 487491 - DNA, 25 bp, Rattus norvegicus
gtattgacattttgacagaagctaa

SEQ ID NO: 487492 - DNA, 25 bp, Rattus norvegicus
gtattgactgtcagtgcactatatg

SEQ ID NO: 487493 - DNA, 25 bp, Rattus norvegicus
gtattgactgtctgtgcactatatg

SEQ ID NO: 487494 - DNA, 25 bp, Rattus norvegicus
gtattgacttcactagaactctgac

SEQ ID NO: 487495 - DNA, 25 bp, Rattus norvegicus
gtattgacttcagtagaactctgac

SEQ ID NO: 487496 - DNA, 25 bp, Rattus norvegicus
gtattgactttgataccttgggcaa

SEQ ID NO: 487497 - DNA, 25 bp, Rattus norvegicus
gtattgactttgttaccttgggcaa

SEQ ID NO: 487498 - DNA, 25 bp, Rattus norvegicus
gtattgagagttcacctctccctgt

SEQ ID NO: 487499 - DNA, 25 bp, Rattus norvegicus
gtattgagagttgacctctccctgt

SEQ ID NO: 487500 - DNA, 25 bp, Rattus norvegicus
gtattgagatgcacctgtccaactt

SEQ ID NO: 487501 - DNA, 25 bp, Rattus norvegicus
gtattgagatgctcctgtccaactt

SEQ ID NO: 487502 - DNA, 25 bp, Rattus norvegicus
gtattgagcacaccaggcaagctct

SEQ ID NO: 487503 - DNA, 25 bp, Rattus norvegicus
gtattgagcacagcaggcaagctct

SEQ ID NO: 487504 - DNA, 25 bp, Rattus norvegicus
gtattgagccatagctgtctacagt

SEQ ID NO: 487505 - DNA, 25 bp, Rattus norvegicus
gtattgagccattgctgtctacagt

SEQ ID NO: 487506 - DNA, 25 bp, Rattus norvegicus
gtattgagccgtcttaacctgccaa

SEQ ID NO: 487507 - DNA, 25 bp, Rattus norvegicus
gtattgagccgtgttaacctgccaa

SEQ ID NO: 487508 - DNA, 25 bp, Rattus norvegicus
gtattgagctgaacgagcctccact

SEQ ID NO: 487509 - DNA, 25 bp, Rattus norvegicus
gtattgagctgatcgagcctccact

SEQ ID NO: 487510 - DNA, 25 bp, Rattus norvegicus
gtattgagctggagtctgaggtttc

SEQ ID NO: 487511 - DNA, 25 bp, Rattus norvegicus
gtattgagctggtgtctgaggtttc

SEQ ID NO: 487512 - DNA, 25 bp, Rattus norvegicus
gtattgagcttcaaggtcgcctgta

SEQ ID NO: 487513 - DNA, 25 bp, Rattus norvegicus
gtattgagcttctaggtcgcctgta

SEQ ID NO: 487514 - DNA, 25 bp, Rattus norvegicus
gtattgaggcatccatcagatctga

SEQ ID NO: 487515 - DNA, 25 bp, Rattus norvegicus
gtattgaggcatgcatcagatctga

SEQ ID NO: 487516 - DNA, 25 bp, Rattus norvegicus
gtattgatcatgagcaacggccaaa

SEQ ID NO: 487517 - DNA, 25 bp, Rattus norvegicus
gtattgatcatgtgcaacggccaaa

SEQ ID NO: 487518 - DNA, 25 bp, Rattus norvegicus
gtattgatctacatccctaattgtg

SEQ ID NO: 487519 - DNA, 25 bp, Rattus norvegicus
gtattgatctacttccctaattgtg

SEQ ID NO: 487520 - DNA, 25 bp, Rattus norvegicus
gtattgatgagcacaggaccaggat

SEQ ID NO: 487521 - DNA, 25 bp, Rattus norvegicus
gtattgatgagctcaggaccaggat

SEQ ID NO: 487522 - DNA, 25 bp, Rattus norvegicus
gtattgatgatcatttggtaagcca

SEQ ID NO: 487523 - DNA, 25 bp, Rattus norvegicus
gtattgatgatcttttggtaagcca

SEQ ID NO: 487524 - DNA, 25 bp, Rattus norvegicus
gtattgatgtacagccttgaatgtg

SEQ ID NO: 487525 - DNA, 25 bp, Rattus norvegicus
gtattgatgtactgccttgaatgtg

SEQ ID NO: 487526 - DNA, 25 bp, Rattus norvegicus
gtattgattatactcatgacatgac

SEQ ID NO: 487527 - DNA, 25 bp, Rattus norvegicus
gtattgattatagtcatgacatgac

SEQ ID NO: 487528 - DNA, 25 bp, Rattus norvegicus
gtattgattccacgggccatgcagg

SEQ ID NO: 487529 - DNA, 25 bp, Rattus norvegicus
gtattgattccaggggccatgcagg

SEQ ID NO: 487530 - DNA, 25 bp, Rattus norvegicus
gtattgattgcccttaaatattaga

SEQ ID NO: 487531 - DNA, 25 bp, Rattus norvegicus
gtattgattgccgttaaatattaga

SEQ ID NO: 487532 - DNA, 25 bp, Rattus norvegicus
gtattgatttcaccttgggccaaaa

SEQ ID NO: 487533 - DNA, 25 bp, Rattus norvegicus
gtattgatttcagcttgggccaaaa

SEQ ID NO: 487534 - DNA, 25 bp, Rattus norvegicus
gtattgcacttgcacggcgaggaac

SEQ ID NO: 487535 - DNA, 25 bp, Rattus norvegicus
gtattgcacttggacggcgaggaac

SEQ ID NO: 487536 - DNA, 25 bp, Rattus norvegicus
gtattgccaaacacagatggaggta

SEQ ID NO: 487537 - DNA, 25 bp, Rattus norvegicus
gtattgccaaactcagatggaggta

SEQ ID NO: 487538 - DNA, 25 bp, Rattus norvegicus
gtattgccaagaccttgaagctcga

SEQ ID NO: 487539 - DNA, 25 bp, Rattus norvegicus
gtattgccaagagcttgaagctcga

SEQ ID NO: 487540 - DNA, 25 bp, Rattus norvegicus
gtattgccacaacagcgacattggt

SEQ ID NO: 487541 - DNA, 25 bp, Rattus norvegicus
gtattgccacaagagcgacattggt

SEQ ID NO: 487542 - DNA, 25 bp, Rattus norvegicus
gtattgccaggaaagccataatcgg

SEQ ID NO: 487543 - DNA, 25 bp, Rattus norvegicus
gtattgccaggatagccataatcgg

SEQ ID NO: 487544 - DNA, 25 bp, Rattus norvegicus
gtattgccatttcatagtctctcac

SEQ ID NO: 487545 - DNA, 25 bp, Rattus norvegicus
gtattgccatttgatagtctctcac

SEQ ID NO: 487546 - DNA, 25 bp, Rattus norvegicus
gtattgcccagaatgtctctttcaa

SEQ ID NO: 487547 - DNA, 25 bp, Rattus norvegicus
gtattgcccagattgtctctttcaa

SEQ ID NO: 487548 - DNA, 25 bp, Rattus norvegicus
gtattgccccaaattccactgataa

SEQ ID NO: 487549 - DNA, 25 bp, Rattus norvegicus
gtattgccccaatttccactgataa

SEQ ID NO: 487550 - DNA, 25 bp, Rattus norvegicus
gtattgcccgatccaatgagaaaaa

SEQ ID NO: 487551 - DNA, 25 bp, Rattus norvegicus
gtattgcccgatgcaatgagaaaaa

SEQ ID NO: 487552 - DNA, 25 bp, Rattus norvegicus
gtattgccctgtattataggtgcct

SEQ ID NO: 487553 - DNA, 25 bp, Rattus norvegicus
gtattgccctgttttataggtgcct

SEQ ID NO: 487554 - DNA, 25 bp, Rattus norvegicus
gtattgccgtcccactatattaaag

SEQ ID NO: 487555 - DNA, 25 bp, Rattus norvegicus
gtattgccgtccgactatattaaag

SEQ ID NO: 487556 - DNA, 25 bp, Rattus norvegicus
gtattgcctcctaaaaccatgtgtt

SEQ ID NO: 487557 - DNA, 25 bp, Rattus norvegicus
gtattgcctccttaaaccatgtgtt

SEQ ID NO: 487558 - DNA, 25 bp, Rattus norvegicus
gtattgcgctaactgaaccttgtca

SEQ ID NO: 487559 - DNA, 25 bp, Rattus norvegicus
gtattgcgctaagtgaaccttgtca

SEQ ID NO: 487560 - DNA, 25 bp, Rattus norvegicus
gtattgctacctatacctgagcctg

SEQ ID NO: 487561 - DNA, 25 bp, Rattus norvegicus
gtattgctacctttacctgagcctg

SEQ ID NO: 487562 - DNA, 25 bp, Rattus norvegicus
gtattgctagagagactgtgaacaa

SEQ ID NO: 487563 - DNA, 25 bp, Rattus norvegicus
gtattgctagagtgactgtgaacaa

SEQ ID NO: 487564 - DNA, 25 bp, Rattus norvegicus
gtattgctcaaaagatctcctagga

SEQ ID NO: 487565 - DNA, 25 bp, Rattus norvegicus
gtattgctcaaatgatctcctagga

SEQ ID NO: 487566 - DNA, 25 bp, Rattus norvegicus
gtattgctgaaactcgtccgctatg

SEQ ID NO: 487567 - DNA, 25 bp, Rattus norvegicus
gtattgctgaaagtcgtccgctatg

SEQ ID NO: 487568 - DNA, 25 bp, Rattus norvegicus
gtattgctgatcatggaacagtttt

SEQ ID NO: 487569 - DNA, 25 bp, Rattus norvegicus
gtattgctgatcttggaacagtttt

SEQ ID NO: 487570 - DNA, 25 bp, Rattus norvegicus
gtattgctgcatacctagtccttaa

SEQ ID NO: 487571 - DNA, 25 bp, Rattus norvegicus
gtattgctgcattcctagtccttaa

SEQ ID NO: 487572 - DNA, 25 bp, Rattus norvegicus
gtattgcttatactgtatattcaaa

SEQ ID NO: 487573 - DNA, 25 bp, Rattus norvegicus
gtattgcttatagtgtatattcaaa

SEQ ID NO: 487574 - DNA, 25 bp, Rattus norvegicus
gtattgcttcttactggcatgttgt

SEQ ID NO: 487575 - DNA, 25 bp, Rattus norvegicus
gtattgcttctttctggcatgttgt

SEQ ID NO: 487576 - DNA, 25 bp, Rattus norvegicus
gtattggaactcatgccgttgactc

SEQ ID NO: 487577 - DNA, 25 bp, Rattus norvegicus
gtattggaactcttgccgttgactc

SEQ ID NO: 487578 - DNA, 25 bp, Rattus norvegicus
gtattggcaataacggacacagtta

SEQ ID NO: 487579 - DNA, 25 bp, Rattus norvegicus
gtattggcaatatcggacacagtta

SEQ ID NO: 487580 - DNA, 25 bp, Rattus norvegicus
gtattggcagagattcaaatcccct

SEQ ID NO: 487581 - DNA, 25 bp, Rattus norvegicus
gtattggcagagtttcaaatcccct

SEQ ID NO: 487582 - DNA, 25 bp, Rattus norvegicus
gtattggcagccacaaagctccaca

SEQ ID NO: 487583 - DNA, 25 bp, Rattus norvegicus
gtattggcagcctcaaagctccaca

SEQ ID NO: 487584 - DNA, 25 bp, Rattus norvegicus
gtattggcagcgattgtgttagcaa

SEQ ID NO: 487585 - DNA, 25 bp, Rattus norvegicus
gtattggcagcgtttgtgttagcaa

SEQ ID NO: 487586 - DNA, 25 bp, Rattus norvegicus
gtattggccatgaaggacaatatat

SEQ ID NO: 487587 - DNA, 25 bp, Rattus norvegicus
gtattggccatgtaggacaatatat

SEQ ID NO: 487588 - DNA, 25 bp, Rattus norvegicus
gtattggctgtgctcggccaaacaa

SEQ ID NO: 487589 - DNA, 25 bp, Rattus norvegicus
gtattggctgtggtcggccaaacaa

SEQ ID NO: 487590 - DNA, 25 bp, Rattus norvegicus
gtattggcttagaagacactgtgtt

SEQ ID NO: 487591 - DNA, 25 bp, Rattus norvegicus
gtattggcttagtagacactgtgtt

SEQ ID NO: 487592 - DNA, 25 bp, Rattus norvegicus
gtattggctttaccagtctcaatgt

SEQ ID NO: 487593 - DNA, 25 bp, Rattus norvegicus
gtattggctttagcagtctcaatgt

SEQ ID NO: 487594 - DNA, 25 bp, Rattus norvegicus
gtattggctttccatgtcatagttt

SEQ ID NO: 487595 - DNA, 25 bp, Rattus norvegicus
gtattggctttcgatgtcatagttt

SEQ ID NO: 487596 - DNA, 25 bp, Rattus norvegicus
gtattgggaagtagcttgcctatca

SEQ ID NO: 487597 - DNA, 25 bp, Rattus norvegicus
gtattgggaagttgcttgcctatca

SEQ ID NO: 487598 - DNA, 25 bp, Rattus norvegicus
gtattgggatacactctttgaaaat

SEQ ID NO: 487599 - DNA, 25 bp, Rattus norvegicus
gtattgggatactctctttgaaaat

SEQ ID NO: 487600 - DNA, 25 bp, Rattus norvegicus
gtattgggatttctcatgtgaacag

SEQ ID NO: 487601 - DNA, 25 bp, Rattus norvegicus
gtattgggatttgtcatgtgaacag

SEQ ID NO: 487602 - DNA, 25 bp, Rattus norvegicus
gtattgggctttatggagacagtag

SEQ ID NO: 487603 - DNA, 25 bp, Rattus norvegicus
gtattgggctttttggagacagtag

SEQ ID NO: 487604 - DNA, 25 bp, Rattus norvegicus
gtattgggtgacactgatctgccca

SEQ ID NO: 487605 - DNA, 25 bp, Rattus norvegicus
gtattgggtgactctgatctgccca

SEQ ID NO: 487606 - DNA, 25 bp, Rattus norvegicus
gtattgggtgctacatgttccgcat

SEQ ID NO: 487607 - DNA, 25 bp, Rattus norvegicus
gtattgggtgcttcatgttccgcat

SEQ ID NO: 487608 - DNA, 25 bp, Rattus norvegicus
gtattgggttgacttatgtttcaga

SEQ ID NO: 487609 - DNA, 25 bp, Rattus norvegicus
gtattgggttgagttatgtttcaga

SEQ ID NO: 487610 - DNA, 25 bp, Rattus norvegicus
gtattggtaccacatatatgcctaa

SEQ ID NO: 487611 - DNA, 25 bp, Rattus norvegicus
gtattggtaccagatatatgcctaa

SEQ ID NO: 487612 - DNA, 25 bp, Rattus norvegicus
gtattggtagcccagagtccggtcc

SEQ ID NO: 487613 - DNA, 25 bp, Rattus norvegicus
gtattggtagccgagagtccggtcc

SEQ ID NO: 487614 - DNA, 25 bp, Rattus norvegicus
gtattggtgggccatgctagtcctc

SEQ ID NO: 487615 - DNA, 25 bp, Rattus norvegicus
gtattggtgggcgatgctagtcctc

SEQ ID NO: 487616 - DNA, 25 bp, Rattus norvegicus
gtattggtgggtaattgggtatcat

SEQ ID NO: 487617 - DNA, 25 bp, Rattus norvegicus
gtattggtgggttattgggtatcat

SEQ ID NO: 487618 - DNA, 25 bp, Rattus norvegicus
gtattggtgtctcctttgaccagag

SEQ ID NO: 487619 - DNA, 25 bp, Rattus norvegicus
gtattggtgtctgctttgaccagag

SEQ ID NO: 487620 - DNA, 25 bp, Rattus norvegicus
gtattggttgaaaccccactctaat

SEQ ID NO: 487621 - DNA, 25 bp, Rattus norvegicus
gtattggttgaatccccactctaat

SEQ ID NO: 487622 - DNA, 25 bp, Rattus norvegicus
gtattggtttcacaacagtctctgc

SEQ ID NO: 487623 - DNA, 25 bp, Rattus norvegicus
gtattggtttcagaacagtctctgc

SEQ ID NO: 487624 - DNA, 25 bp, Rattus norvegicus
gtattggttttacccctcatttgaa

SEQ ID NO: 487625 - DNA, 25 bp, Rattus norvegicus
gtattggttttagccctcatttgaa

SEQ ID NO: 487626 - DNA, 25 bp, Rattus norvegicus
gtattgtaactaactgtccctactg

SEQ ID NO: 487627 - DNA, 25 bp, Rattus norvegicus
gtattgtaactatctgtccctactg

SEQ ID NO: 487628 - DNA, 25 bp, Rattus norvegicus
gtattgtaccttaaacacctgatgt

SEQ ID NO: 487629 - DNA, 25 bp, Rattus norvegicus
gtattgtaccttcagcgtgcagtat

SEQ ID NO: 487630 - DNA, 25 bp, Rattus norvegicus
gtattgtaccttgagcgtgcagtat

SEQ ID NO: 487631 - DNA, 25 bp, Rattus norvegicus
gtattgtacctttaacacctgatgt

SEQ ID NO: 487632 - DNA, 25 bp, Rattus norvegicus
gtattgtactgccattcctaatgta

SEQ ID NO: 487633 - DNA, 25 bp, Rattus norvegicus
gtattgtactgcgattcctaatgta

SEQ ID NO: 487634 - DNA, 25 bp, Rattus norvegicus
gtattgtatccaaccctgaaggaga

SEQ ID NO: 487635 - DNA, 25 bp, Rattus norvegicus
gtattgtatccatccctgaaggaga

SEQ ID NO: 487636 - DNA, 25 bp, Rattus norvegicus
gtattgtatctgacccactttacat

SEQ ID NO: 487637 - DNA, 25 bp, Rattus norvegicus
gtattgtatctgtcccactttacat

SEQ ID NO: 487638 - DNA, 25 bp, Rattus norvegicus
gtattgtcaaccagtgatttccctc

SEQ ID NO: 487639 - DNA, 25 bp, Rattus norvegicus
gtattgtcaacctgtgatttccctc

SEQ ID NO: 487640 - DNA, 25 bp, Rattus norvegicus
gtattgtcacagacttgccataata

SEQ ID NO: 487641 - DNA, 25 bp, Rattus norvegicus
gtattgtcacagtcttgccataata

SEQ ID NO: 487642 - DNA, 25 bp, Rattus norvegicus
gtattgtccagactgactgttgctg

SEQ ID NO: 487643 - DNA, 25 bp, Rattus norvegicus
gtattgtccagagtgactgttgctg

SEQ ID NO: 487644 - DNA, 25 bp, Rattus norvegicus
gtattgtcccacaagcaggaggcat

SEQ ID NO: 487645 - DNA, 25 bp, Rattus norvegicus
gtattgtcccactagcaggaggcat

SEQ ID NO: 487646 - DNA, 25 bp, Rattus norvegicus
gtattgtctgtcatgaatcctccgc

SEQ ID NO: 487647 - DNA, 25 bp, Rattus norvegicus
gtattgtctgtcttgaatcctccgc

SEQ ID NO: 487648 - DNA, 25 bp, Rattus norvegicus
gtattgtgacagctgaagtatcttc

SEQ ID NO: 487649 - DNA, 25 bp, Rattus norvegicus
gtattgtgacaggtgaagtatcttc

SEQ ID NO: 487650 - DNA, 25 bp, Rattus norvegicus
gtattgtgcataattccctccatgt

SEQ ID NO: 487651 - DNA, 25 bp, Rattus norvegicus
gtattgtgcatatttccctccatgt

SEQ ID NO: 487652 - DNA, 25 bp, Rattus norvegicus
gtattgtgctccacctacagggaaa

SEQ ID NO: 487653 - DNA, 25 bp, Rattus norvegicus
gtattgtgctcctcctacagggaaa

SEQ ID NO: 487654 - DNA, 25 bp, Rattus norvegicus
gtattgtggttcattcccgggagat

SEQ ID NO: 487655 - DNA, 25 bp, Rattus norvegicus
gtattgtggttctttcccgggagat

SEQ ID NO: 487656 - DNA, 25 bp, Rattus norvegicus
gtattgtgtccaacagtacctcaga

SEQ ID NO: 487657 - DNA, 25 bp, Rattus norvegicus
gtattgtgtccatcagtacctcaga

SEQ ID NO: 487658 - DNA, 25 bp, Rattus norvegicus
gtattgtgtctgacctcataggcag

SEQ ID NO: 487659 - DNA, 25 bp, Rattus norvegicus
gtattgtgtctgagacagcccaggc

SEQ ID NO: 487660 - DNA, 25 bp, Rattus norvegicus
gtattgtgtctgtcctcataggcag

SEQ ID NO: 487661 - DNA, 25 bp, Rattus norvegicus
gtattgtgtctgtgacagcccaggc

SEQ ID NO: 487662 - DNA, 25 bp, Rattus norvegicus
gtattgttaaacactcttgggaatt

SEQ ID NO: 487663 - DNA, 25 bp, Rattus norvegicus
gtattgttaaactctcttgggaatt

SEQ ID NO: 487664 - DNA, 25 bp, Rattus norvegicus
gtattgttacccatcactgttaatt

SEQ ID NO: 487665 - DNA, 25 bp, Rattus norvegicus
gtattgttacccttcactgttaatt

SEQ ID NO: 487666 - DNA, 25 bp, Rattus norvegicus
gtattgttacctatatcctgttgaa

SEQ ID NO: 487667 - DNA, 25 bp, Rattus norvegicus
gtattgttacctttatcctgttgaa

SEQ ID NO: 487668 - DNA, 25 bp, Rattus norvegicus
gtattgttatctcctatatccacat

SEQ ID NO: 487669 - DNA, 25 bp, Rattus norvegicus
gtattgttatctgctatatccacat

SEQ ID NO: 487670 - DNA, 25 bp, Rattus norvegicus
gtattgttcatcacccacaagtgca

SEQ ID NO: 487671 - DNA, 25 bp, Rattus norvegicus
gtattgttcatctcccacaagtgca

SEQ ID NO: 487672 - DNA, 25 bp, Rattus norvegicus
gtattgttccctattaggtgacgat

SEQ ID NO: 487673 - DNA, 25 bp, Rattus norvegicus
gtattgttcccttttaggtgacgat

SEQ ID NO: 487674 - DNA, 25 bp, Rattus norvegicus
gtattgttctacagcctttcaaatg

SEQ ID NO: 487675 - DNA, 25 bp, Rattus norvegicus
gtattgttctactgcctttcaaatg

SEQ ID NO: 487676 - DNA, 25 bp, Rattus norvegicus
gtattgttggtacactagctcttta

SEQ ID NO: 487677 - DNA, 25 bp, Rattus norvegicus
gtattgttggtagactagctcttta

SEQ ID NO: 487678 - DNA, 25 bp, Rattus norvegicus
gtattgttgtacactttaccgtgta

SEQ ID NO: 487679 - DNA, 25 bp, Rattus norvegicus
gtattgttgtactctttaccgtgta

SEQ ID NO: 487680 - DNA, 25 bp, Rattus norvegicus
gtattgtttcctatgcaaggtactg

SEQ ID NO: 487681 - DNA, 25 bp, Rattus norvegicus
gtattgtttcctttgcaaggtactg

SEQ ID NO: 487682 - DNA, 25 bp, Rattus norvegicus
gtattgtttcttactctcagttcgt

SEQ ID NO: 487683 - DNA, 25 bp, Rattus norvegicus
gtattgtttctttctctcagttcgt

SEQ ID NO: 487684 - DNA, 25 bp, Rattus norvegicus
gtattgttttgtatgccatcactca

SEQ ID NO: 487685 - DNA, 25 bp, Rattus norvegicus
gtattgttttgtccatgtctatgtg

SEQ ID NO: 487686 - DNA, 25 bp, Rattus norvegicus
gtattgttttgtgcatgtctatgtg

SEQ ID NO: 487687 - DNA, 25 bp, Rattus norvegicus
gtattgttttgtttgccatcactca

SEQ ID NO: 487688 - DNA, 25 bp, Rattus norvegicus
gtatttaaaagcatccgcatcaagc

SEQ ID NO: 487689 - DNA, 25 bp, Rattus norvegicus
gtatttaaaagcttccgcatcaagc

SEQ ID NO: 487690 - DNA, 25 bp, Rattus norvegicus
gtatttaaactacctatcgtgcctg

SEQ ID NO: 487691 - DNA, 25 bp, Rattus norvegicus
gtatttaaactagctatcgtgcctg

SEQ ID NO: 487692 - DNA, 25 bp, Rattus norvegicus
gtatttaactccatcttgccaggtg

SEQ ID NO: 487693 - DNA, 25 bp, Rattus norvegicus
gtatttaactccttcttgccaggtg

SEQ ID NO: 487694 - DNA, 25 bp, Rattus norvegicus
gtatttaagatgagctcctgctgtg

SEQ ID NO: 487695 - DNA, 25 bp, Rattus norvegicus
gtatttaagatgtgctcctgctgtg

SEQ ID NO: 487696 - DNA, 25 bp, Rattus norvegicus
gtatttaatcttctagctgtgggct

SEQ ID NO: 487697 - DNA, 25 bp, Rattus norvegicus
gtatttaatcttgtagctgtgggct

SEQ ID NO: 487698 - DNA, 25 bp, Rattus norvegicus
gtatttaattttccagtcccacagg

SEQ ID NO: 487699 - DNA, 25 bp, Rattus norvegicus
gtatttaattttgcagtcccacagg

SEQ ID NO: 487700 - DNA, 25 bp, Rattus norvegicus
gtatttacaatcatacagtcataaa

SEQ ID NO: 487701 - DNA, 25 bp, Rattus norvegicus
gtatttacaatcttacagtcataaa

SEQ ID NO: 487702 - DNA, 25 bp, Rattus norvegicus
gtatttacacaaatgctacatacaa

SEQ ID NO: 487703 - DNA, 25 bp, Rattus norvegicus
gtatttacacaattgctacatacaa

SEQ ID NO: 487704 - DNA, 25 bp, Rattus norvegicus
gtatttacactaaccaggactctct

SEQ ID NO: 487705 - DNA, 25 bp, Rattus norvegicus
gtatttacactatccaggactctct

SEQ ID NO: 487706 - DNA, 25 bp, Rattus norvegicus
gtatttacagttaccagagtttgac

SEQ ID NO: 487707 - DNA, 25 bp, Rattus norvegicus
gtatttacagtttccagagtttgac

SEQ ID NO: 487708 - DNA, 25 bp, Rattus norvegicus
gtatttacatctcatttcccattcc

SEQ ID NO: 487709 - DNA, 25 bp, Rattus norvegicus
gtatttacatctgatttcccattcc

SEQ ID NO: 487710 - DNA, 25 bp, Rattus norvegicus
gtatttacgctgaaggctgctgagt

SEQ ID NO: 487711 - DNA, 25 bp, Rattus norvegicus
gtatttacgctgtaggctgctgagt

SEQ ID NO: 487712 - DNA, 25 bp, Rattus norvegicus
gtatttactagtccatggtcaatgc

SEQ ID NO: 487713 - DNA, 25 bp, Rattus norvegicus
gtatttactagtgcatggtcaatgc

SEQ ID NO: 487714 - DNA, 25 bp, Rattus norvegicus
gtatttactgccagtacttttacac

SEQ ID NO: 487715 - DNA, 25 bp, Rattus norvegicus
gtatttactgcctgtacttttacac

SEQ ID NO: 487716 - DNA, 25 bp, Rattus norvegicus
gtatttactgtgcttccatatttca

SEQ ID NO: 487717 - DNA, 25 bp, Rattus norvegicus
gtatttactgtggttccatatttca

SEQ ID NO: 487718 - DNA, 25 bp, Rattus norvegicus
gtatttacttttcttgactctgttt

SEQ ID NO: 487719 - DNA, 25 bp, Rattus norvegicus
gtatttacttttgttgactctgttt

SEQ ID NO: 487720 - DNA, 25 bp, Rattus norvegicus
gtatttagcaggctatctggcagat

SEQ ID NO: 487721 - DNA, 25 bp, Rattus norvegicus
gtatttagcagggtatctggcagat

SEQ ID NO: 487722 - DNA, 25 bp, Rattus norvegicus
gtatttagccttaggccatccatac

SEQ ID NO: 487723 - DNA, 25 bp, Rattus norvegicus
gtatttagcctttggccatccatac

SEQ ID NO: 487724 - DNA, 25 bp, Rattus norvegicus
gtatttaggtgtctgtactgcaaac

SEQ ID NO: 487725 - DNA, 25 bp, Rattus norvegicus
gtatttaggtgtgtgtactgcaaac

SEQ ID NO: 487726 - DNA, 25 bp, Rattus norvegicus
gtatttagtattatcttcccttcag

SEQ ID NO: 487727 - DNA, 25 bp, Rattus norvegicus
gtatttagtattttcttcccttcag

SEQ ID NO: 487728 - DNA, 25 bp, Rattus norvegicus
gtatttagtcccacattagattttt

SEQ ID NO: 487729 - DNA, 25 bp, Rattus norvegicus
gtatttagtccctcattagattttt

SEQ ID NO: 487730 - DNA, 25 bp, Rattus norvegicus
gtatttagtctaagtatgttccagg

SEQ ID NO: 487731 - DNA, 25 bp, Rattus norvegicus
gtatttagtctatgtatgttccagg

SEQ ID NO: 487732 - DNA, 25 bp, Rattus norvegicus
gtatttagtgccatctgtcttcaag

SEQ ID NO: 487733 - DNA, 25 bp, Rattus norvegicus
gtatttagtgccttctgtcttcaag

SEQ ID NO: 487734 - DNA, 25 bp, Rattus norvegicus
gtatttagtgtgcttgttttccaac

SEQ ID NO: 487735 - DNA, 25 bp, Rattus norvegicus
gtatttagtgtggttgttttccaac

SEQ ID NO: 487736 - DNA, 25 bp, Rattus norvegicus
gtatttagttcaagtttctgccctg

SEQ ID NO: 487737 - DNA, 25 bp, Rattus norvegicus
gtatttagttcatgtttctgccctg

SEQ ID NO: 487738 - DNA, 25 bp, Rattus norvegicus
gtatttatacacacagttctgcaaa

SEQ ID NO: 487739 - DNA, 25 bp, Rattus norvegicus
gtatttatacactcagttctgcaaa

SEQ ID NO: 487740 - DNA, 25 bp, Rattus norvegicus
gtatttatacgtatgtcgctcttca

SEQ ID NO: 487741 - DNA, 25 bp, Rattus norvegicus
gtatttatacgtttgtcgctcttca

SEQ ID NO: 487742 - DNA, 25 bp, Rattus norvegicus
gtatttatagagcagctcccgcgcg

SEQ ID NO: 487743 - DNA, 25 bp, Rattus norvegicus
gtatttatagaggagctcccgcgcg

SEQ ID NO: 487744 - DNA, 25 bp, Rattus norvegicus
gtatttatagcaacccaagcctctc

SEQ ID NO: 487745 - DNA, 25 bp, Rattus norvegicus
gtatttatagcatcccaagcctctc

SEQ ID NO: 487746 - DNA, 25 bp, Rattus norvegicus
gtatttatccatccgtggatccctc

SEQ ID NO: 487747 - DNA, 25 bp, Rattus norvegicus
gtatttatccatgcgtggatccctc

SEQ ID NO: 487748 - DNA, 25 bp, Rattus norvegicus
gtatttatctctcattatcctcttt

SEQ ID NO: 487749 - DNA, 25 bp, Rattus norvegicus
gtatttatctctgattatcctcttt

SEQ ID NO: 487750 - DNA, 25 bp, Rattus norvegicus
gtatttatgtatatcctcctaggtg

SEQ ID NO: 487751 - DNA, 25 bp, Rattus norvegicus
gtatttatgtatttcctcctaggtg

SEQ ID NO: 487752 - DNA, 25 bp, Rattus norvegicus
gtatttatgtgtatgcctgtctgcc

SEQ ID NO: 487753 - DNA, 25 bp, Rattus norvegicus
gtatttatgtgtttgcctgtctgcc

SEQ ID NO: 487754 - DNA, 25 bp, Rattus norvegicus
gtatttatgttaaaagcagtgcctt

SEQ ID NO: 487755 - DNA, 25 bp, Rattus norvegicus
gtatttatgttataagcagtgcctt

SEQ ID NO: 487756 - DNA, 25 bp, Rattus norvegicus
gtatttatgttgcttttgtgtctgt

SEQ ID NO: 487757 - DNA, 25 bp, Rattus norvegicus
gtatttatgttggttttgtgtctgt

SEQ ID NO: 487758 - DNA, 25 bp, Rattus norvegicus
gtatttattactcatttcctcccac

SEQ ID NO: 487759 - DNA, 25 bp, Rattus norvegicus
gtatttattactgatttcctcccac

SEQ ID NO: 487760 - DNA, 25 bp, Rattus norvegicus
gtatttattattaccgctagctttt

SEQ ID NO: 487761 - DNA, 25 bp, Rattus norvegicus
gtatttattatttccgctagctttt

SEQ ID NO: 487762 - DNA, 25 bp, Rattus norvegicus
gtatttattcccctttaggttgcag

SEQ ID NO: 487763 - DNA, 25 bp, Rattus norvegicus
gtatttattcccgtttaggttgcag

SEQ ID NO: 487764 - DNA, 25 bp, Rattus norvegicus
gtatttattgacattggctcttcta

SEQ ID NO: 487765 - DNA, 25 bp, Rattus norvegicus
gtatttattgactttggctcttcta

SEQ ID NO: 487766 - DNA, 25 bp, Rattus norvegicus
gtatttattgtacagcttgtctata

SEQ ID NO: 487767 - DNA, 25 bp, Rattus norvegicus
gtatttattgtagagcttgtctata

SEQ ID NO: 487768 - DNA, 25 bp, Rattus norvegicus
gtatttattgttccttcctaagccg

SEQ ID NO: 487769 - DNA, 25 bp, Rattus norvegicus
gtatttattgttgcttcctaagccg

SEQ ID NO: 487770 - DNA, 25 bp, Rattus norvegicus
gtatttatttataccaccaagtgtg

SEQ ID NO: 487771 - DNA, 25 bp, Rattus norvegicus
gtatttatttattccaccaagtgtg

SEQ ID NO: 487772 - DNA, 25 bp, Rattus norvegicus
gtatttatttcgaattccatgtgta

SEQ ID NO: 487773 - DNA, 25 bp, Rattus norvegicus
gtatttatttcgtattccatgtgta

SEQ ID NO: 487774 - DNA, 25 bp, Rattus norvegicus
gtatttcaaattatcagtgttgctt

SEQ ID NO: 487775 - DNA, 25 bp, Rattus norvegicus
gtatttcaaattttcagtgttgctt

SEQ ID NO: 487776 - DNA, 25 bp, Rattus norvegicus
gtatttcaacttagccaagccagtg

SEQ ID NO: 487777 - DNA, 25 bp, Rattus norvegicus
gtatttcaactttgccaagccagtg

SEQ ID NO: 487778 - DNA, 25 bp, Rattus norvegicus
gtatttcaagaaattgcccgcgcag

SEQ ID NO: 487779 - DNA, 25 bp, Rattus norvegicus
gtatttcaagaatttgcccgcgcag

SEQ ID NO: 487780 - DNA, 25 bp, Rattus norvegicus
gtatttcaagataatgtagtttaag

SEQ ID NO: 487781 - DNA, 25 bp, Rattus norvegicus
gtatttcaagattatgtagtttaag

SEQ ID NO: 487782 - DNA, 25 bp, Rattus norvegicus
gtatttcaaggaaaacgctcggctc

SEQ ID NO: 487783 - DNA, 25 bp, Rattus norvegicus
gtatttcaaggataacgctcggctc

SEQ ID NO: 487784 - DNA, 25 bp, Rattus norvegicus
gtatttcacaggaatgctcaagttt

SEQ ID NO: 487785 - DNA, 25 bp, Rattus norvegicus
gtatttcacaggtatgctcaagttt

SEQ ID NO: 487786 - DNA, 25 bp, Rattus norvegicus
gtatttcagatgctttcaactcttt

SEQ ID NO: 487787 - DNA, 25 bp, Rattus norvegicus
gtatttcagatggtttcaactcttt

SEQ ID NO: 487788 - DNA, 25 bp, Rattus norvegicus
gtatttcaggaacagcacagactct

SEQ ID NO: 487789 - DNA, 25 bp, Rattus norvegicus
gtatttcaggaagagcacagactct

SEQ ID NO: 487790 - DNA, 25 bp, Rattus norvegicus
gtatttcaggagatatttgcattca

SEQ ID NO: 487791 - DNA, 25 bp, Rattus norvegicus
gtatttcaggagttatttgcattca

SEQ ID NO: 487792 - DNA, 25 bp, Rattus norvegicus
gtatttcaggcccaatcaggagcac

SEQ ID NO: 487793 - DNA, 25 bp, Rattus norvegicus
gtatttcaggccgaatcaggagcac

SEQ ID NO: 487794 - DNA, 25 bp, Rattus norvegicus
gtatttcagggacctacggactgcc

SEQ ID NO: 487795 - DNA, 25 bp, Rattus norvegicus
gtatttcagggagctacggactgcc

SEQ ID NO: 487796 - DNA, 25 bp, Rattus norvegicus
gtatttcagtaaagtcctccacttt

SEQ ID NO: 487797 - DNA, 25 bp, Rattus norvegicus
gtatttcagtaaccatcagacaatt

SEQ ID NO: 487798 - DNA, 25 bp, Rattus norvegicus
gtatttcagtaagcatcagacaatt

SEQ ID NO: 487799 - DNA, 25 bp, Rattus norvegicus
gtatttcagtaatgtcctccacttt

SEQ ID NO: 487800 - DNA, 25 bp, Rattus norvegicus
gtatttcagtctagtaggcacacca

SEQ ID NO: 487801 - DNA, 25 bp, Rattus norvegicus
gtatttcagtcttgtaggcacacca

SEQ ID NO: 487802 - DNA, 25 bp, Rattus norvegicus
gtatttcagtgtattgtctttagca

SEQ ID NO: 487803 - DNA, 25 bp, Rattus norvegicus
gtatttcagtgttttgtctttagca

SEQ ID NO: 487804 - DNA, 25 bp, Rattus norvegicus
gtatttcagttcatgtcttgaccag

SEQ ID NO: 487805 - DNA, 25 bp, Rattus norvegicus
gtatttcagttcctggagggagaaa

SEQ ID NO: 487806 - DNA, 25 bp, Rattus norvegicus
gtatttcagttcgtggagggagaaa

SEQ ID NO: 487807 - DNA, 25 bp, Rattus norvegicus
gtatttcagttcttgtcttgaccag

SEQ ID NO: 487808 - DNA, 25 bp, Rattus norvegicus
gtatttcataccatggcctatctgt

SEQ ID NO: 487809 - DNA, 25 bp, Rattus norvegicus
gtatttcataccttggcctatctgt

SEQ ID NO: 487810 - DNA, 25 bp, Rattus norvegicus
gtatttcatagacacgcctttccaa

SEQ ID NO: 487811 - DNA, 25 bp, Rattus norvegicus
gtatttcatagagacgcctttccaa

SEQ ID NO: 487812 - DNA, 25 bp, Rattus norvegicus
gtatttcatagtatccgagacgtca

SEQ ID NO: 487813 - DNA, 25 bp, Rattus norvegicus
gtatttcatagtttccgagacgtca

SEQ ID NO: 487814 - DNA, 25 bp, Rattus norvegicus
gtatttcatcctaatgttttagttg

SEQ ID NO: 487815 - DNA, 25 bp, Rattus norvegicus
gtatttcatccttatgttttagttg

SEQ ID NO: 487816 - DNA, 25 bp, Rattus norvegicus
gtatttcatcttctggctattccat

SEQ ID NO: 487817 - DNA, 25 bp, Rattus norvegicus
gtatttcatcttgtggctattccat

SEQ ID NO: 487818 - DNA, 25 bp, Rattus norvegicus
gtatttccacagattaccttcactt

SEQ ID NO: 487819 - DNA, 25 bp, Rattus norvegicus
gtatttccacagtttaccttcactt

SEQ ID NO: 487820 - DNA, 25 bp, Rattus norvegicus
gtatttccagctctcagcaggcaga

SEQ ID NO: 487821 - DNA, 25 bp, Rattus norvegicus
gtatttccagctgtcagcaggcaga

SEQ ID NO: 487822 - DNA, 25 bp, Rattus norvegicus
gtatttccagttctccaaggacttt

SEQ ID NO: 487823 - DNA, 25 bp, Rattus norvegicus
gtatttccagttgtccaaggacttt

SEQ ID NO: 487824 - DNA, 25 bp, Rattus norvegicus
gtatttcccaaacatgcagctacta

SEQ ID NO: 487825 - DNA, 25 bp, Rattus norvegicus
gtatttcccaaagatgcagctacta

SEQ ID NO: 487826 - DNA, 25 bp, Rattus norvegicus
gtatttccccaaccccaatgaattt

SEQ ID NO: 487827 - DNA, 25 bp, Rattus norvegicus
gtatttccccaagcccaatgaattt

SEQ ID NO: 487828 - DNA, 25 bp, Rattus norvegicus
gtatttccccagcactgaacggtga

SEQ ID NO: 487829 - DNA, 25 bp, Rattus norvegicus
gtatttccccaggactgaacggtga

SEQ ID NO: 487830 - DNA, 25 bp, Rattus norvegicus
gtatttcccttgaaacattgcaaac

SEQ ID NO: 487831 - DNA, 25 bp, Rattus norvegicus
gtatttcccttgtaacattgcaaac

SEQ ID NO: 487832 - DNA, 25 bp, Rattus norvegicus
gtatttccgagcattacgtaccttc

SEQ ID NO: 487833 - DNA, 25 bp, Rattus norvegicus
gtatttccgagctttacgtaccttc

SEQ ID NO: 487834 - DNA, 25 bp, Rattus norvegicus
gtatttcctaaacagaactccaatg

SEQ ID NO: 487835 - DNA, 25 bp, Rattus norvegicus
gtatttcctaaagagaactccaatg

SEQ ID NO: 487836 - DNA, 25 bp, Rattus norvegicus
gtatttcctaagaacccaccttgtg

SEQ ID NO: 487837 - DNA, 25 bp, Rattus norvegicus
gtatttcctaagtacccaccttgtg

SEQ ID NO: 487838 - DNA, 25 bp, Rattus norvegicus
gtatttcctactacacttatgttgg

SEQ ID NO: 487839 - DNA, 25 bp, Rattus norvegicus
gtatttcctacttcacttatgttgg

SEQ ID NO: 487840 - DNA, 25 bp, Rattus norvegicus
gtatttcctagcagacacttgtttt

SEQ ID NO: 487841 - DNA, 25 bp, Rattus norvegicus
gtatttcctagctgacacttgtttt

SEQ ID NO: 487842 - DNA, 25 bp, Rattus norvegicus
gtatttcctcttccacctttatctt

SEQ ID NO: 487843 - DNA, 25 bp, Rattus norvegicus
gtatttcctcttgcacctttatctt

SEQ ID NO: 487844 - DNA, 25 bp, Rattus norvegicus
gtatttcctgtacatctggctttat

SEQ ID NO: 487845 - DNA, 25 bp, Rattus norvegicus
gtatttcctgtagatctggctttat

SEQ ID NO: 487846 - DNA, 25 bp, Rattus norvegicus
gtatttcctgttccgtttgactaag

SEQ ID NO: 487847 - DNA, 25 bp, Rattus norvegicus
gtatttcctgttgcgtttgactaag

SEQ ID NO: 487848 - DNA, 25 bp, Rattus norvegicus
gtatttcctttgaggcctttgccat

SEQ ID NO: 487849 - DNA, 25 bp, Rattus norvegicus
gtatttcctttgtggcctttgccat

SEQ ID NO: 487850 - DNA, 25 bp, Rattus norvegicus
gtatttccttttaatgaacctattg

SEQ ID NO: 487851 - DNA, 25 bp, Rattus norvegicus
gtatttcctttttatgaacctattg

SEQ ID NO: 487852 - DNA, 25 bp, Rattus norvegicus
gtatttctagaactcattggcaaag

SEQ ID NO: 487853 - DNA, 25 bp, Rattus norvegicus
gtatttctagaagtcattggcaaag

SEQ ID NO: 487854 - DNA, 25 bp, Rattus norvegicus
gtatttctagcactgaggctgtgtt

SEQ ID NO: 487855 - DNA, 25 bp, Rattus norvegicus
gtatttctagcagtgaggctgtgtt

SEQ ID NO: 487856 - DNA, 25 bp, Rattus norvegicus
gtatttctatgcaccattaactggt

SEQ ID NO: 487857 - DNA, 25 bp, Rattus norvegicus
gtatttctatgctccattaactggt

SEQ ID NO: 487858 - DNA, 25 bp, Rattus norvegicus
gtatttctcaagatgctactggtga

SEQ ID NO: 487859 - DNA, 25 bp, Rattus norvegicus
gtatttctcaagcagctatctagca

SEQ ID NO: 487860 - DNA, 25 bp, Rattus norvegicus
gtatttctcaaggagctatctagca

SEQ ID NO: 487861 - DNA, 25 bp, Rattus norvegicus
gtatttctcaagttgctactggtga

SEQ ID NO: 487862 - DNA, 25 bp, Rattus norvegicus
gtatttctcagacccaaggaccaaa

SEQ ID NO: 487863 - DNA, 25 bp, Rattus norvegicus
gtatttctcagagccaaggaccaaa

SEQ ID NO: 487864 - DNA, 25 bp, Rattus norvegicus
gtatttctcagcagtgatctttgga

SEQ ID NO: 487865 - DNA, 25 bp, Rattus norvegicus
gtatttctcagctgtgatctttgga

SEQ ID NO: 487866 - DNA, 25 bp, Rattus norvegicus
gtatttctccacaaggtaacctgct

SEQ ID NO: 487867 - DNA, 25 bp, Rattus norvegicus
gtatttctccactaggtaacctgct

SEQ ID NO: 487868 - DNA, 25 bp, Rattus norvegicus
gtatttctccatcacctgtaacaaa

SEQ ID NO: 487869 - DNA, 25 bp, Rattus norvegicus
gtatttctccatgacctgtaacaaa

SEQ ID NO: 487870 - DNA, 25 bp, Rattus norvegicus
gtatttctccgtagttggtgtttgc

SEQ ID NO: 487871 - DNA, 25 bp, Rattus norvegicus
gtatttctccgttgttggtgtttgc

SEQ ID NO: 487872 - DNA, 25 bp, Rattus norvegicus
gtatttctcctcagatatgtgattt

SEQ ID NO: 487873 - DNA, 25 bp, Rattus norvegicus
gtatttctcctctgatatgtgattt

SEQ ID NO: 487874 - DNA, 25 bp, Rattus norvegicus
gtatttctcctgcattttgggatat

SEQ ID NO: 487875 - DNA, 25 bp, Rattus norvegicus
gtatttctcctggattttgggatat

SEQ ID NO: 487876 - DNA, 25 bp, Rattus norvegicus
gtatttctccttagcaatagcagtt

SEQ ID NO: 487877 - DNA, 25 bp, Rattus norvegicus
gtatttctcctttgcaatagcagtt

SEQ ID NO: 487878 - DNA, 25 bp, Rattus norvegicus
gtatttctcgacattatgtcccact

SEQ ID NO: 487879 - DNA, 25 bp, Rattus norvegicus
gtatttctcgactttatgtcccact

SEQ ID NO: 487880 - DNA, 25 bp, Rattus norvegicus
gtatttctcttgacgattttcatat

SEQ ID NO: 487881 - DNA, 25 bp, Rattus norvegicus
gtatttctcttgtcgattttcatat

SEQ ID NO: 487882 - DNA, 25 bp, Rattus norvegicus
gtatttctgattcatgacctctgtt

SEQ ID NO: 487883 - DNA, 25 bp, Rattus norvegicus
gtatttctgattgatgacctctgtt

SEQ ID NO: 487884 - DNA, 25 bp, Rattus norvegicus
gtatttctgcttcgttttgacaaca

SEQ ID NO: 487885 - DNA, 25 bp, Rattus norvegicus
gtatttctgcttggttttgacaaca

SEQ ID NO: 487886 - DNA, 25 bp, Rattus norvegicus
gtatttctgtagaactgttttgcat

SEQ ID NO: 487887 - DNA, 25 bp, Rattus norvegicus
gtatttctgtagtactgttttgcat

SEQ ID NO: 487888 - DNA, 25 bp, Rattus norvegicus
gtatttctgtatatttctcaagtgg

SEQ ID NO: 487889 - DNA, 25 bp, Rattus norvegicus
gtatttctgtatttttctcaagtgg

SEQ ID NO: 487890 - DNA, 25 bp, Rattus norvegicus
gtatttctgtgtctgcaactaagct

SEQ ID NO: 487891 - DNA, 25 bp, Rattus norvegicus
gtatttctgtgtgtgcaactaagct

SEQ ID NO: 487892 - DNA, 25 bp, Rattus norvegicus
gtatttcttattcggcctgtacact

SEQ ID NO: 487893 - DNA, 25 bp, Rattus norvegicus
gtatttcttattgggcctgtacact

SEQ ID NO: 487894 - DNA, 25 bp, Rattus norvegicus
gtatttcttcctctgtagttcctaa

SEQ ID NO: 487895 - DNA, 25 bp, Rattus norvegicus
gtatttcttcctgtgtagttcctaa

SEQ ID NO: 487896 - DNA, 25 bp, Rattus norvegicus
gtatttcttgcacactgtttccagc

SEQ ID NO: 487897 - DNA, 25 bp, Rattus norvegicus
gtatttcttgcagactgtttccagc

SEQ ID NO: 487898 - DNA, 25 bp, Rattus norvegicus
gtatttctttacagctgtatcccca

SEQ ID NO: 487899 - DNA, 25 bp, Rattus norvegicus
gtatttctttactgctgtatcccca

SEQ ID NO: 487900 - DNA, 25 bp, Rattus norvegicus
gtatttcttttgatcagggctcatt

SEQ ID NO: 487901 - DNA, 25 bp, Rattus norvegicus
gtatttcttttgttcagggctcatt

SEQ ID NO: 487902 - DNA, 25 bp, Rattus norvegicus
gtatttgaagccacccttgtataga

SEQ ID NO: 487903 - DNA, 25 bp, Rattus norvegicus
gtatttgaagccctctacagaccga

SEQ ID NO: 487904 - DNA, 25 bp, Rattus norvegicus
gtatttgaagccgtctacagaccga

SEQ ID NO: 487905 - DNA, 25 bp, Rattus norvegicus
gtatttgaagcctcccttgtataga

SEQ ID NO: 487906 - DNA, 25 bp, Rattus norvegicus
gtatttgaatacattagaccacagg

SEQ ID NO: 487907 - DNA, 25 bp, Rattus norvegicus
gtatttgaatactttagaccacagg

SEQ ID NO: 487908 - DNA, 25 bp, Rattus norvegicus
gtatttgacctaatgtaaccttgta

SEQ ID NO: 487909 - DNA, 25 bp, Rattus norvegicus
gtatttgacctattgtaaccttgta

SEQ ID NO: 487910 - DNA, 25 bp, Rattus norvegicus
gtatttgactttaatcttccttgga

SEQ ID NO: 487911 - DNA, 25 bp, Rattus norvegicus
gtatttgacttttatcttccttgga

SEQ ID NO: 487912 - DNA, 25 bp, Rattus norvegicus
gtatttgatagtatcagtcacttta

SEQ ID NO: 487913 - DNA, 25 bp, Rattus norvegicus
gtatttgatagtttcagtcacttta

SEQ ID NO: 487914 - DNA, 25 bp, Rattus norvegicus
gtatttgatcatagccatctgcgca

SEQ ID NO: 487915 - DNA, 25 bp, Rattus norvegicus
gtatttgatcattgccatctgcgca

SEQ ID NO: 487916 - DNA, 25 bp, Rattus norvegicus
gtatttgattaccatctccatgaag

SEQ ID NO: 487917 - DNA, 25 bp, Rattus norvegicus
gtatttgattacgatctccatgaag

SEQ ID NO: 487918 - DNA, 25 bp, Rattus norvegicus
gtatttgcaacactatgaagcgctg

SEQ ID NO: 487919 - DNA, 25 bp, Rattus norvegicus
gtatttgcaacagtatgaagcgctg

SEQ ID NO: 487920 - DNA, 25 bp, Rattus norvegicus
gtatttgcagtcacaaccactctag

SEQ ID NO: 487921 - DNA, 25 bp, Rattus norvegicus
gtatttgcagtctcaaccactctag

SEQ ID NO: 487922 - DNA, 25 bp, Rattus norvegicus
gtatttgccaatcactgaaccatgt

SEQ ID NO: 487923 - DNA, 25 bp, Rattus norvegicus
gtatttgccaatgactgaaccatgt

SEQ ID NO: 487924 - DNA, 25 bp, Rattus norvegicus
gtatttgccatcaacaacaccaagt

SEQ ID NO: 487925 - DNA, 25 bp, Rattus norvegicus
gtatttgccatcctgagggttcgaa

SEQ ID NO: 487926 - DNA, 25 bp, Rattus norvegicus
gtatttgccatcgtgagggttcgaa

SEQ ID NO: 487927 - DNA, 25 bp, Rattus norvegicus
gtatttgccatctacaacaccaagt

SEQ ID NO: 487928 - DNA, 25 bp, Rattus norvegicus
gtatttgcccagatcagaaaatgta

SEQ ID NO: 487929 - DNA, 25 bp, Rattus norvegicus
gtatttgcccagttcagaaaatgta

SEQ ID NO: 487930 - DNA, 25 bp, Rattus norvegicus
gtatttgccctgctgttaattttgt

SEQ ID NO: 487931 - DNA, 25 bp, Rattus norvegicus
gtatttgccctggtgttaattttgt

SEQ ID NO: 487932 - DNA, 25 bp, Rattus norvegicus
gtatttgccgttcttaggatccagt

SEQ ID NO: 487933 - DNA, 25 bp, Rattus norvegicus
gtatttgccgttgttaggatccagt

SEQ ID NO: 487934 - DNA, 25 bp, Rattus norvegicus
gtatttgccttgatcttcgttgaat

SEQ ID NO: 487935 - DNA, 25 bp, Rattus norvegicus
gtatttgccttgttcttcgttgaat

SEQ ID NO: 487936 - DNA, 25 bp, Rattus norvegicus
gtatttgctacactagtgcagctta

SEQ ID NO: 487937 - DNA, 25 bp, Rattus norvegicus
gtatttgctacagtagtgcagctta

SEQ ID NO: 487938 - DNA, 25 bp, Rattus norvegicus
gtatttgctagacacactttgagac

SEQ ID NO: 487939 - DNA, 25 bp, Rattus norvegicus
gtatttgctagagacactttgagac

SEQ ID NO: 487940 - DNA, 25 bp, Rattus norvegicus
gtatttgcttttcaaccagtgtcag

SEQ ID NO: 487941 - DNA, 25 bp, Rattus norvegicus
gtatttgcttttgaaccagtgtcag

SEQ ID NO: 487942 - DNA, 25 bp, Rattus norvegicus
gtatttggaacaactgcctgcacag

SEQ ID NO: 487943 - DNA, 25 bp, Rattus norvegicus
gtatttggaacatctgcctgcacag

SEQ ID NO: 487944 - DNA, 25 bp, Rattus norvegicus
gtatttggacagattacatatgatt

SEQ ID NO: 487945 - DNA, 25 bp, Rattus norvegicus
gtatttggacagtttacatatgatt

SEQ ID NO: 487946 - DNA, 25 bp, Rattus norvegicus
gtatttggcagtcattccttctaat

SEQ ID NO: 487947 - DNA, 25 bp, Rattus norvegicus
gtatttggcagtgattccttctaat

SEQ ID NO: 487948 - DNA, 25 bp, Rattus norvegicus
gtatttgggactcaattgcactaag

SEQ ID NO: 487949 - DNA, 25 bp, Rattus norvegicus
gtatttgggactgaattgcactaag

SEQ ID NO: 487950 - DNA, 25 bp, Rattus norvegicus
gtatttggtaatatcccattagcat

SEQ ID NO: 487951 - DNA, 25 bp, Rattus norvegicus
gtatttggtaatttcccattagcat

SEQ ID NO: 487952 - DNA, 25 bp, Rattus norvegicus
gtatttggtttgactatattatata

SEQ ID NO: 487953 - DNA, 25 bp, Rattus norvegicus
gtatttggtttgtctatattatata

SEQ ID NO: 487954 - DNA, 25 bp, Rattus norvegicus
gtatttgtaacaaggcacttttctt

SEQ ID NO: 487955 - DNA, 25 bp, Rattus norvegicus
gtatttgtaacatggcacttttctt

SEQ ID NO: 487956 - DNA, 25 bp, Rattus norvegicus
gtatttgtaataagatcttctgatt

SEQ ID NO: 487957 - DNA, 25 bp, Rattus norvegicus
gtatttgtaataatctcaggacctg

SEQ ID NO: 487958 - DNA, 25 bp, Rattus norvegicus
gtatttgtaatatgatcttctgatt

SEQ ID NO: 487959 - DNA, 25 bp, Rattus norvegicus
gtatttgtaatattctcaggacctg

SEQ ID NO: 487960 - DNA, 25 bp, Rattus norvegicus
gtatttgtacagaagtgtgcgaaat

SEQ ID NO: 487961 - DNA, 25 bp, Rattus norvegicus
gtatttgtacagtagtgtgcgaaat

SEQ ID NO: 487962 - DNA, 25 bp, Rattus norvegicus
gtatttgtacataaacttgcacttg

SEQ ID NO: 487963 - DNA, 25 bp, Rattus norvegicus
gtatttgtacattaacttgcacttg

SEQ ID NO: 487964 - DNA, 25 bp, Rattus norvegicus
gtatttgtactcctacaacccgaag

SEQ ID NO: 487965 - DNA, 25 bp, Rattus norvegicus
gtatttgtactcgtacaacccgaag

SEQ ID NO: 487966 - DNA, 25 bp, Rattus norvegicus
gtatttgtagacctgactttctgca

SEQ ID NO: 487967 - DNA, 25 bp, Rattus norvegicus
gtatttgtagacgtgactttctgca

SEQ ID NO: 487968 - DNA, 25 bp, Rattus norvegicus
gtatttgtatacaccatcctacctt

SEQ ID NO: 487969 - DNA, 25 bp, Rattus norvegicus
gtatttgtatactccatcctacctt

SEQ ID NO: 487970 - DNA, 25 bp, Rattus norvegicus
gtatttgtcaggatcataggtgatt

SEQ ID NO: 487971 - DNA, 25 bp, Rattus norvegicus
gtatttgtcaggttcataggtgatt

SEQ ID NO: 487972 - DNA, 25 bp, Rattus norvegicus
gtatttgtgactcgctcttcggagc

SEQ ID NO: 487973 - DNA, 25 bp, Rattus norvegicus
gtatttgtgactggctcttcggagc

SEQ ID NO: 487974 - DNA, 25 bp, Rattus norvegicus
gtatttgtgcaaacggagctgactt

SEQ ID NO: 487975 - DNA, 25 bp, Rattus norvegicus
gtatttgtgcaatcggagctgactt

SEQ ID NO: 487976 - DNA, 25 bp, Rattus norvegicus
gtatttgtggttatgccttaggcac

SEQ ID NO: 487977 - DNA, 25 bp, Rattus norvegicus
gtatttgtggttttgccttaggcac

SEQ ID NO: 487978 - DNA, 25 bp, Rattus norvegicus
gtatttgtgtcaatgtatctgccct

SEQ ID NO: 487979 - DNA, 25 bp, Rattus norvegicus
gtatttgtgtcattgtatctgccct

SEQ ID NO: 487980 - DNA, 25 bp, Rattus norvegicus
gtatttgtgtttacgcgatgctaga

SEQ ID NO: 487981 - DNA, 25 bp, Rattus norvegicus
gtatttgtgttttcgcgatgctaga

SEQ ID NO: 487982 - DNA, 25 bp, Rattus norvegicus
gtatttgttaaaccacggttgtcca

SEQ ID NO: 487983 - DNA, 25 bp, Rattus norvegicus
gtatttgttaaagcacggttgtcca

SEQ ID NO: 487984 - DNA, 25 bp, Rattus norvegicus
gtatttgttactactttccaggacg

SEQ ID NO: 487985 - DNA, 25 bp, Rattus norvegicus
gtatttgttacttctttccaggacg

SEQ ID NO: 487986 - DNA, 25 bp, Rattus norvegicus
gtatttgttcatcaggcaacggtcc

SEQ ID NO: 487987 - DNA, 25 bp, Rattus norvegicus
gtatttgttcatgaggcaacggtcc

SEQ ID NO: 487988 - DNA, 25 bp, Rattus norvegicus
gtatttgtttcaaaagcatcttcct

SEQ ID NO: 487989 - DNA, 25 bp, Rattus norvegicus
gtatttgtttcataagcatcttcct

SEQ ID NO: 487990 - DNA, 25 bp, Rattus norvegicus
gtatttgtttcccacatttttgtga

SEQ ID NO: 487991 - DNA, 25 bp, Rattus norvegicus
gtatttgtttccgacatttttgtga

SEQ ID NO: 487992 - DNA, 25 bp, Rattus norvegicus
gtatttgtttctataatttggccaa

SEQ ID NO: 487993 - DNA, 25 bp, Rattus norvegicus
gtatttgtttctttaatttggccaa

SEQ ID NO: 487994 - DNA, 25 bp, Rattus norvegicus
gtatttgtttgaagtgtccacgctc

SEQ ID NO: 487995 - DNA, 25 bp, Rattus norvegicus
gtatttgtttgatgtgtccacgctc

SEQ ID NO: 487996 - DNA, 25 bp, Rattus norvegicus
gtatttgtttggaaaagcaaggcac

SEQ ID NO: 487997 - DNA, 25 bp, Rattus norvegicus
gtatttgtttggtaaagcaaggcac

SEQ ID NO: 487998 - DNA, 25 bp, Rattus norvegicus
gtatttgttttcaacatcgccaagg

SEQ ID NO: 487999 - DNA, 25 bp, Rattus norvegicus
gtatttgttttcctgccaaacttgg

SEQ ID NO: 488000 - DNA, 25 bp, Rattus norvegicus
gtatttgttttcgtgccaaacttgg

SEQ ID NO: 488001 - DNA, 25 bp, Rattus norvegicus
gtatttgttttctacatcgccaagg

SEQ ID NO: 488002 - DNA, 25 bp, Rattus norvegicus
gtattttaactgattctctgatcaa

SEQ ID NO: 488003 - DNA, 25 bp, Rattus norvegicus
gtattttaactgtttctctgatcaa

SEQ ID NO: 488004 - DNA, 25 bp, Rattus norvegicus
gtattttaatatagcctgacctgaa

SEQ ID NO: 488005 - DNA, 25 bp, Rattus norvegicus
gtattttaatattgcctgacctgaa

SEQ ID NO: 488006 - DNA, 25 bp, Rattus norvegicus
gtattttacagaaaccatggttctt

SEQ ID NO: 488007 - DNA, 25 bp, Rattus norvegicus
gtattttacagataccatggttctt

SEQ ID NO: 488008 - DNA, 25 bp, Rattus norvegicus
gtattttaccctccgaattagtcca

SEQ ID NO: 488009 - DNA, 25 bp, Rattus norvegicus
gtattttaccctgcgaattagtcca

SEQ ID NO: 488010 - DNA, 25 bp, Rattus norvegicus
gtattttaccgaattcgactctgtg

SEQ ID NO: 488011 - DNA, 25 bp, Rattus norvegicus
gtattttaccgatttcgactctgtg

SEQ ID NO: 488012 - DNA, 25 bp, Rattus norvegicus
gtattttacctacaaggtccgctat

SEQ ID NO: 488013 - DNA, 25 bp, Rattus norvegicus
gtattttacctagaaggtccgctat

SEQ ID NO: 488014 - DNA, 25 bp, Rattus norvegicus
gtattttacgtgacttgtgcacatg

SEQ ID NO: 488015 - DNA, 25 bp, Rattus norvegicus
gtattttacgtgtcttgtgcacatg

SEQ ID NO: 488016 - DNA, 25 bp, Rattus norvegicus
gtattttactagatccattgcatta

SEQ ID NO: 488017 - DNA, 25 bp, Rattus norvegicus
gtattttactagttccattgcatta

SEQ ID NO: 488018 - DNA, 25 bp, Rattus norvegicus
gtattttacttcattgccatcagca

SEQ ID NO: 488019 - DNA, 25 bp, Rattus norvegicus
gtattttacttcctataatcctaat

SEQ ID NO: 488020 - DNA, 25 bp, Rattus norvegicus
gtattttacttcgtataatcctaat

SEQ ID NO: 488021 - DNA, 25 bp, Rattus norvegicus
gtattttacttctttgccatcagca

SEQ ID NO: 488022 - DNA, 25 bp, Rattus norvegicus
gtattttagaaccacagccatgctt

SEQ ID NO: 488023 - DNA, 25 bp, Rattus norvegicus
gtattttagaacgacagccatgctt

SEQ ID NO: 488024 - DNA, 25 bp, Rattus norvegicus
gtattttagcctcattaagttgcat

SEQ ID NO: 488025 - DNA, 25 bp, Rattus norvegicus
gtattttagcctgattaagttgcat

SEQ ID NO: 488026 - DNA, 25 bp, Rattus norvegicus
gtattttagcttagtggccacgtga

SEQ ID NO: 488027 - DNA, 25 bp, Rattus norvegicus
gtattttagctttgtggccacgtga

SEQ ID NO: 488028 - DNA, 25 bp, Rattus norvegicus
gtattttaggagctgctggcctgcc

SEQ ID NO: 488029 - DNA, 25 bp, Rattus norvegicus
gtattttaggaggtgctggcctgcc

SEQ ID NO: 488030 - DNA, 25 bp, Rattus norvegicus
gtattttagtaaatttggaccagtg

SEQ ID NO: 488031 - DNA, 25 bp, Rattus norvegicus
gtattttagtaattttggaccagtg

SEQ ID NO: 488032 - DNA, 25 bp, Rattus norvegicus
gtattttagtatatcagccaaccag

SEQ ID NO: 488033 - DNA, 25 bp, Rattus norvegicus
gtattttagtatttcagccaaccag

SEQ ID NO: 488034 - DNA, 25 bp, Rattus norvegicus
gtattttatcttcagtgttggtcca

SEQ ID NO: 488035 - DNA, 25 bp, Rattus norvegicus
gtattttatcttgagtgttggtcca

SEQ ID NO: 488036 - DNA, 25 bp, Rattus norvegicus
gtattttcactcctgatacttaata

SEQ ID NO: 488037 - DNA, 25 bp, Rattus norvegicus
gtattttcactcgtgatacttaata

SEQ ID NO: 488038 - DNA, 25 bp, Rattus norvegicus
gtattttcactgcagtatcttgtac

SEQ ID NO: 488039 - DNA, 25 bp, Rattus norvegicus
gtattttcactggagtatcttgtac

SEQ ID NO: 488040 - DNA, 25 bp, Rattus norvegicus
gtattttcagggatgtactgtgtac

SEQ ID NO: 488041 - DNA, 25 bp, Rattus norvegicus
gtattttcagggttgtactgtgtac

SEQ ID NO: 488042 - DNA, 25 bp, Rattus norvegicus
gtattttcatacaggcaaggttctc

SEQ ID NO: 488043 - DNA, 25 bp, Rattus norvegicus
gtattttcatacagtttgacccaag

SEQ ID NO: 488044 - DNA, 25 bp, Rattus norvegicus
gtattttcatactggcaaggttctc

SEQ ID NO: 488045 - DNA, 25 bp, Rattus norvegicus
gtattttcatactgtttgacccaag

SEQ ID NO: 488046 - DNA, 25 bp, Rattus norvegicus
gtattttcatataccttctctttta

SEQ ID NO: 488047 - DNA, 25 bp, Rattus norvegicus
gtattttcatattccttctctttta

SEQ ID NO: 488048 - DNA, 25 bp, Rattus norvegicus
gtattttcatcactcagctcattca

SEQ ID NO: 488049 - DNA, 25 bp, Rattus norvegicus
gtattttcatcagtcagctcattca

SEQ ID NO: 488050 - DNA, 25 bp, Rattus norvegicus
gtattttcatctatgccaggcctaa

SEQ ID NO: 488051 - DNA, 25 bp, Rattus norvegicus
gtattttcatctttgccaggcctaa

SEQ ID NO: 488052 - DNA, 25 bp, Rattus norvegicus
gtattttcatttcaccccaatctct

SEQ ID NO: 488053 - DNA, 25 bp, Rattus norvegicus
gtattttcatttgaccccaatctct

SEQ ID NO: 488054 - DNA, 25 bp, Rattus norvegicus
gtattttccaggcacagaagcattt

SEQ ID NO: 488055 - DNA, 25 bp, Rattus norvegicus
gtattttccagggacagaagcattt

SEQ ID NO: 488056 - DNA, 25 bp, Rattus norvegicus
gtattttccccaatcttatatgcca

SEQ ID NO: 488057 - DNA, 25 bp, Rattus norvegicus
gtattttccccattcttatatgcca

SEQ ID NO: 488058 - DNA, 25 bp, Rattus norvegicus
gtattttcccgtaatgcatgcgcat

SEQ ID NO: 488059 - DNA, 25 bp, Rattus norvegicus
gtattttcccgttatgcatgcgcat

SEQ ID NO: 488060 - DNA, 25 bp, Rattus norvegicus
gtattttccgttatcatttgatttg

SEQ ID NO: 488061 - DNA, 25 bp, Rattus norvegicus
gtattttccgttttcatttgatttg

SEQ ID NO: 488062 - DNA, 25 bp, Rattus norvegicus
gtattttctctacttacaaattcta

SEQ ID NO: 488063 - DNA, 25 bp, Rattus norvegicus
gtattttctctagttacaaattcta

SEQ ID NO: 488064 - DNA, 25 bp, Rattus norvegicus
gtattttctctcaatttaatctaaa

SEQ ID NO: 488065 - DNA, 25 bp, Rattus norvegicus
gtattttctctctatttaatctaaa

SEQ ID NO: 488066 - DNA, 25 bp, Rattus norvegicus
gtattttctctgaccacagttctat

SEQ ID NO: 488067 - DNA, 25 bp, Rattus norvegicus
gtattttctctgtccacagttctat

SEQ ID NO: 488068 - DNA, 25 bp, Rattus norvegicus
gtattttctgctacactagttgtca

SEQ ID NO: 488069 - DNA, 25 bp, Rattus norvegicus
gtattttctgctcgcttcaacagtg

SEQ ID NO: 488070 - DNA, 25 bp, Rattus norvegicus
gtattttctgctggcttcaacagtg

SEQ ID NO: 488071 - DNA, 25 bp, Rattus norvegicus
gtattttctgcttcactagttgtca

SEQ ID NO: 488072 - DNA, 25 bp, Rattus norvegicus
gtattttctggccttggtcctttgc

SEQ ID NO: 488073 - DNA, 25 bp, Rattus norvegicus
gtattttctggcgttggtcctttgc

SEQ ID NO: 488074 - DNA, 25 bp, Rattus norvegicus
gtattttctgtactataactgtcta

SEQ ID NO: 488075 - DNA, 25 bp, Rattus norvegicus
gtattttctgtagtataactgtcta

SEQ ID NO: 488076 - DNA, 25 bp, Rattus norvegicus
gtattttcttatctagtccataaca

SEQ ID NO: 488077 - DNA, 25 bp, Rattus norvegicus
gtattttcttatgtagtccataaca

SEQ ID NO: 488078 - DNA, 25 bp, Rattus norvegicus
gtattttcttgacctcaccacccta

SEQ ID NO: 488079 - DNA, 25 bp, Rattus norvegicus
gtattttcttgagctcaccacccta

SEQ ID NO: 488080 - DNA, 25 bp, Rattus norvegicus
gtattttcttgtctgatcagatcta

SEQ ID NO: 488081 - DNA, 25 bp, Rattus norvegicus
gtattttcttgtgtgatcagatcta

SEQ ID NO: 488082 - DNA, 25 bp, Rattus norvegicus
gtattttctttaatcataagctttg

SEQ ID NO: 488083 - DNA, 25 bp, Rattus norvegicus
gtattttctttattcataagctttg

SEQ ID NO: 488084 - DNA, 25 bp, Rattus norvegicus
gtattttgacttacatgttttggaa

SEQ ID NO: 488085 - DNA, 25 bp, Rattus norvegicus
gtattttgactttcatgttttggaa

SEQ ID NO: 488086 - DNA, 25 bp, Rattus norvegicus
gtattttgataccacatggatgtga

SEQ ID NO: 488087 - DNA, 25 bp, Rattus norvegicus
gtattttgatacgacatggatgtga

SEQ ID NO: 488088 - DNA, 25 bp, Rattus norvegicus
gtattttgcagacctatcaatgtct

SEQ ID NO: 488089 - DNA, 25 bp, Rattus norvegicus
gtattttgcagagctatcaatgtct

SEQ ID NO: 488090 - DNA, 25 bp, Rattus norvegicus
gtattttgccttacaggaagccttt

SEQ ID NO: 488091 - DNA, 25 bp, Rattus norvegicus
gtattttgcctttcaggaagccttt

SEQ ID NO: 488092 - DNA, 25 bp, Rattus norvegicus
gtattttggcacaggaaactttcca

SEQ ID NO: 488093 - DNA, 25 bp, Rattus norvegicus
gtattttggcactggaaactttcca

SEQ ID NO: 488094 - DNA, 25 bp, Rattus norvegicus
gtattttggcataagcagccttctg

SEQ ID NO: 488095 - DNA, 25 bp, Rattus norvegicus
gtattttggcattagcagccttctg

SEQ ID NO: 488096 - DNA, 25 bp, Rattus norvegicus
gtattttggctacagcaaacctttg

SEQ ID NO: 488097 - DNA, 25 bp, Rattus norvegicus
gtattttggctagagcaaacctttg

SEQ ID NO: 488098 - DNA, 25 bp, Rattus norvegicus
gtattttggtagcttctggtgccac

SEQ ID NO: 488099 - DNA, 25 bp, Rattus norvegicus
gtattttggtaggttctggtgccac

SEQ ID NO: 488100 - DNA, 25 bp, Rattus norvegicus
gtattttggttccacatcacagtga

SEQ ID NO: 488101 - DNA, 25 bp, Rattus norvegicus
gtattttggttcgacatcacagtga

SEQ ID NO: 488102 - DNA, 25 bp, Rattus norvegicus
gtattttgtcaaacctttctcatag

SEQ ID NO: 488103 - DNA, 25 bp, Rattus norvegicus
gtattttgtcaatcctttctcatag

SEQ ID NO: 488104 - DNA, 25 bp, Rattus norvegicus
gtattttgtccaaagctgtggtcct

SEQ ID NO: 488105 - DNA, 25 bp, Rattus norvegicus
gtattttgtccatagctgtggtcct

SEQ ID NO: 488106 - DNA, 25 bp, Rattus norvegicus
gtattttgtcttacggagttgtcac

SEQ ID NO: 488107 - DNA, 25 bp, Rattus norvegicus
gtattttgtctttcggagttgtcac

SEQ ID NO: 488108 - DNA, 25 bp, Rattus norvegicus
gtattttgtgagcataccagtaaaa

SEQ ID NO: 488109 - DNA, 25 bp, Rattus norvegicus
gtattttgtgaggataccagtaaaa

SEQ ID NO: 488110 - DNA, 25 bp, Rattus norvegicus
gtattttgtggtactcgatgcttct

SEQ ID NO: 488111 - DNA, 25 bp, Rattus norvegicus
gtattttgtggttctcgatgcttct

SEQ ID NO: 488112 - DNA, 25 bp, Rattus norvegicus
gtattttgtgttaaccctagcagca

SEQ ID NO: 488113 - DNA, 25 bp, Rattus norvegicus
gtattttgtgtttaccctagcagca

SEQ ID NO: 488114 - DNA, 25 bp, Rattus norvegicus
gtattttgttctctttgctatccag

SEQ ID NO: 488115 - DNA, 25 bp, Rattus norvegicus
gtattttgttctgtttgctatccag

SEQ ID NO: 488116 - DNA, 25 bp, Rattus norvegicus
gtatttttacctatgtgccagtcct

SEQ ID NO: 488117 - DNA, 25 bp, Rattus norvegicus
gtatttttacctttgtgccagtcct

SEQ ID NO: 488118 - DNA, 25 bp, Rattus norvegicus
gtatttttatacatcttcaccatct

SEQ ID NO: 488119 - DNA, 25 bp, Rattus norvegicus
gtatttttatacttcttcaccatct

SEQ ID NO: 488120 - DNA, 25 bp, Rattus norvegicus
gtatttttatggaccccaatctgca

SEQ ID NO: 488121 - DNA, 25 bp, Rattus norvegicus
gtatttttatggtccccaatctgca

SEQ ID NO: 488122 - DNA, 25 bp, Rattus norvegicus
gtatttttattcctctttcttcact

SEQ ID NO: 488123 - DNA, 25 bp, Rattus norvegicus
gtatttttattcgtctttcttcact

SEQ ID NO: 488124 - DNA, 25 bp, Rattus norvegicus
gtatttttcattaccgcaaagactt

SEQ ID NO: 488125 - DNA, 25 bp, Rattus norvegicus
gtatttttcatttccgcaaagactt

SEQ ID NO: 488126 - DNA, 25 bp, Rattus norvegicus
gtatttttccagagtacatttcaga

SEQ ID NO: 488127 - DNA, 25 bp, Rattus norvegicus
gtatttttccagtgtacatttcaga

SEQ ID NO: 488128 - DNA, 25 bp, Rattus norvegicus
gtatttttcctgatgacctatccca

SEQ ID NO: 488129 - DNA, 25 bp, Rattus norvegicus
gtatttttcctgttgacctatccca

SEQ ID NO: 488130 - DNA, 25 bp, Rattus norvegicus
gtatttttctgcatactagactaat

SEQ ID NO: 488131 - DNA, 25 bp, Rattus norvegicus
gtatttttctgcttactagactaat

SEQ ID NO: 488132 - DNA, 25 bp, Rattus norvegicus
gtatttttgaaacacctctcactgc

SEQ ID NO: 488133 - DNA, 25 bp, Rattus norvegicus
gtatttttgaaagacctctcactgc

SEQ ID NO: 488134 - DNA, 25 bp, Rattus norvegicus
gtatttttgaatagcctactcccaa

SEQ ID NO: 488135 - DNA, 25 bp, Rattus norvegicus
gtatttttgaattgcctactcccaa

SEQ ID NO: 488136 - DNA, 25 bp, Rattus norvegicus
gtatttttgagtcccttaccctgtc

SEQ ID NO: 488137 - DNA, 25 bp, Rattus norvegicus
gtatttttgagtgccttaccctgtc

SEQ ID NO: 488138 - DNA, 25 bp, Rattus norvegicus
gtatttttgcttcaatgcttccctt

SEQ ID NO: 488139 - DNA, 25 bp, Rattus norvegicus
gtatttttgcttgaatgcttccctt

SEQ ID NO: 488140 - DNA, 25 bp, Rattus norvegicus
gtatttttggctattgctcacctca

SEQ ID NO: 488141 - DNA, 25 bp, Rattus norvegicus
gtatttttggcttttgctcacctca

SEQ ID NO: 488142 - DNA, 25 bp, Rattus norvegicus
gtatttttggtcagtgtacccgtgt

SEQ ID NO: 488143 - DNA, 25 bp, Rattus norvegicus
gtatttttggtctgtgtacccgtgt

SEQ ID NO: 488144 - DNA, 25 bp, Rattus norvegicus
gtatttttgtaacttgctggagtga

SEQ ID NO: 488145 - DNA, 25 bp, Rattus norvegicus
gtatttttgtaagttgctggagtga

SEQ ID NO: 488146 - DNA, 25 bp, Rattus norvegicus
gtattttttagcatttcctgtgtcc

SEQ ID NO: 488147 - DNA, 25 bp, Rattus norvegicus
gtattttttagcttttcctgtgtcc

SEQ ID NO: 488148 - DNA, 25 bp, Rattus norvegicus
gtattttttcacatgtttctgcatt

SEQ ID NO: 488149 - DNA, 25 bp, Rattus norvegicus
gtattttttcacttgtttctgcatt

SEQ ID NO: 488150 - DNA, 25 bp, Rattus norvegicus
gtattttttctgactgtaagccctg

SEQ ID NO: 488151 - DNA, 25 bp, Rattus norvegicus
gtattttttctgtctgtaagccctg

SEQ ID NO: 488152 - DNA, 25 bp, Rattus norvegicus
gtattttttcttcctcagcttgctc

SEQ ID NO: 488153 - DNA, 25 bp, Rattus norvegicus
gtattttttcttgctcagcttgctc

SEQ ID NO: 488154 - DNA, 25 bp, Rattus norvegicus
gtcaaaaacaagctcacctctaaga

SEQ ID NO: 488155 - DNA, 25 bp, Rattus norvegicus
gtcaaaaacaaggtcacctctaaga

SEQ ID NO: 488156 - DNA, 25 bp, Rattus norvegicus
gtcaaaaagctactcaccagttctg

SEQ ID NO: 488157 - DNA, 25 bp, Rattus norvegicus
gtcaaaaagctagtcaccagttctg

SEQ ID NO: 488158 - DNA, 25 bp, Rattus norvegicus
gtcaaaaagtctcttgcacatgcgt

SEQ ID NO: 488159 - DNA, 25 bp, Rattus norvegicus
gtcaaaaagtctgttgcacatgcgt

SEQ ID NO: 488160 - DNA, 25 bp, Rattus norvegicus
gtcaaaaatgtcaccagctgtctgt

SEQ ID NO: 488161 - DNA, 25 bp, Rattus norvegicus
gtcaaaaatgtctccagctgtctgt

SEQ ID NO: 488162 - DNA, 25 bp, Rattus norvegicus
gtcaaaacaaccaacgaaatccaag

SEQ ID NO: 488163 - DNA, 25 bp, Rattus norvegicus
gtcaaaacaacctacgaaatccaag

SEQ ID NO: 488164 - DNA, 25 bp, Rattus norvegicus
gtcaaaaccaccaaggctgagaaga

SEQ ID NO: 488165 - DNA, 25 bp, Rattus norvegicus
gtcaaaaccacctaggctgagaaga

SEQ ID NO: 488166 - DNA, 25 bp, Rattus norvegicus
gtcaaaactcccaaacagactcctt

SEQ ID NO: 488167 - DNA, 25 bp, Rattus norvegicus
gtcaaaactccctaacagactcctt

SEQ ID NO: 488168 - DNA, 25 bp, Rattus norvegicus
gtcaaaactgttatagctgccaaag

SEQ ID NO: 488169 - DNA, 25 bp, Rattus norvegicus
gtcaaaactgttttagctgccaaag

SEQ ID NO: 488170 - DNA, 25 bp, Rattus norvegicus
gtcaaaacttaccagggtcactcat

SEQ ID NO: 488171 - DNA, 25 bp, Rattus norvegicus
gtcaaaacttacgagggtcactcat

SEQ ID NO: 488172 - DNA, 25 bp, Rattus norvegicus
gtcaaaagcaaacctaagaagcatt

SEQ ID NO: 488173 - DNA, 25 bp, Rattus norvegicus
gtcaaaagcaaagctaagaagcatt

SEQ ID NO: 488174 - DNA, 25 bp, Rattus norvegicus
gtcaaaagctgtagcctacatgtgg

SEQ ID NO: 488175 - DNA, 25 bp, Rattus norvegicus
gtcaaaagctgttgcctacatgtgg

SEQ ID NO: 488176 - DNA, 25 bp, Rattus norvegicus
gtcaaaaggcccagattctgccctg

SEQ ID NO: 488177 - DNA, 25 bp, Rattus norvegicus
gtcaaaaggccctgattctgccctg

SEQ ID NO: 488178 - DNA, 25 bp, Rattus norvegicus
gtcaaaaggcctatcaactctcaaa

SEQ ID NO: 488179 - DNA, 25 bp, Rattus norvegicus
gtcaaaaggcctttcaactctcaaa

SEQ ID NO: 488180 - DNA, 25 bp, Rattus norvegicus
gtcaaaataaccaatctgaagatgt

SEQ ID NO: 488181 - DNA, 25 bp, Rattus norvegicus
gtcaaaataacctatctgaagatgt

SEQ ID NO: 488182 - DNA, 25 bp, Rattus norvegicus
gtcaaacaacccaagggatcccagt

SEQ ID NO: 488183 - DNA, 25 bp, Rattus norvegicus
gtcaaacaacccacatattccttaa

SEQ ID NO: 488184 - DNA, 25 bp, Rattus norvegicus
gtcaaacaaccctagggatcccagt

SEQ ID NO: 488185 - DNA, 25 bp, Rattus norvegicus
gtcaaacaaccctcatattccttaa

SEQ ID NO: 488186 - DNA, 25 bp, Rattus norvegicus
gtcaaacaagggacactaagttgta

SEQ ID NO: 488187 - DNA, 25 bp, Rattus norvegicus
gtcaaacaagggtcactaagttgta

SEQ ID NO: 488188 - DNA, 25 bp, Rattus norvegicus
gtcaaacaagttacttcttaggcta

SEQ ID NO: 488189 - DNA, 25 bp, Rattus norvegicus
gtcaaacaagtttcttcttaggcta

SEQ ID NO: 488190 - DNA, 25 bp, Rattus norvegicus
gtcaaacactgaatccaccataagc

SEQ ID NO: 488191 - DNA, 25 bp, Rattus norvegicus
gtcaaacactgattccaccataagc

SEQ ID NO: 488192 - DNA, 25 bp, Rattus norvegicus
gtcaaacaggatctgtttccttctg

SEQ ID NO: 488193 - DNA, 25 bp, Rattus norvegicus
gtcaaacaggatgtgtttccttctg

SEQ ID NO: 488194 - DNA, 25 bp, Rattus norvegicus
gtcaaacagttcacggaagcaggct

SEQ ID NO: 488195 - DNA, 25 bp, Rattus norvegicus
gtcaaacagttctcggaagcaggct

SEQ ID NO: 488196 - DNA, 25 bp, Rattus norvegicus
gtcaaaccaaagctaggtcgtgtca

SEQ ID NO: 488197 - DNA, 25 bp, Rattus norvegicus
gtcaaaccaaaggtaggtcgtgtca

SEQ ID NO: 488198 - DNA, 25 bp, Rattus norvegicus
gtcaaaccacacatgattttccacc

SEQ ID NO: 488199 - DNA, 25 bp, Rattus norvegicus
gtcaaaccacacttgattttccacc

SEQ ID NO: 488200 - DNA, 25 bp, Rattus norvegicus
gtcaaacctctgagactgtccaaag

SEQ ID NO: 488201 - DNA, 25 bp, Rattus norvegicus
gtcaaacctctgtgactgtccaaag

SEQ ID NO: 488202 - DNA, 25 bp, Rattus norvegicus
gtcaaaccttgtaatcttcctgaaa

SEQ ID NO: 488203 - DNA, 25 bp, Rattus norvegicus
gtcaaaccttgtattctccgttgat

SEQ ID NO: 488204 - DNA, 25 bp, Rattus norvegicus
gtcaaaccttgttatcttcctgaaa

SEQ ID NO: 488205 - DNA, 25 bp, Rattus norvegicus
gtcaaaccttgttttctccgttgat

SEQ ID NO: 488206 - DNA, 25 bp, Rattus norvegicus
gtcaaacgcttcagcaaacactgtt

SEQ ID NO: 488207 - DNA, 25 bp, Rattus norvegicus
gtcaaacgcttctgcaaacactgtt

SEQ ID NO: 488208 - DNA, 25 bp, Rattus norvegicus
gtcaaactactgcaactcttatgag

SEQ ID NO: 488209 - DNA, 25 bp, Rattus norvegicus
gtcaaactactggaactcttatgag

SEQ ID NO: 488210 - DNA, 25 bp, Rattus norvegicus
gtcaaactcactcagcagatggcat

SEQ ID NO: 488211 - DNA, 25 bp, Rattus norvegicus
gtcaaactcactgagcagatggcat

SEQ ID NO: 488212 - DNA, 25 bp, Rattus norvegicus
gtcaaactctttcgctttaagtgaa

SEQ ID NO: 488213 - DNA, 25 bp, Rattus norvegicus
gtcaaactctttggctttaagtgaa

SEQ ID NO: 488214 - DNA, 25 bp, Rattus norvegicus
gtcaaactgtatcactcaaacccgc

SEQ ID NO: 488215 - DNA, 25 bp, Rattus norvegicus
gtcaaactgtatgactcaaacccgc

SEQ ID NO: 488216 - DNA, 25 bp, Rattus norvegicus
gtcaaagaaaacatactggctcacg

SEQ ID NO: 488217 - DNA, 25 bp, Rattus norvegicus
gtcaaagaaaacttactggctcacg

SEQ ID NO: 488218 - DNA, 25 bp, Rattus norvegicus
gtcaaagacagcacagaggcctctg

SEQ ID NO: 488219 - DNA, 25 bp, Rattus norvegicus
gtcaaagacagctcagaggcctctg

SEQ ID NO: 488220 - DNA, 25 bp, Rattus norvegicus
gtcaaagacgctcagttggtgcacg

SEQ ID NO: 488221 - DNA, 25 bp, Rattus norvegicus
gtcaaagacgctgagttggtgcacg

SEQ ID NO: 488222 - DNA, 25 bp, Rattus norvegicus
gtcaaagactgtaaggtaccacgta

SEQ ID NO: 488223 - DNA, 25 bp, Rattus norvegicus
gtcaaagactgttaggtaccacgta

SEQ ID NO: 488224 - DNA, 25 bp, Rattus norvegicus
gtcaaagacttactgggtgcaatat

SEQ ID NO: 488225 - DNA, 25 bp, Rattus norvegicus
gtcaaagacttagtgggtgcaatat

SEQ ID NO: 488226 - DNA, 25 bp, Rattus norvegicus
gtcaaagattttccatgactccaaa

SEQ ID NO: 488227 - DNA, 25 bp, Rattus norvegicus
gtcaaagattttgcatgactccaaa

SEQ ID NO: 488228 - DNA, 25 bp, Rattus norvegicus
gtcaaagccaacattatatatccag

SEQ ID NO: 488229 - DNA, 25 bp, Rattus norvegicus
gtcaaagccaactttatatatccag

SEQ ID NO: 488230 - DNA, 25 bp, Rattus norvegicus
gtcaaagccaagacaaagccaagga

SEQ ID NO: 488231 - DNA, 25 bp, Rattus norvegicus
gtcaaagccaagtcaaagccaagga

SEQ ID NO: 488232 - DNA, 25 bp, Rattus norvegicus
gtcaaagcccggcaggaaagcctga

SEQ ID NO: 488233 - DNA, 25 bp, Rattus norvegicus
gtcaaagcccgggaggaaagcctga

SEQ ID NO: 488234 - DNA, 25 bp, Rattus norvegicus
gtcaaagccgtgacaatttgttctt

SEQ ID NO: 488235 - DNA, 25 bp, Rattus norvegicus
gtcaaagccgtgtcaatttgttctt

SEQ ID NO: 488236 - DNA, 25 bp, Rattus norvegicus
gtcaaagcctaacgaggccaccttt

SEQ ID NO: 488237 - DNA, 25 bp, Rattus norvegicus
gtcaaagcctaaggaggccaccttt

SEQ ID NO: 488238 - DNA, 25 bp, Rattus norvegicus
gtcaaagcctgtactttaccaatca

SEQ ID NO: 488239 - DNA, 25 bp, Rattus norvegicus
gtcaaagcctgttctttaccaatca

SEQ ID NO: 488240 - DNA, 25 bp, Rattus norvegicus
gtcaaagctctgactaagccacaat

SEQ ID NO: 488241 - DNA, 25 bp, Rattus norvegicus
gtcaaagctctgtctaagccacaat

SEQ ID NO: 488242 - DNA, 25 bp, Rattus norvegicus
gtcaaagctgacataaggatggaaa

SEQ ID NO: 488243 - DNA, 25 bp, Rattus norvegicus
gtcaaagctgacttaaggatggaaa

SEQ ID NO: 488244 - DNA, 25 bp, Rattus norvegicus
gtcaaagcttttctctccatgcaaa

SEQ ID NO: 488245 - DNA, 25 bp, Rattus norvegicus
gtcaaagcttttgtctccatgcaaa

SEQ ID NO: 488246 - DNA, 25 bp, Rattus norvegicus
gtcaaaggacacacatgttatccat

SEQ ID NO: 488247 - DNA, 25 bp, Rattus norvegicus
gtcaaaggacactcatgttatccat

SEQ ID NO: 488248 - DNA, 25 bp, Rattus norvegicus
gtcaaaggaccaatttgcagctcaa

SEQ ID NO: 488249 - DNA, 25 bp, Rattus norvegicus
gtcaaaggaccattttgcagctcaa

SEQ ID NO: 488250 - DNA, 25 bp, Rattus norvegicus
gtcaaaggcctaagttaactcagaa

SEQ ID NO: 488251 - DNA, 25 bp, Rattus norvegicus
gtcaaaggcctatgttaactcagaa

SEQ ID NO: 488252 - DNA, 25 bp, Rattus norvegicus
gtcaaaggctacacattttaatggg

SEQ ID NO: 488253 - DNA, 25 bp, Rattus norvegicus
gtcaaaggctactcattttaatggg

SEQ ID NO: 488254 - DNA, 25 bp, Rattus norvegicus
gtcaaaggctgtatctttaaagaag

SEQ ID NO: 488255 - DNA, 25 bp, Rattus norvegicus
gtcaaaggctgtttctttaaagaag

SEQ ID NO: 488256 - DNA, 25 bp, Rattus norvegicus
gtcaaagggagccagacctcaccta

SEQ ID NO: 488257 - DNA, 25 bp, Rattus norvegicus
gtcaaagggagcgagacctcaccta

SEQ ID NO: 488258 - DNA, 25 bp, Rattus norvegicus
gtcaaagggccaaaatgctcagctc

SEQ ID NO: 488259 - DNA, 25 bp, Rattus norvegicus
gtcaaagggccataatgctcagctc

SEQ ID NO: 488260 - DNA, 25 bp, Rattus norvegicus
gtcaaagggctaactatgcagcttt

SEQ ID NO: 488261 - DNA, 25 bp, Rattus norvegicus
gtcaaagggctatctatgcagcttt

SEQ ID NO: 488262 - DNA, 25 bp, Rattus norvegicus
gtcaaagggtgaagcgtagtcgcaa

SEQ ID NO: 488263 - DNA, 25 bp, Rattus norvegicus
gtcaaagggtgatgcgtagtcgcaa

SEQ ID NO: 488264 - DNA, 25 bp, Rattus norvegicus
gtcaaagtaccaatagccctgcaga

SEQ ID NO: 488265 - DNA, 25 bp, Rattus norvegicus
gtcaaagtaccattagccctgcaga

SEQ ID NO: 488266 - DNA, 25 bp, Rattus norvegicus
gtcaaagtcacgctcacatgaccat

SEQ ID NO: 488267 - DNA, 25 bp, Rattus norvegicus
gtcaaagtcacggtcacatgaccat

SEQ ID NO: 488268 - DNA, 25 bp, Rattus norvegicus
gtcaaagtcaggagcaccgatgctc

SEQ ID NO: 488269 - DNA, 25 bp, Rattus norvegicus
gtcaaagtcaggtgcaccgatgctc

SEQ ID NO: 488270 - DNA, 25 bp, Rattus norvegicus
gtcaaagtcctccactatgcgtaca

SEQ ID NO: 488271 - DNA, 25 bp, Rattus norvegicus
gtcaaagtcctcgactatgcgtaca

SEQ ID NO: 488272 - DNA, 25 bp, Rattus norvegicus
gtcaaagtccttcatgagcaggcag

SEQ ID NO: 488273 - DNA, 25 bp, Rattus norvegicus
gtcaaagtccttgatgagcaggcag

SEQ ID NO: 488274 - DNA, 25 bp, Rattus norvegicus
gtcaaagtctttactggaggcttct

SEQ ID NO: 488275 - DNA, 25 bp, Rattus norvegicus
gtcaaagtcttttctggaggcttct

SEQ ID NO: 488276 - DNA, 25 bp, Rattus norvegicus
gtcaaagttcatcccttattcagca

SEQ ID NO: 488277 - DNA, 25 bp, Rattus norvegicus
gtcaaagttcatgccttattcagca

SEQ ID NO: 488278 - DNA, 25 bp, Rattus norvegicus
gtcaaagttctaagtccgggagcca

SEQ ID NO: 488279 - DNA, 25 bp, Rattus norvegicus
gtcaaagttctatgtccgggagcca

SEQ ID NO: 488280 - DNA, 25 bp, Rattus norvegicus
gtcaaatactctctctgctatggaa

SEQ ID NO: 488281 - DNA, 25 bp, Rattus norvegicus
gtcaaatactctgtctgctatggaa

SEQ ID NO: 488282 - DNA, 25 bp, Rattus norvegicus
gtcaaatagagaaacgccgcccagc

SEQ ID NO: 488283 - DNA, 25 bp, Rattus norvegicus
gtcaaatagagatacgccgcccagc

SEQ ID NO: 488284 - DNA, 25 bp, Rattus norvegicus
gtcaaatatcccaccatacagtgta

SEQ ID NO: 488285 - DNA, 25 bp, Rattus norvegicus
gtcaaatatccctccatacagtgta

SEQ ID NO: 488286 - DNA, 25 bp, Rattus norvegicus
gtcaaatcaatcaccttgccttgta

SEQ ID NO: 488287 - DNA, 25 bp, Rattus norvegicus
gtcaaatcaatctccttgccttgta

SEQ ID NO: 488288 - DNA, 25 bp, Rattus norvegicus
gtcaaatcattccacacatccctgg

SEQ ID NO: 488289 - DNA, 25 bp, Rattus norvegicus
gtcaaatcattcgacacatccctgg

SEQ ID NO: 488290 - DNA, 25 bp, Rattus norvegicus
gtcaaatcatttacagagtcaaaag

SEQ ID NO: 488291 - DNA, 25 bp, Rattus norvegicus
gtcaaatcattttcagagtcaaaag

SEQ ID NO: 488292 - DNA, 25 bp, Rattus norvegicus
gtcaaatctaatccttcatcactgt

SEQ ID NO: 488293 - DNA, 25 bp, Rattus norvegicus
gtcaaatctaatgcttcatcactgt

SEQ ID NO: 488294 - DNA, 25 bp, Rattus norvegicus
gtcaaatctatgcacgtacccatat

SEQ ID NO: 488295 - DNA, 25 bp, Rattus norvegicus
gtcaaatctatggacgtacccatat

SEQ ID NO: 488296 - DNA, 25 bp, Rattus norvegicus
gtcaaatctgcaatgtctgggtatg

SEQ ID NO: 488297 - DNA, 25 bp, Rattus norvegicus
gtcaaatctgcattgtctgggtatg

SEQ ID NO: 488298 - DNA, 25 bp, Rattus norvegicus
gtcaaatggcacaaaattccagtga

SEQ ID NO: 488299 - DNA, 25 bp, Rattus norvegicus
gtcaaatggcactaaattccagtga

SEQ ID NO: 488300 - DNA, 25 bp, Rattus norvegicus
gtcaaattattgctgaaatccgaga

SEQ ID NO: 488301 - DNA, 25 bp, Rattus norvegicus
gtcaaattattggtgaaatccgaga

SEQ ID NO: 488302 - DNA, 25 bp, Rattus norvegicus
gtcaaattcatacctctcacacaca

SEQ ID NO: 488303 - DNA, 25 bp, Rattus norvegicus
gtcaaattcatagctctcacacaca

SEQ ID NO: 488304 - DNA, 25 bp, Rattus norvegicus
gtcaaattcatcaagtaactgctct

SEQ ID NO: 488305 - DNA, 25 bp, Rattus norvegicus
gtcaaattcatctagtaactgctct

SEQ ID NO: 488306 - DNA, 25 bp, Rattus norvegicus
gtcaaattgcggacatctgggtggt

SEQ ID NO: 488307 - DNA, 25 bp, Rattus norvegicus
gtcaaattgcggtcatctgggtggt

SEQ ID NO: 488308 - DNA, 25 bp, Rattus norvegicus
gtcaaattgggccagcactccgttt

SEQ ID NO: 488309 - DNA, 25 bp, Rattus norvegicus
gtcaaattgggcgagcactccgttt

SEQ ID NO: 488310 - DNA, 25 bp, Rattus norvegicus
gtcaacaaatcaaaactgtccggga

SEQ ID NO: 488311 - DNA, 25 bp, Rattus norvegicus
gtcaacaaatcataactgtccggga

SEQ ID NO: 488312 - DNA, 25 bp, Rattus norvegicus
gtcaacaacggccactttgaggcct

SEQ ID NO: 488313 - DNA, 25 bp, Rattus norvegicus
gtcaacaacggcgactttgaggcct

SEQ ID NO: 488314 - DNA, 25 bp, Rattus norvegicus
gtcaacaagttacccatttcctgcc

SEQ ID NO: 488315 - DNA, 25 bp, Rattus norvegicus
gtcaacaagttagccatttcctgcc

SEQ ID NO: 488316 - DNA, 25 bp, Rattus norvegicus
gtcaacaagtttcatggccagctag

SEQ ID NO: 488317 - DNA, 25 bp, Rattus norvegicus
gtcaacaagtttgatggccagctag

SEQ ID NO: 488318 - DNA, 25 bp, Rattus norvegicus
gtcaacacagtaccagatgccaata

SEQ ID NO: 488319 - DNA, 25 bp, Rattus norvegicus
gtcaacacagtagcagatgccaata

SEQ ID NO: 488320 - DNA, 25 bp, Rattus norvegicus
gtcaacaccagtcctcagctgttag

SEQ ID NO: 488321 - DNA, 25 bp, Rattus norvegicus
gtcaacaccagtgctcagctgttag

SEQ ID NO: 488322 - DNA, 25 bp, Rattus norvegicus
gtcaacacccttaggatacacattt

SEQ ID NO: 488323 - DNA, 25 bp, Rattus norvegicus
gtcaacaccctttggatacacattt

SEQ ID NO: 488324 - DNA, 25 bp, Rattus norvegicus
gtcaacactgccacacgaatggagt

SEQ ID NO: 488325 - DNA, 25 bp, Rattus norvegicus
gtcaacactgcctcacgaatggagt

SEQ ID NO: 488326 - DNA, 25 bp, Rattus norvegicus
gtcaacactgtcatgtggtgccggc

SEQ ID NO: 488327 - DNA, 25 bp, Rattus norvegicus
gtcaacactgtcttgtggtgccggc

SEQ ID NO: 488328 - DNA, 25 bp, Rattus norvegicus
gtcaacagaacaacagcggccatca

SEQ ID NO: 488329 - DNA, 25 bp, Rattus norvegicus
gtcaacagaacatcagcggccatca

SEQ ID NO: 488330 - DNA, 25 bp, Rattus norvegicus
gtcaacagaatgaacagagcttttg

SEQ ID NO: 488331 - DNA, 25 bp, Rattus norvegicus
gtcaacagaatgtacagagcttttg

SEQ ID NO: 488332 - DNA, 25 bp, Rattus norvegicus
gtcaacagcagcaagtaaacactga

SEQ ID NO: 488333 - DNA, 25 bp, Rattus norvegicus
gtcaacagcagctagtaaacactga

SEQ ID NO: 488334 - DNA, 25 bp, Rattus norvegicus
gtcaacagcaggcagtctaggccta

SEQ ID NO: 488335 - DNA, 25 bp, Rattus norvegicus
gtcaacagcagggagtctaggccta

SEQ ID NO: 488336 - DNA, 25 bp, Rattus norvegicus
gtcaacaggtaacacttccgctgct

SEQ ID NO: 488337 - DNA, 25 bp, Rattus norvegicus
gtcaacaggtaagacttccgctgct

SEQ ID NO: 488338 - DNA, 25 bp, Rattus norvegicus
gtcaacaggttgctctaacagccac

SEQ ID NO: 488339 - DNA, 25 bp, Rattus norvegicus
gtcaacaggttggtctaacagccac

SEQ ID NO: 488340 - DNA, 25 bp, Rattus norvegicus
gtcaacagtatcactttcttaggaa

SEQ ID NO: 488341 - DNA, 25 bp, Rattus norvegicus
gtcaacagtatctctttcttaggaa

SEQ ID NO: 488342 - DNA, 25 bp, Rattus norvegicus
gtcaacagtcatcctaaatgagcaa

SEQ ID NO: 488343 - DNA, 25 bp, Rattus norvegicus
gtcaacagtcatgctaaatgagcaa

SEQ ID NO: 488344 - DNA, 25 bp, Rattus norvegicus
gtcaacatatgtagaccgccacatc

SEQ ID NO: 488345 - DNA, 25 bp, Rattus norvegicus
gtcaacatatgttgaccgccacatc

SEQ ID NO: 488346 - DNA, 25 bp, Rattus norvegicus
gtcaacatcgaccagctgctggaat

SEQ ID NO: 488347 - DNA, 25 bp, Rattus norvegicus
gtcaacatcgacgagctgctggaat

SEQ ID NO: 488348 - DNA, 25 bp, Rattus norvegicus
gtcaacatcgccctacagtgagaag

SEQ ID NO: 488349 - DNA, 25 bp, Rattus norvegicus
gtcaacatcgccgtacagtgagaag

SEQ ID NO: 488350 - DNA, 25 bp, Rattus norvegicus
gtcaacattggaagcctcatctgca

SEQ ID NO: 488351 - DNA, 25 bp, Rattus norvegicus
gtcaacattggatgcctcatctgca

SEQ ID NO: 488352 - DNA, 25 bp, Rattus norvegicus
gtcaacattgttattccagaggaag

SEQ ID NO: 488353 - DNA, 25 bp, Rattus norvegicus
gtcaacattgtttttccagaggaag

SEQ ID NO: 488354 - DNA, 25 bp, Rattus norvegicus
gtcaacatttaaacagctgccgtga

SEQ ID NO: 488355 - DNA, 25 bp, Rattus norvegicus
gtcaacatttaatcagctgccgtga

SEQ ID NO: 488356 - DNA, 25 bp, Rattus norvegicus
gtcaacatttgcacttggactccaa

SEQ ID NO: 488357 - DNA, 25 bp, Rattus norvegicus
gtcaacatttgctcttggactccaa

SEQ ID NO: 488358 - DNA, 25 bp, Rattus norvegicus
gtcaaccaaggtctgtagtagcaag

SEQ ID NO: 488359 - DNA, 25 bp, Rattus norvegicus
gtcaaccaaggtgtgtagtagcaag

SEQ ID NO: 488360 - DNA, 25 bp, Rattus norvegicus
gtcaaccacagcattgattccaagt

SEQ ID NO: 488361 - DNA, 25 bp, Rattus norvegicus
gtcaaccacagctttgattccaagt

SEQ ID NO: 488362 - DNA, 25 bp, Rattus norvegicus
gtcaaccacctaagagtttacctag

SEQ ID NO: 488363 - DNA, 25 bp, Rattus norvegicus
gtcaaccacctatgagtttacctag

SEQ ID NO: 488364 - DNA, 25 bp, Rattus norvegicus
gtcaaccacgttcctgacaacagct

SEQ ID NO: 488365 - DNA, 25 bp, Rattus norvegicus
gtcaaccacgttgctgacaacagct

SEQ ID NO: 488366 - DNA, 25 bp, Rattus norvegicus
gtcaaccactccagttcatgtttta

SEQ ID NO: 488367 - DNA, 25 bp, Rattus norvegicus
gtcaaccactcctgttcatgtttta

SEQ ID NO: 488368 - DNA, 25 bp, Rattus norvegicus
gtcaaccacttcaggtgccaggaag

SEQ ID NO: 488369 - DNA, 25 bp, Rattus norvegicus
gtcaaccacttctggtgccaggaag

SEQ ID NO: 488370 - DNA, 25 bp, Rattus norvegicus
gtcaaccatcttattgtgcagccac

SEQ ID NO: 488371 - DNA, 25 bp, Rattus norvegicus
gtcaaccatctttttgtgcagccac

SEQ ID NO: 488372 - DNA, 25 bp, Rattus norvegicus
gtcaaccatgttctacggtggcatt

SEQ ID NO: 488373 - DNA, 25 bp, Rattus norvegicus
gtcaaccatgttgtacggtggcatt

SEQ ID NO: 488374 - DNA, 25 bp, Rattus norvegicus
gtcaacccactgagctatgctggaa

SEQ ID NO: 488375 - DNA, 25 bp, Rattus norvegicus
gtcaacccactgtgctatgctggaa

SEQ ID NO: 488376 - DNA, 25 bp, Rattus norvegicus
gtcaaccccaagactattgcatttt

SEQ ID NO: 488377 - DNA, 25 bp, Rattus norvegicus
gtcaaccccaagtctattgcatttt

SEQ ID NO: 488378 - DNA, 25 bp, Rattus norvegicus
gtcaacccgaaacatcttccagaag

SEQ ID NO: 488379 - DNA, 25 bp, Rattus norvegicus
gtcaacccgaaagatcttccagaag

SEQ ID NO: 488380 - DNA, 25 bp, Rattus norvegicus
gtcaacccgaacaacttgcttgaag

SEQ ID NO: 488381 - DNA, 25 bp, Rattus norvegicus
gtcaacccgaactacttgcttgaag

SEQ ID NO: 488382 - DNA, 25 bp, Rattus norvegicus
gtcaaccctgccattgagaggatga

SEQ ID NO: 488383 - DNA, 25 bp, Rattus norvegicus
gtcaaccctgcctttgagaggatga

SEQ ID NO: 488384 - DNA, 25 bp, Rattus norvegicus
gtcaacccttaccgcattgaaggcc

SEQ ID NO: 488385 - DNA, 25 bp, Rattus norvegicus
gtcaacccttacggcattgaaggcc

SEQ ID NO: 488386 - DNA, 25 bp, Rattus norvegicus
gtcaaccgatgtagcttggatctgt

SEQ ID NO: 488387 - DNA, 25 bp, Rattus norvegicus
gtcaaccgatgttgcttggatctgt

SEQ ID NO: 488388 - DNA, 25 bp, Rattus norvegicus
gtcaaccgggacaagtcagccaaag

SEQ ID NO: 488389 - DNA, 25 bp, Rattus norvegicus
gtcaaccgggactagtcagccaaag

SEQ ID NO: 488390 - DNA, 25 bp, Rattus norvegicus
gtcaaccgtggtaactgtggcagtc

SEQ ID NO: 488391 - DNA, 25 bp, Rattus norvegicus
gtcaaccgtggttactgtggcagtc

SEQ ID NO: 488392 - DNA, 25 bp, Rattus norvegicus
gtcaacctaaacaggagtcccttgg

SEQ ID NO: 488393 - DNA, 25 bp, Rattus norvegicus
gtcaacctaaactggagtcccttgg

SEQ ID NO: 488394 - DNA, 25 bp, Rattus norvegicus
gtcaacctacatctcaaatggcatt

SEQ ID NO: 488395 - DNA, 25 bp, Rattus norvegicus
gtcaacctacatgtcaaatggcatt

SEQ ID NO: 488396 - DNA, 25 bp, Rattus norvegicus
gtcaacctaccaaatgcttaaaatg

SEQ ID NO: 488397 - DNA, 25 bp, Rattus norvegicus
gtcaacctaccatatgcttaaaatg

SEQ ID NO: 488398 - DNA, 25 bp, Rattus norvegicus
gtcaacctatctatatcttctaaaa

SEQ ID NO: 488399 - DNA, 25 bp, Rattus norvegicus
gtcaacctatctttatcttctaaaa

SEQ ID NO: 488400 - DNA, 25 bp, Rattus norvegicus
gtcaacctcataatcatctatttat

SEQ ID NO: 488401 - DNA, 25 bp, Rattus norvegicus
gtcaacctcatattcatctatttat

SEQ ID NO: 488402 - DNA, 25 bp, Rattus norvegicus
gtcaacctcttaattttgcacaaga

SEQ ID NO: 488403 - DNA, 25 bp, Rattus norvegicus
gtcaacctcttatttttgcacaaga

SEQ ID NO: 488404 - DNA, 25 bp, Rattus norvegicus
gtcaacctcttccactcagatatga

SEQ ID NO: 488405 - DNA, 25 bp, Rattus norvegicus
gtcaacctcttcgactcagatatga

SEQ ID NO: 488406 - DNA, 25 bp, Rattus norvegicus
gtcaacctgaggctccttttgctta

SEQ ID NO: 488407 - DNA, 25 bp, Rattus norvegicus
gtcaacctgagggtccttttgctta

SEQ ID NO: 488408 - DNA, 25 bp, Rattus norvegicus
gtcaacctgggcaatgtgggaccct

SEQ ID NO: 488409 - DNA, 25 bp, Rattus norvegicus
gtcaacctgggctatgtgggaccct

SEQ ID NO: 488410 - DNA, 25 bp, Rattus norvegicus
gtcaacctgtaacagccccaatgaa

SEQ ID NO: 488411 - DNA, 25 bp, Rattus norvegicus
gtcaacctgtaagagccccaatgaa

SEQ ID NO: 488412 - DNA, 25 bp, Rattus norvegicus
gtcaacctgttgaacctgtggctgc

SEQ ID NO: 488413 - DNA, 25 bp, Rattus norvegicus
gtcaacctgttgtacctgtggctgc

SEQ ID NO: 488414 - DNA, 25 bp, Rattus norvegicus
gtcaaccttcatcagatgctgttca

SEQ ID NO: 488415 - DNA, 25 bp, Rattus norvegicus
gtcaaccttcatgagatgctgttca

SEQ ID NO: 488416 - DNA, 25 bp, Rattus norvegicus
gtcaaccttccaaggttagcattag

SEQ ID NO: 488417 - DNA, 25 bp, Rattus norvegicus
gtcaaccttccatggttagcattag

SEQ ID NO: 488418 - DNA, 25 bp, Rattus norvegicus
gtcaaccttctgaaagagcacgtcc

SEQ ID NO: 488419 - DNA, 25 bp, Rattus norvegicus
gtcaaccttctgtaagagcacgtcc

SEQ ID NO: 488420 - DNA, 25 bp, Rattus norvegicus
gtcaaccttgatattctttcagcct

SEQ ID NO: 488421 - DNA, 25 bp, Rattus norvegicus
gtcaaccttgattttctttcagcct

SEQ ID NO: 488422 - DNA, 25 bp, Rattus norvegicus
gtcaacgcaatgaactcctttgttt

SEQ ID NO: 488423 - DNA, 25 bp, Rattus norvegicus
gtcaacgcaatgtactcctttgttt

SEQ ID NO: 488424 - DNA, 25 bp, Rattus norvegicus
gtcaacgccagcatgttatcacagt

SEQ ID NO: 488425 - DNA, 25 bp, Rattus norvegicus
gtcaacgccagcttgttatcacagt

SEQ ID NO: 488426 - DNA, 25 bp, Rattus norvegicus
gtcaacgtcgtacacagtcctttaa

SEQ ID NO: 488427 - DNA, 25 bp, Rattus norvegicus
gtcaacgtcgtagacagtcctttaa

SEQ ID NO: 488428 - DNA, 25 bp, Rattus norvegicus
gtcaacgtctccacatctgatctca

SEQ ID NO: 488429 - DNA, 25 bp, Rattus norvegicus
gtcaacgtctcctcatctgatctca

SEQ ID NO: 488430 - DNA, 25 bp, Rattus norvegicus
gtcaacgtggtgatcgtggaccgct

SEQ ID NO: 488431 - DNA, 25 bp, Rattus norvegicus
gtcaacgtggtgttcgtggaccgct

SEQ ID NO: 488432 - DNA, 25 bp, Rattus norvegicus
gtcaactaagtgcacatctggaact

SEQ ID NO: 488433 - DNA, 25 bp, Rattus norvegicus
gtcaactaagtggacatctggaact

SEQ ID NO: 488434 - DNA, 25 bp, Rattus norvegicus
gtcaactaccacagtattttattca

SEQ ID NO: 488435 - DNA, 25 bp, Rattus norvegicus
gtcaactaccactgtattttattca

SEQ ID NO: 488436 - DNA, 25 bp, Rattus norvegicus
gtcaactcaaacactaccatctgga

SEQ ID NO: 488437 - DNA, 25 bp, Rattus norvegicus
gtcaactcaaactctaccatctgga

SEQ ID NO: 488438 - DNA, 25 bp, Rattus norvegicus
gtcaactcaaggacgaggccatcgt

SEQ ID NO: 488439 - DNA, 25 bp, Rattus norvegicus
gtcaactcaaggtcgaggccatcgt

SEQ ID NO: 488440 - DNA, 25 bp, Rattus norvegicus
gtcaactcacttatctgagcagtca

SEQ ID NO: 488441 - DNA, 25 bp, Rattus norvegicus
gtcaactcacttttctgagcagtca

SEQ ID NO: 488442 - DNA, 25 bp, Rattus norvegicus
gtcaactcatgcatggtctctgaaa

SEQ ID NO: 488443 - DNA, 25 bp, Rattus norvegicus
gtcaactcatgcttggtctctgaaa

SEQ ID NO: 488444 - DNA, 25 bp, Rattus norvegicus
gtcaactccagtcgttttctttcac

SEQ ID NO: 488445 - DNA, 25 bp, Rattus norvegicus
gtcaactccagtggttttctttcac

SEQ ID NO: 488446 - DNA, 25 bp, Rattus norvegicus
gtcaactccattagtgcctgtagct

SEQ ID NO: 488447 - DNA, 25 bp, Rattus norvegicus
gtcaactccatttgtgcctgtagct

SEQ ID NO: 488448 - DNA, 25 bp, Rattus norvegicus
gtcaactccttacacacatactttt

SEQ ID NO: 488449 - DNA, 25 bp, Rattus norvegicus
gtcaactccttagacacatactttt

SEQ ID NO: 488450 - DNA, 25 bp, Rattus norvegicus
gtcaactccttcacttagagtcttg

SEQ ID NO: 488451 - DNA, 25 bp, Rattus norvegicus
gtcaactccttctcttagagtcttg

SEQ ID NO: 488452 - DNA, 25 bp, Rattus norvegicus
gtcaactcgaacacaccagtcgatg

SEQ ID NO: 488453 - DNA, 25 bp, Rattus norvegicus
gtcaactcgaactcaccagtcgatg

SEQ ID NO: 488454 - DNA, 25 bp, Rattus norvegicus
gtcaactctactcaggaaacccatt

SEQ ID NO: 488455 - DNA, 25 bp, Rattus norvegicus
gtcaactctactgaggaaacccatt

SEQ ID NO: 488456 - DNA, 25 bp, Rattus norvegicus
gtcaactctcgaccatggacacggg

SEQ ID NO: 488457 - DNA, 25 bp, Rattus norvegicus
gtcaactctcgagcatggacacggg

SEQ ID NO: 488458 - DNA, 25 bp, Rattus norvegicus
gtcaactctctcctacaatgtaaaa

SEQ ID NO: 488459 - DNA, 25 bp, Rattus norvegicus
gtcaactctctcgtacaatgtaaaa

SEQ ID NO: 488460 - DNA, 25 bp, Rattus norvegicus
gtcaactgacaactcttcaagctct

SEQ ID NO: 488461 - DNA, 25 bp, Rattus norvegicus
gtcaactgacaagtcttcaagctct

SEQ ID NO: 488462 - DNA, 25 bp, Rattus norvegicus
gtcaactgccacatgtcacaaaggg

SEQ ID NO: 488463 - DNA, 25 bp, Rattus norvegicus
gtcaactgccacttgtcacaaaggg

SEQ ID NO: 488464 - DNA, 25 bp, Rattus norvegicus
gtcaactgtcttccagtcagtgcca

SEQ ID NO: 488465 - DNA, 25 bp, Rattus norvegicus
gtcaactgtcttgcagtcagtgcca

SEQ ID NO: 488466 - DNA, 25 bp, Rattus norvegicus
gtcaactgtgacacttccactgtta

SEQ ID NO: 488467 - DNA, 25 bp, Rattus norvegicus
gtcaactgtgactcttccactgtta

SEQ ID NO: 488468 - DNA, 25 bp, Rattus norvegicus
gtcaacttgaccatcaacttgcttg

SEQ ID NO: 488469 - DNA, 25 bp, Rattus norvegicus
gtcaacttgaccttcaacttgcttg

SEQ ID NO: 488470 - DNA, 25 bp, Rattus norvegicus
gtcaacttgcagctgtggttatcca

SEQ ID NO: 488471 - DNA, 25 bp, Rattus norvegicus
gtcaacttgcaggtgtggttatcca

SEQ ID NO: 488472 - DNA, 25 bp, Rattus norvegicus
gtcaacttgtcaaactggtgtggct

SEQ ID NO: 488473 - DNA, 25 bp, Rattus norvegicus
gtcaacttgtcatactggtgtggct

SEQ ID NO: 488474 - DNA, 25 bp, Rattus norvegicus
gtcaacttgtggcacttggcacaga

SEQ ID NO: 488475 - DNA, 25 bp, Rattus norvegicus
gtcaacttgtgggacttggcacaga

SEQ ID NO: 488476 - DNA, 25 bp, Rattus norvegicus
gtcaactttattcttctactccaag

SEQ ID NO: 488477 - DNA, 25 bp, Rattus norvegicus
gtcaactttattgttctactccaag

SEQ ID NO: 488478 - DNA, 25 bp, Rattus norvegicus
gtcaactttgctagtcccattgcaa

SEQ ID NO: 488479 - DNA, 25 bp, Rattus norvegicus
gtcaactttgcttgtcccattgcaa

SEQ ID NO: 488480 - DNA, 25 bp, Rattus norvegicus
gtcaagaagaccattggctcatcct

SEQ ID NO: 488481 - DNA, 25 bp, Rattus norvegicus
gtcaagaagacctttggctcatcct

SEQ ID NO: 488482 - DNA, 25 bp, Rattus norvegicus
gtcaagaagcgtagggacaccctga

SEQ ID NO: 488483 - DNA, 25 bp, Rattus norvegicus
gtcaagaagcgttgggacaccctga

SEQ ID NO: 488484 - DNA, 25 bp, Rattus norvegicus
gtcaagaaggaacgactcggcgttt

SEQ ID NO: 488485 - DNA, 25 bp, Rattus norvegicus
gtcaagaaggaaggactcggcgttt

SEQ ID NO: 488486 - DNA, 25 bp, Rattus norvegicus
gtcaagaatcccagaccctttgcta

SEQ ID NO: 488487 - DNA, 25 bp, Rattus norvegicus
gtcaagaatccctgaccctttgcta

SEQ ID NO: 488488 - DNA, 25 bp, Rattus norvegicus
gtcaagaatgtcagctgtcagtctc

SEQ ID NO: 488489 - DNA, 25 bp, Rattus norvegicus
gtcaagaatgtctgctgtcagtctc

SEQ ID NO: 488490 - DNA, 25 bp, Rattus norvegicus
gtcaagacagatcagaccagagctg

SEQ ID NO: 488491 - DNA, 25 bp, Rattus norvegicus
gtcaagacagatgagaccagagctg

SEQ ID NO: 488492 - DNA, 25 bp, Rattus norvegicus
gtcaagacagttaacgatacccgga

SEQ ID NO: 488493 - DNA, 25 bp, Rattus norvegicus
gtcaagacagtttacgatacccgga

SEQ ID NO: 488494 - DNA, 25 bp, Rattus norvegicus
gtcaagacatggattctgtttgctg

SEQ ID NO: 488495 - DNA, 25 bp, Rattus norvegicus
gtcaagacatggcagggttagtact

SEQ ID NO: 488496 - DNA, 25 bp, Rattus norvegicus
gtcaagacatgggagggttagtact

SEQ ID NO: 488497 - DNA, 25 bp, Rattus norvegicus
gtcaagacatggtttctgtttgctg

SEQ ID NO: 488498 - DNA, 25 bp, Rattus norvegicus
gtcaagacggctctctgtgacatcc

SEQ ID NO: 488499 - DNA, 25 bp, Rattus norvegicus
gtcaagacggctgtctgtgacatcc

SEQ ID NO: 488500 - DNA, 25 bp, Rattus norvegicus
gtcaagactcacattagatggataa

SEQ ID NO: 488501 - DNA, 25 bp, Rattus norvegicus
gtcaagactcactttagatggataa

SEQ ID NO: 488502 - DNA, 25 bp, Rattus norvegicus
gtcaagactcatctaaacaaagcag

SEQ ID NO: 488503 - DNA, 25 bp, Rattus norvegicus
gtcaagactcatgtaaacaaagcag

SEQ ID NO: 488504 - DNA, 25 bp, Rattus norvegicus
gtcaagactcttaacctgtgggcct

SEQ ID NO: 488505 - DNA, 25 bp, Rattus norvegicus
gtcaagactctttacctgtgggcct

SEQ ID NO: 488506 - DNA, 25 bp, Rattus norvegicus
gtcaagacttgcaatttagctccgt

SEQ ID NO: 488507 - DNA, 25 bp, Rattus norvegicus
gtcaagacttgctatttagctccgt

SEQ ID NO: 488508 - DNA, 25 bp, Rattus norvegicus
gtcaagacttggctatgtgcatttc

SEQ ID NO: 488509 - DNA, 25 bp, Rattus norvegicus
gtcaagacttggctgcatgaaaccc

SEQ ID NO: 488510 - DNA, 25 bp, Rattus norvegicus
gtcaagacttgggtatgtgcatttc

SEQ ID NO: 488511 - DNA, 25 bp, Rattus norvegicus
gtcaagacttgggtgcatgaaaccc

SEQ ID NO: 488512 - DNA, 25 bp, Rattus norvegicus
gtcaagagctgtattccacatctct

SEQ ID NO: 488513 - DNA, 25 bp, Rattus norvegicus
gtcaagagctgttttccacatctct

SEQ ID NO: 488514 - DNA, 25 bp, Rattus norvegicus
gtcaagagctttactggcaagatga

SEQ ID NO: 488515 - DNA, 25 bp, Rattus norvegicus
gtcaagagcttttctggcaagatga

SEQ ID NO: 488516 - DNA, 25 bp, Rattus norvegicus
gtcaagaggatgaggtgaccgtcca

SEQ ID NO: 488517 - DNA, 25 bp, Rattus norvegicus
gtcaagaggatgtggtgaccgtcca

SEQ ID NO: 488518 - DNA, 25 bp, Rattus norvegicus
gtcaagagggcaacaatcccgtgca

SEQ ID NO: 488519 - DNA, 25 bp, Rattus norvegicus
gtcaagagggcatcaatcccgtgca

SEQ ID NO: 488520 - DNA, 25 bp, Rattus norvegicus
gtcaagagggtacagcgccttcctt

SEQ ID NO: 488521 - DNA, 25 bp, Rattus norvegicus
gtcaagagggtagagcgccttcctt

SEQ ID NO: 488522 - DNA, 25 bp, Rattus norvegicus
gtcaagagtctgacagatgcctaga

SEQ ID NO: 488523 - DNA, 25 bp, Rattus norvegicus
gtcaagagtctgtcagatgcctaga

SEQ ID NO: 488524 - DNA, 25 bp, Rattus norvegicus
gtcaagagtggacatggaccccttt

SEQ ID NO: 488525 - DNA, 25 bp, Rattus norvegicus
gtcaagagtggagatggaccccttt

SEQ ID NO: 488526 - DNA, 25 bp, Rattus norvegicus
gtcaagatagagatatgctaaccta

SEQ ID NO: 488527 - DNA, 25 bp, Rattus norvegicus
gtcaagatagagttatgctaaccta

SEQ ID NO: 488528 - DNA, 25 bp, Rattus norvegicus
gtcaagatcagaccccttatctgcc

SEQ ID NO: 488529 - DNA, 25 bp, Rattus norvegicus
gtcaagatcagagcccttatctgcc

SEQ ID NO: 488530 - DNA, 25 bp, Rattus norvegicus
gtcaagatccagactccagcggata

SEQ ID NO: 488531 - DNA, 25 bp, Rattus norvegicus
gtcaagatccagtctccagcggata

SEQ ID NO: 488532 - DNA, 25 bp, Rattus norvegicus
gtcaagatgagaatccaggtcctgt

SEQ ID NO: 488533 - DNA, 25 bp, Rattus norvegicus
gtcaagatgagattccaggtcctgt

SEQ ID NO: 488534 - DNA, 20 bp, Rattus norvegicus
gtcaagatgctaccgttcag

SEQ ID NO: 488535 - DNA, 25 bp, Rattus norvegicus
gtcaagattcagaggcgcagcacaa

SEQ ID NO: 488536 - DNA, 25 bp, Rattus norvegicus
gtcaagattcagtggcgcagcacaa

SEQ ID NO: 488537 - DNA, 25 bp, Rattus norvegicus
gtcaagatttcaaagccgcagcaag

SEQ ID NO: 488538 - DNA, 25 bp, Rattus norvegicus
gtcaagatttcatagccgcagcaag

SEQ ID NO: 488539 - DNA, 25 bp, Rattus norvegicus
gtcaagcacctcatcttctgaaaga

SEQ ID NO: 488540 - DNA, 25 bp, Rattus norvegicus
gtcaagcacctcttcttctgaaaga

SEQ ID NO: 488541 - DNA, 25 bp, Rattus norvegicus
gtcaagcactgcaggatatcgccga

SEQ ID NO: 488542 - DNA, 25 bp, Rattus norvegicus
gtcaagcactgctggatatcgccga

SEQ ID NO: 488543 - DNA, 25 bp, Rattus norvegicus
gtcaagcagctgaacactgttataa

SEQ ID NO: 488544 - DNA, 25 bp, Rattus norvegicus
gtcaagcagctgtacactgttataa

SEQ ID NO: 488545 - DNA, 25 bp, Rattus norvegicus
gtcaagcagcttatacttcctggaa

SEQ ID NO: 488546 - DNA, 25 bp, Rattus norvegicus
gtcaagcagcttttacttcctggaa

SEQ ID NO: 488547 - DNA, 25 bp, Rattus norvegicus
gtcaagcaggccatgttcaactact

SEQ ID NO: 488548 - DNA, 25 bp, Rattus norvegicus
gtcaagcaggccttgttcaactact

SEQ ID NO: 488549 - DNA, 25 bp, Rattus norvegicus
gtcaagcatgccatcggaactagag

SEQ ID NO: 488550 - DNA, 25 bp, Rattus norvegicus
gtcaagcatgccttcggaactagag

SEQ ID NO: 488551 - DNA, 25 bp, Rattus norvegicus
gtcaagcattacagtttccgtgtga

SEQ ID NO: 488552 - DNA, 25 bp, Rattus norvegicus
gtcaagcattactgtttccgtgtga

SEQ ID NO: 488553 - DNA, 25 bp, Rattus norvegicus
gtcaagccagccatttcctgccttt

SEQ ID NO: 488554 - DNA, 25 bp, Rattus norvegicus
gtcaagccagccttttcctgccttt

SEQ ID NO: 488555 - DNA, 25 bp, Rattus norvegicus
gtcaagccctgtcgtgtatcagcaa

SEQ ID NO: 488556 - DNA, 25 bp, Rattus norvegicus
gtcaagccctgtggtgtatcagcaa

SEQ ID NO: 488557 - DNA, 25 bp, Rattus norvegicus
gtcaagccggcgactcatgtggtgc

SEQ ID NO: 488558 - DNA, 25 bp, Rattus norvegicus
gtcaagccggcgtctcatgtggtgc

SEQ ID NO: 488559 - DNA, 25 bp, Rattus norvegicus
gtcaagccttatactgtattgggaa

SEQ ID NO: 488560 - DNA, 25 bp, Rattus norvegicus
gtcaagccttattctgtattgggaa

SEQ ID NO: 488561 - DNA, 25 bp, Rattus norvegicus
gtcaagctactgatgctatggttat

SEQ ID NO: 488562 - DNA, 25 bp, Rattus norvegicus
gtcaagctactgttgctatggttat

SEQ ID NO: 488563 - DNA, 25 bp, Rattus norvegicus
gtcaagctagacagactccagagcc

SEQ ID NO: 488564 - DNA, 25 bp, Rattus norvegicus
gtcaagctagactgactccagagcc

SEQ ID NO: 488565 - DNA, 25 bp, Rattus norvegicus
gtcaagctcaagattctctgtctga

SEQ ID NO: 488566 - DNA, 25 bp, Rattus norvegicus
gtcaagctcaagtttctctgtctga

SEQ ID NO: 488567 - DNA, 25 bp, Rattus norvegicus
gtcaagctcggtcggcagtaacata

SEQ ID NO: 488568 - DNA, 25 bp, Rattus norvegicus
gtcaagctcggtgggcagtaacata

SEQ ID NO: 488569 - DNA, 25 bp, Rattus norvegicus
gtcaagctggctaacactgcaggct

SEQ ID NO: 488570 - DNA, 25 bp, Rattus norvegicus
gtcaagctggcttacactgcaggct

SEQ ID NO: 488571 - DNA, 25 bp, Rattus norvegicus
gtcaagctgtttcctttatctctat

SEQ ID NO: 488572 - DNA, 25 bp, Rattus norvegicus
gtcaagctgtttgctttatctctat

SEQ ID NO: 488573 - DNA, 25 bp, Rattus norvegicus
gtcaagcttcacattgtaaatggga

SEQ ID NO: 488574 - DNA, 25 bp, Rattus norvegicus
gtcaagcttcactttgtaaatggga

SEQ ID NO: 488575 - DNA, 25 bp, Rattus norvegicus
gtcaagcttccactttgttcttaag

SEQ ID NO: 488576 - DNA, 25 bp, Rattus norvegicus
gtcaagcttccagtttgttcttaag

SEQ ID NO: 488577 - DNA, 25 bp, Rattus norvegicus
gtcaagctttaaaccagggtctcag

SEQ ID NO: 488578 - DNA, 25 bp, Rattus norvegicus
gtcaagctttaatccagggtctcag

SEQ ID NO: 488579 - DNA, 25 bp, Rattus norvegicus
gtcaagctttttagtaccctgaagt

SEQ ID NO: 488580 - DNA, 25 bp, Rattus norvegicus
gtcaagcttttttgtaccctgaagt

SEQ ID NO: 488581 - DNA, 25 bp, Rattus norvegicus
gtcaaggaacctcccaagacctcat

SEQ ID NO: 488582 - DNA, 25 bp, Rattus norvegicus
gtcaaggaacctgccaagacctcat

SEQ ID NO: 488583 - DNA, 25 bp, Rattus norvegicus
gtcaaggaacttctagcccatcaag

SEQ ID NO: 488584 - DNA, 25 bp, Rattus norvegicus
gtcaaggaacttgtagcccatcaag

SEQ ID NO: 488585 - DNA, 25 bp, Rattus norvegicus
gtcaaggacaagcaaccccatgcag

SEQ ID NO: 488586 - DNA, 25 bp, Rattus norvegicus
gtcaaggacaaggaaccccatgcag

SEQ ID NO: 488587 - DNA, 25 bp, Rattus norvegicus
gtcaaggacaggctgttctttccct

SEQ ID NO: 488588 - DNA, 25 bp, Rattus norvegicus
gtcaaggacagggtgttctttccct

SEQ ID NO: 488589 - DNA, 25 bp, Rattus norvegicus
gtcaaggacagtcgttactatgtct

SEQ ID NO: 488590 - DNA, 25 bp, Rattus norvegicus
gtcaaggacagtggttactatgtct

SEQ ID NO: 488591 - DNA, 25 bp, Rattus norvegicus
gtcaaggcaaggagcacaacccatt

SEQ ID NO: 488592 - DNA, 25 bp, Rattus norvegicus
gtcaaggcaaggtgcacaacccatt

SEQ ID NO: 488593 - DNA, 25 bp, Rattus norvegicus
gtcaaggcacataccacggtgatgt

SEQ ID NO: 488594 - DNA, 25 bp, Rattus norvegicus
gtcaaggcacattccacggtgatgt

SEQ ID NO: 488595 - DNA, 25 bp, Rattus norvegicus
gtcaaggcacccctggctgcaagga

SEQ ID NO: 488596 - DNA, 25 bp, Rattus norvegicus
gtcaaggcacccgtggctgcaagga

SEQ ID NO: 488597 - DNA, 25 bp, Rattus norvegicus
gtcaaggcagcccatcagagaggat

SEQ ID NO: 488598 - DNA, 25 bp, Rattus norvegicus
gtcaaggcagccgatcagagaggat

SEQ ID NO: 488599 - DNA, 25 bp, Rattus norvegicus
gtcaaggcagttccttgtgtttaac

SEQ ID NO: 488600 - DNA, 25 bp, Rattus norvegicus
gtcaaggcagttgcttgtgtttaac

SEQ ID NO: 488601 - DNA, 25 bp, Rattus norvegicus
gtcaaggcatgtatactagatattt

SEQ ID NO: 488602 - DNA, 25 bp, Rattus norvegicus
gtcaaggcatgtttactagatattt

SEQ ID NO: 488603 - DNA, 25 bp, Rattus norvegicus
gtcaaggccactaacattacgtaga

SEQ ID NO: 488604 - DNA, 25 bp, Rattus norvegicus
gtcaaggccacttacattacgtaga

SEQ ID NO: 488605 - DNA, 25 bp, Rattus norvegicus
gtcaaggcctacctgtgggacagca

SEQ ID NO: 488606 - DNA, 25 bp, Rattus norvegicus
gtcaaggcctacgtgtgggacagca

SEQ ID NO: 488607 - DNA, 25 bp, Rattus norvegicus
gtcaaggcgatacctcgagggaact

SEQ ID NO: 488608 - DNA, 25 bp, Rattus norvegicus
gtcaaggcgatagctcgagggaact

SEQ ID NO: 488609 - DNA, 25 bp, Rattus norvegicus
gtcaaggctggtcgtgtagctttta

SEQ ID NO: 488610 - DNA, 25 bp, Rattus norvegicus
gtcaaggctggtggtgtagctttta

SEQ ID NO: 488611 - DNA, 25 bp, Rattus norvegicus
gtcaagggaccacccgtacctgtga

SEQ ID NO: 488612 - DNA, 25 bp, Rattus norvegicus
gtcaagggaccagccgtacctgtga

SEQ ID NO: 488613 - DNA, 25 bp, Rattus norvegicus
gtcaagggcagaccgggcgttgagc

SEQ ID NO: 488614 - DNA, 25 bp, Rattus norvegicus
gtcaagggcagagcgggcgttgagc

SEQ ID NO: 488615 - DNA, 25 bp, Rattus norvegicus
gtcaagggcagcacagactacagag

SEQ ID NO: 488616 - DNA, 25 bp, Rattus norvegicus
gtcaagggcagctcagactacagag

SEQ ID NO: 488617 - DNA, 25 bp, Rattus norvegicus
gtcaagggctgaccatacttctagg

SEQ ID NO: 488618 - DNA, 25 bp, Rattus norvegicus
gtcaagggctgagcatacttctagg

SEQ ID NO: 488619 - DNA, 25 bp, Rattus norvegicus
gtcaagggtaaacagaactctccaa

SEQ ID NO: 488620 - DNA, 25 bp, Rattus norvegicus
gtcaagggtaaagagaactctccaa

SEQ ID NO: 488621 - DNA, 25 bp, Rattus norvegicus
gtcaagggtatgagcttcgctcgga

SEQ ID NO: 488622 - DNA, 25 bp, Rattus norvegicus
gtcaagggtatgtgcttcgctcgga

SEQ ID NO: 488623 - DNA, 25 bp, Rattus norvegicus
gtcaagggtgccacaatgccatcga

SEQ ID NO: 488624 - DNA, 25 bp, Rattus norvegicus
gtcaagggtgcctcaatgccatcga

SEQ ID NO: 488625 - DNA, 25 bp, Rattus norvegicus
gtcaagggtggcatcggctccatct

SEQ ID NO: 488626 - DNA, 25 bp, Rattus norvegicus
gtcaagggtggcttcggctccatct

SEQ ID NO: 488627 - DNA, 25 bp, Rattus norvegicus
gtcaaggtacttactcacagcaaca

SEQ ID NO: 488628 - DNA, 25 bp, Rattus norvegicus
gtcaaggtacttcgtgatggccaga

SEQ ID NO: 488629 - DNA, 25 bp, Rattus norvegicus
gtcaaggtacttggtgatggccaga

SEQ ID NO: 488630 - DNA, 25 bp, Rattus norvegicus
gtcaaggtactttctcacagcaaca

SEQ ID NO: 488631 - DNA, 25 bp, Rattus norvegicus
gtcaaggtcactcatgtcagaacac

SEQ ID NO: 488632 - DNA, 25 bp, Rattus norvegicus
gtcaaggtcactgatgtcagaacac

SEQ ID NO: 488633 - DNA, 25 bp, Rattus norvegicus
gtcaagtaaactcatggcggtccat

SEQ ID NO: 488634 - DNA, 25 bp, Rattus norvegicus
gtcaagtaaactgatggcggtccat

SEQ ID NO: 488635 - DNA, 25 bp, Rattus norvegicus
gtcaagtagacccatacggctgtaa

SEQ ID NO: 488636 - DNA, 25 bp, Rattus norvegicus
gtcaagtagaccgatacggctgtaa

SEQ ID NO: 488637 - DNA, 25 bp, Rattus norvegicus
gtcaagtagctgcttatctgccggc

SEQ ID NO: 488638 - DNA, 25 bp, Rattus norvegicus
gtcaagtagctggttatctgccggc

SEQ ID NO: 488639 - DNA, 25 bp, Rattus norvegicus
gtcaagtatacaactgcaggcacac

SEQ ID NO: 488640 - DNA, 25 bp, Rattus norvegicus
gtcaagtatacatctgcaggcacac

SEQ ID NO: 488641 - DNA, 25 bp, Rattus norvegicus
gtcaagtatgcaagttaccttatgt

SEQ ID NO: 488642 - DNA, 25 bp, Rattus norvegicus
gtcaagtatgcatgttaccttatgt

SEQ ID NO: 488643 - DNA, 25 bp, Rattus norvegicus
gtcaagtcacggaccacgttatcat

SEQ ID NO: 488644 - DNA, 25 bp, Rattus norvegicus
gtcaagtcacggtccacgttatcat

SEQ ID NO: 488645 - DNA, 25 bp, Rattus norvegicus
gtcaagtcactgctctgtttgcatt

SEQ ID NO: 488646 - DNA, 25 bp, Rattus norvegicus
gtcaagtcactggtctgtttgcatt

SEQ ID NO: 488647 - DNA, 25 bp, Rattus norvegicus
gtcaagtcagtaacacctgcatggt

SEQ ID NO: 488648 - DNA, 25 bp, Rattus norvegicus
gtcaagtcagtatcacctgcatggt

SEQ ID NO: 488649 - DNA, 25 bp, Rattus norvegicus
gtcaagtcagttccatttacagcta

SEQ ID NO: 488650 - DNA, 25 bp, Rattus norvegicus
gtcaagtcagttgcatttacagcta

SEQ ID NO: 488651 - DNA, 25 bp, Rattus norvegicus
gtcaagtcataacatctgcttctca

SEQ ID NO: 488652 - DNA, 25 bp, Rattus norvegicus
gtcaagtcataagatctgcttctca

SEQ ID NO: 488653 - DNA, 25 bp, Rattus norvegicus
gtcaagtcattgctttcataatcct

SEQ ID NO: 488654 - DNA, 25 bp, Rattus norvegicus
gtcaagtcattggtttcataatcct

SEQ ID NO: 488655 - DNA, 25 bp, Rattus norvegicus
gtcaagtccgacagaggtatctcta

SEQ ID NO: 488656 - DNA, 25 bp, Rattus norvegicus
gtcaagtccgactgaggtatctcta

SEQ ID NO: 488657 - DNA, 25 bp, Rattus norvegicus
gtcaagtccttaccctttgtagcgc

SEQ ID NO: 488658 - DNA, 25 bp, Rattus norvegicus
gtcaagtccttagcctttgtagcgc

SEQ ID NO: 488659 - DNA, 25 bp, Rattus norvegicus
gtcaagtctgacaagtttaagtaag

SEQ ID NO: 488660 - DNA, 25 bp, Rattus norvegicus
gtcaagtctgacatgttttctttct

SEQ ID NO: 488661 - DNA, 25 bp, Rattus norvegicus
gtcaagtctgactagtttaagtaag

SEQ ID NO: 488662 - DNA, 25 bp, Rattus norvegicus
gtcaagtctgacttgttttctttct

SEQ ID NO: 488663 - DNA, 25 bp, Rattus norvegicus
gtcaagtgaagtactcagctacgtc

SEQ ID NO: 488664 - DNA, 25 bp, Rattus norvegicus
gtcaagtgaagttctcagctacgtc

SEQ ID NO: 488665 - DNA, 25 bp, Rattus norvegicus
gtcaagtggactacaacccgtaggt

SEQ ID NO: 488666 - DNA, 25 bp, Rattus norvegicus
gtcaagtggacttcaacccgtaggt

SEQ ID NO: 488667 - DNA, 25 bp, Rattus norvegicus
gtcaagtgtaataccctggccacat

SEQ ID NO: 488668 - DNA, 25 bp, Rattus norvegicus
gtcaagtgtaattccctggccacat

SEQ ID NO: 488669 - DNA, 25 bp, Rattus norvegicus
gtcaagtgtcacaaactcctaagga

SEQ ID NO: 488670 - DNA, 25 bp, Rattus norvegicus
gtcaagtgtcactaactcctaagga

SEQ ID NO: 488671 - DNA, 25 bp, Rattus norvegicus
gtcaagtgtcttataccagagtaca

SEQ ID NO: 488672 - DNA, 25 bp, Rattus norvegicus
gtcaagtgtcttttaccagagtaca

SEQ ID NO: 488673 - DNA, 25 bp, Rattus norvegicus
gtcaagtgtgcccagacagctgcga

SEQ ID NO: 488674 - DNA, 25 bp, Rattus norvegicus
gtcaagtgtgccgagacagctgcga

SEQ ID NO: 488675 - DNA, 25 bp, Rattus norvegicus
gtcaagttaaataatttgtactcag

SEQ ID NO: 488676 - DNA, 25 bp, Rattus norvegicus
gtcaagttaaattatttgtactcag

SEQ ID NO: 488677 - DNA, 25 bp, Rattus norvegicus
gtcaagttcaaacctggcctcacct

SEQ ID NO: 488678 - DNA, 25 bp, Rattus norvegicus
gtcaagttcaaactcctttccaaag

SEQ ID NO: 488679 - DNA, 25 bp, Rattus norvegicus
gtcaagttcaaagctggcctcacct

SEQ ID NO: 488680 - DNA, 25 bp, Rattus norvegicus
gtcaagttcaaagtcctttccaaag

SEQ ID NO: 488681 - DNA, 25 bp, Rattus norvegicus
gtcaagttcaagatgtgctcttcat

SEQ ID NO: 488682 - DNA, 25 bp, Rattus norvegicus
gtcaagttcaagttgtgctcttcat

SEQ ID NO: 488683 - DNA, 25 bp, Rattus norvegicus
gtcaagttcaccactgattcctgaa

SEQ ID NO: 488684 - DNA, 25 bp, Rattus norvegicus
gtcaagttcacctctgattcctgaa

SEQ ID NO: 488685 - DNA, 25 bp, Rattus norvegicus
gtcaagttctagagcacatccttca

SEQ ID NO: 488686 - DNA, 25 bp, Rattus norvegicus
gtcaagttctagtgcacatccttca

SEQ ID NO: 488687 - DNA, 25 bp, Rattus norvegicus
gtcaagttctctcttctttatttcc

SEQ ID NO: 488688 - DNA, 25 bp, Rattus norvegicus
gtcaagttctctgttctttatttcc

SEQ ID NO: 488689 - DNA, 25 bp, Rattus norvegicus
gtcaagttgacaccagcagcaggca

SEQ ID NO: 488690 - DNA, 25 bp, Rattus norvegicus
gtcaagttgacagcagcagcaggca

SEQ ID NO: 488691 - DNA, 25 bp, Rattus norvegicus
gtcaagttgtaccagataaagcgca

SEQ ID NO: 488692 - DNA, 25 bp, Rattus norvegicus
gtcaagttgtacgagataaagcgca

SEQ ID NO: 488693 - DNA, 25 bp, Rattus norvegicus
gtcaagtttaacaggtgtccacaga

SEQ ID NO: 488694 - DNA, 25 bp, Rattus norvegicus
gtcaagtttaactggtgtccacaga

SEQ ID NO: 488695 - DNA, 25 bp, Rattus norvegicus
gtcaagtttattaccagacaagtga

SEQ ID NO: 488696 - DNA, 25 bp, Rattus norvegicus
gtcaagtttatttccagacaagtga

SEQ ID NO: 488697 - DNA, 25 bp, Rattus norvegicus
gtcaagtttcgtcttactacctatg

SEQ ID NO: 488698 - DNA, 25 bp, Rattus norvegicus
gtcaagtttcgtgttactacctatg

SEQ ID NO: 488699 - DNA, 25 bp, Rattus norvegicus
gtcaagtttgcaacccattttataa

SEQ ID NO: 488700 - DNA, 25 bp, Rattus norvegicus
gtcaagtttgcatcccattttataa

SEQ ID NO: 488701 - DNA, 25 bp, Rattus norvegicus
gtcaagttttccacacaatctggtg

SEQ ID NO: 488702 - DNA, 25 bp, Rattus norvegicus
gtcaagttttcctcacaatctggtg

SEQ ID NO: 488703 - DNA, 25 bp, Rattus norvegicus
gtcaagttttctacacttacaaagg

SEQ ID NO: 488704 - DNA, 25 bp, Rattus norvegicus
gtcaagttttcttcacttacaaagg

SEQ ID NO: 488705 - DNA, 25 bp, Rattus norvegicus
gtcaagttttttctgcagactccac

SEQ ID NO: 488706 - DNA, 25 bp, Rattus norvegicus
gtcaagttttttgtgcagactccac

SEQ ID NO: 488707 - DNA, 25 bp, Rattus norvegicus
gtcaataaaactcctcggtgctggt

SEQ ID NO: 488708 - DNA, 25 bp, Rattus norvegicus
gtcaataaaactgctcggtgctggt

SEQ ID NO: 488709 - DNA, 25 bp, Rattus norvegicus
gtcaataaacagaccacgggtcatt

SEQ ID NO: 488710 - DNA, 25 bp, Rattus norvegicus
gtcaataaacagtccacgggtcatt

SEQ ID NO: 488711 - DNA, 25 bp, Rattus norvegicus
gtcaataaatatctctactttctga

SEQ ID NO: 488712 - DNA, 25 bp, Rattus norvegicus
gtcaataaatatgtctactttctga

SEQ ID NO: 488713 - DNA, 25 bp, Rattus norvegicus
gtcaataaattcaccaaagcactag

SEQ ID NO: 488714 - DNA, 25 bp, Rattus norvegicus
gtcaataaattctccaaagcactag

SEQ ID NO: 488715 - DNA, 25 bp, Rattus norvegicus
gtcaataacttgaaatcaccaggtt

SEQ ID NO: 488716 - DNA, 25 bp, Rattus norvegicus
gtcaataacttgtaatcaccaggtt

SEQ ID NO: 488717 - DNA, 25 bp, Rattus norvegicus
gtcaatacacttccaacaggcatcc

SEQ ID NO: 488718 - DNA, 25 bp, Rattus norvegicus
gtcaatacacttgcaacaggcatcc

SEQ ID NO: 488719 - DNA, 25 bp, Rattus norvegicus
gtcaataccagaagtcgttaaccaa

SEQ ID NO: 488720 - DNA, 25 bp, Rattus norvegicus
gtcaataccagatgtcgttaaccaa

SEQ ID NO: 488721 - DNA, 25 bp, Rattus norvegicus
gtcaatacccagagaaaaactaatg

SEQ ID NO: 488722 - DNA, 25 bp, Rattus norvegicus
gtcaatacccagtgaaaaactaatg

SEQ ID NO: 488723 - DNA, 25 bp, Rattus norvegicus
gtcaatacctttatctctacactta

SEQ ID NO: 488724 - DNA, 25 bp, Rattus norvegicus
gtcaatacctttttctctacactta

SEQ ID NO: 488725 - DNA, 25 bp, Rattus norvegicus
gtcaatactcgcaaaagttctcaaa

SEQ ID NO: 488726 - DNA, 25 bp, Rattus norvegicus
gtcaatactcgctaaagttctcaaa

SEQ ID NO: 488727 - DNA, 25 bp, Rattus norvegicus
gtcaatacttacacagcagggcgct

SEQ ID NO: 488728 - DNA, 25 bp, Rattus norvegicus
gtcaatacttactcagcagggcgct

SEQ ID NO: 488729 - DNA, 25 bp, Rattus norvegicus
gtcaataggcagatcatggcggaaa

SEQ ID NO: 488730 - DNA, 25 bp, Rattus norvegicus
gtcaataggcagttcatggcggaaa

SEQ ID NO: 488731 - DNA, 25 bp, Rattus norvegicus
gtcaataggcctaatcttcgtacac

SEQ ID NO: 488732 - DNA, 25 bp, Rattus norvegicus
gtcaataggccttatcttcgtacac

SEQ ID NO: 488733 - DNA, 25 bp, Rattus norvegicus
gtcaatagtgtcattacatactaca

SEQ ID NO: 488734 - DNA, 25 bp, Rattus norvegicus
gtcaatagtgtctttacatactaca

SEQ ID NO: 488735 - DNA, 25 bp, Rattus norvegicus
gtcaatatacccagatgaaggcatt

SEQ ID NO: 488736 - DNA, 25 bp, Rattus norvegicus
gtcaatataccctgatgaaggcatt

SEQ ID NO: 488737 - DNA, 25 bp, Rattus norvegicus
gtcaatatagtcagccgatcgatcg

SEQ ID NO: 488738 - DNA, 25 bp, Rattus norvegicus
gtcaatatagtctgccgatcgatcg

SEQ ID NO: 488739 - DNA, 25 bp, Rattus norvegicus
gtcaatatggccaacagcatcgcta

SEQ ID NO: 488740 - DNA, 25 bp, Rattus norvegicus
gtcaatatggcctacagcatcgcta

SEQ ID NO: 488741 - DNA, 25 bp, Rattus norvegicus
gtcaatattaacagtcacactggct

SEQ ID NO: 488742 - DNA, 25 bp, Rattus norvegicus
gtcaatattaactgtcacactggct

SEQ ID NO: 488743 - DNA, 25 bp, Rattus norvegicus
gtcaatatttgaccactctggactg

SEQ ID NO: 488744 - DNA, 25 bp, Rattus norvegicus
gtcaatatttgagcactctggactg

SEQ ID NO: 488745 - DNA, 25 bp, Rattus norvegicus
gtcaatatttgtattctccggagag

SEQ ID NO: 488746 - DNA, 25 bp, Rattus norvegicus
gtcaatatttgttttctccggagag

SEQ ID NO: 488747 - DNA, 25 bp, Rattus norvegicus
gtcaatcaaaccactcaggctagtt

SEQ ID NO: 488748 - DNA, 25 bp, Rattus norvegicus
gtcaatcaaacctctcaggctagtt

SEQ ID NO: 488749 - DNA, 25 bp, Rattus norvegicus
gtcaatcaaagcacaggctcagcct

SEQ ID NO: 488750 - DNA, 25 bp, Rattus norvegicus
gtcaatcaaagctcaggctcagcct

SEQ ID NO: 488751 - DNA, 25 bp, Rattus norvegicus
gtcaatcaacaccaccagcaaatat

SEQ ID NO: 488752 - DNA, 25 bp, Rattus norvegicus
gtcaatcaacacgaccagcaaatat

SEQ ID NO: 488753 - DNA, 25 bp, Rattus norvegicus
gtcaatcaagatctgtgcttacttt

SEQ ID NO: 488754 - DNA, 25 bp, Rattus norvegicus
gtcaatcaagatgtgtgcttacttt

SEQ ID NO: 488755 - DNA, 25 bp, Rattus norvegicus
gtcaatcaagtgaaggagactttgg

SEQ ID NO: 488756 - DNA, 25 bp, Rattus norvegicus
gtcaatcaagtgtaggagactttgg

SEQ ID NO: 488757 - DNA, 25 bp, Rattus norvegicus
gtcaatcactacctgctctgtaatt

SEQ ID NO: 488758 - DNA, 25 bp, Rattus norvegicus
gtcaatcactacgtgctctgtaatt

SEQ ID NO: 488759 - DNA, 25 bp, Rattus norvegicus
gtcaatcatgcaactcaatttccca

SEQ ID NO: 488760 - DNA, 25 bp, Rattus norvegicus
gtcaatcatgcatctcaatttccca

SEQ ID NO: 488761 - DNA, 25 bp, Rattus norvegicus
gtcaatcattcgaactcggaacatt

SEQ ID NO: 488762 - DNA, 25 bp, Rattus norvegicus
gtcaatcattcgtactcggaacatt

SEQ ID NO: 488763 - DNA, 25 bp, Rattus norvegicus
gtcaatccatcaactgcacatctga

SEQ ID NO: 488764 - DNA, 25 bp, Rattus norvegicus
gtcaatccatcatctgcacatctga

SEQ ID NO: 488765 - DNA, 25 bp, Rattus norvegicus
gtcaatcctaaaccccgagtcgagt

SEQ ID NO: 488766 - DNA, 25 bp, Rattus norvegicus
gtcaatcctaaagcccgagtcgagt

SEQ ID NO: 488767 - DNA, 25 bp, Rattus norvegicus
gtcaatcctgatctgttctagggca

SEQ ID NO: 488768 - DNA, 25 bp, Rattus norvegicus
gtcaatcctgatgtgttctagggca

SEQ ID NO: 488769 - DNA, 25 bp, Rattus norvegicus
gtcaatcggaccattgaaggcctgc

SEQ ID NO: 488770 - DNA, 25 bp, Rattus norvegicus
gtcaatcggacctttgaaggcctgc

SEQ ID NO: 488771 - DNA, 25 bp, Rattus norvegicus
gtcaatcggtctattctaactcttc

SEQ ID NO: 488772 - DNA, 25 bp, Rattus norvegicus
gtcaatcggtcttttctaactcttc

SEQ ID NO: 488773 - DNA, 25 bp, Rattus norvegicus
gtcaatctcaaaactgcttttctgg

SEQ ID NO: 488774 - DNA, 25 bp, Rattus norvegicus
gtcaatctcaaatctgcttttctgg

SEQ ID NO: 488775 - DNA, 25 bp, Rattus norvegicus
gtcaatctcatgacaggcgtcagcc

SEQ ID NO: 488776 - DNA, 25 bp, Rattus norvegicus
gtcaatctcatgactgtgttcttct

SEQ ID NO: 488777 - DNA, 25 bp, Rattus norvegicus
gtcaatctcatgtcaggcgtcagcc

SEQ ID NO: 488778 - DNA, 25 bp, Rattus norvegicus
gtcaatctcatgtctgtgttcttct

SEQ ID NO: 488779 - DNA, 25 bp, Rattus norvegicus
gtcaatgaagttccttctcctaagt

SEQ ID NO: 488780 - DNA, 25 bp, Rattus norvegicus
gtcaatgaagttgcttctcctaagt

SEQ ID NO: 488781 - DNA, 25 bp, Rattus norvegicus
gtcaatgaatgcatcctggagcccg

SEQ ID NO: 488782 - DNA, 25 bp, Rattus norvegicus
gtcaatgaatgcttcctggagcccg

SEQ ID NO: 488783 - DNA, 25 bp, Rattus norvegicus
gtcaatgagacacatgccttttgga

SEQ ID NO: 488784 - DNA, 25 bp, Rattus norvegicus
gtcaatgagacagatgccttttgga

SEQ ID NO: 488785 - DNA, 25 bp, Rattus norvegicus
gtcaatgagagacggcccagcccac

SEQ ID NO: 488786 - DNA, 25 bp, Rattus norvegicus
gtcaatgagagagggcccagcccac

SEQ ID NO: 488787 - DNA, 25 bp, Rattus norvegicus
gtcaatgatgctatagctttcaatt

SEQ ID NO: 488788 - DNA, 25 bp, Rattus norvegicus
gtcaatgatgctttagctttcaatt

SEQ ID NO: 488789 - DNA, 25 bp, Rattus norvegicus
gtcaatgcagacaccgggaggttct

SEQ ID NO: 488790 - DNA, 25 bp, Rattus norvegicus
gtcaatgcagactccgggaggttct

SEQ ID NO: 488791 - DNA, 25 bp, Rattus norvegicus
gtcaatgcagcacaggccatgatgt

SEQ ID NO: 488792 - DNA, 25 bp, Rattus norvegicus
gtcaatgcagcagaggccatgatgt

SEQ ID NO: 488793 - DNA, 25 bp, Rattus norvegicus
gtcaatgcatctccaccatttgata

SEQ ID NO: 488794 - DNA, 25 bp, Rattus norvegicus
gtcaatgcatctgcaccatttgata

SEQ ID NO: 488795 - DNA, 25 bp, Rattus norvegicus
gtcaatgctatgattgtcttcccat

SEQ ID NO: 488796 - DNA, 25 bp, Rattus norvegicus
gtcaatgctatgtttgtcttcccat

SEQ ID NO: 488797 - DNA, 25 bp, Rattus norvegicus
gtcaatgctccaacgtgggatcaat

SEQ ID NO: 488798 - DNA, 25 bp, Rattus norvegicus
gtcaatgctccatcgtgggatcaat

SEQ ID NO: 488799 - DNA, 25 bp, Rattus norvegicus
gtcaatgctgggagtctttcttaag

SEQ ID NO: 488800 - DNA, 25 bp, Rattus norvegicus
gtcaatgctgggtgtctttcttaag

SEQ ID NO: 488801 - DNA, 25 bp, Rattus norvegicus
gtcaatgctgtcattgtccagctgg

SEQ ID NO: 488802 - DNA, 25 bp, Rattus norvegicus
gtcaatgctgtctttgtccagctgg

SEQ ID NO: 488803 - DNA, 25 bp, Rattus norvegicus
gtcaatgcttacacactgcgatgta

SEQ ID NO: 488804 - DNA, 25 bp, Rattus norvegicus
gtcaatgcttactcactgcgatgta

SEQ ID NO: 488805 - DNA, 25 bp, Rattus norvegicus
gtcaatggcaagatgaaactctttg

SEQ ID NO: 488806 - DNA, 25 bp, Rattus norvegicus
gtcaatggcaagttgaaactctttg

SEQ ID NO: 488807 - DNA, 25 bp, Rattus norvegicus
gtcaatggcgcactcctagtggaaa

SEQ ID NO: 488808 - DNA, 25 bp, Rattus norvegicus
gtcaatggcgcagtcctagtggaaa

SEQ ID NO: 488809 - DNA, 25 bp, Rattus norvegicus
gtcaatgggagacaaaacgccctga

SEQ ID NO: 488810 - DNA, 25 bp, Rattus norvegicus
gtcaatgggagagaaaacgccctga

SEQ ID NO: 488811 - DNA, 25 bp, Rattus norvegicus
gtcaatggtgccattctaccagcat

SEQ ID NO: 488812 - DNA, 25 bp, Rattus norvegicus
gtcaatggtgcctttctaccagcat

SEQ ID NO: 488813 - DNA, 25 bp, Rattus norvegicus
gtcaatggttgaacctattctccaa

SEQ ID NO: 488814 - DNA, 25 bp, Rattus norvegicus
gtcaatggttgatcctattctccaa

SEQ ID NO: 488815 - DNA, 25 bp, Rattus norvegicus
gtcaatgtagccaccttgggaaaag

SEQ ID NO: 488816 - DNA, 25 bp, Rattus norvegicus
gtcaatgtagcctccttgggaaaag

SEQ ID NO: 488817 - DNA, 25 bp, Rattus norvegicus
gtcaatgtcggtaaggtgcaggtca

SEQ ID NO: 488818 - DNA, 25 bp, Rattus norvegicus
gtcaatgtcggttaggtgcaggtca

SEQ ID NO: 488819 - DNA, 25 bp, Rattus norvegicus
gtcaatgtgatcatccagctgtgca

SEQ ID NO: 488820 - DNA, 25 bp, Rattus norvegicus
gtcaatgtgatcttccagctgtgca

SEQ ID NO: 488821 - DNA, 25 bp, Rattus norvegicus
gtcaatgtgcacagcttcaagccgg

SEQ ID NO: 488822 - DNA, 25 bp, Rattus norvegicus
gtcaatgtgcactgcttcaagccgg

SEQ ID NO: 488823 - DNA, 25 bp, Rattus norvegicus
gtcaatgttacgcatattgtcataa

SEQ ID NO: 488824 - DNA, 25 bp, Rattus norvegicus
gtcaatgttacggatattgtcataa

SEQ ID NO: 488825 - DNA, 25 bp, Rattus norvegicus
gtcaatgttgaacctttctggcctg

SEQ ID NO: 488826 - DNA, 25 bp, Rattus norvegicus
gtcaatgttgaagctttctggcctg

SEQ ID NO: 488827 - DNA, 25 bp, Rattus norvegicus
gtcaatgttgcccacttgtatgtag

SEQ ID NO: 488828 - DNA, 25 bp, Rattus norvegicus
gtcaatgttgccgacttgtatgtag

SEQ ID NO: 488829 - DNA, 25 bp, Rattus norvegicus
gtcaatgttgtactcagcctatggt

SEQ ID NO: 488830 - DNA, 25 bp, Rattus norvegicus
gtcaatgttgtagtcagcctatggt

SEQ ID NO: 488831 - DNA, 25 bp, Rattus norvegicus
gtcaatgtttacacgagatgtcgga

SEQ ID NO: 488832 - DNA, 25 bp, Rattus norvegicus
gtcaatgtttactcgagatgtcgga

SEQ ID NO: 488833 - DNA, 25 bp, Rattus norvegicus
gtcaattacagcagagcctccataa

SEQ ID NO: 488834 - DNA, 25 bp, Rattus norvegicus
gtcaattacagctgagcctccataa

SEQ ID NO: 488835 - DNA, 25 bp, Rattus norvegicus
gtcaattacctcaagtctcagcaga

SEQ ID NO: 488836 - DNA, 25 bp, Rattus norvegicus
gtcaattacctctagtctcagcaga

SEQ ID NO: 488837 - DNA, 25 bp, Rattus norvegicus
gtcaattattgtccgtgttcctgga

SEQ ID NO: 488838 - DNA, 25 bp, Rattus norvegicus
gtcaattattgtgcgtgttcctgga

SEQ ID NO: 488839 - DNA, 25 bp, Rattus norvegicus
gtcaattcctacatttttcgttact

SEQ ID NO: 488840 - DNA, 25 bp, Rattus norvegicus
gtcaattcctacttttttcgttact

SEQ ID NO: 488841 - DNA, 25 bp, Rattus norvegicus
gtcaattcctcactcttgagttaaa

SEQ ID NO: 488842 - DNA, 25 bp, Rattus norvegicus
gtcaattcctcagtcttgagttaaa

SEQ ID NO: 488843 - DNA, 25 bp, Rattus norvegicus
gtcaattcctgacataacatctgag

SEQ ID NO: 488844 - DNA, 25 bp, Rattus norvegicus
gtcaattcctgagataacatctgag

SEQ ID NO: 488845 - DNA, 25 bp, Rattus norvegicus
gtcaattcctgtctctaggtttagg

SEQ ID NO: 488846 - DNA, 25 bp, Rattus norvegicus
gtcaattcctgtgtctaggtttagg

SEQ ID NO: 488847 - DNA, 25 bp, Rattus norvegicus
gtcaattctgaacttcacattcttg

SEQ ID NO: 488848 - DNA, 25 bp, Rattus norvegicus
gtcaattctgaagttcacattcttg

SEQ ID NO: 488849 - DNA, 25 bp, Rattus norvegicus
gtcaattctgcaaacgagcatcaaa

SEQ ID NO: 488850 - DNA, 25 bp, Rattus norvegicus
gtcaattctgcatacgagcatcaaa

SEQ ID NO: 488851 - DNA, 25 bp, Rattus norvegicus
gtcaattctgctctggacagcttta

SEQ ID NO: 488852 - DNA, 25 bp, Rattus norvegicus
gtcaattctgctgtggacagcttta

SEQ ID NO: 488853 - DNA, 25 bp, Rattus norvegicus
gtcaattcttccaaatgagctcaag

SEQ ID NO: 488854 - DNA, 25 bp, Rattus norvegicus
gtcaattcttcctaatgagctcaag

SEQ ID NO: 488855 - DNA, 25 bp, Rattus norvegicus
gtcaattgcctgaatgtctcgagat

SEQ ID NO: 488856 - DNA, 25 bp, Rattus norvegicus
gtcaattgcctgtatgtctcgagat

SEQ ID NO: 488857 - DNA, 25 bp, Rattus norvegicus
gtcaattggcgcagtgaagtgtgca

SEQ ID NO: 488858 - DNA, 25 bp, Rattus norvegicus
gtcaattggcgctgtgaagtgtgca

SEQ ID NO: 488859 - DNA, 25 bp, Rattus norvegicus
gtcaattgtgacagcaattccaaat

SEQ ID NO: 488860 - DNA, 25 bp, Rattus norvegicus
gtcaattgtgactgcaattccaaat

SEQ ID NO: 488861 - DNA, 25 bp, Rattus norvegicus
gtcaatttaccacctggtccaagtt

SEQ ID NO: 488862 - DNA, 25 bp, Rattus norvegicus
gtcaatttaccagctggtccaagtt

SEQ ID NO: 488863 - DNA, 25 bp, Rattus norvegicus
gtcaatttccttaatatactatgtc

SEQ ID NO: 488864 - DNA, 25 bp, Rattus norvegicus
gtcaatttcctttatatactatgtc

SEQ ID NO: 488865 - DNA, 25 bp, Rattus norvegicus
gtcaatttctgtctagatggacaca

SEQ ID NO: 488866 - DNA, 25 bp, Rattus norvegicus
gtcaatttctgtgtagatggacaca

SEQ ID NO: 488867 - DNA, 25 bp, Rattus norvegicus
gtcaatttgggaatctgtgggagtc

SEQ ID NO: 488868 - DNA, 25 bp, Rattus norvegicus
gtcaatttgggattctgtgggagtc

SEQ ID NO: 488869 - DNA, 25 bp, Rattus norvegicus
gtcaattttcgaattaaggcacctt

SEQ ID NO: 488870 - DNA, 25 bp, Rattus norvegicus
gtcaattttcgatttaaggcacctt

SEQ ID NO: 488871 - DNA, 25 bp, Rattus norvegicus
gtcaattttggtctcactggtcaca

SEQ ID NO: 488872 - DNA, 25 bp, Rattus norvegicus
gtcaattttggtgtcactggtcaca

SEQ ID NO: 488873 - DNA, 25 bp, Rattus norvegicus
gtcaatttttcaaactggttcttta

SEQ ID NO: 488874 - DNA, 25 bp, Rattus norvegicus
gtcaatttttcatactggttcttta

SEQ ID NO: 488875 - DNA, 25 bp, Rattus norvegicus
gtcacaaaaactatgttgtcatagt

SEQ ID NO: 488876 - DNA, 25 bp, Rattus norvegicus
gtcacaaaaactttgttgtcatagt

SEQ ID NO: 488877 - DNA, 25 bp, Rattus norvegicus
gtcacaaaacccacagaagtcattt

SEQ ID NO: 488878 - DNA, 25 bp, Rattus norvegicus
gtcacaaaaccctcagaagtcattt

SEQ ID NO: 488879 - DNA, 25 bp, Rattus norvegicus
gtcacaaacactaactccgatttaa

SEQ ID NO: 488880 - DNA, 25 bp, Rattus norvegicus
gtcacaaacacttactccgatttaa

SEQ ID NO: 488881 - DNA, 25 bp, Rattus norvegicus
gtcacaaactgtacatcttatatta

SEQ ID NO: 488882 - DNA, 25 bp, Rattus norvegicus
gtcacaaactgtcgtttatccaatc

SEQ ID NO: 488883 - DNA, 25 bp, Rattus norvegicus
gtcacaaactgtggtttatccaatc

SEQ ID NO: 488884 - DNA, 25 bp, Rattus norvegicus
gtcacaaactgttcatcttatatta

SEQ ID NO: 488885 - DNA, 25 bp, Rattus norvegicus
gtcacaaagcctacttccacaagaa

SEQ ID NO: 488886 - DNA, 25 bp, Rattus norvegicus
gtcacaaagccttcttccacaagaa

SEQ ID NO: 488887 - DNA, 25 bp, Rattus norvegicus
gtcacaaagtaccagcagcttcgaa

SEQ ID NO: 488888 - DNA, 25 bp, Rattus norvegicus
gtcacaaagtacgagcagcttcgaa

SEQ ID NO: 488889 - DNA, 25 bp, Rattus norvegicus
gtcacaaagtgactcctgggctctg

SEQ ID NO: 488890 - DNA, 25 bp, Rattus norvegicus
gtcacaaagtgagtcctgggctctg

SEQ ID NO: 488891 - DNA, 25 bp, Rattus norvegicus
gtcacaaagttaaaggctggcccct

SEQ ID NO: 488892 - DNA, 25 bp, Rattus norvegicus
gtcacaaagttataggctggcccct

SEQ ID NO: 488893 - DNA, 25 bp, Rattus norvegicus
gtcacaaagtttacacctctccaga

SEQ ID NO: 488894 - DNA, 25 bp, Rattus norvegicus
gtcacaaagttttcacctctccaga

SEQ ID NO: 488895 - DNA, 25 bp, Rattus norvegicus
gtcacaaatctaaggagggctgcag

SEQ ID NO: 488896 - DNA, 25 bp, Rattus norvegicus
gtcacaaatctacgtattcttccct

SEQ ID NO: 488897 - DNA, 25 bp, Rattus norvegicus
gtcacaaatctaggtattcttccct

SEQ ID NO: 488898 - DNA, 25 bp, Rattus norvegicus
gtcacaaatctatggagggctgcag

SEQ ID NO: 488899 - DNA, 25 bp, Rattus norvegicus
gtcacaaatgggacctgagctctgg

SEQ ID NO: 488900 - DNA, 25 bp, Rattus norvegicus
gtcacaaatgggtcctgagctctgg

SEQ ID NO: 488901 - DNA, 25 bp, Rattus norvegicus
gtcacaaatgttctgacacttccag

SEQ ID NO: 488902 - DNA, 25 bp, Rattus norvegicus
gtcacaaatgttgtgacacttccag

SEQ ID NO: 488903 - DNA, 25 bp, Rattus norvegicus
gtcacaacaccaactgacgtgttag

SEQ ID NO: 488904 - DNA, 25 bp, Rattus norvegicus
gtcacaacaccatctgacgtgttag

SEQ ID NO: 488905 - DNA, 25 bp, Rattus norvegicus
gtcacaacactacagttctccaaaa

SEQ ID NO: 488906 - DNA, 25 bp, Rattus norvegicus
gtcacaacactagagttctccaaaa

SEQ ID NO: 488907 - DNA, 25 bp, Rattus norvegicus
gtcacaacagcacgaggatcactta

SEQ ID NO: 488908 - DNA, 25 bp, Rattus norvegicus
gtcacaacagcaggaggatcactta

SEQ ID NO: 488909 - DNA, 25 bp, Rattus norvegicus
gtcacaacccatctccaagtgcttg

SEQ ID NO: 488910 - DNA, 25 bp, Rattus norvegicus
gtcacaacccatgtccaagtgcttg

SEQ ID NO: 488911 - DNA, 25 bp, Rattus norvegicus
gtcacaaccggcactagtgttaggt

SEQ ID NO: 488912 - DNA, 25 bp, Rattus norvegicus
gtcacaaccggctctagtgttaggt

SEQ ID NO: 488913 - DNA, 25 bp, Rattus norvegicus
gtcacaaccttgctcagccattttt

SEQ ID NO: 488914 - DNA, 25 bp, Rattus norvegicus
gtcacaaccttggtcagccattttt

SEQ ID NO: 488915 - DNA, 25 bp, Rattus norvegicus
gtcacaactgaaaatcctcccaaaa

SEQ ID NO: 488916 - DNA, 25 bp, Rattus norvegicus
gtcacaactgaatatcctcccaaaa

SEQ ID NO: 488917 - DNA, 25 bp, Rattus norvegicus
gtcacaactttgagaacaactcaaa

SEQ ID NO: 488918 - DNA, 25 bp, Rattus norvegicus
gtcacaactttgtgaacaactcaaa

SEQ ID NO: 488919 - DNA, 25 bp, Rattus norvegicus
gtcacaagcaagctggactctcaga

SEQ ID NO: 488920 - DNA, 25 bp, Rattus norvegicus
gtcacaagcaaggtggactctcaga

SEQ ID NO: 488921 - DNA, 25 bp, Rattus norvegicus
gtcacaagcctcaaagtcactcaaa

SEQ ID NO: 488922 - DNA, 25 bp, Rattus norvegicus
gtcacaagcctctaagtcactcaaa

SEQ ID NO: 488923 - DNA, 25 bp, Rattus norvegicus
gtcacaagcctgaccacgcagagta

SEQ ID NO: 488924 - DNA, 25 bp, Rattus norvegicus
gtcacaagcctgtccacgcagagta

SEQ ID NO: 488925 - DNA, 25 bp, Rattus norvegicus
gtcacaaggattccgtgttggctct

SEQ ID NO: 488926 - DNA, 25 bp, Rattus norvegicus
gtcacaaggattgcgtgttggctct

SEQ ID NO: 488927 - DNA, 25 bp, Rattus norvegicus
gtcacaaggtagctgtctgaagctg

SEQ ID NO: 488928 - DNA, 25 bp, Rattus norvegicus
gtcacaaggtaggtgtctgaagctg

SEQ ID NO: 488929 - DNA, 25 bp, Rattus norvegicus
gtcacaagtattactaggatagcca

SEQ ID NO: 488930 - DNA, 25 bp, Rattus norvegicus
gtcacaagtatttctaggatagcca

SEQ ID NO: 488931 - DNA, 25 bp, Rattus norvegicus
gtcacaatcaccatgttgctgtggg

SEQ ID NO: 488932 - DNA, 25 bp, Rattus norvegicus
gtcacaatcaccttgttgctgtggg

SEQ ID NO: 488933 - DNA, 25 bp, Rattus norvegicus
gtcacaatccaactgtcctcaagga

SEQ ID NO: 488934 - DNA, 25 bp, Rattus norvegicus
gtcacaatccaagtgtcctcaagga

SEQ ID NO: 488935 - DNA, 25 bp, Rattus norvegicus
gtcacaatcctaatacagtaaagtt

SEQ ID NO: 488936 - DNA, 25 bp, Rattus norvegicus
gtcacaatcctattacagtaaagtt

SEQ ID NO: 488937 - DNA, 25 bp, Rattus norvegicus
gtcacaatgcttataccgttccaag

SEQ ID NO: 488938 - DNA, 25 bp, Rattus norvegicus
gtcacaatgcttttaccgttccaag

SEQ ID NO: 488939 - DNA, 25 bp, Rattus norvegicus
gtcacaatgtctcagctctagtttt

SEQ ID NO: 488940 - DNA, 25 bp, Rattus norvegicus
gtcacaatgtctgagctctagtttt

SEQ ID NO: 488941 - DNA, 25 bp, Rattus norvegicus
gtcacaatgtttccttatagttaaa

SEQ ID NO: 488942 - DNA, 25 bp, Rattus norvegicus
gtcacaatgtttgcttatagttaaa

SEQ ID NO: 488943 - DNA, 25 bp, Rattus norvegicus
gtcacaattagcagtttcttactca

SEQ ID NO: 488944 - DNA, 25 bp, Rattus norvegicus
gtcacaattagctgtttcttactca

SEQ ID NO: 488945 - DNA, 25 bp, Rattus norvegicus
gtcacaattcatactgttcttggga

SEQ ID NO: 488946 - DNA, 25 bp, Rattus norvegicus
gtcacaattcatcactgagggaggt

SEQ ID NO: 488947 - DNA, 25 bp, Rattus norvegicus
gtcacaattcatgactgagggaggt

SEQ ID NO: 488948 - DNA, 25 bp, Rattus norvegicus
gtcacaattcattctgttcttggga

SEQ ID NO: 488949 - DNA, 25 bp, Rattus norvegicus
gtcacacaaataagcctcaggcatt

SEQ ID NO: 488950 - DNA, 25 bp, Rattus norvegicus
gtcacacaaatatgcctcaggcatt

SEQ ID NO: 488951 - DNA, 25 bp, Rattus norvegicus
gtcacacaaatccagccctggcagt

SEQ ID NO: 488952 - DNA, 25 bp, Rattus norvegicus
gtcacacaaatcgagccctggcagt

SEQ ID NO: 488953 - DNA, 25 bp, Rattus norvegicus
gtcacacaacccaccttaggaggag

SEQ ID NO: 488954 - DNA, 25 bp, Rattus norvegicus
gtcacacaaccctccttaggaggag

SEQ ID NO: 488955 - DNA, 25 bp, Rattus norvegicus
gtcacacaaggtactgattgccaga

SEQ ID NO: 488956 - DNA, 25 bp, Rattus norvegicus
gtcacacaaggttctgattgccaga

SEQ ID NO: 488957 - DNA, 25 bp, Rattus norvegicus
gtcacacaatggctcatcaactgaa

SEQ ID NO: 488958 - DNA, 25 bp, Rattus norvegicus
gtcacacaatgggtcatcaactgaa

SEQ ID NO: 488959 - DNA, 25 bp, Rattus norvegicus
gtcacacacagaagggcacaggcta

SEQ ID NO: 488960 - DNA, 25 bp, Rattus norvegicus
gtcacacacagatgggcacaggcta

SEQ ID NO: 488961 - DNA, 25 bp, Rattus norvegicus
gtcacacaccctcagctgaaagcta

SEQ ID NO: 488962 - DNA, 25 bp, Rattus norvegicus
gtcacacaccctgagctgaaagcta

SEQ ID NO: 488963 - DNA, 25 bp, Rattus norvegicus
gtcacacacgtactcttcaggcaag

SEQ ID NO: 488964 - DNA, 25 bp, Rattus norvegicus
gtcacacacgtagtcttcaggcaag

SEQ ID NO: 488965 - DNA, 25 bp, Rattus norvegicus
gtcacacactttccagctcgggata

SEQ ID NO: 488966 - DNA, 25 bp, Rattus norvegicus
gtcacacactttgcagctcgggata

SEQ ID NO: 488967 - DNA, 25 bp, Rattus norvegicus
gtcacacagacaacctacagtcagc

SEQ ID NO: 488968 - DNA, 25 bp, Rattus norvegicus
gtcacacagacatcctacagtcagc

SEQ ID NO: 488969 - DNA, 25 bp, Rattus norvegicus
gtcacacagagcatgagaggccaga

SEQ ID NO: 488970 - DNA, 25 bp, Rattus norvegicus
gtcacacagagcttgagaggccaga

SEQ ID NO: 488971 - DNA, 25 bp, Rattus norvegicus
gtcacacagcaaatatgtatcgctt

SEQ ID NO: 488972 - DNA, 25 bp, Rattus norvegicus
gtcacacagcaattatgtatcgctt

SEQ ID NO: 488973 - DNA, 25 bp, Rattus norvegicus
gtcacacagcataagttagccaggt

SEQ ID NO: 488974 - DNA, 25 bp, Rattus norvegicus
gtcacacagcattagttagccaggt

SEQ ID NO: 488975 - DNA, 25 bp, Rattus norvegicus
gtcacacagccaccaagtggtcttg

SEQ ID NO: 488976 - DNA, 25 bp, Rattus norvegicus
gtcacacagccagcaagtggtcttg

SEQ ID NO: 488977 - DNA, 25 bp, Rattus norvegicus
gtcacacagtgtctgtcacctggga

SEQ ID NO: 488978 - DNA, 25 bp, Rattus norvegicus
gtcacacagtgtgtgtcacctggga

SEQ ID NO: 488979 - DNA, 25 bp, Rattus norvegicus
gtcacacatatcaatctgggttctg

SEQ ID NO: 488980 - DNA, 25 bp, Rattus norvegicus
gtcacacatatctatctgggttctg

SEQ ID NO: 488981 - DNA, 25 bp, Rattus norvegicus
gtcacaccaagcatgtactaacttc

SEQ ID NO: 488982 - DNA, 25 bp, Rattus norvegicus
gtcacaccaagcttgtactaacttc

SEQ ID NO: 488983 - DNA, 25 bp, Rattus norvegicus
gtcacaccgggaagtagtacaaagt

SEQ ID NO: 488984 - DNA, 25 bp, Rattus norvegicus
gtcacaccgggatgtagtacaaagt

SEQ ID NO: 488985 - DNA, 25 bp, Rattus norvegicus
gtcacaccgtccagaagataacctt

SEQ ID NO: 488986 - DNA, 25 bp, Rattus norvegicus
gtcacaccgtcctgaagataacctt

SEQ ID NO: 488987 - DNA, 25 bp, Rattus norvegicus
gtcacacgcatacatctacacgagg

SEQ ID NO: 488988 - DNA, 25 bp, Rattus norvegicus
gtcacacgcatagatctacacgagg

SEQ ID NO: 488989 - DNA, 25 bp, Rattus norvegicus
gtcacacgtgtgaccatagtgggtc

SEQ ID NO: 488990 - DNA, 25 bp, Rattus norvegicus
gtcacacgtgtgtccatagtgggtc

SEQ ID NO: 488991 - DNA, 25 bp, Rattus norvegicus
gtcacactaccactgttgtcaagta

SEQ ID NO: 488992 - DNA, 25 bp, Rattus norvegicus
gtcacactaccagtgttgtcaagta

SEQ ID NO: 488993 - DNA, 25 bp, Rattus norvegicus
gtcacactcataactggatgcccta

SEQ ID NO: 488994 - DNA, 25 bp, Rattus norvegicus
gtcacactcatatctggatgcccta

SEQ ID NO: 488995 - DNA, 25 bp, Rattus norvegicus
gtcacactctacctttgggatttga

SEQ ID NO: 488996 - DNA, 25 bp, Rattus norvegicus
gtcacactctacgtttgggatttga

SEQ ID NO: 488997 - DNA, 25 bp, Rattus norvegicus
gtcacactgaagaagtcattcctca

SEQ ID NO: 488998 - DNA, 25 bp, Rattus norvegicus
gtcacactgaagtagtcattcctca

SEQ ID NO: 488999 - DNA, 25 bp, Rattus norvegicus
gtcacactggaaaccctaaaggctt

SEQ ID NO: 489000 - DNA, 25 bp, Rattus norvegicus
gtcacactggaatccctaaaggctt

SEQ ID NO: 489001 - DNA, 25 bp, Rattus norvegicus
gtcacactggacctacagattcagt

SEQ ID NO: 489002 - DNA, 25 bp, Rattus norvegicus
gtcacactggacgtacagattcagt

SEQ ID NO: 489003 - DNA, 25 bp, Rattus norvegicus
gtcacactgtctaacacttttgcaa

SEQ ID NO: 489004 - DNA, 25 bp, Rattus norvegicus
gtcacactgtcttacacttttgcaa

SEQ ID NO: 489005 - DNA, 25 bp, Rattus norvegicus
gtcacactgtgcctaagaactccaa

SEQ ID NO: 489006 - DNA, 25 bp, Rattus norvegicus
gtcacactgtgcgtaagaactccaa

SEQ ID NO: 489007 - DNA, 25 bp, Rattus norvegicus
gtcacacttcccactgtggtttgaa

SEQ ID NO: 489008 - DNA, 25 bp, Rattus norvegicus
gtcacacttccctctgtggtttgaa

SEQ ID NO: 489009 - DNA, 25 bp, Rattus norvegicus
gtcacacttcggcaaacctttgatt

SEQ ID NO: 489010 - DNA, 25 bp, Rattus norvegicus
gtcacacttcgggaaacctttgatt

SEQ ID NO: 489011 - DNA, 25 bp, Rattus norvegicus
gtcacacttgacatcttggtatata

SEQ ID NO: 489012 - DNA, 25 bp, Rattus norvegicus
gtcacacttgacttcttggtatata

SEQ ID NO: 489013 - DNA, 25 bp, Rattus norvegicus
gtcacacttgatatatggatcatga

SEQ ID NO: 489014 - DNA, 25 bp, Rattus norvegicus
gtcacacttgatttatggatcatga

SEQ ID NO: 489015 - DNA, 25 bp, Rattus norvegicus
gtcacagaacagagccccatgtcct

SEQ ID NO: 489016 - DNA, 25 bp, Rattus norvegicus
gtcacagaacagtgccccatgtcct

SEQ ID NO: 489017 - DNA, 25 bp, Rattus norvegicus
gtcacagaaccaagagccggagccc

SEQ ID NO: 489018 - DNA, 25 bp, Rattus norvegicus
gtcacagaaccatgagccggagccc

SEQ ID NO: 489019 - DNA, 25 bp, Rattus norvegicus
gtcacagaaggcaagagccccacac

SEQ ID NO: 489020 - DNA, 25 bp, Rattus norvegicus
gtcacagaaggcctttatgagacca

SEQ ID NO: 489021 - DNA, 25 bp, Rattus norvegicus
gtcacagaaggcgtttatgagacca

SEQ ID NO: 489022 - DNA, 25 bp, Rattus norvegicus
gtcacagaaggctagagccccacac

SEQ ID NO: 489023 - DNA, 25 bp, Rattus norvegicus
gtcacagacacaattcctactttaa

SEQ ID NO: 489024 - DNA, 25 bp, Rattus norvegicus
gtcacagacacatttcctactttaa

SEQ ID NO: 489025 - DNA, 25 bp, Rattus norvegicus
gtcacagacgggaacagttctcttc

SEQ ID NO: 489026 - DNA, 25 bp, Rattus norvegicus
gtcacagacgggtacagttctcttc

SEQ ID NO: 489027 - DNA, 25 bp, Rattus norvegicus
gtcacagacgtcagctgggctccat

SEQ ID NO: 489028 - DNA, 25 bp, Rattus norvegicus
gtcacagacgtctgctgggctccat

SEQ ID NO: 489029 - DNA, 25 bp, Rattus norvegicus
gtcacagactctcaaattctatgga

SEQ ID NO: 489030 - DNA, 25 bp, Rattus norvegicus
gtcacagactctgaaattctatgga

SEQ ID NO: 489031 - DNA, 25 bp, Rattus norvegicus
gtcacagactgtagggcttgagcaa

SEQ ID NO: 489032 - DNA, 25 bp, Rattus norvegicus
gtcacagactgttgggcttgagcaa

SEQ ID NO: 489033 - DNA, 25 bp, Rattus norvegicus
gtcacagagacacaggaagcactaa

SEQ ID NO: 489034 - DNA, 25 bp, Rattus norvegicus
gtcacagagacagaggaagcactaa

SEQ ID NO: 489035 - DNA, 25 bp, Rattus norvegicus
gtcacagagactcttcataccagtt

SEQ ID NO: 489036 - DNA, 25 bp, Rattus norvegicus
gtcacagagactgttcataccagtt

SEQ ID NO: 489037 - DNA, 25 bp, Rattus norvegicus
gtcacagaggatcctttgcccaaga

SEQ ID NO: 489038 - DNA, 25 bp, Rattus norvegicus
gtcacagaggatgctttgcccaaga

SEQ ID NO: 489039 - DNA, 25 bp, Rattus norvegicus
gtcacagaggcaccagaccctaatt

SEQ ID NO: 489040 - DNA, 25 bp, Rattus norvegicus
gtcacagaggcagcagaccctaatt

SEQ ID NO: 489041 - DNA, 25 bp, Rattus norvegicus
gtcacagagggaatcaggacagact

SEQ ID NO: 489042 - DNA, 25 bp, Rattus norvegicus
gtcacagagggattcaggacagact

SEQ ID NO: 489043 - DNA, 25 bp, Rattus norvegicus
gtcacagaggtgaagtcatggcgct

SEQ ID NO: 489044 - DNA, 25 bp, Rattus norvegicus
gtcacagaggtgtagtcatggcgct

SEQ ID NO: 489045 - DNA, 25 bp, Rattus norvegicus
gtcacagagtacattacagacatac

SEQ ID NO: 489046 - DNA, 25 bp, Rattus norvegicus
gtcacagagtactttacagacatac

SEQ ID NO: 489047 - DNA, 25 bp, Rattus norvegicus
gtcacagagtttcaaattacaccag

SEQ ID NO: 489048 - DNA, 25 bp, Rattus norvegicus
gtcacagagtttgaaattacaccag

SEQ ID NO: 489049 - DNA, 25 bp, Rattus norvegicus
gtcacagatactcccggaggtggat

SEQ ID NO: 489050 - DNA, 25 bp, Rattus norvegicus
gtcacagatactgccggaggtggat

SEQ ID NO: 489051 - DNA, 25 bp, Rattus norvegicus
gtcacagatccaaagcttttccatt

SEQ ID NO: 489052 - DNA, 25 bp, Rattus norvegicus
gtcacagatccatagcttttccatt

SEQ ID NO: 489053 - DNA, 25 bp, Rattus norvegicus
gtcacagatgcaaagcttcctgatc

SEQ ID NO: 489054 - DNA, 25 bp, Rattus norvegicus
gtcacagatgcatagcttcctgatc

SEQ ID NO: 489055 - DNA, 25 bp, Rattus norvegicus
gtcacagatgctcgagggtcagttc

SEQ ID NO: 489056 - DNA, 25 bp, Rattus norvegicus
gtcacagatgctggagggtcagttc

SEQ ID NO: 489057 - DNA, 25 bp, Rattus norvegicus
gtcacagatgtgctctggtcacttc

SEQ ID NO: 489058 - DNA, 25 bp, Rattus norvegicus
gtcacagatgtggtctggtcacttc

SEQ ID NO: 489059 - DNA, 25 bp, Rattus norvegicus
gtcacagatgttagttagctcccat

SEQ ID NO: 489060 - DNA, 25 bp, Rattus norvegicus
gtcacagatgtttgttagctcccat

SEQ ID NO: 489061 - DNA, 25 bp, Rattus norvegicus
gtcacagcaagcaagcaaggcacct

SEQ ID NO: 489062 - DNA, 25 bp, Rattus norvegicus
gtcacagcaagctagcaaggcacct

SEQ ID NO: 489063 - DNA, 25 bp, Rattus norvegicus
gtcacagcagaacgttcctgcgcat

SEQ ID NO: 489064 - DNA, 25 bp, Rattus norvegicus
gtcacagcagaaggttcctgcgcat

SEQ ID NO: 489065 - DNA, 25 bp, Rattus norvegicus
gtcacagcagatatcacaaagcaac

SEQ ID NO: 489066 - DNA, 25 bp, Rattus norvegicus
gtcacagcagatccgaggccacgat

SEQ ID NO: 489067 - DNA, 25 bp, Rattus norvegicus
gtcacagcagatgcgaggccacgat

SEQ ID NO: 489068 - DNA, 25 bp, Rattus norvegicus
gtcacagcagatttcacaaagcaac

SEQ ID NO: 489069 - DNA, 25 bp, Rattus norvegicus
gtcacagccagacctcgatcgagaa

SEQ ID NO: 489070 - DNA, 25 bp, Rattus norvegicus
gtcacagccagagctcgatcgagaa

SEQ ID NO: 489071 - DNA, 25 bp, Rattus norvegicus
gtcacagccattccaggttgctgag

SEQ ID NO: 489072 - DNA, 25 bp, Rattus norvegicus
gtcacagccattgcaggttgctgag

SEQ ID NO: 489073 - DNA, 25 bp, Rattus norvegicus
gtcacagccggaccagccagagcaa

SEQ ID NO: 489074 - DNA, 25 bp, Rattus norvegicus
gtcacagccggagcagccagagcaa

SEQ ID NO: 489075 - DNA, 25 bp, Rattus norvegicus
gtcacagcgcagatgtaatcctcac

SEQ ID NO: 489076 - DNA, 25 bp, Rattus norvegicus
gtcacagcgcagttgtaatcctcac

SEQ ID NO: 489077 - DNA, 25 bp, Rattus norvegicus
gtcacagcgtaaactggttttcgtt

SEQ ID NO: 489078 - DNA, 25 bp, Rattus norvegicus
gtcacagcgtaatctggttttcgtt

SEQ ID NO: 489079 - DNA, 25 bp, Rattus norvegicus
gtcacagctctgacctcaaggacta

SEQ ID NO: 489080 - DNA, 25 bp, Rattus norvegicus
gtcacagctctgtcctcaaggacta

SEQ ID NO: 489081 - DNA, 25 bp, Rattus norvegicus
gtcacagcttcaaacacaatcagag

SEQ ID NO: 489082 - DNA, 25 bp, Rattus norvegicus
gtcacagcttcatacacaatcagag

SEQ ID NO: 489083 - DNA, 25 bp, Rattus norvegicus
gtcacaggacatatttgtgtctctc

SEQ ID NO: 489084 - DNA, 25 bp, Rattus norvegicus
gtcacaggacatttttgtgtctctc

SEQ ID NO: 489085 - DNA, 25 bp, Rattus norvegicus
gtcacaggagtgctaaccgcttgct

SEQ ID NO: 489086 - DNA, 25 bp, Rattus norvegicus
gtcacaggagtggtaaccgcttgct

SEQ ID NO: 489087 - DNA, 25 bp, Rattus norvegicus
gtcacaggatctcctcagggctgaa

SEQ ID NO: 489088 - DNA, 25 bp, Rattus norvegicus
gtcacaggatctgctcagggctgaa

SEQ ID NO: 489089 - DNA, 25 bp, Rattus norvegicus
gtcacaggcagtattgaacttccct

SEQ ID NO: 489090 - DNA, 25 bp, Rattus norvegicus
gtcacaggcagttttgaacttccct

SEQ ID NO: 489091 - DNA, 25 bp, Rattus norvegicus
gtcacaggccttcattagtctgttt

SEQ ID NO: 489092 - DNA, 25 bp, Rattus norvegicus
gtcacaggccttgattagtctgttt

SEQ ID NO: 489093 - DNA, 25 bp, Rattus norvegicus
gtcacagggcttctgacagcaggaa

SEQ ID NO: 489094 - DNA, 25 bp, Rattus norvegicus
gtcacagggcttgtgacagcaggaa

SEQ ID NO: 489095 - DNA, 25 bp, Rattus norvegicus
gtcacaggtctacttttggacttga

SEQ ID NO: 489096 - DNA, 25 bp, Rattus norvegicus
gtcacaggtctagttttggacttga

SEQ ID NO: 489097 - DNA, 25 bp, Rattus norvegicus
gtcacaggtgacattggaatctcag

SEQ ID NO: 489098 - DNA, 25 bp, Rattus norvegicus
gtcacaggtgactttggaatctcag

SEQ ID NO: 489099 - DNA, 25 bp, Rattus norvegicus
gtcacagtatgtaattggcccaaaa

SEQ ID NO: 489100 - DNA, 25 bp, Rattus norvegicus
gtcacagtatgttattggcccaaaa

SEQ ID NO: 489101 - DNA, 25 bp, Rattus norvegicus
gtcacagtccgccaaggagtcggtt

SEQ ID NO: 489102 - DNA, 25 bp, Rattus norvegicus
gtcacagtccgcgaaggagtcggtt

SEQ ID NO: 489103 - DNA, 25 bp, Rattus norvegicus
gtcacagtctacatgtctttgggtt

SEQ ID NO: 489104 - DNA, 25 bp, Rattus norvegicus
gtcacagtctacttgtctttgggtt

SEQ ID NO: 489105 - DNA, 25 bp, Rattus norvegicus
gtcacagtctccctttaaaatcctt

SEQ ID NO: 489106 - DNA, 25 bp, Rattus norvegicus
gtcacagtctccgtttaaaatcctt

SEQ ID NO: 489107 - DNA, 25 bp, Rattus norvegicus
gtcacagtctggcatttgtactcct

SEQ ID NO: 489108 - DNA, 25 bp, Rattus norvegicus
gtcacagtctgggatttgtactcct

SEQ ID NO: 489109 - DNA, 25 bp, Rattus norvegicus
gtcacagtgaaactggaccctaaaa

SEQ ID NO: 489110 - DNA, 25 bp, Rattus norvegicus
gtcacagtgaaagtggaccctaaaa

SEQ ID NO: 489111 - DNA, 25 bp, Rattus norvegicus
gtcacagtgaacagtgtccccagag

SEQ ID NO: 489112 - DNA, 25 bp, Rattus norvegicus
gtcacagtgaactgtgtccccagag

SEQ ID NO: 489113 - DNA, 25 bp, Rattus norvegicus
gtcacagtgacgaaattttagttaa

SEQ ID NO: 489114 - DNA, 25 bp, Rattus norvegicus
gtcacagtgacgtaattttagttaa

SEQ ID NO: 489115 - DNA, 25 bp, Rattus norvegicus
gtcacagtgcagagaatagtaccct

SEQ ID NO: 489116 - DNA, 25 bp, Rattus norvegicus
gtcacagtgcagtgaatagtaccct

SEQ ID NO: 489117 - DNA, 25 bp, Rattus norvegicus
gtcacagtggaaagattgcccctaa

SEQ ID NO: 489118 - DNA, 25 bp, Rattus norvegicus
gtcacagtggaatgattgcccctaa

SEQ ID NO: 489119 - DNA, 25 bp, Rattus norvegicus
gtcacagtgtaccacagcagtgctg

SEQ ID NO: 489120 - DNA, 25 bp, Rattus norvegicus
gtcacagtgtacgacagcagtgctg

SEQ ID NO: 489121 - DNA, 25 bp, Rattus norvegicus
gtcacagtgtcacccattactatgt

SEQ ID NO: 489122 - DNA, 25 bp, Rattus norvegicus
gtcacagtgtcagccattactatgt

SEQ ID NO: 489123 - DNA, 25 bp, Rattus norvegicus
gtcacagtgtgcctgcctctgtgtg

SEQ ID NO: 489124 - DNA, 25 bp, Rattus norvegicus
gtcacagtgtgcgtgcctctgtgtg

SEQ ID NO: 489125 - DNA, 25 bp, Rattus norvegicus
gtcacagttactcgtattttcagct

SEQ ID NO: 489126 - DNA, 25 bp, Rattus norvegicus
gtcacagttactggtattttcagct

SEQ ID NO: 489127 - DNA, 25 bp, Rattus norvegicus
gtcacagttcagatcacagccaatt

SEQ ID NO: 489128 - DNA, 25 bp, Rattus norvegicus
gtcacagttcagttcacagccaatt

SEQ ID NO: 489129 - DNA, 25 bp, Rattus norvegicus
gtcacagttcgccagatattacata

SEQ ID NO: 489130 - DNA, 25 bp, Rattus norvegicus
gtcacagttcgcgagatattacata

SEQ ID NO: 489131 - DNA, 25 bp, Rattus norvegicus
gtcacagttctcaaggaagtgttct

SEQ ID NO: 489132 - DNA, 25 bp, Rattus norvegicus
gtcacagttctctaggaagtgttct

SEQ ID NO: 489133 - DNA, 25 bp, Rattus norvegicus
gtcacataacaaagatggagtttac

SEQ ID NO: 489134 - DNA, 25 bp, Rattus norvegicus
gtcacataacaatgatggagtttac

SEQ ID NO: 489135 - DNA, 25 bp, Rattus norvegicus
gtcacataatttaccttagtgaggg

SEQ ID NO: 489136 - DNA, 25 bp, Rattus norvegicus
gtcacataattttccttagtgaggg

SEQ ID NO: 489137 - DNA, 25 bp, Rattus norvegicus
gtcacatactgtagatatttggcca

SEQ ID NO: 489138 - DNA, 25 bp, Rattus norvegicus
gtcacatactgttgatatttggcca

SEQ ID NO: 489139 - DNA, 25 bp, Rattus norvegicus
gtcacatagattacatacaccactt

SEQ ID NO: 489140 - DNA, 25 bp, Rattus norvegicus
gtcacatagatttcatacaccactt

SEQ ID NO: 489141 - DNA, 25 bp, Rattus norvegicus
gtcacatatccaagttttcctacat

SEQ ID NO: 489142 - DNA, 25 bp, Rattus norvegicus
gtcacatatccatgttttcctacat

SEQ ID NO: 489143 - DNA, 25 bp, Rattus norvegicus
gtcacatcaaaaccttctgaatcca

SEQ ID NO: 489144 - DNA, 25 bp, Rattus norvegicus
gtcacatcaaaagcttctgaatcca

SEQ ID NO: 489145 - DNA, 25 bp, Rattus norvegicus
gtcacatcaagaactacttcagtgt

SEQ ID NO: 489146 - DNA, 25 bp, Rattus norvegicus
gtcacatcaagatctacttcagtgt

SEQ ID NO: 489147 - DNA, 25 bp, Rattus norvegicus
gtcacatcagttcagcacatagcag

SEQ ID NO: 489148 - DNA, 25 bp, Rattus norvegicus
gtcacatcagttgagcacatagcag

SEQ ID NO: 489149 - DNA, 25 bp, Rattus norvegicus
gtcacatcatttagtttcaggctaa

SEQ ID NO: 489150 - DNA, 25 bp, Rattus norvegicus
gtcacatcattttgtttcaggctaa

SEQ ID NO: 489151 - DNA, 25 bp, Rattus norvegicus
gtcacatcccttaagcaatcaaacc

SEQ ID NO: 489152 - DNA, 25 bp, Rattus norvegicus
gtcacatccctttagcaatcaaacc

SEQ ID NO: 489153 - DNA, 25 bp, Rattus norvegicus
gtcacatctcttaattgtcccttaa

SEQ ID NO: 489154 - DNA, 25 bp, Rattus norvegicus
gtcacatctctttattgtcccttaa

SEQ ID NO: 489155 - DNA, 25 bp, Rattus norvegicus
gtcacatcttcaaacctctttaaac

SEQ ID NO: 489156 - DNA, 25 bp, Rattus norvegicus
gtcacatcttcatacctctttaaac

SEQ ID NO: 489157 - DNA, 25 bp, Rattus norvegicus
gtcacatgacctatgattgcttcat

SEQ ID NO: 489158 - DNA, 25 bp, Rattus norvegicus
gtcacatgacctttgattgcttcat

SEQ ID NO: 489159 - DNA, 25 bp, Rattus norvegicus
gtcacatgactgattcccattcttc

SEQ ID NO: 489160 - DNA, 25 bp, Rattus norvegicus
gtcacatgactgtttcccattcttc

SEQ ID NO: 489161 - DNA, 25 bp, Rattus norvegicus
gtcacatgcgctaatagtcaggatt

SEQ ID NO: 489162 - DNA, 25 bp, Rattus norvegicus
gtcacatgcgcttatagtcaggatt

SEQ ID NO: 489163 - DNA, 25 bp, Rattus norvegicus
gtcacatgtagtccaggctttccct

SEQ ID NO: 489164 - DNA, 25 bp, Rattus norvegicus
gtcacatgtagtgcaggctttccct

SEQ ID NO: 489165 - DNA, 25 bp, Rattus norvegicus
gtcacatgtctgctaaaggaccact

SEQ ID NO: 489166 - DNA, 25 bp, Rattus norvegicus
gtcacatgtctggtaaaggaccact

SEQ ID NO: 489167 - DNA, 25 bp, Rattus norvegicus
gtcacatgtgtaaaccgaacctttc

SEQ ID NO: 489168 - DNA, 25 bp, Rattus norvegicus
gtcacatgtgtataccgaacctttc

SEQ ID NO: 489169 - DNA, 25 bp, Rattus norvegicus
gtcacattacacatcttaccgttaa

SEQ ID NO: 489170 - DNA, 25 bp, Rattus norvegicus
gtcacattacacttcttaccgttaa

SEQ ID NO: 489171 - DNA, 25 bp, Rattus norvegicus
gtcacattatccaggtttcttaaat

SEQ ID NO: 489172 - DNA, 25 bp, Rattus norvegicus
gtcacattatcctggtttcttaaat

SEQ ID NO: 489173 - DNA, 25 bp, Rattus norvegicus
gtcacattatctatgttgctgttaa

SEQ ID NO: 489174 - DNA, 25 bp, Rattus norvegicus
gtcacattatctttgttgctgttaa

SEQ ID NO: 489175 - DNA, 25 bp, Rattus norvegicus
gtcacattccttactccaaactgaa

SEQ ID NO: 489176 - DNA, 25 bp, Rattus norvegicus
gtcacattcctttctccaaactgaa

SEQ ID NO: 489177 - DNA, 25 bp, Rattus norvegicus
gtcacattgaagaaacgctgctccg

SEQ ID NO: 489178 - DNA, 25 bp, Rattus norvegicus
gtcacattgaagaagggcacgggat

SEQ ID NO: 489179 - DNA, 25 bp, Rattus norvegicus
gtcacattgaagtaacgctgctccg

SEQ ID NO: 489180 - DNA, 25 bp, Rattus norvegicus
gtcacattgaagtagggcacgggat

SEQ ID NO: 489181 - DNA, 25 bp, Rattus norvegicus
gtcacattgcatactattgccttct

SEQ ID NO: 489182 - DNA, 25 bp, Rattus norvegicus
gtcacattgcattctattgccttct

SEQ ID NO: 489183 - DNA, 25 bp, Rattus norvegicus
gtcacattggatccacacttcccga

SEQ ID NO: 489184 - DNA, 25 bp, Rattus norvegicus
gtcacattggatgcacacttcccga

SEQ ID NO: 489185 - DNA, 25 bp, Rattus norvegicus
gtcacattggtgaagtctcggaaaa

SEQ ID NO: 489186 - DNA, 25 bp, Rattus norvegicus
gtcacattggtgtagtctcggaaaa

SEQ ID NO: 489187 - DNA, 25 bp, Rattus norvegicus
gtcacatttagtcctgctgctttca

SEQ ID NO: 489188 - DNA, 25 bp, Rattus norvegicus
gtcacatttagtgctgctgctttca

SEQ ID NO: 489189 - DNA, 25 bp, Rattus norvegicus
gtcacatttcacagcgtatcacagg

SEQ ID NO: 489190 - DNA, 25 bp, Rattus norvegicus
gtcacatttcactgcgtatcacagg

SEQ ID NO: 489191 - DNA, 25 bp, Rattus norvegicus
gtcacatttctaaattgcagcactt

SEQ ID NO: 489192 - DNA, 25 bp, Rattus norvegicus
gtcacatttctatattgcagcactt

SEQ ID NO: 489193 - DNA, 25 bp, Rattus norvegicus
gtcacatttctgaacattttccgta

SEQ ID NO: 489194 - DNA, 25 bp, Rattus norvegicus
gtcacatttctgtacattttccgta

SEQ ID NO: 489195 - DNA, 25 bp, Rattus norvegicus
gtcacatttgatacatttgctggcc

SEQ ID NO: 489196 - DNA, 25 bp, Rattus norvegicus
gtcacatttgatcgaggcagcacct

SEQ ID NO: 489197 - DNA, 25 bp, Rattus norvegicus
gtcacatttgatggaggcagcacct

SEQ ID NO: 489198 - DNA, 25 bp, Rattus norvegicus
gtcacatttgattcatttgctggcc

SEQ ID NO: 489199 - DNA, 25 bp, Rattus norvegicus
gtcacatttgtgaagactcgtgcaa

SEQ ID NO: 489200 - DNA, 25 bp, Rattus norvegicus
gtcacatttgtgtagactcgtgcaa

SEQ ID NO: 489201 - DNA, 25 bp, Rattus norvegicus
gtcaccaaactgcatttaagggctg

SEQ ID NO: 489202 - DNA, 25 bp, Rattus norvegicus
gtcaccaaactggatttaagggctg

SEQ ID NO: 489203 - DNA, 25 bp, Rattus norvegicus
gtcaccaaaggcagggaggatcatt

SEQ ID NO: 489204 - DNA, 25 bp, Rattus norvegicus
gtcaccaaaggctgggaggatcatt

SEQ ID NO: 489205 - DNA, 25 bp, Rattus norvegicus
gtcaccaaatacaccagcgctaagt

SEQ ID NO: 489206 - DNA, 25 bp, Rattus norvegicus
gtcaccaaatactccagcgctaagt

SEQ ID NO: 489207 - DNA, 25 bp, Rattus norvegicus
gtcaccaaccagctacaactttgag

SEQ ID NO: 489208 - DNA, 25 bp, Rattus norvegicus
gtcaccaaccaggtacaactttgag

SEQ ID NO: 489209 - DNA, 25 bp, Rattus norvegicus
gtcaccaacccaaaaacgcaacaga

SEQ ID NO: 489210 - DNA, 25 bp, Rattus norvegicus
gtcaccaacccataaacgcaacaga

SEQ ID NO: 489211 - DNA, 25 bp, Rattus norvegicus
gtcaccaagtagaggcatcgcgaag

SEQ ID NO: 489212 - DNA, 25 bp, Rattus norvegicus
gtcaccaagtagtggcatcgcgaag

SEQ ID NO: 489213 - DNA, 25 bp, Rattus norvegicus
gtcaccaagtttctacctgagtatt

SEQ ID NO: 489214 - DNA, 25 bp, Rattus norvegicus
gtcaccaagtttgtacctgagtatt

SEQ ID NO: 489215 - DNA, 25 bp, Rattus norvegicus
gtcaccaatcagagcctttgagggt

SEQ ID NO: 489216 - DNA, 25 bp, Rattus norvegicus
gtcaccaatcagtgcctttgagggt

SEQ ID NO: 489217 - DNA, 25 bp, Rattus norvegicus
gtcaccaatcttcatcgcagtaaga

SEQ ID NO: 489218 - DNA, 25 bp, Rattus norvegicus
gtcaccaatcttgatcgcagtaaga

SEQ ID NO: 489219 - DNA, 25 bp, Rattus norvegicus
gtcaccaatttcacttagtgctgaa

SEQ ID NO: 489220 - DNA, 25 bp, Rattus norvegicus
gtcaccaatttctcttagtgctgaa

SEQ ID NO: 489221 - DNA, 25 bp, Rattus norvegicus
gtcaccacagaacgcagcttctgct

SEQ ID NO: 489222 - DNA, 25 bp, Rattus norvegicus
gtcaccacagaaggcagcttctgct

SEQ ID NO: 489223 - DNA, 25 bp, Rattus norvegicus
gtcaccacagtgactcttggcaatg

SEQ ID NO: 489224 - DNA, 25 bp, Rattus norvegicus
gtcaccacagtgtctcttggcaatg

SEQ ID NO: 489225 - DNA, 25 bp, Rattus norvegicus
gtcaccacctggattttgagggaaa

SEQ ID NO: 489226 - DNA, 25 bp, Rattus norvegicus
gtcaccacctggtttttgagggaaa

SEQ ID NO: 489227 - DNA, 25 bp, Rattus norvegicus
gtcaccacctttctccatgatttga

SEQ ID NO: 489228 - DNA, 25 bp, Rattus norvegicus
gtcaccacctttgtccatgatttga

SEQ ID NO: 489229 - DNA, 25 bp, Rattus norvegicus
gtcaccactagcataacctgcctat

SEQ ID NO: 489230 - DNA, 25 bp, Rattus norvegicus
gtcaccactagcttaacctgcctat

SEQ ID NO: 489231 - DNA, 25 bp, Rattus norvegicus
gtcaccactgaaacctggaggaggt

SEQ ID NO: 489232 - DNA, 25 bp, Rattus norvegicus
gtcaccactgaatcctggaggaggt

SEQ ID NO: 489233 - DNA, 25 bp, Rattus norvegicus
gtcaccactgctaagggtgctcaaa

SEQ ID NO: 489234 - DNA, 25 bp, Rattus norvegicus
gtcaccactgcttagggtgctcaaa

SEQ ID NO: 489235 - DNA, 25 bp, Rattus norvegicus
gtcaccactggcaatgaagacatcg

SEQ ID NO: 489236 - DNA, 25 bp, Rattus norvegicus
gtcaccactggctatgaagacatcg

SEQ ID NO: 489237 - DNA, 25 bp, Rattus norvegicus
gtcaccacttttactagcaacacga

SEQ ID NO: 489238 - DNA, 25 bp, Rattus norvegicus
gtcaccactttttctagcaacacga

SEQ ID NO: 489239 - DNA, 25 bp, Rattus norvegicus
gtcaccagcaacagatgcaaagcct

SEQ ID NO: 489240 - DNA, 25 bp, Rattus norvegicus
gtcaccagcaactgatgcaaagcct

SEQ ID NO: 489241 - DNA, 25 bp, Rattus norvegicus
gtcaccagcaccaaccagtatgtgt

SEQ ID NO: 489242 - DNA, 25 bp, Rattus norvegicus
gtcaccagcacctaccagtatgtgt

SEQ ID NO: 489243 - DNA, 25 bp, Rattus norvegicus
gtcaccagcagcctgtggacagaca

SEQ ID NO: 489244 - DNA, 25 bp, Rattus norvegicus
gtcaccagcagcgtgtggacagaca

SEQ ID NO: 489245 - DNA, 25 bp, Rattus norvegicus
gtcaccagcataattttatcgtggg

SEQ ID NO: 489246 - DNA, 25 bp, Rattus norvegicus
gtcaccagcatatttttatcgtggg

SEQ ID NO: 489247 - DNA, 25 bp, Rattus norvegicus
gtcaccagccccagggtatgagtca

SEQ ID NO: 489248 - DNA, 25 bp, Rattus norvegicus
gtcaccagcccctgggtatgagtca

SEQ ID NO: 489249 - DNA, 25 bp, Rattus norvegicus
gtcaccagccttcttttagtgtgta

SEQ ID NO: 489250 - DNA, 25 bp, Rattus norvegicus
gtcaccagccttgttttagtgtgta

SEQ ID NO: 489251 - DNA, 25 bp, Rattus norvegicus
gtcaccagcggaactcccagaggaa

SEQ ID NO: 489252 - DNA, 25 bp, Rattus norvegicus
gtcaccagcggatctcccagaggaa

SEQ ID NO: 489253 - DNA, 25 bp, Rattus norvegicus
gtcaccagcggccacaaaatgtcat

SEQ ID NO: 489254 - DNA, 25 bp, Rattus norvegicus
gtcaccagcggcgacaaaatgtcat

SEQ ID NO: 489255 - DNA, 25 bp, Rattus norvegicus
gtcaccagggagaggaactctttga

SEQ ID NO: 489256 - DNA, 25 bp, Rattus norvegicus
gtcaccagggagtggaactctttga

SEQ ID NO: 489257 - DNA, 25 bp, Rattus norvegicus
gtcaccataaataattgttctgctt

SEQ ID NO: 489258 - DNA, 25 bp, Rattus norvegicus
gtcaccataaattattgttctgctt

SEQ ID NO: 489259 - DNA, 25 bp, Rattus norvegicus
gtcaccatagatagttgcctttgca

SEQ ID NO: 489260 - DNA, 25 bp, Rattus norvegicus
gtcaccatagattgttgcctttgca

SEQ ID NO: 489261 - DNA, 25 bp, Rattus norvegicus
gtcaccatcaacaggatcccgagga

SEQ ID NO: 489262 - DNA, 25 bp, Rattus norvegicus
gtcaccatcaactggatcccgagga

SEQ ID NO: 489263 - DNA, 25 bp, Rattus norvegicus
gtcaccatcctaacagagagcctaa

SEQ ID NO: 489264 - DNA, 25 bp, Rattus norvegicus
gtcaccatcctatcagagagcctaa

SEQ ID NO: 489265 - DNA, 25 bp, Rattus norvegicus
gtcaccatcttcataaacctcaata

SEQ ID NO: 489266 - DNA, 25 bp, Rattus norvegicus
gtcaccatcttcttaaacctcaata

SEQ ID NO: 489267 - DNA, 25 bp, Rattus norvegicus
gtcaccatgaccattggacaggcag

SEQ ID NO: 489268 - DNA, 25 bp, Rattus norvegicus
gtcaccatgacctttggacaggcag

SEQ ID NO: 489269 - DNA, 25 bp, Rattus norvegicus
gtcaccatgcatcttggacacatac

SEQ ID NO: 489270 - DNA, 25 bp, Rattus norvegicus
gtcaccatgcatgttggacacatac

SEQ ID NO: 489271 - DNA, 25 bp, Rattus norvegicus
gtcaccatgctgcttcggagagcaa

SEQ ID NO: 489272 - DNA, 25 bp, Rattus norvegicus
gtcaccatgctggttcggagagcaa

SEQ ID NO: 489273 - DNA, 25 bp, Rattus norvegicus
gtcaccatggacactcatctgttga

SEQ ID NO: 489274 - DNA, 25 bp, Rattus norvegicus
gtcaccatggacagaggctggtctt

SEQ ID NO: 489275 - DNA, 25 bp, Rattus norvegicus
gtcaccatggactctcatctgttga

SEQ ID NO: 489276 - DNA, 25 bp, Rattus norvegicus
gtcaccatggactgaggctggtctt

SEQ ID NO: 489277 - DNA, 25 bp, Rattus norvegicus
gtcaccatgtaaatccgaactgcct

SEQ ID NO: 489278 - DNA, 25 bp, Rattus norvegicus
gtcaccatgtaattccgaactgcct

SEQ ID NO: 489279 - DNA, 25 bp, Rattus norvegicus
gtcaccatgtccagcctaatgtatg

SEQ ID NO: 489280 - DNA, 25 bp, Rattus norvegicus
gtcaccatgtcctgcctaatgtatg

SEQ ID NO: 489281 - DNA, 25 bp, Rattus norvegicus
gtcaccattacaaacacacaagctt

SEQ ID NO: 489282 - DNA, 25 bp, Rattus norvegicus
gtcaccattacatacacacaagctt

SEQ ID NO: 489283 - DNA, 25 bp, Rattus norvegicus
gtcaccattctgatggctctgtcag

SEQ ID NO: 489284 - DNA, 25 bp, Rattus norvegicus
gtcaccattctgttggctctgtcag

SEQ ID NO: 489285 - DNA, 25 bp, Rattus norvegicus
gtcaccattgatctcctttggaaga

SEQ ID NO: 489286 - DNA, 25 bp, Rattus norvegicus
gtcaccattgatgtcctttggaaga

SEQ ID NO: 489287 - DNA, 25 bp, Rattus norvegicus
gtcaccatttgtatatgtccagaca

SEQ ID NO: 489288 - DNA, 25 bp, Rattus norvegicus
gtcaccatttgtatgcttatccata

SEQ ID NO: 489289 - DNA, 25 bp, Rattus norvegicus
gtcaccatttgtttatgtccagaca

SEQ ID NO: 489290 - DNA, 25 bp, Rattus norvegicus
gtcaccatttgtttgcttatccata

SEQ ID NO: 489291 - DNA, 25 bp, Rattus norvegicus
gtcaccattttgaaaagctgcgccc

SEQ ID NO: 489292 - DNA, 25 bp, Rattus norvegicus
gtcaccattttgtaaagctgcgccc

SEQ ID NO: 489293 - DNA, 25 bp, Rattus norvegicus
gtcaccatttttcttctcacgacaa

SEQ ID NO: 489294 - DNA, 25 bp, Rattus norvegicus
gtcaccatttttgttctcacgacaa

SEQ ID NO: 489295 - DNA, 25 bp, Rattus norvegicus
gtcacccacattcaaggcgagcttt

SEQ ID NO: 489296 - DNA, 25 bp, Rattus norvegicus
gtcacccacattccttataacagtt

SEQ ID NO: 489297 - DNA, 25 bp, Rattus norvegicus
gtcacccacattgaaggcgagcttt

SEQ ID NO: 489298 - DNA, 25 bp, Rattus norvegicus
gtcacccacattgcttataacagtt

SEQ ID NO: 489299 - DNA, 25 bp, Rattus norvegicus
gtcacccagagacactgcatcgatt

SEQ ID NO: 489300 - DNA, 25 bp, Rattus norvegicus
gtcacccagagagactgcatcgatt

SEQ ID NO: 489301 - DNA, 25 bp, Rattus norvegicus
gtcacccaggaaactgagtctcatt

SEQ ID NO: 489302 - DNA, 25 bp, Rattus norvegicus
gtcacccaggaaagtgctgtggcca

SEQ ID NO: 489303 - DNA, 25 bp, Rattus norvegicus
gtcacccaggaatctgagtctcatt

SEQ ID NO: 489304 - DNA, 25 bp, Rattus norvegicus
gtcacccaggaatgtgctgtggcca

SEQ ID NO: 489305 - DNA, 25 bp, Rattus norvegicus
gtcacccagtagacattggccatag

SEQ ID NO: 489306 - DNA, 25 bp, Rattus norvegicus
gtcacccagtagtcattggccatag

SEQ ID NO: 489307 - DNA, 25 bp, Rattus norvegicus
gtcacccagtgacttcatcatgcta

SEQ ID NO: 489308 - DNA, 25 bp, Rattus norvegicus
gtcacccagtgagttcatcatgcta

SEQ ID NO: 489309 - DNA, 25 bp, Rattus norvegicus
gtcacccatatcaactttttcttag

SEQ ID NO: 489310 - DNA, 25 bp, Rattus norvegicus
gtcacccatatctactttttcttag

SEQ ID NO: 489311 - DNA, 25 bp, Rattus norvegicus
gtcacccatcatcatagtgcatgag

SEQ ID NO: 489312 - DNA, 25 bp, Rattus norvegicus
gtcacccatcatgatagtgcatgag

SEQ ID NO: 489313 - DNA, 25 bp, Rattus norvegicus
gtcacccatgcacggagaacccagt

SEQ ID NO: 489314 - DNA, 25 bp, Rattus norvegicus
gtcacccatgcagggagaacccagt

SEQ ID NO: 489315 - DNA, 25 bp, Rattus norvegicus
gtcacccatgtgcttcccagaaagg

SEQ ID NO: 489316 - DNA, 25 bp, Rattus norvegicus
gtcacccatgtggttcccagaaagg

SEQ ID NO: 489317 - DNA, 25 bp, Rattus norvegicus
gtcaccccaatcattcagtttggtt

SEQ ID NO: 489318 - DNA, 25 bp, Rattus norvegicus
gtcaccccaatctttcagtttggtt

SEQ ID NO: 489319 - DNA, 25 bp, Rattus norvegicus
gtcaccccaatgcacgatacgggag

SEQ ID NO: 489320 - DNA, 25 bp, Rattus norvegicus
gtcaccccaatggacgatacgggag

SEQ ID NO: 489321 - DNA, 25 bp, Rattus norvegicus
gtcaccccatccctgaagtaggaag

SEQ ID NO: 489322 - DNA, 25 bp, Rattus norvegicus
gtcaccccatccgtgaagtaggaag

SEQ ID NO: 489323 - DNA, 25 bp, Rattus norvegicus
gtcaccccgagactcctgagctgga

SEQ ID NO: 489324 - DNA, 25 bp, Rattus norvegicus
gtcaccccgagagtcctgagctgga

SEQ ID NO: 489325 - DNA, 25 bp, Rattus norvegicus
gtcaccccgagtcagagacagacga

SEQ ID NO: 489326 - DNA, 25 bp, Rattus norvegicus
gtcaccccgagtgagagacagacga

SEQ ID NO: 489327 - DNA, 25 bp, Rattus norvegicus
gtcacccctggcaacgtagtgtaag

SEQ ID NO: 489328 - DNA, 25 bp, Rattus norvegicus
gtcacccctggctacgtagtgtaag

SEQ ID NO: 489329 - DNA, 25 bp, Rattus norvegicus
gtcacccgacatcacgtgtaagttt

SEQ ID NO: 489330 - DNA, 25 bp, Rattus norvegicus
gtcacccgacatgacgtgtaagttt

SEQ ID NO: 489331 - DNA, 25 bp, Rattus norvegicus
gtcacccgaccaatcagagagctaa

SEQ ID NO: 489332 - DNA, 25 bp, Rattus norvegicus
gtcacccgaccattcagagagctaa

SEQ ID NO: 489333 - DNA, 25 bp, Rattus norvegicus
gtcacccggaatctagctgctgagt

SEQ ID NO: 489334 - DNA, 25 bp, Rattus norvegicus
gtcacccggaatgtagctgctgagt

SEQ ID NO: 489335 - DNA, 25 bp, Rattus norvegicus
gtcacccgggccatgcatataaata

SEQ ID NO: 489336 - DNA, 25 bp, Rattus norvegicus
gtcacccgggccttgcatataaata

SEQ ID NO: 489337 - DNA, 25 bp, Rattus norvegicus
gtcaccctaaaacaggtaccagcct

SEQ ID NO: 489338 - DNA, 25 bp, Rattus norvegicus
gtcaccctaaaagaggtaccagcct

SEQ ID NO: 489339 - DNA, 25 bp, Rattus norvegicus
gtcaccctagcacacgagttctaat

SEQ ID NO: 489340 - DNA, 25 bp, Rattus norvegicus
gtcaccctagcagacgagttctaat

SEQ ID NO: 489341 - DNA, 25 bp, Rattus norvegicus
gtcaccctaggaccggttgttctgc

SEQ ID NO: 489342 - DNA, 25 bp, Rattus norvegicus
gtcaccctaggagcggttgttctgc

SEQ ID NO: 489343 - DNA, 25 bp, Rattus norvegicus
gtcaccctcagtataaggatgcgct

SEQ ID NO: 489344 - DNA, 25 bp, Rattus norvegicus
gtcaccctcagtttaaggatgcgct

SEQ ID NO: 489345 - DNA, 25 bp, Rattus norvegicus
gtcaccctcgcgagcgcgttcgaag

SEQ ID NO: 489346 - DNA, 25 bp, Rattus norvegicus
gtcaccctcgcgtgcgcgttcgaag

SEQ ID NO: 489347 - DNA, 25 bp, Rattus norvegicus
gtcaccctctacatggaatgagtgt

SEQ ID NO: 489348 - DNA, 25 bp, Rattus norvegicus
gtcaccctctacttggaatgagtgt

SEQ ID NO: 489349 - DNA, 25 bp, Rattus norvegicus
gtcaccctgccaaacaagcttatat

SEQ ID NO: 489350 - DNA, 25 bp, Rattus norvegicus
gtcaccctgccatacaagcttatat

SEQ ID NO: 489351 - DNA, 25 bp, Rattus norvegicus
gtcaccctgctacataagatgtcgg

SEQ ID NO: 489352 - DNA, 25 bp, Rattus norvegicus
gtcaccctgctagataagatgtcgg

SEQ ID NO: 489353 - DNA, 25 bp, Rattus norvegicus
gtcaccctggaacgttgatacccca

SEQ ID NO: 489354 - DNA, 25 bp, Rattus norvegicus
gtcaccctggaaggttgatacccca

SEQ ID NO: 489355 - DNA, 25 bp, Rattus norvegicus
gtcaccctggtgcatgagatgtact

SEQ ID NO: 489356 - DNA, 25 bp, Rattus norvegicus
gtcaccctggtggatgagatgtact

SEQ ID NO: 489357 - DNA, 25 bp, Rattus norvegicus
gtcaccctgtgacttgagttacatc

SEQ ID NO: 489358 - DNA, 25 bp, Rattus norvegicus
gtcaccctgtgagttgagttacatc

SEQ ID NO: 489359 - DNA, 25 bp, Rattus norvegicus
gtcacccttcatattgcagtgcttt

SEQ ID NO: 489360 - DNA, 25 bp, Rattus norvegicus
gtcacccttcattttgcagtgcttt

SEQ ID NO: 489361 - DNA, 25 bp, Rattus norvegicus
gtcaccctttaacgctctctgagga

SEQ ID NO: 489362 - DNA, 25 bp, Rattus norvegicus
gtcaccctttaaggctctctgagga

SEQ ID NO: 489363 - DNA, 25 bp, Rattus norvegicus
gtcaccgactccattgctggtctgt

SEQ ID NO: 489364 - DNA, 25 bp, Rattus norvegicus
gtcaccgactcctttgctggtctgt

SEQ ID NO: 489365 - DNA, 25 bp, Rattus norvegicus
gtcaccgacttgctgttcatttaat

SEQ ID NO: 489366 - DNA, 25 bp, Rattus norvegicus
gtcaccgacttggtgttcatttaat

SEQ ID NO: 489367 - DNA, 25 bp, Rattus norvegicus
gtcaccgagcagaacaccttgtgta

SEQ ID NO: 489368 - DNA, 25 bp, Rattus norvegicus
gtcaccgagcagtacaccttgtgta

SEQ ID NO: 489369 - DNA, 25 bp, Rattus norvegicus
gtcaccgcagtgatgggctcgatga

SEQ ID NO: 489370 - DNA, 25 bp, Rattus norvegicus
gtcaccgcagtgttgggctcgatga

SEQ ID NO: 489371 - DNA, 25 bp, Rattus norvegicus
gtcaccgcatgaactcgctgggagg

SEQ ID NO: 489372 - DNA, 25 bp, Rattus norvegicus
gtcaccgcatgatctcgctgggagg

SEQ ID NO: 489373 - DNA, 25 bp, Rattus norvegicus
gtcaccgccacacattacagattta

SEQ ID NO: 489374 - DNA, 25 bp, Rattus norvegicus
gtcaccgccacagattacagattta

SEQ ID NO: 489375 - DNA, 25 bp, Rattus norvegicus
gtcaccgcccagcagtgcaaggaaa

SEQ ID NO: 489376 - DNA, 25 bp, Rattus norvegicus
gtcaccgcccaggagtgcaaggaaa

SEQ ID NO: 489377 - DNA, 25 bp, Rattus norvegicus
gtcaccggacacaatcctacagaag

SEQ ID NO: 489378 - DNA, 25 bp, Rattus norvegicus
gtcaccggacactatcctacagaag

SEQ ID NO: 489379 - DNA, 25 bp, Rattus norvegicus
gtcaccgtaatgcaagagcctcttg

SEQ ID NO: 489380 - DNA, 25 bp, Rattus norvegicus
gtcaccgtaatggaagagcctcttg

SEQ ID NO: 489381 - DNA, 25 bp, Rattus norvegicus
gtcaccgtatctctgctgggaggaa

SEQ ID NO: 489382 - DNA, 25 bp, Rattus norvegicus
gtcaccgtatctgtgctgggaggaa

SEQ ID NO: 489383 - DNA, 25 bp, Rattus norvegicus
gtcaccgtcaagaacgaccgcaagg

SEQ ID NO: 489384 - DNA, 25 bp, Rattus norvegicus
gtcaccgtcaagtacgaccgcaagg

SEQ ID NO: 489385 - DNA, 25 bp, Rattus norvegicus
gtcaccgtccttcacactaggaaag

SEQ ID NO: 489386 - DNA, 25 bp, Rattus norvegicus
gtcaccgtccttgacactaggaaag

SEQ ID NO: 489387 - DNA, 25 bp, Rattus norvegicus
gtcaccgtcttccttgtgattatag

SEQ ID NO: 489388 - DNA, 25 bp, Rattus norvegicus
gtcaccgtcttcgttgtgattatag

SEQ ID NO: 489389 - DNA, 25 bp, Rattus norvegicus
gtcaccgtgacaaaaactgtatcat

SEQ ID NO: 489390 - DNA, 25 bp, Rattus norvegicus
gtcaccgtgacataaactgtatcat

SEQ ID NO: 489391 - DNA, 25 bp, Rattus norvegicus
gtcaccgtggaccaggtcttggcaa

SEQ ID NO: 489392 - DNA, 25 bp, Rattus norvegicus
gtcaccgtggacgaggtcttggcaa

SEQ ID NO: 489393 - DNA, 25 bp, Rattus norvegicus
gtcaccgtgtcacgctccattataa

SEQ ID NO: 489394 - DNA, 25 bp, Rattus norvegicus
gtcaccgtgtcaggctccattataa

SEQ ID NO: 489395 - DNA, 25 bp, Rattus norvegicus
gtcacctacagaattaatcttgtat

SEQ ID NO: 489396 - DNA, 25 bp, Rattus norvegicus
gtcacctacagatttaatcttgtat

SEQ ID NO: 489397 - DNA, 25 bp, Rattus norvegicus
gtcacctactcacagccaaggaggg

SEQ ID NO: 489398 - DNA, 25 bp, Rattus norvegicus
gtcacctactcagagccaaggaggg

SEQ ID NO: 489399 - DNA, 25 bp, Rattus norvegicus
gtcacctatgctactgttgctgaag

SEQ ID NO: 489400 - DNA, 25 bp, Rattus norvegicus
gtcacctatgcttctgttgctgaag

SEQ ID NO: 489401 - DNA, 25 bp, Rattus norvegicus
gtcacctattcaacttcaagagctt

SEQ ID NO: 489402 - DNA, 25 bp, Rattus norvegicus
gtcacctattcaatggtttccttga

SEQ ID NO: 489403 - DNA, 25 bp, Rattus norvegicus
gtcacctattcatcttcaagagctt

SEQ ID NO: 489404 - DNA, 25 bp, Rattus norvegicus
gtcacctattcattggtttccttga

SEQ ID NO: 489405 - DNA, 25 bp, Rattus norvegicus
gtcacctcagaaatgagcaagaccc

SEQ ID NO: 489406 - DNA, 25 bp, Rattus norvegicus
gtcacctcagaattgagcaagaccc

SEQ ID NO: 489407 - DNA, 25 bp, Rattus norvegicus
gtcacctcagctattcctatagatt

SEQ ID NO: 489408 - DNA, 25 bp, Rattus norvegicus
gtcacctcagcttttcctatagatt

SEQ ID NO: 489409 - DNA, 25 bp, Rattus norvegicus
gtcacctcaggacatctgtaagcag

SEQ ID NO: 489410 - DNA, 25 bp, Rattus norvegicus
gtcacctcaggagatctgtaagcag

SEQ ID NO: 489411 - DNA, 25 bp, Rattus norvegicus
gtcacctcatgtacacaagggcaga

SEQ ID NO: 489412 - DNA, 25 bp, Rattus norvegicus
gtcacctcatgttcacaagggcaga

SEQ ID NO: 489413 - DNA, 25 bp, Rattus norvegicus
gtcacctccagaagctctgtcgaat

SEQ ID NO: 489414 - DNA, 25 bp, Rattus norvegicus
gtcacctccagaatgattcccaagt

SEQ ID NO: 489415 - DNA, 25 bp, Rattus norvegicus
gtcacctccagatgctctgtcgaat

SEQ ID NO: 489416 - DNA, 25 bp, Rattus norvegicus
gtcacctccagattgattcccaagt

SEQ ID NO: 489417 - DNA, 25 bp, Rattus norvegicus
gtcacctccgacaatgctagtacaa

SEQ ID NO: 489418 - DNA, 25 bp, Rattus norvegicus
gtcacctccgactatgctagtacaa

SEQ ID NO: 489419 - DNA, 25 bp, Rattus norvegicus
gtcacctcctaacagacgctaagag

SEQ ID NO: 489420 - DNA, 25 bp, Rattus norvegicus
gtcacctcctaagagacgctaagag

SEQ ID NO: 489421 - DNA, 25 bp, Rattus norvegicus
gtcacctcctagagctacagacatg

SEQ ID NO: 489422 - DNA, 25 bp, Rattus norvegicus
gtcacctcctagtgctacagacatg

SEQ ID NO: 489423 - DNA, 25 bp, Rattus norvegicus
gtcacctcgcggagaagggtcgcgc

SEQ ID NO: 489424 - DNA, 25 bp, Rattus norvegicus
gtcacctcgcggtgaagggtcgcgc

SEQ ID NO: 489425 - DNA, 25 bp, Rattus norvegicus
gtcacctctacacttgaatctgaga

SEQ ID NO: 489426 - DNA, 25 bp, Rattus norvegicus
gtcacctctacagttgaatctgaga

SEQ ID NO: 489427 - DNA, 25 bp, Rattus norvegicus
gtcacctctggccattacaaagtag

SEQ ID NO: 489428 - DNA, 25 bp, Rattus norvegicus
gtcacctctggcgattacaaagtag

SEQ ID NO: 489429 - DNA, 25 bp, Rattus norvegicus
gtcacctctgtaatcgctgtacata

SEQ ID NO: 489430 - DNA, 25 bp, Rattus norvegicus
gtcacctctgtattcgctgtacata

SEQ ID NO: 489431 - DNA, 25 bp, Rattus norvegicus
gtcacctctgtgaaagttctttccc

SEQ ID NO: 489432 - DNA, 25 bp, Rattus norvegicus
gtcacctctgtgtaagttctttccc

SEQ ID NO: 489433 - DNA, 25 bp, Rattus norvegicus
gtcacctctgttctccagatgggca

SEQ ID NO: 489434 - DNA, 25 bp, Rattus norvegicus
gtcacctctgttgtccagatgggca

SEQ ID NO: 489435 - DNA, 25 bp, Rattus norvegicus
gtcacctcttttcgtttttggcatc

SEQ ID NO: 489436 - DNA, 25 bp, Rattus norvegicus
gtcacctcttttggtttttggcatc

SEQ ID NO: 489437 - DNA, 25 bp, Rattus norvegicus
gtcacctgacatccattgtgggctc

SEQ ID NO: 489438 - DNA, 25 bp, Rattus norvegicus
gtcacctgacatgcattgtgggctc

SEQ ID NO: 489439 - DNA, 25 bp, Rattus norvegicus
gtcacctgacccaggatgagatgga

SEQ ID NO: 489440 - DNA, 25 bp, Rattus norvegicus
gtcacctgaccctggatgagatgga

SEQ ID NO: 489441 - DNA, 25 bp, Rattus norvegicus
gtcacctgacctctggttacgaaat

SEQ ID NO: 489442 - DNA, 25 bp, Rattus norvegicus
gtcacctgacctgtggttacgaaat

SEQ ID NO: 489443 - DNA, 25 bp, Rattus norvegicus
gtcacctgagaactttgccagtgca

SEQ ID NO: 489444 - DNA, 25 bp, Rattus norvegicus
gtcacctgagaagtttgccagtgca

SEQ ID NO: 489445 - DNA, 25 bp, Rattus norvegicus
gtcacctgagagatgggagccaaat

SEQ ID NO: 489446 - DNA, 25 bp, Rattus norvegicus
gtcacctgagagttgggagccaaat

SEQ ID NO: 489447 - DNA, 25 bp, Rattus norvegicus
gtcacctgaggtaaggcggcatcct

SEQ ID NO: 489448 - DNA, 25 bp, Rattus norvegicus
gtcacctgaggtatctaattgcatg

SEQ ID NO: 489449 - DNA, 25 bp, Rattus norvegicus
gtcacctgaggttaggcggcatcct

SEQ ID NO: 489450 - DNA, 25 bp, Rattus norvegicus
gtcacctgaggtttctaattgcatg

SEQ ID NO: 489451 - DNA, 25 bp, Rattus norvegicus
gtcacctgagtgaggctaggcccta

SEQ ID NO: 489452 - DNA, 25 bp, Rattus norvegicus
gtcacctgagtgtggctaggcccta

SEQ ID NO: 489453 - DNA, 25 bp, Rattus norvegicus
gtcacctgatgaagaacgtcgccat

SEQ ID NO: 489454 - DNA, 25 bp, Rattus norvegicus
gtcacctgatgatgaacgtcgccat

SEQ ID NO: 489455 - DNA, 25 bp, Rattus norvegicus
gtcacctgcaaaatgtgttctcctc

SEQ ID NO: 489456 - DNA, 25 bp, Rattus norvegicus
gtcacctgcaaattgtgttctcctc

SEQ ID NO: 489457 - DNA, 25 bp, Rattus norvegicus
gtcacctgcaccaggagcttctgga

SEQ ID NO: 489458 - DNA, 25 bp, Rattus norvegicus
gtcacctgcacctggagcttctgga

SEQ ID NO: 489459 - DNA, 25 bp, Rattus norvegicus
gtcacctgcattccatagcattgtg

SEQ ID NO: 489460 - DNA, 25 bp, Rattus norvegicus
gtcacctgcattgcatagcattgtg

SEQ ID NO: 489461 - DNA, 25 bp, Rattus norvegicus
gtcacctgctgcagtatttggaaac

SEQ ID NO: 489462 - DNA, 25 bp, Rattus norvegicus
gtcacctgctgctgtatttggaaac

SEQ ID NO: 489463 - DNA, 25 bp, Rattus norvegicus
gtcacctggaggaactgcttataca

SEQ ID NO: 489464 - DNA, 25 bp, Rattus norvegicus
gtcacctggaggtactgcttataca

SEQ ID NO: 489465 - DNA, 25 bp, Rattus norvegicus
gtcacctggcagctgtctgtaagaa

SEQ ID NO: 489466 - DNA, 25 bp, Rattus norvegicus
gtcacctggcaggtgtctgtaagaa

SEQ ID NO: 489467 - DNA, 25 bp, Rattus norvegicus
gtcacctggcatctagaccttagca

SEQ ID NO: 489468 - DNA, 25 bp, Rattus norvegicus
gtcacctggcatgtagaccttagca

SEQ ID NO: 489469 - DNA, 25 bp, Rattus norvegicus
gtcacctggctactactattaaagt

SEQ ID NO: 489470 - DNA, 25 bp, Rattus norvegicus
gtcacctggctagtactattaaagt

SEQ ID NO: 489471 - DNA, 25 bp, Rattus norvegicus
gtcacctgggaacttctggcagaat

SEQ ID NO: 489472 - DNA, 25 bp, Rattus norvegicus
gtcacctgggaagttctggcagaat

SEQ ID NO: 489473 - DNA, 25 bp, Rattus norvegicus
gtcacctgggtgactgaagaaagct

SEQ ID NO: 489474 - DNA, 25 bp, Rattus norvegicus
gtcacctgggtgatgaatggcatgt

SEQ ID NO: 489475 - DNA, 25 bp, Rattus norvegicus
gtcacctgggtgtctgaagaaagct

SEQ ID NO: 489476 - DNA, 25 bp, Rattus norvegicus
gtcacctgggtgttgaatggcatgt

SEQ ID NO: 489477 - DNA, 25 bp, Rattus norvegicus
gtcacctgtggccttggaagtgtta

SEQ ID NO: 489478 - DNA, 25 bp, Rattus norvegicus
gtcacctgtggcgttggaagtgtta

SEQ ID NO: 489479 - DNA, 25 bp, Rattus norvegicus
gtcacctgtgttctagcccatgatc

SEQ ID NO: 489480 - DNA, 25 bp, Rattus norvegicus
gtcacctgtgttgtagcccatgatc

SEQ ID NO: 489481 - DNA, 25 bp, Rattus norvegicus
gtcacctgttcaagtgatggaccaa

SEQ ID NO: 489482 - DNA, 25 bp, Rattus norvegicus
gtcacctgttcatgtgatggaccaa

SEQ ID NO: 489483 - DNA, 25 bp, Rattus norvegicus
gtcacctgttggacatttccttttg

SEQ ID NO: 489484 - DNA, 25 bp, Rattus norvegicus
gtcacctgttggatttcctgttcaa

SEQ ID NO: 489485 - DNA, 25 bp, Rattus norvegicus
gtcacctgttggtcatttccttttg

SEQ ID NO: 489486 - DNA, 25 bp, Rattus norvegicus
gtcacctgttggttttcctgttcaa

SEQ ID NO: 489487 - DNA, 25 bp, Rattus norvegicus
gtcacctgtttacgaaaccactgcg

SEQ ID NO: 489488 - DNA, 25 bp, Rattus norvegicus
gtcacctgtttaggaaaccactgcg

SEQ ID NO: 489489 - DNA, 25 bp, Rattus norvegicus
gtcaccttactcacacagggctgaa

SEQ ID NO: 489490 - DNA, 25 bp, Rattus norvegicus
gtcaccttactctcacagggctgaa

SEQ ID NO: 489491 - DNA, 25 bp, Rattus norvegicus
gtcaccttagaaacacattcgctat

SEQ ID NO: 489492 - DNA, 25 bp, Rattus norvegicus
gtcaccttagaatcacattcgctat

SEQ ID NO: 489493 - DNA, 25 bp, Rattus norvegicus
gtcaccttagagaagactgccacca

SEQ ID NO: 489494 - DNA, 25 bp, Rattus norvegicus
gtcaccttagagtagactgccacca

SEQ ID NO: 489495 - DNA, 25 bp, Rattus norvegicus
gtcaccttattcctctgatctggaa

SEQ ID NO: 489496 - DNA, 25 bp, Rattus norvegicus
gtcaccttattcgtctgatctggaa

SEQ ID NO: 489497 - DNA, 25 bp, Rattus norvegicus
gtcaccttcaccattgaaagctttg

SEQ ID NO: 489498 - DNA, 25 bp, Rattus norvegicus
gtcaccttcacctttgaaagctttg

SEQ ID NO: 489499 - DNA, 25 bp, Rattus norvegicus
gtcaccttcaggacaattggcagaa

SEQ ID NO: 489500 - DNA, 25 bp, Rattus norvegicus
gtcaccttcaggtcaattggcagaa

SEQ ID NO: 489501 - DNA, 25 bp, Rattus norvegicus
gtcaccttctgacatctacatgtgt

SEQ ID NO: 489502 - DNA, 25 bp, Rattus norvegicus
gtcaccttctgagatctacatgtgt

SEQ ID NO: 489503 - DNA, 25 bp, Rattus norvegicus
gtcaccttgaccatgttttctgtaa

SEQ ID NO: 489504 - DNA, 25 bp, Rattus norvegicus
gtcaccttgaccttgttttctgtaa

SEQ ID NO: 489505 - DNA, 25 bp, Rattus norvegicus
gtcaccttgatgaaaaaattttgta

SEQ ID NO: 489506 - DNA, 25 bp, Rattus norvegicus
gtcaccttgatgtaaaaattttgta

SEQ ID NO: 489507 - DNA, 25 bp, Rattus norvegicus
gtcaccttgcagctgtggcacataa

SEQ ID NO: 489508 - DNA, 25 bp, Rattus norvegicus
gtcaccttgcaggtgtggcacataa

SEQ ID NO: 489509 - DNA, 25 bp, Rattus norvegicus
gtcaccttgcgtcctccaaatttaa

SEQ ID NO: 489510 - DNA, 25 bp, Rattus norvegicus
gtcaccttgcgtgctccaaatttaa

SEQ ID NO: 489511 - DNA, 25 bp, Rattus norvegicus
gtcaccttgctcagtacagtgctgt

SEQ ID NO: 489512 - DNA, 25 bp, Rattus norvegicus
gtcaccttgctctgtacagtgctgt

SEQ ID NO: 489513 - DNA, 25 bp, Rattus norvegicus
gtcaccttgcttaggaagccactga

SEQ ID NO: 489514 - DNA, 25 bp, Rattus norvegicus
gtcaccttgctttggaagccactga

SEQ ID NO: 489515 - DNA, 25 bp, Rattus norvegicus
gtcaccttggttagggctcatgaaa

SEQ ID NO: 489516 - DNA, 25 bp, Rattus norvegicus
gtcaccttggtttgggctcatgaaa

SEQ ID NO: 489517 - DNA, 25 bp, Rattus norvegicus
gtcaccttgttgatacttgggaaat

SEQ ID NO: 489518 - DNA, 25 bp, Rattus norvegicus
gtcaccttgttgttacttgggaaat

SEQ ID NO: 489519 - DNA, 25 bp, Rattus norvegicus
gtcaccttgtttcgctgaaagtcaa

SEQ ID NO: 489520 - DNA, 25 bp, Rattus norvegicus
gtcaccttgtttggctgaaagtcaa

SEQ ID NO: 489521 - DNA, 25 bp, Rattus norvegicus
gtcacctttataccttggttctcag

SEQ ID NO: 489522 - DNA, 25 bp, Rattus norvegicus
gtcacctttatagcttggttctcag

SEQ ID NO: 489523 - DNA, 25 bp, Rattus norvegicus
gtcacctttctcagtctcaaacgga

SEQ ID NO: 489524 - DNA, 25 bp, Rattus norvegicus
gtcacctttctctgtctcaaacgga

SEQ ID NO: 489525 - DNA, 25 bp, Rattus norvegicus
gtcacctttgtaccatctgattgtc

SEQ ID NO: 489526 - DNA, 25 bp, Rattus norvegicus
gtcacctttgtagcatctgattgtc

SEQ ID NO: 489527 - DNA, 25 bp, Rattus norvegicus
gtcaccttttcaacagatgcttcag

SEQ ID NO: 489528 - DNA, 25 bp, Rattus norvegicus
gtcaccttttcatcagatgcttcag

SEQ ID NO: 489529 - DNA, 25 bp, Rattus norvegicus
gtcacgaactatattccctggattg

SEQ ID NO: 489530 - DNA, 25 bp, Rattus norvegicus
gtcacgaactattttccctggattg

SEQ ID NO: 489531 - DNA, 25 bp, Rattus norvegicus
gtcacgaaggttctgcaccaggcag

SEQ ID NO: 489532 - DNA, 25 bp, Rattus norvegicus
gtcacgaaggttgtgcaccaggcag

SEQ ID NO: 489533 - DNA, 25 bp, Rattus norvegicus
gtcacgaatcggacatcaatgctgt

SEQ ID NO: 489534 - DNA, 25 bp, Rattus norvegicus
gtcacgaatcggtcatcaatgctgt

SEQ ID NO: 489535 - DNA, 25 bp, Rattus norvegicus
gtcacgacactgagttgaacctatg

SEQ ID NO: 489536 - DNA, 25 bp, Rattus norvegicus
gtcacgacactgtgttgaacctatg

SEQ ID NO: 489537 - DNA, 25 bp, Rattus norvegicus
gtcacgagaacgattagagcagctc

SEQ ID NO: 489538 - DNA, 25 bp, Rattus norvegicus
gtcacgagaacgtttagagcagctc

SEQ ID NO: 489539 - DNA, 25 bp, Rattus norvegicus
gtcacgaggattatacctttagaag

SEQ ID NO: 489540 - DNA, 25 bp, Rattus norvegicus
gtcacgaggattttacctttagaag

SEQ ID NO: 489541 - DNA, 25 bp, Rattus norvegicus
gtcacgatgtcacgtagccgccagg

SEQ ID NO: 489542 - DNA, 25 bp, Rattus norvegicus
gtcacgatgtcaggtagccgccagg

SEQ ID NO: 489543 - DNA, 25 bp, Rattus norvegicus
gtcacgcacttaataaagcactgat

SEQ ID NO: 489544 - DNA, 25 bp, Rattus norvegicus
gtcacgcacttattaaagcactgat

SEQ ID NO: 489545 - DNA, 25 bp, Rattus norvegicus
gtcacgcagcagatccctgatggaa

SEQ ID NO: 489546 - DNA, 25 bp, Rattus norvegicus
gtcacgcagcagttccctgatggaa

SEQ ID NO: 489547 - DNA, 25 bp, Rattus norvegicus
gtcacgcaggcgatttccaatgtag

SEQ ID NO: 489548 - DNA, 25 bp, Rattus norvegicus
gtcacgcaggcgttttccaatgtag

SEQ ID NO: 489549 - DNA, 25 bp, Rattus norvegicus
gtcacgcagggacagatgcccagca

SEQ ID NO: 489550 - DNA, 25 bp, Rattus norvegicus
gtcacgcagggagagatgcccagca

SEQ ID NO: 489551 - DNA, 25 bp, Rattus norvegicus
gtcacgccccacaaaagagtctaag

SEQ ID NO: 489552 - DNA, 25 bp, Rattus norvegicus
gtcacgccccactaaagagtctaag

SEQ ID NO: 489553 - DNA, 25 bp, Rattus norvegicus
gtcacgcctggaaacctgaatgcta

SEQ ID NO: 489554 - DNA, 25 bp, Rattus norvegicus
gtcacgcctggatacctgaatgcta

SEQ ID NO: 489555 - DNA, 25 bp, Rattus norvegicus
gtcacgctcttgaccttagggagaa

SEQ ID NO: 489556 - DNA, 25 bp, Rattus norvegicus
gtcacgctcttgtccttagggagaa

SEQ ID NO: 489557 - DNA, 25 bp, Rattus norvegicus
gtcacgctgaatatatgaccacgct

SEQ ID NO: 489558 - DNA, 25 bp, Rattus norvegicus
gtcacgctgaatttatgaccacgct

SEQ ID NO: 489559 - DNA, 25 bp, Rattus norvegicus
gtcacgctgctactgagtccagaat

SEQ ID NO: 489560 - DNA, 25 bp, Rattus norvegicus
gtcacgctgctagtgagtccagaat

SEQ ID NO: 489561 - DNA, 25 bp, Rattus norvegicus
gtcacgcttattaatggtgcctcca

SEQ ID NO: 489562 - DNA, 25 bp, Rattus norvegicus
gtcacgcttatttatggtgcctcca

SEQ ID NO: 489563 - DNA, 25 bp, Rattus norvegicus
gtcacgctttaaaaatcaacccaag

SEQ ID NO: 489564 - DNA, 25 bp, Rattus norvegicus
gtcacgctttaataatcaacccaag

SEQ ID NO: 489565 - DNA, 25 bp, Rattus norvegicus
gtcacgcttttacgactgcaggaag

SEQ ID NO: 489566 - DNA, 25 bp, Rattus norvegicus
gtcacgcttttaggactgcaggaag

SEQ ID NO: 489567 - DNA, 25 bp, Rattus norvegicus
gtcacggacatgatcttctgttcag

SEQ ID NO: 489568 - DNA, 25 bp, Rattus norvegicus
gtcacggacatgttcttctgttcag

SEQ ID NO: 489569 - DNA, 25 bp, Rattus norvegicus
gtcacggagtttctcccattggaga

SEQ ID NO: 489570 - DNA, 25 bp, Rattus norvegicus
gtcacggagtttgtcccattggaga

SEQ ID NO: 489571 - DNA, 25 bp, Rattus norvegicus
gtcacggatgacagcttagcgcgac

SEQ ID NO: 489572 - DNA, 25 bp, Rattus norvegicus
gtcacggatgactgcttagcgcgac

SEQ ID NO: 489573 - DNA, 25 bp, Rattus norvegicus
gtcacggcaaccacatgaaccagat

SEQ ID NO: 489574 - DNA, 25 bp, Rattus norvegicus
gtcacggcaacctcatgaaccagat

SEQ ID NO: 489575 - DNA, 25 bp, Rattus norvegicus
gtcacggccttcctcaaatggattg

SEQ ID NO: 489576 - DNA, 25 bp, Rattus norvegicus
gtcacggccttcgtcaaatggattg

SEQ ID NO: 489577 - DNA, 25 bp, Rattus norvegicus
gtcacggctctgaggtacagcgaca

SEQ ID NO: 489578 - DNA, 25 bp, Rattus norvegicus
gtcacggctctgtggtacagcgaca

SEQ ID NO: 489579 - DNA, 25 bp, Rattus norvegicus
gtcacgggacatagggatttccgaa

SEQ ID NO: 489580 - DNA, 25 bp, Rattus norvegicus
gtcacgggacattgggatttccgaa

SEQ ID NO: 489581 - DNA, 25 bp, Rattus norvegicus
gtcacgggctgcatttccttcatct

SEQ ID NO: 489582 - DNA, 25 bp, Rattus norvegicus
gtcacgggctgcttttccttcatct

SEQ ID NO: 489583 - DNA, 25 bp, Rattus norvegicus
gtcacgggttatctaaccagacaag

SEQ ID NO: 489584 - DNA, 25 bp, Rattus norvegicus
gtcacgggttatgtaaccagacaag

SEQ ID NO: 489585 - DNA, 25 bp, Rattus norvegicus
gtcacggtaaccacgggagtgctta

SEQ ID NO: 489586 - DNA, 25 bp, Rattus norvegicus
gtcacggtaacctcgggagtgctta

SEQ ID NO: 489587 - DNA, 25 bp, Rattus norvegicus
gtcacggtgagcctttgtgtagtaa

SEQ ID NO: 489588 - DNA, 25 bp, Rattus norvegicus
gtcacggtgagcgtttgtgtagtaa

SEQ ID NO: 489589 - DNA, 25 bp, Rattus norvegicus
gtcacggtgcctatagattccggct

SEQ ID NO: 489590 - DNA, 25 bp, Rattus norvegicus
gtcacggtgcctttagattccggct

SEQ ID NO: 489591 - DNA, 25 bp, Rattus norvegicus
gtcacggtgggcagctgaccgcaca

SEQ ID NO: 489592 - DNA, 25 bp, Rattus norvegicus
gtcacggtgggctgctgaccgcaca

SEQ ID NO: 489593 - DNA, 25 bp, Rattus norvegicus
gtcacggttatcatttgacctacca

SEQ ID NO: 489594 - DNA, 25 bp, Rattus norvegicus
gtcacggttatcttttgacctacca

SEQ ID NO: 489595 - DNA, 25 bp, Rattus norvegicus
gtcacggttttcacgaagcttggaa

SEQ ID NO: 489596 - DNA, 25 bp, Rattus norvegicus
gtcacggttttctcgaagcttggaa

SEQ ID NO: 489597 - DNA, 25 bp, Rattus norvegicus
gtcacgtcagtgcaaactgtccgga

SEQ ID NO: 489598 - DNA, 25 bp, Rattus norvegicus
gtcacgtcagtggaaactgtccgga

SEQ ID NO: 489599 - DNA, 25 bp, Rattus norvegicus
gtcacgtcatttacttatgttgctg

SEQ ID NO: 489600 - DNA, 25 bp, Rattus norvegicus
gtcacgtcattttcttatgttgctg

SEQ ID NO: 489601 - DNA, 25 bp, Rattus norvegicus
gtcacgtcgctgacggatcctatat

SEQ ID NO: 489602 - DNA, 25 bp, Rattus norvegicus
gtcacgtcgctgtcggatcctatat

SEQ ID NO: 489603 - DNA, 25 bp, Rattus norvegicus
gtcacgtcgtggagcagaagcccta

SEQ ID NO: 489604 - DNA, 25 bp, Rattus norvegicus
gtcacgtcgtggtgcagaagcccta

SEQ ID NO: 489605 - DNA, 25 bp, Rattus norvegicus
gtcacgtctgggaactagtaacatc

SEQ ID NO: 489606 - DNA, 25 bp, Rattus norvegicus
gtcacgtctgggtactagtaacatc

SEQ ID NO: 489607 - DNA, 25 bp, Rattus norvegicus
gtcacgtgactcctttttcattaaa

SEQ ID NO: 489608 - DNA, 25 bp, Rattus norvegicus
gtcacgtgactcgtttttcattaaa

SEQ ID NO: 489609 - DNA, 25 bp, Rattus norvegicus
gtcacgtgagcgctcggagagcagg

SEQ ID NO: 489610 - DNA, 25 bp, Rattus norvegicus
gtcacgtgagcggtcggagagcagg

SEQ ID NO: 489611 - DNA, 25 bp, Rattus norvegicus
gtcacgtgcattaggaactcagttc

SEQ ID NO: 489612 - DNA, 25 bp, Rattus norvegicus
gtcacgtgcatttggaactcagttc

SEQ ID NO: 489613 - DNA, 25 bp, Rattus norvegicus
gtcacgtgcggaagtctgaacagct

SEQ ID NO: 489614 - DNA, 25 bp, Rattus norvegicus
gtcacgtgcggatgtctgaacagct

SEQ ID NO: 489615 - DNA, 25 bp, Rattus norvegicus
gtcacgtgcttgatctatggttttg

SEQ ID NO: 489616 - DNA, 25 bp, Rattus norvegicus
gtcacgtgcttgttctatggttttg

SEQ ID NO: 489617 - DNA, 25 bp, Rattus norvegicus
gtcacgtgttggcagctcacaagat

SEQ ID NO: 489618 - DNA, 25 bp, Rattus norvegicus
gtcacgtgttgggagctcacaagat

SEQ ID NO: 489619 - DNA, 25 bp, Rattus norvegicus
gtcactaaactcagtggttaatctc

SEQ ID NO: 489620 - DNA, 25 bp, Rattus norvegicus
gtcactaaactctgtggttaatctc

SEQ ID NO: 489621 - DNA, 25 bp, Rattus norvegicus
gtcactaaaggaattgcagcttgcg

SEQ ID NO: 489622 - DNA, 25 bp, Rattus norvegicus
gtcactaaaggatttgcagcttgcg

SEQ ID NO: 489623 - DNA, 25 bp, Rattus norvegicus
gtcactaactaaactctctttggga

SEQ ID NO: 489624 - DNA, 25 bp, Rattus norvegicus
gtcactaactaatctctctttggga

SEQ ID NO: 489625 - DNA, 25 bp, Rattus norvegicus
gtcactaagctgagtgtgtctggtg

SEQ ID NO: 489626 - DNA, 25 bp, Rattus norvegicus
gtcactaagctgtgtgtgtctggtg

SEQ ID NO: 489627 - DNA, 25 bp, Rattus norvegicus
gtcactaatctgaatttcatcatct

SEQ ID NO: 489628 - DNA, 25 bp, Rattus norvegicus
gtcactaatctgtatttcatcatct

SEQ ID NO: 489629 - DNA, 25 bp, Rattus norvegicus
gtcactaatgtgaggaaatctttct

SEQ ID NO: 489630 - DNA, 25 bp, Rattus norvegicus
gtcactaatgtgtggaaatctttct

SEQ ID NO: 489631 - DNA, 25 bp, Rattus norvegicus
gtcactacagacaggctctgcatgt

SEQ ID NO: 489632 - DNA, 25 bp, Rattus norvegicus
gtcactacagactggctctgcatgt

SEQ ID NO: 489633 - DNA, 25 bp, Rattus norvegicus
gtcactacatgtcctctgtggagtt

SEQ ID NO: 489634 - DNA, 25 bp, Rattus norvegicus
gtcactacatgtgctctgtggagtt

SEQ ID NO: 489635 - DNA, 25 bp, Rattus norvegicus
gtcactaccaagagtctggtgtctg

SEQ ID NO: 489636 - DNA, 25 bp, Rattus norvegicus
gtcactaccaagtgtctggtgtctg

SEQ ID NO: 489637 - DNA, 25 bp, Rattus norvegicus
gtcactacccgcagctgcagtaggg

SEQ ID NO: 489638 - DNA, 25 bp, Rattus norvegicus
gtcactacccgctgctgcagtaggg

SEQ ID NO: 489639 - DNA, 25 bp, Rattus norvegicus
gtcactactgtgacacccttgaaag

SEQ ID NO: 489640 - DNA, 25 bp, Rattus norvegicus
gtcactactgtgatatcaactgttt

SEQ ID NO: 489641 - DNA, 25 bp, Rattus norvegicus
gtcactactgtgtcacccttgaaag

SEQ ID NO: 489642 - DNA, 25 bp, Rattus norvegicus
gtcactactgtgttatcaactgttt

SEQ ID NO: 489643 - DNA, 25 bp, Rattus norvegicus
gtcactacttctagatcaatctcct

SEQ ID NO: 489644 - DNA, 25 bp, Rattus norvegicus
gtcactacttcttgatcaatctcct

SEQ ID NO: 489645 - DNA, 25 bp, Rattus norvegicus
gtcactagaactatttgctgtgggt

SEQ ID NO: 489646 - DNA, 25 bp, Rattus norvegicus
gtcactagaactttttgctgtgggt

SEQ ID NO: 489647 - DNA, 25 bp, Rattus norvegicus
gtcactagcattagaagcctgctct

SEQ ID NO: 489648 - DNA, 25 bp, Rattus norvegicus
gtcactagcatttgaagcctgctct

SEQ ID NO: 489649 - DNA, 25 bp, Rattus norvegicus
gtcactagcttgcacaacgtctgca

SEQ ID NO: 489650 - DNA, 25 bp, Rattus norvegicus
gtcactagcttggacaacgtctgca

SEQ ID NO: 489651 - DNA, 25 bp, Rattus norvegicus
gtcactaggcatctgggttagacca

SEQ ID NO: 489652 - DNA, 25 bp, Rattus norvegicus
gtcactaggcatgtgggttagacca

SEQ ID NO: 489653 - DNA, 25 bp, Rattus norvegicus
gtcactaggccactttgggactcag

SEQ ID NO: 489654 - DNA, 25 bp, Rattus norvegicus
gtcactaggccagtttgggactcag

SEQ ID NO: 489655 - DNA, 25 bp, Rattus norvegicus
gtcactaggtagactcccagaaaaa

SEQ ID NO: 489656 - DNA, 25 bp, Rattus norvegicus
gtcactaggtagtctcccagaaaaa

SEQ ID NO: 489657 - DNA, 25 bp, Rattus norvegicus
gtcactatctgaaaacagctctctg

SEQ ID NO: 489658 - DNA, 25 bp, Rattus norvegicus
gtcactatctgataacagctctctg

SEQ ID NO: 489659 - DNA, 25 bp, Rattus norvegicus
gtcactatttcaaagggcccatggt

SEQ ID NO: 489660 - DNA, 25 bp, Rattus norvegicus
gtcactatttcatagggcccatggt

SEQ ID NO: 489661 - DNA, 25 bp, Rattus norvegicus
gtcactcaaacaagggctcacagtt

SEQ ID NO: 489662 - DNA, 25 bp, Rattus norvegicus
gtcactcaaacatgggctcacagtt

SEQ ID NO: 489663 - DNA, 25 bp, Rattus norvegicus
gtcactcaactgcaactaaactcgt

SEQ ID NO: 489664 - DNA, 25 bp, Rattus norvegicus
gtcactcaactggaactaaactcgt

SEQ ID NO: 489665 - DNA, 25 bp, Rattus norvegicus
gtcactcaatccatctctgagattt

SEQ ID NO: 489666 - DNA, 25 bp, Rattus norvegicus
gtcactcaatccttctctgagattt

SEQ ID NO: 489667 - DNA, 25 bp, Rattus norvegicus
gtcactcaccttattgcaggagaag

SEQ ID NO: 489668 - DNA, 25 bp, Rattus norvegicus
gtcactcacctttttgcaggagaag

SEQ ID NO: 489669 - DNA, 25 bp, Rattus norvegicus
gtcactcactgaccatgaagttgat

SEQ ID NO: 489670 - DNA, 25 bp, Rattus norvegicus
gtcactcactgaccggtcttttgaa

SEQ ID NO: 489671 - DNA, 25 bp, Rattus norvegicus
gtcactcactgagcatgaagttgat

SEQ ID NO: 489672 - DNA, 25 bp, Rattus norvegicus
gtcactcactgagcggtcttttgaa

SEQ ID NO: 489673 - DNA, 25 bp, Rattus norvegicus
gtcactcagcctacggttgggatga

SEQ ID NO: 489674 - DNA, 25 bp, Rattus norvegicus
gtcactcagccttcggttgggatga

SEQ ID NO: 489675 - DNA, 25 bp, Rattus norvegicus
gtcactcaggagctctactggcaga

SEQ ID NO: 489676 - DNA, 25 bp, Rattus norvegicus
gtcactcaggaggtctactggcaga

SEQ ID NO: 489677 - DNA, 25 bp, Rattus norvegicus
gtcactcagtgtagtttcagtccca

SEQ ID NO: 489678 - DNA, 25 bp, Rattus norvegicus
gtcactcagtgtctcattctgactg

SEQ ID NO: 489679 - DNA, 25 bp, Rattus norvegicus
gtcactcagtgtgtcattctgactg

SEQ ID NO: 489680 - DNA, 25 bp, Rattus norvegicus
gtcactcagtgttgtttcagtccca

SEQ ID NO: 489681 - DNA, 25 bp, Rattus norvegicus
gtcactcatgacactcgggaacaag

SEQ ID NO: 489682 - DNA, 25 bp, Rattus norvegicus
gtcactcatgactctcgggaacaag

SEQ ID NO: 489683 - DNA, 25 bp, Rattus norvegicus
gtcactcatgagaggcccacagaag

SEQ ID NO: 489684 - DNA, 25 bp, Rattus norvegicus
gtcactcatgagtggcccacagaag

SEQ ID NO: 489685 - DNA, 25 bp, Rattus norvegicus
gtcactcatgtccactacaggattt

SEQ ID NO: 489686 - DNA, 25 bp, Rattus norvegicus
gtcactcatgtcgactacaggattt

SEQ ID NO: 489687 - DNA, 25 bp, Rattus norvegicus
gtcactcatgttatacagtgccatt

SEQ ID NO: 489688 - DNA, 25 bp, Rattus norvegicus
gtcactcatgttttacagtgccatt

SEQ ID NO: 489689 - DNA, 25 bp, Rattus norvegicus
gtcactcatttaccaattgatctgt

SEQ ID NO: 489690 - DNA, 25 bp, Rattus norvegicus
gtcactcatttagcaattgatctgt

SEQ ID NO: 489691 - DNA, 25 bp, Rattus norvegicus
gtcactccaagaccagtaaattctc

SEQ ID NO: 489692 - DNA, 25 bp, Rattus norvegicus
gtcactccaagagcagtaaattctc

SEQ ID NO: 489693 - DNA, 25 bp, Rattus norvegicus
gtcactccagatcactgcggtttta

SEQ ID NO: 489694 - DNA, 25 bp, Rattus norvegicus
gtcactccagatgactgcggtttta

SEQ ID NO: 489695 - DNA, 25 bp, Rattus norvegicus
gtcactccaggcaccattaggcatg

SEQ ID NO: 489696 - DNA, 25 bp, Rattus norvegicus
gtcactccaggctccattaggcatg

SEQ ID NO: 489697 - DNA, 25 bp, Rattus norvegicus
gtcactccatcaaaagatccacatc

SEQ ID NO: 489698 - DNA, 25 bp, Rattus norvegicus
gtcactccatcataagatccacatc

SEQ ID NO: 489699 - DNA, 25 bp, Rattus norvegicus
gtcactccatcgatgttcttcttcg

SEQ ID NO: 489700 - DNA, 25 bp, Rattus norvegicus
gtcactccatcgttgttcttcttcg

SEQ ID NO: 489701 - DNA, 25 bp, Rattus norvegicus
gtcactccatgtcttgtgaggcgct

SEQ ID NO: 489702 - DNA, 25 bp, Rattus norvegicus
gtcactccatgtgttgtgaggcgct

SEQ ID NO: 489703 - DNA, 25 bp, Rattus norvegicus
gtcactcccagtccgatctaattaa

SEQ ID NO: 489704 - DNA, 25 bp, Rattus norvegicus
gtcactcccagtgcgatctaattaa

SEQ ID NO: 489705 - DNA, 25 bp, Rattus norvegicus
gtcactccggagctccgaaacgcaa

SEQ ID NO: 489706 - DNA, 25 bp, Rattus norvegicus
gtcactccggaggtccgaaacgcaa

SEQ ID NO: 489707 - DNA, 25 bp, Rattus norvegicus
gtcactcctcaaaggtgggaagatg

SEQ ID NO: 489708 - DNA, 25 bp, Rattus norvegicus
gtcactcctcaatggtgggaagatg

SEQ ID NO: 489709 - DNA, 25 bp, Rattus norvegicus
gtcactcctctcatttggaagtact

SEQ ID NO: 489710 - DNA, 25 bp, Rattus norvegicus
gtcactcctctcttttggaagtact

SEQ ID NO: 489711 - DNA, 25 bp, Rattus norvegicus
gtcactcctttaaaactgtcttctt

SEQ ID NO: 489712 - DNA, 25 bp, Rattus norvegicus
gtcactcctttataactgtcttctt

SEQ ID NO: 489713 - DNA, 25 bp, Rattus norvegicus
gtcactcggcggctttgtaaagaat

SEQ ID NO: 489714 - DNA, 25 bp, Rattus norvegicus
gtcactcggcgggtttgtaaagaat

SEQ ID NO: 489715 - DNA, 25 bp, Rattus norvegicus
gtcactcgggagacacttttagggt

SEQ ID NO: 489716 - DNA, 25 bp, Rattus norvegicus
gtcactcgggagtcacttttagggt

SEQ ID NO: 489717 - DNA, 25 bp, Rattus norvegicus
gtcactcggttcactgtgaggacaa

SEQ ID NO: 489718 - DNA, 25 bp, Rattus norvegicus
gtcactcggttctctgtgaggacaa

SEQ ID NO: 489719 - DNA, 25 bp, Rattus norvegicus
gtcactctaatgatgtaccatgtag

SEQ ID NO: 489720 - DNA, 25 bp, Rattus norvegicus
gtcactctaatgttgtaccatgtag

SEQ ID NO: 489721 - DNA, 25 bp, Rattus norvegicus
gtcactctagtgcttaggctgcgat

SEQ ID NO: 489722 - DNA, 25 bp, Rattus norvegicus
gtcactctagtggttaggctgcgat

SEQ ID NO: 489723 - DNA, 25 bp, Rattus norvegicus
gtcactctccacatttaatttcact

SEQ ID NO: 489724 - DNA, 25 bp, Rattus norvegicus
gtcactctccacctggttgaacttg

SEQ ID NO: 489725 - DNA, 25 bp, Rattus norvegicus
gtcactctccacgtggttgaacttg

SEQ ID NO: 489726 - DNA, 25 bp, Rattus norvegicus
gtcactctccacttttaatttcact

SEQ ID NO: 489727 - DNA, 25 bp, Rattus norvegicus
gtcactctgactctataatcctgat

SEQ ID NO: 489728 - DNA, 25 bp, Rattus norvegicus
gtcactctgactgtataatcctgat

SEQ ID NO: 489729 - DNA, 25 bp, Rattus norvegicus
gtcactctgcacaaaggaagtccta

SEQ ID NO: 489730 - DNA, 25 bp, Rattus norvegicus
gtcactctgcactaaggaagtccta

SEQ ID NO: 489731 - DNA, 25 bp, Rattus norvegicus
gtcactctggaaacacgaactactc

SEQ ID NO: 489732 - DNA, 25 bp, Rattus norvegicus
gtcactctggaatcacgaactactc

SEQ ID NO: 489733 - DNA, 25 bp, Rattus norvegicus
gtcactctggcacttaactgatggg

SEQ ID NO: 489734 - DNA, 25 bp, Rattus norvegicus
gtcactctggcagttaactgatggg

SEQ ID NO: 489735 - DNA, 25 bp, Rattus norvegicus
gtcactcttgggaaacagcaacaca

SEQ ID NO: 489736 - DNA, 25 bp, Rattus norvegicus
gtcactcttgggtaacagcaacaca

SEQ ID NO: 489737 - DNA, 25 bp, Rattus norvegicus
gtcactcttgttcccgagtatggaa

SEQ ID NO: 489738 - DNA, 25 bp, Rattus norvegicus
gtcactcttgttgccgagtatggaa

SEQ ID NO: 489739 - DNA, 25 bp, Rattus norvegicus
gtcactctttgaccttgtgtatgca

SEQ ID NO: 489740 - DNA, 25 bp, Rattus norvegicus
gtcactctttgagcttgtgtatgca

SEQ ID NO: 489741 - DNA, 25 bp, Rattus norvegicus
gtcactgaaacaaacactgcacctt

SEQ ID NO: 489742 - DNA, 25 bp, Rattus norvegicus
gtcactgaaacatacactgcacctt

SEQ ID NO: 489743 - DNA, 25 bp, Rattus norvegicus
gtcactgaagaccttgcccaaaaag

SEQ ID NO: 489744 - DNA, 25 bp, Rattus norvegicus
gtcactgaagacgttgcccaaaaag

SEQ ID NO: 489745 - DNA, 25 bp, Rattus norvegicus
gtcactgaagttatccctgaaagca

SEQ ID NO: 489746 - DNA, 25 bp, Rattus norvegicus
gtcactgaagttttccctgaaagca

SEQ ID NO: 489747 - DNA, 25 bp, Rattus norvegicus
gtcactgaatctctgctgttttaaa

SEQ ID NO: 489748 - DNA, 25 bp, Rattus norvegicus
gtcactgaatctgtgctgttttaaa

SEQ ID NO: 489749 - DNA, 25 bp, Rattus norvegicus
gtcactgacatgactaaatgatgtg

SEQ ID NO: 489750 - DNA, 25 bp, Rattus norvegicus
gtcactgacatgtctaaatgatgtg

SEQ ID NO: 489751 - DNA, 25 bp, Rattus norvegicus
gtcactgaccaaccatgaaatctga

SEQ ID NO: 489752 - DNA, 25 bp, Rattus norvegicus
gtcactgaccaagcatgaaatctga

SEQ ID NO: 489753 - DNA, 25 bp, Rattus norvegicus
gtcactgagaatattggcacataaa

SEQ ID NO: 489754 - DNA, 25 bp, Rattus norvegicus
gtcactgagaattttggcacataaa

SEQ ID NO: 489755 - DNA, 25 bp, Rattus norvegicus
gtcactgagcaaagtacacccttaa

SEQ ID NO: 489756 - DNA, 25 bp, Rattus norvegicus
gtcactgagcaatgtacacccttaa

SEQ ID NO: 489757 - DNA, 25 bp, Rattus norvegicus
gtcactgagctgactcatggctgaa

SEQ ID NO: 489758 - DNA, 25 bp, Rattus norvegicus
gtcactgagctgtctcatggctgaa

SEQ ID NO: 489759 - DNA, 25 bp, Rattus norvegicus
gtcactgaggacctacacttcaaag

SEQ ID NO: 489760 - DNA, 25 bp, Rattus norvegicus
gtcactgaggacgtacacttcaaag

SEQ ID NO: 489761 - DNA, 25 bp, Rattus norvegicus
gtcactgataggacaggactcgctg

SEQ ID NO: 489762 - DNA, 25 bp, Rattus norvegicus
gtcactgataggtcaggactcgctg

SEQ ID NO: 489763 - DNA, 25 bp, Rattus norvegicus
gtcactgatgttagtccctgtttaa

SEQ ID NO: 489764 - DNA, 25 bp, Rattus norvegicus
gtcactgatgtttgtccctgtttaa

SEQ ID NO: 489765 - DNA, 25 bp, Rattus norvegicus
gtcactgcaataagcccaatgcttc

SEQ ID NO: 489766 - DNA, 25 bp, Rattus norvegicus
gtcactgcaatatgcccaatgcttc

SEQ ID NO: 489767 - DNA, 25 bp, Rattus norvegicus
gtcactgcactacagaacttcaagg

SEQ ID NO: 489768 - DNA, 25 bp, Rattus norvegicus
gtcactgcactagagaacttcaagg

SEQ ID NO: 489769 - DNA, 25 bp, Rattus norvegicus
gtcactgcactcctcggaagagcgt

SEQ ID NO: 489770 - DNA, 25 bp, Rattus norvegicus
gtcactgcactcgtcggaagagcgt

SEQ ID NO: 489771 - DNA, 25 bp, Rattus norvegicus
gtcactgcagagacaatcttctaca

SEQ ID NO: 489772 - DNA, 25 bp, Rattus norvegicus
gtcactgcagagtcaatcttctaca

SEQ ID NO: 489773 - DNA, 25 bp, Rattus norvegicus
gtcactgcagcaagaagctcgccgt

SEQ ID NO: 489774 - DNA, 25 bp, Rattus norvegicus
gtcactgcagcatgaagctcgccgt

SEQ ID NO: 489775 - DNA, 25 bp, Rattus norvegicus
gtcactgcagttaactgtgtctgaa

SEQ ID NO: 489776 - DNA, 25 bp, Rattus norvegicus
gtcactgcagtttactgtgtctgaa

SEQ ID NO: 489777 - DNA, 25 bp, Rattus norvegicus
gtcactgcatcaatcggatttgcgt

SEQ ID NO: 489778 - DNA, 25 bp, Rattus norvegicus
gtcactgcatcattcggatttgcgt

SEQ ID NO: 489779 - DNA, 25 bp, Rattus norvegicus
gtcactgccaaccaaagaacagttt

SEQ ID NO: 489780 - DNA, 25 bp, Rattus norvegicus
gtcactgccaacgaaagaacagttt

SEQ ID NO: 489781 - DNA, 25 bp, Rattus norvegicus
gtcactgccacaaaatagaacaagt

SEQ ID NO: 489782 - DNA, 25 bp, Rattus norvegicus
gtcactgccacataatagaacaagt

SEQ ID NO: 489783 - DNA, 25 bp, Rattus norvegicus
gtcactgccagtagaggtctgtgct

SEQ ID NO: 489784 - DNA, 25 bp, Rattus norvegicus
gtcactgccagttgaggtctgtgct

SEQ ID NO: 489785 - DNA, 25 bp, Rattus norvegicus
gtcactgcccaactatcagcttaaa

SEQ ID NO: 489786 - DNA, 25 bp, Rattus norvegicus
gtcactgcccaagtatcagcttaaa

SEQ ID NO: 489787 - DNA, 25 bp, Rattus norvegicus
gtcactgcccagaggtactgaggaa

SEQ ID NO: 489788 - DNA, 25 bp, Rattus norvegicus
gtcactgcccagtggtactgaggaa

SEQ ID NO: 489789 - DNA, 25 bp, Rattus norvegicus
gtcactgccgacatcaagaactttc

SEQ ID NO: 489790 - DNA, 25 bp, Rattus norvegicus
gtcactgccgacttcaagaactttc

SEQ ID NO: 489791 - DNA, 25 bp, Rattus norvegicus
gtcactgcctagaagcctctgagaa

SEQ ID NO: 489792 - DNA, 25 bp, Rattus norvegicus
gtcactgcctagtagcctctgagaa

SEQ ID NO: 489793 - DNA, 25 bp, Rattus norvegicus
gtcactgccttcagtttatttattt

SEQ ID NO: 489794 - DNA, 25 bp, Rattus norvegicus
gtcactgccttctgtttatttattt

SEQ ID NO: 489795 - DNA, 25 bp, Rattus norvegicus
gtcactgcgcttctgttataccatc

SEQ ID NO: 489796 - DNA, 25 bp, Rattus norvegicus
gtcactgcgcttgtgttataccatc

SEQ ID NO: 489797 - DNA, 25 bp, Rattus norvegicus
gtcactgcgtgaaatgctgatgtca

SEQ ID NO: 489798 - DNA, 25 bp, Rattus norvegicus
gtcactgcgtgatatgctgatgtca

SEQ ID NO: 489799 - DNA, 25 bp, Rattus norvegicus
gtcactgctgtcctgaggaatttga

SEQ ID NO: 489800 - DNA, 25 bp, Rattus norvegicus
gtcactgctgtcgtgaggaatttga

SEQ ID NO: 489801 - DNA, 25 bp, Rattus norvegicus
gtcactgcttcaatcactcttggat

SEQ ID NO: 489802 - DNA, 25 bp, Rattus norvegicus
gtcactgcttcattcactcttggat

SEQ ID NO: 489803 - DNA, 25 bp, Rattus norvegicus
gtcactgcttccaaataattctaaa

SEQ ID NO: 489804 - DNA, 25 bp, Rattus norvegicus
gtcactgcttcctaataattctaaa

SEQ ID NO: 489805 - DNA, 25 bp, Rattus norvegicus
gtcactggaatcattttgttccgat

SEQ ID NO: 489806 - DNA, 25 bp, Rattus norvegicus
gtcactggaatctttttgttccgat

SEQ ID NO: 489807 - DNA, 25 bp, Rattus norvegicus
gtcactggacagatagttcttccca

SEQ ID NO: 489808 - DNA, 25 bp, Rattus norvegicus
gtcactggacagttagttcttccca

SEQ ID NO: 489809 - DNA, 25 bp, Rattus norvegicus
gtcactggcacaagctcaatctcac

SEQ ID NO: 489810 - DNA, 25 bp, Rattus norvegicus
gtcactggcacatgctcaatctcac

SEQ ID NO: 489811 - DNA, 25 bp, Rattus norvegicus
gtcactggcggtaggaagccccaga

SEQ ID NO: 489812 - DNA, 25 bp, Rattus norvegicus
gtcactggcggttggaagccccaga

SEQ ID NO: 489813 - DNA, 25 bp, Rattus norvegicus
gtcactgggaatctactcatctgtt

SEQ ID NO: 489814 - DNA, 25 bp, Rattus norvegicus
gtcactgggaatgtactcatctgtt

SEQ ID NO: 489815 - DNA, 25 bp, Rattus norvegicus
gtcactgggagaaacacacagccac

SEQ ID NO: 489816 - DNA, 25 bp, Rattus norvegicus
gtcactgggagatacacacagccac

SEQ ID NO: 489817 - DNA, 25 bp, Rattus norvegicus
gtcactgggccaactatgttggtga

SEQ ID NO: 489818 - DNA, 25 bp, Rattus norvegicus
gtcactgggccatctatgttggtga

SEQ ID NO: 489819 - DNA, 25 bp, Rattus norvegicus
gtcactgggtttcatgctgggctca

SEQ ID NO: 489820 - DNA, 25 bp, Rattus norvegicus
gtcactgggtttgatgctgggctca

SEQ ID NO: 489821 - DNA, 25 bp, Rattus norvegicus
gtcactggtatcaaaaagacgcctg

SEQ ID NO: 489822 - DNA, 25 bp, Rattus norvegicus
gtcactggtatctaaaagacgcctg

SEQ ID NO: 489823 - DNA, 25 bp, Rattus norvegicus
gtcactggtgtaacttttgttctac

SEQ ID NO: 489824 - DNA, 25 bp, Rattus norvegicus
gtcactggtgtatcttttgttctac

SEQ ID NO: 489825 - DNA, 25 bp, Rattus norvegicus
gtcactggttagaactggccattct

SEQ ID NO: 489826 - DNA, 25 bp, Rattus norvegicus
gtcactggttagtactggccattct

SEQ ID NO: 489827 - DNA, 25 bp, Rattus norvegicus
gtcactggttgtacaggctagccta

SEQ ID NO: 489828 - DNA, 25 bp, Rattus norvegicus
gtcactggttgttcaggctagccta

SEQ ID NO: 489829 - DNA, 25 bp, Rattus norvegicus
gtcactgtaaccaagcttgcggata

SEQ ID NO: 489830 - DNA, 25 bp, Rattus norvegicus
gtcactgtaacctagcttgcggata

SEQ ID NO: 489831 - DNA, 25 bp, Rattus norvegicus
gtcactgtacctccaataatttggc

SEQ ID NO: 489832 - DNA, 25 bp, Rattus norvegicus
gtcactgtacctgcaataatttggc

SEQ ID NO: 489833 - DNA, 25 bp, Rattus norvegicus
gtcactgtagccatttatagcatta

SEQ ID NO: 489834 - DNA, 25 bp, Rattus norvegicus
gtcactgtagccttttatagcatta

SEQ ID NO: 489835 - DNA, 25 bp, Rattus norvegicus
gtcactgtagtccttgctctaaagt

SEQ ID NO: 489836 - DNA, 25 bp, Rattus norvegicus
gtcactgtagtcgttgctctaaagt

SEQ ID NO: 489837 - DNA, 25 bp, Rattus norvegicus
gtcactgtatgaactgctctggtta

SEQ ID NO: 489838 - DNA, 25 bp, Rattus norvegicus
gtcactgtatgatctgctctggtta

SEQ ID NO: 489839 - DNA, 25 bp, Rattus norvegicus
gtcactgtcacaccttgcctggaag

SEQ ID NO: 489840 - DNA, 25 bp, Rattus norvegicus
gtcactgtcacagcttgcctggaag

SEQ ID NO: 489841 - DNA, 25 bp, Rattus norvegicus
gtcactgtcagcatcatgcactgaa

SEQ ID NO: 489842 - DNA, 25 bp, Rattus norvegicus
gtcactgtcagcttcatgcactgaa

SEQ ID NO: 489843 - DNA, 25 bp, Rattus norvegicus
gtcactgtcagtatcgttgagttca

SEQ ID NO: 489844 - DNA, 25 bp, Rattus norvegicus
gtcactgtcagtcggcttcatttga

SEQ ID NO: 489845 - DNA, 25 bp, Rattus norvegicus
gtcactgtcagtgggcttcatttga

SEQ ID NO: 489846 - DNA, 25 bp, Rattus norvegicus
gtcactgtcagtttcgttgagttca

SEQ ID NO: 489847 - DNA, 25 bp, Rattus norvegicus
gtcactgtcatcagaatctgtcggc

SEQ ID NO: 489848 - DNA, 25 bp, Rattus norvegicus
gtcactgtcatctgaatctgtcggc

SEQ ID NO: 489849 - DNA, 25 bp, Rattus norvegicus
gtcactgtccggacattcaaaaagc

SEQ ID NO: 489850 - DNA, 25 bp, Rattus norvegicus
gtcactgtccggtcattcaaaaagc

SEQ ID NO: 489851 - DNA, 25 bp, Rattus norvegicus
gtcactgtcctgaatatcaaggaaa

SEQ ID NO: 489852 - DNA, 25 bp, Rattus norvegicus
gtcactgtcctgtatatcaaggaaa

SEQ ID NO: 489853 - DNA, 25 bp, Rattus norvegicus
gtcactgtccttaaagagcagctga

SEQ ID NO: 489854 - DNA, 25 bp, Rattus norvegicus
gtcactgtcctttaagagcagctga

SEQ ID NO: 489855 - DNA, 25 bp, Rattus norvegicus
gtcactgtctacatttgtatgtgtt

SEQ ID NO: 489856 - DNA, 25 bp, Rattus norvegicus
gtcactgtctacttttgtatgtgtt

SEQ ID NO: 489857 - DNA, 25 bp, Rattus norvegicus
gtcactgtgacaagcttttgtaatc

SEQ ID NO: 489858 - DNA, 25 bp, Rattus norvegicus
gtcactgtgacatgcttttgtaatc

SEQ ID NO: 489859 - DNA, 25 bp, Rattus norvegicus
gtcactgtgcagaccagcttagatg

SEQ ID NO: 489860 - DNA, 25 bp, Rattus norvegicus
gtcactgtgcagcatggagaccttt

SEQ ID NO: 489861 - DNA, 25 bp, Rattus norvegicus
gtcactgtgcaggatggagaccttt

SEQ ID NO: 489862 - DNA, 25 bp, Rattus norvegicus
gtcactgtgcagtccagcttagatg

SEQ ID NO: 489863 - DNA, 25 bp, Rattus norvegicus
gtcactgtgcatccaaacgtaatga

SEQ ID NO: 489864 - DNA, 25 bp, Rattus norvegicus
gtcactgtgcatgcaaacgtaatga

SEQ ID NO: 489865 - DNA, 25 bp, Rattus norvegicus
gtcactgtggacaggagcactgcaa

SEQ ID NO: 489866 - DNA, 25 bp, Rattus norvegicus
gtcactgtggactggagcactgcaa

SEQ ID NO: 489867 - DNA, 25 bp, Rattus norvegicus
gtcactgtggcaacttccaatatga

SEQ ID NO: 489868 - DNA, 25 bp, Rattus norvegicus
gtcactgtggcatcttccaatatga

SEQ ID NO: 489869 - DNA, 25 bp, Rattus norvegicus
gtcactgtgggcaggacaacggcta

SEQ ID NO: 489870 - DNA, 25 bp, Rattus norvegicus
gtcactgtgggctggacaacggcta

SEQ ID NO: 489871 - DNA, 25 bp, Rattus norvegicus
gtcactgtgggtacatcttatgcat

SEQ ID NO: 489872 - DNA, 25 bp, Rattus norvegicus
gtcactgtgggttcatcttatgcat

SEQ ID NO: 489873 - DNA, 25 bp, Rattus norvegicus
gtcactgtggtacgccggcattaaa

SEQ ID NO: 489874 - DNA, 25 bp, Rattus norvegicus
gtcactgtggtaggccggcattaaa

SEQ ID NO: 489875 - DNA, 25 bp, Rattus norvegicus
gtcactgtggtcacaattatggata

SEQ ID NO: 489876 - DNA, 25 bp, Rattus norvegicus
gtcactgtggtctcaattatggata

SEQ ID NO: 489877 - DNA, 25 bp, Rattus norvegicus
gtcactgtgtagatgatgctggctc

SEQ ID NO: 489878 - DNA, 25 bp, Rattus norvegicus
gtcactgtgtagttgatgctggctc

SEQ ID NO: 489879 - DNA, 25 bp, Rattus norvegicus
gtcactgtgtcacttcatgtgggaa

SEQ ID NO: 489880 - DNA, 25 bp, Rattus norvegicus
gtcactgtgtcagttcatgtgggaa

SEQ ID NO: 489881 - DNA, 25 bp, Rattus norvegicus
gtcactgtgtggcacaagaagttta

SEQ ID NO: 489882 - DNA, 25 bp, Rattus norvegicus
gtcactgtgtgggacaagaagttta

SEQ ID NO: 489883 - DNA, 25 bp, Rattus norvegicus
gtcactgtgtgtatctatgtagaca

SEQ ID NO: 489884 - DNA, 25 bp, Rattus norvegicus
gtcactgtgtgtttctatgtagaca

SEQ ID NO: 489885 - DNA, 25 bp, Rattus norvegicus
gtcactgttaacagctctattgaga

SEQ ID NO: 489886 - DNA, 25 bp, Rattus norvegicus
gtcactgttaactgctctattgaga

SEQ ID NO: 489887 - DNA, 25 bp, Rattus norvegicus
gtcactgttagtatagcttggcctc

SEQ ID NO: 489888 - DNA, 25 bp, Rattus norvegicus
gtcactgttagtttagcttggcctc

SEQ ID NO: 489889 - DNA, 25 bp, Rattus norvegicus
gtcactgttctcactgattgtgtaa

SEQ ID NO: 489890 - DNA, 25 bp, Rattus norvegicus
gtcactgttctctctgattgtgtaa

SEQ ID NO: 489891 - DNA, 25 bp, Rattus norvegicus
gtcactgttgatctgcattctgaat

SEQ ID NO: 489892 - DNA, 25 bp, Rattus norvegicus
gtcactgttgatgtgcattctgaat

SEQ ID NO: 489893 - DNA, 25 bp, Rattus norvegicus
gtcactgttgtcactttcactcaaa

SEQ ID NO: 489894 - DNA, 25 bp, Rattus norvegicus
gtcactgttgtctctttcactcaaa

SEQ ID NO: 489895 - DNA, 25 bp, Rattus norvegicus
gtcactgttgtgaacacaggcatag

SEQ ID NO: 489896 - DNA, 25 bp, Rattus norvegicus
gtcactgttgtgcattctggattca

SEQ ID NO: 489897 - DNA, 25 bp, Rattus norvegicus
gtcactgttgtggattctggattca

SEQ ID NO: 489898 - DNA, 25 bp, Rattus norvegicus
gtcactgttgtgtacacaggcatag

SEQ ID NO: 489899 - DNA, 25 bp, Rattus norvegicus
gtcactgtttgactctgaacttatg

SEQ ID NO: 489900 - DNA, 25 bp, Rattus norvegicus
gtcactgtttgagtctgaacttatg

SEQ ID NO: 489901 - DNA, 25 bp, Rattus norvegicus
gtcacttaaataatctacatctggt

SEQ ID NO: 489902 - DNA, 25 bp, Rattus norvegicus
gtcacttaaatattctacatctggt

SEQ ID NO: 489903 - DNA, 25 bp, Rattus norvegicus
gtcacttaaatgctcatgctctctg

SEQ ID NO: 489904 - DNA, 25 bp, Rattus norvegicus
gtcacttaaatggtcatgctctctg

SEQ ID NO: 489905 - DNA, 25 bp, Rattus norvegicus
gtcacttaacacaggagttgcttga

SEQ ID NO: 489906 - DNA, 25 bp, Rattus norvegicus
gtcacttaacactggagttgcttga

SEQ ID NO: 489907 - DNA, 25 bp, Rattus norvegicus
gtcacttaagacagccatgtactat

SEQ ID NO: 489908 - DNA, 25 bp, Rattus norvegicus
gtcacttaagactgccatgtactat

SEQ ID NO: 489909 - DNA, 25 bp, Rattus norvegicus
gtcacttaagagctaccacccggat

SEQ ID NO: 489910 - DNA, 25 bp, Rattus norvegicus
gtcacttaagaggtaccacccggat

SEQ ID NO: 489911 - DNA, 25 bp, Rattus norvegicus
gtcacttacactactgcaaacaatg

SEQ ID NO: 489912 - DNA, 25 bp, Rattus norvegicus
gtcacttacacttctgcaaacaatg

SEQ ID NO: 489913 - DNA, 25 bp, Rattus norvegicus
gtcacttacagcatgcaatccgagg

SEQ ID NO: 489914 - DNA, 25 bp, Rattus norvegicus
gtcacttacagcttgcaatccgagg

SEQ ID NO: 489915 - DNA, 25 bp, Rattus norvegicus
gtcacttaccttatggtctgggtag

SEQ ID NO: 489916 - DNA, 25 bp, Rattus norvegicus
gtcacttaccttttggtctgggtag

SEQ ID NO: 489917 - DNA, 25 bp, Rattus norvegicus
gtcacttactaaatgcttcttttca

SEQ ID NO: 489918 - DNA, 25 bp, Rattus norvegicus
gtcacttactaattgcttcttttca

SEQ ID NO: 489919 - DNA, 25 bp, Rattus norvegicus
gtcacttactctacaaacacaatat

SEQ ID NO: 489920 - DNA, 25 bp, Rattus norvegicus
gtcacttactcttcaaacacaatat

SEQ ID NO: 489921 - DNA, 25 bp, Rattus norvegicus
gtcacttactgtcacttctagagca

SEQ ID NO: 489922 - DNA, 25 bp, Rattus norvegicus
gtcacttactgtgacttctagagca

SEQ ID NO: 489923 - DNA, 25 bp, Rattus norvegicus
gtcacttaggcaaagttcatggcta

SEQ ID NO: 489924 - DNA, 25 bp, Rattus norvegicus
gtcacttaggcatagttcatggcta

SEQ ID NO: 489925 - DNA, 25 bp, Rattus norvegicus
gtcacttatatactcccaggtatgg

SEQ ID NO: 489926 - DNA, 25 bp, Rattus norvegicus
gtcacttatatagtcccaggtatgg

SEQ ID NO: 489927 - DNA, 25 bp, Rattus norvegicus
gtcacttcacggaatttactttctt

SEQ ID NO: 489928 - DNA, 25 bp, Rattus norvegicus
gtcacttcacggtatttactttctt

SEQ ID NO: 489929 - DNA, 25 bp, Rattus norvegicus
gtcacttcaggcactgtgggctaca

SEQ ID NO: 489930 - DNA, 25 bp, Rattus norvegicus
gtcacttcaggctctgtgggctaca

SEQ ID NO: 489931 - DNA, 25 bp, Rattus norvegicus
gtcacttcatttcgctggaactact

SEQ ID NO: 489932 - DNA, 25 bp, Rattus norvegicus
gtcacttcatttggctggaactact

SEQ ID NO: 489933 - DNA, 25 bp, Rattus norvegicus
gtcacttccctcctatgagaagctg

SEQ ID NO: 489934 - DNA, 25 bp, Rattus norvegicus
gtcacttccctcgtatgagaagctg

SEQ ID NO: 489935 - DNA, 25 bp, Rattus norvegicus
gtcacttcctagacactattctcta

SEQ ID NO: 489936 - DNA, 25 bp, Rattus norvegicus
gtcacttcctagtcactattctcta

SEQ ID NO: 489937 - DNA, 25 bp, Rattus norvegicus
gtcacttcctggaagtgtcctaatg

SEQ ID NO: 489938 - DNA, 25 bp, Rattus norvegicus
gtcacttcctggtagtgtcctaatg

SEQ ID NO: 489939 - DNA, 25 bp, Rattus norvegicus
gtcacttctagaaggtggtacctct

SEQ ID NO: 489940 - DNA, 25 bp, Rattus norvegicus
gtcacttctagatggtggtacctct

SEQ ID NO: 489941 - DNA, 25 bp, Rattus norvegicus
gtcacttctaggactgtggcaggct

SEQ ID NO: 489942 - DNA, 25 bp, Rattus norvegicus
gtcacttctaggtctgtggcaggct

SEQ ID NO: 489943 - DNA, 25 bp, Rattus norvegicus
gtcacttctccgagggaatgcattt

SEQ ID NO: 489944 - DNA, 25 bp, Rattus norvegicus
gtcacttctccgtgggaatgcattt

SEQ ID NO: 489945 - DNA, 25 bp, Rattus norvegicus
gtcacttctgaaaacttggctggta

SEQ ID NO: 489946 - DNA, 25 bp, Rattus norvegicus
gtcacttctgaatacttggctggta

SEQ ID NO: 489947 - DNA, 25 bp, Rattus norvegicus
gtcacttctgagcttgtcctttaca

SEQ ID NO: 489948 - DNA, 25 bp, Rattus norvegicus
gtcacttctgaggttgtcctttaca

SEQ ID NO: 489949 - DNA, 25 bp, Rattus norvegicus
gtcacttctggtatgagaggatgca

SEQ ID NO: 489950 - DNA, 25 bp, Rattus norvegicus
gtcacttctggtttgagaggatgca

SEQ ID NO: 489951 - DNA, 25 bp, Rattus norvegicus
gtcacttcttaactgaggctggcat

SEQ ID NO: 489952 - DNA, 25 bp, Rattus norvegicus
gtcacttcttaagtgaggctggcat

SEQ ID NO: 489953 - DNA, 25 bp, Rattus norvegicus
gtcacttcttgccagtgctagattt

SEQ ID NO: 489954 - DNA, 25 bp, Rattus norvegicus
gtcacttcttgcgagtgctagattt

SEQ ID NO: 489955 - DNA, 25 bp, Rattus norvegicus
gtcacttgaggtagcagttccggat

SEQ ID NO: 489956 - DNA, 25 bp, Rattus norvegicus
gtcacttgaggttgcagttccggat

SEQ ID NO: 489957 - DNA, 25 bp, Rattus norvegicus
gtcacttgatagattgccttttgca

SEQ ID NO: 489958 - DNA, 25 bp, Rattus norvegicus
gtcacttgatagtttgccttttgca

SEQ ID NO: 489959 - DNA, 25 bp, Rattus norvegicus
gtcacttgattgacattttcctcat

SEQ ID NO: 489960 - DNA, 25 bp, Rattus norvegicus
gtcacttgattgtcattttcctcat

SEQ ID NO: 489961 - DNA, 25 bp, Rattus norvegicus
gtcacttgcgtaagtacaaccatgt

SEQ ID NO: 489962 - DNA, 25 bp, Rattus norvegicus
gtcacttgcgtatgtacaaccatgt

SEQ ID NO: 489963 - DNA, 25 bp, Rattus norvegicus
gtcacttggtttacttactctgtaa

SEQ ID NO: 489964 - DNA, 25 bp, Rattus norvegicus
gtcacttggttttcttactctgtaa

SEQ ID NO: 489965 - DNA, 25 bp, Rattus norvegicus
gtcacttgtaagatattgctctcca

SEQ ID NO: 489966 - DNA, 25 bp, Rattus norvegicus
gtcacttgtaagttattgctctcca

SEQ ID NO: 489967 - DNA, 25 bp, Rattus norvegicus
gtcacttgtccacacactaaggcag

SEQ ID NO: 489968 - DNA, 25 bp, Rattus norvegicus
gtcacttgtccagacactaaggcag

SEQ ID NO: 489969 - DNA, 25 bp, Rattus norvegicus
gtcacttgtcccacttgtcaaggga

SEQ ID NO: 489970 - DNA, 25 bp, Rattus norvegicus
gtcacttgtccctcttgtcaaggga

SEQ ID NO: 489971 - DNA, 25 bp, Rattus norvegicus
gtcactttaaacagctgcggtcgtt

SEQ ID NO: 489972 - DNA, 25 bp, Rattus norvegicus
gtcactttaaactgctgcggtcgtt

SEQ ID NO: 489973 - DNA, 25 bp, Rattus norvegicus
gtcactttaacaaaccacaactctg

SEQ ID NO: 489974 - DNA, 25 bp, Rattus norvegicus
gtcactttaacataccacaactctg

SEQ ID NO: 489975 - DNA, 25 bp, Rattus norvegicus
gtcactttacccataactacagcat

SEQ ID NO: 489976 - DNA, 25 bp, Rattus norvegicus
gtcactttacccttaactacagcat

SEQ ID NO: 489977 - DNA, 25 bp, Rattus norvegicus
gtcactttacttcaatagatttcca

SEQ ID NO: 489978 - DNA, 25 bp, Rattus norvegicus
gtcactttacttgaatagatttcca

SEQ ID NO: 489979 - DNA, 25 bp, Rattus norvegicus
gtcactttagagacgagaacctcag

SEQ ID NO: 489980 - DNA, 25 bp, Rattus norvegicus
gtcactttagagtcgagaacctcag

SEQ ID NO: 489981 - DNA, 25 bp, Rattus norvegicus
gtcactttataaacttggtcctatt

SEQ ID NO: 489982 - DNA, 25 bp, Rattus norvegicus
gtcactttataatcttggtcctatt

SEQ ID NO: 489983 - DNA, 25 bp, Rattus norvegicus
gtcactttcatgaaggctccagcgg

SEQ ID NO: 489984 - DNA, 25 bp, Rattus norvegicus
gtcactttcatgtaggctccagcgg

SEQ ID NO: 489985 - DNA, 25 bp, Rattus norvegicus
gtcactttcctgactggagggcaga

SEQ ID NO: 489986 - DNA, 25 bp, Rattus norvegicus
gtcactttcctgtctggagggcaga

SEQ ID NO: 489987 - DNA, 25 bp, Rattus norvegicus
gtcactttctgaagtcactttcttt

SEQ ID NO: 489988 - DNA, 25 bp, Rattus norvegicus
gtcactttctgatgtcactttcttt

SEQ ID NO: 489989 - DNA, 25 bp, Rattus norvegicus
gtcactttgccaaggattccatgag

SEQ ID NO: 489990 - DNA, 25 bp, Rattus norvegicus
gtcactttgccatggattccatgag

SEQ ID NO: 489991 - DNA, 25 bp, Rattus norvegicus
gtcactttgctgaacacagcctgga

SEQ ID NO: 489992 - DNA, 25 bp, Rattus norvegicus
gtcactttgctgtacacagcctgga

SEQ ID NO: 489993 - DNA, 25 bp, Rattus norvegicus
gtcactttggaactaaattgcctcg

SEQ ID NO: 489994 - DNA, 25 bp, Rattus norvegicus
gtcactttggaagtaaattgcctcg

SEQ ID NO: 489995 - DNA, 25 bp, Rattus norvegicus
gtcactttggatcaagttacctcag

SEQ ID NO: 489996 - DNA, 25 bp, Rattus norvegicus
gtcactttggatgaagttacctcag

SEQ ID NO: 489997 - DNA, 25 bp, Rattus norvegicus
gtcactttgtgaacgatgggcgtcc

SEQ ID NO: 489998 - DNA, 25 bp, Rattus norvegicus
gtcactttgtgatcgatgggcgtcc

SEQ ID NO: 489999 - DNA, 25 bp, Rattus norvegicus
gtcactttgttcaatggtacccatc

SEQ ID NO: 490000 - DNA, 25 bp, Rattus norvegicus
gtcactttgttctatggtacccatc

SEQ ID NO: 490001 - DNA, 25 bp, Rattus norvegicus
gtcactttgttgatgttcccttcat

SEQ ID NO: 490002 - DNA, 25 bp, Rattus norvegicus
gtcactttgttgttgttcccttcat

SEQ ID NO: 490003 - DNA, 25 bp, Rattus norvegicus
gtcacttttaatctcagtgccccag

SEQ ID NO: 490004 - DNA, 25 bp, Rattus norvegicus
gtcacttttaatgtcagtgccccag

SEQ ID NO: 490005 - DNA, 25 bp, Rattus norvegicus
gtcacttttcccagcacaaatgcat

SEQ ID NO: 490006 - DNA, 25 bp, Rattus norvegicus
gtcacttttccctgcacaaatgcat

SEQ ID NO: 490007 - DNA, 25 bp, Rattus norvegicus
gtcagaaaaattatgccctccctca

SEQ ID NO: 490008 - DNA, 25 bp, Rattus norvegicus
gtcagaaaaattttgccctccctca

SEQ ID NO: 490009 - DNA, 25 bp, Rattus norvegicus
gtcagaaaacgtctccagggattac

SEQ ID NO: 490010 - DNA, 25 bp, Rattus norvegicus
gtcagaaaacgtgtccagggattac

SEQ ID NO: 490011 - DNA, 25 bp, Rattus norvegicus
gtcagaaaaggtcactggctacctg

SEQ ID NO: 490012 - DNA, 25 bp, Rattus norvegicus
gtcagaaaaggtgactggctacctg

SEQ ID NO: 490013 - DNA, 25 bp, Rattus norvegicus
gtcagaaagcctcgttagccacgga

SEQ ID NO: 490014 - DNA, 25 bp, Rattus norvegicus
gtcagaaagcctggttagccacgga

SEQ ID NO: 490015 - DNA, 25 bp, Rattus norvegicus
gtcagaaaggtactgttggttccaa

SEQ ID NO: 490016 - DNA, 25 bp, Rattus norvegicus
gtcagaaaggtagtgttggttccaa

SEQ ID NO: 490017 - DNA, 25 bp, Rattus norvegicus
gtcagaaatagcagcctccatgtct

SEQ ID NO: 490018 - DNA, 25 bp, Rattus norvegicus
gtcagaaatagctgcctccatgtct

SEQ ID NO: 490019 - DNA, 25 bp, Rattus norvegicus
gtcagaaatcccattctttgctttc

SEQ ID NO: 490020 - DNA, 25 bp, Rattus norvegicus
gtcagaaatccctttctttgctttc

SEQ ID NO: 490021 - DNA, 25 bp, Rattus norvegicus
gtcagaacaaccaacacctgtgtgc

SEQ ID NO: 490022 - DNA, 25 bp, Rattus norvegicus
gtcagaacaacctacacctgtgtgc

SEQ ID NO: 490023 - DNA, 25 bp, Rattus norvegicus
gtcagaacaagtctccaatggccct

SEQ ID NO: 490024 - DNA, 25 bp, Rattus norvegicus
gtcagaacaagtgtccaatggccct

SEQ ID NO: 490025 - DNA, 25 bp, Rattus norvegicus
gtcagaacagttatatctcttagga

SEQ ID NO: 490026 - DNA, 25 bp, Rattus norvegicus
gtcagaacagttttatctcttagga

SEQ ID NO: 490027 - DNA, 25 bp, Rattus norvegicus
gtcagaacatgtacactcatagtga

SEQ ID NO: 490028 - DNA, 25 bp, Rattus norvegicus
gtcagaacatgttcactcatagtga

SEQ ID NO: 490029 - DNA, 25 bp, Rattus norvegicus
gtcagaaccagccaaggtgacccaa

SEQ ID NO: 490030 - DNA, 25 bp, Rattus norvegicus
gtcagaaccagcgaaggtgacccaa

SEQ ID NO: 490031 - DNA, 25 bp, Rattus norvegicus
gtcagaaccaggaacaacatcctct

SEQ ID NO: 490032 - DNA, 25 bp, Rattus norvegicus
gtcagaaccaggtacaacatcctct

SEQ ID NO: 490033 - DNA, 25 bp, Rattus norvegicus
gtcagaaccatgaggctctgttttt

SEQ ID NO: 490034 - DNA, 25 bp, Rattus norvegicus
gtcagaaccatgtggctctgttttt

SEQ ID NO: 490035 - DNA, 25 bp, Rattus norvegicus
gtcagaacccctctagcaggagcag

SEQ ID NO: 490036 - DNA, 25 bp, Rattus norvegicus
gtcagaacccctgtagcaggagcag

SEQ ID NO: 490037 - DNA, 25 bp, Rattus norvegicus
gtcagaaccctgacatctttctttt

SEQ ID NO: 490038 - DNA, 25 bp, Rattus norvegicus
gtcagaaccctgtcatctttctttt

SEQ ID NO: 490039 - DNA, 25 bp, Rattus norvegicus
gtcagaacctaccaggacctatgtg

SEQ ID NO: 490040 - DNA, 25 bp, Rattus norvegicus
gtcagaacctacgaggacctatgtg

SEQ ID NO: 490041 - DNA, 25 bp, Rattus norvegicus
gtcagaacctagctcagatccatac

SEQ ID NO: 490042 - DNA, 25 bp, Rattus norvegicus
gtcagaacctaggtcagatccatac

SEQ ID NO: 490043 - DNA, 25 bp, Rattus norvegicus
gtcagaactcacaggcttctctggg

SEQ ID NO: 490044 - DNA, 25 bp, Rattus norvegicus
gtcagaactcactggcttctctggg

SEQ ID NO: 490045 - DNA, 25 bp, Rattus norvegicus
gtcagaacttttctcttagccagca

SEQ ID NO: 490046 - DNA, 25 bp, Rattus norvegicus
gtcagaacttttgtcttagccagca

SEQ ID NO: 490047 - DNA, 25 bp, Rattus norvegicus
gtcagaagaaagagccacaccccta

SEQ ID NO: 490048 - DNA, 25 bp, Rattus norvegicus
gtcagaagaaagtgccacaccccta

SEQ ID NO: 490049 - DNA, 25 bp, Rattus norvegicus
gtcagaagactcacactatctataa

SEQ ID NO: 490050 - DNA, 25 bp, Rattus norvegicus
gtcagaagactctcactatctataa

SEQ ID NO: 490051 - DNA, 25 bp, Rattus norvegicus
gtcagaagagcccttgaccaccttg

SEQ ID NO: 490052 - DNA, 25 bp, Rattus norvegicus
gtcagaagagccgttgaccaccttg

SEQ ID NO: 490053 - DNA, 25 bp, Rattus norvegicus
gtcagaagatgacttgcggccagat

SEQ ID NO: 490054 - DNA, 25 bp, Rattus norvegicus
gtcagaagatgagttgcggccagat

SEQ ID NO: 490055 - DNA, 25 bp, Rattus norvegicus
gtcagaagcaacagcctcacgtaat

SEQ ID NO: 490056 - DNA, 25 bp, Rattus norvegicus
gtcagaagcaactgcctcacgtaat

SEQ ID NO: 490057 - DNA, 25 bp, Rattus norvegicus
gtcagaagcctaagccacgctggga

SEQ ID NO: 490058 - DNA, 25 bp, Rattus norvegicus
gtcagaagcctatgccacgctggga

SEQ ID NO: 490059 - DNA, 25 bp, Rattus norvegicus
gtcagaagctctcagtacttcagat

SEQ ID NO: 490060 - DNA, 25 bp, Rattus norvegicus
gtcagaagctctgagtacttcagat

SEQ ID NO: 490061 - DNA, 25 bp, Rattus norvegicus
gtcagaagctggacacgtacgtgtg

SEQ ID NO: 490062 - DNA, 25 bp, Rattus norvegicus
gtcagaagctggtcacgtacgtgtg

SEQ ID NO: 490063 - DNA, 25 bp, Rattus norvegicus
gtcagaaggagcagctcctggcacc

SEQ ID NO: 490064 - DNA, 25 bp, Rattus norvegicus
gtcagaaggagctgctcctggcacc

SEQ ID NO: 490065 - DNA, 25 bp, Rattus norvegicus
gtcagaagtggcataccctgtctct

SEQ ID NO: 490066 - DNA, 25 bp, Rattus norvegicus
gtcagaagtggcttaccctgtctct

SEQ ID NO: 490067 - DNA, 25 bp, Rattus norvegicus
gtcagaatacccacggaatccagat

SEQ ID NO: 490068 - DNA, 25 bp, Rattus norvegicus
gtcagaataccctcggaatccagat

SEQ ID NO: 490069 - DNA, 25 bp, Rattus norvegicus
gtcagaatagcacctgtcagaccag

SEQ ID NO: 490070 - DNA, 25 bp, Rattus norvegicus
gtcagaatagcagctgtcagaccag

SEQ ID NO: 490071 - DNA, 25 bp, Rattus norvegicus
gtcagaatattccaacacagtgtgt

SEQ ID NO: 490072 - DNA, 25 bp, Rattus norvegicus
gtcagaatattcgaacacagtgtgt

SEQ ID NO: 490073 - DNA, 25 bp, Rattus norvegicus
gtcagaatcctcaagttttcactcc

SEQ ID NO: 490074 - DNA, 25 bp, Rattus norvegicus
gtcagaatcctctagttttcactcc

SEQ ID NO: 490075 - DNA, 25 bp, Rattus norvegicus
gtcagaatctcacccatgtgttgca

SEQ ID NO: 490076 - DNA, 25 bp, Rattus norvegicus
gtcagaatctcagccatgtgttgca

SEQ ID NO: 490077 - DNA, 25 bp, Rattus norvegicus
gtcagaatctctaagtgtcaacgta

SEQ ID NO: 490078 - DNA, 25 bp, Rattus norvegicus
gtcagaatctcttagtgtcaacgta

SEQ ID NO: 490079 - DNA, 25 bp, Rattus norvegicus
gtcagaatctgcacacccttgagaa

SEQ ID NO: 490080 - DNA, 25 bp, Rattus norvegicus
gtcagaatctgctcacccttgagaa

SEQ ID NO: 490081 - DNA, 25 bp, Rattus norvegicus
gtcagaatgaaccatccagccggta

SEQ ID NO: 490082 - DNA, 25 bp, Rattus norvegicus
gtcagaatgaacgatccagccggta

SEQ ID NO: 490083 - DNA, 25 bp, Rattus norvegicus
gtcagaatgcataatatacagtgtg

SEQ ID NO: 490084 - DNA, 25 bp, Rattus norvegicus
gtcagaatgcattatatacagtgtg

SEQ ID NO: 490085 - DNA, 25 bp, Rattus norvegicus
gtcagaatgctgctatcatcctgtt

SEQ ID NO: 490086 - DNA, 25 bp, Rattus norvegicus
gtcagaatgctggtatcatcctgtt

SEQ ID NO: 490087 - DNA, 25 bp, Rattus norvegicus
gtcagaattttgatgagctgctaag

SEQ ID NO: 490088 - DNA, 25 bp, Rattus norvegicus
gtcagaattttgttgagctgctaag

SEQ ID NO: 490089 - DNA, 25 bp, Rattus norvegicus
gtcagacaactgagtcctgccggat

SEQ ID NO: 490090 - DNA, 25 bp, Rattus norvegicus
gtcagacaactgtgtcctgccggat

SEQ ID NO: 490091 - DNA, 25 bp, Rattus norvegicus
gtcagacaatgtattctcacctcaa

SEQ ID NO: 490092 - DNA, 25 bp, Rattus norvegicus
gtcagacaatgttttctcacctcaa

SEQ ID NO: 490093 - DNA, 25 bp, Rattus norvegicus
gtcagacacagcatccaccatttta

SEQ ID NO: 490094 - DNA, 25 bp, Rattus norvegicus
gtcagacacagcttccaccatttta

SEQ ID NO: 490095 - DNA, 25 bp, Rattus norvegicus
gtcagacactccataaaaatcattg

SEQ ID NO: 490096 - DNA, 25 bp, Rattus norvegicus
gtcagacactccttaaaaatcattg

SEQ ID NO: 490097 - DNA, 25 bp, Rattus norvegicus
gtcagacactggacttgatcctctg

SEQ ID NO: 490098 - DNA, 25 bp, Rattus norvegicus
gtcagacactggtcttgatcctctg

SEQ ID NO: 490099 - DNA, 25 bp, Rattus norvegicus
gtcagacacttacggatgcgcattt

SEQ ID NO: 490100 - DNA, 25 bp, Rattus norvegicus
gtcagacacttagggatgcgcattt

SEQ ID NO: 490101 - DNA, 25 bp, Rattus norvegicus
gtcagacagacaacgtactatcctt

SEQ ID NO: 490102 - DNA, 25 bp, Rattus norvegicus
gtcagacagacatcgtactatcctt

SEQ ID NO: 490103 - DNA, 25 bp, Rattus norvegicus
gtcagacagaccaaggcacatagaa

SEQ ID NO: 490104 - DNA, 25 bp, Rattus norvegicus
gtcagacagacctaggcacatagaa

SEQ ID NO: 490105 - DNA, 25 bp, Rattus norvegicus
gtcagacagatgattgcttcccgag

SEQ ID NO: 490106 - DNA, 25 bp, Rattus norvegicus
gtcagacagatgtttgcttcccgag

SEQ ID NO: 490107 - DNA, 25 bp, Rattus norvegicus
gtcagacaggagctgcacatgcttt

SEQ ID NO: 490108 - DNA, 25 bp, Rattus norvegicus
gtcagacaggaggtgcacatgcttt

SEQ ID NO: 490109 - DNA, 25 bp, Rattus norvegicus
gtcagacagtctctgtttcgaccag

SEQ ID NO: 490110 - DNA, 25 bp, Rattus norvegicus
gtcagacagtctgtgtttcgaccag

SEQ ID NO: 490111 - DNA, 25 bp, Rattus norvegicus
gtcagacatcaaagtcatgggcctt

SEQ ID NO: 490112 - DNA, 25 bp, Rattus norvegicus
gtcagacatcaatgtcatgggcctt

SEQ ID NO: 490113 - DNA, 25 bp, Rattus norvegicus
gtcagacatcatagtataatacctt

SEQ ID NO: 490114 - DNA, 25 bp, Rattus norvegicus
gtcagacatcattgtataatacctt

SEQ ID NO: 490115 - DNA, 25 bp, Rattus norvegicus
gtcagacatccaagtttacatcgtt

SEQ ID NO: 490116 - DNA, 25 bp, Rattus norvegicus
gtcagacatccatgtttacatcgtt

SEQ ID NO: 490117 - DNA, 25 bp, Rattus norvegicus
gtcagacatctacatgctcaatttg

SEQ ID NO: 490118 - DNA, 25 bp, Rattus norvegicus
gtcagacatctagatgctcaatttg

SEQ ID NO: 490119 - DNA, 25 bp, Rattus norvegicus
gtcagacatctgcttggttgtacaa

SEQ ID NO: 490120 - DNA, 25 bp, Rattus norvegicus
gtcagacatctggttggttgtacaa

SEQ ID NO: 490121 - DNA, 25 bp, Rattus norvegicus
gtcagacatgataccgggaagaatt

SEQ ID NO: 490122 - DNA, 25 bp, Rattus norvegicus
gtcagacatgattccgggaagaatt

SEQ ID NO: 490123 - DNA, 25 bp, Rattus norvegicus
gtcagacatgtacctgatctgccgc

SEQ ID NO: 490124 - DNA, 25 bp, Rattus norvegicus
gtcagacatgtagctgatctgccgc

SEQ ID NO: 490125 - DNA, 25 bp, Rattus norvegicus
gtcagaccaactatgacgtcttcga

SEQ ID NO: 490126 - DNA, 25 bp, Rattus norvegicus
gtcagaccaactttgacgtcttcga

SEQ ID NO: 490127 - DNA, 25 bp, Rattus norvegicus
gtcagaccacgtattgatcctgttg

SEQ ID NO: 490128 - DNA, 25 bp, Rattus norvegicus
gtcagaccacgttttgatcctgttg

SEQ ID NO: 490129 - DNA, 25 bp, Rattus norvegicus
gtcagaccagttctatcgctacaag

SEQ ID NO: 490130 - DNA, 25 bp, Rattus norvegicus
gtcagaccagttgtatcgctacaag

SEQ ID NO: 490131 - DNA, 25 bp, Rattus norvegicus
gtcagaccctaacatggctacacgg

SEQ ID NO: 490132 - DNA, 25 bp, Rattus norvegicus
gtcagaccctaagatggctacacgg

SEQ ID NO: 490133 - DNA, 25 bp, Rattus norvegicus
gtcagaccggccagaaggtggctct

SEQ ID NO: 490134 - DNA, 25 bp, Rattus norvegicus
gtcagaccggcctgaaggtggctct

SEQ ID NO: 490135 - DNA, 25 bp, Rattus norvegicus
gtcagacctcttcagaggacacggg

SEQ ID NO: 490136 - DNA, 25 bp, Rattus norvegicus
gtcagacctcttgagaggacacggg

SEQ ID NO: 490137 - DNA, 25 bp, Rattus norvegicus
gtcagaccttaactgttttcaccgt

SEQ ID NO: 490138 - DNA, 25 bp, Rattus norvegicus
gtcagaccttaagtgttttcaccgt

SEQ ID NO: 490139 - DNA, 25 bp, Rattus norvegicus
gtcagacgcaagcactacagtcagt

SEQ ID NO: 490140 - DNA, 25 bp, Rattus norvegicus
gtcagacgcaaggactacagtcagt

SEQ ID NO: 490141 - DNA, 25 bp, Rattus norvegicus
gtcagacggtttatagctatttgaa

SEQ ID NO: 490142 - DNA, 25 bp, Rattus norvegicus
gtcagacggtttttagctatttgaa

SEQ ID NO: 490143 - DNA, 25 bp, Rattus norvegicus
gtcagactaccgaaattgtaaccat

SEQ ID NO: 490144 - DNA, 25 bp, Rattus norvegicus
gtcagactaccgtaattgtaaccat

SEQ ID NO: 490145 - DNA, 25 bp, Rattus norvegicus
gtcagactcaacacagaaaagccct

SEQ ID NO: 490146 - DNA, 25 bp, Rattus norvegicus
gtcagactcaactcagaaaagccct

SEQ ID NO: 490147 - DNA, 25 bp, Rattus norvegicus
gtcagactcactattatttcaatcc

SEQ ID NO: 490148 - DNA, 25 bp, Rattus norvegicus
gtcagactcacttttatttcaatcc

SEQ ID NO: 490149 - DNA, 25 bp, Rattus norvegicus
gtcagactcagtacattcttacata

SEQ ID NO: 490150 - DNA, 25 bp, Rattus norvegicus
gtcagactcagttcattcttacata

SEQ ID NO: 490151 - DNA, 25 bp, Rattus norvegicus
gtcagactcatacaatactcaatag

SEQ ID NO: 490152 - DNA, 25 bp, Rattus norvegicus
gtcagactcatagaatactcaatag

SEQ ID NO: 490153 - DNA, 25 bp, Rattus norvegicus
gtcagactccaaacagagctctcct

SEQ ID NO: 490154 - DNA, 25 bp, Rattus norvegicus
gtcagactccaatcagagctctcct

SEQ ID NO: 490155 - DNA, 25 bp, Rattus norvegicus
gtcagactccacactttaaagcaga

SEQ ID NO: 490156 - DNA, 25 bp, Rattus norvegicus
gtcagactccactctttaaagcaga

SEQ ID NO: 490157 - DNA, 25 bp, Rattus norvegicus
gtcagactccggcttttcgatagtg

SEQ ID NO: 490158 - DNA, 25 bp, Rattus norvegicus
gtcagactccgggttttcgatagtg

SEQ ID NO: 490159 - DNA, 25 bp, Rattus norvegicus
gtcagactcctgacactataaatgg

SEQ ID NO: 490160 - DNA, 25 bp, Rattus norvegicus
gtcagactcctgtcactataaatgg

SEQ ID NO: 490161 - DNA, 25 bp, Rattus norvegicus
gtcagactgcccaggaatggagcac

SEQ ID NO: 490162 - DNA, 25 bp, Rattus norvegicus
gtcagactgccctggaatggagcac

SEQ ID NO: 490163 - DNA, 25 bp, Rattus norvegicus
gtcagactgggacttatactactaa

SEQ ID NO: 490164 - DNA, 25 bp, Rattus norvegicus
gtcagactgggagttatactactaa

SEQ ID NO: 490165 - DNA, 25 bp, Rattus norvegicus
gtcagactgtgtagtttcttaaaga

SEQ ID NO: 490166 - DNA, 25 bp, Rattus norvegicus
gtcagactgtgttgtttcttaaaga

SEQ ID NO: 490167 - DNA, 25 bp, Rattus norvegicus
gtcagagaaccaagatgcccttcaa

SEQ ID NO: 490168 - DNA, 25 bp, Rattus norvegicus
gtcagagaaccatgatgcccttcaa

SEQ ID NO: 490169 - DNA, 25 bp, Rattus norvegicus
gtcagagaatgcagaccactccaca

SEQ ID NO: 490170 - DNA, 25 bp, Rattus norvegicus
gtcagagaatgctgaccactccaca

SEQ ID NO: 490171 - DNA, 25 bp, Rattus norvegicus
gtcagagaatttactgtgaacagct

SEQ ID NO: 490172 - DNA, 25 bp, Rattus norvegicus
gtcagagaattttctgtgaacagct

SEQ ID NO: 490173 - DNA, 25 bp, Rattus norvegicus
gtcagagacaagagcactacagtat

SEQ ID NO: 490174 - DNA, 25 bp, Rattus norvegicus
gtcagagacaagatcaaaagtgcca

SEQ ID NO: 490175 - DNA, 25 bp, Rattus norvegicus
gtcagagacaagtgcactacagtat

SEQ ID NO: 490176 - DNA, 25 bp, Rattus norvegicus
gtcagagacaagttcaaaagtgcca

SEQ ID NO: 490177 - DNA, 25 bp, Rattus norvegicus
gtcagagacacacctagatgccggt

SEQ ID NO: 490178 - DNA, 25 bp, Rattus norvegicus
gtcagagacacagctagatgccggt

SEQ ID NO: 490179 - DNA, 25 bp, Rattus norvegicus
gtcagagacattattcacgtcgcca

SEQ ID NO: 490180 - DNA, 25 bp, Rattus norvegicus
gtcagagacatttttcacgtcgcca

SEQ ID NO: 490181 - DNA, 25 bp, Rattus norvegicus
gtcagagaccatagggccatcttca

SEQ ID NO: 490182 - DNA, 25 bp, Rattus norvegicus
gtcagagaccattgggccatcttca

SEQ ID NO: 490183 - DNA, 25 bp, Rattus norvegicus
gtcagagacggcctggaccatgtca

SEQ ID NO: 490184 - DNA, 25 bp, Rattus norvegicus
gtcagagacggcgtggaccatgtca

SEQ ID NO: 490185 - DNA, 25 bp, Rattus norvegicus
gtcagagacttaagcccagcatgga

SEQ ID NO: 490186 - DNA, 25 bp, Rattus norvegicus
gtcagagacttatgcccagcatgga

SEQ ID NO: 490187 - DNA, 25 bp, Rattus norvegicus
gtcagagagactactggaggtcaaa

SEQ ID NO: 490188 - DNA, 25 bp, Rattus norvegicus
gtcagagagacttctggaggtcaaa

SEQ ID NO: 490189 - DNA, 25 bp, Rattus norvegicus
gtcagagagattcctgcctatcgca

SEQ ID NO: 490190 - DNA, 25 bp, Rattus norvegicus
gtcagagagattgctgcctatcgca

SEQ ID NO: 490191 - DNA, 25 bp, Rattus norvegicus
gtcagagcacctacagattgggaat

SEQ ID NO: 490192 - DNA, 25 bp, Rattus norvegicus
gtcagagcaccttcagattgggaat

SEQ ID NO: 490193 - DNA, 25 bp, Rattus norvegicus
gtcagagcagctatgagcctccatc

SEQ ID NO: 490194 - DNA, 25 bp, Rattus norvegicus
gtcagagcagctttgagcctccatc

SEQ ID NO: 490195 - DNA, 25 bp, Rattus norvegicus
gtcagagccaaaagtgtctgcccct

SEQ ID NO: 490196 - DNA, 25 bp, Rattus norvegicus
gtcagagccaaatgtgtctgcccct

SEQ ID NO: 490197 - DNA, 25 bp, Rattus norvegicus
gtcagagccctgacatggaacttta

SEQ ID NO: 490198 - DNA, 25 bp, Rattus norvegicus
gtcagagccctgtcatggaacttta

SEQ ID NO: 490199 - DNA, 25 bp, Rattus norvegicus
gtcagagcctgactcagtggtctaa

SEQ ID NO: 490200 - DNA, 25 bp, Rattus norvegicus
gtcagagcctgagtcagtggtctaa

SEQ ID NO: 490201 - DNA, 25 bp, Rattus norvegicus
gtcagagcgagcatggagtgcctca

SEQ ID NO: 490202 - DNA, 25 bp, Rattus norvegicus
gtcagagcgagcttggagtgcctca

SEQ ID NO: 490203 - DNA, 25 bp, Rattus norvegicus
gtcagagcgctgacctggtcagcat

SEQ ID NO: 490204 - DNA, 25 bp, Rattus norvegicus
gtcagagcgctgtcctggtcagcat

SEQ ID NO: 490205 - DNA, 25 bp, Rattus norvegicus
gtcagagctgctaccagtaaggcca

SEQ ID NO: 490206 - DNA, 25 bp, Rattus norvegicus
gtcagagctgcttccagtaaggcca

SEQ ID NO: 490207 - DNA, 25 bp, Rattus norvegicus
gtcagagctgtgaccacagctccac

SEQ ID NO: 490208 - DNA, 25 bp, Rattus norvegicus
gtcagagctgtgtccacagctccac

SEQ ID NO: 490209 - DNA, 25 bp, Rattus norvegicus
gtcagagcttctcccagggctaatt

SEQ ID NO: 490210 - DNA, 25 bp, Rattus norvegicus
gtcagagcttctgccagggctaatt

SEQ ID NO: 490211 - DNA, 25 bp, Rattus norvegicus
gtcagagcttgacccgcggcaaaga

SEQ ID NO: 490212 - DNA, 25 bp, Rattus norvegicus
gtcagagcttgagccgcggcaaaga

SEQ ID NO: 490213 - DNA, 25 bp, Rattus norvegicus
gtcagagcttgcatcgttacagtca

SEQ ID NO: 490214 - DNA, 25 bp, Rattus norvegicus
gtcagagcttgccttgtgctgtcta

SEQ ID NO: 490215 - DNA, 25 bp, Rattus norvegicus
gtcagagcttgcgttgtgctgtcta

SEQ ID NO: 490216 - DNA, 25 bp, Rattus norvegicus
gtcagagcttgcttcgttacagtca

SEQ ID NO: 490217 - DNA, 25 bp, Rattus norvegicus
gtcagaggacaccttgcaggagtct

SEQ ID NO: 490218 - DNA, 25 bp, Rattus norvegicus
gtcagaggacacgttgcaggagtct

SEQ ID NO: 490219 - DNA, 25 bp, Rattus norvegicus
gtcagaggagccaggtctacttact

SEQ ID NO: 490220 - DNA, 25 bp, Rattus norvegicus
gtcagaggagcctggtctacttact

SEQ ID NO: 490221 - DNA, 25 bp, Rattus norvegicus
gtcagaggcactattggtaatgtaa

SEQ ID NO: 490222 - DNA, 25 bp, Rattus norvegicus
gtcagaggcacttttggtaatgtaa

SEQ ID NO: 490223 - DNA, 25 bp, Rattus norvegicus
gtcagaggccgaattcactaagtag

SEQ ID NO: 490224 - DNA, 25 bp, Rattus norvegicus
gtcagaggccgatttcactaagtag

SEQ ID NO: 490225 - DNA, 25 bp, Rattus norvegicus
gtcagagggcaacttacggtaatcg

SEQ ID NO: 490226 - DNA, 25 bp, Rattus norvegicus
gtcagagggcaagttacggtaatcg

SEQ ID NO: 490227 - DNA, 25 bp, Rattus norvegicus
gtcagagggcagagcacgtagatca

SEQ ID NO: 490228 - DNA, 25 bp, Rattus norvegicus
gtcagagggcagtgcacgtagatca

SEQ ID NO: 490229 - DNA, 25 bp, Rattus norvegicus
gtcagagggccacactcaggagtca

SEQ ID NO: 490230 - DNA, 25 bp, Rattus norvegicus
gtcagagggccagactcaggagtca

SEQ ID NO: 490231 - DNA, 25 bp, Rattus norvegicus
gtcagaggtcatactcatgttcctg

SEQ ID NO: 490232 - DNA, 25 bp, Rattus norvegicus
gtcagaggtcattctcatgttcctg

SEQ ID NO: 490233 - DNA, 25 bp, Rattus norvegicus
gtcagaggtcccaggtggtaactaa

SEQ ID NO: 490234 - DNA, 25 bp, Rattus norvegicus
gtcagaggtccctggtggtaactaa

SEQ ID NO: 490235 - DNA, 25 bp, Rattus norvegicus
gtcagaggtctcatactttgtttct

SEQ ID NO: 490236 - DNA, 25 bp, Rattus norvegicus
gtcagaggtctcttactttgtttct

SEQ ID NO: 490237 - DNA, 25 bp, Rattus norvegicus
gtcagaggtgcccatcttgatgata

SEQ ID NO: 490238 - DNA, 25 bp, Rattus norvegicus
gtcagaggtgccgatcttgatgata

SEQ ID NO: 490239 - DNA, 25 bp, Rattus norvegicus
gtcagagtaatccttttcatgccag

SEQ ID NO: 490240 - DNA, 25 bp, Rattus norvegicus
gtcagagtaatcgttttcatgccag

SEQ ID NO: 490241 - DNA, 25 bp, Rattus norvegicus
gtcagagtacggagtcacggcacag

SEQ ID NO: 490242 - DNA, 25 bp, Rattus norvegicus
gtcagagtacggtgtcacggcacag

SEQ ID NO: 490243 - DNA, 25 bp, Rattus norvegicus
gtcagagtacttaaattcatcttca

SEQ ID NO: 490244 - DNA, 25 bp, Rattus norvegicus
gtcagagtactttaattcatcttca

SEQ ID NO: 490245 - DNA, 25 bp, Rattus norvegicus
gtcagagtatttactcctgccttct

SEQ ID NO: 490246 - DNA, 25 bp, Rattus norvegicus
gtcagagtattttctcctgccttct

SEQ ID NO: 490247 - DNA, 25 bp, Rattus norvegicus
gtcagagtccatcaagagagctcag

SEQ ID NO: 490248 - DNA, 25 bp, Rattus norvegicus
gtcagagtccatgaagagagctcag

SEQ ID NO: 490249 - DNA, 25 bp, Rattus norvegicus
gtcagagtctagctcctgggaagcc

SEQ ID NO: 490250 - DNA, 25 bp, Rattus norvegicus
gtcagagtctaggtcctgggaagcc

SEQ ID NO: 490251 - DNA, 25 bp, Rattus norvegicus
gtcagagtctcaaaattctgcataa

SEQ ID NO: 490252 - DNA, 25 bp, Rattus norvegicus
gtcagagtctcataattctgcataa

SEQ ID NO: 490253 - DNA, 25 bp, Rattus norvegicus
gtcagagtgagcaatatcctgcccc

SEQ ID NO: 490254 - DNA, 25 bp, Rattus norvegicus
gtcagagtgagctatatcctgcccc

SEQ ID NO: 490255 - DNA, 25 bp, Rattus norvegicus
gtcagagtgcttacggttcattccg

SEQ ID NO: 490256 - DNA, 25 bp, Rattus norvegicus
gtcagagtgctttcggttcattccg

SEQ ID NO: 490257 - DNA, 25 bp, Rattus norvegicus
gtcagagtggcgaagagttcagatt

SEQ ID NO: 490258 - DNA, 25 bp, Rattus norvegicus
gtcagagtggcgtagagttcagatt

SEQ ID NO: 490259 - DNA, 25 bp, Rattus norvegicus
gtcagagttactcttgtcgactgct

SEQ ID NO: 490260 - DNA, 25 bp, Rattus norvegicus
gtcagagttactgttgtcgactgct

SEQ ID NO: 490261 - DNA, 25 bp, Rattus norvegicus
gtcagagttatccttagctacccaa

SEQ ID NO: 490262 - DNA, 25 bp, Rattus norvegicus
gtcagagttatcgttagctacccaa

SEQ ID NO: 490263 - DNA, 25 bp, Rattus norvegicus
gtcagagttccacgagtcttacact

SEQ ID NO: 490264 - DNA, 25 bp, Rattus norvegicus
gtcagagttccaggagtcttacact

SEQ ID NO: 490265 - DNA, 25 bp, Rattus norvegicus
gtcagagttctactaggaagtcctt

SEQ ID NO: 490266 - DNA, 25 bp, Rattus norvegicus
gtcagagttctagtaggaagtcctt

SEQ ID NO: 490267 - DNA, 25 bp, Rattus norvegicus
gtcagagttctccaactgcattgtc

SEQ ID NO: 490268 - DNA, 25 bp, Rattus norvegicus
gtcagagttctcgaactgcattgtc

SEQ ID NO: 490269 - DNA, 25 bp, Rattus norvegicus
gtcagagtttccagatggctccaag

SEQ ID NO: 490270 - DNA, 25 bp, Rattus norvegicus
gtcagagtttcctgatggctccaag

SEQ ID NO: 490271 - DNA, 25 bp, Rattus norvegicus
gtcagataaaacacttccctgttgg

SEQ ID NO: 490272 - DNA, 25 bp, Rattus norvegicus
gtcagataaaactcttccctgttgg

SEQ ID NO: 490273 - DNA, 25 bp, Rattus norvegicus
gtcagatactgcacatcatttgcaa

SEQ ID NO: 490274 - DNA, 25 bp, Rattus norvegicus
gtcagatactgctcatcatttgcaa

SEQ ID NO: 490275 - DNA, 25 bp, Rattus norvegicus
gtcagatacttcaagatctaggctt

SEQ ID NO: 490276 - DNA, 25 bp, Rattus norvegicus
gtcagatacttctagatctaggctt

SEQ ID NO: 490277 - DNA, 25 bp, Rattus norvegicus
gtcagatatgttcttgtgcacttat

SEQ ID NO: 490278 - DNA, 25 bp, Rattus norvegicus
gtcagatatgttgttgtgcacttat

SEQ ID NO: 490279 - DNA, 25 bp, Rattus norvegicus
gtcagatcaaagacccagcggtgga

SEQ ID NO: 490280 - DNA, 25 bp, Rattus norvegicus
gtcagatcaaagtcccagcggtgga

SEQ ID NO: 490281 - DNA, 25 bp, Rattus norvegicus
gtcagatcaggtatggactccttcc

SEQ ID NO: 490282 - DNA, 25 bp, Rattus norvegicus
gtcagatcaggtttggactccttcc

SEQ ID NO: 490283 - DNA, 25 bp, Rattus norvegicus
gtcagatcccagaatgccgaaccag

SEQ ID NO: 490284 - DNA, 25 bp, Rattus norvegicus
gtcagatcccagtatgccgaaccag

SEQ ID NO: 490285 - DNA, 25 bp, Rattus norvegicus
gtcagatccttcagctttgcttcag

SEQ ID NO: 490286 - DNA, 25 bp, Rattus norvegicus
gtcagatccttctgctttgcttcag

SEQ ID NO: 490287 - DNA, 25 bp, Rattus norvegicus
gtcagatcgtagatggcctcaggta

SEQ ID NO: 490288 - DNA, 25 bp, Rattus norvegicus
gtcagatcgtagttggcctcaggta

SEQ ID NO: 490289 - DNA, 25 bp, Rattus norvegicus
gtcagatctaagagactccctcagt

SEQ ID NO: 490290 - DNA, 25 bp, Rattus norvegicus
gtcagatctaagtgactccctcagt

SEQ ID NO: 490291 - DNA, 25 bp, Rattus norvegicus
gtcagatctctacttctactatgtg

SEQ ID NO: 490292 - DNA, 25 bp, Rattus norvegicus
gtcagatctctagttctactatgtg

SEQ ID NO: 490293 - DNA, 25 bp, Rattus norvegicus
gtcagatcttacagcagtctaccta

SEQ ID NO: 490294 - DNA, 25 bp, Rattus norvegicus
gtcagatcttactgcagtctaccta

SEQ ID NO: 490295 - DNA, 25 bp, Rattus norvegicus
gtcagatgacctctcagtgtgaccc

SEQ ID NO: 490296 - DNA, 25 bp, Rattus norvegicus
gtcagatgacctgtcagtgtgaccc

SEQ ID NO: 490297 - DNA, 25 bp, Rattus norvegicus
gtcagatgagctagtgcaggagcat

SEQ ID NO: 490298 - DNA, 25 bp, Rattus norvegicus
gtcagatgagcttgtgcaggagcat

SEQ ID NO: 490299 - DNA, 25 bp, Rattus norvegicus
gtcagatgaggtacactcctgtgtt

SEQ ID NO: 490300 - DNA, 25 bp, Rattus norvegicus
gtcagatgaggttcactcctgtgtt

SEQ ID NO: 490301 - DNA, 25 bp, Rattus norvegicus
gtcagatgcctacaatcccagcagt

SEQ ID NO: 490302 - DNA, 25 bp, Rattus norvegicus
gtcagatgcctagaatcccagcagt

SEQ ID NO: 490303 - DNA, 25 bp, Rattus norvegicus
gtcagatggaggcttttgccttctt

SEQ ID NO: 490304 - DNA, 25 bp, Rattus norvegicus
gtcagatggagggttttgccttctt

SEQ ID NO: 490305 - DNA, 25 bp, Rattus norvegicus
gtcagatgtcaacttcagcagtgct

SEQ ID NO: 490306 - DNA, 25 bp, Rattus norvegicus
gtcagatgtcaagttcagcagtgct

SEQ ID NO: 490307 - DNA, 25 bp, Rattus norvegicus
gtcagatgtccaatgatgcttcgaa

SEQ ID NO: 490308 - DNA, 25 bp, Rattus norvegicus
gtcagatgtccattgatgcttcgaa

SEQ ID NO: 490309 - DNA, 25 bp, Rattus norvegicus
gtcagatgtctccttaacactgtct

SEQ ID NO: 490310 - DNA, 25 bp, Rattus norvegicus
gtcagatgtctcgttaacactgtct

SEQ ID NO: 490311 - DNA, 25 bp, Rattus norvegicus
gtcagatgtctgagatgagaggcca

SEQ ID NO: 490312 - DNA, 25 bp, Rattus norvegicus
gtcagatgtctgtgatgagaggcca

SEQ ID NO: 490313 - DNA, 25 bp, Rattus norvegicus
gtcagattagcacagatttctacca

SEQ ID NO: 490314 - DNA, 25 bp, Rattus norvegicus
gtcagattagcactgtactcggagt

SEQ ID NO: 490315 - DNA, 25 bp, Rattus norvegicus
gtcagattagcagagatttctacca

SEQ ID NO: 490316 - DNA, 25 bp, Rattus norvegicus
gtcagattagcagtgtactcggagt

SEQ ID NO: 490317 - DNA, 25 bp, Rattus norvegicus
gtcagattcataaccatcttgctca

SEQ ID NO: 490318 - DNA, 25 bp, Rattus norvegicus
gtcagattcatatccatcttgctca

SEQ ID NO: 490319 - DNA, 25 bp, Rattus norvegicus
gtcagattctgcatttcaaccacaa

SEQ ID NO: 490320 - DNA, 25 bp, Rattus norvegicus
gtcagattctgcttttcaaccacaa

SEQ ID NO: 490321 - DNA, 25 bp, Rattus norvegicus
gtcagattctgtacggtgctgtact

SEQ ID NO: 490322 - DNA, 25 bp, Rattus norvegicus
gtcagattctgttcggtgctgtact

SEQ ID NO: 490323 - DNA, 25 bp, Rattus norvegicus
gtcagattgcccagaggaccatcag

SEQ ID NO: 490324 - DNA, 25 bp, Rattus norvegicus
gtcagattgccctgaggaccatcag

SEQ ID NO: 490325 - DNA, 25 bp, Rattus norvegicus
gtcagattgtctcgcttttagccga

SEQ ID NO: 490326 - DNA, 25 bp, Rattus norvegicus
gtcagattgtctggcttttagccga

SEQ ID NO: 490327 - DNA, 25 bp, Rattus norvegicus
gtcagatttgcacccgctaacacat

SEQ ID NO: 490328 - DNA, 25 bp, Rattus norvegicus
gtcagatttgcagccgctaacacat

SEQ ID NO: 490329 - DNA, 25 bp, Rattus norvegicus
gtcagatttggcaccagagtataga

SEQ ID NO: 490330 - DNA, 25 bp, Rattus norvegicus
gtcagatttggctccagagtataga

SEQ ID NO: 490331 - DNA, 25 bp, Rattus norvegicus
gtcagcaaataacctgtggcccaat

SEQ ID NO: 490332 - DNA, 25 bp, Rattus norvegicus
gtcagcaaataagctgtggcccaat

SEQ ID NO: 490333 - DNA, 25 bp, Rattus norvegicus
gtcagcaacaggatcttctcagtct

SEQ ID NO: 490334 - DNA, 25 bp, Rattus norvegicus
gtcagcaacaggttcttctcagtct

SEQ ID NO: 490335 - DNA, 25 bp, Rattus norvegicus
gtcagcaactcgaggaccgcatgga

SEQ ID NO: 490336 - DNA, 25 bp, Rattus norvegicus
gtcagcaactcgtggaccgcatgga

SEQ ID NO: 490337 - DNA, 25 bp, Rattus norvegicus
gtcagcaagaagaactagcctcaca

SEQ ID NO: 490338 - DNA, 25 bp, Rattus norvegicus
gtcagcaagaagtactagcctcaca

SEQ ID NO: 490339 - DNA, 25 bp, Rattus norvegicus
gtcagcaagtctctgttcgctttct

SEQ ID NO: 490340 - DNA, 25 bp, Rattus norvegicus
gtcagcaagtctgtgttcgctttct

SEQ ID NO: 490341 - DNA, 25 bp, Rattus norvegicus
gtcagcaatagcaggttcacacttc

SEQ ID NO: 490342 - DNA, 25 bp, Rattus norvegicus
gtcagcaatagctggttcacacttc

SEQ ID NO: 490343 - DNA, 25 bp, Rattus norvegicus
gtcagcaatgcacaaacagagtgtg

SEQ ID NO: 490344 - DNA, 25 bp, Rattus norvegicus
gtcagcaatgcagaaacagagtgtg

SEQ ID NO: 490345 - DNA, 25 bp, Rattus norvegicus
gtcagcacaaaaagaaatccccggg

SEQ ID NO: 490346 - DNA, 25 bp, Rattus norvegicus
gtcagcacaaaatgaaatccccggg

SEQ ID NO: 490347 - DNA, 25 bp, Rattus norvegicus
gtcagcacaactcctgtttccagtt

SEQ ID NO: 490348 - DNA, 25 bp, Rattus norvegicus
gtcagcacaactgctgtttccagtt

SEQ ID NO: 490349 - DNA, 25 bp, Rattus norvegicus
gtcagcacagaacccctggatgtag

SEQ ID NO: 490350 - DNA, 25 bp, Rattus norvegicus
gtcagcacagaagccctggatgtag

SEQ ID NO: 490351 - DNA, 25 bp, Rattus norvegicus
gtcagcacagacaccattcttaggg

SEQ ID NO: 490352 - DNA, 25 bp, Rattus norvegicus
gtcagcacagactccattcttaggg

SEQ ID NO: 490353 - DNA, 25 bp, Rattus norvegicus
gtcagcacagtacggacaatgtctt

SEQ ID NO: 490354 - DNA, 25 bp, Rattus norvegicus
gtcagcacagtagggacaatgtctt

SEQ ID NO: 490355 - DNA, 25 bp, Rattus norvegicus
gtcagcaccagccacgggaagataa

SEQ ID NO: 490356 - DNA, 25 bp, Rattus norvegicus
gtcagcaccagcgacgggaagataa

SEQ ID NO: 490357 - DNA, 25 bp, Rattus norvegicus
gtcagcactgtacaggcccaggcag

SEQ ID NO: 490358 - DNA, 25 bp, Rattus norvegicus
gtcagcactgtagaggcccaggcag

SEQ ID NO: 490359 - DNA, 25 bp, Rattus norvegicus
gtcagcactgtgctatgacctaaat

SEQ ID NO: 490360 - DNA, 25 bp, Rattus norvegicus
gtcagcactgtggtatgacctaaat

SEQ ID NO: 490361 - DNA, 25 bp, Rattus norvegicus
gtcagcacttcgcacattgggcaag

SEQ ID NO: 490362 - DNA, 25 bp, Rattus norvegicus
gtcagcacttcggacattgggcaag

SEQ ID NO: 490363 - DNA, 25 bp, Rattus norvegicus
gtcagcacttttactgaaccctgtc

SEQ ID NO: 490364 - DNA, 25 bp, Rattus norvegicus
gtcagcactttttctgaaccctgtc

SEQ ID NO: 490365 - DNA, 25 bp, Rattus norvegicus
gtcagcagaccccaaactcgtgtgt

SEQ ID NO: 490366 - DNA, 25 bp, Rattus norvegicus
gtcagcagacccgaaactcgtgtgt

SEQ ID NO: 490367 - DNA, 25 bp, Rattus norvegicus
gtcagcagactgagtttatctgtcc

SEQ ID NO: 490368 - DNA, 25 bp, Rattus norvegicus
gtcagcagactgctgagaacagctc

SEQ ID NO: 490369 - DNA, 25 bp, Rattus norvegicus
gtcagcagactggtgagaacagctc

SEQ ID NO: 490370 - DNA, 25 bp, Rattus norvegicus
gtcagcagactgtgtttatctgtcc

SEQ ID NO: 490371 - DNA, 25 bp, Rattus norvegicus
gtcagcagagccataggccagccta

SEQ ID NO: 490372 - DNA, 25 bp, Rattus norvegicus
gtcagcagagccttaggccagccta

SEQ ID NO: 490373 - DNA, 25 bp, Rattus norvegicus
gtcagcagagtcaatgcatgttgta

SEQ ID NO: 490374 - DNA, 25 bp, Rattus norvegicus
gtcagcagagtctatgcatgttgta

SEQ ID NO: 490375 - DNA, 25 bp, Rattus norvegicus
gtcagcagattcactctactggaga

SEQ ID NO: 490376 - DNA, 25 bp, Rattus norvegicus
gtcagcagattctctctactggaga

SEQ ID NO: 490377 - DNA, 25 bp, Rattus norvegicus
gtcagcagcactccgtaaagcaggt

SEQ ID NO: 490378 - DNA, 25 bp, Rattus norvegicus
gtcagcagcactgcgtaaagcaggt

SEQ ID NO: 490379 - DNA, 25 bp, Rattus norvegicus
gtcagcagcccaatgcagagagggt

SEQ ID NO: 490380 - DNA, 25 bp, Rattus norvegicus
gtcagcagcccattgcagagagggt

SEQ ID NO: 490381 - DNA, 25 bp, Rattus norvegicus
gtcagcagcgcaccgcgagtcacga

SEQ ID NO: 490382 - DNA, 25 bp, Rattus norvegicus
gtcagcagcgcagcgcgagtcacga

SEQ ID NO: 490383 - DNA, 25 bp, Rattus norvegicus
gtcagcagctggctcctggacatca

SEQ ID NO: 490384 - DNA, 25 bp, Rattus norvegicus
gtcagcagctgggtcctggacatca

SEQ ID NO: 490385 - DNA, 25 bp, Rattus norvegicus
gtcagcaggtctatcttcagtatac

SEQ ID NO: 490386 - DNA, 25 bp, Rattus norvegicus
gtcagcaggtctttcttcagtatac

SEQ ID NO: 490387 - DNA, 25 bp, Rattus norvegicus
gtcagcagtcgtaagagtcatcatt

SEQ ID NO: 490388 - DNA, 25 bp, Rattus norvegicus
gtcagcagtcgttagagtcatcatt

SEQ ID NO: 490389 - DNA, 25 bp, Rattus norvegicus
gtcagcagtgacaaacgacgtgata

SEQ ID NO: 490390 - DNA, 25 bp, Rattus norvegicus
gtcagcagtgactaacgacgtgata

SEQ ID NO: 490391 - DNA, 25 bp, Rattus norvegicus
gtcagcagttctaaatgggtccgga

SEQ ID NO: 490392 - DNA, 25 bp, Rattus norvegicus
gtcagcagttcttaatgggtccgga

SEQ ID NO: 490393 - DNA, 25 bp, Rattus norvegicus
gtcagcatacctattgtgggccaat

SEQ ID NO: 490394 - DNA, 25 bp, Rattus norvegicus
gtcagcataccttttgtgggccaat

SEQ ID NO: 490395 - DNA, 25 bp, Rattus norvegicus
gtcagcatatccactttatggccaa

SEQ ID NO: 490396 - DNA, 25 bp, Rattus norvegicus
gtcagcatatcctctttatggccaa

SEQ ID NO: 490397 - DNA, 25 bp, Rattus norvegicus
gtcagcatatggcaagtgccgtcat

SEQ ID NO: 490398 - DNA, 25 bp, Rattus norvegicus
gtcagcatatgggaagtgccgtcat

SEQ ID NO: 490399 - DNA, 25 bp, Rattus norvegicus
gtcagcatcactccagtgcagagtt

SEQ ID NO: 490400 - DNA, 25 bp, Rattus norvegicus
gtcagcatcactgcagtgcagagtt

SEQ ID NO: 490401 - DNA, 25 bp, Rattus norvegicus
gtcagcatcatccagtcgtatgaag

SEQ ID NO: 490402 - DNA, 25 bp, Rattus norvegicus
gtcagcatcatcgagtcgtatgaag

SEQ ID NO: 490403 - DNA, 25 bp, Rattus norvegicus
gtcagcatcgccagtggtttcactt

SEQ ID NO: 490404 - DNA, 25 bp, Rattus norvegicus
gtcagcatcgccattgcactcaaat

SEQ ID NO: 490405 - DNA, 25 bp, Rattus norvegicus
gtcagcatcgcctgtggtttcactt

SEQ ID NO: 490406 - DNA, 25 bp, Rattus norvegicus
gtcagcatcgcctttgcactcaaat

SEQ ID NO: 490407 - DNA, 25 bp, Rattus norvegicus
gtcagcatcttcactcatgtgcata

SEQ ID NO: 490408 - DNA, 25 bp, Rattus norvegicus
gtcagcatcttctctcatgtgcata

SEQ ID NO: 490409 - DNA, 25 bp, Rattus norvegicus
gtcagcatcttgctcctgtaccagg

SEQ ID NO: 490410 - DNA, 25 bp, Rattus norvegicus
gtcagcatcttggtcctgtaccagg

SEQ ID NO: 490411 - DNA, 25 bp, Rattus norvegicus
gtcagcatgaaccaccttggcgaga

SEQ ID NO: 490412 - DNA, 25 bp, Rattus norvegicus
gtcagcatgaacgaccttggcgaga

SEQ ID NO: 490413 - DNA, 25 bp, Rattus norvegicus
gtcagcatgacgaaaactgcccgca

SEQ ID NO: 490414 - DNA, 25 bp, Rattus norvegicus
gtcagcatgacgtaaactgcccgca

SEQ ID NO: 490415 - DNA, 25 bp, Rattus norvegicus
gtcagcatgccaagggaccataggt

SEQ ID NO: 490416 - DNA, 25 bp, Rattus norvegicus
gtcagcatgccatgggaccataggt

SEQ ID NO: 490417 - DNA, 25 bp, Rattus norvegicus
gtcagcattagcctatgcacctagt

SEQ ID NO: 490418 - DNA, 25 bp, Rattus norvegicus
gtcagcattagcgtatgcacctagt

SEQ ID NO: 490419 - DNA, 25 bp, Rattus norvegicus
gtcagcattatgacactgtgggcca

SEQ ID NO: 490420 - DNA, 25 bp, Rattus norvegicus
gtcagcattatgtcactgtgggcca

SEQ ID NO: 490421 - DNA, 25 bp, Rattus norvegicus
gtcagcattccaattccaacatggt

SEQ ID NO: 490422 - DNA, 25 bp, Rattus norvegicus
gtcagcattccatttccaacatggt

SEQ ID NO: 490423 - DNA, 25 bp, Rattus norvegicus
gtcagcattctccatcggagccctt

SEQ ID NO: 490424 - DNA, 25 bp, Rattus norvegicus
gtcagcattctcgatcggagccctt

SEQ ID NO: 490425 - DNA, 25 bp, Rattus norvegicus
gtcagcatttcgcaagggtcatgta

SEQ ID NO: 490426 - DNA, 25 bp, Rattus norvegicus
gtcagcatttcggaagggtcatgta

SEQ ID NO: 490427 - DNA, 25 bp, Rattus norvegicus
gtcagccacaaaatagccagccaag

SEQ ID NO: 490428 - DNA, 25 bp, Rattus norvegicus
gtcagccacaaattagccagccaag

SEQ ID NO: 490429 - DNA, 25 bp, Rattus norvegicus
gtcagccacgctatagggtaatgtc

SEQ ID NO: 490430 - DNA, 25 bp, Rattus norvegicus
gtcagccacgctttagggtaatgtc

SEQ ID NO: 490431 - DNA, 25 bp, Rattus norvegicus
gtcagccactgtcagtctctggaaa

SEQ ID NO: 490432 - DNA, 25 bp, Rattus norvegicus
gtcagccactgtgagtctctggaaa

SEQ ID NO: 490433 - DNA, 25 bp, Rattus norvegicus
gtcagccagctgagcccatgtgagt

SEQ ID NO: 490434 - DNA, 25 bp, Rattus norvegicus
gtcagccagctgtgcccatgtgagt

SEQ ID NO: 490435 - DNA, 25 bp, Rattus norvegicus
gtcagccaggataagggactctgct

SEQ ID NO: 490436 - DNA, 25 bp, Rattus norvegicus
gtcagccaggattagggactctgct

SEQ ID NO: 490437 - DNA, 25 bp, Rattus norvegicus
gtcagccaggctcagaatcttgtca

SEQ ID NO: 490438 - DNA, 25 bp, Rattus norvegicus
gtcagccaggctgagaatcttgtca

SEQ ID NO: 490439 - DNA, 25 bp, Rattus norvegicus
gtcagccataagacggaccgacagt

SEQ ID NO: 490440 - DNA, 25 bp, Rattus norvegicus
gtcagccataagtcggaccgacagt

SEQ ID NO: 490441 - DNA, 25 bp, Rattus norvegicus
gtcagccatcacagcagacttgctt

SEQ ID NO: 490442 - DNA, 25 bp, Rattus norvegicus
gtcagccatcactgcagacttgctt

SEQ ID NO: 490443 - DNA, 25 bp, Rattus norvegicus
gtcagccatgacagtgccagttgca

SEQ ID NO: 490444 - DNA, 25 bp, Rattus norvegicus
gtcagccatgactgtgccagttgca

SEQ ID NO: 490445 - DNA, 25 bp, Rattus norvegicus
gtcagccatgtcaaaagcttaccta

SEQ ID NO: 490446 - DNA, 25 bp, Rattus norvegicus
gtcagccatgtctaaagcttaccta

SEQ ID NO: 490447 - DNA, 25 bp, Rattus norvegicus
gtcagccattcactgcagatcctag

SEQ ID NO: 490448 - DNA, 25 bp, Rattus norvegicus
gtcagccattcagtgcagatcctag

SEQ ID NO: 490449 - DNA, 25 bp, Rattus norvegicus
gtcagccattcgacggcgatgaaat

SEQ ID NO: 490450 - DNA, 25 bp, Rattus norvegicus
gtcagccattcgtcggcgatgaaat

SEQ ID NO: 490451 - DNA, 25 bp, Rattus norvegicus
gtcagccattctcatgtggtcctta

SEQ ID NO: 490452 - DNA, 25 bp, Rattus norvegicus
gtcagccattctgatgtggtcctta

SEQ ID NO: 490453 - DNA, 25 bp, Rattus norvegicus
gtcagccattgaaacggtagtcact

SEQ ID NO: 490454 - DNA, 25 bp, Rattus norvegicus
gtcagccattgatacggtagtcact

SEQ ID NO: 490455 - DNA, 25 bp, Rattus norvegicus
gtcagcccagcccagggtgataaat

SEQ ID NO: 490456 - DNA, 25 bp, Rattus norvegicus
gtcagcccagccgagggtgataaat

SEQ ID NO: 490457 - DNA, 25 bp, Rattus norvegicus
gtcagcccagggatttactggtgat

SEQ ID NO: 490458 - DNA, 25 bp, Rattus norvegicus
gtcagcccagggttttactggtgat

SEQ ID NO: 490459 - DNA, 25 bp, Rattus norvegicus
gtcagcccatagactatacacattt

SEQ ID NO: 490460 - DNA, 25 bp, Rattus norvegicus
gtcagcccatagtctatacacattt

SEQ ID NO: 490461 - DNA, 25 bp, Rattus norvegicus
gtcagccccagaaatagatgctata

SEQ ID NO: 490462 - DNA, 25 bp, Rattus norvegicus
gtcagccccagatatagatgctata

SEQ ID NO: 490463 - DNA, 25 bp, Rattus norvegicus
gtcagccccgaacaagccttgatta

SEQ ID NO: 490464 - DNA, 25 bp, Rattus norvegicus
gtcagccccgaagaagccttgatta

SEQ ID NO: 490465 - DNA, 25 bp, Rattus norvegicus
gtcagcccggaaacggttcgtgatc

SEQ ID NO: 490466 - DNA, 25 bp, Rattus norvegicus
gtcagcccggaatcggttcgtgatc

SEQ ID NO: 490467 - DNA, 25 bp, Rattus norvegicus
gtcagcccgtttacatcaggaagtc

SEQ ID NO: 490468 - DNA, 25 bp, Rattus norvegicus
gtcagcccgttttcatcaggaagtc

SEQ ID NO: 490469 - DNA, 25 bp, Rattus norvegicus
gtcagccctgaaaaatccaaacact

SEQ ID NO: 490470 - DNA, 25 bp, Rattus norvegicus
gtcagccctgaataatccaaacact

SEQ ID NO: 490471 - DNA, 25 bp, Rattus norvegicus
gtcagccctgagacttgaacacata

SEQ ID NO: 490472 - DNA, 25 bp, Rattus norvegicus
gtcagccctgagtcttgaacacata

SEQ ID NO: 490473 - DNA, 25 bp, Rattus norvegicus
gtcagccctgctcgatggcaagaac

SEQ ID NO: 490474 - DNA, 25 bp, Rattus norvegicus
gtcagccctgctggatggcaagaac

SEQ ID NO: 490475 - DNA, 25 bp, Rattus norvegicus
gtcagccctgttcagttggagtact

SEQ ID NO: 490476 - DNA, 25 bp, Rattus norvegicus
gtcagccctgttgagttggagtact

SEQ ID NO: 490477 - DNA, 25 bp, Rattus norvegicus
gtcagccgctacatctactgtaaga

SEQ ID NO: 490478 - DNA, 25 bp, Rattus norvegicus
gtcagccgctacttctactgtaaga

SEQ ID NO: 490479 - DNA, 25 bp, Rattus norvegicus
gtcagccggcttcagtttgttcaat

SEQ ID NO: 490480 - DNA, 25 bp, Rattus norvegicus
gtcagccggcttgagtttgttcaat

SEQ ID NO: 490481 - DNA, 25 bp, Rattus norvegicus
gtcagcctactcacctcggagtgag

SEQ ID NO: 490482 - DNA, 25 bp, Rattus norvegicus
gtcagcctactccagctgttatgag

SEQ ID NO: 490483 - DNA, 25 bp, Rattus norvegicus
gtcagcctactcgagctgttatgag

SEQ ID NO: 490484 - DNA, 25 bp, Rattus norvegicus
gtcagcctactctcctcggagtgag

SEQ ID NO: 490485 - DNA, 25 bp, Rattus norvegicus
gtcagcctaggtcgaccatggtaaa

SEQ ID NO: 490486 - DNA, 25 bp, Rattus norvegicus
gtcagcctaggtggaccatggtaaa

SEQ ID NO: 490487 - DNA, 25 bp, Rattus norvegicus
gtcagcctcaggattgggttcggtt

SEQ ID NO: 490488 - DNA, 25 bp, Rattus norvegicus
gtcagcctcaggcacaaagggattt

SEQ ID NO: 490489 - DNA, 25 bp, Rattus norvegicus
gtcagcctcagggacaaagggattt

SEQ ID NO: 490490 - DNA, 25 bp, Rattus norvegicus
gtcagcctcaggtttgggttcggtt

SEQ ID NO: 490491 - DNA, 25 bp, Rattus norvegicus
gtcagcctccctcgatttaaaatag

SEQ ID NO: 490492 - DNA, 25 bp, Rattus norvegicus
gtcagcctccctggatttaaaatag

SEQ ID NO: 490493 - DNA, 25 bp, Rattus norvegicus
gtcagcctcttacacaggcagccat

SEQ ID NO: 490494 - DNA, 25 bp, Rattus norvegicus
gtcagcctcttagacaggcagccat

SEQ ID NO: 490495 - DNA, 25 bp, Rattus norvegicus
gtcagcctgagccagacccttctgg

SEQ ID NO: 490496 - DNA, 25 bp, Rattus norvegicus
gtcagcctgagcgagacccttctgg

SEQ ID NO: 490497 - DNA, 25 bp, Rattus norvegicus
gtcagcctgatccacattgtgagtt

SEQ ID NO: 490498 - DNA, 25 bp, Rattus norvegicus
gtcagcctgatcgacattgtgagtt

SEQ ID NO: 490499 - DNA, 25 bp, Rattus norvegicus
gtcagcctggccctgatgaacgagt

SEQ ID NO: 490500 - DNA, 25 bp, Rattus norvegicus
gtcagcctggccgtgatgaacgagt

SEQ ID NO: 490501 - DNA, 25 bp, Rattus norvegicus
gtcagcctgggcatggtgcacatca

SEQ ID NO: 490502 - DNA, 25 bp, Rattus norvegicus
gtcagcctgggcctgcttaaaacta

SEQ ID NO: 490503 - DNA, 25 bp, Rattus norvegicus
gtcagcctgggcgtgcttaaaacta

SEQ ID NO: 490504 - DNA, 25 bp, Rattus norvegicus
gtcagcctgggcttggtgcacatca

SEQ ID NO: 490505 - DNA, 25 bp, Rattus norvegicus
gtcagcctgtgtaaacattagcgtt

SEQ ID NO: 490506 - DNA, 25 bp, Rattus norvegicus
gtcagcctgtgtcatggttgccttt

SEQ ID NO: 490507 - DNA, 25 bp, Rattus norvegicus
gtcagcctgtgtcctaatattgcca

SEQ ID NO: 490508 - DNA, 25 bp, Rattus norvegicus
gtcagcctgtgtgatggttgccttt

SEQ ID NO: 490509 - DNA, 25 bp, Rattus norvegicus
gtcagcctgtgtgctaatattgcca

SEQ ID NO: 490510 - DNA, 25 bp, Rattus norvegicus
gtcagcctgtgttaacattagcgtt

SEQ ID NO: 490511 - DNA, 25 bp, Rattus norvegicus
gtcagccttactctgatccaagcat

SEQ ID NO: 490512 - DNA, 25 bp, Rattus norvegicus
gtcagccttactgtgatccaagcat

SEQ ID NO: 490513 - DNA, 25 bp, Rattus norvegicus
gtcagccttattacaacagtcgcgg

SEQ ID NO: 490514 - DNA, 25 bp, Rattus norvegicus
gtcagccttatttcaacagtcgcgg

SEQ ID NO: 490515 - DNA, 25 bp, Rattus norvegicus
gtcagccttctaaagcaagtggaga

SEQ ID NO: 490516 - DNA, 25 bp, Rattus norvegicus
gtcagccttctatagcaagtggaga

SEQ ID NO: 490517 - DNA, 25 bp, Rattus norvegicus
gtcagccttgctctttatacccaag

SEQ ID NO: 490518 - DNA, 25 bp, Rattus norvegicus
gtcagccttgctgtttatacccaag

SEQ ID NO: 490519 - DNA, 25 bp, Rattus norvegicus
gtcagcctttaacttctgcgtgaaa

SEQ ID NO: 490520 - DNA, 25 bp, Rattus norvegicus
gtcagcctttaagttctgcgtgaaa

SEQ ID NO: 490521 - DNA, 25 bp, Rattus norvegicus
gtcagcctttttcgagggtgtcttt

SEQ ID NO: 490522 - DNA, 25 bp, Rattus norvegicus
gtcagcctttttggagggtgtcttt

SEQ ID NO: 490523 - DNA, 25 bp, Rattus norvegicus
gtcagcgaaaaacagtacaccatct

SEQ ID NO: 490524 - DNA, 25 bp, Rattus norvegicus
gtcagcgaaaaagagtacaccatct

SEQ ID NO: 490525 - DNA, 25 bp, Rattus norvegicus
gtcagcgaaagcacttgggattctt

SEQ ID NO: 490526 - DNA, 25 bp, Rattus norvegicus
gtcagcgaaagctcttgggattctt

SEQ ID NO: 490527 - DNA, 25 bp, Rattus norvegicus
gtcagcgaactgatggcgattctac

SEQ ID NO: 490528 - DNA, 25 bp, Rattus norvegicus
gtcagcgaactgttggcgattctac

SEQ ID NO: 490529 - DNA, 25 bp, Rattus norvegicus
gtcagcgaggagagacacttgctgc

SEQ ID NO: 490530 - DNA, 25 bp, Rattus norvegicus
gtcagcgaggagtgacacttgctgc

SEQ ID NO: 490531 - DNA, 25 bp, Rattus norvegicus
gtcagcgatgtcactgaaatgctat

SEQ ID NO: 490532 - DNA, 25 bp, Rattus norvegicus
gtcagcgatgtctctgaaatgctat

SEQ ID NO: 490533 - DNA, 25 bp, Rattus norvegicus
gtcagcgattgacttctacaggaag

SEQ ID NO: 490534 - DNA, 25 bp, Rattus norvegicus
gtcagcgattgagttctacaggaag

SEQ ID NO: 490535 - DNA, 25 bp, Rattus norvegicus
gtcagcgcacacaaaaaggcttcac

SEQ ID NO: 490536 - DNA, 25 bp, Rattus norvegicus
gtcagcgcacactaaaaggcttcac

SEQ ID NO: 490537 - DNA, 25 bp, Rattus norvegicus
gtcagcgccatcagaggtctacaga

SEQ ID NO: 490538 - DNA, 25 bp, Rattus norvegicus
gtcagcgccatctgaggtctacaga

SEQ ID NO: 490539 - DNA, 25 bp, Rattus norvegicus
gtcagcgccccacaagcaggaagtg

SEQ ID NO: 490540 - DNA, 25 bp, Rattus norvegicus
gtcagcgccccagaagcaggaagtg

SEQ ID NO: 490541 - DNA, 25 bp, Rattus norvegicus
gtcagcggaaaaacttgctaccaag

SEQ ID NO: 490542 - DNA, 25 bp, Rattus norvegicus
gtcagcggaaaatcttgctaccaag

SEQ ID NO: 490543 - DNA, 25 bp, Rattus norvegicus
gtcagcggctgcacatgagagagcc

SEQ ID NO: 490544 - DNA, 25 bp, Rattus norvegicus
gtcagcggctgctcatgagagagcc

SEQ ID NO: 490545 - DNA, 25 bp, Rattus norvegicus
gtcagcgggctgctgaatcatgtcc

SEQ ID NO: 490546 - DNA, 25 bp, Rattus norvegicus
gtcagcgggctggtgaatcatgtcc

SEQ ID NO: 490547 - DNA, 25 bp, Rattus norvegicus
gtcagcgtcccgaaggcctcgaagt

SEQ ID NO: 490548 - DNA, 25 bp, Rattus norvegicus
gtcagcgtcccgtaggcctcgaagt

SEQ ID NO: 490549 - DNA, 25 bp, Rattus norvegicus
gtcagcgtcgaacaacagcttttca

SEQ ID NO: 490550 - DNA, 25 bp, Rattus norvegicus
gtcagcgtcgaagaacagcttttca

SEQ ID NO: 490551 - DNA, 25 bp, Rattus norvegicus
gtcagcgtctgtctacttgtgggaa

SEQ ID NO: 490552 - DNA, 25 bp, Rattus norvegicus
gtcagcgtctgtgtacttgtgggaa

SEQ ID NO: 490553 - DNA, 25 bp, Rattus norvegicus
gtcagcgtgacaagtaccgaatttt

SEQ ID NO: 490554 - DNA, 25 bp, Rattus norvegicus
gtcagcgtgacatgtaccgaatttt

SEQ ID NO: 490555 - DNA, 25 bp, Rattus norvegicus
gtcagcgtggtcactgtggacgaca

SEQ ID NO: 490556 - DNA, 25 bp, Rattus norvegicus
gtcagcgtggtctctgtggacgaca

SEQ ID NO: 490557 - DNA, 25 bp, Rattus norvegicus
gtcagcgtgtgaccttctgcacaga

SEQ ID NO: 490558 - DNA, 25 bp, Rattus norvegicus
gtcagcgtgtgagcttctgcacaga

SEQ ID NO: 490559 - DNA, 25 bp, Rattus norvegicus
gtcagcgtttcgatctttatcaaat

SEQ ID NO: 490560 - DNA, 25 bp, Rattus norvegicus
gtcagcgtttcgttctttatcaaat

SEQ ID NO: 490561 - DNA, 25 bp, Rattus norvegicus
gtcagcgtttgtcttcatttacttt

SEQ ID NO: 490562 - DNA, 25 bp, Rattus norvegicus
gtcagcgtttgtgttcatttacttt

SEQ ID NO: 490563 - DNA, 25 bp, Rattus norvegicus
gtcagctaaatcaaacctccgggtc

SEQ ID NO: 490564 - DNA, 25 bp, Rattus norvegicus
gtcagctaaatctaacctccgggtc

SEQ ID NO: 490565 - DNA, 25 bp, Rattus norvegicus
gtcagctaagctatggatgttttcg

SEQ ID NO: 490566 - DNA, 25 bp, Rattus norvegicus
gtcagctaagctttggatgttttcg

SEQ ID NO: 490567 - DNA, 25 bp, Rattus norvegicus
gtcagctacactcagtagtctaggt

SEQ ID NO: 490568 - DNA, 25 bp, Rattus norvegicus
gtcagctacactgagtagtctaggt

SEQ ID NO: 490569 - DNA, 25 bp, Rattus norvegicus
gtcagctaccaacccttaggagata

SEQ ID NO: 490570 - DNA, 25 bp, Rattus norvegicus
gtcagctaccaagccttaggagata

SEQ ID NO: 490571 - DNA, 25 bp, Rattus norvegicus
gtcagctacttcacgaaatgttggt

SEQ ID NO: 490572 - DNA, 25 bp, Rattus norvegicus
gtcagctacttcactgtgacacaag

SEQ ID NO: 490573 - DNA, 25 bp, Rattus norvegicus
gtcagctacttctcgaaatgttggt

SEQ ID NO: 490574 - DNA, 25 bp, Rattus norvegicus
gtcagctacttctctgtgacacaag

SEQ ID NO: 490575 - DNA, 25 bp, Rattus norvegicus
gtcagctagcagacaaatgtgttct

SEQ ID NO: 490576 - DNA, 25 bp, Rattus norvegicus
gtcagctagcagtcaaatgtgttct

SEQ ID NO: 490577 - DNA, 25 bp, Rattus norvegicus
gtcagctaggagatcatagtgcagc

SEQ ID NO: 490578 - DNA, 25 bp, Rattus norvegicus
gtcagctaggagttcatagtgcagc

SEQ ID NO: 490579 - DNA, 25 bp, Rattus norvegicus
gtcagctagtttccatatgctccag

SEQ ID NO: 490580 - DNA, 25 bp, Rattus norvegicus
gtcagctagtttgcatatgctccag

SEQ ID NO: 490581 - DNA, 25 bp, Rattus norvegicus
gtcagctatttgaacaattcctagg

SEQ ID NO: 490582 - DNA, 25 bp, Rattus norvegicus
gtcagctatttgtacaattcctagg

SEQ ID NO: 490583 - DNA, 25 bp, Rattus norvegicus
gtcagctcacggcacagcgatgtca

SEQ ID NO: 490584 - DNA, 25 bp, Rattus norvegicus
gtcagctcacgggacagcgatgtca

SEQ ID NO: 490585 - DNA, 25 bp, Rattus norvegicus
gtcagctcagttcacaggccagaga

SEQ ID NO: 490586 - DNA, 25 bp, Rattus norvegicus
gtcagctcagttgacaggccagaga

SEQ ID NO: 490587 - DNA, 25 bp, Rattus norvegicus
gtcagctccattcagaaccagatgc

SEQ ID NO: 490588 - DNA, 25 bp, Rattus norvegicus
gtcagctccattgagaaccagatgc

SEQ ID NO: 490589 - DNA, 25 bp, Rattus norvegicus
gtcagctcccatagctctaagttct

SEQ ID NO: 490590 - DNA, 25 bp, Rattus norvegicus
gtcagctcccattgctctaagttct

SEQ ID NO: 490591 - DNA, 25 bp, Rattus norvegicus
gtcagctccgaaaagcttgctttct

SEQ ID NO: 490592 - DNA, 25 bp, Rattus norvegicus
gtcagctccgaatagcttgctttct

SEQ ID NO: 490593 - DNA, 25 bp, Rattus norvegicus
gtcagctcctgtccggtctaggata

SEQ ID NO: 490594 - DNA, 25 bp, Rattus norvegicus
gtcagctcctgtgcggtctaggata

SEQ ID NO: 490595 - DNA, 25 bp, Rattus norvegicus
gtcagctcgaacaacactttttatt

SEQ ID NO: 490596 - DNA, 25 bp, Rattus norvegicus
gtcagctcgaactacactttttatt

SEQ ID NO: 490597 - DNA, 25 bp, Rattus norvegicus
gtcagctctcccaagcttcaagtga

SEQ ID NO: 490598 - DNA, 25 bp, Rattus norvegicus
gtcagctctccctagcttcaagtga

SEQ ID NO: 490599 - DNA, 25 bp, Rattus norvegicus
gtcagctctgccattaaggtgtgca

SEQ ID NO: 490600 - DNA, 25 bp, Rattus norvegicus
gtcagctctgcctttaaggtgtgca

SEQ ID NO: 490601 - DNA, 25 bp, Rattus norvegicus
gtcagctctggtatggaaaaatcct

SEQ ID NO: 490602 - DNA, 25 bp, Rattus norvegicus
gtcagctctggtttggaaaaatcct

SEQ ID NO: 490603 - DNA, 25 bp, Rattus norvegicus
gtcagctctgtaattcagcagcgcc

SEQ ID NO: 490604 - DNA, 25 bp, Rattus norvegicus
gtcagctctgtatttcagcagcgcc

SEQ ID NO: 490605 - DNA, 25 bp, Rattus norvegicus
gtcagctcttcacgtgtggatatat

SEQ ID NO: 490606 - DNA, 25 bp, Rattus norvegicus
gtcagctcttcaggtgtggatatat

SEQ ID NO: 490607 - DNA, 25 bp, Rattus norvegicus
gtcagctcttgtcccatgccaggga

SEQ ID NO: 490608 - DNA, 25 bp, Rattus norvegicus
gtcagctcttgtgccatgccaggga

SEQ ID NO: 490609 - DNA, 25 bp, Rattus norvegicus
gtcagctcttttctgtttattttca

SEQ ID NO: 490610 - DNA, 25 bp, Rattus norvegicus
gtcagctcttttgtgtttattttca

SEQ ID NO: 490611 - DNA, 25 bp, Rattus norvegicus
gtcagctgaatcaacatgtctcttg

SEQ ID NO: 490612 - DNA, 25 bp, Rattus norvegicus
gtcagctgaatctacatgtctcttg

SEQ ID NO: 490613 - DNA, 25 bp, Rattus norvegicus
gtcagctgacctatatggacctaga

SEQ ID NO: 490614 - DNA, 25 bp, Rattus norvegicus
gtcagctgacctttatggacctaga

SEQ ID NO: 490615 - DNA, 25 bp, Rattus norvegicus
gtcagctgagtcctcaatgttccag

SEQ ID NO: 490616 - DNA, 25 bp, Rattus norvegicus
gtcagctgagtcgtcaatgttccag

SEQ ID NO: 490617 - DNA, 25 bp, Rattus norvegicus
gtcagctgagtgattcttcctgtca

SEQ ID NO: 490618 - DNA, 25 bp, Rattus norvegicus
gtcagctgagtgtttcttcctgtca

SEQ ID NO: 490619 - DNA, 25 bp, Rattus norvegicus
gtcagctgatacagactcactcctg

SEQ ID NO: 490620 - DNA, 25 bp, Rattus norvegicus
gtcagctgatactgactcactcctg

SEQ ID NO: 490621 - DNA, 25 bp, Rattus norvegicus
gtcagctgatctcgagtctgcagtt

SEQ ID NO: 490622 - DNA, 25 bp, Rattus norvegicus
gtcagctgatctggagtctgcagtt

SEQ ID NO: 490623 - DNA, 25 bp, Rattus norvegicus
gtcagctgatgcacaccaaatgctc

SEQ ID NO: 490624 - DNA, 25 bp, Rattus norvegicus
gtcagctgatgctcaccaaatgctc

SEQ ID NO: 490625 - DNA, 25 bp, Rattus norvegicus
gtcagctgcaaacctggacagtggt

SEQ ID NO: 490626 - DNA, 25 bp, Rattus norvegicus
gtcagctgcaaagctggacagtggt

SEQ ID NO: 490627 - DNA, 25 bp, Rattus norvegicus
gtcagctgcaacagagcatgtgcgt

SEQ ID NO: 490628 - DNA, 25 bp, Rattus norvegicus
gtcagctgcaactgagcatgtgcgt

SEQ ID NO: 490629 - DNA, 25 bp, Rattus norvegicus
gtcagctgcagtctatgatcttata

SEQ ID NO: 490630 - DNA, 25 bp, Rattus norvegicus
gtcagctgcagtgtatgatcttata

SEQ ID NO: 490631 - DNA, 25 bp, Rattus norvegicus
gtcagctgccatagttgttttctgt

SEQ ID NO: 490632 - DNA, 25 bp, Rattus norvegicus
gtcagctgccattgttgttttctgt

SEQ ID NO: 490633 - DNA, 25 bp, Rattus norvegicus
gtcagctgcttgagttgtgatgcca

SEQ ID NO: 490634 - DNA, 25 bp, Rattus norvegicus
gtcagctgcttgtgttgtgatgcca

SEQ ID NO: 490635 - DNA, 25 bp, Rattus norvegicus
gtcagctggcgtacttcctgagcaa

SEQ ID NO: 490636 - DNA, 25 bp, Rattus norvegicus
gtcagctggcgttcttcctgagcaa

SEQ ID NO: 490637 - DNA, 25 bp, Rattus norvegicus
gtcagctgggacaattttgcggagc

SEQ ID NO: 490638 - DNA, 25 bp, Rattus norvegicus
gtcagctgggactattttgcggagc

SEQ ID NO: 490639 - DNA, 25 bp, Rattus norvegicus
gtcagctggtttacatcgcactgga

SEQ ID NO: 490640 - DNA, 25 bp, Rattus norvegicus
gtcagctggttttcatcgcactgga

SEQ ID NO: 490641 - DNA, 25 bp, Rattus norvegicus
gtcagctgtaccacaagactttagg

SEQ ID NO: 490642 - DNA, 25 bp, Rattus norvegicus
gtcagctgtacctcaagactttagg

SEQ ID NO: 490643 - DNA, 25 bp, Rattus norvegicus
gtcagctgtagaaggtctgcccctg

SEQ ID NO: 490644 - DNA, 25 bp, Rattus norvegicus
gtcagctgtagatggtctgcccctg

SEQ ID NO: 490645 - DNA, 25 bp, Rattus norvegicus
gtcagctgttgactcggttaacctc

SEQ ID NO: 490646 - DNA, 25 bp, Rattus norvegicus
gtcagctgttgagtcggttaacctc

SEQ ID NO: 490647 - DNA, 25 bp, Rattus norvegicus
gtcagcttaaaactcccaggttcta

SEQ ID NO: 490648 - DNA, 25 bp, Rattus norvegicus
gtcagcttaaaagtcccaggttcta

SEQ ID NO: 490649 - DNA, 25 bp, Rattus norvegicus
gtcagcttaggtacagtctgtctgg

SEQ ID NO: 490650 - DNA, 25 bp, Rattus norvegicus
gtcagcttaggttcagtctgtctgg

SEQ ID NO: 490651 - DNA, 25 bp, Rattus norvegicus
gtcagcttattaccactcgttagag

SEQ ID NO: 490652 - DNA, 25 bp, Rattus norvegicus
gtcagcttattagcactcgttagag

SEQ ID NO: 490653 - DNA, 25 bp, Rattus norvegicus
gtcagcttcaacatagcttctgtgg

SEQ ID NO: 490654 - DNA, 25 bp, Rattus norvegicus
gtcagcttcaacttagcttctgtgg

SEQ ID NO: 490655 - DNA, 25 bp, Rattus norvegicus
gtcagcttcagaacctttgtatctt

SEQ ID NO: 490656 - DNA, 25 bp, Rattus norvegicus
gtcagcttcagatcctttgtatctt

SEQ ID NO: 490657 - DNA, 25 bp, Rattus norvegicus
gtcagcttcatcactcagcatagtt

SEQ ID NO: 490658 - DNA, 25 bp, Rattus norvegicus
gtcagcttcatctctcagcatagtt

SEQ ID NO: 490659 - DNA, 25 bp, Rattus norvegicus
gtcagcttccccataagaaatgaaa

SEQ ID NO: 490660 - DNA, 25 bp, Rattus norvegicus
gtcagcttccccttaagaaatgaaa

SEQ ID NO: 490661 - DNA, 25 bp, Rattus norvegicus
gtcagcttcgcaagttctaggcaaa

SEQ ID NO: 490662 - DNA, 25 bp, Rattus norvegicus
gtcagcttcgcatgttctaggcaaa

SEQ ID NO: 490663 - DNA, 25 bp, Rattus norvegicus
gtcagcttctacctaataggccgcc

SEQ ID NO: 490664 - DNA, 25 bp, Rattus norvegicus
gtcagcttctacgtaataggccgcc

SEQ ID NO: 490665 - DNA, 25 bp, Rattus norvegicus
gtcagcttctatataatgtgccaat

SEQ ID NO: 490666 - DNA, 25 bp, Rattus norvegicus
gtcagcttctatttaatgtgccaat

SEQ ID NO: 490667 - DNA, 25 bp, Rattus norvegicus
gtcagcttgaccacaggaatactgc

SEQ ID NO: 490668 - DNA, 25 bp, Rattus norvegicus
gtcagcttgacctcaggaatactgc

SEQ ID NO: 490669 - DNA, 25 bp, Rattus norvegicus
gtcagcttgagtcacggcagtgaca

SEQ ID NO: 490670 - DNA, 25 bp, Rattus norvegicus
gtcagcttgagtgacggcagtgaca

SEQ ID NO: 490671 - DNA, 25 bp, Rattus norvegicus
gtcagcttgtgtacttattcgcaaa

SEQ ID NO: 490672 - DNA, 25 bp, Rattus norvegicus
gtcagcttgtgtctatactatgtct

SEQ ID NO: 490673 - DNA, 25 bp, Rattus norvegicus
gtcagcttgtgtgtatactatgtct

SEQ ID NO: 490674 - DNA, 25 bp, Rattus norvegicus
gtcagcttgtgttcttattcgcaaa

SEQ ID NO: 490675 - DNA, 25 bp, Rattus norvegicus
gtcagctttactatcaaggtcattg

SEQ ID NO: 490676 - DNA, 25 bp, Rattus norvegicus
gtcagctttactttcaaggtcattg

SEQ ID NO: 490677 - DNA, 25 bp, Rattus norvegicus
gtcagctttattaccaggaaggcca

SEQ ID NO: 490678 - DNA, 25 bp, Rattus norvegicus
gtcagctttatttccaggaaggcca

SEQ ID NO: 490679 - DNA, 25 bp, Rattus norvegicus
gtcagctttcccagaggtgcagaga

SEQ ID NO: 490680 - DNA, 25 bp, Rattus norvegicus
gtcagctttcccatcagtagtagtg

SEQ ID NO: 490681 - DNA, 25 bp, Rattus norvegicus
gtcagctttccctgaggtgcagaga

SEQ ID NO: 490682 - DNA, 25 bp, Rattus norvegicus
gtcagctttcccttcagtagtagtg

SEQ ID NO: 490683 - DNA, 25 bp, Rattus norvegicus
gtcagctttctaaatgctacttgag

SEQ ID NO: 490684 - DNA, 25 bp, Rattus norvegicus
gtcagctttctatatgctacttgag

SEQ ID NO: 490685 - DNA, 25 bp, Rattus norvegicus
gtcagctttgtgagtctagcatctg

SEQ ID NO: 490686 - DNA, 25 bp, Rattus norvegicus
gtcagctttgtgcaacgatcagtaa

SEQ ID NO: 490687 - DNA, 25 bp, Rattus norvegicus
gtcagctttgtggaacgatcagtaa

SEQ ID NO: 490688 - DNA, 25 bp, Rattus norvegicus
gtcagctttgtgtgtctagcatctg

SEQ ID NO: 490689 - DNA, 25 bp, Rattus norvegicus
gtcagctttgttagcacaattgtca

SEQ ID NO: 490690 - DNA, 25 bp, Rattus norvegicus
gtcagctttgtttgcacaattgtca

SEQ ID NO: 490691 - DNA, 25 bp, Rattus norvegicus
gtcagcttttggagactggcaccaa

SEQ ID NO: 490692 - DNA, 25 bp, Rattus norvegicus
gtcagcttttggtgactggcaccaa

SEQ ID NO: 490693 - DNA, 25 bp, Rattus norvegicus
gtcagctttttaatacagccaatca

SEQ ID NO: 490694 - DNA, 25 bp, Rattus norvegicus
gtcagctttttattacagccaatca

SEQ ID NO: 490695 - DNA, 25 bp, Rattus norvegicus
gtcaggaaagcccttccaacgagga

SEQ ID NO: 490696 - DNA, 25 bp, Rattus norvegicus
gtcaggaaagccgttccaacgagga

SEQ ID NO: 490697 - DNA, 25 bp, Rattus norvegicus
gtcaggaaaggcacttgtgcagaaa

SEQ ID NO: 490698 - DNA, 25 bp, Rattus norvegicus
gtcaggaaaggctcttgtgcagaaa

SEQ ID NO: 490699 - DNA, 25 bp, Rattus norvegicus
gtcaggaaatgaactccacccataa

SEQ ID NO: 490700 - DNA, 25 bp, Rattus norvegicus
gtcaggaaatgatctccacccataa

SEQ ID NO: 490701 - DNA, 25 bp, Rattus norvegicus
gtcaggaacactaccccaatgagtt

SEQ ID NO: 490702 - DNA, 25 bp, Rattus norvegicus
gtcaggaacacttccccaatgagtt

SEQ ID NO: 490703 - DNA, 25 bp, Rattus norvegicus
gtcaggaacagcctggacaggcttt

SEQ ID NO: 490704 - DNA, 25 bp, Rattus norvegicus
gtcaggaacagcgtggacaggcttt

SEQ ID NO: 490705 - DNA, 25 bp, Rattus norvegicus
gtcaggaacattctgcggtttcttc

SEQ ID NO: 490706 - DNA, 25 bp, Rattus norvegicus
gtcaggaacattgtgcggtttcttc

SEQ ID NO: 490707 - DNA, 25 bp, Rattus norvegicus
gtcaggaaccctcttgggagacccg

SEQ ID NO: 490708 - DNA, 25 bp, Rattus norvegicus
gtcaggaaccctgttgggagacccg

SEQ ID NO: 490709 - DNA, 25 bp, Rattus norvegicus
gtcaggaacgcacagaccggcccta

SEQ ID NO: 490710 - DNA, 25 bp, Rattus norvegicus
gtcaggaacgcagagaccggcccta

SEQ ID NO: 490711 - DNA, 25 bp, Rattus norvegicus
gtcaggaactggagccttctcaatt

SEQ ID NO: 490712 - DNA, 25 bp, Rattus norvegicus
gtcaggaactggtgccttctcaatt

SEQ ID NO: 490713 - DNA, 25 bp, Rattus norvegicus
gtcaggaagggtcttagtcctaagt

SEQ ID NO: 490714 - DNA, 25 bp, Rattus norvegicus
gtcaggaagggtgttagtcctaagt

SEQ ID NO: 490715 - DNA, 25 bp, Rattus norvegicus
gtcaggaatgcaccactgttcccag

SEQ ID NO: 490716 - DNA, 25 bp, Rattus norvegicus
gtcaggaatgcagcactgttcccag

SEQ ID NO: 490717 - DNA, 25 bp, Rattus norvegicus
gtcaggacaaatcgcttactcagct

SEQ ID NO: 490718 - DNA, 25 bp, Rattus norvegicus
gtcaggacaaatggcttactcagct

SEQ ID NO: 490719 - DNA, 25 bp, Rattus norvegicus
gtcaggacacctattctaactatca

SEQ ID NO: 490720 - DNA, 25 bp, Rattus norvegicus
gtcaggacaccttttctaactatca

SEQ ID NO: 490721 - DNA, 25 bp, Rattus norvegicus
gtcaggacactgaaaggttaccgtg

SEQ ID NO: 490722 - DNA, 25 bp, Rattus norvegicus
gtcaggacactgtaaggttaccgtg

SEQ ID NO: 490723 - DNA, 25 bp, Rattus norvegicus
gtcaggacagaaccactggagctct

SEQ ID NO: 490724 - DNA, 25 bp, Rattus norvegicus
gtcaggacagaagcactggagctct

SEQ ID NO: 490725 - DNA, 25 bp, Rattus norvegicus
gtcaggacatatcctttgggataac

SEQ ID NO: 490726 - DNA, 25 bp, Rattus norvegicus
gtcaggacatatgctttgggataac

SEQ ID NO: 490727 - DNA, 25 bp, Rattus norvegicus
gtcaggaccaggaccccattgatgc

SEQ ID NO: 490728 - DNA, 25 bp, Rattus norvegicus
gtcaggaccaggtccccattgatgc

SEQ ID NO: 490729 - DNA, 25 bp, Rattus norvegicus
gtcaggacctgactgtaccacccgg

SEQ ID NO: 490730 - DNA, 25 bp, Rattus norvegicus
gtcaggacctgagtgtaccacccgg

SEQ ID NO: 490731 - DNA, 25 bp, Rattus norvegicus
gtcaggacctttactctacacaaga

SEQ ID NO: 490732 - DNA, 25 bp, Rattus norvegicus
gtcaggaccttttctctacacaaga

SEQ ID NO: 490733 - DNA, 25 bp, Rattus norvegicus
gtcaggactcagagtcaggctccaa

SEQ ID NO: 490734 - DNA, 25 bp, Rattus norvegicus
gtcaggactcagtgtcaggctccaa

SEQ ID NO: 490735 - DNA, 25 bp, Rattus norvegicus
gtcaggactgagctggcatttctat

SEQ ID NO: 490736 - DNA, 25 bp, Rattus norvegicus
gtcaggactgaggtggcatttctat

SEQ ID NO: 490737 - DNA, 25 bp, Rattus norvegicus
gtcaggacttaaccgttggctttat

SEQ ID NO: 490738 - DNA, 25 bp, Rattus norvegicus
gtcaggacttaagcgttggctttat

SEQ ID NO: 490739 - DNA, 25 bp, Rattus norvegicus
gtcaggagacgcactcagcgggctt

SEQ ID NO: 490740 - DNA, 25 bp, Rattus norvegicus
gtcaggagacgctctcagcgggctt

SEQ ID NO: 490741 - DNA, 25 bp, Rattus norvegicus
gtcaggagcactaactactcttact

SEQ ID NO: 490742 - DNA, 25 bp, Rattus norvegicus
gtcaggagcacttactactcttact

SEQ ID NO: 490743 - DNA, 25 bp, Rattus norvegicus
gtcaggagcagactcggccaccgtt

SEQ ID NO: 490744 - DNA, 25 bp, Rattus norvegicus
gtcaggagcagagtcggccaccgtt

SEQ ID NO: 490745 - DNA, 25 bp, Rattus norvegicus
gtcaggagccagacagaccttgaaa

SEQ ID NO: 490746 - DNA, 25 bp, Rattus norvegicus
gtcaggagccagtcagaccttgaaa

SEQ ID NO: 490747 - DNA, 25 bp, Rattus norvegicus
gtcaggagcggaacttcctcctcag

SEQ ID NO: 490748 - DNA, 25 bp, Rattus norvegicus
gtcaggagcggatcttcctcctcag

SEQ ID NO: 490749 - DNA, 25 bp, Rattus norvegicus
gtcaggagctcgcagtctgttgttt

SEQ ID NO: 490750 - DNA, 25 bp, Rattus norvegicus
gtcaggagctcggagtctgttgttt

SEQ ID NO: 490751 - DNA, 25 bp, Rattus norvegicus
gtcaggagggtcctcttcaagtcca

SEQ ID NO: 490752 - DNA, 25 bp, Rattus norvegicus
gtcaggagggtcgtcttcaagtcca

SEQ ID NO: 490753 - DNA, 25 bp, Rattus norvegicus
gtcaggaggtcccaaagcctactta

SEQ ID NO: 490754 - DNA, 25 bp, Rattus norvegicus
gtcaggaggtccgaaagcctactta

SEQ ID NO: 490755 - DNA, 25 bp, Rattus norvegicus
gtcaggatgctgcagtcgctctgca

SEQ ID NO: 490756 - DNA, 25 bp, Rattus norvegicus
gtcaggatgctggagtcgctctgca

SEQ ID NO: 490757 - DNA, 25 bp, Rattus norvegicus
gtcaggattaccctggagtcctcag

SEQ ID NO: 490758 - DNA, 25 bp, Rattus norvegicus
gtcaggattaccgtggagtcctcag

SEQ ID NO: 490759 - DNA, 25 bp, Rattus norvegicus
gtcaggattcgaagcagtgtgtctt

SEQ ID NO: 490760 - DNA, 25 bp, Rattus norvegicus
gtcaggattcgatgcagtgtgtctt

SEQ ID NO: 490761 - DNA, 25 bp, Rattus norvegicus
gtcaggatttagcaggtaggtacaa

SEQ ID NO: 490762 - DNA, 25 bp, Rattus norvegicus
gtcaggatttaggaggtaggtacaa

SEQ ID NO: 490763 - DNA, 25 bp, Rattus norvegicus
gtcaggatttctactatcttgccat

SEQ ID NO: 490764 - DNA, 25 bp, Rattus norvegicus
gtcaggatttcttctatcttgccat

SEQ ID NO: 490765 - DNA, 25 bp, Rattus norvegicus
gtcaggattttgcagattccaaagt

SEQ ID NO: 490766 - DNA, 25 bp, Rattus norvegicus
gtcaggattttggagattccaaagt

SEQ ID NO: 490767 - DNA, 25 bp, Rattus norvegicus
gtcaggcaaaaaacctacccttcaa

SEQ ID NO: 490768 - DNA, 25 bp, Rattus norvegicus
gtcaggcaaaaatcctacccttcaa

SEQ ID NO: 490769 - DNA, 25 bp, Rattus norvegicus
gtcaggcaagatcaccgtgcactga

SEQ ID NO: 490770 - DNA, 25 bp, Rattus norvegicus
gtcaggcaagatgaccgtgcactga

SEQ ID NO: 490771 - DNA, 25 bp, Rattus norvegicus
gtcaggcactgacggtcaggtcact

SEQ ID NO: 490772 - DNA, 25 bp, Rattus norvegicus
gtcaggcactgagggtcaggtcact

SEQ ID NO: 490773 - DNA, 25 bp, Rattus norvegicus
gtcaggcagaaaacgttcatctcat

SEQ ID NO: 490774 - DNA, 25 bp, Rattus norvegicus
gtcaggcagaaatcgttcatctcat

SEQ ID NO: 490775 - DNA, 25 bp, Rattus norvegicus
gtcaggcagctcaggactgctcaaa

SEQ ID NO: 490776 - DNA, 25 bp, Rattus norvegicus
gtcaggcagctctggactgctcaaa

SEQ ID NO: 490777 - DNA, 25 bp, Rattus norvegicus
gtcaggcatcccatatgaatgagac

SEQ ID NO: 490778 - DNA, 25 bp, Rattus norvegicus
gtcaggcatcccttatgaatgagac

SEQ ID NO: 490779 - DNA, 25 bp, Rattus norvegicus
gtcaggcatgagaattacactactt

SEQ ID NO: 490780 - DNA, 25 bp, Rattus norvegicus
gtcaggcatgagtattacactactt

SEQ ID NO: 490781 - DNA, 25 bp, Rattus norvegicus
gtcaggcatgcgcagataattacac

SEQ ID NO: 490782 - DNA, 25 bp, Rattus norvegicus
gtcaggcatgcggagataattacac

SEQ ID NO: 490783 - DNA, 25 bp, Rattus norvegicus
gtcaggccagagcacaaaagcaaag

SEQ ID NO: 490784 - DNA, 25 bp, Rattus norvegicus
gtcaggccagagctatagcacctac

SEQ ID NO: 490785 - DNA, 25 bp, Rattus norvegicus
gtcaggccagaggacaaaagcaaag

SEQ ID NO: 490786 - DNA, 25 bp, Rattus norvegicus
gtcaggccagaggtatagcacctac

SEQ ID NO: 490787 - DNA, 25 bp, Rattus norvegicus
gtcaggccatccactagagcatggg

SEQ ID NO: 490788 - DNA, 25 bp, Rattus norvegicus
gtcaggccatcctctagagcatggg

SEQ ID NO: 490789 - DNA, 25 bp, Rattus norvegicus
gtcaggccccacatgtctaaaaaga

SEQ ID NO: 490790 - DNA, 25 bp, Rattus norvegicus
gtcaggccccacttgtctaaaaaga

SEQ ID NO: 490791 - DNA, 25 bp, Rattus norvegicus
gtcaggccgcctccattttgagttc

SEQ ID NO: 490792 - DNA, 25 bp, Rattus norvegicus
gtcaggccgcctgcattttgagttc

SEQ ID NO: 490793 - DNA, 25 bp, Rattus norvegicus
gtcaggcctgagctaatttatttga

SEQ ID NO: 490794 - DNA, 25 bp, Rattus norvegicus
gtcaggcctgaggtaatttatttga

SEQ ID NO: 490795 - DNA, 25 bp, Rattus norvegicus
gtcaggcctggtccttggagatcat

SEQ ID NO: 490796 - DNA, 25 bp, Rattus norvegicus
gtcaggcctggtgcttggagatcat

SEQ ID NO: 490797 - DNA, 25 bp, Rattus norvegicus
gtcaggccttaaactgtatgcttaa

SEQ ID NO: 490798 - DNA, 25 bp, Rattus norvegicus
gtcaggccttaatctgtatgcttaa

SEQ ID NO: 490799 - DNA, 25 bp, Rattus norvegicus
gtcaggcgctatctgagttccaggc

SEQ ID NO: 490800 - DNA, 25 bp, Rattus norvegicus
gtcaggcgctatgtgagttccaggc

SEQ ID NO: 490801 - DNA, 25 bp, Rattus norvegicus
gtcaggcggcacatctaacttatct

SEQ ID NO: 490802 - DNA, 25 bp, Rattus norvegicus
gtcaggcggcacttctaacttatct

SEQ ID NO: 490803 - DNA, 25 bp, Rattus norvegicus
gtcaggcggtgccaacaggtccatt

SEQ ID NO: 490804 - DNA, 25 bp, Rattus norvegicus
gtcaggcggtgcgaacaggtccatt

SEQ ID NO: 490805 - DNA, 25 bp, Rattus norvegicus
gtcaggcgtgttaaagcatgccctc

SEQ ID NO: 490806 - DNA, 25 bp, Rattus norvegicus
gtcaggcgtgtttaagcatgccctc

SEQ ID NO: 490807 - DNA, 25 bp, Rattus norvegicus
gtcaggcgttgcagtaacagactca

SEQ ID NO: 490808 - DNA, 25 bp, Rattus norvegicus
gtcaggcgttgctgtaacagactca

SEQ ID NO: 490809 - DNA, 25 bp, Rattus norvegicus
gtcaggctacgtcgtccctagagta

SEQ ID NO: 490810 - DNA, 25 bp, Rattus norvegicus
gtcaggctacgtggtccctagagta

SEQ ID NO: 490811 - DNA, 25 bp, Rattus norvegicus
gtcaggctcaccaaggcaatgatgt

SEQ ID NO: 490812 - DNA, 25 bp, Rattus norvegicus
gtcaggctcacctaggcaatgatgt

SEQ ID NO: 490813 - DNA, 25 bp, Rattus norvegicus
gtcaggctcaggactgaaccttgtt

SEQ ID NO: 490814 - DNA, 25 bp, Rattus norvegicus
gtcaggctcaggtctgaaccttgtt

SEQ ID NO: 490815 - DNA, 25 bp, Rattus norvegicus
gtcaggctcattctaggcagcacca

SEQ ID NO: 490816 - DNA, 25 bp, Rattus norvegicus
gtcaggctcattgtaggcagcacca

SEQ ID NO: 490817 - DNA, 25 bp, Rattus norvegicus
gtcaggctccctaataacatgtaac

SEQ ID NO: 490818 - DNA, 25 bp, Rattus norvegicus
gtcaggctcccttataacatgtaac

SEQ ID NO: 490819 - DNA, 25 bp, Rattus norvegicus
gtcaggctctgacatcagtgggtca

SEQ ID NO: 490820 - DNA, 25 bp, Rattus norvegicus
gtcaggctctgagatcagtgggtca

SEQ ID NO: 490821 - DNA, 25 bp, Rattus norvegicus
gtcaggctgacaaaggaccgagtga

SEQ ID NO: 490822 - DNA, 25 bp, Rattus norvegicus
gtcaggctgacataggaccgagtga

SEQ ID NO: 490823 - DNA, 25 bp, Rattus norvegicus
gtcaggctgcagatggaccacagaa

SEQ ID NO: 490824 - DNA, 25 bp, Rattus norvegicus
gtcaggctgcagttggaccacagaa

SEQ ID NO: 490825 - DNA, 25 bp, Rattus norvegicus
gtcaggctgcttattttccagatgc

SEQ ID NO: 490826 - DNA, 25 bp, Rattus norvegicus
gtcaggctgctttttttccagatgc

SEQ ID NO: 490827 - DNA, 25 bp, Rattus norvegicus
gtcaggctggccatggctggaaaaa

SEQ ID NO: 490828 - DNA, 25 bp, Rattus norvegicus
gtcaggctggccttggctggaaaaa

SEQ ID NO: 490829 - DNA, 25 bp, Rattus norvegicus
gtcaggctgtctaggcactcttgga

SEQ ID NO: 490830 - DNA, 25 bp, Rattus norvegicus
gtcaggctgtcttggcactcttgga

SEQ ID NO: 490831 - DNA, 25 bp, Rattus norvegicus
gtcaggctgtggctttaaacttcta

SEQ ID NO: 490832 - DNA, 25 bp, Rattus norvegicus
gtcaggctgtgggtttaaacttcta

SEQ ID NO: 490833 - DNA, 25 bp, Rattus norvegicus
gtcaggcttacgctgccaagggatt

SEQ ID NO: 490834 - DNA, 25 bp, Rattus norvegicus
gtcaggcttacggtgccaagggatt

SEQ ID NO: 490835 - DNA, 25 bp, Rattus norvegicus
gtcaggcttcgacctttgggttctg

SEQ ID NO: 490836 - DNA, 25 bp, Rattus norvegicus
gtcaggcttcgagctttgggttctg

SEQ ID NO: 490837 - DNA, 25 bp, Rattus norvegicus
gtcaggcttgtgctgcagtttgcca

SEQ ID NO: 490838 - DNA, 25 bp, Rattus norvegicus
gtcaggcttgtggtgcagtttgcca

SEQ ID NO: 490839 - DNA, 25 bp, Rattus norvegicus
gtcaggctttaacctttactttagt

SEQ ID NO: 490840 - DNA, 25 bp, Rattus norvegicus
gtcaggctttaagctttactttagt

SEQ ID NO: 490841 - DNA, 25 bp, Rattus norvegicus
gtcaggctttagctgcatgagcagt

SEQ ID NO: 490842 - DNA, 25 bp, Rattus norvegicus
gtcaggctttaggtgcatgagcagt

SEQ ID NO: 490843 - DNA, 25 bp, Rattus norvegicus
gtcaggctttcaatactatgtgtaa

SEQ ID NO: 490844 - DNA, 25 bp, Rattus norvegicus
gtcaggctttcattactatgtgtaa

SEQ ID NO: 490845 - DNA, 25 bp, Rattus norvegicus
gtcagggaacacacagggagcctat

SEQ ID NO: 490846 - DNA, 25 bp, Rattus norvegicus
gtcagggaacacagccttttttcta

SEQ ID NO: 490847 - DNA, 25 bp, Rattus norvegicus
gtcagggaacactcagggagcctat

SEQ ID NO: 490848 - DNA, 25 bp, Rattus norvegicus
gtcagggaacactgccttttttcta

SEQ ID NO: 490849 - DNA, 25 bp, Rattus norvegicus
gtcagggaacatctataccgctatc

SEQ ID NO: 490850 - DNA, 25 bp, Rattus norvegicus
gtcagggaacatgtataccgctatc

SEQ ID NO: 490851 - DNA, 25 bp, Rattus norvegicus
gtcagggagaccatatttttcctaa

SEQ ID NO: 490852 - DNA, 25 bp, Rattus norvegicus
gtcagggagaccttatttttcctaa

SEQ ID NO: 490853 - DNA, 25 bp, Rattus norvegicus
gtcagggatactcagaccctgcctc

SEQ ID NO: 490854 - DNA, 25 bp, Rattus norvegicus
gtcagggatactgagaccctgcctc

SEQ ID NO: 490855 - DNA, 25 bp, Rattus norvegicus
gtcagggcaacaaccagactctgga

SEQ ID NO: 490856 - DNA, 25 bp, Rattus norvegicus
gtcagggcaacatccagactctgga

SEQ ID NO: 490857 - DNA, 25 bp, Rattus norvegicus
gtcagggcaactctgttctgttagt

SEQ ID NO: 490858 - DNA, 25 bp, Rattus norvegicus
gtcagggcaactgtgttctgttagt

SEQ ID NO: 490859 - DNA, 25 bp, Rattus norvegicus
gtcagggcaaggcagcaaaccacat

SEQ ID NO: 490860 - DNA, 25 bp, Rattus norvegicus
gtcagggcaagggagcaaaccacat

SEQ ID NO: 490861 - DNA, 25 bp, Rattus norvegicus
gtcagggcaagtcgtgtgttttcta

SEQ ID NO: 490862 - DNA, 25 bp, Rattus norvegicus
gtcagggcaagtggtgtgttttcta

SEQ ID NO: 490863 - DNA, 25 bp, Rattus norvegicus
gtcagggcacctatactagtaacca

SEQ ID NO: 490864 - DNA, 25 bp, Rattus norvegicus
gtcagggcacctttactagtaacca

SEQ ID NO: 490865 - DNA, 25 bp, Rattus norvegicus
gtcagggcagccacatagagttcag

SEQ ID NO: 490866 - DNA, 25 bp, Rattus norvegicus
gtcagggcagcctcatagagttcag

SEQ ID NO: 490867 - DNA, 25 bp, Rattus norvegicus
gtcagggcagctagactggtaaacc

SEQ ID NO: 490868 - DNA, 25 bp, Rattus norvegicus
gtcagggcagcttgactggtaaacc

SEQ ID NO: 490869 - DNA, 25 bp, Rattus norvegicus
gtcagggccaagatgcagagcttcc

SEQ ID NO: 490870 - DNA, 25 bp, Rattus norvegicus
gtcagggccaagttgcagagcttcc

SEQ ID NO: 490871 - DNA, 25 bp, Rattus norvegicus
gtcagggccccacaggtagcagttt

SEQ ID NO: 490872 - DNA, 25 bp, Rattus norvegicus
gtcagggccccagaggtagcagttt

SEQ ID NO: 490873 - DNA, 25 bp, Rattus norvegicus
gtcagggcccccatggaggacatgc

SEQ ID NO: 490874 - DNA, 25 bp, Rattus norvegicus
gtcagggcccccttggaggacatgc

SEQ ID NO: 490875 - DNA, 25 bp, Rattus norvegicus
gtcagggcctaaactcaggagcaca

SEQ ID NO: 490876 - DNA, 25 bp, Rattus norvegicus
gtcagggcctaatctcaggagcaca

SEQ ID NO: 490877 - DNA, 25 bp, Rattus norvegicus
gtcagggctaagagttgaatttacc

SEQ ID NO: 490878 - DNA, 25 bp, Rattus norvegicus
gtcagggctaagtgttgaatttacc

SEQ ID NO: 490879 - DNA, 25 bp, Rattus norvegicus
gtcagggctaccataggctacatga

SEQ ID NO: 490880 - DNA, 25 bp, Rattus norvegicus
gtcagggctaccttaggctacatga

SEQ ID NO: 490881 - DNA, 25 bp, Rattus norvegicus
gtcagggctataactatatttcata

SEQ ID NO: 490882 - DNA, 25 bp, Rattus norvegicus
gtcagggctatatctatatttcata

SEQ ID NO: 490883 - DNA, 25 bp, Rattus norvegicus
gtcagggctgatcgagcctccatta

SEQ ID NO: 490884 - DNA, 25 bp, Rattus norvegicus
gtcagggctgatggagcctccatta

SEQ ID NO: 490885 - DNA, 25 bp, Rattus norvegicus
gtcagggcttcaatacaggtaactt

SEQ ID NO: 490886 - DNA, 25 bp, Rattus norvegicus
gtcagggcttcattacaggtaactt

SEQ ID NO: 490887 - DNA, 25 bp, Rattus norvegicus
gtcagggtagagctctccaaccagt

SEQ ID NO: 490888 - DNA, 25 bp, Rattus norvegicus
gtcagggtagaggtctccaaccagt

SEQ ID NO: 490889 - DNA, 25 bp, Rattus norvegicus
gtcagggtccagatgcaggaactaa

SEQ ID NO: 490890 - DNA, 25 bp, Rattus norvegicus
gtcagggtccagttgcaggaactaa

SEQ ID NO: 490891 - DNA, 25 bp, Rattus norvegicus
gtcagggtccggaacctggcatatg

SEQ ID NO: 490892 - DNA, 25 bp, Rattus norvegicus
gtcagggtccggtacctggcatatg

SEQ ID NO: 490893 - DNA, 25 bp, Rattus norvegicus
gtcagggtccttcctcgaagagtgc

SEQ ID NO: 490894 - DNA, 25 bp, Rattus norvegicus
gtcagggtccttgctcgaagagtgc

SEQ ID NO: 490895 - DNA, 25 bp, Rattus norvegicus
gtcagggtcgacaactcaatttcat

SEQ ID NO: 490896 - DNA, 25 bp, Rattus norvegicus
gtcagggtcgactactcaatttcat

SEQ ID NO: 490897 - DNA, 25 bp, Rattus norvegicus
gtcagggtctttagcgtgttaacac

SEQ ID NO: 490898 - DNA, 25 bp, Rattus norvegicus
gtcagggtcttttgcgtgttaacac

SEQ ID NO: 490899 - DNA, 25 bp, Rattus norvegicus
gtcagggtgaacattattgaactca

SEQ ID NO: 490900 - DNA, 25 bp, Rattus norvegicus
gtcagggtgaactttattgaactca

SEQ ID NO: 490901 - DNA, 25 bp, Rattus norvegicus
gtcagggtgaagatccctgtgtgtt

SEQ ID NO: 490902 - DNA, 25 bp, Rattus norvegicus
gtcagggtgaagttccctgtgtgtt

SEQ ID NO: 490903 - DNA, 25 bp, Rattus norvegicus
gtcagggtggccatcttggtgacaa

SEQ ID NO: 490904 - DNA, 25 bp, Rattus norvegicus
gtcagggtggccttcttggtgacaa

SEQ ID NO: 490905 - DNA, 25 bp, Rattus norvegicus
gtcagggtggtaactcctttttgta

SEQ ID NO: 490906 - DNA, 25 bp, Rattus norvegicus
gtcagggtggtatctcctttttgta

SEQ ID NO: 490907 - DNA, 25 bp, Rattus norvegicus
gtcagggtgtgcatccagcatagcc

SEQ ID NO: 490908 - DNA, 25 bp, Rattus norvegicus
gtcagggtgtgcttccagcatagcc

SEQ ID NO: 490909 - DNA, 25 bp, Rattus norvegicus
gtcagggttcagcaagtcacatgcc

SEQ ID NO: 490910 - DNA, 25 bp, Rattus norvegicus
gtcagggttcaggaagtcacatgcc

SEQ ID NO: 490911 - DNA, 25 bp, Rattus norvegicus
gtcagggtttgcattgaccacatgt

SEQ ID NO: 490912 - DNA, 25 bp, Rattus norvegicus
gtcagggtttgctttgaccacatgt

SEQ ID NO: 490913 - DNA, 25 bp, Rattus norvegicus
gtcaggtagacaaagggcccgagaa

SEQ ID NO: 490914 - DNA, 25 bp, Rattus norvegicus
gtcaggtagacatagggcccgagaa

SEQ ID NO: 490915 - DNA, 25 bp, Rattus norvegicus
gtcaggtagagtaaatgtgcccata

SEQ ID NO: 490916 - DNA, 25 bp, Rattus norvegicus
gtcaggtagagttaatgtgcccata

SEQ ID NO: 490917 - DNA, 25 bp, Rattus norvegicus
gtcaggtatttgctcttagcagcaa

SEQ ID NO: 490918 - DNA, 25 bp, Rattus norvegicus
gtcaggtatttggtcttagcagcaa

SEQ ID NO: 490919 - DNA, 25 bp, Rattus norvegicus
gtcaggtccaatctcttcagtgaag

SEQ ID NO: 490920 - DNA, 25 bp, Rattus norvegicus
gtcaggtccaatgtcttcagtgaag

SEQ ID NO: 490921 - DNA, 25 bp, Rattus norvegicus
gtcaggtccctcatcaccgatgatg

SEQ ID NO: 490922 - DNA, 25 bp, Rattus norvegicus
gtcaggtccctcttcaccgatgatg

SEQ ID NO: 490923 - DNA, 25 bp, Rattus norvegicus
gtcaggtccgagcttggtttatgtt

SEQ ID NO: 490924 - DNA, 25 bp, Rattus norvegicus
gtcaggtccgaggttggtttatgtt

SEQ ID NO: 490925 - DNA, 25 bp, Rattus norvegicus
gtcaggtcctctcgtgacagcagaa

SEQ ID NO: 490926 - DNA, 25 bp, Rattus norvegicus
gtcaggtcctctggtgacagcagaa

SEQ ID NO: 490927 - DNA, 25 bp, Rattus norvegicus
gtcaggtcgtttccagatcttaaaa

SEQ ID NO: 490928 - DNA, 25 bp, Rattus norvegicus
gtcaggtcgtttgcagatcttaaaa

SEQ ID NO: 490929 - DNA, 25 bp, Rattus norvegicus
gtcaggtctacgctcatatgtgcaa

SEQ ID NO: 490930 - DNA, 25 bp, Rattus norvegicus
gtcaggtctacggtcatatgtgcaa

SEQ ID NO: 490931 - DNA, 25 bp, Rattus norvegicus
gtcaggtctcctcggctgaggcttt

SEQ ID NO: 490932 - DNA, 25 bp, Rattus norvegicus
gtcaggtctcctgggctgaggcttt

SEQ ID NO: 490933 - DNA, 25 bp, Rattus norvegicus
gtcaggtctgctatggtgtctaaaa

SEQ ID NO: 490934 - DNA, 25 bp, Rattus norvegicus
gtcaggtctgctttggtgtctaaaa

SEQ ID NO: 490935 - DNA, 25 bp, Rattus norvegicus
gtcaggtctggcctagagctcagtt

SEQ ID NO: 490936 - DNA, 25 bp, Rattus norvegicus
gtcaggtctggcgtagagctcagtt

SEQ ID NO: 490937 - DNA, 25 bp, Rattus norvegicus
gtcaggtgacacaggcgcagagatc

SEQ ID NO: 490938 - DNA, 25 bp, Rattus norvegicus
gtcaggtgacactggcgcagagatc

SEQ ID NO: 490939 - DNA, 25 bp, Rattus norvegicus
gtcaggtgagaaatgccatggaact

SEQ ID NO: 490940 - DNA, 25 bp, Rattus norvegicus
gtcaggtgagaattgccatggaact

SEQ ID NO: 490941 - DNA, 25 bp, Rattus norvegicus
gtcaggtgatctctcagctgtcagt

SEQ ID NO: 490942 - DNA, 25 bp, Rattus norvegicus
gtcaggtgatctgtcagctgtcagt

SEQ ID NO: 490943 - DNA, 25 bp, Rattus norvegicus
gtcaggtgattcaaacactcagggt

SEQ ID NO: 490944 - DNA, 25 bp, Rattus norvegicus
gtcaggtgattctaacactcagggt

SEQ ID NO: 490945 - DNA, 25 bp, Rattus norvegicus
gtcaggtgcccaccagtggatttat

SEQ ID NO: 490946 - DNA, 25 bp, Rattus norvegicus
gtcaggtgcccagcagtggatttat

SEQ ID NO: 490947 - DNA, 25 bp, Rattus norvegicus
gtcaggtgccctcggcctcatctta

SEQ ID NO: 490948 - DNA, 25 bp, Rattus norvegicus
gtcaggtgccctgggcctcatctta

SEQ ID NO: 490949 - DNA, 25 bp, Rattus norvegicus
gtcaggtgcctgatacattgtttaa

SEQ ID NO: 490950 - DNA, 25 bp, Rattus norvegicus
gtcaggtgcctgttacattgtttaa

SEQ ID NO: 490951 - DNA, 25 bp, Rattus norvegicus
gtcaggtgctgacaaagcttctcat

SEQ ID NO: 490952 - DNA, 25 bp, Rattus norvegicus
gtcaggtgctgagaaagcttctcat

SEQ ID NO: 490953 - DNA, 25 bp, Rattus norvegicus
gtcaggtgctttctgcttgtacata

SEQ ID NO: 490954 - DNA, 25 bp, Rattus norvegicus
gtcaggtgctttgtgcttgtacata

SEQ ID NO: 490955 - DNA, 25 bp, Rattus norvegicus
gtcaggtgtagaccttacctctgtg

SEQ ID NO: 490956 - DNA, 25 bp, Rattus norvegicus
gtcaggtgtagagcttacctctgtg

SEQ ID NO: 490957 - DNA, 25 bp, Rattus norvegicus
gtcaggtgtgcaagcttgagcagct

SEQ ID NO: 490958 - DNA, 25 bp, Rattus norvegicus
gtcaggtgtgcatgcttgagcagct

SEQ ID NO: 490959 - DNA, 25 bp, Rattus norvegicus
gtcaggttactgagctcacattatg

SEQ ID NO: 490960 - DNA, 25 bp, Rattus norvegicus
gtcaggttactgtgctcacattatg

SEQ ID NO: 490961 - DNA, 25 bp, Rattus norvegicus
gtcaggttccagacatagccaaacg

SEQ ID NO: 490962 - DNA, 25 bp, Rattus norvegicus
gtcaggttccagtcatagccaaacg

SEQ ID NO: 490963 - DNA, 25 bp, Rattus norvegicus
gtcaggttcgacagccccggcgagg

SEQ ID NO: 490964 - DNA, 25 bp, Rattus norvegicus
gtcaggttcgactgccccggcgagg

SEQ ID NO: 490965 - DNA, 25 bp, Rattus norvegicus
gtcaggttctgtatctttccccaga

SEQ ID NO: 490966 - DNA, 25 bp, Rattus norvegicus
gtcaggttctgtttctttccccaga

SEQ ID NO: 490967 - DNA, 25 bp, Rattus norvegicus
gtcaggttggccacgcactaaagga

SEQ ID NO: 490968 - DNA, 25 bp, Rattus norvegicus
gtcaggttggcctcgcactaaagga

SEQ ID NO: 490969 - DNA, 25 bp, Rattus norvegicus
gtcaggtttattcctaatccacccg

SEQ ID NO: 490970 - DNA, 25 bp, Rattus norvegicus
gtcaggtttattgctaatccacccg

SEQ ID NO: 490971 - DNA, 25 bp, Rattus norvegicus
gtcaggtttcgcattcattgttttt

SEQ ID NO: 490972 - DNA, 25 bp, Rattus norvegicus
gtcaggtttcgctttcattgttttt

SEQ ID NO: 490973 - DNA, 25 bp, Rattus norvegicus
gtcaggtttcttcttctttttccat

SEQ ID NO: 490974 - DNA, 25 bp, Rattus norvegicus
gtcaggtttcttgttctttttccat

SEQ ID NO: 490975 - DNA, 25 bp, Rattus norvegicus
gtcaggttttatctgcttttcctca

SEQ ID NO: 490976 - DNA, 25 bp, Rattus norvegicus
gtcaggttttatgtgcttttcctca

SEQ ID NO: 490977 - DNA, 25 bp, Rattus norvegicus
gtcagtaaacttaggcctgcagtag

SEQ ID NO: 490978 - DNA, 25 bp, Rattus norvegicus
gtcagtaaactttggcctgcagtag

SEQ ID NO: 490979 - DNA, 25 bp, Rattus norvegicus
gtcagtaacactctttccatttgaa

SEQ ID NO: 490980 - DNA, 25 bp, Rattus norvegicus
gtcagtaacactgtttccatttgaa

SEQ ID NO: 490981 - DNA, 25 bp, Rattus norvegicus
gtcagtaacagacctcttatcaaat

SEQ ID NO: 490982 - DNA, 25 bp, Rattus norvegicus
gtcagtaacagagctcttatcaaat

SEQ ID NO: 490983 - DNA, 25 bp, Rattus norvegicus
gtcagtaacagtccctagtgtgagt

SEQ ID NO: 490984 - DNA, 25 bp, Rattus norvegicus
gtcagtaacagtgcctagtgtgagt

SEQ ID NO: 490985 - DNA, 25 bp, Rattus norvegicus
gtcagtaagaccagcatgcgactca

SEQ ID NO: 490986 - DNA, 25 bp, Rattus norvegicus
gtcagtaagacctgcatgcgactca

SEQ ID NO: 490987 - DNA, 25 bp, Rattus norvegicus
gtcagtaaggttcgttctgccggca

SEQ ID NO: 490988 - DNA, 25 bp, Rattus norvegicus
gtcagtaaggttggttctgccggca

SEQ ID NO: 490989 - DNA, 25 bp, Rattus norvegicus
gtcagtaagttaattgcccagcatc

SEQ ID NO: 490990 - DNA, 25 bp, Rattus norvegicus
gtcagtaagttatttgcccagcatc

SEQ ID NO: 490991 - DNA, 25 bp, Rattus norvegicus
gtcagtaataccactgtctgtatgt

SEQ ID NO: 490992 - DNA, 25 bp, Rattus norvegicus
gtcagtaatacctctgtctgtatgt

SEQ ID NO: 490993 - DNA, 25 bp, Rattus norvegicus
gtcagtaattgcattgttgtacatt

SEQ ID NO: 490994 - DNA, 25 bp, Rattus norvegicus
gtcagtaattgctttgttgtacatt

SEQ ID NO: 490995 - DNA, 25 bp, Rattus norvegicus
gtcagtacacttatctcaacaggct

SEQ ID NO: 490996 - DNA, 25 bp, Rattus norvegicus
gtcagtacacttttctcaacaggct

SEQ ID NO: 490997 - DNA, 25 bp, Rattus norvegicus
gtcagtacagcaccatttaacctct

SEQ ID NO: 490998 - DNA, 25 bp, Rattus norvegicus
gtcagtacagcagcatttaacctct

SEQ ID NO: 490999 - DNA, 25 bp, Rattus norvegicus
gtcagtacagttcctggtacagcat

SEQ ID NO: 491000 - DNA, 25 bp, Rattus norvegicus
gtcagtacagttgctggtacagcat

SEQ ID NO: 491001 - DNA, 25 bp, Rattus norvegicus
gtcagtacatatacatcctgagctc

SEQ ID NO: 491002 - DNA, 25 bp, Rattus norvegicus
gtcagtacatattcatcctgagctc

SEQ ID NO: 491003 - DNA, 25 bp, Rattus norvegicus
gtcagtacctctcaagtctacaagt

SEQ ID NO: 491004 - DNA, 25 bp, Rattus norvegicus
gtcagtacctctgaagtctacaagt

SEQ ID NO: 491005 - DNA, 25 bp, Rattus norvegicus
gtcagtacctgcacagtgatctgca

SEQ ID NO: 491006 - DNA, 25 bp, Rattus norvegicus
gtcagtacctgctcagtgatctgca

SEQ ID NO: 491007 - DNA, 25 bp, Rattus norvegicus
gtcagtacgtctatctgcatcagtg

SEQ ID NO: 491008 - DNA, 25 bp, Rattus norvegicus
gtcagtacgtctttctgcatcagtg

SEQ ID NO: 491009 - DNA, 25 bp, Rattus norvegicus
gtcagtactacaactatgatctaca

SEQ ID NO: 491010 - DNA, 25 bp, Rattus norvegicus
gtcagtactacatctatgatctaca

SEQ ID NO: 491011 - DNA, 25 bp, Rattus norvegicus
gtcagtactactatcttgcctgttc

SEQ ID NO: 491012 - DNA, 25 bp, Rattus norvegicus
gtcagtactactttcttgcctgttc

SEQ ID NO: 491013 - DNA, 25 bp, Rattus norvegicus
gtcagtactctgagagcagccttca

SEQ ID NO: 491014 - DNA, 25 bp, Rattus norvegicus
gtcagtactctgtgagcagccttca

SEQ ID NO: 491015 - DNA, 25 bp, Rattus norvegicus
gtcagtactgttctgcttgtatgga

SEQ ID NO: 491016 - DNA, 25 bp, Rattus norvegicus
gtcagtactgttgtgcttgtatgga

SEQ ID NO: 491017 - DNA, 25 bp, Rattus norvegicus
gtcagtacttctacgagacgcgctg

SEQ ID NO: 491018 - DNA, 25 bp, Rattus norvegicus
gtcagtacttctctagctttctggc

SEQ ID NO: 491019 - DNA, 25 bp, Rattus norvegicus
gtcagtacttctgtagctttctggc

SEQ ID NO: 491020 - DNA, 25 bp, Rattus norvegicus
gtcagtacttcttcgagacgcgctg

SEQ ID NO: 491021 - DNA, 25 bp, Rattus norvegicus
gtcagtagccatctatgcatcctaa

SEQ ID NO: 491022 - DNA, 25 bp, Rattus norvegicus
gtcagtagccatgtatgcatcctaa

SEQ ID NO: 491023 - DNA, 25 bp, Rattus norvegicus
gtcagtagctccctgtggagacagt

SEQ ID NO: 491024 - DNA, 25 bp, Rattus norvegicus
gtcagtagctccgtgtggagacagt

SEQ ID NO: 491025 - DNA, 25 bp, Rattus norvegicus
gtcagtaggttgcaggcttcttgct

SEQ ID NO: 491026 - DNA, 25 bp, Rattus norvegicus
gtcagtaggttggaggcttcttgct

SEQ ID NO: 491027 - DNA, 25 bp, Rattus norvegicus
gtcagtagtcacatggattccgctg

SEQ ID NO: 491028 - DNA, 25 bp, Rattus norvegicus
gtcagtagtcacttggattccgctg

SEQ ID NO: 491029 - DNA, 25 bp, Rattus norvegicus
gtcagtatcatacaatccaccaacc

SEQ ID NO: 491030 - DNA, 25 bp, Rattus norvegicus
gtcagtatcatagaatccaccaacc

SEQ ID NO: 491031 - DNA, 25 bp, Rattus norvegicus
gtcagtatccgacagaactgctgtt

SEQ ID NO: 491032 - DNA, 25 bp, Rattus norvegicus
gtcagtatccgagagaactgctgtt

SEQ ID NO: 491033 - DNA, 25 bp, Rattus norvegicus
gtcagtatctggcttaagagcataa

SEQ ID NO: 491034 - DNA, 25 bp, Rattus norvegicus
gtcagtatctgggttaagagcataa

SEQ ID NO: 491035 - DNA, 25 bp, Rattus norvegicus
gtcagtattataacatccagccaaa

SEQ ID NO: 491036 - DNA, 25 bp, Rattus norvegicus
gtcagtattatatcatccagccaaa

SEQ ID NO: 491037 - DNA, 25 bp, Rattus norvegicus
gtcagtattattacaaaggttcttt

SEQ ID NO: 491038 - DNA, 25 bp, Rattus norvegicus
gtcagtattatttcaaaggttcttt

SEQ ID NO: 491039 - DNA, 25 bp, Rattus norvegicus
gtcagtattcaaccggcctgaggcc

SEQ ID NO: 491040 - DNA, 25 bp, Rattus norvegicus
gtcagtattcaagcggcctgaggcc

SEQ ID NO: 491041 - DNA, 25 bp, Rattus norvegicus
gtcagtattccacagttgggtcatt

SEQ ID NO: 491042 - DNA, 25 bp, Rattus norvegicus
gtcagtattccagagttgggtcatt

SEQ ID NO: 491043 - DNA, 25 bp, Rattus norvegicus
gtcagtattcttctggttcagcata

SEQ ID NO: 491044 - DNA, 25 bp, Rattus norvegicus
gtcagtattcttgtggttcagcata

SEQ ID NO: 491045 - DNA, 25 bp, Rattus norvegicus
gtcagtatttggatgtcgctgcatt

SEQ ID NO: 491046 - DNA, 25 bp, Rattus norvegicus
gtcagtatttggttgtcgctgcatt

SEQ ID NO: 491047 - DNA, 25 bp, Rattus norvegicus
gtcagtattttaatgttgccaattc

SEQ ID NO: 491048 - DNA, 25 bp, Rattus norvegicus
gtcagtattttattgttgccaattc

SEQ ID NO: 491049 - DNA, 25 bp, Rattus norvegicus
gtcagtcaagctatctctccaagct

SEQ ID NO: 491050 - DNA, 25 bp, Rattus norvegicus
gtcagtcaagctttctctccaagct

SEQ ID NO: 491051 - DNA, 25 bp, Rattus norvegicus
gtcagtcaagtcattcagcaccagc

SEQ ID NO: 491052 - DNA, 25 bp, Rattus norvegicus
gtcagtcaagtctttcagcaccagc

SEQ ID NO: 491053 - DNA, 25 bp, Rattus norvegicus
gtcagtcacactctccttgagtcac

SEQ ID NO: 491054 - DNA, 25 bp, Rattus norvegicus
gtcagtcacactgtccttgagtcac

SEQ ID NO: 491055 - DNA, 25 bp, Rattus norvegicus
gtcagtcacagcacatcatgggttt

SEQ ID NO: 491056 - DNA, 25 bp, Rattus norvegicus
gtcagtcacagctcatcatgggttt

SEQ ID NO: 491057 - DNA, 25 bp, Rattus norvegicus
gtcagtcacagtataatcattttgg

SEQ ID NO: 491058 - DNA, 25 bp, Rattus norvegicus
gtcagtcacagtttaatcattttgg

SEQ ID NO: 491059 - DNA, 25 bp, Rattus norvegicus
gtcagtcaccaacatgctgtttgtc

SEQ ID NO: 491060 - DNA, 25 bp, Rattus norvegicus
gtcagtcaccaagatgctgtttgtc

SEQ ID NO: 491061 - DNA, 25 bp, Rattus norvegicus
gtcagtcaccagatgctgtcaaatt

SEQ ID NO: 491062 - DNA, 25 bp, Rattus norvegicus
gtcagtcaccagttgctgtcaaatt

SEQ ID NO: 491063 - DNA, 25 bp, Rattus norvegicus
gtcagtcaccccactgggtatatag

SEQ ID NO: 491064 - DNA, 25 bp, Rattus norvegicus
gtcagtcacccctctgggtatatag

SEQ ID NO: 491065 - DNA, 25 bp, Rattus norvegicus
gtcagtcacctcacttaagctgaaa

SEQ ID NO: 491066 - DNA, 25 bp, Rattus norvegicus
gtcagtcacctctcttaagctgaaa

SEQ ID NO: 491067 - DNA, 25 bp, Rattus norvegicus
gtcagtcactcacaggttctcagtc

SEQ ID NO: 491068 - DNA, 25 bp, Rattus norvegicus
gtcagtcactcagaggttctcagtc

SEQ ID NO: 491069 - DNA, 25 bp, Rattus norvegicus
gtcagtcactctagttatgggcagt

SEQ ID NO: 491070 - DNA, 25 bp, Rattus norvegicus
gtcagtcactcttgttatgggcagt

SEQ ID NO: 491071 - DNA, 25 bp, Rattus norvegicus
gtcagtcagaatactgtttgctgag

SEQ ID NO: 491072 - DNA, 25 bp, Rattus norvegicus
gtcagtcagaattctgtttgctgag

SEQ ID NO: 491073 - DNA, 25 bp, Rattus norvegicus
gtcagtcagcttactgttactgtaa

SEQ ID NO: 491074 - DNA, 25 bp, Rattus norvegicus
gtcagtcagctttctgttactgtaa

SEQ ID NO: 491075 - DNA, 25 bp, Rattus norvegicus
gtcagtcagtagaatgctctcgcta

SEQ ID NO: 491076 - DNA, 25 bp, Rattus norvegicus
gtcagtcagtagtatgctctcgcta

SEQ ID NO: 491077 - DNA, 25 bp, Rattus norvegicus
gtcagtcagtatccagatctccttt

SEQ ID NO: 491078 - DNA, 25 bp, Rattus norvegicus
gtcagtcagtatgcagatctccttt

SEQ ID NO: 491079 - DNA, 25 bp, Rattus norvegicus
gtcagtcagtttccggatcccgaag

SEQ ID NO: 491080 - DNA, 25 bp, Rattus norvegicus
gtcagtcagtttgcggatcccgaag

SEQ ID NO: 491081 - DNA, 25 bp, Rattus norvegicus
gtcagtcatatcatttctggcagat

SEQ ID NO: 491082 - DNA, 25 bp, Rattus norvegicus
gtcagtcatatcttttctggcagat

SEQ ID NO: 491083 - DNA, 25 bp, Rattus norvegicus
gtcagtcatggtctgctgtctatgt

SEQ ID NO: 491084 - DNA, 25 bp, Rattus norvegicus
gtcagtcatggtgtgctgtctatgt

SEQ ID NO: 491085 - DNA, 25 bp, Rattus norvegicus
gtcagtcatgtacagttgttaccaa

SEQ ID NO: 491086 - DNA, 25 bp, Rattus norvegicus
gtcagtcatgtagagttgttaccaa

SEQ ID NO: 491087 - DNA, 25 bp, Rattus norvegicus
gtcagtccacatctataaccacact

SEQ ID NO: 491088 - DNA, 25 bp, Rattus norvegicus
gtcagtccacatgtataaccacact

SEQ ID NO: 491089 - DNA, 25 bp, Rattus norvegicus
gtcagtccatggctgatccagagag

SEQ ID NO: 491090 - DNA, 25 bp, Rattus norvegicus
gtcagtccatgggtgatccagagag

SEQ ID NO: 491091 - DNA, 25 bp, Rattus norvegicus
gtcagtcccagtctacaagtgtgta

SEQ ID NO: 491092 - DNA, 25 bp, Rattus norvegicus
gtcagtcccagtgtacaagtgtgta

SEQ ID NO: 491093 - DNA, 25 bp, Rattus norvegicus
gtcagtccgaacaacatgagagtct

SEQ ID NO: 491094 - DNA, 25 bp, Rattus norvegicus
gtcagtccgaactacatgagagtct

SEQ ID NO: 491095 - DNA, 25 bp, Rattus norvegicus
gtcagtcctggaagtctttctttta

SEQ ID NO: 491096 - DNA, 25 bp, Rattus norvegicus
gtcagtcctggatgtctttctttta

SEQ ID NO: 491097 - DNA, 25 bp, Rattus norvegicus
gtcagtccttggcagttagggacat

SEQ ID NO: 491098 - DNA, 25 bp, Rattus norvegicus
gtcagtccttgggagttagggacat

SEQ ID NO: 491099 - DNA, 25 bp, Rattus norvegicus
gtcagtcctttgctgaatgtccttg

SEQ ID NO: 491100 - DNA, 25 bp, Rattus norvegicus
gtcagtcctttggtgaatgtccttg

SEQ ID NO: 491101 - DNA, 25 bp, Rattus norvegicus
gtcagtcgactgctaagattggtta

SEQ ID NO: 491102 - DNA, 25 bp, Rattus norvegicus
gtcagtcgactggtaagattggtta

SEQ ID NO: 491103 - DNA, 25 bp, Rattus norvegicus
gtcagtcgagagacagacgtacgga

SEQ ID NO: 491104 - DNA, 25 bp, Rattus norvegicus
gtcagtcgagagtcagacgtacgga

SEQ ID NO: 491105 - DNA, 25 bp, Rattus norvegicus
gtcagtcggtggcttttgtaaattt

SEQ ID NO: 491106 - DNA, 25 bp, Rattus norvegicus
gtcagtcggtgggttttgtaaattt
